United States Patent 12,290,554 (COMPOSITIONS FOR OPTIMIZED BCR-ABL PEPTIDE VACCINES) - sequence listing, part 2

SEQ ID NO: 22186 - protein, 20 aa, synthetic construct
  source 1..20: note = Seed: SATGFKQSSKALQRPVASDF
SATGFKQSSRALSRPVATDF

SEQ ID NO: 22187 - protein, 20 aa, synthetic construct
  source 1..20: note = Seed: SATGFKQSSKALQRPVASDF
SATGFKQSSRALSRPVAVDF

SEQ ID NO: 22188 - protein, 20 aa, synthetic construct
  source 1..20: note = Seed: SATGFKQSSKALQRPVASDF
SATGFKQSSRALSRVVAADF

SEQ ID NO: 22189 - protein, 20 aa, synthetic construct
  source 1..20: note = Seed: SATGFKQSSKALQRPVASDF
SATGFKQSSRALSRVVAHDF

SEQ ID NO: 22190 - protein, 20 aa, synthetic construct
  source 1..20: note = Seed: SATGFKQSSKALQRPVASDF
SATGFKQSSRALSRVVAIDF

SEQ ID NO: 22191 - protein, 20 aa, synthetic construct
  source 1..20: note = Seed: SATGFKQSSKALQRPVASDF
SATGFKQSSRALSRVVALDF

SEQ ID NO: 22192 - protein, 20 aa, synthetic construct
  source 1..20: note = Seed: SATGFKQSSKALQRPVASDF
SATGFKQSSRALSRVVAMDF

SEQ ID NO: 22193 - protein, 20 aa, synthetic construct
  source 1..20: note = Seed: SATGFKQSSKALQRPVASDF
SATGFKQSSRALSRVVANDF

SEQ ID NO: 22194 - protein, 20 aa, synthetic construct
  source 1..20: note = Seed: SATGFKQSSKALQRPVASDF
SATGFKQSSRALSRVVASDF

SEQ ID NO: 22195 - protein, 20 aa, synthetic construct
  source 1..20: note = Seed: SATGFKQSSKALQRPVASDF
SATGFKQSSRALSRVVATDF

SEQ ID NO: 22196 - protein, 20 aa, synthetic construct
  source 1..20: note = Seed: SATGFKQSSKALQRPVASDF
SATGFKQSSRALSRVVAVDF

SEQ ID NO: 22197 - protein, 20 aa, synthetic construct
  source 1..20: note = Seed: SATGFKQSSKALQRPVASDF
SATGFKQSSRALTRAVAADF

SEQ ID NO: 22198 - protein, 20 aa, synthetic construct
  source 1..20: note = Seed: SATGFKQSSKALQRPVASDF
SATGFKQSSRALTRAVAHDF

SEQ ID NO: 22199 - protein, 20 aa, synthetic construct
  source 1..20: note = Seed: SATGFKQSSKALQRPVASDF
SATGFKQSSRALTRAVAIDF

SEQ ID NO: 22200 - protein, 20 aa, synthetic construct
  source 1..20: note = Seed: SATGFKQSSKALQRPVASDF
SATGFKQSSRALTRAVALDF

SEQ ID NO: 22201 - protein, 20 aa, synthetic construct
  source 1..20: note = Seed: SATGFKQSSKALQRPVASDF
SATGFKQSSRALTRAVAMDF

SEQ ID NO: 22202 - protein, 20 aa, synthetic construct
  source 1..20: note = Seed: SATGFKQSSKALQRPVASDF
SATGFKQSSRALTRAVANDF

SEQ ID NO: 22203 - protein, 20 aa, synthetic construct
  source 1..20: note = Seed: SATGFKQSSKALQRPVASDF
SATGFKQSSRALTRAVAQDF

SEQ ID NO: 22204 - protein, 20 aa, synthetic construct
  source 1..20: note = Seed: SATGFKQSSKALQRPVASDF
SATGFKQSSRALTRAVASDF

SEQ ID NO: 22205 - protein, 20 aa, synthetic construct
  source 1..20: note = Seed: SATGFKQSSKALQRPVASDF
SATGFKQSSRALTRAVATDF

SEQ ID NO: 22206 - protein, 20 aa, synthetic construct
  source 1..20: note = Seed: SATGFKQSSKALQRPVASDF
SATGFKQSSRALTRAVAVDF

SEQ ID NO: 22207 - protein, 20 aa, synthetic construct
  source 1..20: note = Seed: SATGFKQSSKALQRPVASDF
SATGFKQSSRALTRIVAADF

SEQ ID NO: 22208 - protein, 20 aa, synthetic construct
  source 1..20: note = Seed: SATGFKQSSKALQRPVASDF
SATGFKQSSRALTRIVAIDF

SEQ ID NO: 22209 - protein, 20 aa, synthetic construct
  source 1..20: note = Seed: SATGFKQSSKALQRPVASDF
SATGFKQSSRALTRIVAMDF

SEQ ID NO: 22210 - protein, 20 aa, synthetic construct
  source 1..20: note = Seed: SATGFKQSSKALQRPVASDF
SATGFKQSSRALTRIVANDF

SEQ ID NO: 22211 - protein, 20 aa, synthetic construct
  source 1..20: note = Seed: SATGFKQSSKALQRPVASDF
SATGFKQSSRALTRIVASDF

SEQ ID NO: 22212 - protein, 20 aa, synthetic construct
  source 1..20: note = Seed: SATGFKQSSKALQRPVASDF
SATGFKQSSRALTRIVATDF

SEQ ID NO: 22213 - protein, 20 aa, synthetic construct
  source 1..20: note = Seed: SATGFKQSSKALQRPVASDF
SATGFKQSSRALTRIVAVDF

SEQ ID NO: 22214 - protein, 20 aa, synthetic construct
  source 1..20: note = Seed: SATGFKQSSKALQRPVASDF
SATGFKQSSRALTRPVAADF

SEQ ID NO: 22215 - protein, 20 aa, synthetic construct
  source 1..20: note = Seed: SATGFKQSSKALQRPVASDF
SATGFKQSSRALTRPVANDF

SEQ ID NO: 22216 - protein, 20 aa, synthetic construct
  source 1..20: note = Seed: SATGFKQSSKALQRPVASDF
SATGFKQSSRALTRVVAADF

SEQ ID NO: 22217 - protein, 20 aa, synthetic construct
  source 1..20: note = Seed: SATGFKQSSKALQRPVASDF
SATGFKQSSRALTRVVAIDF

SEQ ID NO: 22218 - protein, 20 aa, synthetic construct
  source 1..20: note = Seed: SATGFKQSSKALQRPVASDF
SATGFKQSSRALTRVVALDF

SEQ ID NO: 22219 - protein, 20 aa, synthetic construct
  source 1..20: note = Seed: SATGFKQSSKALQRPVASDF
SATGFKQSSRALTRVVAMDF

SEQ ID NO: 22220 - protein, 20 aa, synthetic construct
  source 1..20: note = Seed: SATGFKQSSKALQRPVASDF
SATGFKQSSRALTRVVANDF

SEQ ID NO: 22221 - protein, 20 aa, synthetic construct
  source 1..20: note = Seed: SATGFKQSSKALQRPVASDF
SATGFKQSSRALTRVVASDF

SEQ ID NO: 22222 - protein, 20 aa, synthetic construct
  source 1..20: note = Seed: SATGFKQSSKALQRPVASDF
SATGFKQSSRALTRVVATDF

SEQ ID NO: 22223 - protein, 20 aa, synthetic construct
  source 1..20: note = Seed: SATGFKQSSKALQRPVASDF
SATGFKQSSRALTRVVAVDF

SEQ ID NO: 22224 - protein, 20 aa, synthetic construct
  source 1..20: note = Seed: SATGFKQSSKALQRPVASDF
SATGFKQSSRALVRAVAADF

SEQ ID NO: 22225 - protein, 20 aa, synthetic construct
  source 1..20: note = Seed: SATGFKQSSKALQRPVASDF
SATGFKQSSRALVRAVADDF

SEQ ID NO: 22226 - protein, 20 aa, synthetic construct
  source 1..20: note = Seed: SATGFKQSSKALQRPVASDF
SATGFKQSSRALVRAVAEDF

SEQ ID NO: 22227 - protein, 20 aa, synthetic construct
  source 1..20: note = Seed: SATGFKQSSKALQRPVASDF
SATGFKQSSRALVRAVAHDF

SEQ ID NO: 22228 - protein, 20 aa, synthetic construct
  source 1..20: note = Seed: SATGFKQSSKALQRPVASDF
SATGFKQSSRALVRAVAIDF

SEQ ID NO: 22229 - protein, 20 aa, synthetic construct
  source 1..20: note = Seed: SATGFKQSSKALQRPVASDF
SATGFKQSSRALVRAVAMDF

SEQ ID NO: 22230 - protein, 20 aa, synthetic construct
  source 1..20: note = Seed: SATGFKQSSKALQRPVASDF
SATGFKQSSRALVRAVANDF

SEQ ID NO: 22231 - protein, 20 aa, synthetic construct
  source 1..20: note = Seed: SATGFKQSSKALQRPVASDF
SATGFKQSSRALVRAVAQDF

SEQ ID NO: 22232 - protein, 20 aa, synthetic construct
  source 1..20: note = Seed: SATGFKQSSKALQRPVASDF
SATGFKQSSRALVRAVASDF

SEQ ID NO: 22233 - protein, 20 aa, synthetic construct
  source 1..20: note = Seed: SATGFKQSSKALQRPVASDF
SATGFKQSSRALVRAVATDF

SEQ ID NO: 22234 - protein, 20 aa, synthetic construct
  source 1..20: note = Seed: SATGFKQSSKALQRPVASDF
SATGFKQSSRALVRAVAVDF

SEQ ID NO: 22235 - protein, 20 aa, synthetic construct
  source 1..20: note = Seed: SATGFKQSSKALQRPVASDF
SATGFKQSSRALVRIVAADF

SEQ ID NO: 22236 - protein, 20 aa, synthetic construct
  source 1..20: note = Seed: SATGFKQSSKALQRPVASDF
SATGFKQSSRALVRIVANDF

SEQ ID NO: 22237 - protein, 20 aa, synthetic construct
  source 1..20: note = Seed: SATGFKQSSKALQRPVASDF
SATGFKQSSRALVRIVASDF

SEQ ID NO: 22238 - protein, 20 aa, synthetic construct
  source 1..20: note = Seed: SATGFKQSSKALQRPVASDF
SATGFKQSSRALVRPVAADF

SEQ ID NO: 22239 - protein, 20 aa, synthetic construct
  source 1..20: note = Seed: SATGFKQSSKALQRPVASDF
SATGFKQSSRALVRPVANDF

SEQ ID NO: 22240 - protein, 20 aa, synthetic construct
  source 1..20: note = Seed: SATGFKQSSKALQRPVASDF
SATGFKQSSRALVRPVATDF

SEQ ID NO: 22241 - protein, 20 aa, synthetic construct
  source 1..20: note = Seed: SATGFKQSSKALQRPVASDF
SATGFKQSSRALVRPVAVDF

SEQ ID NO: 22242 - protein, 20 aa, synthetic construct
  source 1..20: note = Seed: SATGFKQSSKALQRPVASDF
SATGFKQSSRALVRVVAADF

SEQ ID NO: 22243 - protein, 20 aa, synthetic construct
  source 1..20: note = Seed: SATGFKQSSKALQRPVASDF
SATGFKQSSRALVRVVANDF

SEQ ID NO: 22244 - protein, 20 aa, synthetic construct
  source 1..20: note = Seed: SATGFKQSSKALQRPVASDF
SATGFKQSSRALVRVVASDF

SEQ ID NO: 22245 - protein, 20 aa, synthetic construct
  source 1..20: note = Seed: SATGFKQSSKALQRPVASDF
SATGFKQSSRALVRVVATDF

SEQ ID NO: 22246 - protein, 20 aa, synthetic construct
  source 1..20: note = Seed: SATGFKQSSKALQRPVASDF
SATGFKQSSYALARAVANDF

SEQ ID NO: 22247 - protein, 20 aa, synthetic construct
  source 1..20: note = Seed: SATGFKQSSKALQRPVASDF
SATGFAQSFKFLQIPVASDF

SEQ ID NO: 22248 - protein, 20 aa, synthetic construct
  source 1..20: note = Seed: SATGFKQSSKALQRPVASDF
SATGFAQSFKFLQLPVASDF

SEQ ID NO: 22249 - protein, 20 aa, synthetic construct
  source 1..20: note = Seed: SATGFKQSSKALQRPVASDF
SATGFAQSFKFLQMPVASDF

SEQ ID NO: 22250 - protein, 20 aa, synthetic construct
  source 1..20: note = Seed: SATGFKQSSKALQRPVASDF
SATGFAQSFKFLQVPVASDF

SEQ ID NO: 22251 - protein, 20 aa, synthetic construct
  source 1..20: note = Seed: SATGFKQSSKALQRPVASDF
SATGFAQSHKFLQIPVASDF

SEQ ID NO: 22252 - protein, 20 aa, synthetic construct
  source 1..20: note = Seed: SATGFKQSSKALQRPVASDF
SATGFAQSIKFLQIPVASDF

SEQ ID NO: 22253 - protein, 20 aa, synthetic construct
  source 1..20: note = Seed: SATGFKQSSKALQRPVASDF
SATGFAQSIKFLQLPVASDF

SEQ ID NO: 22254 - protein, 20 aa, synthetic construct
  source 1..20: note = Seed: SATGFKQSSKALQRPVASDF
SATGFAQSSKFLQIPVASDF

SEQ ID NO: 22255 - protein, 20 aa, synthetic construct
  source 1..20: note = Seed: SATGFKQSSKALQRPVASDF
SATGFAQSTKFLQIPVASDF

SEQ ID NO: 22256 - protein, 20 aa, synthetic construct
  source 1..20: note = Seed: SATGFKQSSKALQRPVASDF
SATGFCQSAKFLQFPVASDF

SEQ ID NO: 22257 - protein, 20 aa, synthetic construct
  source 1..20: note = Seed: SATGFKQSSKALQRPVASDF
SATGFCQSAKFLQIPVASDF

SEQ ID NO: 22258 - protein, 20 aa, synthetic construct
  source 1..20: note = Seed: SATGFKQSSKALQRPVASDF
SATGFCQSAKFLQLPVASDF

SEQ ID NO: 22259 - protein, 20 aa, synthetic construct
  source 1..20: note = Seed: SATGFKQSSKALQRPVASDF
SATGFCQSAKFLQVPVASDF

SEQ ID NO: 22260 - protein, 20 aa, synthetic construct
  source 1..20: note = Seed: SATGFKQSSKALQRPVASDF
SATGFCQSEKFLQIPVASDF

SEQ ID NO: 22261 - protein, 20 aa, synthetic construct
  source 1..20: note = Seed: SATGFKQSSKALQRPVASDF
SATGFCQSEKFLQVPVASDF

SEQ ID NO: 22262 - protein, 20 aa, synthetic construct
  source 1..20: note = Seed: SATGFKQSSKALQRPVASDF
SATGFCQSFKFLQIPVASDF

SEQ ID NO: 22263 - protein, 20 aa, synthetic construct
  source 1..20: note = Seed: SATGFKQSSKALQRPVASDF
SATGFCQSFKFLQLPVASDF

SEQ ID NO: 22264 - protein, 20 aa, synthetic construct
  source 1..20: note = Seed: SATGFKQSSKALQRPVASDF
SATGFCQSFKFLQMPVASDF

SEQ ID NO: 22265 - protein, 20 aa, synthetic construct
  source 1..20: note = Seed: SATGFKQSSKALQRPVASDF
SATGFCQSFKFLQVPVASDF

SEQ ID NO: 22266 - protein, 20 aa, synthetic construct
  source 1..20: note = Seed: SATGFKQSSKALQRPVASDF
SATGFCQSFKFLQYPVASDF

SEQ ID NO: 22267 - protein, 20 aa, synthetic construct
  source 1..20: note = Seed: SATGFKQSSKALQRPVASDF
SATGFCQSFKILQIPVASDF

SEQ ID NO: 22268 - protein, 20 aa, synthetic construct
  source 1..20: note = Seed: SATGFKQSSKALQRPVASDF
SATGFCQSFKILQLPVASDF

SEQ ID NO: 22269 - protein, 20 aa, synthetic construct
  source 1..20: note = Seed: SATGFKQSSKALQRPVASDF
SATGFCQSFKLLQIPVASDF

SEQ ID NO: 22270 - protein, 20 aa, synthetic construct
  source 1..20: note = Seed: SATGFKQSSKALQRPVASDF
SATGFCQSFKLLQLPVASDF

SEQ ID NO: 22271 - protein, 20 aa, synthetic construct
  source 1..20: note = Seed: SATGFKQSSKALQRPVASDF
SATGFCQSFKLLQVPVASDF

SEQ ID NO: 22272 - protein, 20 aa, synthetic construct
  source 1..20: note = Seed: SATGFKQSSKALQRPVASDF
SATGFCQSFKYLQIPVASDF

SEQ ID NO: 22273 - protein, 20 aa, synthetic construct
  source 1..20: note = Seed: SATGFKQSSKALQRPVASDF
SATGFCQSHKFLQFPVASDF

SEQ ID NO: 22274 - protein, 20 aa, synthetic construct
  source 1..20: note = Seed: SATGFKQSSKALQRPVASDF
SATGFCQSHKFLQIPVASDF

SEQ ID NO: 22275 - protein, 20 aa, synthetic construct
  source 1..20: note = Seed: SATGFKQSSKALQRPVASDF
SATGFCQSHKFLQLPVASDF

SEQ ID NO: 22276 - protein, 20 aa, synthetic construct
  source 1..20: note = Seed: SATGFKQSSKALQRPVASDF
SATGFCQSHKFLQVPVASDF

SEQ ID NO: 22277 - protein, 20 aa, synthetic construct
  source 1..20: note = Seed: SATGFKQSSKALQRPVASDF
SATGFCQSIKFLQIPVASDF

SEQ ID NO: 22278 - protein, 20 aa, synthetic construct
  source 1..20: note = Seed: SATGFKQSSKALQRPVASDF
SATGFCQSIKFLQLPVASDF

SEQ ID NO: 22279 - protein, 20 aa, synthetic construct
  source 1..20: note = Seed: SATGFKQSSKALQRPVASDF
SATGFCQSIKFLQMPVASDF

SEQ ID NO: 22280 - protein, 20 aa, synthetic construct
  source 1..20: note = Seed: SATGFKQSSKALQRPVASDF
SATGFCQSIKFLQVPVASDF

SEQ ID NO: 22281 - protein, 20 aa, synthetic construct
  source 1..20: note = Seed: SATGFKQSSKALQRPVASDF
SATGFCQSKKFLQIPVASDF

SEQ ID NO: 22282 - protein, 20 aa, synthetic construct
  source 1..20: note = Seed: SATGFKQSSKALQRPVASDF
SATGFCQSLKFLQIPVASDF

SEQ ID NO: 22283 - protein, 20 aa, synthetic construct
  source 1..20: note = Seed: SATGFKQSSKALQRPVASDF
SATGFCQSLKFLQLPVASDF

SEQ ID NO: 22284 - protein, 20 aa, synthetic construct
  source 1..20: note = Seed: SATGFKQSSKALQRPVASDF
SATGFCQSLKFLQVPVASDF

SEQ ID NO: 22285 - protein, 20 aa, synthetic construct
  source 1..20: note = Seed: SATGFKQSSKALQRPVASDF
SATGFCQSMKFLQIPVASDF

SEQ ID NO: 22286 - protein, 20 aa, synthetic construct
  source 1..20: note = Seed: SATGFKQSSKALQRPVASDF
SATGFCQSMKFLQLPVASDF

SEQ ID NO: 22287 - protein, 20 aa, synthetic construct
  source 1..20: note = Seed: SATGFKQSSKALQRPVASDF
SATGFCQSMKFLQVPVASDF

SEQ ID NO: 22288 - protein, 20 aa, synthetic construct
  source 1..20: note = Seed: SATGFKQSSKALQRPVASDF
SATGFCQSQKFLQIPVASDF

SEQ ID NO: 22289 - protein, 20 aa, synthetic construct
  source 1..20: note = Seed: SATGFKQSSKALQRPVASDF
SATGFCQSSKFLQFPVASDF

SEQ ID NO: 22290 - protein, 20 aa, synthetic construct
  source 1..20: note = Seed: SATGFKQSSKALQRPVASDF
SATGFCQSSKFLQIPVASDF

SEQ ID NO: 22291 - protein, 20 aa, synthetic construct
  source 1..20: note = Seed: SATGFKQSSKALQRPVASDF
SATGFCQSSKFLQLPVASDF

SEQ ID NO: 22292 - protein, 20 aa, synthetic construct
  source 1..20: note = Seed: SATGFKQSSKALQRPVASDF
SATGFCQSSKFLQMPVASDF

SEQ ID NO: 22293 - protein, 20 aa, synthetic construct
  source 1..20: note = Seed: SATGFKQSSKALQRPVASDF
SATGFCQSSKFLQVPVASDF

SEQ ID NO: 22294 - protein, 20 aa, synthetic construct
  source 1..20: note = Seed: SATGFKQSSKALQRPVASDF
SATGFCQSTKFLQFPVASDF

SEQ ID NO: 22295 - protein, 20 aa, synthetic construct
  source 1..20: note = Seed: SATGFKQSSKALQRPVASDF
SATGFCQSTKFLQIPVASDF

SEQ ID NO: 22296 - protein, 20 aa, synthetic construct
  source 1..20: note = Seed: SATGFKQSSKALQRPVASDF
SATGFCQSTKFLQLPVASDF

SEQ ID NO: 22297 - protein, 20 aa, synthetic construct
  source 1..20: note = Seed: SATGFKQSSKALQRPVASDF
SATGFCQSTKFLQMPVASDF

SEQ ID NO: 22298 - protein, 20 aa, synthetic construct
  source 1..20: note = Seed: SATGFKQSSKALQRPVASDF
SATGFCQSTKFLQVPVASDF

SEQ ID NO: 22299 - protein, 20 aa, synthetic construct
  source 1..20: note = Seed: SATGFKQSSKALQRPVASDF
SATGFCQSVKFLQFPVASDF

SEQ ID NO: 22300 - protein, 20 aa, synthetic construct
  source 1..20: note = Seed: SATGFKQSSKALQRPVASDF
SATGFCQSVKFLQIPVASDF

SEQ ID NO: 22301 - protein, 20 aa, synthetic construct
  source 1..20: note = Seed: SATGFKQSSKALQRPVASDF
SATGFCQSVKFLQLPVASDF

SEQ ID NO: 22302 - protein, 20 aa, synthetic construct
  source 1..20: note = Seed: SATGFKQSSKALQRPVASDF
SATGFCQSVKFLQMPVASDF

SEQ ID NO: 22303 - protein, 20 aa, synthetic construct
  source 1..20: note = Seed: SATGFKQSSKALQRPVASDF
SATGFCQSVKFLQVPVASDF

SEQ ID NO: 22304 - protein, 20 aa, synthetic construct
  source 1..20: note = Seed: SATGFKQSSKALQRPVASDF
SATGFCQSWKFLQIPVASDF

SEQ ID NO: 22305 - protein, 20 aa, synthetic construct
  source 1..20: note = Seed: SATGFKQSSKALQRPVASDF
SATGFCQSWKFLQLPVASDF

SEQ ID NO: 22306 - protein, 20 aa, synthetic construct
  source 1..20: note = Seed: SATGFKQSSKALQRPVASDF
SATGFCQSWKFLQVPVASDF

SEQ ID NO: 22307 - protein, 20 aa, synthetic construct
  source 1..20: note = Seed: SATGFKQSSKALQRPVASDF
SATGFCQSYKFLQIPVASDF

SEQ ID NO: 22308 - protein, 20 aa, synthetic construct
  source 1..20: note = Seed: SATGFKQSSKALQRPVASDF
SATGFCQSYKFLQLPVASDF

SEQ ID NO: 22309 - protein, 20 aa, synthetic construct
  source 1..20: note = Seed: SATGFKQSSKALQRPVASDF
SATGFCQSYKFLQMPVASDF

SEQ ID NO: 22310 - protein, 20 aa, synthetic construct
  source 1..20: note = Seed: SATGFKQSSKALQRPVASDF
SATGFCQSYKFLQVPVASDF

SEQ ID NO: 22311 - protein, 20 aa, synthetic construct
  source 1..20: note = Seed: SATGFKQSSKALQRPVASDF
SATGFDQSFKFLQIPVASDF

SEQ ID NO: 22312 - protein, 20 aa, synthetic construct
  source 1..20: note = Seed: SATGFKQSSKALQRPVASDF
SATGFDQSIKFLQIPVASDF

SEQ ID NO: 22313 - protein, 20 aa, synthetic construct
  source 1..20: note = Seed: SATGFKQSSKALQRPVASDF
SATGFEQSFKFLQIPVASDF

SEQ ID NO: 22314 - protein, 20 aa, synthetic construct
  source 1..20: note = Seed: SATGFKQSSKALQRPVASDF
SATGFEQSFKFLQLPVASDF

SEQ ID NO: 22315 - protein, 20 aa, synthetic construct
  source 1..20: note = Seed: SATGFKQSSKALQRPVASDF
SATGFEQSFKFLQVPVASDF

SEQ ID NO: 22316 - protein, 20 aa, synthetic construct
  source 1..20: note = Seed: SATGFKQSSKALQRPVASDF
SATGFEQSIKFLQIPVASDF

SEQ ID NO: 22317 - protein, 20 aa, synthetic construct
  source 1..20: note = Seed: SATGFKQSSKALQRPVASDF
SATGFEQSIKFLQLPVASDF

SEQ ID NO: 22318 - protein, 20 aa, synthetic construct
  source 1..20: note = Seed: SATGFKQSSKALQRPVASDF
SATGFEQSIKFLQVPVASDF

SEQ ID NO: 22319 - protein, 20 aa, synthetic construct
  source 1..20: note = Seed: SATGFKQSSKALQRPVASDF
SATGFEQSVKFLQIPVASDF

SEQ ID NO: 22320 - protein, 20 aa, synthetic construct
  source 1..20: note = Seed: SATGFKQSSKALQRPVASDF
SATGFFQSAKFLQAPVASDF

SEQ ID NO: 22321 - protein, 20 aa, synthetic construct
  source 1..20: note = Seed: SATGFKQSSKALQRPVASDF
SATGFFQSAKFLQDPVASDF

SEQ ID NO: 22322 - protein, 20 aa, synthetic construct
  source 1..20: note = Seed: SATGFKQSSKALQRPVASDF
SATGFFQSAKFLQEPVASDF

SEQ ID NO: 22323 - protein, 20 aa, synthetic construct
  source 1..20: note = Seed: SATGFKQSSKALQRPVASDF
SATGFFQSAKFLQFPVASDF

SEQ ID NO: 22324 - protein, 20 aa, synthetic construct
  source 1..20: note = Seed: SATGFKQSSKALQRPVASDF
SATGFFQSAKFLQHPVASDF

SEQ ID NO: 22325 - protein, 20 aa, synthetic construct
  source 1..20: note = Seed: SATGFKQSSKALQRPVASDF
SATGFFQSAKFLQIPVASDF

SEQ ID NO: 22326 - protein, 20 aa, synthetic construct
  source 1..20: note = Seed: SATGFKQSSKALQRPVASDF
SATGFFQSAKFLQKPVASDF

SEQ ID NO: 22327 - protein, 20 aa, synthetic construct
  source 1..20: note = Seed: SATGFKQSSKALQRPVASDF
SATGFFQSAKFLQLPVASDF

SEQ ID NO: 22328 - protein, 20 aa, synthetic construct
  source 1..20: note = Seed: SATGFKQSSKALQRPVASDF
SATGFFQSAKFLQMPVASDF

SEQ ID NO: 22329 - protein, 20 aa, synthetic construct
  source 1..20: note = Seed: SATGFKQSSKALQRPVASDF
SATGFFQSAKFLQNPVASDF

SEQ ID NO: 22330 - protein, 20 aa, synthetic construct
  source 1..20: note = Seed: SATGFKQSSKALQRPVASDF
SATGFFQSAKFLQQPVASDF

SEQ ID NO: 22331 - protein, 20 aa, synthetic construct
  source 1..20: note = Seed: SATGFKQSSKALQRPVASDF
SATGFFQSAKFLQRPVASDF

SEQ ID NO: 22332 - protein, 20 aa, synthetic construct
  source 1..20: note = Seed: SATGFKQSSKALQRPVASDF
SATGFFQSAKFLQSPVASDF

SEQ ID NO: 22333 - protein, 20 aa, synthetic construct
  source 1..20: note = Seed: SATGFKQSSKALQRPVASDF
SATGFFQSAKFLQTPVASDF

SEQ ID NO: 22334 - protein, 20 aa, synthetic construct
  source 1..20: note = Seed: SATGFKQSSKALQRPVASDF
SATGFFQSAKFLQVPVASDF

SEQ ID NO: 22335 - protein, 20 aa, synthetic construct
  source 1..20: note = Seed: SATGFKQSSKALQRPVASDF
SATGFFQSAKFLQYPVASDF

SEQ ID NO: 22336 - protein, 20 aa, synthetic construct
  source 1..20: note = Seed: SATGFKQSSKALQRPVASDF
SATGFFQSAKILQFPVASDF

SEQ ID NO: 22337 - protein, 20 aa, synthetic construct
  source 1..20: note = Seed: SATGFKQSSKALQRPVASDF
SATGFFQSAKILQIPVASDF

SEQ ID NO: 22338 - protein, 20 aa, synthetic construct
  source 1..20: note = Seed: SATGFKQSSKALQRPVASDF
SATGFFQSAKILQLPVASDF

SEQ ID NO: 22339 - protein, 20 aa, synthetic construct
  source 1..20: note = Seed: SATGFKQSSKALQRPVASDF
SATGFFQSAKILQMPVASDF

SEQ ID NO: 22340 - protein, 20 aa, synthetic construct
  source 1..20: note = Seed: SATGFKQSSKALQRPVASDF
SATGFFQSAKILQVPVASDF

SEQ ID NO: 22341 - protein, 20 aa, synthetic construct
  source 1..20: note = Seed: SATGFKQSSKALQRPVASDF
SATGFFQSAKLLQFPVASDF

SEQ ID NO: 22342 - protein, 20 aa, synthetic construct
  source 1..20: note = Seed: SATGFKQSSKALQRPVASDF
SATGFFQSAKLLQIPVASDF

SEQ ID NO: 22343 - protein, 20 aa, synthetic construct
  source 1..20: note = Seed: SATGFKQSSKALQRPVASDF
SATGFFQSAKLLQLPVASDF

SEQ ID NO: 22344 - protein, 20 aa, synthetic construct
  source 1..20: note = Seed: SATGFKQSSKALQRPVASDF
SATGFFQSAKLLQMPVASDF

SEQ ID NO: 22345 - protein, 20 aa, synthetic construct
  source 1..20: note = Seed: SATGFKQSSKALQRPVASDF
SATGFFQSAKLLQNPVASDF

SEQ ID NO: 22346 - protein, 20 aa, synthetic construct
  source 1..20: note = Seed: SATGFKQSSKALQRPVASDF
SATGFFQSAKLLQVPVASDF

SEQ ID NO: 22347 - protein, 20 aa, synthetic construct
  source 1..20: note = Seed: SATGFKQSSKALQRPVASDF
SATGFFQSAKLLQYPVASDF

SEQ ID NO: 22348 - protein, 20 aa, synthetic construct
  source 1..20: note = Seed: SATGFKQSSKALQRPVASDF
SATGFFQSAKMLQIPVASDF

SEQ ID NO: 22349 - protein, 20 aa, synthetic construct
  source 1..20: note = Seed: SATGFKQSSKALQRPVASDF
SATGFFQSAKMLQLPVASDF

SEQ ID NO: 22350 - protein, 20 aa, synthetic construct
  source 1..20: note = Seed: SATGFKQSSKALQRPVASDF
SATGFFQSAKMLQVPVASDF

SEQ ID NO: 22351 - protein, 20 aa, synthetic construct
  source 1..20: note = Seed: SATGFKQSSKALQRPVASDF
SATGFFQSAKVLQIPVASDF

SEQ ID NO: 22352 - protein, 20 aa, synthetic construct
  source 1..20: note = Seed: SATGFKQSSKALQRPVASDF
SATGFFQSAKVLQLPVASDF

SEQ ID NO: 22353 - protein, 20 aa, synthetic construct
  source 1..20: note = Seed: SATGFKQSSKALQRPVASDF
SATGFFQSAKWLQFPVASDF

SEQ ID NO: 22354 - protein, 20 aa, synthetic construct
  source 1..20: note = Seed: SATGFKQSSKALQRPVASDF
SATGFFQSAKWLQIPVASDF

SEQ ID NO: 22355 - protein, 20 aa, synthetic construct
  source 1..20: note = Seed: SATGFKQSSKALQRPVASDF
SATGFFQSAKWLQLPVASDF

SEQ ID NO: 22356 - protein, 20 aa, synthetic construct
  source 1..20: note = Seed: SATGFKQSSKALQRPVASDF
SATGFFQSAKWLQMPVASDF

SEQ ID NO: 22357 - protein, 20 aa, synthetic construct
  source 1..20: note = Seed: SATGFKQSSKALQRPVASDF
SATGFFQSAKWLQNPVASDF

SEQ ID NO: 22358 - protein, 20 aa, synthetic construct
  source 1..20: note = Seed: SATGFKQSSKALQRPVASDF
SATGFFQSAKWLQVPVASDF

SEQ ID NO: 22359 - protein, 20 aa, synthetic construct
  source 1..20: note = Seed: SATGFKQSSKALQRPVASDF
SATGFFQSAKYLQFPVASDF

SEQ ID NO: 22360 - protein, 20 aa, synthetic construct
  source 1..20: note = Seed: SATGFKQSSKALQRPVASDF
SATGFFQSAKYLQIPVASDF

SEQ ID NO: 22361 - protein, 20 aa, synthetic construct
  source 1..20: note = Seed: SATGFKQSSKALQRPVASDF
SATGFFQSAKYLQLPVASDF

SEQ ID NO: 22362 - protein, 20 aa, synthetic construct
  source 1..20: note = Seed: SATGFKQSSKALQRPVASDF
SATGFFQSAKYLQMPVASDF

SEQ ID NO: 22363 - protein, 20 aa, synthetic construct
  source 1..20: note = Seed: SATGFKQSSKALQRPVASDF
SATGFFQSAKYLQNPVASDF

SEQ ID NO: 22364 - protein, 20 aa, synthetic construct
  source 1..20: note = Seed: SATGFKQSSKALQRPVASDF
SATGFFQSAKYLQVPVASDF

SEQ ID NO: 22365 - protein, 20 aa, synthetic construct
  source 1..20: note = Seed: SATGFKQSSKALQRPVASDF
SATGFFQSCKFLQFPVASDF

SEQ ID NO: 22366 - protein, 20 aa, synthetic construct
  source 1..20: note = Seed: SATGFKQSSKALQRPVASDF
SATGFFQSCKFLQIPVASDF

SEQ ID NO: 22367 - protein, 20 aa, synthetic construct
  source 1..20: note = Seed: SATGFKQSSKALQRPVASDF
SATGFFQSCKFLQLPVASDF

SEQ ID NO: 22368 - protein, 20 aa, synthetic construct
  source 1..20: note = Seed: SATGFKQSSKALQRPVASDF
SATGFFQSCKFLQMPVASDF

SEQ ID NO: 22369 - protein, 20 aa, synthetic construct
  source 1..20: note = Seed: SATGFKQSSKALQRPVASDF
SATGFFQSCKFLQVPVASDF

SEQ ID NO: 22370 - protein, 20 aa, synthetic construct
  source 1..20: note = Seed: SATGFKQSSKALQRPVASDF
SATGFFQSCKFLQYPVASDF

SEQ ID NO: 22371 - protein, 20 aa, synthetic construct
  source 1..20: note = Seed: SATGFKQSSKALQRPVASDF
SATGFFQSDKFLQAPVASDF

SEQ ID NO: 22372 - protein, 20 aa, synthetic construct
  source 1..20: note = Seed: SATGFKQSSKALQRPVASDF
SATGFFQSDKFLQFPVASDF

SEQ ID NO: 22373 - protein, 20 aa, synthetic construct
  source 1..20: note = Seed: SATGFKQSSKALQRPVASDF
SATGFFQSDKFLQIPVASDF

SEQ ID NO: 22374 - protein, 20 aa, synthetic construct
  source 1..20: note = Seed: SATGFKQSSKALQRPVASDF
SATGFFQSDKFLQLPVASDF

SEQ ID NO: 22375 - protein, 20 aa, synthetic construct
  source 1..20: note = Seed: SATGFKQSSKALQRPVASDF
SATGFFQSDKFLQMPVASDF

SEQ ID NO: 22376 - protein, 20 aa, synthetic construct
  source 1..20: note = Seed: SATGFKQSSKALQRPVASDF
SATGFFQSDKFLQNPVASDF

SEQ ID NO: 22377 - protein, 20 aa, synthetic construct
  source 1..20: note = Seed: SATGFKQSSKALQRPVASDF
SATGFFQSDKFLQSPVASDF

SEQ ID NO: 22378 - protein, 20 aa, synthetic construct
  source 1..20: note = Seed: SATGFKQSSKALQRPVASDF
SATGFFQSDKFLQTPVASDF

SEQ ID NO: 22379 - protein, 20 aa, synthetic construct
  source 1..20: note = Seed: SATGFKQSSKALQRPVASDF
SATGFFQSDKFLQVPVASDF

SEQ ID NO: 22380 - protein, 20 aa, synthetic construct
  source 1..20: note = Seed: SATGFKQSSKALQRPVASDF
SATGFFQSEKALQIPVASDF

SEQ ID NO: 22381 - protein, 20 aa, synthetic construct
  source 1..20: note = Seed: SATGFKQSSKALQRPVASDF
SATGFFQSEKALQLPVASDF

SEQ ID NO: 22382 - protein, 20 aa, synthetic construct
  source 1..20: note = Seed: SATGFKQSSKALQRPVASDF
SATGFFQSEKFLQAPVASDF

SEQ ID NO: 22383 - protein, 20 aa, synthetic construct
  source 1..20: note = Seed: SATGFKQSSKALQRPVASDF
SATGFFQSEKFLQDPVASDF

SEQ ID NO: 22384 - protein, 20 aa, synthetic construct
  source 1..20: note = Seed: SATGFKQSSKALQRPVASDF
SATGFFQSEKFLQEPVASDF

SEQ ID NO: 22385 - protein, 20 aa, synthetic construct
  source 1..20: note = Seed: SATGFKQSSKALQRPVASDF
SATGFFQSEKFLQFPVASDF

SEQ ID NO: 22386 - protein, 20 aa, synthetic construct
  source 1..20: note = Seed: SATGFKQSSKALQRPVASDF
SATGFFQSEKFLQHPVASDF

SEQ ID NO: 22387 - protein, 20 aa, synthetic construct
  source 1..20: note = Seed: SATGFKQSSKALQRPVASDF
SATGFFQSEKFLQIPVASDF

SEQ ID NO: 22388 - protein, 20 aa, synthetic construct
  source 1..20: note = Seed: SATGFKQSSKALQRPVASDF
SATGFFQSEKFLQKPVASDF

SEQ ID NO: 22389 - protein, 20 aa, synthetic construct
  source 1..20: note = Seed: SATGFKQSSKALQRPVASDF
SATGFFQSEKFLQLPVASDF

SEQ ID NO: 22390 - protein, 20 aa, synthetic construct
  source 1..20: note = Seed: SATGFKQSSKALQRPVASDF
SATGFFQSEKFLQMPVASDF

SEQ ID NO: 22391 - protein, 20 aa, synthetic construct
  source 1..20: note = Seed: SATGFKQSSKALQRPVASDF
SATGFFQSEKFLQNPVASDF

SEQ ID NO: 22392 - protein, 20 aa, synthetic construct
  source 1..20: note = Seed: SATGFKQSSKALQRPVASDF
SATGFFQSEKFLQRPVASDF

SEQ ID NO: 22393 - protein, 20 aa, synthetic construct
  source 1..20: note = Seed: SATGFKQSSKALQRPVASDF
SATGFFQSEKFLQSPVASDF

SEQ ID NO: 22394 - protein, 20 aa, synthetic construct
  source 1..20: note = Seed: SATGFKQSSKALQRPVASDF
SATGFFQSEKFLQTPVASDF

SEQ ID NO: 22395 - protein, 20 aa, synthetic construct
  source 1..20: note = Seed: SATGFKQSSKALQRPVASDF
SATGFFQSEKFLQVPVASDF

SEQ ID NO: 22396 - protein, 20 aa, synthetic construct
  source 1..20: note = Seed: SATGFKQSSKALQRPVASDF
SATGFFQSEKFLQYPVASDF

SEQ ID NO: 22397 - protein, 20 aa, synthetic construct
  source 1..20: note = Seed: SATGFKQSSKALQRPVASDF
SATGFFQSEKILQFPVASDF

SEQ ID NO: 22398 - protein, 20 aa, synthetic construct
  source 1..20: note = Seed: SATGFKQSSKALQRPVASDF
SATGFFQSEKILQIPVASDF

SEQ ID NO: 22399 - protein, 20 aa, synthetic construct
  source 1..20: note = Seed: SATGFKQSSKALQRPVASDF
SATGFFQSEKILQLPVASDF

SEQ ID NO: 22400 - protein, 20 aa, synthetic construct
  source 1..20: note = Seed: SATGFKQSSKALQRPVASDF
SATGFFQSEKILQMPVASDF

SEQ ID NO: 22401 - protein, 20 aa, synthetic construct
  source 1..20: note = Seed: SATGFKQSSKALQRPVASDF
SATGFFQSEKILQNPVASDF

SEQ ID NO: 22402 - protein, 20 aa, synthetic construct
  source 1..20: note = Seed: SATGFKQSSKALQRPVASDF
SATGFFQSEKILQVPVASDF

SEQ ID NO: 22403 - protein, 20 aa, synthetic construct
  source 1..20: note = Seed: SATGFKQSSKALQRPVASDF
SATGFFQSEKILQYPVASDF

SEQ ID NO: 22404 - protein, 20 aa, synthetic construct
  source 1..20: note = Seed: SATGFKQSSKALQRPVASDF
SATGFFQSEKLLQFPVASDF

SEQ ID NO: 22405 - protein, 20 aa, synthetic construct
  source 1..20: note = Seed: SATGFKQSSKALQRPVASDF
SATGFFQSEKLLQIPVASDF

SEQ ID NO: 22406 - protein, 20 aa, synthetic construct
  source 1..20: note = Seed: SATGFKQSSKALQRPVASDF
SATGFFQSEKLLQLPVASDF

SEQ ID NO: 22407 - protein, 20 aa, synthetic construct
  source 1..20: note = Seed: SATGFKQSSKALQRPVASDF
SATGFFQSEKLLQMPVASDF

SEQ ID NO: 22408 - protein, 20 aa, synthetic construct
  source 1..20: note = Seed: SATGFKQSSKALQRPVASDF
SATGFFQSEKLLQNPVASDF

SEQ ID NO: 22409 - protein, 20 aa, synthetic construct
  source 1..20: note = Seed: SATGFKQSSKALQRPVASDF
SATGFFQSEKLLQVPVASDF

SEQ ID NO: 22410 - protein, 20 aa, synthetic construct
  source 1..20: note = Seed: SATGFKQSSKALQRPVASDF
SATGFFQSEKLLQYPVASDF

SEQ ID NO: 22411 - protein, 20 aa, synthetic construct
  source 1..20: note = Seed: SATGFKQSSKALQRPVASDF
SATGFFQSEKMLQIPVASDF

SEQ ID NO: 22412 - protein, 20 aa, synthetic construct
  source 1..20: note = Seed: SATGFKQSSKALQRPVASDF
SATGFFQSEKMLQLPVASDF

SEQ ID NO: 22413 - protein, 20 aa, synthetic construct
  source 1..20: note = Seed: SATGFKQSSKALQRPVASDF
SATGFFQSEKMLQVPVASDF

SEQ ID NO: 22414 - protein, 20 aa, synthetic construct
  source 1..20: note = Seed: SATGFKQSSKALQRPVASDF
SATGFFQSEKVLQIPVASDF

SEQ ID NO: 22415 - protein, 20 aa, synthetic construct
  source 1..20: note = Seed: SATGFKQSSKALQRPVASDF
SATGFFQSEKVLQLPVASDF

SEQ ID NO: 22416 - protein, 20 aa, synthetic construct
  source 1..20: note = Seed: SATGFKQSSKALQRPVASDF
SATGFFQSEKVLQVPVASDF

SEQ ID NO: 22417 - protein, 20 aa, synthetic construct
  source 1..20: note = Seed: SATGFKQSSKALQRPVASDF
SATGFFQSEKWLQFPVASDF

SEQ ID NO: 22418 - protein, 20 aa, synthetic construct
  source 1..20: note = Seed: SATGFKQSSKALQRPVASDF
SATGFFQSEKWLQIPVASDF

SEQ ID NO: 22419 - protein, 20 aa, synthetic construct
  source 1..20: note = Seed: SATGFKQSSKALQRPVASDF
SATGFFQSEKWLQLPVASDF

SEQ ID NO: 22420 - protein, 20 aa, synthetic construct
  source 1..20: note = Seed: SATGFKQSSKALQRPVASDF
SATGFFQSEKWLQMPVASDF

SEQ ID NO: 22421 - protein, 20 aa, synthetic construct
  source 1..20: note = Seed: SATGFKQSSKALQRPVASDF
SATGFFQSEKWLQVPVASDF

SEQ ID NO: 22422 - protein, 20 aa, synthetic construct
  source 1..20: note = Seed: SATGFKQSSKALQRPVASDF
SATGFFQSEKYLQFPVASDF

SEQ ID NO: 22423 - protein, 20 aa, synthetic construct
  source 1..20: note = Seed: SATGFKQSSKALQRPVASDF
SATGFFQSEKYLQIPVASDF

SEQ ID NO: 22424 - protein, 20 aa, synthetic construct
  source 1..20: note = Seed: SATGFKQSSKALQRPVASDF
SATGFFQSEKYLQLPVASDF

SEQ ID NO: 22425 - protein, 20 aa, synthetic construct
  source 1..20: note = Seed: SATGFKQSSKALQRPVASDF
SATGFFQSEKYLQVPVASDF

SEQ ID NO: 22426 - protein, 20 aa, synthetic construct
  source 1..20: note = Seed: SATGFKQSSKALQRPVASDF
SATGFFQSFKALQFPVASDF

SEQ ID NO: 22427 - protein, 20 aa, synthetic construct
  source 1..20: note = Seed: SATGFKQSSKALQRPVASDF
SATGFFQSFKALQIPVASDF

SEQ ID NO: 22428 - protein, 20 aa, synthetic construct
  source 1..20: note = Seed: SATGFKQSSKALQRPVASDF
SATGFFQSFKALQLPVASDF

SEQ ID NO: 22429 - protein, 20 aa, synthetic construct
  source 1..20: note = Seed: SATGFKQSSKALQRPVASDF
SATGFFQSFKALQMPVASDF

SEQ ID NO: 22430 - protein, 20 aa, synthetic construct
  source 1..20: note = Seed: SATGFKQSSKALQRPVASDF
SATGFFQSFKALQVPVASDF

SEQ ID NO: 22431 - protein, 20 aa, synthetic construct
  source 1..20: note = Seed: SATGFKQSSKALQRPVASDF
SATGFFQSFKALQYPVASDF

SEQ ID NO: 22432 - protein, 20 aa, synthetic construct
  source 1..20: note = Seed: SATGFKQSSKALQRPVASDF
SATGFFQSFKFLQAPVASDF

SEQ ID NO: 22433 - protein, 20 aa, synthetic construct
  source 1..20: note = Seed: SATGFKQSSKALQRPVASDF
SATGFFQSFKFLQDPVASDF

SEQ ID NO: 22434 - protein, 20 aa, synthetic construct
  source 1..20: note = Seed: SATGFKQSSKALQRPVASDF
SATGFFQSFKFLQEPVASDF

SEQ ID NO: 22435 - protein, 20 aa, synthetic construct
  source 1..20: note = Seed: SATGFKQSSKALQRPVASDF
SATGFFQSFKFLQFPVASDF

SEQ ID NO: 22436 - protein, 20 aa, synthetic construct
  source 1..20: note = Seed: SATGFKQSSKALQRPVASDF
SATGFFQSFKFLQHPVASDF

SEQ ID NO: 22437 - protein, 20 aa, synthetic construct
  source 1..20: note = Seed: SATGFKQSSKALQRPVASDF
SATGFFQSFKFLQIPVASDF

SEQ ID NO: 22438 - protein, 20 aa, synthetic construct
  source 1..20: note = Seed: SATGFKQSSKALQRPVASDF
SATGFFQSFKFLQKPVASDF

SEQ ID NO: 22439 - protein, 20 aa, synthetic construct
  source 1..20: note = Seed: SATGFKQSSKALQRPVASDF
SATGFFQSFKFLQLPVASDF

SEQ ID NO: 22440 - protein, 20 aa, synthetic construct
  source 1..20: note = Seed: SATGFKQSSKALQRPVASDF
SATGFFQSFKFLQMPVASDF

SEQ ID NO: 22441 - protein, 20 aa, synthetic construct
  source 1..20: note = Seed: SATGFKQSSKALQRPVASDF
SATGFFQSFKFLQNPVASDF

SEQ ID NO: 22442 - protein, 20 aa, synthetic construct
  source 1..20: note = Seed: SATGFKQSSKALQRPVASDF
SATGFFQSFKFLQPPVASDF

SEQ ID NO: 22443 - protein, 20 aa, synthetic construct
  source 1..20: note = Seed: SATGFKQSSKALQRPVASDF
SATGFFQSFKFLQQPVASDF

SEQ ID NO: 22444 - protein, 20 aa, synthetic construct
  source 1..20: note = Seed: SATGFKQSSKALQRPVASDF
SATGFFQSFKFLQRPVASDF

SEQ ID NO: 22445 - protein, 20 aa, synthetic construct
  source 1..20: note = Seed: SATGFKQSSKALQRPVASDF
SATGFFQSFKFLQSPVASDF

SEQ ID NO: 22446 - protein, 20 aa, synthetic construct
  source 1..20: note = Seed: SATGFKQSSKALQRPVASDF
SATGFFQSFKFLQTPVASDF

SEQ ID NO: 22447 - protein, 20 aa, synthetic construct
  source 1..20: note = Seed: SATGFKQSSKALQRPVASDF
SATGFFQSFKFLQVPVASDF

SEQ ID NO: 22448 - protein, 20 aa, synthetic construct
  source 1..20: note = Seed: SATGFKQSSKALQRPVASDF
SATGFFQSFKFLQYPVASDF

SEQ ID NO: 22449 - protein, 20 aa, synthetic construct
  source 1..20: note = Seed: SATGFKQSSKALQRPVASDF
SATGFFQSFKILQAPVASDF

SEQ ID NO: 22450 - protein, 20 aa, synthetic construct
  source 1..20: note = Seed: SATGFKQSSKALQRPVASDF
SATGFFQSFKILQDPVASDF

SEQ ID NO: 22451 - protein, 20 aa, synthetic construct
  source 1..20: note = Seed: SATGFKQSSKALQRPVASDF
SATGFFQSFKILQEPVASDF

SEQ ID NO: 22452 - protein, 20 aa, synthetic construct
  source 1..20: note = Seed: SATGFKQSSKALQRPVASDF
SATGFFQSFKILQFPVASDF

SEQ ID NO: 22453 - protein, 20 aa, synthetic construct
  source 1..20: note = Seed: SATGFKQSSKALQRPVASDF
SATGFFQSFKILQHPVASDF

SEQ ID NO: 22454 - protein, 20 aa, synthetic construct
  source 1..20: note = Seed: SATGFKQSSKALQRPVASDF
SATGFFQSFKILQIPVASDF

SEQ ID NO: 22455 - protein, 20 aa, synthetic construct
  source 1..20: note = Seed: SATGFKQSSKALQRPVASDF
SATGFFQSFKILQLPVASDF

SEQ ID NO: 22456 - protein, 20 aa, synthetic construct
  source 1..20: note = Seed: SATGFKQSSKALQRPVASDF
SATGFFQSFKILQMPVASDF

SEQ ID NO: 22457 - protein, 20 aa, synthetic construct
  source 1..20: note = Seed: SATGFKQSSKALQRPVASDF
SATGFFQSFKILQNPVASDF

SEQ ID NO: 22458 - protein, 20 aa, synthetic construct
  source 1..20: note = Seed: SATGFKQSSKALQRPVASDF
SATGFFQSFKILQRPVASDF

SEQ ID NO: 22459 - protein, 20 aa, synthetic construct
  source 1..20: note = Seed: SATGFKQSSKALQRPVASDF
SATGFFQSFKILQSPVASDF

SEQ ID NO: 22460 - protein, 20 aa, synthetic construct
  source 1..20: note = Seed: SATGFKQSSKALQRPVASDF
SATGFFQSFKILQTPVASDF

SEQ ID NO: 22461 - protein, 20 aa, synthetic construct
  source 1..20: note = Seed: SATGFKQSSKALQRPVASDF
SATGFFQSFKILQVPVASDF

SEQ ID NO: 22462 - protein, 20 aa, synthetic construct
  source 1..20: note = Seed: SATGFKQSSKALQRPVASDF
SATGFFQSFKILQYPVASDF

SEQ ID NO: 22463 - protein, 20 aa, synthetic construct
  source 1..20: note = Seed: SATGFKQSSKALQRPVASDF
SATGFFQSFKLLQAPVASDF

SEQ ID NO: 22464 - protein, 20 aa, synthetic construct
  source 1..20: note = Seed: SATGFKQSSKALQRPVASDF
SATGFFQSFKLLQDPVASDF

SEQ ID NO: 22465 - protein, 20 aa, synthetic construct
  source 1..20: note = Seed: SATGFKQSSKALQRPVASDF
SATGFFQSFKLLQEPVASDF

SEQ ID NO: 22466 - protein, 20 aa, synthetic construct
  source 1..20: note = Seed: SATGFKQSSKALQRPVASDF
SATGFFQSFKLLQFPVASDF

SEQ ID NO: 22467 - protein, 20 aa, synthetic construct
  source 1..20: note = Seed: SATGFKQSSKALQRPVASDF
SATGFFQSFKLLQHPVASDF

SEQ ID NO: 22468 - protein, 20 aa, synthetic construct
  source 1..20: note = Seed: SATGFKQSSKALQRPVASDF
SATGFFQSFKLLQIPVASDF

SEQ ID NO: 22469 - protein, 20 aa, synthetic construct
  source 1..20: note = Seed: SATGFKQSSKALQRPVASDF
SATGFFQSFKLLQLPVASDF

SEQ ID NO: 22470 - protein, 20 aa, synthetic construct
  source 1..20: note = Seed: SATGFKQSSKALQRPVASDF
SATGFFQSFKLLQMPVASDF

SEQ ID NO: 22471 - protein, 20 aa, synthetic construct
  source 1..20: note = Seed: SATGFKQSSKALQRPVASDF
SATGFFQSFKLLQNPVASDF

SEQ ID NO: 22472 - protein, 20 aa, synthetic construct
  source 1..20: note = Seed: SATGFKQSSKALQRPVASDF
SATGFFQSFKLLQRPVASDF

SEQ ID NO: 22473 - protein, 20 aa, synthetic construct
  source 1..20: note = Seed: SATGFKQSSKALQRPVASDF
SATGFFQSFKLLQSPVASDF

SEQ ID NO: 22474 - protein, 20 aa, synthetic construct
  source 1..20: note = Seed: SATGFKQSSKALQRPVASDF
SATGFFQSFKLLQTPVASDF

SEQ ID NO: 22475 - protein, 20 aa, synthetic construct
  source 1..20: note = Seed: SATGFKQSSKALQRPVASDF
SATGFFQSFKLLQVPVASDF

SEQ ID NO: 22476 - protein, 20 aa, synthetic construct
  source 1..20: note = Seed: SATGFKQSSKALQRPVASDF
SATGFFQSFKLLQYPVASDF

SEQ ID NO: 22477 - protein, 20 aa, synthetic construct
  source 1..20: note = Seed: SATGFKQSSKALQRPVASDF
SATGFFQSFKMLQHPVASDF

SEQ ID NO: 22478 - protein, 20 aa, synthetic construct
  source 1..20: note = Seed: SATGFKQSSKALQRPVASDF
SATGFFQSFKMLQIPVASDF

SEQ ID NO: 22479 - protein, 20 aa, synthetic construct
  source 1..20: note = Seed: SATGFKQSSKALQRPVASDF
SATGFFQSFKMLQLPVASDF

SEQ ID NO: 22480 - protein, 20 aa, synthetic construct
  source 1..20: note = Seed: SATGFKQSSKALQRPVASDF
SATGFFQSFKMLQMPVASDF

SEQ ID NO: 22481 - protein, 20 aa, synthetic construct
  source 1..20: note = Seed: SATGFKQSSKALQRPVASDF
SATGFFQSFKMLQNPVASDF

SEQ ID NO: 22482 - protein, 20 aa, synthetic construct
  source 1..20: note = Seed: SATGFKQSSKALQRPVASDF
SATGFFQSFKMLQRPVASDF

SEQ ID NO: 22483 - protein, 20 aa, synthetic construct
  source 1..20: note = Seed: SATGFKQSSKALQRPVASDF
SATGFFQSFKMLQVPVASDF

SEQ ID NO: 22484 - protein, 20 aa, synthetic construct
  source 1..20: note = Seed: SATGFKQSSKALQRPVASDF
SATGFFQSFKMLQYPVASDF

SEQ ID NO: 22485 - protein, 20 aa, synthetic construct
  source 1..20: note = Seed: SATGFKQSSKALQRPVASDF
SATGFFQSFKPLQIPVASDF

SEQ ID NO: 22486 - protein, 20 aa, synthetic construct
  source 1..20: note = Seed: SATGFKQSSKALQRPVASDF
SATGFFQSFKPLQLPVASDF

SEQ ID NO: 22487 - protein, 20 aa, synthetic construct
  source 1..20: note = Seed: SATGFKQSSKALQRPVASDF
SATGFFQSFKTLQLPVASDF

SEQ ID NO: 22488 - protein, 20 aa, synthetic construct
  source 1..20: note = Seed: SATGFKQSSKALQRPVASDF
SATGFFQSFKVLQFPVASDF

SEQ ID NO: 22489 - protein, 20 aa, synthetic construct
  source 1..20: note = Seed: SATGFKQSSKALQRPVASDF
SATGFFQSFKVLQIPVASDF

SEQ ID NO: 22490 - protein, 20 aa, synthetic construct
  source 1..20: note = Seed: SATGFKQSSKALQRPVASDF
SATGFFQSFKVLQLPVASDF

SEQ ID NO: 22491 - protein, 20 aa, synthetic construct
  source 1..20: note = Seed: SATGFKQSSKALQRPVASDF
SATGFFQSFKVLQMPVASDF

SEQ ID NO: 22492 - protein, 20 aa, synthetic construct
  source 1..20: note = Seed: SATGFKQSSKALQRPVASDF
SATGFFQSFKVLQNPVASDF

SEQ ID NO: 22493 - protein, 20 aa, synthetic construct
  source 1..20: note = Seed: SATGFKQSSKALQRPVASDF
SATGFFQSFKVLQVPVASDF

SEQ ID NO: 22494 - protein, 20 aa, synthetic construct
  source 1..20: note = Seed: SATGFKQSSKALQRPVASDF
SATGFFQSFKVLQYPVASDF

SEQ ID NO: 22495 - protein, 20 aa, synthetic construct
  source 1..20: note = Seed: SATGFKQSSKALQRPVASDF
SATGFFQSFKWLQEPVASDF

SEQ ID NO: 22496 - protein, 20 aa, synthetic construct
  source 1..20: note = Seed: SATGFKQSSKALQRPVASDF
SATGFFQSFKWLQIPVASDF

SEQ ID NO: 22497 - protein, 20 aa, synthetic construct
  source 1..20: note = Seed: SATGFKQSSKALQRPVASDF
SATGFFQSFKWLQLPVASDF

SEQ ID NO: 22498 - protein, 20 aa, synthetic construct
  source 1..20: note = Seed: SATGFKQSSKALQRPVASDF
SATGFFQSFKWLQMPVASDF

SEQ ID NO: 22499 - protein, 20 aa, synthetic construct
  source 1..20: note = Seed: SATGFKQSSKALQRPVASDF
SATGFFQSFKWLQNPVASDF

SEQ ID NO: 22500 - protein, 20 aa, synthetic construct
  source 1..20: note = Seed: SATGFKQSSKALQRPVASDF
SATGFFQSFKWLQVPVASDF

SEQ ID NO: 22501 - protein, 20 aa, synthetic construct
  source 1..20: note = Seed: SATGFKQSSKALQRPVASDF
SATGFFQSFKWLQYPVASDF

SEQ ID NO: 22502 - protein, 20 aa, synthetic construct
  source 1..20: note = Seed: SATGFKQSSKALQRPVASDF
SATGFFQSFKYLQAPVASDF

SEQ ID NO: 22503 - protein, 20 aa, synthetic construct
  source 1..20: note = Seed: SATGFKQSSKALQRPVASDF
SATGFFQSFKYLQEPVASDF

SEQ ID NO: 22504 - protein, 20 aa, synthetic construct
  source 1..20: note = Seed: SATGFKQSSKALQRPVASDF
SATGFFQSFKYLQIPVASDF

SEQ ID NO: 22505 - protein, 20 aa, synthetic construct
  source 1..20: note = Seed: SATGFKQSSKALQRPVASDF
SATGFFQSFKYLQLPVASDF

SEQ ID NO: 22506 - protein, 20 aa, synthetic construct
  source 1..20: note = Seed: SATGFKQSSKALQRPVASDF
SATGFFQSFKYLQMPVASDF

SEQ ID NO: 22507 - protein, 20 aa, synthetic construct
  source 1..20: note = Seed: SATGFKQSSKALQRPVASDF
SATGFFQSFKYLQNPVASDF

SEQ ID NO: 22508 - protein, 20 aa, synthetic construct
  source 1..20: note = Seed: SATGFKQSSKALQRPVASDF
SATGFFQSFKYLQSPVASDF

SEQ ID NO: 22509 - protein, 20 aa, synthetic construct
  source 1..20: note = Seed: SATGFKQSSKALQRPVASDF
SATGFFQSFKYLQTPVASDF

SEQ ID NO: 22510 - protein, 20 aa, synthetic construct
  source 1..20: note = Seed: SATGFKQSSKALQRPVASDF
SATGFFQSFKYLQVPVASDF

SEQ ID NO: 22511 - protein, 20 aa, synthetic construct
  source 1..20: note = Seed: SATGFKQSSKALQRPVASDF
SATGFFQSFKYLQYPVASDF

SEQ ID NO: 22512 - protein, 20 aa, synthetic construct
  source 1..20: note = Seed: SATGFKQSSKALQRPVASDF
SATGFFQSGKFLQFPVASDF

SEQ ID NO: 22513 - protein, 20 aa, synthetic construct
  source 1..20: note = Seed: SATGFKQSSKALQRPVASDF
SATGFFQSGKFLQIPVASDF

SEQ ID NO: 22514 - protein, 20 aa, synthetic construct
  source 1..20: note = Seed: SATGFKQSSKALQRPVASDF
SATGFFQSGKFLQLPVASDF

SEQ ID NO: 22515 - protein, 20 aa, synthetic construct
  source 1..20: note = Seed: SATGFKQSSKALQRPVASDF
SATGFFQSGKFLQMPVASDF

SEQ ID NO: 22516 - protein, 20 aa, synthetic construct
  source 1..20: note = Seed: SATGFKQSSKALQRPVASDF
SATGFFQSGKFLQVPVASDF

SEQ ID NO: 22517 - protein, 20 aa, synthetic construct
  source 1..20: note = Seed: SATGFKQSSKALQRPVASDF
SATGFFQSHKALQFPVASDF

SEQ ID NO: 22518 - protein, 20 aa, synthetic construct
  source 1..20: note = Seed: SATGFKQSSKALQRPVASDF
SATGFFQSHKALQIPVASDF

SEQ ID NO: 22519 - protein, 20 aa, synthetic construct
  source 1..20: note = Seed: SATGFKQSSKALQRPVASDF
SATGFFQSHKALQLPVASDF

SEQ ID NO: 22520 - protein, 20 aa, synthetic construct
  source 1..20: note = Seed: SATGFKQSSKALQRPVASDF
SATGFFQSHKALQVPVASDF

SEQ ID NO: 22521 - protein, 20 aa, synthetic construct
  source 1..20: note = Seed: SATGFKQSSKALQRPVASDF
SATGFFQSHKFLQAPVASDF

SEQ ID NO: 22522 - protein, 20 aa, synthetic construct
  source 1..20: note = Seed: SATGFKQSSKALQRPVASDF
SATGFFQSHKFLQCPVASDF

SEQ ID NO: 22523 - protein, 20 aa, synthetic construct
  source 1..20: note = Seed: SATGFKQSSKALQRPVASDF
SATGFFQSHKFLQDPVASDF

SEQ ID NO: 22524 - protein, 20 aa, synthetic construct
  source 1..20: note = Seed: SATGFKQSSKALQRPVASDF
SATGFFQSHKFLQEPVASDF

SEQ ID NO: 22525 - protein, 20 aa, synthetic construct
  source 1..20: note = Seed: SATGFKQSSKALQRPVASDF
SATGFFQSHKFLQFPVASDF

SEQ ID NO: 22526 - protein, 20 aa, synthetic construct
  source 1..20: note = Seed: SATGFKQSSKALQRPVASDF
SATGFFQSHKFLQGPVASDF

SEQ ID NO: 22527 - protein, 20 aa, synthetic construct
  source 1..20: note = Seed: SATGFKQSSKALQRPVASDF
SATGFFQSHKFLQHPVASDF

SEQ ID NO: 22528 - protein, 20 aa, synthetic construct
  source 1..20: note = Seed: SATGFKQSSKALQRPVASDF
SATGFFQSHKFLQIPVASDF

SEQ ID NO: 22529 - protein, 20 aa, synthetic construct
  source 1..20: note = Seed: SATGFKQSSKALQRPVASDF
SATGFFQSHKFLQKPVASDF

SEQ ID NO: 22530 - protein, 20 aa, synthetic construct
  source 1..20: note = Seed: SATGFKQSSKALQRPVASDF
SATGFFQSHKFLQLPVASDF

SEQ ID NO: 22531 - protein, 20 aa, synthetic construct
  source 1..20: note = Seed: SATGFKQSSKALQRPVASDF
SATGFFQSHKFLQMPVASDF

SEQ ID NO: 22532 - protein, 20 aa, synthetic construct
  source 1..20: note = Seed: SATGFKQSSKALQRPVASDF
SATGFFQSHKFLQNPVASDF

SEQ ID NO: 22533 - protein, 20 aa, synthetic construct
  source 1..20: note = Seed: SATGFKQSSKALQRPVASDF
SATGFFQSHKFLQPPVASDF

SEQ ID NO: 22534 - protein, 20 aa, synthetic construct
  source 1..20: note = Seed: SATGFKQSSKALQRPVASDF
SATGFFQSHKFLQQPVASDF

SEQ ID NO: 22535 - protein, 20 aa, synthetic construct
  source 1..20: note = Seed: SATGFKQSSKALQRPVASDF
SATGFFQSHKFLQRPVASDF

SEQ ID NO: 22536 - protein, 20 aa, synthetic construct
  source 1..20: note = Seed: SATGFKQSSKALQRPVASDF
SATGFFQSHKFLQSPVASDF

SEQ ID NO: 22537 - protein, 20 aa, synthetic construct
  source 1..20: note = Seed: SATGFKQSSKALQRPVASDF
SATGFFQSHKFLQTPVASDF

SEQ ID NO: 22538 - protein, 20 aa, synthetic construct
  source 1..20: note = Seed: SATGFKQSSKALQRPVASDF
SATGFFQSHKFLQVPVASDF

SEQ ID NO: 22539 - protein, 20 aa, synthetic construct
  source 1..20: note = Seed: SATGFKQSSKALQRPVASDF
SATGFFQSHKFLQWPVASDF

SEQ ID NO: 22540 - protein, 20 aa, synthetic construct
  source 1..20: note = Seed: SATGFKQSSKALQRPVASDF
SATGFFQSHKFLQYPVASDF

SEQ ID NO: 22541 - protein, 20 aa, synthetic construct
  source 1..20: note = Seed: SATGFKQSSKALQRPVASDF
SATGFFQSHKILQFPVASDF

SEQ ID NO: 22542 - protein, 20 aa, synthetic construct
  source 1..20: note = Seed: SATGFKQSSKALQRPVASDF
SATGFFQSHKILQIPVASDF

SEQ ID NO: 22543 - protein, 20 aa, synthetic construct
  source 1..20: note = Seed: SATGFKQSSKALQRPVASDF
SATGFFQSHKILQLPVASDF

SEQ ID NO: 22544 - protein, 20 aa, synthetic construct
  source 1..20: note = Seed: SATGFKQSSKALQRPVASDF
SATGFFQSHKILQMPVASDF

SEQ ID NO: 22545 - protein, 20 aa, synthetic construct
  source 1..20: note = Seed: SATGFKQSSKALQRPVASDF
SATGFFQSHKILQNPVASDF

SEQ ID NO: 22546 - protein, 20 aa, synthetic construct
  source 1..20: note = Seed: SATGFKQSSKALQRPVASDF
SATGFFQSHKILQTPVASDF

SEQ ID NO: 22547 - protein, 20 aa, synthetic construct
  source 1..20: note = Seed: SATGFKQSSKALQRPVASDF
SATGFFQSHKILQVPVASDF

SEQ ID NO: 22548 - protein, 20 aa, synthetic construct
  source 1..20: note = Seed: SATGFKQSSKALQRPVASDF
SATGFFQSHKILQYPVASDF

SEQ ID NO: 22549 - protein, 20 aa, synthetic construct
  source 1..20: note = Seed: SATGFKQSSKALQRPVASDF
SATGFFQSHKLLQAPVASDF

SEQ ID NO: 22550 - protein, 20 aa, synthetic construct
  source 1..20: note = Seed: SATGFKQSSKALQRPVASDF
SATGFFQSHKLLQEPVASDF

SEQ ID NO: 22551 - protein, 20 aa, synthetic construct
  source 1..20: note = Seed: SATGFKQSSKALQRPVASDF
SATGFFQSHKLLQFPVASDF

SEQ ID NO: 22552 - protein, 20 aa, synthetic construct
  source 1..20: note = Seed: SATGFKQSSKALQRPVASDF
SATGFFQSHKLLQIPVASDF

SEQ ID NO: 22553 - protein, 20 aa, synthetic construct
  source 1..20: note = Seed: SATGFKQSSKALQRPVASDF
SATGFFQSHKLLQLPVASDF

SEQ ID NO: 22554 - protein, 20 aa, synthetic construct
  source 1..20: note = Seed: SATGFKQSSKALQRPVASDF
SATGFFQSHKLLQMPVASDF

SEQ ID NO: 22555 - protein, 20 aa, synthetic construct
  source 1..20: note = Seed: SATGFKQSSKALQRPVASDF
SATGFFQSHKLLQNPVASDF

SEQ ID NO: 22556 - protein, 20 aa, synthetic construct
  source 1..20: note = Seed: SATGFKQSSKALQRPVASDF
SATGFFQSHKLLQRPVASDF

SEQ ID NO: 22557 - protein, 20 aa, synthetic construct
  source 1..20: note = Seed: SATGFKQSSKALQRPVASDF
SATGFFQSHKLLQSPVASDF

SEQ ID NO: 22558 - protein, 20 aa, synthetic construct
  source 1..20: note = Seed: SATGFKQSSKALQRPVASDF
SATGFFQSHKLLQTPVASDF

SEQ ID NO: 22559 - protein, 20 aa, synthetic construct
  source 1..20: note = Seed: SATGFKQSSKALQRPVASDF
SATGFFQSHKLLQVPVASDF

SEQ ID NO: 22560 - protein, 20 aa, synthetic construct
  source 1..20: note = Seed: SATGFKQSSKALQRPVASDF
SATGFFQSHKLLQYPVASDF

SEQ ID NO: 22561 - protein, 20 aa, synthetic construct
  source 1..20: note = Seed: SATGFKQSSKALQRPVASDF
SATGFFQSHKMLQFPVASDF

SEQ ID NO: 22562 - protein, 20 aa, synthetic construct
  source 1..20: note = Seed: SATGFKQSSKALQRPVASDF
SATGFFQSHKMLQIPVASDF

SEQ ID NO: 22563 - protein, 20 aa, synthetic construct
  source 1..20: note = Seed: SATGFKQSSKALQRPVASDF
SATGFFQSHKMLQLPVASDF

SEQ ID NO: 22564 - protein, 20 aa, synthetic construct
  source 1..20: note = Seed: SATGFKQSSKALQRPVASDF
SATGFFQSHKMLQMPVASDF

SEQ ID NO: 22565 - protein, 20 aa, synthetic construct
  source 1..20: note = Seed: SATGFKQSSKALQRPVASDF
SATGFFQSHKMLQVPVASDF

SEQ ID NO: 22566 - protein, 20 aa, synthetic construct
  source 1..20: note = Seed: SATGFKQSSKALQRPVASDF
SATGFFQSHKMLQYPVASDF

SEQ ID NO: 22567 - protein, 20 aa, synthetic construct
  source 1..20: note = Seed: SATGFKQSSKALQRPVASDF
SATGFFQSHKVLQFPVASDF

SEQ ID NO: 22568 - protein, 20 aa, synthetic construct
  source 1..20: note = Seed: SATGFKQSSKALQRPVASDF
SATGFFQSHKVLQIPVASDF

SEQ ID NO: 22569 - protein, 20 aa, synthetic construct
  source 1..20: note = Seed: SATGFKQSSKALQRPVASDF
SATGFFQSHKVLQLPVASDF

SEQ ID NO: 22570 - protein, 20 aa, synthetic construct
  source 1..20: note = Seed: SATGFKQSSKALQRPVASDF
SATGFFQSHKVLQMPVASDF

SEQ ID NO: 22571 - protein, 20 aa, synthetic construct
  source 1..20: note = Seed: SATGFKQSSKALQRPVASDF
SATGFFQSHKVLQVPVASDF

SEQ ID NO: 22572 - protein, 20 aa, synthetic construct
  source 1..20: note = Seed: SATGFKQSSKALQRPVASDF
SATGFFQSHKWLQAPVASDF

SEQ ID NO: 22573 - protein, 20 aa, synthetic construct
  source 1..20: note = Seed: SATGFKQSSKALQRPVASDF
SATGFFQSHKWLQFPVASDF

SEQ ID NO: 22574 - protein, 20 aa, synthetic construct
  source 1..20: note = Seed: SATGFKQSSKALQRPVASDF
SATGFFQSHKWLQIPVASDF

SEQ ID NO: 22575 - protein, 20 aa, synthetic construct
  source 1..20: note = Seed: SATGFKQSSKALQRPVASDF
SATGFFQSHKWLQLPVASDF

SEQ ID NO: 22576 - protein, 20 aa, synthetic construct
  source 1..20: note = Seed: SATGFKQSSKALQRPVASDF
SATGFFQSHKWLQMPVASDF

SEQ ID NO: 22577 - protein, 20 aa, synthetic construct
  source 1..20: note = Seed: SATGFKQSSKALQRPVASDF
SATGFFQSHKWLQSPVASDF

SEQ ID NO: 22578 - protein, 20 aa, synthetic construct
  source 1..20: note = Seed: SATGFKQSSKALQRPVASDF
SATGFFQSHKWLQTPVASDF

SEQ ID NO: 22579 - protein, 20 aa, synthetic construct
  source 1..20: note = Seed: SATGFKQSSKALQRPVASDF
SATGFFQSHKWLQVPVASDF

SEQ ID NO: 22580 - protein, 20 aa, synthetic construct
  source 1..20: note = Seed: SATGFKQSSKALQRPVASDF
SATGFFQSHKWLQYPVASDF

SEQ ID NO: 22581 - protein, 20 aa, synthetic construct
  source 1..20: note = Seed: SATGFKQSSKALQRPVASDF
SATGFFQSHKYLQAPVASDF

SEQ ID NO: 22582 - protein, 20 aa, synthetic construct
  source 1..20: note = Seed: SATGFKQSSKALQRPVASDF
SATGFFQSHKYLQFPVASDF

SEQ ID NO: 22583 - protein, 20 aa, synthetic construct
  source 1..20: note = Seed: SATGFKQSSKALQRPVASDF
SATGFFQSHKYLQIPVASDF

SEQ ID NO: 22584 - protein, 20 aa, synthetic construct
  source 1..20: note = Seed: SATGFKQSSKALQRPVASDF
SATGFFQSHKYLQLPVASDF

SEQ ID NO: 22585 - protein, 20 aa, synthetic construct
  source 1..20: note = Seed: SATGFKQSSKALQRPVASDF
SATGFFQSHKYLQMPVASDF

SEQ ID NO: 22586 - protein, 20 aa, synthetic construct
  source 1..20: note = Seed: SATGFKQSSKALQRPVASDF
SATGFFQSHKYLQNPVASDF

SEQ ID NO: 22587 - protein, 20 aa, synthetic construct
  source 1..20: note = Seed: SATGFKQSSKALQRPVASDF
SATGFFQSHKYLQSPVASDF

SEQ ID NO: 22588 - protein, 20 aa, synthetic construct
  source 1..20: note = Seed: SATGFKQSSKALQRPVASDF
SATGFFQSHKYLQTPVASDF

SEQ ID NO: 22589 - protein, 20 aa, synthetic construct
  source 1..20: note = Seed: SATGFKQSSKALQRPVASDF
SATGFFQSHKYLQVPVASDF

SEQ ID NO: 22590 - protein, 20 aa, synthetic construct
  source 1..20: note = Seed: SATGFKQSSKALQRPVASDF
SATGFFQSHKYLQYPVASDF

SEQ ID NO: 22591 - protein, 20 aa, synthetic construct
  source 1..20: note = Seed: SATGFKQSSKALQRPVASDF
SATGFFQSIKALQFPVASDF

SEQ ID NO: 22592 - protein, 20 aa, synthetic construct
  source 1..20: note = Seed: SATGFKQSSKALQRPVASDF
SATGFFQSIKALQIPVASDF

SEQ ID NO: 22593 - protein, 20 aa, synthetic construct
  source 1..20: note = Seed: SATGFKQSSKALQRPVASDF
SATGFFQSIKALQLPVASDF

SEQ ID NO: 22594 - protein, 20 aa, synthetic construct
  source 1..20: note = Seed: SATGFKQSSKALQRPVASDF
SATGFFQSIKALQVPVASDF

SEQ ID NO: 22595 - protein, 20 aa, synthetic construct
  source 1..20: note = Seed: SATGFKQSSKALQRPVASDF
SATGFFQSIKFLQAPVASDF

SEQ ID NO: 22596 - protein, 20 aa, synthetic construct
  source 1..20: note = Seed: SATGFKQSSKALQRPVASDF
SATGFFQSIKFLQDPVASDF

SEQ ID NO: 22597 - protein, 20 aa, synthetic construct
  source 1..20: note = Seed: SATGFKQSSKALQRPVASDF
SATGFFQSIKFLQEPVASDF

SEQ ID NO: 22598 - protein, 20 aa, synthetic construct
  source 1..20: note = Seed: SATGFKQSSKALQRPVASDF
SATGFFQSIKFLQFPVASDF

SEQ ID NO: 22599 - protein, 20 aa, synthetic construct
  source 1..20: note = Seed: SATGFKQSSKALQRPVASDF
SATGFFQSIKFLQHPVASDF

SEQ ID NO: 22600 - protein, 20 aa, synthetic construct
  source 1..20: note = Seed: SATGFKQSSKALQRPVASDF
SATGFFQSIKFLQIPVASDF

SEQ ID NO: 22601 - protein, 20 aa, synthetic construct
  source 1..20: note = Seed: SATGFKQSSKALQRPVASDF
SATGFFQSIKFLQKPVASDF

SEQ ID NO: 22602 - protein, 20 aa, synthetic construct
  source 1..20: note = Seed: SATGFKQSSKALQRPVASDF
SATGFFQSIKFLQLPVASDF

SEQ ID NO: 22603 - protein, 20 aa, synthetic construct
  source 1..20: note = Seed: SATGFKQSSKALQRPVASDF
SATGFFQSIKFLQMPVASDF

SEQ ID NO: 22604 - protein, 20 aa, synthetic construct
  source 1..20: note = Seed: SATGFKQSSKALQRPVASDF
SATGFFQSIKFLQNPVASDF

SEQ ID NO: 22605 - protein, 20 aa, synthetic construct
  source 1..20: note = Seed: SATGFKQSSKALQRPVASDF
SATGFFQSIKFLQPPVASDF

SEQ ID NO: 22606 - protein, 20 aa, synthetic construct
  source 1..20: note = Seed: SATGFKQSSKALQRPVASDF
SATGFFQSIKFLQQPVASDF

SEQ ID NO: 22607 - protein, 20 aa, synthetic construct
  source 1..20: note = Seed: SATGFKQSSKALQRPVASDF
SATGFFQSIKFLQRPVASDF

SEQ ID NO: 22608 - protein, 20 aa, synthetic construct
  source 1..20: note = Seed: SATGFKQSSKALQRPVASDF
SATGFFQSIKFLQSPVASDF

SEQ ID NO: 22609 - protein, 20 aa, synthetic construct
  source 1..20: note = Seed: SATGFKQSSKALQRPVASDF
SATGFFQSIKFLQTPVASDF

SEQ ID NO: 22610 - protein, 20 aa, synthetic construct
  source 1..20: note = Seed: SATGFKQSSKALQRPVASDF
SATGFFQSIKFLQVPVASDF

SEQ ID NO: 22611 - protein, 20 aa, synthetic construct
  source 1..20: note = Seed: SATGFKQSSKALQRPVASDF
SATGFFQSIKFLQYPVASDF

SEQ ID NO: 22612 - protein, 20 aa, synthetic construct
  source 1..20: note = Seed: SATGFKQSSKALQRPVASDF
SATGFFQSIKILQFPVASDF

SEQ ID NO: 22613 - protein, 20 aa, synthetic construct
  source 1..20: note = Seed: SATGFKQSSKALQRPVASDF
SATGFFQSIKILQIPVASDF

SEQ ID NO: 22614 - protein, 20 aa, synthetic construct
  source 1..20: note = Seed: SATGFKQSSKALQRPVASDF
SATGFFQSIKILQLPVASDF

SEQ ID NO: 22615 - protein, 20 aa, synthetic construct
  source 1..20: note = Seed: SATGFKQSSKALQRPVASDF
SATGFFQSIKILQMPVASDF

SEQ ID NO: 22616 - protein, 20 aa, synthetic construct
  source 1..20: note = Seed: SATGFKQSSKALQRPVASDF
SATGFFQSIKILQNPVASDF

SEQ ID NO: 22617 - protein, 20 aa, synthetic construct
  source 1..20: note = Seed: SATGFKQSSKALQRPVASDF
SATGFFQSIKILQTPVASDF

SEQ ID NO: 22618 - protein, 20 aa, synthetic construct
  source 1..20: note = Seed: SATGFKQSSKALQRPVASDF
SATGFFQSIKILQVPVASDF

SEQ ID NO: 22619 - protein, 20 aa, synthetic construct
  source 1..20: note = Seed: SATGFKQSSKALQRPVASDF
SATGFFQSIKILQYPVASDF

SEQ ID NO: 22620 - protein, 20 aa, synthetic construct
  source 1..20: note = Seed: SATGFKQSSKALQRPVASDF
SATGFFQSIKLLQDPVASDF

SEQ ID NO: 22621 - protein, 20 aa, synthetic construct
  source 1..20: note = Seed: SATGFKQSSKALQRPVASDF
SATGFFQSIKLLQEPVASDF

SEQ ID NO: 22622 - protein, 20 aa, synthetic construct
  source 1..20: note = Seed: SATGFKQSSKALQRPVASDF
SATGFFQSIKLLQFPVASDF

SEQ ID NO: 22623 - protein, 20 aa, synthetic construct
  source 1..20: note = Seed: SATGFKQSSKALQRPVASDF
SATGFFQSIKLLQIPVASDF

SEQ ID NO: 22624 - protein, 20 aa, synthetic construct
  source 1..20: note = Seed: SATGFKQSSKALQRPVASDF
SATGFFQSIKLLQLPVASDF

SEQ ID NO: 22625 - protein, 20 aa, synthetic construct
  source 1..20: note = Seed: SATGFKQSSKALQRPVASDF
SATGFFQSIKLLQMPVASDF

SEQ ID NO: 22626 - protein, 20 aa, synthetic construct
  source 1..20: note = Seed: SATGFKQSSKALQRPVASDF
SATGFFQSIKLLQNPVASDF

SEQ ID NO: 22627 - protein, 20 aa, synthetic construct
  source 1..20: note = Seed: SATGFKQSSKALQRPVASDF
SATGFFQSIKLLQSPVASDF

SEQ ID NO: 22628 - protein, 20 aa, synthetic construct
  source 1..20: note = Seed: SATGFKQSSKALQRPVASDF
SATGFFQSIKLLQTPVASDF

SEQ ID NO: 22629 - protein, 20 aa, synthetic construct
  source 1..20: note = Seed: SATGFKQSSKALQRPVASDF
SATGFFQSIKLLQVPVASDF

SEQ ID NO: 22630 - protein, 20 aa, synthetic construct
  source 1..20: note = Seed: SATGFKQSSKALQRPVASDF
SATGFFQSIKLLQYPVASDF

SEQ ID NO: 22631 - protein, 20 aa, synthetic construct
  source 1..20: note = Seed: SATGFKQSSKALQRPVASDF
SATGFFQSIKMLQFPVASDF

SEQ ID NO: 22632 - protein, 20 aa, synthetic construct
  source 1..20: note = Seed: SATGFKQSSKALQRPVASDF
SATGFFQSIKMLQIPVASDF

SEQ ID NO: 22633 - protein, 20 aa, synthetic construct
  source 1..20: note = Seed: SATGFKQSSKALQRPVASDF
SATGFFQSIKMLQLPVASDF

SEQ ID NO: 22634 - protein, 20 aa, synthetic construct
  source 1..20: note = Seed: SATGFKQSSKALQRPVASDF
SATGFFQSIKMLQMPVASDF

SEQ ID NO: 22635 - protein, 20 aa, synthetic construct
  source 1..20: note = Seed: SATGFKQSSKALQRPVASDF
SATGFFQSIKMLQVPVASDF

SEQ ID NO: 22636 - protein, 20 aa, synthetic construct
  source 1..20: note = Seed: SATGFKQSSKALQRPVASDF
SATGFFQSIKMLQYPVASDF

SEQ ID NO: 22637 - protein, 20 aa, synthetic construct
  source 1..20: note = Seed: SATGFKQSSKALQRPVASDF
SATGFFQSIKVLQFPVASDF

SEQ ID NO: 22638 - protein, 20 aa, synthetic construct
  source 1..20: note = Seed: SATGFKQSSKALQRPVASDF
SATGFFQSIKVLQIPVASDF

SEQ ID NO: 22639 - protein, 20 aa, synthetic construct
  source 1..20: note = Seed: SATGFKQSSKALQRPVASDF
SATGFFQSIKVLQLPVASDF

SEQ ID NO: 22640 - protein, 20 aa, synthetic construct
  source 1..20: note = Seed: SATGFKQSSKALQRPVASDF
SATGFFQSIKVLQVPVASDF

SEQ ID NO: 22641 - protein, 20 aa, synthetic construct
  source 1..20: note = Seed: SATGFKQSSKALQRPVASDF
SATGFFQSIKWLQFPVASDF

SEQ ID NO: 22642 - protein, 20 aa, synthetic construct
  source 1..20: note = Seed: SATGFKQSSKALQRPVASDF
SATGFFQSIKWLQIPVASDF

SEQ ID NO: 22643 - protein, 20 aa, synthetic construct
  source 1..20: note = Seed: SATGFKQSSKALQRPVASDF
SATGFFQSIKWLQLPVASDF

SEQ ID NO: 22644 - protein, 20 aa, synthetic construct
  source 1..20: note = Seed: SATGFKQSSKALQRPVASDF
SATGFFQSIKWLQMPVASDF

SEQ ID NO: 22645 - protein, 20 aa, synthetic construct
  source 1..20: note = Seed: SATGFKQSSKALQRPVASDF
SATGFFQSIKWLQNPVASDF

SEQ ID NO: 22646 - protein, 20 aa, synthetic construct
  source 1..20: note = Seed: SATGFKQSSKALQRPVASDF
SATGFFQSIKWLQTPVASDF

SEQ ID NO: 22647 - protein, 20 aa, synthetic construct
  source 1..20: note = Seed: SATGFKQSSKALQRPVASDF
SATGFFQSIKWLQVPVASDF

SEQ ID NO: 22648 - protein, 20 aa, synthetic construct
  source 1..20: note = Seed: SATGFKQSSKALQRPVASDF
SATGFFQSIKWLQYPVASDF

SEQ ID NO: 22649 - protein, 20 aa, synthetic construct
  source 1..20: note = Seed: SATGFKQSSKALQRPVASDF
SATGFFQSIKYLQAPVASDF

SEQ ID NO: 22650 - protein, 20 aa, synthetic construct
  source 1..20: note = Seed: SATGFKQSSKALQRPVASDF
SATGFFQSIKYLQFPVASDF

SEQ ID NO: 22651 - protein, 20 aa, synthetic construct
  source 1..20: note = Seed: SATGFKQSSKALQRPVASDF
SATGFFQSIKYLQIPVASDF

SEQ ID NO: 22652 - protein, 20 aa, synthetic construct
  source 1..20: note = Seed: SATGFKQSSKALQRPVASDF
SATGFFQSIKYLQLPVASDF

SEQ ID NO: 22653 - protein, 20 aa, synthetic construct
  source 1..20: note = Seed: SATGFKQSSKALQRPVASDF
SATGFFQSIKYLQMPVASDF

SEQ ID NO: 22654 - protein, 20 aa, synthetic construct
  source 1..20: note = Seed: SATGFKQSSKALQRPVASDF
SATGFFQSIKYLQNPVASDF

SEQ ID NO: 22655 - protein, 20 aa, synthetic construct
  source 1..20: note = Seed: SATGFKQSSKALQRPVASDF
SATGFFQSIKYLQSPVASDF

SEQ ID NO: 22656 - protein, 20 aa, synthetic construct
  source 1..20: note = Seed: SATGFKQSSKALQRPVASDF
SATGFFQSIKYLQTPVASDF

SEQ ID NO: 22657 - protein, 20 aa, synthetic construct
  source 1..20: note = Seed: SATGFKQSSKALQRPVASDF
SATGFFQSIKYLQVPVASDF

SEQ ID NO: 22658 - protein, 20 aa, synthetic construct
  source 1..20: note = Seed: SATGFKQSSKALQRPVASDF
SATGFFQSIKYLQYPVASDF

SEQ ID NO: 22659 - protein, 20 aa, synthetic construct
  source 1..20: note = Seed: SATGFKQSSKALQRPVASDF
SATGFFQSKKFLQAPVASDF

SEQ ID NO: 22660 - protein, 20 aa, synthetic construct
  source 1..20: note = Seed: SATGFKQSSKALQRPVASDF
SATGFFQSKKFLQEPVASDF

SEQ ID NO: 22661 - protein, 20 aa, synthetic construct
  source 1..20: note = Seed: SATGFKQSSKALQRPVASDF
SATGFFQSKKFLQFPVASDF

SEQ ID NO: 22662 - protein, 20 aa, synthetic construct
  source 1..20: note = Seed: SATGFKQSSKALQRPVASDF
SATGFFQSKKFLQHPVASDF

SEQ ID NO: 22663 - protein, 20 aa, synthetic construct
  source 1..20: note = Seed: SATGFKQSSKALQRPVASDF
SATGFFQSKKFLQIPVASDF

SEQ ID NO: 22664 - protein, 20 aa, synthetic construct
  source 1..20: note = Seed: SATGFKQSSKALQRPVASDF
SATGFFQSKKFLQLPVASDF

SEQ ID NO: 22665 - protein, 20 aa, synthetic construct
  source 1..20: note = Seed: SATGFKQSSKALQRPVASDF
SATGFFQSKKFLQMPVASDF

SEQ ID NO: 22666 - protein, 20 aa, synthetic construct
  source 1..20: note = Seed: SATGFKQSSKALQRPVASDF
SATGFFQSKKFLQNPVASDF

SEQ ID NO: 22667 - protein, 20 aa, synthetic construct
  source 1..20: note = Seed: SATGFKQSSKALQRPVASDF
SATGFFQSKKFLQSPVASDF

SEQ ID NO: 22668 - protein, 20 aa, synthetic construct
  source 1..20: note = Seed: SATGFKQSSKALQRPVASDF
SATGFFQSKKFLQTPVASDF

SEQ ID NO: 22669 - protein, 20 aa, synthetic construct
  source 1..20: note = Seed: SATGFKQSSKALQRPVASDF
SATGFFQSKKFLQYPVASDF

SEQ ID NO: 22670 - protein, 20 aa, synthetic construct
  source 1..20: note = Seed: SATGFKQSSKALQRPVASDF
SATGFFQSKKILQFPVASDF

SEQ ID NO: 22671 - protein, 20 aa, synthetic construct
  source 1..20: note = Seed: SATGFKQSSKALQRPVASDF
SATGFFQSKKILQIPVASDF

SEQ ID NO: 22672 - protein, 20 aa, synthetic construct
  source 1..20: note = Seed: SATGFKQSSKALQRPVASDF
SATGFFQSKKILQLPVASDF

SEQ ID NO: 22673 - protein, 20 aa, synthetic construct
  source 1..20: note = Seed: SATGFKQSSKALQRPVASDF
SATGFFQSKKILQVPVASDF

SEQ ID NO: 22674 - protein, 20 aa, synthetic construct
  source 1..20: note = Seed: SATGFKQSSKALQRPVASDF
SATGFFQSKKLLQFPVASDF

SEQ ID NO: 22675 - protein, 20 aa, synthetic construct
  source 1..20: note = Seed: SATGFKQSSKALQRPVASDF
SATGFFQSKKLLQIPVASDF

SEQ ID NO: 22676 - protein, 20 aa, synthetic construct
  source 1..20: note = Seed: SATGFKQSSKALQRPVASDF
SATGFFQSKKLLQLPVASDF

SEQ ID NO: 22677 - protein, 20 aa, synthetic construct
  source 1..20: note = Seed: SATGFKQSSKALQRPVASDF
SATGFFQSKKLLQVPVASDF

SEQ ID NO: 22678 - protein, 20 aa, synthetic construct
  source 1..20: note = Seed: SATGFKQSSKALQRPVASDF
SATGFFQSKKMLQIPVASDF

SEQ ID NO: 22679 - protein, 20 aa, synthetic construct
  source 1..20: note = Seed: SATGFKQSSKALQRPVASDF
SATGFFQSKKMLQLPVASDF

SEQ ID NO: 22680 - protein, 20 aa, synthetic construct
  source 1..20: note = Seed: SATGFKQSSKALQRPVASDF
SATGFFQSKKVLQLPVASDF

SEQ ID NO: 22681 - protein, 20 aa, synthetic construct
  source 1..20: note = Seed: SATGFKQSSKALQRPVASDF
SATGFFQSKKWLQFPVASDF

SEQ ID NO: 22682 - protein, 20 aa, synthetic construct
  source 1..20: note = Seed: SATGFKQSSKALQRPVASDF
SATGFFQSKKWLQIPVASDF

SEQ ID NO: 22683 - protein, 20 aa, synthetic construct
  source 1..20: note = Seed: SATGFKQSSKALQRPVASDF
SATGFFQSKKWLQLPVASDF

SEQ ID NO: 22684 - protein, 20 aa, synthetic construct
  source 1..20: note = Seed: SATGFKQSSKALQRPVASDF
SATGFFQSKKWLQVPVASDF

SEQ ID NO: 22685 - protein, 20 aa, synthetic construct
  source 1..20: note = Seed: SATGFKQSSKALQRPVASDF
SATGFFQSKKYLQFPVASDF

SEQ ID NO: 22686 - protein, 20 aa, synthetic construct
  source 1..20: note = Seed: SATGFKQSSKALQRPVASDF
SATGFFQSKKYLQIPVASDF

SEQ ID NO: 22687 - protein, 20 aa, synthetic construct
  source 1..20: note = Seed: SATGFKQSSKALQRPVASDF
SATGFFQSKKYLQLPVASDF

SEQ ID NO: 22688 - protein, 20 aa, synthetic construct
  source 1..20: note = Seed: SATGFKQSSKALQRPVASDF
SATGFFQSKKYLQVPVASDF

SEQ ID NO: 22689 - protein, 20 aa, synthetic construct
  source 1..20: note = Seed: SATGFKQSSKALQRPVASDF
SATGFFQSLKALQFPVASDF

SEQ ID NO: 22690 - protein, 20 aa, synthetic construct
  source 1..20: note = Seed: SATGFKQSSKALQRPVASDF
SATGFFQSLKALQLPVASDF

SEQ ID NO: 22691 - protein, 20 aa, synthetic construct
  source 1..20: note = Seed: SATGFKQSSKALQRPVASDF
SATGFFQSLKFLQAPVASDF

SEQ ID NO: 22692 - protein, 20 aa, synthetic construct
  source 1..20: note = Seed: SATGFKQSSKALQRPVASDF
SATGFFQSLKFLQDPVASDF

SEQ ID NO: 22693 - protein, 20 aa, synthetic construct
  source 1..20: note = Seed: SATGFKQSSKALQRPVASDF
SATGFFQSLKFLQEPVASDF

SEQ ID NO: 22694 - protein, 20 aa, synthetic construct
  source 1..20: note = Seed: SATGFKQSSKALQRPVASDF
SATGFFQSLKFLQFPVASDF

SEQ ID NO: 22695 - protein, 20 aa, synthetic construct
  source 1..20: note = Seed: SATGFKQSSKALQRPVASDF
SATGFFQSLKFLQHPVASDF

SEQ ID NO: 22696 - protein, 20 aa, synthetic construct
  source 1..20: note = Seed: SATGFKQSSKALQRPVASDF
SATGFFQSLKFLQIPVASDF

SEQ ID NO: 22697 - protein, 20 aa, synthetic construct
  source 1..20: note = Seed: SATGFKQSSKALQRPVASDF
SATGFFQSLKFLQLPVASDF

SEQ ID NO: 22698 - protein, 20 aa, synthetic construct
  source 1..20: note = Seed: SATGFKQSSKALQRPVASDF
SATGFFQSLKFLQMPVASDF

SEQ ID NO: 22699 - protein, 20 aa, synthetic construct
  source 1..20: note = Seed: SATGFKQSSKALQRPVASDF
SATGFFQSLKFLQNPVASDF

SEQ ID NO: 22700 - protein, 20 aa, synthetic construct
  source 1..20: note = Seed: SATGFKQSSKALQRPVASDF
SATGFFQSLKFLQRPVASDF

SEQ ID NO: 22701 - protein, 20 aa, synthetic construct
  source 1..20: note = Seed: SATGFKQSSKALQRPVASDF
SATGFFQSLKFLQSPVASDF

SEQ ID NO: 22702 - protein, 20 aa, synthetic construct
  source 1..20: note = Seed: SATGFKQSSKALQRPVASDF
SATGFFQSLKFLQTPVASDF

SEQ ID NO: 22703 - protein, 20 aa, synthetic construct
  source 1..20: note = Seed: SATGFKQSSKALQRPVASDF
SATGFFQSLKFLQVPVASDF

SEQ ID NO: 22704 - protein, 20 aa, synthetic construct
  source 1..20: note = Seed: SATGFKQSSKALQRPVASDF
SATGFFQSLKFLQYPVASDF

SEQ ID NO: 22705 - protein, 20 aa, synthetic construct
  source 1..20: note = Seed: SATGFKQSSKALQRPVASDF
SATGFFQSLKILQFPVASDF

SEQ ID NO: 22706 - protein, 20 aa, synthetic construct
  source 1..20: note = Seed: SATGFKQSSKALQRPVASDF
SATGFFQSLKILQIPVASDF

SEQ ID NO: 22707 - protein, 20 aa, synthetic construct
  source 1..20: note = Seed: SATGFKQSSKALQRPVASDF
SATGFFQSLKILQLPVASDF

SEQ ID NO: 22708 - protein, 20 aa, synthetic construct
  source 1..20: note = Seed: SATGFKQSSKALQRPVASDF
SATGFFQSLKILQMPVASDF

SEQ ID NO: 22709 - protein, 20 aa, synthetic construct
  source 1..20: note = Seed: SATGFKQSSKALQRPVASDF
SATGFFQSLKILQVPVASDF

SEQ ID NO: 22710 - protein, 20 aa, synthetic construct
  source 1..20: note = Seed: SATGFKQSSKALQRPVASDF
SATGFFQSLKLLQFPVASDF

SEQ ID NO: 22711 - protein, 20 aa, synthetic construct
  source 1..20: note = Seed: SATGFKQSSKALQRPVASDF
SATGFFQSLKLLQIPVASDF

SEQ ID NO: 22712 - protein, 20 aa, synthetic construct
  source 1..20: note = Seed: SATGFKQSSKALQRPVASDF
SATGFFQSLKLLQLPVASDF

SEQ ID NO: 22713 - protein, 20 aa, synthetic construct
  source 1..20: note = Seed: SATGFKQSSKALQRPVASDF
SATGFFQSLKLLQMPVASDF

SEQ ID NO: 22714 - protein, 20 aa, synthetic construct
  source 1..20: note = Seed: SATGFKQSSKALQRPVASDF
SATGFFQSLKLLQVPVASDF

SEQ ID NO: 22715 - protein, 20 aa, synthetic construct
  source 1..20: note = Seed: SATGFKQSSKALQRPVASDF
SATGFFQSLKLLQYPVASDF

SEQ ID NO: 22716 - protein, 20 aa, synthetic construct
  source 1..20: note = Seed: SATGFKQSSKALQRPVASDF
SATGFFQSLKMLQFPVASDF

SEQ ID NO: 22717 - protein, 20 aa, synthetic construct
  source 1..20: note = Seed: SATGFKQSSKALQRPVASDF
SATGFFQSLKMLQIPVASDF

SEQ ID NO: 22718 - protein, 20 aa, synthetic construct
  source 1..20: note = Seed: SATGFKQSSKALQRPVASDF
SATGFFQSLKMLQLPVASDF

SEQ ID NO: 22719 - protein, 20 aa, synthetic construct
  source 1..20: note = Seed: SATGFKQSSKALQRPVASDF
SATGFFQSLKMLQVPVASDF

SEQ ID NO: 22720 - protein, 20 aa, synthetic construct
  source 1..20: note = Seed: SATGFKQSSKALQRPVASDF
SATGFFQSLKVLQFPVASDF

SEQ ID NO: 22721 - protein, 20 aa, synthetic construct
  source 1..20: note = Seed: SATGFKQSSKALQRPVASDF
SATGFFQSLKVLQLPVASDF

SEQ ID NO: 22722 - protein, 20 aa, synthetic construct
  source 1..20: note = Seed: SATGFKQSSKALQRPVASDF
SATGFFQSLKWLQFPVASDF

SEQ ID NO: 22723 - protein, 20 aa, synthetic construct
  source 1..20: note = Seed: SATGFKQSSKALQRPVASDF
SATGFFQSLKWLQIPVASDF

SEQ ID NO: 22724 - protein, 20 aa, synthetic construct
  source 1..20: note = Seed: SATGFKQSSKALQRPVASDF
SATGFFQSLKWLQLPVASDF

SEQ ID NO: 22725 - protein, 20 aa, synthetic construct
  source 1..20: note = Seed: SATGFKQSSKALQRPVASDF
SATGFFQSLKWLQMPVASDF

SEQ ID NO: 22726 - protein, 20 aa, synthetic construct
  source 1..20: note = Seed: SATGFKQSSKALQRPVASDF
SATGFFQSLKWLQVPVASDF

SEQ ID NO: 22727 - protein, 20 aa, synthetic construct
  source 1..20: note = Seed: SATGFKQSSKALQRPVASDF
SATGFFQSLKYLQFPVASDF

SEQ ID NO: 22728 - protein, 20 aa, synthetic construct
  source 1..20: note = Seed: SATGFKQSSKALQRPVASDF
SATGFFQSLKYLQIPVASDF

SEQ ID NO: 22729 - protein, 20 aa, synthetic construct
  source 1..20: note = Seed: SATGFKQSSKALQRPVASDF
SATGFFQSLKYLQLPVASDF

SEQ ID NO: 22730 - protein, 20 aa, synthetic construct
  source 1..20: note = Seed: SATGFKQSSKALQRPVASDF
SATGFFQSLKYLQMPVASDF

SEQ ID NO: 22731 - protein, 20 aa, synthetic construct
  source 1..20: note = Seed: SATGFKQSSKALQRPVASDF
SATGFFQSLKYLQVPVASDF

SEQ ID NO: 22732 - protein, 20 aa, synthetic construct
  source 1..20: note = Seed: SATGFKQSSKALQRPVASDF
SATGFFQSLKYLQYPVASDF

SEQ ID NO: 22733 - protein, 20 aa, synthetic construct
  source 1..20: note = Seed: SATGFKQSSKALQRPVASDF
SATGFFQSMKFLQAPVASDF

SEQ ID NO: 22734 - protein, 20 aa, synthetic construct
  source 1..20: note = Seed: SATGFKQSSKALQRPVASDF
SATGFFQSMKFLQDPVASDF

SEQ ID NO: 22735 - protein, 20 aa, synthetic construct
  source 1..20: note = Seed: SATGFKQSSKALQRPVASDF
SATGFFQSMKFLQEPVASDF

SEQ ID NO: 22736 - protein, 20 aa, synthetic construct
  source 1..20: note = Seed: SATGFKQSSKALQRPVASDF
SATGFFQSMKFLQFPVASDF

SEQ ID NO: 22737 - protein, 20 aa, synthetic construct
  source 1..20: note = Seed: SATGFKQSSKALQRPVASDF
SATGFFQSMKFLQHPVASDF

SEQ ID NO: 22738 - protein, 20 aa, synthetic construct
  source 1..20: note = Seed: SATGFKQSSKALQRPVASDF
SATGFFQSMKFLQIPVASDF

SEQ ID NO: 22739 - protein, 20 aa, synthetic construct
  source 1..20: note = Seed: SATGFKQSSKALQRPVASDF
SATGFFQSMKFLQLPVASDF

SEQ ID NO: 22740 - protein, 20 aa, synthetic construct
  source 1..20: note = Seed: SATGFKQSSKALQRPVASDF
SATGFFQSMKFLQMPVASDF

SEQ ID NO: 22741 - protein, 20 aa, synthetic construct
  source 1..20: note = Seed: SATGFKQSSKALQRPVASDF
SATGFFQSMKFLQNPVASDF

SEQ ID NO: 22742 - protein, 20 aa, synthetic construct
  source 1..20: note = Seed: SATGFKQSSKALQRPVASDF
SATGFFQSMKFLQRPVASDF

SEQ ID NO: 22743 - protein, 20 aa, synthetic construct
  source 1..20: note = Seed: SATGFKQSSKALQRPVASDF
SATGFFQSMKFLQSPVASDF

SEQ ID NO: 22744 - protein, 20 aa, synthetic construct
  source 1..20: note = Seed: SATGFKQSSKALQRPVASDF
SATGFFQSMKFLQTPVASDF

SEQ ID NO: 22745 - protein, 20 aa, synthetic construct
  source 1..20: note = Seed: SATGFKQSSKALQRPVASDF
SATGFFQSMKFLQVPVASDF

SEQ ID NO: 22746 - protein, 20 aa, synthetic construct
  source 1..20: note = Seed: SATGFKQSSKALQRPVASDF
SATGFFQSMKFLQYPVASDF

SEQ ID NO: 22747 - protein, 20 aa, synthetic construct
  source 1..20: note = Seed: SATGFKQSSKALQRPVASDF
SATGFFQSMKILQFPVASDF

SEQ ID NO: 22748 - protein, 20 aa, synthetic construct
  source 1..20: note = Seed: SATGFKQSSKALQRPVASDF
SATGFFQSMKILQIPVASDF

SEQ ID NO: 22749 - protein, 20 aa, synthetic construct
  source 1..20: note = Seed: SATGFKQSSKALQRPVASDF
SATGFFQSMKILQLPVASDF

SEQ ID NO: 22750 - protein, 20 aa, synthetic construct
  source 1..20: note = Seed: SATGFKQSSKALQRPVASDF
SATGFFQSMKILQVPVASDF

SEQ ID NO: 22751 - protein, 20 aa, synthetic construct
  source 1..20: note = Seed: SATGFKQSSKALQRPVASDF
SATGFFQSMKLLQFPVASDF

SEQ ID NO: 22752 - protein, 20 aa, synthetic construct
  source 1..20: note = Seed: SATGFKQSSKALQRPVASDF
SATGFFQSMKLLQIPVASDF

SEQ ID NO: 22753 - protein, 20 aa, synthetic construct
  source 1..20: note = Seed: SATGFKQSSKALQRPVASDF
SATGFFQSMKLLQLPVASDF

SEQ ID NO: 22754 - protein, 20 aa, synthetic construct
  source 1..20: note = Seed: SATGFKQSSKALQRPVASDF
SATGFFQSMKLLQMPVASDF

SEQ ID NO: 22755 - protein, 20 aa, synthetic construct
  source 1..20: note = Seed: SATGFKQSSKALQRPVASDF
SATGFFQSMKLLQVPVASDF

SEQ ID NO: 22756 - protein, 20 aa, synthetic construct
  source 1..20: note = Seed: SATGFKQSSKALQRPVASDF
SATGFFQSMKLLQYPVASDF

SEQ ID NO: 22757 - protein, 20 aa, synthetic construct
  source 1..20: note = Seed: SATGFKQSSKALQRPVASDF
SATGFFQSMKMLQFPVASDF

SEQ ID NO: 22758 - protein, 20 aa, synthetic construct
  source 1..20: note = Seed: SATGFKQSSKALQRPVASDF
SATGFFQSMKMLQIPVASDF

SEQ ID NO: 22759 - protein, 20 aa, synthetic construct
  source 1..20: note = Seed: SATGFKQSSKALQRPVASDF
SATGFFQSMKMLQLPVASDF

SEQ ID NO: 22760 - protein, 20 aa, synthetic construct
  source 1..20: note = Seed: SATGFKQSSKALQRPVASDF
SATGFFQSMKMLQVPVASDF

SEQ ID NO: 22761 - protein, 20 aa, synthetic construct
  source 1..20: note = Seed: SATGFKQSSKALQRPVASDF
SATGFFQSMKVLQFPVASDF

SEQ ID NO: 22762 - protein, 20 aa, synthetic construct
  source 1..20: note = Seed: SATGFKQSSKALQRPVASDF
SATGFFQSMKWLQFPVASDF

SEQ ID NO: 22763 - protein, 20 aa, synthetic construct
  source 1..20: note = Seed: SATGFKQSSKALQRPVASDF
SATGFFQSMKWLQIPVASDF

SEQ ID NO: 22764 - protein, 20 aa, synthetic construct
  source 1..20: note = Seed: SATGFKQSSKALQRPVASDF
SATGFFQSMKWLQLPVASDF

SEQ ID NO: 22765 - protein, 20 aa, synthetic construct
  source 1..20: note = Seed: SATGFKQSSKALQRPVASDF
SATGFFQSMKWLQVPVASDF

SEQ ID NO: 22766 - protein, 20 aa, synthetic construct
  source 1..20: note = Seed: SATGFKQSSKALQRPVASDF
SATGFFQSMKYLQFPVASDF

SEQ ID NO: 22767 - protein, 20 aa, synthetic construct
  source 1..20: note = Seed: SATGFKQSSKALQRPVASDF
SATGFFQSMKYLQIPVASDF

SEQ ID NO: 22768 - protein, 20 aa, synthetic construct
  source 1..20: note = Seed: SATGFKQSSKALQRPVASDF
SATGFFQSMKYLQLPVASDF

SEQ ID NO: 22769 - protein, 20 aa, synthetic construct
  source 1..20: note = Seed: SATGFKQSSKALQRPVASDF
SATGFFQSMKYLQMPVASDF

SEQ ID NO: 22770 - protein, 20 aa, synthetic construct
  source 1..20: note = Seed: SATGFKQSSKALQRPVASDF
SATGFFQSMKYLQVPVASDF

SEQ ID NO: 22771 - protein, 20 aa, synthetic construct
  source 1..20: note = Seed: SATGFKQSSKALQRPVASDF
SATGFFQSMKYLQYPVASDF

SEQ ID NO: 22772 - protein, 20 aa, synthetic construct
  source 1..20: note = Seed: SATGFKQSSKALQRPVASDF
SATGFFQSNKFLQAPVASDF

SEQ ID NO: 22773 - protein, 20 aa, synthetic construct
  source 1..20: note = Seed: SATGFKQSSKALQRPVASDF
SATGFFQSNKFLQEPVASDF

SEQ ID NO: 22774 - protein, 20 aa, synthetic construct
  source 1..20: note = Seed: SATGFKQSSKALQRPVASDF
SATGFFQSNKFLQFPVASDF

SEQ ID NO: 22775 - protein, 20 aa, synthetic construct
  source 1..20: note = Seed: SATGFKQSSKALQRPVASDF
SATGFFQSNKFLQIPVASDF

SEQ ID NO: 22776 - protein, 20 aa, synthetic construct
  source 1..20: note = Seed: SATGFKQSSKALQRPVASDF
SATGFFQSNKFLQLPVASDF

SEQ ID NO: 22777 - protein, 20 aa, synthetic construct
  source 1..20: note = Seed: SATGFKQSSKALQRPVASDF
SATGFFQSNKFLQMPVASDF

SEQ ID NO: 22778 - protein, 20 aa, synthetic construct
  source 1..20: note = Seed: SATGFKQSSKALQRPVASDF
SATGFFQSNKFLQNPVASDF

SEQ ID NO: 22779 - protein, 20 aa, synthetic construct
  source 1..20: note = Seed: SATGFKQSSKALQRPVASDF
SATGFFQSNKFLQSPVASDF

SEQ ID NO: 22780 - protein, 20 aa, synthetic construct
  source 1..20: note = Seed: SATGFKQSSKALQRPVASDF
SATGFFQSNKFLQTPVASDF

SEQ ID NO: 22781 - protein, 20 aa, synthetic construct
  source 1..20: note = Seed: SATGFKQSSKALQRPVASDF
SATGFFQSNKFLQVPVASDF

SEQ ID NO: 22782 - protein, 20 aa, synthetic construct
  source 1..20: note = Seed: SATGFKQSSKALQRPVASDF
SATGFFQSNKFLQYPVASDF

SEQ ID NO: 22783 - protein, 20 aa, synthetic construct
  source 1..20: note = Seed: SATGFKQSSKALQRPVASDF
SATGFFQSNKILQIPVASDF

SEQ ID NO: 22784 - protein, 20 aa, synthetic construct
  source 1..20: note = Seed: SATGFKQSSKALQRPVASDF
SATGFFQSNKILQLPVASDF

SEQ ID NO: 22785 - protein, 20 aa, synthetic construct
  source 1..20: note = Seed: SATGFKQSSKALQRPVASDF
SATGFFQSNKILQVPVASDF

SEQ ID NO: 22786 - protein, 20 aa, synthetic construct
  source 1..20: note = Seed: SATGFKQSSKALQRPVASDF
SATGFFQSNKLLQFPVASDF

SEQ ID NO: 22787 - protein, 20 aa, synthetic construct
  source 1..20: note = Seed: SATGFKQSSKALQRPVASDF
SATGFFQSNKLLQIPVASDF

SEQ ID NO: 22788 - protein, 20 aa, synthetic construct
  source 1..20: note = Seed: SATGFKQSSKALQRPVASDF
SATGFFQSNKLLQLPVASDF

SEQ ID NO: 22789 - protein, 20 aa, synthetic construct
  source 1..20: note = Seed: SATGFKQSSKALQRPVASDF
SATGFFQSNKLLQVPVASDF

SEQ ID NO: 22790 - protein, 20 aa, synthetic construct
  source 1..20: note = Seed: SATGFKQSSKALQRPVASDF
SATGFFQSNKMLQIPVASDF

SEQ ID NO: 22791 - protein, 20 aa, synthetic construct
  source 1..20: note = Seed: SATGFKQSSKALQRPVASDF
SATGFFQSNKMLQLPVASDF

SEQ ID NO: 22792 - protein, 20 aa, synthetic construct
  source 1..20: note = Seed: SATGFKQSSKALQRPVASDF
SATGFFQSNKWLQIPVASDF

SEQ ID NO: 22793 - protein, 20 aa, synthetic construct
  source 1..20: note = Seed: SATGFKQSSKALQRPVASDF
SATGFFQSNKWLQVPVASDF

SEQ ID NO: 22794 - protein, 20 aa, synthetic construct
  source 1..20: note = Seed: SATGFKQSSKALQRPVASDF
SATGFFQSNKYLQFPVASDF

SEQ ID NO: 22795 - protein, 20 aa, synthetic construct
  source 1..20: note = Seed: SATGFKQSSKALQRPVASDF
SATGFFQSNKYLQIPVASDF

SEQ ID NO: 22796 - protein, 20 aa, synthetic construct
  source 1..20: note = Seed: SATGFKQSSKALQRPVASDF
SATGFFQSNKYLQLPVASDF

SEQ ID NO: 22797 - protein, 20 aa, synthetic construct
  source 1..20: note = Seed: SATGFKQSSKALQRPVASDF
SATGFFQSNKYLQVPVASDF

SEQ ID NO: 22798 - protein, 20 aa, synthetic construct
  source 1..20: note = Seed: SATGFKQSSKALQRPVASDF
SATGFFQSPKFLQFPVASDF

SEQ ID NO: 22799 - protein, 20 aa, synthetic construct
  source 1..20: note = Seed: SATGFKQSSKALQRPVASDF
SATGFFQSPKFLQIPVASDF

SEQ ID NO: 22800 - protein, 20 aa, synthetic construct
  source 1..20: note = Seed: SATGFKQSSKALQRPVASDF
SATGFFQSPKFLQLPVASDF

SEQ ID NO: 22801 - protein, 20 aa, synthetic construct
  source 1..20: note = Seed: SATGFKQSSKALQRPVASDF
SATGFFQSPKFLQMPVASDF

SEQ ID NO: 22802 - protein, 20 aa, synthetic construct
  source 1..20: note = Seed: SATGFKQSSKALQRPVASDF
SATGFFQSPKFLQVPVASDF

SEQ ID NO: 22803 - protein, 20 aa, synthetic construct
  source 1..20: note = Seed: SATGFKQSSKALQRPVASDF
SATGFFQSQKFLQAPVASDF

SEQ ID NO: 22804 - protein, 20 aa, synthetic construct
  source 1..20: note = Seed: SATGFKQSSKALQRPVASDF
SATGFFQSQKFLQEPVASDF

SEQ ID NO: 22805 - protein, 20 aa, synthetic construct
  source 1..20: note = Seed: SATGFKQSSKALQRPVASDF
SATGFFQSQKFLQFPVASDF

SEQ ID NO: 22806 - protein, 20 aa, synthetic construct
  source 1..20: note = Seed: SATGFKQSSKALQRPVASDF
SATGFFQSQKFLQIPVASDF

SEQ ID NO: 22807 - protein, 20 aa, synthetic construct
  source 1..20: note = Seed: SATGFKQSSKALQRPVASDF
SATGFFQSQKFLQLPVASDF

SEQ ID NO: 22808 - protein, 20 aa, synthetic construct
  source 1..20: note = Seed: SATGFKQSSKALQRPVASDF
SATGFFQSQKFLQMPVASDF

SEQ ID NO: 22809 - protein, 20 aa, synthetic construct
  source 1..20: note = Seed: SATGFKQSSKALQRPVASDF
SATGFFQSQKFLQNPVASDF

SEQ ID NO: 22810 - protein, 20 aa, synthetic construct
  source 1..20: note = Seed: SATGFKQSSKALQRPVASDF
SATGFFQSQKFLQRPVASDF

SEQ ID NO: 22811 - protein, 20 aa, synthetic construct
  source 1..20: note = Seed: SATGFKQSSKALQRPVASDF
SATGFFQSQKFLQSPVASDF

SEQ ID NO: 22812 - protein, 20 aa, synthetic construct
  source 1..20: note = Seed: SATGFKQSSKALQRPVASDF
SATGFFQSQKFLQTPVASDF

SEQ ID NO: 22813 - protein, 20 aa, synthetic construct
  source 1..20: note = Seed: SATGFKQSSKALQRPVASDF
SATGFFQSQKFLQVPVASDF

SEQ ID NO: 22814 - protein, 20 aa, synthetic construct
  source 1..20: note = Seed: SATGFKQSSKALQRPVASDF
SATGFFQSQKFLQYPVASDF

SEQ ID NO: 22815 - protein, 20 aa, synthetic construct
  source 1..20: note = Seed: SATGFKQSSKALQRPVASDF
SATGFFQSQKILQFPVASDF

SEQ ID NO: 22816 - protein, 20 aa, synthetic construct
  source 1..20: note = Seed: SATGFKQSSKALQRPVASDF
SATGFFQSQKILQIPVASDF

SEQ ID NO: 22817 - protein, 20 aa, synthetic construct
  source 1..20: note = Seed: SATGFKQSSKALQRPVASDF
SATGFFQSQKILQLPVASDF

SEQ ID NO: 22818 - protein, 20 aa, synthetic construct
  source 1..20: note = Seed: SATGFKQSSKALQRPVASDF
SATGFFQSQKILQVPVASDF

SEQ ID NO: 22819 - protein, 20 aa, synthetic construct
  source 1..20: note = Seed: SATGFKQSSKALQRPVASDF
SATGFFQSQKLLQFPVASDF

SEQ ID NO: 22820 - protein, 20 aa, synthetic construct
  source 1..20: note = Seed: SATGFKQSSKALQRPVASDF
SATGFFQSQKLLQIPVASDF

SEQ ID NO: 22821 - protein, 20 aa, synthetic construct
  source 1..20: note = Seed: SATGFKQSSKALQRPVASDF
SATGFFQSQKLLQLPVASDF

SEQ ID NO: 22822 - protein, 20 aa, synthetic construct
  source 1..20: note = Seed: SATGFKQSSKALQRPVASDF
SATGFFQSQKLLQMPVASDF

SEQ ID NO: 22823 - protein, 20 aa, synthetic construct
  source 1..20: note = Seed: SATGFKQSSKALQRPVASDF
SATGFFQSQKLLQVPVASDF

SEQ ID NO: 22824 - protein, 20 aa, synthetic construct
  source 1..20: note = Seed: SATGFKQSSKALQRPVASDF
SATGFFQSQKMLQIPVASDF

SEQ ID NO: 22825 - protein, 20 aa, synthetic construct
  source 1..20: note = Seed: SATGFKQSSKALQRPVASDF
SATGFFQSQKMLQLPVASDF

SEQ ID NO: 22826 - protein, 20 aa, synthetic construct
  source 1..20: note = Seed: SATGFKQSSKALQRPVASDF
SATGFFQSQKMLQVPVASDF

SEQ ID NO: 22827 - protein, 20 aa, synthetic construct
  source 1..20: note = Seed: SATGFKQSSKALQRPVASDF
SATGFFQSQKVLQIPVASDF

SEQ ID NO: 22828 - protein, 20 aa, synthetic construct
  source 1..20: note = Seed: SATGFKQSSKALQRPVASDF
SATGFFQSQKWLQFPVASDF

SEQ ID NO: 22829 - protein, 20 aa, synthetic construct
  source 1..20: note = Seed: SATGFKQSSKALQRPVASDF
SATGFFQSQKWLQIPVASDF

SEQ ID NO: 22830 - protein, 20 aa, synthetic construct
  source 1..20: note = Seed: SATGFKQSSKALQRPVASDF
SATGFFQSQKWLQLPVASDF

SEQ ID NO: 22831 - protein, 20 aa, synthetic construct
  source 1..20: note = Seed: SATGFKQSSKALQRPVASDF
SATGFFQSQKWLQVPVASDF

SEQ ID NO: 22832 - protein, 20 aa, synthetic construct
  source 1..20: note = Seed: SATGFKQSSKALQRPVASDF
SATGFFQSQKYLQFPVASDF

SEQ ID NO: 22833 - protein, 20 aa, synthetic construct
  source 1..20: note = Seed: SATGFKQSSKALQRPVASDF
SATGFFQSQKYLQIPVASDF

SEQ ID NO: 22834 - protein, 20 aa, synthetic construct
  source 1..20: note = Seed: SATGFKQSSKALQRPVASDF
SATGFFQSQKYLQLPVASDF

SEQ ID NO: 22835 - protein, 20 aa, synthetic construct
  source 1..20: note = Seed: SATGFKQSSKALQRPVASDF
SATGFFQSQKYLQVPVASDF

SEQ ID NO: 22836 - protein, 20 aa, synthetic construct
  source 1..20: note = Seed: SATGFKQSSKALQRPVASDF
SATGFFQSRKFLQAPVASDF

SEQ ID NO: 22837 - protein, 20 aa, synthetic construct
  source 1..20: note = Seed: SATGFKQSSKALQRPVASDF
SATGFFQSRKFLQFPVASDF

SEQ ID NO: 22838 - protein, 20 aa, synthetic construct
  source 1..20: note = Seed: SATGFKQSSKALQRPVASDF
SATGFFQSRKFLQIPVASDF

SEQ ID NO: 22839 - protein, 20 aa, synthetic construct
  source 1..20: note = Seed: SATGFKQSSKALQRPVASDF
SATGFFQSRKFLQLPVASDF

SEQ ID NO: 22840 - protein, 20 aa, synthetic construct
  source 1..20: note = Seed: SATGFKQSSKALQRPVASDF
SATGFFQSRKFLQMPVASDF

SEQ ID NO: 22841 - protein, 20 aa, synthetic construct
  source 1..20: note = Seed: SATGFKQSSKALQRPVASDF
SATGFFQSRKFLQSPVASDF

SEQ ID NO: 22842 - protein, 20 aa, synthetic construct
  source 1..20: note = Seed: SATGFKQSSKALQRPVASDF
SATGFFQSRKFLQTPVASDF

SEQ ID NO: 22843 - protein, 20 aa, synthetic construct
  source 1..20: note = Seed: SATGFKQSSKALQRPVASDF
SATGFFQSRKFLQVPVASDF

SEQ ID NO: 22844 - protein, 20 aa, synthetic construct
  source 1..20: note = Seed: SATGFKQSSKALQRPVASDF
SATGFFQSRKFLQYPVASDF

SEQ ID NO: 22845 - protein, 20 aa, synthetic construct
  source 1..20: note = Seed: SATGFKQSSKALQRPVASDF
SATGFFQSRKILQFPVASDF

SEQ ID NO: 22846 - protein, 20 aa, synthetic construct
  source 1..20: note = Seed: SATGFKQSSKALQRPVASDF
SATGFFQSRKILQIPVASDF

SEQ ID NO: 22847 - protein, 20 aa, synthetic construct
  source 1..20: note = Seed: SATGFKQSSKALQRPVASDF
SATGFFQSRKILQLPVASDF

SEQ ID NO: 22848 - protein, 20 aa, synthetic construct
  source 1..20: note = Seed: SATGFKQSSKALQRPVASDF
SATGFFQSRKLLQFPVASDF

SEQ ID NO: 22849 - protein, 20 aa, synthetic construct
  source 1..20: note = Seed: SATGFKQSSKALQRPVASDF
SATGFFQSRKLLQIPVASDF

SEQ ID NO: 22850 - protein, 20 aa, synthetic construct
  source 1..20: note = Seed: SATGFKQSSKALQRPVASDF
SATGFFQSRKLLQLPVASDF

SEQ ID NO: 22851 - protein, 20 aa, synthetic construct
  source 1..20: note = Seed: SATGFKQSSKALQRPVASDF
SATGFFQSRKLLQVPVASDF

SEQ ID NO: 22852 - protein, 20 aa, synthetic construct
  source 1..20: note = Seed: SATGFKQSSKALQRPVASDF
SATGFFQSRKMLQFPVASDF

SEQ ID NO: 22853 - protein, 20 aa, synthetic construct
  source 1..20: note = Seed: SATGFKQSSKALQRPVASDF
SATGFFQSRKMLQLPVASDF

SEQ ID NO: 22854 - protein, 20 aa, synthetic construct
  source 1..20: note = Seed: SATGFKQSSKALQRPVASDF
SATGFFQSRKWLQFPVASDF

SEQ ID NO: 22855 - protein, 20 aa, synthetic construct
  source 1..20: note = Seed: SATGFKQSSKALQRPVASDF
SATGFFQSRKWLQIPVASDF

SEQ ID NO: 22856 - protein, 20 aa, synthetic construct
  source 1..20: note = Seed: SATGFKQSSKALQRPVASDF
SATGFFQSRKWLQLPVASDF

SEQ ID NO: 22857 - protein, 20 aa, synthetic construct
  source 1..20: note = Seed: SATGFKQSSKALQRPVASDF
SATGFFQSRKYLQFPVASDF

SEQ ID NO: 22858 - protein, 20 aa, synthetic construct
  source 1..20: note = Seed: SATGFKQSSKALQRPVASDF
SATGFFQSRKYLQIPVASDF

SEQ ID NO: 22859 - protein, 20 aa, synthetic construct
  source 1..20: note = Seed: SATGFKQSSKALQRPVASDF
SATGFFQSRKYLQLPVASDF

SEQ ID NO: 22860 - protein, 20 aa, synthetic construct
  source 1..20: note = Seed: SATGFKQSSKALQRPVASDF
SATGFFQSSKALQFPVASDF

SEQ ID NO: 22861 - protein, 20 aa, synthetic construct
  source 1..20: note = Seed: SATGFKQSSKALQRPVASDF
SATGFFQSSKALQIPVASDF

SEQ ID NO: 22862 - protein, 20 aa, synthetic construct
  source 1..20: note = Seed: SATGFKQSSKALQRPVASDF
SATGFFQSSKALQLPVASDF

SEQ ID NO: 22863 - protein, 20 aa, synthetic construct
  source 1..20: note = Seed: SATGFKQSSKALQRPVASDF
SATGFFQSSKALQVPVASDF

SEQ ID NO: 22864 - protein, 20 aa, synthetic construct
  source 1..20: note = Seed: SATGFKQSSKALQRPVASDF
SATGFFQSSKFLQAPVASDF

SEQ ID NO: 22865 - protein, 20 aa, synthetic construct
  source 1..20: note = Seed: SATGFKQSSKALQRPVASDF
SATGFFQSSKFLQDPVASDF

SEQ ID NO: 22866 - protein, 20 aa, synthetic construct
  source 1..20: note = Seed: SATGFKQSSKALQRPVASDF
SATGFFQSSKFLQEPVASDF

SEQ ID NO: 22867 - protein, 20 aa, synthetic construct
  source 1..20: note = Seed: SATGFKQSSKALQRPVASDF
SATGFFQSSKFLQFPVASDF

SEQ ID NO: 22868 - protein, 20 aa, synthetic construct
  source 1..20: note = Seed: SATGFKQSSKALQRPVASDF
SATGFFQSSKFLQHPVASDF

SEQ ID NO: 22869 - protein, 20 aa, synthetic construct
  source 1..20: note = Seed: SATGFKQSSKALQRPVASDF
SATGFFQSSKFLQIPVASDF

SEQ ID NO: 22870 - protein, 20 aa, synthetic construct
  source 1..20: note = Seed: SATGFKQSSKALQRPVASDF
SATGFFQSSKFLQKPVASDF

SEQ ID NO: 22871 - protein, 20 aa, synthetic construct
  source 1..20: note = Seed: SATGFKQSSKALQRPVASDF
SATGFFQSSKFLQLPVASDF

SEQ ID NO: 22872 - protein, 20 aa, synthetic construct
  source 1..20: note = Seed: SATGFKQSSKALQRPVASDF
SATGFFQSSKFLQMPVASDF

SEQ ID NO: 22873 - protein, 20 aa, synthetic construct
  source 1..20: note = Seed: SATGFKQSSKALQRPVASDF
SATGFFQSSKFLQNPVASDF

SEQ ID NO: 22874 - protein, 20 aa, synthetic construct
  source 1..20: note = Seed: SATGFKQSSKALQRPVASDF
SATGFFQSSKFLQPPVASDF

SEQ ID NO: 22875 - protein, 20 aa, synthetic construct
  source 1..20: note = Seed: SATGFKQSSKALQRPVASDF
SATGFFQSSKFLQQPVASDF

SEQ ID NO: 22876 - protein, 20 aa, synthetic construct
  source 1..20: note = Seed: SATGFKQSSKALQRPVASDF
SATGFFQSSKFLQRPVASDF

SEQ ID NO: 22877 - protein, 20 aa, synthetic construct
  source 1..20: note = Seed: SATGFKQSSKALQRPVASDF
SATGFFQSSKFLQSPVASDF

SEQ ID NO: 22878 - protein, 20 aa, synthetic construct
  source 1..20: note = Seed: SATGFKQSSKALQRPVASDF
SATGFFQSSKFLQTPVASDF

SEQ ID NO: 22879 - protein, 20 aa, synthetic construct
  source 1..20: note = Seed: SATGFKQSSKALQRPVASDF
SATGFFQSSKFLQVPVASDF

SEQ ID NO: 22880 - protein, 20 aa, synthetic construct
  source 1..20: note = Seed: SATGFKQSSKALQRPVASDF
SATGFFQSSKFLQWPVASDF

SEQ ID NO: 22881 - protein, 20 aa, synthetic construct
  source 1..20: note = Seed: SATGFKQSSKALQRPVASDF
SATGFFQSSKFLQYPVASDF

SEQ ID NO: 22882 - protein, 20 aa, synthetic construct
  source 1..20: note = Seed: SATGFKQSSKALQRPVASDF
SATGFFQSSKILQFPVASDF

SEQ ID NO: 22883 - protein, 20 aa, synthetic construct
  source 1..20: note = Seed: SATGFKQSSKALQRPVASDF
SATGFFQSSKILQIPVASDF

SEQ ID NO: 22884 - protein, 20 aa, synthetic construct
  source 1..20: note = Seed: SATGFKQSSKALQRPVASDF
SATGFFQSSKILQLPVASDF

SEQ ID NO: 22885 - protein, 20 aa, synthetic construct
  source 1..20: note = Seed: SATGFKQSSKALQRPVASDF
SATGFFQSSKILQMPVASDF

SEQ ID NO: 22886 - protein, 20 aa, synthetic construct
  source 1..20: note = Seed: SATGFKQSSKALQRPVASDF
SATGFFQSSKILQNPVASDF

SEQ ID NO: 22887 - protein, 20 aa, synthetic construct
  source 1..20: note = Seed: SATGFKQSSKALQRPVASDF
SATGFFQSSKILQVPVASDF

SEQ ID NO: 22888 - protein, 20 aa, synthetic construct
  source 1..20: note = Seed: SATGFKQSSKALQRPVASDF
SATGFFQSSKILQYPVASDF

SEQ ID NO: 22889 - protein, 20 aa, synthetic construct
  source 1..20: note = Seed: SATGFKQSSKALQRPVASDF
SATGFFQSSKLLQFPVASDF

SEQ ID NO: 22890 - protein, 20 aa, synthetic construct
  source 1..20: note = Seed: SATGFKQSSKALQRPVASDF
SATGFFQSSKLLQIPVASDF

SEQ ID NO: 22891 - protein, 20 aa, synthetic construct
  source 1..20: note = Seed: SATGFKQSSKALQRPVASDF
SATGFFQSSKLLQLPVASDF

SEQ ID NO: 22892 - protein, 20 aa, synthetic construct
  source 1..20: note = Seed: SATGFKQSSKALQRPVASDF
SATGFFQSSKLLQMPVASDF

SEQ ID NO: 22893 - protein, 20 aa, synthetic construct
  source 1..20: note = Seed: SATGFKQSSKALQRPVASDF
SATGFFQSSKLLQNPVASDF

SEQ ID NO: 22894 - protein, 20 aa, synthetic construct
  source 1..20: note = Seed: SATGFKQSSKALQRPVASDF
SATGFFQSSKLLQTPVASDF

SEQ ID NO: 22895 - protein, 20 aa, synthetic construct
  source 1..20: note = Seed: SATGFKQSSKALQRPVASDF
SATGFFQSSKLLQVPVASDF

SEQ ID NO: 22896 - protein, 20 aa, synthetic construct
  source 1..20: note = Seed: SATGFKQSSKALQRPVASDF
SATGFFQSSKLLQYPVASDF

SEQ ID NO: 22897 - protein, 20 aa, synthetic construct
  source 1..20: note = Seed: SATGFKQSSKALQRPVASDF
SATGFFQSSKMLQFPVASDF

SEQ ID NO: 22898 - protein, 20 aa, synthetic construct
  source 1..20: note = Seed: SATGFKQSSKALQRPVASDF
SATGFFQSSKMLQIPVASDF

SEQ ID NO: 22899 - protein, 20 aa, synthetic construct
  source 1..20: note = Seed: SATGFKQSSKALQRPVASDF
SATGFFQSSKMLQLPVASDF

SEQ ID NO: 22900 - protein, 20 aa, synthetic construct
  source 1..20: note = Seed: SATGFKQSSKALQRPVASDF
SATGFFQSSKMLQMPVASDF

SEQ ID NO: 22901 - protein, 20 aa, synthetic construct
  source 1..20: note = Seed: SATGFKQSSKALQRPVASDF
SATGFFQSSKMLQNPVASDF

SEQ ID NO: 22902 - protein, 20 aa, synthetic construct
  source 1..20: note = Seed: SATGFKQSSKALQRPVASDF
SATGFFQSSKMLQVPVASDF

SEQ ID NO: 22903 - protein, 20 aa, synthetic construct
  source 1..20: note = Seed: SATGFKQSSKALQRPVASDF
SATGFFQSSKMLQYPVASDF

SEQ ID NO: 22904 - protein, 20 aa, synthetic construct
  source 1..20: note = Seed: SATGFKQSSKALQRPVASDF
SATGFFQSSKVLQFPVASDF

SEQ ID NO: 22905 - protein, 20 aa, synthetic construct
  source 1..20: note = Seed: SATGFKQSSKALQRPVASDF
SATGFFQSSKVLQIPVASDF

SEQ ID NO: 22906 - protein, 20 aa, synthetic construct
  source 1..20: note = Seed: SATGFKQSSKALQRPVASDF
SATGFFQSSKVLQLPVASDF

SEQ ID NO: 22907 - protein, 20 aa, synthetic construct
  source 1..20: note = Seed: SATGFKQSSKALQRPVASDF
SATGFFQSSKVLQVPVASDF

SEQ ID NO: 22908 - protein, 20 aa, synthetic construct
  source 1..20: note = Seed: SATGFKQSSKALQRPVASDF
SATGFFQSSKWLQFPVASDF

SEQ ID NO: 22909 - protein, 20 aa, synthetic construct
  source 1..20: note = Seed: SATGFKQSSKALQRPVASDF
SATGFFQSSKWLQIPVASDF

SEQ ID NO: 22910 - protein, 20 aa, synthetic construct
  source 1..20: note = Seed: SATGFKQSSKALQRPVASDF
SATGFFQSSKWLQLPVASDF

SEQ ID NO: 22911 - protein, 20 aa, synthetic construct
  source 1..20: note = Seed: SATGFKQSSKALQRPVASDF
SATGFFQSSKWLQMPVASDF

SEQ ID NO: 22912 - protein, 20 aa, synthetic construct
  source 1..20: note = Seed: SATGFKQSSKALQRPVASDF
SATGFFQSSKWLQNPVASDF

SEQ ID NO: 22913 - protein, 20 aa, synthetic construct
  source 1..20: note = Seed: SATGFKQSSKALQRPVASDF
SATGFFQSSKWLQTPVASDF

SEQ ID NO: 22914 - protein, 20 aa, synthetic construct
  source 1..20: note = Seed: SATGFKQSSKALQRPVASDF
SATGFFQSSKWLQVPVASDF

SEQ ID NO: 22915 - protein, 20 aa, synthetic construct
  source 1..20: note = Seed: SATGFKQSSKALQRPVASDF
SATGFFQSSKYLQAPVASDF

SEQ ID NO: 22916 - protein, 20 aa, synthetic construct
  source 1..20: note = Seed: SATGFKQSSKALQRPVASDF
SATGFFQSSKYLQFPVASDF

SEQ ID NO: 22917 - protein, 20 aa, synthetic construct
  source 1..20: note = Seed: SATGFKQSSKALQRPVASDF
SATGFFQSSKYLQIPVASDF

SEQ ID NO: 22918 - protein, 20 aa, synthetic construct
  source 1..20: note = Seed: SATGFKQSSKALQRPVASDF
SATGFFQSSKYLQLPVASDF

SEQ ID NO: 22919 - protein, 20 aa, synthetic construct
  source 1..20: note = Seed: SATGFKQSSKALQRPVASDF
SATGFFQSSKYLQMPVASDF

SEQ ID NO: 22920 - protein, 20 aa, synthetic construct
  source 1..20: note = Seed: SATGFKQSSKALQRPVASDF
SATGFFQSSKYLQNPVASDF

SEQ ID NO: 22921 - protein, 20 aa, synthetic construct
  source 1..20: note = Seed: SATGFKQSSKALQRPVASDF
SATGFFQSSKYLQTPVASDF

SEQ ID NO: 22922 - protein, 20 aa, synthetic construct
  source 1..20: note = Seed: SATGFKQSSKALQRPVASDF
SATGFFQSSKYLQVPVASDF

SEQ ID NO: 22923 - protein, 20 aa, synthetic construct
  source 1..20: note = Seed: SATGFKQSSKALQRPVASDF
SATGFFQSSKYLQYPVASDF

SEQ ID NO: 22924 - protein, 20 aa, synthetic construct
  source 1..20: note = Seed: SATGFKQSSKALQRPVASDF
SATGFFQSTKALQFPVASDF

SEQ ID NO: 22925 - protein, 20 aa, synthetic construct
  source 1..20: note = Seed: SATGFKQSSKALQRPVASDF
SATGFFQSTKALQIPVASDF

SEQ ID NO: 22926 - protein, 20 aa, synthetic construct
  source 1..20: note = Seed: SATGFKQSSKALQRPVASDF
SATGFFQSTKALQLPVASDF

SEQ ID NO: 22927 - protein, 20 aa, synthetic construct
  source 1..20: note = Seed: SATGFKQSSKALQRPVASDF
SATGFFQSTKALQMPVASDF

SEQ ID NO: 22928 - protein, 20 aa, synthetic construct
  source 1..20: note = Seed: SATGFKQSSKALQRPVASDF
SATGFFQSTKALQVPVASDF

SEQ ID NO: 22929 - protein, 20 aa, synthetic construct
  source 1..20: note = Seed: SATGFKQSSKALQRPVASDF
SATGFFQSTKFLQAPVASDF

SEQ ID NO: 22930 - protein, 20 aa, synthetic construct
  source 1..20: note = Seed: SATGFKQSSKALQRPVASDF
SATGFFQSTKFLQDPVASDF

SEQ ID NO: 22931 - protein, 20 aa, synthetic construct
  source 1..20: note = Seed: SATGFKQSSKALQRPVASDF
SATGFFQSTKFLQEPVASDF

SEQ ID NO: 22932 - protein, 20 aa, synthetic construct
  source 1..20: note = Seed: SATGFKQSSKALQRPVASDF
SATGFFQSTKFLQFPVASDF

SEQ ID NO: 22933 - protein, 20 aa, synthetic construct
  source 1..20: note = Seed: SATGFKQSSKALQRPVASDF
SATGFFQSTKFLQHPVASDF

SEQ ID NO: 22934 - protein, 20 aa, synthetic construct
  source 1..20: note = Seed: SATGFKQSSKALQRPVASDF
SATGFFQSTKFLQIPVASDF

SEQ ID NO: 22935 - protein, 20 aa, synthetic construct
  source 1..20: note = Seed: SATGFKQSSKALQRPVASDF
SATGFFQSTKFLQKPVASDF

SEQ ID NO: 22936 - protein, 20 aa, synthetic construct
  source 1..20: note = Seed: SATGFKQSSKALQRPVASDF
SATGFFQSTKFLQLPVASDF

SEQ ID NO: 22937 - protein, 20 aa, synthetic construct
  source 1..20: note = Seed: SATGFKQSSKALQRPVASDF
SATGFFQSTKFLQMPVASDF

SEQ ID NO: 22938 - protein, 20 aa, synthetic construct
  source 1..20: note = Seed: SATGFKQSSKALQRPVASDF
SATGFFQSTKFLQNPVASDF

SEQ ID NO: 22939 - protein, 20 aa, synthetic construct
  source 1..20: note = Seed: SATGFKQSSKALQRPVASDF
SATGFFQSTKFLQPPVASDF

SEQ ID NO: 22940 - protein, 20 aa, synthetic construct
  source 1..20: note = Seed: SATGFKQSSKALQRPVASDF
SATGFFQSTKFLQQPVASDF

SEQ ID NO: 22941 - protein, 20 aa, synthetic construct
  source 1..20: note = Seed: SATGFKQSSKALQRPVASDF
SATGFFQSTKFLQRPVASDF

SEQ ID NO: 22942 - protein, 20 aa, synthetic construct
  source 1..20: note = Seed: SATGFKQSSKALQRPVASDF
SATGFFQSTKFLQSPVASDF

SEQ ID NO: 22943 - protein, 20 aa, synthetic construct
  source 1..20: note = Seed: SATGFKQSSKALQRPVASDF
SATGFFQSTKFLQTPVASDF

SEQ ID NO: 22944 - protein, 20 aa, synthetic construct
  source 1..20: note = Seed: SATGFKQSSKALQRPVASDF
SATGFFQSTKFLQVPVASDF

SEQ ID NO: 22945 - protein, 20 aa, synthetic construct
  source 1..20: note = Seed: SATGFKQSSKALQRPVASDF
SATGFFQSTKFLQWPVASDF

SEQ ID NO: 22946 - protein, 20 aa, synthetic construct
  source 1..20: note = Seed: SATGFKQSSKALQRPVASDF
SATGFFQSTKFLQYPVASDF

SEQ ID NO: 22947 - protein, 20 aa, synthetic construct
  source 1..20: note = Seed: SATGFKQSSKALQRPVASDF
SATGFFQSTKILQAPVASDF

SEQ ID NO: 22948 - protein, 20 aa, synthetic construct
  source 1..20: note = Seed: SATGFKQSSKALQRPVASDF
SATGFFQSTKILQEPVASDF

SEQ ID NO: 22949 - protein, 20 aa, synthetic construct
  source 1..20: note = Seed: SATGFKQSSKALQRPVASDF
SATGFFQSTKILQFPVASDF

SEQ ID NO: 22950 - protein, 20 aa, synthetic construct
  source 1..20: note = Seed: SATGFKQSSKALQRPVASDF
SATGFFQSTKILQIPVASDF

SEQ ID NO: 22951 - protein, 20 aa, synthetic construct
  source 1..20: note = Seed: SATGFKQSSKALQRPVASDF
SATGFFQSTKILQLPVASDF

SEQ ID NO: 22952 - protein, 20 aa, synthetic construct
  source 1..20: note = Seed: SATGFKQSSKALQRPVASDF
SATGFFQSTKILQMPVASDF

SEQ ID NO: 22953 - protein, 20 aa, synthetic construct
  source 1..20: note = Seed: SATGFKQSSKALQRPVASDF
SATGFFQSTKILQNPVASDF

SEQ ID NO: 22954 - protein, 20 aa, synthetic construct
  source 1..20: note = Seed: SATGFKQSSKALQRPVASDF
SATGFFQSTKILQSPVASDF

SEQ ID NO: 22955 - protein, 20 aa, synthetic construct
  source 1..20: note = Seed: SATGFKQSSKALQRPVASDF
SATGFFQSTKILQTPVASDF

SEQ ID NO: 22956 - protein, 20 aa, synthetic construct
  source 1..20: note = Seed: SATGFKQSSKALQRPVASDF
SATGFFQSTKILQVPVASDF

SEQ ID NO: 22957 - protein, 20 aa, synthetic construct
  source 1..20: note = Seed: SATGFKQSSKALQRPVASDF
SATGFFQSTKILQYPVASDF

SEQ ID NO: 22958 - protein, 20 aa, synthetic construct
  source 1..20: note = Seed: SATGFKQSSKALQRPVASDF
SATGFFQSTKLLQAPVASDF

SEQ ID NO: 22959 - protein, 20 aa, synthetic construct
  source 1..20: note = Seed: SATGFKQSSKALQRPVASDF
SATGFFQSTKLLQEPVASDF

SEQ ID NO: 22960 - protein, 20 aa, synthetic construct
  source 1..20: note = Seed: SATGFKQSSKALQRPVASDF
SATGFFQSTKLLQFPVASDF

SEQ ID NO: 22961 - protein, 20 aa, synthetic construct
  source 1..20: note = Seed: SATGFKQSSKALQRPVASDF
SATGFFQSTKLLQIPVASDF

SEQ ID NO: 22962 - protein, 20 aa, synthetic construct
  source 1..20: note = Seed: SATGFKQSSKALQRPVASDF
SATGFFQSTKLLQLPVASDF

SEQ ID NO: 22963 - protein, 20 aa, synthetic construct
  source 1..20: note = Seed: SATGFKQSSKALQRPVASDF
SATGFFQSTKLLQMPVASDF

SEQ ID NO: 22964 - protein, 20 aa, synthetic construct
  source 1..20: note = Seed: SATGFKQSSKALQRPVASDF
SATGFFQSTKLLQNPVASDF

SEQ ID NO: 22965 - protein, 20 aa, synthetic construct
  source 1..20: note = Seed: SATGFKQSSKALQRPVASDF
SATGFFQSTKLLQSPVASDF

SEQ ID NO: 22966 - protein, 20 aa, synthetic construct
  source 1..20: note = Seed: SATGFKQSSKALQRPVASDF
SATGFFQSTKLLQTPVASDF

SEQ ID NO: 22967 - protein, 20 aa, synthetic construct
  source 1..20: note = Seed: SATGFKQSSKALQRPVASDF
SATGFFQSTKLLQVPVASDF

SEQ ID NO: 22968 - protein, 20 aa, synthetic construct
  source 1..20: note = Seed: SATGFKQSSKALQRPVASDF
SATGFFQSTKLLQYPVASDF

SEQ ID NO: 22969 - protein, 20 aa, synthetic construct
  source 1..20: note = Seed: SATGFKQSSKALQRPVASDF
SATGFFQSTKMLQFPVASDF

SEQ ID NO: 22970 - protein, 20 aa, synthetic construct
  source 1..20: note = Seed: SATGFKQSSKALQRPVASDF
SATGFFQSTKMLQIPVASDF

SEQ ID NO: 22971 - protein, 20 aa, synthetic construct
  source 1..20: note = Seed: SATGFKQSSKALQRPVASDF
SATGFFQSTKMLQLPVASDF

SEQ ID NO: 22972 - protein, 20 aa, synthetic construct
  source 1..20: note = Seed: SATGFKQSSKALQRPVASDF
SATGFFQSTKMLQMPVASDF

SEQ ID NO: 22973 - protein, 20 aa, synthetic construct
  source 1..20: note = Seed: SATGFKQSSKALQRPVASDF
SATGFFQSTKMLQNPVASDF

SEQ ID NO: 22974 - protein, 20 aa, synthetic construct
  source 1..20: note = Seed: SATGFKQSSKALQRPVASDF
SATGFFQSTKMLQVPVASDF

SEQ ID NO: 22975 - protein, 20 aa, synthetic construct
  source 1..20: note = Seed: SATGFKQSSKALQRPVASDF
SATGFFQSTKMLQYPVASDF

SEQ ID NO: 22976 - protein, 20 aa, synthetic construct
  source 1..20: note = Seed: SATGFKQSSKALQRPVASDF
SATGFFQSTKPLQIPVASDF

SEQ ID NO: 22977 - protein, 20 aa, synthetic construct
  source 1..20: note = Seed: SATGFKQSSKALQRPVASDF
SATGFFQSTKVLQFPVASDF

SEQ ID NO: 22978 - protein, 20 aa, synthetic construct
  source 1..20: note = Seed: SATGFKQSSKALQRPVASDF
SATGFFQSTKVLQIPVASDF

SEQ ID NO: 22979 - protein, 20 aa, synthetic construct
  source 1..20: note = Seed: SATGFKQSSKALQRPVASDF
SATGFFQSTKVLQLPVASDF

SEQ ID NO: 22980 - protein, 20 aa, synthetic construct
  source 1..20: note = Seed: SATGFKQSSKALQRPVASDF
SATGFFQSTKVLQMPVASDF

SEQ ID NO: 22981 - protein, 20 aa, synthetic construct
  source 1..20: note = Seed: SATGFKQSSKALQRPVASDF
SATGFFQSTKVLQVPVASDF

SEQ ID NO: 22982 - protein, 20 aa, synthetic construct
  source 1..20: note = Seed: SATGFKQSSKALQRPVASDF
SATGFFQSTKVLQYPVASDF

SEQ ID NO: 22983 - protein, 20 aa, synthetic construct
  source 1..20: note = Seed: SATGFKQSSKALQRPVASDF
SATGFFQSTKWLQAPVASDF

SEQ ID NO: 22984 - protein, 20 aa, synthetic construct
  source 1..20: note = Seed: SATGFKQSSKALQRPVASDF
SATGFFQSTKWLQFPVASDF

SEQ ID NO: 22985 - protein, 20 aa, synthetic construct
  source 1..20: note = Seed: SATGFKQSSKALQRPVASDF
SATGFFQSTKWLQIPVASDF

SEQ ID NO: 22986 - protein, 20 aa, synthetic construct
  source 1..20: note = Seed: SATGFKQSSKALQRPVASDF
SATGFFQSTKWLQLPVASDF

SEQ ID NO: 22987 - protein, 20 aa, synthetic construct
  source 1..20: note = Seed: SATGFKQSSKALQRPVASDF
SATGFFQSTKWLQMPVASDF

SEQ ID NO: 22988 - protein, 20 aa, synthetic construct
  source 1..20: note = Seed: SATGFKQSSKALQRPVASDF
SATGFFQSTKWLQNPVASDF

SEQ ID NO: 22989 - protein, 20 aa, synthetic construct
  source 1..20: note = Seed: SATGFKQSSKALQRPVASDF
SATGFFQSTKWLQSPVASDF

SEQ ID NO: 22990 - protein, 20 aa, synthetic construct
  source 1..20: note = Seed: SATGFKQSSKALQRPVASDF
SATGFFQSTKWLQTPVASDF

SEQ ID NO: 22991 - protein, 20 aa, synthetic construct
  source 1..20: note = Seed: SATGFKQSSKALQRPVASDF
SATGFFQSTKWLQVPVASDF

SEQ ID NO: 22992 - protein, 20 aa, synthetic construct
  source 1..20: note = Seed: SATGFKQSSKALQRPVASDF
SATGFFQSTKWLQYPVASDF

SEQ ID NO: 22993 - protein, 20 aa, synthetic construct
  source 1..20: note = Seed: SATGFKQSSKALQRPVASDF
SATGFFQSTKYLQAPVASDF

SEQ ID NO: 22994 - protein, 20 aa, synthetic construct
  source 1..20: note = Seed: SATGFKQSSKALQRPVASDF
SATGFFQSTKYLQFPVASDF

SEQ ID NO: 22995 - protein, 20 aa, synthetic construct
  source 1..20: note = Seed: SATGFKQSSKALQRPVASDF
SATGFFQSTKYLQIPVASDF

SEQ ID NO: 22996 - protein, 20 aa, synthetic construct
  source 1..20: note = Seed: SATGFKQSSKALQRPVASDF
SATGFFQSTKYLQLPVASDF

SEQ ID NO: 22997 - protein, 20 aa, synthetic construct
  source 1..20: note = Seed: SATGFKQSSKALQRPVASDF
SATGFFQSTKYLQMPVASDF

SEQ ID NO: 22998 - protein, 20 aa, synthetic construct
  source 1..20: note = Seed: SATGFKQSSKALQRPVASDF
SATGFFQSTKYLQNPVASDF

SEQ ID NO: 22999 - protein, 20 aa, synthetic construct
  source 1..20: note = Seed: SATGFKQSSKALQRPVASDF
SATGFFQSTKYLQSPVASDF

SEQ ID NO: 23000 - protein, 20 aa, synthetic construct
  source 1..20: note = Seed: SATGFKQSSKALQRPVASDF
SATGFFQSTKYLQTPVASDF

SEQ ID NO: 23001 - protein, 20 aa, synthetic construct
  source 1..20: note = Seed: SATGFKQSSKALQRPVASDF
SATGFFQSTKYLQVPVASDF

SEQ ID NO: 23002 - protein, 20 aa, synthetic construct
  source 1..20: note = Seed: SATGFKQSSKALQRPVASDF
SATGFFQSTKYLQYPVASDF

SEQ ID NO: 23003 - protein, 20 aa, synthetic construct
  source 1..20: note = Seed: SATGFKQSSKALQRPVASDF
SATGFFQSVKALQFPVASDF

SEQ ID NO: 23004 - protein, 20 aa, synthetic construct
  source 1..20: note = Seed: SATGFKQSSKALQRPVASDF
SATGFFQSVKALQIPVASDF

SEQ ID NO: 23005 - protein, 20 aa, synthetic construct
  source 1..20: note = Seed: SATGFKQSSKALQRPVASDF
SATGFFQSVKALQLPVASDF

SEQ ID NO: 23006 - protein, 20 aa, synthetic construct
  source 1..20: note = Seed: SATGFKQSSKALQRPVASDF
SATGFFQSVKALQVPVASDF

SEQ ID NO: 23007 - protein, 20 aa, synthetic construct
  source 1..20: note = Seed: SATGFKQSSKALQRPVASDF
SATGFFQSVKFLQAPVASDF

SEQ ID NO: 23008 - protein, 20 aa, synthetic construct
  source 1..20: note = Seed: SATGFKQSSKALQRPVASDF
SATGFFQSVKFLQDPVASDF

SEQ ID NO: 23009 - protein, 20 aa, synthetic construct
  source 1..20: note = Seed: SATGFKQSSKALQRPVASDF
SATGFFQSVKFLQEPVASDF

SEQ ID NO: 23010 - protein, 20 aa, synthetic construct
  source 1..20: note = Seed: SATGFKQSSKALQRPVASDF
SATGFFQSVKFLQFPVASDF

SEQ ID NO: 23011 - protein, 20 aa, synthetic construct
  source 1..20: note = Seed: SATGFKQSSKALQRPVASDF
SATGFFQSVKFLQHPVASDF

SEQ ID NO: 23012 - protein, 20 aa, synthetic construct
  source 1..20: note = Seed: SATGFKQSSKALQRPVASDF
SATGFFQSVKFLQIPVASDF

SEQ ID NO: 23013 - protein, 20 aa, synthetic construct
  source 1..20: note = Seed: SATGFKQSSKALQRPVASDF
SATGFFQSVKFLQKPVASDF

SEQ ID NO: 23014 - protein, 20 aa, synthetic construct
  source 1..20: note = Seed: SATGFKQSSKALQRPVASDF
SATGFFQSVKFLQLPVASDF

SEQ ID NO: 23015 - protein, 20 aa, synthetic construct
  source 1..20: note = Seed: SATGFKQSSKALQRPVASDF
SATGFFQSVKFLQMPVASDF

SEQ ID NO: 23016 - protein, 20 aa, synthetic construct
  source 1..20: note = Seed: SATGFKQSSKALQRPVASDF
SATGFFQSVKFLQNPVASDF

SEQ ID NO: 23017 - protein, 20 aa, synthetic construct
  source 1..20: note = Seed: SATGFKQSSKALQRPVASDF
SATGFFQSVKFLQPPVASDF

SEQ ID NO: 23018 - protein, 20 aa, synthetic construct
  source 1..20: note = Seed: SATGFKQSSKALQRPVASDF
SATGFFQSVKFLQQPVASDF

SEQ ID NO: 23019 - protein, 20 aa, synthetic construct
  source 1..20: note = Seed: SATGFKQSSKALQRPVASDF
SATGFFQSVKFLQRPVASDF

SEQ ID NO: 23020 - protein, 20 aa, synthetic construct
  source 1..20: note = Seed: SATGFKQSSKALQRPVASDF
SATGFFQSVKFLQSPVASDF

SEQ ID NO: 23021 - protein, 20 aa, synthetic construct
  source 1..20: note = Seed: SATGFKQSSKALQRPVASDF
SATGFFQSVKFLQTPVASDF

SEQ ID NO: 23022 - protein, 20 aa, synthetic construct
  source 1..20: note = Seed: SATGFKQSSKALQRPVASDF
SATGFFQSVKFLQVPVASDF

SEQ ID NO: 23023 - protein, 20 aa, synthetic construct
  source 1..20: note = Seed: SATGFKQSSKALQRPVASDF
SATGFFQSVKFLQYPVASDF

SEQ ID NO: 23024 - protein, 20 aa, synthetic construct
  source 1..20: note = Seed: SATGFKQSSKALQRPVASDF
SATGFFQSVKILQFPVASDF

SEQ ID NO: 23025 - protein, 20 aa, synthetic construct
  source 1..20: note = Seed: SATGFKQSSKALQRPVASDF
SATGFFQSVKILQIPVASDF

SEQ ID NO: 23026 - protein, 20 aa, synthetic construct
  source 1..20: note = Seed: SATGFKQSSKALQRPVASDF
SATGFFQSVKILQLPVASDF

SEQ ID NO: 23027 - protein, 20 aa, synthetic construct
  source 1..20: note = Seed: SATGFKQSSKALQRPVASDF
SATGFFQSVKILQMPVASDF

SEQ ID NO: 23028 - protein, 20 aa, synthetic construct
  source 1..20: note = Seed: SATGFKQSSKALQRPVASDF
SATGFFQSVKILQNPVASDF

SEQ ID NO: 23029 - protein, 20 aa, synthetic construct
  source 1..20: note = Seed: SATGFKQSSKALQRPVASDF
SATGFFQSVKILQTPVASDF

SEQ ID NO: 23030 - protein, 20 aa, synthetic construct
  source 1..20: note = Seed: SATGFKQSSKALQRPVASDF
SATGFFQSVKILQVPVASDF

SEQ ID NO: 23031 - protein, 20 aa, synthetic construct
  source 1..20: note = Seed: SATGFKQSSKALQRPVASDF
SATGFFQSVKILQYPVASDF

SEQ ID NO: 23032 - protein, 20 aa, synthetic construct
  source 1..20: note = Seed: SATGFKQSSKALQRPVASDF
SATGFFQSVKLLQEPVASDF

SEQ ID NO: 23033 - protein, 20 aa, synthetic construct
  source 1..20: note = Seed: SATGFKQSSKALQRPVASDF
SATGFFQSVKLLQFPVASDF

SEQ ID NO: 23034 - protein, 20 aa, synthetic construct
  source 1..20: note = Seed: SATGFKQSSKALQRPVASDF
SATGFFQSVKLLQIPVASDF

SEQ ID NO: 23035 - protein, 20 aa, synthetic construct
  source 1..20: note = Seed: SATGFKQSSKALQRPVASDF
SATGFFQSVKLLQLPVASDF

SEQ ID NO: 23036 - protein, 20 aa, synthetic construct
  source 1..20: note = Seed: SATGFKQSSKALQRPVASDF
SATGFFQSVKLLQMPVASDF

SEQ ID NO: 23037 - protein, 20 aa, synthetic construct
  source 1..20: note = Seed: SATGFKQSSKALQRPVASDF
SATGFFQSVKLLQNPVASDF

SEQ ID NO: 23038 - protein, 20 aa, synthetic construct
  source 1..20: note = Seed: SATGFKQSSKALQRPVASDF
SATGFFQSVKLLQSPVASDF

SEQ ID NO: 23039 - protein, 20 aa, synthetic construct
  source 1..20: note = Seed: SATGFKQSSKALQRPVASDF
SATGFFQSVKLLQTPVASDF

SEQ ID NO: 23040 - protein, 20 aa, synthetic construct
  source 1..20: note = Seed: SATGFKQSSKALQRPVASDF
SATGFFQSVKLLQVPVASDF

SEQ ID NO: 23041 - protein, 20 aa, synthetic construct
  source 1..20: note = Seed: SATGFKQSSKALQRPVASDF
SATGFFQSVKLLQYPVASDF

SEQ ID NO: 23042 - protein, 20 aa, synthetic construct
  source 1..20: note = Seed: SATGFKQSSKALQRPVASDF
SATGFFQSVKMLQFPVASDF

SEQ ID NO: 23043 - protein, 20 aa, synthetic construct
  source 1..20: note = Seed: SATGFKQSSKALQRPVASDF
SATGFFQSVKMLQIPVASDF

SEQ ID NO: 23044 - protein, 20 aa, synthetic construct
  source 1..20: note = Seed: SATGFKQSSKALQRPVASDF
SATGFFQSVKMLQLPVASDF

SEQ ID NO: 23045 - protein, 20 aa, synthetic construct
  source 1..20: note = Seed: SATGFKQSSKALQRPVASDF
SATGFFQSVKMLQMPVASDF

SEQ ID NO: 23046 - protein, 20 aa, synthetic construct
  source 1..20: note = Seed: SATGFKQSSKALQRPVASDF
SATGFFQSVKMLQVPVASDF

SEQ ID NO: 23047 - protein, 20 aa, synthetic construct
  source 1..20: note = Seed: SATGFKQSSKALQRPVASDF
SATGFFQSVKMLQYPVASDF

SEQ ID NO: 23048 - protein, 20 aa, synthetic construct
  source 1..20: note = Seed: SATGFKQSSKALQRPVASDF
SATGFFQSVKVLQFPVASDF

SEQ ID NO: 23049 - protein, 20 aa, synthetic construct
  source 1..20: note = Seed: SATGFKQSSKALQRPVASDF
SATGFFQSVKVLQIPVASDF

SEQ ID NO: 23050 - protein, 20 aa, synthetic construct
  source 1..20: note = Seed: SATGFKQSSKALQRPVASDF
SATGFFQSVKVLQLPVASDF

SEQ ID NO: 23051 - protein, 20 aa, synthetic construct
  source 1..20: note = Seed: SATGFKQSSKALQRPVASDF
SATGFFQSVKVLQVPVASDF

SEQ ID NO: 23052 - protein, 20 aa, synthetic construct
  source 1..20: note = Seed: SATGFKQSSKALQRPVASDF
SATGFFQSVKWLQFPVASDF

SEQ ID NO: 23053 - protein, 20 aa, synthetic construct
  source 1..20: note = Seed: SATGFKQSSKALQRPVASDF
SATGFFQSVKWLQIPVASDF

SEQ ID NO: 23054 - protein, 20 aa, synthetic construct
  source 1..20: note = Seed: SATGFKQSSKALQRPVASDF
SATGFFQSVKWLQLPVASDF

SEQ ID NO: 23055 - protein, 20 aa, synthetic construct
  source 1..20: note = Seed: SATGFKQSSKALQRPVASDF
SATGFFQSVKWLQMPVASDF

SEQ ID NO: 23056 - protein, 20 aa, synthetic construct
  source 1..20: note = Seed: SATGFKQSSKALQRPVASDF
SATGFFQSVKWLQNPVASDF

SEQ ID NO: 23057 - protein, 20 aa, synthetic construct
  source 1..20: note = Seed: SATGFKQSSKALQRPVASDF
SATGFFQSVKWLQVPVASDF

SEQ ID NO: 23058 - protein, 20 aa, synthetic construct
  source 1..20: note = Seed: SATGFKQSSKALQRPVASDF
SATGFFQSVKWLQYPVASDF

SEQ ID NO: 23059 - protein, 20 aa, synthetic construct
  source 1..20: note = Seed: SATGFKQSSKALQRPVASDF
SATGFFQSVKYLQAPVASDF

SEQ ID NO: 23060 - protein, 20 aa, synthetic construct
  source 1..20: note = Seed: SATGFKQSSKALQRPVASDF
SATGFFQSVKYLQFPVASDF

SEQ ID NO: 23061 - protein, 20 aa, synthetic construct
  source 1..20: note = Seed: SATGFKQSSKALQRPVASDF
SATGFFQSVKYLQIPVASDF

SEQ ID NO: 23062 - protein, 20 aa, synthetic construct
  source 1..20: note = Seed: SATGFKQSSKALQRPVASDF
SATGFFQSVKYLQLPVASDF

SEQ ID NO: 23063 - protein, 20 aa, synthetic construct
  source 1..20: note = Seed: SATGFKQSSKALQRPVASDF
SATGFFQSVKYLQMPVASDF

SEQ ID NO: 23064 - protein, 20 aa, synthetic construct
  source 1..20: note = Seed: SATGFKQSSKALQRPVASDF
SATGFFQSVKYLQNPVASDF

SEQ ID NO: 23065 - protein, 20 aa, synthetic construct
  source 1..20: note = Seed: SATGFKQSSKALQRPVASDF
SATGFFQSVKYLQSPVASDF

SEQ ID NO: 23066 - protein, 20 aa, synthetic construct
  source 1..20: note = Seed: SATGFKQSSKALQRPVASDF
SATGFFQSVKYLQTPVASDF

SEQ ID NO: 23067 - protein, 20 aa, synthetic construct
  source 1..20: note = Seed: SATGFKQSSKALQRPVASDF
SATGFFQSVKYLQVPVASDF

SEQ ID NO: 23068 - protein, 20 aa, synthetic construct
  source 1..20: note = Seed: SATGFKQSSKALQRPVASDF
SATGFFQSVKYLQYPVASDF

SEQ ID NO: 23069 - protein, 20 aa, synthetic construct
  source 1..20: note = Seed: SATGFKQSSKALQRPVASDF
SATGFFQSWKALQFPVASDF

SEQ ID NO: 23070 - protein, 20 aa, synthetic construct
  source 1..20: note = Seed: SATGFKQSSKALQRPVASDF
SATGFFQSWKALQIPVASDF

SEQ ID NO: 23071 - protein, 20 aa, synthetic construct
  source 1..20: note = Seed: SATGFKQSSKALQRPVASDF
SATGFFQSWKALQLPVASDF

SEQ ID NO: 23072 - protein, 20 aa, synthetic construct
  source 1..20: note = Seed: SATGFKQSSKALQRPVASDF
SATGFFQSWKALQVPVASDF

SEQ ID NO: 23073 - protein, 20 aa, synthetic construct
  source 1..20: note = Seed: SATGFKQSSKALQRPVASDF
SATGFFQSWKFLQAPVASDF

SEQ ID NO: 23074 - protein, 20 aa, synthetic construct
  source 1..20: note = Seed: SATGFKQSSKALQRPVASDF
SATGFFQSWKFLQEPVASDF

SEQ ID NO: 23075 - protein, 20 aa, synthetic construct
  source 1..20: note = Seed: SATGFKQSSKALQRPVASDF
SATGFFQSWKFLQFPVASDF

SEQ ID NO: 23076 - protein, 20 aa, synthetic construct
  source 1..20: note = Seed: SATGFKQSSKALQRPVASDF
SATGFFQSWKFLQHPVASDF

SEQ ID NO: 23077 - protein, 20 aa, synthetic construct
  source 1..20: note = Seed: SATGFKQSSKALQRPVASDF
SATGFFQSWKFLQIPVASDF

SEQ ID NO: 23078 - protein, 20 aa, synthetic construct
  source 1..20: note = Seed: SATGFKQSSKALQRPVASDF
SATGFFQSWKFLQLPVASDF

SEQ ID NO: 23079 - protein, 20 aa, synthetic construct
  source 1..20: note = Seed: SATGFKQSSKALQRPVASDF
SATGFFQSWKFLQMPVASDF

SEQ ID NO: 23080 - protein, 20 aa, synthetic construct
  source 1..20: note = Seed: SATGFKQSSKALQRPVASDF
SATGFFQSWKFLQNPVASDF

SEQ ID NO: 23081 - protein, 20 aa, synthetic construct
  source 1..20: note = Seed: SATGFKQSSKALQRPVASDF
SATGFFQSWKFLQRPVASDF

SEQ ID NO: 23082 - protein, 20 aa, synthetic construct
  source 1..20: note = Seed: SATGFKQSSKALQRPVASDF
SATGFFQSWKFLQSPVASDF

SEQ ID NO: 23083 - protein, 20 aa, synthetic construct
  source 1..20: note = Seed: SATGFKQSSKALQRPVASDF
SATGFFQSWKFLQTPVASDF

SEQ ID NO: 23084 - protein, 20 aa, synthetic construct
  source 1..20: note = Seed: SATGFKQSSKALQRPVASDF
SATGFFQSWKFLQVPVASDF

SEQ ID NO: 23085 - protein, 20 aa, synthetic construct
  source 1..20: note = Seed: SATGFKQSSKALQRPVASDF
SATGFFQSWKFLQYPVASDF

SEQ ID NO: 23086 - protein, 20 aa, synthetic construct
  source 1..20: note = Seed: SATGFKQSSKALQRPVASDF
SATGFFQSWKILQFPVASDF

SEQ ID NO: 23087 - protein, 20 aa, synthetic construct
  source 1..20: note = Seed: SATGFKQSSKALQRPVASDF
SATGFFQSWKILQIPVASDF

SEQ ID NO: 23088 - protein, 20 aa, synthetic construct
  source 1..20: note = Seed: SATGFKQSSKALQRPVASDF
SATGFFQSWKILQLPVASDF

SEQ ID NO: 23089 - protein, 20 aa, synthetic construct
  source 1..20: note = Seed: SATGFKQSSKALQRPVASDF
SATGFFQSWKILQMPVASDF

SEQ ID NO: 23090 - protein, 20 aa, synthetic construct
  source 1..20: note = Seed: SATGFKQSSKALQRPVASDF
SATGFFQSWKILQVPVASDF

SEQ ID NO: 23091 - protein, 20 aa, synthetic construct
  source 1..20: note = Seed: SATGFKQSSKALQRPVASDF
SATGFFQSWKILQYPVASDF

SEQ ID NO: 23092 - protein, 20 aa, synthetic construct
  source 1..20: note = Seed: SATGFKQSSKALQRPVASDF
SATGFFQSWKLLQEPVASDF

SEQ ID NO: 23093 - protein, 20 aa, synthetic construct
  source 1..20: note = Seed: SATGFKQSSKALQRPVASDF
SATGFFQSWKLLQFPVASDF

SEQ ID NO: 23094 - protein, 20 aa, synthetic construct
  source 1..20: note = Seed: SATGFKQSSKALQRPVASDF
SATGFFQSWKLLQIPVASDF

SEQ ID NO: 23095 - protein, 20 aa, synthetic construct
  source 1..20: note = Seed: SATGFKQSSKALQRPVASDF
SATGFFQSWKLLQLPVASDF

SEQ ID NO: 23096 - protein, 20 aa, synthetic construct
  source 1..20: note = Seed: SATGFKQSSKALQRPVASDF
SATGFFQSWKLLQMPVASDF

SEQ ID NO: 23097 - protein, 20 aa, synthetic construct
  source 1..20: note = Seed: SATGFKQSSKALQRPVASDF
SATGFFQSWKLLQNPVASDF

SEQ ID NO: 23098 - protein, 20 aa, synthetic construct
  source 1..20: note = Seed: SATGFKQSSKALQRPVASDF
SATGFFQSWKLLQTPVASDF

SEQ ID NO: 23099 - protein, 20 aa, synthetic construct
  source 1..20: note = Seed: SATGFKQSSKALQRPVASDF
SATGFFQSWKLLQVPVASDF

SEQ ID NO: 23100 - protein, 20 aa, synthetic construct
  source 1..20: note = Seed: SATGFKQSSKALQRPVASDF
SATGFFQSWKLLQYPVASDF

SEQ ID NO: 23101 - protein, 20 aa, synthetic construct
  source 1..20: note = Seed: SATGFKQSSKALQRPVASDF
SATGFFQSWKMLQFPVASDF

SEQ ID NO: 23102 - protein, 20 aa, synthetic construct
  source 1..20: note = Seed: SATGFKQSSKALQRPVASDF
SATGFFQSWKMLQIPVASDF

SEQ ID NO: 23103 - protein, 20 aa, synthetic construct
  source 1..20: note = Seed: SATGFKQSSKALQRPVASDF
SATGFFQSWKMLQLPVASDF

SEQ ID NO: 23104 - protein, 20 aa, synthetic construct
  source 1..20: note = Seed: SATGFKQSSKALQRPVASDF
SATGFFQSWKMLQMPVASDF

SEQ ID NO: 23105 - protein, 20 aa, synthetic construct
  source 1..20: note = Seed: SATGFKQSSKALQRPVASDF
SATGFFQSWKMLQVPVASDF

SEQ ID NO: 23106 - protein, 20 aa, synthetic construct
  source 1..20: note = Seed: SATGFKQSSKALQRPVASDF
SATGFFQSWKVLQFPVASDF

SEQ ID NO: 23107 - protein, 20 aa, synthetic construct
  source 1..20: note = Seed: SATGFKQSSKALQRPVASDF
SATGFFQSWKVLQIPVASDF

SEQ ID NO: 23108 - protein, 20 aa, synthetic construct
  source 1..20: note = Seed: SATGFKQSSKALQRPVASDF
SATGFFQSWKVLQLPVASDF

SEQ ID NO: 23109 - protein, 20 aa, synthetic construct
  source 1..20: note = Seed: SATGFKQSSKALQRPVASDF
SATGFFQSWKVLQVPVASDF

SEQ ID NO: 23110 - protein, 20 aa, synthetic construct
  source 1..20: note = Seed: SATGFKQSSKALQRPVASDF
SATGFFQSWKWLQFPVASDF

SEQ ID NO: 23111 - protein, 20 aa, synthetic construct
  source 1..20: note = Seed: SATGFKQSSKALQRPVASDF
SATGFFQSWKWLQIPVASDF

SEQ ID NO: 23112 - protein, 20 aa, synthetic construct
  source 1..20: note = Seed: SATGFKQSSKALQRPVASDF
SATGFFQSWKWLQLPVASDF

SEQ ID NO: 23113 - protein, 20 aa, synthetic construct
  source 1..20: note = Seed: SATGFKQSSKALQRPVASDF
SATGFFQSWKWLQMPVASDF

SEQ ID NO: 23114 - protein, 20 aa, synthetic construct
  source 1..20: note = Seed: SATGFKQSSKALQRPVASDF
SATGFFQSWKWLQVPVASDF

SEQ ID NO: 23115 - protein, 20 aa, synthetic construct
  source 1..20: note = Seed: SATGFKQSSKALQRPVASDF
SATGFFQSWKYLQFPVASDF

SEQ ID NO: 23116 - protein, 20 aa, synthetic construct
  source 1..20: note = Seed: SATGFKQSSKALQRPVASDF
SATGFFQSWKYLQIPVASDF

SEQ ID NO: 23117 - protein, 20 aa, synthetic construct
  source 1..20: note = Seed: SATGFKQSSKALQRPVASDF
SATGFFQSWKYLQLPVASDF

SEQ ID NO: 23118 - protein, 20 aa, synthetic construct
  source 1..20: note = Seed: SATGFKQSSKALQRPVASDF
SATGFFQSWKYLQMPVASDF

SEQ ID NO: 23119 - protein, 20 aa, synthetic construct
  source 1..20: note = Seed: SATGFKQSSKALQRPVASDF
SATGFFQSWKYLQVPVASDF

SEQ ID NO: 23120 - protein, 20 aa, synthetic construct
  source 1..20: note = Seed: SATGFKQSSKALQRPVASDF
SATGFFQSWKYLQYPVASDF

SEQ ID NO: 23121 - protein, 20 aa, synthetic construct
  source 1..20: note = Seed: SATGFKQSSKALQRPVASDF
SATGFFQSYKALQIPVASDF

SEQ ID NO: 23122 - protein, 20 aa, synthetic construct
  source 1..20: note = Seed: SATGFKQSSKALQRPVASDF
SATGFFQSYKALQLPVASDF

SEQ ID NO: 23123 - protein, 20 aa, synthetic construct
  source 1..20: note = Seed: SATGFKQSSKALQRPVASDF
SATGFFQSYKALQVPVASDF

SEQ ID NO: 23124 - protein, 20 aa, synthetic construct
  source 1..20: note = Seed: SATGFKQSSKALQRPVASDF
SATGFFQSYKFLQAPVASDF

SEQ ID NO: 23125 - protein, 20 aa, synthetic construct
  source 1..20: note = Seed: SATGFKQSSKALQRPVASDF
SATGFFQSYKFLQDPVASDF

SEQ ID NO: 23126 - protein, 20 aa, synthetic construct
  source 1..20: note = Seed: SATGFKQSSKALQRPVASDF
SATGFFQSYKFLQEPVASDF

SEQ ID NO: 23127 - protein, 20 aa, synthetic construct
  source 1..20: note = Seed: SATGFKQSSKALQRPVASDF
SATGFFQSYKFLQFPVASDF

SEQ ID NO: 23128 - protein, 20 aa, synthetic construct
  source 1..20: note = Seed: SATGFKQSSKALQRPVASDF
SATGFFQSYKFLQHPVASDF

SEQ ID NO: 23129 - protein, 20 aa, synthetic construct
  source 1..20: note = Seed: SATGFKQSSKALQRPVASDF
SATGFFQSYKFLQIPVASDF

SEQ ID NO: 23130 - protein, 20 aa, synthetic construct
  source 1..20: note = Seed: SATGFKQSSKALQRPVASDF
SATGFFQSYKFLQLPVASDF

SEQ ID NO: 23131 - protein, 20 aa, synthetic construct
  source 1..20: note = Seed: SATGFKQSSKALQRPVASDF
SATGFFQSYKFLQMPVASDF

SEQ ID NO: 23132 - protein, 20 aa, synthetic construct
  source 1..20: note = Seed: SATGFKQSSKALQRPVASDF
SATGFFQSYKFLQNPVASDF

SEQ ID NO: 23133 - protein, 20 aa, synthetic construct
  source 1..20: note = Seed: SATGFKQSSKALQRPVASDF
SATGFFQSYKFLQRPVASDF

SEQ ID NO: 23134 - protein, 20 aa, synthetic construct
  source 1..20: note = Seed: SATGFKQSSKALQRPVASDF
SATGFFQSYKFLQSPVASDF

SEQ ID NO: 23135 - protein, 20 aa, synthetic construct
  source 1..20: note = Seed: SATGFKQSSKALQRPVASDF
SATGFFQSYKFLQTPVASDF

SEQ ID NO: 23136 - protein, 20 aa, synthetic construct
  source 1..20: note = Seed: SATGFKQSSKALQRPVASDF
SATGFFQSYKFLQVPVASDF

SEQ ID NO: 23137 - protein, 20 aa, synthetic construct
  source 1..20: note = Seed: SATGFKQSSKALQRPVASDF
SATGFFQSYKFLQYPVASDF

SEQ ID NO: 23138 - protein, 20 aa, synthetic construct
  source 1..20: note = Seed: SATGFKQSSKALQRPVASDF
SATGFFQSYKILQEPVASDF

SEQ ID NO: 23139 - protein, 20 aa, synthetic construct
  source 1..20: note = Seed: SATGFKQSSKALQRPVASDF
SATGFFQSYKILQFPVASDF

SEQ ID NO: 23140 - protein, 20 aa, synthetic construct
  source 1..20: note = Seed: SATGFKQSSKALQRPVASDF
SATGFFQSYKILQIPVASDF

SEQ ID NO: 23141 - protein, 20 aa, synthetic construct
  source 1..20: note = Seed: SATGFKQSSKALQRPVASDF
SATGFFQSYKILQLPVASDF

SEQ ID NO: 23142 - protein, 20 aa, synthetic construct
  source 1..20: note = Seed: SATGFKQSSKALQRPVASDF
SATGFFQSYKILQMPVASDF

SEQ ID NO: 23143 - protein, 20 aa, synthetic construct
  source 1..20: note = Seed: SATGFKQSSKALQRPVASDF
SATGFFQSYKILQNPVASDF

SEQ ID NO: 23144 - protein, 20 aa, synthetic construct
  source 1..20: note = Seed: SATGFKQSSKALQRPVASDF
SATGFFQSYKILQVPVASDF

SEQ ID NO: 23145 - protein, 20 aa, synthetic construct
  source 1..20: note = Seed: SATGFKQSSKALQRPVASDF
SATGFFQSYKILQYPVASDF

SEQ ID NO: 23146 - protein, 20 aa, synthetic construct
  source 1..20: note = Seed: SATGFKQSSKALQRPVASDF
SATGFFQSYKLLQEPVASDF

SEQ ID NO: 23147 - protein, 20 aa, synthetic construct
  source 1..20: note = Seed: SATGFKQSSKALQRPVASDF
SATGFFQSYKLLQFPVASDF

SEQ ID NO: 23148 - protein, 20 aa, synthetic construct
  source 1..20: note = Seed: SATGFKQSSKALQRPVASDF
SATGFFQSYKLLQHPVASDF

SEQ ID NO: 23149 - protein, 20 aa, synthetic construct
  source 1..20: note = Seed: SATGFKQSSKALQRPVASDF
SATGFFQSYKLLQIPVASDF

SEQ ID NO: 23150 - protein, 20 aa, synthetic construct
  source 1..20: note = Seed: SATGFKQSSKALQRPVASDF
SATGFFQSYKLLQLPVASDF

SEQ ID NO: 23151 - protein, 20 aa, synthetic construct
  source 1..20: note = Seed: SATGFKQSSKALQRPVASDF
SATGFFQSYKLLQMPVASDF

SEQ ID NO: 23152 - protein, 20 aa, synthetic construct
  source 1..20: note = Seed: SATGFKQSSKALQRPVASDF
SATGFFQSYKLLQNPVASDF

SEQ ID NO: 23153 - protein, 20 aa, synthetic construct
  source 1..20: note = Seed: SATGFKQSSKALQRPVASDF
SATGFFQSYKLLQSPVASDF

SEQ ID NO: 23154 - protein, 20 aa, synthetic construct
  source 1..20: note = Seed: SATGFKQSSKALQRPVASDF
SATGFFQSYKLLQTPVASDF

SEQ ID NO: 23155 - protein, 20 aa, synthetic construct
  source 1..20: note = Seed: SATGFKQSSKALQRPVASDF
SATGFFQSYKLLQVPVASDF

SEQ ID NO: 23156 - protein, 20 aa, synthetic construct
  source 1..20: note = Seed: SATGFKQSSKALQRPVASDF
SATGFFQSYKLLQYPVASDF

SEQ ID NO: 23157 - protein, 20 aa, synthetic construct
  source 1..20: note = Seed: SATGFKQSSKALQRPVASDF
SATGFFQSYKMLQFPVASDF

SEQ ID NO: 23158 - protein, 20 aa, synthetic construct
  source 1..20: note = Seed: SATGFKQSSKALQRPVASDF
SATGFFQSYKMLQIPVASDF

SEQ ID NO: 23159 - protein, 20 aa, synthetic construct
  source 1..20: note = Seed: SATGFKQSSKALQRPVASDF
SATGFFQSYKMLQLPVASDF

SEQ ID NO: 23160 - protein, 20 aa, synthetic construct
  source 1..20: note = Seed: SATGFKQSSKALQRPVASDF
SATGFFQSYKMLQMPVASDF

SEQ ID NO: 23161 - protein, 20 aa, synthetic construct
  source 1..20: note = Seed: SATGFKQSSKALQRPVASDF
SATGFFQSYKMLQVPVASDF

SEQ ID NO: 23162 - protein, 20 aa, synthetic construct
  source 1..20: note = Seed: SATGFKQSSKALQRPVASDF
SATGFFQSYKMLQYPVASDF

SEQ ID NO: 23163 - protein, 20 aa, synthetic construct
  source 1..20: note = Seed: SATGFKQSSKALQRPVASDF
SATGFFQSYKVLQFPVASDF

SEQ ID NO: 23164 - protein, 20 aa, synthetic construct
  source 1..20: note = Seed: SATGFKQSSKALQRPVASDF
SATGFFQSYKVLQIPVASDF

SEQ ID NO: 23165 - protein, 20 aa, synthetic construct
  source 1..20: note = Seed: SATGFKQSSKALQRPVASDF
SATGFFQSYKVLQLPVASDF

SEQ ID NO: 23166 - protein, 20 aa, synthetic construct
  source 1..20: note = Seed: SATGFKQSSKALQRPVASDF
SATGFFQSYKVLQVPVASDF

SEQ ID NO: 23167 - protein, 20 aa, synthetic construct
  source 1..20: note = Seed: SATGFKQSSKALQRPVASDF
SATGFFQSYKWLQIPVASDF

SEQ ID NO: 23168 - protein, 20 aa, synthetic construct
  source 1..20: note = Seed: SATGFKQSSKALQRPVASDF
SATGFFQSYKWLQLPVASDF

SEQ ID NO: 23169 - protein, 20 aa, synthetic construct
  source 1..20: note = Seed: SATGFKQSSKALQRPVASDF
SATGFFQSYKWLQMPVASDF

SEQ ID NO: 23170 - protein, 20 aa, synthetic construct
  source 1..20: note = Seed: SATGFKQSSKALQRPVASDF
SATGFFQSYKWLQVPVASDF

SEQ ID NO: 23171 - protein, 20 aa, synthetic construct
  source 1..20: note = Seed: SATGFKQSSKALQRPVASDF
SATGFFQSYKYLQIPVASDF

SEQ ID NO: 23172 - protein, 20 aa, synthetic construct
  source 1..20: note = Seed: SATGFKQSSKALQRPVASDF
SATGFFQSYKYLQLPVASDF

SEQ ID NO: 23173 - protein, 20 aa, synthetic construct
  source 1..20: note = Seed: SATGFKQSSKALQRPVASDF
SATGFFQSYKYLQMPVASDF

SEQ ID NO: 23174 - protein, 20 aa, synthetic construct
  source 1..20: note = Seed: SATGFKQSSKALQRPVASDF
SATGFFQSYKYLQVPVASDF

SEQ ID NO: 23175 - protein, 20 aa, synthetic construct
  source 1..20: note = Seed: SATGFKQSSKALQRPVASDF
SATGFFQSYKYLQYPVASDF

SEQ ID NO: 23176 - protein, 20 aa, synthetic construct
  source 1..20: note = Seed: SATGFKQSSKALQRPVASDF
SATGFHQSFKFLQIPVASDF

SEQ ID NO: 23177 - protein, 20 aa, synthetic construct
  source 1..20: note = Seed: SATGFKQSSKALQRPVASDF
SATGFHQSFKFLQLPVASDF

SEQ ID NO: 23178 - protein, 20 aa, synthetic construct
  source 1..20: note = Seed: SATGFKQSSKALQRPVASDF
SATGFHQSFKFLQMPVASDF

SEQ ID NO: 23179 - protein, 20 aa, synthetic construct
  source 1..20: note = Seed: SATGFKQSSKALQRPVASDF
SATGFHQSFKFLQVPVASDF

SEQ ID NO: 23180 - protein, 20 aa, synthetic construct
  source 1..20: note = Seed: SATGFKQSSKALQRPVASDF
SATGFHQSIKFLQIPVASDF

SEQ ID NO: 23181 - protein, 20 aa, synthetic construct
  source 1..20: note = Seed: SATGFKQSSKALQRPVASDF
SATGFHQSIKFLQLPVASDF

SEQ ID NO: 23182 - protein, 20 aa, synthetic construct
  source 1..20: note = Seed: SATGFKQSSKALQRPVASDF
SATGFHQSIKFLQVPVASDF

SEQ ID NO: 23183 - protein, 20 aa, synthetic construct
  source 1..20: note = Seed: SATGFKQSSKALQRPVASDF
SATGFHQSLKFLQIPVASDF

SEQ ID NO: 23184 - protein, 20 aa, synthetic construct
  source 1..20: note = Seed: SATGFKQSSKALQRPVASDF
SATGFHQSLKFLQLPVASDF

SEQ ID NO: 23185 - protein, 20 aa, synthetic construct
  source 1..20: note = Seed: SATGFKQSSKALQRPVASDF
SATGFHQSLKFLQVPVASDF

SEQ ID NO: 23186 - protein, 20 aa, synthetic construct
  source 1..20: note = Seed: SATGFKQSSKALQRPVASDF
SATGFHQSMKFLQIPVASDF

SEQ ID NO: 23187 - protein, 20 aa, synthetic construct
  source 1..20: note = Seed: SATGFKQSSKALQRPVASDF
SATGFHQSMKFLQLPVASDF

SEQ ID NO: 23188 - protein, 20 aa, synthetic construct
  source 1..20: note = Seed: SATGFKQSSKALQRPVASDF
SATGFHQSMKFLQVPVASDF

SEQ ID NO: 23189 - protein, 20 aa, synthetic construct
  source 1..20: note = Seed: SATGFKQSSKALQRPVASDF
SATGFHQSVKFLQFPVASDF

SEQ ID NO: 23190 - protein, 20 aa, synthetic construct
  source 1..20: note = Seed: SATGFKQSSKALQRPVASDF
SATGFHQSVKFLQIPVASDF

SEQ ID NO: 23191 - protein, 20 aa, synthetic construct
  source 1..20: note = Seed: SATGFKQSSKALQRPVASDF
SATGFHQSVKFLQLPVASDF

SEQ ID NO: 23192 - protein, 20 aa, synthetic construct
  source 1..20: note = Seed: SATGFKQSSKALQRPVASDF
SATGFHQSVKFLQVPVASDF

SEQ ID NO: 23193 - protein, 20 aa, synthetic construct
  source 1..20: note = Seed: SATGFKQSSKALQRPVASDF
SATGFHQSWKFLQIPVASDF

SEQ ID NO: 23194 - protein, 20 aa, synthetic construct
  source 1..20: note = Seed: SATGFKQSSKALQRPVASDF
SATGFHQSWKFLQLPVASDF

SEQ ID NO: 23195 - protein, 20 aa, synthetic construct
  source 1..20: note = Seed: SATGFKQSSKALQRPVASDF
SATGFIQSAKALQAPVASDF

SEQ ID NO: 23196 - protein, 20 aa, synthetic construct
  source 1..20: note = Seed: SATGFKQSSKALQRPVASDF
SATGFIQSAKALQSPVASDF

SEQ ID NO: 23197 - protein, 20 aa, synthetic construct
  source 1..20: note = Seed: SATGFKQSSKALQRPVASDF
SATGFIQSAKFLQAPVASDF

SEQ ID NO: 23198 - protein, 20 aa, synthetic construct
  source 1..20: note = Seed: SATGFKQSSKALQRPVASDF
SATGFIQSAKFLQDPVASDF

SEQ ID NO: 23199 - protein, 20 aa, synthetic construct
  source 1..20: note = Seed: SATGFKQSSKALQRPVASDF
SATGFIQSAKFLQEPVASDF

SEQ ID NO: 23200 - protein, 20 aa, synthetic construct
  source 1..20: note = Seed: SATGFKQSSKALQRPVASDF
SATGFIQSAKFLQFPVASDF

SEQ ID NO: 23201 - protein, 20 aa, synthetic construct
  source 1..20: note = Seed: SATGFKQSSKALQRPVASDF
SATGFIQSAKFLQIPVASDF

SEQ ID NO: 23202 - protein, 20 aa, synthetic construct
  source 1..20: note = Seed: SATGFKQSSKALQRPVASDF
SATGFIQSAKFLQLPVASDF

SEQ ID NO: 23203 - protein, 20 aa, synthetic construct
  source 1..20: note = Seed: SATGFKQSSKALQRPVASDF
SATGFIQSAKFLQMPVASDF

SEQ ID NO: 23204 - protein, 20 aa, synthetic construct
  source 1..20: note = Seed: SATGFKQSSKALQRPVASDF
SATGFIQSAKFLQNPVASDF

SEQ ID NO: 23205 - protein, 20 aa, synthetic construct
  source 1..20: note = Seed: SATGFKQSSKALQRPVASDF
SATGFIQSAKFLQSPVASDF

SEQ ID NO: 23206 - protein, 20 aa, synthetic construct
  source 1..20: note = Seed: SATGFKQSSKALQRPVASDF
SATGFIQSAKFLQTPVASDF

SEQ ID NO: 23207 - protein, 20 aa, synthetic construct
  source 1..20: note = Seed: SATGFKQSSKALQRPVASDF
SATGFIQSAKFLQVPVASDF

SEQ ID NO: 23208 - protein, 20 aa, synthetic construct
  source 1..20: note = Seed: SATGFKQSSKALQRPVASDF
SATGFIQSAKFLQYPVASDF

SEQ ID NO: 23209 - protein, 20 aa, synthetic construct
  source 1..20: note = Seed: SATGFKQSSKALQRPVASDF
SATGFIQSAKILQAPVASDF

SEQ ID NO: 23210 - protein, 20 aa, synthetic construct
  source 1..20: note = Seed: SATGFKQSSKALQRPVASDF
SATGFIQSAKILQSPVASDF

SEQ ID NO: 23211 - protein, 20 aa, synthetic construct
  source 1..20: note = Seed: SATGFKQSSKALQRPVASDF
SATGFIQSAKPLQAPVASDF

SEQ ID NO: 23212 - protein, 20 aa, synthetic construct
  source 1..20: note = Seed: SATGFKQSSKALQRPVASDF
SATGFIQSAKPLQSPVASDF

SEQ ID NO: 23213 - protein, 20 aa, synthetic construct
  source 1..20: note = Seed: SATGFKQSSKALQRPVASDF
SATGFIQSAKVLQAPVASDF

SEQ ID NO: 23214 - protein, 20 aa, synthetic construct
  source 1..20: note = Seed: SATGFKQSSKALQRPVASDF
SATGFIQSAKVLQSPVASDF

SEQ ID NO: 23215 - protein, 20 aa, synthetic construct
  source 1..20: note = Seed: SATGFKQSSKALQRPVASDF
SATGFIQSAKYLQFPVASDF

SEQ ID NO: 23216 - protein, 20 aa, synthetic construct
  source 1..20: note = Seed: SATGFKQSSKALQRPVASDF
SATGFIQSAKYLQIPVASDF

SEQ ID NO: 23217 - protein, 20 aa, synthetic construct
  source 1..20: note = Seed: SATGFKQSSKALQRPVASDF
SATGFIQSAKYLQLPVASDF

SEQ ID NO: 23218 - protein, 20 aa, synthetic construct
  source 1..20: note = Seed: SATGFKQSSKALQRPVASDF
SATGFIQSAKYLQVPVASDF

SEQ ID NO: 23219 - protein, 20 aa, synthetic construct
  source 1..20: note = Seed: SATGFKQSSKALQRPVASDF
SATGFIQSCKFLQFPVASDF

SEQ ID NO: 23220 - protein, 20 aa, synthetic construct
  source 1..20: note = Seed: SATGFKQSSKALQRPVASDF
SATGFIQSCKFLQIPVASDF

SEQ ID NO: 23221 - protein, 20 aa, synthetic construct
  source 1..20: note = Seed: SATGFKQSSKALQRPVASDF
SATGFIQSCKFLQLPVASDF

SEQ ID NO: 23222 - protein, 20 aa, synthetic construct
  source 1..20: note = Seed: SATGFKQSSKALQRPVASDF
SATGFIQSCKFLQVPVASDF

SEQ ID NO: 23223 - protein, 20 aa, synthetic construct
  source 1..20: note = Seed: SATGFKQSSKALQRPVASDF
SATGFIQSDKFLQFPVASDF

SEQ ID NO: 23224 - protein, 20 aa, synthetic construct
  source 1..20: note = Seed: SATGFKQSSKALQRPVASDF
SATGFIQSDKFLQIPVASDF

SEQ ID NO: 23225 - protein, 20 aa, synthetic construct
  source 1..20: note = Seed: SATGFKQSSKALQRPVASDF
SATGFIQSDKFLQLPVASDF

SEQ ID NO: 23226 - protein, 20 aa, synthetic construct
  source 1..20: note = Seed: SATGFKQSSKALQRPVASDF
SATGFIQSDKFLQVPVASDF

SEQ ID NO: 23227 - protein, 20 aa, synthetic construct
  source 1..20: note = Seed: SATGFKQSSKALQRPVASDF
SATGFIQSEKFLQAPVASDF

SEQ ID NO: 23228 - protein, 20 aa, synthetic construct
  source 1..20: note = Seed: SATGFKQSSKALQRPVASDF
SATGFIQSEKFLQEPVASDF

SEQ ID NO: 23229 - protein, 20 aa, synthetic construct
  source 1..20: note = Seed: SATGFKQSSKALQRPVASDF
SATGFIQSEKFLQFPVASDF

SEQ ID NO: 23230 - protein, 20 aa, synthetic construct
  source 1..20: note = Seed: SATGFKQSSKALQRPVASDF
SATGFIQSEKFLQIPVASDF

SEQ ID NO: 23231 - protein, 20 aa, synthetic construct
  source 1..20: note = Seed: SATGFKQSSKALQRPVASDF
SATGFIQSEKFLQLPVASDF

SEQ ID NO: 23232 - protein, 20 aa, synthetic construct
  source 1..20: note = Seed: SATGFKQSSKALQRPVASDF
SATGFIQSEKFLQMPVASDF

SEQ ID NO: 23233 - protein, 20 aa, synthetic construct
  source 1..20: note = Seed: SATGFKQSSKALQRPVASDF
SATGFIQSEKFLQNPVASDF

SEQ ID NO: 23234 - protein, 20 aa, synthetic construct
  source 1..20: note = Seed: SATGFKQSSKALQRPVASDF
SATGFIQSEKFLQSPVASDF

SEQ ID NO: 23235 - protein, 20 aa, synthetic construct
  source 1..20: note = Seed: SATGFKQSSKALQRPVASDF
SATGFIQSEKFLQTPVASDF

SEQ ID NO: 23236 - protein, 20 aa, synthetic construct
  source 1..20: note = Seed: SATGFKQSSKALQRPVASDF
SATGFIQSEKFLQVPVASDF

SEQ ID NO: 23237 - protein, 20 aa, synthetic construct
  source 1..20: note = Seed: SATGFKQSSKALQRPVASDF
SATGFIQSEKFLQYPVASDF

SEQ ID NO: 23238 - protein, 20 aa, synthetic construct
  source 1..20: note = Seed: SATGFKQSSKALQRPVASDF
SATGFIQSEKILQIPVASDF

SEQ ID NO: 23239 - protein, 20 aa, synthetic construct
  source 1..20: note = Seed: SATGFKQSSKALQRPVASDF
SATGFIQSEKLLQIPVASDF

SEQ ID NO: 23240 - protein, 20 aa, synthetic construct
  source 1..20: note = Seed: SATGFKQSSKALQRPVASDF
SATGFIQSEKLLQLPVASDF

SEQ ID NO: 23241 - protein, 20 aa, synthetic construct
  source 1..20: note = Seed: SATGFKQSSKALQRPVASDF
SATGFIQSEKLLQVPVASDF

SEQ ID NO: 23242 - protein, 20 aa, synthetic construct
  source 1..20: note = Seed: SATGFKQSSKALQRPVASDF
SATGFIQSEKWLQIPVASDF

SEQ ID NO: 23243 - protein, 20 aa, synthetic construct
  source 1..20: note = Seed: SATGFKQSSKALQRPVASDF
SATGFIQSEKYLQIPVASDF

SEQ ID NO: 23244 - protein, 20 aa, synthetic construct
  source 1..20: note = Seed: SATGFKQSSKALQRPVASDF
SATGFIQSEKYLQLPVASDF

SEQ ID NO: 23245 - protein, 20 aa, synthetic construct
  source 1..20: note = Seed: SATGFKQSSKALQRPVASDF
SATGFIQSFKALQIPVASDF

SEQ ID NO: 23246 - protein, 20 aa, synthetic construct
  source 1..20: note = Seed: SATGFKQSSKALQRPVASDF
SATGFIQSFKALQLPVASDF

SEQ ID NO: 23247 - protein, 20 aa, synthetic construct
  source 1..20: note = Seed: SATGFKQSSKALQRPVASDF
SATGFIQSFKALQVPVASDF

SEQ ID NO: 23248 - protein, 20 aa, synthetic construct
  source 1..20: note = Seed: SATGFKQSSKALQRPVASDF
SATGFIQSFKFLQAPVASDF

SEQ ID NO: 23249 - protein, 20 aa, synthetic construct
  source 1..20: note = Seed: SATGFKQSSKALQRPVASDF
SATGFIQSFKFLQDPVASDF

SEQ ID NO: 23250 - protein, 20 aa, synthetic construct
  source 1..20: note = Seed: SATGFKQSSKALQRPVASDF
SATGFIQSFKFLQEPVASDF

SEQ ID NO: 23251 - protein, 20 aa, synthetic construct
  source 1..20: note = Seed: SATGFKQSSKALQRPVASDF
SATGFIQSFKFLQHPVASDF

SEQ ID NO: 23252 - protein, 20 aa, synthetic construct
  source 1..20: note = Seed: SATGFKQSSKALQRPVASDF
SATGFIQSFKFLQIPVASDF

SEQ ID NO: 23253 - protein, 20 aa, synthetic construct
  source 1..20: note = Seed: SATGFKQSSKALQRPVASDF
SATGFIQSFKFLQLPVASDF

SEQ ID NO: 23254 - protein, 20 aa, synthetic construct
  source 1..20: note = Seed: SATGFKQSSKALQRPVASDF
SATGFIQSFKFLQMPVASDF

SEQ ID NO: 23255 - protein, 20 aa, synthetic construct
  source 1..20: note = Seed: SATGFKQSSKALQRPVASDF
SATGFIQSFKFLQNPVASDF

SEQ ID NO: 23256 - protein, 20 aa, synthetic construct
  source 1..20: note = Seed: SATGFKQSSKALQRPVASDF
SATGFIQSFKFLQSPVASDF

SEQ ID NO: 23257 - protein, 20 aa, synthetic construct
  source 1..20: note = Seed: SATGFKQSSKALQRPVASDF
SATGFIQSFKFLQTPVASDF

SEQ ID NO: 23258 - protein, 20 aa, synthetic construct
  source 1..20: note = Seed: SATGFKQSSKALQRPVASDF
SATGFIQSFKFLQVPVASDF

SEQ ID NO: 23259 - protein, 20 aa, synthetic construct
  source 1..20: note = Seed: SATGFKQSSKALQRPVASDF
SATGFIQSFKFLQYPVASDF

SEQ ID NO: 23260 - protein, 20 aa, synthetic construct
  source 1..20: note = Seed: SATGFKQSSKALQRPVASDF
SATGFIQSFKILQIPVASDF

SEQ ID NO: 23261 - protein, 20 aa, synthetic construct
  source 1..20: note = Seed: SATGFKQSSKALQRPVASDF
SATGFIQSFKILQLPVASDF

SEQ ID NO: 23262 - protein, 20 aa, synthetic construct
  source 1..20: note = Seed: SATGFKQSSKALQRPVASDF
SATGFIQSFKILQMPVASDF

SEQ ID NO: 23263 - protein, 20 aa, synthetic construct
  source 1..20: note = Seed: SATGFKQSSKALQRPVASDF
SATGFIQSFKILQVPVASDF

SEQ ID NO: 23264 - protein, 20 aa, synthetic construct
  source 1..20: note = Seed: SATGFKQSSKALQRPVASDF
SATGFIQSFKILQYPVASDF

SEQ ID NO: 23265 - protein, 20 aa, synthetic construct
  source 1..20: note = Seed: SATGFKQSSKALQRPVASDF
SATGFIQSFKLLQIPVASDF

SEQ ID NO: 23266 - protein, 20 aa, synthetic construct
  source 1..20: note = Seed: SATGFKQSSKALQRPVASDF
SATGFIQSFKLLQLPVASDF

SEQ ID NO: 23267 - protein, 20 aa, synthetic construct
  source 1..20: note = Seed: SATGFKQSSKALQRPVASDF
SATGFIQSFKLLQMPVASDF

SEQ ID NO: 23268 - protein, 20 aa, synthetic construct
  source 1..20: note = Seed: SATGFKQSSKALQRPVASDF
SATGFIQSFKLLQNPVASDF

SEQ ID NO: 23269 - protein, 20 aa, synthetic construct
  source 1..20: note = Seed: SATGFKQSSKALQRPVASDF
SATGFIQSFKLLQVPVASDF

SEQ ID NO: 23270 - protein, 20 aa, synthetic construct
  source 1..20: note = Seed: SATGFKQSSKALQRPVASDF
SATGFIQSFKLLQYPVASDF

SEQ ID NO: 23271 - protein, 20 aa, synthetic construct
  source 1..20: note = Seed: SATGFKQSSKALQRPVASDF
SATGFIQSFKMLQIPVASDF

SEQ ID NO: 23272 - protein, 20 aa, synthetic construct
  source 1..20: note = Seed: SATGFKQSSKALQRPVASDF
SATGFIQSFKMLQLPVASDF

SEQ ID NO: 23273 - protein, 20 aa, synthetic construct
  source 1..20: note = Seed: SATGFKQSSKALQRPVASDF
SATGFIQSFKMLQVPVASDF

SEQ ID NO: 23274 - protein, 20 aa, synthetic construct
  source 1..20: note = Seed: SATGFKQSSKALQRPVASDF
SATGFIQSFKMLQYPVASDF

SEQ ID NO: 23275 - protein, 20 aa, synthetic construct
  source 1..20: note = Seed: SATGFKQSSKALQRPVASDF
SATGFIQSFKWLQIPVASDF

SEQ ID NO: 23276 - protein, 20 aa, synthetic construct
  source 1..20: note = Seed: SATGFKQSSKALQRPVASDF
SATGFIQSFKWLQLPVASDF

SEQ ID NO: 23277 - protein, 20 aa, synthetic construct
  source 1..20: note = Seed: SATGFKQSSKALQRPVASDF
SATGFIQSFKYLQIPVASDF

SEQ ID NO: 23278 - protein, 20 aa, synthetic construct
  source 1..20: note = Seed: SATGFKQSSKALQRPVASDF
SATGFIQSFKYLQLPVASDF

SEQ ID NO: 23279 - protein, 20 aa, synthetic construct
  source 1..20: note = Seed: SATGFKQSSKALQRPVASDF
SATGFIQSFKYLQMPVASDF

SEQ ID NO: 23280 - protein, 20 aa, synthetic construct
  source 1..20: note = Seed: SATGFKQSSKALQRPVASDF
SATGFIQSFKYLQVPVASDF

SEQ ID NO: 23281 - protein, 20 aa, synthetic construct
  source 1..20: note = Seed: SATGFKQSSKALQRPVASDF
SATGFIQSFKYLQYPVASDF

SEQ ID NO: 23282 - protein, 20 aa, synthetic construct
  source 1..20: note = Seed: SATGFKQSSKALQRPVASDF
SATGFIQSGKALQAPVASDF

SEQ ID NO: 23283 - protein, 20 aa, synthetic construct
  source 1..20: note = Seed: SATGFKQSSKALQRPVASDF
SATGFIQSGKFLQIPVASDF

SEQ ID NO: 23284 - protein, 20 aa, synthetic construct
  source 1..20: note = Seed: SATGFKQSSKALQRPVASDF
SATGFIQSGKFLQLPVASDF

SEQ ID NO: 23285 - protein, 20 aa, synthetic construct
  source 1..20: note = Seed: SATGFKQSSKALQRPVASDF
SATGFIQSGKILQAPVASDF

SEQ ID NO: 23286 - protein, 20 aa, synthetic construct
  source 1..20: note = Seed: SATGFKQSSKALQRPVASDF
SATGFIQSGKVLQAPVASDF

SEQ ID NO: 23287 - protein, 20 aa, synthetic construct
  source 1..20: note = Seed: SATGFKQSSKALQRPVASDF
SATGFIQSHKFLQAPVASDF

SEQ ID NO: 23288 - protein, 20 aa, synthetic construct
  source 1..20: note = Seed: SATGFKQSSKALQRPVASDF
SATGFIQSHKFLQDPVASDF

SEQ ID NO: 23289 - protein, 20 aa, synthetic construct
  source 1..20: note = Seed: SATGFKQSSKALQRPVASDF
SATGFIQSHKFLQEPVASDF

SEQ ID NO: 23290 - protein, 20 aa, synthetic construct
  source 1..20: note = Seed: SATGFKQSSKALQRPVASDF
SATGFIQSHKFLQFPVASDF

SEQ ID NO: 23291 - protein, 20 aa, synthetic construct
  source 1..20: note = Seed: SATGFKQSSKALQRPVASDF
SATGFIQSHKFLQHPVASDF

SEQ ID NO: 23292 - protein, 20 aa, synthetic construct
  source 1..20: note = Seed: SATGFKQSSKALQRPVASDF
SATGFIQSHKFLQIPVASDF

SEQ ID NO: 23293 - protein, 20 aa, synthetic construct
  source 1..20: note = Seed: SATGFKQSSKALQRPVASDF
SATGFIQSHKFLQKPVASDF

SEQ ID NO: 23294 - protein, 20 aa, synthetic construct
  source 1..20: note = Seed: SATGFKQSSKALQRPVASDF
SATGFIQSHKFLQLPVASDF

SEQ ID NO: 23295 - protein, 20 aa, synthetic construct
  source 1..20: note = Seed: SATGFKQSSKALQRPVASDF
SATGFIQSHKFLQMPVASDF

SEQ ID NO: 23296 - protein, 20 aa, synthetic construct
  source 1..20: note = Seed: SATGFKQSSKALQRPVASDF
SATGFIQSHKFLQNPVASDF

SEQ ID NO: 23297 - protein, 20 aa, synthetic construct
  source 1..20: note = Seed: SATGFKQSSKALQRPVASDF
SATGFIQSHKFLQRPVASDF

SEQ ID NO: 23298 - protein, 20 aa, synthetic construct
  source 1..20: note = Seed: SATGFKQSSKALQRPVASDF
SATGFIQSHKFLQSPVASDF

SEQ ID NO: 23299 - protein, 20 aa, synthetic construct
  source 1..20: note = Seed: SATGFKQSSKALQRPVASDF
SATGFIQSHKFLQTPVASDF

SEQ ID NO: 23300 - protein, 20 aa, synthetic construct
  source 1..20: note = Seed: SATGFKQSSKALQRPVASDF
SATGFIQSHKFLQVPVASDF

SEQ ID NO: 23301 - protein, 20 aa, synthetic construct
  source 1..20: note = Seed: SATGFKQSSKALQRPVASDF
SATGFIQSHKFLQWPVASDF

SEQ ID NO: 23302 - protein, 20 aa, synthetic construct
  source 1..20: note = Seed: SATGFKQSSKALQRPVASDF
SATGFIQSHKFLQYPVASDF

SEQ ID NO: 23303 - protein, 20 aa, synthetic construct
  source 1..20: note = Seed: SATGFKQSSKALQRPVASDF
SATGFIQSHKILQFPVASDF

SEQ ID NO: 23304 - protein, 20 aa, synthetic construct
  source 1..20: note = Seed: SATGFKQSSKALQRPVASDF
SATGFIQSHKILQIPVASDF

SEQ ID NO: 23305 - protein, 20 aa, synthetic construct
  source 1..20: note = Seed: SATGFKQSSKALQRPVASDF
SATGFIQSHKILQLPVASDF

SEQ ID NO: 23306 - protein, 20 aa, synthetic construct
  source 1..20: note = Seed: SATGFKQSSKALQRPVASDF
SATGFIQSHKILQVPVASDF

SEQ ID NO: 23307 - protein, 20 aa, synthetic construct
  source 1..20: note = Seed: SATGFKQSSKALQRPVASDF
SATGFIQSHKLLQFPVASDF

SEQ ID NO: 23308 - protein, 20 aa, synthetic construct
  source 1..20: note = Seed: SATGFKQSSKALQRPVASDF
SATGFIQSHKLLQIPVASDF

SEQ ID NO: 23309 - protein, 20 aa, synthetic construct
  source 1..20: note = Seed: SATGFKQSSKALQRPVASDF
SATGFIQSHKLLQLPVASDF

SEQ ID NO: 23310 - protein, 20 aa, synthetic construct
  source 1..20: note = Seed: SATGFKQSSKALQRPVASDF
SATGFIQSHKLLQMPVASDF

SEQ ID NO: 23311 - protein, 20 aa, synthetic construct
  source 1..20: note = Seed: SATGFKQSSKALQRPVASDF
SATGFIQSHKLLQVPVASDF

SEQ ID NO: 23312 - protein, 20 aa, synthetic construct
  source 1..20: note = Seed: SATGFKQSSKALQRPVASDF
SATGFIQSHKMLQFPVASDF

SEQ ID NO: 23313 - protein, 20 aa, synthetic construct
  source 1..20: note = Seed: SATGFKQSSKALQRPVASDF
SATGFIQSHKMLQIPVASDF

SEQ ID NO: 23314 - protein, 20 aa, synthetic construct
  source 1..20: note = Seed: SATGFKQSSKALQRPVASDF
SATGFIQSHKMLQLPVASDF

SEQ ID NO: 23315 - protein, 20 aa, synthetic construct
  source 1..20: note = Seed: SATGFKQSSKALQRPVASDF
SATGFIQSHKMLQVPVASDF

SEQ ID NO: 23316 - protein, 20 aa, synthetic construct
  source 1..20: note = Seed: SATGFKQSSKALQRPVASDF
SATGFIQSHKWLQFPVASDF

SEQ ID NO: 23317 - protein, 20 aa, synthetic construct
  source 1..20: note = Seed: SATGFKQSSKALQRPVASDF
SATGFIQSHKWLQIPVASDF

SEQ ID NO: 23318 - protein, 20 aa, synthetic construct
  source 1..20: note = Seed: SATGFKQSSKALQRPVASDF
SATGFIQSHKWLQLPVASDF

SEQ ID NO: 23319 - protein, 20 aa, synthetic construct
  source 1..20: note = Seed: SATGFKQSSKALQRPVASDF
SATGFIQSHKWLQVPVASDF

SEQ ID NO: 23320 - protein, 20 aa, synthetic construct
  source 1..20: note = Seed: SATGFKQSSKALQRPVASDF
SATGFIQSHKYLQFPVASDF

SEQ ID NO: 23321 - protein, 20 aa, synthetic construct
  source 1..20: note = Seed: SATGFKQSSKALQRPVASDF
SATGFIQSHKYLQIPVASDF

SEQ ID NO: 23322 - protein, 20 aa, synthetic construct
  source 1..20: note = Seed: SATGFKQSSKALQRPVASDF
SATGFIQSHKYLQLPVASDF

SEQ ID NO: 23323 - protein, 20 aa, synthetic construct
  source 1..20: note = Seed: SATGFKQSSKALQRPVASDF
SATGFIQSHKYLQVPVASDF

SEQ ID NO: 23324 - protein, 20 aa, synthetic construct
  source 1..20: note = Seed: SATGFKQSSKALQRPVASDF
SATGFIQSIKFLQAPVASDF

SEQ ID NO: 23325 - protein, 20 aa, synthetic construct
  source 1..20: note = Seed: SATGFKQSSKALQRPVASDF
SATGFIQSIKFLQDPVASDF

SEQ ID NO: 23326 - protein, 20 aa, synthetic construct
  source 1..20: note = Seed: SATGFKQSSKALQRPVASDF
SATGFIQSIKFLQEPVASDF

SEQ ID NO: 23327 - protein, 20 aa, synthetic construct
  source 1..20: note = Seed: SATGFKQSSKALQRPVASDF
SATGFIQSIKFLQFPVASDF

SEQ ID NO: 23328 - protein, 20 aa, synthetic construct
  source 1..20: note = Seed: SATGFKQSSKALQRPVASDF
SATGFIQSIKFLQHPVASDF

SEQ ID NO: 23329 - protein, 20 aa, synthetic construct
  source 1..20: note = Seed: SATGFKQSSKALQRPVASDF
SATGFIQSIKFLQIPVASDF

SEQ ID NO: 23330 - protein, 20 aa, synthetic construct
  source 1..20: note = Seed: SATGFKQSSKALQRPVASDF
SATGFIQSIKFLQLPVASDF

SEQ ID NO: 23331 - protein, 20 aa, synthetic construct
  source 1..20: note = Seed: SATGFKQSSKALQRPVASDF
SATGFIQSIKFLQMPVASDF

SEQ ID NO: 23332 - protein, 20 aa, synthetic construct
  source 1..20: note = Seed: SATGFKQSSKALQRPVASDF
SATGFIQSIKFLQNPVASDF

SEQ ID NO: 23333 - protein, 20 aa, synthetic construct
  source 1..20: note = Seed: SATGFKQSSKALQRPVASDF
SATGFIQSIKFLQSPVASDF

SEQ ID NO: 23334 - protein, 20 aa, synthetic construct
  source 1..20: note = Seed: SATGFKQSSKALQRPVASDF
SATGFIQSIKFLQTPVASDF

SEQ ID NO: 23335 - protein, 20 aa, synthetic construct
  source 1..20: note = Seed: SATGFKQSSKALQRPVASDF
SATGFIQSIKFLQVPVASDF

SEQ ID NO: 23336 - protein, 20 aa, synthetic construct
  source 1..20: note = Seed: SATGFKQSSKALQRPVASDF
SATGFIQSIKFLQYPVASDF

SEQ ID NO: 23337 - protein, 20 aa, synthetic construct
  source 1..20: note = Seed: SATGFKQSSKALQRPVASDF
SATGFIQSIKLLQIPVASDF

SEQ ID NO: 23338 - protein, 20 aa, synthetic construct
  source 1..20: note = Seed: SATGFKQSSKALQRPVASDF
SATGFIQSIKLLQVPVASDF

SEQ ID NO: 23339 - protein, 20 aa, synthetic construct
  source 1..20: note = Seed: SATGFKQSSKALQRPVASDF
SATGFIQSIKYLQIPVASDF

SEQ ID NO: 23340 - protein, 20 aa, synthetic construct
  source 1..20: note = Seed: SATGFKQSSKALQRPVASDF
SATGFIQSIKYLQLPVASDF

SEQ ID NO: 23341 - protein, 20 aa, synthetic construct
  source 1..20: note = Seed: SATGFKQSSKALQRPVASDF
SATGFIQSIKYLQMPVASDF

SEQ ID NO: 23342 - protein, 20 aa, synthetic construct
  source 1..20: note = Seed: SATGFKQSSKALQRPVASDF
SATGFIQSIKYLQVPVASDF

SEQ ID NO: 23343 - protein, 20 aa, synthetic construct
  source 1..20: note = Seed: SATGFKQSSKALQRPVASDF
SATGFIQSKKFLQFPVASDF

SEQ ID NO: 23344 - protein, 20 aa, synthetic construct
  source 1..20: note = Seed: SATGFKQSSKALQRPVASDF
SATGFIQSKKFLQIPVASDF

SEQ ID NO: 23345 - protein, 20 aa, synthetic construct
  source 1..20: note = Seed: SATGFKQSSKALQRPVASDF
SATGFIQSKKFLQLPVASDF

SEQ ID NO: 23346 - protein, 20 aa, synthetic construct
  source 1..20: note = Seed: SATGFKQSSKALQRPVASDF
SATGFIQSKKFLQMPVASDF

SEQ ID NO: 23347 - protein, 20 aa, synthetic construct
  source 1..20: note = Seed: SATGFKQSSKALQRPVASDF
SATGFIQSKKFLQVPVASDF

SEQ ID NO: 23348 - protein, 20 aa, synthetic construct
  source 1..20: note = Seed: SATGFKQSSKALQRPVASDF
SATGFIQSLKFLQAPVASDF

SEQ ID NO: 23349 - protein, 20 aa, synthetic construct
  source 1..20: note = Seed: SATGFKQSSKALQRPVASDF
SATGFIQSLKFLQDPVASDF

SEQ ID NO: 23350 - protein, 20 aa, synthetic construct
  source 1..20: note = Seed: SATGFKQSSKALQRPVASDF
SATGFIQSLKFLQEPVASDF

SEQ ID NO: 23351 - protein, 20 aa, synthetic construct
  source 1..20: note = Seed: SATGFKQSSKALQRPVASDF
SATGFIQSLKFLQFPVASDF

SEQ ID NO: 23352 - protein, 20 aa, synthetic construct
  source 1..20: note = Seed: SATGFKQSSKALQRPVASDF
SATGFIQSLKFLQHPVASDF

SEQ ID NO: 23353 - protein, 20 aa, synthetic construct
  source 1..20: note = Seed: SATGFKQSSKALQRPVASDF
SATGFIQSLKFLQIPVASDF

SEQ ID NO: 23354 - protein, 20 aa, synthetic construct
  source 1..20: note = Seed: SATGFKQSSKALQRPVASDF
SATGFIQSLKFLQLPVASDF

SEQ ID NO: 23355 - protein, 20 aa, synthetic construct
  source 1..20: note = Seed: SATGFKQSSKALQRPVASDF
SATGFIQSLKFLQMPVASDF

SEQ ID NO: 23356 - protein, 20 aa, synthetic construct
  source 1..20: note = Seed: SATGFKQSSKALQRPVASDF
SATGFIQSLKFLQNPVASDF

SEQ ID NO: 23357 - protein, 20 aa, synthetic construct
  source 1..20: note = Seed: SATGFKQSSKALQRPVASDF
SATGFIQSLKFLQSPVASDF

SEQ ID NO: 23358 - protein, 20 aa, synthetic construct
  source 1..20: note = Seed: SATGFKQSSKALQRPVASDF
SATGFIQSLKFLQTPVASDF

SEQ ID NO: 23359 - protein, 20 aa, synthetic construct
  source 1..20: note = Seed: SATGFKQSSKALQRPVASDF
SATGFIQSLKFLQVPVASDF

SEQ ID NO: 23360 - protein, 20 aa, synthetic construct
  source 1..20: note = Seed: SATGFKQSSKALQRPVASDF
SATGFIQSLKFLQYPVASDF

SEQ ID NO: 23361 - protein, 20 aa, synthetic construct
  source 1..20: note = Seed: SATGFKQSSKALQRPVASDF
SATGFIQSLKYLQIPVASDF

SEQ ID NO: 23362 - protein, 20 aa, synthetic construct
  source 1..20: note = Seed: SATGFKQSSKALQRPVASDF
SATGFIQSLKYLQLPVASDF

SEQ ID NO: 23363 - protein, 20 aa, synthetic construct
  source 1..20: note = Seed: SATGFKQSSKALQRPVASDF
SATGFIQSLKYLQVPVASDF

SEQ ID NO: 23364 - protein, 20 aa, synthetic construct
  source 1..20: note = Seed: SATGFKQSSKALQRPVASDF
SATGFIQSMKFLQAPVASDF

SEQ ID NO: 23365 - protein, 20 aa, synthetic construct
  source 1..20: note = Seed: SATGFKQSSKALQRPVASDF
SATGFIQSMKFLQEPVASDF

SEQ ID NO: 23366 - protein, 20 aa, synthetic construct
  source 1..20: note = Seed: SATGFKQSSKALQRPVASDF
SATGFIQSMKFLQFPVASDF

SEQ ID NO: 23367 - protein, 20 aa, synthetic construct
  source 1..20: note = Seed: SATGFKQSSKALQRPVASDF
SATGFIQSMKFLQIPVASDF

SEQ ID NO: 23368 - protein, 20 aa, synthetic construct
  source 1..20: note = Seed: SATGFKQSSKALQRPVASDF
SATGFIQSMKFLQLPVASDF

SEQ ID NO: 23369 - protein, 20 aa, synthetic construct
  source 1..20: note = Seed: SATGFKQSSKALQRPVASDF
SATGFIQSMKFLQMPVASDF

SEQ ID NO: 23370 - protein, 20 aa, synthetic construct
  source 1..20: note = Seed: SATGFKQSSKALQRPVASDF
SATGFIQSMKFLQNPVASDF

SEQ ID NO: 23371 - protein, 20 aa, synthetic construct
  source 1..20: note = Seed: SATGFKQSSKALQRPVASDF
SATGFIQSMKFLQTPVASDF

SEQ ID NO: 23372 - protein, 20 aa, synthetic construct
  source 1..20: note = Seed: SATGFKQSSKALQRPVASDF
SATGFIQSMKFLQVPVASDF

SEQ ID NO: 23373 - protein, 20 aa, synthetic construct
  source 1..20: note = Seed: SATGFKQSSKALQRPVASDF
SATGFIQSMKFLQYPVASDF

SEQ ID NO: 23374 - protein, 20 aa, synthetic construct
  source 1..20: note = Seed: SATGFKQSSKALQRPVASDF
SATGFIQSMKYLQIPVASDF

SEQ ID NO: 23375 - protein, 20 aa, synthetic construct
  source 1..20: note = Seed: SATGFKQSSKALQRPVASDF
SATGFIQSMKYLQVPVASDF

SEQ ID NO: 23376 - protein, 20 aa, synthetic construct
  source 1..20: note = Seed: SATGFKQSSKALQRPVASDF
SATGFIQSNKFLQAPVASDF

SEQ ID NO: 23377 - protein, 20 aa, synthetic construct
  source 1..20: note = Seed: SATGFKQSSKALQRPVASDF
SATGFIQSNKFLQFPVASDF

SEQ ID NO: 23378 - protein, 20 aa, synthetic construct
  source 1..20: note = Seed: SATGFKQSSKALQRPVASDF
SATGFIQSNKFLQIPVASDF

SEQ ID NO: 23379 - protein, 20 aa, synthetic construct
  source 1..20: note = Seed: SATGFKQSSKALQRPVASDF
SATGFIQSNKFLQLPVASDF

SEQ ID NO: 23380 - protein, 20 aa, synthetic construct
  source 1..20: note = Seed: SATGFKQSSKALQRPVASDF
SATGFIQSNKFLQMPVASDF

SEQ ID NO: 23381 - protein, 20 aa, synthetic construct
  source 1..20: note = Seed: SATGFKQSSKALQRPVASDF
SATGFIQSNKFLQTPVASDF

SEQ ID NO: 23382 - protein, 20 aa, synthetic construct
  source 1..20: note = Seed: SATGFKQSSKALQRPVASDF
SATGFIQSNKFLQVPVASDF

SEQ ID NO: 23383 - protein, 20 aa, synthetic construct
  source 1..20: note = Seed: SATGFKQSSKALQRPVASDF
SATGFIQSPKFLQIPVASDF

SEQ ID NO: 23384 - protein, 20 aa, synthetic construct
  source 1..20: note = Seed: SATGFKQSSKALQRPVASDF
SATGFIQSPKFLQLPVASDF

SEQ ID NO: 23385 - protein, 20 aa, synthetic construct
  source 1..20: note = Seed: SATGFKQSSKALQRPVASDF
SATGFIQSQKFLQAPVASDF

SEQ ID NO: 23386 - protein, 20 aa, synthetic construct
  source 1..20: note = Seed: SATGFKQSSKALQRPVASDF
SATGFIQSQKFLQFPVASDF

SEQ ID NO: 23387 - protein, 20 aa, synthetic construct
  source 1..20: note = Seed: SATGFKQSSKALQRPVASDF
SATGFIQSQKFLQIPVASDF

SEQ ID NO: 23388 - protein, 20 aa, synthetic construct
  source 1..20: note = Seed: SATGFKQSSKALQRPVASDF
SATGFIQSQKFLQLPVASDF

SEQ ID NO: 23389 - protein, 20 aa, synthetic construct
  source 1..20: note = Seed: SATGFKQSSKALQRPVASDF
SATGFIQSQKFLQMPVASDF

SEQ ID NO: 23390 - protein, 20 aa, synthetic construct
  source 1..20: note = Seed: SATGFKQSSKALQRPVASDF
SATGFIQSQKFLQTPVASDF

SEQ ID NO: 23391 - protein, 20 aa, synthetic construct
  source 1..20: note = Seed: SATGFKQSSKALQRPVASDF
SATGFIQSQKFLQVPVASDF

SEQ ID NO: 23392 - protein, 20 aa, synthetic construct
  source 1..20: note = Seed: SATGFKQSSKALQRPVASDF
SATGFIQSQKFLQYPVASDF

SEQ ID NO: 23393 - protein, 20 aa, synthetic construct
  source 1..20: note = Seed: SATGFKQSSKALQRPVASDF
SATGFIQSQKLLQIPVASDF

SEQ ID NO: 23394 - protein, 20 aa, synthetic construct
  source 1..20: note = Seed: SATGFKQSSKALQRPVASDF
SATGFIQSQKLLQVPVASDF

SEQ ID NO: 23395 - protein, 20 aa, synthetic construct
  source 1..20: note = Seed: SATGFKQSSKALQRPVASDF
SATGFIQSRKFLQFPVASDF

SEQ ID NO: 23396 - protein, 20 aa, synthetic construct
  source 1..20: note = Seed: SATGFKQSSKALQRPVASDF
SATGFIQSRKFLQIPVASDF

SEQ ID NO: 23397 - protein, 20 aa, synthetic construct
  source 1..20: note = Seed: SATGFKQSSKALQRPVASDF
SATGFIQSRKFLQLPVASDF

SEQ ID NO: 23398 - protein, 20 aa, synthetic construct
  source 1..20: note = Seed: SATGFKQSSKALQRPVASDF
SATGFIQSRKFLQMPVASDF

SEQ ID NO: 23399 - protein, 20 aa, synthetic construct
  source 1..20: note = Seed: SATGFKQSSKALQRPVASDF
SATGFIQSRKFLQVPVASDF

SEQ ID NO: 23400 - protein, 20 aa, synthetic construct
  source 1..20: note = Seed: SATGFKQSSKALQRPVASDF
SATGFIQSSKALQAPVASDF

SEQ ID NO: 23401 - protein, 20 aa, synthetic construct
  source 1..20: note = Seed: SATGFKQSSKALQRPVASDF
SATGFIQSSKALQSPVASDF

SEQ ID NO: 23402 - protein, 20 aa, synthetic construct
  source 1..20: note = Seed: SATGFKQSSKALQRPVASDF
SATGFIQSSKFLQAPVASDF

SEQ ID NO: 23403 - protein, 20 aa, synthetic construct
  source 1..20: note = Seed: SATGFKQSSKALQRPVASDF
SATGFIQSSKFLQDPVASDF

SEQ ID NO: 23404 - protein, 20 aa, synthetic construct
  source 1..20: note = Seed: SATGFKQSSKALQRPVASDF
SATGFIQSSKFLQEPVASDF

SEQ ID NO: 23405 - protein, 20 aa, synthetic construct
  source 1..20: note = Seed: SATGFKQSSKALQRPVASDF
SATGFIQSSKFLQFPVASDF

SEQ ID NO: 23406 - protein, 20 aa, synthetic construct
  source 1..20: note = Seed: SATGFKQSSKALQRPVASDF
SATGFIQSSKFLQHPVASDF

SEQ ID NO: 23407 - protein, 20 aa, synthetic construct
  source 1..20: note = Seed: SATGFKQSSKALQRPVASDF
SATGFIQSSKFLQIPVASDF

SEQ ID NO: 23408 - protein, 20 aa, synthetic construct
  source 1..20: note = Seed: SATGFKQSSKALQRPVASDF
SATGFIQSSKFLQLPVASDF

SEQ ID NO: 23409 - protein, 20 aa, synthetic construct
  source 1..20: note = Seed: SATGFKQSSKALQRPVASDF
SATGFIQSSKFLQMPVASDF

SEQ ID NO: 23410 - protein, 20 aa, synthetic construct
  source 1..20: note = Seed: SATGFKQSSKALQRPVASDF
SATGFIQSSKFLQNPVASDF

SEQ ID NO: 23411 - protein, 20 aa, synthetic construct
  source 1..20: note = Seed: SATGFKQSSKALQRPVASDF
SATGFIQSSKFLQSPVASDF

SEQ ID NO: 23412 - protein, 20 aa, synthetic construct
  source 1..20: note = Seed: SATGFKQSSKALQRPVASDF
SATGFIQSSKFLQTPVASDF

SEQ ID NO: 23413 - protein, 20 aa, synthetic construct
  source 1..20: note = Seed: SATGFKQSSKALQRPVASDF
SATGFIQSSKFLQVPVASDF

SEQ ID NO: 23414 - protein, 20 aa, synthetic construct
  source 1..20: note = Seed: SATGFKQSSKALQRPVASDF
SATGFIQSSKFLQYPVASDF

SEQ ID NO: 23415 - protein, 20 aa, synthetic construct
  source 1..20: note = Seed: SATGFKQSSKALQRPVASDF
SATGFIQSSKILQAPVASDF

SEQ ID NO: 23416 - protein, 20 aa, synthetic construct
  source 1..20: note = Seed: SATGFKQSSKALQRPVASDF
SATGFIQSSKILQIPVASDF

SEQ ID NO: 23417 - protein, 20 aa, synthetic construct
  source 1..20: note = Seed: SATGFKQSSKALQRPVASDF
SATGFIQSSKILQLPVASDF

SEQ ID NO: 23418 - protein, 20 aa, synthetic construct
  source 1..20: note = Seed: SATGFKQSSKALQRPVASDF
SATGFIQSSKILQSPVASDF

SEQ ID NO: 23419 - protein, 20 aa, synthetic construct
  source 1..20: note = Seed: SATGFKQSSKALQRPVASDF
SATGFIQSSKILQVPVASDF

SEQ ID NO: 23420 - protein, 20 aa, synthetic construct
  source 1..20: note = Seed: SATGFKQSSKALQRPVASDF
SATGFIQSSKLLQFPVASDF

SEQ ID NO: 23421 - protein, 20 aa, synthetic construct
  source 1..20: note = Seed: SATGFKQSSKALQRPVASDF
SATGFIQSSKLLQIPVASDF

SEQ ID NO: 23422 - protein, 20 aa, synthetic construct
  source 1..20: note = Seed: SATGFKQSSKALQRPVASDF
SATGFIQSSKLLQLPVASDF

SEQ ID NO: 23423 - protein, 20 aa, synthetic construct
  source 1..20: note = Seed: SATGFKQSSKALQRPVASDF
SATGFIQSSKLLQMPVASDF

SEQ ID NO: 23424 - protein, 20 aa, synthetic construct
  source 1..20: note = Seed: SATGFKQSSKALQRPVASDF
SATGFIQSSKLLQVPVASDF

SEQ ID NO: 23425 - protein, 20 aa, synthetic construct
  source 1..20: note = Seed: SATGFKQSSKALQRPVASDF
SATGFIQSSKMLQLPVASDF

SEQ ID NO: 23426 - protein, 20 aa, synthetic construct
  source 1..20: note = Seed: SATGFKQSSKALQRPVASDF
SATGFIQSSKPLQAPVASDF

SEQ ID NO: 23427 - protein, 20 aa, synthetic construct
  source 1..20: note = Seed: SATGFKQSSKALQRPVASDF
SATGFIQSSKPLQSPVASDF

SEQ ID NO: 23428 - protein, 20 aa, synthetic construct
  source 1..20: note = Seed: SATGFKQSSKALQRPVASDF
SATGFIQSSKVLQAPVASDF

SEQ ID NO: 23429 - protein, 20 aa, synthetic construct
  source 1..20: note = Seed: SATGFKQSSKALQRPVASDF
SATGFIQSSKVLQSPVASDF

SEQ ID NO: 23430 - protein, 20 aa, synthetic construct
  source 1..20: note = Seed: SATGFKQSSKALQRPVASDF
SATGFIQSSKWLQIPVASDF

SEQ ID NO: 23431 - protein, 20 aa, synthetic construct
  source 1..20: note = Seed: SATGFKQSSKALQRPVASDF
SATGFIQSSKWLQLPVASDF

SEQ ID NO: 23432 - protein, 20 aa, synthetic construct
  source 1..20: note = Seed: SATGFKQSSKALQRPVASDF
SATGFIQSSKWLQVPVASDF

SEQ ID NO: 23433 - protein, 20 aa, synthetic construct
  source 1..20: note = Seed: SATGFKQSSKALQRPVASDF
SATGFIQSSKYLQFPVASDF

SEQ ID NO: 23434 - protein, 20 aa, synthetic construct
  source 1..20: note = Seed: SATGFKQSSKALQRPVASDF
SATGFIQSSKYLQIPVASDF

SEQ ID NO: 23435 - protein, 20 aa, synthetic construct
  source 1..20: note = Seed: SATGFKQSSKALQRPVASDF
SATGFIQSSKYLQLPVASDF

SEQ ID NO: 23436 - protein, 20 aa, synthetic construct
  source 1..20: note = Seed: SATGFKQSSKALQRPVASDF
SATGFIQSSKYLQVPVASDF

SEQ ID NO: 23437 - protein, 20 aa, synthetic construct
  source 1..20: note = Seed: SATGFKQSSKALQRPVASDF
SATGFIQSTKALQIPVASDF

SEQ ID NO: 23438 - protein, 20 aa, synthetic construct
  source 1..20: note = Seed: SATGFKQSSKALQRPVASDF
SATGFIQSTKALQLPVASDF

SEQ ID NO: 23439 - protein, 20 aa, synthetic construct
  source 1..20: note = Seed: SATGFKQSSKALQRPVASDF
SATGFIQSTKFLQAPVASDF

SEQ ID NO: 23440 - protein, 20 aa, synthetic construct
  source 1..20: note = Seed: SATGFKQSSKALQRPVASDF
SATGFIQSTKFLQDPVASDF

SEQ ID NO: 23441 - protein, 20 aa, synthetic construct
  source 1..20: note = Seed: SATGFKQSSKALQRPVASDF
SATGFIQSTKFLQEPVASDF

SEQ ID NO: 23442 - protein, 20 aa, synthetic construct
  source 1..20: note = Seed: SATGFKQSSKALQRPVASDF
SATGFIQSTKFLQFPVASDF

SEQ ID NO: 23443 - protein, 20 aa, synthetic construct
  source 1..20: note = Seed: SATGFKQSSKALQRPVASDF
SATGFIQSTKFLQHPVASDF

SEQ ID NO: 23444 - protein, 20 aa, synthetic construct
  source 1..20: note = Seed: SATGFKQSSKALQRPVASDF
SATGFIQSTKFLQIPVASDF

SEQ ID NO: 23445 - protein, 20 aa, synthetic construct
  source 1..20: note = Seed: SATGFKQSSKALQRPVASDF
SATGFIQSTKFLQLPVASDF

SEQ ID NO: 23446 - protein, 20 aa, synthetic construct
  source 1..20: note = Seed: SATGFKQSSKALQRPVASDF
SATGFIQSTKFLQMPVASDF

SEQ ID NO: 23447 - protein, 20 aa, synthetic construct
  source 1..20: note = Seed: SATGFKQSSKALQRPVASDF
SATGFIQSTKFLQNPVASDF

SEQ ID NO: 23448 - protein, 20 aa, synthetic construct
  source 1..20: note = Seed: SATGFKQSSKALQRPVASDF
SATGFIQSTKFLQRPVASDF

SEQ ID NO: 23449 - protein, 20 aa, synthetic construct
  source 1..20: note = Seed: SATGFKQSSKALQRPVASDF
SATGFIQSTKFLQSPVASDF

SEQ ID NO: 23450 - protein, 20 aa, synthetic construct
  source 1..20: note = Seed: SATGFKQSSKALQRPVASDF
SATGFIQSTKFLQTPVASDF

SEQ ID NO: 23451 - protein, 20 aa, synthetic construct
  source 1..20: note = Seed: SATGFKQSSKALQRPVASDF
SATGFIQSTKFLQVPVASDF

SEQ ID NO: 23452 - protein, 20 aa, synthetic construct
  source 1..20: note = Seed: SATGFKQSSKALQRPVASDF
SATGFIQSTKFLQYPVASDF

SEQ ID NO: 23453 - protein, 20 aa, synthetic construct
  source 1..20: note = Seed: SATGFKQSSKALQRPVASDF
SATGFIQSTKILQFPVASDF

SEQ ID NO: 23454 - protein, 20 aa, synthetic construct
  source 1..20: note = Seed: SATGFKQSSKALQRPVASDF
SATGFIQSTKILQIPVASDF

SEQ ID NO: 23455 - protein, 20 aa, synthetic construct
  source 1..20: note = Seed: SATGFKQSSKALQRPVASDF
SATGFIQSTKILQLPVASDF

SEQ ID NO: 23456 - protein, 20 aa, synthetic construct
  source 1..20: note = Seed: SATGFKQSSKALQRPVASDF
SATGFIQSTKILQVPVASDF

SEQ ID NO: 23457 - protein, 20 aa, synthetic construct
  source 1..20: note = Seed: SATGFKQSSKALQRPVASDF
SATGFIQSTKLLQFPVASDF

SEQ ID NO: 23458 - protein, 20 aa, synthetic construct
  source 1..20: note = Seed: SATGFKQSSKALQRPVASDF
SATGFIQSTKLLQIPVASDF

SEQ ID NO: 23459 - protein, 20 aa, synthetic construct
  source 1..20: note = Seed: SATGFKQSSKALQRPVASDF
SATGFIQSTKLLQLPVASDF

SEQ ID NO: 23460 - protein, 20 aa, synthetic construct
  source 1..20: note = Seed: SATGFKQSSKALQRPVASDF
SATGFIQSTKLLQMPVASDF

SEQ ID NO: 23461 - protein, 20 aa, synthetic construct
  source 1..20: note = Seed: SATGFKQSSKALQRPVASDF
SATGFIQSTKLLQVPVASDF

SEQ ID NO: 23462 - protein, 20 aa, synthetic construct
  source 1..20: note = Seed: SATGFKQSSKALQRPVASDF
SATGFIQSTKLLQYPVASDF

SEQ ID NO: 23463 - protein, 20 aa, synthetic construct
  source 1..20: note = Seed: SATGFKQSSKALQRPVASDF
SATGFIQSTKMLQIPVASDF

SEQ ID NO: 23464 - protein, 20 aa, synthetic construct
  source 1..20: note = Seed: SATGFKQSSKALQRPVASDF
SATGFIQSTKMLQLPVASDF

SEQ ID NO: 23465 - protein, 20 aa, synthetic construct
  source 1..20: note = Seed: SATGFKQSSKALQRPVASDF
SATGFIQSTKMLQVPVASDF

SEQ ID NO: 23466 - protein, 20 aa, synthetic construct
  source 1..20: note = Seed: SATGFKQSSKALQRPVASDF
SATGFIQSTKVLQIPVASDF

SEQ ID NO: 23467 - protein, 20 aa, synthetic construct
  source 1..20: note = Seed: SATGFKQSSKALQRPVASDF
SATGFIQSTKVLQLPVASDF

SEQ ID NO: 23468 - protein, 20 aa, synthetic construct
  source 1..20: note = Seed: SATGFKQSSKALQRPVASDF
SATGFIQSTKWLQFPVASDF

SEQ ID NO: 23469 - protein, 20 aa, synthetic construct
  source 1..20: note = Seed: SATGFKQSSKALQRPVASDF
SATGFIQSTKWLQIPVASDF

SEQ ID NO: 23470 - protein, 20 aa, synthetic construct
  source 1..20: note = Seed: SATGFKQSSKALQRPVASDF
SATGFIQSTKWLQLPVASDF

SEQ ID NO: 23471 - protein, 20 aa, synthetic construct
  source 1..20: note = Seed: SATGFKQSSKALQRPVASDF
SATGFIQSTKWLQVPVASDF

SEQ ID NO: 23472 - protein, 20 aa, synthetic construct
  source 1..20: note = Seed: SATGFKQSSKALQRPVASDF
SATGFIQSTKYLQFPVASDF

SEQ ID NO: 23473 - protein, 20 aa, synthetic construct
  source 1..20: note = Seed: SATGFKQSSKALQRPVASDF
SATGFIQSTKYLQIPVASDF

SEQ ID NO: 23474 - protein, 20 aa, synthetic construct
  source 1..20: note = Seed: SATGFKQSSKALQRPVASDF
SATGFIQSTKYLQLPVASDF

SEQ ID NO: 23475 - protein, 20 aa, synthetic construct
  source 1..20: note = Seed: SATGFKQSSKALQRPVASDF
SATGFIQSTKYLQMPVASDF

SEQ ID NO: 23476 - protein, 20 aa, synthetic construct
  source 1..20: note = Seed: SATGFKQSSKALQRPVASDF
SATGFIQSTKYLQVPVASDF

SEQ ID NO: 23477 - protein, 20 aa, synthetic construct
  source 1..20: note = Seed: SATGFKQSSKALQRPVASDF
SATGFIQSVKFLQAPVASDF

SEQ ID NO: 23478 - protein, 20 aa, synthetic construct
  source 1..20: note = Seed: SATGFKQSSKALQRPVASDF
SATGFIQSVKFLQDPVASDF

SEQ ID NO: 23479 - protein, 20 aa, synthetic construct
  source 1..20: note = Seed: SATGFKQSSKALQRPVASDF
SATGFIQSVKFLQEPVASDF

SEQ ID NO: 23480 - protein, 20 aa, synthetic construct
  source 1..20: note = Seed: SATGFKQSSKALQRPVASDF
SATGFIQSVKFLQFPVASDF

SEQ ID NO: 23481 - protein, 20 aa, synthetic construct
  source 1..20: note = Seed: SATGFKQSSKALQRPVASDF
SATGFIQSVKFLQHPVASDF

SEQ ID NO: 23482 - protein, 20 aa, synthetic construct
  source 1..20: note = Seed: SATGFKQSSKALQRPVASDF
SATGFIQSVKFLQIPVASDF

SEQ ID NO: 23483 - protein, 20 aa, synthetic construct
  source 1..20: note = Seed: SATGFKQSSKALQRPVASDF
SATGFIQSVKFLQLPVASDF

SEQ ID NO: 23484 - protein, 20 aa, synthetic construct
  source 1..20: note = Seed: SATGFKQSSKALQRPVASDF
SATGFIQSVKFLQMPVASDF

SEQ ID NO: 23485 - protein, 20 aa, synthetic construct
  source 1..20: note = Seed: SATGFKQSSKALQRPVASDF
SATGFIQSVKFLQNPVASDF

SEQ ID NO: 23486 - protein, 20 aa, synthetic construct
  source 1..20: note = Seed: SATGFKQSSKALQRPVASDF
SATGFIQSVKFLQSPVASDF

SEQ ID NO: 23487 - protein, 20 aa, synthetic construct
  source 1..20: note = Seed: SATGFKQSSKALQRPVASDF
SATGFIQSVKFLQTPVASDF

SEQ ID NO: 23488 - protein, 20 aa, synthetic construct
  source 1..20: note = Seed: SATGFKQSSKALQRPVASDF
SATGFIQSVKFLQVPVASDF

SEQ ID NO: 23489 - protein, 20 aa, synthetic construct
  source 1..20: note = Seed: SATGFKQSSKALQRPVASDF
SATGFIQSVKFLQYPVASDF

SEQ ID NO: 23490 - protein, 20 aa, synthetic construct
  source 1..20: note = Seed: SATGFKQSSKALQRPVASDF
SATGFIQSVKYLQFPVASDF

SEQ ID NO: 23491 - protein, 20 aa, synthetic construct
  source 1..20: note = Seed: SATGFKQSSKALQRPVASDF
SATGFIQSVKYLQIPVASDF

SEQ ID NO: 23492 - protein, 20 aa, synthetic construct
  source 1..20: note = Seed: SATGFKQSSKALQRPVASDF
SATGFIQSVKYLQLPVASDF

SEQ ID NO: 23493 - protein, 20 aa, synthetic construct
  source 1..20: note = Seed: SATGFKQSSKALQRPVASDF
SATGFIQSVKYLQMPVASDF

SEQ ID NO: 23494 - protein, 20 aa, synthetic construct
  source 1..20: note = Seed: SATGFKQSSKALQRPVASDF
SATGFIQSVKYLQVPVASDF

SEQ ID NO: 23495 - protein, 20 aa, synthetic construct
  source 1..20: note = Seed: SATGFKQSSKALQRPVASDF
SATGFIQSWKFLQEPVASDF

SEQ ID NO: 23496 - protein, 20 aa, synthetic construct
  source 1..20: note = Seed: SATGFKQSSKALQRPVASDF
SATGFIQSWKFLQFPVASDF

SEQ ID NO: 23497 - protein, 20 aa, synthetic construct
  source 1..20: note = Seed: SATGFKQSSKALQRPVASDF
SATGFIQSWKFLQIPVASDF

SEQ ID NO: 23498 - protein, 20 aa, synthetic construct
  source 1..20: note = Seed: SATGFKQSSKALQRPVASDF
SATGFIQSWKFLQLPVASDF

SEQ ID NO: 23499 - protein, 20 aa, synthetic construct
  source 1..20: note = Seed: SATGFKQSSKALQRPVASDF
SATGFIQSWKFLQMPVASDF

SEQ ID NO: 23500 - protein, 20 aa, synthetic construct
  source 1..20: note = Seed: SATGFKQSSKALQRPVASDF
SATGFIQSWKFLQTPVASDF

SEQ ID NO: 23501 - protein, 20 aa, synthetic construct
  source 1..20: note = Seed: SATGFKQSSKALQRPVASDF
SATGFIQSWKFLQVPVASDF

SEQ ID NO: 23502 - protein, 20 aa, synthetic construct
  source 1..20: note = Seed: SATGFKQSSKALQRPVASDF
SATGFIQSWKFLQYPVASDF

SEQ ID NO: 23503 - protein, 20 aa, synthetic construct
  source 1..20: note = Seed: SATGFKQSSKALQRPVASDF
SATGFIQSWKILQFPVASDF

SEQ ID NO: 23504 - protein, 20 aa, synthetic construct
  source 1..20: note = Seed: SATGFKQSSKALQRPVASDF
SATGFIQSWKILQIPVASDF

SEQ ID NO: 23505 - protein, 20 aa, synthetic construct
  source 1..20: note = Seed: SATGFKQSSKALQRPVASDF
SATGFIQSWKILQLPVASDF

SEQ ID NO: 23506 - protein, 20 aa, synthetic construct
  source 1..20: note = Seed: SATGFKQSSKALQRPVASDF
SATGFIQSWKLLQFPVASDF

SEQ ID NO: 23507 - protein, 20 aa, synthetic construct
  source 1..20: note = Seed: SATGFKQSSKALQRPVASDF
SATGFIQSWKLLQIPVASDF

SEQ ID NO: 23508 - protein, 20 aa, synthetic construct
  source 1..20: note = Seed: SATGFKQSSKALQRPVASDF
SATGFIQSWKLLQLPVASDF

SEQ ID NO: 23509 - protein, 20 aa, synthetic construct
  source 1..20: note = Seed: SATGFKQSSKALQRPVASDF
SATGFIQSWKLLQVPVASDF

SEQ ID NO: 23510 - protein, 20 aa, synthetic construct
  source 1..20: note = Seed: SATGFKQSSKALQRPVASDF
SATGFIQSWKWLQLPVASDF

SEQ ID NO: 23511 - protein, 20 aa, synthetic construct
  source 1..20: note = Seed: SATGFKQSSKALQRPVASDF
SATGFIQSWKYLQIPVASDF

SEQ ID NO: 23512 - protein, 20 aa, synthetic construct
  source 1..20: note = Seed: SATGFKQSSKALQRPVASDF
SATGFIQSWKYLQLPVASDF

SEQ ID NO: 23513 - protein, 20 aa, synthetic construct
  source 1..20: note = Seed: SATGFKQSSKALQRPVASDF
SATGFIQSYKFLQAPVASDF

SEQ ID NO: 23514 - protein, 20 aa, synthetic construct
  source 1..20: note = Seed: SATGFKQSSKALQRPVASDF
SATGFIQSYKFLQEPVASDF

SEQ ID NO: 23515 - protein, 20 aa, synthetic construct
  source 1..20: note = Seed: SATGFKQSSKALQRPVASDF
SATGFIQSYKFLQFPVASDF

SEQ ID NO: 23516 - protein, 20 aa, synthetic construct
  source 1..20: note = Seed: SATGFKQSSKALQRPVASDF
SATGFIQSYKFLQHPVASDF

SEQ ID NO: 23517 - protein, 20 aa, synthetic construct
  source 1..20: note = Seed: SATGFKQSSKALQRPVASDF
SATGFIQSYKFLQIPVASDF

SEQ ID NO: 23518 - protein, 20 aa, synthetic construct
  source 1..20: note = Seed: SATGFKQSSKALQRPVASDF
SATGFIQSYKFLQLPVASDF

SEQ ID NO: 23519 - protein, 20 aa, synthetic construct
  source 1..20: note = Seed: SATGFKQSSKALQRPVASDF
SATGFIQSYKFLQMPVASDF

SEQ ID NO: 23520 - protein, 20 aa, synthetic construct
  source 1..20: note = Seed: SATGFKQSSKALQRPVASDF
SATGFIQSYKFLQNPVASDF

SEQ ID NO: 23521 - protein, 20 aa, synthetic construct
  source 1..20: note = Seed: SATGFKQSSKALQRPVASDF
SATGFIQSYKFLQSPVASDF

SEQ ID NO: 23522 - protein, 20 aa, synthetic construct
  source 1..20: note = Seed: SATGFKQSSKALQRPVASDF
SATGFIQSYKFLQTPVASDF

SEQ ID NO: 23523 - protein, 20 aa, synthetic construct
  source 1..20: note = Seed: SATGFKQSSKALQRPVASDF
SATGFIQSYKFLQVPVASDF

SEQ ID NO: 23524 - protein, 20 aa, synthetic construct
  source 1..20: note = Seed: SATGFKQSSKALQRPVASDF
SATGFIQSYKFLQYPVASDF

SEQ ID NO: 23525 - protein, 20 aa, synthetic construct
  source 1..20: note = Seed: SATGFKQSSKALQRPVASDF
SATGFIQSYKILQFPVASDF

SEQ ID NO: 23526 - protein, 20 aa, synthetic construct
  source 1..20: note = Seed: SATGFKQSSKALQRPVASDF
SATGFIQSYKILQIPVASDF

SEQ ID NO: 23527 - protein, 20 aa, synthetic construct
  source 1..20: note = Seed: SATGFKQSSKALQRPVASDF
SATGFIQSYKILQLPVASDF

SEQ ID NO: 23528 - protein, 20 aa, synthetic construct
  source 1..20: note = Seed: SATGFKQSSKALQRPVASDF
SATGFIQSYKILQVPVASDF

SEQ ID NO: 23529 - protein, 20 aa, synthetic construct
  source 1..20: note = Seed: SATGFKQSSKALQRPVASDF
SATGFIQSYKLLQFPVASDF

SEQ ID NO: 23530 - protein, 20 aa, synthetic construct
  source 1..20: note = Seed: SATGFKQSSKALQRPVASDF
SATGFIQSYKLLQIPVASDF

SEQ ID NO: 23531 - protein, 20 aa, synthetic construct
  source 1..20: note = Seed: SATGFKQSSKALQRPVASDF
SATGFIQSYKLLQLPVASDF

SEQ ID NO: 23532 - protein, 20 aa, synthetic construct
  source 1..20: note = Seed: SATGFKQSSKALQRPVASDF
SATGFIQSYKLLQVPVASDF

SEQ ID NO: 23533 - protein, 20 aa, synthetic construct
  source 1..20: note = Seed: SATGFKQSSKALQRPVASDF
SATGFIQSYKYLQIPVASDF

SEQ ID NO: 23534 - protein, 20 aa, synthetic construct
  source 1..20: note = Seed: SATGFKQSSKALQRPVASDF
SATGFIQSYKYLQLPVASDF

SEQ ID NO: 23535 - protein, 20 aa, synthetic construct
  source 1..20: note = Seed: SATGFKQSSKALQRPVASDF
SATGFIQSYKYLQVPVASDF

SEQ ID NO: 23536 - protein, 20 aa, synthetic construct
  source 1..20: note = Seed: SATGFKQSSKALQRPVASDF
SATGFKQSAKFLQFPVASDF

SEQ ID NO: 23537 - protein, 20 aa, synthetic construct
  source 1..20: note = Seed: SATGFKQSSKALQRPVASDF
SATGFKQSAKFLQIPVASDF

SEQ ID NO: 23538 - protein, 20 aa, synthetic construct
  source 1..20: note = Seed: SATGFKQSSKALQRPVASDF
SATGFKQSAKFLQLPVASDF

SEQ ID NO: 23539 - protein, 20 aa, synthetic construct
  source 1..20: note = Seed: SATGFKQSSKALQRPVASDF
SATGFKQSFKFLQAPVASDF

SEQ ID NO: 23540 - protein, 20 aa, synthetic construct
  source 1..20: note = Seed: SATGFKQSSKALQRPVASDF
SATGFKQSFKFLQIPVASDF

SEQ ID NO: 23541 - protein, 20 aa, synthetic construct
  source 1..20: note = Seed: SATGFKQSSKALQRPVASDF
SATGFKQSFKFLQLPVASDF

SEQ ID NO: 23542 - protein, 20 aa, synthetic construct
  source 1..20: note = Seed: SATGFKQSSKALQRPVASDF
SATGFKQSFKFLQMPVASDF

SEQ ID NO: 23543 - protein, 20 aa, synthetic construct
  source 1..20: note = Seed: SATGFKQSSKALQRPVASDF
SATGFKQSFKFLQVPVASDF

SEQ ID NO: 23544 - protein, 20 aa, synthetic construct
  source 1..20: note = Seed: SATGFKQSSKALQRPVASDF
SATGFKQSFKILQIPVASDF

SEQ ID NO: 23545 - protein, 20 aa, synthetic construct
  source 1..20: note = Seed: SATGFKQSSKALQRPVASDF
SATGFKQSFKILQLPVASDF

SEQ ID NO: 23546 - protein, 20 aa, synthetic construct
  source 1..20: note = Seed: SATGFKQSSKALQRPVASDF
SATGFKQSFKILQVPVASDF

SEQ ID NO: 23547 - protein, 20 aa, synthetic construct
  source 1..20: note = Seed: SATGFKQSSKALQRPVASDF
SATGFKQSFKLLQIPVASDF

SEQ ID NO: 23548 - protein, 20 aa, synthetic construct
  source 1..20: note = Seed: SATGFKQSSKALQRPVASDF
SATGFKQSFKLLQLPVASDF

SEQ ID NO: 23549 - protein, 20 aa, synthetic construct
  source 1..20: note = Seed: SATGFKQSSKALQRPVASDF
SATGFKQSFKLLQMPVASDF

SEQ ID NO: 23550 - protein, 20 aa, synthetic construct
  source 1..20: note = Seed: SATGFKQSSKALQRPVASDF
SATGFKQSFKLLQVPVASDF

SEQ ID NO: 23551 - protein, 20 aa, synthetic construct
  source 1..20: note = Seed: SATGFKQSSKALQRPVASDF
SATGFKQSFKMLQIPVASDF

SEQ ID NO: 23552 - protein, 20 aa, synthetic construct
  source 1..20: note = Seed: SATGFKQSSKALQRPVASDF
SATGFKQSHKFLQIPVASDF

SEQ ID NO: 23553 - protein, 20 aa, synthetic construct
  source 1..20: note = Seed: SATGFKQSSKALQRPVASDF
SATGFKQSIKFLQIPVASDF

SEQ ID NO: 23554 - protein, 20 aa, synthetic construct
  source 1..20: note = Seed: SATGFKQSSKALQRPVASDF
SATGFKQSIKFLQLPVASDF

SEQ ID NO: 23555 - protein, 20 aa, synthetic construct
  source 1..20: note = Seed: SATGFKQSSKALQRPVASDF
SATGFKQSIKFLQMPVASDF

SEQ ID NO: 23556 - protein, 20 aa, synthetic construct
  source 1..20: note = Seed: SATGFKQSSKALQRPVASDF
SATGFKQSIKFLQVPVASDF

SEQ ID NO: 23557 - protein, 20 aa, synthetic construct
  source 1..20: note = Seed: SATGFKQSSKALQRPVASDF
SATGFKQSLKFLQIPVASDF

SEQ ID NO: 23558 - protein, 20 aa, synthetic construct
  source 1..20: note = Seed: SATGFKQSSKALQRPVASDF
SATGFKQSLKFLQLPVASDF

SEQ ID NO: 23559 - protein, 20 aa, synthetic construct
  source 1..20: note = Seed: SATGFKQSSKALQRPVASDF
SATGFKQSLKFLQMPVASDF

SEQ ID NO: 23560 - protein, 20 aa, synthetic construct
  source 1..20: note = Seed: SATGFKQSSKALQRPVASDF
SATGFKQSLKFLQVPVASDF

SEQ ID NO: 23561 - protein, 20 aa, synthetic construct
  source 1..20: note = Seed: SATGFKQSSKALQRPVASDF
SATGFKQSMKFLQIPVASDF

SEQ ID NO: 23562 - protein, 20 aa, synthetic construct
  source 1..20: note = Seed: SATGFKQSSKALQRPVASDF
SATGFKQSMKFLQLPVASDF

SEQ ID NO: 23563 - protein, 20 aa, synthetic construct
  source 1..20: note = Seed: SATGFKQSSKALQRPVASDF
SATGFKQSMKFLQVPVASDF

SEQ ID NO: 23564 - protein, 20 aa, synthetic construct
  source 1..20: note = Seed: SATGFKQSSKALQRPVASDF
SATGFKQSSKFLQFPVASDF

SEQ ID NO: 23565 - protein, 20 aa, synthetic construct
  source 1..20: note = Seed: SATGFKQSSKALQRPVASDF
SATGFKQSSKFLQIPVASDF

SEQ ID NO: 23566 - protein, 20 aa, synthetic construct
  source 1..20: note = Seed: SATGFKQSSKALQRPVASDF
SATGFKQSSKFLQLPVASDF

SEQ ID NO: 23567 - protein, 20 aa, synthetic construct
  source 1..20: note = Seed: SATGFKQSSKALQRPVASDF
SATGFKQSSKFLQVPVASDF

SEQ ID NO: 23568 - protein, 20 aa, synthetic construct
  source 1..20: note = Seed: SATGFKQSSKALQRPVASDF
SATGFKQSTKFLQFPVASDF

SEQ ID NO: 23569 - protein, 20 aa, synthetic construct
  source 1..20: note = Seed: SATGFKQSSKALQRPVASDF
SATGFKQSTKFLQIPVASDF

SEQ ID NO: 23570 - protein, 20 aa, synthetic construct
  source 1..20: note = Seed: SATGFKQSSKALQRPVASDF
SATGFKQSTKFLQLPVASDF

SEQ ID NO: 23571 - protein, 20 aa, synthetic construct
  source 1..20: note = Seed: SATGFKQSSKALQRPVASDF
SATGFKQSTKFLQVPVASDF

SEQ ID NO: 23572 - protein, 20 aa, synthetic construct
  source 1..20: note = Seed: SATGFKQSSKALQRPVASDF
SATGFKQSVKFLQIPVASDF

SEQ ID NO: 23573 - protein, 20 aa, synthetic construct
  source 1..20: note = Seed: SATGFKQSSKALQRPVASDF
SATGFKQSVKFLQLPVASDF

SEQ ID NO: 23574 - protein, 20 aa, synthetic construct
  source 1..20: note = Seed: SATGFKQSSKALQRPVASDF
SATGFKQSVKFLQMPVASDF

SEQ ID NO: 23575 - protein, 20 aa, synthetic construct
  source 1..20: note = Seed: SATGFKQSSKALQRPVASDF
SATGFKQSVKFLQVPVASDF

SEQ ID NO: 23576 - protein, 20 aa, synthetic construct
  source 1..20: note = Seed: SATGFKQSSKALQRPVASDF
SATGFKQSWKFLQIPVASDF

SEQ ID NO: 23577 - protein, 20 aa, synthetic construct
  source 1..20: note = Seed: SATGFKQSSKALQRPVASDF
SATGFKQSWKFLQLPVASDF

SEQ ID NO: 23578 - protein, 20 aa, synthetic construct
  source 1..20: note = Seed: SATGFKQSSKALQRPVASDF
SATGFKQSWKFLQVPVASDF

SEQ ID NO: 23579 - protein, 20 aa, synthetic construct
  source 1..20: note = Seed: SATGFKQSSKALQRPVASDF
SATGFKQSYKFLQIPVASDF

SEQ ID NO: 23580 - protein, 20 aa, synthetic construct
  source 1..20: note = Seed: SATGFKQSSKALQRPVASDF
SATGFKQSYKFLQLPVASDF

SEQ ID NO: 23581 - protein, 20 aa, synthetic construct
  source 1..20: note = Seed: SATGFKQSSKALQRPVASDF
SATGFKQSYKFLQMPVASDF

SEQ ID NO: 23582 - protein, 20 aa, synthetic construct
  source 1..20: note = Seed: SATGFKQSSKALQRPVASDF
SATGFKQSYKFLQVPVASDF

SEQ ID NO: 23583 - protein, 20 aa, synthetic construct
  source 1..20: note = Seed: SATGFKQSSKALQRPVASDF
SATGFLQSAKALQAPVASDF

SEQ ID NO: 23584 - protein, 20 aa, synthetic construct
  source 1..20: note = Seed: SATGFKQSSKALQRPVASDF
SATGFLQSAKFLQAPVASDF

SEQ ID NO: 23585 - protein, 20 aa, synthetic construct
  source 1..20: note = Seed: SATGFKQSSKALQRPVASDF
SATGFLQSAKFLQDPVASDF

SEQ ID NO: 23586 - protein, 20 aa, synthetic construct
  source 1..20: note = Seed: SATGFKQSSKALQRPVASDF
SATGFLQSAKFLQEPVASDF

SEQ ID NO: 23587 - protein, 20 aa, synthetic construct
  source 1..20: note = Seed: SATGFKQSSKALQRPVASDF
SATGFLQSAKFLQFPVASDF

SEQ ID NO: 23588 - protein, 20 aa, synthetic construct
  source 1..20: note = Seed: SATGFKQSSKALQRPVASDF
SATGFLQSAKFLQIPVASDF

SEQ ID NO: 23589 - protein, 20 aa, synthetic construct
  source 1..20: note = Seed: SATGFKQSSKALQRPVASDF
SATGFLQSAKFLQLPVASDF

SEQ ID NO: 23590 - protein, 20 aa, synthetic construct
  source 1..20: note = Seed: SATGFKQSSKALQRPVASDF
SATGFLQSAKFLQMPVASDF

SEQ ID NO: 23591 - protein, 20 aa, synthetic construct
  source 1..20: note = Seed: SATGFKQSSKALQRPVASDF
SATGFLQSAKFLQNPVASDF

SEQ ID NO: 23592 - protein, 20 aa, synthetic construct
  source 1..20: note = Seed: SATGFKQSSKALQRPVASDF
SATGFLQSAKFLQSPVASDF

SEQ ID NO: 23593 - protein, 20 aa, synthetic construct
  source 1..20: note = Seed: SATGFKQSSKALQRPVASDF
SATGFLQSAKFLQTPVASDF

SEQ ID NO: 23594 - protein, 20 aa, synthetic construct
  source 1..20: note = Seed: SATGFKQSSKALQRPVASDF
SATGFLQSAKFLQVPVASDF

SEQ ID NO: 23595 - protein, 20 aa, synthetic construct
  source 1..20: note = Seed: SATGFKQSSKALQRPVASDF
SATGFLQSAKFLQYPVASDF

SEQ ID NO: 23596 - protein, 20 aa, synthetic construct
  source 1..20: note = Seed: SATGFKQSSKALQRPVASDF
SATGFLQSAKLLQIPVASDF

SEQ ID NO: 23597 - protein, 20 aa, synthetic construct
  source 1..20: note = Seed: SATGFKQSSKALQRPVASDF
SATGFLQSAKLLQLPVASDF

SEQ ID NO: 23598 - protein, 20 aa, synthetic construct
  source 1..20: note = Seed: SATGFKQSSKALQRPVASDF
SATGFLQSAKLLQVPVASDF

SEQ ID NO: 23599 - protein, 20 aa, synthetic construct
  source 1..20: note = Seed: SATGFKQSSKALQRPVASDF
SATGFLQSAKPLQAPVASDF

SEQ ID NO: 23600 - protein, 20 aa, synthetic construct
  source 1..20: note = Seed: SATGFKQSSKALQRPVASDF
SATGFLQSAKYLQFPVASDF

SEQ ID NO: 23601 - protein, 20 aa, synthetic construct
  source 1..20: note = Seed: SATGFKQSSKALQRPVASDF
SATGFLQSAKYLQIPVASDF

SEQ ID NO: 23602 - protein, 20 aa, synthetic construct
  source 1..20: note = Seed: SATGFKQSSKALQRPVASDF
SATGFLQSAKYLQLPVASDF

SEQ ID NO: 23603 - protein, 20 aa, synthetic construct
  source 1..20: note = Seed: SATGFKQSSKALQRPVASDF
SATGFLQSAKYLQVPVASDF

SEQ ID NO: 23604 - protein, 20 aa, synthetic construct
  source 1..20: note = Seed: SATGFKQSSKALQRPVASDF
SATGFLQSCKFLQFPVASDF

SEQ ID NO: 23605 - protein, 20 aa, synthetic construct
  source 1..20: note = Seed: SATGFKQSSKALQRPVASDF
SATGFLQSCKFLQIPVASDF

SEQ ID NO: 23606 - protein, 20 aa, synthetic construct
  source 1..20: note = Seed: SATGFKQSSKALQRPVASDF
SATGFLQSCKFLQLPVASDF

SEQ ID NO: 23607 - protein, 20 aa, synthetic construct
  source 1..20: note = Seed: SATGFKQSSKALQRPVASDF
SATGFLQSCKFLQVPVASDF

SEQ ID NO: 23608 - protein, 20 aa, synthetic construct
  source 1..20: note = Seed: SATGFKQSSKALQRPVASDF
SATGFLQSDKFLQFPVASDF

SEQ ID NO: 23609 - protein, 20 aa, synthetic construct
  source 1..20: note = Seed: SATGFKQSSKALQRPVASDF
SATGFLQSDKFLQIPVASDF

SEQ ID NO: 23610 - protein, 20 aa, synthetic construct
  source 1..20: note = Seed: SATGFKQSSKALQRPVASDF
SATGFLQSDKFLQLPVASDF

SEQ ID NO: 23611 - protein, 20 aa, synthetic construct
  source 1..20: note = Seed: SATGFKQSSKALQRPVASDF
SATGFLQSDKFLQVPVASDF

SEQ ID NO: 23612 - protein, 20 aa, synthetic construct
  source 1..20: note = Seed: SATGFKQSSKALQRPVASDF
SATGFLQSEKFLQAPVASDF

SEQ ID NO: 23613 - protein, 20 aa, synthetic construct
  source 1..20: note = Seed: SATGFKQSSKALQRPVASDF
SATGFLQSEKFLQFPVASDF

SEQ ID NO: 23614 - protein, 20 aa, synthetic construct
  source 1..20: note = Seed: SATGFKQSSKALQRPVASDF
SATGFLQSEKFLQIPVASDF

SEQ ID NO: 23615 - protein, 20 aa, synthetic construct
  source 1..20: note = Seed: SATGFKQSSKALQRPVASDF
SATGFLQSEKFLQLPVASDF

SEQ ID NO: 23616 - protein, 20 aa, synthetic construct
  source 1..20: note = Seed: SATGFKQSSKALQRPVASDF
SATGFLQSEKFLQMPVASDF

SEQ ID NO: 23617 - protein, 20 aa, synthetic construct
  source 1..20: note = Seed: SATGFKQSSKALQRPVASDF
SATGFLQSEKFLQNPVASDF

SEQ ID NO: 23618 - protein, 20 aa, synthetic construct
  source 1..20: note = Seed: SATGFKQSSKALQRPVASDF
SATGFLQSEKFLQSPVASDF

SEQ ID NO: 23619 - protein, 20 aa, synthetic construct
  source 1..20: note = Seed: SATGFKQSSKALQRPVASDF
SATGFLQSEKFLQTPVASDF

SEQ ID NO: 23620 - protein, 20 aa, synthetic construct
  source 1..20: note = Seed: SATGFKQSSKALQRPVASDF
SATGFLQSEKFLQVPVASDF

SEQ ID NO: 23621 - protein, 20 aa, synthetic construct
  source 1..20: note = Seed: SATGFKQSSKALQRPVASDF
SATGFLQSEKFLQYPVASDF

SEQ ID NO: 23622 - protein, 20 aa, synthetic construct
  source 1..20: note = Seed: SATGFKQSSKALQRPVASDF
SATGFLQSEKILQIPVASDF

SEQ ID NO: 23623 - protein, 20 aa, synthetic construct
  source 1..20: note = Seed: SATGFKQSSKALQRPVASDF
SATGFLQSEKILQLPVASDF

SEQ ID NO: 23624 - protein, 20 aa, synthetic construct
  source 1..20: note = Seed: SATGFKQSSKALQRPVASDF
SATGFLQSEKILQVPVASDF

SEQ ID NO: 23625 - protein, 20 aa, synthetic construct
  source 1..20: note = Seed: SATGFKQSSKALQRPVASDF
SATGFLQSEKLLQFPVASDF

SEQ ID NO: 23626 - protein, 20 aa, synthetic construct
  source 1..20: note = Seed: SATGFKQSSKALQRPVASDF
SATGFLQSEKLLQIPVASDF

SEQ ID NO: 23627 - protein, 20 aa, synthetic construct
  source 1..20: note = Seed: SATGFKQSSKALQRPVASDF
SATGFLQSEKLLQLPVASDF

SEQ ID NO: 23628 - protein, 20 aa, synthetic construct
  source 1..20: note = Seed: SATGFKQSSKALQRPVASDF
SATGFLQSEKLLQMPVASDF

SEQ ID NO: 23629 - protein, 20 aa, synthetic construct
  source 1..20: note = Seed: SATGFKQSSKALQRPVASDF
SATGFLQSEKLLQVPVASDF

SEQ ID NO: 23630 - protein, 20 aa, synthetic construct
  source 1..20: note = Seed: SATGFKQSSKALQRPVASDF
SATGFLQSEKMLQIPVASDF

SEQ ID NO: 23631 - protein, 20 aa, synthetic construct
  source 1..20: note = Seed: SATGFKQSSKALQRPVASDF
SATGFLQSEKWLQIPVASDF

SEQ ID NO: 23632 - protein, 20 aa, synthetic construct
  source 1..20: note = Seed: SATGFKQSSKALQRPVASDF
SATGFLQSFKALQIPVASDF

SEQ ID NO: 23633 - protein, 20 aa, synthetic construct
  source 1..20: note = Seed: SATGFKQSSKALQRPVASDF
SATGFLQSFKALQLPVASDF

SEQ ID NO: 23634 - protein, 20 aa, synthetic construct
  source 1..20: note = Seed: SATGFKQSSKALQRPVASDF
SATGFLQSFKALQVPVASDF

SEQ ID NO: 23635 - protein, 20 aa, synthetic construct
  source 1..20: note = Seed: SATGFKQSSKALQRPVASDF
SATGFLQSFKFLQAPVASDF

SEQ ID NO: 23636 - protein, 20 aa, synthetic construct
  source 1..20: note = Seed: SATGFKQSSKALQRPVASDF
SATGFLQSFKFLQDPVASDF

SEQ ID NO: 23637 - protein, 20 aa, synthetic construct
  source 1..20: note = Seed: SATGFKQSSKALQRPVASDF
SATGFLQSFKFLQEPVASDF

SEQ ID NO: 23638 - protein, 20 aa, synthetic construct
  source 1..20: note = Seed: SATGFKQSSKALQRPVASDF
SATGFLQSFKFLQHPVASDF

SEQ ID NO: 23639 - protein, 20 aa, synthetic construct
  source 1..20: note = Seed: SATGFKQSSKALQRPVASDF
SATGFLQSFKFLQIPVASDF

SEQ ID NO: 23640 - protein, 20 aa, synthetic construct
  source 1..20: note = Seed: SATGFKQSSKALQRPVASDF
SATGFLQSFKFLQLPVASDF

SEQ ID NO: 23641 - protein, 20 aa, synthetic construct
  source 1..20: note = Seed: SATGFKQSSKALQRPVASDF
SATGFLQSFKFLQMPVASDF

SEQ ID NO: 23642 - protein, 20 aa, synthetic construct
  source 1..20: note = Seed: SATGFKQSSKALQRPVASDF
SATGFLQSFKFLQNPVASDF

SEQ ID NO: 23643 - protein, 20 aa, synthetic construct
  source 1..20: note = Seed: SATGFKQSSKALQRPVASDF
SATGFLQSFKFLQSPVASDF

SEQ ID NO: 23644 - protein, 20 aa, synthetic construct
  source 1..20: note = Seed: SATGFKQSSKALQRPVASDF
SATGFLQSFKFLQTPVASDF

SEQ ID NO: 23645 - protein, 20 aa, synthetic construct
  source 1..20: note = Seed: SATGFKQSSKALQRPVASDF
SATGFLQSFKFLQVPVASDF

SEQ ID NO: 23646 - protein, 20 aa, synthetic construct
  source 1..20: note = Seed: SATGFKQSSKALQRPVASDF
SATGFLQSFKFLQYPVASDF

SEQ ID NO: 23647 - protein, 20 aa, synthetic construct
  source 1..20: note = Seed: SATGFKQSSKALQRPVASDF
SATGFLQSFKILQIPVASDF

SEQ ID NO: 23648 - protein, 20 aa, synthetic construct
  source 1..20: note = Seed: SATGFKQSSKALQRPVASDF
SATGFLQSFKILQLPVASDF

SEQ ID NO: 23649 - protein, 20 aa, synthetic construct
  source 1..20: note = Seed: SATGFKQSSKALQRPVASDF
SATGFLQSFKILQMPVASDF

SEQ ID NO: 23650 - protein, 20 aa, synthetic construct
  source 1..20: note = Seed: SATGFKQSSKALQRPVASDF
SATGFLQSFKILQVPVASDF

SEQ ID NO: 23651 - protein, 20 aa, synthetic construct
  source 1..20: note = Seed: SATGFKQSSKALQRPVASDF
SATGFLQSFKILQYPVASDF

SEQ ID NO: 23652 - protein, 20 aa, synthetic construct
  source 1..20: note = Seed: SATGFKQSSKALQRPVASDF
SATGFLQSFKLLQEPVASDF

SEQ ID NO: 23653 - protein, 20 aa, synthetic construct
  source 1..20: note = Seed: SATGFKQSSKALQRPVASDF
SATGFLQSFKLLQFPVASDF

SEQ ID NO: 23654 - protein, 20 aa, synthetic construct
  source 1..20: note = Seed: SATGFKQSSKALQRPVASDF
SATGFLQSFKLLQIPVASDF

SEQ ID NO: 23655 - protein, 20 aa, synthetic construct
  source 1..20: note = Seed: SATGFKQSSKALQRPVASDF
SATGFLQSFKLLQLPVASDF

SEQ ID NO: 23656 - protein, 20 aa, synthetic construct
  source 1..20: note = Seed: SATGFKQSSKALQRPVASDF
SATGFLQSFKLLQMPVASDF

SEQ ID NO: 23657 - protein, 20 aa, synthetic construct
  source 1..20: note = Seed: SATGFKQSSKALQRPVASDF
SATGFLQSFKLLQNPVASDF

SEQ ID NO: 23658 - protein, 20 aa, synthetic construct
  source 1..20: note = Seed: SATGFKQSSKALQRPVASDF
SATGFLQSFKLLQVPVASDF

SEQ ID NO: 23659 - protein, 20 aa, synthetic construct
  source 1..20: note = Seed: SATGFKQSSKALQRPVASDF
SATGFLQSFKLLQYPVASDF

SEQ ID NO: 23660 - protein, 20 aa, synthetic construct
  source 1..20: note = Seed: SATGFKQSSKALQRPVASDF
SATGFLQSFKMLQIPVASDF

SEQ ID NO: 23661 - protein, 20 aa, synthetic construct
  source 1..20: note = Seed: SATGFKQSSKALQRPVASDF
SATGFLQSFKMLQLPVASDF

SEQ ID NO: 23662 - protein, 20 aa, synthetic construct
  source 1..20: note = Seed: SATGFKQSSKALQRPVASDF
SATGFLQSFKMLQMPVASDF

SEQ ID NO: 23663 - protein, 20 aa, synthetic construct
  source 1..20: note = Seed: SATGFKQSSKALQRPVASDF
SATGFLQSFKMLQVPVASDF

SEQ ID NO: 23664 - protein, 20 aa, synthetic construct
  source 1..20: note = Seed: SATGFKQSSKALQRPVASDF
SATGFLQSFKMLQYPVASDF

SEQ ID NO: 23665 - protein, 20 aa, synthetic construct
  source 1..20: note = Seed: SATGFKQSSKALQRPVASDF
SATGFLQSFKVLQIPVASDF

SEQ ID NO: 23666 - protein, 20 aa, synthetic construct
  source 1..20: note = Seed: SATGFKQSSKALQRPVASDF
SATGFLQSFKVLQLPVASDF

SEQ ID NO: 23667 - protein, 20 aa, synthetic construct
  source 1..20: note = Seed: SATGFKQSSKALQRPVASDF
SATGFLQSFKVLQVPVASDF

SEQ ID NO: 23668 - protein, 20 aa, synthetic construct
  source 1..20: note = Seed: SATGFKQSSKALQRPVASDF
SATGFLQSFKWLQIPVASDF

SEQ ID NO: 23669 - protein, 20 aa, synthetic construct
  source 1..20: note = Seed: SATGFKQSSKALQRPVASDF
SATGFLQSFKWLQLPVASDF

SEQ ID NO: 23670 - protein, 20 aa, synthetic construct
  source 1..20: note = Seed: SATGFKQSSKALQRPVASDF
SATGFLQSFKWLQVPVASDF

SEQ ID NO: 23671 - protein, 20 aa, synthetic construct
  source 1..20: note = Seed: SATGFKQSSKALQRPVASDF
SATGFLQSFKYLQIPVASDF

SEQ ID NO: 23672 - protein, 20 aa, synthetic construct
  source 1..20: note = Seed: SATGFKQSSKALQRPVASDF
SATGFLQSFKYLQLPVASDF

SEQ ID NO: 23673 - protein, 20 aa, synthetic construct
  source 1..20: note = Seed: SATGFKQSSKALQRPVASDF
SATGFLQSFKYLQMPVASDF

SEQ ID NO: 23674 - protein, 20 aa, synthetic construct
  source 1..20: note = Seed: SATGFKQSSKALQRPVASDF
SATGFLQSFKYLQVPVASDF

SEQ ID NO: 23675 - protein, 20 aa, synthetic construct
  source 1..20: note = Seed: SATGFKQSSKALQRPVASDF
SATGFLQSFKYLQYPVASDF

SEQ ID NO: 23676 - protein, 20 aa, synthetic construct
  source 1..20: note = Seed: SATGFKQSSKALQRPVASDF
SATGFLQSGKFLQIPVASDF

SEQ ID NO: 23677 - protein, 20 aa, synthetic construct
  source 1..20: note = Seed: SATGFKQSSKALQRPVASDF
SATGFLQSGKFLQLPVASDF

SEQ ID NO: 23678 - protein, 20 aa, synthetic construct
  source 1..20: note = Seed: SATGFKQSSKALQRPVASDF
SATGFLQSHKFLQAPVASDF

SEQ ID NO: 23679 - protein, 20 aa, synthetic construct
  source 1..20: note = Seed: SATGFKQSSKALQRPVASDF
SATGFLQSHKFLQDPVASDF

SEQ ID NO: 23680 - protein, 20 aa, synthetic construct
  source 1..20: note = Seed: SATGFKQSSKALQRPVASDF
SATGFLQSHKFLQEPVASDF

SEQ ID NO: 23681 - protein, 20 aa, synthetic construct
  source 1..20: note = Seed: SATGFKQSSKALQRPVASDF
SATGFLQSHKFLQFPVASDF

SEQ ID NO: 23682 - protein, 20 aa, synthetic construct
  source 1..20: note = Seed: SATGFKQSSKALQRPVASDF
SATGFLQSHKFLQHPVASDF

SEQ ID NO: 23683 - protein, 20 aa, synthetic construct
  source 1..20: note = Seed: SATGFKQSSKALQRPVASDF
SATGFLQSHKFLQIPVASDF

SEQ ID NO: 23684 - protein, 20 aa, synthetic construct
  source 1..20: note = Seed: SATGFKQSSKALQRPVASDF
SATGFLQSHKFLQKPVASDF

SEQ ID NO: 23685 - protein, 20 aa, synthetic construct
  source 1..20: note = Seed: SATGFKQSSKALQRPVASDF
SATGFLQSHKFLQLPVASDF

SEQ ID NO: 23686 - protein, 20 aa, synthetic construct
  source 1..20: note = Seed: SATGFKQSSKALQRPVASDF
SATGFLQSHKFLQMPVASDF

SEQ ID NO: 23687 - protein, 20 aa, synthetic construct
  source 1..20: note = Seed: SATGFKQSSKALQRPVASDF
SATGFLQSHKFLQNPVASDF

SEQ ID NO: 23688 - protein, 20 aa, synthetic construct
  source 1..20: note = Seed: SATGFKQSSKALQRPVASDF
SATGFLQSHKFLQRPVASDF

SEQ ID NO: 23689 - protein, 20 aa, synthetic construct
  source 1..20: note = Seed: SATGFKQSSKALQRPVASDF
SATGFLQSHKFLQSPVASDF

SEQ ID NO: 23690 - protein, 20 aa, synthetic construct
  source 1..20: note = Seed: SATGFKQSSKALQRPVASDF
SATGFLQSHKFLQTPVASDF

SEQ ID NO: 23691 - protein, 20 aa, synthetic construct
  source 1..20: note = Seed: SATGFKQSSKALQRPVASDF
SATGFLQSHKFLQVPVASDF

SEQ ID NO: 23692 - protein, 20 aa, synthetic construct
  source 1..20: note = Seed: SATGFKQSSKALQRPVASDF
SATGFLQSHKFLQWPVASDF

SEQ ID NO: 23693 - protein, 20 aa, synthetic construct
  source 1..20: note = Seed: SATGFKQSSKALQRPVASDF
SATGFLQSHKFLQYPVASDF

SEQ ID NO: 23694 - protein, 20 aa, synthetic construct
  source 1..20: note = Seed: SATGFKQSSKALQRPVASDF
SATGFLQSHKILQFPVASDF

SEQ ID NO: 23695 - protein, 20 aa, synthetic construct
  source 1..20: note = Seed: SATGFKQSSKALQRPVASDF
SATGFLQSHKILQIPVASDF

SEQ ID NO: 23696 - protein, 20 aa, synthetic construct
  source 1..20: note = Seed: SATGFKQSSKALQRPVASDF
SATGFLQSHKILQLPVASDF

SEQ ID NO: 23697 - protein, 20 aa, synthetic construct
  source 1..20: note = Seed: SATGFKQSSKALQRPVASDF
SATGFLQSHKILQMPVASDF

SEQ ID NO: 23698 - protein, 20 aa, synthetic construct
  source 1..20: note = Seed: SATGFKQSSKALQRPVASDF
SATGFLQSHKILQVPVASDF

SEQ ID NO: 23699 - protein, 20 aa, synthetic construct
  source 1..20: note = Seed: SATGFKQSSKALQRPVASDF
SATGFLQSHKLLQFPVASDF

SEQ ID NO: 23700 - protein, 20 aa, synthetic construct
  source 1..20: note = Seed: SATGFKQSSKALQRPVASDF
SATGFLQSHKLLQIPVASDF

SEQ ID NO: 23701 - protein, 20 aa, synthetic construct
  source 1..20: note = Seed: SATGFKQSSKALQRPVASDF
SATGFLQSHKLLQLPVASDF

SEQ ID NO: 23702 - protein, 20 aa, synthetic construct
  source 1..20: note = Seed: SATGFKQSSKALQRPVASDF
SATGFLQSHKLLQMPVASDF

SEQ ID NO: 23703 - protein, 20 aa, synthetic construct
  source 1..20: note = Seed: SATGFKQSSKALQRPVASDF
SATGFLQSHKLLQVPVASDF

SEQ ID NO: 23704 - protein, 20 aa, synthetic construct
  source 1..20: note = Seed: SATGFKQSSKALQRPVASDF
SATGFLQSHKLLQYPVASDF

SEQ ID NO: 23705 - protein, 20 aa, synthetic construct
  source 1..20: note = Seed: SATGFKQSSKALQRPVASDF
SATGFLQSHKMLQFPVASDF

SEQ ID NO: 23706 - protein, 20 aa, synthetic construct
  source 1..20: note = Seed: SATGFKQSSKALQRPVASDF
SATGFLQSHKMLQIPVASDF

SEQ ID NO: 23707 - protein, 20 aa, synthetic construct
  source 1..20: note = Seed: SATGFKQSSKALQRPVASDF
SATGFLQSHKMLQLPVASDF

SEQ ID NO: 23708 - protein, 20 aa, synthetic construct
  source 1..20: note = Seed: SATGFKQSSKALQRPVASDF
SATGFLQSHKMLQVPVASDF

SEQ ID NO: 23709 - protein, 20 aa, synthetic construct
  source 1..20: note = Seed: SATGFKQSSKALQRPVASDF
SATGFLQSHKVLQIPVASDF

SEQ ID NO: 23710 - protein, 20 aa, synthetic construct
  source 1..20: note = Seed: SATGFKQSSKALQRPVASDF
SATGFLQSHKVLQLPVASDF

SEQ ID NO: 23711 - protein, 20 aa, synthetic construct
  source 1..20: note = Seed: SATGFKQSSKALQRPVASDF
SATGFLQSHKWLQFPVASDF

SEQ ID NO: 23712 - protein, 20 aa, synthetic construct
  source 1..20: note = Seed: SATGFKQSSKALQRPVASDF
SATGFLQSHKWLQIPVASDF

SEQ ID NO: 23713 - protein, 20 aa, synthetic construct
  source 1..20: note = Seed: SATGFKQSSKALQRPVASDF
SATGFLQSHKWLQLPVASDF

SEQ ID NO: 23714 - protein, 20 aa, synthetic construct
  source 1..20: note = Seed: SATGFKQSSKALQRPVASDF
SATGFLQSHKWLQVPVASDF

SEQ ID NO: 23715 - protein, 20 aa, synthetic construct
  source 1..20: note = Seed: SATGFKQSSKALQRPVASDF
SATGFLQSHKYLQFPVASDF

SEQ ID NO: 23716 - protein, 20 aa, synthetic construct
  source 1..20: note = Seed: SATGFKQSSKALQRPVASDF
SATGFLQSHKYLQIPVASDF

SEQ ID NO: 23717 - protein, 20 aa, synthetic construct
  source 1..20: note = Seed: SATGFKQSSKALQRPVASDF
SATGFLQSHKYLQLPVASDF

SEQ ID NO: 23718 - protein, 20 aa, synthetic construct
  source 1..20: note = Seed: SATGFKQSSKALQRPVASDF
SATGFLQSHKYLQVPVASDF

SEQ ID NO: 23719 - protein, 20 aa, synthetic construct
  source 1..20: note = Seed: SATGFKQSSKALQRPVASDF
SATGFLQSIKFLQAPVASDF

SEQ ID NO: 23720 - protein, 20 aa, synthetic construct
  source 1..20: note = Seed: SATGFKQSSKALQRPVASDF
SATGFLQSIKFLQDPVASDF

SEQ ID NO: 23721 - protein, 20 aa, synthetic construct
  source 1..20: note = Seed: SATGFKQSSKALQRPVASDF
SATGFLQSIKFLQEPVASDF

SEQ ID NO: 23722 - protein, 20 aa, synthetic construct
  source 1..20: note = Seed: SATGFKQSSKALQRPVASDF
SATGFLQSIKFLQFPVASDF

SEQ ID NO: 23723 - protein, 20 aa, synthetic construct
  source 1..20: note = Seed: SATGFKQSSKALQRPVASDF
SATGFLQSIKFLQHPVASDF

SEQ ID NO: 23724 - protein, 20 aa, synthetic construct
  source 1..20: note = Seed: SATGFKQSSKALQRPVASDF
SATGFLQSIKFLQIPVASDF

SEQ ID NO: 23725 - protein, 20 aa, synthetic construct
  source 1..20: note = Seed: SATGFKQSSKALQRPVASDF
SATGFLQSIKFLQLPVASDF

SEQ ID NO: 23726 - protein, 20 aa, synthetic construct
  source 1..20: note = Seed: SATGFKQSSKALQRPVASDF
SATGFLQSIKFLQMPVASDF

SEQ ID NO: 23727 - protein, 20 aa, synthetic construct
  source 1..20: note = Seed: SATGFKQSSKALQRPVASDF
SATGFLQSIKFLQNPVASDF

SEQ ID NO: 23728 - protein, 20 aa, synthetic construct
  source 1..20: note = Seed: SATGFKQSSKALQRPVASDF
SATGFLQSIKFLQSPVASDF

SEQ ID NO: 23729 - protein, 20 aa, synthetic construct
  source 1..20: note = Seed: SATGFKQSSKALQRPVASDF
SATGFLQSIKFLQTPVASDF

SEQ ID NO: 23730 - protein, 20 aa, synthetic construct
  source 1..20: note = Seed: SATGFKQSSKALQRPVASDF
SATGFLQSIKFLQVPVASDF

SEQ ID NO: 23731 - protein, 20 aa, synthetic construct
  source 1..20: note = Seed: SATGFKQSSKALQRPVASDF
SATGFLQSIKFLQYPVASDF

SEQ ID NO: 23732 - protein, 20 aa, synthetic construct
  source 1..20: note = Seed: SATGFKQSSKALQRPVASDF
SATGFLQSIKILQIPVASDF

SEQ ID NO: 23733 - protein, 20 aa, synthetic construct
  source 1..20: note = Seed: SATGFKQSSKALQRPVASDF
SATGFLQSIKILQLPVASDF

SEQ ID NO: 23734 - protein, 20 aa, synthetic construct
  source 1..20: note = Seed: SATGFKQSSKALQRPVASDF
SATGFLQSIKLLQIPVASDF

SEQ ID NO: 23735 - protein, 20 aa, synthetic construct
  source 1..20: note = Seed: SATGFKQSSKALQRPVASDF
SATGFLQSIKLLQLPVASDF

SEQ ID NO: 23736 - protein, 20 aa, synthetic construct
  source 1..20: note = Seed: SATGFKQSSKALQRPVASDF
SATGFLQSIKLLQMPVASDF

SEQ ID NO: 23737 - protein, 20 aa, synthetic construct
  source 1..20: note = Seed: SATGFKQSSKALQRPVASDF
SATGFLQSIKLLQVPVASDF

SEQ ID NO: 23738 - protein, 20 aa, synthetic construct
  source 1..20: note = Seed: SATGFKQSSKALQRPVASDF
SATGFLQSIKLLQYPVASDF

SEQ ID NO: 23739 - protein, 20 aa, synthetic construct
  source 1..20: note = Seed: SATGFKQSSKALQRPVASDF
SATGFLQSIKWLQIPVASDF

SEQ ID NO: 23740 - protein, 20 aa, synthetic construct
  source 1..20: note = Seed: SATGFKQSSKALQRPVASDF
SATGFLQSIKWLQLPVASDF

SEQ ID NO: 23741 - protein, 20 aa, synthetic construct
  source 1..20: note = Seed: SATGFKQSSKALQRPVASDF
SATGFLQSIKWLQVPVASDF

SEQ ID NO: 23742 - protein, 20 aa, synthetic construct
  source 1..20: note = Seed: SATGFKQSSKALQRPVASDF
SATGFLQSIKYLQIPVASDF

SEQ ID NO: 23743 - protein, 20 aa, synthetic construct
  source 1..20: note = Seed: SATGFKQSSKALQRPVASDF
SATGFLQSIKYLQLPVASDF

SEQ ID NO: 23744 - protein, 20 aa, synthetic construct
  source 1..20: note = Seed: SATGFKQSSKALQRPVASDF
SATGFLQSIKYLQMPVASDF

SEQ ID NO: 23745 - protein, 20 aa, synthetic construct
  source 1..20: note = Seed: SATGFKQSSKALQRPVASDF
SATGFLQSIKYLQVPVASDF

SEQ ID NO: 23746 - protein, 20 aa, synthetic construct
  source 1..20: note = Seed: SATGFKQSSKALQRPVASDF
SATGFLQSKKFLQFPVASDF

SEQ ID NO: 23747 - protein, 20 aa, synthetic construct
  source 1..20: note = Seed: SATGFKQSSKALQRPVASDF
SATGFLQSKKFLQIPVASDF

SEQ ID NO: 23748 - protein, 20 aa, synthetic construct
  source 1..20: note = Seed: SATGFKQSSKALQRPVASDF
SATGFLQSKKFLQLPVASDF

SEQ ID NO: 23749 - protein, 20 aa, synthetic construct
  source 1..20: note = Seed: SATGFKQSSKALQRPVASDF
SATGFLQSKKFLQMPVASDF

SEQ ID NO: 23750 - protein, 20 aa, synthetic construct
  source 1..20: note = Seed: SATGFKQSSKALQRPVASDF
SATGFLQSKKFLQTPVASDF

SEQ ID NO: 23751 - protein, 20 aa, synthetic construct
  source 1..20: note = Seed: SATGFKQSSKALQRPVASDF
SATGFLQSKKFLQVPVASDF

SEQ ID NO: 23752 - protein, 20 aa, synthetic construct
  source 1..20: note = Seed: SATGFKQSSKALQRPVASDF
SATGFLQSKKLLQFPVASDF

SEQ ID NO: 23753 - protein, 20 aa, synthetic construct
  source 1..20: note = Seed: SATGFKQSSKALQRPVASDF
SATGFLQSKKLLQIPVASDF

SEQ ID NO: 23754 - protein, 20 aa, synthetic construct
  source 1..20: note = Seed: SATGFKQSSKALQRPVASDF
SATGFLQSLKFLQAPVASDF

SEQ ID NO: 23755 - protein, 20 aa, synthetic construct
  source 1..20: note = Seed: SATGFKQSSKALQRPVASDF
SATGFLQSLKFLQDPVASDF

SEQ ID NO: 23756 - protein, 20 aa, synthetic construct
  source 1..20: note = Seed: SATGFKQSSKALQRPVASDF
SATGFLQSLKFLQEPVASDF

SEQ ID NO: 23757 - protein, 20 aa, synthetic construct
  source 1..20: note = Seed: SATGFKQSSKALQRPVASDF
SATGFLQSLKFLQFPVASDF

SEQ ID NO: 23758 - protein, 20 aa, synthetic construct
  source 1..20: note = Seed: SATGFKQSSKALQRPVASDF
SATGFLQSLKFLQHPVASDF

SEQ ID NO: 23759 - protein, 20 aa, synthetic construct
  source 1..20: note = Seed: SATGFKQSSKALQRPVASDF
SATGFLQSLKFLQIPVASDF

SEQ ID NO: 23760 - protein, 20 aa, synthetic construct
  source 1..20: note = Seed: SATGFKQSSKALQRPVASDF
SATGFLQSLKFLQLPVASDF

SEQ ID NO: 23761 - protein, 20 aa, synthetic construct
  source 1..20: note = Seed: SATGFKQSSKALQRPVASDF
SATGFLQSLKFLQMPVASDF

SEQ ID NO: 23762 - protein, 20 aa, synthetic construct
  source 1..20: note = Seed: SATGFKQSSKALQRPVASDF
SATGFLQSLKFLQNPVASDF

SEQ ID NO: 23763 - protein, 20 aa, synthetic construct
  source 1..20: note = Seed: SATGFKQSSKALQRPVASDF
SATGFLQSLKFLQSPVASDF

SEQ ID NO: 23764 - protein, 20 aa, synthetic construct
  source 1..20: note = Seed: SATGFKQSSKALQRPVASDF
SATGFLQSLKFLQTPVASDF

SEQ ID NO: 23765 - protein, 20 aa, synthetic construct
  source 1..20: note = Seed: SATGFKQSSKALQRPVASDF
SATGFLQSLKFLQVPVASDF

SEQ ID NO: 23766 - protein, 20 aa, synthetic construct
  source 1..20: note = Seed: SATGFKQSSKALQRPVASDF
SATGFLQSLKFLQYPVASDF

SEQ ID NO: 23767 - protein, 20 aa, synthetic construct
  source 1..20: note = Seed: SATGFKQSSKALQRPVASDF
SATGFLQSLKYLQIPVASDF

SEQ ID NO: 23768 - protein, 20 aa, synthetic construct
  source 1..20: note = Seed: SATGFKQSSKALQRPVASDF
SATGFLQSLKYLQLPVASDF

SEQ ID NO: 23769 - protein, 20 aa, synthetic construct
  source 1..20: note = Seed: SATGFKQSSKALQRPVASDF
SATGFLQSLKYLQVPVASDF

SEQ ID NO: 23770 - protein, 20 aa, synthetic construct
  source 1..20: note = Seed: SATGFKQSSKALQRPVASDF
SATGFLQSMKFLQAPVASDF

SEQ ID NO: 23771 - protein, 20 aa, synthetic construct
  source 1..20: note = Seed: SATGFKQSSKALQRPVASDF
SATGFLQSMKFLQEPVASDF

SEQ ID NO: 23772 - protein, 20 aa, synthetic construct
  source 1..20: note = Seed: SATGFKQSSKALQRPVASDF
SATGFLQSMKFLQFPVASDF

SEQ ID NO: 23773 - protein, 20 aa, synthetic construct
  source 1..20: note = Seed: SATGFKQSSKALQRPVASDF
SATGFLQSMKFLQHPVASDF

SEQ ID NO: 23774 - protein, 20 aa, synthetic construct
  source 1..20: note = Seed: SATGFKQSSKALQRPVASDF
SATGFLQSMKFLQIPVASDF

SEQ ID NO: 23775 - protein, 20 aa, synthetic construct
  source 1..20: note = Seed: SATGFKQSSKALQRPVASDF
SATGFLQSMKFLQLPVASDF

SEQ ID NO: 23776 - protein, 20 aa, synthetic construct
  source 1..20: note = Seed: SATGFKQSSKALQRPVASDF
SATGFLQSMKFLQMPVASDF

SEQ ID NO: 23777 - protein, 20 aa, synthetic construct
  source 1..20: note = Seed: SATGFKQSSKALQRPVASDF
SATGFLQSMKFLQNPVASDF

SEQ ID NO: 23778 - protein, 20 aa, synthetic construct
  source 1..20: note = Seed: SATGFKQSSKALQRPVASDF
SATGFLQSMKFLQSPVASDF

SEQ ID NO: 23779 - protein, 20 aa, synthetic construct
  source 1..20: note = Seed: SATGFKQSSKALQRPVASDF
SATGFLQSMKFLQTPVASDF

SEQ ID NO: 23780 - protein, 20 aa, synthetic construct
  source 1..20: note = Seed: SATGFKQSSKALQRPVASDF
SATGFLQSMKFLQVPVASDF

SEQ ID NO: 23781 - protein, 20 aa, synthetic construct
  source 1..20: note = Seed: SATGFKQSSKALQRPVASDF
SATGFLQSMKFLQYPVASDF

SEQ ID NO: 23782 - protein, 20 aa, synthetic construct
  source 1..20: note = Seed: SATGFKQSSKALQRPVASDF
SATGFLQSMKYLQIPVASDF

SEQ ID NO: 23783 - protein, 20 aa, synthetic construct
  source 1..20: note = Seed: SATGFKQSSKALQRPVASDF
SATGFLQSMKYLQLPVASDF

SEQ ID NO: 23784 - protein, 20 aa, synthetic construct
  source 1..20: note = Seed: SATGFKQSSKALQRPVASDF
SATGFLQSMKYLQVPVASDF

SEQ ID NO: 23785 - protein, 20 aa, synthetic construct
  source 1..20: note = Seed: SATGFKQSSKALQRPVASDF
SATGFLQSNKFLQAPVASDF

SEQ ID NO: 23786 - protein, 20 aa, synthetic construct
  source 1..20: note = Seed: SATGFKQSSKALQRPVASDF
SATGFLQSNKFLQFPVASDF

SEQ ID NO: 23787 - protein, 20 aa, synthetic construct
  source 1..20: note = Seed: SATGFKQSSKALQRPVASDF
SATGFLQSNKFLQIPVASDF

SEQ ID NO: 23788 - protein, 20 aa, synthetic construct
  source 1..20: note = Seed: SATGFKQSSKALQRPVASDF
SATGFLQSNKFLQLPVASDF

SEQ ID NO: 23789 - protein, 20 aa, synthetic construct
  source 1..20: note = Seed: SATGFKQSSKALQRPVASDF
SATGFLQSNKFLQMPVASDF

SEQ ID NO: 23790 - protein, 20 aa, synthetic construct
  source 1..20: note = Seed: SATGFKQSSKALQRPVASDF
SATGFLQSNKFLQVPVASDF

SEQ ID NO: 23791 - protein, 20 aa, synthetic construct
  source 1..20: note = Seed: SATGFKQSSKALQRPVASDF
SATGFLQSPKFLQIPVASDF

SEQ ID NO: 23792 - protein, 20 aa, synthetic construct
  source 1..20: note = Seed: SATGFKQSSKALQRPVASDF
SATGFLQSPKFLQLPVASDF

SEQ ID NO: 23793 - protein, 20 aa, synthetic construct
  source 1..20: note = Seed: SATGFKQSSKALQRPVASDF
SATGFLQSQKFLQAPVASDF

SEQ ID NO: 23794 - protein, 20 aa, synthetic construct
  source 1..20: note = Seed: SATGFKQSSKALQRPVASDF
SATGFLQSQKFLQFPVASDF

SEQ ID NO: 23795 - protein, 20 aa, synthetic construct
  source 1..20: note = Seed: SATGFKQSSKALQRPVASDF
SATGFLQSQKFLQIPVASDF

SEQ ID NO: 23796 - protein, 20 aa, synthetic construct
  source 1..20: note = Seed: SATGFKQSSKALQRPVASDF
SATGFLQSQKFLQLPVASDF

SEQ ID NO: 23797 - protein, 20 aa, synthetic construct
  source 1..20: note = Seed: SATGFKQSSKALQRPVASDF
SATGFLQSQKFLQMPVASDF

SEQ ID NO: 23798 - protein, 20 aa, synthetic construct
  source 1..20: note = Seed: SATGFKQSSKALQRPVASDF
SATGFLQSQKFLQTPVASDF

SEQ ID NO: 23799 - protein, 20 aa, synthetic construct
  source 1..20: note = Seed: SATGFKQSSKALQRPVASDF
SATGFLQSQKFLQVPVASDF

SEQ ID NO: 23800 - protein, 20 aa, synthetic construct
  source 1..20: note = Seed: SATGFKQSSKALQRPVASDF
SATGFLQSQKFLQYPVASDF

SEQ ID NO: 23801 - protein, 20 aa, synthetic construct
  source 1..20: note = Seed: SATGFKQSSKALQRPVASDF
SATGFLQSQKLLQIPVASDF

SEQ ID NO: 23802 - protein, 20 aa, synthetic construct
  source 1..20: note = Seed: SATGFKQSSKALQRPVASDF
SATGFLQSQKLLQLPVASDF

SEQ ID NO: 23803 - protein, 20 aa, synthetic construct
  source 1..20: note = Seed: SATGFKQSSKALQRPVASDF
SATGFLQSQKLLQVPVASDF

SEQ ID NO: 23804 - protein, 20 aa, synthetic construct
  source 1..20: note = Seed: SATGFKQSSKALQRPVASDF
SATGFLQSRKFLQFPVASDF

SEQ ID NO: 23805 - protein, 20 aa, synthetic construct
  source 1..20: note = Seed: SATGFKQSSKALQRPVASDF
SATGFLQSRKFLQIPVASDF

SEQ ID NO: 23806 - protein, 20 aa, synthetic construct
  source 1..20: note = Seed: SATGFKQSSKALQRPVASDF
SATGFLQSRKFLQLPVASDF

SEQ ID NO: 23807 - protein, 20 aa, synthetic construct
  source 1..20: note = Seed: SATGFKQSSKALQRPVASDF
SATGFLQSRKFLQMPVASDF

SEQ ID NO: 23808 - protein, 20 aa, synthetic construct
  source 1..20: note = Seed: SATGFKQSSKALQRPVASDF
SATGFLQSRKFLQVPVASDF

SEQ ID NO: 23809 - protein, 20 aa, synthetic construct
  source 1..20: note = Seed: SATGFKQSSKALQRPVASDF
SATGFLQSSKALQAPVASDF

SEQ ID NO: 23810 - protein, 20 aa, synthetic construct
  source 1..20: note = Seed: SATGFKQSSKALQRPVASDF
SATGFLQSSKFLQAPVASDF

SEQ ID NO: 23811 - protein, 20 aa, synthetic construct
  source 1..20: note = Seed: SATGFKQSSKALQRPVASDF
SATGFLQSSKFLQDPVASDF

SEQ ID NO: 23812 - protein, 20 aa, synthetic construct
  source 1..20: note = Seed: SATGFKQSSKALQRPVASDF
SATGFLQSSKFLQEPVASDF

SEQ ID NO: 23813 - protein, 20 aa, synthetic construct
  source 1..20: note = Seed: SATGFKQSSKALQRPVASDF
SATGFLQSSKFLQFPVASDF

SEQ ID NO: 23814 - protein, 20 aa, synthetic construct
  source 1..20: note = Seed: SATGFKQSSKALQRPVASDF
SATGFLQSSKFLQIPVASDF

SEQ ID NO: 23815 - protein, 20 aa, synthetic construct
  source 1..20: note = Seed: SATGFKQSSKALQRPVASDF
SATGFLQSSKFLQLPVASDF

SEQ ID NO: 23816 - protein, 20 aa, synthetic construct
  source 1..20: note = Seed: SATGFKQSSKALQRPVASDF
SATGFLQSSKFLQMPVASDF

SEQ ID NO: 23817 - protein, 20 aa, synthetic construct
  source 1..20: note = Seed: SATGFKQSSKALQRPVASDF
SATGFLQSSKFLQNPVASDF

SEQ ID NO: 23818 - protein, 20 aa, synthetic construct
  source 1..20: note = Seed: SATGFKQSSKALQRPVASDF
SATGFLQSSKFLQSPVASDF

SEQ ID NO: 23819 - protein, 20 aa, synthetic construct
  source 1..20: note = Seed: SATGFKQSSKALQRPVASDF
SATGFLQSSKFLQTPVASDF

SEQ ID NO: 23820 - protein, 20 aa, synthetic construct
  source 1..20: note = Seed: SATGFKQSSKALQRPVASDF
SATGFLQSSKFLQVPVASDF

SEQ ID NO: 23821 - protein, 20 aa, synthetic construct
  source 1..20: note = Seed: SATGFKQSSKALQRPVASDF
SATGFLQSSKFLQYPVASDF

SEQ ID NO: 23822 - protein, 20 aa, synthetic construct
  source 1..20: note = Seed: SATGFKQSSKALQRPVASDF
SATGFLQSSKILQIPVASDF

SEQ ID NO: 23823 - protein, 20 aa, synthetic construct
  source 1..20: note = Seed: SATGFKQSSKALQRPVASDF
SATGFLQSSKILQLPVASDF

SEQ ID NO: 23824 - protein, 20 aa, synthetic construct
  source 1..20: note = Seed: SATGFKQSSKALQRPVASDF
SATGFLQSSKILQVPVASDF

SEQ ID NO: 23825 - protein, 20 aa, synthetic construct
  source 1..20: note = Seed: SATGFKQSSKALQRPVASDF
SATGFLQSSKLLQFPVASDF

SEQ ID NO: 23826 - protein, 20 aa, synthetic construct
  source 1..20: note = Seed: SATGFKQSSKALQRPVASDF
SATGFLQSSKLLQIPVASDF

SEQ ID NO: 23827 - protein, 20 aa, synthetic construct
  source 1..20: note = Seed: SATGFKQSSKALQRPVASDF
SATGFLQSSKLLQLPVASDF

SEQ ID NO: 23828 - protein, 20 aa, synthetic construct
  source 1..20: note = Seed: SATGFKQSSKALQRPVASDF
SATGFLQSSKLLQMPVASDF

SEQ ID NO: 23829 - protein, 20 aa, synthetic construct
  source 1..20: note = Seed: SATGFKQSSKALQRPVASDF
SATGFLQSSKLLQVPVASDF

SEQ ID NO: 23830 - protein, 20 aa, synthetic construct
  source 1..20: note = Seed: SATGFKQSSKALQRPVASDF
SATGFLQSSKMLQIPVASDF

SEQ ID NO: 23831 - protein, 20 aa, synthetic construct
  source 1..20: note = Seed: SATGFKQSSKALQRPVASDF
SATGFLQSSKMLQLPVASDF

SEQ ID NO: 23832 - protein, 20 aa, synthetic construct
  source 1..20: note = Seed: SATGFKQSSKALQRPVASDF
SATGFLQSSKMLQVPVASDF

SEQ ID NO: 23833 - protein, 20 aa, synthetic construct
  source 1..20: note = Seed: SATGFKQSSKALQRPVASDF
SATGFLQSSKWLQFPVASDF

SEQ ID NO: 23834 - protein, 20 aa, synthetic construct
  source 1..20: note = Seed: SATGFKQSSKALQRPVASDF
SATGFLQSSKWLQIPVASDF

SEQ ID NO: 23835 - protein, 20 aa, synthetic construct
  source 1..20: note = Seed: SATGFKQSSKALQRPVASDF
SATGFLQSSKWLQLPVASDF

SEQ ID NO: 23836 - protein, 20 aa, synthetic construct
  source 1..20: note = Seed: SATGFKQSSKALQRPVASDF
SATGFLQSSKWLQVPVASDF

SEQ ID NO: 23837 - protein, 20 aa, synthetic construct
  source 1..20: note = Seed: SATGFKQSSKALQRPVASDF
SATGFLQSSKYLQFPVASDF

SEQ ID NO: 23838 - protein, 20 aa, synthetic construct
  source 1..20: note = Seed: SATGFKQSSKALQRPVASDF
SATGFLQSSKYLQIPVASDF

SEQ ID NO: 23839 - protein, 20 aa, synthetic construct
  source 1..20: note = Seed: SATGFKQSSKALQRPVASDF
SATGFLQSSKYLQLPVASDF

SEQ ID NO: 23840 - protein, 20 aa, synthetic construct
  source 1..20: note = Seed: SATGFKQSSKALQRPVASDF
SATGFLQSSKYLQVPVASDF

SEQ ID NO: 23841 - protein, 20 aa, synthetic construct
  source 1..20: note = Seed: SATGFKQSSKALQRPVASDF
SATGFLQSTKALQIPVASDF

SEQ ID NO: 23842 - protein, 20 aa, synthetic construct
  source 1..20: note = Seed: SATGFKQSSKALQRPVASDF
SATGFLQSTKALQLPVASDF

SEQ ID NO: 23843 - protein, 20 aa, synthetic construct
  source 1..20: note = Seed: SATGFKQSSKALQRPVASDF
SATGFLQSTKALQVPVASDF

SEQ ID NO: 23844 - protein, 20 aa, synthetic construct
  source 1..20: note = Seed: SATGFKQSSKALQRPVASDF
SATGFLQSTKFLQAPVASDF

SEQ ID NO: 23845 - protein, 20 aa, synthetic construct
  source 1..20: note = Seed: SATGFKQSSKALQRPVASDF
SATGFLQSTKFLQDPVASDF

SEQ ID NO: 23846 - protein, 20 aa, synthetic construct
  source 1..20: note = Seed: SATGFKQSSKALQRPVASDF
SATGFLQSTKFLQEPVASDF

SEQ ID NO: 23847 - protein, 20 aa, synthetic construct
  source 1..20: note = Seed: SATGFKQSSKALQRPVASDF
SATGFLQSTKFLQFPVASDF

SEQ ID NO: 23848 - protein, 20 aa, synthetic construct
  source 1..20: note = Seed: SATGFKQSSKALQRPVASDF
SATGFLQSTKFLQHPVASDF

SEQ ID NO: 23849 - protein, 20 aa, synthetic construct
  source 1..20: note = Seed: SATGFKQSSKALQRPVASDF
SATGFLQSTKFLQIPVASDF

SEQ ID NO: 23850 - protein, 20 aa, synthetic construct
  source 1..20: note = Seed: SATGFKQSSKALQRPVASDF
SATGFLQSTKFLQLPVASDF

SEQ ID NO: 23851 - protein, 20 aa, synthetic construct
  source 1..20: note = Seed: SATGFKQSSKALQRPVASDF
SATGFLQSTKFLQMPVASDF

SEQ ID NO: 23852 - protein, 20 aa, synthetic construct
  source 1..20: note = Seed: SATGFKQSSKALQRPVASDF
SATGFLQSTKFLQNPVASDF

SEQ ID NO: 23853 - protein, 20 aa, synthetic construct
  source 1..20: note = Seed: SATGFKQSSKALQRPVASDF
SATGFLQSTKFLQQPVASDF

SEQ ID NO: 23854 - protein, 20 aa, synthetic construct
  source 1..20: note = Seed: SATGFKQSSKALQRPVASDF
SATGFLQSTKFLQRPVASDF

SEQ ID NO: 23855 - protein, 20 aa, synthetic construct
  source 1..20: note = Seed: SATGFKQSSKALQRPVASDF
SATGFLQSTKFLQSPVASDF

SEQ ID NO: 23856 - protein, 20 aa, synthetic construct
  source 1..20: note = Seed: SATGFKQSSKALQRPVASDF
SATGFLQSTKFLQTPVASDF

SEQ ID NO: 23857 - protein, 20 aa, synthetic construct
  source 1..20: note = Seed: SATGFKQSSKALQRPVASDF
SATGFLQSTKFLQVPVASDF

SEQ ID NO: 23858 - protein, 20 aa, synthetic construct
  source 1..20: note = Seed: SATGFKQSSKALQRPVASDF
SATGFLQSTKFLQYPVASDF

SEQ ID NO: 23859 - protein, 20 aa, synthetic construct
  source 1..20: note = Seed: SATGFKQSSKALQRPVASDF
SATGFLQSTKILQFPVASDF

SEQ ID NO: 23860 - protein, 20 aa, synthetic construct
  source 1..20: note = Seed: SATGFKQSSKALQRPVASDF
SATGFLQSTKILQIPVASDF

SEQ ID NO: 23861 - protein, 20 aa, synthetic construct
  source 1..20: note = Seed: SATGFKQSSKALQRPVASDF
SATGFLQSTKILQLPVASDF

SEQ ID NO: 23862 - protein, 20 aa, synthetic construct
  source 1..20: note = Seed: SATGFKQSSKALQRPVASDF
SATGFLQSTKILQMPVASDF

SEQ ID NO: 23863 - protein, 20 aa, synthetic construct
  source 1..20: note = Seed: SATGFKQSSKALQRPVASDF
SATGFLQSTKILQVPVASDF

SEQ ID NO: 23864 - protein, 20 aa, synthetic construct
  source 1..20: note = Seed: SATGFKQSSKALQRPVASDF
SATGFLQSTKLLQFPVASDF

SEQ ID NO: 23865 - protein, 20 aa, synthetic construct
  source 1..20: note = Seed: SATGFKQSSKALQRPVASDF
SATGFLQSTKLLQIPVASDF

SEQ ID NO: 23866 - protein, 20 aa, synthetic construct
  source 1..20: note = Seed: SATGFKQSSKALQRPVASDF
SATGFLQSTKLLQLPVASDF

SEQ ID NO: 23867 - protein, 20 aa, synthetic construct
  source 1..20: note = Seed: SATGFKQSSKALQRPVASDF
SATGFLQSTKLLQMPVASDF

SEQ ID NO: 23868 - protein, 20 aa, synthetic construct
  source 1..20: note = Seed: SATGFKQSSKALQRPVASDF
SATGFLQSTKLLQVPVASDF

SEQ ID NO: 23869 - protein, 20 aa, synthetic construct
  source 1..20: note = Seed: SATGFKQSSKALQRPVASDF
SATGFLQSTKLLQYPVASDF

SEQ ID NO: 23870 - protein, 20 aa, synthetic construct
  source 1..20: note = Seed: SATGFKQSSKALQRPVASDF
SATGFLQSTKMLQIPVASDF

SEQ ID NO: 23871 - protein, 20 aa, synthetic construct
  source 1..20: note = Seed: SATGFKQSSKALQRPVASDF
SATGFLQSTKMLQLPVASDF

SEQ ID NO: 23872 - protein, 20 aa, synthetic construct
  source 1..20: note = Seed: SATGFKQSSKALQRPVASDF
SATGFLQSTKMLQVPVASDF

SEQ ID NO: 23873 - protein, 20 aa, synthetic construct
  source 1..20: note = Seed: SATGFKQSSKALQRPVASDF
SATGFLQSTKVLQIPVASDF

SEQ ID NO: 23874 - protein, 20 aa, synthetic construct
  source 1..20: note = Seed: SATGFKQSSKALQRPVASDF
SATGFLQSTKVLQLPVASDF

SEQ ID NO: 23875 - protein, 20 aa, synthetic construct
  source 1..20: note = Seed: SATGFKQSSKALQRPVASDF
SATGFLQSTKVLQVPVASDF

SEQ ID NO: 23876 - protein, 20 aa, synthetic construct
  source 1..20: note = Seed: SATGFKQSSKALQRPVASDF
SATGFLQSTKWLQFPVASDF

SEQ ID NO: 23877 - protein, 20 aa, synthetic construct
  source 1..20: note = Seed: SATGFKQSSKALQRPVASDF
SATGFLQSTKWLQIPVASDF

SEQ ID NO: 23878 - protein, 20 aa, synthetic construct
  source 1..20: note = Seed: SATGFKQSSKALQRPVASDF
SATGFLQSTKWLQLPVASDF

SEQ ID NO: 23879 - protein, 20 aa, synthetic construct
  source 1..20: note = Seed: SATGFKQSSKALQRPVASDF
SATGFLQSTKWLQVPVASDF

SEQ ID NO: 23880 - protein, 20 aa, synthetic construct
  source 1..20: note = Seed: SATGFKQSSKALQRPVASDF
SATGFLQSTKYLQFPVASDF

SEQ ID NO: 23881 - protein, 20 aa, synthetic construct
  source 1..20: note = Seed: SATGFKQSSKALQRPVASDF
SATGFLQSTKYLQIPVASDF

SEQ ID NO: 23882 - protein, 20 aa, synthetic construct
  source 1..20: note = Seed: SATGFKQSSKALQRPVASDF
SATGFLQSTKYLQLPVASDF

SEQ ID NO: 23883 - protein, 20 aa, synthetic construct
  source 1..20: note = Seed: SATGFKQSSKALQRPVASDF
SATGFLQSTKYLQMPVASDF

SEQ ID NO: 23884 - protein, 20 aa, synthetic construct
  source 1..20: note = Seed: SATGFKQSSKALQRPVASDF
SATGFLQSTKYLQVPVASDF

SEQ ID NO: 23885 - protein, 20 aa, synthetic construct
  source 1..20: note = Seed: SATGFKQSSKALQRPVASDF
SATGFLQSVKFLQAPVASDF

SEQ ID NO: 23886 - protein, 20 aa, synthetic construct
  source 1..20: note = Seed: SATGFKQSSKALQRPVASDF
SATGFLQSVKFLQDPVASDF

SEQ ID NO: 23887 - protein, 20 aa, synthetic construct
  source 1..20: note = Seed: SATGFKQSSKALQRPVASDF
SATGFLQSVKFLQEPVASDF

SEQ ID NO: 23888 - protein, 20 aa, synthetic construct
  source 1..20: note = Seed: SATGFKQSSKALQRPVASDF
SATGFLQSVKFLQFPVASDF

SEQ ID NO: 23889 - protein, 20 aa, synthetic construct
  source 1..20: note = Seed: SATGFKQSSKALQRPVASDF
SATGFLQSVKFLQHPVASDF

SEQ ID NO: 23890 - protein, 20 aa, synthetic construct
  source 1..20: note = Seed: SATGFKQSSKALQRPVASDF
SATGFLQSVKFLQIPVASDF

SEQ ID NO: 23891 - protein, 20 aa, synthetic construct
  source 1..20: note = Seed: SATGFKQSSKALQRPVASDF
SATGFLQSVKFLQLPVASDF

SEQ ID NO: 23892 - protein, 20 aa, synthetic construct
  source 1..20: note = Seed: SATGFKQSSKALQRPVASDF
SATGFLQSVKFLQMPVASDF

SEQ ID NO: 23893 - protein, 20 aa, synthetic construct
  source 1..20: note = Seed: SATGFKQSSKALQRPVASDF
SATGFLQSVKFLQNPVASDF

SEQ ID NO: 23894 - protein, 20 aa, synthetic construct
  source 1..20: note = Seed: SATGFKQSSKALQRPVASDF
SATGFLQSVKFLQSPVASDF

SEQ ID NO: 23895 - protein, 20 aa, synthetic construct
  source 1..20: note = Seed: SATGFKQSSKALQRPVASDF
SATGFLQSVKFLQTPVASDF

SEQ ID NO: 23896 - protein, 20 aa, synthetic construct
  source 1..20: note = Seed: SATGFKQSSKALQRPVASDF
SATGFLQSVKFLQVPVASDF

SEQ ID NO: 23897 - protein, 20 aa, synthetic construct
  source 1..20: note = Seed: SATGFKQSSKALQRPVASDF
SATGFLQSVKFLQYPVASDF

SEQ ID NO: 23898 - protein, 20 aa, synthetic construct
  source 1..20: note = Seed: SATGFKQSSKALQRPVASDF
SATGFLQSVKLLQIPVASDF

SEQ ID NO: 23899 - protein, 20 aa, synthetic construct
  source 1..20: note = Seed: SATGFKQSSKALQRPVASDF
SATGFLQSVKLLQLPVASDF

SEQ ID NO: 23900 - protein, 20 aa, synthetic construct
  source 1..20: note = Seed: SATGFKQSSKALQRPVASDF
SATGFLQSVKLLQVPVASDF

SEQ ID NO: 23901 - protein, 20 aa, synthetic construct
  source 1..20: note = Seed: SATGFKQSSKALQRPVASDF
SATGFLQSVKLLQYPVASDF

SEQ ID NO: 23902 - protein, 20 aa, synthetic construct
  source 1..20: note = Seed: SATGFKQSSKALQRPVASDF
SATGFLQSVKWLQIPVASDF

SEQ ID NO: 23903 - protein, 20 aa, synthetic construct
  source 1..20: note = Seed: SATGFKQSSKALQRPVASDF
SATGFLQSVKWLQLPVASDF

SEQ ID NO: 23904 - protein, 20 aa, synthetic construct
  source 1..20: note = Seed: SATGFKQSSKALQRPVASDF
SATGFLQSVKYLQFPVASDF

SEQ ID NO: 23905 - protein, 20 aa, synthetic construct
  source 1..20: note = Seed: SATGFKQSSKALQRPVASDF
SATGFLQSVKYLQIPVASDF

SEQ ID NO: 23906 - protein, 20 aa, synthetic construct
  source 1..20: note = Seed: SATGFKQSSKALQRPVASDF
SATGFLQSVKYLQLPVASDF

SEQ ID NO: 23907 - protein, 20 aa, synthetic construct
  source 1..20: note = Seed: SATGFKQSSKALQRPVASDF
SATGFLQSVKYLQMPVASDF

SEQ ID NO: 23908 - protein, 20 aa, synthetic construct
  source 1..20: note = Seed: SATGFKQSSKALQRPVASDF
SATGFLQSVKYLQVPVASDF

SEQ ID NO: 23909 - protein, 20 aa, synthetic construct
  source 1..20: note = Seed: SATGFKQSSKALQRPVASDF
SATGFLQSWKFLQAPVASDF

SEQ ID NO: 23910 - protein, 20 aa, synthetic construct
  source 1..20: note = Seed: SATGFKQSSKALQRPVASDF
SATGFLQSWKFLQEPVASDF

SEQ ID NO: 23911 - protein, 20 aa, synthetic construct
  source 1..20: note = Seed: SATGFKQSSKALQRPVASDF
SATGFLQSWKFLQFPVASDF

SEQ ID NO: 23912 - protein, 20 aa, synthetic construct
  source 1..20: note = Seed: SATGFKQSSKALQRPVASDF
SATGFLQSWKFLQIPVASDF

SEQ ID NO: 23913 - protein, 20 aa, synthetic construct
  source 1..20: note = Seed: SATGFKQSSKALQRPVASDF
SATGFLQSWKFLQLPVASDF

SEQ ID NO: 23914 - protein, 20 aa, synthetic construct
  source 1..20: note = Seed: SATGFKQSSKALQRPVASDF
SATGFLQSWKFLQMPVASDF

SEQ ID NO: 23915 - protein, 20 aa, synthetic construct
  source 1..20: note = Seed: SATGFKQSSKALQRPVASDF
SATGFLQSWKFLQNPVASDF

SEQ ID NO: 23916 - protein, 20 aa, synthetic construct
  source 1..20: note = Seed: SATGFKQSSKALQRPVASDF
SATGFLQSWKFLQTPVASDF

SEQ ID NO: 23917 - protein, 20 aa, synthetic construct
  source 1..20: note = Seed: SATGFKQSSKALQRPVASDF
SATGFLQSWKFLQVPVASDF

SEQ ID NO: 23918 - protein, 20 aa, synthetic construct
  source 1..20: note = Seed: SATGFKQSSKALQRPVASDF
SATGFLQSWKFLQYPVASDF

SEQ ID NO: 23919 - protein, 20 aa, synthetic construct
  source 1..20: note = Seed: SATGFKQSSKALQRPVASDF
SATGFLQSWKILQFPVASDF

SEQ ID NO: 23920 - protein, 20 aa, synthetic construct
  source 1..20: note = Seed: SATGFKQSSKALQRPVASDF
SATGFLQSWKILQIPVASDF

SEQ ID NO: 23921 - protein, 20 aa, synthetic construct
  source 1..20: note = Seed: SATGFKQSSKALQRPVASDF
SATGFLQSWKILQLPVASDF

SEQ ID NO: 23922 - protein, 20 aa, synthetic construct
  source 1..20: note = Seed: SATGFKQSSKALQRPVASDF
SATGFLQSWKILQVPVASDF

SEQ ID NO: 23923 - protein, 20 aa, synthetic construct
  source 1..20: note = Seed: SATGFKQSSKALQRPVASDF
SATGFLQSWKLLQFPVASDF

SEQ ID NO: 23924 - protein, 20 aa, synthetic construct
  source 1..20: note = Seed: SATGFKQSSKALQRPVASDF
SATGFLQSWKLLQIPVASDF

SEQ ID NO: 23925 - protein, 20 aa, synthetic construct
  source 1..20: note = Seed: SATGFKQSSKALQRPVASDF
SATGFLQSWKLLQLPVASDF

SEQ ID NO: 23926 - protein, 20 aa, synthetic construct
  source 1..20: note = Seed: SATGFKQSSKALQRPVASDF
SATGFLQSWKLLQMPVASDF

SEQ ID NO: 23927 - protein, 20 aa, synthetic construct
  source 1..20: note = Seed: SATGFKQSSKALQRPVASDF
SATGFLQSWKLLQVPVASDF

SEQ ID NO: 23928 - protein, 20 aa, synthetic construct
  source 1..20: note = Seed: SATGFKQSSKALQRPVASDF
SATGFLQSWKWLQLPVASDF

SEQ ID NO: 23929 - protein, 20 aa, synthetic construct
  source 1..20: note = Seed: SATGFKQSSKALQRPVASDF
SATGFLQSWKYLQIPVASDF

SEQ ID NO: 23930 - protein, 20 aa, synthetic construct
  source 1..20: note = Seed: SATGFKQSSKALQRPVASDF
SATGFLQSWKYLQLPVASDF

SEQ ID NO: 23931 - protein, 20 aa, synthetic construct
  source 1..20: note = Seed: SATGFKQSSKALQRPVASDF
SATGFLQSYKFLQAPVASDF

SEQ ID NO: 23932 - protein, 20 aa, synthetic construct
  source 1..20: note = Seed: SATGFKQSSKALQRPVASDF
SATGFLQSYKFLQEPVASDF

SEQ ID NO: 23933 - protein, 20 aa, synthetic construct
  source 1..20: note = Seed: SATGFKQSSKALQRPVASDF
SATGFLQSYKFLQFPVASDF

SEQ ID NO: 23934 - protein, 20 aa, synthetic construct
  source 1..20: note = Seed: SATGFKQSSKALQRPVASDF
SATGFLQSYKFLQHPVASDF

SEQ ID NO: 23935 - protein, 20 aa, synthetic construct
  source 1..20: note = Seed: SATGFKQSSKALQRPVASDF
SATGFLQSYKFLQIPVASDF

SEQ ID NO: 23936 - protein, 20 aa, synthetic construct
  source 1..20: note = Seed: SATGFKQSSKALQRPVASDF
SATGFLQSYKFLQLPVASDF

SEQ ID NO: 23937 - protein, 20 aa, synthetic construct
  source 1..20: note = Seed: SATGFKQSSKALQRPVASDF
SATGFLQSYKFLQMPVASDF

SEQ ID NO: 23938 - protein, 20 aa, synthetic construct
  source 1..20: note = Seed: SATGFKQSSKALQRPVASDF
SATGFLQSYKFLQNPVASDF

SEQ ID NO: 23939 - protein, 20 aa, synthetic construct
  source 1..20: note = Seed: SATGFKQSSKALQRPVASDF
SATGFLQSYKFLQSPVASDF

SEQ ID NO: 23940 - protein, 20 aa, synthetic construct
  source 1..20: note = Seed: SATGFKQSSKALQRPVASDF
SATGFLQSYKFLQTPVASDF

SEQ ID NO: 23941 - protein, 20 aa, synthetic construct
  source 1..20: note = Seed: SATGFKQSSKALQRPVASDF
SATGFLQSYKFLQVPVASDF

SEQ ID NO: 23942 - protein, 20 aa, synthetic construct
  source 1..20: note = Seed: SATGFKQSSKALQRPVASDF
SATGFLQSYKFLQYPVASDF

SEQ ID NO: 23943 - protein, 20 aa, synthetic construct
  source 1..20: note = Seed: SATGFKQSSKALQRPVASDF
SATGFLQSYKILQFPVASDF

SEQ ID NO: 23944 - protein, 20 aa, synthetic construct
  source 1..20: note = Seed: SATGFKQSSKALQRPVASDF
SATGFLQSYKILQIPVASDF

SEQ ID NO: 23945 - protein, 20 aa, synthetic construct
  source 1..20: note = Seed: SATGFKQSSKALQRPVASDF
SATGFLQSYKILQLPVASDF

SEQ ID NO: 23946 - protein, 20 aa, synthetic construct
  source 1..20: note = Seed: SATGFKQSSKALQRPVASDF
SATGFLQSYKILQVPVASDF

SEQ ID NO: 23947 - protein, 20 aa, synthetic construct
  source 1..20: note = Seed: SATGFKQSSKALQRPVASDF
SATGFLQSYKLLQFPVASDF

SEQ ID NO: 23948 - protein, 20 aa, synthetic construct
  source 1..20: note = Seed: SATGFKQSSKALQRPVASDF
SATGFLQSYKLLQIPVASDF

SEQ ID NO: 23949 - protein, 20 aa, synthetic construct
  source 1..20: note = Seed: SATGFKQSSKALQRPVASDF
SATGFLQSYKLLQLPVASDF

SEQ ID NO: 23950 - protein, 20 aa, synthetic construct
  source 1..20: note = Seed: SATGFKQSSKALQRPVASDF
SATGFLQSYKLLQVPVASDF

SEQ ID NO: 23951 - protein, 20 aa, synthetic construct
  source 1..20: note = Seed: SATGFKQSSKALQRPVASDF
SATGFLQSYKMLQFPVASDF

SEQ ID NO: 23952 - protein, 20 aa, synthetic construct
  source 1..20: note = Seed: SATGFKQSSKALQRPVASDF
SATGFLQSYKWLQLPVASDF

SEQ ID NO: 23953 - protein, 20 aa, synthetic construct
  source 1..20: note = Seed: SATGFKQSSKALQRPVASDF
SATGFLQSYKYLQIPVASDF

SEQ ID NO: 23954 - protein, 20 aa, synthetic construct
  source 1..20: note = Seed: SATGFKQSSKALQRPVASDF
SATGFLQSYKYLQLPVASDF

SEQ ID NO: 23955 - protein, 20 aa, synthetic construct
  source 1..20: note = Seed: SATGFKQSSKALQRPVASDF
SATGFLQSYKYLQMPVASDF

SEQ ID NO: 23956 - protein, 20 aa, synthetic construct
  source 1..20: note = Seed: SATGFKQSSKALQRPVASDF
SATGFLQSYKYLQVPVASDF

SEQ ID NO: 23957 - protein, 20 aa, synthetic construct
  source 1..20: note = Seed: SATGFKQSSKALQRPVASDF
SATGFMQSAKALQAPVASDF

SEQ ID NO: 23958 - protein, 20 aa, synthetic construct
  source 1..20: note = Seed: SATGFKQSSKALQRPVASDF
SATGFMQSAKALQSPVASDF

SEQ ID NO: 23959 - protein, 20 aa, synthetic construct
  source 1..20: note = Seed: SATGFKQSSKALQRPVASDF
SATGFMQSAKFLQFPVASDF

SEQ ID NO: 23960 - protein, 20 aa, synthetic construct
  source 1..20: note = Seed: SATGFKQSSKALQRPVASDF
SATGFMQSAKFLQIPVASDF

SEQ ID NO: 23961 - protein, 20 aa, synthetic construct
  source 1..20: note = Seed: SATGFKQSSKALQRPVASDF
SATGFMQSAKFLQLPVASDF

SEQ ID NO: 23962 - protein, 20 aa, synthetic construct
  source 1..20: note = Seed: SATGFKQSSKALQRPVASDF
SATGFMQSAKFLQMPVASDF

SEQ ID NO: 23963 - protein, 20 aa, synthetic construct
  source 1..20: note = Seed: SATGFKQSSKALQRPVASDF
SATGFMQSAKFLQVPVASDF

SEQ ID NO: 23964 - protein, 20 aa, synthetic construct
  source 1..20: note = Seed: SATGFKQSSKALQRPVASDF
SATGFMQSAKILQAPVASDF

SEQ ID NO: 23965 - protein, 20 aa, synthetic construct
  source 1..20: note = Seed: SATGFKQSSKALQRPVASDF
SATGFMQSAKILQSPVASDF

SEQ ID NO: 23966 - protein, 20 aa, synthetic construct
  source 1..20: note = Seed: SATGFKQSSKALQRPVASDF
SATGFMQSAKPLQAPVASDF

SEQ ID NO: 23967 - protein, 20 aa, synthetic construct
  source 1..20: note = Seed: SATGFKQSSKALQRPVASDF
SATGFMQSAKPLQSPVASDF

SEQ ID NO: 23968 - protein, 20 aa, synthetic construct
  source 1..20: note = Seed: SATGFKQSSKALQRPVASDF
SATGFMQSAKVLQAPVASDF

SEQ ID NO: 23969 - protein, 20 aa, synthetic construct
  source 1..20: note = Seed: SATGFKQSSKALQRPVASDF
SATGFMQSAKVLQSPVASDF

SEQ ID NO: 23970 - protein, 20 aa, synthetic construct
  source 1..20: note = Seed: SATGFKQSSKALQRPVASDF
SATGFMQSDKFLQIPVASDF

SEQ ID NO: 23971 - protein, 20 aa, synthetic construct
  source 1..20: note = Seed: SATGFKQSSKALQRPVASDF
SATGFMQSDKFLQVPVASDF

SEQ ID NO: 23972 - protein, 20 aa, synthetic construct
  source 1..20: note = Seed: SATGFKQSSKALQRPVASDF
SATGFMQSEKFLQFPVASDF

SEQ ID NO: 23973 - protein, 20 aa, synthetic construct
  source 1..20: note = Seed: SATGFKQSSKALQRPVASDF
SATGFMQSEKFLQIPVASDF

SEQ ID NO: 23974 - protein, 20 aa, synthetic construct
  source 1..20: note = Seed: SATGFKQSSKALQRPVASDF
SATGFMQSEKFLQLPVASDF

SEQ ID NO: 23975 - protein, 20 aa, synthetic construct
  source 1..20: note = Seed: SATGFKQSSKALQRPVASDF
SATGFMQSEKFLQMPVASDF

SEQ ID NO: 23976 - protein, 20 aa, synthetic construct
  source 1..20: note = Seed: SATGFKQSSKALQRPVASDF
SATGFMQSEKFLQVPVASDF

SEQ ID NO: 23977 - protein, 20 aa, synthetic construct
  source 1..20: note = Seed: SATGFKQSSKALQRPVASDF
SATGFMQSFKFLQAPVASDF

SEQ ID NO: 23978 - protein, 20 aa, synthetic construct
  source 1..20: note = Seed: SATGFKQSSKALQRPVASDF
SATGFMQSFKFLQEPVASDF

SEQ ID NO: 23979 - protein, 20 aa, synthetic construct
  source 1..20: note = Seed: SATGFKQSSKALQRPVASDF
SATGFMQSFKFLQHPVASDF

SEQ ID NO: 23980 - protein, 20 aa, synthetic construct
  source 1..20: note = Seed: SATGFKQSSKALQRPVASDF
SATGFMQSFKFLQIPVASDF

SEQ ID NO: 23981 - protein, 20 aa, synthetic construct
  source 1..20: note = Seed: SATGFKQSSKALQRPVASDF
SATGFMQSFKFLQLPVASDF

SEQ ID NO: 23982 - protein, 20 aa, synthetic construct
  source 1..20: note = Seed: SATGFKQSSKALQRPVASDF
SATGFMQSFKFLQMPVASDF

SEQ ID NO: 23983 - protein, 20 aa, synthetic construct
  source 1..20: note = Seed: SATGFKQSSKALQRPVASDF
SATGFMQSFKFLQNPVASDF

SEQ ID NO: 23984 - protein, 20 aa, synthetic construct
  source 1..20: note = Seed: SATGFKQSSKALQRPVASDF
SATGFMQSFKFLQSPVASDF

SEQ ID NO: 23985 - protein, 20 aa, synthetic construct
  source 1..20: note = Seed: SATGFKQSSKALQRPVASDF
SATGFMQSFKFLQTPVASDF

SEQ ID NO: 23986 - protein, 20 aa, synthetic construct
  source 1..20: note = Seed: SATGFKQSSKALQRPVASDF
SATGFMQSFKFLQVPVASDF

SEQ ID NO: 23987 - protein, 20 aa, synthetic construct
  source 1..20: note = Seed: SATGFKQSSKALQRPVASDF
SATGFMQSFKFLQYPVASDF

SEQ ID NO: 23988 - protein, 20 aa, synthetic construct
  source 1..20: note = Seed: SATGFKQSSKALQRPVASDF
SATGFMQSFKILQIPVASDF

SEQ ID NO: 23989 - protein, 20 aa, synthetic construct
  source 1..20: note = Seed: SATGFKQSSKALQRPVASDF
SATGFMQSFKILQLPVASDF

SEQ ID NO: 23990 - protein, 20 aa, synthetic construct
  source 1..20: note = Seed: SATGFKQSSKALQRPVASDF
SATGFMQSFKILQMPVASDF

SEQ ID NO: 23991 - protein, 20 aa, synthetic construct
  source 1..20: note = Seed: SATGFKQSSKALQRPVASDF
SATGFMQSFKILQVPVASDF

SEQ ID NO: 23992 - protein, 20 aa, synthetic construct
  source 1..20: note = Seed: SATGFKQSSKALQRPVASDF
SATGFMQSFKLLQFPVASDF

SEQ ID NO: 23993 - protein, 20 aa, synthetic construct
  source 1..20: note = Seed: SATGFKQSSKALQRPVASDF
SATGFMQSFKLLQIPVASDF

SEQ ID NO: 23994 - protein, 20 aa, synthetic construct
  source 1..20: note = Seed: SATGFKQSSKALQRPVASDF
SATGFMQSFKLLQLPVASDF

SEQ ID NO: 23995 - protein, 20 aa, synthetic construct
  source 1..20: note = Seed: SATGFKQSSKALQRPVASDF
SATGFMQSFKLLQMPVASDF

SEQ ID NO: 23996 - protein, 20 aa, synthetic construct
  source 1..20: note = Seed: SATGFKQSSKALQRPVASDF
SATGFMQSFKLLQVPVASDF

SEQ ID NO: 23997 - protein, 20 aa, synthetic construct
  source 1..20: note = Seed: SATGFKQSSKALQRPVASDF
SATGFMQSFKLLQYPVASDF

SEQ ID NO: 23998 - protein, 20 aa, synthetic construct
  source 1..20: note = Seed: SATGFKQSSKALQRPVASDF
SATGFMQSFKMLQIPVASDF

SEQ ID NO: 23999 - protein, 20 aa, synthetic construct
  source 1..20: note = Seed: SATGFKQSSKALQRPVASDF
SATGFMQSFKMLQLPVASDF

SEQ ID NO: 24000 - protein, 20 aa, synthetic construct
  source 1..20: note = Seed: SATGFKQSSKALQRPVASDF
SATGFMQSFKYLQIPVASDF

SEQ ID NO: 24001 - protein, 20 aa, synthetic construct
  source 1..20: note = Seed: SATGFKQSSKALQRPVASDF
SATGFMQSFKYLQLPVASDF

SEQ ID NO: 24002 - protein, 20 aa, synthetic construct
  source 1..20: note = Seed: SATGFKQSSKALQRPVASDF
SATGFMQSFKYLQMPVASDF

SEQ ID NO: 24003 - protein, 20 aa, synthetic construct
  source 1..20: note = Seed: SATGFKQSSKALQRPVASDF
SATGFMQSFKYLQVPVASDF

SEQ ID NO: 24004 - protein, 20 aa, synthetic construct
  source 1..20: note = Seed: SATGFKQSSKALQRPVASDF
SATGFMQSGKILQAPVASDF

SEQ ID NO: 24005 - protein, 20 aa, synthetic construct
  source 1..20: note = Seed: SATGFKQSSKALQRPVASDF
SATGFMQSGKVLQAPVASDF

SEQ ID NO: 24006 - protein, 20 aa, synthetic construct
  source 1..20: note = Seed: SATGFKQSSKALQRPVASDF
SATGFMQSHKFLQAPVASDF

SEQ ID NO: 24007 - protein, 20 aa, synthetic construct
  source 1..20: note = Seed: SATGFKQSSKALQRPVASDF
SATGFMQSHKFLQFPVASDF

SEQ ID NO: 24008 - protein, 20 aa, synthetic construct
  source 1..20: note = Seed: SATGFKQSSKALQRPVASDF
SATGFMQSHKFLQIPVASDF

SEQ ID NO: 24009 - protein, 20 aa, synthetic construct
  source 1..20: note = Seed: SATGFKQSSKALQRPVASDF
SATGFMQSHKFLQLPVASDF

SEQ ID NO: 24010 - protein, 20 aa, synthetic construct
  source 1..20: note = Seed: SATGFKQSSKALQRPVASDF
SATGFMQSHKFLQMPVASDF

SEQ ID NO: 24011 - protein, 20 aa, synthetic construct
  source 1..20: note = Seed: SATGFKQSSKALQRPVASDF
SATGFMQSHKFLQSPVASDF

SEQ ID NO: 24012 - protein, 20 aa, synthetic construct
  source 1..20: note = Seed: SATGFKQSSKALQRPVASDF
SATGFMQSHKFLQTPVASDF

SEQ ID NO: 24013 - protein, 20 aa, synthetic construct
  source 1..20: note = Seed: SATGFKQSSKALQRPVASDF
SATGFMQSHKFLQVPVASDF

SEQ ID NO: 24014 - protein, 20 aa, synthetic construct
  source 1..20: note = Seed: SATGFKQSSKALQRPVASDF
SATGFMQSHKFLQYPVASDF

SEQ ID NO: 24015 - protein, 20 aa, synthetic construct
  source 1..20: note = Seed: SATGFKQSSKALQRPVASDF
SATGFMQSHKILQLPVASDF

SEQ ID NO: 24016 - protein, 20 aa, synthetic construct
  source 1..20: note = Seed: SATGFKQSSKALQRPVASDF
SATGFMQSHKLLQFPVASDF

SEQ ID NO: 24017 - protein, 20 aa, synthetic construct
  source 1..20: note = Seed: SATGFKQSSKALQRPVASDF
SATGFMQSHKLLQIPVASDF

SEQ ID NO: 24018 - protein, 20 aa, synthetic construct
  source 1..20: note = Seed: SATGFKQSSKALQRPVASDF
SATGFMQSHKLLQLPVASDF

SEQ ID NO: 24019 - protein, 20 aa, synthetic construct
  source 1..20: note = Seed: SATGFKQSSKALQRPVASDF
SATGFMQSHKLLQVPVASDF

SEQ ID NO: 24020 - protein, 20 aa, synthetic construct
  source 1..20: note = Seed: SATGFKQSSKALQRPVASDF
SATGFMQSIKFLQAPVASDF

SEQ ID NO: 24021 - protein, 20 aa, synthetic construct
  source 1..20: note = Seed: SATGFKQSSKALQRPVASDF
SATGFMQSIKFLQEPVASDF

SEQ ID NO: 24022 - protein, 20 aa, synthetic construct
  source 1..20: note = Seed: SATGFKQSSKALQRPVASDF
SATGFMQSIKFLQFPVASDF

SEQ ID NO: 24023 - protein, 20 aa, synthetic construct
  source 1..20: note = Seed: SATGFKQSSKALQRPVASDF
SATGFMQSIKFLQHPVASDF

SEQ ID NO: 24024 - protein, 20 aa, synthetic construct
  source 1..20: note = Seed: SATGFKQSSKALQRPVASDF
SATGFMQSIKFLQIPVASDF

SEQ ID NO: 24025 - protein, 20 aa, synthetic construct
  source 1..20: note = Seed: SATGFKQSSKALQRPVASDF
SATGFMQSIKFLQLPVASDF

SEQ ID NO: 24026 - protein, 20 aa, synthetic construct
  source 1..20: note = Seed: SATGFKQSSKALQRPVASDF
SATGFMQSIKFLQMPVASDF

SEQ ID NO: 24027 - protein, 20 aa, synthetic construct
  source 1..20: note = Seed: SATGFKQSSKALQRPVASDF
SATGFMQSIKFLQNPVASDF

SEQ ID NO: 24028 - protein, 20 aa, synthetic construct
  source 1..20: note = Seed: SATGFKQSSKALQRPVASDF
SATGFMQSIKFLQSPVASDF

SEQ ID NO: 24029 - protein, 20 aa, synthetic construct
  source 1..20: note = Seed: SATGFKQSSKALQRPVASDF
SATGFMQSIKFLQTPVASDF

SEQ ID NO: 24030 - protein, 20 aa, synthetic construct
  source 1..20: note = Seed: SATGFKQSSKALQRPVASDF
SATGFMQSIKFLQVPVASDF

SEQ ID NO: 24031 - protein, 20 aa, synthetic construct
  source 1..20: note = Seed: SATGFKQSSKALQRPVASDF
SATGFMQSIKFLQYPVASDF

SEQ ID NO: 24032 - protein, 20 aa, synthetic construct
  source 1..20: note = Seed: SATGFKQSSKALQRPVASDF
SATGFMQSIKLLQLPVASDF

SEQ ID NO: 24033 - protein, 20 aa, synthetic construct
  source 1..20: note = Seed: SATGFKQSSKALQRPVASDF
SATGFMQSIKYLQIPVASDF

SEQ ID NO: 24034 - protein, 20 aa, synthetic construct
  source 1..20: note = Seed: SATGFKQSSKALQRPVASDF
SATGFMQSIKYLQLPVASDF

SEQ ID NO: 24035 - protein, 20 aa, synthetic construct
  source 1..20: note = Seed: SATGFKQSSKALQRPVASDF
SATGFMQSIKYLQVPVASDF

SEQ ID NO: 24036 - protein, 20 aa, synthetic construct
  source 1..20: note = Seed: SATGFKQSSKALQRPVASDF
SATGFMQSKKFLQFPVASDF

SEQ ID NO: 24037 - protein, 20 aa, synthetic construct
  source 1..20: note = Seed: SATGFKQSSKALQRPVASDF
SATGFMQSKKFLQIPVASDF

SEQ ID NO: 24038 - protein, 20 aa, synthetic construct
  source 1..20: note = Seed: SATGFKQSSKALQRPVASDF
SATGFMQSKKFLQLPVASDF

SEQ ID NO: 24039 - protein, 20 aa, synthetic construct
  source 1..20: note = Seed: SATGFKQSSKALQRPVASDF
SATGFMQSKKFLQVPVASDF

SEQ ID NO: 24040 - protein, 20 aa, synthetic construct
  source 1..20: note = Seed: SATGFKQSSKALQRPVASDF
SATGFMQSLKFLQEPVASDF

SEQ ID NO: 24041 - protein, 20 aa, synthetic construct
  source 1..20: note = Seed: SATGFKQSSKALQRPVASDF
SATGFMQSLKFLQFPVASDF

SEQ ID NO: 24042 - protein, 20 aa, synthetic construct
  source 1..20: note = Seed: SATGFKQSSKALQRPVASDF
SATGFMQSLKFLQIPVASDF

SEQ ID NO: 24043 - protein, 20 aa, synthetic construct
  source 1..20: note = Seed: SATGFKQSSKALQRPVASDF
SATGFMQSLKFLQLPVASDF

SEQ ID NO: 24044 - protein, 20 aa, synthetic construct
  source 1..20: note = Seed: SATGFKQSSKALQRPVASDF
SATGFMQSLKFLQMPVASDF

SEQ ID NO: 24045 - protein, 20 aa, synthetic construct
  source 1..20: note = Seed: SATGFKQSSKALQRPVASDF
SATGFMQSLKFLQVPVASDF

SEQ ID NO: 24046 - protein, 20 aa, synthetic construct
  source 1..20: note = Seed: SATGFKQSSKALQRPVASDF
SATGFMQSLKFLQYPVASDF

SEQ ID NO: 24047 - protein, 20 aa, synthetic construct
  source 1..20: note = Seed: SATGFKQSSKALQRPVASDF
SATGFMQSMKFLQFPVASDF

SEQ ID NO: 24048 - protein, 20 aa, synthetic construct
  source 1..20: note = Seed: SATGFKQSSKALQRPVASDF
SATGFMQSMKFLQIPVASDF

SEQ ID NO: 24049 - protein, 20 aa, synthetic construct
  source 1..20: note = Seed: SATGFKQSSKALQRPVASDF
SATGFMQSMKFLQLPVASDF

SEQ ID NO: 24050 - protein, 20 aa, synthetic construct
  source 1..20: note = Seed: SATGFKQSSKALQRPVASDF
SATGFMQSMKFLQMPVASDF

SEQ ID NO: 24051 - protein, 20 aa, synthetic construct
  source 1..20: note = Seed: SATGFKQSSKALQRPVASDF
SATGFMQSMKFLQTPVASDF

SEQ ID NO: 24052 - protein, 20 aa, synthetic construct
  source 1..20: note = Seed: SATGFKQSSKALQRPVASDF
SATGFMQSMKFLQVPVASDF

SEQ ID NO: 24053 - protein, 20 aa, synthetic construct
  source 1..20: note = Seed: SATGFKQSSKALQRPVASDF
SATGFMQSMKFLQYPVASDF

SEQ ID NO: 24054 - protein, 20 aa, synthetic construct
  source 1..20: note = Seed: SATGFKQSSKALQRPVASDF
SATGFMQSNKFLQFPVASDF

SEQ ID NO: 24055 - protein, 20 aa, synthetic construct
  source 1..20: note = Seed: SATGFKQSSKALQRPVASDF
SATGFMQSNKFLQIPVASDF

SEQ ID NO: 24056 - protein, 20 aa, synthetic construct
  source 1..20: note = Seed: SATGFKQSSKALQRPVASDF
SATGFMQSNKFLQLPVASDF

SEQ ID NO: 24057 - protein, 20 aa, synthetic construct
  source 1..20: note = Seed: SATGFKQSSKALQRPVASDF
SATGFMQSNKFLQVPVASDF

SEQ ID NO: 24058 - protein, 20 aa, synthetic construct
  source 1..20: note = Seed: SATGFKQSSKALQRPVASDF
SATGFMQSQKFLQFPVASDF

SEQ ID NO: 24059 - protein, 20 aa, synthetic construct
  source 1..20: note = Seed: SATGFKQSSKALQRPVASDF
SATGFMQSQKFLQIPVASDF

SEQ ID NO: 24060 - protein, 20 aa, synthetic construct
  source 1..20: note = Seed: SATGFKQSSKALQRPVASDF
SATGFMQSQKFLQLPVASDF

SEQ ID NO: 24061 - protein, 20 aa, synthetic construct
  source 1..20: note = Seed: SATGFKQSSKALQRPVASDF
SATGFMQSQKFLQMPVASDF

SEQ ID NO: 24062 - protein, 20 aa, synthetic construct
  source 1..20: note = Seed: SATGFKQSSKALQRPVASDF
SATGFMQSQKFLQVPVASDF

SEQ ID NO: 24063 - protein, 20 aa, synthetic construct
  source 1..20: note = Seed: SATGFKQSSKALQRPVASDF
SATGFMQSRKFLQFPVASDF

SEQ ID NO: 24064 - protein, 20 aa, synthetic construct
  source 1..20: note = Seed: SATGFKQSSKALQRPVASDF
SATGFMQSRKFLQIPVASDF

SEQ ID NO: 24065 - protein, 20 aa, synthetic construct
  source 1..20: note = Seed: SATGFKQSSKALQRPVASDF
SATGFMQSRKFLQLPVASDF

SEQ ID NO: 24066 - protein, 20 aa, synthetic construct
  source 1..20: note = Seed: SATGFKQSSKALQRPVASDF
SATGFMQSRKFLQVPVASDF

SEQ ID NO: 24067 - protein, 20 aa, synthetic construct
  source 1..20: note = Seed: SATGFKQSSKALQRPVASDF
SATGFMQSSKALQAPVASDF

SEQ ID NO: 24068 - protein, 20 aa, synthetic construct
  source 1..20: note = Seed: SATGFKQSSKALQRPVASDF
SATGFMQSSKALQSPVASDF

SEQ ID NO: 24069 - protein, 20 aa, synthetic construct
  source 1..20: note = Seed: SATGFKQSSKALQRPVASDF
SATGFMQSSKFLQAPVASDF

SEQ ID NO: 24070 - protein, 20 aa, synthetic construct
  source 1..20: note = Seed: SATGFKQSSKALQRPVASDF
SATGFMQSSKFLQFPVASDF

SEQ ID NO: 24071 - protein, 20 aa, synthetic construct
  source 1..20: note = Seed: SATGFKQSSKALQRPVASDF
SATGFMQSSKFLQIPVASDF

SEQ ID NO: 24072 - protein, 20 aa, synthetic construct
  source 1..20: note = Seed: SATGFKQSSKALQRPVASDF
SATGFMQSSKFLQLPVASDF

SEQ ID NO: 24073 - protein, 20 aa, synthetic construct
  source 1..20: note = Seed: SATGFKQSSKALQRPVASDF
SATGFMQSSKFLQMPVASDF

SEQ ID NO: 24074 - protein, 20 aa, synthetic construct
  source 1..20: note = Seed: SATGFKQSSKALQRPVASDF
SATGFMQSSKFLQNPVASDF

SEQ ID NO: 24075 - protein, 20 aa, synthetic construct
  source 1..20: note = Seed: SATGFKQSSKALQRPVASDF
SATGFMQSSKFLQTPVASDF

SEQ ID NO: 24076 - protein, 20 aa, synthetic construct
  source 1..20: note = Seed: SATGFKQSSKALQRPVASDF
SATGFMQSSKFLQVPVASDF

SEQ ID NO: 24077 - protein, 20 aa, synthetic construct
  source 1..20: note = Seed: SATGFKQSSKALQRPVASDF
SATGFMQSSKFLQYPVASDF

SEQ ID NO: 24078 - protein, 20 aa, synthetic construct
  source 1..20: note = Seed: SATGFKQSSKALQRPVASDF
SATGFMQSSKILQAPVASDF

SEQ ID NO: 24079 - protein, 20 aa, synthetic construct
  source 1..20: note = Seed: SATGFKQSSKALQRPVASDF
SATGFMQSSKILQSPVASDF

SEQ ID NO: 24080 - protein, 20 aa, synthetic construct
  source 1..20: note = Seed: SATGFKQSSKALQRPVASDF
SATGFMQSSKLLQIPVASDF

SEQ ID NO: 24081 - protein, 20 aa, synthetic construct
  source 1..20: note = Seed: SATGFKQSSKALQRPVASDF
SATGFMQSSKLLQLPVASDF

SEQ ID NO: 24082 - protein, 20 aa, synthetic construct
  source 1..20: note = Seed: SATGFKQSSKALQRPVASDF
SATGFMQSSKVLQAPVASDF

SEQ ID NO: 24083 - protein, 20 aa, synthetic construct
  source 1..20: note = Seed: SATGFKQSSKALQRPVASDF
SATGFMQSSKVLQSPVASDF

SEQ ID NO: 24084 - protein, 20 aa, synthetic construct
  source 1..20: note = Seed: SATGFKQSSKALQRPVASDF
SATGFMQSTKFLQAPVASDF

SEQ ID NO: 24085 - protein, 20 aa, synthetic construct
  source 1..20: note = Seed: SATGFKQSSKALQRPVASDF
SATGFMQSTKFLQEPVASDF

SEQ ID NO: 24086 - protein, 20 aa, synthetic construct
  source 1..20: note = Seed: SATGFKQSSKALQRPVASDF
SATGFMQSTKFLQFPVASDF

SEQ ID NO: 24087 - protein, 20 aa, synthetic construct
  source 1..20: note = Seed: SATGFKQSSKALQRPVASDF
SATGFMQSTKFLQIPVASDF

SEQ ID NO: 24088 - protein, 20 aa, synthetic construct
  source 1..20: note = Seed: SATGFKQSSKALQRPVASDF
SATGFMQSTKFLQLPVASDF

SEQ ID NO: 24089 - protein, 20 aa, synthetic construct
  source 1..20: note = Seed: SATGFKQSSKALQRPVASDF
SATGFMQSTKFLQMPVASDF

SEQ ID NO: 24090 - protein, 20 aa, synthetic construct
  source 1..20: note = Seed: SATGFKQSSKALQRPVASDF
SATGFMQSTKFLQNPVASDF

SEQ ID NO: 24091 - protein, 20 aa, synthetic construct
  source 1..20: note = Seed: SATGFKQSSKALQRPVASDF
SATGFMQSTKFLQSPVASDF

SEQ ID NO: 24092 - protein, 20 aa, synthetic construct
  source 1..20: note = Seed: SATGFKQSSKALQRPVASDF
SATGFMQSTKFLQTPVASDF

SEQ ID NO: 24093 - protein, 20 aa, synthetic construct
  source 1..20: note = Seed: SATGFKQSSKALQRPVASDF
SATGFMQSTKFLQVPVASDF

SEQ ID NO: 24094 - protein, 20 aa, synthetic construct
  source 1..20: note = Seed: SATGFKQSSKALQRPVASDF
SATGFMQSTKFLQYPVASDF

SEQ ID NO: 24095 - protein, 20 aa, synthetic construct
  source 1..20: note = Seed: SATGFKQSSKALQRPVASDF
SATGFMQSTKILQIPVASDF

SEQ ID NO: 24096 - protein, 20 aa, synthetic construct
  source 1..20: note = Seed: SATGFKQSSKALQRPVASDF
SATGFMQSTKLLQFPVASDF

SEQ ID NO: 24097 - protein, 20 aa, synthetic construct
  source 1..20: note = Seed: SATGFKQSSKALQRPVASDF
SATGFMQSTKLLQIPVASDF

SEQ ID NO: 24098 - protein, 20 aa, synthetic construct
  source 1..20: note = Seed: SATGFKQSSKALQRPVASDF
SATGFMQSTKLLQLPVASDF

SEQ ID NO: 24099 - protein, 20 aa, synthetic construct
  source 1..20: note = Seed: SATGFKQSSKALQRPVASDF
SATGFMQSTKLLQVPVASDF

SEQ ID NO: 24100 - protein, 20 aa, synthetic construct
  source 1..20: note = Seed: SATGFKQSSKALQRPVASDF
SATGFMQSTKYLQIPVASDF

SEQ ID NO: 24101 - protein, 20 aa, synthetic construct
  source 1..20: note = Seed: SATGFKQSSKALQRPVASDF
SATGFMQSTKYLQLPVASDF

SEQ ID NO: 24102 - protein, 20 aa, synthetic construct
  source 1..20: note = Seed: SATGFKQSSKALQRPVASDF
SATGFMQSVKFLQAPVASDF

SEQ ID NO: 24103 - protein, 20 aa, synthetic construct
  source 1..20: note = Seed: SATGFKQSSKALQRPVASDF
SATGFMQSVKFLQEPVASDF

SEQ ID NO: 24104 - protein, 20 aa, synthetic construct
  source 1..20: note = Seed: SATGFKQSSKALQRPVASDF
SATGFMQSVKFLQFPVASDF

SEQ ID NO: 24105 - protein, 20 aa, synthetic construct
  source 1..20: note = Seed: SATGFKQSSKALQRPVASDF
SATGFMQSVKFLQIPVASDF

SEQ ID NO: 24106 - protein, 20 aa, synthetic construct
  source 1..20: note = Seed: SATGFKQSSKALQRPVASDF
SATGFMQSVKFLQLPVASDF

SEQ ID NO: 24107 - protein, 20 aa, synthetic construct
  source 1..20: note = Seed: SATGFKQSSKALQRPVASDF
SATGFMQSVKFLQMPVASDF

SEQ ID NO: 24108 - protein, 20 aa, synthetic construct
  source 1..20: note = Seed: SATGFKQSSKALQRPVASDF
SATGFMQSVKFLQNPVASDF

SEQ ID NO: 24109 - protein, 20 aa, synthetic construct
  source 1..20: note = Seed: SATGFKQSSKALQRPVASDF
SATGFMQSVKFLQSPVASDF

SEQ ID NO: 24110 - protein, 20 aa, synthetic construct
  source 1..20: note = Seed: SATGFKQSSKALQRPVASDF
SATGFMQSVKFLQTPVASDF

SEQ ID NO: 24111 - protein, 20 aa, synthetic construct
  source 1..20: note = Seed: SATGFKQSSKALQRPVASDF
SATGFMQSVKFLQVPVASDF

SEQ ID NO: 24112 - protein, 20 aa, synthetic construct
  source 1..20: note = Seed: SATGFKQSSKALQRPVASDF
SATGFMQSVKFLQYPVASDF

SEQ ID NO: 24113 - protein, 20 aa, synthetic construct
  source 1..20: note = Seed: SATGFKQSSKALQRPVASDF
SATGFMQSVKYLQLPVASDF

SEQ ID NO: 24114 - protein, 20 aa, synthetic construct
  source 1..20: note = Seed: SATGFKQSSKALQRPVASDF
SATGFMQSWKFLQFPVASDF

SEQ ID NO: 24115 - protein, 20 aa, synthetic construct
  source 1..20: note = Seed: SATGFKQSSKALQRPVASDF
SATGFMQSWKFLQIPVASDF

SEQ ID NO: 24116 - protein, 20 aa, synthetic construct
  source 1..20: note = Seed: SATGFKQSSKALQRPVASDF
SATGFMQSWKFLQLPVASDF

SEQ ID NO: 24117 - protein, 20 aa, synthetic construct
  source 1..20: note = Seed: SATGFKQSSKALQRPVASDF
SATGFMQSWKFLQMPVASDF

SEQ ID NO: 24118 - protein, 20 aa, synthetic construct
  source 1..20: note = Seed: SATGFKQSSKALQRPVASDF
SATGFMQSWKFLQVPVASDF

SEQ ID NO: 24119 - protein, 20 aa, synthetic construct
  source 1..20: note = Seed: SATGFKQSSKALQRPVASDF
SATGFMQSWKFLQYPVASDF

SEQ ID NO: 24120 - protein, 20 aa, synthetic construct
  source 1..20: note = Seed: SATGFKQSSKALQRPVASDF
SATGFMQSWKILQIPVASDF

SEQ ID NO: 24121 - protein, 20 aa, synthetic construct
  source 1..20: note = Seed: SATGFKQSSKALQRPVASDF
SATGFMQSWKILQLPVASDF

SEQ ID NO: 24122 - protein, 20 aa, synthetic construct
  source 1..20: note = Seed: SATGFKQSSKALQRPVASDF
SATGFMQSWKLLQFPVASDF

SEQ ID NO: 24123 - protein, 20 aa, synthetic construct
  source 1..20: note = Seed: SATGFKQSSKALQRPVASDF
SATGFMQSWKLLQIPVASDF

SEQ ID NO: 24124 - protein, 20 aa, synthetic construct
  source 1..20: note = Seed: SATGFKQSSKALQRPVASDF
SATGFMQSWKLLQLPVASDF

SEQ ID NO: 24125 - protein, 20 aa, synthetic construct
  source 1..20: note = Seed: SATGFKQSSKALQRPVASDF
SATGFMQSWKLLQVPVASDF

SEQ ID NO: 24126 - protein, 20 aa, synthetic construct
  source 1..20: note = Seed: SATGFKQSSKALQRPVASDF
SATGFMQSWKYLQIPVASDF

SEQ ID NO: 24127 - protein, 20 aa, synthetic construct
  source 1..20: note = Seed: SATGFKQSSKALQRPVASDF
SATGFMQSWKYLQLPVASDF

SEQ ID NO: 24128 - protein, 20 aa, synthetic construct
  source 1..20: note = Seed: SATGFKQSSKALQRPVASDF
SATGFMQSYKFLQAPVASDF

SEQ ID NO: 24129 - protein, 20 aa, synthetic construct
  source 1..20: note = Seed: SATGFKQSSKALQRPVASDF
SATGFMQSYKFLQFPVASDF

SEQ ID NO: 24130 - protein, 20 aa, synthetic construct
  source 1..20: note = Seed: SATGFKQSSKALQRPVASDF
SATGFMQSYKFLQIPVASDF

SEQ ID NO: 24131 - protein, 20 aa, synthetic construct
  source 1..20: note = Seed: SATGFKQSSKALQRPVASDF
SATGFMQSYKFLQLPVASDF

SEQ ID NO: 24132 - protein, 20 aa, synthetic construct
  source 1..20: note = Seed: SATGFKQSSKALQRPVASDF
SATGFMQSYKFLQMPVASDF

SEQ ID NO: 24133 - protein, 20 aa, synthetic construct
  source 1..20: note = Seed: SATGFKQSSKALQRPVASDF
SATGFMQSYKFLQTPVASDF

SEQ ID NO: 24134 - protein, 20 aa, synthetic construct
  source 1..20: note = Seed: SATGFKQSSKALQRPVASDF
SATGFMQSYKFLQVPVASDF

SEQ ID NO: 24135 - protein, 20 aa, synthetic construct
  source 1..20: note = Seed: SATGFKQSSKALQRPVASDF
SATGFMQSYKFLQYPVASDF

SEQ ID NO: 24136 - protein, 20 aa, synthetic construct
  source 1..20: note = Seed: SATGFKQSSKALQRPVASDF
SATGFMQSYKLLQFPVASDF

SEQ ID NO: 24137 - protein, 20 aa, synthetic construct
  source 1..20: note = Seed: SATGFKQSSKALQRPVASDF
SATGFMQSYKLLQIPVASDF

SEQ ID NO: 24138 - protein, 20 aa, synthetic construct
  source 1..20: note = Seed: SATGFKQSSKALQRPVASDF
SATGFMQSYKLLQLPVASDF

SEQ ID NO: 24139 - protein, 20 aa, synthetic construct
  source 1..20: note = Seed: SATGFKQSSKALQRPVASDF
SATGFMQSYKYLQIPVASDF

SEQ ID NO: 24140 - protein, 20 aa, synthetic construct
  source 1..20: note = Seed: SATGFKQSSKALQRPVASDF
SATGFMQSYKYLQLPVASDF

SEQ ID NO: 24141 - protein, 20 aa, synthetic construct
  source 1..20: note = Seed: SATGFKQSSKALQRPVASDF
SATGFNQSAKALQAPVASDF

SEQ ID NO: 24142 - protein, 20 aa, synthetic construct
  source 1..20: note = Seed: SATGFKQSSKALQRPVASDF
SATGFNQSAKALQSPVASDF

SEQ ID NO: 24143 - protein, 20 aa, synthetic construct
  source 1..20: note = Seed: SATGFKQSSKALQRPVASDF
SATGFNQSAKALQVPVASDF

SEQ ID NO: 24144 - protein, 20 aa, synthetic construct
  source 1..20: note = Seed: SATGFKQSSKALQRPVASDF
SATGFNQSAKILQAPVASDF

SEQ ID NO: 24145 - protein, 20 aa, synthetic construct
  source 1..20: note = Seed: SATGFKQSSKALQRPVASDF
SATGFNQSAKILQGPVASDF

SEQ ID NO: 24146 - protein, 20 aa, synthetic construct
  source 1..20: note = Seed: SATGFKQSSKALQRPVASDF
SATGFNQSAKILQSPVASDF

SEQ ID NO: 24147 - protein, 20 aa, synthetic construct
  source 1..20: note = Seed: SATGFKQSSKALQRPVASDF
SATGFNQSAKILQTPVASDF

SEQ ID NO: 24148 - protein, 20 aa, synthetic construct
  source 1..20: note = Seed: SATGFKQSSKALQRPVASDF
SATGFNQSAKILQVPVASDF

SEQ ID NO: 24149 - protein, 20 aa, synthetic construct
  source 1..20: note = Seed: SATGFKQSSKALQRPVASDF
SATGFNQSAKLLQAPVASDF

SEQ ID NO: 24150 - protein, 20 aa, synthetic construct
  source 1..20: note = Seed: SATGFKQSSKALQRPVASDF
SATGFNQSAKMLQAPVASDF

SEQ ID NO: 24151 - protein, 20 aa, synthetic construct
  source 1..20: note = Seed: SATGFKQSSKALQRPVASDF
SATGFNQSAKMLQSPVASDF

SEQ ID NO: 24152 - protein, 20 aa, synthetic construct
  source 1..20: note = Seed: SATGFKQSSKALQRPVASDF
SATGFNQSAKPLQAPVASDF

SEQ ID NO: 24153 - protein, 20 aa, synthetic construct
  source 1..20: note = Seed: SATGFKQSSKALQRPVASDF
SATGFNQSAKTLQAPVASDF

SEQ ID NO: 24154 - protein, 20 aa, synthetic construct
  source 1..20: note = Seed: SATGFKQSSKALQRPVASDF
SATGFNQSAKVLQIPVASDF

SEQ ID NO: 24155 - protein, 20 aa, synthetic construct
  source 1..20: note = Seed: SATGFKQSSKALQRPVASDF
SATGFNQSAKVLQSPVASDF

SEQ ID NO: 24156 - protein, 20 aa, synthetic construct
  source 1..20: note = Seed: SATGFKQSSKALQRPVASDF
SATGFNQSAKVLQTPVASDF

SEQ ID NO: 24157 - protein, 20 aa, synthetic construct
  source 1..20: note = Seed: SATGFKQSSKALQRPVASDF
SATGFNQSAKVLQVPVASDF

SEQ ID NO: 24158 - protein, 20 aa, synthetic construct
  source 1..20: note = Seed: SATGFKQSSKALQRPVASDF
SATGFNQSFKFLQIPVASDF

SEQ ID NO: 24159 - protein, 20 aa, synthetic construct
  source 1..20: note = Seed: SATGFKQSSKALQRPVASDF
SATGFNQSFKFLQVPVASDF

SEQ ID NO: 24160 - protein, 20 aa, synthetic construct
  source 1..20: note = Seed: SATGFKQSSKALQRPVASDF
SATGFNQSGKILQAPVASDF

SEQ ID NO: 24161 - protein, 20 aa, synthetic construct
  source 1..20: note = Seed: SATGFKQSSKALQRPVASDF
SATGFNQSGKILQSPVASDF

SEQ ID NO: 24162 - protein, 20 aa, synthetic construct
  source 1..20: note = Seed: SATGFKQSSKALQRPVASDF
SATGFNQSGKVLQAPVASDF

SEQ ID NO: 24163 - protein, 20 aa, synthetic construct
  source 1..20: note = Seed: SATGFKQSSKALQRPVASDF
SATGFNQSGKVLQSPVASDF

SEQ ID NO: 24164 - protein, 20 aa, synthetic construct
  source 1..20: note = Seed: SATGFKQSSKALQRPVASDF
SATGFNQSIKFLQIPVASDF

SEQ ID NO: 24165 - protein, 20 aa, synthetic construct
  source 1..20: note = Seed: SATGFKQSSKALQRPVASDF
SATGFNQSSKALQAPVASDF

SEQ ID NO: 24166 - protein, 20 aa, synthetic construct
  source 1..20: note = Seed: SATGFKQSSKALQRPVASDF
SATGFNQSSKALQSPVASDF

SEQ ID NO: 24167 - protein, 20 aa, synthetic construct
  source 1..20: note = Seed: SATGFKQSSKALQRPVASDF
SATGFNQSSKILQAPVASDF

SEQ ID NO: 24168 - protein, 20 aa, synthetic construct
  source 1..20: note = Seed: SATGFKQSSKALQRPVASDF
SATGFNQSSKILQGPVASDF

SEQ ID NO: 24169 - protein, 20 aa, synthetic construct
  source 1..20: note = Seed: SATGFKQSSKALQRPVASDF
SATGFNQSSKILQSPVASDF

SEQ ID NO: 24170 - protein, 20 aa, synthetic construct
  source 1..20: note = Seed: SATGFKQSSKALQRPVASDF
SATGFNQSSKMLQAPVASDF

SEQ ID NO: 24171 - protein, 20 aa, synthetic construct
  source 1..20: note = Seed: SATGFKQSSKALQRPVASDF
SATGFNQSSKVLQAPVASDF

SEQ ID NO: 24172 - protein, 20 aa, synthetic construct
  source 1..20: note = Seed: SATGFKQSSKALQRPVASDF
SATGFNQSSKVLQSPVASDF

SEQ ID NO: 24173 - protein, 20 aa, synthetic construct
  source 1..20: note = Seed: SATGFKQSSKALQRPVASDF
SATGFQQSFKFLQIPVASDF

SEQ ID NO: 24174 - protein, 20 aa, synthetic construct
  source 1..20: note = Seed: SATGFKQSSKALQRPVASDF
SATGFQQSFKFLQLPVASDF

SEQ ID NO: 24175 - protein, 20 aa, synthetic construct
  source 1..20: note = Seed: SATGFKQSSKALQRPVASDF
SATGFQQSFKFLQMPVASDF

SEQ ID NO: 24176 - protein, 20 aa, synthetic construct
  source 1..20: note = Seed: SATGFKQSSKALQRPVASDF
SATGFQQSFKFLQVPVASDF

SEQ ID NO: 24177 - protein, 20 aa, synthetic construct
  source 1..20: note = Seed: SATGFKQSSKALQRPVASDF
SATGFQQSFKLLQLPVASDF

SEQ ID NO: 24178 - protein, 20 aa, synthetic construct
  source 1..20: note = Seed: SATGFKQSSKALQRPVASDF
SATGFQQSIKFLQIPVASDF

SEQ ID NO: 24179 - protein, 20 aa, synthetic construct
  source 1..20: note = Seed: SATGFKQSSKALQRPVASDF
SATGFQQSIKFLQLPVASDF

SEQ ID NO: 24180 - protein, 20 aa, synthetic construct
  source 1..20: note = Seed: SATGFKQSSKALQRPVASDF
SATGFQQSIKFLQVPVASDF

SEQ ID NO: 24181 - protein, 20 aa, synthetic construct
  source 1..20: note = Seed: SATGFKQSSKALQRPVASDF
SATGFQQSLKFLQIPVASDF

SEQ ID NO: 24182 - protein, 20 aa, synthetic construct
  source 1..20: note = Seed: SATGFKQSSKALQRPVASDF
SATGFQQSMKFLQIPVASDF

SEQ ID NO: 24183 - protein, 20 aa, synthetic construct
  source 1..20: note = Seed: SATGFKQSSKALQRPVASDF
SATGFQQSSKFLQIPVASDF

SEQ ID NO: 24184 - protein, 20 aa, synthetic construct
  source 1..20: note = Seed: SATGFKQSSKALQRPVASDF
SATGFQQSTKFLQIPVASDF

SEQ ID NO: 24185 - protein, 20 aa, synthetic construct
  source 1..20: note = Seed: SATGFKQSSKALQRPVASDF
SATGFQQSTKFLQLPVASDF

SEQ ID NO: 24186 - protein, 20 aa, synthetic construct
  source 1..20: note = Seed: SATGFKQSSKALQRPVASDF
SATGFQQSTKFLQVPVASDF

SEQ ID NO: 24187 - protein, 20 aa, synthetic construct
  source 1..20: note = Seed: SATGFKQSSKALQRPVASDF
SATGFQQSVKFLQIPVASDF

SEQ ID NO: 24188 - protein, 20 aa, synthetic construct
  source 1..20: note = Seed: SATGFKQSSKALQRPVASDF
SATGFQQSVKFLQLPVASDF

SEQ ID NO: 24189 - protein, 20 aa, synthetic construct
  source 1..20: note = Seed: SATGFKQSSKALQRPVASDF
SATGFQQSVKFLQVPVASDF

SEQ ID NO: 24190 - protein, 20 aa, synthetic construct
  source 1..20: note = Seed: SATGFKQSSKALQRPVASDF
SATGFQQSWKFLQIPVASDF

SEQ ID NO: 24191 - protein, 20 aa, synthetic construct
  source 1..20: note = Seed: SATGFKQSSKALQRPVASDF
SATGFQQSYKFLQIPVASDF

SEQ ID NO: 24192 - protein, 20 aa, synthetic construct
  source 1..20: note = Seed: SATGFKQSSKALQRPVASDF
SATGFQQSYKFLQLPVASDF

SEQ ID NO: 24193 - protein, 20 aa, synthetic construct
  source 1..20: note = Seed: SATGFKQSSKALQRPVASDF
SATGFRQSAKALQIPVASDF

SEQ ID NO: 24194 - protein, 20 aa, synthetic construct
  source 1..20: note = Seed: SATGFKQSSKALQRPVASDF
SATGFRQSAKALQLPVASDF

SEQ ID NO: 24195 - protein, 20 aa, synthetic construct
  source 1..20: note = Seed: SATGFKQSSKALQRPVASDF
SATGFRQSAKFLQAPVASDF

SEQ ID NO: 24196 - protein, 20 aa, synthetic construct
  source 1..20: note = Seed: SATGFKQSSKALQRPVASDF
SATGFRQSAKFLQFPVASDF

SEQ ID NO: 24197 - protein, 20 aa, synthetic construct
  source 1..20: note = Seed: SATGFKQSSKALQRPVASDF
SATGFRQSAKFLQIPVASDF

SEQ ID NO: 24198 - protein, 20 aa, synthetic construct
  source 1..20: note = Seed: SATGFKQSSKALQRPVASDF
SATGFRQSAKFLQLPVASDF

SEQ ID NO: 24199 - protein, 20 aa, synthetic construct
  source 1..20: note = Seed: SATGFKQSSKALQRPVASDF
SATGFRQSAKFLQMPVASDF

SEQ ID NO: 24200 - protein, 20 aa, synthetic construct
  source 1..20: note = Seed: SATGFKQSSKALQRPVASDF
SATGFRQSAKFLQSPVASDF

SEQ ID NO: 24201 - protein, 20 aa, synthetic construct
  source 1..20: note = Seed: SATGFKQSSKALQRPVASDF
SATGFRQSAKFLQTPVASDF

SEQ ID NO: 24202 - protein, 20 aa, synthetic construct
  source 1..20: note = Seed: SATGFKQSSKALQRPVASDF
SATGFRQSAKFLQVPVASDF

SEQ ID NO: 24203 - protein, 20 aa, synthetic construct
  source 1..20: note = Seed: SATGFKQSSKALQRPVASDF
SATGFRQSAKILQIPVASDF

SEQ ID NO: 24204 - protein, 20 aa, synthetic construct
  source 1..20: note = Seed: SATGFKQSSKALQRPVASDF
SATGFRQSAKILQLPVASDF

SEQ ID NO: 24205 - protein, 20 aa, synthetic construct
  source 1..20: note = Seed: SATGFKQSSKALQRPVASDF
SATGFRQSAKILQVPVASDF

SEQ ID NO: 24206 - protein, 20 aa, synthetic construct
  source 1..20: note = Seed: SATGFKQSSKALQRPVASDF
SATGFRQSAKLLQIPVASDF

SEQ ID NO: 24207 - protein, 20 aa, synthetic construct
  source 1..20: note = Seed: SATGFKQSSKALQRPVASDF
SATGFRQSAKLLQLPVASDF

SEQ ID NO: 24208 - protein, 20 aa, synthetic construct
  source 1..20: note = Seed: SATGFKQSSKALQRPVASDF
SATGFRQSAKLLQVPVASDF

SEQ ID NO: 24209 - protein, 20 aa, synthetic construct
  source 1..20: note = Seed: SATGFKQSSKALQRPVASDF
SATGFRQSDKFLQIPVASDF

SEQ ID NO: 24210 - protein, 20 aa, synthetic construct
  source 1..20: note = Seed: SATGFKQSSKALQRPVASDF
SATGFRQSDKFLQLPVASDF

SEQ ID NO: 24211 - protein, 20 aa, synthetic construct
  source 1..20: note = Seed: SATGFKQSSKALQRPVASDF
SATGFRQSDKFLQVPVASDF

SEQ ID NO: 24212 - protein, 20 aa, synthetic construct
  source 1..20: note = Seed: SATGFKQSSKALQRPVASDF
SATGFRQSEKFLQAPVASDF

SEQ ID NO: 24213 - protein, 20 aa, synthetic construct
  source 1..20: note = Seed: SATGFKQSSKALQRPVASDF
SATGFRQSEKFLQFPVASDF

SEQ ID NO: 24214 - protein, 20 aa, synthetic construct
  source 1..20: note = Seed: SATGFKQSSKALQRPVASDF
SATGFRQSEKFLQIPVASDF

SEQ ID NO: 24215 - protein, 20 aa, synthetic construct
  source 1..20: note = Seed: SATGFKQSSKALQRPVASDF
SATGFRQSEKFLQLPVASDF

SEQ ID NO: 24216 - protein, 20 aa, synthetic construct
  source 1..20: note = Seed: SATGFKQSSKALQRPVASDF
SATGFRQSEKFLQMPVASDF

SEQ ID NO: 24217 - protein, 20 aa, synthetic construct
  source 1..20: note = Seed: SATGFKQSSKALQRPVASDF
SATGFRQSEKFLQVPVASDF

SEQ ID NO: 24218 - protein, 20 aa, synthetic construct
  source 1..20: note = Seed: SATGFKQSSKALQRPVASDF
SATGFRQSEKILQLPVASDF

SEQ ID NO: 24219 - protein, 20 aa, synthetic construct
  source 1..20: note = Seed: SATGFKQSSKALQRPVASDF
SATGFRQSFKALQIPVASDF

SEQ ID NO: 24220 - protein, 20 aa, synthetic construct
  source 1..20: note = Seed: SATGFKQSSKALQRPVASDF
SATGFRQSFKALQLPVASDF

SEQ ID NO: 24221 - protein, 20 aa, synthetic construct
  source 1..20: note = Seed: SATGFKQSSKALQRPVASDF
SATGFRQSFKFLQAPVASDF

SEQ ID NO: 24222 - protein, 20 aa, synthetic construct
  source 1..20: note = Seed: SATGFKQSSKALQRPVASDF
SATGFRQSFKFLQEPVASDF

SEQ ID NO: 24223 - protein, 20 aa, synthetic construct
  source 1..20: note = Seed: SATGFKQSSKALQRPVASDF
SATGFRQSFKFLQHPVASDF

SEQ ID NO: 24224 - protein, 20 aa, synthetic construct
  source 1..20: note = Seed: SATGFKQSSKALQRPVASDF
SATGFRQSFKFLQIPVASDF

SEQ ID NO: 24225 - protein, 20 aa, synthetic construct
  source 1..20: note = Seed: SATGFKQSSKALQRPVASDF
SATGFRQSFKFLQLPVASDF

SEQ ID NO: 24226 - protein, 20 aa, synthetic construct
  source 1..20: note = Seed: SATGFKQSSKALQRPVASDF
SATGFRQSFKFLQMPVASDF

SEQ ID NO: 24227 - protein, 20 aa, synthetic construct
  source 1..20: note = Seed: SATGFKQSSKALQRPVASDF
SATGFRQSFKFLQSPVASDF

SEQ ID NO: 24228 - protein, 20 aa, synthetic construct
  source 1..20: note = Seed: SATGFKQSSKALQRPVASDF
SATGFRQSFKFLQTPVASDF

SEQ ID NO: 24229 - protein, 20 aa, synthetic construct
  source 1..20: note = Seed: SATGFKQSSKALQRPVASDF
SATGFRQSFKFLQVPVASDF

SEQ ID NO: 24230 - protein, 20 aa, synthetic construct
  source 1..20: note = Seed: SATGFKQSSKALQRPVASDF
SATGFRQSFKILQIPVASDF

SEQ ID NO: 24231 - protein, 20 aa, synthetic construct
  source 1..20: note = Seed: SATGFKQSSKALQRPVASDF
SATGFRQSFKILQLPVASDF

SEQ ID NO: 24232 - protein, 20 aa, synthetic construct
  source 1..20: note = Seed: SATGFKQSSKALQRPVASDF
SATGFRQSFKILQMPVASDF

SEQ ID NO: 24233 - protein, 20 aa, synthetic construct
  source 1..20: note = Seed: SATGFKQSSKALQRPVASDF
SATGFRQSFKILQVPVASDF

SEQ ID NO: 24234 - protein, 20 aa, synthetic construct
  source 1..20: note = Seed: SATGFKQSSKALQRPVASDF
SATGFRQSFKILQYPVASDF

SEQ ID NO: 24235 - protein, 20 aa, synthetic construct
  source 1..20: note = Seed: SATGFKQSSKALQRPVASDF
SATGFRQSFKLLQAPVASDF

SEQ ID NO: 24236 - protein, 20 aa, synthetic construct
  source 1..20: note = Seed: SATGFKQSSKALQRPVASDF
SATGFRQSFKLLQIPVASDF

SEQ ID NO: 24237 - protein, 20 aa, synthetic construct
  source 1..20: note = Seed: SATGFKQSSKALQRPVASDF
SATGFRQSFKLLQLPVASDF

SEQ ID NO: 24238 - protein, 20 aa, synthetic construct
  source 1..20: note = Seed: SATGFKQSSKALQRPVASDF
SATGFRQSFKLLQMPVASDF

SEQ ID NO: 24239 - protein, 20 aa, synthetic construct
  source 1..20: note = Seed: SATGFKQSSKALQRPVASDF
SATGFRQSFKLLQTPVASDF

SEQ ID NO: 24240 - protein, 20 aa, synthetic construct
  source 1..20: note = Seed: SATGFKQSSKALQRPVASDF
SATGFRQSFKLLQVPVASDF

SEQ ID NO: 24241 - protein, 20 aa, synthetic construct
  source 1..20: note = Seed: SATGFKQSSKALQRPVASDF
SATGFRQSFKLLQYPVASDF

SEQ ID NO: 24242 - protein, 20 aa, synthetic construct
  source 1..20: note = Seed: SATGFKQSSKALQRPVASDF
SATGFRQSFKMLQIPVASDF

SEQ ID NO: 24243 - protein, 20 aa, synthetic construct
  source 1..20: note = Seed: SATGFKQSSKALQRPVASDF
SATGFRQSFKMLQLPVASDF

SEQ ID NO: 24244 - protein, 20 aa, synthetic construct
  source 1..20: note = Seed: SATGFKQSSKALQRPVASDF
SATGFRQSFKMLQMPVASDF

SEQ ID NO: 24245 - protein, 20 aa, synthetic construct
  source 1..20: note = Seed: SATGFKQSSKALQRPVASDF
SATGFRQSFKMLQVPVASDF

SEQ ID NO: 24246 - protein, 20 aa, synthetic construct
  source 1..20: note = Seed: SATGFKQSSKALQRPVASDF
SATGFRQSFKVLQIPVASDF

SEQ ID NO: 24247 - protein, 20 aa, synthetic construct
  source 1..20: note = Seed: SATGFKQSSKALQRPVASDF
SATGFRQSFKVLQLPVASDF

SEQ ID NO: 24248 - protein, 20 aa, synthetic construct
  source 1..20: note = Seed: SATGFKQSSKALQRPVASDF
SATGFRQSFKVLQMPVASDF

SEQ ID NO: 24249 - protein, 20 aa, synthetic construct
  source 1..20: note = Seed: SATGFKQSSKALQRPVASDF
SATGFRQSFKVLQVPVASDF

SEQ ID NO: 24250 - protein, 20 aa, synthetic construct
  source 1..20: note = Seed: SATGFKQSSKALQRPVASDF
SATGFRQSFKVLQYPVASDF

SEQ ID NO: 24251 - protein, 20 aa, synthetic construct
  source 1..20: note = Seed: SATGFKQSSKALQRPVASDF
SATGFRQSFKWLQIPVASDF

SEQ ID NO: 24252 - protein, 20 aa, synthetic construct
  source 1..20: note = Seed: SATGFKQSSKALQRPVASDF
SATGFRQSFKWLQMPVASDF

SEQ ID NO: 24253 - protein, 20 aa, synthetic construct
  source 1..20: note = Seed: SATGFKQSSKALQRPVASDF
SATGFRQSFKWLQVPVASDF

SEQ ID NO: 24254 - protein, 20 aa, synthetic construct
  source 1..20: note = Seed: SATGFKQSSKALQRPVASDF
SATGFRQSFKYLQIPVASDF

SEQ ID NO: 24255 - protein, 20 aa, synthetic construct
  source 1..20: note = Seed: SATGFKQSSKALQRPVASDF
SATGFRQSFKYLQMPVASDF

SEQ ID NO: 24256 - protein, 20 aa, synthetic construct
  source 1..20: note = Seed: SATGFKQSSKALQRPVASDF
SATGFRQSFKYLQVPVASDF

SEQ ID NO: 24257 - protein, 20 aa, synthetic construct
  source 1..20: note = Seed: SATGFKQSSKALQRPVASDF
SATGFRQSHKFLQFPVASDF

SEQ ID NO: 24258 - protein, 20 aa, synthetic construct
  source 1..20: note = Seed: SATGFKQSSKALQRPVASDF
SATGFRQSHKFLQIPVASDF

SEQ ID NO: 24259 - protein, 20 aa, synthetic construct
  source 1..20: note = Seed: SATGFKQSSKALQRPVASDF
SATGFRQSHKFLQLPVASDF

SEQ ID NO: 24260 - protein, 20 aa, synthetic construct
  source 1..20: note = Seed: SATGFKQSSKALQRPVASDF
SATGFRQSHKFLQMPVASDF

SEQ ID NO: 24261 - protein, 20 aa, synthetic construct
  source 1..20: note = Seed: SATGFKQSSKALQRPVASDF
SATGFRQSHKFLQVPVASDF

SEQ ID NO: 24262 - protein, 20 aa, synthetic construct
  source 1..20: note = Seed: SATGFKQSSKALQRPVASDF
SATGFRQSHKLLQIPVASDF

SEQ ID NO: 24263 - protein, 20 aa, synthetic construct
  source 1..20: note = Seed: SATGFKQSSKALQRPVASDF
SATGFRQSHKLLQLPVASDF

SEQ ID NO: 24264 - protein, 20 aa, synthetic construct
  source 1..20: note = Seed: SATGFKQSSKALQRPVASDF
SATGFRQSIKALQAPVASDF

SEQ ID NO: 24265 - protein, 20 aa, synthetic construct
  source 1..20: note = Seed: SATGFKQSSKALQRPVASDF
SATGFRQSIKALQFPVASDF

SEQ ID NO: 24266 - protein, 20 aa, synthetic construct
  source 1..20: note = Seed: SATGFKQSSKALQRPVASDF
SATGFRQSIKALQIPVASDF

SEQ ID NO: 24267 - protein, 20 aa, synthetic construct
  source 1..20: note = Seed: SATGFKQSSKALQRPVASDF
SATGFRQSIKALQLPVASDF

SEQ ID NO: 24268 - protein, 20 aa, synthetic construct
  source 1..20: note = Seed: SATGFKQSSKALQRPVASDF
SATGFRQSIKALQMPVASDF

SEQ ID NO: 24269 - protein, 20 aa, synthetic construct
  source 1..20: note = Seed: SATGFKQSSKALQRPVASDF
SATGFRQSIKALQNPVASDF

SEQ ID NO: 24270 - protein, 20 aa, synthetic construct
  source 1..20: note = Seed: SATGFKQSSKALQRPVASDF
SATGFRQSIKALQSPVASDF

SEQ ID NO: 24271 - protein, 20 aa, synthetic construct
  source 1..20: note = Seed: SATGFKQSSKALQRPVASDF
SATGFRQSIKALQVPVASDF

SEQ ID NO: 24272 - protein, 20 aa, synthetic construct
  source 1..20: note = Seed: SATGFKQSSKALQRPVASDF
SATGFRQSIKFLQAPVASDF

SEQ ID NO: 24273 - protein, 20 aa, synthetic construct
  source 1..20: note = Seed: SATGFKQSSKALQRPVASDF
SATGFRQSIKFLQEPVASDF

SEQ ID NO: 24274 - protein, 20 aa, synthetic construct
  source 1..20: note = Seed: SATGFKQSSKALQRPVASDF
SATGFRQSIKFLQFPVASDF

SEQ ID NO: 24275 - protein, 20 aa, synthetic construct
  source 1..20: note = Seed: SATGFKQSSKALQRPVASDF
SATGFRQSIKFLQHPVASDF

SEQ ID NO: 24276 - protein, 20 aa, synthetic construct
  source 1..20: note = Seed: SATGFKQSSKALQRPVASDF
SATGFRQSIKFLQIPVASDF

SEQ ID NO: 24277 - protein, 20 aa, synthetic construct
  source 1..20: note = Seed: SATGFKQSSKALQRPVASDF
SATGFRQSIKFLQLPVASDF

SEQ ID NO: 24278 - protein, 20 aa, synthetic construct
  source 1..20: note = Seed: SATGFKQSSKALQRPVASDF
SATGFRQSIKFLQMPVASDF

SEQ ID NO: 24279 - protein, 20 aa, synthetic construct
  source 1..20: note = Seed: SATGFKQSSKALQRPVASDF
SATGFRQSIKFLQNPVASDF

SEQ ID NO: 24280 - protein, 20 aa, synthetic construct
  source 1..20: note = Seed: SATGFKQSSKALQRPVASDF
SATGFRQSIKFLQSPVASDF

SEQ ID NO: 24281 - protein, 20 aa, synthetic construct
  source 1..20: note = Seed: SATGFKQSSKALQRPVASDF
SATGFRQSIKFLQTPVASDF

SEQ ID NO: 24282 - protein, 20 aa, synthetic construct
  source 1..20: note = Seed: SATGFKQSSKALQRPVASDF
SATGFRQSIKFLQVPVASDF

SEQ ID NO: 24283 - protein, 20 aa, synthetic construct
  source 1..20: note = Seed: SATGFKQSSKALQRPVASDF
SATGFRQSIKILQFPVASDF

SEQ ID NO: 24284 - protein, 20 aa, synthetic construct
  source 1..20: note = Seed: SATGFKQSSKALQRPVASDF
SATGFRQSIKILQIPVASDF

SEQ ID NO: 24285 - protein, 20 aa, synthetic construct
  source 1..20: note = Seed: SATGFKQSSKALQRPVASDF
SATGFRQSIKILQLPVASDF

SEQ ID NO: 24286 - protein, 20 aa, synthetic construct
  source 1..20: note = Seed: SATGFKQSSKALQRPVASDF
SATGFRQSIKILQMPVASDF

SEQ ID NO: 24287 - protein, 20 aa, synthetic construct
  source 1..20: note = Seed: SATGFKQSSKALQRPVASDF
SATGFRQSIKILQNPVASDF

SEQ ID NO: 24288 - protein, 20 aa, synthetic construct
  source 1..20: note = Seed: SATGFKQSSKALQRPVASDF
SATGFRQSIKILQVPVASDF

SEQ ID NO: 24289 - protein, 20 aa, synthetic construct
  source 1..20: note = Seed: SATGFKQSSKALQRPVASDF
SATGFRQSIKLLQFPVASDF

SEQ ID NO: 24290 - protein, 20 aa, synthetic construct
  source 1..20: note = Seed: SATGFKQSSKALQRPVASDF
SATGFRQSIKLLQIPVASDF

SEQ ID NO: 24291 - protein, 20 aa, synthetic construct
  source 1..20: note = Seed: SATGFKQSSKALQRPVASDF
SATGFRQSIKLLQLPVASDF

SEQ ID NO: 24292 - protein, 20 aa, synthetic construct
  source 1..20: note = Seed: SATGFKQSSKALQRPVASDF
SATGFRQSIKLLQMPVASDF

SEQ ID NO: 24293 - protein, 20 aa, synthetic construct
  source 1..20: note = Seed: SATGFKQSSKALQRPVASDF
SATGFRQSIKLLQNPVASDF

SEQ ID NO: 24294 - protein, 20 aa, synthetic construct
  source 1..20: note = Seed: SATGFKQSSKALQRPVASDF
SATGFRQSIKLLQSPVASDF

SEQ ID NO: 24295 - protein, 20 aa, synthetic construct
  source 1..20: note = Seed: SATGFKQSSKALQRPVASDF
SATGFRQSIKLLQVPVASDF

SEQ ID NO: 24296 - protein, 20 aa, synthetic construct
  source 1..20: note = Seed: SATGFKQSSKALQRPVASDF
SATGFRQSIKMLQIPVASDF

SEQ ID NO: 24297 - protein, 20 aa, synthetic construct
  source 1..20: note = Seed: SATGFKQSSKALQRPVASDF
SATGFRQSIKMLQLPVASDF

SEQ ID NO: 24298 - protein, 20 aa, synthetic construct
  source 1..20: note = Seed: SATGFKQSSKALQRPVASDF
SATGFRQSIKVLQFPVASDF

SEQ ID NO: 24299 - protein, 20 aa, synthetic construct
  source 1..20: note = Seed: SATGFKQSSKALQRPVASDF
SATGFRQSIKYLQIPVASDF

SEQ ID NO: 24300 - protein, 20 aa, synthetic construct
  source 1..20: note = Seed: SATGFKQSSKALQRPVASDF
SATGFRQSIKYLQLPVASDF

SEQ ID NO: 24301 - protein, 20 aa, synthetic construct
  source 1..20: note = Seed: SATGFKQSSKALQRPVASDF
SATGFRQSIKYLQVPVASDF

SEQ ID NO: 24302 - protein, 20 aa, synthetic construct
  source 1..20: note = Seed: SATGFKQSSKALQRPVASDF
SATGFRQSKKFLQFPVASDF

SEQ ID NO: 24303 - protein, 20 aa, synthetic construct
  source 1..20: note = Seed: SATGFKQSSKALQRPVASDF
SATGFRQSKKFLQIPVASDF

SEQ ID NO: 24304 - protein, 20 aa, synthetic construct
  source 1..20: note = Seed: SATGFKQSSKALQRPVASDF
SATGFRQSLKALQLPVASDF

SEQ ID NO: 24305 - protein, 20 aa, synthetic construct
  source 1..20: note = Seed: SATGFKQSSKALQRPVASDF
SATGFRQSLKFLQAPVASDF

SEQ ID NO: 24306 - protein, 20 aa, synthetic construct
  source 1..20: note = Seed: SATGFKQSSKALQRPVASDF
SATGFRQSLKFLQFPVASDF

SEQ ID NO: 24307 - protein, 20 aa, synthetic construct
  source 1..20: note = Seed: SATGFKQSSKALQRPVASDF
SATGFRQSLKFLQIPVASDF

SEQ ID NO: 24308 - protein, 20 aa, synthetic construct
  source 1..20: note = Seed: SATGFKQSSKALQRPVASDF
SATGFRQSLKFLQLPVASDF

SEQ ID NO: 24309 - protein, 20 aa, synthetic construct
  source 1..20: note = Seed: SATGFKQSSKALQRPVASDF
SATGFRQSLKFLQMPVASDF

SEQ ID NO: 24310 - protein, 20 aa, synthetic construct
  source 1..20: note = Seed: SATGFKQSSKALQRPVASDF
SATGFRQSLKFLQSPVASDF

SEQ ID NO: 24311 - protein, 20 aa, synthetic construct
  source 1..20: note = Seed: SATGFKQSSKALQRPVASDF
SATGFRQSLKFLQTPVASDF

SEQ ID NO: 24312 - protein, 20 aa, synthetic construct
  source 1..20: note = Seed: SATGFKQSSKALQRPVASDF
SATGFRQSLKFLQVPVASDF

SEQ ID NO: 24313 - protein, 20 aa, synthetic construct
  source 1..20: note = Seed: SATGFKQSSKALQRPVASDF
SATGFRQSLKILQIPVASDF

SEQ ID NO: 24314 - protein, 20 aa, synthetic construct
  source 1..20: note = Seed: SATGFKQSSKALQRPVASDF
SATGFRQSLKILQLPVASDF

SEQ ID NO: 24315 - protein, 20 aa, synthetic construct
  source 1..20: note = Seed: SATGFKQSSKALQRPVASDF
SATGFRQSLKLLQFPVASDF

SEQ ID NO: 24316 - protein, 20 aa, synthetic construct
  source 1..20: note = Seed: SATGFKQSSKALQRPVASDF
SATGFRQSLKLLQIPVASDF

SEQ ID NO: 24317 - protein, 20 aa, synthetic construct
  source 1..20: note = Seed: SATGFKQSSKALQRPVASDF
SATGFRQSLKLLQLPVASDF

SEQ ID NO: 24318 - protein, 20 aa, synthetic construct
  source 1..20: note = Seed: SATGFKQSSKALQRPVASDF
SATGFRQSLKLLQVPVASDF

SEQ ID NO: 24319 - protein, 20 aa, synthetic construct
  source 1..20: note = Seed: SATGFKQSSKALQRPVASDF
SATGFRQSLKYLQIPVASDF

SEQ ID NO: 24320 - protein, 20 aa, synthetic construct
  source 1..20: note = Seed: SATGFKQSSKALQRPVASDF
SATGFRQSMKFLQIPVASDF

SEQ ID NO: 24321 - protein, 20 aa, synthetic construct
  source 1..20: note = Seed: SATGFKQSSKALQRPVASDF
SATGFRQSMKFLQLPVASDF

SEQ ID NO: 24322 - protein, 20 aa, synthetic construct
  source 1..20: note = Seed: SATGFKQSSKALQRPVASDF
SATGFRQSMKFLQMPVASDF

SEQ ID NO: 24323 - protein, 20 aa, synthetic construct
  source 1..20: note = Seed: SATGFKQSSKALQRPVASDF
SATGFRQSMKFLQVPVASDF

SEQ ID NO: 24324 - protein, 20 aa, synthetic construct
  source 1..20: note = Seed: SATGFKQSSKALQRPVASDF
SATGFRQSMKFLQYPVASDF

SEQ ID NO: 24325 - protein, 20 aa, synthetic construct
  source 1..20: note = Seed: SATGFKQSSKALQRPVASDF
SATGFRQSMKILQFPVASDF

SEQ ID NO: 24326 - protein, 20 aa, synthetic construct
  source 1..20: note = Seed: SATGFKQSSKALQRPVASDF
SATGFRQSMKLLQFPVASDF

SEQ ID NO: 24327 - protein, 20 aa, synthetic construct
  source 1..20: note = Seed: SATGFKQSSKALQRPVASDF
SATGFRQSMKLLQIPVASDF

SEQ ID NO: 24328 - protein, 20 aa, synthetic construct
  source 1..20: note = Seed: SATGFKQSSKALQRPVASDF
SATGFRQSMKLLQLPVASDF

SEQ ID NO: 24329 - protein, 20 aa, synthetic construct
  source 1..20: note = Seed: SATGFKQSSKALQRPVASDF
SATGFRQSMKLLQVPVASDF

SEQ ID NO: 24330 - protein, 20 aa, synthetic construct
  source 1..20: note = Seed: SATGFKQSSKALQRPVASDF
SATGFRQSNKFLQFPVASDF

SEQ ID NO: 24331 - protein, 20 aa, synthetic construct
  source 1..20: note = Seed: SATGFKQSSKALQRPVASDF
SATGFRQSNKFLQIPVASDF

SEQ ID NO: 24332 - protein, 20 aa, synthetic construct
  source 1..20: note = Seed: SATGFKQSSKALQRPVASDF
SATGFRQSNKFLQLPVASDF

SEQ ID NO: 24333 - protein, 20 aa, synthetic construct
  source 1..20: note = Seed: SATGFKQSSKALQRPVASDF
SATGFRQSNKFLQVPVASDF

SEQ ID NO: 24334 - protein, 20 aa, synthetic construct
  source 1..20: note = Seed: SATGFKQSSKALQRPVASDF
SATGFRQSQKFLQFPVASDF

SEQ ID NO: 24335 - protein, 20 aa, synthetic construct
  source 1..20: note = Seed: SATGFKQSSKALQRPVASDF
SATGFRQSQKFLQIPVASDF

SEQ ID NO: 24336 - protein, 20 aa, synthetic construct
  source 1..20: note = Seed: SATGFKQSSKALQRPVASDF
SATGFRQSQKFLQLPVASDF

SEQ ID NO: 24337 - protein, 20 aa, synthetic construct
  source 1..20: note = Seed: SATGFKQSSKALQRPVASDF
SATGFRQSQKFLQVPVASDF

SEQ ID NO: 24338 - protein, 20 aa, synthetic construct
  source 1..20: note = Seed: SATGFKQSSKALQRPVASDF
SATGFRQSRKFLQIPVASDF

SEQ ID NO: 24339 - protein, 20 aa, synthetic construct
  source 1..20: note = Seed: SATGFKQSSKALQRPVASDF
SATGFRQSSKALQIPVASDF

SEQ ID NO: 24340 - protein, 20 aa, synthetic construct
  source 1..20: note = Seed: SATGFKQSSKALQRPVASDF
SATGFRQSSKALQLPVASDF

SEQ ID NO: 24341 - protein, 20 aa, synthetic construct
  source 1..20: note = Seed: SATGFKQSSKALQRPVASDF
SATGFRQSSKALQVPVASDF

SEQ ID NO: 24342 - protein, 20 aa, synthetic construct
  source 1..20: note = Seed: SATGFKQSSKALQRPVASDF
SATGFRQSSKFLQAPVASDF

SEQ ID NO: 24343 - protein, 20 aa, synthetic construct
  source 1..20: note = Seed: SATGFKQSSKALQRPVASDF
SATGFRQSSKFLQFPVASDF

SEQ ID NO: 24344 - protein, 20 aa, synthetic construct
  source 1..20: note = Seed: SATGFKQSSKALQRPVASDF
SATGFRQSSKFLQIPVASDF

SEQ ID NO: 24345 - protein, 20 aa, synthetic construct
  source 1..20: note = Seed: SATGFKQSSKALQRPVASDF
SATGFRQSSKFLQLPVASDF

SEQ ID NO: 24346 - protein, 20 aa, synthetic construct
  source 1..20: note = Seed: SATGFKQSSKALQRPVASDF
SATGFRQSSKFLQMPVASDF

SEQ ID NO: 24347 - protein, 20 aa, synthetic construct
  source 1..20: note = Seed: SATGFKQSSKALQRPVASDF
SATGFRQSSKFLQSPVASDF

SEQ ID NO: 24348 - protein, 20 aa, synthetic construct
  source 1..20: note = Seed: SATGFKQSSKALQRPVASDF
SATGFRQSSKFLQTPVASDF

SEQ ID NO: 24349 - protein, 20 aa, synthetic construct
  source 1..20: note = Seed: SATGFKQSSKALQRPVASDF
SATGFRQSSKFLQVPVASDF

SEQ ID NO: 24350 - protein, 20 aa, synthetic construct
  source 1..20: note = Seed: SATGFKQSSKALQRPVASDF
SATGFRQSSKILQIPVASDF

SEQ ID NO: 24351 - protein, 20 aa, synthetic construct
  source 1..20: note = Seed: SATGFKQSSKALQRPVASDF
SATGFRQSSKILQLPVASDF

SEQ ID NO: 24352 - protein, 20 aa, synthetic construct
  source 1..20: note = Seed: SATGFKQSSKALQRPVASDF
SATGFRQSSKILQMPVASDF

SEQ ID NO: 24353 - protein, 20 aa, synthetic construct
  source 1..20: note = Seed: SATGFKQSSKALQRPVASDF
SATGFRQSSKILQVPVASDF

SEQ ID NO: 24354 - protein, 20 aa, synthetic construct
  source 1..20: note = Seed: SATGFKQSSKALQRPVASDF
SATGFRQSSKLLQIPVASDF

SEQ ID NO: 24355 - protein, 20 aa, synthetic construct
  source 1..20: note = Seed: SATGFKQSSKALQRPVASDF
SATGFRQSSKLLQLPVASDF

SEQ ID NO: 24356 - protein, 20 aa, synthetic construct
  source 1..20: note = Seed: SATGFKQSSKALQRPVASDF
SATGFRQSSKLLQMPVASDF

SEQ ID NO: 24357 - protein, 20 aa, synthetic construct
  source 1..20: note = Seed: SATGFKQSSKALQRPVASDF
SATGFRQSSKLLQVPVASDF

SEQ ID NO: 24358 - protein, 20 aa, synthetic construct
  source 1..20: note = Seed: SATGFKQSSKALQRPVASDF
SATGFRQSSKVLQLPVASDF

SEQ ID NO: 24359 - protein, 20 aa, synthetic construct
  source 1..20: note = Seed: SATGFKQSSKALQRPVASDF
SATGFRQSTKALQLPVASDF

SEQ ID NO: 24360 - protein, 20 aa, synthetic construct
  source 1..20: note = Seed: SATGFKQSSKALQRPVASDF
SATGFRQSTKFLQAPVASDF

SEQ ID NO: 24361 - protein, 20 aa, synthetic construct
  source 1..20: note = Seed: SATGFKQSSKALQRPVASDF
SATGFRQSTKFLQFPVASDF

SEQ ID NO: 24362 - protein, 20 aa, synthetic construct
  source 1..20: note = Seed: SATGFKQSSKALQRPVASDF
SATGFRQSTKFLQIPVASDF

SEQ ID NO: 24363 - protein, 20 aa, synthetic construct
  source 1..20: note = Seed: SATGFKQSSKALQRPVASDF
SATGFRQSTKFLQLPVASDF

SEQ ID NO: 24364 - protein, 20 aa, synthetic construct
  source 1..20: note = Seed: SATGFKQSSKALQRPVASDF
SATGFRQSTKFLQMPVASDF

SEQ ID NO: 24365 - protein, 20 aa, synthetic construct
  source 1..20: note = Seed: SATGFKQSSKALQRPVASDF
SATGFRQSTKFLQSPVASDF

SEQ ID NO: 24366 - protein, 20 aa, synthetic construct
  source 1..20: note = Seed: SATGFKQSSKALQRPVASDF
SATGFRQSTKFLQTPVASDF

SEQ ID NO: 24367 - protein, 20 aa, synthetic construct
  source 1..20: note = Seed: SATGFKQSSKALQRPVASDF
SATGFRQSTKFLQVPVASDF

SEQ ID NO: 24368 - protein, 20 aa, synthetic construct
  source 1..20: note = Seed: SATGFKQSSKALQRPVASDF
SATGFRQSTKFLQYPVASDF

SEQ ID NO: 24369 - protein, 20 aa, synthetic construct
  source 1..20: note = Seed: SATGFKQSSKALQRPVASDF
SATGFRQSTKILQIPVASDF

SEQ ID NO: 24370 - protein, 20 aa, synthetic construct
  source 1..20: note = Seed: SATGFKQSSKALQRPVASDF
SATGFRQSTKILQLPVASDF

SEQ ID NO: 24371 - protein, 20 aa, synthetic construct
  source 1..20: note = Seed: SATGFKQSSKALQRPVASDF
SATGFRQSTKILQMPVASDF

SEQ ID NO: 24372 - protein, 20 aa, synthetic construct
  source 1..20: note = Seed: SATGFKQSSKALQRPVASDF
SATGFRQSTKILQVPVASDF

SEQ ID NO: 24373 - protein, 20 aa, synthetic construct
  source 1..20: note = Seed: SATGFKQSSKALQRPVASDF
SATGFRQSTKLLQFPVASDF

SEQ ID NO: 24374 - protein, 20 aa, synthetic construct
  source 1..20: note = Seed: SATGFKQSSKALQRPVASDF
SATGFRQSTKLLQIPVASDF

SEQ ID NO: 24375 - protein, 20 aa, synthetic construct
  source 1..20: note = Seed: SATGFKQSSKALQRPVASDF
SATGFRQSTKLLQLPVASDF

SEQ ID NO: 24376 - protein, 20 aa, synthetic construct
  source 1..20: note = Seed: SATGFKQSSKALQRPVASDF
SATGFRQSTKLLQMPVASDF

SEQ ID NO: 24377 - protein, 20 aa, synthetic construct
  source 1..20: note = Seed: SATGFKQSSKALQRPVASDF
SATGFRQSTKLLQVPVASDF

SEQ ID NO: 24378 - protein, 20 aa, synthetic construct
  source 1..20: note = Seed: SATGFKQSSKALQRPVASDF
SATGFRQSTKVLQLPVASDF

SEQ ID NO: 24379 - protein, 20 aa, synthetic construct
  source 1..20: note = Seed: SATGFKQSSKALQRPVASDF
SATGFRQSVKALQIPVASDF

SEQ ID NO: 24380 - protein, 20 aa, synthetic construct
  source 1..20: note = Seed: SATGFKQSSKALQRPVASDF
SATGFRQSVKFLQAPVASDF

SEQ ID NO: 24381 - protein, 20 aa, synthetic construct
  source 1..20: note = Seed: SATGFKQSSKALQRPVASDF
SATGFRQSVKFLQEPVASDF

SEQ ID NO: 24382 - protein, 20 aa, synthetic construct
  source 1..20: note = Seed: SATGFKQSSKALQRPVASDF
SATGFRQSVKFLQFPVASDF

SEQ ID NO: 24383 - protein, 20 aa, synthetic construct
  source 1..20: note = Seed: SATGFKQSSKALQRPVASDF
SATGFRQSVKFLQIPVASDF

SEQ ID NO: 24384 - protein, 20 aa, synthetic construct
  source 1..20: note = Seed: SATGFKQSSKALQRPVASDF
SATGFRQSVKFLQLPVASDF

SEQ ID NO: 24385 - protein, 20 aa, synthetic construct
  source 1..20: note = Seed: SATGFKQSSKALQRPVASDF
SATGFRQSVKFLQMPVASDF

SEQ ID NO: 24386 - protein, 20 aa, synthetic construct
  source 1..20: note = Seed: SATGFKQSSKALQRPVASDF
SATGFRQSVKFLQTPVASDF

SEQ ID NO: 24387 - protein, 20 aa, synthetic construct
  source 1..20: note = Seed: SATGFKQSSKALQRPVASDF
SATGFRQSVKFLQVPVASDF

SEQ ID NO: 24388 - protein, 20 aa, synthetic construct
  source 1..20: note = Seed: SATGFKQSSKALQRPVASDF
SATGFRQSVKFLQYPVASDF

SEQ ID NO: 24389 - protein, 20 aa, synthetic construct
  source 1..20: note = Seed: SATGFKQSSKALQRPVASDF
SATGFRQSVKILQFPVASDF

SEQ ID NO: 24390 - protein, 20 aa, synthetic construct
  source 1..20: note = Seed: SATGFKQSSKALQRPVASDF
SATGFRQSVKILQIPVASDF

SEQ ID NO: 24391 - protein, 20 aa, synthetic construct
  source 1..20: note = Seed: SATGFKQSSKALQRPVASDF
SATGFRQSVKILQLPVASDF

SEQ ID NO: 24392 - protein, 20 aa, synthetic construct
  source 1..20: note = Seed: SATGFKQSSKALQRPVASDF
SATGFRQSVKLLQFPVASDF

SEQ ID NO: 24393 - protein, 20 aa, synthetic construct
  source 1..20: note = Seed: SATGFKQSSKALQRPVASDF
SATGFRQSVKLLQIPVASDF

SEQ ID NO: 24394 - protein, 20 aa, synthetic construct
  source 1..20: note = Seed: SATGFKQSSKALQRPVASDF
SATGFRQSVKLLQLPVASDF

SEQ ID NO: 24395 - protein, 20 aa, synthetic construct
  source 1..20: note = Seed: SATGFKQSSKALQRPVASDF
SATGFRQSVKLLQMPVASDF

SEQ ID NO: 24396 - protein, 20 aa, synthetic construct
  source 1..20: note = Seed: SATGFKQSSKALQRPVASDF
SATGFRQSVKLLQVPVASDF

SEQ ID NO: 24397 - protein, 20 aa, synthetic construct
  source 1..20: note = Seed: SATGFKQSSKALQRPVASDF
SATGFRQSWKFLQIPVASDF

SEQ ID NO: 24398 - protein, 20 aa, synthetic construct
  source 1..20: note = Seed: SATGFKQSSKALQRPVASDF
SATGFRQSWKFLQLPVASDF

SEQ ID NO: 24399 - protein, 20 aa, synthetic construct
  source 1..20: note = Seed: SATGFKQSSKALQRPVASDF
SATGFRQSWKFLQMPVASDF

SEQ ID NO: 24400 - protein, 20 aa, synthetic construct
  source 1..20: note = Seed: SATGFKQSSKALQRPVASDF
SATGFRQSWKFLQVPVASDF

SEQ ID NO: 24401 - protein, 20 aa, synthetic construct
  source 1..20: note = Seed: SATGFKQSSKALQRPVASDF
SATGFRQSWKILQFPVASDF

SEQ ID NO: 24402 - protein, 20 aa, synthetic construct
  source 1..20: note = Seed: SATGFKQSSKALQRPVASDF
SATGFRQSWKILQIPVASDF

SEQ ID NO: 24403 - protein, 20 aa, synthetic construct
  source 1..20: note = Seed: SATGFKQSSKALQRPVASDF
SATGFRQSWKILQLPVASDF

SEQ ID NO: 24404 - protein, 20 aa, synthetic construct
  source 1..20: note = Seed: SATGFKQSSKALQRPVASDF
SATGFRQSWKLLQFPVASDF

SEQ ID NO: 24405 - protein, 20 aa, synthetic construct
  source 1..20: note = Seed: SATGFKQSSKALQRPVASDF
SATGFRQSWKLLQIPVASDF

SEQ ID NO: 24406 - protein, 20 aa, synthetic construct
  source 1..20: note = Seed: SATGFKQSSKALQRPVASDF
SATGFRQSWKLLQLPVASDF

SEQ ID NO: 24407 - protein, 20 aa, synthetic construct
  source 1..20: note = Seed: SATGFKQSSKALQRPVASDF
SATGFRQSWKLLQVPVASDF

SEQ ID NO: 24408 - protein, 20 aa, synthetic construct
  source 1..20: note = Seed: SATGFKQSSKALQRPVASDF
SATGFRQSYKFLQIPVASDF

SEQ ID NO: 24409 - protein, 20 aa, synthetic construct
  source 1..20: note = Seed: SATGFKQSSKALQRPVASDF
SATGFRQSYKFLQLPVASDF

SEQ ID NO: 24410 - protein, 20 aa, synthetic construct
  source 1..20: note = Seed: SATGFKQSSKALQRPVASDF
SATGFRQSYKFLQMPVASDF

SEQ ID NO: 24411 - protein, 20 aa, synthetic construct
  source 1..20: note = Seed: SATGFKQSSKALQRPVASDF
SATGFRQSYKFLQVPVASDF

SEQ ID NO: 24412 - protein, 20 aa, synthetic construct
  source 1..20: note = Seed: SATGFKQSSKALQRPVASDF
SATGFRQSYKILQIPVASDF

SEQ ID NO: 24413 - protein, 20 aa, synthetic construct
  source 1..20: note = Seed: SATGFKQSSKALQRPVASDF
SATGFRQSYKILQLPVASDF

SEQ ID NO: 24414 - protein, 20 aa, synthetic construct
  source 1..20: note = Seed: SATGFKQSSKALQRPVASDF
SATGFRQSYKILQVPVASDF

SEQ ID NO: 24415 - protein, 20 aa, synthetic construct
  source 1..20: note = Seed: SATGFKQSSKALQRPVASDF
SATGFRQSYKLLQIPVASDF

SEQ ID NO: 24416 - protein, 20 aa, synthetic construct
  source 1..20: note = Seed: SATGFKQSSKALQRPVASDF
SATGFRQSYKLLQLPVASDF

SEQ ID NO: 24417 - protein, 20 aa, synthetic construct
  source 1..20: note = Seed: SATGFKQSSKALQRPVASDF
SATGFRQSYKLLQVPVASDF

SEQ ID NO: 24418 - protein, 20 aa, synthetic construct
  source 1..20: note = Seed: SATGFKQSSKALQRPVASDF
SATGFSQSFKFLQIPVASDF

SEQ ID NO: 24419 - protein, 20 aa, synthetic construct
  source 1..20: note = Seed: SATGFKQSSKALQRPVASDF
SATGFSQSFKFLQVPVASDF

SEQ ID NO: 24420 - protein, 20 aa, synthetic construct
  source 1..20: note = Seed: SATGFKQSSKALQRPVASDF
SATGFSQSIKFLQIPVASDF

SEQ ID NO: 24421 - protein, 20 aa, synthetic construct
  source 1..20: note = Seed: SATGFKQSSKALQRPVASDF
SATGFTQSFKFLQIPVASDF

SEQ ID NO: 24422 - protein, 20 aa, synthetic construct
  source 1..20: note = Seed: SATGFKQSSKALQRPVASDF
SATGFTQSFKFLQLPVASDF

SEQ ID NO: 24423 - protein, 20 aa, synthetic construct
  source 1..20: note = Seed: SATGFKQSSKALQRPVASDF
SATGFTQSFKFLQMPVASDF

SEQ ID NO: 24424 - protein, 20 aa, synthetic construct
  source 1..20: note = Seed: SATGFKQSSKALQRPVASDF
SATGFTQSFKFLQVPVASDF

SEQ ID NO: 24425 - protein, 20 aa, synthetic construct
  source 1..20: note = Seed: SATGFKQSSKALQRPVASDF
SATGFTQSHKFLQIPVASDF

SEQ ID NO: 24426 - protein, 20 aa, synthetic construct
  source 1..20: note = Seed: SATGFKQSSKALQRPVASDF
SATGFTQSIKFLQIPVASDF

SEQ ID NO: 24427 - protein, 20 aa, synthetic construct
  source 1..20: note = Seed: SATGFKQSSKALQRPVASDF
SATGFTQSIKFLQLPVASDF

SEQ ID NO: 24428 - protein, 20 aa, synthetic construct
  source 1..20: note = Seed: SATGFKQSSKALQRPVASDF
SATGFTQSIKFLQVPVASDF

SEQ ID NO: 24429 - protein, 20 aa, synthetic construct
  source 1..20: note = Seed: SATGFKQSSKALQRPVASDF
SATGFTQSLKFLQIPVASDF

SEQ ID NO: 24430 - protein, 20 aa, synthetic construct
  source 1..20: note = Seed: SATGFKQSSKALQRPVASDF
SATGFTQSSKFLQIPVASDF

SEQ ID NO: 24431 - protein, 20 aa, synthetic construct
  source 1..20: note = Seed: SATGFKQSSKALQRPVASDF
SATGFTQSSKFLQLPVASDF

SEQ ID NO: 24432 - protein, 20 aa, synthetic construct
  source 1..20: note = Seed: SATGFKQSSKALQRPVASDF
SATGFTQSTKFLQIPVASDF

SEQ ID NO: 24433 - protein, 20 aa, synthetic construct
  source 1..20: note = Seed: SATGFKQSSKALQRPVASDF
SATGFTQSTKFLQLPVASDF

SEQ ID NO: 24434 - protein, 20 aa, synthetic construct
  source 1..20: note = Seed: SATGFKQSSKALQRPVASDF
SATGFTQSVKFLQIPVASDF

SEQ ID NO: 24435 - protein, 20 aa, synthetic construct
  source 1..20: note = Seed: SATGFKQSSKALQRPVASDF
SATGFTQSWKFLQIPVASDF

SEQ ID NO: 24436 - protein, 20 aa, synthetic construct
  source 1..20: note = Seed: SATGFKQSSKALQRPVASDF
SATGFVQSAKALQAPVASDF

SEQ ID NO: 24437 - protein, 20 aa, synthetic construct
  source 1..20: note = Seed: SATGFKQSSKALQRPVASDF
SATGFVQSAKFLQFPVASDF

SEQ ID NO: 24438 - protein, 20 aa, synthetic construct
  source 1..20: note = Seed: SATGFKQSSKALQRPVASDF
SATGFVQSAKFLQIPVASDF

SEQ ID NO: 24439 - protein, 20 aa, synthetic construct
  source 1..20: note = Seed: SATGFKQSSKALQRPVASDF
SATGFVQSAKFLQLPVASDF

SEQ ID NO: 24440 - protein, 20 aa, synthetic construct
  source 1..20: note = Seed: SATGFKQSSKALQRPVASDF
SATGFVQSAKFLQMPVASDF

SEQ ID NO: 24441 - protein, 20 aa, synthetic construct
  source 1..20: note = Seed: SATGFKQSSKALQRPVASDF
SATGFVQSAKFLQVPVASDF

SEQ ID NO: 24442 - protein, 20 aa, synthetic construct
  source 1..20: note = Seed: SATGFKQSSKALQRPVASDF
SATGFVQSAKPLQAPVASDF

SEQ ID NO: 24443 - protein, 20 aa, synthetic construct
  source 1..20: note = Seed: SATGFKQSSKALQRPVASDF
SATGFVQSDKFLQIPVASDF

SEQ ID NO: 24444 - protein, 20 aa, synthetic construct
  source 1..20: note = Seed: SATGFKQSSKALQRPVASDF
SATGFVQSEKFLQFPVASDF

SEQ ID NO: 24445 - protein, 20 aa, synthetic construct
  source 1..20: note = Seed: SATGFKQSSKALQRPVASDF
SATGFVQSEKFLQIPVASDF

SEQ ID NO: 24446 - protein, 20 aa, synthetic construct
  source 1..20: note = Seed: SATGFKQSSKALQRPVASDF
SATGFVQSEKFLQLPVASDF

SEQ ID NO: 24447 - protein, 20 aa, synthetic construct
  source 1..20: note = Seed: SATGFKQSSKALQRPVASDF
SATGFVQSEKFLQMPVASDF

SEQ ID NO: 24448 - protein, 20 aa, synthetic construct
  source 1..20: note = Seed: SATGFKQSSKALQRPVASDF
SATGFVQSEKFLQVPVASDF

SEQ ID NO: 24449 - protein, 20 aa, synthetic construct
  source 1..20: note = Seed: SATGFKQSSKALQRPVASDF
SATGFVQSEKFLQYPVASDF

SEQ ID NO: 24450 - protein, 20 aa, synthetic construct
  source 1..20: note = Seed: SATGFKQSSKALQRPVASDF
SATGFVQSFKFLQAPVASDF

SEQ ID NO: 24451 - protein, 20 aa, synthetic construct
  source 1..20: note = Seed: SATGFKQSSKALQRPVASDF
SATGFVQSFKFLQEPVASDF

SEQ ID NO: 24452 - protein, 20 aa, synthetic construct
  source 1..20: note = Seed: SATGFKQSSKALQRPVASDF
SATGFVQSFKFLQHPVASDF

SEQ ID NO: 24453 - protein, 20 aa, synthetic construct
  source 1..20: note = Seed: SATGFKQSSKALQRPVASDF
SATGFVQSFKFLQIPVASDF

SEQ ID NO: 24454 - protein, 20 aa, synthetic construct
  source 1..20: note = Seed: SATGFKQSSKALQRPVASDF
SATGFVQSFKFLQLPVASDF

SEQ ID NO: 24455 - protein, 20 aa, synthetic construct
  source 1..20: note = Seed: SATGFKQSSKALQRPVASDF
SATGFVQSFKFLQMPVASDF

SEQ ID NO: 24456 - protein, 20 aa, synthetic construct
  source 1..20: note = Seed: SATGFKQSSKALQRPVASDF
SATGFVQSFKFLQNPVASDF

SEQ ID NO: 24457 - protein, 20 aa, synthetic construct
  source 1..20: note = Seed: SATGFKQSSKALQRPVASDF
SATGFVQSFKFLQTPVASDF

SEQ ID NO: 24458 - protein, 20 aa, synthetic construct
  source 1..20: note = Seed: SATGFKQSSKALQRPVASDF
SATGFVQSFKFLQVPVASDF

SEQ ID NO: 24459 - protein, 20 aa, synthetic construct
  source 1..20: note = Seed: SATGFKQSSKALQRPVASDF
SATGFVQSFKFLQYPVASDF

SEQ ID NO: 24460 - protein, 20 aa, synthetic construct
  source 1..20: note = Seed: SATGFKQSSKALQRPVASDF
SATGFVQSFKILQIPVASDF

SEQ ID NO: 24461 - protein, 20 aa, synthetic construct
  source 1..20: note = Seed: SATGFKQSSKALQRPVASDF
SATGFVQSFKILQLPVASDF

SEQ ID NO: 24462 - protein, 20 aa, synthetic construct
  source 1..20: note = Seed: SATGFKQSSKALQRPVASDF
SATGFVQSFKILQVPVASDF

SEQ ID NO: 24463 - protein, 20 aa, synthetic construct
  source 1..20: note = Seed: SATGFKQSSKALQRPVASDF
SATGFVQSFKLLQIPVASDF

SEQ ID NO: 24464 - protein, 20 aa, synthetic construct
  source 1..20: note = Seed: SATGFKQSSKALQRPVASDF
SATGFVQSFKLLQLPVASDF

SEQ ID NO: 24465 - protein, 20 aa, synthetic construct
  source 1..20: note = Seed: SATGFKQSSKALQRPVASDF
SATGFVQSFKLLQMPVASDF

SEQ ID NO: 24466 - protein, 20 aa, synthetic construct
  source 1..20: note = Seed: SATGFKQSSKALQRPVASDF
SATGFVQSFKLLQVPVASDF

SEQ ID NO: 24467 - protein, 20 aa, synthetic construct
  source 1..20: note = Seed: SATGFKQSSKALQRPVASDF
SATGFVQSFKLLQYPVASDF

SEQ ID NO: 24468 - protein, 20 aa, synthetic construct
  source 1..20: note = Seed: SATGFKQSSKALQRPVASDF
SATGFVQSFKMLQIPVASDF

SEQ ID NO: 24469 - protein, 20 aa, synthetic construct
  source 1..20: note = Seed: SATGFKQSSKALQRPVASDF
SATGFVQSFKMLQLPVASDF

SEQ ID NO: 24470 - protein, 20 aa, synthetic construct
  source 1..20: note = Seed: SATGFKQSSKALQRPVASDF
SATGFVQSFKYLQIPVASDF

SEQ ID NO: 24471 - protein, 20 aa, synthetic construct
  source 1..20: note = Seed: SATGFKQSSKALQRPVASDF
SATGFVQSFKYLQLPVASDF

SEQ ID NO: 24472 - protein, 20 aa, synthetic construct
  source 1..20: note = Seed: SATGFKQSSKALQRPVASDF
SATGFVQSFKYLQMPVASDF

SEQ ID NO: 24473 - protein, 20 aa, synthetic construct
  source 1..20: note = Seed: SATGFKQSSKALQRPVASDF
SATGFVQSFKYLQVPVASDF

SEQ ID NO: 24474 - protein, 20 aa, synthetic construct
  source 1..20: note = Seed: SATGFKQSSKALQRPVASDF
SATGFVQSHKFLQAPVASDF

SEQ ID NO: 24475 - protein, 20 aa, synthetic construct
  source 1..20: note = Seed: SATGFKQSSKALQRPVASDF
SATGFVQSHKFLQEPVASDF

SEQ ID NO: 24476 - protein, 20 aa, synthetic construct
  source 1..20: note = Seed: SATGFKQSSKALQRPVASDF
SATGFVQSHKFLQFPVASDF

SEQ ID NO: 24477 - protein, 20 aa, synthetic construct
  source 1..20: note = Seed: SATGFKQSSKALQRPVASDF
SATGFVQSHKFLQIPVASDF

SEQ ID NO: 24478 - protein, 20 aa, synthetic construct
  source 1..20: note = Seed: SATGFKQSSKALQRPVASDF
SATGFVQSHKFLQLPVASDF

SEQ ID NO: 24479 - protein, 20 aa, synthetic construct
  source 1..20: note = Seed: SATGFKQSSKALQRPVASDF
SATGFVQSHKFLQMPVASDF

SEQ ID NO: 24480 - protein, 20 aa, synthetic construct
  source 1..20: note = Seed: SATGFKQSSKALQRPVASDF
SATGFVQSHKFLQSPVASDF

SEQ ID NO: 24481 - protein, 20 aa, synthetic construct
  source 1..20: note = Seed: SATGFKQSSKALQRPVASDF
SATGFVQSHKFLQTPVASDF

SEQ ID NO: 24482 - protein, 20 aa, synthetic construct
  source 1..20: note = Seed: SATGFKQSSKALQRPVASDF
SATGFVQSHKFLQVPVASDF

SEQ ID NO: 24483 - protein, 20 aa, synthetic construct
  source 1..20: note = Seed: SATGFKQSSKALQRPVASDF
SATGFVQSHKFLQYPVASDF

SEQ ID NO: 24484 - protein, 20 aa, synthetic construct
  source 1..20: note = Seed: SATGFKQSSKALQRPVASDF
SATGFVQSHKILQIPVASDF

SEQ ID NO: 24485 - protein, 20 aa, synthetic construct
  source 1..20: note = Seed: SATGFKQSSKALQRPVASDF
SATGFVQSHKILQLPVASDF

SEQ ID NO: 24486 - protein, 20 aa, synthetic construct
  source 1..20: note = Seed: SATGFKQSSKALQRPVASDF
SATGFVQSHKILQVPVASDF

SEQ ID NO: 24487 - protein, 20 aa, synthetic construct
  source 1..20: note = Seed: SATGFKQSSKALQRPVASDF
SATGFVQSHKLLQFPVASDF

SEQ ID NO: 24488 - protein, 20 aa, synthetic construct
  source 1..20: note = Seed: SATGFKQSSKALQRPVASDF
SATGFVQSHKLLQIPVASDF

SEQ ID NO: 24489 - protein, 20 aa, synthetic construct
  source 1..20: note = Seed: SATGFKQSSKALQRPVASDF
SATGFVQSHKLLQLPVASDF

SEQ ID NO: 24490 - protein, 20 aa, synthetic construct
  source 1..20: note = Seed: SATGFKQSSKALQRPVASDF
SATGFVQSHKLLQVPVASDF

SEQ ID NO: 24491 - protein, 20 aa, synthetic construct
  source 1..20: note = Seed: SATGFKQSSKALQRPVASDF
SATGFVQSIKFLQAPVASDF

SEQ ID NO: 24492 - protein, 20 aa, synthetic construct
  source 1..20: note = Seed: SATGFKQSSKALQRPVASDF
SATGFVQSIKFLQEPVASDF

SEQ ID NO: 24493 - protein, 20 aa, synthetic construct
  source 1..20: note = Seed: SATGFKQSSKALQRPVASDF
SATGFVQSIKFLQFPVASDF

SEQ ID NO: 24494 - protein, 20 aa, synthetic construct
  source 1..20: note = Seed: SATGFKQSSKALQRPVASDF
SATGFVQSIKFLQHPVASDF

SEQ ID NO: 24495 - protein, 20 aa, synthetic construct
  source 1..20: note = Seed: SATGFKQSSKALQRPVASDF
SATGFVQSIKFLQIPVASDF

SEQ ID NO: 24496 - protein, 20 aa, synthetic construct
  source 1..20: note = Seed: SATGFKQSSKALQRPVASDF
SATGFVQSIKFLQLPVASDF

SEQ ID NO: 24497 - protein, 20 aa, synthetic construct
  source 1..20: note = Seed: SATGFKQSSKALQRPVASDF
SATGFVQSIKFLQMPVASDF

SEQ ID NO: 24498 - protein, 20 aa, synthetic construct
  source 1..20: note = Seed: SATGFKQSSKALQRPVASDF
SATGFVQSIKFLQNPVASDF

SEQ ID NO: 24499 - protein, 20 aa, synthetic construct
  source 1..20: note = Seed: SATGFKQSSKALQRPVASDF
SATGFVQSIKFLQTPVASDF

SEQ ID NO: 24500 - protein, 20 aa, synthetic construct
  source 1..20: note = Seed: SATGFKQSSKALQRPVASDF
SATGFVQSIKFLQVPVASDF

SEQ ID NO: 24501 - protein, 20 aa, synthetic construct
  source 1..20: note = Seed: SATGFKQSSKALQRPVASDF
SATGFVQSIKFLQYPVASDF

SEQ ID NO: 24502 - protein, 20 aa, synthetic construct
  source 1..20: note = Seed: SATGFKQSSKALQRPVASDF
SATGFVQSIKYLQIPVASDF

SEQ ID NO: 24503 - protein, 20 aa, synthetic construct
  source 1..20: note = Seed: SATGFKQSSKALQRPVASDF
SATGFVQSIKYLQLPVASDF

SEQ ID NO: 24504 - protein, 20 aa, synthetic construct
  source 1..20: note = Seed: SATGFKQSSKALQRPVASDF
SATGFVQSIKYLQVPVASDF

SEQ ID NO: 24505 - protein, 20 aa, synthetic construct
  source 1..20: note = Seed: SATGFKQSSKALQRPVASDF
SATGFVQSKKFLQFPVASDF

SEQ ID NO: 24506 - protein, 20 aa, synthetic construct
  source 1..20: note = Seed: SATGFKQSSKALQRPVASDF
SATGFVQSKKFLQIPVASDF

SEQ ID NO: 24507 - protein, 20 aa, synthetic construct
  source 1..20: note = Seed: SATGFKQSSKALQRPVASDF
SATGFVQSKKFLQLPVASDF

SEQ ID NO: 24508 - protein, 20 aa, synthetic construct
  source 1..20: note = Seed: SATGFKQSSKALQRPVASDF
SATGFVQSKKFLQMPVASDF

SEQ ID NO: 24509 - protein, 20 aa, synthetic construct
  source 1..20: note = Seed: SATGFKQSSKALQRPVASDF
SATGFVQSKKFLQVPVASDF

SEQ ID NO: 24510 - protein, 20 aa, synthetic construct
  source 1..20: note = Seed: SATGFKQSSKALQRPVASDF
SATGFVQSLKFLQFPVASDF

SEQ ID NO: 24511 - protein, 20 aa, synthetic construct
  source 1..20: note = Seed: SATGFKQSSKALQRPVASDF
SATGFVQSLKFLQIPVASDF

SEQ ID NO: 24512 - protein, 20 aa, synthetic construct
  source 1..20: note = Seed: SATGFKQSSKALQRPVASDF
SATGFVQSLKFLQLPVASDF

SEQ ID NO: 24513 - protein, 20 aa, synthetic construct
  source 1..20: note = Seed: SATGFKQSSKALQRPVASDF
SATGFVQSLKFLQMPVASDF

SEQ ID NO: 24514 - protein, 20 aa, synthetic construct
  source 1..20: note = Seed: SATGFKQSSKALQRPVASDF
SATGFVQSLKFLQVPVASDF

SEQ ID NO: 24515 - protein, 20 aa, synthetic construct
  source 1..20: note = Seed: SATGFKQSSKALQRPVASDF
SATGFVQSMKFLQFPVASDF

SEQ ID NO: 24516 - protein, 20 aa, synthetic construct
  source 1..20: note = Seed: SATGFKQSSKALQRPVASDF
SATGFVQSMKFLQIPVASDF

SEQ ID NO: 24517 - protein, 20 aa, synthetic construct
  source 1..20: note = Seed: SATGFKQSSKALQRPVASDF
SATGFVQSMKFLQLPVASDF

SEQ ID NO: 24518 - protein, 20 aa, synthetic construct
  source 1..20: note = Seed: SATGFKQSSKALQRPVASDF
SATGFVQSMKFLQVPVASDF

SEQ ID NO: 24519 - protein, 20 aa, synthetic construct
  source 1..20: note = Seed: SATGFKQSSKALQRPVASDF
SATGFVQSNKFLQFPVASDF

SEQ ID NO: 24520 - protein, 20 aa, synthetic construct
  source 1..20: note = Seed: SATGFKQSSKALQRPVASDF
SATGFVQSNKFLQIPVASDF

SEQ ID NO: 24521 - protein, 20 aa, synthetic construct
  source 1..20: note = Seed: SATGFKQSSKALQRPVASDF
SATGFVQSNKFLQLPVASDF

SEQ ID NO: 24522 - protein, 20 aa, synthetic construct
  source 1..20: note = Seed: SATGFKQSSKALQRPVASDF
SATGFVQSNKFLQMPVASDF

SEQ ID NO: 24523 - protein, 20 aa, synthetic construct
  source 1..20: note = Seed: SATGFKQSSKALQRPVASDF
SATGFVQSNKFLQVPVASDF

SEQ ID NO: 24524 - protein, 20 aa, synthetic construct
  source 1..20: note = Seed: SATGFKQSSKALQRPVASDF
SATGFVQSQKFLQFPVASDF

SEQ ID NO: 24525 - protein, 20 aa, synthetic construct
  source 1..20: note = Seed: SATGFKQSSKALQRPVASDF
SATGFVQSQKFLQIPVASDF

SEQ ID NO: 24526 - protein, 20 aa, synthetic construct
  source 1..20: note = Seed: SATGFKQSSKALQRPVASDF
SATGFVQSQKFLQLPVASDF

SEQ ID NO: 24527 - protein, 20 aa, synthetic construct
  source 1..20: note = Seed: SATGFKQSSKALQRPVASDF
SATGFVQSQKFLQMPVASDF

SEQ ID NO: 24528 - protein, 20 aa, synthetic construct
  source 1..20: note = Seed: SATGFKQSSKALQRPVASDF
SATGFVQSQKFLQVPVASDF

SEQ ID NO: 24529 - protein, 20 aa, synthetic construct
  source 1..20: note = Seed: SATGFKQSSKALQRPVASDF
SATGFVQSRKFLQFPVASDF

SEQ ID NO: 24530 - protein, 20 aa, synthetic construct
  source 1..20: note = Seed: SATGFKQSSKALQRPVASDF
SATGFVQSRKFLQIPVASDF

SEQ ID NO: 24531 - protein, 20 aa, synthetic construct
  source 1..20: note = Seed: SATGFKQSSKALQRPVASDF
SATGFVQSRKFLQLPVASDF

SEQ ID NO: 24532 - protein, 20 aa, synthetic construct
  source 1..20: note = Seed: SATGFKQSSKALQRPVASDF
SATGFVQSRKFLQVPVASDF

SEQ ID NO: 24533 - protein, 20 aa, synthetic construct
  source 1..20: note = Seed: SATGFKQSSKALQRPVASDF
SATGFVQSSKALQAPVASDF

SEQ ID NO: 24534 - protein, 20 aa, synthetic construct
  source 1..20: note = Seed: SATGFKQSSKALQRPVASDF
SATGFVQSSKFLQAPVASDF

SEQ ID NO: 24535 - protein, 20 aa, synthetic construct
  source 1..20: note = Seed: SATGFKQSSKALQRPVASDF
SATGFVQSSKFLQEPVASDF

SEQ ID NO: 24536 - protein, 20 aa, synthetic construct
  source 1..20: note = Seed: SATGFKQSSKALQRPVASDF
SATGFVQSSKFLQFPVASDF

SEQ ID NO: 24537 - protein, 20 aa, synthetic construct
  source 1..20: note = Seed: SATGFKQSSKALQRPVASDF
SATGFVQSSKFLQIPVASDF

SEQ ID NO: 24538 - protein, 20 aa, synthetic construct
  source 1..20: note = Seed: SATGFKQSSKALQRPVASDF
SATGFVQSSKFLQLPVASDF

SEQ ID NO: 24539 - protein, 20 aa, synthetic construct
  source 1..20: note = Seed: SATGFKQSSKALQRPVASDF
SATGFVQSSKFLQMPVASDF

SEQ ID NO: 24540 - protein, 20 aa, synthetic construct
  source 1..20: note = Seed: SATGFKQSSKALQRPVASDF
SATGFVQSSKFLQNPVASDF

SEQ ID NO: 24541 - protein, 20 aa, synthetic construct
  source 1..20: note = Seed: SATGFKQSSKALQRPVASDF
SATGFVQSSKFLQTPVASDF

SEQ ID NO: 24542 - protein, 20 aa, synthetic construct
  source 1..20: note = Seed: SATGFKQSSKALQRPVASDF
SATGFVQSSKFLQVPVASDF

SEQ ID NO: 24543 - protein, 20 aa, synthetic construct
  source 1..20: note = Seed: SATGFKQSSKALQRPVASDF
SATGFVQSSKFLQYPVASDF

SEQ ID NO: 24544 - protein, 20 aa, synthetic construct
  source 1..20: note = Seed: SATGFKQSSKALQRPVASDF
SATGFVQSSKPLQAPVASDF

SEQ ID NO: 24545 - protein, 20 aa, synthetic construct
  source 1..20: note = Seed: SATGFKQSSKALQRPVASDF
SATGFVQSSKVLQAPVASDF

SEQ ID NO: 24546 - protein, 20 aa, synthetic construct
  source 1..20: note = Seed: SATGFKQSSKALQRPVASDF
SATGFVQSSKYLQIPVASDF

SEQ ID NO: 24547 - protein, 20 aa, synthetic construct
  source 1..20: note = Seed: SATGFKQSSKALQRPVASDF
SATGFVQSSKYLQLPVASDF

SEQ ID NO: 24548 - protein, 20 aa, synthetic construct
  source 1..20: note = Seed: SATGFKQSSKALQRPVASDF
SATGFVQSTKFLQAPVASDF

SEQ ID NO: 24549 - protein, 20 aa, synthetic construct
  source 1..20: note = Seed: SATGFKQSSKALQRPVASDF
SATGFVQSTKFLQEPVASDF

SEQ ID NO: 24550 - protein, 20 aa, synthetic construct
  source 1..20: note = Seed: SATGFKQSSKALQRPVASDF
SATGFVQSTKFLQFPVASDF

SEQ ID NO: 24551 - protein, 20 aa, synthetic construct
  source 1..20: note = Seed: SATGFKQSSKALQRPVASDF
SATGFVQSTKFLQIPVASDF

SEQ ID NO: 24552 - protein, 20 aa, synthetic construct
  source 1..20: note = Seed: SATGFKQSSKALQRPVASDF
SATGFVQSTKFLQLPVASDF

SEQ ID NO: 24553 - protein, 20 aa, synthetic construct
  source 1..20: note = Seed: SATGFKQSSKALQRPVASDF
SATGFVQSTKFLQMPVASDF

SEQ ID NO: 24554 - protein, 20 aa, synthetic construct
  source 1..20: note = Seed: SATGFKQSSKALQRPVASDF
SATGFVQSTKFLQNPVASDF

SEQ ID NO: 24555 - protein, 20 aa, synthetic construct
  source 1..20: note = Seed: SATGFKQSSKALQRPVASDF
SATGFVQSTKFLQSPVASDF

SEQ ID NO: 24556 - protein, 20 aa, synthetic construct
  source 1..20: note = Seed: SATGFKQSSKALQRPVASDF
SATGFVQSTKFLQTPVASDF

SEQ ID NO: 24557 - protein, 20 aa, synthetic construct
  source 1..20: note = Seed: SATGFKQSSKALQRPVASDF
SATGFVQSTKFLQVPVASDF

SEQ ID NO: 24558 - protein, 20 aa, synthetic construct
  source 1..20: note = Seed: SATGFKQSSKALQRPVASDF
SATGFVQSTKFLQYPVASDF

SEQ ID NO: 24559 - protein, 20 aa, synthetic construct
  source 1..20: note = Seed: SATGFKQSSKALQRPVASDF
SATGFVQSTKILQLPVASDF

SEQ ID NO: 24560 - protein, 20 aa, synthetic construct
  source 1..20: note = Seed: SATGFKQSSKALQRPVASDF
SATGFVQSTKLLQFPVASDF

SEQ ID NO: 24561 - protein, 20 aa, synthetic construct
  source 1..20: note = Seed: SATGFKQSSKALQRPVASDF
SATGFVQSTKLLQIPVASDF

SEQ ID NO: 24562 - protein, 20 aa, synthetic construct
  source 1..20: note = Seed: SATGFKQSSKALQRPVASDF
SATGFVQSTKLLQLPVASDF

SEQ ID NO: 24563 - protein, 20 aa, synthetic construct
  source 1..20: note = Seed: SATGFKQSSKALQRPVASDF
SATGFVQSTKLLQVPVASDF

SEQ ID NO: 24564 - protein, 20 aa, synthetic construct
  source 1..20: note = Seed: SATGFKQSSKALQRPVASDF
SATGFVQSTKWLQIPVASDF

SEQ ID NO: 24565 - protein, 20 aa, synthetic construct
  source 1..20: note = Seed: SATGFKQSSKALQRPVASDF
SATGFVQSTKYLQFPVASDF

SEQ ID NO: 24566 - protein, 20 aa, synthetic construct
  source 1..20: note = Seed: SATGFKQSSKALQRPVASDF
SATGFVQSTKYLQIPVASDF

SEQ ID NO: 24567 - protein, 20 aa, synthetic construct
  source 1..20: note = Seed: SATGFKQSSKALQRPVASDF
SATGFVQSTKYLQLPVASDF

SEQ ID NO: 24568 - protein, 20 aa, synthetic construct
  source 1..20: note = Seed: SATGFKQSSKALQRPVASDF
SATGFVQSTKYLQVPVASDF

SEQ ID NO: 24569 - protein, 20 aa, synthetic construct
  source 1..20: note = Seed: SATGFKQSSKALQRPVASDF
SATGFVQSVKFLQEPVASDF

SEQ ID NO: 24570 - protein, 20 aa, synthetic construct
  source 1..20: note = Seed: SATGFKQSSKALQRPVASDF
SATGFVQSVKFLQFPVASDF

SEQ ID NO: 24571 - protein, 20 aa, synthetic construct
  source 1..20: note = Seed: SATGFKQSSKALQRPVASDF
SATGFVQSVKFLQIPVASDF

SEQ ID NO: 24572 - protein, 20 aa, synthetic construct
  source 1..20: note = Seed: SATGFKQSSKALQRPVASDF
SATGFVQSVKFLQLPVASDF

SEQ ID NO: 24573 - protein, 20 aa, synthetic construct
  source 1..20: note = Seed: SATGFKQSSKALQRPVASDF
SATGFVQSVKFLQMPVASDF

SEQ ID NO: 24574 - protein, 20 aa, synthetic construct
  source 1..20: note = Seed: SATGFKQSSKALQRPVASDF
SATGFVQSVKFLQNPVASDF

SEQ ID NO: 24575 - protein, 20 aa, synthetic construct
  source 1..20: note = Seed: SATGFKQSSKALQRPVASDF
SATGFVQSVKFLQTPVASDF

SEQ ID NO: 24576 - protein, 20 aa, synthetic construct
  source 1..20: note = Seed: SATGFKQSSKALQRPVASDF
SATGFVQSVKFLQVPVASDF

SEQ ID NO: 24577 - protein, 20 aa, synthetic construct
  source 1..20: note = Seed: SATGFKQSSKALQRPVASDF
SATGFVQSVKFLQYPVASDF

SEQ ID NO: 24578 - protein, 20 aa, synthetic construct
  source 1..20: note = Seed: SATGFKQSSKALQRPVASDF
SATGFVQSWKFLQFPVASDF

SEQ ID NO: 24579 - protein, 20 aa, synthetic construct
  source 1..20: note = Seed: SATGFKQSSKALQRPVASDF
SATGFVQSWKFLQIPVASDF

SEQ ID NO: 24580 - protein, 20 aa, synthetic construct
  source 1..20: note = Seed: SATGFKQSSKALQRPVASDF
SATGFVQSWKFLQLPVASDF

SEQ ID NO: 24581 - protein, 20 aa, synthetic construct
  source 1..20: note = Seed: SATGFKQSSKALQRPVASDF
SATGFVQSWKFLQMPVASDF

SEQ ID NO: 24582 - protein, 20 aa, synthetic construct
  source 1..20: note = Seed: SATGFKQSSKALQRPVASDF
SATGFVQSWKFLQVPVASDF

SEQ ID NO: 24583 - protein, 20 aa, synthetic construct
  source 1..20: note = Seed: SATGFKQSSKALQRPVASDF
SATGFVQSWKYLQLPVASDF

SEQ ID NO: 24584 - protein, 20 aa, synthetic construct
  source 1..20: note = Seed: SATGFKQSSKALQRPVASDF
SATGFVQSYKFLQIPVASDF

SEQ ID NO: 24585 - protein, 20 aa, synthetic construct
  source 1..20: note = Seed: SATGFKQSSKALQRPVASDF
SATGFVQSYKFLQLPVASDF

SEQ ID NO: 24586 - protein, 20 aa, synthetic construct
  source 1..20: note = Seed: SATGFKQSSKALQRPVASDF
SATGFVQSYKFLQMPVASDF

SEQ ID NO: 24587 - protein, 20 aa, synthetic construct
  source 1..20: note = Seed: SATGFKQSSKALQRPVASDF
SATGFVQSYKFLQVPVASDF

SEQ ID NO: 24588 - protein, 20 aa, synthetic construct
  source 1..20: note = Seed: SATGFKQSSKALQRPVASDF
SATGFVQSYKFLQYPVASDF

SEQ ID NO: 24589 - protein, 20 aa, synthetic construct
  source 1..20: note = Seed: SATGFKQSSKALQRPVASDF
SATGFVQSYKLLQIPVASDF

SEQ ID NO: 24590 - protein, 20 aa, synthetic construct
  source 1..20: note = Seed: SATGFKQSSKALQRPVASDF
SATGFVQSYKLLQLPVASDF

SEQ ID NO: 24591 - protein, 20 aa, synthetic construct
  source 1..20: note = Seed: SATGFKQSSKALQRPVASDF
SATGFVQSYKYLQLPVASDF

SEQ ID NO: 24592 - protein, 20 aa, synthetic construct
  source 1..20: note = Seed: SATGFKQSSKALQRPVASDF
SATGFWQSAKFLQFPVASDF

SEQ ID NO: 24593 - protein, 20 aa, synthetic construct
  source 1..20: note = Seed: SATGFKQSSKALQRPVASDF
SATGFWQSAKFLQIPVASDF

SEQ ID NO: 24594 - protein, 20 aa, synthetic construct
  source 1..20: note = Seed: SATGFKQSSKALQRPVASDF
SATGFWQSAKFLQLPVASDF

SEQ ID NO: 24595 - protein, 20 aa, synthetic construct
  source 1..20: note = Seed: SATGFKQSSKALQRPVASDF
SATGFWQSAKFLQMPVASDF

SEQ ID NO: 24596 - protein, 20 aa, synthetic construct
  source 1..20: note = Seed: SATGFKQSSKALQRPVASDF
SATGFWQSAKFLQVPVASDF

SEQ ID NO: 24597 - protein, 20 aa, synthetic construct
  source 1..20: note = Seed: SATGFKQSSKALQRPVASDF
SATGFWQSDKFLQIPVASDF

SEQ ID NO: 24598 - protein, 20 aa, synthetic construct
  source 1..20: note = Seed: SATGFKQSSKALQRPVASDF
SATGFWQSEKFLQFPVASDF

SEQ ID NO: 24599 - protein, 20 aa, synthetic construct
  source 1..20: note = Seed: SATGFKQSSKALQRPVASDF
SATGFWQSEKFLQIPVASDF

SEQ ID NO: 24600 - protein, 20 aa, synthetic construct
  source 1..20: note = Seed: SATGFKQSSKALQRPVASDF
SATGFWQSEKFLQLPVASDF

SEQ ID NO: 24601 - protein, 20 aa, synthetic construct
  source 1..20: note = Seed: SATGFKQSSKALQRPVASDF
SATGFWQSEKFLQMPVASDF

SEQ ID NO: 24602 - protein, 20 aa, synthetic construct
  source 1..20: note = Seed: SATGFKQSSKALQRPVASDF
SATGFWQSEKFLQVPVASDF

SEQ ID NO: 24603 - protein, 20 aa, synthetic construct
  source 1..20: note = Seed: SATGFKQSSKALQRPVASDF
SATGFWQSEKFLQYPVASDF

SEQ ID NO: 24604 - protein, 20 aa, synthetic construct
  source 1..20: note = Seed: SATGFKQSSKALQRPVASDF
SATGFWQSFKFLQAPVASDF

SEQ ID NO: 24605 - protein, 20 aa, synthetic construct
  source 1..20: note = Seed: SATGFKQSSKALQRPVASDF
SATGFWQSFKFLQEPVASDF

SEQ ID NO: 24606 - protein, 20 aa, synthetic construct
  source 1..20: note = Seed: SATGFKQSSKALQRPVASDF
SATGFWQSFKFLQFPVASDF

SEQ ID NO: 24607 - protein, 20 aa, synthetic construct
  source 1..20: note = Seed: SATGFKQSSKALQRPVASDF
SATGFWQSFKFLQIPVASDF

SEQ ID NO: 24608 - protein, 20 aa, synthetic construct
  source 1..20: note = Seed: SATGFKQSSKALQRPVASDF
SATGFWQSFKFLQLPVASDF

SEQ ID NO: 24609 - protein, 20 aa, synthetic construct
  source 1..20: note = Seed: SATGFKQSSKALQRPVASDF
SATGFWQSFKFLQMPVASDF

SEQ ID NO: 24610 - protein, 20 aa, synthetic construct
  source 1..20: note = Seed: SATGFKQSSKALQRPVASDF
SATGFWQSFKFLQVPVASDF

SEQ ID NO: 24611 - protein, 20 aa, synthetic construct
  source 1..20: note = Seed: SATGFKQSSKALQRPVASDF
SATGFWQSFKFLQYPVASDF

SEQ ID NO: 24612 - protein, 20 aa, synthetic construct
  source 1..20: note = Seed: SATGFKQSSKALQRPVASDF
SATGFWQSFKILQLPVASDF

SEQ ID NO: 24613 - protein, 20 aa, synthetic construct
  source 1..20: note = Seed: SATGFKQSSKALQRPVASDF
SATGFWQSFKLLQIPVASDF

SEQ ID NO: 24614 - protein, 20 aa, synthetic construct
  source 1..20: note = Seed: SATGFKQSSKALQRPVASDF
SATGFWQSFKLLQLPVASDF

SEQ ID NO: 24615 - protein, 20 aa, synthetic construct
  source 1..20: note = Seed: SATGFKQSSKALQRPVASDF
SATGFWQSFKLLQMPVASDF

SEQ ID NO: 24616 - protein, 20 aa, synthetic construct
  source 1..20: note = Seed: SATGFKQSSKALQRPVASDF
SATGFWQSFKMLQLPVASDF

SEQ ID NO: 24617 - protein, 20 aa, synthetic construct
  source 1..20: note = Seed: SATGFKQSSKALQRPVASDF
SATGFWQSFKYLQIPVASDF

SEQ ID NO: 24618 - protein, 20 aa, synthetic construct
  source 1..20: note = Seed: SATGFKQSSKALQRPVASDF
SATGFWQSFKYLQLPVASDF

SEQ ID NO: 24619 - protein, 20 aa, synthetic construct
  source 1..20: note = Seed: SATGFKQSSKALQRPVASDF
SATGFWQSFKYLQVPVASDF

SEQ ID NO: 24620 - protein, 20 aa, synthetic construct
  source 1..20: note = Seed: SATGFKQSSKALQRPVASDF
SATGFWQSHKFLQAPVASDF

SEQ ID NO: 24621 - protein, 20 aa, synthetic construct
  source 1..20: note = Seed: SATGFKQSSKALQRPVASDF
SATGFWQSHKFLQFPVASDF

SEQ ID NO: 24622 - protein, 20 aa, synthetic construct
  source 1..20: note = Seed: SATGFKQSSKALQRPVASDF
SATGFWQSHKFLQIPVASDF

SEQ ID NO: 24623 - protein, 20 aa, synthetic construct
  source 1..20: note = Seed: SATGFKQSSKALQRPVASDF
SATGFWQSHKFLQLPVASDF

SEQ ID NO: 24624 - protein, 20 aa, synthetic construct
  source 1..20: note = Seed: SATGFKQSSKALQRPVASDF
SATGFWQSHKFLQMPVASDF

SEQ ID NO: 24625 - protein, 20 aa, synthetic construct
  source 1..20: note = Seed: SATGFKQSSKALQRPVASDF
SATGFWQSHKFLQTPVASDF

SEQ ID NO: 24626 - protein, 20 aa, synthetic construct
  source 1..20: note = Seed: SATGFKQSSKALQRPVASDF
SATGFWQSHKFLQVPVASDF

SEQ ID NO: 24627 - protein, 20 aa, synthetic construct
  source 1..20: note = Seed: SATGFKQSSKALQRPVASDF
SATGFWQSHKFLQYPVASDF

SEQ ID NO: 24628 - protein, 20 aa, synthetic construct
  source 1..20: note = Seed: SATGFKQSSKALQRPVASDF
SATGFWQSHKLLQFPVASDF

SEQ ID NO: 24629 - protein, 20 aa, synthetic construct
  source 1..20: note = Seed: SATGFKQSSKALQRPVASDF
SATGFWQSHKLLQIPVASDF

SEQ ID NO: 24630 - protein, 20 aa, synthetic construct
  source 1..20: note = Seed: SATGFKQSSKALQRPVASDF
SATGFWQSHKLLQLPVASDF

SEQ ID NO: 24631 - protein, 20 aa, synthetic construct
  source 1..20: note = Seed: SATGFKQSSKALQRPVASDF
SATGFWQSIKFLQAPVASDF

SEQ ID NO: 24632 - protein, 20 aa, synthetic construct
  source 1..20: note = Seed: SATGFKQSSKALQRPVASDF
SATGFWQSIKFLQEPVASDF

SEQ ID NO: 24633 - protein, 20 aa, synthetic construct
  source 1..20: note = Seed: SATGFKQSSKALQRPVASDF
SATGFWQSIKFLQFPVASDF

SEQ ID NO: 24634 - protein, 20 aa, synthetic construct
  source 1..20: note = Seed: SATGFKQSSKALQRPVASDF
SATGFWQSIKFLQIPVASDF

SEQ ID NO: 24635 - protein, 20 aa, synthetic construct
  source 1..20: note = Seed: SATGFKQSSKALQRPVASDF
SATGFWQSIKFLQLPVASDF

SEQ ID NO: 24636 - protein, 20 aa, synthetic construct
  source 1..20: note = Seed: SATGFKQSSKALQRPVASDF
SATGFWQSIKFLQMPVASDF

SEQ ID NO: 24637 - protein, 20 aa, synthetic construct
  source 1..20: note = Seed: SATGFKQSSKALQRPVASDF
SATGFWQSIKFLQTPVASDF

SEQ ID NO: 24638 - protein, 20 aa, synthetic construct
  source 1..20: note = Seed: SATGFKQSSKALQRPVASDF
SATGFWQSIKFLQVPVASDF

SEQ ID NO: 24639 - protein, 20 aa, synthetic construct
  source 1..20: note = Seed: SATGFKQSSKALQRPVASDF
SATGFWQSIKFLQYPVASDF

SEQ ID NO: 24640 - protein, 20 aa, synthetic construct
  source 1..20: note = Seed: SATGFKQSSKALQRPVASDF
SATGFWQSIKYLQIPVASDF

SEQ ID NO: 24641 - protein, 20 aa, synthetic construct
  source 1..20: note = Seed: SATGFKQSSKALQRPVASDF
SATGFWQSKKFLQFPVASDF

SEQ ID NO: 24642 - protein, 20 aa, synthetic construct
  source 1..20: note = Seed: SATGFKQSSKALQRPVASDF
SATGFWQSKKFLQIPVASDF

SEQ ID NO: 24643 - protein, 20 aa, synthetic construct
  source 1..20: note = Seed: SATGFKQSSKALQRPVASDF
SATGFWQSKKFLQLPVASDF

SEQ ID NO: 24644 - protein, 20 aa, synthetic construct
  source 1..20: note = Seed: SATGFKQSSKALQRPVASDF
SATGFWQSKKFLQMPVASDF

SEQ ID NO: 24645 - protein, 20 aa, synthetic construct
  source 1..20: note = Seed: SATGFKQSSKALQRPVASDF
SATGFWQSKKFLQVPVASDF

SEQ ID NO: 24646 - protein, 20 aa, synthetic construct
  source 1..20: note = Seed: SATGFKQSSKALQRPVASDF
SATGFWQSLKFLQFPVASDF

SEQ ID NO: 24647 - protein, 20 aa, synthetic construct
  source 1..20: note = Seed: SATGFKQSSKALQRPVASDF
SATGFWQSLKFLQIPVASDF

SEQ ID NO: 24648 - protein, 20 aa, synthetic construct
  source 1..20: note = Seed: SATGFKQSSKALQRPVASDF
SATGFWQSLKFLQLPVASDF

SEQ ID NO: 24649 - protein, 20 aa, synthetic construct
  source 1..20: note = Seed: SATGFKQSSKALQRPVASDF
SATGFWQSLKFLQMPVASDF

SEQ ID NO: 24650 - protein, 20 aa, synthetic construct
  source 1..20: note = Seed: SATGFKQSSKALQRPVASDF
SATGFWQSLKFLQVPVASDF

SEQ ID NO: 24651 - protein, 20 aa, synthetic construct
  source 1..20: note = Seed: SATGFKQSSKALQRPVASDF
SATGFWQSMKFLQFPVASDF

SEQ ID NO: 24652 - protein, 20 aa, synthetic construct
  source 1..20: note = Seed: SATGFKQSSKALQRPVASDF
SATGFWQSMKFLQIPVASDF

SEQ ID NO: 24653 - protein, 20 aa, synthetic construct
  source 1..20: note = Seed: SATGFKQSSKALQRPVASDF
SATGFWQSMKFLQLPVASDF

SEQ ID NO: 24654 - protein, 20 aa, synthetic construct
  source 1..20: note = Seed: SATGFKQSSKALQRPVASDF
SATGFWQSMKFLQMPVASDF

SEQ ID NO: 24655 - protein, 20 aa, synthetic construct
  source 1..20: note = Seed: SATGFKQSSKALQRPVASDF
SATGFWQSMKFLQVPVASDF

SEQ ID NO: 24656 - protein, 20 aa, synthetic construct
  source 1..20: note = Seed: SATGFKQSSKALQRPVASDF
SATGFWQSNKFLQFPVASDF

SEQ ID NO: 24657 - protein, 20 aa, synthetic construct
  source 1..20: note = Seed: SATGFKQSSKALQRPVASDF
SATGFWQSNKFLQIPVASDF

SEQ ID NO: 24658 - protein, 20 aa, synthetic construct
  source 1..20: note = Seed: SATGFKQSSKALQRPVASDF
SATGFWQSNKFLQLPVASDF

SEQ ID NO: 24659 - protein, 20 aa, synthetic construct
  source 1..20: note = Seed: SATGFKQSSKALQRPVASDF
SATGFWQSNKFLQMPVASDF

SEQ ID NO: 24660 - protein, 20 aa, synthetic construct
  source 1..20: note = Seed: SATGFKQSSKALQRPVASDF
SATGFWQSNKFLQVPVASDF

SEQ ID NO: 24661 - protein, 20 aa, synthetic construct
  source 1..20: note = Seed: SATGFKQSSKALQRPVASDF
SATGFWQSQKFLQFPVASDF

SEQ ID NO: 24662 - protein, 20 aa, synthetic construct
  source 1..20: note = Seed: SATGFKQSSKALQRPVASDF
SATGFWQSQKFLQIPVASDF

SEQ ID NO: 24663 - protein, 20 aa, synthetic construct
  source 1..20: note = Seed: SATGFKQSSKALQRPVASDF
SATGFWQSQKFLQLPVASDF

SEQ ID NO: 24664 - protein, 20 aa, synthetic construct
  source 1..20: note = Seed: SATGFKQSSKALQRPVASDF
SATGFWQSQKFLQMPVASDF

SEQ ID NO: 24665 - protein, 20 aa, synthetic construct
  source 1..20: note = Seed: SATGFKQSSKALQRPVASDF
SATGFWQSQKFLQVPVASDF

SEQ ID NO: 24666 - protein, 20 aa, synthetic construct
  source 1..20: note = Seed: SATGFKQSSKALQRPVASDF
SATGFWQSRKFLQFPVASDF

SEQ ID NO: 24667 - protein, 20 aa, synthetic construct
  source 1..20: note = Seed: SATGFKQSSKALQRPVASDF
SATGFWQSRKFLQIPVASDF

SEQ ID NO: 24668 - protein, 20 aa, synthetic construct
  source 1..20: note = Seed: SATGFKQSSKALQRPVASDF
SATGFWQSRKFLQLPVASDF

SEQ ID NO: 24669 - protein, 20 aa, synthetic construct
  source 1..20: note = Seed: SATGFKQSSKALQRPVASDF
SATGFWQSRKFLQVPVASDF

SEQ ID NO: 24670 - protein, 20 aa, synthetic construct
  source 1..20: note = Seed: SATGFKQSSKALQRPVASDF
SATGFWQSSKFLQAPVASDF

SEQ ID NO: 24671 - protein, 20 aa, synthetic construct
  source 1..20: note = Seed: SATGFKQSSKALQRPVASDF
SATGFWQSSKFLQEPVASDF

SEQ ID NO: 24672 - protein, 20 aa, synthetic construct
  source 1..20: note = Seed: SATGFKQSSKALQRPVASDF
SATGFWQSSKFLQFPVASDF

SEQ ID NO: 24673 - protein, 20 aa, synthetic construct
  source 1..20: note = Seed: SATGFKQSSKALQRPVASDF
SATGFWQSSKFLQIPVASDF

SEQ ID NO: 24674 - protein, 20 aa, synthetic construct
  source 1..20: note = Seed: SATGFKQSSKALQRPVASDF
SATGFWQSSKFLQLPVASDF

SEQ ID NO: 24675 - protein, 20 aa, synthetic construct
  source 1..20: note = Seed: SATGFKQSSKALQRPVASDF
SATGFWQSSKFLQMPVASDF

SEQ ID NO: 24676 - protein, 20 aa, synthetic construct
  source 1..20: note = Seed: SATGFKQSSKALQRPVASDF
SATGFWQSSKFLQTPVASDF

SEQ ID NO: 24677 - protein, 20 aa, synthetic construct
  source 1..20: note = Seed: SATGFKQSSKALQRPVASDF
SATGFWQSSKFLQVPVASDF

SEQ ID NO: 24678 - protein, 20 aa, synthetic construct
  source 1..20: note = Seed: SATGFKQSSKALQRPVASDF
SATGFWQSSKFLQYPVASDF

SEQ ID NO: 24679 - protein, 20 aa, synthetic construct
  source 1..20: note = Seed: SATGFKQSSKALQRPVASDF
SATGFWQSTKFLQAPVASDF

SEQ ID NO: 24680 - protein, 20 aa, synthetic construct
  source 1..20: note = Seed: SATGFKQSSKALQRPVASDF
SATGFWQSTKFLQEPVASDF

SEQ ID NO: 24681 - protein, 20 aa, synthetic construct
  source 1..20: note = Seed: SATGFKQSSKALQRPVASDF
SATGFWQSTKFLQFPVASDF

SEQ ID NO: 24682 - protein, 20 aa, synthetic construct
  source 1..20: note = Seed: SATGFKQSSKALQRPVASDF
SATGFWQSTKFLQIPVASDF

SEQ ID NO: 24683 - protein, 20 aa, synthetic construct
  source 1..20: note = Seed: SATGFKQSSKALQRPVASDF
SATGFWQSTKFLQLPVASDF

SEQ ID NO: 24684 - protein, 20 aa, synthetic construct
  source 1..20: note = Seed: SATGFKQSSKALQRPVASDF
SATGFWQSTKFLQMPVASDF

SEQ ID NO: 24685 - protein, 20 aa, synthetic construct
  source 1..20: note = Seed: SATGFKQSSKALQRPVASDF
SATGFWQSTKFLQNPVASDF

SEQ ID NO: 24686 - protein, 20 aa, synthetic construct
  source 1..20: note = Seed: SATGFKQSSKALQRPVASDF
SATGFWQSTKFLQSPVASDF

SEQ ID NO: 24687 - protein, 20 aa, synthetic construct
  source 1..20: note = Seed: SATGFKQSSKALQRPVASDF
SATGFWQSTKFLQTPVASDF

SEQ ID NO: 24688 - protein, 20 aa, synthetic construct
  source 1..20: note = Seed: SATGFKQSSKALQRPVASDF
SATGFWQSTKFLQVPVASDF

SEQ ID NO: 24689 - protein, 20 aa, synthetic construct
  source 1..20: note = Seed: SATGFKQSSKALQRPVASDF
SATGFWQSTKFLQYPVASDF

SEQ ID NO: 24690 - protein, 20 aa, synthetic construct
  source 1..20: note = Seed: SATGFKQSSKALQRPVASDF
SATGFWQSTKLLQLPVASDF

SEQ ID NO: 24691 - protein, 20 aa, synthetic construct
  source 1..20: note = Seed: SATGFKQSSKALQRPVASDF
SATGFWQSTKYLQIPVASDF

SEQ ID NO: 24692 - protein, 20 aa, synthetic construct
  source 1..20: note = Seed: SATGFKQSSKALQRPVASDF
SATGFWQSTKYLQLPVASDF

SEQ ID NO: 24693 - protein, 20 aa, synthetic construct
  source 1..20: note = Seed: SATGFKQSSKALQRPVASDF
SATGFWQSVKFLQEPVASDF

SEQ ID NO: 24694 - protein, 20 aa, synthetic construct
  source 1..20: note = Seed: SATGFKQSSKALQRPVASDF
SATGFWQSVKFLQFPVASDF

SEQ ID NO: 24695 - protein, 20 aa, synthetic construct
  source 1..20: note = Seed: SATGFKQSSKALQRPVASDF
SATGFWQSVKFLQIPVASDF

SEQ ID NO: 24696 - protein, 20 aa, synthetic construct
  source 1..20: note = Seed: SATGFKQSSKALQRPVASDF
SATGFWQSVKFLQLPVASDF

SEQ ID NO: 24697 - protein, 20 aa, synthetic construct
  source 1..20: note = Seed: SATGFKQSSKALQRPVASDF
SATGFWQSVKFLQMPVASDF

SEQ ID NO: 24698 - protein, 20 aa, synthetic construct
  source 1..20: note = Seed: SATGFKQSSKALQRPVASDF
SATGFWQSVKFLQTPVASDF

SEQ ID NO: 24699 - protein, 20 aa, synthetic construct
  source 1..20: note = Seed: SATGFKQSSKALQRPVASDF
SATGFWQSVKFLQVPVASDF

SEQ ID NO: 24700 - protein, 20 aa, synthetic construct
  source 1..20: note = Seed: SATGFKQSSKALQRPVASDF
SATGFWQSVKFLQYPVASDF

SEQ ID NO: 24701 - protein, 20 aa, synthetic construct
  source 1..20: note = Seed: SATGFKQSSKALQRPVASDF
SATGFWQSWKFLQFPVASDF

SEQ ID NO: 24702 - protein, 20 aa, synthetic construct
  source 1..20: note = Seed: SATGFKQSSKALQRPVASDF
SATGFWQSWKFLQIPVASDF

SEQ ID NO: 24703 - protein, 20 aa, synthetic construct
  source 1..20: note = Seed: SATGFKQSSKALQRPVASDF
SATGFWQSWKFLQLPVASDF

SEQ ID NO: 24704 - protein, 20 aa, synthetic construct
  source 1..20: note = Seed: SATGFKQSSKALQRPVASDF
SATGFWQSWKFLQMPVASDF

SEQ ID NO: 24705 - protein, 20 aa, synthetic construct
  source 1..20: note = Seed: SATGFKQSSKALQRPVASDF
SATGFWQSWKFLQVPVASDF

SEQ ID NO: 24706 - protein, 20 aa, synthetic construct
  source 1..20: note = Seed: SATGFKQSSKALQRPVASDF
SATGFWQSWKFLQYPVASDF

SEQ ID NO: 24707 - protein, 20 aa, synthetic construct
  source 1..20: note = Seed: SATGFKQSSKALQRPVASDF
SATGFWQSYKFLQFPVASDF

SEQ ID NO: 24708 - protein, 20 aa, synthetic construct
  source 1..20: note = Seed: SATGFKQSSKALQRPVASDF
SATGFWQSYKFLQIPVASDF

SEQ ID NO: 24709 - protein, 20 aa, synthetic construct
  source 1..20: note = Seed: SATGFKQSSKALQRPVASDF
SATGFWQSYKFLQLPVASDF

SEQ ID NO: 24710 - protein, 20 aa, synthetic construct
  source 1..20: note = Seed: SATGFKQSSKALQRPVASDF
SATGFWQSYKFLQMPVASDF

SEQ ID NO: 24711 - protein, 20 aa, synthetic construct
  source 1..20: note = Seed: SATGFKQSSKALQRPVASDF
SATGFWQSYKFLQVPVASDF

SEQ ID NO: 24712 - protein, 20 aa, synthetic construct
  source 1..20: note = Seed: SATGFKQSSKALQRPVASDF
SATGFYQSAKFLQAPVASDF

SEQ ID NO: 24713 - protein, 20 aa, synthetic construct
  source 1..20: note = Seed: SATGFKQSSKALQRPVASDF
SATGFYQSAKFLQEPVASDF

SEQ ID NO: 24714 - protein, 20 aa, synthetic construct
  source 1..20: note = Seed: SATGFKQSSKALQRPVASDF
SATGFYQSAKFLQFPVASDF

SEQ ID NO: 24715 - protein, 20 aa, synthetic construct
  source 1..20: note = Seed: SATGFKQSSKALQRPVASDF
SATGFYQSAKFLQIPVASDF

SEQ ID NO: 24716 - protein, 20 aa, synthetic construct
  source 1..20: note = Seed: SATGFKQSSKALQRPVASDF
SATGFYQSAKFLQLPVASDF

SEQ ID NO: 24717 - protein, 20 aa, synthetic construct
  source 1..20: note = Seed: SATGFKQSSKALQRPVASDF
SATGFYQSAKFLQMPVASDF

SEQ ID NO: 24718 - protein, 20 aa, synthetic construct
  source 1..20: note = Seed: SATGFKQSSKALQRPVASDF
SATGFYQSAKFLQNPVASDF

SEQ ID NO: 24719 - protein, 20 aa, synthetic construct
  source 1..20: note = Seed: SATGFKQSSKALQRPVASDF
SATGFYQSAKFLQTPVASDF

SEQ ID NO: 24720 - protein, 20 aa, synthetic construct
  source 1..20: note = Seed: SATGFKQSSKALQRPVASDF
SATGFYQSAKFLQVPVASDF

SEQ ID NO: 24721 - protein, 20 aa, synthetic construct
  source 1..20: note = Seed: SATGFKQSSKALQRPVASDF
SATGFYQSAKFLQYPVASDF

SEQ ID NO: 24722 - protein, 20 aa, synthetic construct
  source 1..20: note = Seed: SATGFKQSSKALQRPVASDF
SATGFYQSCKFLQIPVASDF

SEQ ID NO: 24723 - protein, 20 aa, synthetic construct
  source 1..20: note = Seed: SATGFKQSSKALQRPVASDF
SATGFYQSDKFLQFPVASDF

SEQ ID NO: 24724 - protein, 20 aa, synthetic construct
  source 1..20: note = Seed: SATGFKQSSKALQRPVASDF
SATGFYQSDKFLQIPVASDF

SEQ ID NO: 24725 - protein, 20 aa, synthetic construct
  source 1..20: note = Seed: SATGFKQSSKALQRPVASDF
SATGFYQSDKFLQLPVASDF

SEQ ID NO: 24726 - protein, 20 aa, synthetic construct
  source 1..20: note = Seed: SATGFKQSSKALQRPVASDF
SATGFYQSDKFLQVPVASDF

SEQ ID NO: 24727 - protein, 20 aa, synthetic construct
  source 1..20: note = Seed: SATGFKQSSKALQRPVASDF
SATGFYQSEKFLQAPVASDF

SEQ ID NO: 24728 - protein, 20 aa, synthetic construct
  source 1..20: note = Seed: SATGFKQSSKALQRPVASDF
SATGFYQSEKFLQFPVASDF

SEQ ID NO: 24729 - protein, 20 aa, synthetic construct
  source 1..20: note = Seed: SATGFKQSSKALQRPVASDF
SATGFYQSEKFLQIPVASDF

SEQ ID NO: 24730 - protein, 20 aa, synthetic construct
  source 1..20: note = Seed: SATGFKQSSKALQRPVASDF
SATGFYQSEKFLQLPVASDF

SEQ ID NO: 24731 - protein, 20 aa, synthetic construct
  source 1..20: note = Seed: SATGFKQSSKALQRPVASDF
SATGFYQSEKFLQMPVASDF

SEQ ID NO: 24732 - protein, 20 aa, synthetic construct
  source 1..20: note = Seed: SATGFKQSSKALQRPVASDF
SATGFYQSEKFLQSPVASDF

SEQ ID NO: 24733 - protein, 20 aa, synthetic construct
  source 1..20: note = Seed: SATGFKQSSKALQRPVASDF
SATGFYQSEKFLQTPVASDF

SEQ ID NO: 24734 - protein, 20 aa, synthetic construct
  source 1..20: note = Seed: SATGFKQSSKALQRPVASDF
SATGFYQSEKFLQVPVASDF

SEQ ID NO: 24735 - protein, 20 aa, synthetic construct
  source 1..20: note = Seed: SATGFKQSSKALQRPVASDF
SATGFYQSEKFLQYPVASDF

SEQ ID NO: 24736 - protein, 20 aa, synthetic construct
  source 1..20: note = Seed: SATGFKQSSKALQRPVASDF
SATGFYQSFKFLQAPVASDF

SEQ ID NO: 24737 - protein, 20 aa, synthetic construct
  source 1..20: note = Seed: SATGFKQSSKALQRPVASDF
SATGFYQSFKFLQEPVASDF

SEQ ID NO: 24738 - protein, 20 aa, synthetic construct
  source 1..20: note = Seed: SATGFKQSSKALQRPVASDF
SATGFYQSFKFLQFPVASDF

SEQ ID NO: 24739 - protein, 20 aa, synthetic construct
  source 1..20: note = Seed: SATGFKQSSKALQRPVASDF
SATGFYQSFKFLQHPVASDF

SEQ ID NO: 24740 - protein, 20 aa, synthetic construct
  source 1..20: note = Seed: SATGFKQSSKALQRPVASDF
SATGFYQSFKFLQIPVASDF

SEQ ID NO: 24741 - protein, 20 aa, synthetic construct
  source 1..20: note = Seed: SATGFKQSSKALQRPVASDF
SATGFYQSFKFLQLPVASDF

SEQ ID NO: 24742 - protein, 20 aa, synthetic construct
  source 1..20: note = Seed: SATGFKQSSKALQRPVASDF
SATGFYQSFKFLQMPVASDF

SEQ ID NO: 24743 - protein, 20 aa, synthetic construct
  source 1..20: note = Seed: SATGFKQSSKALQRPVASDF
SATGFYQSFKFLQNPVASDF

SEQ ID NO: 24744 - protein, 20 aa, synthetic construct
  source 1..20: note = Seed: SATGFKQSSKALQRPVASDF
SATGFYQSFKFLQSPVASDF

SEQ ID NO: 24745 - protein, 20 aa, synthetic construct
  source 1..20: note = Seed: SATGFKQSSKALQRPVASDF
SATGFYQSFKFLQTPVASDF

SEQ ID NO: 24746 - protein, 20 aa, synthetic construct
  source 1..20: note = Seed: SATGFKQSSKALQRPVASDF
SATGFYQSFKFLQVPVASDF

SEQ ID NO: 24747 - protein, 20 aa, synthetic construct
  source 1..20: note = Seed: SATGFKQSSKALQRPVASDF
SATGFYQSFKFLQYPVASDF

SEQ ID NO: 24748 - protein, 20 aa, synthetic construct
  source 1..20: note = Seed: SATGFKQSSKALQRPVASDF
SATGFYQSFKILQIPVASDF

SEQ ID NO: 24749 - protein, 20 aa, synthetic construct
  source 1..20: note = Seed: SATGFKQSSKALQRPVASDF
SATGFYQSFKILQLPVASDF

SEQ ID NO: 24750 - protein, 20 aa, synthetic construct
  source 1..20: note = Seed: SATGFKQSSKALQRPVASDF
SATGFYQSFKILQMPVASDF

SEQ ID NO: 24751 - protein, 20 aa, synthetic construct
  source 1..20: note = Seed: SATGFKQSSKALQRPVASDF
SATGFYQSFKILQVPVASDF

SEQ ID NO: 24752 - protein, 20 aa, synthetic construct
  source 1..20: note = Seed: SATGFKQSSKALQRPVASDF
SATGFYQSFKILQYPVASDF

SEQ ID NO: 24753 - protein, 20 aa, synthetic construct
  source 1..20: note = Seed: SATGFKQSSKALQRPVASDF
SATGFYQSFKLLQFPVASDF

SEQ ID NO: 24754 - protein, 20 aa, synthetic construct
  source 1..20: note = Seed: SATGFKQSSKALQRPVASDF
SATGFYQSFKLLQIPVASDF

SEQ ID NO: 24755 - protein, 20 aa, synthetic construct
  source 1..20: note = Seed: SATGFKQSSKALQRPVASDF
SATGFYQSFKLLQLPVASDF

SEQ ID NO: 24756 - protein, 20 aa, synthetic construct
  source 1..20: note = Seed: SATGFKQSSKALQRPVASDF
SATGFYQSFKLLQMPVASDF

SEQ ID NO: 24757 - protein, 20 aa, synthetic construct
  source 1..20: note = Seed: SATGFKQSSKALQRPVASDF
SATGFYQSFKLLQVPVASDF

SEQ ID NO: 24758 - protein, 20 aa, synthetic construct
  source 1..20: note = Seed: SATGFKQSSKALQRPVASDF
SATGFYQSFKLLQYPVASDF

SEQ ID NO: 24759 - protein, 20 aa, synthetic construct
  source 1..20: note = Seed: SATGFKQSSKALQRPVASDF
SATGFYQSFKMLQIPVASDF

SEQ ID NO: 24760 - protein, 20 aa, synthetic construct
  source 1..20: note = Seed: SATGFKQSSKALQRPVASDF
SATGFYQSFKMLQLPVASDF

SEQ ID NO: 24761 - protein, 20 aa, synthetic construct
  source 1..20: note = Seed: SATGFKQSSKALQRPVASDF
SATGFYQSFKMLQMPVASDF

SEQ ID NO: 24762 - protein, 20 aa, synthetic construct
  source 1..20: note = Seed: SATGFKQSSKALQRPVASDF
SATGFYQSFKMLQVPVASDF

SEQ ID NO: 24763 - protein, 20 aa, synthetic construct
  source 1..20: note = Seed: SATGFKQSSKALQRPVASDF
SATGFYQSFKVLQLPVASDF

SEQ ID NO: 24764 - protein, 20 aa, synthetic construct
  source 1..20: note = Seed: SATGFKQSSKALQRPVASDF
SATGFYQSFKWLQIPVASDF

SEQ ID NO: 24765 - protein, 20 aa, synthetic construct
  source 1..20: note = Seed: SATGFKQSSKALQRPVASDF
SATGFYQSFKWLQLPVASDF

SEQ ID NO: 24766 - protein, 20 aa, synthetic construct
  source 1..20: note = Seed: SATGFKQSSKALQRPVASDF
SATGFYQSFKWLQVPVASDF

SEQ ID NO: 24767 - protein, 20 aa, synthetic construct
  source 1..20: note = Seed: SATGFKQSSKALQRPVASDF
SATGFYQSFKYLQIPVASDF

SEQ ID NO: 24768 - protein, 20 aa, synthetic construct
  source 1..20: note = Seed: SATGFKQSSKALQRPVASDF
SATGFYQSFKYLQLPVASDF

SEQ ID NO: 24769 - protein, 20 aa, synthetic construct
  source 1..20: note = Seed: SATGFKQSSKALQRPVASDF
SATGFYQSFKYLQMPVASDF

SEQ ID NO: 24770 - protein, 20 aa, synthetic construct
  source 1..20: note = Seed: SATGFKQSSKALQRPVASDF
SATGFYQSFKYLQVPVASDF

SEQ ID NO: 24771 - protein, 20 aa, synthetic construct
  source 1..20: note = Seed: SATGFKQSSKALQRPVASDF
SATGFYQSFKYLQYPVASDF

SEQ ID NO: 24772 - protein, 20 aa, synthetic construct
  source 1..20: note = Seed: SATGFKQSSKALQRPVASDF
SATGFYQSHKFLQAPVASDF

SEQ ID NO: 24773 - protein, 20 aa, synthetic construct
  source 1..20: note = Seed: SATGFKQSSKALQRPVASDF
SATGFYQSHKFLQEPVASDF

SEQ ID NO: 24774 - protein, 20 aa, synthetic construct
  source 1..20: note = Seed: SATGFKQSSKALQRPVASDF
SATGFYQSHKFLQFPVASDF

SEQ ID NO: 24775 - protein, 20 aa, synthetic construct
  source 1..20: note = Seed: SATGFKQSSKALQRPVASDF
SATGFYQSHKFLQIPVASDF

SEQ ID NO: 24776 - protein, 20 aa, synthetic construct
  source 1..20: note = Seed: SATGFKQSSKALQRPVASDF
SATGFYQSHKFLQLPVASDF

SEQ ID NO: 24777 - protein, 20 aa, synthetic construct
  source 1..20: note = Seed: SATGFKQSSKALQRPVASDF
SATGFYQSHKFLQMPVASDF

SEQ ID NO: 24778 - protein, 20 aa, synthetic construct
  source 1..20: note = Seed: SATGFKQSSKALQRPVASDF
SATGFYQSHKFLQNPVASDF

SEQ ID NO: 24779 - protein, 20 aa, synthetic construct
  source 1..20: note = Seed: SATGFKQSSKALQRPVASDF
SATGFYQSHKFLQSPVASDF

SEQ ID NO: 24780 - protein, 20 aa, synthetic construct
  source 1..20: note = Seed: SATGFKQSSKALQRPVASDF
SATGFYQSHKFLQTPVASDF

SEQ ID NO: 24781 - protein, 20 aa, synthetic construct
  source 1..20: note = Seed: SATGFKQSSKALQRPVASDF
SATGFYQSHKFLQVPVASDF

SEQ ID NO: 24782 - protein, 20 aa, synthetic construct
  source 1..20: note = Seed: SATGFKQSSKALQRPVASDF
SATGFYQSHKFLQYPVASDF

SEQ ID NO: 24783 - protein, 20 aa, synthetic construct
  source 1..20: note = Seed: SATGFKQSSKALQRPVASDF
SATGFYQSHKILQFPVASDF

SEQ ID NO: 24784 - protein, 20 aa, synthetic construct
  source 1..20: note = Seed: SATGFKQSSKALQRPVASDF
SATGFYQSHKILQIPVASDF

SEQ ID NO: 24785 - protein, 20 aa, synthetic construct
  source 1..20: note = Seed: SATGFKQSSKALQRPVASDF
SATGFYQSHKILQLPVASDF

SEQ ID NO: 24786 - protein, 20 aa, synthetic construct
  source 1..20: note = Seed: SATGFKQSSKALQRPVASDF
SATGFYQSHKLLQFPVASDF

SEQ ID NO: 24787 - protein, 20 aa, synthetic construct
  source 1..20: note = Seed: SATGFKQSSKALQRPVASDF
SATGFYQSHKLLQIPVASDF

SEQ ID NO: 24788 - protein, 20 aa, synthetic construct
  source 1..20: note = Seed: SATGFKQSSKALQRPVASDF
SATGFYQSHKLLQLPVASDF

SEQ ID NO: 24789 - protein, 20 aa, synthetic construct
  source 1..20: note = Seed: SATGFKQSSKALQRPVASDF
SATGFYQSHKLLQVPVASDF

SEQ ID NO: 24790 - protein, 20 aa, synthetic construct
  source 1..20: note = Seed: SATGFKQSSKALQRPVASDF
SATGFYQSHKMLQLPVASDF

SEQ ID NO: 24791 - protein, 20 aa, synthetic construct
  source 1..20: note = Seed: SATGFKQSSKALQRPVASDF
SATGFYQSHKWLQIPVASDF

SEQ ID NO: 24792 - protein, 20 aa, synthetic construct
  source 1..20: note = Seed: SATGFKQSSKALQRPVASDF
SATGFYQSHKWLQLPVASDF

SEQ ID NO: 24793 - protein, 20 aa, synthetic construct
  source 1..20: note = Seed: SATGFKQSSKALQRPVASDF
SATGFYQSHKWLQVPVASDF

SEQ ID NO: 24794 - protein, 20 aa, synthetic construct
  source 1..20: note = Seed: SATGFKQSSKALQRPVASDF
SATGFYQSHKYLQIPVASDF

SEQ ID NO: 24795 - protein, 20 aa, synthetic construct
  source 1..20: note = Seed: SATGFKQSSKALQRPVASDF
SATGFYQSHKYLQLPVASDF

SEQ ID NO: 24796 - protein, 20 aa, synthetic construct
  source 1..20: note = Seed: SATGFKQSSKALQRPVASDF
SATGFYQSHKYLQVPVASDF

SEQ ID NO: 24797 - protein, 20 aa, synthetic construct
  source 1..20: note = Seed: SATGFKQSSKALQRPVASDF
SATGFYQSIKFLQAPVASDF

SEQ ID NO: 24798 - protein, 20 aa, synthetic construct
  source 1..20: note = Seed: SATGFKQSSKALQRPVASDF
SATGFYQSIKFLQDPVASDF

SEQ ID NO: 24799 - protein, 20 aa, synthetic construct
  source 1..20: note = Seed: SATGFKQSSKALQRPVASDF
SATGFYQSIKFLQEPVASDF

SEQ ID NO: 24800 - protein, 20 aa, synthetic construct
  source 1..20: note = Seed: SATGFKQSSKALQRPVASDF
SATGFYQSIKFLQFPVASDF

SEQ ID NO: 24801 - protein, 20 aa, synthetic construct
  source 1..20: note = Seed: SATGFKQSSKALQRPVASDF
SATGFYQSIKFLQHPVASDF

SEQ ID NO: 24802 - protein, 20 aa, synthetic construct
  source 1..20: note = Seed: SATGFKQSSKALQRPVASDF
SATGFYQSIKFLQIPVASDF

SEQ ID NO: 24803 - protein, 20 aa, synthetic construct
  source 1..20: note = Seed: SATGFKQSSKALQRPVASDF
SATGFYQSIKFLQLPVASDF

SEQ ID NO: 24804 - protein, 20 aa, synthetic construct
  source 1..20: note = Seed: SATGFKQSSKALQRPVASDF
SATGFYQSIKFLQMPVASDF

SEQ ID NO: 24805 - protein, 20 aa, synthetic construct
  source 1..20: note = Seed: SATGFKQSSKALQRPVASDF
SATGFYQSIKFLQNPVASDF

SEQ ID NO: 24806 - protein, 20 aa, synthetic construct
  source 1..20: note = Seed: SATGFKQSSKALQRPVASDF
SATGFYQSIKFLQSPVASDF

SEQ ID NO: 24807 - protein, 20 aa, synthetic construct
  source 1..20: note = Seed: SATGFKQSSKALQRPVASDF
SATGFYQSIKFLQTPVASDF

SEQ ID NO: 24808 - protein, 20 aa, synthetic construct
  source 1..20: note = Seed: SATGFKQSSKALQRPVASDF
SATGFYQSIKFLQVPVASDF

SEQ ID NO: 24809 - protein, 20 aa, synthetic construct
  source 1..20: note = Seed: SATGFKQSSKALQRPVASDF
SATGFYQSIKFLQYPVASDF

SEQ ID NO: 24810 - protein, 20 aa, synthetic construct
  source 1..20: note = Seed: SATGFKQSSKALQRPVASDF
SATGFYQSIKLLQFPVASDF

SEQ ID NO: 24811 - protein, 20 aa, synthetic construct
  source 1..20: note = Seed: SATGFKQSSKALQRPVASDF
SATGFYQSIKLLQIPVASDF

SEQ ID NO: 24812 - protein, 20 aa, synthetic construct
  source 1..20: note = Seed: SATGFKQSSKALQRPVASDF
SATGFYQSIKLLQLPVASDF

SEQ ID NO: 24813 - protein, 20 aa, synthetic construct
  source 1..20: note = Seed: SATGFKQSSKALQRPVASDF
SATGFYQSIKLLQVPVASDF

SEQ ID NO: 24814 - protein, 20 aa, synthetic construct
  source 1..20: note = Seed: SATGFKQSSKALQRPVASDF
SATGFYQSIKWLQFPVASDF

SEQ ID NO: 24815 - protein, 20 aa, synthetic construct
  source 1..20: note = Seed: SATGFKQSSKALQRPVASDF
SATGFYQSIKWLQIPVASDF

SEQ ID NO: 24816 - protein, 20 aa, synthetic construct
  source 1..20: note = Seed: SATGFKQSSKALQRPVASDF
SATGFYQSIKWLQLPVASDF

SEQ ID NO: 24817 - protein, 20 aa, synthetic construct
  source 1..20: note = Seed: SATGFKQSSKALQRPVASDF
SATGFYQSIKWLQVPVASDF

SEQ ID NO: 24818 - protein, 20 aa, synthetic construct
  source 1..20: note = Seed: SATGFKQSSKALQRPVASDF
SATGFYQSIKYLQIPVASDF

SEQ ID NO: 24819 - protein, 20 aa, synthetic construct
  source 1..20: note = Seed: SATGFKQSSKALQRPVASDF
SATGFYQSIKYLQLPVASDF

SEQ ID NO: 24820 - protein, 20 aa, synthetic construct
  source 1..20: note = Seed: SATGFKQSSKALQRPVASDF
SATGFYQSIKYLQMPVASDF

SEQ ID NO: 24821 - protein, 20 aa, synthetic construct
  source 1..20: note = Seed: SATGFKQSSKALQRPVASDF
SATGFYQSIKYLQVPVASDF

SEQ ID NO: 24822 - protein, 20 aa, synthetic construct
  source 1..20: note = Seed: SATGFKQSSKALQRPVASDF
SATGFYQSKKFLQFPVASDF

SEQ ID NO: 24823 - protein, 20 aa, synthetic construct
  source 1..20: note = Seed: SATGFKQSSKALQRPVASDF
SATGFYQSKKFLQIPVASDF

SEQ ID NO: 24824 - protein, 20 aa, synthetic construct
  source 1..20: note = Seed: SATGFKQSSKALQRPVASDF
SATGFYQSKKFLQLPVASDF

SEQ ID NO: 24825 - protein, 20 aa, synthetic construct
  source 1..20: note = Seed: SATGFKQSSKALQRPVASDF
SATGFYQSKKFLQMPVASDF

SEQ ID NO: 24826 - protein, 20 aa, synthetic construct
  source 1..20: note = Seed: SATGFKQSSKALQRPVASDF
SATGFYQSKKFLQVPVASDF

SEQ ID NO: 24827 - protein, 20 aa, synthetic construct
  source 1..20: note = Seed: SATGFKQSSKALQRPVASDF
SATGFYQSLKFLQAPVASDF

SEQ ID NO: 24828 - protein, 20 aa, synthetic construct
  source 1..20: note = Seed: SATGFKQSSKALQRPVASDF
SATGFYQSLKFLQEPVASDF

SEQ ID NO: 24829 - protein, 20 aa, synthetic construct
  source 1..20: note = Seed: SATGFKQSSKALQRPVASDF
SATGFYQSLKFLQFPVASDF

SEQ ID NO: 24830 - protein, 20 aa, synthetic construct
  source 1..20: note = Seed: SATGFKQSSKALQRPVASDF
SATGFYQSLKFLQIPVASDF

SEQ ID NO: 24831 - protein, 20 aa, synthetic construct
  source 1..20: note = Seed: SATGFKQSSKALQRPVASDF
SATGFYQSLKFLQLPVASDF

SEQ ID NO: 24832 - protein, 20 aa, synthetic construct
  source 1..20: note = Seed: SATGFKQSSKALQRPVASDF
SATGFYQSLKFLQMPVASDF

SEQ ID NO: 24833 - protein, 20 aa, synthetic construct
  source 1..20: note = Seed: SATGFKQSSKALQRPVASDF
SATGFYQSLKFLQNPVASDF

SEQ ID NO: 24834 - protein, 20 aa, synthetic construct
  source 1..20: note = Seed: SATGFKQSSKALQRPVASDF
SATGFYQSLKFLQSPVASDF

SEQ ID NO: 24835 - protein, 20 aa, synthetic construct
  source 1..20: note = Seed: SATGFKQSSKALQRPVASDF
SATGFYQSLKFLQTPVASDF

SEQ ID NO: 24836 - protein, 20 aa, synthetic construct
  source 1..20: note = Seed: SATGFKQSSKALQRPVASDF
SATGFYQSLKFLQVPVASDF

SEQ ID NO: 24837 - protein, 20 aa, synthetic construct
  source 1..20: note = Seed: SATGFKQSSKALQRPVASDF
SATGFYQSLKFLQYPVASDF

SEQ ID NO: 24838 - protein, 20 aa, synthetic construct
  source 1..20: note = Seed: SATGFKQSSKALQRPVASDF
SATGFYQSLKLLQFPVASDF

SEQ ID NO: 24839 - protein, 20 aa, synthetic construct
  source 1..20: note = Seed: SATGFKQSSKALQRPVASDF
SATGFYQSLKLLQLPVASDF

SEQ ID NO: 24840 - protein, 20 aa, synthetic construct
  source 1..20: note = Seed: SATGFKQSSKALQRPVASDF
SATGFYQSLKYLQIPVASDF

SEQ ID NO: 24841 - protein, 20 aa, synthetic construct
  source 1..20: note = Seed: SATGFKQSSKALQRPVASDF
SATGFYQSLKYLQLPVASDF

SEQ ID NO: 24842 - protein, 20 aa, synthetic construct
  source 1..20: note = Seed: SATGFKQSSKALQRPVASDF
SATGFYQSLKYLQVPVASDF

SEQ ID NO: 24843 - protein, 20 aa, synthetic construct
  source 1..20: note = Seed: SATGFKQSSKALQRPVASDF
SATGFYQSMKFLQAPVASDF

SEQ ID NO: 24844 - protein, 20 aa, synthetic construct
  source 1..20: note = Seed: SATGFKQSSKALQRPVASDF
SATGFYQSMKFLQEPVASDF

SEQ ID NO: 24845 - protein, 20 aa, synthetic construct
  source 1..20: note = Seed: SATGFKQSSKALQRPVASDF
SATGFYQSMKFLQFPVASDF

SEQ ID NO: 24846 - protein, 20 aa, synthetic construct
  source 1..20: note = Seed: SATGFKQSSKALQRPVASDF
SATGFYQSMKFLQIPVASDF

SEQ ID NO: 24847 - protein, 20 aa, synthetic construct
  source 1..20: note = Seed: SATGFKQSSKALQRPVASDF
SATGFYQSMKFLQLPVASDF

SEQ ID NO: 24848 - protein, 20 aa, synthetic construct
  source 1..20: note = Seed: SATGFKQSSKALQRPVASDF
SATGFYQSMKFLQMPVASDF

SEQ ID NO: 24849 - protein, 20 aa, synthetic construct
  source 1..20: note = Seed: SATGFKQSSKALQRPVASDF
SATGFYQSMKFLQSPVASDF

SEQ ID NO: 24850 - protein, 20 aa, synthetic construct
  source 1..20: note = Seed: SATGFKQSSKALQRPVASDF
SATGFYQSMKFLQTPVASDF

SEQ ID NO: 24851 - protein, 20 aa, synthetic construct
  source 1..20: note = Seed: SATGFKQSSKALQRPVASDF
SATGFYQSMKFLQVPVASDF

SEQ ID NO: 24852 - protein, 20 aa, synthetic construct
  source 1..20: note = Seed: SATGFKQSSKALQRPVASDF
SATGFYQSMKFLQYPVASDF

SEQ ID NO: 24853 - protein, 20 aa, synthetic construct
  source 1..20: note = Seed: SATGFKQSSKALQRPVASDF
SATGFYQSNKFLQFPVASDF

SEQ ID NO: 24854 - protein, 20 aa, synthetic construct
  source 1..20: note = Seed: SATGFKQSSKALQRPVASDF
SATGFYQSNKFLQIPVASDF

SEQ ID NO: 24855 - protein, 20 aa, synthetic construct
  source 1..20: note = Seed: SATGFKQSSKALQRPVASDF
SATGFYQSNKFLQLPVASDF

SEQ ID NO: 24856 - protein, 20 aa, synthetic construct
  source 1..20: note = Seed: SATGFKQSSKALQRPVASDF
SATGFYQSNKFLQMPVASDF

SEQ ID NO: 24857 - protein, 20 aa, synthetic construct
  source 1..20: note = Seed: SATGFKQSSKALQRPVASDF
SATGFYQSNKFLQVPVASDF

SEQ ID NO: 24858 - protein, 20 aa, synthetic construct
  source 1..20: note = Seed: SATGFKQSSKALQRPVASDF
SATGFYQSQKFLQFPVASDF

SEQ ID NO: 24859 - protein, 20 aa, synthetic construct
  source 1..20: note = Seed: SATGFKQSSKALQRPVASDF
SATGFYQSQKFLQIPVASDF

SEQ ID NO: 24860 - protein, 20 aa, synthetic construct
  source 1..20: note = Seed: SATGFKQSSKALQRPVASDF
SATGFYQSQKFLQLPVASDF

SEQ ID NO: 24861 - protein, 20 aa, synthetic construct
  source 1..20: note = Seed: SATGFKQSSKALQRPVASDF
SATGFYQSQKFLQMPVASDF

SEQ ID NO: 24862 - protein, 20 aa, synthetic construct
  source 1..20: note = Seed: SATGFKQSSKALQRPVASDF
SATGFYQSQKFLQVPVASDF

SEQ ID NO: 24863 - protein, 20 aa, synthetic construct
  source 1..20: note = Seed: SATGFKQSSKALQRPVASDF
SATGFYQSRKFLQFPVASDF

SEQ ID NO: 24864 - protein, 20 aa, synthetic construct
  source 1..20: note = Seed: SATGFKQSSKALQRPVASDF
SATGFYQSRKFLQIPVASDF

SEQ ID NO: 24865 - protein, 20 aa, synthetic construct
  source 1..20: note = Seed: SATGFKQSSKALQRPVASDF
SATGFYQSRKFLQLPVASDF

SEQ ID NO: 24866 - protein, 20 aa, synthetic construct
  source 1..20: note = Seed: SATGFKQSSKALQRPVASDF
SATGFYQSRKFLQMPVASDF

SEQ ID NO: 24867 - protein, 20 aa, synthetic construct
  source 1..20: note = Seed: SATGFKQSSKALQRPVASDF
SATGFYQSRKFLQVPVASDF

SEQ ID NO: 24868 - protein, 20 aa, synthetic construct
  source 1..20: note = Seed: SATGFKQSSKALQRPVASDF
SATGFYQSSKFLQAPVASDF

SEQ ID NO: 24869 - protein, 20 aa, synthetic construct
  source 1..20: note = Seed: SATGFKQSSKALQRPVASDF
SATGFYQSSKFLQEPVASDF

SEQ ID NO: 24870 - protein, 20 aa, synthetic construct
  source 1..20: note = Seed: SATGFKQSSKALQRPVASDF
SATGFYQSSKFLQFPVASDF

SEQ ID NO: 24871 - protein, 20 aa, synthetic construct
  source 1..20: note = Seed: SATGFKQSSKALQRPVASDF
SATGFYQSSKFLQIPVASDF

SEQ ID NO: 24872 - protein, 20 aa, synthetic construct
  source 1..20: note = Seed: SATGFKQSSKALQRPVASDF
SATGFYQSSKFLQLPVASDF

SEQ ID NO: 24873 - protein, 20 aa, synthetic construct
  source 1..20: note = Seed: SATGFKQSSKALQRPVASDF
SATGFYQSSKFLQMPVASDF

SEQ ID NO: 24874 - protein, 20 aa, synthetic construct
  source 1..20: note = Seed: SATGFKQSSKALQRPVASDF
SATGFYQSSKFLQNPVASDF

SEQ ID NO: 24875 - protein, 20 aa, synthetic construct
  source 1..20: note = Seed: SATGFKQSSKALQRPVASDF
SATGFYQSSKFLQSPVASDF

SEQ ID NO: 24876 - protein, 20 aa, synthetic construct
  source 1..20: note = Seed: SATGFKQSSKALQRPVASDF
SATGFYQSSKFLQTPVASDF

SEQ ID NO: 24877 - protein, 20 aa, synthetic construct
  source 1..20: note = Seed: SATGFKQSSKALQRPVASDF
SATGFYQSSKFLQVPVASDF

SEQ ID NO: 24878 - protein, 20 aa, synthetic construct
  source 1..20: note = Seed: SATGFKQSSKALQRPVASDF
SATGFYQSSKFLQYPVASDF

SEQ ID NO: 24879 - protein, 20 aa, synthetic construct
  source 1..20: note = Seed: SATGFKQSSKALQRPVASDF
SATGFYQSSKILQIPVASDF

SEQ ID NO: 24880 - protein, 20 aa, synthetic construct
  source 1..20: note = Seed: SATGFKQSSKALQRPVASDF
SATGFYQSSKILQLPVASDF

SEQ ID NO: 24881 - protein, 20 aa, synthetic construct
  source 1..20: note = Seed: SATGFKQSSKALQRPVASDF
SATGFYQSSKLLQFPVASDF

SEQ ID NO: 24882 - protein, 20 aa, synthetic construct
  source 1..20: note = Seed: SATGFKQSSKALQRPVASDF
SATGFYQSSKLLQIPVASDF

SEQ ID NO: 24883 - protein, 20 aa, synthetic construct
  source 1..20: note = Seed: SATGFKQSSKALQRPVASDF
SATGFYQSSKLLQLPVASDF

SEQ ID NO: 24884 - protein, 20 aa, synthetic construct
  source 1..20: note = Seed: SATGFKQSSKALQRPVASDF
SATGFYQSSKLLQVPVASDF

SEQ ID NO: 24885 - protein, 20 aa, synthetic construct
  source 1..20: note = Seed: SATGFKQSSKALQRPVASDF
SATGFYQSSKWLQIPVASDF

SEQ ID NO: 24886 - protein, 20 aa, synthetic construct
  source 1..20: note = Seed: SATGFKQSSKALQRPVASDF
SATGFYQSSKWLQLPVASDF

SEQ ID NO: 24887 - protein, 20 aa, synthetic construct
  source 1..20: note = Seed: SATGFKQSSKALQRPVASDF
SATGFYQSSKWLQVPVASDF

SEQ ID NO: 24888 - protein, 20 aa, synthetic construct
  source 1..20: note = Seed: SATGFKQSSKALQRPVASDF
SATGFYQSSKYLQFPVASDF

SEQ ID NO: 24889 - protein, 20 aa, synthetic construct
  source 1..20: note = Seed: SATGFKQSSKALQRPVASDF
SATGFYQSSKYLQIPVASDF

SEQ ID NO: 24890 - protein, 20 aa, synthetic construct
  source 1..20: note = Seed: SATGFKQSSKALQRPVASDF
SATGFYQSSKYLQLPVASDF

SEQ ID NO: 24891 - protein, 20 aa, synthetic construct
  source 1..20: note = Seed: SATGFKQSSKALQRPVASDF
SATGFYQSSKYLQVPVASDF

SEQ ID NO: 24892 - protein, 20 aa, synthetic construct
  source 1..20: note = Seed: SATGFKQSSKALQRPVASDF
SATGFYQSTKFLQAPVASDF

SEQ ID NO: 24893 - protein, 20 aa, synthetic construct
  source 1..20: note = Seed: SATGFKQSSKALQRPVASDF
SATGFYQSTKFLQEPVASDF

SEQ ID NO: 24894 - protein, 20 aa, synthetic construct
  source 1..20: note = Seed: SATGFKQSSKALQRPVASDF
SATGFYQSTKFLQFPVASDF

SEQ ID NO: 24895 - protein, 20 aa, synthetic construct
  source 1..20: note = Seed: SATGFKQSSKALQRPVASDF
SATGFYQSTKFLQIPVASDF

SEQ ID NO: 24896 - protein, 20 aa, synthetic construct
  source 1..20: note = Seed: SATGFKQSSKALQRPVASDF
SATGFYQSTKFLQLPVASDF

SEQ ID NO: 24897 - protein, 20 aa, synthetic construct
  source 1..20: note = Seed: SATGFKQSSKALQRPVASDF
SATGFYQSTKFLQMPVASDF

SEQ ID NO: 24898 - protein, 20 aa, synthetic construct
  source 1..20: note = Seed: SATGFKQSSKALQRPVASDF
SATGFYQSTKFLQNPVASDF

SEQ ID NO: 24899 - protein, 20 aa, synthetic construct
  source 1..20: note = Seed: SATGFKQSSKALQRPVASDF
SATGFYQSTKFLQSPVASDF

SEQ ID NO: 24900 - protein, 20 aa, synthetic construct
  source 1..20: note = Seed: SATGFKQSSKALQRPVASDF
SATGFYQSTKFLQTPVASDF

SEQ ID NO: 24901 - protein, 20 aa, synthetic construct
  source 1..20: note = Seed: SATGFKQSSKALQRPVASDF
SATGFYQSTKFLQVPVASDF

SEQ ID NO: 24902 - protein, 20 aa, synthetic construct
  source 1..20: note = Seed: SATGFKQSSKALQRPVASDF
SATGFYQSTKFLQYPVASDF

SEQ ID NO: 24903 - protein, 20 aa, synthetic construct
  source 1..20: note = Seed: SATGFKQSSKALQRPVASDF
SATGFYQSTKILQFPVASDF

SEQ ID NO: 24904 - protein, 20 aa, synthetic construct
  source 1..20: note = Seed: SATGFKQSSKALQRPVASDF
SATGFYQSTKILQIPVASDF

SEQ ID NO: 24905 - protein, 20 aa, synthetic construct
  source 1..20: note = Seed: SATGFKQSSKALQRPVASDF
SATGFYQSTKILQLPVASDF

SEQ ID NO: 24906 - protein, 20 aa, synthetic construct
  source 1..20: note = Seed: SATGFKQSSKALQRPVASDF
SATGFYQSTKILQVPVASDF

SEQ ID NO: 24907 - protein, 20 aa, synthetic construct
  source 1..20: note = Seed: SATGFKQSSKALQRPVASDF
SATGFYQSTKLLQFPVASDF

SEQ ID NO: 24908 - protein, 20 aa, synthetic construct
  source 1..20: note = Seed: SATGFKQSSKALQRPVASDF
SATGFYQSTKLLQIPVASDF

SEQ ID NO: 24909 - protein, 20 aa, synthetic construct
  source 1..20: note = Seed: SATGFKQSSKALQRPVASDF
SATGFYQSTKLLQLPVASDF

SEQ ID NO: 24910 - protein, 20 aa, synthetic construct
  source 1..20: note = Seed: SATGFKQSSKALQRPVASDF
SATGFYQSTKLLQMPVASDF

SEQ ID NO: 24911 - protein, 20 aa, synthetic construct
  source 1..20: note = Seed: SATGFKQSSKALQRPVASDF
SATGFYQSTKLLQVPVASDF

SEQ ID NO: 24912 - protein, 20 aa, synthetic construct
  source 1..20: note = Seed: SATGFKQSSKALQRPVASDF
SATGFYQSTKMLQLPVASDF

SEQ ID NO: 24913 - protein, 20 aa, synthetic construct
  source 1..20: note = Seed: SATGFKQSSKALQRPVASDF
SATGFYQSTKWLQIPVASDF

SEQ ID NO: 24914 - protein, 20 aa, synthetic construct
  source 1..20: note = Seed: SATGFKQSSKALQRPVASDF
SATGFYQSTKWLQLPVASDF

SEQ ID NO: 24915 - protein, 20 aa, synthetic construct
  source 1..20: note = Seed: SATGFKQSSKALQRPVASDF
SATGFYQSTKWLQVPVASDF

SEQ ID NO: 24916 - protein, 20 aa, synthetic construct
  source 1..20: note = Seed: SATGFKQSSKALQRPVASDF
SATGFYQSTKYLQFPVASDF

SEQ ID NO: 24917 - protein, 20 aa, synthetic construct
  source 1..20: note = Seed: SATGFKQSSKALQRPVASDF
SATGFYQSTKYLQIPVASDF

SEQ ID NO: 24918 - protein, 20 aa, synthetic construct
  source 1..20: note = Seed: SATGFKQSSKALQRPVASDF
SATGFYQSTKYLQLPVASDF

SEQ ID NO: 24919 - protein, 20 aa, synthetic construct
  source 1..20: note = Seed: SATGFKQSSKALQRPVASDF
SATGFYQSTKYLQVPVASDF

SEQ ID NO: 24920 - protein, 20 aa, synthetic construct
  source 1..20: note = Seed: SATGFKQSSKALQRPVASDF
SATGFYQSVKFLQAPVASDF

SEQ ID NO: 24921 - protein, 20 aa, synthetic construct
  source 1..20: note = Seed: SATGFKQSSKALQRPVASDF
SATGFYQSVKFLQDPVASDF

SEQ ID NO: 24922 - protein, 20 aa, synthetic construct
  source 1..20: note = Seed: SATGFKQSSKALQRPVASDF
SATGFYQSVKFLQEPVASDF

SEQ ID NO: 24923 - protein, 20 aa, synthetic construct
  source 1..20: note = Seed: SATGFKQSSKALQRPVASDF
SATGFYQSVKFLQFPVASDF

SEQ ID NO: 24924 - protein, 20 aa, synthetic construct
  source 1..20: note = Seed: SATGFKQSSKALQRPVASDF
SATGFYQSVKFLQHPVASDF

SEQ ID NO: 24925 - protein, 20 aa, synthetic construct
  source 1..20: note = Seed: SATGFKQSSKALQRPVASDF
SATGFYQSVKFLQIPVASDF

SEQ ID NO: 24926 - protein, 20 aa, synthetic construct
  source 1..20: note = Seed: SATGFKQSSKALQRPVASDF
SATGFYQSVKFLQLPVASDF

SEQ ID NO: 24927 - protein, 20 aa, synthetic construct
  source 1..20: note = Seed: SATGFKQSSKALQRPVASDF
SATGFYQSVKFLQMPVASDF

SEQ ID NO: 24928 - protein, 20 aa, synthetic construct
  source 1..20: note = Seed: SATGFKQSSKALQRPVASDF
SATGFYQSVKFLQNPVASDF

SEQ ID NO: 24929 - protein, 20 aa, synthetic construct
  source 1..20: note = Seed: SATGFKQSSKALQRPVASDF
SATGFYQSVKFLQSPVASDF

SEQ ID NO: 24930 - protein, 20 aa, synthetic construct
  source 1..20: note = Seed: SATGFKQSSKALQRPVASDF
SATGFYQSVKFLQTPVASDF

SEQ ID NO: 24931 - protein, 20 aa, synthetic construct
  source 1..20: note = Seed: SATGFKQSSKALQRPVASDF
SATGFYQSVKFLQVPVASDF

SEQ ID NO: 24932 - protein, 20 aa, synthetic construct
  source 1..20: note = Seed: SATGFKQSSKALQRPVASDF
SATGFYQSVKFLQYPVASDF

SEQ ID NO: 24933 - protein, 20 aa, synthetic construct
  source 1..20: note = Seed: SATGFKQSSKALQRPVASDF
SATGFYQSVKLLQFPVASDF

SEQ ID NO: 24934 - protein, 20 aa, synthetic construct
  source 1..20: note = Seed: SATGFKQSSKALQRPVASDF
SATGFYQSVKLLQIPVASDF

SEQ ID NO: 24935 - protein, 20 aa, synthetic construct
  source 1..20: note = Seed: SATGFKQSSKALQRPVASDF
SATGFYQSVKLLQLPVASDF

SEQ ID NO: 24936 - protein, 20 aa, synthetic construct
  source 1..20: note = Seed: SATGFKQSSKALQRPVASDF
SATGFYQSVKLLQVPVASDF

SEQ ID NO: 24937 - protein, 20 aa, synthetic construct
  source 1..20: note = Seed: SATGFKQSSKALQRPVASDF
SATGFYQSVKWLQIPVASDF

SEQ ID NO: 24938 - protein, 20 aa, synthetic construct
  source 1..20: note = Seed: SATGFKQSSKALQRPVASDF
SATGFYQSVKWLQLPVASDF

SEQ ID NO: 24939 - protein, 20 aa, synthetic construct
  source 1..20: note = Seed: SATGFKQSSKALQRPVASDF
SATGFYQSVKYLQFPVASDF

SEQ ID NO: 24940 - protein, 20 aa, synthetic construct
  source 1..20: note = Seed: SATGFKQSSKALQRPVASDF
SATGFYQSVKYLQIPVASDF

SEQ ID NO: 24941 - protein, 20 aa, synthetic construct
  source 1..20: note = Seed: SATGFKQSSKALQRPVASDF
SATGFYQSVKYLQLPVASDF

SEQ ID NO: 24942 - protein, 20 aa, synthetic construct
  source 1..20: note = Seed: SATGFKQSSKALQRPVASDF
SATGFYQSVKYLQVPVASDF

SEQ ID NO: 24943 - protein, 20 aa, synthetic construct
  source 1..20: note = Seed: SATGFKQSSKALQRPVASDF
SATGFYQSWKFLQFPVASDF

SEQ ID NO: 24944 - protein, 20 aa, synthetic construct
  source 1..20: note = Seed: SATGFKQSSKALQRPVASDF
SATGFYQSWKFLQIPVASDF

SEQ ID NO: 24945 - protein, 20 aa, synthetic construct
  source 1..20: note = Seed: SATGFKQSSKALQRPVASDF
SATGFYQSWKFLQLPVASDF

SEQ ID NO: 24946 - protein, 20 aa, synthetic construct
  source 1..20: note = Seed: SATGFKQSSKALQRPVASDF
SATGFYQSWKFLQMPVASDF

SEQ ID NO: 24947 - protein, 20 aa, synthetic construct
  source 1..20: note = Seed: SATGFKQSSKALQRPVASDF
SATGFYQSWKFLQVPVASDF

SEQ ID NO: 24948 - protein, 20 aa, synthetic construct
  source 1..20: note = Seed: SATGFKQSSKALQRPVASDF
SATGFYQSWKFLQYPVASDF

SEQ ID NO: 24949 - protein, 20 aa, synthetic construct
  source 1..20: note = Seed: SATGFKQSSKALQRPVASDF
SATGFYQSWKILQLPVASDF

SEQ ID NO: 24950 - protein, 20 aa, synthetic construct
  source 1..20: note = Seed: SATGFKQSSKALQRPVASDF
SATGFYQSWKLLQFPVASDF

SEQ ID NO: 24951 - protein, 20 aa, synthetic construct
  source 1..20: note = Seed: SATGFKQSSKALQRPVASDF
SATGFYQSWKLLQIPVASDF

SEQ ID NO: 24952 - protein, 20 aa, synthetic construct
  source 1..20: note = Seed: SATGFKQSSKALQRPVASDF
SATGFYQSWKLLQLPVASDF

SEQ ID NO: 24953 - protein, 20 aa, synthetic construct
  source 1..20: note = Seed: SATGFKQSSKALQRPVASDF
SATGFYQSWKYLQLPVASDF

SEQ ID NO: 24954 - protein, 20 aa, synthetic construct
  source 1..20: note = Seed: SATGFKQSSKALQRPVASDF
SATGFYQSYKFLQFPVASDF

SEQ ID NO: 24955 - protein, 20 aa, synthetic construct
  source 1..20: note = Seed: SATGFKQSSKALQRPVASDF
SATGFYQSYKFLQIPVASDF

SEQ ID NO: 24956 - protein, 20 aa, synthetic construct
  source 1..20: note = Seed: SATGFKQSSKALQRPVASDF
SATGFYQSYKFLQLPVASDF

SEQ ID NO: 24957 - protein, 20 aa, synthetic construct
  source 1..20: note = Seed: SATGFKQSSKALQRPVASDF
SATGFYQSYKFLQMPVASDF

SEQ ID NO: 24958 - protein, 20 aa, synthetic construct
  source 1..20: note = Seed: SATGFKQSSKALQRPVASDF
SATGFYQSYKFLQVPVASDF

SEQ ID NO: 24959 - protein, 20 aa, synthetic construct
  source 1..20: note = Seed: SATGFKQSSKALQRPVASDF
SATGFYQSYKFLQYPVASDF

SEQ ID NO: 24960 - protein, 20 aa, synthetic construct
  source 1..20: note = Seed: SATGFKQSSKALQRPVASDF
SATGFYQSYKILQLPVASDF

SEQ ID NO: 24961 - protein, 20 aa, synthetic construct
  source 1..20: note = Seed: SATGFKQSSKALQRPVASDF
SATGFYQSYKLLQFPVASDF

SEQ ID NO: 24962 - protein, 20 aa, synthetic construct
  source 1..20: note = Seed: SATGFKQSSKALQRPVASDF
SATGFYQSYKLLQIPVASDF

SEQ ID NO: 24963 - protein, 20 aa, synthetic construct
  source 1..20: note = Seed: SATGFKQSSKALQRPVASDF
SATGFYQSYKLLQLPVASDF

SEQ ID NO: 24964 - protein, 25 aa, synthetic construct
  source 1..25: note = Seed: YGFLNVIVHSATGFKQSSKALQRPV
YGFLNVIVHSATGAKQISKALRRPV

SEQ ID NO: 24965 - protein, 25 aa, synthetic construct
  source 1..25: note = Seed: YGFLNVIVHSATGFKQSSKALQRPV
YGFLNVIVHSATGAKQISRALRRPV

SEQ ID NO: 24966 - protein, 25 aa, synthetic construct
  source 1..25: note = Seed: YGFLNVIVHSATGFKQSSKALQRPV
YGFLNVIVHSATGAKQLSRALRRPV

SEQ ID NO: 24967 - protein, 25 aa, synthetic construct
  source 1..25: note = Seed: YGFLNVIVHSATGFKQSSKALQRPV
YGFLNVIVHSATGCKQFSFALLRPV

SEQ ID NO: 24968 - protein, 25 aa, synthetic construct
  source 1..25: note = Seed: YGFLNVIVHSATGFKQSSKALQRPV
YGFLNVIVHSATGFKQASAALARPV

SEQ ID NO: 24969 - protein, 25 aa, synthetic construct
  source 1..25: note = Seed: YGFLNVIVHSATGFKQSSKALQRPV
YGFLNVIVHSATGFKQASAALCRPV

SEQ ID NO: 24970 - protein, 25 aa, synthetic construct
  source 1..25: note = Seed: YGFLNVIVHSATGFKQSSKALQRPV
YGFLNVIVHSATGFKQASAALDRPV

SEQ ID NO: 24971 - protein, 25 aa, synthetic construct
  source 1..25: note = Seed: YGFLNVIVHSATGFKQSSKALQRPV
YGFLNVIVHSATGFKQASAALERPV

SEQ ID NO: 24972 - protein, 25 aa, synthetic construct
  source 1..25: note = Seed: YGFLNVIVHSATGFKQSSKALQRPV
YGFLNVIVHSATGFKQASAALFRPV

SEQ ID NO: 24973 - protein, 25 aa, synthetic construct
  source 1..25: note = Seed: YGFLNVIVHSATGFKQSSKALQRPV
YGFLNVIVHSATGFKQASAALGRPV

SEQ ID NO: 24974 - protein, 25 aa, synthetic construct
  source 1..25: note = Seed: YGFLNVIVHSATGFKQSSKALQRPV
YGFLNVIVHSATGFKQASAALHRPV

SEQ ID NO: 24975 - protein, 25 aa, synthetic construct
  source 1..25: note = Seed: YGFLNVIVHSATGFKQSSKALQRPV
YGFLNVIVHSATGFKQASAALIRPV

SEQ ID NO: 24976 - protein, 25 aa, synthetic construct
  source 1..25: note = Seed: YGFLNVIVHSATGFKQSSKALQRPV
YGFLNVIVHSATGFKQASAALKRPV

SEQ ID NO: 24977 - protein, 25 aa, synthetic construct
  source 1..25: note = Seed: YGFLNVIVHSATGFKQSSKALQRPV
YGFLNVIVHSATGFKQASAALLRPV

SEQ ID NO: 24978 - protein, 25 aa, synthetic construct
  source 1..25: note = Seed: YGFLNVIVHSATGFKQSSKALQRPV
YGFLNVIVHSATGFKQASAALMRPV

SEQ ID NO: 24979 - protein, 25 aa, synthetic construct
  source 1..25: note = Seed: YGFLNVIVHSATGFKQSSKALQRPV
YGFLNVIVHSATGFKQASAALNRPV

SEQ ID NO: 24980 - protein, 25 aa, synthetic construct
  source 1..25: note = Seed: YGFLNVIVHSATGFKQSSKALQRPV
YGFLNVIVHSATGFKQASAALPRPV

SEQ ID NO: 24981 - protein, 25 aa, synthetic construct
  source 1..25: note = Seed: YGFLNVIVHSATGFKQSSKALQRPV
YGFLNVIVHSATGFKQASAALQRPV

SEQ ID NO: 24982 - protein, 25 aa, synthetic construct
  source 1..25: note = Seed: YGFLNVIVHSATGFKQSSKALQRPV
YGFLNVIVHSATGFKQASAALRRPV

SEQ ID NO: 24983 - protein, 25 aa, synthetic construct
  source 1..25: note = Seed: YGFLNVIVHSATGFKQSSKALQRPV
YGFLNVIVHSATGFKQASAALSRPV

SEQ ID NO: 24984 - protein, 25 aa, synthetic construct
  source 1..25: note = Seed: YGFLNVIVHSATGFKQSSKALQRPV
YGFLNVIVHSATGFKQASAALTRPV

SEQ ID NO: 24985 - protein, 25 aa, synthetic construct
  source 1..25: note = Seed: YGFLNVIVHSATGFKQSSKALQRPV
YGFLNVIVHSATGFKQASAALVRPV

SEQ ID NO: 24986 - protein, 25 aa, synthetic construct
  source 1..25: note = Seed: YGFLNVIVHSATGFKQSSKALQRPV
YGFLNVIVHSATGFKQASAALWRPV

SEQ ID NO: 24987 - protein, 25 aa, synthetic construct
  source 1..25: note = Seed: YGFLNVIVHSATGFKQSSKALQRPV
YGFLNVIVHSATGFKQASAALYRPV

SEQ ID NO: 24988 - protein, 25 aa, synthetic construct
  source 1..25: note = Seed: YGFLNVIVHSATGFKQSSKALQRPV
YGFLNVIVHSATGFKQASCALARPV

SEQ ID NO: 24989 - protein, 25 aa, synthetic construct
  source 1..25: note = Seed: YGFLNVIVHSATGFKQSSKALQRPV
YGFLNVIVHSATGFKQASCALNRPV

SEQ ID NO: 24990 - protein, 25 aa, synthetic construct
  source 1..25: note = Seed: YGFLNVIVHSATGFKQSSKALQRPV
YGFLNVIVHSATGFKQASCALSRPV

SEQ ID NO: 24991 - protein, 25 aa, synthetic construct
  source 1..25: note = Seed: YGFLNVIVHSATGFKQSSKALQRPV
YGFLNVIVHSATGFKQASDALARPV

SEQ ID NO: 24992 - protein, 25 aa, synthetic construct
  source 1..25: note = Seed: YGFLNVIVHSATGFKQSSKALQRPV
YGFLNVIVHSATGFKQASDALNRPV

SEQ ID NO: 24993 - protein, 25 aa, synthetic construct
  source 1..25: note = Seed: YGFLNVIVHSATGFKQSSKALQRPV
YGFLNVIVHSATGFKQASDALSRPV

SEQ ID NO: 24994 - protein, 25 aa, synthetic construct
  source 1..25: note = Seed: YGFLNVIVHSATGFKQSSKALQRPV
YGFLNVIVHSATGFKQASEALARPV

SEQ ID NO: 24995 - protein, 25 aa, synthetic construct
  source 1..25: note = Seed: YGFLNVIVHSATGFKQSSKALQRPV
YGFLNVIVHSATGFKQASEALNRPV

SEQ ID NO: 24996 - protein, 25 aa, synthetic construct
  source 1..25: note = Seed: YGFLNVIVHSATGFKQSSKALQRPV
YGFLNVIVHSATGFKQASEALSRPV

SEQ ID NO: 24997 - protein, 25 aa, synthetic construct
  source 1..25: note = Seed: YGFLNVIVHSATGFKQSSKALQRPV
YGFLNVIVHSATGFKQASFALARPV

SEQ ID NO: 24998 - protein, 25 aa, synthetic construct
  source 1..25: note = Seed: YGFLNVIVHSATGFKQSSKALQRPV
YGFLNVIVHSATGFKQASFALDRPV

SEQ ID NO: 24999 - protein, 25 aa, synthetic construct
  source 1..25: note = Seed: YGFLNVIVHSATGFKQSSKALQRPV
YGFLNVIVHSATGFKQASFALERPV

SEQ ID NO: 25000 - protein, 25 aa, synthetic construct
  source 1..25: note = Seed: YGFLNVIVHSATGFKQSSKALQRPV
YGFLNVIVHSATGFKQASFALFRPV

SEQ ID NO: 25001 - protein, 25 aa, synthetic construct
  source 1..25: note = Seed: YGFLNVIVHSATGFKQSSKALQRPV
YGFLNVIVHSATGFKQASFALIRPV

SEQ ID NO: 25002 - protein, 25 aa, synthetic construct
  source 1..25: note = Seed: YGFLNVIVHSATGFKQSSKALQRPV
YGFLNVIVHSATGFKQASFALLRPV

SEQ ID NO: 25003 - protein, 25 aa, synthetic construct
  source 1..25: note = Seed: YGFLNVIVHSATGFKQSSKALQRPV
YGFLNVIVHSATGFKQASFALMRPV

SEQ ID NO: 25004 - protein, 25 aa, synthetic construct
  source 1..25: note = Seed: YGFLNVIVHSATGFKQSSKALQRPV
YGFLNVIVHSATGFKQASFALNRPV

SEQ ID NO: 25005 - protein, 25 aa, synthetic construct
  source 1..25: note = Seed: YGFLNVIVHSATGFKQSSKALQRPV
YGFLNVIVHSATGFKQASFALSRPV

SEQ ID NO: 25006 - protein, 25 aa, synthetic construct
  source 1..25: note = Seed: YGFLNVIVHSATGFKQSSKALQRPV
YGFLNVIVHSATGFKQASFALTRPV

SEQ ID NO: 25007 - protein, 25 aa, synthetic construct
  source 1..25: note = Seed: YGFLNVIVHSATGFKQSSKALQRPV
YGFLNVIVHSATGFKQASFALVRPV

SEQ ID NO: 25008 - protein, 25 aa, synthetic construct
  source 1..25: note = Seed: YGFLNVIVHSATGFKQSSKALQRPV
YGFLNVIVHSATGFKQASFALYRPV

SEQ ID NO: 25009 - protein, 25 aa, synthetic construct
  source 1..25: note = Seed: YGFLNVIVHSATGFKQSSKALQRPV
YGFLNVIVHSATGFKQASGALARPV

SEQ ID NO: 25010 - protein, 25 aa, synthetic construct
  source 1..25: note = Seed: YGFLNVIVHSATGFKQSSKALQRPV
YGFLNVIVHSATGFKQASGALDRPV

SEQ ID NO: 25011 - protein, 25 aa, synthetic construct
  source 1..25: note = Seed: YGFLNVIVHSATGFKQSSKALQRPV
YGFLNVIVHSATGFKQASGALERPV

SEQ ID NO: 25012 - protein, 25 aa, synthetic construct
  source 1..25: note = Seed: YGFLNVIVHSATGFKQSSKALQRPV
YGFLNVIVHSATGFKQASGALGRPV

SEQ ID NO: 25013 - protein, 25 aa, synthetic construct
  source 1..25: note = Seed: YGFLNVIVHSATGFKQSSKALQRPV
YGFLNVIVHSATGFKQASGALHRPV

SEQ ID NO: 25014 - protein, 25 aa, synthetic construct
  source 1..25: note = Seed: YGFLNVIVHSATGFKQSSKALQRPV
YGFLNVIVHSATGFKQASGALIRPV

SEQ ID NO: 25015 - protein, 25 aa, synthetic construct
  source 1..25: note = Seed: YGFLNVIVHSATGFKQSSKALQRPV
YGFLNVIVHSATGFKQASGALLRPV

SEQ ID NO: 25016 - protein, 25 aa, synthetic construct
  source 1..25: note = Seed: YGFLNVIVHSATGFKQSSKALQRPV
YGFLNVIVHSATGFKQASGALMRPV

SEQ ID NO: 25017 - protein, 25 aa, synthetic construct
  source 1..25: note = Seed: YGFLNVIVHSATGFKQSSKALQRPV
YGFLNVIVHSATGFKQASGALNRPV

SEQ ID NO: 25018 - protein, 25 aa, synthetic construct
  source 1..25: note = Seed: YGFLNVIVHSATGFKQSSKALQRPV
YGFLNVIVHSATGFKQASGALPRPV

SEQ ID NO: 25019 - protein, 25 aa, synthetic construct
  source 1..25: note = Seed: YGFLNVIVHSATGFKQSSKALQRPV
YGFLNVIVHSATGFKQASGALQRPV

SEQ ID NO: 25020 - protein, 25 aa, synthetic construct
  source 1..25: note = Seed: YGFLNVIVHSATGFKQSSKALQRPV
YGFLNVIVHSATGFKQASGALSRPV

SEQ ID NO: 25021 - protein, 25 aa, synthetic construct
  source 1..25: note = Seed: YGFLNVIVHSATGFKQSSKALQRPV
YGFLNVIVHSATGFKQASGALTRPV

SEQ ID NO: 25022 - protein, 25 aa, synthetic construct
  source 1..25: note = Seed: YGFLNVIVHSATGFKQSSKALQRPV
YGFLNVIVHSATGFKQASGALVRPV

SEQ ID NO: 25023 - protein, 25 aa, synthetic construct
  source 1..25: note = Seed: YGFLNVIVHSATGFKQSSKALQRPV
YGFLNVIVHSATGFKQASHALARPV

SEQ ID NO: 25024 - protein, 25 aa, synthetic construct
  source 1..25: note = Seed: YGFLNVIVHSATGFKQSSKALQRPV
YGFLNVIVHSATGFKQASHALNRPV

SEQ ID NO: 25025 - protein, 25 aa, synthetic construct
  source 1..25: note = Seed: YGFLNVIVHSATGFKQSSKALQRPV
YGFLNVIVHSATGFKQASHALSRPV

SEQ ID NO: 25026 - protein, 25 aa, synthetic construct
  source 1..25: note = Seed: YGFLNVIVHSATGFKQSSKALQRPV
YGFLNVIVHSATGFKQASIALARPV

SEQ ID NO: 25027 - protein, 25 aa, synthetic construct
  source 1..25: note = Seed: YGFLNVIVHSATGFKQSSKALQRPV
YGFLNVIVHSATGFKQASIALCRPV

SEQ ID NO: 25028 - protein, 25 aa, synthetic construct
  source 1..25: note = Seed: YGFLNVIVHSATGFKQSSKALQRPV
YGFLNVIVHSATGFKQASIALDRPV

SEQ ID NO: 25029 - protein, 25 aa, synthetic construct
  source 1..25: note = Seed: YGFLNVIVHSATGFKQSSKALQRPV
YGFLNVIVHSATGFKQASIALERPV

SEQ ID NO: 25030 - protein, 25 aa, synthetic construct
  source 1..25: note = Seed: YGFLNVIVHSATGFKQSSKALQRPV
YGFLNVIVHSATGFKQASIALGRPV

SEQ ID NO: 25031 - protein, 25 aa, synthetic construct
  source 1..25: note = Seed: YGFLNVIVHSATGFKQSSKALQRPV
YGFLNVIVHSATGFKQASIALHRPV

SEQ ID NO: 25032 - protein, 25 aa, synthetic construct
  source 1..25: note = Seed: YGFLNVIVHSATGFKQSSKALQRPV
YGFLNVIVHSATGFKQASIALIRPV

SEQ ID NO: 25033 - protein, 25 aa, synthetic construct
  source 1..25: note = Seed: YGFLNVIVHSATGFKQSSKALQRPV
YGFLNVIVHSATGFKQASIALKRPV

SEQ ID NO: 25034 - protein, 25 aa, synthetic construct
  source 1..25: note = Seed: YGFLNVIVHSATGFKQSSKALQRPV
YGFLNVIVHSATGFKQASIALLRPV

SEQ ID NO: 25035 - protein, 25 aa, synthetic construct
  source 1..25: note = Seed: YGFLNVIVHSATGFKQSSKALQRPV
YGFLNVIVHSATGFKQASIALMRPV

SEQ ID NO: 25036 - protein, 25 aa, synthetic construct
  source 1..25: note = Seed: YGFLNVIVHSATGFKQSSKALQRPV
YGFLNVIVHSATGFKQASIALNRPV

SEQ ID NO: 25037 - protein, 25 aa, synthetic construct
  source 1..25: note = Seed: YGFLNVIVHSATGFKQSSKALQRPV
YGFLNVIVHSATGFKQASIALPRPV

SEQ ID NO: 25038 - protein, 25 aa, synthetic construct
  source 1..25: note = Seed: YGFLNVIVHSATGFKQSSKALQRPV
YGFLNVIVHSATGFKQASIALQRPV

SEQ ID NO: 25039 - protein, 25 aa, synthetic construct
  source 1..25: note = Seed: YGFLNVIVHSATGFKQSSKALQRPV
YGFLNVIVHSATGFKQASIALSRPV

SEQ ID NO: 25040 - protein, 25 aa, synthetic construct
  source 1..25: note = Seed: YGFLNVIVHSATGFKQSSKALQRPV
YGFLNVIVHSATGFKQASIALTRPV

SEQ ID NO: 25041 - protein, 25 aa, synthetic construct
  source 1..25: note = Seed: YGFLNVIVHSATGFKQSSKALQRPV
YGFLNVIVHSATGFKQASIALVRPV

SEQ ID NO: 25042 - protein, 25 aa, synthetic construct
  source 1..25: note = Seed: YGFLNVIVHSATGFKQSSKALQRPV
YGFLNVIVHSATGFKQASIALYRPV

SEQ ID NO: 25043 - protein, 25 aa, synthetic construct
  source 1..25: note = Seed: YGFLNVIVHSATGFKQSSKALQRPV
YGFLNVIVHSATGFKQASKALARPV

SEQ ID NO: 25044 - protein, 25 aa, synthetic construct
  source 1..25: note = Seed: YGFLNVIVHSATGFKQSSKALQRPV
YGFLNVIVHSATGFKQASKALGRPV

SEQ ID NO: 25045 - protein, 25 aa, synthetic construct
  source 1..25: note = Seed: YGFLNVIVHSATGFKQSSKALQRPV
YGFLNVIVHSATGFKQASKALHRPV

SEQ ID NO: 25046 - protein, 25 aa, synthetic construct
  source 1..25: note = Seed: YGFLNVIVHSATGFKQSSKALQRPV
YGFLNVIVHSATGFKQASKALIRPV

SEQ ID NO: 25047 - protein, 25 aa, synthetic construct
  source 1..25: note = Seed: YGFLNVIVHSATGFKQSSKALQRPV
YGFLNVIVHSATGFKQASKALKRPV

SEQ ID NO: 25048 - protein, 25 aa, synthetic construct
  source 1..25: note = Seed: YGFLNVIVHSATGFKQSSKALQRPV
YGFLNVIVHSATGFKQASKALMRPV

SEQ ID NO: 25049 - protein, 25 aa, synthetic construct
  source 1..25: note = Seed: YGFLNVIVHSATGFKQSSKALQRPV
YGFLNVIVHSATGFKQASKALNRPV

SEQ ID NO: 25050 - protein, 25 aa, synthetic construct
  source 1..25: note = Seed: YGFLNVIVHSATGFKQSSKALQRPV
YGFLNVIVHSATGFKQASKALPRPV

SEQ ID NO: 25051 - protein, 25 aa, synthetic construct
  source 1..25: note = Seed: YGFLNVIVHSATGFKQSSKALQRPV
YGFLNVIVHSATGFKQASKALQRPV

SEQ ID NO: 25052 - protein, 25 aa, synthetic construct
  source 1..25: note = Seed: YGFLNVIVHSATGFKQSSKALQRPV
YGFLNVIVHSATGFKQASKALRRPV

SEQ ID NO: 25053 - protein, 25 aa, synthetic construct
  source 1..25: note = Seed: YGFLNVIVHSATGFKQSSKALQRPV
YGFLNVIVHSATGFKQASKALSRPV

SEQ ID NO: 25054 - protein, 25 aa, synthetic construct
  source 1..25: note = Seed: YGFLNVIVHSATGFKQSSKALQRPV
YGFLNVIVHSATGFKQASKALTRPV

SEQ ID NO: 25055 - protein, 25 aa, synthetic construct
  source 1..25: note = Seed: YGFLNVIVHSATGFKQSSKALQRPV
YGFLNVIVHSATGFKQASKALVRPV

SEQ ID NO: 25056 - protein, 25 aa, synthetic construct
  source 1..25: note = Seed: YGFLNVIVHSATGFKQSSKALQRPV
YGFLNVIVHSATGFKQASKALYRPV

SEQ ID NO: 25057 - protein, 25 aa, synthetic construct
  source 1..25: note = Seed: YGFLNVIVHSATGFKQSSKALQRPV
YGFLNVIVHSATGFKQASLALARPV

SEQ ID NO: 25058 - protein, 25 aa, synthetic construct
  source 1..25: note = Seed: YGFLNVIVHSATGFKQSSKALQRPV
YGFLNVIVHSATGFKQASLALDRPV

SEQ ID NO: 25059 - protein, 25 aa, synthetic construct
  source 1..25: note = Seed: YGFLNVIVHSATGFKQSSKALQRPV
YGFLNVIVHSATGFKQASLALGRPV

SEQ ID NO: 25060 - protein, 25 aa, synthetic construct
  source 1..25: note = Seed: YGFLNVIVHSATGFKQSSKALQRPV
YGFLNVIVHSATGFKQASLALHRPV

SEQ ID NO: 25061 - protein, 25 aa, synthetic construct
  source 1..25: note = Seed: YGFLNVIVHSATGFKQSSKALQRPV
YGFLNVIVHSATGFKQASLALIRPV

SEQ ID NO: 25062 - protein, 25 aa, synthetic construct
  source 1..25: note = Seed: YGFLNVIVHSATGFKQSSKALQRPV
YGFLNVIVHSATGFKQASLALLRPV

SEQ ID NO: 25063 - protein, 25 aa, synthetic construct
  source 1..25: note = Seed: YGFLNVIVHSATGFKQSSKALQRPV
YGFLNVIVHSATGFKQASLALMRPV

SEQ ID NO: 25064 - protein, 25 aa, synthetic construct
  source 1..25: note = Seed: YGFLNVIVHSATGFKQSSKALQRPV
YGFLNVIVHSATGFKQASLALNRPV

SEQ ID NO: 25065 - protein, 25 aa, synthetic construct
  source 1..25: note = Seed: YGFLNVIVHSATGFKQSSKALQRPV
YGFLNVIVHSATGFKQASLALQRPV

SEQ ID NO: 25066 - protein, 25 aa, synthetic construct
  source 1..25: note = Seed: YGFLNVIVHSATGFKQSSKALQRPV
YGFLNVIVHSATGFKQASLALSRPV

SEQ ID NO: 25067 - protein, 25 aa, synthetic construct
  source 1..25: note = Seed: YGFLNVIVHSATGFKQSSKALQRPV
YGFLNVIVHSATGFKQASLALTRPV

SEQ ID NO: 25068 - protein, 25 aa, synthetic construct
  source 1..25: note = Seed: YGFLNVIVHSATGFKQSSKALQRPV
YGFLNVIVHSATGFKQASLALVRPV

SEQ ID NO: 25069 - protein, 25 aa, synthetic construct
  source 1..25: note = Seed: YGFLNVIVHSATGFKQSSKALQRPV
YGFLNVIVHSATGFKQASMALARPV

SEQ ID NO: 25070 - protein, 25 aa, synthetic construct
  source 1..25: note = Seed: YGFLNVIVHSATGFKQSSKALQRPV
YGFLNVIVHSATGFKQASMALGRPV

SEQ ID NO: 25071 - protein, 25 aa, synthetic construct
  source 1..25: note = Seed: YGFLNVIVHSATGFKQSSKALQRPV
YGFLNVIVHSATGFKQASMALHRPV

SEQ ID NO: 25072 - protein, 25 aa, synthetic construct
  source 1..25: note = Seed: YGFLNVIVHSATGFKQSSKALQRPV
YGFLNVIVHSATGFKQASMALIRPV

SEQ ID NO: 25073 - protein, 25 aa, synthetic construct
  source 1..25: note = Seed: YGFLNVIVHSATGFKQSSKALQRPV
YGFLNVIVHSATGFKQASMALLRPV

SEQ ID NO: 25074 - protein, 25 aa, synthetic construct
  source 1..25: note = Seed: YGFLNVIVHSATGFKQSSKALQRPV
YGFLNVIVHSATGFKQASMALMRPV

SEQ ID NO: 25075 - protein, 25 aa, synthetic construct
  source 1..25: note = Seed: YGFLNVIVHSATGFKQSSKALQRPV
YGFLNVIVHSATGFKQASMALNRPV

SEQ ID NO: 25076 - protein, 25 aa, synthetic construct
  source 1..25: note = Seed: YGFLNVIVHSATGFKQSSKALQRPV
YGFLNVIVHSATGFKQASMALQRPV

SEQ ID NO: 25077 - protein, 25 aa, synthetic construct
  source 1..25: note = Seed: YGFLNVIVHSATGFKQSSKALQRPV
YGFLNVIVHSATGFKQASMALSRPV

SEQ ID NO: 25078 - protein, 25 aa, synthetic construct
  source 1..25: note = Seed: YGFLNVIVHSATGFKQSSKALQRPV
YGFLNVIVHSATGFKQASMALTRPV

SEQ ID NO: 25079 - protein, 25 aa, synthetic construct
  source 1..25: note = Seed: YGFLNVIVHSATGFKQSSKALQRPV
YGFLNVIVHSATGFKQASMALVRPV

SEQ ID NO: 25080 - protein, 25 aa, synthetic construct
  source 1..25: note = Seed: YGFLNVIVHSATGFKQSSKALQRPV
YGFLNVIVHSATGFKQASNALARPV

SEQ ID NO: 25081 - protein, 25 aa, synthetic construct
  source 1..25: note = Seed: YGFLNVIVHSATGFKQSSKALQRPV
YGFLNVIVHSATGFKQASNALCRPV

SEQ ID NO: 25082 - protein, 25 aa, synthetic construct
  source 1..25: note = Seed: YGFLNVIVHSATGFKQSSKALQRPV
YGFLNVIVHSATGFKQASNALDRPV

SEQ ID NO: 25083 - protein, 25 aa, synthetic construct
  source 1..25: note = Seed: YGFLNVIVHSATGFKQSSKALQRPV
YGFLNVIVHSATGFKQASNALERPV

SEQ ID NO: 25084 - protein, 25 aa, synthetic construct
  source 1..25: note = Seed: YGFLNVIVHSATGFKQSSKALQRPV
YGFLNVIVHSATGFKQASNALGRPV

SEQ ID NO: 25085 - protein, 25 aa, synthetic construct
  source 1..25: note = Seed: YGFLNVIVHSATGFKQSSKALQRPV
YGFLNVIVHSATGFKQASNALHRPV

SEQ ID NO: 25086 - protein, 25 aa, synthetic construct
  source 1..25: note = Seed: YGFLNVIVHSATGFKQSSKALQRPV
YGFLNVIVHSATGFKQASNALIRPV

SEQ ID NO: 25087 - protein, 25 aa, synthetic construct
  source 1..25: note = Seed: YGFLNVIVHSATGFKQSSKALQRPV
YGFLNVIVHSATGFKQASNALLRPV

SEQ ID NO: 25088 - protein, 25 aa, synthetic construct
  source 1..25: note = Seed: YGFLNVIVHSATGFKQSSKALQRPV
YGFLNVIVHSATGFKQASNALMRPV

SEQ ID NO: 25089 - protein, 25 aa, synthetic construct
  source 1..25: note = Seed: YGFLNVIVHSATGFKQSSKALQRPV
YGFLNVIVHSATGFKQASNALNRPV

SEQ ID NO: 25090 - protein, 25 aa, synthetic construct
  source 1..25: note = Seed: YGFLNVIVHSATGFKQSSKALQRPV
YGFLNVIVHSATGFKQASNALPRPV

SEQ ID NO: 25091 - protein, 25 aa, synthetic construct
  source 1..25: note = Seed: YGFLNVIVHSATGFKQSSKALQRPV
YGFLNVIVHSATGFKQASNALQRPV

SEQ ID NO: 25092 - protein, 25 aa, synthetic construct
  source 1..25: note = Seed: YGFLNVIVHSATGFKQSSKALQRPV
YGFLNVIVHSATGFKQASNALSRPV

SEQ ID NO: 25093 - protein, 25 aa, synthetic construct
  source 1..25: note = Seed: YGFLNVIVHSATGFKQSSKALQRPV
YGFLNVIVHSATGFKQASNALTRPV

SEQ ID NO: 25094 - protein, 25 aa, synthetic construct
  source 1..25: note = Seed: YGFLNVIVHSATGFKQSSKALQRPV
YGFLNVIVHSATGFKQASNALVRPV

SEQ ID NO: 25095 - protein, 25 aa, synthetic construct
  source 1..25: note = Seed: YGFLNVIVHSATGFKQSSKALQRPV
YGFLNVIVHSATGFKQASPALARPV

SEQ ID NO: 25096 - protein, 25 aa, synthetic construct
  source 1..25: note = Seed: YGFLNVIVHSATGFKQSSKALQRPV
YGFLNVIVHSATGFKQASPALCRPV

SEQ ID NO: 25097 - protein, 25 aa, synthetic construct
  source 1..25: note = Seed: YGFLNVIVHSATGFKQSSKALQRPV
YGFLNVIVHSATGFKQASPALDRPV

SEQ ID NO: 25098 - protein, 25 aa, synthetic construct
  source 1..25: note = Seed: YGFLNVIVHSATGFKQSSKALQRPV
YGFLNVIVHSATGFKQASPALERPV

SEQ ID NO: 25099 - protein, 25 aa, synthetic construct
  source 1..25: note = Seed: YGFLNVIVHSATGFKQSSKALQRPV
YGFLNVIVHSATGFKQASPALFRPV

SEQ ID NO: 25100 - protein, 25 aa, synthetic construct
  source 1..25: note = Seed: YGFLNVIVHSATGFKQSSKALQRPV
YGFLNVIVHSATGFKQASPALGRPV

SEQ ID NO: 25101 - protein, 25 aa, synthetic construct
  source 1..25: note = Seed: YGFLNVIVHSATGFKQSSKALQRPV
YGFLNVIVHSATGFKQASPALHRPV

SEQ ID NO: 25102 - protein, 25 aa, synthetic construct
  source 1..25: note = Seed: YGFLNVIVHSATGFKQSSKALQRPV
YGFLNVIVHSATGFKQASPALIRPV

SEQ ID NO: 25103 - protein, 25 aa, synthetic construct
  source 1..25: note = Seed: YGFLNVIVHSATGFKQSSKALQRPV
YGFLNVIVHSATGFKQASPALKRPV

SEQ ID NO: 25104 - protein, 25 aa, synthetic construct
  source 1..25: note = Seed: YGFLNVIVHSATGFKQSSKALQRPV
YGFLNVIVHSATGFKQASPALLRPV

SEQ ID NO: 25105 - protein, 25 aa, synthetic construct
  source 1..25: note = Seed: YGFLNVIVHSATGFKQSSKALQRPV
YGFLNVIVHSATGFKQASPALMRPV

SEQ ID NO: 25106 - protein, 25 aa, synthetic construct
  source 1..25: note = Seed: YGFLNVIVHSATGFKQSSKALQRPV
YGFLNVIVHSATGFKQASPALNRPV

SEQ ID NO: 25107 - protein, 25 aa, synthetic construct
  source 1..25: note = Seed: YGFLNVIVHSATGFKQSSKALQRPV
YGFLNVIVHSATGFKQASPALPRPV

SEQ ID NO: 25108 - protein, 25 aa, synthetic construct
  source 1..25: note = Seed: YGFLNVIVHSATGFKQSSKALQRPV
YGFLNVIVHSATGFKQASPALQRPV

SEQ ID NO: 25109 - protein, 25 aa, synthetic construct
  source 1..25: note = Seed: YGFLNVIVHSATGFKQSSKALQRPV
YGFLNVIVHSATGFKQASPALRRPV

SEQ ID NO: 25110 - protein, 25 aa, synthetic construct
  source 1..25: note = Seed: YGFLNVIVHSATGFKQSSKALQRPV
YGFLNVIVHSATGFKQASPALSRPV

SEQ ID NO: 25111 - protein, 25 aa, synthetic construct
  source 1..25: note = Seed: YGFLNVIVHSATGFKQSSKALQRPV
YGFLNVIVHSATGFKQASPALTRPV

SEQ ID NO: 25112 - protein, 25 aa, synthetic construct
  source 1..25: note = Seed: YGFLNVIVHSATGFKQSSKALQRPV
YGFLNVIVHSATGFKQASPALVRPV

SEQ ID NO: 25113 - protein, 25 aa, synthetic construct
  source 1..25: note = Seed: YGFLNVIVHSATGFKQSSKALQRPV
YGFLNVIVHSATGFKQASPALWRPV

SEQ ID NO: 25114 - protein, 25 aa, synthetic construct
  source 1..25: note = Seed: YGFLNVIVHSATGFKQSSKALQRPV
YGFLNVIVHSATGFKQASPALYRPV

SEQ ID NO: 25115 - protein, 25 aa, synthetic construct
  source 1..25: note = Seed: YGFLNVIVHSATGFKQSSKALQRPV
YGFLNVIVHSATGFKQASQALARPV

SEQ ID NO: 25116 - protein, 25 aa, synthetic construct
  source 1..25: note = Seed: YGFLNVIVHSATGFKQSSKALQRPV
YGFLNVIVHSATGFKQASQALNRPV

SEQ ID NO: 25117 - protein, 25 aa, synthetic construct
  source 1..25: note = Seed: YGFLNVIVHSATGFKQSSKALQRPV
YGFLNVIVHSATGFKQASQALSRPV

SEQ ID NO: 25118 - protein, 25 aa, synthetic construct
  source 1..25: note = Seed: YGFLNVIVHSATGFKQSSKALQRPV
YGFLNVIVHSATGFKQASQALTRPV

SEQ ID NO: 25119 - protein, 25 aa, synthetic construct
  source 1..25: note = Seed: YGFLNVIVHSATGFKQSSKALQRPV
YGFLNVIVHSATGFKQASQALVRPV

SEQ ID NO: 25120 - protein, 25 aa, synthetic construct
  source 1..25: note = Seed: YGFLNVIVHSATGFKQSSKALQRPV
YGFLNVIVHSATGFKQASRALARPV

SEQ ID NO: 25121 - protein, 25 aa, synthetic construct
  source 1..25: note = Seed: YGFLNVIVHSATGFKQSSKALQRPV
YGFLNVIVHSATGFKQASRALGRPV

SEQ ID NO: 25122 - protein, 25 aa, synthetic construct
  source 1..25: note = Seed: YGFLNVIVHSATGFKQSSKALQRPV
YGFLNVIVHSATGFKQASRALHRPV

SEQ ID NO: 25123 - protein, 25 aa, synthetic construct
  source 1..25: note = Seed: YGFLNVIVHSATGFKQSSKALQRPV
YGFLNVIVHSATGFKQASRALIRPV

SEQ ID NO: 25124 - protein, 25 aa, synthetic construct
  source 1..25: note = Seed: YGFLNVIVHSATGFKQSSKALQRPV
YGFLNVIVHSATGFKQASRALKRPV

SEQ ID NO: 25125 - protein, 25 aa, synthetic construct
  source 1..25: note = Seed: YGFLNVIVHSATGFKQSSKALQRPV
YGFLNVIVHSATGFKQASRALLRPV

SEQ ID NO: 25126 - protein, 25 aa, synthetic construct
  source 1..25: note = Seed: YGFLNVIVHSATGFKQSSKALQRPV
YGFLNVIVHSATGFKQASRALMRPV

SEQ ID NO: 25127 - protein, 25 aa, synthetic construct
  source 1..25: note = Seed: YGFLNVIVHSATGFKQSSKALQRPV
YGFLNVIVHSATGFKQASRALNRPV

SEQ ID NO: 25128 - protein, 25 aa, synthetic construct
  source 1..25: note = Seed: YGFLNVIVHSATGFKQSSKALQRPV
YGFLNVIVHSATGFKQASRALPRPV

SEQ ID NO: 25129 - protein, 25 aa, synthetic construct
  source 1..25: note = Seed: YGFLNVIVHSATGFKQSSKALQRPV
YGFLNVIVHSATGFKQASRALQRPV

SEQ ID NO: 25130 - protein, 25 aa, synthetic construct
  source 1..25: note = Seed: YGFLNVIVHSATGFKQSSKALQRPV
YGFLNVIVHSATGFKQASRALRRPV

SEQ ID NO: 25131 - protein, 25 aa, synthetic construct
  source 1..25: note = Seed: YGFLNVIVHSATGFKQSSKALQRPV
YGFLNVIVHSATGFKQASRALSRPV

SEQ ID NO: 25132 - protein, 25 aa, synthetic construct
  source 1..25: note = Seed: YGFLNVIVHSATGFKQSSKALQRPV
YGFLNVIVHSATGFKQASRALTRPV

SEQ ID NO: 25133 - protein, 25 aa, synthetic construct
  source 1..25: note = Seed: YGFLNVIVHSATGFKQSSKALQRPV
YGFLNVIVHSATGFKQASRALVRPV

SEQ ID NO: 25134 - protein, 25 aa, synthetic construct
  source 1..25: note = Seed: YGFLNVIVHSATGFKQSSKALQRPV
YGFLNVIVHSATGFKQASRALYRPV

SEQ ID NO: 25135 - protein, 25 aa, synthetic construct
  source 1..25: note = Seed: YGFLNVIVHSATGFKQSSKALQRPV
YGFLNVIVHSATGFKQASSALARPV

SEQ ID NO: 25136 - protein, 25 aa, synthetic construct
  source 1..25: note = Seed: YGFLNVIVHSATGFKQSSKALQRPV
YGFLNVIVHSATGFKQASSALCRPV

SEQ ID NO: 25137 - protein, 25 aa, synthetic construct
  source 1..25: note = Seed: YGFLNVIVHSATGFKQSSKALQRPV
YGFLNVIVHSATGFKQASSALDRPV

SEQ ID NO: 25138 - protein, 25 aa, synthetic construct
  source 1..25: note = Seed: YGFLNVIVHSATGFKQSSKALQRPV
YGFLNVIVHSATGFKQASSALERPV

SEQ ID NO: 25139 - protein, 25 aa, synthetic construct
  source 1..25: note = Seed: YGFLNVIVHSATGFKQSSKALQRPV
YGFLNVIVHSATGFKQASSALFRPV

SEQ ID NO: 25140 - protein, 25 aa, synthetic construct
  source 1..25: note = Seed: YGFLNVIVHSATGFKQSSKALQRPV
YGFLNVIVHSATGFKQASSALGRPV

SEQ ID NO: 25141 - protein, 25 aa, synthetic construct
  source 1..25: note = Seed: YGFLNVIVHSATGFKQSSKALQRPV
YGFLNVIVHSATGFKQASSALHRPV

SEQ ID NO: 25142 - protein, 25 aa, synthetic construct
  source 1..25: note = Seed: YGFLNVIVHSATGFKQSSKALQRPV
YGFLNVIVHSATGFKQASSALIRPV

SEQ ID NO: 25143 - protein, 25 aa, synthetic construct
  source 1..25: note = Seed: YGFLNVIVHSATGFKQSSKALQRPV
YGFLNVIVHSATGFKQASSALLRPV

SEQ ID NO: 25144 - protein, 25 aa, synthetic construct
  source 1..25: note = Seed: YGFLNVIVHSATGFKQSSKALQRPV
YGFLNVIVHSATGFKQASSALMRPV

SEQ ID NO: 25145 - protein, 25 aa, synthetic construct
  source 1..25: note = Seed: YGFLNVIVHSATGFKQSSKALQRPV
YGFLNVIVHSATGFKQASSALNRPV

SEQ ID NO: 25146 - protein, 25 aa, synthetic construct
  source 1..25: note = Seed: YGFLNVIVHSATGFKQSSKALQRPV
YGFLNVIVHSATGFKQASSALPRPV

SEQ ID NO: 25147 - protein, 25 aa, synthetic construct
  source 1..25: note = Seed: YGFLNVIVHSATGFKQSSKALQRPV
YGFLNVIVHSATGFKQASSALQRPV

SEQ ID NO: 25148 - protein, 25 aa, synthetic construct
  source 1..25: note = Seed: YGFLNVIVHSATGFKQSSKALQRPV
YGFLNVIVHSATGFKQASSALSRPV

SEQ ID NO: 25149 - protein, 25 aa, synthetic construct
  source 1..25: note = Seed: YGFLNVIVHSATGFKQSSKALQRPV
YGFLNVIVHSATGFKQASSALTRPV

SEQ ID NO: 25150 - protein, 25 aa, synthetic construct
  source 1..25: note = Seed: YGFLNVIVHSATGFKQSSKALQRPV
YGFLNVIVHSATGFKQASSALVRPV

SEQ ID NO: 25151 - protein, 25 aa, synthetic construct
  source 1..25: note = Seed: YGFLNVIVHSATGFKQSSKALQRPV
YGFLNVIVHSATGFKQASSALWRPV

SEQ ID NO: 25152 - protein, 25 aa, synthetic construct
  source 1..25: note = Seed: YGFLNVIVHSATGFKQSSKALQRPV
YGFLNVIVHSATGFKQASSALYRPV

SEQ ID NO: 25153 - protein, 25 aa, synthetic construct
  source 1..25: note = Seed: YGFLNVIVHSATGFKQSSKALQRPV
YGFLNVIVHSATGFKQASTALARPV

SEQ ID NO: 25154 - protein, 25 aa, synthetic construct
  source 1..25: note = Seed: YGFLNVIVHSATGFKQSSKALQRPV
YGFLNVIVHSATGFKQASTALCRPV

SEQ ID NO: 25155 - protein, 25 aa, synthetic construct
  source 1..25: note = Seed: YGFLNVIVHSATGFKQSSKALQRPV
YGFLNVIVHSATGFKQASTALDRPV

SEQ ID NO: 25156 - protein, 25 aa, synthetic construct
  source 1..25: note = Seed: YGFLNVIVHSATGFKQSSKALQRPV
YGFLNVIVHSATGFKQASTALERPV

SEQ ID NO: 25157 - protein, 25 aa, synthetic construct
  source 1..25: note = Seed: YGFLNVIVHSATGFKQSSKALQRPV
YGFLNVIVHSATGFKQASTALFRPV

SEQ ID NO: 25158 - protein, 25 aa, synthetic construct
  source 1..25: note = Seed: YGFLNVIVHSATGFKQSSKALQRPV
YGFLNVIVHSATGFKQASTALGRPV

SEQ ID NO: 25159 - protein, 25 aa, synthetic construct
  source 1..25: note = Seed: YGFLNVIVHSATGFKQSSKALQRPV
YGFLNVIVHSATGFKQASTALHRPV

SEQ ID NO: 25160 - protein, 25 aa, synthetic construct
  source 1..25: note = Seed: YGFLNVIVHSATGFKQSSKALQRPV
YGFLNVIVHSATGFKQASTALIRPV

SEQ ID NO: 25161 - protein, 25 aa, synthetic construct
  source 1..25: note = Seed: YGFLNVIVHSATGFKQSSKALQRPV
YGFLNVIVHSATGFKQASTALKRPV

SEQ ID NO: 25162 - protein, 25 aa, synthetic construct
  source 1..25: note = Seed: YGFLNVIVHSATGFKQSSKALQRPV
YGFLNVIVHSATGFKQASTALLRPV

SEQ ID NO: 25163 - protein, 25 aa, synthetic construct
  source 1..25: note = Seed: YGFLNVIVHSATGFKQSSKALQRPV
YGFLNVIVHSATGFKQASTALMRPV

SEQ ID NO: 25164 - protein, 25 aa, synthetic construct
  source 1..25: note = Seed: YGFLNVIVHSATGFKQSSKALQRPV
YGFLNVIVHSATGFKQASTALNRPV

SEQ ID NO: 25165 - protein, 25 aa, synthetic construct
  source 1..25: note = Seed: YGFLNVIVHSATGFKQSSKALQRPV
YGFLNVIVHSATGFKQASTALPRPV

SEQ ID NO: 25166 - protein, 25 aa, synthetic construct
  source 1..25: note = Seed: YGFLNVIVHSATGFKQSSKALQRPV
YGFLNVIVHSATGFKQASTALQRPV

SEQ ID NO: 25167 - protein, 25 aa, synthetic construct
  source 1..25: note = Seed: YGFLNVIVHSATGFKQSSKALQRPV
YGFLNVIVHSATGFKQASTALRRPV

SEQ ID NO: 25168 - protein, 25 aa, synthetic construct
  source 1..25: note = Seed: YGFLNVIVHSATGFKQSSKALQRPV
YGFLNVIVHSATGFKQASTALSRPV

SEQ ID NO: 25169 - protein, 25 aa, synthetic construct
  source 1..25: note = Seed: YGFLNVIVHSATGFKQSSKALQRPV
YGFLNVIVHSATGFKQASTALTRPV

SEQ ID NO: 25170 - protein, 25 aa, synthetic construct
  source 1..25: note = Seed: YGFLNVIVHSATGFKQSSKALQRPV
YGFLNVIVHSATGFKQASTALVRPV

SEQ ID NO: 25171 - protein, 25 aa, synthetic construct
  source 1..25: note = Seed: YGFLNVIVHSATGFKQSSKALQRPV
YGFLNVIVHSATGFKQASTALWRPV

SEQ ID NO: 25172 - protein, 25 aa, synthetic construct
  source 1..25: note = Seed: YGFLNVIVHSATGFKQSSKALQRPV
YGFLNVIVHSATGFKQASTALYRPV

SEQ ID NO: 25173 - protein, 25 aa, synthetic construct
  source 1..25: note = Seed: YGFLNVIVHSATGFKQSSKALQRPV
YGFLNVIVHSATGFKQASVALARPV

SEQ ID NO: 25174 - protein, 25 aa, synthetic construct
  source 1..25: note = Seed: YGFLNVIVHSATGFKQSSKALQRPV
YGFLNVIVHSATGFKQASVALCRPV

SEQ ID NO: 25175 - protein, 25 aa, synthetic construct
  source 1..25: note = Seed: YGFLNVIVHSATGFKQSSKALQRPV
YGFLNVIVHSATGFKQASVALDRPV

SEQ ID NO: 25176 - protein, 25 aa, synthetic construct
  source 1..25: note = Seed: YGFLNVIVHSATGFKQSSKALQRPV
YGFLNVIVHSATGFKQASVALERPV

SEQ ID NO: 25177 - protein, 25 aa, synthetic construct
  source 1..25: note = Seed: YGFLNVIVHSATGFKQSSKALQRPV
YGFLNVIVHSATGFKQASVALFRPV

SEQ ID NO: 25178 - protein, 25 aa, synthetic construct
  source 1..25: note = Seed: YGFLNVIVHSATGFKQSSKALQRPV
YGFLNVIVHSATGFKQASVALGRPV

SEQ ID NO: 25179 - protein, 25 aa, synthetic construct
  source 1..25: note = Seed: YGFLNVIVHSATGFKQSSKALQRPV
YGFLNVIVHSATGFKQASVALHRPV

SEQ ID NO: 25180 - protein, 25 aa, synthetic construct
  source 1..25: note = Seed: YGFLNVIVHSATGFKQSSKALQRPV
YGFLNVIVHSATGFKQASVALIRPV

SEQ ID NO: 25181 - protein, 25 aa, synthetic construct
  source 1..25: note = Seed: YGFLNVIVHSATGFKQSSKALQRPV
YGFLNVIVHSATGFKQASVALKRPV

SEQ ID NO: 25182 - protein, 25 aa, synthetic construct
  source 1..25: note = Seed: YGFLNVIVHSATGFKQSSKALQRPV
YGFLNVIVHSATGFKQASVALLRPV

SEQ ID NO: 25183 - protein, 25 aa, synthetic construct
  source 1..25: note = Seed: YGFLNVIVHSATGFKQSSKALQRPV
YGFLNVIVHSATGFKQASVALMRPV

SEQ ID NO: 25184 - protein, 25 aa, synthetic construct
  source 1..25: note = Seed: YGFLNVIVHSATGFKQSSKALQRPV
YGFLNVIVHSATGFKQASVALNRPV

SEQ ID NO: 25185 - protein, 25 aa, synthetic construct
  source 1..25: note = Seed: YGFLNVIVHSATGFKQSSKALQRPV
YGFLNVIVHSATGFKQASVALPRPV

SEQ ID NO: 25186 - protein, 25 aa, synthetic construct
  source 1..25: note = Seed: YGFLNVIVHSATGFKQSSKALQRPV
YGFLNVIVHSATGFKQASVALQRPV

SEQ ID NO: 25187 - protein, 25 aa, synthetic construct
  source 1..25: note = Seed: YGFLNVIVHSATGFKQSSKALQRPV
YGFLNVIVHSATGFKQASVALRRPV

SEQ ID NO: 25188 - protein, 25 aa, synthetic construct
  source 1..25: note = Seed: YGFLNVIVHSATGFKQSSKALQRPV
YGFLNVIVHSATGFKQASVALSRPV

SEQ ID NO: 25189 - protein, 25 aa, synthetic construct
  source 1..25: note = Seed: YGFLNVIVHSATGFKQSSKALQRPV
YGFLNVIVHSATGFKQASVALTRPV

SEQ ID NO: 25190 - protein, 25 aa, synthetic construct
  source 1..25: note = Seed: YGFLNVIVHSATGFKQSSKALQRPV
YGFLNVIVHSATGFKQASVALVRPV

SEQ ID NO: 25191 - protein, 25 aa, synthetic construct
  source 1..25: note = Seed: YGFLNVIVHSATGFKQSSKALQRPV
YGFLNVIVHSATGFKQASVALYRPV

SEQ ID NO: 25192 - protein, 25 aa, synthetic construct
  source 1..25: note = Seed: YGFLNVIVHSATGFKQSSKALQRPV
YGFLNVIVHSATGFKQASWALARPV

SEQ ID NO: 25193 - protein, 25 aa, synthetic construct
  source 1..25: note = Seed: YGFLNVIVHSATGFKQSSKALQRPV
YGFLNVIVHSATGFKQASWALFRPV

SEQ ID NO: 25194 - protein, 25 aa, synthetic construct
  source 1..25: note = Seed: YGFLNVIVHSATGFKQSSKALQRPV
YGFLNVIVHSATGFKQASWALNRPV

SEQ ID NO: 25195 - protein, 25 aa, synthetic construct
  source 1..25: note = Seed: YGFLNVIVHSATGFKQSSKALQRPV
YGFLNVIVHSATGFKQASYALARPV

SEQ ID NO: 25196 - protein, 25 aa, synthetic construct
  source 1..25: note = Seed: YGFLNVIVHSATGFKQSSKALQRPV
YGFLNVIVHSATGFKQASYALFRPV

SEQ ID NO: 25197 - protein, 25 aa, synthetic construct
  source 1..25: note = Seed: YGFLNVIVHSATGFKQSSKALQRPV
YGFLNVIVHSATGFKQASYALLRPV

SEQ ID NO: 25198 - protein, 25 aa, synthetic construct
  source 1..25: note = Seed: YGFLNVIVHSATGFKQSSKALQRPV
YGFLNVIVHSATGFKQCSAALARPV

SEQ ID NO: 25199 - protein, 25 aa, synthetic construct
  source 1..25: note = Seed: YGFLNVIVHSATGFKQSSKALQRPV
YGFLNVIVHSATGFKQCSAALNRPV

SEQ ID NO: 25200 - protein, 25 aa, synthetic construct
  source 1..25: note = Seed: YGFLNVIVHSATGFKQSSKALQRPV
YGFLNVIVHSATGFKQCSAALSRPV

SEQ ID NO: 25201 - protein, 25 aa, synthetic construct
  source 1..25: note = Seed: YGFLNVIVHSATGFKQSSKALQRPV
YGFLNVIVHSATGFKQCSFALFRPV

SEQ ID NO: 25202 - protein, 25 aa, synthetic construct
  source 1..25: note = Seed: YGFLNVIVHSATGFKQSSKALQRPV
YGFLNVIVHSATGFKQCSFALIRPV

SEQ ID NO: 25203 - protein, 25 aa, synthetic construct
  source 1..25: note = Seed: YGFLNVIVHSATGFKQSSKALQRPV
YGFLNVIVHSATGFKQCSFALLRPV

SEQ ID NO: 25204 - protein, 25 aa, synthetic construct
  source 1..25: note = Seed: YGFLNVIVHSATGFKQSSKALQRPV
YGFLNVIVHSATGFKQCSFALVRPV

SEQ ID NO: 25205 - protein, 25 aa, synthetic construct
  source 1..25: note = Seed: YGFLNVIVHSATGFKQSSKALQRPV
YGFLNVIVHSATGFKQCSKALARPV

SEQ ID NO: 25206 - protein, 25 aa, synthetic construct
  source 1..25: note = Seed: YGFLNVIVHSATGFKQSSKALQRPV
YGFLNVIVHSATGFKQCSKALSRPV

SEQ ID NO: 25207 - protein, 25 aa, synthetic construct
  source 1..25: note = Seed: YGFLNVIVHSATGFKQSSKALQRPV
YGFLNVIVHSATGFKQCSPALARPV

SEQ ID NO: 25208 - protein, 25 aa, synthetic construct
  source 1..25: note = Seed: YGFLNVIVHSATGFKQSSKALQRPV
YGFLNVIVHSATGFKQCSPALNRPV

SEQ ID NO: 25209 - protein, 25 aa, synthetic construct
  source 1..25: note = Seed: YGFLNVIVHSATGFKQSSKALQRPV
YGFLNVIVHSATGFKQCSPALSRPV

SEQ ID NO: 25210 - protein, 25 aa, synthetic construct
  source 1..25: note = Seed: YGFLNVIVHSATGFKQSSKALQRPV
YGFLNVIVHSATGFKQCSRALARPV

SEQ ID NO: 25211 - protein, 25 aa, synthetic construct
  source 1..25: note = Seed: YGFLNVIVHSATGFKQSSKALQRPV
YGFLNVIVHSATGFKQCSRALGRPV

SEQ ID NO: 25212 - protein, 25 aa, synthetic construct
  source 1..25: note = Seed: YGFLNVIVHSATGFKQSSKALQRPV
YGFLNVIVHSATGFKQCSRALQRPV

SEQ ID NO: 25213 - protein, 25 aa, synthetic construct
  source 1..25: note = Seed: YGFLNVIVHSATGFKQSSKALQRPV
YGFLNVIVHSATGFKQCSRALSRPV

SEQ ID NO: 25214 - protein, 25 aa, synthetic construct
  source 1..25: note = Seed: YGFLNVIVHSATGFKQSSKALQRPV
YGFLNVIVHSATGFKQCSSALARPV

SEQ ID NO: 25215 - protein, 25 aa, synthetic construct
  source 1..25: note = Seed: YGFLNVIVHSATGFKQSSKALQRPV
YGFLNVIVHSATGFKQCSSALNRPV

SEQ ID NO: 25216 - protein, 25 aa, synthetic construct
  source 1..25: note = Seed: YGFLNVIVHSATGFKQSSKALQRPV
YGFLNVIVHSATGFKQCSTALARPV

SEQ ID NO: 25217 - protein, 25 aa, synthetic construct
  source 1..25: note = Seed: YGFLNVIVHSATGFKQSSKALQRPV
YGFLNVIVHSATGFKQCSVALARPV

SEQ ID NO: 25218 - protein, 25 aa, synthetic construct
  source 1..25: note = Seed: YGFLNVIVHSATGFKQSSKALQRPV
YGFLNVIVHSATGFKQCSVALNRPV

SEQ ID NO: 25219 - protein, 25 aa, synthetic construct
  source 1..25: note = Seed: YGFLNVIVHSATGFKQSSKALQRPV
YGFLNVIVHSATGFKQCSVALSRPV

SEQ ID NO: 25220 - protein, 25 aa, synthetic construct
  source 1..25: note = Seed: YGFLNVIVHSATGFKQSSKALQRPV
YGFLNVIVHSATGFKQCSYALFRPV

SEQ ID NO: 25221 - protein, 25 aa, synthetic construct
  source 1..25: note = Seed: YGFLNVIVHSATGFKQSSKALQRPV
YGFLNVIVHSATGFKQDSAALARPV

SEQ ID NO: 25222 - protein, 25 aa, synthetic construct
  source 1..25: note = Seed: YGFLNVIVHSATGFKQSSKALQRPV
YGFLNVIVHSATGFKQDSAALGRPV

SEQ ID NO: 25223 - protein, 25 aa, synthetic construct
  source 1..25: note = Seed: YGFLNVIVHSATGFKQSSKALQRPV
YGFLNVIVHSATGFKQDSAALSRPV

SEQ ID NO: 25224 - protein, 25 aa, synthetic construct
  source 1..25: note = Seed: YGFLNVIVHSATGFKQSSKALQRPV
YGFLNVIVHSATGFKQDSDALARPV

SEQ ID NO: 25225 - protein, 25 aa, synthetic construct
  source 1..25: note = Seed: YGFLNVIVHSATGFKQSSKALQRPV
YGFLNVIVHSATGFKQDSFALIRPV

SEQ ID NO: 25226 - protein, 25 aa, synthetic construct
  source 1..25: note = Seed: YGFLNVIVHSATGFKQSSKALQRPV
YGFLNVIVHSATGFKQDSFALLRPV

SEQ ID NO: 25227 - protein, 25 aa, synthetic construct
  source 1..25: note = Seed: YGFLNVIVHSATGFKQSSKALQRPV
YGFLNVIVHSATGFKQDSFALVRPV

SEQ ID NO: 25228 - protein, 25 aa, synthetic construct
  source 1..25: note = Seed: YGFLNVIVHSATGFKQSSKALQRPV
YGFLNVIVHSATGFKQDSIALARPV

SEQ ID NO: 25229 - protein, 25 aa, synthetic construct
  source 1..25: note = Seed: YGFLNVIVHSATGFKQSSKALQRPV
YGFLNVIVHSATGFKQDSNALARPV

SEQ ID NO: 25230 - protein, 25 aa, synthetic construct
  source 1..25: note = Seed: YGFLNVIVHSATGFKQSSKALQRPV
YGFLNVIVHSATGFKQDSNALGRPV

SEQ ID NO: 25231 - protein, 25 aa, synthetic construct
  source 1..25: note = Seed: YGFLNVIVHSATGFKQSSKALQRPV
YGFLNVIVHSATGFKQDSNALNRPV

SEQ ID NO: 25232 - protein, 25 aa, synthetic construct
  source 1..25: note = Seed: YGFLNVIVHSATGFKQSSKALQRPV
YGFLNVIVHSATGFKQDSNALQRPV

SEQ ID NO: 25233 - protein, 25 aa, synthetic construct
  source 1..25: note = Seed: YGFLNVIVHSATGFKQSSKALQRPV
YGFLNVIVHSATGFKQDSNALSRPV

SEQ ID NO: 25234 - protein, 25 aa, synthetic construct
  source 1..25: note = Seed: YGFLNVIVHSATGFKQSSKALQRPV
YGFLNVIVHSATGFKQDSNALTRPV

SEQ ID NO: 25235 - protein, 25 aa, synthetic construct
  source 1..25: note = Seed: YGFLNVIVHSATGFKQSSKALQRPV
YGFLNVIVHSATGFKQDSNALVRPV

SEQ ID NO: 25236 - protein, 25 aa, synthetic construct
  source 1..25: note = Seed: YGFLNVIVHSATGFKQSSKALQRPV
YGFLNVIVHSATGFKQDSPALARPV

SEQ ID NO: 25237 - protein, 25 aa, synthetic construct
  source 1..25: note = Seed: YGFLNVIVHSATGFKQSSKALQRPV
YGFLNVIVHSATGFKQDSSALARPV

SEQ ID NO: 25238 - protein, 25 aa, synthetic construct
  source 1..25: note = Seed: YGFLNVIVHSATGFKQSSKALQRPV
YGFLNVIVHSATGFKQDSSALGRPV

SEQ ID NO: 25239 - protein, 25 aa, synthetic construct
  source 1..25: note = Seed: YGFLNVIVHSATGFKQSSKALQRPV
YGFLNVIVHSATGFKQDSSALQRPV

SEQ ID NO: 25240 - protein, 25 aa, synthetic construct
  source 1..25: note = Seed: YGFLNVIVHSATGFKQSSKALQRPV
YGFLNVIVHSATGFKQDSSALSRPV

SEQ ID NO: 25241 - protein, 25 aa, synthetic construct
  source 1..25: note = Seed: YGFLNVIVHSATGFKQSSKALQRPV
YGFLNVIVHSATGFKQDSTALARPV

SEQ ID NO: 25242 - protein, 25 aa, synthetic construct
  source 1..25: note = Seed: YGFLNVIVHSATGFKQSSKALQRPV
YGFLNVIVHSATGFKQDSTALGRPV

SEQ ID NO: 25243 - protein, 25 aa, synthetic construct
  source 1..25: note = Seed: YGFLNVIVHSATGFKQSSKALQRPV
YGFLNVIVHSATGFKQDSTALHRPV

SEQ ID NO: 25244 - protein, 25 aa, synthetic construct
  source 1..25: note = Seed: YGFLNVIVHSATGFKQSSKALQRPV
YGFLNVIVHSATGFKQDSTALIRPV

SEQ ID NO: 25245 - protein, 25 aa, synthetic construct
  source 1..25: note = Seed: YGFLNVIVHSATGFKQSSKALQRPV
YGFLNVIVHSATGFKQDSTALMRPV

SEQ ID NO: 25246 - protein, 25 aa, synthetic construct
  source 1..25: note = Seed: YGFLNVIVHSATGFKQSSKALQRPV
YGFLNVIVHSATGFKQDSTALNRPV

SEQ ID NO: 25247 - protein, 25 aa, synthetic construct
  source 1..25: note = Seed: YGFLNVIVHSATGFKQSSKALQRPV
YGFLNVIVHSATGFKQDSTALQRPV

SEQ ID NO: 25248 - protein, 25 aa, synthetic construct
  source 1..25: note = Seed: YGFLNVIVHSATGFKQSSKALQRPV
YGFLNVIVHSATGFKQDSTALSRPV

SEQ ID NO: 25249 - protein, 25 aa, synthetic construct
  source 1..25: note = Seed: YGFLNVIVHSATGFKQSSKALQRPV
YGFLNVIVHSATGFKQDSTALTRPV

SEQ ID NO: 25250 - protein, 25 aa, synthetic construct
  source 1..25: note = Seed: YGFLNVIVHSATGFKQSSKALQRPV
YGFLNVIVHSATGFKQDSTALVRPV

SEQ ID NO: 25251 - protein, 25 aa, synthetic construct
  source 1..25: note = Seed: YGFLNVIVHSATGFKQSSKALQRPV
YGFLNVIVHSATGFKQDSVALARPV

SEQ ID NO: 25252 - protein, 25 aa, synthetic construct
  source 1..25: note = Seed: YGFLNVIVHSATGFKQSSKALQRPV
YGFLNVIVHSATGFKQDSVALGRPV

SEQ ID NO: 25253 - protein, 25 aa, synthetic construct
  source 1..25: note = Seed: YGFLNVIVHSATGFKQSSKALQRPV
YGFLNVIVHSATGFKQDSVALSRPV

SEQ ID NO: 25254 - protein, 25 aa, synthetic construct
  source 1..25: note = Seed: YGFLNVIVHSATGFKQSSKALQRPV
YGFLNVIVHSATGFKQESAALARPV

SEQ ID NO: 25255 - protein, 25 aa, synthetic construct
  source 1..25: note = Seed: YGFLNVIVHSATGFKQSSKALQRPV
YGFLNVIVHSATGFKQESAALDRPV

SEQ ID NO: 25256 - protein, 25 aa, synthetic construct
  source 1..25: note = Seed: YGFLNVIVHSATGFKQSSKALQRPV
YGFLNVIVHSATGFKQESAALGRPV

SEQ ID NO: 25257 - protein, 25 aa, synthetic construct
  source 1..25: note = Seed: YGFLNVIVHSATGFKQSSKALQRPV
YGFLNVIVHSATGFKQESAALHRPV

SEQ ID NO: 25258 - protein, 25 aa, synthetic construct
  source 1..25: note = Seed: YGFLNVIVHSATGFKQSSKALQRPV
YGFLNVIVHSATGFKQESAALIRPV

SEQ ID NO: 25259 - protein, 25 aa, synthetic construct
  source 1..25: note = Seed: YGFLNVIVHSATGFKQSSKALQRPV
YGFLNVIVHSATGFKQESAALLRPV

SEQ ID NO: 25260 - protein, 25 aa, synthetic construct
  source 1..25: note = Seed: YGFLNVIVHSATGFKQSSKALQRPV
YGFLNVIVHSATGFKQESAALMRPV

SEQ ID NO: 25261 - protein, 25 aa, synthetic construct
  source 1..25: note = Seed: YGFLNVIVHSATGFKQSSKALQRPV
YGFLNVIVHSATGFKQESAALNRPV

SEQ ID NO: 25262 - protein, 25 aa, synthetic construct
  source 1..25: note = Seed: YGFLNVIVHSATGFKQSSKALQRPV
YGFLNVIVHSATGFKQESAALPRPV

SEQ ID NO: 25263 - protein, 25 aa, synthetic construct
  source 1..25: note = Seed: YGFLNVIVHSATGFKQSSKALQRPV
YGFLNVIVHSATGFKQESAALQRPV

SEQ ID NO: 25264 - protein, 25 aa, synthetic construct
  source 1..25: note = Seed: YGFLNVIVHSATGFKQSSKALQRPV
YGFLNVIVHSATGFKQESAALSRPV

SEQ ID NO: 25265 - protein, 25 aa, synthetic construct
  source 1..25: note = Seed: YGFLNVIVHSATGFKQSSKALQRPV
YGFLNVIVHSATGFKQESAALTRPV

SEQ ID NO: 25266 - protein, 25 aa, synthetic construct
  source 1..25: note = Seed: YGFLNVIVHSATGFKQSSKALQRPV
YGFLNVIVHSATGFKQESAALVRPV

SEQ ID NO: 25267 - protein, 25 aa, synthetic construct
  source 1..25: note = Seed: YGFLNVIVHSATGFKQSSKALQRPV
YGFLNVIVHSATGFKQESFALARPV

SEQ ID NO: 25268 - protein, 25 aa, synthetic construct
  source 1..25: note = Seed: YGFLNVIVHSATGFKQSSKALQRPV
YGFLNVIVHSATGFKQESFALDRPV

SEQ ID NO: 25269 - protein, 25 aa, synthetic construct
  source 1..25: note = Seed: YGFLNVIVHSATGFKQSSKALQRPV
YGFLNVIVHSATGFKQESFALERPV

SEQ ID NO: 25270 - protein, 25 aa, synthetic construct
  source 1..25: note = Seed: YGFLNVIVHSATGFKQSSKALQRPV
YGFLNVIVHSATGFKQESFALFRPV

SEQ ID NO: 25271 - protein, 25 aa, synthetic construct
  source 1..25: note = Seed: YGFLNVIVHSATGFKQSSKALQRPV
YGFLNVIVHSATGFKQESFALIRPV

SEQ ID NO: 25272 - protein, 25 aa, synthetic construct
  source 1..25: note = Seed: YGFLNVIVHSATGFKQSSKALQRPV
YGFLNVIVHSATGFKQESFALLRPV

SEQ ID NO: 25273 - protein, 25 aa, synthetic construct
  source 1..25: note = Seed: YGFLNVIVHSATGFKQSSKALQRPV
YGFLNVIVHSATGFKQESFALMRPV

SEQ ID NO: 25274 - protein, 25 aa, synthetic construct
  source 1..25: note = Seed: YGFLNVIVHSATGFKQSSKALQRPV
YGFLNVIVHSATGFKQESFALNRPV

SEQ ID NO: 25275 - protein, 25 aa, synthetic construct
  source 1..25: note = Seed: YGFLNVIVHSATGFKQSSKALQRPV
YGFLNVIVHSATGFKQESFALTRPV

SEQ ID NO: 25276 - protein, 25 aa, synthetic construct
  source 1..25: note = Seed: YGFLNVIVHSATGFKQSSKALQRPV
YGFLNVIVHSATGFKQESFALVRPV

SEQ ID NO: 25277 - protein, 25 aa, synthetic construct
  source 1..25: note = Seed: YGFLNVIVHSATGFKQSSKALQRPV
YGFLNVIVHSATGFKQESFALYRPV

SEQ ID NO: 25278 - protein, 25 aa, synthetic construct
  source 1..25: note = Seed: YGFLNVIVHSATGFKQSSKALQRPV
YGFLNVIVHSATGFKQESGALARPV

SEQ ID NO: 25279 - protein, 25 aa, synthetic construct
  source 1..25: note = Seed: YGFLNVIVHSATGFKQSSKALQRPV
YGFLNVIVHSATGFKQESGALNRPV

SEQ ID NO: 25280 - protein, 25 aa, synthetic construct
  source 1..25: note = Seed: YGFLNVIVHSATGFKQSSKALQRPV
YGFLNVIVHSATGFKQESGALSRPV

SEQ ID NO: 25281 - protein, 25 aa, synthetic construct
  source 1..25: note = Seed: YGFLNVIVHSATGFKQSSKALQRPV
YGFLNVIVHSATGFKQESIALARPV

SEQ ID NO: 25282 - protein, 25 aa, synthetic construct
  source 1..25: note = Seed: YGFLNVIVHSATGFKQSSKALQRPV
YGFLNVIVHSATGFKQESIALGRPV

SEQ ID NO: 25283 - protein, 25 aa, synthetic construct
  source 1..25: note = Seed: YGFLNVIVHSATGFKQSSKALQRPV
YGFLNVIVHSATGFKQESIALNRPV

SEQ ID NO: 25284 - protein, 25 aa, synthetic construct
  source 1..25: note = Seed: YGFLNVIVHSATGFKQSSKALQRPV
YGFLNVIVHSATGFKQESIALSRPV

SEQ ID NO: 25285 - protein, 25 aa, synthetic construct
  source 1..25: note = Seed: YGFLNVIVHSATGFKQSSKALQRPV
YGFLNVIVHSATGFKQESIALTRPV

SEQ ID NO: 25286 - protein, 25 aa, synthetic construct
  source 1..25: note = Seed: YGFLNVIVHSATGFKQSSKALQRPV
YGFLNVIVHSATGFKQESMALARPV

SEQ ID NO: 25287 - protein, 25 aa, synthetic construct
  source 1..25: note = Seed: YGFLNVIVHSATGFKQSSKALQRPV
YGFLNVIVHSATGFKQESNALARPV

SEQ ID NO: 25288 - protein, 25 aa, synthetic construct
  source 1..25: note = Seed: YGFLNVIVHSATGFKQSSKALQRPV
YGFLNVIVHSATGFKQESNALGRPV

SEQ ID NO: 25289 - protein, 25 aa, synthetic construct
  source 1..25: note = Seed: YGFLNVIVHSATGFKQSSKALQRPV
YGFLNVIVHSATGFKQESNALNRPV

SEQ ID NO: 25290 - protein, 25 aa, synthetic construct
  source 1..25: note = Seed: YGFLNVIVHSATGFKQSSKALQRPV
YGFLNVIVHSATGFKQESNALSRPV

SEQ ID NO: 25291 - protein, 25 aa, synthetic construct
  source 1..25: note = Seed: YGFLNVIVHSATGFKQSSKALQRPV
YGFLNVIVHSATGFKQESPALARPV

SEQ ID NO: 25292 - protein, 25 aa, synthetic construct
  source 1..25: note = Seed: YGFLNVIVHSATGFKQSSKALQRPV
YGFLNVIVHSATGFKQESPALGRPV

SEQ ID NO: 25293 - protein, 25 aa, synthetic construct
  source 1..25: note = Seed: YGFLNVIVHSATGFKQSSKALQRPV
YGFLNVIVHSATGFKQESPALHRPV

SEQ ID NO: 25294 - protein, 25 aa, synthetic construct
  source 1..25: note = Seed: YGFLNVIVHSATGFKQSSKALQRPV
YGFLNVIVHSATGFKQESPALIRPV

SEQ ID NO: 25295 - protein, 25 aa, synthetic construct
  source 1..25: note = Seed: YGFLNVIVHSATGFKQSSKALQRPV
YGFLNVIVHSATGFKQESPALLRPV

SEQ ID NO: 25296 - protein, 25 aa, synthetic construct
  source 1..25: note = Seed: YGFLNVIVHSATGFKQSSKALQRPV
YGFLNVIVHSATGFKQESPALMRPV

SEQ ID NO: 25297 - protein, 25 aa, synthetic construct
  source 1..25: note = Seed: YGFLNVIVHSATGFKQSSKALQRPV
YGFLNVIVHSATGFKQESPALNRPV

SEQ ID NO: 25298 - protein, 25 aa, synthetic construct
  source 1..25: note = Seed: YGFLNVIVHSATGFKQSSKALQRPV
YGFLNVIVHSATGFKQESPALQRPV

SEQ ID NO: 25299 - protein, 25 aa, synthetic construct
  source 1..25: note = Seed: YGFLNVIVHSATGFKQSSKALQRPV
YGFLNVIVHSATGFKQESPALSRPV

SEQ ID NO: 25300 - protein, 25 aa, synthetic construct
  source 1..25: note = Seed: YGFLNVIVHSATGFKQSSKALQRPV
YGFLNVIVHSATGFKQESPALTRPV

SEQ ID NO: 25301 - protein, 25 aa, synthetic construct
  source 1..25: note = Seed: YGFLNVIVHSATGFKQSSKALQRPV
YGFLNVIVHSATGFKQESPALVRPV

SEQ ID NO: 25302 - protein, 25 aa, synthetic construct
  source 1..25: note = Seed: YGFLNVIVHSATGFKQSSKALQRPV
YGFLNVIVHSATGFKQESSALARPV

SEQ ID NO: 25303 - protein, 25 aa, synthetic construct
  source 1..25: note = Seed: YGFLNVIVHSATGFKQSSKALQRPV
YGFLNVIVHSATGFKQESSALGRPV

SEQ ID NO: 25304 - protein, 25 aa, synthetic construct
  source 1..25: note = Seed: YGFLNVIVHSATGFKQSSKALQRPV
YGFLNVIVHSATGFKQESSALNRPV

SEQ ID NO: 25305 - protein, 25 aa, synthetic construct
  source 1..25: note = Seed: YGFLNVIVHSATGFKQSSKALQRPV
YGFLNVIVHSATGFKQESSALSRPV

SEQ ID NO: 25306 - protein, 25 aa, synthetic construct
  source 1..25: note = Seed: YGFLNVIVHSATGFKQSSKALQRPV
YGFLNVIVHSATGFKQESSALTRPV

SEQ ID NO: 25307 - protein, 25 aa, synthetic construct
  source 1..25: note = Seed: YGFLNVIVHSATGFKQSSKALQRPV
YGFLNVIVHSATGFKQESSALVRPV

SEQ ID NO: 25308 - protein, 25 aa, synthetic construct
  source 1..25: note = Seed: YGFLNVIVHSATGFKQSSKALQRPV
YGFLNVIVHSATGFKQESTALARPV

SEQ ID NO: 25309 - protein, 25 aa, synthetic construct
  source 1..25: note = Seed: YGFLNVIVHSATGFKQSSKALQRPV
YGFLNVIVHSATGFKQESTALGRPV

SEQ ID NO: 25310 - protein, 25 aa, synthetic construct
  source 1..25: note = Seed: YGFLNVIVHSATGFKQSSKALQRPV
YGFLNVIVHSATGFKQESTALHRPV

SEQ ID NO: 25311 - protein, 25 aa, synthetic construct
  source 1..25: note = Seed: YGFLNVIVHSATGFKQSSKALQRPV
YGFLNVIVHSATGFKQESTALIRPV

SEQ ID NO: 25312 - protein, 25 aa, synthetic construct
  source 1..25: note = Seed: YGFLNVIVHSATGFKQSSKALQRPV
YGFLNVIVHSATGFKQESTALMRPV

SEQ ID NO: 25313 - protein, 25 aa, synthetic construct
  source 1..25: note = Seed: YGFLNVIVHSATGFKQSSKALQRPV
YGFLNVIVHSATGFKQESTALNRPV

SEQ ID NO: 25314 - protein, 25 aa, synthetic construct
  source 1..25: note = Seed: YGFLNVIVHSATGFKQSSKALQRPV
YGFLNVIVHSATGFKQESTALQRPV

SEQ ID NO: 25315 - protein, 25 aa, synthetic construct
  source 1..25: note = Seed: YGFLNVIVHSATGFKQSSKALQRPV
YGFLNVIVHSATGFKQESTALSRPV

SEQ ID NO: 25316 - protein, 25 aa, synthetic construct
  source 1..25: note = Seed: YGFLNVIVHSATGFKQSSKALQRPV
YGFLNVIVHSATGFKQESTALTRPV

SEQ ID NO: 25317 - protein, 25 aa, synthetic construct
  source 1..25: note = Seed: YGFLNVIVHSATGFKQSSKALQRPV
YGFLNVIVHSATGFKQESTALVRPV

SEQ ID NO: 25318 - protein, 25 aa, synthetic construct
  source 1..25: note = Seed: YGFLNVIVHSATGFKQSSKALQRPV
YGFLNVIVHSATGFKQESVALARPV

SEQ ID NO: 25319 - protein, 25 aa, synthetic construct
  source 1..25: note = Seed: YGFLNVIVHSATGFKQSSKALQRPV
YGFLNVIVHSATGFKQESVALGRPV

SEQ ID NO: 25320 - protein, 25 aa, synthetic construct
  source 1..25: note = Seed: YGFLNVIVHSATGFKQSSKALQRPV
YGFLNVIVHSATGFKQESVALHRPV

SEQ ID NO: 25321 - protein, 25 aa, synthetic construct
  source 1..25: note = Seed: YGFLNVIVHSATGFKQSSKALQRPV
YGFLNVIVHSATGFKQESVALIRPV

SEQ ID NO: 25322 - protein, 25 aa, synthetic construct
  source 1..25: note = Seed: YGFLNVIVHSATGFKQSSKALQRPV
YGFLNVIVHSATGFKQESVALMRPV

SEQ ID NO: 25323 - protein, 25 aa, synthetic construct
  source 1..25: note = Seed: YGFLNVIVHSATGFKQSSKALQRPV
YGFLNVIVHSATGFKQESVALNRPV

SEQ ID NO: 25324 - protein, 25 aa, synthetic construct
  source 1..25: note = Seed: YGFLNVIVHSATGFKQSSKALQRPV
YGFLNVIVHSATGFKQESVALQRPV

SEQ ID NO: 25325 - protein, 25 aa, synthetic construct
  source 1..25: note = Seed: YGFLNVIVHSATGFKQSSKALQRPV
YGFLNVIVHSATGFKQESVALSRPV

SEQ ID NO: 25326 - protein, 25 aa, synthetic construct
  source 1..25: note = Seed: YGFLNVIVHSATGFKQSSKALQRPV
YGFLNVIVHSATGFKQESVALTRPV

SEQ ID NO: 25327 - protein, 25 aa, synthetic construct
  source 1..25: note = Seed: YGFLNVIVHSATGFKQSSKALQRPV
YGFLNVIVHSATGFKQESVALVRPV

SEQ ID NO: 25328 - protein, 25 aa, synthetic construct
  source 1..25: note = Seed: YGFLNVIVHSATGFKQSSKALQRPV
YGFLNVIVHSATGFKQESWALFRPV

SEQ ID NO: 25329 - protein, 25 aa, synthetic construct
  source 1..25: note = Seed: YGFLNVIVHSATGFKQSSKALQRPV
YGFLNVIVHSATGFKQESWALIRPV

SEQ ID NO: 25330 - protein, 25 aa, synthetic construct
  source 1..25: note = Seed: YGFLNVIVHSATGFKQSSKALQRPV
YGFLNVIVHSATGFKQESWALLRPV

SEQ ID NO: 25331 - protein, 25 aa, synthetic construct
  source 1..25: note = Seed: YGFLNVIVHSATGFKQSSKALQRPV
YGFLNVIVHSATGFKQESWALVRPV

SEQ ID NO: 25332 - protein, 25 aa, synthetic construct
  source 1..25: note = Seed: YGFLNVIVHSATGFKQSSKALQRPV
YGFLNVIVHSATGFKQESYALFRPV

SEQ ID NO: 25333 - protein, 25 aa, synthetic construct
  source 1..25: note = Seed: YGFLNVIVHSATGFKQSSKALQRPV
YGFLNVIVHSATGFKQESYALIRPV

SEQ ID NO: 25334 - protein, 25 aa, synthetic construct
  source 1..25: note = Seed: YGFLNVIVHSATGFKQSSKALQRPV
YGFLNVIVHSATGFKQESYALLRPV

SEQ ID NO: 25335 - protein, 25 aa, synthetic construct
  source 1..25: note = Seed: YGFLNVIVHSATGFKQSSKALQRPV
YGFLNVIVHSATGFKQFSAALARPV

SEQ ID NO: 25336 - protein, 25 aa, synthetic construct
  source 1..25: note = Seed: YGFLNVIVHSATGFKQSSKALQRPV
YGFLNVIVHSATGFKQFSAALCRPV

SEQ ID NO: 25337 - protein, 25 aa, synthetic construct
  source 1..25: note = Seed: YGFLNVIVHSATGFKQSSKALQRPV
YGFLNVIVHSATGFKQFSAALDRPV

SEQ ID NO: 25338 - protein, 25 aa, synthetic construct
  source 1..25: note = Seed: YGFLNVIVHSATGFKQSSKALQRPV
YGFLNVIVHSATGFKQFSAALERPV

SEQ ID NO: 25339 - protein, 25 aa, synthetic construct
  source 1..25: note = Seed: YGFLNVIVHSATGFKQSSKALQRPV
YGFLNVIVHSATGFKQFSAALFRPV

SEQ ID NO: 25340 - protein, 25 aa, synthetic construct
  source 1..25: note = Seed: YGFLNVIVHSATGFKQSSKALQRPV
YGFLNVIVHSATGFKQFSAALGRPV

SEQ ID NO: 25341 - protein, 25 aa, synthetic construct
  source 1..25: note = Seed: YGFLNVIVHSATGFKQSSKALQRPV
YGFLNVIVHSATGFKQFSAALHRPV

SEQ ID NO: 25342 - protein, 25 aa, synthetic construct
  source 1..25: note = Seed: YGFLNVIVHSATGFKQSSKALQRPV
YGFLNVIVHSATGFKQFSAALIRPV

SEQ ID NO: 25343 - protein, 25 aa, synthetic construct
  source 1..25: note = Seed: YGFLNVIVHSATGFKQSSKALQRPV
YGFLNVIVHSATGFKQFSAALLRPV

SEQ ID NO: 25344 - protein, 25 aa, synthetic construct
  source 1..25: note = Seed: YGFLNVIVHSATGFKQSSKALQRPV
YGFLNVIVHSATGFKQFSAALMRPV

SEQ ID NO: 25345 - protein, 25 aa, synthetic construct
  source 1..25: note = Seed: YGFLNVIVHSATGFKQSSKALQRPV
YGFLNVIVHSATGFKQFSAALNRPV

SEQ ID NO: 25346 - protein, 25 aa, synthetic construct
  source 1..25: note = Seed: YGFLNVIVHSATGFKQSSKALQRPV
YGFLNVIVHSATGFKQFSAALPRPV

SEQ ID NO: 25347 - protein, 25 aa, synthetic construct
  source 1..25: note = Seed: YGFLNVIVHSATGFKQSSKALQRPV
YGFLNVIVHSATGFKQFSAALQRPV

SEQ ID NO: 25348 - protein, 25 aa, synthetic construct
  source 1..25: note = Seed: YGFLNVIVHSATGFKQSSKALQRPV
YGFLNVIVHSATGFKQFSAALSRPV

SEQ ID NO: 25349 - protein, 25 aa, synthetic construct
  source 1..25: note = Seed: YGFLNVIVHSATGFKQSSKALQRPV
YGFLNVIVHSATGFKQFSAALTRPV

SEQ ID NO: 25350 - protein, 25 aa, synthetic construct
  source 1..25: note = Seed: YGFLNVIVHSATGFKQSSKALQRPV
YGFLNVIVHSATGFKQFSAALVRPV

SEQ ID NO: 25351 - protein, 25 aa, synthetic construct
  source 1..25: note = Seed: YGFLNVIVHSATGFKQSSKALQRPV
YGFLNVIVHSATGFKQFSAALWRPV

SEQ ID NO: 25352 - protein, 25 aa, synthetic construct
  source 1..25: note = Seed: YGFLNVIVHSATGFKQSSKALQRPV
YGFLNVIVHSATGFKQFSAALYRPV

SEQ ID NO: 25353 - protein, 25 aa, synthetic construct
  source 1..25: note = Seed: YGFLNVIVHSATGFKQSSKALQRPV
YGFLNVIVHSATGFKQFSDALFRPV

SEQ ID NO: 25354 - protein, 25 aa, synthetic construct
  source 1..25: note = Seed: YGFLNVIVHSATGFKQSSKALQRPV
YGFLNVIVHSATGFKQFSEALARPV

SEQ ID NO: 25355 - protein, 25 aa, synthetic construct
  source 1..25: note = Seed: YGFLNVIVHSATGFKQSSKALQRPV
YGFLNVIVHSATGFKQFSEALFRPV

SEQ ID NO: 25356 - protein, 25 aa, synthetic construct
  source 1..25: note = Seed: YGFLNVIVHSATGFKQSSKALQRPV
YGFLNVIVHSATGFKQFSFALARPV

SEQ ID NO: 25357 - protein, 25 aa, synthetic construct
  source 1..25: note = Seed: YGFLNVIVHSATGFKQSSKALQRPV
YGFLNVIVHSATGFKQFSFALDRPV

SEQ ID NO: 25358 - protein, 25 aa, synthetic construct
  source 1..25: note = Seed: YGFLNVIVHSATGFKQSSKALQRPV
YGFLNVIVHSATGFKQFSFALERPV

SEQ ID NO: 25359 - protein, 25 aa, synthetic construct
  source 1..25: note = Seed: YGFLNVIVHSATGFKQSSKALQRPV
YGFLNVIVHSATGFKQFSFALFRPV

SEQ ID NO: 25360 - protein, 25 aa, synthetic construct
  source 1..25: note = Seed: YGFLNVIVHSATGFKQSSKALQRPV
YGFLNVIVHSATGFKQFSFALHRPV

SEQ ID NO: 25361 - protein, 25 aa, synthetic construct
  source 1..25: note = Seed: YGFLNVIVHSATGFKQSSKALQRPV
YGFLNVIVHSATGFKQFSFALIRPV

SEQ ID NO: 25362 - protein, 25 aa, synthetic construct
  source 1..25: note = Seed: YGFLNVIVHSATGFKQSSKALQRPV
YGFLNVIVHSATGFKQFSFALKRPV

SEQ ID NO: 25363 - protein, 25 aa, synthetic construct
  source 1..25: note = Seed: YGFLNVIVHSATGFKQSSKALQRPV
YGFLNVIVHSATGFKQFSFALLRPV

SEQ ID NO: 25364 - protein, 25 aa, synthetic construct
  source 1..25: note = Seed: YGFLNVIVHSATGFKQSSKALQRPV
YGFLNVIVHSATGFKQFSFALMRPV

SEQ ID NO: 25365 - protein, 25 aa, synthetic construct
  source 1..25: note = Seed: YGFLNVIVHSATGFKQSSKALQRPV
YGFLNVIVHSATGFKQFSFALNRPV

SEQ ID NO: 25366 - protein, 25 aa, synthetic construct
  source 1..25: note = Seed: YGFLNVIVHSATGFKQSSKALQRPV
YGFLNVIVHSATGFKQFSFALPRPV

SEQ ID NO: 25367 - protein, 25 aa, synthetic construct
  source 1..25: note = Seed: YGFLNVIVHSATGFKQSSKALQRPV
YGFLNVIVHSATGFKQFSFALQRPV

SEQ ID NO: 25368 - protein, 25 aa, synthetic construct
  source 1..25: note = Seed: YGFLNVIVHSATGFKQSSKALQRPV
YGFLNVIVHSATGFKQFSFALRRPV

SEQ ID NO: 25369 - protein, 25 aa, synthetic construct
  source 1..25: note = Seed: YGFLNVIVHSATGFKQSSKALQRPV
YGFLNVIVHSATGFKQFSFALSRPV

SEQ ID NO: 25370 - protein, 25 aa, synthetic construct
  source 1..25: note = Seed: YGFLNVIVHSATGFKQSSKALQRPV
YGFLNVIVHSATGFKQFSFALTRPV

SEQ ID NO: 25371 - protein, 25 aa, synthetic construct
  source 1..25: note = Seed: YGFLNVIVHSATGFKQSSKALQRPV
YGFLNVIVHSATGFKQFSFALVRPV

SEQ ID NO: 25372 - protein, 25 aa, synthetic construct
  source 1..25: note = Seed: YGFLNVIVHSATGFKQSSKALQRPV
YGFLNVIVHSATGFKQFSFALWRPV

SEQ ID NO: 25373 - protein, 25 aa, synthetic construct
  source 1..25: note = Seed: YGFLNVIVHSATGFKQSSKALQRPV
YGFLNVIVHSATGFKQFSFALYRPV

SEQ ID NO: 25374 - protein, 25 aa, synthetic construct
  source 1..25: note = Seed: YGFLNVIVHSATGFKQSSKALQRPV
YGFLNVIVHSATGFKQFSGALARPV

SEQ ID NO: 25375 - protein, 25 aa, synthetic construct
  source 1..25: note = Seed: YGFLNVIVHSATGFKQSSKALQRPV
YGFLNVIVHSATGFKQFSGALGRPV

SEQ ID NO: 25376 - protein, 25 aa, synthetic construct
  source 1..25: note = Seed: YGFLNVIVHSATGFKQSSKALQRPV
YGFLNVIVHSATGFKQFSGALIRPV

SEQ ID NO: 25377 - protein, 25 aa, synthetic construct
  source 1..25: note = Seed: YGFLNVIVHSATGFKQSSKALQRPV
YGFLNVIVHSATGFKQFSGALLRPV

SEQ ID NO: 25378 - protein, 25 aa, synthetic construct
  source 1..25: note = Seed: YGFLNVIVHSATGFKQSSKALQRPV
YGFLNVIVHSATGFKQFSGALMRPV

SEQ ID NO: 25379 - protein, 25 aa, synthetic construct
  source 1..25: note = Seed: YGFLNVIVHSATGFKQSSKALQRPV
YGFLNVIVHSATGFKQFSGALNRPV

SEQ ID NO: 25380 - protein, 25 aa, synthetic construct
  source 1..25: note = Seed: YGFLNVIVHSATGFKQSSKALQRPV
YGFLNVIVHSATGFKQFSGALSRPV

SEQ ID NO: 25381 - protein, 25 aa, synthetic construct
  source 1..25: note = Seed: YGFLNVIVHSATGFKQSSKALQRPV
YGFLNVIVHSATGFKQFSGALTRPV

SEQ ID NO: 25382 - protein, 25 aa, synthetic construct
  source 1..25: note = Seed: YGFLNVIVHSATGFKQSSKALQRPV
YGFLNVIVHSATGFKQFSGALVRPV

SEQ ID NO: 25383 - protein, 25 aa, synthetic construct
  source 1..25: note = Seed: YGFLNVIVHSATGFKQSSKALQRPV
YGFLNVIVHSATGFKQFSGALYRPV

SEQ ID NO: 25384 - protein, 25 aa, synthetic construct
  source 1..25: note = Seed: YGFLNVIVHSATGFKQSSKALQRPV
YGFLNVIVHSATGFKQFSHALARPV

SEQ ID NO: 25385 - protein, 25 aa, synthetic construct
  source 1..25: note = Seed: YGFLNVIVHSATGFKQSSKALQRPV
YGFLNVIVHSATGFKQFSHALFRPV

SEQ ID NO: 25386 - protein, 25 aa, synthetic construct
  source 1..25: note = Seed: YGFLNVIVHSATGFKQSSKALQRPV
YGFLNVIVHSATGFKQFSHALNRPV

SEQ ID NO: 25387 - protein, 25 aa, synthetic construct
  source 1..25: note = Seed: YGFLNVIVHSATGFKQSSKALQRPV
YGFLNVIVHSATGFKQFSHALSRPV

SEQ ID NO: 25388 - protein, 25 aa, synthetic construct
  source 1..25: note = Seed: YGFLNVIVHSATGFKQSSKALQRPV
YGFLNVIVHSATGFKQFSHALTRPV

SEQ ID NO: 25389 - protein, 25 aa, synthetic construct
  source 1..25: note = Seed: YGFLNVIVHSATGFKQSSKALQRPV
YGFLNVIVHSATGFKQFSHALVRPV

SEQ ID NO: 25390 - protein, 25 aa, synthetic construct
  source 1..25: note = Seed: YGFLNVIVHSATGFKQSSKALQRPV
YGFLNVIVHSATGFKQFSHALYRPV

SEQ ID NO: 25391 - protein, 25 aa, synthetic construct
  source 1..25: note = Seed: YGFLNVIVHSATGFKQSSKALQRPV
YGFLNVIVHSATGFKQFSIALARPV

SEQ ID NO: 25392 - protein, 25 aa, synthetic construct
  source 1..25: note = Seed: YGFLNVIVHSATGFKQSSKALQRPV
YGFLNVIVHSATGFKQFSIALDRPV

SEQ ID NO: 25393 - protein, 25 aa, synthetic construct
  source 1..25: note = Seed: YGFLNVIVHSATGFKQSSKALQRPV
YGFLNVIVHSATGFKQFSIALERPV

SEQ ID NO: 25394 - protein, 25 aa, synthetic construct
  source 1..25: note = Seed: YGFLNVIVHSATGFKQSSKALQRPV
YGFLNVIVHSATGFKQFSIALFRPV

SEQ ID NO: 25395 - protein, 25 aa, synthetic construct
  source 1..25: note = Seed: YGFLNVIVHSATGFKQSSKALQRPV
YGFLNVIVHSATGFKQFSIALGRPV

SEQ ID NO: 25396 - protein, 25 aa, synthetic construct
  source 1..25: note = Seed: YGFLNVIVHSATGFKQSSKALQRPV
YGFLNVIVHSATGFKQFSIALHRPV

SEQ ID NO: 25397 - protein, 25 aa, synthetic construct
  source 1..25: note = Seed: YGFLNVIVHSATGFKQSSKALQRPV
YGFLNVIVHSATGFKQFSIALIRPV

SEQ ID NO: 25398 - protein, 25 aa, synthetic construct
  source 1..25: note = Seed: YGFLNVIVHSATGFKQSSKALQRPV
YGFLNVIVHSATGFKQFSIALLRPV

SEQ ID NO: 25399 - protein, 25 aa, synthetic construct
  source 1..25: note = Seed: YGFLNVIVHSATGFKQSSKALQRPV
YGFLNVIVHSATGFKQFSIALMRPV

SEQ ID NO: 25400 - protein, 25 aa, synthetic construct
  source 1..25: note = Seed: YGFLNVIVHSATGFKQSSKALQRPV
YGFLNVIVHSATGFKQFSIALNRPV

SEQ ID NO: 25401 - protein, 25 aa, synthetic construct
  source 1..25: note = Seed: YGFLNVIVHSATGFKQSSKALQRPV
YGFLNVIVHSATGFKQFSIALPRPV

SEQ ID NO: 25402 - protein, 25 aa, synthetic construct
  source 1..25: note = Seed: YGFLNVIVHSATGFKQSSKALQRPV
YGFLNVIVHSATGFKQFSIALQRPV

SEQ ID NO: 25403 - protein, 25 aa, synthetic construct
  source 1..25: note = Seed: YGFLNVIVHSATGFKQSSKALQRPV
YGFLNVIVHSATGFKQFSIALSRPV

SEQ ID NO: 25404 - protein, 25 aa, synthetic construct
  source 1..25: note = Seed: YGFLNVIVHSATGFKQSSKALQRPV
YGFLNVIVHSATGFKQFSIALTRPV

SEQ ID NO: 25405 - protein, 25 aa, synthetic construct
  source 1..25: note = Seed: YGFLNVIVHSATGFKQSSKALQRPV
YGFLNVIVHSATGFKQFSIALVRPV

SEQ ID NO: 25406 - protein, 25 aa, synthetic construct
  source 1..25: note = Seed: YGFLNVIVHSATGFKQSSKALQRPV
YGFLNVIVHSATGFKQFSIALWRPV

SEQ ID NO: 25407 - protein, 25 aa, synthetic construct
  source 1..25: note = Seed: YGFLNVIVHSATGFKQSSKALQRPV
YGFLNVIVHSATGFKQFSIALYRPV

SEQ ID NO: 25408 - protein, 25 aa, synthetic construct
  source 1..25: note = Seed: YGFLNVIVHSATGFKQSSKALQRPV
YGFLNVIVHSATGFKQFSKALARPV

SEQ ID NO: 25409 - protein, 25 aa, synthetic construct
  source 1..25: note = Seed: YGFLNVIVHSATGFKQSSKALQRPV
YGFLNVIVHSATGFKQFSKALFRPV

SEQ ID NO: 25410 - protein, 25 aa, synthetic construct
  source 1..25: note = Seed: YGFLNVIVHSATGFKQSSKALQRPV
YGFLNVIVHSATGFKQFSKALGRPV

SEQ ID NO: 25411 - protein, 25 aa, synthetic construct
  source 1..25: note = Seed: YGFLNVIVHSATGFKQSSKALQRPV
YGFLNVIVHSATGFKQFSKALHRPV

SEQ ID NO: 25412 - protein, 25 aa, synthetic construct
  source 1..25: note = Seed: YGFLNVIVHSATGFKQSSKALQRPV
YGFLNVIVHSATGFKQFSKALKRPV

SEQ ID NO: 25413 - protein, 25 aa, synthetic construct
  source 1..25: note = Seed: YGFLNVIVHSATGFKQSSKALQRPV
YGFLNVIVHSATGFKQFSKALNRPV

SEQ ID NO: 25414 - protein, 25 aa, synthetic construct
  source 1..25: note = Seed: YGFLNVIVHSATGFKQSSKALQRPV
YGFLNVIVHSATGFKQFSKALQRPV

SEQ ID NO: 25415 - protein, 25 aa, synthetic construct
  source 1..25: note = Seed: YGFLNVIVHSATGFKQSSKALQRPV
YGFLNVIVHSATGFKQFSKALRRPV

SEQ ID NO: 25416 - protein, 25 aa, synthetic construct
  source 1..25: note = Seed: YGFLNVIVHSATGFKQSSKALQRPV
YGFLNVIVHSATGFKQFSKALSRPV

SEQ ID NO: 25417 - protein, 25 aa, synthetic construct
  source 1..25: note = Seed: YGFLNVIVHSATGFKQSSKALQRPV
YGFLNVIVHSATGFKQFSKALTRPV

SEQ ID NO: 25418 - protein, 25 aa, synthetic construct
  source 1..25: note = Seed: YGFLNVIVHSATGFKQSSKALQRPV
YGFLNVIVHSATGFKQFSLALARPV

SEQ ID NO: 25419 - protein, 25 aa, synthetic construct
  source 1..25: note = Seed: YGFLNVIVHSATGFKQSSKALQRPV
YGFLNVIVHSATGFKQFSLALFRPV

SEQ ID NO: 25420 - protein, 25 aa, synthetic construct
  source 1..25: note = Seed: YGFLNVIVHSATGFKQSSKALQRPV
YGFLNVIVHSATGFKQFSLALGRPV

SEQ ID NO: 25421 - protein, 25 aa, synthetic construct
  source 1..25: note = Seed: YGFLNVIVHSATGFKQSSKALQRPV
YGFLNVIVHSATGFKQFSLALHRPV

SEQ ID NO: 25422 - protein, 25 aa, synthetic construct
  source 1..25: note = Seed: YGFLNVIVHSATGFKQSSKALQRPV
YGFLNVIVHSATGFKQFSLALIRPV

SEQ ID NO: 25423 - protein, 25 aa, synthetic construct
  source 1..25: note = Seed: YGFLNVIVHSATGFKQSSKALQRPV
YGFLNVIVHSATGFKQFSLALLRPV

SEQ ID NO: 25424 - protein, 25 aa, synthetic construct
  source 1..25: note = Seed: YGFLNVIVHSATGFKQSSKALQRPV
YGFLNVIVHSATGFKQFSLALMRPV

SEQ ID NO: 25425 - protein, 25 aa, synthetic construct
  source 1..25: note = Seed: YGFLNVIVHSATGFKQSSKALQRPV
YGFLNVIVHSATGFKQFSLALNRPV

SEQ ID NO: 25426 - protein, 25 aa, synthetic construct
  source 1..25: note = Seed: YGFLNVIVHSATGFKQSSKALQRPV
YGFLNVIVHSATGFKQFSLALSRPV

SEQ ID NO: 25427 - protein, 25 aa, synthetic construct
  source 1..25: note = Seed: YGFLNVIVHSATGFKQSSKALQRPV
YGFLNVIVHSATGFKQFSLALTRPV

SEQ ID NO: 25428 - protein, 25 aa, synthetic construct
  source 1..25: note = Seed: YGFLNVIVHSATGFKQSSKALQRPV
YGFLNVIVHSATGFKQFSLALVRPV

SEQ ID NO: 25429 - protein, 25 aa, synthetic construct
  source 1..25: note = Seed: YGFLNVIVHSATGFKQSSKALQRPV
YGFLNVIVHSATGFKQFSLALWRPV

SEQ ID NO: 25430 - protein, 25 aa, synthetic construct
  source 1..25: note = Seed: YGFLNVIVHSATGFKQSSKALQRPV
YGFLNVIVHSATGFKQFSLALYRPV

SEQ ID NO: 25431 - protein, 25 aa, synthetic construct
  source 1..25: note = Seed: YGFLNVIVHSATGFKQSSKALQRPV
YGFLNVIVHSATGFKQFSMALARPV

SEQ ID NO: 25432 - protein, 25 aa, synthetic construct
  source 1..25: note = Seed: YGFLNVIVHSATGFKQSSKALQRPV
YGFLNVIVHSATGFKQFSMALFRPV

SEQ ID NO: 25433 - protein, 25 aa, synthetic construct
  source 1..25: note = Seed: YGFLNVIVHSATGFKQSSKALQRPV
YGFLNVIVHSATGFKQFSMALGRPV

SEQ ID NO: 25434 - protein, 25 aa, synthetic construct
  source 1..25: note = Seed: YGFLNVIVHSATGFKQSSKALQRPV
YGFLNVIVHSATGFKQFSMALHRPV

SEQ ID NO: 25435 - protein, 25 aa, synthetic construct
  source 1..25: note = Seed: YGFLNVIVHSATGFKQSSKALQRPV
YGFLNVIVHSATGFKQFSMALIRPV

SEQ ID NO: 25436 - protein, 25 aa, synthetic construct
  source 1..25: note = Seed: YGFLNVIVHSATGFKQSSKALQRPV
YGFLNVIVHSATGFKQFSMALLRPV

SEQ ID NO: 25437 - protein, 25 aa, synthetic construct
  source 1..25: note = Seed: YGFLNVIVHSATGFKQSSKALQRPV
YGFLNVIVHSATGFKQFSMALMRPV

SEQ ID NO: 25438 - protein, 25 aa, synthetic construct
  source 1..25: note = Seed: YGFLNVIVHSATGFKQSSKALQRPV
YGFLNVIVHSATGFKQFSMALNRPV

SEQ ID NO: 25439 - protein, 25 aa, synthetic construct
  source 1..25: note = Seed: YGFLNVIVHSATGFKQSSKALQRPV
YGFLNVIVHSATGFKQFSMALSRPV

SEQ ID NO: 25440 - protein, 25 aa, synthetic construct
  source 1..25: note = Seed: YGFLNVIVHSATGFKQSSKALQRPV
YGFLNVIVHSATGFKQFSMALVRPV

SEQ ID NO: 25441 - protein, 25 aa, synthetic construct
  source 1..25: note = Seed: YGFLNVIVHSATGFKQSSKALQRPV
YGFLNVIVHSATGFKQFSMALWRPV

SEQ ID NO: 25442 - protein, 25 aa, synthetic construct
  source 1..25: note = Seed: YGFLNVIVHSATGFKQSSKALQRPV
YGFLNVIVHSATGFKQFSMALYRPV

SEQ ID NO: 25443 - protein, 25 aa, synthetic construct
  source 1..25: note = Seed: YGFLNVIVHSATGFKQSSKALQRPV
YGFLNVIVHSATGFKQFSNALARPV

SEQ ID NO: 25444 - protein, 25 aa, synthetic construct
  source 1..25: note = Seed: YGFLNVIVHSATGFKQSSKALQRPV
YGFLNVIVHSATGFKQFSNALFRPV

SEQ ID NO: 25445 - protein, 25 aa, synthetic construct
  source 1..25: note = Seed: YGFLNVIVHSATGFKQSSKALQRPV
YGFLNVIVHSATGFKQFSNALGRPV

SEQ ID NO: 25446 - protein, 25 aa, synthetic construct
  source 1..25: note = Seed: YGFLNVIVHSATGFKQSSKALQRPV
YGFLNVIVHSATGFKQFSNALIRPV

SEQ ID NO: 25447 - protein, 25 aa, synthetic construct
  source 1..25: note = Seed: YGFLNVIVHSATGFKQSSKALQRPV
YGFLNVIVHSATGFKQFSNALNRPV

SEQ ID NO: 25448 - protein, 25 aa, synthetic construct
  source 1..25: note = Seed: YGFLNVIVHSATGFKQSSKALQRPV
YGFLNVIVHSATGFKQFSNALSRPV

SEQ ID NO: 25449 - protein, 25 aa, synthetic construct
  source 1..25: note = Seed: YGFLNVIVHSATGFKQSSKALQRPV
YGFLNVIVHSATGFKQFSNALTRPV

SEQ ID NO: 25450 - protein, 25 aa, synthetic construct
  source 1..25: note = Seed: YGFLNVIVHSATGFKQSSKALQRPV
YGFLNVIVHSATGFKQFSNALVRPV

SEQ ID NO: 25451 - protein, 25 aa, synthetic construct
  source 1..25: note = Seed: YGFLNVIVHSATGFKQSSKALQRPV
YGFLNVIVHSATGFKQFSPALARPV

SEQ ID NO: 25452 - protein, 25 aa, synthetic construct
  source 1..25: note = Seed: YGFLNVIVHSATGFKQSSKALQRPV
YGFLNVIVHSATGFKQFSPALCRPV

SEQ ID NO: 25453 - protein, 25 aa, synthetic construct
  source 1..25: note = Seed: YGFLNVIVHSATGFKQSSKALQRPV
YGFLNVIVHSATGFKQFSPALDRPV

SEQ ID NO: 25454 - protein, 25 aa, synthetic construct
  source 1..25: note = Seed: YGFLNVIVHSATGFKQSSKALQRPV
YGFLNVIVHSATGFKQFSPALERPV

SEQ ID NO: 25455 - protein, 25 aa, synthetic construct
  source 1..25: note = Seed: YGFLNVIVHSATGFKQSSKALQRPV
YGFLNVIVHSATGFKQFSPALFRPV

SEQ ID NO: 25456 - protein, 25 aa, synthetic construct
  source 1..25: note = Seed: YGFLNVIVHSATGFKQSSKALQRPV
YGFLNVIVHSATGFKQFSPALGRPV

SEQ ID NO: 25457 - protein, 25 aa, synthetic construct
  source 1..25: note = Seed: YGFLNVIVHSATGFKQSSKALQRPV
YGFLNVIVHSATGFKQFSPALHRPV

SEQ ID NO: 25458 - protein, 25 aa, synthetic construct
  source 1..25: note = Seed: YGFLNVIVHSATGFKQSSKALQRPV
YGFLNVIVHSATGFKQFSPALIRPV

SEQ ID NO: 25459 - protein, 25 aa, synthetic construct
  source 1..25: note = Seed: YGFLNVIVHSATGFKQSSKALQRPV
YGFLNVIVHSATGFKQFSPALLRPV

SEQ ID NO: 25460 - protein, 25 aa, synthetic construct
  source 1..25: note = Seed: YGFLNVIVHSATGFKQSSKALQRPV
YGFLNVIVHSATGFKQFSPALMRPV

SEQ ID NO: 25461 - protein, 25 aa, synthetic construct
  source 1..25: note = Seed: YGFLNVIVHSATGFKQSSKALQRPV
YGFLNVIVHSATGFKQFSPALNRPV

SEQ ID NO: 25462 - protein, 25 aa, synthetic construct
  source 1..25: note = Seed: YGFLNVIVHSATGFKQSSKALQRPV
YGFLNVIVHSATGFKQFSPALPRPV

SEQ ID NO: 25463 - protein, 25 aa, synthetic construct
  source 1..25: note = Seed: YGFLNVIVHSATGFKQSSKALQRPV
YGFLNVIVHSATGFKQFSPALQRPV

SEQ ID NO: 25464 - protein, 25 aa, synthetic construct
  source 1..25: note = Seed: YGFLNVIVHSATGFKQSSKALQRPV
YGFLNVIVHSATGFKQFSPALSRPV

SEQ ID NO: 25465 - protein, 25 aa, synthetic construct
  source 1..25: note = Seed: YGFLNVIVHSATGFKQSSKALQRPV
YGFLNVIVHSATGFKQFSPALTRPV

SEQ ID NO: 25466 - protein, 25 aa, synthetic construct
  source 1..25: note = Seed: YGFLNVIVHSATGFKQSSKALQRPV
YGFLNVIVHSATGFKQFSPALVRPV

SEQ ID NO: 25467 - protein, 25 aa, synthetic construct
  source 1..25: note = Seed: YGFLNVIVHSATGFKQSSKALQRPV
YGFLNVIVHSATGFKQFSQALARPV

SEQ ID NO: 25468 - protein, 25 aa, synthetic construct
  source 1..25: note = Seed: YGFLNVIVHSATGFKQSSKALQRPV
YGFLNVIVHSATGFKQFSQALFRPV

SEQ ID NO: 25469 - protein, 25 aa, synthetic construct
  source 1..25: note = Seed: YGFLNVIVHSATGFKQSSKALQRPV
YGFLNVIVHSATGFKQFSQALSRPV

SEQ ID NO: 25470 - protein, 25 aa, synthetic construct
  source 1..25: note = Seed: YGFLNVIVHSATGFKQSSKALQRPV
YGFLNVIVHSATGFKQFSRALARPV

SEQ ID NO: 25471 - protein, 25 aa, synthetic construct
  source 1..25: note = Seed: YGFLNVIVHSATGFKQSSKALQRPV
YGFLNVIVHSATGFKQFSRALFRPV

SEQ ID NO: 25472 - protein, 25 aa, synthetic construct
  source 1..25: note = Seed: YGFLNVIVHSATGFKQSSKALQRPV
YGFLNVIVHSATGFKQFSRALGRPV

SEQ ID NO: 25473 - protein, 25 aa, synthetic construct
  source 1..25: note = Seed: YGFLNVIVHSATGFKQSSKALQRPV
YGFLNVIVHSATGFKQFSRALHRPV

SEQ ID NO: 25474 - protein, 25 aa, synthetic construct
  source 1..25: note = Seed: YGFLNVIVHSATGFKQSSKALQRPV
YGFLNVIVHSATGFKQFSRALKRPV

SEQ ID NO: 25475 - protein, 25 aa, synthetic construct
  source 1..25: note = Seed: YGFLNVIVHSATGFKQSSKALQRPV
YGFLNVIVHSATGFKQFSRALNRPV

SEQ ID NO: 25476 - protein, 25 aa, synthetic construct
  source 1..25: note = Seed: YGFLNVIVHSATGFKQSSKALQRPV
YGFLNVIVHSATGFKQFSRALQRPV

SEQ ID NO: 25477 - protein, 25 aa, synthetic construct
  source 1..25: note = Seed: YGFLNVIVHSATGFKQSSKALQRPV
YGFLNVIVHSATGFKQFSRALRRPV

SEQ ID NO: 25478 - protein, 25 aa, synthetic construct
  source 1..25: note = Seed: YGFLNVIVHSATGFKQSSKALQRPV
YGFLNVIVHSATGFKQFSRALSRPV

SEQ ID NO: 25479 - protein, 25 aa, synthetic construct
  source 1..25: note = Seed: YGFLNVIVHSATGFKQSSKALQRPV
YGFLNVIVHSATGFKQFSRALTRPV

SEQ ID NO: 25480 - protein, 25 aa, synthetic construct
  source 1..25: note = Seed: YGFLNVIVHSATGFKQSSKALQRPV
YGFLNVIVHSATGFKQFSRALVRPV

SEQ ID NO: 25481 - protein, 25 aa, synthetic construct
  source 1..25: note = Seed: YGFLNVIVHSATGFKQSSKALQRPV
YGFLNVIVHSATGFKQFSRALYRPV

SEQ ID NO: 25482 - protein, 25 aa, synthetic construct
  source 1..25: note = Seed: YGFLNVIVHSATGFKQSSKALQRPV
YGFLNVIVHSATGFKQFSSALARPV

SEQ ID NO: 25483 - protein, 25 aa, synthetic construct
  source 1..25: note = Seed: YGFLNVIVHSATGFKQSSKALQRPV
YGFLNVIVHSATGFKQFSSALGRPV

SEQ ID NO: 25484 - protein, 25 aa, synthetic construct
  source 1..25: note = Seed: YGFLNVIVHSATGFKQSSKALQRPV
YGFLNVIVHSATGFKQFSSALHRPV

SEQ ID NO: 25485 - protein, 25 aa, synthetic construct
  source 1..25: note = Seed: YGFLNVIVHSATGFKQSSKALQRPV
YGFLNVIVHSATGFKQFSSALIRPV

SEQ ID NO: 25486 - protein, 25 aa, synthetic construct
  source 1..25: note = Seed: YGFLNVIVHSATGFKQSSKALQRPV
YGFLNVIVHSATGFKQFSSALLRPV

SEQ ID NO: 25487 - protein, 25 aa, synthetic construct
  source 1..25: note = Seed: YGFLNVIVHSATGFKQSSKALQRPV
YGFLNVIVHSATGFKQFSSALMRPV

SEQ ID NO: 25488 - protein, 25 aa, synthetic construct
  source 1..25: note = Seed: YGFLNVIVHSATGFKQSSKALQRPV
YGFLNVIVHSATGFKQFSSALNRPV

SEQ ID NO: 25489 - protein, 25 aa, synthetic construct
  source 1..25: note = Seed: YGFLNVIVHSATGFKQSSKALQRPV
YGFLNVIVHSATGFKQFSSALPRPV

SEQ ID NO: 25490 - protein, 25 aa, synthetic construct
  source 1..25: note = Seed: YGFLNVIVHSATGFKQSSKALQRPV
YGFLNVIVHSATGFKQFSSALQRPV

SEQ ID NO: 25491 - protein, 25 aa, synthetic construct
  source 1..25: note = Seed: YGFLNVIVHSATGFKQSSKALQRPV
YGFLNVIVHSATGFKQFSSALSRPV

SEQ ID NO: 25492 - protein, 25 aa, synthetic construct
  source 1..25: note = Seed: YGFLNVIVHSATGFKQSSKALQRPV
YGFLNVIVHSATGFKQFSSALTRPV

SEQ ID NO: 25493 - protein, 25 aa, synthetic construct
  source 1..25: note = Seed: YGFLNVIVHSATGFKQSSKALQRPV
YGFLNVIVHSATGFKQFSSALVRPV

SEQ ID NO: 25494 - protein, 25 aa, synthetic construct
  source 1..25: note = Seed: YGFLNVIVHSATGFKQSSKALQRPV
YGFLNVIVHSATGFKQFSSALYRPV

SEQ ID NO: 25495 - protein, 25 aa, synthetic construct
  source 1..25: note = Seed: YGFLNVIVHSATGFKQSSKALQRPV
YGFLNVIVHSATGFKQFSTALARPV

SEQ ID NO: 25496 - protein, 25 aa, synthetic construct
  source 1..25: note = Seed: YGFLNVIVHSATGFKQSSKALQRPV
YGFLNVIVHSATGFKQFSTALDRPV

SEQ ID NO: 25497 - protein, 25 aa, synthetic construct
  source 1..25: note = Seed: YGFLNVIVHSATGFKQSSKALQRPV
YGFLNVIVHSATGFKQFSTALERPV

SEQ ID NO: 25498 - protein, 25 aa, synthetic construct
  source 1..25: note = Seed: YGFLNVIVHSATGFKQSSKALQRPV
YGFLNVIVHSATGFKQFSTALFRPV

SEQ ID NO: 25499 - protein, 25 aa, synthetic construct
  source 1..25: note = Seed: YGFLNVIVHSATGFKQSSKALQRPV
YGFLNVIVHSATGFKQFSTALGRPV

SEQ ID NO: 25500 - protein, 25 aa, synthetic construct
  source 1..25: note = Seed: YGFLNVIVHSATGFKQSSKALQRPV
YGFLNVIVHSATGFKQFSTALHRPV

SEQ ID NO: 25501 - protein, 25 aa, synthetic construct
  source 1..25: note = Seed: YGFLNVIVHSATGFKQSSKALQRPV
YGFLNVIVHSATGFKQFSTALIRPV

SEQ ID NO: 25502 - protein, 25 aa, synthetic construct
  source 1..25: note = Seed: YGFLNVIVHSATGFKQSSKALQRPV
YGFLNVIVHSATGFKQFSTALLRPV

SEQ ID NO: 25503 - protein, 25 aa, synthetic construct
  source 1..25: note = Seed: YGFLNVIVHSATGFKQSSKALQRPV
YGFLNVIVHSATGFKQFSTALMRPV

SEQ ID NO: 25504 - protein, 25 aa, synthetic construct
  source 1..25: note = Seed: YGFLNVIVHSATGFKQSSKALQRPV
YGFLNVIVHSATGFKQFSTALNRPV

SEQ ID NO: 25505 - protein, 25 aa, synthetic construct
  source 1..25: note = Seed: YGFLNVIVHSATGFKQSSKALQRPV
YGFLNVIVHSATGFKQFSTALPRPV

SEQ ID NO: 25506 - protein, 25 aa, synthetic construct
  source 1..25: note = Seed: YGFLNVIVHSATGFKQSSKALQRPV
YGFLNVIVHSATGFKQFSTALQRPV

SEQ ID NO: 25507 - protein, 25 aa, synthetic construct
  source 1..25: note = Seed: YGFLNVIVHSATGFKQSSKALQRPV
YGFLNVIVHSATGFKQFSTALSRPV

SEQ ID NO: 25508 - protein, 25 aa, synthetic construct
  source 1..25: note = Seed: YGFLNVIVHSATGFKQSSKALQRPV
YGFLNVIVHSATGFKQFSTALTRPV

SEQ ID NO: 25509 - protein, 25 aa, synthetic construct
  source 1..25: note = Seed: YGFLNVIVHSATGFKQSSKALQRPV
YGFLNVIVHSATGFKQFSTALVRPV

SEQ ID NO: 25510 - protein, 25 aa, synthetic construct
  source 1..25: note = Seed: YGFLNVIVHSATGFKQSSKALQRPV
YGFLNVIVHSATGFKQFSTALWRPV

SEQ ID NO: 25511 - protein, 25 aa, synthetic construct
  source 1..25: note = Seed: YGFLNVIVHSATGFKQSSKALQRPV
YGFLNVIVHSATGFKQFSTALYRPV

SEQ ID NO: 25512 - protein, 25 aa, synthetic construct
  source 1..25: note = Seed: YGFLNVIVHSATGFKQSSKALQRPV
YGFLNVIVHSATGFKQFSVALARPV

SEQ ID NO: 25513 - protein, 25 aa, synthetic construct
  source 1..25: note = Seed: YGFLNVIVHSATGFKQSSKALQRPV
YGFLNVIVHSATGFKQFSVALDRPV

SEQ ID NO: 25514 - protein, 25 aa, synthetic construct
  source 1..25: note = Seed: YGFLNVIVHSATGFKQSSKALQRPV
YGFLNVIVHSATGFKQFSVALERPV

SEQ ID NO: 25515 - protein, 25 aa, synthetic construct
  source 1..25: note = Seed: YGFLNVIVHSATGFKQSSKALQRPV
YGFLNVIVHSATGFKQFSVALFRPV

SEQ ID NO: 25516 - protein, 25 aa, synthetic construct
  source 1..25: note = Seed: YGFLNVIVHSATGFKQSSKALQRPV
YGFLNVIVHSATGFKQFSVALGRPV

SEQ ID NO: 25517 - protein, 25 aa, synthetic construct
  source 1..25: note = Seed: YGFLNVIVHSATGFKQSSKALQRPV
YGFLNVIVHSATGFKQFSVALHRPV

SEQ ID NO: 25518 - protein, 25 aa, synthetic construct
  source 1..25: note = Seed: YGFLNVIVHSATGFKQSSKALQRPV
YGFLNVIVHSATGFKQFSVALIRPV

SEQ ID NO: 25519 - protein, 25 aa, synthetic construct
  source 1..25: note = Seed: YGFLNVIVHSATGFKQSSKALQRPV
YGFLNVIVHSATGFKQFSVALLRPV

SEQ ID NO: 25520 - protein, 25 aa, synthetic construct
  source 1..25: note = Seed: YGFLNVIVHSATGFKQSSKALQRPV
YGFLNVIVHSATGFKQFSVALMRPV

SEQ ID NO: 25521 - protein, 25 aa, synthetic construct
  source 1..25: note = Seed: YGFLNVIVHSATGFKQSSKALQRPV
YGFLNVIVHSATGFKQFSVALNRPV

SEQ ID NO: 25522 - protein, 25 aa, synthetic construct
  source 1..25: note = Seed: YGFLNVIVHSATGFKQSSKALQRPV
YGFLNVIVHSATGFKQFSVALPRPV

SEQ ID NO: 25523 - protein, 25 aa, synthetic construct
  source 1..25: note = Seed: YGFLNVIVHSATGFKQSSKALQRPV
YGFLNVIVHSATGFKQFSVALQRPV

SEQ ID NO: 25524 - protein, 25 aa, synthetic construct
  source 1..25: note = Seed: YGFLNVIVHSATGFKQSSKALQRPV
YGFLNVIVHSATGFKQFSVALSRPV

SEQ ID NO: 25525 - protein, 25 aa, synthetic construct
  source 1..25: note = Seed: YGFLNVIVHSATGFKQSSKALQRPV
YGFLNVIVHSATGFKQFSVALTRPV

SEQ ID NO: 25526 - protein, 25 aa, synthetic construct
  source 1..25: note = Seed: YGFLNVIVHSATGFKQSSKALQRPV
YGFLNVIVHSATGFKQFSVALVRPV

SEQ ID NO: 25527 - protein, 25 aa, synthetic construct
  source 1..25: note = Seed: YGFLNVIVHSATGFKQSSKALQRPV
YGFLNVIVHSATGFKQFSVALYRPV

SEQ ID NO: 25528 - protein, 25 aa, synthetic construct
  source 1..25: note = Seed: YGFLNVIVHSATGFKQSSKALQRPV
YGFLNVIVHSATGFKQFSWALARPV

SEQ ID NO: 25529 - protein, 25 aa, synthetic construct
  source 1..25: note = Seed: YGFLNVIVHSATGFKQSSKALQRPV
YGFLNVIVHSATGFKQFSWALIRPV

SEQ ID NO: 25530 - protein, 25 aa, synthetic construct
  source 1..25: note = Seed: YGFLNVIVHSATGFKQSSKALQRPV
YGFLNVIVHSATGFKQFSWALLRPV

SEQ ID NO: 25531 - protein, 25 aa, synthetic construct
  source 1..25: note = Seed: YGFLNVIVHSATGFKQSSKALQRPV
YGFLNVIVHSATGFKQFSWALMRPV

SEQ ID NO: 25532 - protein, 25 aa, synthetic construct
  source 1..25: note = Seed: YGFLNVIVHSATGFKQSSKALQRPV
YGFLNVIVHSATGFKQFSWALSRPV

SEQ ID NO: 25533 - protein, 25 aa, synthetic construct
  source 1..25: note = Seed: YGFLNVIVHSATGFKQSSKALQRPV
YGFLNVIVHSATGFKQFSWALVRPV

SEQ ID NO: 25534 - protein, 25 aa, synthetic construct
  source 1..25: note = Seed: YGFLNVIVHSATGFKQSSKALQRPV
YGFLNVIVHSATGFKQFSWALWRPV

SEQ ID NO: 25535 - protein, 25 aa, synthetic construct
  source 1..25: note = Seed: YGFLNVIVHSATGFKQSSKALQRPV
YGFLNVIVHSATGFKQFSWALYRPV

SEQ ID NO: 25536 - protein, 25 aa, synthetic construct
  source 1..25: note = Seed: YGFLNVIVHSATGFKQSSKALQRPV
YGFLNVIVHSATGFKQFSYALARPV

SEQ ID NO: 25537 - protein, 25 aa, synthetic construct
  source 1..25: note = Seed: YGFLNVIVHSATGFKQSSKALQRPV
YGFLNVIVHSATGFKQFSYALGRPV

SEQ ID NO: 25538 - protein, 25 aa, synthetic construct
  source 1..25: note = Seed: YGFLNVIVHSATGFKQSSKALQRPV
YGFLNVIVHSATGFKQFSYALIRPV

SEQ ID NO: 25539 - protein, 25 aa, synthetic construct
  source 1..25: note = Seed: YGFLNVIVHSATGFKQSSKALQRPV
YGFLNVIVHSATGFKQFSYALLRPV

SEQ ID NO: 25540 - protein, 25 aa, synthetic construct
  source 1..25: note = Seed: YGFLNVIVHSATGFKQSSKALQRPV
YGFLNVIVHSATGFKQFSYALMRPV

SEQ ID NO: 25541 - protein, 25 aa, synthetic construct
  source 1..25: note = Seed: YGFLNVIVHSATGFKQSSKALQRPV
YGFLNVIVHSATGFKQFSYALNRPV

SEQ ID NO: 25542 - protein, 25 aa, synthetic construct
  source 1..25: note = Seed: YGFLNVIVHSATGFKQSSKALQRPV
YGFLNVIVHSATGFKQFSYALSRPV

SEQ ID NO: 25543 - protein, 25 aa, synthetic construct
  source 1..25: note = Seed: YGFLNVIVHSATGFKQSSKALQRPV
YGFLNVIVHSATGFKQFSYALVRPV

SEQ ID NO: 25544 - protein, 25 aa, synthetic construct
  source 1..25: note = Seed: YGFLNVIVHSATGFKQSSKALQRPV
YGFLNVIVHSATGFKQFSYALWRPV

SEQ ID NO: 25545 - protein, 25 aa, synthetic construct
  source 1..25: note = Seed: YGFLNVIVHSATGFKQSSKALQRPV
YGFLNVIVHSATGFKQFSYALYRPV

SEQ ID NO: 25546 - protein, 25 aa, synthetic construct
  source 1..25: note = Seed: YGFLNVIVHSATGFKQSSKALQRPV
YGFLNVIVHSATGFKQGSAALARPV

SEQ ID NO: 25547 - protein, 25 aa, synthetic construct
  source 1..25: note = Seed: YGFLNVIVHSATGFKQSSKALQRPV
YGFLNVIVHSATGFKQGSAALIRPV

SEQ ID NO: 25548 - protein, 25 aa, synthetic construct
  source 1..25: note = Seed: YGFLNVIVHSATGFKQSSKALQRPV
YGFLNVIVHSATGFKQGSAALLRPV

SEQ ID NO: 25549 - protein, 25 aa, synthetic construct
  source 1..25: note = Seed: YGFLNVIVHSATGFKQSSKALQRPV
YGFLNVIVHSATGFKQGSAALMRPV

SEQ ID NO: 25550 - protein, 25 aa, synthetic construct
  source 1..25: note = Seed: YGFLNVIVHSATGFKQSSKALQRPV
YGFLNVIVHSATGFKQGSAALNRPV

SEQ ID NO: 25551 - protein, 25 aa, synthetic construct
  source 1..25: note = Seed: YGFLNVIVHSATGFKQSSKALQRPV
YGFLNVIVHSATGFKQGSAALQRPV

SEQ ID NO: 25552 - protein, 25 aa, synthetic construct
  source 1..25: note = Seed: YGFLNVIVHSATGFKQSSKALQRPV
YGFLNVIVHSATGFKQGSAALSRPV

SEQ ID NO: 25553 - protein, 25 aa, synthetic construct
  source 1..25: note = Seed: YGFLNVIVHSATGFKQSSKALQRPV
YGFLNVIVHSATGFKQGSAALVRPV

SEQ ID NO: 25554 - protein, 25 aa, synthetic construct
  source 1..25: note = Seed: YGFLNVIVHSATGFKQSSKALQRPV
YGFLNVIVHSATGFKQGSFALLRPV

SEQ ID NO: 25555 - protein, 25 aa, synthetic construct
  source 1..25: note = Seed: YGFLNVIVHSATGFKQSSKALQRPV
YGFLNVIVHSATGFKQGSIALARPV

SEQ ID NO: 25556 - protein, 25 aa, synthetic construct
  source 1..25: note = Seed: YGFLNVIVHSATGFKQSSKALQRPV
YGFLNVIVHSATGFKQGSIALNRPV

SEQ ID NO: 25557 - protein, 25 aa, synthetic construct
  source 1..25: note = Seed: YGFLNVIVHSATGFKQSSKALQRPV
YGFLNVIVHSATGFKQGSIALSRPV

SEQ ID NO: 25558 - protein, 25 aa, synthetic construct
  source 1..25: note = Seed: YGFLNVIVHSATGFKQSSKALQRPV
YGFLNVIVHSATGFKQGSPALARPV

SEQ ID NO: 25559 - protein, 25 aa, synthetic construct
  source 1..25: note = Seed: YGFLNVIVHSATGFKQSSKALQRPV
YGFLNVIVHSATGFKQGSPALMRPV

SEQ ID NO: 25560 - protein, 25 aa, synthetic construct
  source 1..25: note = Seed: YGFLNVIVHSATGFKQSSKALQRPV
YGFLNVIVHSATGFKQGSPALNRPV

SEQ ID NO: 25561 - protein, 25 aa, synthetic construct
  source 1..25: note = Seed: YGFLNVIVHSATGFKQSSKALQRPV
YGFLNVIVHSATGFKQGSPALSRPV

SEQ ID NO: 25562 - protein, 25 aa, synthetic construct
  source 1..25: note = Seed: YGFLNVIVHSATGFKQSSKALQRPV
YGFLNVIVHSATGFKQGSSALARPV

SEQ ID NO: 25563 - protein, 25 aa, synthetic construct
  source 1..25: note = Seed: YGFLNVIVHSATGFKQSSKALQRPV
YGFLNVIVHSATGFKQGSSALNRPV

SEQ ID NO: 25564 - protein, 25 aa, synthetic construct
  source 1..25: note = Seed: YGFLNVIVHSATGFKQSSKALQRPV
YGFLNVIVHSATGFKQGSSALSRPV

SEQ ID NO: 25565 - protein, 25 aa, synthetic construct
  source 1..25: note = Seed: YGFLNVIVHSATGFKQSSKALQRPV
YGFLNVIVHSATGFKQGSTALARPV

SEQ ID NO: 25566 - protein, 25 aa, synthetic construct
  source 1..25: note = Seed: YGFLNVIVHSATGFKQSSKALQRPV
YGFLNVIVHSATGFKQGSTALNRPV

SEQ ID NO: 25567 - protein, 25 aa, synthetic construct
  source 1..25: note = Seed: YGFLNVIVHSATGFKQSSKALQRPV
YGFLNVIVHSATGFKQGSTALSRPV

SEQ ID NO: 25568 - protein, 25 aa, synthetic construct
  source 1..25: note = Seed: YGFLNVIVHSATGFKQSSKALQRPV
YGFLNVIVHSATGFKQGSVALARPV

SEQ ID NO: 25569 - protein, 25 aa, synthetic construct
  source 1..25: note = Seed: YGFLNVIVHSATGFKQSSKALQRPV
YGFLNVIVHSATGFKQGSVALMRPV

SEQ ID NO: 25570 - protein, 25 aa, synthetic construct
  source 1..25: note = Seed: YGFLNVIVHSATGFKQSSKALQRPV
YGFLNVIVHSATGFKQGSVALNRPV

SEQ ID NO: 25571 - protein, 25 aa, synthetic construct
  source 1..25: note = Seed: YGFLNVIVHSATGFKQSSKALQRPV
YGFLNVIVHSATGFKQGSVALSRPV

SEQ ID NO: 25572 - protein, 25 aa, synthetic construct
  source 1..25: note = Seed: YGFLNVIVHSATGFKQSSKALQRPV
YGFLNVIVHSATGFKQGSVALVRPV

SEQ ID NO: 25573 - protein, 25 aa, synthetic construct
  source 1..25: note = Seed: YGFLNVIVHSATGFKQSSKALQRPV
YGFLNVIVHSATGFKQHSAALARPV

SEQ ID NO: 25574 - protein, 25 aa, synthetic construct
  source 1..25: note = Seed: YGFLNVIVHSATGFKQSSKALQRPV
YGFLNVIVHSATGFKQHSAALNRPV

SEQ ID NO: 25575 - protein, 25 aa, synthetic construct
  source 1..25: note = Seed: YGFLNVIVHSATGFKQSSKALQRPV
YGFLNVIVHSATGFKQHSAALSRPV

SEQ ID NO: 25576 - protein, 25 aa, synthetic construct
  source 1..25: note = Seed: YGFLNVIVHSATGFKQSSKALQRPV
YGFLNVIVHSATGFKQHSFALFRPV

SEQ ID NO: 25577 - protein, 25 aa, synthetic construct
  source 1..25: note = Seed: YGFLNVIVHSATGFKQSSKALQRPV
YGFLNVIVHSATGFKQHSFALIRPV

SEQ ID NO: 25578 - protein, 25 aa, synthetic construct
  source 1..25: note = Seed: YGFLNVIVHSATGFKQSSKALQRPV
YGFLNVIVHSATGFKQHSFALLRPV

SEQ ID NO: 25579 - protein, 25 aa, synthetic construct
  source 1..25: note = Seed: YGFLNVIVHSATGFKQSSKALQRPV
YGFLNVIVHSATGFKQHSFALMRPV

SEQ ID NO: 25580 - protein, 25 aa, synthetic construct
  source 1..25: note = Seed: YGFLNVIVHSATGFKQSSKALQRPV
YGFLNVIVHSATGFKQHSFALVRPV

SEQ ID NO: 25581 - protein, 25 aa, synthetic construct
  source 1..25: note = Seed: YGFLNVIVHSATGFKQSSKALQRPV
YGFLNVIVHSATGFKQHSFALYRPV

SEQ ID NO: 25582 - protein, 25 aa, synthetic construct
  source 1..25: note = Seed: YGFLNVIVHSATGFKQSSKALQRPV
YGFLNVIVHSATGFKQHSIALARPV

SEQ ID NO: 25583 - protein, 25 aa, synthetic construct
  source 1..25: note = Seed: YGFLNVIVHSATGFKQSSKALQRPV
YGFLNVIVHSATGFKQHSIALNRPV

SEQ ID NO: 25584 - protein, 25 aa, synthetic construct
  source 1..25: note = Seed: YGFLNVIVHSATGFKQSSKALQRPV
YGFLNVIVHSATGFKQHSIALSRPV

SEQ ID NO: 25585 - protein, 25 aa, synthetic construct
  source 1..25: note = Seed: YGFLNVIVHSATGFKQSSKALQRPV
YGFLNVIVHSATGFKQHSPALARPV

SEQ ID NO: 25586 - protein, 25 aa, synthetic construct
  source 1..25: note = Seed: YGFLNVIVHSATGFKQSSKALQRPV
YGFLNVIVHSATGFKQHSPALNRPV

SEQ ID NO: 25587 - protein, 25 aa, synthetic construct
  source 1..25: note = Seed: YGFLNVIVHSATGFKQSSKALQRPV
YGFLNVIVHSATGFKQHSPALSRPV

SEQ ID NO: 25588 - protein, 25 aa, synthetic construct
  source 1..25: note = Seed: YGFLNVIVHSATGFKQSSKALQRPV
YGFLNVIVHSATGFKQHSSALARPV

SEQ ID NO: 25589 - protein, 25 aa, synthetic construct
  source 1..25: note = Seed: YGFLNVIVHSATGFKQSSKALQRPV
YGFLNVIVHSATGFKQHSTALARPV

SEQ ID NO: 25590 - protein, 25 aa, synthetic construct
  source 1..25: note = Seed: YGFLNVIVHSATGFKQSSKALQRPV
YGFLNVIVHSATGFKQHSTALNRPV

SEQ ID NO: 25591 - protein, 25 aa, synthetic construct
  source 1..25: note = Seed: YGFLNVIVHSATGFKQSSKALQRPV
YGFLNVIVHSATGFKQHSVALARPV

SEQ ID NO: 25592 - protein, 25 aa, synthetic construct
  source 1..25: note = Seed: YGFLNVIVHSATGFKQSSKALQRPV
YGFLNVIVHSATGFKQHSVALNRPV

SEQ ID NO: 25593 - protein, 25 aa, synthetic construct
  source 1..25: note = Seed: YGFLNVIVHSATGFKQSSKALQRPV
YGFLNVIVHSATGFKQHSVALSRPV

SEQ ID NO: 25594 - protein, 25 aa, synthetic construct
  source 1..25: note = Seed: YGFLNVIVHSATGFKQSSKALQRPV
YGFLNVIVHSATGFKQISAALCRPV

SEQ ID NO: 25595 - protein, 25 aa, synthetic construct
  source 1..25: note = Seed: YGFLNVIVHSATGFKQSSKALQRPV
YGFLNVIVHSATGFKQISAALDRPV

SEQ ID NO: 25596 - protein, 25 aa, synthetic construct
  source 1..25: note = Seed: YGFLNVIVHSATGFKQSSKALQRPV
YGFLNVIVHSATGFKQISAALERPV

SEQ ID NO: 25597 - protein, 25 aa, synthetic construct
  source 1..25: note = Seed: YGFLNVIVHSATGFKQSSKALQRPV
YGFLNVIVHSATGFKQISAALFRPV

SEQ ID NO: 25598 - protein, 25 aa, synthetic construct
  source 1..25: note = Seed: YGFLNVIVHSATGFKQSSKALQRPV
YGFLNVIVHSATGFKQISAALGRPV

SEQ ID NO: 25599 - protein, 25 aa, synthetic construct
  source 1..25: note = Seed: YGFLNVIVHSATGFKQSSKALQRPV
YGFLNVIVHSATGFKQISAALHRPV

SEQ ID NO: 25600 - protein, 25 aa, synthetic construct
  source 1..25: note = Seed: YGFLNVIVHSATGFKQSSKALQRPV
YGFLNVIVHSATGFKQISAALIRPV

SEQ ID NO: 25601 - protein, 25 aa, synthetic construct
  source 1..25: note = Seed: YGFLNVIVHSATGFKQSSKALQRPV
YGFLNVIVHSATGFKQISAALKRPV

SEQ ID NO: 25602 - protein, 25 aa, synthetic construct
  source 1..25: note = Seed: YGFLNVIVHSATGFKQSSKALQRPV
YGFLNVIVHSATGFKQISAALLRPV

SEQ ID NO: 25603 - protein, 25 aa, synthetic construct
  source 1..25: note = Seed: YGFLNVIVHSATGFKQSSKALQRPV
YGFLNVIVHSATGFKQISAALMRPV

SEQ ID NO: 25604 - protein, 25 aa, synthetic construct
  source 1..25: note = Seed: YGFLNVIVHSATGFKQSSKALQRPV
YGFLNVIVHSATGFKQISAALNRPV

SEQ ID NO: 25605 - protein, 25 aa, synthetic construct
  source 1..25: note = Seed: YGFLNVIVHSATGFKQSSKALQRPV
YGFLNVIVHSATGFKQISAALPRPV

SEQ ID NO: 25606 - protein, 25 aa, synthetic construct
  source 1..25: note = Seed: YGFLNVIVHSATGFKQSSKALQRPV
YGFLNVIVHSATGFKQISAALQRPV

SEQ ID NO: 25607 - protein, 25 aa, synthetic construct
  source 1..25: note = Seed: YGFLNVIVHSATGFKQSSKALQRPV
YGFLNVIVHSATGFKQISAALRRPV

SEQ ID NO: 25608 - protein, 25 aa, synthetic construct
  source 1..25: note = Seed: YGFLNVIVHSATGFKQSSKALQRPV
YGFLNVIVHSATGFKQISAALSRPV

SEQ ID NO: 25609 - protein, 25 aa, synthetic construct
  source 1..25: note = Seed: YGFLNVIVHSATGFKQSSKALQRPV
YGFLNVIVHSATGFKQISAALTRPV

SEQ ID NO: 25610 - protein, 25 aa, synthetic construct
  source 1..25: note = Seed: YGFLNVIVHSATGFKQSSKALQRPV
YGFLNVIVHSATGFKQISAALVRPV

SEQ ID NO: 25611 - protein, 25 aa, synthetic construct
  source 1..25: note = Seed: YGFLNVIVHSATGFKQSSKALQRPV
YGFLNVIVHSATGFKQISAALWRPV

SEQ ID NO: 25612 - protein, 25 aa, synthetic construct
  source 1..25: note = Seed: YGFLNVIVHSATGFKQSSKALQRPV
YGFLNVIVHSATGFKQISAALYRPV

SEQ ID NO: 25613 - protein, 25 aa, synthetic construct
  source 1..25: note = Seed: YGFLNVIVHSATGFKQSSKALQRPV
YGFLNVIVHSATGFKQISCALARPV

SEQ ID NO: 25614 - protein, 25 aa, synthetic construct
  source 1..25: note = Seed: YGFLNVIVHSATGFKQSSKALQRPV
YGFLNVIVHSATGFKQISCALNRPV

SEQ ID NO: 25615 - protein, 25 aa, synthetic construct
  source 1..25: note = Seed: YGFLNVIVHSATGFKQSSKALQRPV
YGFLNVIVHSATGFKQISCALSRPV

SEQ ID NO: 25616 - protein, 25 aa, synthetic construct
  source 1..25: note = Seed: YGFLNVIVHSATGFKQSSKALQRPV
YGFLNVIVHSATGFKQISDALARPV

SEQ ID NO: 25617 - protein, 25 aa, synthetic construct
  source 1..25: note = Seed: YGFLNVIVHSATGFKQSSKALQRPV
YGFLNVIVHSATGFKQISDALGRPV

SEQ ID NO: 25618 - protein, 25 aa, synthetic construct
  source 1..25: note = Seed: YGFLNVIVHSATGFKQSSKALQRPV
YGFLNVIVHSATGFKQISDALNRPV

SEQ ID NO: 25619 - protein, 25 aa, synthetic construct
  source 1..25: note = Seed: YGFLNVIVHSATGFKQSSKALQRPV
YGFLNVIVHSATGFKQISDALSRPV

SEQ ID NO: 25620 - protein, 25 aa, synthetic construct
  source 1..25: note = Seed: YGFLNVIVHSATGFKQSSKALQRPV
YGFLNVIVHSATGFKQISDALVRPV

SEQ ID NO: 25621 - protein, 25 aa, synthetic construct
  source 1..25: note = Seed: YGFLNVIVHSATGFKQSSKALQRPV
YGFLNVIVHSATGFKQISEALARPV

SEQ ID NO: 25622 - protein, 25 aa, synthetic construct
  source 1..25: note = Seed: YGFLNVIVHSATGFKQSSKALQRPV
YGFLNVIVHSATGFKQISEALNRPV

SEQ ID NO: 25623 - protein, 25 aa, synthetic construct
  source 1..25: note = Seed: YGFLNVIVHSATGFKQSSKALQRPV
YGFLNVIVHSATGFKQISEALSRPV

SEQ ID NO: 25624 - protein, 25 aa, synthetic construct
  source 1..25: note = Seed: YGFLNVIVHSATGFKQSSKALQRPV
YGFLNVIVHSATGFKQISEALTRPV

SEQ ID NO: 25625 - protein, 25 aa, synthetic construct
  source 1..25: note = Seed: YGFLNVIVHSATGFKQSSKALQRPV
YGFLNVIVHSATGFKQISFALARPV

SEQ ID NO: 25626 - protein, 25 aa, synthetic construct
  source 1..25: note = Seed: YGFLNVIVHSATGFKQSSKALQRPV
YGFLNVIVHSATGFKQISFALDRPV

SEQ ID NO: 25627 - protein, 25 aa, synthetic construct
  source 1..25: note = Seed: YGFLNVIVHSATGFKQSSKALQRPV
YGFLNVIVHSATGFKQISFALERPV

SEQ ID NO: 25628 - protein, 25 aa, synthetic construct
  source 1..25: note = Seed: YGFLNVIVHSATGFKQSSKALQRPV
YGFLNVIVHSATGFKQISFALFRPV

SEQ ID NO: 25629 - protein, 25 aa, synthetic construct
  source 1..25: note = Seed: YGFLNVIVHSATGFKQSSKALQRPV
YGFLNVIVHSATGFKQISFALHRPV

SEQ ID NO: 25630 - protein, 25 aa, synthetic construct
  source 1..25: note = Seed: YGFLNVIVHSATGFKQSSKALQRPV
YGFLNVIVHSATGFKQISFALIRPV

SEQ ID NO: 25631 - protein, 25 aa, synthetic construct
  source 1..25: note = Seed: YGFLNVIVHSATGFKQSSKALQRPV
YGFLNVIVHSATGFKQISFALLRPV

SEQ ID NO: 25632 - protein, 25 aa, synthetic construct
  source 1..25: note = Seed: YGFLNVIVHSATGFKQSSKALQRPV
YGFLNVIVHSATGFKQISFALMRPV

SEQ ID NO: 25633 - protein, 25 aa, synthetic construct
  source 1..25: note = Seed: YGFLNVIVHSATGFKQSSKALQRPV
YGFLNVIVHSATGFKQISFALNRPV

SEQ ID NO: 25634 - protein, 25 aa, synthetic construct
  source 1..25: note = Seed: YGFLNVIVHSATGFKQSSKALQRPV
YGFLNVIVHSATGFKQISFALPRPV

SEQ ID NO: 25635 - protein, 25 aa, synthetic construct
  source 1..25: note = Seed: YGFLNVIVHSATGFKQSSKALQRPV
YGFLNVIVHSATGFKQISFALQRPV

SEQ ID NO: 25636 - protein, 25 aa, synthetic construct
  source 1..25: note = Seed: YGFLNVIVHSATGFKQSSKALQRPV
YGFLNVIVHSATGFKQISFALRRPV

SEQ ID NO: 25637 - protein, 25 aa, synthetic construct
  source 1..25: note = Seed: YGFLNVIVHSATGFKQSSKALQRPV
YGFLNVIVHSATGFKQISFALSRPV

SEQ ID NO: 25638 - protein, 25 aa, synthetic construct
  source 1..25: note = Seed: YGFLNVIVHSATGFKQSSKALQRPV
YGFLNVIVHSATGFKQISFALTRPV

SEQ ID NO: 25639 - protein, 25 aa, synthetic construct
  source 1..25: note = Seed: YGFLNVIVHSATGFKQSSKALQRPV
YGFLNVIVHSATGFKQISFALVRPV

SEQ ID NO: 25640 - protein, 25 aa, synthetic construct
  source 1..25: note = Seed: YGFLNVIVHSATGFKQSSKALQRPV
YGFLNVIVHSATGFKQISFALWRPV

SEQ ID NO: 25641 - protein, 25 aa, synthetic construct
  source 1..25: note = Seed: YGFLNVIVHSATGFKQSSKALQRPV
YGFLNVIVHSATGFKQISFALYRPV

SEQ ID NO: 25642 - protein, 25 aa, synthetic construct
  source 1..25: note = Seed: YGFLNVIVHSATGFKQSSKALQRPV
YGFLNVIVHSATGFKQISGALARPV

SEQ ID NO: 25643 - protein, 25 aa, synthetic construct
  source 1..25: note = Seed: YGFLNVIVHSATGFKQSSKALQRPV
YGFLNVIVHSATGFKQISGALCRPV

SEQ ID NO: 25644 - protein, 25 aa, synthetic construct
  source 1..25: note = Seed: YGFLNVIVHSATGFKQSSKALQRPV
YGFLNVIVHSATGFKQISGALDRPV

SEQ ID NO: 25645 - protein, 25 aa, synthetic construct
  source 1..25: note = Seed: YGFLNVIVHSATGFKQSSKALQRPV
YGFLNVIVHSATGFKQISGALERPV

SEQ ID NO: 25646 - protein, 25 aa, synthetic construct
  source 1..25: note = Seed: YGFLNVIVHSATGFKQSSKALQRPV
YGFLNVIVHSATGFKQISGALFRPV

SEQ ID NO: 25647 - protein, 25 aa, synthetic construct
  source 1..25: note = Seed: YGFLNVIVHSATGFKQSSKALQRPV
YGFLNVIVHSATGFKQISGALGRPV

SEQ ID NO: 25648 - protein, 25 aa, synthetic construct
  source 1..25: note = Seed: YGFLNVIVHSATGFKQSSKALQRPV
YGFLNVIVHSATGFKQISGALHRPV

SEQ ID NO: 25649 - protein, 25 aa, synthetic construct
  source 1..25: note = Seed: YGFLNVIVHSATGFKQSSKALQRPV
YGFLNVIVHSATGFKQISGALIRPV

SEQ ID NO: 25650 - protein, 25 aa, synthetic construct
  source 1..25: note = Seed: YGFLNVIVHSATGFKQSSKALQRPV
YGFLNVIVHSATGFKQISGALLRPV

SEQ ID NO: 25651 - protein, 25 aa, synthetic construct
  source 1..25: note = Seed: YGFLNVIVHSATGFKQSSKALQRPV
YGFLNVIVHSATGFKQISGALMRPV

SEQ ID NO: 25652 - protein, 25 aa, synthetic construct
  source 1..25: note = Seed: YGFLNVIVHSATGFKQSSKALQRPV
YGFLNVIVHSATGFKQISGALNRPV

SEQ ID NO: 25653 - protein, 25 aa, synthetic construct
  source 1..25: note = Seed: YGFLNVIVHSATGFKQSSKALQRPV
YGFLNVIVHSATGFKQISGALPRPV

SEQ ID NO: 25654 - protein, 25 aa, synthetic construct
  source 1..25: note = Seed: YGFLNVIVHSATGFKQSSKALQRPV
YGFLNVIVHSATGFKQISGALQRPV

SEQ ID NO: 25655 - protein, 25 aa, synthetic construct
  source 1..25: note = Seed: YGFLNVIVHSATGFKQSSKALQRPV
YGFLNVIVHSATGFKQISGALSRPV

SEQ ID NO: 25656 - protein, 25 aa, synthetic construct
  source 1..25: note = Seed: YGFLNVIVHSATGFKQSSKALQRPV
YGFLNVIVHSATGFKQISGALTRPV

SEQ ID NO: 25657 - protein, 25 aa, synthetic construct
  source 1..25: note = Seed: YGFLNVIVHSATGFKQSSKALQRPV
YGFLNVIVHSATGFKQISGALVRPV

SEQ ID NO: 25658 - protein, 25 aa, synthetic construct
  source 1..25: note = Seed: YGFLNVIVHSATGFKQSSKALQRPV
YGFLNVIVHSATGFKQISHALARPV

SEQ ID NO: 25659 - protein, 25 aa, synthetic construct
  source 1..25: note = Seed: YGFLNVIVHSATGFKQSSKALQRPV
YGFLNVIVHSATGFKQISHALFRPV

SEQ ID NO: 25660 - protein, 25 aa, synthetic construct
  source 1..25: note = Seed: YGFLNVIVHSATGFKQSSKALQRPV
YGFLNVIVHSATGFKQISHALGRPV

SEQ ID NO: 25661 - protein, 25 aa, synthetic construct
  source 1..25: note = Seed: YGFLNVIVHSATGFKQSSKALQRPV
YGFLNVIVHSATGFKQISHALHRPV

SEQ ID NO: 25662 - protein, 25 aa, synthetic construct
  source 1..25: note = Seed: YGFLNVIVHSATGFKQSSKALQRPV
YGFLNVIVHSATGFKQISHALNRPV

SEQ ID NO: 25663 - protein, 25 aa, synthetic construct
  source 1..25: note = Seed: YGFLNVIVHSATGFKQSSKALQRPV
YGFLNVIVHSATGFKQISHALQRPV

SEQ ID NO: 25664 - protein, 25 aa, synthetic construct
  source 1..25: note = Seed: YGFLNVIVHSATGFKQSSKALQRPV
YGFLNVIVHSATGFKQISHALRRPV

SEQ ID NO: 25665 - protein, 25 aa, synthetic construct
  source 1..25: note = Seed: YGFLNVIVHSATGFKQSSKALQRPV
YGFLNVIVHSATGFKQISHALSRPV

SEQ ID NO: 25666 - protein, 25 aa, synthetic construct
  source 1..25: note = Seed: YGFLNVIVHSATGFKQSSKALQRPV
YGFLNVIVHSATGFKQISHALTRPV

SEQ ID NO: 25667 - protein, 25 aa, synthetic construct
  source 1..25: note = Seed: YGFLNVIVHSATGFKQSSKALQRPV
YGFLNVIVHSATGFKQISHALVRPV

SEQ ID NO: 25668 - protein, 25 aa, synthetic construct
  source 1..25: note = Seed: YGFLNVIVHSATGFKQSSKALQRPV
YGFLNVIVHSATGFKQISIALARPV

SEQ ID NO: 25669 - protein, 25 aa, synthetic construct
  source 1..25: note = Seed: YGFLNVIVHSATGFKQSSKALQRPV
YGFLNVIVHSATGFKQISIALCRPV

SEQ ID NO: 25670 - protein, 25 aa, synthetic construct
  source 1..25: note = Seed: YGFLNVIVHSATGFKQSSKALQRPV
YGFLNVIVHSATGFKQISIALDRPV

SEQ ID NO: 25671 - protein, 25 aa, synthetic construct
  source 1..25: note = Seed: YGFLNVIVHSATGFKQSSKALQRPV
YGFLNVIVHSATGFKQISIALERPV

SEQ ID NO: 25672 - protein, 25 aa, synthetic construct
  source 1..25: note = Seed: YGFLNVIVHSATGFKQSSKALQRPV
YGFLNVIVHSATGFKQISIALFRPV

SEQ ID NO: 25673 - protein, 25 aa, synthetic construct
  source 1..25: note = Seed: YGFLNVIVHSATGFKQSSKALQRPV
YGFLNVIVHSATGFKQISIALGRPV

SEQ ID NO: 25674 - protein, 25 aa, synthetic construct
  source 1..25: note = Seed: YGFLNVIVHSATGFKQSSKALQRPV
YGFLNVIVHSATGFKQISIALHRPV

SEQ ID NO: 25675 - protein, 25 aa, synthetic construct
  source 1..25: note = Seed: YGFLNVIVHSATGFKQSSKALQRPV
YGFLNVIVHSATGFKQISIALIRPV

SEQ ID NO: 25676 - protein, 25 aa, synthetic construct
  source 1..25: note = Seed: YGFLNVIVHSATGFKQSSKALQRPV
YGFLNVIVHSATGFKQISIALKRPV

SEQ ID NO: 25677 - protein, 25 aa, synthetic construct
  source 1..25: note = Seed: YGFLNVIVHSATGFKQSSKALQRPV
YGFLNVIVHSATGFKQISIALLRPV

SEQ ID NO: 25678 - protein, 25 aa, synthetic construct
  source 1..25: note = Seed: YGFLNVIVHSATGFKQSSKALQRPV
YGFLNVIVHSATGFKQISIALMRPV

SEQ ID NO: 25679 - protein, 25 aa, synthetic construct
  source 1..25: note = Seed: YGFLNVIVHSATGFKQSSKALQRPV
YGFLNVIVHSATGFKQISIALNRPV

SEQ ID NO: 25680 - protein, 25 aa, synthetic construct
  source 1..25: note = Seed: YGFLNVIVHSATGFKQSSKALQRPV
YGFLNVIVHSATGFKQISIALPRPV

SEQ ID NO: 25681 - protein, 25 aa, synthetic construct
  source 1..25: note = Seed: YGFLNVIVHSATGFKQSSKALQRPV
YGFLNVIVHSATGFKQISIALQRPV

SEQ ID NO: 25682 - protein, 25 aa, synthetic construct
  source 1..25: note = Seed: YGFLNVIVHSATGFKQSSKALQRPV
YGFLNVIVHSATGFKQISIALRRPV

SEQ ID NO: 25683 - protein, 25 aa, synthetic construct
  source 1..25: note = Seed: YGFLNVIVHSATGFKQSSKALQRPV
YGFLNVIVHSATGFKQISIALSRPV

SEQ ID NO: 25684 - protein, 25 aa, synthetic construct
  source 1..25: note = Seed: YGFLNVIVHSATGFKQSSKALQRPV
YGFLNVIVHSATGFKQISIALTRPV

SEQ ID NO: 25685 - protein, 25 aa, synthetic construct
  source 1..25: note = Seed: YGFLNVIVHSATGFKQSSKALQRPV
YGFLNVIVHSATGFKQISIALVRPV

SEQ ID NO: 25686 - protein, 25 aa, synthetic construct
  source 1..25: note = Seed: YGFLNVIVHSATGFKQSSKALQRPV
YGFLNVIVHSATGFKQISIALYRPV

SEQ ID NO: 25687 - protein, 25 aa, synthetic construct
  source 1..25: note = Seed: YGFLNVIVHSATGFKQSSKALQRPV
YGFLNVIVHSATGFKQISKALARPV

SEQ ID NO: 25688 - protein, 25 aa, synthetic construct
  source 1..25: note = Seed: YGFLNVIVHSATGFKQSSKALQRPV
YGFLNVIVHSATGFKQISKALCRPV

SEQ ID NO: 25689 - protein, 25 aa, synthetic construct
  source 1..25: note = Seed: YGFLNVIVHSATGFKQSSKALQRPV
YGFLNVIVHSATGFKQISKALDRPV

SEQ ID NO: 25690 - protein, 25 aa, synthetic construct
  source 1..25: note = Seed: YGFLNVIVHSATGFKQSSKALQRPV
YGFLNVIVHSATGFKQISKALERPV

SEQ ID NO: 25691 - protein, 25 aa, synthetic construct
  source 1..25: note = Seed: YGFLNVIVHSATGFKQSSKALQRPV
YGFLNVIVHSATGFKQISKALGRPV

SEQ ID NO: 25692 - protein, 25 aa, synthetic construct
  source 1..25: note = Seed: YGFLNVIVHSATGFKQSSKALQRPV
YGFLNVIVHSATGFKQISKALHRPV

SEQ ID NO: 25693 - protein, 25 aa, synthetic construct
  source 1..25: note = Seed: YGFLNVIVHSATGFKQSSKALQRPV
YGFLNVIVHSATGFKQISKALIRPV

SEQ ID NO: 25694 - protein, 25 aa, synthetic construct
  source 1..25: note = Seed: YGFLNVIVHSATGFKQSSKALQRPV
YGFLNVIVHSATGFKQISKALKRPV

SEQ ID NO: 25695 - protein, 25 aa, synthetic construct
  source 1..25: note = Seed: YGFLNVIVHSATGFKQSSKALQRPV
YGFLNVIVHSATGFKQISKALLRPV

SEQ ID NO: 25696 - protein, 25 aa, synthetic construct
  source 1..25: note = Seed: YGFLNVIVHSATGFKQSSKALQRPV
YGFLNVIVHSATGFKQISKALMRPV

SEQ ID NO: 25697 - protein, 25 aa, synthetic construct
  source 1..25: note = Seed: YGFLNVIVHSATGFKQSSKALQRPV
YGFLNVIVHSATGFKQISKALNRPV

SEQ ID NO: 25698 - protein, 25 aa, synthetic construct
  source 1..25: note = Seed: YGFLNVIVHSATGFKQSSKALQRPV
YGFLNVIVHSATGFKQISKALPRPV

SEQ ID NO: 25699 - protein, 25 aa, synthetic construct
  source 1..25: note = Seed: YGFLNVIVHSATGFKQSSKALQRPV
YGFLNVIVHSATGFKQISKALQRPV

SEQ ID NO: 25700 - protein, 25 aa, synthetic construct
  source 1..25: note = Seed: YGFLNVIVHSATGFKQSSKALQRPV
YGFLNVIVHSATGFKQISKALRRPV

SEQ ID NO: 25701 - protein, 25 aa, synthetic construct
  source 1..25: note = Seed: YGFLNVIVHSATGFKQSSKALQRPV
YGFLNVIVHSATGFKQISKALSRPV

SEQ ID NO: 25702 - protein, 25 aa, synthetic construct
  source 1..25: note = Seed: YGFLNVIVHSATGFKQSSKALQRPV
YGFLNVIVHSATGFKQISKALTRPV

SEQ ID NO: 25703 - protein, 25 aa, synthetic construct
  source 1..25: note = Seed: YGFLNVIVHSATGFKQSSKALQRPV
YGFLNVIVHSATGFKQISKALVRPV

SEQ ID NO: 25704 - protein, 25 aa, synthetic construct
  source 1..25: note = Seed: YGFLNVIVHSATGFKQSSKALQRPV
YGFLNVIVHSATGFKQISKALYRPV

SEQ ID NO: 25705 - protein, 25 aa, synthetic construct
  source 1..25: note = Seed: YGFLNVIVHSATGFKQSSKALQRPV
YGFLNVIVHSATGFKQISLALARPV

SEQ ID NO: 25706 - protein, 25 aa, synthetic construct
  source 1..25: note = Seed: YGFLNVIVHSATGFKQSSKALQRPV
YGFLNVIVHSATGFKQISLALDRPV

SEQ ID NO: 25707 - protein, 25 aa, synthetic construct
  source 1..25: note = Seed: YGFLNVIVHSATGFKQSSKALQRPV
YGFLNVIVHSATGFKQISLALFRPV

SEQ ID NO: 25708 - protein, 25 aa, synthetic construct
  source 1..25: note = Seed: YGFLNVIVHSATGFKQSSKALQRPV
YGFLNVIVHSATGFKQISLALGRPV

SEQ ID NO: 25709 - protein, 25 aa, synthetic construct
  source 1..25: note = Seed: YGFLNVIVHSATGFKQSSKALQRPV
YGFLNVIVHSATGFKQISLALHRPV

SEQ ID NO: 25710 - protein, 25 aa, synthetic construct
  source 1..25: note = Seed: YGFLNVIVHSATGFKQSSKALQRPV
YGFLNVIVHSATGFKQISLALIRPV

SEQ ID NO: 25711 - protein, 25 aa, synthetic construct
  source 1..25: note = Seed: YGFLNVIVHSATGFKQSSKALQRPV
YGFLNVIVHSATGFKQISLALLRPV

SEQ ID NO: 25712 - protein, 25 aa, synthetic construct
  source 1..25: note = Seed: YGFLNVIVHSATGFKQSSKALQRPV
YGFLNVIVHSATGFKQISLALMRPV

SEQ ID NO: 25713 - protein, 25 aa, synthetic construct
  source 1..25: note = Seed: YGFLNVIVHSATGFKQSSKALQRPV
YGFLNVIVHSATGFKQISLALNRPV

SEQ ID NO: 25714 - protein, 25 aa, synthetic construct
  source 1..25: note = Seed: YGFLNVIVHSATGFKQSSKALQRPV
YGFLNVIVHSATGFKQISLALPRPV

SEQ ID NO: 25715 - protein, 25 aa, synthetic construct
  source 1..25: note = Seed: YGFLNVIVHSATGFKQSSKALQRPV
YGFLNVIVHSATGFKQISLALRRPV

SEQ ID NO: 25716 - protein, 25 aa, synthetic construct
  source 1..25: note = Seed: YGFLNVIVHSATGFKQSSKALQRPV
YGFLNVIVHSATGFKQISLALSRPV

SEQ ID NO: 25717 - protein, 25 aa, synthetic construct
  source 1..25: note = Seed: YGFLNVIVHSATGFKQSSKALQRPV
YGFLNVIVHSATGFKQISLALTRPV

SEQ ID NO: 25718 - protein, 25 aa, synthetic construct
  source 1..25: note = Seed: YGFLNVIVHSATGFKQSSKALQRPV
YGFLNVIVHSATGFKQISLALVRPV

SEQ ID NO: 25719 - protein, 25 aa, synthetic construct
  source 1..25: note = Seed: YGFLNVIVHSATGFKQSSKALQRPV
YGFLNVIVHSATGFKQISLALYRPV

SEQ ID NO: 25720 - protein, 25 aa, synthetic construct
  source 1..25: note = Seed: YGFLNVIVHSATGFKQSSKALQRPV
YGFLNVIVHSATGFKQISMALARPV

SEQ ID NO: 25721 - protein, 25 aa, synthetic construct
  source 1..25: note = Seed: YGFLNVIVHSATGFKQSSKALQRPV
YGFLNVIVHSATGFKQISMALDRPV

SEQ ID NO: 25722 - protein, 25 aa, synthetic construct
  source 1..25: note = Seed: YGFLNVIVHSATGFKQSSKALQRPV
YGFLNVIVHSATGFKQISMALFRPV

SEQ ID NO: 25723 - protein, 25 aa, synthetic construct
  source 1..25: note = Seed: YGFLNVIVHSATGFKQSSKALQRPV
YGFLNVIVHSATGFKQISMALGRPV

SEQ ID NO: 25724 - protein, 25 aa, synthetic construct
  source 1..25: note = Seed: YGFLNVIVHSATGFKQSSKALQRPV
YGFLNVIVHSATGFKQISMALHRPV

SEQ ID NO: 25725 - protein, 25 aa, synthetic construct
  source 1..25: note = Seed: YGFLNVIVHSATGFKQSSKALQRPV
YGFLNVIVHSATGFKQISMALIRPV

SEQ ID NO: 25726 - protein, 25 aa, synthetic construct
  source 1..25: note = Seed: YGFLNVIVHSATGFKQSSKALQRPV
YGFLNVIVHSATGFKQISMALLRPV

SEQ ID NO: 25727 - protein, 25 aa, synthetic construct
  source 1..25: note = Seed: YGFLNVIVHSATGFKQSSKALQRPV
YGFLNVIVHSATGFKQISMALMRPV

SEQ ID NO: 25728 - protein, 25 aa, synthetic construct
  source 1..25: note = Seed: YGFLNVIVHSATGFKQSSKALQRPV
YGFLNVIVHSATGFKQISMALNRPV

SEQ ID NO: 25729 - protein, 25 aa, synthetic construct
  source 1..25: note = Seed: YGFLNVIVHSATGFKQSSKALQRPV
YGFLNVIVHSATGFKQISMALPRPV

SEQ ID NO: 25730 - protein, 25 aa, synthetic construct
  source 1..25: note = Seed: YGFLNVIVHSATGFKQSSKALQRPV
YGFLNVIVHSATGFKQISMALQRPV

SEQ ID NO: 25731 - protein, 25 aa, synthetic construct
  source 1..25: note = Seed: YGFLNVIVHSATGFKQSSKALQRPV
YGFLNVIVHSATGFKQISMALRRPV

SEQ ID NO: 25732 - protein, 25 aa, synthetic construct
  source 1..25: note = Seed: YGFLNVIVHSATGFKQSSKALQRPV
YGFLNVIVHSATGFKQISMALSRPV

SEQ ID NO: 25733 - protein, 25 aa, synthetic construct
  source 1..25: note = Seed: YGFLNVIVHSATGFKQSSKALQRPV
YGFLNVIVHSATGFKQISMALTRPV

SEQ ID NO: 25734 - protein, 25 aa, synthetic construct
  source 1..25: note = Seed: YGFLNVIVHSATGFKQSSKALQRPV
YGFLNVIVHSATGFKQISMALVRPV

SEQ ID NO: 25735 - protein, 25 aa, synthetic construct
  source 1..25: note = Seed: YGFLNVIVHSATGFKQSSKALQRPV
YGFLNVIVHSATGFKQISMALYRPV

SEQ ID NO: 25736 - protein, 25 aa, synthetic construct
  source 1..25: note = Seed: YGFLNVIVHSATGFKQSSKALQRPV
YGFLNVIVHSATGFKQISNALARPV

SEQ ID NO: 25737 - protein, 25 aa, synthetic construct
  source 1..25: note = Seed: YGFLNVIVHSATGFKQSSKALQRPV
YGFLNVIVHSATGFKQISNALCRPV

SEQ ID NO: 25738 - protein, 25 aa, synthetic construct
  source 1..25: note = Seed: YGFLNVIVHSATGFKQSSKALQRPV
YGFLNVIVHSATGFKQISNALDRPV

SEQ ID NO: 25739 - protein, 25 aa, synthetic construct
  source 1..25: note = Seed: YGFLNVIVHSATGFKQSSKALQRPV
YGFLNVIVHSATGFKQISNALERPV

SEQ ID NO: 25740 - protein, 25 aa, synthetic construct
  source 1..25: note = Seed: YGFLNVIVHSATGFKQSSKALQRPV
YGFLNVIVHSATGFKQISNALFRPV

SEQ ID NO: 25741 - protein, 25 aa, synthetic construct
  source 1..25: note = Seed: YGFLNVIVHSATGFKQSSKALQRPV
YGFLNVIVHSATGFKQISNALGRPV

SEQ ID NO: 25742 - protein, 25 aa, synthetic construct
  source 1..25: note = Seed: YGFLNVIVHSATGFKQSSKALQRPV
YGFLNVIVHSATGFKQISNALHRPV

SEQ ID NO: 25743 - protein, 25 aa, synthetic construct
  source 1..25: note = Seed: YGFLNVIVHSATGFKQSSKALQRPV
YGFLNVIVHSATGFKQISNALIRPV

SEQ ID NO: 25744 - protein, 25 aa, synthetic construct
  source 1..25: note = Seed: YGFLNVIVHSATGFKQSSKALQRPV
YGFLNVIVHSATGFKQISNALLRPV

SEQ ID NO: 25745 - protein, 25 aa, synthetic construct
  source 1..25: note = Seed: YGFLNVIVHSATGFKQSSKALQRPV
YGFLNVIVHSATGFKQISNALMRPV

SEQ ID NO: 25746 - protein, 25 aa, synthetic construct
  source 1..25: note = Seed: YGFLNVIVHSATGFKQSSKALQRPV
YGFLNVIVHSATGFKQISNALNRPV

SEQ ID NO: 25747 - protein, 25 aa, synthetic construct
  source 1..25: note = Seed: YGFLNVIVHSATGFKQSSKALQRPV
YGFLNVIVHSATGFKQISNALPRPV

SEQ ID NO: 25748 - protein, 25 aa, synthetic construct
  source 1..25: note = Seed: YGFLNVIVHSATGFKQSSKALQRPV
YGFLNVIVHSATGFKQISNALQRPV

SEQ ID NO: 25749 - protein, 25 aa, synthetic construct
  source 1..25: note = Seed: YGFLNVIVHSATGFKQSSKALQRPV
YGFLNVIVHSATGFKQISNALSRPV

SEQ ID NO: 25750 - protein, 25 aa, synthetic construct
  source 1..25: note = Seed: YGFLNVIVHSATGFKQSSKALQRPV
YGFLNVIVHSATGFKQISNALTRPV

SEQ ID NO: 25751 - protein, 25 aa, synthetic construct
  source 1..25: note = Seed: YGFLNVIVHSATGFKQSSKALQRPV
YGFLNVIVHSATGFKQISNALVRPV

SEQ ID NO: 25752 - protein, 25 aa, synthetic construct
  source 1..25: note = Seed: YGFLNVIVHSATGFKQSSKALQRPV
YGFLNVIVHSATGFKQISNALYRPV

SEQ ID NO: 25753 - protein, 25 aa, synthetic construct
  source 1..25: note = Seed: YGFLNVIVHSATGFKQSSKALQRPV
YGFLNVIVHSATGFKQISPALARPV

SEQ ID NO: 25754 - protein, 25 aa, synthetic construct
  source 1..25: note = Seed: YGFLNVIVHSATGFKQSSKALQRPV
YGFLNVIVHSATGFKQISPALCRPV

SEQ ID NO: 25755 - protein, 25 aa, synthetic construct
  source 1..25: note = Seed: YGFLNVIVHSATGFKQSSKALQRPV
YGFLNVIVHSATGFKQISPALDRPV

SEQ ID NO: 25756 - protein, 25 aa, synthetic construct
  source 1..25: note = Seed: YGFLNVIVHSATGFKQSSKALQRPV
YGFLNVIVHSATGFKQISPALERPV

SEQ ID NO: 25757 - protein, 25 aa, synthetic construct
  source 1..25: note = Seed: YGFLNVIVHSATGFKQSSKALQRPV
YGFLNVIVHSATGFKQISPALFRPV

SEQ ID NO: 25758 - protein, 25 aa, synthetic construct
  source 1..25: note = Seed: YGFLNVIVHSATGFKQSSKALQRPV
YGFLNVIVHSATGFKQISPALGRPV

SEQ ID NO: 25759 - protein, 25 aa, synthetic construct
  source 1..25: note = Seed: YGFLNVIVHSATGFKQSSKALQRPV
YGFLNVIVHSATGFKQISPALHRPV

SEQ ID NO: 25760 - protein, 25 aa, synthetic construct
  source 1..25: note = Seed: YGFLNVIVHSATGFKQSSKALQRPV
YGFLNVIVHSATGFKQISPALIRPV

SEQ ID NO: 25761 - protein, 25 aa, synthetic construct
  source 1..25: note = Seed: YGFLNVIVHSATGFKQSSKALQRPV
YGFLNVIVHSATGFKQISPALKRPV

SEQ ID NO: 25762 - protein, 25 aa, synthetic construct
  source 1..25: note = Seed: YGFLNVIVHSATGFKQSSKALQRPV
YGFLNVIVHSATGFKQISPALLRPV

SEQ ID NO: 25763 - protein, 25 aa, synthetic construct
  source 1..25: note = Seed: YGFLNVIVHSATGFKQSSKALQRPV
YGFLNVIVHSATGFKQISPALMRPV

SEQ ID NO: 25764 - protein, 25 aa, synthetic construct
  source 1..25: note = Seed: YGFLNVIVHSATGFKQSSKALQRPV
YGFLNVIVHSATGFKQISPALNRPV

SEQ ID NO: 25765 - protein, 25 aa, synthetic construct
  source 1..25: note = Seed: YGFLNVIVHSATGFKQSSKALQRPV
YGFLNVIVHSATGFKQISPALPRPV

SEQ ID NO: 25766 - protein, 25 aa, synthetic construct
  source 1..25: note = Seed: YGFLNVIVHSATGFKQSSKALQRPV
YGFLNVIVHSATGFKQISPALQRPV

SEQ ID NO: 25767 - protein, 25 aa, synthetic construct
  source 1..25: note = Seed: YGFLNVIVHSATGFKQSSKALQRPV
YGFLNVIVHSATGFKQISPALRRPV

SEQ ID NO: 25768 - protein, 25 aa, synthetic construct
  source 1..25: note = Seed: YGFLNVIVHSATGFKQSSKALQRPV
YGFLNVIVHSATGFKQISPALSRPV

SEQ ID NO: 25769 - protein, 25 aa, synthetic construct
  source 1..25: note = Seed: YGFLNVIVHSATGFKQSSKALQRPV
YGFLNVIVHSATGFKQISPALTRPV

SEQ ID NO: 25770 - protein, 25 aa, synthetic construct
  source 1..25: note = Seed: YGFLNVIVHSATGFKQSSKALQRPV
YGFLNVIVHSATGFKQISPALVRPV

SEQ ID NO: 25771 - protein, 25 aa, synthetic construct
  source 1..25: note = Seed: YGFLNVIVHSATGFKQSSKALQRPV
YGFLNVIVHSATGFKQISPALWRPV

SEQ ID NO: 25772 - protein, 25 aa, synthetic construct
  source 1..25: note = Seed: YGFLNVIVHSATGFKQSSKALQRPV
YGFLNVIVHSATGFKQISPALYRPV

SEQ ID NO: 25773 - protein, 25 aa, synthetic construct
  source 1..25: note = Seed: YGFLNVIVHSATGFKQSSKALQRPV
YGFLNVIVHSATGFKQISQALARPV

SEQ ID NO: 25774 - protein, 25 aa, synthetic construct
  source 1..25: note = Seed: YGFLNVIVHSATGFKQSSKALQRPV
YGFLNVIVHSATGFKQISQALFRPV

SEQ ID NO: 25775 - protein, 25 aa, synthetic construct
  source 1..25: note = Seed: YGFLNVIVHSATGFKQSSKALQRPV
YGFLNVIVHSATGFKQISQALGRPV

SEQ ID NO: 25776 - protein, 25 aa, synthetic construct
  source 1..25: note = Seed: YGFLNVIVHSATGFKQSSKALQRPV
YGFLNVIVHSATGFKQISQALNRPV

SEQ ID NO: 25777 - protein, 25 aa, synthetic construct
  source 1..25: note = Seed: YGFLNVIVHSATGFKQSSKALQRPV
YGFLNVIVHSATGFKQISQALSRPV

SEQ ID NO: 25778 - protein, 25 aa, synthetic construct
  source 1..25: note = Seed: YGFLNVIVHSATGFKQSSKALQRPV
YGFLNVIVHSATGFKQISQALTRPV

SEQ ID NO: 25779 - protein, 25 aa, synthetic construct
  source 1..25: note = Seed: YGFLNVIVHSATGFKQSSKALQRPV
YGFLNVIVHSATGFKQISQALVRPV

SEQ ID NO: 25780 - protein, 25 aa, synthetic construct
  source 1..25: note = Seed: YGFLNVIVHSATGFKQSSKALQRPV
YGFLNVIVHSATGFKQISRALARPV

SEQ ID NO: 25781 - protein, 25 aa, synthetic construct
  source 1..25: note = Seed: YGFLNVIVHSATGFKQSSKALQRPV
YGFLNVIVHSATGFKQISRALCRPV

SEQ ID NO: 25782 - protein, 25 aa, synthetic construct
  source 1..25: note = Seed: YGFLNVIVHSATGFKQSSKALQRPV
YGFLNVIVHSATGFKQISRALDRPV

SEQ ID NO: 25783 - protein, 25 aa, synthetic construct
  source 1..25: note = Seed: YGFLNVIVHSATGFKQSSKALQRPV
YGFLNVIVHSATGFKQISRALERPV

SEQ ID NO: 25784 - protein, 25 aa, synthetic construct
  source 1..25: note = Seed: YGFLNVIVHSATGFKQSSKALQRPV
YGFLNVIVHSATGFKQISRALFRPV

SEQ ID NO: 25785 - protein, 25 aa, synthetic construct
  source 1..25: note = Seed: YGFLNVIVHSATGFKQSSKALQRPV
YGFLNVIVHSATGFKQISRALGRPV

SEQ ID NO: 25786 - protein, 25 aa, synthetic construct
  source 1..25: note = Seed: YGFLNVIVHSATGFKQSSKALQRPV
YGFLNVIVHSATGFKQISRALHRPV

SEQ ID NO: 25787 - protein, 25 aa, synthetic construct
  source 1..25: note = Seed: YGFLNVIVHSATGFKQSSKALQRPV
YGFLNVIVHSATGFKQISRALIRPV

SEQ ID NO: 25788 - protein, 25 aa, synthetic construct
  source 1..25: note = Seed: YGFLNVIVHSATGFKQSSKALQRPV
YGFLNVIVHSATGFKQISRALKRPV

SEQ ID NO: 25789 - protein, 25 aa, synthetic construct
  source 1..25: note = Seed: YGFLNVIVHSATGFKQSSKALQRPV
YGFLNVIVHSATGFKQISRALLRPV

SEQ ID NO: 25790 - protein, 25 aa, synthetic construct
  source 1..25: note = Seed: YGFLNVIVHSATGFKQSSKALQRPV
YGFLNVIVHSATGFKQISRALMRPV

SEQ ID NO: 25791 - protein, 25 aa, synthetic construct
  source 1..25: note = Seed: YGFLNVIVHSATGFKQSSKALQRPV
YGFLNVIVHSATGFKQISRALNRPV

SEQ ID NO: 25792 - protein, 25 aa, synthetic construct
  source 1..25: note = Seed: YGFLNVIVHSATGFKQSSKALQRPV
YGFLNVIVHSATGFKQISRALPRPV

SEQ ID NO: 25793 - protein, 25 aa, synthetic construct
  source 1..25: note = Seed: YGFLNVIVHSATGFKQSSKALQRPV
YGFLNVIVHSATGFKQISRALQRPV

SEQ ID NO: 25794 - protein, 25 aa, synthetic construct
  source 1..25: note = Seed: YGFLNVIVHSATGFKQSSKALQRPV
YGFLNVIVHSATGFKQISRALRRPV

SEQ ID NO: 25795 - protein, 25 aa, synthetic construct
  source 1..25: note = Seed: YGFLNVIVHSATGFKQSSKALQRPV
YGFLNVIVHSATGFKQISRALSRPV

SEQ ID NO: 25796 - protein, 25 aa, synthetic construct
  source 1..25: note = Seed: YGFLNVIVHSATGFKQSSKALQRPV
YGFLNVIVHSATGFKQISRALTRPV

SEQ ID NO: 25797 - protein, 25 aa, synthetic construct
  source 1..25: note = Seed: YGFLNVIVHSATGFKQSSKALQRPV
YGFLNVIVHSATGFKQISRALVRPV

SEQ ID NO: 25798 - protein, 25 aa, synthetic construct
  source 1..25: note = Seed: YGFLNVIVHSATGFKQSSKALQRPV
YGFLNVIVHSATGFKQISRALYRPV

SEQ ID NO: 25799 - protein, 25 aa, synthetic construct
  source 1..25: note = Seed: YGFLNVIVHSATGFKQSSKALQRPV
YGFLNVIVHSATGFKQISSALARPV

SEQ ID NO: 25800 - protein, 25 aa, synthetic construct
  source 1..25: note = Seed: YGFLNVIVHSATGFKQSSKALQRPV
YGFLNVIVHSATGFKQISSALCRPV

SEQ ID NO: 25801 - protein, 25 aa, synthetic construct
  source 1..25: note = Seed: YGFLNVIVHSATGFKQSSKALQRPV
YGFLNVIVHSATGFKQISSALDRPV

SEQ ID NO: 25802 - protein, 25 aa, synthetic construct
  source 1..25: note = Seed: YGFLNVIVHSATGFKQSSKALQRPV
YGFLNVIVHSATGFKQISSALERPV

SEQ ID NO: 25803 - protein, 25 aa, synthetic construct
  source 1..25: note = Seed: YGFLNVIVHSATGFKQSSKALQRPV
YGFLNVIVHSATGFKQISSALFRPV

SEQ ID NO: 25804 - protein, 25 aa, synthetic construct
  source 1..25: note = Seed: YGFLNVIVHSATGFKQSSKALQRPV
YGFLNVIVHSATGFKQISSALGRPV

SEQ ID NO: 25805 - protein, 25 aa, synthetic construct
  source 1..25: note = Seed: YGFLNVIVHSATGFKQSSKALQRPV
YGFLNVIVHSATGFKQISSALHRPV

SEQ ID NO: 25806 - protein, 25 aa, synthetic construct
  source 1..25: note = Seed: YGFLNVIVHSATGFKQSSKALQRPV
YGFLNVIVHSATGFKQISSALIRPV

SEQ ID NO: 25807 - protein, 25 aa, synthetic construct
  source 1..25: note = Seed: YGFLNVIVHSATGFKQSSKALQRPV
YGFLNVIVHSATGFKQISSALKRPV

SEQ ID NO: 25808 - protein, 25 aa, synthetic construct
  source 1..25: note = Seed: YGFLNVIVHSATGFKQSSKALQRPV
YGFLNVIVHSATGFKQISSALLRPV

SEQ ID NO: 25809 - protein, 25 aa, synthetic construct
  source 1..25: note = Seed: YGFLNVIVHSATGFKQSSKALQRPV
YGFLNVIVHSATGFKQISSALMRPV

SEQ ID NO: 25810 - protein, 25 aa, synthetic construct
  source 1..25: note = Seed: YGFLNVIVHSATGFKQSSKALQRPV
YGFLNVIVHSATGFKQISSALNRPV

SEQ ID NO: 25811 - protein, 25 aa, synthetic construct
  source 1..25: note = Seed: YGFLNVIVHSATGFKQSSKALQRPV
YGFLNVIVHSATGFKQISSALPRPV

SEQ ID NO: 25812 - protein, 25 aa, synthetic construct
  source 1..25: note = Seed: YGFLNVIVHSATGFKQSSKALQRPV
YGFLNVIVHSATGFKQISSALQRPV

SEQ ID NO: 25813 - protein, 25 aa, synthetic construct
  source 1..25: note = Seed: YGFLNVIVHSATGFKQSSKALQRPV
YGFLNVIVHSATGFKQISSALRRPV

SEQ ID NO: 25814 - protein, 25 aa, synthetic construct
  source 1..25: note = Seed: YGFLNVIVHSATGFKQSSKALQRPV
YGFLNVIVHSATGFKQISSALSRPV

SEQ ID NO: 25815 - protein, 25 aa, synthetic construct
  source 1..25: note = Seed: YGFLNVIVHSATGFKQSSKALQRPV
YGFLNVIVHSATGFKQISSALTRPV

SEQ ID NO: 25816 - protein, 25 aa, synthetic construct
  source 1..25: note = Seed: YGFLNVIVHSATGFKQSSKALQRPV
YGFLNVIVHSATGFKQISSALVRPV

SEQ ID NO: 25817 - protein, 25 aa, synthetic construct
  source 1..25: note = Seed: YGFLNVIVHSATGFKQSSKALQRPV
YGFLNVIVHSATGFKQISSALYRPV

SEQ ID NO: 25818 - protein, 25 aa, synthetic construct
  source 1..25: note = Seed: YGFLNVIVHSATGFKQSSKALQRPV
YGFLNVIVHSATGFKQISTALCRPV

SEQ ID NO: 25819 - protein, 25 aa, synthetic construct
  source 1..25: note = Seed: YGFLNVIVHSATGFKQSSKALQRPV
YGFLNVIVHSATGFKQISTALDRPV

SEQ ID NO: 25820 - protein, 25 aa, synthetic construct
  source 1..25: note = Seed: YGFLNVIVHSATGFKQSSKALQRPV
YGFLNVIVHSATGFKQISTALERPV

SEQ ID NO: 25821 - protein, 25 aa, synthetic construct
  source 1..25: note = Seed: YGFLNVIVHSATGFKQSSKALQRPV
YGFLNVIVHSATGFKQISTALFRPV

SEQ ID NO: 25822 - protein, 25 aa, synthetic construct
  source 1..25: note = Seed: YGFLNVIVHSATGFKQSSKALQRPV
YGFLNVIVHSATGFKQISTALGRPV

SEQ ID NO: 25823 - protein, 25 aa, synthetic construct
  source 1..25: note = Seed: YGFLNVIVHSATGFKQSSKALQRPV
YGFLNVIVHSATGFKQISTALHRPV

SEQ ID NO: 25824 - protein, 25 aa, synthetic construct
  source 1..25: note = Seed: YGFLNVIVHSATGFKQSSKALQRPV
YGFLNVIVHSATGFKQISTALIRPV

SEQ ID NO: 25825 - protein, 25 aa, synthetic construct
  source 1..25: note = Seed: YGFLNVIVHSATGFKQSSKALQRPV
YGFLNVIVHSATGFKQISTALKRPV

SEQ ID NO: 25826 - protein, 25 aa, synthetic construct
  source 1..25: note = Seed: YGFLNVIVHSATGFKQSSKALQRPV
YGFLNVIVHSATGFKQISTALLRPV

SEQ ID NO: 25827 - protein, 25 aa, synthetic construct
  source 1..25: note = Seed: YGFLNVIVHSATGFKQSSKALQRPV
YGFLNVIVHSATGFKQISTALMRPV

SEQ ID NO: 25828 - protein, 25 aa, synthetic construct
  source 1..25: note = Seed: YGFLNVIVHSATGFKQSSKALQRPV
YGFLNVIVHSATGFKQISTALNRPV

SEQ ID NO: 25829 - protein, 25 aa, synthetic construct
  source 1..25: note = Seed: YGFLNVIVHSATGFKQSSKALQRPV
YGFLNVIVHSATGFKQISTALPRPV

SEQ ID NO: 25830 - protein, 25 aa, synthetic construct
  source 1..25: note = Seed: YGFLNVIVHSATGFKQSSKALQRPV
YGFLNVIVHSATGFKQISTALQRPV

SEQ ID NO: 25831 - protein, 25 aa, synthetic construct
  source 1..25: note = Seed: YGFLNVIVHSATGFKQSSKALQRPV
YGFLNVIVHSATGFKQISTALRRPV

SEQ ID NO: 25832 - protein, 25 aa, synthetic construct
  source 1..25: note = Seed: YGFLNVIVHSATGFKQSSKALQRPV
YGFLNVIVHSATGFKQISTALSRPV

SEQ ID NO: 25833 - protein, 25 aa, synthetic construct
  source 1..25: note = Seed: YGFLNVIVHSATGFKQSSKALQRPV
YGFLNVIVHSATGFKQISTALTRPV

SEQ ID NO: 25834 - protein, 25 aa, synthetic construct
  source 1..25: note = Seed: YGFLNVIVHSATGFKQSSKALQRPV
YGFLNVIVHSATGFKQISTALVRPV

SEQ ID NO: 25835 - protein, 25 aa, synthetic construct
  source 1..25: note = Seed: YGFLNVIVHSATGFKQSSKALQRPV
YGFLNVIVHSATGFKQISTALYRPV

SEQ ID NO: 25836 - protein, 25 aa, synthetic construct
  source 1..25: note = Seed: YGFLNVIVHSATGFKQSSKALQRPV
YGFLNVIVHSATGFKQISVALARPV

SEQ ID NO: 25837 - protein, 25 aa, synthetic construct
  source 1..25: note = Seed: YGFLNVIVHSATGFKQSSKALQRPV
YGFLNVIVHSATGFKQISVALCRPV

SEQ ID NO: 25838 - protein, 25 aa, synthetic construct
  source 1..25: note = Seed: YGFLNVIVHSATGFKQSSKALQRPV
YGFLNVIVHSATGFKQISVALDRPV

SEQ ID NO: 25839 - protein, 25 aa, synthetic construct
  source 1..25: note = Seed: YGFLNVIVHSATGFKQSSKALQRPV
YGFLNVIVHSATGFKQISVALERPV

SEQ ID NO: 25840 - protein, 25 aa, synthetic construct
  source 1..25: note = Seed: YGFLNVIVHSATGFKQSSKALQRPV
YGFLNVIVHSATGFKQISVALFRPV

SEQ ID NO: 25841 - protein, 25 aa, synthetic construct
  source 1..25: note = Seed: YGFLNVIVHSATGFKQSSKALQRPV
YGFLNVIVHSATGFKQISVALGRPV

SEQ ID NO: 25842 - protein, 25 aa, synthetic construct
  source 1..25: note = Seed: YGFLNVIVHSATGFKQSSKALQRPV
YGFLNVIVHSATGFKQISVALHRPV

SEQ ID NO: 25843 - protein, 25 aa, synthetic construct
  source 1..25: note = Seed: YGFLNVIVHSATGFKQSSKALQRPV
YGFLNVIVHSATGFKQISVALIRPV

SEQ ID NO: 25844 - protein, 25 aa, synthetic construct
  source 1..25: note = Seed: YGFLNVIVHSATGFKQSSKALQRPV
YGFLNVIVHSATGFKQISVALKRPV

SEQ ID NO: 25845 - protein, 25 aa, synthetic construct
  source 1..25: note = Seed: YGFLNVIVHSATGFKQSSKALQRPV
YGFLNVIVHSATGFKQISVALLRPV

SEQ ID NO: 25846 - protein, 25 aa, synthetic construct
  source 1..25: note = Seed: YGFLNVIVHSATGFKQSSKALQRPV
YGFLNVIVHSATGFKQISVALMRPV

SEQ ID NO: 25847 - protein, 25 aa, synthetic construct
  source 1..25: note = Seed: YGFLNVIVHSATGFKQSSKALQRPV
YGFLNVIVHSATGFKQISVALNRPV

SEQ ID NO: 25848 - protein, 25 aa, synthetic construct
  source 1..25: note = Seed: YGFLNVIVHSATGFKQSSKALQRPV
YGFLNVIVHSATGFKQISVALPRPV

SEQ ID NO: 25849 - protein, 25 aa, synthetic construct
  source 1..25: note = Seed: YGFLNVIVHSATGFKQSSKALQRPV
YGFLNVIVHSATGFKQISVALQRPV

SEQ ID NO: 25850 - protein, 25 aa, synthetic construct
  source 1..25: note = Seed: YGFLNVIVHSATGFKQSSKALQRPV
YGFLNVIVHSATGFKQISVALRRPV

SEQ ID NO: 25851 - protein, 25 aa, synthetic construct
  source 1..25: note = Seed: YGFLNVIVHSATGFKQSSKALQRPV
YGFLNVIVHSATGFKQISVALSRPV

SEQ ID NO: 25852 - protein, 25 aa, synthetic construct
  source 1..25: note = Seed: YGFLNVIVHSATGFKQSSKALQRPV
YGFLNVIVHSATGFKQISVALTRPV

SEQ ID NO: 25853 - protein, 25 aa, synthetic construct
  source 1..25: note = Seed: YGFLNVIVHSATGFKQSSKALQRPV
YGFLNVIVHSATGFKQISVALVRPV

SEQ ID NO: 25854 - protein, 25 aa, synthetic construct
  source 1..25: note = Seed: YGFLNVIVHSATGFKQSSKALQRPV
YGFLNVIVHSATGFKQISVALYRPV

SEQ ID NO: 25855 - protein, 25 aa, synthetic construct
  source 1..25: note = Seed: YGFLNVIVHSATGFKQSSKALQRPV
YGFLNVIVHSATGFKQISWALARPV

SEQ ID NO: 25856 - protein, 25 aa, synthetic construct
  source 1..25: note = Seed: YGFLNVIVHSATGFKQSSKALQRPV
YGFLNVIVHSATGFKQISWALFRPV

SEQ ID NO: 25857 - protein, 25 aa, synthetic construct
  source 1..25: note = Seed: YGFLNVIVHSATGFKQSSKALQRPV
YGFLNVIVHSATGFKQISWALIRPV

SEQ ID NO: 25858 - protein, 25 aa, synthetic construct
  source 1..25: note = Seed: YGFLNVIVHSATGFKQSSKALQRPV
YGFLNVIVHSATGFKQISWALLRPV

SEQ ID NO: 25859 - protein, 25 aa, synthetic construct
  source 1..25: note = Seed: YGFLNVIVHSATGFKQSSKALQRPV
YGFLNVIVHSATGFKQISWALMRPV

SEQ ID NO: 25860 - protein, 25 aa, synthetic construct
  source 1..25: note = Seed: YGFLNVIVHSATGFKQSSKALQRPV
YGFLNVIVHSATGFKQISWALNRPV

SEQ ID NO: 25861 - protein, 25 aa, synthetic construct
  source 1..25: note = Seed: YGFLNVIVHSATGFKQSSKALQRPV
YGFLNVIVHSATGFKQISWALSRPV

SEQ ID NO: 25862 - protein, 25 aa, synthetic construct
  source 1..25: note = Seed: YGFLNVIVHSATGFKQSSKALQRPV
YGFLNVIVHSATGFKQISWALTRPV

SEQ ID NO: 25863 - protein, 25 aa, synthetic construct
  source 1..25: note = Seed: YGFLNVIVHSATGFKQSSKALQRPV
YGFLNVIVHSATGFKQISWALVRPV

SEQ ID NO: 25864 - protein, 25 aa, synthetic construct
  source 1..25: note = Seed: YGFLNVIVHSATGFKQSSKALQRPV
YGFLNVIVHSATGFKQISWALWRPV

SEQ ID NO: 25865 - protein, 25 aa, synthetic construct
  source 1..25: note = Seed: YGFLNVIVHSATGFKQSSKALQRPV
YGFLNVIVHSATGFKQISWALYRPV

SEQ ID NO: 25866 - protein, 25 aa, synthetic construct
  source 1..25: note = Seed: YGFLNVIVHSATGFKQSSKALQRPV
YGFLNVIVHSATGFKQISYALARPV

SEQ ID NO: 25867 - protein, 25 aa, synthetic construct
  source 1..25: note = Seed: YGFLNVIVHSATGFKQSSKALQRPV
YGFLNVIVHSATGFKQISYALFRPV

SEQ ID NO: 25868 - protein, 25 aa, synthetic construct
  source 1..25: note = Seed: YGFLNVIVHSATGFKQSSKALQRPV
YGFLNVIVHSATGFKQISYALIRPV

SEQ ID NO: 25869 - protein, 25 aa, synthetic construct
  source 1..25: note = Seed: YGFLNVIVHSATGFKQSSKALQRPV
YGFLNVIVHSATGFKQISYALLRPV

SEQ ID NO: 25870 - protein, 25 aa, synthetic construct
  source 1..25: note = Seed: YGFLNVIVHSATGFKQSSKALQRPV
YGFLNVIVHSATGFKQISYALMRPV

SEQ ID NO: 25871 - protein, 25 aa, synthetic construct
  source 1..25: note = Seed: YGFLNVIVHSATGFKQSSKALQRPV
YGFLNVIVHSATGFKQISYALNRPV

SEQ ID NO: 25872 - protein, 25 aa, synthetic construct
  source 1..25: note = Seed: YGFLNVIVHSATGFKQSSKALQRPV
YGFLNVIVHSATGFKQISYALRRPV

SEQ ID NO: 25873 - protein, 25 aa, synthetic construct
  source 1..25: note = Seed: YGFLNVIVHSATGFKQSSKALQRPV
YGFLNVIVHSATGFKQISYALSRPV

SEQ ID NO: 25874 - protein, 25 aa, synthetic construct
  source 1..25: note = Seed: YGFLNVIVHSATGFKQSSKALQRPV
YGFLNVIVHSATGFKQISYALVRPV

SEQ ID NO: 25875 - protein, 25 aa, synthetic construct
  source 1..25: note = Seed: YGFLNVIVHSATGFKQSSKALQRPV
YGFLNVIVHSATGFKQISYALWRPV

SEQ ID NO: 25876 - protein, 25 aa, synthetic construct
  source 1..25: note = Seed: YGFLNVIVHSATGFKQSSKALQRPV
YGFLNVIVHSATGFKQISYALYRPV

SEQ ID NO: 25877 - protein, 25 aa, synthetic construct
  source 1..25: note = Seed: YGFLNVIVHSATGFKQSSKALQRPV
YGFLNVIVHSATGFKQKSFALFRPV

SEQ ID NO: 25878 - protein, 25 aa, synthetic construct
  source 1..25: note = Seed: YGFLNVIVHSATGFKQSSKALQRPV
YGFLNVIVHSATGFKQKSFALLRPV

SEQ ID NO: 25879 - protein, 25 aa, synthetic construct
  source 1..25: note = Seed: YGFLNVIVHSATGFKQSSKALQRPV
YGFLNVIVHSATGFKQKSKALARPV

SEQ ID NO: 25880 - protein, 25 aa, synthetic construct
  source 1..25: note = Seed: YGFLNVIVHSATGFKQSSKALQRPV
YGFLNVIVHSATGFKQKSRALARPV

SEQ ID NO: 25881 - protein, 25 aa, synthetic construct
  source 1..25: note = Seed: YGFLNVIVHSATGFKQSSKALQRPV
YGFLNVIVHSATGFKQKSRALSRPV

SEQ ID NO: 25882 - protein, 25 aa, synthetic construct
  source 1..25: note = Seed: YGFLNVIVHSATGFKQSSKALQRPV
YGFLNVIVHSATGFKQLSAALARPV

SEQ ID NO: 25883 - protein, 25 aa, synthetic construct
  source 1..25: note = Seed: YGFLNVIVHSATGFKQSSKALQRPV
YGFLNVIVHSATGFKQLSAALCRPV

SEQ ID NO: 25884 - protein, 25 aa, synthetic construct
  source 1..25: note = Seed: YGFLNVIVHSATGFKQSSKALQRPV
YGFLNVIVHSATGFKQLSAALDRPV

SEQ ID NO: 25885 - protein, 25 aa, synthetic construct
  source 1..25: note = Seed: YGFLNVIVHSATGFKQSSKALQRPV
YGFLNVIVHSATGFKQLSAALERPV

SEQ ID NO: 25886 - protein, 25 aa, synthetic construct
  source 1..25: note = Seed: YGFLNVIVHSATGFKQSSKALQRPV
YGFLNVIVHSATGFKQLSAALFRPV

SEQ ID NO: 25887 - protein, 25 aa, synthetic construct
  source 1..25: note = Seed: YGFLNVIVHSATGFKQSSKALQRPV
YGFLNVIVHSATGFKQLSAALGRPV

SEQ ID NO: 25888 - protein, 25 aa, synthetic construct
  source 1..25: note = Seed: YGFLNVIVHSATGFKQSSKALQRPV
YGFLNVIVHSATGFKQLSAALHRPV

SEQ ID NO: 25889 - protein, 25 aa, synthetic construct
  source 1..25: note = Seed: YGFLNVIVHSATGFKQSSKALQRPV
YGFLNVIVHSATGFKQLSAALIRPV

SEQ ID NO: 25890 - protein, 25 aa, synthetic construct
  source 1..25: note = Seed: YGFLNVIVHSATGFKQSSKALQRPV
YGFLNVIVHSATGFKQLSAALKRPV

SEQ ID NO: 25891 - protein, 25 aa, synthetic construct
  source 1..25: note = Seed: YGFLNVIVHSATGFKQSSKALQRPV
YGFLNVIVHSATGFKQLSAALLRPV

SEQ ID NO: 25892 - protein, 25 aa, synthetic construct
  source 1..25: note = Seed: YGFLNVIVHSATGFKQSSKALQRPV
YGFLNVIVHSATGFKQLSAALMRPV

SEQ ID NO: 25893 - protein, 25 aa, synthetic construct
  source 1..25: note = Seed: YGFLNVIVHSATGFKQSSKALQRPV
YGFLNVIVHSATGFKQLSAALNRPV

SEQ ID NO: 25894 - protein, 25 aa, synthetic construct
  source 1..25: note = Seed: YGFLNVIVHSATGFKQSSKALQRPV
YGFLNVIVHSATGFKQLSAALPRPV

SEQ ID NO: 25895 - protein, 25 aa, synthetic construct
  source 1..25: note = Seed: YGFLNVIVHSATGFKQSSKALQRPV
YGFLNVIVHSATGFKQLSAALQRPV

SEQ ID NO: 25896 - protein, 25 aa, synthetic construct
  source 1..25: note = Seed: YGFLNVIVHSATGFKQSSKALQRPV
YGFLNVIVHSATGFKQLSAALRRPV

SEQ ID NO: 25897 - protein, 25 aa, synthetic construct
  source 1..25: note = Seed: YGFLNVIVHSATGFKQSSKALQRPV
YGFLNVIVHSATGFKQLSAALSRPV

SEQ ID NO: 25898 - protein, 25 aa, synthetic construct
  source 1..25: note = Seed: YGFLNVIVHSATGFKQSSKALQRPV
YGFLNVIVHSATGFKQLSAALTRPV

SEQ ID NO: 25899 - protein, 25 aa, synthetic construct
  source 1..25: note = Seed: YGFLNVIVHSATGFKQSSKALQRPV
YGFLNVIVHSATGFKQLSAALVRPV

SEQ ID NO: 25900 - protein, 25 aa, synthetic construct
  source 1..25: note = Seed: YGFLNVIVHSATGFKQSSKALQRPV
YGFLNVIVHSATGFKQLSAALWRPV

SEQ ID NO: 25901 - protein, 25 aa, synthetic construct
  source 1..25: note = Seed: YGFLNVIVHSATGFKQSSKALQRPV
YGFLNVIVHSATGFKQLSAALYRPV

SEQ ID NO: 25902 - protein, 25 aa, synthetic construct
  source 1..25: note = Seed: YGFLNVIVHSATGFKQSSKALQRPV
YGFLNVIVHSATGFKQLSCALARPV

SEQ ID NO: 25903 - protein, 25 aa, synthetic construct
  source 1..25: note = Seed: YGFLNVIVHSATGFKQSSKALQRPV
YGFLNVIVHSATGFKQLSCALHRPV

SEQ ID NO: 25904 - protein, 25 aa, synthetic construct
  source 1..25: note = Seed: YGFLNVIVHSATGFKQSSKALQRPV
YGFLNVIVHSATGFKQLSCALNRPV

SEQ ID NO: 25905 - protein, 25 aa, synthetic construct
  source 1..25: note = Seed: YGFLNVIVHSATGFKQSSKALQRPV
YGFLNVIVHSATGFKQLSCALSRPV

SEQ ID NO: 25906 - protein, 25 aa, synthetic construct
  source 1..25: note = Seed: YGFLNVIVHSATGFKQSSKALQRPV
YGFLNVIVHSATGFKQLSCALTRPV

SEQ ID NO: 25907 - protein, 25 aa, synthetic construct
  source 1..25: note = Seed: YGFLNVIVHSATGFKQSSKALQRPV
YGFLNVIVHSATGFKQLSDALARPV

SEQ ID NO: 25908 - protein, 25 aa, synthetic construct
  source 1..25: note = Seed: YGFLNVIVHSATGFKQSSKALQRPV
YGFLNVIVHSATGFKQLSDALIRPV

SEQ ID NO: 25909 - protein, 25 aa, synthetic construct
  source 1..25: note = Seed: YGFLNVIVHSATGFKQSSKALQRPV
YGFLNVIVHSATGFKQLSDALNRPV

SEQ ID NO: 25910 - protein, 25 aa, synthetic construct
  source 1..25: note = Seed: YGFLNVIVHSATGFKQSSKALQRPV
YGFLNVIVHSATGFKQLSDALSRPV

SEQ ID NO: 25911 - protein, 25 aa, synthetic construct
  source 1..25: note = Seed: YGFLNVIVHSATGFKQSSKALQRPV
YGFLNVIVHSATGFKQLSDALTRPV

SEQ ID NO: 25912 - protein, 25 aa, synthetic construct
  source 1..25: note = Seed: YGFLNVIVHSATGFKQSSKALQRPV
YGFLNVIVHSATGFKQLSDALVRPV

SEQ ID NO: 25913 - protein, 25 aa, synthetic construct
  source 1..25: note = Seed: YGFLNVIVHSATGFKQSSKALQRPV
YGFLNVIVHSATGFKQLSEALARPV

SEQ ID NO: 25914 - protein, 25 aa, synthetic construct
  source 1..25: note = Seed: YGFLNVIVHSATGFKQSSKALQRPV
YGFLNVIVHSATGFKQLSEALGRPV

SEQ ID NO: 25915 - protein, 25 aa, synthetic construct
  source 1..25: note = Seed: YGFLNVIVHSATGFKQSSKALQRPV
YGFLNVIVHSATGFKQLSEALIRPV

SEQ ID NO: 25916 - protein, 25 aa, synthetic construct
  source 1..25: note = Seed: YGFLNVIVHSATGFKQSSKALQRPV
YGFLNVIVHSATGFKQLSEALNRPV

SEQ ID NO: 25917 - protein, 25 aa, synthetic construct
  source 1..25: note = Seed: YGFLNVIVHSATGFKQSSKALQRPV
YGFLNVIVHSATGFKQLSEALSRPV

SEQ ID NO: 25918 - protein, 25 aa, synthetic construct
  source 1..25: note = Seed: YGFLNVIVHSATGFKQSSKALQRPV
YGFLNVIVHSATGFKQLSEALTRPV

SEQ ID NO: 25919 - protein, 25 aa, synthetic construct
  source 1..25: note = Seed: YGFLNVIVHSATGFKQSSKALQRPV
YGFLNVIVHSATGFKQLSEALVRPV

SEQ ID NO: 25920 - protein, 25 aa, synthetic construct
  source 1..25: note = Seed: YGFLNVIVHSATGFKQSSKALQRPV
YGFLNVIVHSATGFKQLSFALARPV

SEQ ID NO: 25921 - protein, 25 aa, synthetic construct
  source 1..25: note = Seed: YGFLNVIVHSATGFKQSSKALQRPV
YGFLNVIVHSATGFKQLSFALDRPV

SEQ ID NO: 25922 - protein, 25 aa, synthetic construct
  source 1..25: note = Seed: YGFLNVIVHSATGFKQSSKALQRPV
YGFLNVIVHSATGFKQLSFALERPV

SEQ ID NO: 25923 - protein, 25 aa, synthetic construct
  source 1..25: note = Seed: YGFLNVIVHSATGFKQSSKALQRPV
YGFLNVIVHSATGFKQLSFALFRPV

SEQ ID NO: 25924 - protein, 25 aa, synthetic construct
  source 1..25: note = Seed: YGFLNVIVHSATGFKQSSKALQRPV
YGFLNVIVHSATGFKQLSFALHRPV

SEQ ID NO: 25925 - protein, 25 aa, synthetic construct
  source 1..25: note = Seed: YGFLNVIVHSATGFKQSSKALQRPV
YGFLNVIVHSATGFKQLSFALIRPV

SEQ ID NO: 25926 - protein, 25 aa, synthetic construct
  source 1..25: note = Seed: YGFLNVIVHSATGFKQSSKALQRPV
YGFLNVIVHSATGFKQLSFALLRPV

SEQ ID NO: 25927 - protein, 25 aa, synthetic construct
  source 1..25: note = Seed: YGFLNVIVHSATGFKQSSKALQRPV
YGFLNVIVHSATGFKQLSFALMRPV

SEQ ID NO: 25928 - protein, 25 aa, synthetic construct
  source 1..25: note = Seed: YGFLNVIVHSATGFKQSSKALQRPV
YGFLNVIVHSATGFKQLSFALNRPV

SEQ ID NO: 25929 - protein, 25 aa, synthetic construct
  source 1..25: note = Seed: YGFLNVIVHSATGFKQSSKALQRPV
YGFLNVIVHSATGFKQLSFALPRPV

SEQ ID NO: 25930 - protein, 25 aa, synthetic construct
  source 1..25: note = Seed: YGFLNVIVHSATGFKQSSKALQRPV
YGFLNVIVHSATGFKQLSFALQRPV

SEQ ID NO: 25931 - protein, 25 aa, synthetic construct
  source 1..25: note = Seed: YGFLNVIVHSATGFKQSSKALQRPV
YGFLNVIVHSATGFKQLSFALRRPV

SEQ ID NO: 25932 - protein, 25 aa, synthetic construct
  source 1..25: note = Seed: YGFLNVIVHSATGFKQSSKALQRPV
YGFLNVIVHSATGFKQLSFALSRPV

SEQ ID NO: 25933 - protein, 25 aa, synthetic construct
  source 1..25: note = Seed: YGFLNVIVHSATGFKQSSKALQRPV
YGFLNVIVHSATGFKQLSFALTRPV

SEQ ID NO: 25934 - protein, 25 aa, synthetic construct
  source 1..25: note = Seed: YGFLNVIVHSATGFKQSSKALQRPV
YGFLNVIVHSATGFKQLSFALVRPV

SEQ ID NO: 25935 - protein, 25 aa, synthetic construct
  source 1..25: note = Seed: YGFLNVIVHSATGFKQSSKALQRPV
YGFLNVIVHSATGFKQLSFALWRPV

SEQ ID NO: 25936 - protein, 25 aa, synthetic construct
  source 1..25: note = Seed: YGFLNVIVHSATGFKQSSKALQRPV
YGFLNVIVHSATGFKQLSFALYRPV

SEQ ID NO: 25937 - protein, 25 aa, synthetic construct
  source 1..25: note = Seed: YGFLNVIVHSATGFKQSSKALQRPV
YGFLNVIVHSATGFKQLSGALARPV

SEQ ID NO: 25938 - protein, 25 aa, synthetic construct
  source 1..25: note = Seed: YGFLNVIVHSATGFKQSSKALQRPV
YGFLNVIVHSATGFKQLSGALCRPV

SEQ ID NO: 25939 - protein, 25 aa, synthetic construct
  source 1..25: note = Seed: YGFLNVIVHSATGFKQSSKALQRPV
YGFLNVIVHSATGFKQLSGALDRPV

SEQ ID NO: 25940 - protein, 25 aa, synthetic construct
  source 1..25: note = Seed: YGFLNVIVHSATGFKQSSKALQRPV
YGFLNVIVHSATGFKQLSGALERPV

SEQ ID NO: 25941 - protein, 25 aa, synthetic construct
  source 1..25: note = Seed: YGFLNVIVHSATGFKQSSKALQRPV
YGFLNVIVHSATGFKQLSGALFRPV

SEQ ID NO: 25942 - protein, 25 aa, synthetic construct
  source 1..25: note = Seed: YGFLNVIVHSATGFKQSSKALQRPV
YGFLNVIVHSATGFKQLSGALGRPV

SEQ ID NO: 25943 - protein, 25 aa, synthetic construct
  source 1..25: note = Seed: YGFLNVIVHSATGFKQSSKALQRPV
YGFLNVIVHSATGFKQLSGALHRPV

SEQ ID NO: 25944 - protein, 25 aa, synthetic construct
  source 1..25: note = Seed: YGFLNVIVHSATGFKQSSKALQRPV
YGFLNVIVHSATGFKQLSGALIRPV

SEQ ID NO: 25945 - protein, 25 aa, synthetic construct
  source 1..25: note = Seed: YGFLNVIVHSATGFKQSSKALQRPV
YGFLNVIVHSATGFKQLSGALLRPV

SEQ ID NO: 25946 - protein, 25 aa, synthetic construct
  source 1..25: note = Seed: YGFLNVIVHSATGFKQSSKALQRPV
YGFLNVIVHSATGFKQLSGALMRPV

SEQ ID NO: 25947 - protein, 25 aa, synthetic construct
  source 1..25: note = Seed: YGFLNVIVHSATGFKQSSKALQRPV
YGFLNVIVHSATGFKQLSGALNRPV

SEQ ID NO: 25948 - protein, 25 aa, synthetic construct
  source 1..25: note = Seed: YGFLNVIVHSATGFKQSSKALQRPV
YGFLNVIVHSATGFKQLSGALPRPV

SEQ ID NO: 25949 - protein, 25 aa, synthetic construct
  source 1..25: note = Seed: YGFLNVIVHSATGFKQSSKALQRPV
YGFLNVIVHSATGFKQLSGALQRPV

SEQ ID NO: 25950 - protein, 25 aa, synthetic construct
  source 1..25: note = Seed: YGFLNVIVHSATGFKQSSKALQRPV
YGFLNVIVHSATGFKQLSGALSRPV

SEQ ID NO: 25951 - protein, 25 aa, synthetic construct
  source 1..25: note = Seed: YGFLNVIVHSATGFKQSSKALQRPV
YGFLNVIVHSATGFKQLSGALTRPV

SEQ ID NO: 25952 - protein, 25 aa, synthetic construct
  source 1..25: note = Seed: YGFLNVIVHSATGFKQSSKALQRPV
YGFLNVIVHSATGFKQLSGALVRPV

SEQ ID NO: 25953 - protein, 25 aa, synthetic construct
  source 1..25: note = Seed: YGFLNVIVHSATGFKQSSKALQRPV
YGFLNVIVHSATGFKQLSGALYRPV

SEQ ID NO: 25954 - protein, 25 aa, synthetic construct
  source 1..25: note = Seed: YGFLNVIVHSATGFKQSSKALQRPV
YGFLNVIVHSATGFKQLSHALARPV

SEQ ID NO: 25955 - protein, 25 aa, synthetic construct
  source 1..25: note = Seed: YGFLNVIVHSATGFKQSSKALQRPV
YGFLNVIVHSATGFKQLSHALFRPV

SEQ ID NO: 25956 - protein, 25 aa, synthetic construct
  source 1..25: note = Seed: YGFLNVIVHSATGFKQSSKALQRPV
YGFLNVIVHSATGFKQLSHALGRPV

SEQ ID NO: 25957 - protein, 25 aa, synthetic construct
  source 1..25: note = Seed: YGFLNVIVHSATGFKQSSKALQRPV
YGFLNVIVHSATGFKQLSHALHRPV

SEQ ID NO: 25958 - protein, 25 aa, synthetic construct
  source 1..25: note = Seed: YGFLNVIVHSATGFKQSSKALQRPV
YGFLNVIVHSATGFKQLSHALIRPV

SEQ ID NO: 25959 - protein, 25 aa, synthetic construct
  source 1..25: note = Seed: YGFLNVIVHSATGFKQSSKALQRPV
YGFLNVIVHSATGFKQLSHALMRPV

SEQ ID NO: 25960 - protein, 25 aa, synthetic construct
  source 1..25: note = Seed: YGFLNVIVHSATGFKQSSKALQRPV
YGFLNVIVHSATGFKQLSHALNRPV

SEQ ID NO: 25961 - protein, 25 aa, synthetic construct
  source 1..25: note = Seed: YGFLNVIVHSATGFKQSSKALQRPV
YGFLNVIVHSATGFKQLSHALSRPV

SEQ ID NO: 25962 - protein, 25 aa, synthetic construct
  source 1..25: note = Seed: YGFLNVIVHSATGFKQSSKALQRPV
YGFLNVIVHSATGFKQLSHALTRPV

SEQ ID NO: 25963 - protein, 25 aa, synthetic construct
  source 1..25: note = Seed: YGFLNVIVHSATGFKQSSKALQRPV
YGFLNVIVHSATGFKQLSHALVRPV

SEQ ID NO: 25964 - protein, 25 aa, synthetic construct
  source 1..25: note = Seed: YGFLNVIVHSATGFKQSSKALQRPV
YGFLNVIVHSATGFKQLSIALARPV

SEQ ID NO: 25965 - protein, 25 aa, synthetic construct
  source 1..25: note = Seed: YGFLNVIVHSATGFKQSSKALQRPV
YGFLNVIVHSATGFKQLSIALCRPV

SEQ ID NO: 25966 - protein, 25 aa, synthetic construct
  source 1..25: note = Seed: YGFLNVIVHSATGFKQSSKALQRPV
YGFLNVIVHSATGFKQLSIALDRPV

SEQ ID NO: 25967 - protein, 25 aa, synthetic construct
  source 1..25: note = Seed: YGFLNVIVHSATGFKQSSKALQRPV
YGFLNVIVHSATGFKQLSIALERPV

SEQ ID NO: 25968 - protein, 25 aa, synthetic construct
  source 1..25: note = Seed: YGFLNVIVHSATGFKQSSKALQRPV
YGFLNVIVHSATGFKQLSIALFRPV

SEQ ID NO: 25969 - protein, 25 aa, synthetic construct
  source 1..25: note = Seed: YGFLNVIVHSATGFKQSSKALQRPV
YGFLNVIVHSATGFKQLSIALGRPV

SEQ ID NO: 25970 - protein, 25 aa, synthetic construct
  source 1..25: note = Seed: YGFLNVIVHSATGFKQSSKALQRPV
YGFLNVIVHSATGFKQLSIALHRPV

SEQ ID NO: 25971 - protein, 25 aa, synthetic construct
  source 1..25: note = Seed: YGFLNVIVHSATGFKQSSKALQRPV
YGFLNVIVHSATGFKQLSIALIRPV

SEQ ID NO: 25972 - protein, 25 aa, synthetic construct
  source 1..25: note = Seed: YGFLNVIVHSATGFKQSSKALQRPV
YGFLNVIVHSATGFKQLSIALKRPV

SEQ ID NO: 25973 - protein, 25 aa, synthetic construct
  source 1..25: note = Seed: YGFLNVIVHSATGFKQSSKALQRPV
YGFLNVIVHSATGFKQLSIALLRPV

SEQ ID NO: 25974 - protein, 25 aa, synthetic construct
  source 1..25: note = Seed: YGFLNVIVHSATGFKQSSKALQRPV
YGFLNVIVHSATGFKQLSIALMRPV

SEQ ID NO: 25975 - protein, 25 aa, synthetic construct
  source 1..25: note = Seed: YGFLNVIVHSATGFKQSSKALQRPV
YGFLNVIVHSATGFKQLSIALNRPV

SEQ ID NO: 25976 - protein, 25 aa, synthetic construct
  source 1..25: note = Seed: YGFLNVIVHSATGFKQSSKALQRPV
YGFLNVIVHSATGFKQLSIALPRPV

SEQ ID NO: 25977 - protein, 25 aa, synthetic construct
  source 1..25: note = Seed: YGFLNVIVHSATGFKQSSKALQRPV
YGFLNVIVHSATGFKQLSIALQRPV

SEQ ID NO: 25978 - protein, 25 aa, synthetic construct
  source 1..25: note = Seed: YGFLNVIVHSATGFKQSSKALQRPV
YGFLNVIVHSATGFKQLSIALRRPV

SEQ ID NO: 25979 - protein, 25 aa, synthetic construct
  source 1..25: note = Seed: YGFLNVIVHSATGFKQSSKALQRPV
YGFLNVIVHSATGFKQLSIALSRPV

SEQ ID NO: 25980 - protein, 25 aa, synthetic construct
  source 1..25: note = Seed: YGFLNVIVHSATGFKQSSKALQRPV
YGFLNVIVHSATGFKQLSIALTRPV

SEQ ID NO: 25981 - protein, 25 aa, synthetic construct
  source 1..25: note = Seed: YGFLNVIVHSATGFKQSSKALQRPV
YGFLNVIVHSATGFKQLSIALVRPV

SEQ ID NO: 25982 - protein, 25 aa, synthetic construct
  source 1..25: note = Seed: YGFLNVIVHSATGFKQSSKALQRPV
YGFLNVIVHSATGFKQLSIALYRPV

SEQ ID NO: 25983 - protein, 25 aa, synthetic construct
  source 1..25: note = Seed: YGFLNVIVHSATGFKQSSKALQRPV
YGFLNVIVHSATGFKQLSKALARPV

SEQ ID NO: 25984 - protein, 25 aa, synthetic construct
  source 1..25: note = Seed: YGFLNVIVHSATGFKQSSKALQRPV
YGFLNVIVHSATGFKQLSKALCRPV

SEQ ID NO: 25985 - protein, 25 aa, synthetic construct
  source 1..25: note = Seed: YGFLNVIVHSATGFKQSSKALQRPV
YGFLNVIVHSATGFKQLSKALDRPV

SEQ ID NO: 25986 - protein, 25 aa, synthetic construct
  source 1..25: note = Seed: YGFLNVIVHSATGFKQSSKALQRPV
YGFLNVIVHSATGFKQLSKALERPV

SEQ ID NO: 25987 - protein, 25 aa, synthetic construct
  source 1..25: note = Seed: YGFLNVIVHSATGFKQSSKALQRPV
YGFLNVIVHSATGFKQLSKALGRPV

SEQ ID NO: 25988 - protein, 25 aa, synthetic construct
  source 1..25: note = Seed: YGFLNVIVHSATGFKQSSKALQRPV
YGFLNVIVHSATGFKQLSKALHRPV

SEQ ID NO: 25989 - protein, 25 aa, synthetic construct
  source 1..25: note = Seed: YGFLNVIVHSATGFKQSSKALQRPV
YGFLNVIVHSATGFKQLSKALIRPV

SEQ ID NO: 25990 - protein, 25 aa, synthetic construct
  source 1..25: note = Seed: YGFLNVIVHSATGFKQSSKALQRPV
YGFLNVIVHSATGFKQLSKALKRPV

SEQ ID NO: 25991 - protein, 25 aa, synthetic construct
  source 1..25: note = Seed: YGFLNVIVHSATGFKQSSKALQRPV
YGFLNVIVHSATGFKQLSKALLRPV

SEQ ID NO: 25992 - protein, 25 aa, synthetic construct
  source 1..25: note = Seed: YGFLNVIVHSATGFKQSSKALQRPV
YGFLNVIVHSATGFKQLSKALMRPV

SEQ ID NO: 25993 - protein, 25 aa, synthetic construct
  source 1..25: note = Seed: YGFLNVIVHSATGFKQSSKALQRPV
YGFLNVIVHSATGFKQLSKALNRPV

SEQ ID NO: 25994 - protein, 25 aa, synthetic construct
  source 1..25: note = Seed: YGFLNVIVHSATGFKQSSKALQRPV
YGFLNVIVHSATGFKQLSKALPRPV

SEQ ID NO: 25995 - protein, 25 aa, synthetic construct
  source 1..25: note = Seed: YGFLNVIVHSATGFKQSSKALQRPV
YGFLNVIVHSATGFKQLSKALQRPV

SEQ ID NO: 25996 - protein, 25 aa, synthetic construct
  source 1..25: note = Seed: YGFLNVIVHSATGFKQSSKALQRPV
YGFLNVIVHSATGFKQLSKALRRPV

SEQ ID NO: 25997 - protein, 25 aa, synthetic construct
  source 1..25: note = Seed: YGFLNVIVHSATGFKQSSKALQRPV
YGFLNVIVHSATGFKQLSKALSRPV

SEQ ID NO: 25998 - protein, 25 aa, synthetic construct
  source 1..25: note = Seed: YGFLNVIVHSATGFKQSSKALQRPV
YGFLNVIVHSATGFKQLSKALTRPV

SEQ ID NO: 25999 - protein, 25 aa, synthetic construct
  source 1..25: note = Seed: YGFLNVIVHSATGFKQSSKALQRPV
YGFLNVIVHSATGFKQLSKALVRPV

SEQ ID NO: 26000 - protein, 25 aa, synthetic construct
  source 1..25: note = Seed: YGFLNVIVHSATGFKQSSKALQRPV
YGFLNVIVHSATGFKQLSKALYRPV

SEQ ID NO: 26001 - protein, 25 aa, synthetic construct
  source 1..25: note = Seed: YGFLNVIVHSATGFKQSSKALQRPV
YGFLNVIVHSATGFKQLSLALARPV

SEQ ID NO: 26002 - protein, 25 aa, synthetic construct
  source 1..25: note = Seed: YGFLNVIVHSATGFKQSSKALQRPV
YGFLNVIVHSATGFKQLSLALDRPV

SEQ ID NO: 26003 - protein, 25 aa, synthetic construct
  source 1..25: note = Seed: YGFLNVIVHSATGFKQSSKALQRPV
YGFLNVIVHSATGFKQLSLALERPV

SEQ ID NO: 26004 - protein, 25 aa, synthetic construct
  source 1..25: note = Seed: YGFLNVIVHSATGFKQSSKALQRPV
YGFLNVIVHSATGFKQLSLALFRPV

SEQ ID NO: 26005 - protein, 25 aa, synthetic construct
  source 1..25: note = Seed: YGFLNVIVHSATGFKQSSKALQRPV
YGFLNVIVHSATGFKQLSLALGRPV

SEQ ID NO: 26006 - protein, 25 aa, synthetic construct
  source 1..25: note = Seed: YGFLNVIVHSATGFKQSSKALQRPV
YGFLNVIVHSATGFKQLSLALHRPV

SEQ ID NO: 26007 - protein, 25 aa, synthetic construct
  source 1..25: note = Seed: YGFLNVIVHSATGFKQSSKALQRPV
YGFLNVIVHSATGFKQLSLALIRPV

SEQ ID NO: 26008 - protein, 25 aa, synthetic construct
  source 1..25: note = Seed: YGFLNVIVHSATGFKQSSKALQRPV
YGFLNVIVHSATGFKQLSLALLRPV

SEQ ID NO: 26009 - protein, 25 aa, synthetic construct
  source 1..25: note = Seed: YGFLNVIVHSATGFKQSSKALQRPV
YGFLNVIVHSATGFKQLSLALMRPV

SEQ ID NO: 26010 - protein, 25 aa, synthetic construct
  source 1..25: note = Seed: YGFLNVIVHSATGFKQSSKALQRPV
YGFLNVIVHSATGFKQLSLALNRPV

SEQ ID NO: 26011 - protein, 25 aa, synthetic construct
  source 1..25: note = Seed: YGFLNVIVHSATGFKQSSKALQRPV
YGFLNVIVHSATGFKQLSLALPRPV

SEQ ID NO: 26012 - protein, 25 aa, synthetic construct
  source 1..25: note = Seed: YGFLNVIVHSATGFKQSSKALQRPV
YGFLNVIVHSATGFKQLSLALQRPV

SEQ ID NO: 26013 - protein, 25 aa, synthetic construct
  source 1..25: note = Seed: YGFLNVIVHSATGFKQSSKALQRPV
YGFLNVIVHSATGFKQLSLALRRPV

SEQ ID NO: 26014 - protein, 25 aa, synthetic construct
  source 1..25: note = Seed: YGFLNVIVHSATGFKQSSKALQRPV
YGFLNVIVHSATGFKQLSLALSRPV

SEQ ID NO: 26015 - protein, 25 aa, synthetic construct
  source 1..25: note = Seed: YGFLNVIVHSATGFKQSSKALQRPV
YGFLNVIVHSATGFKQLSLALTRPV

SEQ ID NO: 26016 - protein, 25 aa, synthetic construct
  source 1..25: note = Seed: YGFLNVIVHSATGFKQSSKALQRPV
YGFLNVIVHSATGFKQLSLALVRPV

SEQ ID NO: 26017 - protein, 25 aa, synthetic construct
  source 1..25: note = Seed: YGFLNVIVHSATGFKQSSKALQRPV
YGFLNVIVHSATGFKQLSLALYRPV

SEQ ID NO: 26018 - protein, 25 aa, synthetic construct
  source 1..25: note = Seed: YGFLNVIVHSATGFKQSSKALQRPV
YGFLNVIVHSATGFKQLSMALARPV

SEQ ID NO: 26019 - protein, 25 aa, synthetic construct
  source 1..25: note = Seed: YGFLNVIVHSATGFKQSSKALQRPV
YGFLNVIVHSATGFKQLSMALDRPV

SEQ ID NO: 26020 - protein, 25 aa, synthetic construct
  source 1..25: note = Seed: YGFLNVIVHSATGFKQSSKALQRPV
YGFLNVIVHSATGFKQLSMALERPV

SEQ ID NO: 26021 - protein, 25 aa, synthetic construct
  source 1..25: note = Seed: YGFLNVIVHSATGFKQSSKALQRPV
YGFLNVIVHSATGFKQLSMALFRPV

SEQ ID NO: 26022 - protein, 25 aa, synthetic construct
  source 1..25: note = Seed: YGFLNVIVHSATGFKQSSKALQRPV
YGFLNVIVHSATGFKQLSMALGRPV

SEQ ID NO: 26023 - protein, 25 aa, synthetic construct
  source 1..25: note = Seed: YGFLNVIVHSATGFKQSSKALQRPV
YGFLNVIVHSATGFKQLSMALHRPV

SEQ ID NO: 26024 - protein, 25 aa, synthetic construct
  source 1..25: note = Seed: YGFLNVIVHSATGFKQSSKALQRPV
YGFLNVIVHSATGFKQLSMALIRPV

SEQ ID NO: 26025 - protein, 25 aa, synthetic construct
  source 1..25: note = Seed: YGFLNVIVHSATGFKQSSKALQRPV
YGFLNVIVHSATGFKQLSMALLRPV

SEQ ID NO: 26026 - protein, 25 aa, synthetic construct
  source 1..25: note = Seed: YGFLNVIVHSATGFKQSSKALQRPV
YGFLNVIVHSATGFKQLSMALMRPV

SEQ ID NO: 26027 - protein, 25 aa, synthetic construct
  source 1..25: note = Seed: YGFLNVIVHSATGFKQSSKALQRPV
YGFLNVIVHSATGFKQLSMALNRPV

SEQ ID NO: 26028 - protein, 25 aa, synthetic construct
  source 1..25: note = Seed: YGFLNVIVHSATGFKQSSKALQRPV
YGFLNVIVHSATGFKQLSMALPRPV

SEQ ID NO: 26029 - protein, 25 aa, synthetic construct
  source 1..25: note = Seed: YGFLNVIVHSATGFKQSSKALQRPV
YGFLNVIVHSATGFKQLSMALQRPV

SEQ ID NO: 26030 - protein, 25 aa, synthetic construct
  source 1..25: note = Seed: YGFLNVIVHSATGFKQSSKALQRPV
YGFLNVIVHSATGFKQLSMALRRPV

SEQ ID NO: 26031 - protein, 25 aa, synthetic construct
  source 1..25: note = Seed: YGFLNVIVHSATGFKQSSKALQRPV
YGFLNVIVHSATGFKQLSMALSRPV

SEQ ID NO: 26032 - protein, 25 aa, synthetic construct
  source 1..25: note = Seed: YGFLNVIVHSATGFKQSSKALQRPV
YGFLNVIVHSATGFKQLSMALTRPV

SEQ ID NO: 26033 - protein, 25 aa, synthetic construct
  source 1..25: note = Seed: YGFLNVIVHSATGFKQSSKALQRPV
YGFLNVIVHSATGFKQLSMALVRPV

SEQ ID NO: 26034 - protein, 25 aa, synthetic construct
  source 1..25: note = Seed: YGFLNVIVHSATGFKQSSKALQRPV
YGFLNVIVHSATGFKQLSMALYRPV

SEQ ID NO: 26035 - protein, 25 aa, synthetic construct
  source 1..25: note = Seed: YGFLNVIVHSATGFKQSSKALQRPV
YGFLNVIVHSATGFKQLSNALARPV

SEQ ID NO: 26036 - protein, 25 aa, synthetic construct
  source 1..25: note = Seed: YGFLNVIVHSATGFKQSSKALQRPV
YGFLNVIVHSATGFKQLSNALCRPV

SEQ ID NO: 26037 - protein, 25 aa, synthetic construct
  source 1..25: note = Seed: YGFLNVIVHSATGFKQSSKALQRPV
YGFLNVIVHSATGFKQLSNALDRPV

SEQ ID NO: 26038 - protein, 25 aa, synthetic construct
  source 1..25: note = Seed: YGFLNVIVHSATGFKQSSKALQRPV
YGFLNVIVHSATGFKQLSNALERPV

SEQ ID NO: 26039 - protein, 25 aa, synthetic construct
  source 1..25: note = Seed: YGFLNVIVHSATGFKQSSKALQRPV
YGFLNVIVHSATGFKQLSNALFRPV

SEQ ID NO: 26040 - protein, 25 aa, synthetic construct
  source 1..25: note = Seed: YGFLNVIVHSATGFKQSSKALQRPV
YGFLNVIVHSATGFKQLSNALGRPV

SEQ ID NO: 26041 - protein, 25 aa, synthetic construct
  source 1..25: note = Seed: YGFLNVIVHSATGFKQSSKALQRPV
YGFLNVIVHSATGFKQLSNALHRPV

SEQ ID NO: 26042 - protein, 25 aa, synthetic construct
  source 1..25: note = Seed: YGFLNVIVHSATGFKQSSKALQRPV
YGFLNVIVHSATGFKQLSNALIRPV

SEQ ID NO: 26043 - protein, 25 aa, synthetic construct
  source 1..25: note = Seed: YGFLNVIVHSATGFKQSSKALQRPV
YGFLNVIVHSATGFKQLSNALLRPV

SEQ ID NO: 26044 - protein, 25 aa, synthetic construct
  source 1..25: note = Seed: YGFLNVIVHSATGFKQSSKALQRPV
YGFLNVIVHSATGFKQLSNALMRPV

SEQ ID NO: 26045 - protein, 25 aa, synthetic construct
  source 1..25: note = Seed: YGFLNVIVHSATGFKQSSKALQRPV
YGFLNVIVHSATGFKQLSNALNRPV

SEQ ID NO: 26046 - protein, 25 aa, synthetic construct
  source 1..25: note = Seed: YGFLNVIVHSATGFKQSSKALQRPV
YGFLNVIVHSATGFKQLSNALPRPV

SEQ ID NO: 26047 - protein, 25 aa, synthetic construct
  source 1..25: note = Seed: YGFLNVIVHSATGFKQSSKALQRPV
YGFLNVIVHSATGFKQLSNALQRPV

SEQ ID NO: 26048 - protein, 25 aa, synthetic construct
  source 1..25: note = Seed: YGFLNVIVHSATGFKQSSKALQRPV
YGFLNVIVHSATGFKQLSNALSRPV

SEQ ID NO: 26049 - protein, 25 aa, synthetic construct
  source 1..25: note = Seed: YGFLNVIVHSATGFKQSSKALQRPV
YGFLNVIVHSATGFKQLSNALTRPV

SEQ ID NO: 26050 - protein, 25 aa, synthetic construct
  source 1..25: note = Seed: YGFLNVIVHSATGFKQSSKALQRPV
YGFLNVIVHSATGFKQLSNALVRPV

SEQ ID NO: 26051 - protein, 25 aa, synthetic construct
  source 1..25: note = Seed: YGFLNVIVHSATGFKQSSKALQRPV
YGFLNVIVHSATGFKQLSNALYRPV

SEQ ID NO: 26052 - protein, 25 aa, synthetic construct
  source 1..25: note = Seed: YGFLNVIVHSATGFKQSSKALQRPV
YGFLNVIVHSATGFKQLSPALARPV

SEQ ID NO: 26053 - protein, 25 aa, synthetic construct
  source 1..25: note = Seed: YGFLNVIVHSATGFKQSSKALQRPV
YGFLNVIVHSATGFKQLSPALCRPV

SEQ ID NO: 26054 - protein, 25 aa, synthetic construct
  source 1..25: note = Seed: YGFLNVIVHSATGFKQSSKALQRPV
YGFLNVIVHSATGFKQLSPALDRPV

SEQ ID NO: 26055 - protein, 25 aa, synthetic construct
  source 1..25: note = Seed: YGFLNVIVHSATGFKQSSKALQRPV
YGFLNVIVHSATGFKQLSPALERPV

SEQ ID NO: 26056 - protein, 25 aa, synthetic construct
  source 1..25: note = Seed: YGFLNVIVHSATGFKQSSKALQRPV
YGFLNVIVHSATGFKQLSPALFRPV

SEQ ID NO: 26057 - protein, 25 aa, synthetic construct
  source 1..25: note = Seed: YGFLNVIVHSATGFKQSSKALQRPV
YGFLNVIVHSATGFKQLSPALGRPV

SEQ ID NO: 26058 - protein, 25 aa, synthetic construct
  source 1..25: note = Seed: YGFLNVIVHSATGFKQSSKALQRPV
YGFLNVIVHSATGFKQLSPALHRPV

SEQ ID NO: 26059 - protein, 25 aa, synthetic construct
  source 1..25: note = Seed: YGFLNVIVHSATGFKQSSKALQRPV
YGFLNVIVHSATGFKQLSPALIRPV

SEQ ID NO: 26060 - protein, 25 aa, synthetic construct
  source 1..25: note = Seed: YGFLNVIVHSATGFKQSSKALQRPV
YGFLNVIVHSATGFKQLSPALKRPV

SEQ ID NO: 26061 - protein, 25 aa, synthetic construct
  source 1..25: note = Seed: YGFLNVIVHSATGFKQSSKALQRPV
YGFLNVIVHSATGFKQLSPALLRPV

SEQ ID NO: 26062 - protein, 25 aa, synthetic construct
  source 1..25: note = Seed: YGFLNVIVHSATGFKQSSKALQRPV
YGFLNVIVHSATGFKQLSPALMRPV

SEQ ID NO: 26063 - protein, 25 aa, synthetic construct
  source 1..25: note = Seed: YGFLNVIVHSATGFKQSSKALQRPV
YGFLNVIVHSATGFKQLSPALNRPV

SEQ ID NO: 26064 - protein, 25 aa, synthetic construct
  source 1..25: note = Seed: YGFLNVIVHSATGFKQSSKALQRPV
YGFLNVIVHSATGFKQLSPALPRPV

SEQ ID NO: 26065 - protein, 25 aa, synthetic construct
  source 1..25: note = Seed: YGFLNVIVHSATGFKQSSKALQRPV
YGFLNVIVHSATGFKQLSPALQRPV

SEQ ID NO: 26066 - protein, 25 aa, synthetic construct
  source 1..25: note = Seed: YGFLNVIVHSATGFKQSSKALQRPV
YGFLNVIVHSATGFKQLSPALRRPV

SEQ ID NO: 26067 - protein, 25 aa, synthetic construct
  source 1..25: note = Seed: YGFLNVIVHSATGFKQSSKALQRPV
YGFLNVIVHSATGFKQLSPALSRPV

SEQ ID NO: 26068 - protein, 25 aa, synthetic construct
  source 1..25: note = Seed: YGFLNVIVHSATGFKQSSKALQRPV
YGFLNVIVHSATGFKQLSPALTRPV

SEQ ID NO: 26069 - protein, 25 aa, synthetic construct
  source 1..25: note = Seed: YGFLNVIVHSATGFKQSSKALQRPV
YGFLNVIVHSATGFKQLSPALVRPV

SEQ ID NO: 26070 - protein, 25 aa, synthetic construct
  source 1..25: note = Seed: YGFLNVIVHSATGFKQSSKALQRPV
YGFLNVIVHSATGFKQLSPALWRPV

SEQ ID NO: 26071 - protein, 25 aa, synthetic construct
  source 1..25: note = Seed: YGFLNVIVHSATGFKQSSKALQRPV
YGFLNVIVHSATGFKQLSPALYRPV

SEQ ID NO: 26072 - protein, 25 aa, synthetic construct
  source 1..25: note = Seed: YGFLNVIVHSATGFKQSSKALQRPV
YGFLNVIVHSATGFKQLSQALARPV

SEQ ID NO: 26073 - protein, 25 aa, synthetic construct
  source 1..25: note = Seed: YGFLNVIVHSATGFKQSSKALQRPV
YGFLNVIVHSATGFKQLSQALGRPV

SEQ ID NO: 26074 - protein, 25 aa, synthetic construct
  source 1..25: note = Seed: YGFLNVIVHSATGFKQSSKALQRPV
YGFLNVIVHSATGFKQLSQALIRPV

SEQ ID NO: 26075 - protein, 25 aa, synthetic construct
  source 1..25: note = Seed: YGFLNVIVHSATGFKQSSKALQRPV
YGFLNVIVHSATGFKQLSQALMRPV

SEQ ID NO: 26076 - protein, 25 aa, synthetic construct
  source 1..25: note = Seed: YGFLNVIVHSATGFKQSSKALQRPV
YGFLNVIVHSATGFKQLSQALNRPV

SEQ ID NO: 26077 - protein, 25 aa, synthetic construct
  source 1..25: note = Seed: YGFLNVIVHSATGFKQSSKALQRPV
YGFLNVIVHSATGFKQLSQALSRPV

SEQ ID NO: 26078 - protein, 25 aa, synthetic construct
  source 1..25: note = Seed: YGFLNVIVHSATGFKQSSKALQRPV
YGFLNVIVHSATGFKQLSQALTRPV

SEQ ID NO: 26079 - protein, 25 aa, synthetic construct
  source 1..25: note = Seed: YGFLNVIVHSATGFKQSSKALQRPV
YGFLNVIVHSATGFKQLSQALVRPV

SEQ ID NO: 26080 - protein, 25 aa, synthetic construct
  source 1..25: note = Seed: YGFLNVIVHSATGFKQSSKALQRPV
YGFLNVIVHSATGFKQLSRALARPV

SEQ ID NO: 26081 - protein, 25 aa, synthetic construct
  source 1..25: note = Seed: YGFLNVIVHSATGFKQSSKALQRPV
YGFLNVIVHSATGFKQLSRALCRPV

SEQ ID NO: 26082 - protein, 25 aa, synthetic construct
  source 1..25: note = Seed: YGFLNVIVHSATGFKQSSKALQRPV
YGFLNVIVHSATGFKQLSRALDRPV

SEQ ID NO: 26083 - protein, 25 aa, synthetic construct
  source 1..25: note = Seed: YGFLNVIVHSATGFKQSSKALQRPV
YGFLNVIVHSATGFKQLSRALERPV

SEQ ID NO: 26084 - protein, 25 aa, synthetic construct
  source 1..25: note = Seed: YGFLNVIVHSATGFKQSSKALQRPV
YGFLNVIVHSATGFKQLSRALFRPV

SEQ ID NO: 26085 - protein, 25 aa, synthetic construct
  source 1..25: note = Seed: YGFLNVIVHSATGFKQSSKALQRPV
YGFLNVIVHSATGFKQLSRALGRPV

SEQ ID NO: 26086 - protein, 25 aa, synthetic construct
  source 1..25: note = Seed: YGFLNVIVHSATGFKQSSKALQRPV
YGFLNVIVHSATGFKQLSRALHRPV

SEQ ID NO: 26087 - protein, 25 aa, synthetic construct
  source 1..25: note = Seed: YGFLNVIVHSATGFKQSSKALQRPV
YGFLNVIVHSATGFKQLSRALIRPV

SEQ ID NO: 26088 - protein, 25 aa, synthetic construct
  source 1..25: note = Seed: YGFLNVIVHSATGFKQSSKALQRPV
YGFLNVIVHSATGFKQLSRALKRPV

SEQ ID NO: 26089 - protein, 25 aa, synthetic construct
  source 1..25: note = Seed: YGFLNVIVHSATGFKQSSKALQRPV
YGFLNVIVHSATGFKQLSRALLRPV

SEQ ID NO: 26090 - protein, 25 aa, synthetic construct
  source 1..25: note = Seed: YGFLNVIVHSATGFKQSSKALQRPV
YGFLNVIVHSATGFKQLSRALMRPV

SEQ ID NO: 26091 - protein, 25 aa, synthetic construct
  source 1..25: note = Seed: YGFLNVIVHSATGFKQSSKALQRPV
YGFLNVIVHSATGFKQLSRALNRPV

SEQ ID NO: 26092 - protein, 25 aa, synthetic construct
  source 1..25: note = Seed: YGFLNVIVHSATGFKQSSKALQRPV
YGFLNVIVHSATGFKQLSRALPRPV

SEQ ID NO: 26093 - protein, 25 aa, synthetic construct
  source 1..25: note = Seed: YGFLNVIVHSATGFKQSSKALQRPV
YGFLNVIVHSATGFKQLSRALQRPV

SEQ ID NO: 26094 - protein, 25 aa, synthetic construct
  source 1..25: note = Seed: YGFLNVIVHSATGFKQSSKALQRPV
YGFLNVIVHSATGFKQLSRALRRPV

SEQ ID NO: 26095 - protein, 25 aa, synthetic construct
  source 1..25: note = Seed: YGFLNVIVHSATGFKQSSKALQRPV
YGFLNVIVHSATGFKQLSRALSRPV

SEQ ID NO: 26096 - protein, 25 aa, synthetic construct
  source 1..25: note = Seed: YGFLNVIVHSATGFKQSSKALQRPV
YGFLNVIVHSATGFKQLSRALTRPV

SEQ ID NO: 26097 - protein, 25 aa, synthetic construct
  source 1..25: note = Seed: YGFLNVIVHSATGFKQSSKALQRPV
YGFLNVIVHSATGFKQLSRALVRPV

SEQ ID NO: 26098 - protein, 25 aa, synthetic construct
  source 1..25: note = Seed: YGFLNVIVHSATGFKQSSKALQRPV
YGFLNVIVHSATGFKQLSRALYRPV

SEQ ID NO: 26099 - protein, 25 aa, synthetic construct
  source 1..25: note = Seed: YGFLNVIVHSATGFKQSSKALQRPV
YGFLNVIVHSATGFKQLSSALARPV

SEQ ID NO: 26100 - protein, 25 aa, synthetic construct
  source 1..25: note = Seed: YGFLNVIVHSATGFKQSSKALQRPV
YGFLNVIVHSATGFKQLSSALCRPV

SEQ ID NO: 26101 - protein, 25 aa, synthetic construct
  source 1..25: note = Seed: YGFLNVIVHSATGFKQSSKALQRPV
YGFLNVIVHSATGFKQLSSALDRPV

SEQ ID NO: 26102 - protein, 25 aa, synthetic construct
  source 1..25: note = Seed: YGFLNVIVHSATGFKQSSKALQRPV
YGFLNVIVHSATGFKQLSSALERPV

SEQ ID NO: 26103 - protein, 25 aa, synthetic construct
  source 1..25: note = Seed: YGFLNVIVHSATGFKQSSKALQRPV
YGFLNVIVHSATGFKQLSSALFRPV

SEQ ID NO: 26104 - protein, 25 aa, synthetic construct
  source 1..25: note = Seed: YGFLNVIVHSATGFKQSSKALQRPV
YGFLNVIVHSATGFKQLSSALGRPV

SEQ ID NO: 26105 - protein, 25 aa, synthetic construct
  source 1..25: note = Seed: YGFLNVIVHSATGFKQSSKALQRPV
YGFLNVIVHSATGFKQLSSALHRPV

SEQ ID NO: 26106 - protein, 25 aa, synthetic construct
  source 1..25: note = Seed: YGFLNVIVHSATGFKQSSKALQRPV
YGFLNVIVHSATGFKQLSSALIRPV

SEQ ID NO: 26107 - protein, 25 aa, synthetic construct
  source 1..25: note = Seed: YGFLNVIVHSATGFKQSSKALQRPV
YGFLNVIVHSATGFKQLSSALKRPV

SEQ ID NO: 26108 - protein, 25 aa, synthetic construct
  source 1..25: note = Seed: YGFLNVIVHSATGFKQSSKALQRPV
YGFLNVIVHSATGFKQLSSALLRPV

SEQ ID NO: 26109 - protein, 25 aa, synthetic construct
  source 1..25: note = Seed: YGFLNVIVHSATGFKQSSKALQRPV
YGFLNVIVHSATGFKQLSSALMRPV

SEQ ID NO: 26110 - protein, 25 aa, synthetic construct
  source 1..25: note = Seed: YGFLNVIVHSATGFKQSSKALQRPV
YGFLNVIVHSATGFKQLSSALNRPV

SEQ ID NO: 26111 - protein, 25 aa, synthetic construct
  source 1..25: note = Seed: YGFLNVIVHSATGFKQSSKALQRPV
YGFLNVIVHSATGFKQLSSALPRPV

SEQ ID NO: 26112 - protein, 25 aa, synthetic construct
  source 1..25: note = Seed: YGFLNVIVHSATGFKQSSKALQRPV
YGFLNVIVHSATGFKQLSSALQRPV

SEQ ID NO: 26113 - protein, 25 aa, synthetic construct
  source 1..25: note = Seed: YGFLNVIVHSATGFKQSSKALQRPV
YGFLNVIVHSATGFKQLSSALRRPV

SEQ ID NO: 26114 - protein, 25 aa, synthetic construct
  source 1..25: note = Seed: YGFLNVIVHSATGFKQSSKALQRPV
YGFLNVIVHSATGFKQLSSALSRPV

SEQ ID NO: 26115 - protein, 25 aa, synthetic construct
  source 1..25: note = Seed: YGFLNVIVHSATGFKQSSKALQRPV
YGFLNVIVHSATGFKQLSSALTRPV

SEQ ID NO: 26116 - protein, 25 aa, synthetic construct
  source 1..25: note = Seed: YGFLNVIVHSATGFKQSSKALQRPV
YGFLNVIVHSATGFKQLSSALVRPV

SEQ ID NO: 26117 - protein, 25 aa, synthetic construct
  source 1..25: note = Seed: YGFLNVIVHSATGFKQSSKALQRPV
YGFLNVIVHSATGFKQLSSALYRPV

SEQ ID NO: 26118 - protein, 25 aa, synthetic construct
  source 1..25: note = Seed: YGFLNVIVHSATGFKQSSKALQRPV
YGFLNVIVHSATGFKQLSTALARPV

SEQ ID NO: 26119 - protein, 25 aa, synthetic construct
  source 1..25: note = Seed: YGFLNVIVHSATGFKQSSKALQRPV
YGFLNVIVHSATGFKQLSTALCRPV

SEQ ID NO: 26120 - protein, 25 aa, synthetic construct
  source 1..25: note = Seed: YGFLNVIVHSATGFKQSSKALQRPV
YGFLNVIVHSATGFKQLSTALDRPV

SEQ ID NO: 26121 - protein, 25 aa, synthetic construct
  source 1..25: note = Seed: YGFLNVIVHSATGFKQSSKALQRPV
YGFLNVIVHSATGFKQLSTALERPV

SEQ ID NO: 26122 - protein, 25 aa, synthetic construct
  source 1..25: note = Seed: YGFLNVIVHSATGFKQSSKALQRPV
YGFLNVIVHSATGFKQLSTALFRPV

SEQ ID NO: 26123 - protein, 25 aa, synthetic construct
  source 1..25: note = Seed: YGFLNVIVHSATGFKQSSKALQRPV
YGFLNVIVHSATGFKQLSTALGRPV

SEQ ID NO: 26124 - protein, 25 aa, synthetic construct
  source 1..25: note = Seed: YGFLNVIVHSATGFKQSSKALQRPV
YGFLNVIVHSATGFKQLSTALHRPV

SEQ ID NO: 26125 - protein, 25 aa, synthetic construct
  source 1..25: note = Seed: YGFLNVIVHSATGFKQSSKALQRPV
YGFLNVIVHSATGFKQLSTALIRPV

SEQ ID NO: 26126 - protein, 25 aa, synthetic construct
  source 1..25: note = Seed: YGFLNVIVHSATGFKQSSKALQRPV
YGFLNVIVHSATGFKQLSTALKRPV

SEQ ID NO: 26127 - protein, 25 aa, synthetic construct
  source 1..25: note = Seed: YGFLNVIVHSATGFKQSSKALQRPV
YGFLNVIVHSATGFKQLSTALLRPV

SEQ ID NO: 26128 - protein, 25 aa, synthetic construct
  source 1..25: note = Seed: YGFLNVIVHSATGFKQSSKALQRPV
YGFLNVIVHSATGFKQLSTALMRPV

SEQ ID NO: 26129 - protein, 25 aa, synthetic construct
  source 1..25: note = Seed: YGFLNVIVHSATGFKQSSKALQRPV
YGFLNVIVHSATGFKQLSTALNRPV

SEQ ID NO: 26130 - protein, 25 aa, synthetic construct
  source 1..25: note = Seed: YGFLNVIVHSATGFKQSSKALQRPV
YGFLNVIVHSATGFKQLSTALPRPV

SEQ ID NO: 26131 - protein, 25 aa, synthetic construct
  source 1..25: note = Seed: YGFLNVIVHSATGFKQSSKALQRPV
YGFLNVIVHSATGFKQLSTALQRPV

SEQ ID NO: 26132 - protein, 25 aa, synthetic construct
  source 1..25: note = Seed: YGFLNVIVHSATGFKQSSKALQRPV
YGFLNVIVHSATGFKQLSTALRRPV

SEQ ID NO: 26133 - protein, 25 aa, synthetic construct
  source 1..25: note = Seed: YGFLNVIVHSATGFKQSSKALQRPV
YGFLNVIVHSATGFKQLSTALSRPV

SEQ ID NO: 26134 - protein, 25 aa, synthetic construct
  source 1..25: note = Seed: YGFLNVIVHSATGFKQSSKALQRPV
YGFLNVIVHSATGFKQLSTALTRPV

SEQ ID NO: 26135 - protein, 25 aa, synthetic construct
  source 1..25: note = Seed: YGFLNVIVHSATGFKQSSKALQRPV
YGFLNVIVHSATGFKQLSTALVRPV

SEQ ID NO: 26136 - protein, 25 aa, synthetic construct
  source 1..25: note = Seed: YGFLNVIVHSATGFKQSSKALQRPV
YGFLNVIVHSATGFKQLSTALYRPV

SEQ ID NO: 26137 - protein, 25 aa, synthetic construct
  source 1..25: note = Seed: YGFLNVIVHSATGFKQSSKALQRPV
YGFLNVIVHSATGFKQLSVALARPV

SEQ ID NO: 26138 - protein, 25 aa, synthetic construct
  source 1..25: note = Seed: YGFLNVIVHSATGFKQSSKALQRPV
YGFLNVIVHSATGFKQLSVALCRPV

SEQ ID NO: 26139 - protein, 25 aa, synthetic construct
  source 1..25: note = Seed: YGFLNVIVHSATGFKQSSKALQRPV
YGFLNVIVHSATGFKQLSVALDRPV

SEQ ID NO: 26140 - protein, 25 aa, synthetic construct
  source 1..25: note = Seed: YGFLNVIVHSATGFKQSSKALQRPV
YGFLNVIVHSATGFKQLSVALERPV

SEQ ID NO: 26141 - protein, 25 aa, synthetic construct
  source 1..25: note = Seed: YGFLNVIVHSATGFKQSSKALQRPV
YGFLNVIVHSATGFKQLSVALFRPV

SEQ ID NO: 26142 - protein, 25 aa, synthetic construct
  source 1..25: note = Seed: YGFLNVIVHSATGFKQSSKALQRPV
YGFLNVIVHSATGFKQLSVALGRPV

SEQ ID NO: 26143 - protein, 25 aa, synthetic construct
  source 1..25: note = Seed: YGFLNVIVHSATGFKQSSKALQRPV
YGFLNVIVHSATGFKQLSVALHRPV

SEQ ID NO: 26144 - protein, 25 aa, synthetic construct
  source 1..25: note = Seed: YGFLNVIVHSATGFKQSSKALQRPV
YGFLNVIVHSATGFKQLSVALIRPV

SEQ ID NO: 26145 - protein, 25 aa, synthetic construct
  source 1..25: note = Seed: YGFLNVIVHSATGFKQSSKALQRPV
YGFLNVIVHSATGFKQLSVALKRPV

SEQ ID NO: 26146 - protein, 25 aa, synthetic construct
  source 1..25: note = Seed: YGFLNVIVHSATGFKQSSKALQRPV
YGFLNVIVHSATGFKQLSVALLRPV

SEQ ID NO: 26147 - protein, 25 aa, synthetic construct
  source 1..25: note = Seed: YGFLNVIVHSATGFKQSSKALQRPV
YGFLNVIVHSATGFKQLSVALMRPV

SEQ ID NO: 26148 - protein, 25 aa, synthetic construct
  source 1..25: note = Seed: YGFLNVIVHSATGFKQSSKALQRPV
YGFLNVIVHSATGFKQLSVALNRPV

SEQ ID NO: 26149 - protein, 25 aa, synthetic construct
  source 1..25: note = Seed: YGFLNVIVHSATGFKQSSKALQRPV
YGFLNVIVHSATGFKQLSVALPRPV

SEQ ID NO: 26150 - protein, 25 aa, synthetic construct
  source 1..25: note = Seed: YGFLNVIVHSATGFKQSSKALQRPV
YGFLNVIVHSATGFKQLSVALQRPV

SEQ ID NO: 26151 - protein, 25 aa, synthetic construct
  source 1..25: note = Seed: YGFLNVIVHSATGFKQSSKALQRPV
YGFLNVIVHSATGFKQLSVALRRPV

SEQ ID NO: 26152 - protein, 25 aa, synthetic construct
  source 1..25: note = Seed: YGFLNVIVHSATGFKQSSKALQRPV
YGFLNVIVHSATGFKQLSVALSRPV

SEQ ID NO: 26153 - protein, 25 aa, synthetic construct
  source 1..25: note = Seed: YGFLNVIVHSATGFKQSSKALQRPV
YGFLNVIVHSATGFKQLSVALTRPV

SEQ ID NO: 26154 - protein, 25 aa, synthetic construct
  source 1..25: note = Seed: YGFLNVIVHSATGFKQSSKALQRPV
YGFLNVIVHSATGFKQLSVALVRPV

SEQ ID NO: 26155 - protein, 25 aa, synthetic construct
  source 1..25: note = Seed: YGFLNVIVHSATGFKQSSKALQRPV
YGFLNVIVHSATGFKQLSVALYRPV

SEQ ID NO: 26156 - protein, 25 aa, synthetic construct
  source 1..25: note = Seed: YGFLNVIVHSATGFKQSSKALQRPV
YGFLNVIVHSATGFKQLSWALARPV

SEQ ID NO: 26157 - protein, 25 aa, synthetic construct
  source 1..25: note = Seed: YGFLNVIVHSATGFKQSSKALQRPV
YGFLNVIVHSATGFKQLSWALFRPV

SEQ ID NO: 26158 - protein, 25 aa, synthetic construct
  source 1..25: note = Seed: YGFLNVIVHSATGFKQSSKALQRPV
YGFLNVIVHSATGFKQLSWALIRPV

SEQ ID NO: 26159 - protein, 25 aa, synthetic construct
  source 1..25: note = Seed: YGFLNVIVHSATGFKQSSKALQRPV
YGFLNVIVHSATGFKQLSWALLRPV

SEQ ID NO: 26160 - protein, 25 aa, synthetic construct
  source 1..25: note = Seed: YGFLNVIVHSATGFKQSSKALQRPV
YGFLNVIVHSATGFKQLSWALMRPV

SEQ ID NO: 26161 - protein, 25 aa, synthetic construct
  source 1..25: note = Seed: YGFLNVIVHSATGFKQSSKALQRPV
YGFLNVIVHSATGFKQLSWALNRPV

SEQ ID NO: 26162 - protein, 25 aa, synthetic construct
  source 1..25: note = Seed: YGFLNVIVHSATGFKQSSKALQRPV
YGFLNVIVHSATGFKQLSWALSRPV

SEQ ID NO: 26163 - protein, 25 aa, synthetic construct
  source 1..25: note = Seed: YGFLNVIVHSATGFKQSSKALQRPV
YGFLNVIVHSATGFKQLSWALVRPV

SEQ ID NO: 26164 - protein, 25 aa, synthetic construct
  source 1..25: note = Seed: YGFLNVIVHSATGFKQSSKALQRPV
YGFLNVIVHSATGFKQLSWALWRPV

SEQ ID NO: 26165 - protein, 25 aa, synthetic construct
  source 1..25: note = Seed: YGFLNVIVHSATGFKQSSKALQRPV
YGFLNVIVHSATGFKQLSWALYRPV

SEQ ID NO: 26166 - protein, 25 aa, synthetic construct
  source 1..25: note = Seed: YGFLNVIVHSATGFKQSSKALQRPV
YGFLNVIVHSATGFKQLSYALARPV

SEQ ID NO: 26167 - protein, 25 aa, synthetic construct
  source 1..25: note = Seed: YGFLNVIVHSATGFKQSSKALQRPV
YGFLNVIVHSATGFKQLSYALFRPV

SEQ ID NO: 26168 - protein, 25 aa, synthetic construct
  source 1..25: note = Seed: YGFLNVIVHSATGFKQSSKALQRPV
YGFLNVIVHSATGFKQLSYALIRPV

SEQ ID NO: 26169 - protein, 25 aa, synthetic construct
  source 1..25: note = Seed: YGFLNVIVHSATGFKQSSKALQRPV
YGFLNVIVHSATGFKQLSYALLRPV

SEQ ID NO: 26170 - protein, 25 aa, synthetic construct
  source 1..25: note = Seed: YGFLNVIVHSATGFKQSSKALQRPV
YGFLNVIVHSATGFKQLSYALMRPV

SEQ ID NO: 26171 - protein, 25 aa, synthetic construct
  source 1..25: note = Seed: YGFLNVIVHSATGFKQSSKALQRPV
YGFLNVIVHSATGFKQLSYALNRPV

SEQ ID NO: 26172 - protein, 25 aa, synthetic construct
  source 1..25: note = Seed: YGFLNVIVHSATGFKQSSKALQRPV
YGFLNVIVHSATGFKQLSYALSRPV

SEQ ID NO: 26173 - protein, 25 aa, synthetic construct
  source 1..25: note = Seed: YGFLNVIVHSATGFKQSSKALQRPV
YGFLNVIVHSATGFKQLSYALVRPV

SEQ ID NO: 26174 - protein, 25 aa, synthetic construct
  source 1..25: note = Seed: YGFLNVIVHSATGFKQSSKALQRPV
YGFLNVIVHSATGFKQLSYALWRPV

SEQ ID NO: 26175 - protein, 25 aa, synthetic construct
  source 1..25: note = Seed: YGFLNVIVHSATGFKQSSKALQRPV
YGFLNVIVHSATGFKQLSYALYRPV

SEQ ID NO: 26176 - protein, 25 aa, synthetic construct
  source 1..25: note = Seed: YGFLNVIVHSATGFKQSSKALQRPV
YGFLNVIVHSATGFKQMSAALARPV

SEQ ID NO: 26177 - protein, 25 aa, synthetic construct
  source 1..25: note = Seed: YGFLNVIVHSATGFKQSSKALQRPV
YGFLNVIVHSATGFKQMSAALCRPV

SEQ ID NO: 26178 - protein, 25 aa, synthetic construct
  source 1..25: note = Seed: YGFLNVIVHSATGFKQSSKALQRPV
YGFLNVIVHSATGFKQMSAALDRPV

SEQ ID NO: 26179 - protein, 25 aa, synthetic construct
  source 1..25: note = Seed: YGFLNVIVHSATGFKQSSKALQRPV
YGFLNVIVHSATGFKQMSAALERPV

SEQ ID NO: 26180 - protein, 25 aa, synthetic construct
  source 1..25: note = Seed: YGFLNVIVHSATGFKQSSKALQRPV
YGFLNVIVHSATGFKQMSAALFRPV

SEQ ID NO: 26181 - protein, 25 aa, synthetic construct
  source 1..25: note = Seed: YGFLNVIVHSATGFKQSSKALQRPV
YGFLNVIVHSATGFKQMSAALGRPV

SEQ ID NO: 26182 - protein, 25 aa, synthetic construct
  source 1..25: note = Seed: YGFLNVIVHSATGFKQSSKALQRPV
YGFLNVIVHSATGFKQMSAALHRPV

SEQ ID NO: 26183 - protein, 25 aa, synthetic construct
  source 1..25: note = Seed: YGFLNVIVHSATGFKQSSKALQRPV
YGFLNVIVHSATGFKQMSAALIRPV

SEQ ID NO: 26184 - protein, 25 aa, synthetic construct
  source 1..25: note = Seed: YGFLNVIVHSATGFKQSSKALQRPV
YGFLNVIVHSATGFKQMSAALKRPV

SEQ ID NO: 26185 - protein, 25 aa, synthetic construct
  source 1..25: note = Seed: YGFLNVIVHSATGFKQSSKALQRPV
YGFLNVIVHSATGFKQMSAALLRPV

SEQ ID NO: 26186 - protein, 25 aa, synthetic construct
  source 1..25: note = Seed: YGFLNVIVHSATGFKQSSKALQRPV
YGFLNVIVHSATGFKQMSAALMRPV

SEQ ID NO: 26187 - protein, 25 aa, synthetic construct
  source 1..25: note = Seed: YGFLNVIVHSATGFKQSSKALQRPV
YGFLNVIVHSATGFKQMSAALNRPV

SEQ ID NO: 26188 - protein, 25 aa, synthetic construct
  source 1..25: note = Seed: YGFLNVIVHSATGFKQSSKALQRPV
YGFLNVIVHSATGFKQMSAALPRPV

SEQ ID NO: 26189 - protein, 25 aa, synthetic construct
  source 1..25: note = Seed: YGFLNVIVHSATGFKQSSKALQRPV
YGFLNVIVHSATGFKQMSAALQRPV

SEQ ID NO: 26190 - protein, 25 aa, synthetic construct
  source 1..25: note = Seed: YGFLNVIVHSATGFKQSSKALQRPV
YGFLNVIVHSATGFKQMSAALRRPV

SEQ ID NO: 26191 - protein, 25 aa, synthetic construct
  source 1..25: note = Seed: YGFLNVIVHSATGFKQSSKALQRPV
YGFLNVIVHSATGFKQMSAALSRPV

SEQ ID NO: 26192 - protein, 25 aa, synthetic construct
  source 1..25: note = Seed: YGFLNVIVHSATGFKQSSKALQRPV
YGFLNVIVHSATGFKQMSAALTRPV

SEQ ID NO: 26193 - protein, 25 aa, synthetic construct
  source 1..25: note = Seed: YGFLNVIVHSATGFKQSSKALQRPV
YGFLNVIVHSATGFKQMSAALVRPV

SEQ ID NO: 26194 - protein, 25 aa, synthetic construct
  source 1..25: note = Seed: YGFLNVIVHSATGFKQSSKALQRPV
YGFLNVIVHSATGFKQMSAALWRPV

SEQ ID NO: 26195 - protein, 25 aa, synthetic construct
  source 1..25: note = Seed: YGFLNVIVHSATGFKQSSKALQRPV
YGFLNVIVHSATGFKQMSAALYRPV

SEQ ID NO: 26196 - protein, 25 aa, synthetic construct
  source 1..25: note = Seed: YGFLNVIVHSATGFKQSSKALQRPV
YGFLNVIVHSATGFKQMSCALARPV

SEQ ID NO: 26197 - protein, 25 aa, synthetic construct
  source 1..25: note = Seed: YGFLNVIVHSATGFKQSSKALQRPV
YGFLNVIVHSATGFKQMSCALGRPV

SEQ ID NO: 26198 - protein, 25 aa, synthetic construct
  source 1..25: note = Seed: YGFLNVIVHSATGFKQSSKALQRPV
YGFLNVIVHSATGFKQMSCALHRPV

SEQ ID NO: 26199 - protein, 25 aa, synthetic construct
  source 1..25: note = Seed: YGFLNVIVHSATGFKQSSKALQRPV
YGFLNVIVHSATGFKQMSCALMRPV

SEQ ID NO: 26200 - protein, 25 aa, synthetic construct
  source 1..25: note = Seed: YGFLNVIVHSATGFKQSSKALQRPV
YGFLNVIVHSATGFKQMSCALNRPV

SEQ ID NO: 26201 - protein, 25 aa, synthetic construct
  source 1..25: note = Seed: YGFLNVIVHSATGFKQSSKALQRPV
YGFLNVIVHSATGFKQMSCALSRPV

SEQ ID NO: 26202 - protein, 25 aa, synthetic construct
  source 1..25: note = Seed: YGFLNVIVHSATGFKQSSKALQRPV
YGFLNVIVHSATGFKQMSCALTRPV

SEQ ID NO: 26203 - protein, 25 aa, synthetic construct
  source 1..25: note = Seed: YGFLNVIVHSATGFKQSSKALQRPV
YGFLNVIVHSATGFKQMSCALVRPV

SEQ ID NO: 26204 - protein, 25 aa, synthetic construct
  source 1..25: note = Seed: YGFLNVIVHSATGFKQSSKALQRPV
YGFLNVIVHSATGFKQMSDALARPV

SEQ ID NO: 26205 - protein, 25 aa, synthetic construct
  source 1..25: note = Seed: YGFLNVIVHSATGFKQSSKALQRPV
YGFLNVIVHSATGFKQMSDALGRPV

SEQ ID NO: 26206 - protein, 25 aa, synthetic construct
  source 1..25: note = Seed: YGFLNVIVHSATGFKQSSKALQRPV
YGFLNVIVHSATGFKQMSDALIRPV

SEQ ID NO: 26207 - protein, 25 aa, synthetic construct
  source 1..25: note = Seed: YGFLNVIVHSATGFKQSSKALQRPV
YGFLNVIVHSATGFKQMSDALLRPV

SEQ ID NO: 26208 - protein, 25 aa, synthetic construct
  source 1..25: note = Seed: YGFLNVIVHSATGFKQSSKALQRPV
YGFLNVIVHSATGFKQMSDALMRPV

SEQ ID NO: 26209 - protein, 25 aa, synthetic construct
  source 1..25: note = Seed: YGFLNVIVHSATGFKQSSKALQRPV
YGFLNVIVHSATGFKQMSDALNRPV

SEQ ID NO: 26210 - protein, 25 aa, synthetic construct
  source 1..25: note = Seed: YGFLNVIVHSATGFKQSSKALQRPV
YGFLNVIVHSATGFKQMSDALSRPV

SEQ ID NO: 26211 - protein, 25 aa, synthetic construct
  source 1..25: note = Seed: YGFLNVIVHSATGFKQSSKALQRPV
YGFLNVIVHSATGFKQMSDALTRPV

SEQ ID NO: 26212 - protein, 25 aa, synthetic construct
  source 1..25: note = Seed: YGFLNVIVHSATGFKQSSKALQRPV
YGFLNVIVHSATGFKQMSDALVRPV

SEQ ID NO: 26213 - protein, 25 aa, synthetic construct
  source 1..25: note = Seed: YGFLNVIVHSATGFKQSSKALQRPV
YGFLNVIVHSATGFKQMSEALARPV

SEQ ID NO: 26214 - protein, 25 aa, synthetic construct
  source 1..25: note = Seed: YGFLNVIVHSATGFKQSSKALQRPV
YGFLNVIVHSATGFKQMSEALGRPV

SEQ ID NO: 26215 - protein, 25 aa, synthetic construct
  source 1..25: note = Seed: YGFLNVIVHSATGFKQSSKALQRPV
YGFLNVIVHSATGFKQMSEALHRPV

SEQ ID NO: 26216 - protein, 25 aa, synthetic construct
  source 1..25: note = Seed: YGFLNVIVHSATGFKQSSKALQRPV
YGFLNVIVHSATGFKQMSEALIRPV

SEQ ID NO: 26217 - protein, 25 aa, synthetic construct
  source 1..25: note = Seed: YGFLNVIVHSATGFKQSSKALQRPV
YGFLNVIVHSATGFKQMSEALLRPV

SEQ ID NO: 26218 - protein, 25 aa, synthetic construct
  source 1..25: note = Seed: YGFLNVIVHSATGFKQSSKALQRPV
YGFLNVIVHSATGFKQMSEALMRPV

SEQ ID NO: 26219 - protein, 25 aa, synthetic construct
  source 1..25: note = Seed: YGFLNVIVHSATGFKQSSKALQRPV
YGFLNVIVHSATGFKQMSEALNRPV

SEQ ID NO: 26220 - protein, 25 aa, synthetic construct
  source 1..25: note = Seed: YGFLNVIVHSATGFKQSSKALQRPV
YGFLNVIVHSATGFKQMSEALSRPV

SEQ ID NO: 26221 - protein, 25 aa, synthetic construct
  source 1..25: note = Seed: YGFLNVIVHSATGFKQSSKALQRPV
YGFLNVIVHSATGFKQMSEALTRPV

SEQ ID NO: 26222 - protein, 25 aa, synthetic construct
  source 1..25: note = Seed: YGFLNVIVHSATGFKQSSKALQRPV
YGFLNVIVHSATGFKQMSEALVRPV

SEQ ID NO: 26223 - protein, 25 aa, synthetic construct
  source 1..25: note = Seed: YGFLNVIVHSATGFKQSSKALQRPV
YGFLNVIVHSATGFKQMSFALARPV

SEQ ID NO: 26224 - protein, 25 aa, synthetic construct
  source 1..25: note = Seed: YGFLNVIVHSATGFKQSSKALQRPV
YGFLNVIVHSATGFKQMSFALDRPV

SEQ ID NO: 26225 - protein, 25 aa, synthetic construct
  source 1..25: note = Seed: YGFLNVIVHSATGFKQSSKALQRPV
YGFLNVIVHSATGFKQMSFALERPV

SEQ ID NO: 26226 - protein, 25 aa, synthetic construct
  source 1..25: note = Seed: YGFLNVIVHSATGFKQSSKALQRPV
YGFLNVIVHSATGFKQMSFALFRPV

SEQ ID NO: 26227 - protein, 25 aa, synthetic construct
  source 1..25: note = Seed: YGFLNVIVHSATGFKQSSKALQRPV
YGFLNVIVHSATGFKQMSFALHRPV

SEQ ID NO: 26228 - protein, 25 aa, synthetic construct
  source 1..25: note = Seed: YGFLNVIVHSATGFKQSSKALQRPV
YGFLNVIVHSATGFKQMSFALIRPV

SEQ ID NO: 26229 - protein, 25 aa, synthetic construct
  source 1..25: note = Seed: YGFLNVIVHSATGFKQSSKALQRPV
YGFLNVIVHSATGFKQMSFALLRPV

SEQ ID NO: 26230 - protein, 25 aa, synthetic construct
  source 1..25: note = Seed: YGFLNVIVHSATGFKQSSKALQRPV
YGFLNVIVHSATGFKQMSFALMRPV

SEQ ID NO: 26231 - protein, 25 aa, synthetic construct
  source 1..25: note = Seed: YGFLNVIVHSATGFKQSSKALQRPV
YGFLNVIVHSATGFKQMSFALNRPV

SEQ ID NO: 26232 - protein, 25 aa, synthetic construct
  source 1..25: note = Seed: YGFLNVIVHSATGFKQSSKALQRPV
YGFLNVIVHSATGFKQMSFALSRPV

SEQ ID NO: 26233 - protein, 25 aa, synthetic construct
  source 1..25: note = Seed: YGFLNVIVHSATGFKQSSKALQRPV
YGFLNVIVHSATGFKQMSFALTRPV

SEQ ID NO: 26234 - protein, 25 aa, synthetic construct
  source 1..25: note = Seed: YGFLNVIVHSATGFKQSSKALQRPV
YGFLNVIVHSATGFKQMSFALVRPV

SEQ ID NO: 26235 - protein, 25 aa, synthetic construct
  source 1..25: note = Seed: YGFLNVIVHSATGFKQSSKALQRPV
YGFLNVIVHSATGFKQMSFALWRPV

SEQ ID NO: 26236 - protein, 25 aa, synthetic construct
  source 1..25: note = Seed: YGFLNVIVHSATGFKQSSKALQRPV
YGFLNVIVHSATGFKQMSFALYRPV

SEQ ID NO: 26237 - protein, 25 aa, synthetic construct
  source 1..25: note = Seed: YGFLNVIVHSATGFKQSSKALQRPV
YGFLNVIVHSATGFKQMSGALARPV

SEQ ID NO: 26238 - protein, 25 aa, synthetic construct
  source 1..25: note = Seed: YGFLNVIVHSATGFKQSSKALQRPV
YGFLNVIVHSATGFKQMSGALCRPV

SEQ ID NO: 26239 - protein, 25 aa, synthetic construct
  source 1..25: note = Seed: YGFLNVIVHSATGFKQSSKALQRPV
YGFLNVIVHSATGFKQMSGALDRPV

SEQ ID NO: 26240 - protein, 25 aa, synthetic construct
  source 1..25: note = Seed: YGFLNVIVHSATGFKQSSKALQRPV
YGFLNVIVHSATGFKQMSGALERPV

SEQ ID NO: 26241 - protein, 25 aa, synthetic construct
  source 1..25: note = Seed: YGFLNVIVHSATGFKQSSKALQRPV
YGFLNVIVHSATGFKQMSGALFRPV

SEQ ID NO: 26242 - protein, 25 aa, synthetic construct
  source 1..25: note = Seed: YGFLNVIVHSATGFKQSSKALQRPV
YGFLNVIVHSATGFKQMSGALGRPV

SEQ ID NO: 26243 - protein, 25 aa, synthetic construct
  source 1..25: note = Seed: YGFLNVIVHSATGFKQSSKALQRPV
YGFLNVIVHSATGFKQMSGALHRPV

SEQ ID NO: 26244 - protein, 25 aa, synthetic construct
  source 1..25: note = Seed: YGFLNVIVHSATGFKQSSKALQRPV
YGFLNVIVHSATGFKQMSGALIRPV

SEQ ID NO: 26245 - protein, 25 aa, synthetic construct
  source 1..25: note = Seed: YGFLNVIVHSATGFKQSSKALQRPV
YGFLNVIVHSATGFKQMSGALLRPV

SEQ ID NO: 26246 - protein, 25 aa, synthetic construct
  source 1..25: note = Seed: YGFLNVIVHSATGFKQSSKALQRPV
YGFLNVIVHSATGFKQMSGALMRPV

SEQ ID NO: 26247 - protein, 25 aa, synthetic construct
  source 1..25: note = Seed: YGFLNVIVHSATGFKQSSKALQRPV
YGFLNVIVHSATGFKQMSGALNRPV

SEQ ID NO: 26248 - protein, 25 aa, synthetic construct
  source 1..25: note = Seed: YGFLNVIVHSATGFKQSSKALQRPV
YGFLNVIVHSATGFKQMSGALPRPV

SEQ ID NO: 26249 - protein, 25 aa, synthetic construct
  source 1..25: note = Seed: YGFLNVIVHSATGFKQSSKALQRPV
YGFLNVIVHSATGFKQMSGALQRPV

SEQ ID NO: 26250 - protein, 25 aa, synthetic construct
  source 1..25: note = Seed: YGFLNVIVHSATGFKQSSKALQRPV
YGFLNVIVHSATGFKQMSGALSRPV

SEQ ID NO: 26251 - protein, 25 aa, synthetic construct
  source 1..25: note = Seed: YGFLNVIVHSATGFKQSSKALQRPV
YGFLNVIVHSATGFKQMSGALTRPV

SEQ ID NO: 26252 - protein, 25 aa, synthetic construct
  source 1..25: note = Seed: YGFLNVIVHSATGFKQSSKALQRPV
YGFLNVIVHSATGFKQMSGALVRPV

SEQ ID NO: 26253 - protein, 25 aa, synthetic construct
  source 1..25: note = Seed: YGFLNVIVHSATGFKQSSKALQRPV
YGFLNVIVHSATGFKQMSGALYRPV

SEQ ID NO: 26254 - protein, 25 aa, synthetic construct
  source 1..25: note = Seed: YGFLNVIVHSATGFKQSSKALQRPV
YGFLNVIVHSATGFKQMSHALARPV

SEQ ID NO: 26255 - protein, 25 aa, synthetic construct
  source 1..25: note = Seed: YGFLNVIVHSATGFKQSSKALQRPV
YGFLNVIVHSATGFKQMSHALDRPV

SEQ ID NO: 26256 - protein, 25 aa, synthetic construct
  source 1..25: note = Seed: YGFLNVIVHSATGFKQSSKALQRPV
YGFLNVIVHSATGFKQMSHALGRPV

SEQ ID NO: 26257 - protein, 25 aa, synthetic construct
  source 1..25: note = Seed: YGFLNVIVHSATGFKQSSKALQRPV
YGFLNVIVHSATGFKQMSHALHRPV

SEQ ID NO: 26258 - protein, 25 aa, synthetic construct
  source 1..25: note = Seed: YGFLNVIVHSATGFKQSSKALQRPV
YGFLNVIVHSATGFKQMSHALIRPV

SEQ ID NO: 26259 - protein, 25 aa, synthetic construct
  source 1..25: note = Seed: YGFLNVIVHSATGFKQSSKALQRPV
YGFLNVIVHSATGFKQMSHALLRPV

SEQ ID NO: 26260 - protein, 25 aa, synthetic construct
  source 1..25: note = Seed: YGFLNVIVHSATGFKQSSKALQRPV
YGFLNVIVHSATGFKQMSHALMRPV

SEQ ID NO: 26261 - protein, 25 aa, synthetic construct
  source 1..25: note = Seed: YGFLNVIVHSATGFKQSSKALQRPV
YGFLNVIVHSATGFKQMSHALNRPV

SEQ ID NO: 26262 - protein, 25 aa, synthetic construct
  source 1..25: note = Seed: YGFLNVIVHSATGFKQSSKALQRPV
YGFLNVIVHSATGFKQMSHALPRPV

SEQ ID NO: 26263 - protein, 25 aa, synthetic construct
  source 1..25: note = Seed: YGFLNVIVHSATGFKQSSKALQRPV
YGFLNVIVHSATGFKQMSHALQRPV

SEQ ID NO: 26264 - protein, 25 aa, synthetic construct
  source 1..25: note = Seed: YGFLNVIVHSATGFKQSSKALQRPV
YGFLNVIVHSATGFKQMSHALSRPV

SEQ ID NO: 26265 - protein, 25 aa, synthetic construct
  source 1..25: note = Seed: YGFLNVIVHSATGFKQSSKALQRPV
YGFLNVIVHSATGFKQMSHALTRPV

SEQ ID NO: 26266 - protein, 25 aa, synthetic construct
  source 1..25: note = Seed: YGFLNVIVHSATGFKQSSKALQRPV
YGFLNVIVHSATGFKQMSHALVRPV

SEQ ID NO: 26267 - protein, 25 aa, synthetic construct
  source 1..25: note = Seed: YGFLNVIVHSATGFKQSSKALQRPV
YGFLNVIVHSATGFKQMSIALARPV

SEQ ID NO: 26268 - protein, 25 aa, synthetic construct
  source 1..25: note = Seed: YGFLNVIVHSATGFKQSSKALQRPV
YGFLNVIVHSATGFKQMSIALCRPV

SEQ ID NO: 26269 - protein, 25 aa, synthetic construct
  source 1..25: note = Seed: YGFLNVIVHSATGFKQSSKALQRPV
YGFLNVIVHSATGFKQMSIALDRPV

SEQ ID NO: 26270 - protein, 25 aa, synthetic construct
  source 1..25: note = Seed: YGFLNVIVHSATGFKQSSKALQRPV
YGFLNVIVHSATGFKQMSIALERPV

SEQ ID NO: 26271 - protein, 25 aa, synthetic construct
  source 1..25: note = Seed: YGFLNVIVHSATGFKQSSKALQRPV
YGFLNVIVHSATGFKQMSIALFRPV

SEQ ID NO: 26272 - protein, 25 aa, synthetic construct
  source 1..25: note = Seed: YGFLNVIVHSATGFKQSSKALQRPV
YGFLNVIVHSATGFKQMSIALGRPV

SEQ ID NO: 26273 - protein, 25 aa, synthetic construct
  source 1..25: note = Seed: YGFLNVIVHSATGFKQSSKALQRPV
YGFLNVIVHSATGFKQMSIALHRPV

SEQ ID NO: 26274 - protein, 25 aa, synthetic construct
  source 1..25: note = Seed: YGFLNVIVHSATGFKQSSKALQRPV
YGFLNVIVHSATGFKQMSIALIRPV

SEQ ID NO: 26275 - protein, 25 aa, synthetic construct
  source 1..25: note = Seed: YGFLNVIVHSATGFKQSSKALQRPV
YGFLNVIVHSATGFKQMSIALKRPV

SEQ ID NO: 26276 - protein, 25 aa, synthetic construct
  source 1..25: note = Seed: YGFLNVIVHSATGFKQSSKALQRPV
YGFLNVIVHSATGFKQMSIALLRPV

SEQ ID NO: 26277 - protein, 25 aa, synthetic construct
  source 1..25: note = Seed: YGFLNVIVHSATGFKQSSKALQRPV
YGFLNVIVHSATGFKQMSIALMRPV

SEQ ID NO: 26278 - protein, 25 aa, synthetic construct
  source 1..25: note = Seed: YGFLNVIVHSATGFKQSSKALQRPV
YGFLNVIVHSATGFKQMSIALNRPV

SEQ ID NO: 26279 - protein, 25 aa, synthetic construct
  source 1..25: note = Seed: YGFLNVIVHSATGFKQSSKALQRPV
YGFLNVIVHSATGFKQMSIALPRPV

SEQ ID NO: 26280 - protein, 25 aa, synthetic construct
  source 1..25: note = Seed: YGFLNVIVHSATGFKQSSKALQRPV
YGFLNVIVHSATGFKQMSIALQRPV

SEQ ID NO: 26281 - protein, 25 aa, synthetic construct
  source 1..25: note = Seed: YGFLNVIVHSATGFKQSSKALQRPV
YGFLNVIVHSATGFKQMSIALRRPV

SEQ ID NO: 26282 - protein, 25 aa, synthetic construct
  source 1..25: note = Seed: YGFLNVIVHSATGFKQSSKALQRPV
YGFLNVIVHSATGFKQMSIALSRPV

SEQ ID NO: 26283 - protein, 25 aa, synthetic construct
  source 1..25: note = Seed: YGFLNVIVHSATGFKQSSKALQRPV
YGFLNVIVHSATGFKQMSIALTRPV

SEQ ID NO: 26284 - protein, 25 aa, synthetic construct
  source 1..25: note = Seed: YGFLNVIVHSATGFKQSSKALQRPV
YGFLNVIVHSATGFKQMSIALVRPV

SEQ ID NO: 26285 - protein, 25 aa, synthetic construct
  source 1..25: note = Seed: YGFLNVIVHSATGFKQSSKALQRPV
YGFLNVIVHSATGFKQMSIALYRPV

SEQ ID NO: 26286 - protein, 25 aa, synthetic construct
  source 1..25: note = Seed: YGFLNVIVHSATGFKQSSKALQRPV
YGFLNVIVHSATGFKQMSKALARPV

SEQ ID NO: 26287 - protein, 25 aa, synthetic construct
  source 1..25: note = Seed: YGFLNVIVHSATGFKQSSKALQRPV
YGFLNVIVHSATGFKQMSKALCRPV

SEQ ID NO: 26288 - protein, 25 aa, synthetic construct
  source 1..25: note = Seed: YGFLNVIVHSATGFKQSSKALQRPV
YGFLNVIVHSATGFKQMSKALDRPV

SEQ ID NO: 26289 - protein, 25 aa, synthetic construct
  source 1..25: note = Seed: YGFLNVIVHSATGFKQSSKALQRPV
YGFLNVIVHSATGFKQMSKALERPV

SEQ ID NO: 26290 - protein, 25 aa, synthetic construct
  source 1..25: note = Seed: YGFLNVIVHSATGFKQSSKALQRPV
YGFLNVIVHSATGFKQMSKALFRPV

SEQ ID NO: 26291 - protein, 25 aa, synthetic construct
  source 1..25: note = Seed: YGFLNVIVHSATGFKQSSKALQRPV
YGFLNVIVHSATGFKQMSKALGRPV

SEQ ID NO: 26292 - protein, 25 aa, synthetic construct
  source 1..25: note = Seed: YGFLNVIVHSATGFKQSSKALQRPV
YGFLNVIVHSATGFKQMSKALHRPV

SEQ ID NO: 26293 - protein, 25 aa, synthetic construct
  source 1..25: note = Seed: YGFLNVIVHSATGFKQSSKALQRPV
YGFLNVIVHSATGFKQMSKALIRPV

SEQ ID NO: 26294 - protein, 25 aa, synthetic construct
  source 1..25: note = Seed: YGFLNVIVHSATGFKQSSKALQRPV
YGFLNVIVHSATGFKQMSKALKRPV

SEQ ID NO: 26295 - protein, 25 aa, synthetic construct
  source 1..25: note = Seed: YGFLNVIVHSATGFKQSSKALQRPV
YGFLNVIVHSATGFKQMSKALLRPV

SEQ ID NO: 26296 - protein, 25 aa, synthetic construct
  source 1..25: note = Seed: YGFLNVIVHSATGFKQSSKALQRPV
YGFLNVIVHSATGFKQMSKALMRPV

SEQ ID NO: 26297 - protein, 25 aa, synthetic construct
  source 1..25: note = Seed: YGFLNVIVHSATGFKQSSKALQRPV
YGFLNVIVHSATGFKQMSKALNRPV

SEQ ID NO: 26298 - protein, 25 aa, synthetic construct
  source 1..25: note = Seed: YGFLNVIVHSATGFKQSSKALQRPV
YGFLNVIVHSATGFKQMSKALPRPV

SEQ ID NO: 26299 - protein, 25 aa, synthetic construct
  source 1..25: note = Seed: YGFLNVIVHSATGFKQSSKALQRPV
YGFLNVIVHSATGFKQMSKALQRPV

SEQ ID NO: 26300 - protein, 25 aa, synthetic construct
  source 1..25: note = Seed: YGFLNVIVHSATGFKQSSKALQRPV
YGFLNVIVHSATGFKQMSKALRRPV

SEQ ID NO: 26301 - protein, 25 aa, synthetic construct
  source 1..25: note = Seed: YGFLNVIVHSATGFKQSSKALQRPV
YGFLNVIVHSATGFKQMSKALSRPV

SEQ ID NO: 26302 - protein, 25 aa, synthetic construct
  source 1..25: note = Seed: YGFLNVIVHSATGFKQSSKALQRPV
YGFLNVIVHSATGFKQMSKALTRPV

SEQ ID NO: 26303 - protein, 25 aa, synthetic construct
  source 1..25: note = Seed: YGFLNVIVHSATGFKQSSKALQRPV
YGFLNVIVHSATGFKQMSKALVRPV

SEQ ID NO: 26304 - protein, 25 aa, synthetic construct
  source 1..25: note = Seed: YGFLNVIVHSATGFKQSSKALQRPV
YGFLNVIVHSATGFKQMSKALYRPV

SEQ ID NO: 26305 - protein, 25 aa, synthetic construct
  source 1..25: note = Seed: YGFLNVIVHSATGFKQSSKALQRPV
YGFLNVIVHSATGFKQMSLALARPV

SEQ ID NO: 26306 - protein, 25 aa, synthetic construct
  source 1..25: note = Seed: YGFLNVIVHSATGFKQSSKALQRPV
YGFLNVIVHSATGFKQMSLALCRPV

SEQ ID NO: 26307 - protein, 25 aa, synthetic construct
  source 1..25: note = Seed: YGFLNVIVHSATGFKQSSKALQRPV
YGFLNVIVHSATGFKQMSLALDRPV

SEQ ID NO: 26308 - protein, 25 aa, synthetic construct
  source 1..25: note = Seed: YGFLNVIVHSATGFKQSSKALQRPV
YGFLNVIVHSATGFKQMSLALERPV

SEQ ID NO: 26309 - protein, 25 aa, synthetic construct
  source 1..25: note = Seed: YGFLNVIVHSATGFKQSSKALQRPV
YGFLNVIVHSATGFKQMSLALFRPV

SEQ ID NO: 26310 - protein, 25 aa, synthetic construct
  source 1..25: note = Seed: YGFLNVIVHSATGFKQSSKALQRPV
YGFLNVIVHSATGFKQMSLALGRPV

SEQ ID NO: 26311 - protein, 25 aa, synthetic construct
  source 1..25: note = Seed: YGFLNVIVHSATGFKQSSKALQRPV
YGFLNVIVHSATGFKQMSLALHRPV

SEQ ID NO: 26312 - protein, 25 aa, synthetic construct
  source 1..25: note = Seed: YGFLNVIVHSATGFKQSSKALQRPV
YGFLNVIVHSATGFKQMSLALIRPV

SEQ ID NO: 26313 - protein, 25 aa, synthetic construct
  source 1..25: note = Seed: YGFLNVIVHSATGFKQSSKALQRPV
YGFLNVIVHSATGFKQMSLALKRPV

SEQ ID NO: 26314 - protein, 25 aa, synthetic construct
  source 1..25: note = Seed: YGFLNVIVHSATGFKQSSKALQRPV
YGFLNVIVHSATGFKQMSLALLRPV

SEQ ID NO: 26315 - protein, 25 aa, synthetic construct
  source 1..25: note = Seed: YGFLNVIVHSATGFKQSSKALQRPV
YGFLNVIVHSATGFKQMSLALMRPV

SEQ ID NO: 26316 - protein, 25 aa, synthetic construct
  source 1..25: note = Seed: YGFLNVIVHSATGFKQSSKALQRPV
YGFLNVIVHSATGFKQMSLALNRPV

SEQ ID NO: 26317 - protein, 25 aa, synthetic construct
  source 1..25: note = Seed: YGFLNVIVHSATGFKQSSKALQRPV
YGFLNVIVHSATGFKQMSLALPRPV

SEQ ID NO: 26318 - protein, 25 aa, synthetic construct
  source 1..25: note = Seed: YGFLNVIVHSATGFKQSSKALQRPV
YGFLNVIVHSATGFKQMSLALQRPV

SEQ ID NO: 26319 - protein, 25 aa, synthetic construct
  source 1..25: note = Seed: YGFLNVIVHSATGFKQSSKALQRPV
YGFLNVIVHSATGFKQMSLALRRPV

SEQ ID NO: 26320 - protein, 25 aa, synthetic construct
  source 1..25: note = Seed: YGFLNVIVHSATGFKQSSKALQRPV
YGFLNVIVHSATGFKQMSLALSRPV

SEQ ID NO: 26321 - protein, 25 aa, synthetic construct
  source 1..25: note = Seed: YGFLNVIVHSATGFKQSSKALQRPV
YGFLNVIVHSATGFKQMSLALTRPV

SEQ ID NO: 26322 - protein, 25 aa, synthetic construct
  source 1..25: note = Seed: YGFLNVIVHSATGFKQSSKALQRPV
YGFLNVIVHSATGFKQMSLALVRPV

SEQ ID NO: 26323 - protein, 25 aa, synthetic construct
  source 1..25: note = Seed: YGFLNVIVHSATGFKQSSKALQRPV
YGFLNVIVHSATGFKQMSMALARPV

SEQ ID NO: 26324 - protein, 25 aa, synthetic construct
  source 1..25: note = Seed: YGFLNVIVHSATGFKQSSKALQRPV
YGFLNVIVHSATGFKQMSMALCRPV

SEQ ID NO: 26325 - protein, 25 aa, synthetic construct
  source 1..25: note = Seed: YGFLNVIVHSATGFKQSSKALQRPV
YGFLNVIVHSATGFKQMSMALDRPV

SEQ ID NO: 26326 - protein, 25 aa, synthetic construct
  source 1..25: note = Seed: YGFLNVIVHSATGFKQSSKALQRPV
YGFLNVIVHSATGFKQMSMALERPV

SEQ ID NO: 26327 - protein, 25 aa, synthetic construct
  source 1..25: note = Seed: YGFLNVIVHSATGFKQSSKALQRPV
YGFLNVIVHSATGFKQMSMALFRPV

SEQ ID NO: 26328 - protein, 25 aa, synthetic construct
  source 1..25: note = Seed: YGFLNVIVHSATGFKQSSKALQRPV
YGFLNVIVHSATGFKQMSMALGRPV

SEQ ID NO: 26329 - protein, 25 aa, synthetic construct
  source 1..25: note = Seed: YGFLNVIVHSATGFKQSSKALQRPV
YGFLNVIVHSATGFKQMSMALHRPV

SEQ ID NO: 26330 - protein, 25 aa, synthetic construct
  source 1..25: note = Seed: YGFLNVIVHSATGFKQSSKALQRPV
YGFLNVIVHSATGFKQMSMALIRPV

SEQ ID NO: 26331 - protein, 25 aa, synthetic construct
  source 1..25: note = Seed: YGFLNVIVHSATGFKQSSKALQRPV
YGFLNVIVHSATGFKQMSMALKRPV

SEQ ID NO: 26332 - protein, 25 aa, synthetic construct
  source 1..25: note = Seed: YGFLNVIVHSATGFKQSSKALQRPV
YGFLNVIVHSATGFKQMSMALLRPV

SEQ ID NO: 26333 - protein, 25 aa, synthetic construct
  source 1..25: note = Seed: YGFLNVIVHSATGFKQSSKALQRPV
YGFLNVIVHSATGFKQMSMALMRPV

SEQ ID NO: 26334 - protein, 25 aa, synthetic construct
  source 1..25: note = Seed: YGFLNVIVHSATGFKQSSKALQRPV
YGFLNVIVHSATGFKQMSMALNRPV

SEQ ID NO: 26335 - protein, 25 aa, synthetic construct
  source 1..25: note = Seed: YGFLNVIVHSATGFKQSSKALQRPV
YGFLNVIVHSATGFKQMSMALPRPV

SEQ ID NO: 26336 - protein, 25 aa, synthetic construct
  source 1..25: note = Seed: YGFLNVIVHSATGFKQSSKALQRPV
YGFLNVIVHSATGFKQMSMALQRPV

SEQ ID NO: 26337 - protein, 25 aa, synthetic construct
  source 1..25: note = Seed: YGFLNVIVHSATGFKQSSKALQRPV
YGFLNVIVHSATGFKQMSMALRRPV

SEQ ID NO: 26338 - protein, 25 aa, synthetic construct
  source 1..25: note = Seed: YGFLNVIVHSATGFKQSSKALQRPV
YGFLNVIVHSATGFKQMSMALSRPV

SEQ ID NO: 26339 - protein, 25 aa, synthetic construct
  source 1..25: note = Seed: YGFLNVIVHSATGFKQSSKALQRPV
YGFLNVIVHSATGFKQMSMALTRPV

SEQ ID NO: 26340 - protein, 25 aa, synthetic construct
  source 1..25: note = Seed: YGFLNVIVHSATGFKQSSKALQRPV
YGFLNVIVHSATGFKQMSMALVRPV

SEQ ID NO: 26341 - protein, 25 aa, synthetic construct
  source 1..25: note = Seed: YGFLNVIVHSATGFKQSSKALQRPV
YGFLNVIVHSATGFKQMSMALYRPV

SEQ ID NO: 26342 - protein, 25 aa, synthetic construct
  source 1..25: note = Seed: YGFLNVIVHSATGFKQSSKALQRPV
YGFLNVIVHSATGFKQMSNALARPV

SEQ ID NO: 26343 - protein, 25 aa, synthetic construct
  source 1..25: note = Seed: YGFLNVIVHSATGFKQSSKALQRPV
YGFLNVIVHSATGFKQMSNALCRPV

SEQ ID NO: 26344 - protein, 25 aa, synthetic construct
  source 1..25: note = Seed: YGFLNVIVHSATGFKQSSKALQRPV
YGFLNVIVHSATGFKQMSNALDRPV

SEQ ID NO: 26345 - protein, 25 aa, synthetic construct
  source 1..25: note = Seed: YGFLNVIVHSATGFKQSSKALQRPV
YGFLNVIVHSATGFKQMSNALERPV

SEQ ID NO: 26346 - protein, 25 aa, synthetic construct
  source 1..25: note = Seed: YGFLNVIVHSATGFKQSSKALQRPV
YGFLNVIVHSATGFKQMSNALFRPV

SEQ ID NO: 26347 - protein, 25 aa, synthetic construct
  source 1..25: note = Seed: YGFLNVIVHSATGFKQSSKALQRPV
YGFLNVIVHSATGFKQMSNALGRPV

SEQ ID NO: 26348 - protein, 25 aa, synthetic construct
  source 1..25: note = Seed: YGFLNVIVHSATGFKQSSKALQRPV
YGFLNVIVHSATGFKQMSNALHRPV

SEQ ID NO: 26349 - protein, 25 aa, synthetic construct
  source 1..25: note = Seed: YGFLNVIVHSATGFKQSSKALQRPV
YGFLNVIVHSATGFKQMSNALIRPV

SEQ ID NO: 26350 - protein, 25 aa, synthetic construct
  source 1..25: note = Seed: YGFLNVIVHSATGFKQSSKALQRPV
YGFLNVIVHSATGFKQMSNALLRPV

SEQ ID NO: 26351 - protein, 25 aa, synthetic construct
  source 1..25: note = Seed: YGFLNVIVHSATGFKQSSKALQRPV
YGFLNVIVHSATGFKQMSNALMRPV

SEQ ID NO: 26352 - protein, 25 aa, synthetic construct
  source 1..25: note = Seed: YGFLNVIVHSATGFKQSSKALQRPV
YGFLNVIVHSATGFKQMSNALNRPV

SEQ ID NO: 26353 - protein, 25 aa, synthetic construct
  source 1..25: note = Seed: YGFLNVIVHSATGFKQSSKALQRPV
YGFLNVIVHSATGFKQMSNALPRPV

SEQ ID NO: 26354 - protein, 25 aa, synthetic construct
  source 1..25: note = Seed: YGFLNVIVHSATGFKQSSKALQRPV
YGFLNVIVHSATGFKQMSNALQRPV

SEQ ID NO: 26355 - protein, 25 aa, synthetic construct
  source 1..25: note = Seed: YGFLNVIVHSATGFKQSSKALQRPV
YGFLNVIVHSATGFKQMSNALSRPV

SEQ ID NO: 26356 - protein, 25 aa, synthetic construct
  source 1..25: note = Seed: YGFLNVIVHSATGFKQSSKALQRPV
YGFLNVIVHSATGFKQMSNALTRPV

SEQ ID NO: 26357 - protein, 25 aa, synthetic construct
  source 1..25: note = Seed: YGFLNVIVHSATGFKQSSKALQRPV
YGFLNVIVHSATGFKQMSNALVRPV

SEQ ID NO: 26358 - protein, 25 aa, synthetic construct
  source 1..25: note = Seed: YGFLNVIVHSATGFKQSSKALQRPV
YGFLNVIVHSATGFKQMSNALWRPV

SEQ ID NO: 26359 - protein, 25 aa, synthetic construct
  source 1..25: note = Seed: YGFLNVIVHSATGFKQSSKALQRPV
YGFLNVIVHSATGFKQMSNALYRPV

SEQ ID NO: 26360 - protein, 25 aa, synthetic construct
  source 1..25: note = Seed: YGFLNVIVHSATGFKQSSKALQRPV
YGFLNVIVHSATGFKQMSPALARPV

SEQ ID NO: 26361 - protein, 25 aa, synthetic construct
  source 1..25: note = Seed: YGFLNVIVHSATGFKQSSKALQRPV
YGFLNVIVHSATGFKQMSPALCRPV

SEQ ID NO: 26362 - protein, 25 aa, synthetic construct
  source 1..25: note = Seed: YGFLNVIVHSATGFKQSSKALQRPV
YGFLNVIVHSATGFKQMSPALDRPV

SEQ ID NO: 26363 - protein, 25 aa, synthetic construct
  source 1..25: note = Seed: YGFLNVIVHSATGFKQSSKALQRPV
YGFLNVIVHSATGFKQMSPALERPV

SEQ ID NO: 26364 - protein, 25 aa, synthetic construct
  source 1..25: note = Seed: YGFLNVIVHSATGFKQSSKALQRPV
YGFLNVIVHSATGFKQMSPALFRPV

SEQ ID NO: 26365 - protein, 25 aa, synthetic construct
  source 1..25: note = Seed: YGFLNVIVHSATGFKQSSKALQRPV
YGFLNVIVHSATGFKQMSPALGRPV

SEQ ID NO: 26366 - protein, 25 aa, synthetic construct
  source 1..25: note = Seed: YGFLNVIVHSATGFKQSSKALQRPV
YGFLNVIVHSATGFKQMSPALHRPV

SEQ ID NO: 26367 - protein, 25 aa, synthetic construct
  source 1..25: note = Seed: YGFLNVIVHSATGFKQSSKALQRPV
YGFLNVIVHSATGFKQMSPALIRPV

SEQ ID NO: 26368 - protein, 25 aa, synthetic construct
  source 1..25: note = Seed: YGFLNVIVHSATGFKQSSKALQRPV
YGFLNVIVHSATGFKQMSPALKRPV

SEQ ID NO: 26369 - protein, 25 aa, synthetic construct
  source 1..25: note = Seed: YGFLNVIVHSATGFKQSSKALQRPV
YGFLNVIVHSATGFKQMSPALLRPV

SEQ ID NO: 26370 - protein, 25 aa, synthetic construct
  source 1..25: note = Seed: YGFLNVIVHSATGFKQSSKALQRPV
YGFLNVIVHSATGFKQMSPALMRPV

SEQ ID NO: 26371 - protein, 25 aa, synthetic construct
  source 1..25: note = Seed: YGFLNVIVHSATGFKQSSKALQRPV
YGFLNVIVHSATGFKQMSPALNRPV

SEQ ID NO: 26372 - protein, 25 aa, synthetic construct
  source 1..25: note = Seed: YGFLNVIVHSATGFKQSSKALQRPV
YGFLNVIVHSATGFKQMSPALPRPV

SEQ ID NO: 26373 - protein, 25 aa, synthetic construct
  source 1..25: note = Seed: YGFLNVIVHSATGFKQSSKALQRPV
YGFLNVIVHSATGFKQMSPALQRPV

SEQ ID NO: 26374 - protein, 25 aa, synthetic construct
  source 1..25: note = Seed: YGFLNVIVHSATGFKQSSKALQRPV
YGFLNVIVHSATGFKQMSPALRRPV

SEQ ID NO: 26375 - protein, 25 aa, synthetic construct
  source 1..25: note = Seed: YGFLNVIVHSATGFKQSSKALQRPV
YGFLNVIVHSATGFKQMSPALSRPV

SEQ ID NO: 26376 - protein, 25 aa, synthetic construct
  source 1..25: note = Seed: YGFLNVIVHSATGFKQSSKALQRPV
YGFLNVIVHSATGFKQMSPALTRPV

SEQ ID NO: 26377 - protein, 25 aa, synthetic construct
  source 1..25: note = Seed: YGFLNVIVHSATGFKQSSKALQRPV
YGFLNVIVHSATGFKQMSPALVRPV

SEQ ID NO: 26378 - protein, 25 aa, synthetic construct
  source 1..25: note = Seed: YGFLNVIVHSATGFKQSSKALQRPV
YGFLNVIVHSATGFKQMSPALWRPV

SEQ ID NO: 26379 - protein, 25 aa, synthetic construct
  source 1..25: note = Seed: YGFLNVIVHSATGFKQSSKALQRPV
YGFLNVIVHSATGFKQMSPALYRPV

SEQ ID NO: 26380 - protein, 25 aa, synthetic construct
  source 1..25: note = Seed: YGFLNVIVHSATGFKQSSKALQRPV
YGFLNVIVHSATGFKQMSQALARPV

SEQ ID NO: 26381 - protein, 25 aa, synthetic construct
  source 1..25: note = Seed: YGFLNVIVHSATGFKQSSKALQRPV
YGFLNVIVHSATGFKQMSQALGRPV

SEQ ID NO: 26382 - protein, 25 aa, synthetic construct
  source 1..25: note = Seed: YGFLNVIVHSATGFKQSSKALQRPV
YGFLNVIVHSATGFKQMSQALHRPV

SEQ ID NO: 26383 - protein, 25 aa, synthetic construct
  source 1..25: note = Seed: YGFLNVIVHSATGFKQSSKALQRPV
YGFLNVIVHSATGFKQMSQALIRPV

SEQ ID NO: 26384 - protein, 25 aa, synthetic construct
  source 1..25: note = Seed: YGFLNVIVHSATGFKQSSKALQRPV
YGFLNVIVHSATGFKQMSQALLRPV

SEQ ID NO: 26385 - protein, 25 aa, synthetic construct
  source 1..25: note = Seed: YGFLNVIVHSATGFKQSSKALQRPV
YGFLNVIVHSATGFKQMSQALMRPV

SEQ ID NO: 26386 - protein, 25 aa, synthetic construct
  source 1..25: note = Seed: YGFLNVIVHSATGFKQSSKALQRPV
YGFLNVIVHSATGFKQMSQALNRPV

SEQ ID NO: 26387 - protein, 25 aa, synthetic construct
  source 1..25: note = Seed: YGFLNVIVHSATGFKQSSKALQRPV
YGFLNVIVHSATGFKQMSQALPRPV

SEQ ID NO: 26388 - protein, 25 aa, synthetic construct
  source 1..25: note = Seed: YGFLNVIVHSATGFKQSSKALQRPV
YGFLNVIVHSATGFKQMSQALQRPV

SEQ ID NO: 26389 - protein, 25 aa, synthetic construct
  source 1..25: note = Seed: YGFLNVIVHSATGFKQSSKALQRPV
YGFLNVIVHSATGFKQMSQALSRPV

SEQ ID NO: 26390 - protein, 25 aa, synthetic construct
  source 1..25: note = Seed: YGFLNVIVHSATGFKQSSKALQRPV
YGFLNVIVHSATGFKQMSQALTRPV

SEQ ID NO: 26391 - protein, 25 aa, synthetic construct
  source 1..25: note = Seed: YGFLNVIVHSATGFKQSSKALQRPV
YGFLNVIVHSATGFKQMSQALVRPV

SEQ ID NO: 26392 - protein, 25 aa, synthetic construct
  source 1..25: note = Seed: YGFLNVIVHSATGFKQSSKALQRPV
YGFLNVIVHSATGFKQMSRALARPV

SEQ ID NO: 26393 - protein, 25 aa, synthetic construct
  source 1..25: note = Seed: YGFLNVIVHSATGFKQSSKALQRPV
YGFLNVIVHSATGFKQMSRALCRPV

SEQ ID NO: 26394 - protein, 25 aa, synthetic construct
  source 1..25: note = Seed: YGFLNVIVHSATGFKQSSKALQRPV
YGFLNVIVHSATGFKQMSRALDRPV

SEQ ID NO: 26395 - protein, 25 aa, synthetic construct
  source 1..25: note = Seed: YGFLNVIVHSATGFKQSSKALQRPV
YGFLNVIVHSATGFKQMSRALERPV

SEQ ID NO: 26396 - protein, 25 aa, synthetic construct
  source 1..25: note = Seed: YGFLNVIVHSATGFKQSSKALQRPV
YGFLNVIVHSATGFKQMSRALFRPV

SEQ ID NO: 26397 - protein, 25 aa, synthetic construct
  source 1..25: note = Seed: YGFLNVIVHSATGFKQSSKALQRPV
YGFLNVIVHSATGFKQMSRALGRPV

SEQ ID NO: 26398 - protein, 25 aa, synthetic construct
  source 1..25: note = Seed: YGFLNVIVHSATGFKQSSKALQRPV
YGFLNVIVHSATGFKQMSRALHRPV

SEQ ID NO: 26399 - protein, 25 aa, synthetic construct
  source 1..25: note = Seed: YGFLNVIVHSATGFKQSSKALQRPV
YGFLNVIVHSATGFKQMSRALIRPV

SEQ ID NO: 26400 - protein, 25 aa, synthetic construct
  source 1..25: note = Seed: YGFLNVIVHSATGFKQSSKALQRPV
YGFLNVIVHSATGFKQMSRALKRPV

SEQ ID NO: 26401 - protein, 25 aa, synthetic construct
  source 1..25: note = Seed: YGFLNVIVHSATGFKQSSKALQRPV
YGFLNVIVHSATGFKQMSRALLRPV

SEQ ID NO: 26402 - protein, 25 aa, synthetic construct
  source 1..25: note = Seed: YGFLNVIVHSATGFKQSSKALQRPV
YGFLNVIVHSATGFKQMSRALMRPV

SEQ ID NO: 26403 - protein, 25 aa, synthetic construct
  source 1..25: note = Seed: YGFLNVIVHSATGFKQSSKALQRPV
YGFLNVIVHSATGFKQMSRALNRPV

SEQ ID NO: 26404 - protein, 25 aa, synthetic construct
  source 1..25: note = Seed: YGFLNVIVHSATGFKQSSKALQRPV
YGFLNVIVHSATGFKQMSRALPRPV

SEQ ID NO: 26405 - protein, 25 aa, synthetic construct
  source 1..25: note = Seed: YGFLNVIVHSATGFKQSSKALQRPV
YGFLNVIVHSATGFKQMSRALQRPV

SEQ ID NO: 26406 - protein, 25 aa, synthetic construct
  source 1..25: note = Seed: YGFLNVIVHSATGFKQSSKALQRPV
YGFLNVIVHSATGFKQMSRALRRPV

SEQ ID NO: 26407 - protein, 25 aa, synthetic construct
  source 1..25: note = Seed: YGFLNVIVHSATGFKQSSKALQRPV
YGFLNVIVHSATGFKQMSRALSRPV

SEQ ID NO: 26408 - protein, 25 aa, synthetic construct
  source 1..25: note = Seed: YGFLNVIVHSATGFKQSSKALQRPV
YGFLNVIVHSATGFKQMSRALTRPV

SEQ ID NO: 26409 - protein, 25 aa, synthetic construct
  source 1..25: note = Seed: YGFLNVIVHSATGFKQSSKALQRPV
YGFLNVIVHSATGFKQMSRALVRPV

SEQ ID NO: 26410 - protein, 25 aa, synthetic construct
  source 1..25: note = Seed: YGFLNVIVHSATGFKQSSKALQRPV
YGFLNVIVHSATGFKQMSRALWRPV

SEQ ID NO: 26411 - protein, 25 aa, synthetic construct
  source 1..25: note = Seed: YGFLNVIVHSATGFKQSSKALQRPV
YGFLNVIVHSATGFKQMSRALYRPV

SEQ ID NO: 26412 - protein, 25 aa, synthetic construct
  source 1..25: note = Seed: YGFLNVIVHSATGFKQSSKALQRPV
YGFLNVIVHSATGFKQMSSALARPV

SEQ ID NO: 26413 - protein, 25 aa, synthetic construct
  source 1..25: note = Seed: YGFLNVIVHSATGFKQSSKALQRPV
YGFLNVIVHSATGFKQMSSALCRPV

SEQ ID NO: 26414 - protein, 25 aa, synthetic construct
  source 1..25: note = Seed: YGFLNVIVHSATGFKQSSKALQRPV
YGFLNVIVHSATGFKQMSSALDRPV

SEQ ID NO: 26415 - protein, 25 aa, synthetic construct
  source 1..25: note = Seed: YGFLNVIVHSATGFKQSSKALQRPV
YGFLNVIVHSATGFKQMSSALERPV

SEQ ID NO: 26416 - protein, 25 aa, synthetic construct
  source 1..25: note = Seed: YGFLNVIVHSATGFKQSSKALQRPV
YGFLNVIVHSATGFKQMSSALFRPV

SEQ ID NO: 26417 - protein, 25 aa, synthetic construct
  source 1..25: note = Seed: YGFLNVIVHSATGFKQSSKALQRPV
YGFLNVIVHSATGFKQMSSALGRPV

SEQ ID NO: 26418 - protein, 25 aa, synthetic construct
  source 1..25: note = Seed: YGFLNVIVHSATGFKQSSKALQRPV
YGFLNVIVHSATGFKQMSSALHRPV

SEQ ID NO: 26419 - protein, 25 aa, synthetic construct
  source 1..25: note = Seed: YGFLNVIVHSATGFKQSSKALQRPV
YGFLNVIVHSATGFKQMSSALIRPV

SEQ ID NO: 26420 - protein, 25 aa, synthetic construct
  source 1..25: note = Seed: YGFLNVIVHSATGFKQSSKALQRPV
YGFLNVIVHSATGFKQMSSALKRPV

SEQ ID NO: 26421 - protein, 25 aa, synthetic construct
  source 1..25: note = Seed: YGFLNVIVHSATGFKQSSKALQRPV
YGFLNVIVHSATGFKQMSSALLRPV

SEQ ID NO: 26422 - protein, 25 aa, synthetic construct
  source 1..25: note = Seed: YGFLNVIVHSATGFKQSSKALQRPV
YGFLNVIVHSATGFKQMSSALMRPV

SEQ ID NO: 26423 - protein, 25 aa, synthetic construct
  source 1..25: note = Seed: YGFLNVIVHSATGFKQSSKALQRPV
YGFLNVIVHSATGFKQMSSALNRPV

SEQ ID NO: 26424 - protein, 25 aa, synthetic construct
  source 1..25: note = Seed: YGFLNVIVHSATGFKQSSKALQRPV
YGFLNVIVHSATGFKQMSSALPRPV

SEQ ID NO: 26425 - protein, 25 aa, synthetic construct
  source 1..25: note = Seed: YGFLNVIVHSATGFKQSSKALQRPV
YGFLNVIVHSATGFKQMSSALQRPV

SEQ ID NO: 26426 - protein, 25 aa, synthetic construct
  source 1..25: note = Seed: YGFLNVIVHSATGFKQSSKALQRPV
YGFLNVIVHSATGFKQMSSALRRPV

SEQ ID NO: 26427 - protein, 25 aa, synthetic construct
  source 1..25: note = Seed: YGFLNVIVHSATGFKQSSKALQRPV
YGFLNVIVHSATGFKQMSSALSRPV

SEQ ID NO: 26428 - protein, 25 aa, synthetic construct
  source 1..25: note = Seed: YGFLNVIVHSATGFKQSSKALQRPV
YGFLNVIVHSATGFKQMSSALTRPV

SEQ ID NO: 26429 - protein, 25 aa, synthetic construct
  source 1..25: note = Seed: YGFLNVIVHSATGFKQSSKALQRPV
YGFLNVIVHSATGFKQMSSALVRPV

SEQ ID NO: 26430 - protein, 25 aa, synthetic construct
  source 1..25: note = Seed: YGFLNVIVHSATGFKQSSKALQRPV
YGFLNVIVHSATGFKQMSSALWRPV

SEQ ID NO: 26431 - protein, 25 aa, synthetic construct
  source 1..25: note = Seed: YGFLNVIVHSATGFKQSSKALQRPV
YGFLNVIVHSATGFKQMSSALYRPV

SEQ ID NO: 26432 - protein, 25 aa, synthetic construct
  source 1..25: note = Seed: YGFLNVIVHSATGFKQSSKALQRPV
YGFLNVIVHSATGFKQMSTALARPV

SEQ ID NO: 26433 - protein, 25 aa, synthetic construct
  source 1..25: note = Seed: YGFLNVIVHSATGFKQSSKALQRPV
YGFLNVIVHSATGFKQMSTALCRPV

SEQ ID NO: 26434 - protein, 25 aa, synthetic construct
  source 1..25: note = Seed: YGFLNVIVHSATGFKQSSKALQRPV
YGFLNVIVHSATGFKQMSTALDRPV

SEQ ID NO: 26435 - protein, 25 aa, synthetic construct
  source 1..25: note = Seed: YGFLNVIVHSATGFKQSSKALQRPV
YGFLNVIVHSATGFKQMSTALERPV

SEQ ID NO: 26436 - protein, 25 aa, synthetic construct
  source 1..25: note = Seed: YGFLNVIVHSATGFKQSSKALQRPV
YGFLNVIVHSATGFKQMSTALFRPV

SEQ ID NO: 26437 - protein, 25 aa, synthetic construct
  source 1..25: note = Seed: YGFLNVIVHSATGFKQSSKALQRPV
YGFLNVIVHSATGFKQMSTALGRPV

SEQ ID NO: 26438 - protein, 25 aa, synthetic construct
  source 1..25: note = Seed: YGFLNVIVHSATGFKQSSKALQRPV
YGFLNVIVHSATGFKQMSTALHRPV

SEQ ID NO: 26439 - protein, 25 aa, synthetic construct
  source 1..25: note = Seed: YGFLNVIVHSATGFKQSSKALQRPV
YGFLNVIVHSATGFKQMSTALIRPV

SEQ ID NO: 26440 - protein, 25 aa, synthetic construct
  source 1..25: note = Seed: YGFLNVIVHSATGFKQSSKALQRPV
YGFLNVIVHSATGFKQMSTALKRPV

SEQ ID NO: 26441 - protein, 25 aa, synthetic construct
  source 1..25: note = Seed: YGFLNVIVHSATGFKQSSKALQRPV
YGFLNVIVHSATGFKQMSTALLRPV

SEQ ID NO: 26442 - protein, 25 aa, synthetic construct
  source 1..25: note = Seed: YGFLNVIVHSATGFKQSSKALQRPV
YGFLNVIVHSATGFKQMSTALMRPV

SEQ ID NO: 26443 - protein, 25 aa, synthetic construct
  source 1..25: note = Seed: YGFLNVIVHSATGFKQSSKALQRPV
YGFLNVIVHSATGFKQMSTALNRPV

SEQ ID NO: 26444 - protein, 25 aa, synthetic construct
  source 1..25: note = Seed: YGFLNVIVHSATGFKQSSKALQRPV
YGFLNVIVHSATGFKQMSTALPRPV

SEQ ID NO: 26445 - protein, 25 aa, synthetic construct
  source 1..25: note = Seed: YGFLNVIVHSATGFKQSSKALQRPV
YGFLNVIVHSATGFKQMSTALQRPV

SEQ ID NO: 26446 - protein, 25 aa, synthetic construct
  source 1..25: note = Seed: YGFLNVIVHSATGFKQSSKALQRPV
YGFLNVIVHSATGFKQMSTALRRPV

SEQ ID NO: 26447 - protein, 25 aa, synthetic construct
  source 1..25: note = Seed: YGFLNVIVHSATGFKQSSKALQRPV
YGFLNVIVHSATGFKQMSTALSRPV

SEQ ID NO: 26448 - protein, 25 aa, synthetic construct
  source 1..25: note = Seed: YGFLNVIVHSATGFKQSSKALQRPV
YGFLNVIVHSATGFKQMSTALTRPV

SEQ ID NO: 26449 - protein, 25 aa, synthetic construct
  source 1..25: note = Seed: YGFLNVIVHSATGFKQSSKALQRPV
YGFLNVIVHSATGFKQMSTALVRPV

SEQ ID NO: 26450 - protein, 25 aa, synthetic construct
  source 1..25: note = Seed: YGFLNVIVHSATGFKQSSKALQRPV
YGFLNVIVHSATGFKQMSTALWRPV

SEQ ID NO: 26451 - protein, 25 aa, synthetic construct
  source 1..25: note = Seed: YGFLNVIVHSATGFKQSSKALQRPV
YGFLNVIVHSATGFKQMSTALYRPV

SEQ ID NO: 26452 - protein, 25 aa, synthetic construct
  source 1..25: note = Seed: YGFLNVIVHSATGFKQSSKALQRPV
YGFLNVIVHSATGFKQMSVALARPV

SEQ ID NO: 26453 - protein, 25 aa, synthetic construct
  source 1..25: note = Seed: YGFLNVIVHSATGFKQSSKALQRPV
YGFLNVIVHSATGFKQMSVALCRPV

SEQ ID NO: 26454 - protein, 25 aa, synthetic construct
  source 1..25: note = Seed: YGFLNVIVHSATGFKQSSKALQRPV
YGFLNVIVHSATGFKQMSVALDRPV

SEQ ID NO: 26455 - protein, 25 aa, synthetic construct
  source 1..25: note = Seed: YGFLNVIVHSATGFKQSSKALQRPV
YGFLNVIVHSATGFKQMSVALERPV

SEQ ID NO: 26456 - protein, 25 aa, synthetic construct
  source 1..25: note = Seed: YGFLNVIVHSATGFKQSSKALQRPV
YGFLNVIVHSATGFKQMSVALFRPV

SEQ ID NO: 26457 - protein, 25 aa, synthetic construct
  source 1..25: note = Seed: YGFLNVIVHSATGFKQSSKALQRPV
YGFLNVIVHSATGFKQMSVALGRPV

SEQ ID NO: 26458 - protein, 25 aa, synthetic construct
  source 1..25: note = Seed: YGFLNVIVHSATGFKQSSKALQRPV
YGFLNVIVHSATGFKQMSVALHRPV

SEQ ID NO: 26459 - protein, 25 aa, synthetic construct
  source 1..25: note = Seed: YGFLNVIVHSATGFKQSSKALQRPV
YGFLNVIVHSATGFKQMSVALIRPV

SEQ ID NO: 26460 - protein, 25 aa, synthetic construct
  source 1..25: note = Seed: YGFLNVIVHSATGFKQSSKALQRPV
YGFLNVIVHSATGFKQMSVALKRPV

SEQ ID NO: 26461 - protein, 25 aa, synthetic construct
  source 1..25: note = Seed: YGFLNVIVHSATGFKQSSKALQRPV
YGFLNVIVHSATGFKQMSVALLRPV

SEQ ID NO: 26462 - protein, 25 aa, synthetic construct
  source 1..25: note = Seed: YGFLNVIVHSATGFKQSSKALQRPV
YGFLNVIVHSATGFKQMSVALMRPV

SEQ ID NO: 26463 - protein, 25 aa, synthetic construct
  source 1..25: note = Seed: YGFLNVIVHSATGFKQSSKALQRPV
YGFLNVIVHSATGFKQMSVALNRPV

SEQ ID NO: 26464 - protein, 25 aa, synthetic construct
  source 1..25: note = Seed: YGFLNVIVHSATGFKQSSKALQRPV
YGFLNVIVHSATGFKQMSVALPRPV

SEQ ID NO: 26465 - protein, 25 aa, synthetic construct
  source 1..25: note = Seed: YGFLNVIVHSATGFKQSSKALQRPV
YGFLNVIVHSATGFKQMSVALQRPV

SEQ ID NO: 26466 - protein, 25 aa, synthetic construct
  source 1..25: note = Seed: YGFLNVIVHSATGFKQSSKALQRPV
YGFLNVIVHSATGFKQMSVALRRPV

SEQ ID NO: 26467 - protein, 25 aa, synthetic construct
  source 1..25: note = Seed: YGFLNVIVHSATGFKQSSKALQRPV
YGFLNVIVHSATGFKQMSVALSRPV

SEQ ID NO: 26468 - protein, 25 aa, synthetic construct
  source 1..25: note = Seed: YGFLNVIVHSATGFKQSSKALQRPV
YGFLNVIVHSATGFKQMSVALTRPV

SEQ ID NO: 26469 - protein, 25 aa, synthetic construct
  source 1..25: note = Seed: YGFLNVIVHSATGFKQSSKALQRPV
YGFLNVIVHSATGFKQMSVALVRPV

SEQ ID NO: 26470 - protein, 25 aa, synthetic construct
  source 1..25: note = Seed: YGFLNVIVHSATGFKQSSKALQRPV
YGFLNVIVHSATGFKQMSVALYRPV

SEQ ID NO: 26471 - protein, 25 aa, synthetic construct
  source 1..25: note = Seed: YGFLNVIVHSATGFKQSSKALQRPV
YGFLNVIVHSATGFKQMSWALARPV

SEQ ID NO: 26472 - protein, 25 aa, synthetic construct
  source 1..25: note = Seed: YGFLNVIVHSATGFKQSSKALQRPV
YGFLNVIVHSATGFKQMSWALFRPV

SEQ ID NO: 26473 - protein, 25 aa, synthetic construct
  source 1..25: note = Seed: YGFLNVIVHSATGFKQSSKALQRPV
YGFLNVIVHSATGFKQMSWALHRPV

SEQ ID NO: 26474 - protein, 25 aa, synthetic construct
  source 1..25: note = Seed: YGFLNVIVHSATGFKQSSKALQRPV
YGFLNVIVHSATGFKQMSWALIRPV

SEQ ID NO: 26475 - protein, 25 aa, synthetic construct
  source 1..25: note = Seed: YGFLNVIVHSATGFKQSSKALQRPV
YGFLNVIVHSATGFKQMSWALLRPV

SEQ ID NO: 26476 - protein, 25 aa, synthetic construct
  source 1..25: note = Seed: YGFLNVIVHSATGFKQSSKALQRPV
YGFLNVIVHSATGFKQMSWALMRPV

SEQ ID NO: 26477 - protein, 25 aa, synthetic construct
  source 1..25: note = Seed: YGFLNVIVHSATGFKQSSKALQRPV
YGFLNVIVHSATGFKQMSWALNRPV

SEQ ID NO: 26478 - protein, 25 aa, synthetic construct
  source 1..25: note = Seed: YGFLNVIVHSATGFKQSSKALQRPV
YGFLNVIVHSATGFKQMSWALSRPV

SEQ ID NO: 26479 - protein, 25 aa, synthetic construct
  source 1..25: note = Seed: YGFLNVIVHSATGFKQSSKALQRPV
YGFLNVIVHSATGFKQMSWALTRPV

SEQ ID NO: 26480 - protein, 25 aa, synthetic construct
  source 1..25: note = Seed: YGFLNVIVHSATGFKQSSKALQRPV
YGFLNVIVHSATGFKQMSWALVRPV

SEQ ID NO: 26481 - protein, 25 aa, synthetic construct
  source 1..25: note = Seed: YGFLNVIVHSATGFKQSSKALQRPV
YGFLNVIVHSATGFKQMSWALYRPV

SEQ ID NO: 26482 - protein, 25 aa, synthetic construct
  source 1..25: note = Seed: YGFLNVIVHSATGFKQSSKALQRPV
YGFLNVIVHSATGFKQMSYALARPV

SEQ ID NO: 26483 - protein, 25 aa, synthetic construct
  source 1..25: note = Seed: YGFLNVIVHSATGFKQSSKALQRPV
YGFLNVIVHSATGFKQMSYALFRPV

SEQ ID NO: 26484 - protein, 25 aa, synthetic construct
  source 1..25: note = Seed: YGFLNVIVHSATGFKQSSKALQRPV
YGFLNVIVHSATGFKQMSYALIRPV

SEQ ID NO: 26485 - protein, 25 aa, synthetic construct
  source 1..25: note = Seed: YGFLNVIVHSATGFKQSSKALQRPV
YGFLNVIVHSATGFKQMSYALLRPV

SEQ ID NO: 26486 - protein, 25 aa, synthetic construct
  source 1..25: note = Seed: YGFLNVIVHSATGFKQSSKALQRPV
YGFLNVIVHSATGFKQMSYALMRPV

SEQ ID NO: 26487 - protein, 25 aa, synthetic construct
  source 1..25: note = Seed: YGFLNVIVHSATGFKQSSKALQRPV
YGFLNVIVHSATGFKQMSYALNRPV

SEQ ID NO: 26488 - protein, 25 aa, synthetic construct
  source 1..25: note = Seed: YGFLNVIVHSATGFKQSSKALQRPV
YGFLNVIVHSATGFKQMSYALSRPV

SEQ ID NO: 26489 - protein, 25 aa, synthetic construct
  source 1..25: note = Seed: YGFLNVIVHSATGFKQSSKALQRPV
YGFLNVIVHSATGFKQMSYALTRPV

SEQ ID NO: 26490 - protein, 25 aa, synthetic construct
  source 1..25: note = Seed: YGFLNVIVHSATGFKQSSKALQRPV
YGFLNVIVHSATGFKQMSYALVRPV

SEQ ID NO: 26491 - protein, 25 aa, synthetic construct
  source 1..25: note = Seed: YGFLNVIVHSATGFKQSSKALQRPV
YGFLNVIVHSATGFKQMSYALYRPV

SEQ ID NO: 26492 - protein, 25 aa, synthetic construct
  source 1..25: note = Seed: YGFLNVIVHSATGFKQSSKALQRPV
YGFLNVIVHSATGFKQNSAALARPV

SEQ ID NO: 26493 - protein, 25 aa, synthetic construct
  source 1..25: note = Seed: YGFLNVIVHSATGFKQSSKALQRPV
YGFLNVIVHSATGFKQNSAALFRPV

SEQ ID NO: 26494 - protein, 25 aa, synthetic construct
  source 1..25: note = Seed: YGFLNVIVHSATGFKQSSKALQRPV
YGFLNVIVHSATGFKQNSAALIRPV

SEQ ID NO: 26495 - protein, 25 aa, synthetic construct
  source 1..25: note = Seed: YGFLNVIVHSATGFKQSSKALQRPV
YGFLNVIVHSATGFKQNSAALLRPV

SEQ ID NO: 26496 - protein, 25 aa, synthetic construct
  source 1..25: note = Seed: YGFLNVIVHSATGFKQSSKALQRPV
YGFLNVIVHSATGFKQNSAALMRPV

SEQ ID NO: 26497 - protein, 25 aa, synthetic construct
  source 1..25: note = Seed: YGFLNVIVHSATGFKQSSKALQRPV
YGFLNVIVHSATGFKQNSAALNRPV

SEQ ID NO: 26498 - protein, 25 aa, synthetic construct
  source 1..25: note = Seed: YGFLNVIVHSATGFKQSSKALQRPV
YGFLNVIVHSATGFKQNSAALSRPV

SEQ ID NO: 26499 - protein, 25 aa, synthetic construct
  source 1..25: note = Seed: YGFLNVIVHSATGFKQSSKALQRPV
YGFLNVIVHSATGFKQNSAALTRPV

SEQ ID NO: 26500 - protein, 25 aa, synthetic construct
  source 1..25: note = Seed: YGFLNVIVHSATGFKQSSKALQRPV
YGFLNVIVHSATGFKQNSAALVRPV

SEQ ID NO: 26501 - protein, 25 aa, synthetic construct
  source 1..25: note = Seed: YGFLNVIVHSATGFKQSSKALQRPV
YGFLNVIVHSATGFKQNSAALWRPV

SEQ ID NO: 26502 - protein, 25 aa, synthetic construct
  source 1..25: note = Seed: YGFLNVIVHSATGFKQSSKALQRPV
YGFLNVIVHSATGFKQNSAALYRPV

SEQ ID NO: 26503 - protein, 25 aa, synthetic construct
  source 1..25: note = Seed: YGFLNVIVHSATGFKQSSKALQRPV
YGFLNVIVHSATGFKQNSCALIRPV

SEQ ID NO: 26504 - protein, 25 aa, synthetic construct
  source 1..25: note = Seed: YGFLNVIVHSATGFKQSSKALQRPV
YGFLNVIVHSATGFKQNSCALVRPV

SEQ ID NO: 26505 - protein, 25 aa, synthetic construct
  source 1..25: note = Seed: YGFLNVIVHSATGFKQSSKALQRPV
YGFLNVIVHSATGFKQNSFALIRPV

SEQ ID NO: 26506 - protein, 25 aa, synthetic construct
  source 1..25: note = Seed: YGFLNVIVHSATGFKQSSKALQRPV
YGFLNVIVHSATGFKQNSFALLRPV

SEQ ID NO: 26507 - protein, 25 aa, synthetic construct
  source 1..25: note = Seed: YGFLNVIVHSATGFKQSSKALQRPV
YGFLNVIVHSATGFKQNSFALVRPV

SEQ ID NO: 26508 - protein, 25 aa, synthetic construct
  source 1..25: note = Seed: YGFLNVIVHSATGFKQSSKALQRPV
YGFLNVIVHSATGFKQNSGALARPV

SEQ ID NO: 26509 - protein, 25 aa, synthetic construct
  source 1..25: note = Seed: YGFLNVIVHSATGFKQSSKALQRPV
YGFLNVIVHSATGFKQNSGALFRPV

SEQ ID NO: 26510 - protein, 25 aa, synthetic construct
  source 1..25: note = Seed: YGFLNVIVHSATGFKQSSKALQRPV
YGFLNVIVHSATGFKQNSGALIRPV

SEQ ID NO: 26511 - protein, 25 aa, synthetic construct
  source 1..25: note = Seed: YGFLNVIVHSATGFKQSSKALQRPV
YGFLNVIVHSATGFKQNSGALLRPV

SEQ ID NO: 26512 - protein, 25 aa, synthetic construct
  source 1..25: note = Seed: YGFLNVIVHSATGFKQSSKALQRPV
YGFLNVIVHSATGFKQNSGALMRPV

SEQ ID NO: 26513 - protein, 25 aa, synthetic construct
  source 1..25: note = Seed: YGFLNVIVHSATGFKQSSKALQRPV
YGFLNVIVHSATGFKQNSGALVRPV

SEQ ID NO: 26514 - protein, 25 aa, synthetic construct
  source 1..25: note = Seed: YGFLNVIVHSATGFKQSSKALQRPV
YGFLNVIVHSATGFKQNSGALYRPV

SEQ ID NO: 26515 - protein, 25 aa, synthetic construct
  source 1..25: note = Seed: YGFLNVIVHSATGFKQSSKALQRPV
YGFLNVIVHSATGFKQNSHALFRPV

SEQ ID NO: 26516 - protein, 25 aa, synthetic construct
  source 1..25: note = Seed: YGFLNVIVHSATGFKQSSKALQRPV
YGFLNVIVHSATGFKQNSHALIRPV

SEQ ID NO: 26517 - protein, 25 aa, synthetic construct
  source 1..25: note = Seed: YGFLNVIVHSATGFKQSSKALQRPV
YGFLNVIVHSATGFKQNSHALLRPV

SEQ ID NO: 26518 - protein, 25 aa, synthetic construct
  source 1..25: note = Seed: YGFLNVIVHSATGFKQSSKALQRPV
YGFLNVIVHSATGFKQNSHALVRPV

SEQ ID NO: 26519 - protein, 25 aa, synthetic construct
  source 1..25: note = Seed: YGFLNVIVHSATGFKQSSKALQRPV
YGFLNVIVHSATGFKQNSHALYRPV

SEQ ID NO: 26520 - protein, 25 aa, synthetic construct
  source 1..25: note = Seed: YGFLNVIVHSATGFKQSSKALQRPV
YGFLNVIVHSATGFKQNSIALARPV

SEQ ID NO: 26521 - protein, 25 aa, synthetic construct
  source 1..25: note = Seed: YGFLNVIVHSATGFKQSSKALQRPV
YGFLNVIVHSATGFKQNSIALFRPV

SEQ ID NO: 26522 - protein, 25 aa, synthetic construct
  source 1..25: note = Seed: YGFLNVIVHSATGFKQSSKALQRPV
YGFLNVIVHSATGFKQNSIALIRPV

SEQ ID NO: 26523 - protein, 25 aa, synthetic construct
  source 1..25: note = Seed: YGFLNVIVHSATGFKQSSKALQRPV
YGFLNVIVHSATGFKQNSIALLRPV

SEQ ID NO: 26524 - protein, 25 aa, synthetic construct
  source 1..25: note = Seed: YGFLNVIVHSATGFKQSSKALQRPV
YGFLNVIVHSATGFKQNSIALMRPV

SEQ ID NO: 26525 - protein, 25 aa, synthetic construct
  source 1..25: note = Seed: YGFLNVIVHSATGFKQSSKALQRPV
YGFLNVIVHSATGFKQNSIALNRPV

SEQ ID NO: 26526 - protein, 25 aa, synthetic construct
  source 1..25: note = Seed: YGFLNVIVHSATGFKQSSKALQRPV
YGFLNVIVHSATGFKQNSIALTRPV

SEQ ID NO: 26527 - protein, 25 aa, synthetic construct
  source 1..25: note = Seed: YGFLNVIVHSATGFKQSSKALQRPV
YGFLNVIVHSATGFKQNSIALVRPV

SEQ ID NO: 26528 - protein, 25 aa, synthetic construct
  source 1..25: note = Seed: YGFLNVIVHSATGFKQSSKALQRPV
YGFLNVIVHSATGFKQNSIALYRPV

SEQ ID NO: 26529 - protein, 25 aa, synthetic construct
  source 1..25: note = Seed: YGFLNVIVHSATGFKQSSKALQRPV
YGFLNVIVHSATGFKQNSKALARPV

SEQ ID NO: 26530 - protein, 25 aa, synthetic construct
  source 1..25: note = Seed: YGFLNVIVHSATGFKQSSKALQRPV
YGFLNVIVHSATGFKQNSLALFRPV

SEQ ID NO: 26531 - protein, 25 aa, synthetic construct
  source 1..25: note = Seed: YGFLNVIVHSATGFKQSSKALQRPV
YGFLNVIVHSATGFKQNSLALIRPV

SEQ ID NO: 26532 - protein, 25 aa, synthetic construct
  source 1..25: note = Seed: YGFLNVIVHSATGFKQSSKALQRPV
YGFLNVIVHSATGFKQNSLALLRPV

SEQ ID NO: 26533 - protein, 25 aa, synthetic construct
  source 1..25: note = Seed: YGFLNVIVHSATGFKQSSKALQRPV
YGFLNVIVHSATGFKQNSLALMRPV

SEQ ID NO: 26534 - protein, 25 aa, synthetic construct
  source 1..25: note = Seed: YGFLNVIVHSATGFKQSSKALQRPV
YGFLNVIVHSATGFKQNSLALVRPV

SEQ ID NO: 26535 - protein, 25 aa, synthetic construct
  source 1..25: note = Seed: YGFLNVIVHSATGFKQSSKALQRPV
YGFLNVIVHSATGFKQNSLALYRPV

SEQ ID NO: 26536 - protein, 25 aa, synthetic construct
  source 1..25: note = Seed: YGFLNVIVHSATGFKQSSKALQRPV
YGFLNVIVHSATGFKQNSMALFRPV

SEQ ID NO: 26537 - protein, 25 aa, synthetic construct
  source 1..25: note = Seed: YGFLNVIVHSATGFKQSSKALQRPV
YGFLNVIVHSATGFKQNSMALIRPV

SEQ ID NO: 26538 - protein, 25 aa, synthetic construct
  source 1..25: note = Seed: YGFLNVIVHSATGFKQSSKALQRPV
YGFLNVIVHSATGFKQNSMALLRPV

SEQ ID NO: 26539 - protein, 25 aa, synthetic construct
  source 1..25: note = Seed: YGFLNVIVHSATGFKQSSKALQRPV
YGFLNVIVHSATGFKQNSMALMRPV

SEQ ID NO: 26540 - protein, 25 aa, synthetic construct
  source 1..25: note = Seed: YGFLNVIVHSATGFKQSSKALQRPV
YGFLNVIVHSATGFKQNSMALVRPV

SEQ ID NO: 26541 - protein, 25 aa, synthetic construct
  source 1..25: note = Seed: YGFLNVIVHSATGFKQSSKALQRPV
YGFLNVIVHSATGFKQNSMALYRPV

SEQ ID NO: 26542 - protein, 25 aa, synthetic construct
  source 1..25: note = Seed: YGFLNVIVHSATGFKQSSKALQRPV
YGFLNVIVHSATGFKQNSNALFRPV

SEQ ID NO: 26543 - protein, 25 aa, synthetic construct
  source 1..25: note = Seed: YGFLNVIVHSATGFKQSSKALQRPV
YGFLNVIVHSATGFKQNSNALIRPV

SEQ ID NO: 26544 - protein, 25 aa, synthetic construct
  source 1..25: note = Seed: YGFLNVIVHSATGFKQSSKALQRPV
YGFLNVIVHSATGFKQNSNALLRPV

SEQ ID NO: 26545 - protein, 25 aa, synthetic construct
  source 1..25: note = Seed: YGFLNVIVHSATGFKQSSKALQRPV
YGFLNVIVHSATGFKQNSNALMRPV

SEQ ID NO: 26546 - protein, 25 aa, synthetic construct
  source 1..25: note = Seed: YGFLNVIVHSATGFKQSSKALQRPV
YGFLNVIVHSATGFKQNSNALSRPV

SEQ ID NO: 26547 - protein, 25 aa, synthetic construct
  source 1..25: note = Seed: YGFLNVIVHSATGFKQSSKALQRPV
YGFLNVIVHSATGFKQNSNALTRPV

SEQ ID NO: 26548 - protein, 25 aa, synthetic construct
  source 1..25: note = Seed: YGFLNVIVHSATGFKQSSKALQRPV
YGFLNVIVHSATGFKQNSNALVRPV

SEQ ID NO: 26549 - protein, 25 aa, synthetic construct
  source 1..25: note = Seed: YGFLNVIVHSATGFKQSSKALQRPV
YGFLNVIVHSATGFKQNSNALWRPV

SEQ ID NO: 26550 - protein, 25 aa, synthetic construct
  source 1..25: note = Seed: YGFLNVIVHSATGFKQSSKALQRPV
YGFLNVIVHSATGFKQNSNALYRPV

SEQ ID NO: 26551 - protein, 25 aa, synthetic construct
  source 1..25: note = Seed: YGFLNVIVHSATGFKQSSKALQRPV
YGFLNVIVHSATGFKQNSPALARPV

SEQ ID NO: 26552 - protein, 25 aa, synthetic construct
  source 1..25: note = Seed: YGFLNVIVHSATGFKQSSKALQRPV
YGFLNVIVHSATGFKQNSPALFRPV

SEQ ID NO: 26553 - protein, 25 aa, synthetic construct
  source 1..25: note = Seed: YGFLNVIVHSATGFKQSSKALQRPV
YGFLNVIVHSATGFKQNSPALIRPV

SEQ ID NO: 26554 - protein, 25 aa, synthetic construct
  source 1..25: note = Seed: YGFLNVIVHSATGFKQSSKALQRPV
YGFLNVIVHSATGFKQNSPALLRPV

SEQ ID NO: 26555 - protein, 25 aa, synthetic construct
  source 1..25: note = Seed: YGFLNVIVHSATGFKQSSKALQRPV
YGFLNVIVHSATGFKQNSPALMRPV

SEQ ID NO: 26556 - protein, 25 aa, synthetic construct
  source 1..25: note = Seed: YGFLNVIVHSATGFKQSSKALQRPV
YGFLNVIVHSATGFKQNSPALNRPV

SEQ ID NO: 26557 - protein, 25 aa, synthetic construct
  source 1..25: note = Seed: YGFLNVIVHSATGFKQSSKALQRPV
YGFLNVIVHSATGFKQNSPALSRPV

SEQ ID NO: 26558 - protein, 25 aa, synthetic construct
  source 1..25: note = Seed: YGFLNVIVHSATGFKQSSKALQRPV
YGFLNVIVHSATGFKQNSPALVRPV

SEQ ID NO: 26559 - protein, 25 aa, synthetic construct
  source 1..25: note = Seed: YGFLNVIVHSATGFKQSSKALQRPV
YGFLNVIVHSATGFKQNSPALWRPV

SEQ ID NO: 26560 - protein, 25 aa, synthetic construct
  source 1..25: note = Seed: YGFLNVIVHSATGFKQSSKALQRPV
YGFLNVIVHSATGFKQNSPALYRPV

SEQ ID NO: 26561 - protein, 25 aa, synthetic construct
  source 1..25: note = Seed: YGFLNVIVHSATGFKQSSKALQRPV
YGFLNVIVHSATGFKQNSQALIRPV

SEQ ID NO: 26562 - protein, 25 aa, synthetic construct
  source 1..25: note = Seed: YGFLNVIVHSATGFKQSSKALQRPV
YGFLNVIVHSATGFKQNSQALVRPV

SEQ ID NO: 26563 - protein, 25 aa, synthetic construct
  source 1..25: note = Seed: YGFLNVIVHSATGFKQSSKALQRPV
YGFLNVIVHSATGFKQNSRALARPV

SEQ ID NO: 26564 - protein, 25 aa, synthetic construct
  source 1..25: note = Seed: YGFLNVIVHSATGFKQSSKALQRPV
YGFLNVIVHSATGFKQNSRALSRPV

SEQ ID NO: 26565 - protein, 25 aa, synthetic construct
  source 1..25: note = Seed: YGFLNVIVHSATGFKQSSKALQRPV
YGFLNVIVHSATGFKQNSSALARPV

SEQ ID NO: 26566 - protein, 25 aa, synthetic construct
  source 1..25: note = Seed: YGFLNVIVHSATGFKQSSKALQRPV
YGFLNVIVHSATGFKQNSSALFRPV

SEQ ID NO: 26567 - protein, 25 aa, synthetic construct
  source 1..25: note = Seed: YGFLNVIVHSATGFKQSSKALQRPV
YGFLNVIVHSATGFKQNSSALIRPV

SEQ ID NO: 26568 - protein, 25 aa, synthetic construct
  source 1..25: note = Seed: YGFLNVIVHSATGFKQSSKALQRPV
YGFLNVIVHSATGFKQNSSALLRPV

SEQ ID NO: 26569 - protein, 25 aa, synthetic construct
  source 1..25: note = Seed: YGFLNVIVHSATGFKQSSKALQRPV
YGFLNVIVHSATGFKQNSSALMRPV

SEQ ID NO: 26570 - protein, 25 aa, synthetic construct
  source 1..25: note = Seed: YGFLNVIVHSATGFKQSSKALQRPV
YGFLNVIVHSATGFKQNSSALSRPV

SEQ ID NO: 26571 - protein, 25 aa, synthetic construct
  source 1..25: note = Seed: YGFLNVIVHSATGFKQSSKALQRPV
YGFLNVIVHSATGFKQNSSALTRPV

SEQ ID NO: 26572 - protein, 25 aa, synthetic construct
  source 1..25: note = Seed: YGFLNVIVHSATGFKQSSKALQRPV
YGFLNVIVHSATGFKQNSSALVRPV

SEQ ID NO: 26573 - protein, 25 aa, synthetic construct
  source 1..25: note = Seed: YGFLNVIVHSATGFKQSSKALQRPV
YGFLNVIVHSATGFKQNSSALWRPV

SEQ ID NO: 26574 - protein, 25 aa, synthetic construct
  source 1..25: note = Seed: YGFLNVIVHSATGFKQSSKALQRPV
YGFLNVIVHSATGFKQNSSALYRPV

SEQ ID NO: 26575 - protein, 25 aa, synthetic construct
  source 1..25: note = Seed: YGFLNVIVHSATGFKQSSKALQRPV
YGFLNVIVHSATGFKQNSTALFRPV

SEQ ID NO: 26576 - protein, 25 aa, synthetic construct
  source 1..25: note = Seed: YGFLNVIVHSATGFKQSSKALQRPV
YGFLNVIVHSATGFKQNSTALIRPV

SEQ ID NO: 26577 - protein, 25 aa, synthetic construct
  source 1..25: note = Seed: YGFLNVIVHSATGFKQSSKALQRPV
YGFLNVIVHSATGFKQNSTALLRPV

SEQ ID NO: 26578 - protein, 25 aa, synthetic construct
  source 1..25: note = Seed: YGFLNVIVHSATGFKQSSKALQRPV
YGFLNVIVHSATGFKQNSTALMRPV

SEQ ID NO: 26579 - protein, 25 aa, synthetic construct
  source 1..25: note = Seed: YGFLNVIVHSATGFKQSSKALQRPV
YGFLNVIVHSATGFKQNSTALNRPV

SEQ ID NO: 26580 - protein, 25 aa, synthetic construct
  source 1..25: note = Seed: YGFLNVIVHSATGFKQSSKALQRPV
YGFLNVIVHSATGFKQNSTALSRPV

SEQ ID NO: 26581 - protein, 25 aa, synthetic construct
  source 1..25: note = Seed: YGFLNVIVHSATGFKQSSKALQRPV
YGFLNVIVHSATGFKQNSTALVRPV

SEQ ID NO: 26582 - protein, 25 aa, synthetic construct
  source 1..25: note = Seed: YGFLNVIVHSATGFKQSSKALQRPV
YGFLNVIVHSATGFKQNSTALWRPV

SEQ ID NO: 26583 - protein, 25 aa, synthetic construct
  source 1..25: note = Seed: YGFLNVIVHSATGFKQSSKALQRPV
YGFLNVIVHSATGFKQNSTALYRPV

SEQ ID NO: 26584 - protein, 25 aa, synthetic construct
  source 1..25: note = Seed: YGFLNVIVHSATGFKQSSKALQRPV
YGFLNVIVHSATGFKQNSVALARPV

SEQ ID NO: 26585 - protein, 25 aa, synthetic construct
  source 1..25: note = Seed: YGFLNVIVHSATGFKQSSKALQRPV
YGFLNVIVHSATGFKQNSVALFRPV

SEQ ID NO: 26586 - protein, 25 aa, synthetic construct
  source 1..25: note = Seed: YGFLNVIVHSATGFKQSSKALQRPV
YGFLNVIVHSATGFKQNSVALIRPV

SEQ ID NO: 26587 - protein, 25 aa, synthetic construct
  source 1..25: note = Seed: YGFLNVIVHSATGFKQSSKALQRPV
YGFLNVIVHSATGFKQNSVALLRPV

SEQ ID NO: 26588 - protein, 25 aa, synthetic construct
  source 1..25: note = Seed: YGFLNVIVHSATGFKQSSKALQRPV
YGFLNVIVHSATGFKQNSVALMRPV

SEQ ID NO: 26589 - protein, 25 aa, synthetic construct
  source 1..25: note = Seed: YGFLNVIVHSATGFKQSSKALQRPV
YGFLNVIVHSATGFKQNSVALNRPV

SEQ ID NO: 26590 - protein, 25 aa, synthetic construct
  source 1..25: note = Seed: YGFLNVIVHSATGFKQSSKALQRPV
YGFLNVIVHSATGFKQNSVALSRPV

SEQ ID NO: 26591 - protein, 25 aa, synthetic construct
  source 1..25: note = Seed: YGFLNVIVHSATGFKQSSKALQRPV
YGFLNVIVHSATGFKQNSVALTRPV

SEQ ID NO: 26592 - protein, 25 aa, synthetic construct
  source 1..25: note = Seed: YGFLNVIVHSATGFKQSSKALQRPV
YGFLNVIVHSATGFKQNSVALVRPV

SEQ ID NO: 26593 - protein, 25 aa, synthetic construct
  source 1..25: note = Seed: YGFLNVIVHSATGFKQSSKALQRPV
YGFLNVIVHSATGFKQNSVALWRPV

SEQ ID NO: 26594 - protein, 25 aa, synthetic construct
  source 1..25: note = Seed: YGFLNVIVHSATGFKQSSKALQRPV
YGFLNVIVHSATGFKQNSVALYRPV

SEQ ID NO: 26595 - protein, 25 aa, synthetic construct
  source 1..25: note = Seed: YGFLNVIVHSATGFKQSSKALQRPV
YGFLNVIVHSATGFKQNSYALIRPV

SEQ ID NO: 26596 - protein, 25 aa, synthetic construct
  source 1..25: note = Seed: YGFLNVIVHSATGFKQSSKALQRPV
YGFLNVIVHSATGFKQNSYALVRPV

SEQ ID NO: 26597 - protein, 25 aa, synthetic construct
  source 1..25: note = Seed: YGFLNVIVHSATGFKQSSKALQRPV
YGFLNVIVHSATGFKQQSAALARPV

SEQ ID NO: 26598 - protein, 25 aa, synthetic construct
  source 1..25: note = Seed: YGFLNVIVHSATGFKQSSKALQRPV
YGFLNVIVHSATGFKQQSAALCRPV

SEQ ID NO: 26599 - protein, 25 aa, synthetic construct
  source 1..25: note = Seed: YGFLNVIVHSATGFKQSSKALQRPV
YGFLNVIVHSATGFKQQSAALDRPV

SEQ ID NO: 26600 - protein, 25 aa, synthetic construct
  source 1..25: note = Seed: YGFLNVIVHSATGFKQSSKALQRPV
YGFLNVIVHSATGFKQQSAALERPV

SEQ ID NO: 26601 - protein, 25 aa, synthetic construct
  source 1..25: note = Seed: YGFLNVIVHSATGFKQSSKALQRPV
YGFLNVIVHSATGFKQQSAALFRPV

SEQ ID NO: 26602 - protein, 25 aa, synthetic construct
  source 1..25: note = Seed: YGFLNVIVHSATGFKQSSKALQRPV
YGFLNVIVHSATGFKQQSAALGRPV

SEQ ID NO: 26603 - protein, 25 aa, synthetic construct
  source 1..25: note = Seed: YGFLNVIVHSATGFKQSSKALQRPV
YGFLNVIVHSATGFKQQSAALHRPV

SEQ ID NO: 26604 - protein, 25 aa, synthetic construct
  source 1..25: note = Seed: YGFLNVIVHSATGFKQSSKALQRPV
YGFLNVIVHSATGFKQQSAALIRPV

SEQ ID NO: 26605 - protein, 25 aa, synthetic construct
  source 1..25: note = Seed: YGFLNVIVHSATGFKQSSKALQRPV
YGFLNVIVHSATGFKQQSAALLRPV

SEQ ID NO: 26606 - protein, 25 aa, synthetic construct
  source 1..25: note = Seed: YGFLNVIVHSATGFKQSSKALQRPV
YGFLNVIVHSATGFKQQSAALMRPV

SEQ ID NO: 26607 - protein, 25 aa, synthetic construct
  source 1..25: note = Seed: YGFLNVIVHSATGFKQSSKALQRPV
YGFLNVIVHSATGFKQQSAALNRPV

SEQ ID NO: 26608 - protein, 25 aa, synthetic construct
  source 1..25: note = Seed: YGFLNVIVHSATGFKQSSKALQRPV
YGFLNVIVHSATGFKQQSAALPRPV

SEQ ID NO: 26609 - protein, 25 aa, synthetic construct
  source 1..25: note = Seed: YGFLNVIVHSATGFKQSSKALQRPV
YGFLNVIVHSATGFKQQSAALQRPV

SEQ ID NO: 26610 - protein, 25 aa, synthetic construct
  source 1..25: note = Seed: YGFLNVIVHSATGFKQSSKALQRPV
YGFLNVIVHSATGFKQQSAALSRPV

SEQ ID NO: 26611 - protein, 25 aa, synthetic construct
  source 1..25: note = Seed: YGFLNVIVHSATGFKQSSKALQRPV
YGFLNVIVHSATGFKQQSAALTRPV

SEQ ID NO: 26612 - protein, 25 aa, synthetic construct
  source 1..25: note = Seed: YGFLNVIVHSATGFKQSSKALQRPV
YGFLNVIVHSATGFKQQSAALVRPV

SEQ ID NO: 26613 - protein, 25 aa, synthetic construct
  source 1..25: note = Seed: YGFLNVIVHSATGFKQSSKALQRPV
YGFLNVIVHSATGFKQQSAALWRPV

SEQ ID NO: 26614 - protein, 25 aa, synthetic construct
  source 1..25: note = Seed: YGFLNVIVHSATGFKQSSKALQRPV
YGFLNVIVHSATGFKQQSFALFRPV

SEQ ID NO: 26615 - protein, 25 aa, synthetic construct
  source 1..25: note = Seed: YGFLNVIVHSATGFKQSSKALQRPV
YGFLNVIVHSATGFKQQSFALIRPV

SEQ ID NO: 26616 - protein, 25 aa, synthetic construct
  source 1..25: note = Seed: YGFLNVIVHSATGFKQSSKALQRPV
YGFLNVIVHSATGFKQQSFALLRPV

SEQ ID NO: 26617 - protein, 25 aa, synthetic construct
  source 1..25: note = Seed: YGFLNVIVHSATGFKQSSKALQRPV
YGFLNVIVHSATGFKQQSFALMRPV

SEQ ID NO: 26618 - protein, 25 aa, synthetic construct
  source 1..25: note = Seed: YGFLNVIVHSATGFKQSSKALQRPV
YGFLNVIVHSATGFKQQSFALVRPV

SEQ ID NO: 26619 - protein, 25 aa, synthetic construct
  source 1..25: note = Seed: YGFLNVIVHSATGFKQSSKALQRPV
YGFLNVIVHSATGFKQQSFALYRPV

SEQ ID NO: 26620 - protein, 25 aa, synthetic construct
  source 1..25: note = Seed: YGFLNVIVHSATGFKQSSKALQRPV
YGFLNVIVHSATGFKQQSGALARPV

SEQ ID NO: 26621 - protein, 25 aa, synthetic construct
  source 1..25: note = Seed: YGFLNVIVHSATGFKQSSKALQRPV
YGFLNVIVHSATGFKQQSGALIRPV

SEQ ID NO: 26622 - protein, 25 aa, synthetic construct
  source 1..25: note = Seed: YGFLNVIVHSATGFKQSSKALQRPV
YGFLNVIVHSATGFKQQSGALMRPV

SEQ ID NO: 26623 - protein, 25 aa, synthetic construct
  source 1..25: note = Seed: YGFLNVIVHSATGFKQSSKALQRPV
YGFLNVIVHSATGFKQQSGALNRPV

SEQ ID NO: 26624 - protein, 25 aa, synthetic construct
  source 1..25: note = Seed: YGFLNVIVHSATGFKQSSKALQRPV
YGFLNVIVHSATGFKQQSGALSRPV

SEQ ID NO: 26625 - protein, 25 aa, synthetic construct
  source 1..25: note = Seed: YGFLNVIVHSATGFKQSSKALQRPV
YGFLNVIVHSATGFKQQSGALTRPV

SEQ ID NO: 26626 - protein, 25 aa, synthetic construct
  source 1..25: note = Seed: YGFLNVIVHSATGFKQSSKALQRPV
YGFLNVIVHSATGFKQQSGALVRPV

SEQ ID NO: 26627 - protein, 25 aa, synthetic construct
  source 1..25: note = Seed: YGFLNVIVHSATGFKQSSKALQRPV
YGFLNVIVHSATGFKQQSIALARPV

SEQ ID NO: 26628 - protein, 25 aa, synthetic construct
  source 1..25: note = Seed: YGFLNVIVHSATGFKQSSKALQRPV
YGFLNVIVHSATGFKQQSIALDRPV

SEQ ID NO: 26629 - protein, 25 aa, synthetic construct
  source 1..25: note = Seed: YGFLNVIVHSATGFKQSSKALQRPV
YGFLNVIVHSATGFKQQSIALGRPV

SEQ ID NO: 26630 - protein, 25 aa, synthetic construct
  source 1..25: note = Seed: YGFLNVIVHSATGFKQSSKALQRPV
YGFLNVIVHSATGFKQQSIALHRPV

SEQ ID NO: 26631 - protein, 25 aa, synthetic construct
  source 1..25: note = Seed: YGFLNVIVHSATGFKQSSKALQRPV
YGFLNVIVHSATGFKQQSIALIRPV

SEQ ID NO: 26632 - protein, 25 aa, synthetic construct
  source 1..25: note = Seed: YGFLNVIVHSATGFKQSSKALQRPV
YGFLNVIVHSATGFKQQSIALLRPV

SEQ ID NO: 26633 - protein, 25 aa, synthetic construct
  source 1..25: note = Seed: YGFLNVIVHSATGFKQSSKALQRPV
YGFLNVIVHSATGFKQQSIALMRPV

SEQ ID NO: 26634 - protein, 25 aa, synthetic construct
  source 1..25: note = Seed: YGFLNVIVHSATGFKQSSKALQRPV
YGFLNVIVHSATGFKQQSIALNRPV

SEQ ID NO: 26635 - protein, 25 aa, synthetic construct
  source 1..25: note = Seed: YGFLNVIVHSATGFKQSSKALQRPV
YGFLNVIVHSATGFKQQSIALPRPV

SEQ ID NO: 26636 - protein, 25 aa, synthetic construct
  source 1..25: note = Seed: YGFLNVIVHSATGFKQSSKALQRPV
YGFLNVIVHSATGFKQQSIALQRPV

SEQ ID NO: 26637 - protein, 25 aa, synthetic construct
  source 1..25: note = Seed: YGFLNVIVHSATGFKQSSKALQRPV
YGFLNVIVHSATGFKQQSIALSRPV

SEQ ID NO: 26638 - protein, 25 aa, synthetic construct
  source 1..25: note = Seed: YGFLNVIVHSATGFKQSSKALQRPV
YGFLNVIVHSATGFKQQSIALTRPV

SEQ ID NO: 26639 - protein, 25 aa, synthetic construct
  source 1..25: note = Seed: YGFLNVIVHSATGFKQSSKALQRPV
YGFLNVIVHSATGFKQQSIALVRPV

SEQ ID NO: 26640 - protein, 25 aa, synthetic construct
  source 1..25: note = Seed: YGFLNVIVHSATGFKQSSKALQRPV
YGFLNVIVHSATGFKQQSKALARPV

SEQ ID NO: 26641 - protein, 25 aa, synthetic construct
  source 1..25: note = Seed: YGFLNVIVHSATGFKQSSKALQRPV
YGFLNVIVHSATGFKQQSKALGRPV

SEQ ID NO: 26642 - protein, 25 aa, synthetic construct
  source 1..25: note = Seed: YGFLNVIVHSATGFKQSSKALQRPV
YGFLNVIVHSATGFKQQSKALSRPV

SEQ ID NO: 26643 - protein, 25 aa, synthetic construct
  source 1..25: note = Seed: YGFLNVIVHSATGFKQSSKALQRPV
YGFLNVIVHSATGFKQQSLALARPV

SEQ ID NO: 26644 - protein, 25 aa, synthetic construct
  source 1..25: note = Seed: YGFLNVIVHSATGFKQSSKALQRPV
YGFLNVIVHSATGFKQQSLALMRPV

SEQ ID NO: 26645 - protein, 25 aa, synthetic construct
  source 1..25: note = Seed: YGFLNVIVHSATGFKQSSKALQRPV
YGFLNVIVHSATGFKQQSLALNRPV

SEQ ID NO: 26646 - protein, 25 aa, synthetic construct
  source 1..25: note = Seed: YGFLNVIVHSATGFKQSSKALQRPV
YGFLNVIVHSATGFKQQSLALSRPV

SEQ ID NO: 26647 - protein, 25 aa, synthetic construct
  source 1..25: note = Seed: YGFLNVIVHSATGFKQSSKALQRPV
YGFLNVIVHSATGFKQQSLALTRPV

SEQ ID NO: 26648 - protein, 25 aa, synthetic construct
  source 1..25: note = Seed: YGFLNVIVHSATGFKQSSKALQRPV
YGFLNVIVHSATGFKQQSLALVRPV

SEQ ID NO: 26649 - protein, 25 aa, synthetic construct
  source 1..25: note = Seed: YGFLNVIVHSATGFKQSSKALQRPV
YGFLNVIVHSATGFKQQSMALARPV

SEQ ID NO: 26650 - protein, 25 aa, synthetic construct
  source 1..25: note = Seed: YGFLNVIVHSATGFKQSSKALQRPV
YGFLNVIVHSATGFKQQSMALIRPV

SEQ ID NO: 26651 - protein, 25 aa, synthetic construct
  source 1..25: note = Seed: YGFLNVIVHSATGFKQSSKALQRPV
YGFLNVIVHSATGFKQQSMALMRPV

SEQ ID NO: 26652 - protein, 25 aa, synthetic construct
  source 1..25: note = Seed: YGFLNVIVHSATGFKQSSKALQRPV
YGFLNVIVHSATGFKQQSMALNRPV

SEQ ID NO: 26653 - protein, 25 aa, synthetic construct
  source 1..25: note = Seed: YGFLNVIVHSATGFKQSSKALQRPV
YGFLNVIVHSATGFKQQSMALSRPV

SEQ ID NO: 26654 - protein, 25 aa, synthetic construct
  source 1..25: note = Seed: YGFLNVIVHSATGFKQSSKALQRPV
YGFLNVIVHSATGFKQQSMALTRPV

SEQ ID NO: 26655 - protein, 25 aa, synthetic construct
  source 1..25: note = Seed: YGFLNVIVHSATGFKQSSKALQRPV
YGFLNVIVHSATGFKQQSMALVRPV

SEQ ID NO: 26656 - protein, 25 aa, synthetic construct
  source 1..25: note = Seed: YGFLNVIVHSATGFKQSSKALQRPV
YGFLNVIVHSATGFKQQSNALARPV

SEQ ID NO: 26657 - protein, 25 aa, synthetic construct
  source 1..25: note = Seed: YGFLNVIVHSATGFKQSSKALQRPV
YGFLNVIVHSATGFKQQSNALGRPV

SEQ ID NO: 26658 - protein, 25 aa, synthetic construct
  source 1..25: note = Seed: YGFLNVIVHSATGFKQSSKALQRPV
YGFLNVIVHSATGFKQQSNALIRPV

SEQ ID NO: 26659 - protein, 25 aa, synthetic construct
  source 1..25: note = Seed: YGFLNVIVHSATGFKQSSKALQRPV
YGFLNVIVHSATGFKQQSNALLRPV

SEQ ID NO: 26660 - protein, 25 aa, synthetic construct
  source 1..25: note = Seed: YGFLNVIVHSATGFKQSSKALQRPV
YGFLNVIVHSATGFKQQSNALMRPV

SEQ ID NO: 26661 - protein, 25 aa, synthetic construct
  source 1..25: note = Seed: YGFLNVIVHSATGFKQSSKALQRPV
YGFLNVIVHSATGFKQQSNALNRPV

SEQ ID NO: 26662 - protein, 25 aa, synthetic construct
  source 1..25: note = Seed: YGFLNVIVHSATGFKQSSKALQRPV
YGFLNVIVHSATGFKQQSNALQRPV

SEQ ID NO: 26663 - protein, 25 aa, synthetic construct
  source 1..25: note = Seed: YGFLNVIVHSATGFKQSSKALQRPV
YGFLNVIVHSATGFKQQSNALSRPV

SEQ ID NO: 26664 - protein, 25 aa, synthetic construct
  source 1..25: note = Seed: YGFLNVIVHSATGFKQSSKALQRPV
YGFLNVIVHSATGFKQQSNALTRPV

SEQ ID NO: 26665 - protein, 25 aa, synthetic construct
  source 1..25: note = Seed: YGFLNVIVHSATGFKQSSKALQRPV
YGFLNVIVHSATGFKQQSNALVRPV

SEQ ID NO: 26666 - protein, 25 aa, synthetic construct
  source 1..25: note = Seed: YGFLNVIVHSATGFKQSSKALQRPV
YGFLNVIVHSATGFKQQSPALARPV

SEQ ID NO: 26667 - protein, 25 aa, synthetic construct
  source 1..25: note = Seed: YGFLNVIVHSATGFKQSSKALQRPV
YGFLNVIVHSATGFKQQSPALCRPV

SEQ ID NO: 26668 - protein, 25 aa, synthetic construct
  source 1..25: note = Seed: YGFLNVIVHSATGFKQSSKALQRPV
YGFLNVIVHSATGFKQQSPALDRPV

SEQ ID NO: 26669 - protein, 25 aa, synthetic construct
  source 1..25: note = Seed: YGFLNVIVHSATGFKQSSKALQRPV
YGFLNVIVHSATGFKQQSPALERPV

SEQ ID NO: 26670 - protein, 25 aa, synthetic construct
  source 1..25: note = Seed: YGFLNVIVHSATGFKQSSKALQRPV
YGFLNVIVHSATGFKQQSPALGRPV

SEQ ID NO: 26671 - protein, 25 aa, synthetic construct
  source 1..25: note = Seed: YGFLNVIVHSATGFKQSSKALQRPV
YGFLNVIVHSATGFKQQSPALHRPV

SEQ ID NO: 26672 - protein, 25 aa, synthetic construct
  source 1..25: note = Seed: YGFLNVIVHSATGFKQSSKALQRPV
YGFLNVIVHSATGFKQQSPALIRPV

SEQ ID NO: 26673 - protein, 25 aa, synthetic construct
  source 1..25: note = Seed: YGFLNVIVHSATGFKQSSKALQRPV
YGFLNVIVHSATGFKQQSPALLRPV

SEQ ID NO: 26674 - protein, 25 aa, synthetic construct
  source 1..25: note = Seed: YGFLNVIVHSATGFKQSSKALQRPV
YGFLNVIVHSATGFKQQSPALMRPV

SEQ ID NO: 26675 - protein, 25 aa, synthetic construct
  source 1..25: note = Seed: YGFLNVIVHSATGFKQSSKALQRPV
YGFLNVIVHSATGFKQQSPALNRPV

SEQ ID NO: 26676 - protein, 25 aa, synthetic construct
  source 1..25: note = Seed: YGFLNVIVHSATGFKQSSKALQRPV
YGFLNVIVHSATGFKQQSPALPRPV

SEQ ID NO: 26677 - protein, 25 aa, synthetic construct
  source 1..25: note = Seed: YGFLNVIVHSATGFKQSSKALQRPV
YGFLNVIVHSATGFKQQSPALQRPV

SEQ ID NO: 26678 - protein, 25 aa, synthetic construct
  source 1..25: note = Seed: YGFLNVIVHSATGFKQSSKALQRPV
YGFLNVIVHSATGFKQQSPALSRPV

SEQ ID NO: 26679 - protein, 25 aa, synthetic construct
  source 1..25: note = Seed: YGFLNVIVHSATGFKQSSKALQRPV
YGFLNVIVHSATGFKQQSPALTRPV

SEQ ID NO: 26680 - protein, 25 aa, synthetic construct
  source 1..25: note = Seed: YGFLNVIVHSATGFKQSSKALQRPV
YGFLNVIVHSATGFKQQSPALVRPV

SEQ ID NO: 26681 - protein, 25 aa, synthetic construct
  source 1..25: note = Seed: YGFLNVIVHSATGFKQSSKALQRPV
YGFLNVIVHSATGFKQQSPALWRPV

SEQ ID NO: 26682 - protein, 25 aa, synthetic construct
  source 1..25: note = Seed: YGFLNVIVHSATGFKQSSKALQRPV
YGFLNVIVHSATGFKQQSRALARPV

SEQ ID NO: 26683 - protein, 25 aa, synthetic construct
  source 1..25: note = Seed: YGFLNVIVHSATGFKQSSKALQRPV
YGFLNVIVHSATGFKQQSRALGRPV

SEQ ID NO: 26684 - protein, 25 aa, synthetic construct
  source 1..25: note = Seed: YGFLNVIVHSATGFKQSSKALQRPV
YGFLNVIVHSATGFKQQSRALHRPV

SEQ ID NO: 26685 - protein, 25 aa, synthetic construct
  source 1..25: note = Seed: YGFLNVIVHSATGFKQSSKALQRPV
YGFLNVIVHSATGFKQQSRALQRPV

SEQ ID NO: 26686 - protein, 25 aa, synthetic construct
  source 1..25: note = Seed: YGFLNVIVHSATGFKQSSKALQRPV
YGFLNVIVHSATGFKQQSRALSRPV

SEQ ID NO: 26687 - protein, 25 aa, synthetic construct
  source 1..25: note = Seed: YGFLNVIVHSATGFKQSSKALQRPV
YGFLNVIVHSATGFKQQSRALTRPV

SEQ ID NO: 26688 - protein, 25 aa, synthetic construct
  source 1..25: note = Seed: YGFLNVIVHSATGFKQSSKALQRPV
YGFLNVIVHSATGFKQQSSALARPV

SEQ ID NO: 26689 - protein, 25 aa, synthetic construct
  source 1..25: note = Seed: YGFLNVIVHSATGFKQSSKALQRPV
YGFLNVIVHSATGFKQQSSALDRPV

SEQ ID NO: 26690 - protein, 25 aa, synthetic construct
  source 1..25: note = Seed: YGFLNVIVHSATGFKQSSKALQRPV
YGFLNVIVHSATGFKQQSSALGRPV

SEQ ID NO: 26691 - protein, 25 aa, synthetic construct
  source 1..25: note = Seed: YGFLNVIVHSATGFKQSSKALQRPV
YGFLNVIVHSATGFKQQSSALHRPV

SEQ ID NO: 26692 - protein, 25 aa, synthetic construct
  source 1..25: note = Seed: YGFLNVIVHSATGFKQSSKALQRPV
YGFLNVIVHSATGFKQQSSALIRPV

SEQ ID NO: 26693 - protein, 25 aa, synthetic construct
  source 1..25: note = Seed: YGFLNVIVHSATGFKQSSKALQRPV
YGFLNVIVHSATGFKQQSSALLRPV

SEQ ID NO: 26694 - protein, 25 aa, synthetic construct
  source 1..25: note = Seed: YGFLNVIVHSATGFKQSSKALQRPV
YGFLNVIVHSATGFKQQSSALMRPV

SEQ ID NO: 26695 - protein, 25 aa, synthetic construct
  source 1..25: note = Seed: YGFLNVIVHSATGFKQSSKALQRPV
YGFLNVIVHSATGFKQQSSALNRPV

SEQ ID NO: 26696 - protein, 25 aa, synthetic construct
  source 1..25: note = Seed: YGFLNVIVHSATGFKQSSKALQRPV
YGFLNVIVHSATGFKQQSSALPRPV

SEQ ID NO: 26697 - protein, 25 aa, synthetic construct
  source 1..25: note = Seed: YGFLNVIVHSATGFKQSSKALQRPV
YGFLNVIVHSATGFKQQSSALQRPV

SEQ ID NO: 26698 - protein, 25 aa, synthetic construct
  source 1..25: note = Seed: YGFLNVIVHSATGFKQSSKALQRPV
YGFLNVIVHSATGFKQQSSALSRPV

SEQ ID NO: 26699 - protein, 25 aa, synthetic construct
  source 1..25: note = Seed: YGFLNVIVHSATGFKQSSKALQRPV
YGFLNVIVHSATGFKQQSSALTRPV

SEQ ID NO: 26700 - protein, 25 aa, synthetic construct
  source 1..25: note = Seed: YGFLNVIVHSATGFKQSSKALQRPV
YGFLNVIVHSATGFKQQSSALVRPV

SEQ ID NO: 26701 - protein, 25 aa, synthetic construct
  source 1..25: note = Seed: YGFLNVIVHSATGFKQSSKALQRPV
YGFLNVIVHSATGFKQQSTALARPV

SEQ ID NO: 26702 - protein, 25 aa, synthetic construct
  source 1..25: note = Seed: YGFLNVIVHSATGFKQSSKALQRPV
YGFLNVIVHSATGFKQQSTALCRPV

SEQ ID NO: 26703 - protein, 25 aa, synthetic construct
  source 1..25: note = Seed: YGFLNVIVHSATGFKQSSKALQRPV
YGFLNVIVHSATGFKQQSTALDRPV

SEQ ID NO: 26704 - protein, 25 aa, synthetic construct
  source 1..25: note = Seed: YGFLNVIVHSATGFKQSSKALQRPV
YGFLNVIVHSATGFKQQSTALERPV

SEQ ID NO: 26705 - protein, 25 aa, synthetic construct
  source 1..25: note = Seed: YGFLNVIVHSATGFKQSSKALQRPV
YGFLNVIVHSATGFKQQSTALGRPV

SEQ ID NO: 26706 - protein, 25 aa, synthetic construct
  source 1..25: note = Seed: YGFLNVIVHSATGFKQSSKALQRPV
YGFLNVIVHSATGFKQQSTALHRPV

SEQ ID NO: 26707 - protein, 25 aa, synthetic construct
  source 1..25: note = Seed: YGFLNVIVHSATGFKQSSKALQRPV
YGFLNVIVHSATGFKQQSTALIRPV

SEQ ID NO: 26708 - protein, 25 aa, synthetic construct
  source 1..25: note = Seed: YGFLNVIVHSATGFKQSSKALQRPV
YGFLNVIVHSATGFKQQSTALLRPV

SEQ ID NO: 26709 - protein, 25 aa, synthetic construct
  source 1..25: note = Seed: YGFLNVIVHSATGFKQSSKALQRPV
YGFLNVIVHSATGFKQQSTALMRPV

SEQ ID NO: 26710 - protein, 25 aa, synthetic construct
  source 1..25: note = Seed: YGFLNVIVHSATGFKQSSKALQRPV
YGFLNVIVHSATGFKQQSTALNRPV

SEQ ID NO: 26711 - protein, 25 aa, synthetic construct
  source 1..25: note = Seed: YGFLNVIVHSATGFKQSSKALQRPV
YGFLNVIVHSATGFKQQSTALPRPV

SEQ ID NO: 26712 - protein, 25 aa, synthetic construct
  source 1..25: note = Seed: YGFLNVIVHSATGFKQSSKALQRPV
YGFLNVIVHSATGFKQQSTALQRPV

SEQ ID NO: 26713 - protein, 25 aa, synthetic construct
  source 1..25: note = Seed: YGFLNVIVHSATGFKQSSKALQRPV
YGFLNVIVHSATGFKQQSTALSRPV

SEQ ID NO: 26714 - protein, 25 aa, synthetic construct
  source 1..25: note = Seed: YGFLNVIVHSATGFKQSSKALQRPV
YGFLNVIVHSATGFKQQSTALTRPV

SEQ ID NO: 26715 - protein, 25 aa, synthetic construct
  source 1..25: note = Seed: YGFLNVIVHSATGFKQSSKALQRPV
YGFLNVIVHSATGFKQQSTALVRPV

SEQ ID NO: 26716 - protein, 25 aa, synthetic construct
  source 1..25: note = Seed: YGFLNVIVHSATGFKQSSKALQRPV
YGFLNVIVHSATGFKQQSVALARPV

SEQ ID NO: 26717 - protein, 25 aa, synthetic construct
  source 1..25: note = Seed: YGFLNVIVHSATGFKQSSKALQRPV
YGFLNVIVHSATGFKQQSVALCRPV

SEQ ID NO: 26718 - protein, 25 aa, synthetic construct
  source 1..25: note = Seed: YGFLNVIVHSATGFKQSSKALQRPV
YGFLNVIVHSATGFKQQSVALDRPV

SEQ ID NO: 26719 - protein, 25 aa, synthetic construct
  source 1..25: note = Seed: YGFLNVIVHSATGFKQSSKALQRPV
YGFLNVIVHSATGFKQQSVALERPV

SEQ ID NO: 26720 - protein, 25 aa, synthetic construct
  source 1..25: note = Seed: YGFLNVIVHSATGFKQSSKALQRPV
YGFLNVIVHSATGFKQQSVALGRPV

SEQ ID NO: 26721 - protein, 25 aa, synthetic construct
  source 1..25: note = Seed: YGFLNVIVHSATGFKQSSKALQRPV
YGFLNVIVHSATGFKQQSVALHRPV

SEQ ID NO: 26722 - protein, 25 aa, synthetic construct
  source 1..25: note = Seed: YGFLNVIVHSATGFKQSSKALQRPV
YGFLNVIVHSATGFKQQSVALIRPV

SEQ ID NO: 26723 - protein, 25 aa, synthetic construct
  source 1..25: note = Seed: YGFLNVIVHSATGFKQSSKALQRPV
YGFLNVIVHSATGFKQQSVALLRPV

SEQ ID NO: 26724 - protein, 25 aa, synthetic construct
  source 1..25: note = Seed: YGFLNVIVHSATGFKQSSKALQRPV
YGFLNVIVHSATGFKQQSVALMRPV

SEQ ID NO: 26725 - protein, 25 aa, synthetic construct
  source 1..25: note = Seed: YGFLNVIVHSATGFKQSSKALQRPV
YGFLNVIVHSATGFKQQSVALNRPV

SEQ ID NO: 26726 - protein, 25 aa, synthetic construct
  source 1..25: note = Seed: YGFLNVIVHSATGFKQSSKALQRPV
YGFLNVIVHSATGFKQQSVALPRPV

SEQ ID NO: 26727 - protein, 25 aa, synthetic construct
  source 1..25: note = Seed: YGFLNVIVHSATGFKQSSKALQRPV
YGFLNVIVHSATGFKQQSVALQRPV

SEQ ID NO: 26728 - protein, 25 aa, synthetic construct
  source 1..25: note = Seed: YGFLNVIVHSATGFKQSSKALQRPV
YGFLNVIVHSATGFKQQSVALSRPV

SEQ ID NO: 26729 - protein, 25 aa, synthetic construct
  source 1..25: note = Seed: YGFLNVIVHSATGFKQSSKALQRPV
YGFLNVIVHSATGFKQQSVALTRPV

SEQ ID NO: 26730 - protein, 25 aa, synthetic construct
  source 1..25: note = Seed: YGFLNVIVHSATGFKQSSKALQRPV
YGFLNVIVHSATGFKQQSVALVRPV

SEQ ID NO: 26731 - protein, 25 aa, synthetic construct
  source 1..25: note = Seed: YGFLNVIVHSATGFKQSSKALQRPV
YGFLNVIVHSATGFKQQSWALFRPV

SEQ ID NO: 26732 - protein, 25 aa, synthetic construct
  source 1..25: note = Seed: YGFLNVIVHSATGFKQSSKALQRPV
YGFLNVIVHSATGFKQQSYALFRPV

SEQ ID NO: 26733 - protein, 25 aa, synthetic construct
  source 1..25: note = Seed: YGFLNVIVHSATGFKQSSKALQRPV
YGFLNVIVHSATGFKQRSFALFRPV

SEQ ID NO: 26734 - protein, 25 aa, synthetic construct
  source 1..25: note = Seed: YGFLNVIVHSATGFKQSSKALQRPV
YGFLNVIVHSATGFKQRSRALRRPV

SEQ ID NO: 26735 - protein, 25 aa, synthetic construct
  source 1..25: note = Seed: YGFLNVIVHSATGFKQSSKALQRPV
YGFLNVIVHSATGFKQSSAALARPV

SEQ ID NO: 26736 - protein, 25 aa, synthetic construct
  source 1..25: note = Seed: YGFLNVIVHSATGFKQSSKALQRPV
YGFLNVIVHSATGFKQSSAALDRPV

SEQ ID NO: 26737 - protein, 25 aa, synthetic construct
  source 1..25: note = Seed: YGFLNVIVHSATGFKQSSKALQRPV
YGFLNVIVHSATGFKQSSAALERPV

SEQ ID NO: 26738 - protein, 25 aa, synthetic construct
  source 1..25: note = Seed: YGFLNVIVHSATGFKQSSKALQRPV
YGFLNVIVHSATGFKQSSAALFRPV

SEQ ID NO: 26739 - protein, 25 aa, synthetic construct
  source 1..25: note = Seed: YGFLNVIVHSATGFKQSSKALQRPV
YGFLNVIVHSATGFKQSSAALGRPV

SEQ ID NO: 26740 - protein, 25 aa, synthetic construct
  source 1..25: note = Seed: YGFLNVIVHSATGFKQSSKALQRPV
YGFLNVIVHSATGFKQSSAALHRPV

SEQ ID NO: 26741 - protein, 25 aa, synthetic construct
  source 1..25: note = Seed: YGFLNVIVHSATGFKQSSKALQRPV
YGFLNVIVHSATGFKQSSAALIRPV

SEQ ID NO: 26742 - protein, 25 aa, synthetic construct
  source 1..25: note = Seed: YGFLNVIVHSATGFKQSSKALQRPV
YGFLNVIVHSATGFKQSSAALLRPV

SEQ ID NO: 26743 - protein, 25 aa, synthetic construct
  source 1..25: note = Seed: YGFLNVIVHSATGFKQSSKALQRPV
YGFLNVIVHSATGFKQSSAALMRPV

SEQ ID NO: 26744 - protein, 25 aa, synthetic construct
  source 1..25: note = Seed: YGFLNVIVHSATGFKQSSKALQRPV
YGFLNVIVHSATGFKQSSAALNRPV

SEQ ID NO: 26745 - protein, 25 aa, synthetic construct
  source 1..25: note = Seed: YGFLNVIVHSATGFKQSSKALQRPV
YGFLNVIVHSATGFKQSSAALPRPV

SEQ ID NO: 26746 - protein, 25 aa, synthetic construct
  source 1..25: note = Seed: YGFLNVIVHSATGFKQSSKALQRPV
YGFLNVIVHSATGFKQSSAALQRPV

SEQ ID NO: 26747 - protein, 25 aa, synthetic construct
  source 1..25: note = Seed: YGFLNVIVHSATGFKQSSKALQRPV
YGFLNVIVHSATGFKQSSAALSRPV

SEQ ID NO: 26748 - protein, 25 aa, synthetic construct
  source 1..25: note = Seed: YGFLNVIVHSATGFKQSSKALQRPV
YGFLNVIVHSATGFKQSSAALTRPV

SEQ ID NO: 26749 - protein, 25 aa, synthetic construct
  source 1..25: note = Seed: YGFLNVIVHSATGFKQSSKALQRPV
YGFLNVIVHSATGFKQSSAALVRPV

SEQ ID NO: 26750 - protein, 25 aa, synthetic construct
  source 1..25: note = Seed: YGFLNVIVHSATGFKQSSKALQRPV
YGFLNVIVHSATGFKQSSFALARPV

SEQ ID NO: 26751 - protein, 25 aa, synthetic construct
  source 1..25: note = Seed: YGFLNVIVHSATGFKQSSKALQRPV
YGFLNVIVHSATGFKQSSFALDRPV

SEQ ID NO: 26752 - protein, 25 aa, synthetic construct
  source 1..25: note = Seed: YGFLNVIVHSATGFKQSSKALQRPV
YGFLNVIVHSATGFKQSSFALERPV

SEQ ID NO: 26753 - protein, 25 aa, synthetic construct
  source 1..25: note = Seed: YGFLNVIVHSATGFKQSSKALQRPV
YGFLNVIVHSATGFKQSSFALFRPV

SEQ ID NO: 26754 - protein, 25 aa, synthetic construct
  source 1..25: note = Seed: YGFLNVIVHSATGFKQSSKALQRPV
YGFLNVIVHSATGFKQSSFALIRPV

SEQ ID NO: 26755 - protein, 25 aa, synthetic construct
  source 1..25: note = Seed: YGFLNVIVHSATGFKQSSKALQRPV
YGFLNVIVHSATGFKQSSFALLRPV

SEQ ID NO: 26756 - protein, 25 aa, synthetic construct
  source 1..25: note = Seed: YGFLNVIVHSATGFKQSSKALQRPV
YGFLNVIVHSATGFKQSSFALMRPV

SEQ ID NO: 26757 - protein, 25 aa, synthetic construct
  source 1..25: note = Seed: YGFLNVIVHSATGFKQSSKALQRPV
YGFLNVIVHSATGFKQSSFALNRPV

SEQ ID NO: 26758 - protein, 25 aa, synthetic construct
  source 1..25: note = Seed: YGFLNVIVHSATGFKQSSKALQRPV
YGFLNVIVHSATGFKQSSFALSRPV

SEQ ID NO: 26759 - protein, 25 aa, synthetic construct
  source 1..25: note = Seed: YGFLNVIVHSATGFKQSSKALQRPV
YGFLNVIVHSATGFKQSSFALTRPV

SEQ ID NO: 26760 - protein, 25 aa, synthetic construct
  source 1..25: note = Seed: YGFLNVIVHSATGFKQSSKALQRPV
YGFLNVIVHSATGFKQSSFALVRPV

SEQ ID NO: 26761 - protein, 25 aa, synthetic construct
  source 1..25: note = Seed: YGFLNVIVHSATGFKQSSKALQRPV
YGFLNVIVHSATGFKQSSFALYRPV

SEQ ID NO: 26762 - protein, 25 aa, synthetic construct
  source 1..25: note = Seed: YGFLNVIVHSATGFKQSSKALQRPV
YGFLNVIVHSATGFKQSSGALARPV

SEQ ID NO: 26763 - protein, 25 aa, synthetic construct
  source 1..25: note = Seed: YGFLNVIVHSATGFKQSSKALQRPV
YGFLNVIVHSATGFKQSSGALNRPV

SEQ ID NO: 26764 - protein, 25 aa, synthetic construct
  source 1..25: note = Seed: YGFLNVIVHSATGFKQSSKALQRPV
YGFLNVIVHSATGFKQSSGALSRPV

SEQ ID NO: 26765 - protein, 25 aa, synthetic construct
  source 1..25: note = Seed: YGFLNVIVHSATGFKQSSKALQRPV
YGFLNVIVHSATGFKQSSIALARPV

SEQ ID NO: 26766 - protein, 25 aa, synthetic construct
  source 1..25: note = Seed: YGFLNVIVHSATGFKQSSKALQRPV
YGFLNVIVHSATGFKQSSIALGRPV

SEQ ID NO: 26767 - protein, 25 aa, synthetic construct
  source 1..25: note = Seed: YGFLNVIVHSATGFKQSSKALQRPV
YGFLNVIVHSATGFKQSSIALHRPV

SEQ ID NO: 26768 - protein, 25 aa, synthetic construct
  source 1..25: note = Seed: YGFLNVIVHSATGFKQSSKALQRPV
YGFLNVIVHSATGFKQSSIALIRPV

SEQ ID NO: 26769 - protein, 25 aa, synthetic construct
  source 1..25: note = Seed: YGFLNVIVHSATGFKQSSKALQRPV
YGFLNVIVHSATGFKQSSIALMRPV

SEQ ID NO: 26770 - protein, 25 aa, synthetic construct
  source 1..25: note = Seed: YGFLNVIVHSATGFKQSSKALQRPV
YGFLNVIVHSATGFKQSSIALNRPV

SEQ ID NO: 26771 - protein, 25 aa, synthetic construct
  source 1..25: note = Seed: YGFLNVIVHSATGFKQSSKALQRPV
YGFLNVIVHSATGFKQSSIALQRPV

SEQ ID NO: 26772 - protein, 25 aa, synthetic construct
  source 1..25: note = Seed: YGFLNVIVHSATGFKQSSKALQRPV
YGFLNVIVHSATGFKQSSIALSRPV

SEQ ID NO: 26773 - protein, 25 aa, synthetic construct
  source 1..25: note = Seed: YGFLNVIVHSATGFKQSSKALQRPV
YGFLNVIVHSATGFKQSSIALTRPV

SEQ ID NO: 26774 - protein, 25 aa, synthetic construct
  source 1..25: note = Seed: YGFLNVIVHSATGFKQSSKALQRPV
YGFLNVIVHSATGFKQSSIALVRPV

SEQ ID NO: 26775 - protein, 25 aa, synthetic construct
  source 1..25: note = Seed: YGFLNVIVHSATGFKQSSKALQRPV
YGFLNVIVHSATGFKQSSKALARPV

SEQ ID NO: 26776 - protein, 25 aa, synthetic construct
  source 1..25: note = Seed: YGFLNVIVHSATGFKQSSKALQRPV
YGFLNVIVHSATGFKQSSKALGRPV

SEQ ID NO: 26777 - protein, 25 aa, synthetic construct
  source 1..25: note = Seed: YGFLNVIVHSATGFKQSSKALQRPV
YGFLNVIVHSATGFKQSSKALSRPV

SEQ ID NO: 26778 - protein, 25 aa, synthetic construct
  source 1..25: note = Seed: YGFLNVIVHSATGFKQSSKALQRPV
YGFLNVIVHSATGFKQSSKALTRPV

SEQ ID NO: 26779 - protein, 25 aa, synthetic construct
  source 1..25: note = Seed: YGFLNVIVHSATGFKQSSKALQRPV
YGFLNVIVHSATGFKQSSLALARPV

SEQ ID NO: 26780 - protein, 25 aa, synthetic construct
  source 1..25: note = Seed: YGFLNVIVHSATGFKQSSKALQRPV
YGFLNVIVHSATGFKQSSLALNRPV

SEQ ID NO: 26781 - protein, 25 aa, synthetic construct
  source 1..25: note = Seed: YGFLNVIVHSATGFKQSSKALQRPV
YGFLNVIVHSATGFKQSSLALSRPV

SEQ ID NO: 26782 - protein, 25 aa, synthetic construct
  source 1..25: note = Seed: YGFLNVIVHSATGFKQSSKALQRPV
YGFLNVIVHSATGFKQSSMALARPV

SEQ ID NO: 26783 - protein, 25 aa, synthetic construct
  source 1..25: note = Seed: YGFLNVIVHSATGFKQSSKALQRPV
YGFLNVIVHSATGFKQSSMALNRPV

SEQ ID NO: 26784 - protein, 25 aa, synthetic construct
  source 1..25: note = Seed: YGFLNVIVHSATGFKQSSKALQRPV
YGFLNVIVHSATGFKQSSMALSRPV

SEQ ID NO: 26785 - protein, 25 aa, synthetic construct
  source 1..25: note = Seed: YGFLNVIVHSATGFKQSSKALQRPV
YGFLNVIVHSATGFKQSSNALARPV

SEQ ID NO: 26786 - protein, 25 aa, synthetic construct
  source 1..25: note = Seed: YGFLNVIVHSATGFKQSSKALQRPV
YGFLNVIVHSATGFKQSSNALGRPV

SEQ ID NO: 26787 - protein, 25 aa, synthetic construct
  source 1..25: note = Seed: YGFLNVIVHSATGFKQSSKALQRPV
YGFLNVIVHSATGFKQSSNALNRPV

SEQ ID NO: 26788 - protein, 25 aa, synthetic construct
  source 1..25: note = Seed: YGFLNVIVHSATGFKQSSKALQRPV
YGFLNVIVHSATGFKQSSNALQRPV

SEQ ID NO: 26789 - protein, 25 aa, synthetic construct
  source 1..25: note = Seed: YGFLNVIVHSATGFKQSSKALQRPV
YGFLNVIVHSATGFKQSSNALSRPV

SEQ ID NO: 26790 - protein, 25 aa, synthetic construct
  source 1..25: note = Seed: YGFLNVIVHSATGFKQSSKALQRPV
YGFLNVIVHSATGFKQSSPALARPV

SEQ ID NO: 26791 - protein, 25 aa, synthetic construct
  source 1..25: note = Seed: YGFLNVIVHSATGFKQSSKALQRPV
YGFLNVIVHSATGFKQSSPALGRPV

SEQ ID NO: 26792 - protein, 25 aa, synthetic construct
  source 1..25: note = Seed: YGFLNVIVHSATGFKQSSKALQRPV
YGFLNVIVHSATGFKQSSPALHRPV

SEQ ID NO: 26793 - protein, 25 aa, synthetic construct
  source 1..25: note = Seed: YGFLNVIVHSATGFKQSSKALQRPV
YGFLNVIVHSATGFKQSSPALIRPV

SEQ ID NO: 26794 - protein, 25 aa, synthetic construct
  source 1..25: note = Seed: YGFLNVIVHSATGFKQSSKALQRPV
YGFLNVIVHSATGFKQSSPALLRPV

SEQ ID NO: 26795 - protein, 25 aa, synthetic construct
  source 1..25: note = Seed: YGFLNVIVHSATGFKQSSKALQRPV
YGFLNVIVHSATGFKQSSPALMRPV

SEQ ID NO: 26796 - protein, 25 aa, synthetic construct
  source 1..25: note = Seed: YGFLNVIVHSATGFKQSSKALQRPV
YGFLNVIVHSATGFKQSSPALNRPV

SEQ ID NO: 26797 - protein, 25 aa, synthetic construct
  source 1..25: note = Seed: YGFLNVIVHSATGFKQSSKALQRPV
YGFLNVIVHSATGFKQSSPALPRPV

SEQ ID NO: 26798 - protein, 25 aa, synthetic construct
  source 1..25: note = Seed: YGFLNVIVHSATGFKQSSKALQRPV
YGFLNVIVHSATGFKQSSPALQRPV

SEQ ID NO: 26799 - protein, 25 aa, synthetic construct
  source 1..25: note = Seed: YGFLNVIVHSATGFKQSSKALQRPV
YGFLNVIVHSATGFKQSSPALSRPV

SEQ ID NO: 26800 - protein, 25 aa, synthetic construct
  source 1..25: note = Seed: YGFLNVIVHSATGFKQSSKALQRPV
YGFLNVIVHSATGFKQSSPALTRPV

SEQ ID NO: 26801 - protein, 25 aa, synthetic construct
  source 1..25: note = Seed: YGFLNVIVHSATGFKQSSKALQRPV
YGFLNVIVHSATGFKQSSPALVRPV

SEQ ID NO: 26802 - protein, 25 aa, synthetic construct
  source 1..25: note = Seed: YGFLNVIVHSATGFKQSSKALQRPV
YGFLNVIVHSATGFKQSSRALARPV

SEQ ID NO: 26803 - protein, 25 aa, synthetic construct
  source 1..25: note = Seed: YGFLNVIVHSATGFKQSSKALQRPV
YGFLNVIVHSATGFKQSSRALGRPV

SEQ ID NO: 26804 - protein, 25 aa, synthetic construct
  source 1..25: note = Seed: YGFLNVIVHSATGFKQSSKALQRPV
YGFLNVIVHSATGFKQSSRALHRPV

SEQ ID NO: 26805 - protein, 25 aa, synthetic construct
  source 1..25: note = Seed: YGFLNVIVHSATGFKQSSKALQRPV
YGFLNVIVHSATGFKQSSRALQRPV

SEQ ID NO: 26806 - protein, 25 aa, synthetic construct
  source 1..25: note = Seed: YGFLNVIVHSATGFKQSSKALQRPV
YGFLNVIVHSATGFKQSSRALSRPV

SEQ ID NO: 26807 - protein, 25 aa, synthetic construct
  source 1..25: note = Seed: YGFLNVIVHSATGFKQSSKALQRPV
YGFLNVIVHSATGFKQSSRALTRPV

SEQ ID NO: 26808 - protein, 25 aa, synthetic construct
  source 1..25: note = Seed: YGFLNVIVHSATGFKQSSKALQRPV
YGFLNVIVHSATGFKQSSSALARPV

SEQ ID NO: 26809 - protein, 25 aa, synthetic construct
  source 1..25: note = Seed: YGFLNVIVHSATGFKQSSKALQRPV
YGFLNVIVHSATGFKQSSSALGRPV

SEQ ID NO: 26810 - protein, 25 aa, synthetic construct
  source 1..25: note = Seed: YGFLNVIVHSATGFKQSSKALQRPV
YGFLNVIVHSATGFKQSSSALHRPV

SEQ ID NO: 26811 - protein, 25 aa, synthetic construct
  source 1..25: note = Seed: YGFLNVIVHSATGFKQSSKALQRPV
YGFLNVIVHSATGFKQSSSALIRPV

SEQ ID NO: 26812 - protein, 25 aa, synthetic construct
  source 1..25: note = Seed: YGFLNVIVHSATGFKQSSKALQRPV
YGFLNVIVHSATGFKQSSSALLRPV

SEQ ID NO: 26813 - protein, 25 aa, synthetic construct
  source 1..25: note = Seed: YGFLNVIVHSATGFKQSSKALQRPV
YGFLNVIVHSATGFKQSSSALMRPV

SEQ ID NO: 26814 - protein, 25 aa, synthetic construct
  source 1..25: note = Seed: YGFLNVIVHSATGFKQSSKALQRPV
YGFLNVIVHSATGFKQSSSALNRPV

SEQ ID NO: 26815 - protein, 25 aa, synthetic construct
  source 1..25: note = Seed: YGFLNVIVHSATGFKQSSKALQRPV
YGFLNVIVHSATGFKQSSSALQRPV

SEQ ID NO: 26816 - protein, 25 aa, synthetic construct
  source 1..25: note = Seed: YGFLNVIVHSATGFKQSSKALQRPV
YGFLNVIVHSATGFKQSSSALSRPV

SEQ ID NO: 26817 - protein, 25 aa, synthetic construct
  source 1..25: note = Seed: YGFLNVIVHSATGFKQSSKALQRPV
YGFLNVIVHSATGFKQSSSALTRPV

SEQ ID NO: 26818 - protein, 25 aa, synthetic construct
  source 1..25: note = Seed: YGFLNVIVHSATGFKQSSKALQRPV
YGFLNVIVHSATGFKQSSSALVRPV

SEQ ID NO: 26819 - protein, 25 aa, synthetic construct
  source 1..25: note = Seed: YGFLNVIVHSATGFKQSSKALQRPV
YGFLNVIVHSATGFKQSSTALARPV

SEQ ID NO: 26820 - protein, 25 aa, synthetic construct
  source 1..25: note = Seed: YGFLNVIVHSATGFKQSSKALQRPV
YGFLNVIVHSATGFKQSSTALGRPV

SEQ ID NO: 26821 - protein, 25 aa, synthetic construct
  source 1..25: note = Seed: YGFLNVIVHSATGFKQSSKALQRPV
YGFLNVIVHSATGFKQSSTALHRPV

SEQ ID NO: 26822 - protein, 25 aa, synthetic construct
  source 1..25: note = Seed: YGFLNVIVHSATGFKQSSKALQRPV
YGFLNVIVHSATGFKQSSTALIRPV

SEQ ID NO: 26823 - protein, 25 aa, synthetic construct
  source 1..25: note = Seed: YGFLNVIVHSATGFKQSSKALQRPV
YGFLNVIVHSATGFKQSSTALLRPV

SEQ ID NO: 26824 - protein, 25 aa, synthetic construct
  source 1..25: note = Seed: YGFLNVIVHSATGFKQSSKALQRPV
YGFLNVIVHSATGFKQSSTALMRPV

SEQ ID NO: 26825 - protein, 25 aa, synthetic construct
  source 1..25: note = Seed: YGFLNVIVHSATGFKQSSKALQRPV
YGFLNVIVHSATGFKQSSTALNRPV

SEQ ID NO: 26826 - protein, 25 aa, synthetic construct
  source 1..25: note = Seed: YGFLNVIVHSATGFKQSSKALQRPV
YGFLNVIVHSATGFKQSSTALQRPV

SEQ ID NO: 26827 - protein, 25 aa, synthetic construct
  source 1..25: note = Seed: YGFLNVIVHSATGFKQSSKALQRPV
YGFLNVIVHSATGFKQSSTALSRPV

SEQ ID NO: 26828 - protein, 25 aa, synthetic construct
  source 1..25: note = Seed: YGFLNVIVHSATGFKQSSKALQRPV
YGFLNVIVHSATGFKQSSTALTRPV

SEQ ID NO: 26829 - protein, 25 aa, synthetic construct
  source 1..25: note = Seed: YGFLNVIVHSATGFKQSSKALQRPV
YGFLNVIVHSATGFKQSSTALVRPV

SEQ ID NO: 26830 - protein, 25 aa, synthetic construct
  source 1..25: note = Seed: YGFLNVIVHSATGFKQSSKALQRPV
YGFLNVIVHSATGFKQSSVALARPV

SEQ ID NO: 26831 - protein, 25 aa, synthetic construct
  source 1..25: note = Seed: YGFLNVIVHSATGFKQSSKALQRPV
YGFLNVIVHSATGFKQSSVALGRPV

SEQ ID NO: 26832 - protein, 25 aa, synthetic construct
  source 1..25: note = Seed: YGFLNVIVHSATGFKQSSKALQRPV
YGFLNVIVHSATGFKQSSVALHRPV

SEQ ID NO: 26833 - protein, 25 aa, synthetic construct
  source 1..25: note = Seed: YGFLNVIVHSATGFKQSSKALQRPV
YGFLNVIVHSATGFKQSSVALIRPV

SEQ ID NO: 26834 - protein, 25 aa, synthetic construct
  source 1..25: note = Seed: YGFLNVIVHSATGFKQSSKALQRPV
YGFLNVIVHSATGFKQSSVALLRPV

SEQ ID NO: 26835 - protein, 25 aa, synthetic construct
  source 1..25: note = Seed: YGFLNVIVHSATGFKQSSKALQRPV
YGFLNVIVHSATGFKQSSVALMRPV

SEQ ID NO: 26836 - protein, 25 aa, synthetic construct
  source 1..25: note = Seed: YGFLNVIVHSATGFKQSSKALQRPV
YGFLNVIVHSATGFKQSSVALNRPV

SEQ ID NO: 26837 - protein, 25 aa, synthetic construct
  source 1..25: note = Seed: YGFLNVIVHSATGFKQSSKALQRPV
YGFLNVIVHSATGFKQSSVALQRPV

SEQ ID NO: 26838 - protein, 25 aa, synthetic construct
  source 1..25: note = Seed: YGFLNVIVHSATGFKQSSKALQRPV
YGFLNVIVHSATGFKQSSVALSRPV

SEQ ID NO: 26839 - protein, 25 aa, synthetic construct
  source 1..25: note = Seed: YGFLNVIVHSATGFKQSSKALQRPV
YGFLNVIVHSATGFKQSSVALTRPV

SEQ ID NO: 26840 - protein, 25 aa, synthetic construct
  source 1..25: note = Seed: YGFLNVIVHSATGFKQSSKALQRPV
YGFLNVIVHSATGFKQSSVALVRPV

SEQ ID NO: 26841 - protein, 25 aa, synthetic construct
  source 1..25: note = Seed: YGFLNVIVHSATGFKQSSKALQRPV
YGFLNVIVHSATGFKQSSWALFRPV

SEQ ID NO: 26842 - protein, 25 aa, synthetic construct
  source 1..25: note = Seed: YGFLNVIVHSATGFKQSSKALQRPV
YGFLNVIVHSATGFKQSSWALIRPV

SEQ ID NO: 26843 - protein, 25 aa, synthetic construct
  source 1..25: note = Seed: YGFLNVIVHSATGFKQSSKALQRPV
YGFLNVIVHSATGFKQSSWALLRPV

SEQ ID NO: 26844 - protein, 25 aa, synthetic construct
  source 1..25: note = Seed: YGFLNVIVHSATGFKQSSKALQRPV
YGFLNVIVHSATGFKQSSWALVRPV

SEQ ID NO: 26845 - protein, 25 aa, synthetic construct
  source 1..25: note = Seed: YGFLNVIVHSATGFKQSSKALQRPV
YGFLNVIVHSATGFKQSSYALFRPV

SEQ ID NO: 26846 - protein, 25 aa, synthetic construct
  source 1..25: note = Seed: YGFLNVIVHSATGFKQSSKALQRPV
YGFLNVIVHSATGFKQSSYALIRPV

SEQ ID NO: 26847 - protein, 25 aa, synthetic construct
  source 1..25: note = Seed: YGFLNVIVHSATGFKQSSKALQRPV
YGFLNVIVHSATGFKQSSYALLRPV

SEQ ID NO: 26848 - protein, 25 aa, synthetic construct
  source 1..25: note = Seed: YGFLNVIVHSATGFKQSSKALQRPV
YGFLNVIVHSATGFKQSSYALVRPV

SEQ ID NO: 26849 - protein, 25 aa, synthetic construct
  source 1..25: note = Seed: YGFLNVIVHSATGFKQSSKALQRPV
YGFLNVIVHSATGFKQTSAALARPV

SEQ ID NO: 26850 - protein, 25 aa, synthetic construct
  source 1..25: note = Seed: YGFLNVIVHSATGFKQSSKALQRPV
YGFLNVIVHSATGFKQTSAALDRPV

SEQ ID NO: 26851 - protein, 25 aa, synthetic construct
  source 1..25: note = Seed: YGFLNVIVHSATGFKQSSKALQRPV
YGFLNVIVHSATGFKQTSAALERPV

SEQ ID NO: 26852 - protein, 25 aa, synthetic construct
  source 1..25: note = Seed: YGFLNVIVHSATGFKQSSKALQRPV
YGFLNVIVHSATGFKQTSAALGRPV

SEQ ID NO: 26853 - protein, 25 aa, synthetic construct
  source 1..25: note = Seed: YGFLNVIVHSATGFKQSSKALQRPV
YGFLNVIVHSATGFKQTSAALHRPV

SEQ ID NO: 26854 - protein, 25 aa, synthetic construct
  source 1..25: note = Seed: YGFLNVIVHSATGFKQSSKALQRPV
YGFLNVIVHSATGFKQTSAALIRPV

SEQ ID NO: 26855 - protein, 25 aa, synthetic construct
  source 1..25: note = Seed: YGFLNVIVHSATGFKQSSKALQRPV
YGFLNVIVHSATGFKQTSAALLRPV

SEQ ID NO: 26856 - protein, 25 aa, synthetic construct
  source 1..25: note = Seed: YGFLNVIVHSATGFKQSSKALQRPV
YGFLNVIVHSATGFKQTSAALMRPV

SEQ ID NO: 26857 - protein, 25 aa, synthetic construct
  source 1..25: note = Seed: YGFLNVIVHSATGFKQSSKALQRPV
YGFLNVIVHSATGFKQTSAALNRPV

SEQ ID NO: 26858 - protein, 25 aa, synthetic construct
  source 1..25: note = Seed: YGFLNVIVHSATGFKQSSKALQRPV
YGFLNVIVHSATGFKQTSAALPRPV

SEQ ID NO: 26859 - protein, 25 aa, synthetic construct
  source 1..25: note = Seed: YGFLNVIVHSATGFKQSSKALQRPV
YGFLNVIVHSATGFKQTSAALQRPV

SEQ ID NO: 26860 - protein, 25 aa, synthetic construct
  source 1..25: note = Seed: YGFLNVIVHSATGFKQSSKALQRPV
YGFLNVIVHSATGFKQTSAALSRPV

SEQ ID NO: 26861 - protein, 25 aa, synthetic construct
  source 1..25: note = Seed: YGFLNVIVHSATGFKQSSKALQRPV
YGFLNVIVHSATGFKQTSAALTRPV

SEQ ID NO: 26862 - protein, 25 aa, synthetic construct
  source 1..25: note = Seed: YGFLNVIVHSATGFKQSSKALQRPV
YGFLNVIVHSATGFKQTSAALVRPV

SEQ ID NO: 26863 - protein, 25 aa, synthetic construct
  source 1..25: note = Seed: YGFLNVIVHSATGFKQSSKALQRPV
YGFLNVIVHSATGFKQTSFALARPV

SEQ ID NO: 26864 - protein, 25 aa, synthetic construct
  source 1..25: note = Seed: YGFLNVIVHSATGFKQSSKALQRPV
YGFLNVIVHSATGFKQTSFALDRPV

SEQ ID NO: 26865 - protein, 25 aa, synthetic construct
  source 1..25: note = Seed: YGFLNVIVHSATGFKQSSKALQRPV
YGFLNVIVHSATGFKQTSFALERPV

SEQ ID NO: 26866 - protein, 25 aa, synthetic construct
  source 1..25: note = Seed: YGFLNVIVHSATGFKQSSKALQRPV
YGFLNVIVHSATGFKQTSFALFRPV

SEQ ID NO: 26867 - protein, 25 aa, synthetic construct
  source 1..25: note = Seed: YGFLNVIVHSATGFKQSSKALQRPV
YGFLNVIVHSATGFKQTSFALHRPV

SEQ ID NO: 26868 - protein, 25 aa, synthetic construct
  source 1..25: note = Seed: YGFLNVIVHSATGFKQSSKALQRPV
YGFLNVIVHSATGFKQTSFALIRPV

SEQ ID NO: 26869 - protein, 25 aa, synthetic construct
  source 1..25: note = Seed: YGFLNVIVHSATGFKQSSKALQRPV
YGFLNVIVHSATGFKQTSFALLRPV

SEQ ID NO: 26870 - protein, 25 aa, synthetic construct
  source 1..25: note = Seed: YGFLNVIVHSATGFKQSSKALQRPV
YGFLNVIVHSATGFKQTSFALMRPV

SEQ ID NO: 26871 - protein, 25 aa, synthetic construct
  source 1..25: note = Seed: YGFLNVIVHSATGFKQSSKALQRPV
YGFLNVIVHSATGFKQTSFALSRPV

SEQ ID NO: 26872 - protein, 25 aa, synthetic construct
  source 1..25: note = Seed: YGFLNVIVHSATGFKQSSKALQRPV
YGFLNVIVHSATGFKQTSFALTRPV

SEQ ID NO: 26873 - protein, 25 aa, synthetic construct
  source 1..25: note = Seed: YGFLNVIVHSATGFKQSSKALQRPV
YGFLNVIVHSATGFKQTSFALVRPV

SEQ ID NO: 26874 - protein, 25 aa, synthetic construct
  source 1..25: note = Seed: YGFLNVIVHSATGFKQSSKALQRPV
YGFLNVIVHSATGFKQTSFALWRPV

SEQ ID NO: 26875 - protein, 25 aa, synthetic construct
  source 1..25: note = Seed: YGFLNVIVHSATGFKQSSKALQRPV
YGFLNVIVHSATGFKQTSFALYRPV

SEQ ID NO: 26876 - protein, 25 aa, synthetic construct
  source 1..25: note = Seed: YGFLNVIVHSATGFKQSSKALQRPV
YGFLNVIVHSATGFKQTSGALARPV

SEQ ID NO: 26877 - protein, 25 aa, synthetic construct
  source 1..25: note = Seed: YGFLNVIVHSATGFKQSSKALQRPV
YGFLNVIVHSATGFKQTSGALNRPV

SEQ ID NO: 26878 - protein, 25 aa, synthetic construct
  source 1..25: note = Seed: YGFLNVIVHSATGFKQSSKALQRPV
YGFLNVIVHSATGFKQTSGALSRPV

SEQ ID NO: 26879 - protein, 25 aa, synthetic construct
  source 1..25: note = Seed: YGFLNVIVHSATGFKQSSKALQRPV
YGFLNVIVHSATGFKQTSGALVRPV

SEQ ID NO: 26880 - protein, 25 aa, synthetic construct
  source 1..25: note = Seed: YGFLNVIVHSATGFKQSSKALQRPV
YGFLNVIVHSATGFKQTSIALARPV

SEQ ID NO: 26881 - protein, 25 aa, synthetic construct
  source 1..25: note = Seed: YGFLNVIVHSATGFKQSSKALQRPV
YGFLNVIVHSATGFKQTSIALGRPV

SEQ ID NO: 26882 - protein, 25 aa, synthetic construct
  source 1..25: note = Seed: YGFLNVIVHSATGFKQSSKALQRPV
YGFLNVIVHSATGFKQTSIALHRPV

SEQ ID NO: 26883 - protein, 25 aa, synthetic construct
  source 1..25: note = Seed: YGFLNVIVHSATGFKQSSKALQRPV
YGFLNVIVHSATGFKQTSIALMRPV

SEQ ID NO: 26884 - protein, 25 aa, synthetic construct
  source 1..25: note = Seed: YGFLNVIVHSATGFKQSSKALQRPV
YGFLNVIVHSATGFKQTSIALNRPV

SEQ ID NO: 26885 - protein, 25 aa, synthetic construct
  source 1..25: note = Seed: YGFLNVIVHSATGFKQSSKALQRPV
YGFLNVIVHSATGFKQTSIALSRPV

SEQ ID NO: 26886 - protein, 25 aa, synthetic construct
  source 1..25: note = Seed: YGFLNVIVHSATGFKQSSKALQRPV
YGFLNVIVHSATGFKQTSIALTRPV

SEQ ID NO: 26887 - protein, 25 aa, synthetic construct
  source 1..25: note = Seed: YGFLNVIVHSATGFKQSSKALQRPV
YGFLNVIVHSATGFKQTSIALVRPV

SEQ ID NO: 26888 - protein, 25 aa, synthetic construct
  source 1..25: note = Seed: YGFLNVIVHSATGFKQSSKALQRPV
YGFLNVIVHSATGFKQTSKALARPV

SEQ ID NO: 26889 - protein, 25 aa, synthetic construct
  source 1..25: note = Seed: YGFLNVIVHSATGFKQSSKALQRPV
YGFLNVIVHSATGFKQTSKALGRPV

SEQ ID NO: 26890 - protein, 25 aa, synthetic construct
  source 1..25: note = Seed: YGFLNVIVHSATGFKQSSKALQRPV
YGFLNVIVHSATGFKQTSKALSRPV

SEQ ID NO: 26891 - protein, 25 aa, synthetic construct
  source 1..25: note = Seed: YGFLNVIVHSATGFKQSSKALQRPV
YGFLNVIVHSATGFKQTSKALTRPV

SEQ ID NO: 26892 - protein, 25 aa, synthetic construct
  source 1..25: note = Seed: YGFLNVIVHSATGFKQSSKALQRPV
YGFLNVIVHSATGFKQTSLALARPV

SEQ ID NO: 26893 - protein, 25 aa, synthetic construct
  source 1..25: note = Seed: YGFLNVIVHSATGFKQSSKALQRPV
YGFLNVIVHSATGFKQTSLALFRPV

SEQ ID NO: 26894 - protein, 25 aa, synthetic construct
  source 1..25: note = Seed: YGFLNVIVHSATGFKQSSKALQRPV
YGFLNVIVHSATGFKQTSLALIRPV

SEQ ID NO: 26895 - protein, 25 aa, synthetic construct
  source 1..25: note = Seed: YGFLNVIVHSATGFKQSSKALQRPV
YGFLNVIVHSATGFKQTSLALLRPV

SEQ ID NO: 26896 - protein, 25 aa, synthetic construct
  source 1..25: note = Seed: YGFLNVIVHSATGFKQSSKALQRPV
YGFLNVIVHSATGFKQTSLALNRPV

SEQ ID NO: 26897 - protein, 25 aa, synthetic construct
  source 1..25: note = Seed: YGFLNVIVHSATGFKQSSKALQRPV
YGFLNVIVHSATGFKQTSLALSRPV

SEQ ID NO: 26898 - protein, 25 aa, synthetic construct
  source 1..25: note = Seed: YGFLNVIVHSATGFKQSSKALQRPV
YGFLNVIVHSATGFKQTSMALARPV

SEQ ID NO: 26899 - protein, 25 aa, synthetic construct
  source 1..25: note = Seed: YGFLNVIVHSATGFKQSSKALQRPV
YGFLNVIVHSATGFKQTSMALNRPV

SEQ ID NO: 26900 - protein, 25 aa, synthetic construct
  source 1..25: note = Seed: YGFLNVIVHSATGFKQSSKALQRPV
YGFLNVIVHSATGFKQTSMALSRPV

SEQ ID NO: 26901 - protein, 25 aa, synthetic construct
  source 1..25: note = Seed: YGFLNVIVHSATGFKQSSKALQRPV
YGFLNVIVHSATGFKQTSNALARPV

SEQ ID NO: 26902 - protein, 25 aa, synthetic construct
  source 1..25: note = Seed: YGFLNVIVHSATGFKQSSKALQRPV
YGFLNVIVHSATGFKQTSNALNRPV

SEQ ID NO: 26903 - protein, 25 aa, synthetic construct
  source 1..25: note = Seed: YGFLNVIVHSATGFKQSSKALQRPV
YGFLNVIVHSATGFKQTSNALSRPV

SEQ ID NO: 26904 - protein, 25 aa, synthetic construct
  source 1..25: note = Seed: YGFLNVIVHSATGFKQSSKALQRPV
YGFLNVIVHSATGFKQTSPALARPV

SEQ ID NO: 26905 - protein, 25 aa, synthetic construct
  source 1..25: note = Seed: YGFLNVIVHSATGFKQSSKALQRPV
YGFLNVIVHSATGFKQTSPALGRPV

SEQ ID NO: 26906 - protein, 25 aa, synthetic construct
  source 1..25: note = Seed: YGFLNVIVHSATGFKQSSKALQRPV
YGFLNVIVHSATGFKQTSPALHRPV

SEQ ID NO: 26907 - protein, 25 aa, synthetic construct
  source 1..25: note = Seed: YGFLNVIVHSATGFKQSSKALQRPV
YGFLNVIVHSATGFKQTSPALIRPV

SEQ ID NO: 26908 - protein, 25 aa, synthetic construct
  source 1..25: note = Seed: YGFLNVIVHSATGFKQSSKALQRPV
YGFLNVIVHSATGFKQTSPALLRPV

SEQ ID NO: 26909 - protein, 25 aa, synthetic construct
  source 1..25: note = Seed: YGFLNVIVHSATGFKQSSKALQRPV
YGFLNVIVHSATGFKQTSPALMRPV

SEQ ID NO: 26910 - protein, 25 aa, synthetic construct
  source 1..25: note = Seed: YGFLNVIVHSATGFKQSSKALQRPV
YGFLNVIVHSATGFKQTSPALNRPV

SEQ ID NO: 26911 - protein, 25 aa, synthetic construct
  source 1..25: note = Seed: YGFLNVIVHSATGFKQSSKALQRPV
YGFLNVIVHSATGFKQTSPALQRPV

SEQ ID NO: 26912 - protein, 25 aa, synthetic construct
  source 1..25: note = Seed: YGFLNVIVHSATGFKQSSKALQRPV
YGFLNVIVHSATGFKQTSPALSRPV

SEQ ID NO: 26913 - protein, 25 aa, synthetic construct
  source 1..25: note = Seed: YGFLNVIVHSATGFKQSSKALQRPV
YGFLNVIVHSATGFKQTSPALTRPV

SEQ ID NO: 26914 - protein, 25 aa, synthetic construct
  source 1..25: note = Seed: YGFLNVIVHSATGFKQSSKALQRPV
YGFLNVIVHSATGFKQTSPALVRPV

SEQ ID NO: 26915 - protein, 25 aa, synthetic construct
  source 1..25: note = Seed: YGFLNVIVHSATGFKQSSKALQRPV
YGFLNVIVHSATGFKQTSRALARPV

SEQ ID NO: 26916 - protein, 25 aa, synthetic construct
  source 1..25: note = Seed: YGFLNVIVHSATGFKQSSKALQRPV
YGFLNVIVHSATGFKQTSRALGRPV

SEQ ID NO: 26917 - protein, 25 aa, synthetic construct
  source 1..25: note = Seed: YGFLNVIVHSATGFKQSSKALQRPV
YGFLNVIVHSATGFKQTSRALHRPV

SEQ ID NO: 26918 - protein, 25 aa, synthetic construct
  source 1..25: note = Seed: YGFLNVIVHSATGFKQSSKALQRPV
YGFLNVIVHSATGFKQTSRALNRPV

SEQ ID NO: 26919 - protein, 25 aa, synthetic construct
  source 1..25: note = Seed: YGFLNVIVHSATGFKQSSKALQRPV
YGFLNVIVHSATGFKQTSRALQRPV

SEQ ID NO: 26920 - protein, 25 aa, synthetic construct
  source 1..25: note = Seed: YGFLNVIVHSATGFKQSSKALQRPV
YGFLNVIVHSATGFKQTSRALSRPV

SEQ ID NO: 26921 - protein, 25 aa, synthetic construct
  source 1..25: note = Seed: YGFLNVIVHSATGFKQSSKALQRPV
YGFLNVIVHSATGFKQTSRALTRPV

SEQ ID NO: 26922 - protein, 25 aa, synthetic construct
  source 1..25: note = Seed: YGFLNVIVHSATGFKQSSKALQRPV
YGFLNVIVHSATGFKQTSSALARPV

SEQ ID NO: 26923 - protein, 25 aa, synthetic construct
  source 1..25: note = Seed: YGFLNVIVHSATGFKQSSKALQRPV
YGFLNVIVHSATGFKQTSSALGRPV

SEQ ID NO: 26924 - protein, 25 aa, synthetic construct
  source 1..25: note = Seed: YGFLNVIVHSATGFKQSSKALQRPV
YGFLNVIVHSATGFKQTSSALHRPV

SEQ ID NO: 26925 - protein, 25 aa, synthetic construct
  source 1..25: note = Seed: YGFLNVIVHSATGFKQSSKALQRPV
YGFLNVIVHSATGFKQTSSALIRPV

SEQ ID NO: 26926 - protein, 25 aa, synthetic construct
  source 1..25: note = Seed: YGFLNVIVHSATGFKQSSKALQRPV
YGFLNVIVHSATGFKQTSSALLRPV

SEQ ID NO: 26927 - protein, 25 aa, synthetic construct
  source 1..25: note = Seed: YGFLNVIVHSATGFKQSSKALQRPV
YGFLNVIVHSATGFKQTSSALMRPV

SEQ ID NO: 26928 - protein, 25 aa, synthetic construct
  source 1..25: note = Seed: YGFLNVIVHSATGFKQSSKALQRPV
YGFLNVIVHSATGFKQTSSALNRPV

SEQ ID NO: 26929 - protein, 25 aa, synthetic construct
  source 1..25: note = Seed: YGFLNVIVHSATGFKQSSKALQRPV
YGFLNVIVHSATGFKQTSSALQRPV

SEQ ID NO: 26930 - protein, 25 aa, synthetic construct
  source 1..25: note = Seed: YGFLNVIVHSATGFKQSSKALQRPV
YGFLNVIVHSATGFKQTSSALSRPV

SEQ ID NO: 26931 - protein, 25 aa, synthetic construct
  source 1..25: note = Seed: YGFLNVIVHSATGFKQSSKALQRPV
YGFLNVIVHSATGFKQTSSALTRPV

SEQ ID NO: 26932 - protein, 25 aa, synthetic construct
  source 1..25: note = Seed: YGFLNVIVHSATGFKQSSKALQRPV
YGFLNVIVHSATGFKQTSSALVRPV

SEQ ID NO: 26933 - protein, 25 aa, synthetic construct
  source 1..25: note = Seed: YGFLNVIVHSATGFKQSSKALQRPV
YGFLNVIVHSATGFKQTSTALARPV

SEQ ID NO: 26934 - protein, 25 aa, synthetic construct
  source 1..25: note = Seed: YGFLNVIVHSATGFKQSSKALQRPV
YGFLNVIVHSATGFKQTSTALGRPV

SEQ ID NO: 26935 - protein, 25 aa, synthetic construct
  source 1..25: note = Seed: YGFLNVIVHSATGFKQSSKALQRPV
YGFLNVIVHSATGFKQTSTALHRPV

SEQ ID NO: 26936 - protein, 25 aa, synthetic construct
  source 1..25: note = Seed: YGFLNVIVHSATGFKQSSKALQRPV
YGFLNVIVHSATGFKQTSTALIRPV

SEQ ID NO: 26937 - protein, 25 aa, synthetic construct
  source 1..25: note = Seed: YGFLNVIVHSATGFKQSSKALQRPV
YGFLNVIVHSATGFKQTSTALLRPV

SEQ ID NO: 26938 - protein, 25 aa, synthetic construct
  source 1..25: note = Seed: YGFLNVIVHSATGFKQSSKALQRPV
YGFLNVIVHSATGFKQTSTALMRPV

SEQ ID NO: 26939 - protein, 25 aa, synthetic construct
  source 1..25: note = Seed: YGFLNVIVHSATGFKQSSKALQRPV
YGFLNVIVHSATGFKQTSTALNRPV

SEQ ID NO: 26940 - protein, 25 aa, synthetic construct
  source 1..25: note = Seed: YGFLNVIVHSATGFKQSSKALQRPV
YGFLNVIVHSATGFKQTSTALQRPV

SEQ ID NO: 26941 - protein, 25 aa, synthetic construct
  source 1..25: note = Seed: YGFLNVIVHSATGFKQSSKALQRPV
YGFLNVIVHSATGFKQTSTALSRPV

SEQ ID NO: 26942 - protein, 25 aa, synthetic construct
  source 1..25: note = Seed: YGFLNVIVHSATGFKQSSKALQRPV
YGFLNVIVHSATGFKQTSTALTRPV

SEQ ID NO: 26943 - protein, 25 aa, synthetic construct
  source 1..25: note = Seed: YGFLNVIVHSATGFKQSSKALQRPV
YGFLNVIVHSATGFKQTSTALVRPV

SEQ ID NO: 26944 - protein, 25 aa, synthetic construct
  source 1..25: note = Seed: YGFLNVIVHSATGFKQSSKALQRPV
YGFLNVIVHSATGFKQTSVALARPV

SEQ ID NO: 26945 - protein, 25 aa, synthetic construct
  source 1..25: note = Seed: YGFLNVIVHSATGFKQSSKALQRPV
YGFLNVIVHSATGFKQTSVALGRPV

SEQ ID NO: 26946 - protein, 25 aa, synthetic construct
  source 1..25: note = Seed: YGFLNVIVHSATGFKQSSKALQRPV
YGFLNVIVHSATGFKQTSVALHRPV

SEQ ID NO: 26947 - protein, 25 aa, synthetic construct
  source 1..25: note = Seed: YGFLNVIVHSATGFKQSSKALQRPV
YGFLNVIVHSATGFKQTSVALIRPV

SEQ ID NO: 26948 - protein, 25 aa, synthetic construct
  source 1..25: note = Seed: YGFLNVIVHSATGFKQSSKALQRPV
YGFLNVIVHSATGFKQTSVALLRPV

SEQ ID NO: 26949 - protein, 25 aa, synthetic construct
  source 1..25: note = Seed: YGFLNVIVHSATGFKQSSKALQRPV
YGFLNVIVHSATGFKQTSVALMRPV

SEQ ID NO: 26950 - protein, 25 aa, synthetic construct
  source 1..25: note = Seed: YGFLNVIVHSATGFKQSSKALQRPV
YGFLNVIVHSATGFKQTSVALNRPV

SEQ ID NO: 26951 - protein, 25 aa, synthetic construct
  source 1..25: note = Seed: YGFLNVIVHSATGFKQSSKALQRPV
YGFLNVIVHSATGFKQTSVALQRPV

SEQ ID NO: 26952 - protein, 25 aa, synthetic construct
  source 1..25: note = Seed: YGFLNVIVHSATGFKQSSKALQRPV
YGFLNVIVHSATGFKQTSVALSRPV

SEQ ID NO: 26953 - protein, 25 aa, synthetic construct
  source 1..25: note = Seed: YGFLNVIVHSATGFKQSSKALQRPV
YGFLNVIVHSATGFKQTSVALTRPV

SEQ ID NO: 26954 - protein, 25 aa, synthetic construct
  source 1..25: note = Seed: YGFLNVIVHSATGFKQSSKALQRPV
YGFLNVIVHSATGFKQTSVALVRPV

SEQ ID NO: 26955 - protein, 25 aa, synthetic construct
  source 1..25: note = Seed: YGFLNVIVHSATGFKQSSKALQRPV
YGFLNVIVHSATGFKQTSWALFRPV

SEQ ID NO: 26956 - protein, 25 aa, synthetic construct
  source 1..25: note = Seed: YGFLNVIVHSATGFKQSSKALQRPV
YGFLNVIVHSATGFKQTSWALIRPV

SEQ ID NO: 26957 - protein, 25 aa, synthetic construct
  source 1..25: note = Seed: YGFLNVIVHSATGFKQSSKALQRPV
YGFLNVIVHSATGFKQTSWALLRPV

SEQ ID NO: 26958 - protein, 25 aa, synthetic construct
  source 1..25: note = Seed: YGFLNVIVHSATGFKQSSKALQRPV
YGFLNVIVHSATGFKQTSWALVRPV

SEQ ID NO: 26959 - protein, 25 aa, synthetic construct
  source 1..25: note = Seed: YGFLNVIVHSATGFKQSSKALQRPV
YGFLNVIVHSATGFKQTSYALFRPV

SEQ ID NO: 26960 - protein, 25 aa, synthetic construct
  source 1..25: note = Seed: YGFLNVIVHSATGFKQSSKALQRPV
YGFLNVIVHSATGFKQTSYALIRPV

SEQ ID NO: 26961 - protein, 25 aa, synthetic construct
  source 1..25: note = Seed: YGFLNVIVHSATGFKQSSKALQRPV
YGFLNVIVHSATGFKQTSYALLRPV

SEQ ID NO: 26962 - protein, 25 aa, synthetic construct
  source 1..25: note = Seed: YGFLNVIVHSATGFKQSSKALQRPV
YGFLNVIVHSATGFKQTSYALVRPV

SEQ ID NO: 26963 - protein, 25 aa, synthetic construct
  source 1..25: note = Seed: YGFLNVIVHSATGFKQSSKALQRPV
YGFLNVIVHSATGFKQVSAALARPV

SEQ ID NO: 26964 - protein, 25 aa, synthetic construct
  source 1..25: note = Seed: YGFLNVIVHSATGFKQSSKALQRPV
YGFLNVIVHSATGFKQVSAALCRPV

SEQ ID NO: 26965 - protein, 25 aa, synthetic construct
  source 1..25: note = Seed: YGFLNVIVHSATGFKQSSKALQRPV
YGFLNVIVHSATGFKQVSAALDRPV

SEQ ID NO: 26966 - protein, 25 aa, synthetic construct
  source 1..25: note = Seed: YGFLNVIVHSATGFKQSSKALQRPV
YGFLNVIVHSATGFKQVSAALERPV

SEQ ID NO: 26967 - protein, 25 aa, synthetic construct
  source 1..25: note = Seed: YGFLNVIVHSATGFKQSSKALQRPV
YGFLNVIVHSATGFKQVSAALFRPV

SEQ ID NO: 26968 - protein, 25 aa, synthetic construct
  source 1..25: note = Seed: YGFLNVIVHSATGFKQSSKALQRPV
YGFLNVIVHSATGFKQVSAALGRPV

SEQ ID NO: 26969 - protein, 25 aa, synthetic construct
  source 1..25: note = Seed: YGFLNVIVHSATGFKQSSKALQRPV
YGFLNVIVHSATGFKQVSAALHRPV

SEQ ID NO: 26970 - protein, 25 aa, synthetic construct
  source 1..25: note = Seed: YGFLNVIVHSATGFKQSSKALQRPV
YGFLNVIVHSATGFKQVSAALIRPV

SEQ ID NO: 26971 - protein, 25 aa, synthetic construct
  source 1..25: note = Seed: YGFLNVIVHSATGFKQSSKALQRPV
YGFLNVIVHSATGFKQVSAALKRPV

SEQ ID NO: 26972 - protein, 25 aa, synthetic construct
  source 1..25: note = Seed: YGFLNVIVHSATGFKQSSKALQRPV
YGFLNVIVHSATGFKQVSAALLRPV

SEQ ID NO: 26973 - protein, 25 aa, synthetic construct
  source 1..25: note = Seed: YGFLNVIVHSATGFKQSSKALQRPV
YGFLNVIVHSATGFKQVSAALMRPV

SEQ ID NO: 26974 - protein, 25 aa, synthetic construct
  source 1..25: note = Seed: YGFLNVIVHSATGFKQSSKALQRPV
YGFLNVIVHSATGFKQVSAALNRPV

SEQ ID NO: 26975 - protein, 25 aa, synthetic construct
  source 1..25: note = Seed: YGFLNVIVHSATGFKQSSKALQRPV
YGFLNVIVHSATGFKQVSAALPRPV

SEQ ID NO: 26976 - protein, 25 aa, synthetic construct
  source 1..25: note = Seed: YGFLNVIVHSATGFKQSSKALQRPV
YGFLNVIVHSATGFKQVSAALQRPV

SEQ ID NO: 26977 - protein, 25 aa, synthetic construct
  source 1..25: note = Seed: YGFLNVIVHSATGFKQSSKALQRPV
YGFLNVIVHSATGFKQVSAALRRPV

SEQ ID NO: 26978 - protein, 25 aa, synthetic construct
  source 1..25: note = Seed: YGFLNVIVHSATGFKQSSKALQRPV
YGFLNVIVHSATGFKQVSAALSRPV

SEQ ID NO: 26979 - protein, 25 aa, synthetic construct
  source 1..25: note = Seed: YGFLNVIVHSATGFKQSSKALQRPV
YGFLNVIVHSATGFKQVSAALTRPV

SEQ ID NO: 26980 - protein, 25 aa, synthetic construct
  source 1..25: note = Seed: YGFLNVIVHSATGFKQSSKALQRPV
YGFLNVIVHSATGFKQVSAALVRPV

SEQ ID NO: 26981 - protein, 25 aa, synthetic construct
  source 1..25: note = Seed: YGFLNVIVHSATGFKQSSKALQRPV
YGFLNVIVHSATGFKQVSAALYRPV

SEQ ID NO: 26982 - protein, 25 aa, synthetic construct
  source 1..25: note = Seed: YGFLNVIVHSATGFKQSSKALQRPV
YGFLNVIVHSATGFKQVSCALNRPV

SEQ ID NO: 26983 - protein, 25 aa, synthetic construct
  source 1..25: note = Seed: YGFLNVIVHSATGFKQSSKALQRPV
YGFLNVIVHSATGFKQVSDALARPV

SEQ ID NO: 26984 - protein, 25 aa, synthetic construct
  source 1..25: note = Seed: YGFLNVIVHSATGFKQSSKALQRPV
YGFLNVIVHSATGFKQVSEALARPV

SEQ ID NO: 26985 - protein, 25 aa, synthetic construct
  source 1..25: note = Seed: YGFLNVIVHSATGFKQSSKALQRPV
YGFLNVIVHSATGFKQVSFALARPV

SEQ ID NO: 26986 - protein, 25 aa, synthetic construct
  source 1..25: note = Seed: YGFLNVIVHSATGFKQSSKALQRPV
YGFLNVIVHSATGFKQVSFALDRPV

SEQ ID NO: 26987 - protein, 25 aa, synthetic construct
  source 1..25: note = Seed: YGFLNVIVHSATGFKQSSKALQRPV
YGFLNVIVHSATGFKQVSFALERPV

SEQ ID NO: 26988 - protein, 25 aa, synthetic construct
  source 1..25: note = Seed: YGFLNVIVHSATGFKQSSKALQRPV
YGFLNVIVHSATGFKQVSFALFRPV

SEQ ID NO: 26989 - protein, 25 aa, synthetic construct
  source 1..25: note = Seed: YGFLNVIVHSATGFKQSSKALQRPV
YGFLNVIVHSATGFKQVSFALHRPV

SEQ ID NO: 26990 - protein, 25 aa, synthetic construct
  source 1..25: note = Seed: YGFLNVIVHSATGFKQSSKALQRPV
YGFLNVIVHSATGFKQVSFALIRPV

SEQ ID NO: 26991 - protein, 25 aa, synthetic construct
  source 1..25: note = Seed: YGFLNVIVHSATGFKQSSKALQRPV
YGFLNVIVHSATGFKQVSFALLRPV

SEQ ID NO: 26992 - protein, 25 aa, synthetic construct
  source 1..25: note = Seed: YGFLNVIVHSATGFKQSSKALQRPV
YGFLNVIVHSATGFKQVSFALMRPV

SEQ ID NO: 26993 - protein, 25 aa, synthetic construct
  source 1..25: note = Seed: YGFLNVIVHSATGFKQSSKALQRPV
YGFLNVIVHSATGFKQVSFALNRPV

SEQ ID NO: 26994 - protein, 25 aa, synthetic construct
  source 1..25: note = Seed: YGFLNVIVHSATGFKQSSKALQRPV
YGFLNVIVHSATGFKQVSFALQRPV

SEQ ID NO: 26995 - protein, 25 aa, synthetic construct
  source 1..25: note = Seed: YGFLNVIVHSATGFKQSSKALQRPV
YGFLNVIVHSATGFKQVSFALRRPV

SEQ ID NO: 26996 - protein, 25 aa, synthetic construct
  source 1..25: note = Seed: YGFLNVIVHSATGFKQSSKALQRPV
YGFLNVIVHSATGFKQVSFALSRPV

SEQ ID NO: 26997 - protein, 25 aa, synthetic construct
  source 1..25: note = Seed: YGFLNVIVHSATGFKQSSKALQRPV
YGFLNVIVHSATGFKQVSFALTRPV

SEQ ID NO: 26998 - protein, 25 aa, synthetic construct
  source 1..25: note = Seed: YGFLNVIVHSATGFKQSSKALQRPV
YGFLNVIVHSATGFKQVSFALVRPV

SEQ ID NO: 26999 - protein, 25 aa, synthetic construct
  source 1..25: note = Seed: YGFLNVIVHSATGFKQSSKALQRPV
YGFLNVIVHSATGFKQVSFALWRPV

SEQ ID NO: 27000 - protein, 25 aa, synthetic construct
  source 1..25: note = Seed: YGFLNVIVHSATGFKQSSKALQRPV
YGFLNVIVHSATGFKQVSFALYRPV

SEQ ID NO: 27001 - protein, 25 aa, synthetic construct
  source 1..25: note = Seed: YGFLNVIVHSATGFKQSSKALQRPV
YGFLNVIVHSATGFKQVSGALARPV

SEQ ID NO: 27002 - protein, 25 aa, synthetic construct
  source 1..25: note = Seed: YGFLNVIVHSATGFKQSSKALQRPV
YGFLNVIVHSATGFKQVSGALDRPV

SEQ ID NO: 27003 - protein, 25 aa, synthetic construct
  source 1..25: note = Seed: YGFLNVIVHSATGFKQSSKALQRPV
YGFLNVIVHSATGFKQVSGALERPV

SEQ ID NO: 27004 - protein, 25 aa, synthetic construct
  source 1..25: note = Seed: YGFLNVIVHSATGFKQSSKALQRPV
YGFLNVIVHSATGFKQVSGALGRPV

SEQ ID NO: 27005 - protein, 25 aa, synthetic construct
  source 1..25: note = Seed: YGFLNVIVHSATGFKQSSKALQRPV
YGFLNVIVHSATGFKQVSGALHRPV

SEQ ID NO: 27006 - protein, 25 aa, synthetic construct
  source 1..25: note = Seed: YGFLNVIVHSATGFKQSSKALQRPV
YGFLNVIVHSATGFKQVSGALIRPV

SEQ ID NO: 27007 - protein, 25 aa, synthetic construct
  source 1..25: note = Seed: YGFLNVIVHSATGFKQSSKALQRPV
YGFLNVIVHSATGFKQVSGALLRPV

SEQ ID NO: 27008 - protein, 25 aa, synthetic construct
  source 1..25: note = Seed: YGFLNVIVHSATGFKQSSKALQRPV
YGFLNVIVHSATGFKQVSGALMRPV

SEQ ID NO: 27009 - protein, 25 aa, synthetic construct
  source 1..25: note = Seed: YGFLNVIVHSATGFKQSSKALQRPV
YGFLNVIVHSATGFKQVSGALNRPV

SEQ ID NO: 27010 - protein, 25 aa, synthetic construct
  source 1..25: note = Seed: YGFLNVIVHSATGFKQSSKALQRPV
YGFLNVIVHSATGFKQVSGALPRPV

SEQ ID NO: 27011 - protein, 25 aa, synthetic construct
  source 1..25: note = Seed: YGFLNVIVHSATGFKQSSKALQRPV
YGFLNVIVHSATGFKQVSGALQRPV

SEQ ID NO: 27012 - protein, 25 aa, synthetic construct
  source 1..25: note = Seed: YGFLNVIVHSATGFKQSSKALQRPV
YGFLNVIVHSATGFKQVSGALSRPV

SEQ ID NO: 27013 - protein, 25 aa, synthetic construct
  source 1..25: note = Seed: YGFLNVIVHSATGFKQSSKALQRPV
YGFLNVIVHSATGFKQVSGALTRPV

SEQ ID NO: 27014 - protein, 25 aa, synthetic construct
  source 1..25: note = Seed: YGFLNVIVHSATGFKQSSKALQRPV
YGFLNVIVHSATGFKQVSGALVRPV

SEQ ID NO: 27015 - protein, 25 aa, synthetic construct
  source 1..25: note = Seed: YGFLNVIVHSATGFKQSSKALQRPV
YGFLNVIVHSATGFKQVSHALARPV

SEQ ID NO: 27016 - protein, 25 aa, synthetic construct
  source 1..25: note = Seed: YGFLNVIVHSATGFKQSSKALQRPV
YGFLNVIVHSATGFKQVSHALGRPV

SEQ ID NO: 27017 - protein, 25 aa, synthetic construct
  source 1..25: note = Seed: YGFLNVIVHSATGFKQSSKALQRPV
YGFLNVIVHSATGFKQVSHALNRPV

SEQ ID NO: 27018 - protein, 25 aa, synthetic construct
  source 1..25: note = Seed: YGFLNVIVHSATGFKQSSKALQRPV
YGFLNVIVHSATGFKQVSHALSRPV

SEQ ID NO: 27019 - protein, 25 aa, synthetic construct
  source 1..25: note = Seed: YGFLNVIVHSATGFKQSSKALQRPV
YGFLNVIVHSATGFKQVSIALARPV

SEQ ID NO: 27020 - protein, 25 aa, synthetic construct
  source 1..25: note = Seed: YGFLNVIVHSATGFKQSSKALQRPV
YGFLNVIVHSATGFKQVSIALDRPV

SEQ ID NO: 27021 - protein, 25 aa, synthetic construct
  source 1..25: note = Seed: YGFLNVIVHSATGFKQSSKALQRPV
YGFLNVIVHSATGFKQVSIALERPV

SEQ ID NO: 27022 - protein, 25 aa, synthetic construct
  source 1..25: note = Seed: YGFLNVIVHSATGFKQSSKALQRPV
YGFLNVIVHSATGFKQVSIALFRPV

SEQ ID NO: 27023 - protein, 25 aa, synthetic construct
  source 1..25: note = Seed: YGFLNVIVHSATGFKQSSKALQRPV
YGFLNVIVHSATGFKQVSIALGRPV

SEQ ID NO: 27024 - protein, 25 aa, synthetic construct
  source 1..25: note = Seed: YGFLNVIVHSATGFKQSSKALQRPV
YGFLNVIVHSATGFKQVSIALHRPV

SEQ ID NO: 27025 - protein, 25 aa, synthetic construct
  source 1..25: note = Seed: YGFLNVIVHSATGFKQSSKALQRPV
YGFLNVIVHSATGFKQVSIALIRPV

SEQ ID NO: 27026 - protein, 25 aa, synthetic construct
  source 1..25: note = Seed: YGFLNVIVHSATGFKQSSKALQRPV
YGFLNVIVHSATGFKQVSIALMRPV

SEQ ID NO: 27027 - protein, 25 aa, synthetic construct
  source 1..25: note = Seed: YGFLNVIVHSATGFKQSSKALQRPV
YGFLNVIVHSATGFKQVSIALNRPV

SEQ ID NO: 27028 - protein, 25 aa, synthetic construct
  source 1..25: note = Seed: YGFLNVIVHSATGFKQSSKALQRPV
YGFLNVIVHSATGFKQVSIALPRPV

SEQ ID NO: 27029 - protein, 25 aa, synthetic construct
  source 1..25: note = Seed: YGFLNVIVHSATGFKQSSKALQRPV
YGFLNVIVHSATGFKQVSIALQRPV

SEQ ID NO: 27030 - protein, 25 aa, synthetic construct
  source 1..25: note = Seed: YGFLNVIVHSATGFKQSSKALQRPV
YGFLNVIVHSATGFKQVSIALSRPV

SEQ ID NO: 27031 - protein, 25 aa, synthetic construct
  source 1..25: note = Seed: YGFLNVIVHSATGFKQSSKALQRPV
YGFLNVIVHSATGFKQVSIALTRPV

SEQ ID NO: 27032 - protein, 25 aa, synthetic construct
  source 1..25: note = Seed: YGFLNVIVHSATGFKQSSKALQRPV
YGFLNVIVHSATGFKQVSIALVRPV

SEQ ID NO: 27033 - protein, 25 aa, synthetic construct
  source 1..25: note = Seed: YGFLNVIVHSATGFKQSSKALQRPV
YGFLNVIVHSATGFKQVSKALARPV

SEQ ID NO: 27034 - protein, 25 aa, synthetic construct
  source 1..25: note = Seed: YGFLNVIVHSATGFKQSSKALQRPV
YGFLNVIVHSATGFKQVSKALDRPV

SEQ ID NO: 27035 - protein, 25 aa, synthetic construct
  source 1..25: note = Seed: YGFLNVIVHSATGFKQSSKALQRPV
YGFLNVIVHSATGFKQVSKALGRPV

SEQ ID NO: 27036 - protein, 25 aa, synthetic construct
  source 1..25: note = Seed: YGFLNVIVHSATGFKQSSKALQRPV
YGFLNVIVHSATGFKQVSKALHRPV

SEQ ID NO: 27037 - protein, 25 aa, synthetic construct
  source 1..25: note = Seed: YGFLNVIVHSATGFKQSSKALQRPV
YGFLNVIVHSATGFKQVSKALIRPV

SEQ ID NO: 27038 - protein, 25 aa, synthetic construct
  source 1..25: note = Seed: YGFLNVIVHSATGFKQSSKALQRPV
YGFLNVIVHSATGFKQVSKALKRPV

SEQ ID NO: 27039 - protein, 25 aa, synthetic construct
  source 1..25: note = Seed: YGFLNVIVHSATGFKQSSKALQRPV
YGFLNVIVHSATGFKQVSKALLRPV

SEQ ID NO: 27040 - protein, 25 aa, synthetic construct
  source 1..25: note = Seed: YGFLNVIVHSATGFKQSSKALQRPV
YGFLNVIVHSATGFKQVSKALMRPV

SEQ ID NO: 27041 - protein, 25 aa, synthetic construct
  source 1..25: note = Seed: YGFLNVIVHSATGFKQSSKALQRPV
YGFLNVIVHSATGFKQVSKALNRPV

SEQ ID NO: 27042 - protein, 25 aa, synthetic construct
  source 1..25: note = Seed: YGFLNVIVHSATGFKQSSKALQRPV
YGFLNVIVHSATGFKQVSKALPRPV

SEQ ID NO: 27043 - protein, 25 aa, synthetic construct
  source 1..25: note = Seed: YGFLNVIVHSATGFKQSSKALQRPV
YGFLNVIVHSATGFKQVSKALQRPV

SEQ ID NO: 27044 - protein, 25 aa, synthetic construct
  source 1..25: note = Seed: YGFLNVIVHSATGFKQSSKALQRPV
YGFLNVIVHSATGFKQVSKALRRPV

SEQ ID NO: 27045 - protein, 25 aa, synthetic construct
  source 1..25: note = Seed: YGFLNVIVHSATGFKQSSKALQRPV
YGFLNVIVHSATGFKQVSKALSRPV

SEQ ID NO: 27046 - protein, 25 aa, synthetic construct
  source 1..25: note = Seed: YGFLNVIVHSATGFKQSSKALQRPV
YGFLNVIVHSATGFKQVSKALTRPV

SEQ ID NO: 27047 - protein, 25 aa, synthetic construct
  source 1..25: note = Seed: YGFLNVIVHSATGFKQSSKALQRPV
YGFLNVIVHSATGFKQVSKALVRPV

SEQ ID NO: 27048 - protein, 25 aa, synthetic construct
  source 1..25: note = Seed: YGFLNVIVHSATGFKQSSKALQRPV
YGFLNVIVHSATGFKQVSKALYRPV

SEQ ID NO: 27049 - protein, 25 aa, synthetic construct
  source 1..25: note = Seed: YGFLNVIVHSATGFKQSSKALQRPV
YGFLNVIVHSATGFKQVSLALARPV

SEQ ID NO: 27050 - protein, 25 aa, synthetic construct
  source 1..25: note = Seed: YGFLNVIVHSATGFKQSSKALQRPV
YGFLNVIVHSATGFKQVSLALFRPV

SEQ ID NO: 27051 - protein, 25 aa, synthetic construct
  source 1..25: note = Seed: YGFLNVIVHSATGFKQSSKALQRPV
YGFLNVIVHSATGFKQVSLALHRPV

SEQ ID NO: 27052 - protein, 25 aa, synthetic construct
  source 1..25: note = Seed: YGFLNVIVHSATGFKQSSKALQRPV
YGFLNVIVHSATGFKQVSLALLRPV

SEQ ID NO: 27053 - protein, 25 aa, synthetic construct
  source 1..25: note = Seed: YGFLNVIVHSATGFKQSSKALQRPV
YGFLNVIVHSATGFKQVSLALNRPV

SEQ ID NO: 27054 - protein, 25 aa, synthetic construct
  source 1..25: note = Seed: YGFLNVIVHSATGFKQSSKALQRPV
YGFLNVIVHSATGFKQVSLALSRPV

SEQ ID NO: 27055 - protein, 25 aa, synthetic construct
  source 1..25: note = Seed: YGFLNVIVHSATGFKQSSKALQRPV
YGFLNVIVHSATGFKQVSLALTRPV

SEQ ID NO: 27056 - protein, 25 aa, synthetic construct
  source 1..25: note = Seed: YGFLNVIVHSATGFKQSSKALQRPV
YGFLNVIVHSATGFKQVSLALYRPV

SEQ ID NO: 27057 - protein, 25 aa, synthetic construct
  source 1..25: note = Seed: YGFLNVIVHSATGFKQSSKALQRPV
YGFLNVIVHSATGFKQVSMALARPV

SEQ ID NO: 27058 - protein, 25 aa, synthetic construct
  source 1..25: note = Seed: YGFLNVIVHSATGFKQSSKALQRPV
YGFLNVIVHSATGFKQVSMALFRPV

SEQ ID NO: 27059 - protein, 25 aa, synthetic construct
  source 1..25: note = Seed: YGFLNVIVHSATGFKQSSKALQRPV
YGFLNVIVHSATGFKQVSMALGRPV

SEQ ID NO: 27060 - protein, 25 aa, synthetic construct
  source 1..25: note = Seed: YGFLNVIVHSATGFKQSSKALQRPV
YGFLNVIVHSATGFKQVSMALHRPV

SEQ ID NO: 27061 - protein, 25 aa, synthetic construct
  source 1..25: note = Seed: YGFLNVIVHSATGFKQSSKALQRPV
YGFLNVIVHSATGFKQVSMALMRPV

SEQ ID NO: 27062 - protein, 25 aa, synthetic construct
  source 1..25: note = Seed: YGFLNVIVHSATGFKQSSKALQRPV
YGFLNVIVHSATGFKQVSMALNRPV

SEQ ID NO: 27063 - protein, 25 aa, synthetic construct
  source 1..25: note = Seed: YGFLNVIVHSATGFKQSSKALQRPV
YGFLNVIVHSATGFKQVSMALRRPV

SEQ ID NO: 27064 - protein, 25 aa, synthetic construct
  source 1..25: note = Seed: YGFLNVIVHSATGFKQSSKALQRPV
YGFLNVIVHSATGFKQVSMALSRPV

SEQ ID NO: 27065 - protein, 25 aa, synthetic construct
  source 1..25: note = Seed: YGFLNVIVHSATGFKQSSKALQRPV
YGFLNVIVHSATGFKQVSMALTRPV

SEQ ID NO: 27066 - protein, 25 aa, synthetic construct
  source 1..25: note = Seed: YGFLNVIVHSATGFKQSSKALQRPV
YGFLNVIVHSATGFKQVSMALVRPV

SEQ ID NO: 27067 - protein, 25 aa, synthetic construct
  source 1..25: note = Seed: YGFLNVIVHSATGFKQSSKALQRPV
YGFLNVIVHSATGFKQVSNALARPV

SEQ ID NO: 27068 - protein, 25 aa, synthetic construct
  source 1..25: note = Seed: YGFLNVIVHSATGFKQSSKALQRPV
YGFLNVIVHSATGFKQVSNALDRPV

SEQ ID NO: 27069 - protein, 25 aa, synthetic construct
  source 1..25: note = Seed: YGFLNVIVHSATGFKQSSKALQRPV
YGFLNVIVHSATGFKQVSNALGRPV

SEQ ID NO: 27070 - protein, 25 aa, synthetic construct
  source 1..25: note = Seed: YGFLNVIVHSATGFKQSSKALQRPV
YGFLNVIVHSATGFKQVSNALHRPV

SEQ ID NO: 27071 - protein, 25 aa, synthetic construct
  source 1..25: note = Seed: YGFLNVIVHSATGFKQSSKALQRPV
YGFLNVIVHSATGFKQVSNALIRPV

SEQ ID NO: 27072 - protein, 25 aa, synthetic construct
  source 1..25: note = Seed: YGFLNVIVHSATGFKQSSKALQRPV
YGFLNVIVHSATGFKQVSNALLRPV

SEQ ID NO: 27073 - protein, 25 aa, synthetic construct
  source 1..25: note = Seed: YGFLNVIVHSATGFKQSSKALQRPV
YGFLNVIVHSATGFKQVSNALMRPV

SEQ ID NO: 27074 - protein, 25 aa, synthetic construct
  source 1..25: note = Seed: YGFLNVIVHSATGFKQSSKALQRPV
YGFLNVIVHSATGFKQVSNALNRPV

SEQ ID NO: 27075 - protein, 25 aa, synthetic construct
  source 1..25: note = Seed: YGFLNVIVHSATGFKQSSKALQRPV
YGFLNVIVHSATGFKQVSNALPRPV

SEQ ID NO: 27076 - protein, 25 aa, synthetic construct
  source 1..25: note = Seed: YGFLNVIVHSATGFKQSSKALQRPV
YGFLNVIVHSATGFKQVSNALQRPV

SEQ ID NO: 27077 - protein, 25 aa, synthetic construct
  source 1..25: note = Seed: YGFLNVIVHSATGFKQSSKALQRPV
YGFLNVIVHSATGFKQVSNALSRPV

SEQ ID NO: 27078 - protein, 25 aa, synthetic construct
  source 1..25: note = Seed: YGFLNVIVHSATGFKQSSKALQRPV
YGFLNVIVHSATGFKQVSNALTRPV

SEQ ID NO: 27079 - protein, 25 aa, synthetic construct
  source 1..25: note = Seed: YGFLNVIVHSATGFKQSSKALQRPV
YGFLNVIVHSATGFKQVSNALVRPV

SEQ ID NO: 27080 - protein, 25 aa, synthetic construct
  source 1..25: note = Seed: YGFLNVIVHSATGFKQSSKALQRPV
YGFLNVIVHSATGFKQVSPALARPV

SEQ ID NO: 27081 - protein, 25 aa, synthetic construct
  source 1..25: note = Seed: YGFLNVIVHSATGFKQSSKALQRPV
YGFLNVIVHSATGFKQVSPALCRPV

SEQ ID NO: 27082 - protein, 25 aa, synthetic construct
  source 1..25: note = Seed: YGFLNVIVHSATGFKQSSKALQRPV
YGFLNVIVHSATGFKQVSPALDRPV

SEQ ID NO: 27083 - protein, 25 aa, synthetic construct
  source 1..25: note = Seed: YGFLNVIVHSATGFKQSSKALQRPV
YGFLNVIVHSATGFKQVSPALERPV

SEQ ID NO: 27084 - protein, 25 aa, synthetic construct
  source 1..25: note = Seed: YGFLNVIVHSATGFKQSSKALQRPV
YGFLNVIVHSATGFKQVSPALFRPV

SEQ ID NO: 27085 - protein, 25 aa, synthetic construct
  source 1..25: note = Seed: YGFLNVIVHSATGFKQSSKALQRPV
YGFLNVIVHSATGFKQVSPALGRPV

SEQ ID NO: 27086 - protein, 25 aa, synthetic construct
  source 1..25: note = Seed: YGFLNVIVHSATGFKQSSKALQRPV
YGFLNVIVHSATGFKQVSPALHRPV

SEQ ID NO: 27087 - protein, 25 aa, synthetic construct
  source 1..25: note = Seed: YGFLNVIVHSATGFKQSSKALQRPV
YGFLNVIVHSATGFKQVSPALIRPV

SEQ ID NO: 27088 - protein, 25 aa, synthetic construct
  source 1..25: note = Seed: YGFLNVIVHSATGFKQSSKALQRPV
YGFLNVIVHSATGFKQVSPALLRPV

SEQ ID NO: 27089 - protein, 25 aa, synthetic construct
  source 1..25: note = Seed: YGFLNVIVHSATGFKQSSKALQRPV
YGFLNVIVHSATGFKQVSPALMRPV

SEQ ID NO: 27090 - protein, 25 aa, synthetic construct
  source 1..25: note = Seed: YGFLNVIVHSATGFKQSSKALQRPV
YGFLNVIVHSATGFKQVSPALNRPV

SEQ ID NO: 27091 - protein, 25 aa, synthetic construct
  source 1..25: note = Seed: YGFLNVIVHSATGFKQSSKALQRPV
YGFLNVIVHSATGFKQVSPALPRPV

SEQ ID NO: 27092 - protein, 25 aa, synthetic construct
  source 1..25: note = Seed: YGFLNVIVHSATGFKQSSKALQRPV
YGFLNVIVHSATGFKQVSPALQRPV

SEQ ID NO: 27093 - protein, 25 aa, synthetic construct
  source 1..25: note = Seed: YGFLNVIVHSATGFKQSSKALQRPV
YGFLNVIVHSATGFKQVSPALSRPV

SEQ ID NO: 27094 - protein, 25 aa, synthetic construct
  source 1..25: note = Seed: YGFLNVIVHSATGFKQSSKALQRPV
YGFLNVIVHSATGFKQVSPALTRPV

SEQ ID NO: 27095 - protein, 25 aa, synthetic construct
  source 1..25: note = Seed: YGFLNVIVHSATGFKQSSKALQRPV
YGFLNVIVHSATGFKQVSPALVRPV

SEQ ID NO: 27096 - protein, 25 aa, synthetic construct
  source 1..25: note = Seed: YGFLNVIVHSATGFKQSSKALQRPV
YGFLNVIVHSATGFKQVSPALWRPV

SEQ ID NO: 27097 - protein, 25 aa, synthetic construct
  source 1..25: note = Seed: YGFLNVIVHSATGFKQSSKALQRPV
YGFLNVIVHSATGFKQVSPALYRPV

SEQ ID NO: 27098 - protein, 25 aa, synthetic construct
  source 1..25: note = Seed: YGFLNVIVHSATGFKQSSKALQRPV
YGFLNVIVHSATGFKQVSQALARPV

SEQ ID NO: 27099 - protein, 25 aa, synthetic construct
  source 1..25: note = Seed: YGFLNVIVHSATGFKQSSKALQRPV
YGFLNVIVHSATGFKQVSQALNRPV

SEQ ID NO: 27100 - protein, 25 aa, synthetic construct
  source 1..25: note = Seed: YGFLNVIVHSATGFKQSSKALQRPV
YGFLNVIVHSATGFKQVSQALSRPV

SEQ ID NO: 27101 - protein, 25 aa, synthetic construct
  source 1..25: note = Seed: YGFLNVIVHSATGFKQSSKALQRPV
YGFLNVIVHSATGFKQVSRALARPV

SEQ ID NO: 27102 - protein, 25 aa, synthetic construct
  source 1..25: note = Seed: YGFLNVIVHSATGFKQSSKALQRPV
YGFLNVIVHSATGFKQVSRALDRPV

SEQ ID NO: 27103 - protein, 25 aa, synthetic construct
  source 1..25: note = Seed: YGFLNVIVHSATGFKQSSKALQRPV
YGFLNVIVHSATGFKQVSRALERPV

SEQ ID NO: 27104 - protein, 25 aa, synthetic construct
  source 1..25: note = Seed: YGFLNVIVHSATGFKQSSKALQRPV
YGFLNVIVHSATGFKQVSRALGRPV

SEQ ID NO: 27105 - protein, 25 aa, synthetic construct
  source 1..25: note = Seed: YGFLNVIVHSATGFKQSSKALQRPV
YGFLNVIVHSATGFKQVSRALHRPV

SEQ ID NO: 27106 - protein, 25 aa, synthetic construct
  source 1..25: note = Seed: YGFLNVIVHSATGFKQSSKALQRPV
YGFLNVIVHSATGFKQVSRALIRPV

SEQ ID NO: 27107 - protein, 25 aa, synthetic construct
  source 1..25: note = Seed: YGFLNVIVHSATGFKQSSKALQRPV
YGFLNVIVHSATGFKQVSRALKRPV

SEQ ID NO: 27108 - protein, 25 aa, synthetic construct
  source 1..25: note = Seed: YGFLNVIVHSATGFKQSSKALQRPV
YGFLNVIVHSATGFKQVSRALLRPV

SEQ ID NO: 27109 - protein, 25 aa, synthetic construct
  source 1..25: note = Seed: YGFLNVIVHSATGFKQSSKALQRPV
YGFLNVIVHSATGFKQVSRALMRPV

SEQ ID NO: 27110 - protein, 25 aa, synthetic construct
  source 1..25: note = Seed: YGFLNVIVHSATGFKQSSKALQRPV
YGFLNVIVHSATGFKQVSRALNRPV

SEQ ID NO: 27111 - protein, 25 aa, synthetic construct
  source 1..25: note = Seed: YGFLNVIVHSATGFKQSSKALQRPV
YGFLNVIVHSATGFKQVSRALPRPV

SEQ ID NO: 27112 - protein, 25 aa, synthetic construct
  source 1..25: note = Seed: YGFLNVIVHSATGFKQSSKALQRPV
YGFLNVIVHSATGFKQVSRALQRPV

SEQ ID NO: 27113 - protein, 25 aa, synthetic construct
  source 1..25: note = Seed: YGFLNVIVHSATGFKQSSKALQRPV
YGFLNVIVHSATGFKQVSRALRRPV

SEQ ID NO: 27114 - protein, 25 aa, synthetic construct
  source 1..25: note = Seed: YGFLNVIVHSATGFKQSSKALQRPV
YGFLNVIVHSATGFKQVSRALSRPV

SEQ ID NO: 27115 - protein, 25 aa, synthetic construct
  source 1..25: note = Seed: YGFLNVIVHSATGFKQSSKALQRPV
YGFLNVIVHSATGFKQVSRALTRPV

SEQ ID NO: 27116 - protein, 25 aa, synthetic construct
  source 1..25: note = Seed: YGFLNVIVHSATGFKQSSKALQRPV
YGFLNVIVHSATGFKQVSRALVRPV

SEQ ID NO: 27117 - protein, 25 aa, synthetic construct
  source 1..25: note = Seed: YGFLNVIVHSATGFKQSSKALQRPV
YGFLNVIVHSATGFKQVSRALYRPV

SEQ ID NO: 27118 - protein, 25 aa, synthetic construct
  source 1..25: note = Seed: YGFLNVIVHSATGFKQSSKALQRPV
YGFLNVIVHSATGFKQVSSALARPV

SEQ ID NO: 27119 - protein, 25 aa, synthetic construct
  source 1..25: note = Seed: YGFLNVIVHSATGFKQSSKALQRPV
YGFLNVIVHSATGFKQVSSALCRPV

SEQ ID NO: 27120 - protein, 25 aa, synthetic construct
  source 1..25: note = Seed: YGFLNVIVHSATGFKQSSKALQRPV
YGFLNVIVHSATGFKQVSSALDRPV

SEQ ID NO: 27121 - protein, 25 aa, synthetic construct
  source 1..25: note = Seed: YGFLNVIVHSATGFKQSSKALQRPV
YGFLNVIVHSATGFKQVSSALERPV

SEQ ID NO: 27122 - protein, 25 aa, synthetic construct
  source 1..25: note = Seed: YGFLNVIVHSATGFKQSSKALQRPV
YGFLNVIVHSATGFKQVSSALGRPV

SEQ ID NO: 27123 - protein, 25 aa, synthetic construct
  source 1..25: note = Seed: YGFLNVIVHSATGFKQSSKALQRPV
YGFLNVIVHSATGFKQVSSALHRPV

SEQ ID NO: 27124 - protein, 25 aa, synthetic construct
  source 1..25: note = Seed: YGFLNVIVHSATGFKQSSKALQRPV
YGFLNVIVHSATGFKQVSSALIRPV

SEQ ID NO: 27125 - protein, 25 aa, synthetic construct
  source 1..25: note = Seed: YGFLNVIVHSATGFKQSSKALQRPV
YGFLNVIVHSATGFKQVSSALLRPV

SEQ ID NO: 27126 - protein, 25 aa, synthetic construct
  source 1..25: note = Seed: YGFLNVIVHSATGFKQSSKALQRPV
YGFLNVIVHSATGFKQVSSALMRPV

SEQ ID NO: 27127 - protein, 25 aa, synthetic construct
  source 1..25: note = Seed: YGFLNVIVHSATGFKQSSKALQRPV
YGFLNVIVHSATGFKQVSSALNRPV

SEQ ID NO: 27128 - protein, 25 aa, synthetic construct
  source 1..25: note = Seed: YGFLNVIVHSATGFKQSSKALQRPV
YGFLNVIVHSATGFKQVSSALPRPV

SEQ ID NO: 27129 - protein, 25 aa, synthetic construct
  source 1..25: note = Seed: YGFLNVIVHSATGFKQSSKALQRPV
YGFLNVIVHSATGFKQVSSALQRPV

SEQ ID NO: 27130 - protein, 25 aa, synthetic construct
  source 1..25: note = Seed: YGFLNVIVHSATGFKQSSKALQRPV
YGFLNVIVHSATGFKQVSSALSRPV

SEQ ID NO: 27131 - protein, 25 aa, synthetic construct
  source 1..25: note = Seed: YGFLNVIVHSATGFKQSSKALQRPV
YGFLNVIVHSATGFKQVSSALTRPV

SEQ ID NO: 27132 - protein, 25 aa, synthetic construct
  source 1..25: note = Seed: YGFLNVIVHSATGFKQSSKALQRPV
YGFLNVIVHSATGFKQVSSALVRPV

SEQ ID NO: 27133 - protein, 25 aa, synthetic construct
  source 1..25: note = Seed: YGFLNVIVHSATGFKQSSKALQRPV
YGFLNVIVHSATGFKQVSSALYRPV

SEQ ID NO: 27134 - protein, 25 aa, synthetic construct
  source 1..25: note = Seed: YGFLNVIVHSATGFKQSSKALQRPV
YGFLNVIVHSATGFKQVSTALARPV

SEQ ID NO: 27135 - protein, 25 aa, synthetic construct
  source 1..25: note = Seed: YGFLNVIVHSATGFKQSSKALQRPV
YGFLNVIVHSATGFKQVSTALCRPV

SEQ ID NO: 27136 - protein, 25 aa, synthetic construct
  source 1..25: note = Seed: YGFLNVIVHSATGFKQSSKALQRPV
YGFLNVIVHSATGFKQVSTALDRPV

SEQ ID NO: 27137 - protein, 25 aa, synthetic construct
  source 1..25: note = Seed: YGFLNVIVHSATGFKQSSKALQRPV
YGFLNVIVHSATGFKQVSTALERPV

SEQ ID NO: 27138 - protein, 25 aa, synthetic construct
  source 1..25: note = Seed: YGFLNVIVHSATGFKQSSKALQRPV
YGFLNVIVHSATGFKQVSTALFRPV

SEQ ID NO: 27139 - protein, 25 aa, synthetic construct
  source 1..25: note = Seed: YGFLNVIVHSATGFKQSSKALQRPV
YGFLNVIVHSATGFKQVSTALGRPV

SEQ ID NO: 27140 - protein, 25 aa, synthetic construct
  source 1..25: note = Seed: YGFLNVIVHSATGFKQSSKALQRPV
YGFLNVIVHSATGFKQVSTALHRPV

SEQ ID NO: 27141 - protein, 25 aa, synthetic construct
  source 1..25: note = Seed: YGFLNVIVHSATGFKQSSKALQRPV
YGFLNVIVHSATGFKQVSTALIRPV

SEQ ID NO: 27142 - protein, 25 aa, synthetic construct
  source 1..25: note = Seed: YGFLNVIVHSATGFKQSSKALQRPV
YGFLNVIVHSATGFKQVSTALLRPV

SEQ ID NO: 27143 - protein, 25 aa, synthetic construct
  source 1..25: note = Seed: YGFLNVIVHSATGFKQSSKALQRPV
YGFLNVIVHSATGFKQVSTALMRPV

SEQ ID NO: 27144 - protein, 25 aa, synthetic construct
  source 1..25: note = Seed: YGFLNVIVHSATGFKQSSKALQRPV
YGFLNVIVHSATGFKQVSTALNRPV

SEQ ID NO: 27145 - protein, 25 aa, synthetic construct
  source 1..25: note = Seed: YGFLNVIVHSATGFKQSSKALQRPV
YGFLNVIVHSATGFKQVSTALPRPV

SEQ ID NO: 27146 - protein, 25 aa, synthetic construct
  source 1..25: note = Seed: YGFLNVIVHSATGFKQSSKALQRPV
YGFLNVIVHSATGFKQVSTALQRPV

SEQ ID NO: 27147 - protein, 25 aa, synthetic construct
  source 1..25: note = Seed: YGFLNVIVHSATGFKQSSKALQRPV
YGFLNVIVHSATGFKQVSTALSRPV

SEQ ID NO: 27148 - protein, 25 aa, synthetic construct
  source 1..25: note = Seed: YGFLNVIVHSATGFKQSSKALQRPV
YGFLNVIVHSATGFKQVSTALTRPV

SEQ ID NO: 27149 - protein, 25 aa, synthetic construct
  source 1..25: note = Seed: YGFLNVIVHSATGFKQSSKALQRPV
YGFLNVIVHSATGFKQVSTALVRPV

SEQ ID NO: 27150 - protein, 25 aa, synthetic construct
  source 1..25: note = Seed: YGFLNVIVHSATGFKQSSKALQRPV
YGFLNVIVHSATGFKQVSTALYRPV

SEQ ID NO: 27151 - protein, 25 aa, synthetic construct
  source 1..25: note = Seed: YGFLNVIVHSATGFKQSSKALQRPV
YGFLNVIVHSATGFKQVSVALARPV

SEQ ID NO: 27152 - protein, 25 aa, synthetic construct
  source 1..25: note = Seed: YGFLNVIVHSATGFKQSSKALQRPV
YGFLNVIVHSATGFKQVSVALDRPV

SEQ ID NO: 27153 - protein, 25 aa, synthetic construct
  source 1..25: note = Seed: YGFLNVIVHSATGFKQSSKALQRPV
YGFLNVIVHSATGFKQVSVALERPV

SEQ ID NO: 27154 - protein, 25 aa, synthetic construct
  source 1..25: note = Seed: YGFLNVIVHSATGFKQSSKALQRPV
YGFLNVIVHSATGFKQVSVALFRPV

SEQ ID NO: 27155 - protein, 25 aa, synthetic construct
  source 1..25: note = Seed: YGFLNVIVHSATGFKQSSKALQRPV
YGFLNVIVHSATGFKQVSVALGRPV

SEQ ID NO: 27156 - protein, 25 aa, synthetic construct
  source 1..25: note = Seed: YGFLNVIVHSATGFKQSSKALQRPV
YGFLNVIVHSATGFKQVSVALHRPV

SEQ ID NO: 27157 - protein, 25 aa, synthetic construct
  source 1..25: note = Seed: YGFLNVIVHSATGFKQSSKALQRPV
YGFLNVIVHSATGFKQVSVALIRPV

SEQ ID NO: 27158 - protein, 25 aa, synthetic construct
  source 1..25: note = Seed: YGFLNVIVHSATGFKQSSKALQRPV
YGFLNVIVHSATGFKQVSVALKRPV

SEQ ID NO: 27159 - protein, 25 aa, synthetic construct
  source 1..25: note = Seed: YGFLNVIVHSATGFKQSSKALQRPV
YGFLNVIVHSATGFKQVSVALLRPV

SEQ ID NO: 27160 - protein, 25 aa, synthetic construct
  source 1..25: note = Seed: YGFLNVIVHSATGFKQSSKALQRPV
YGFLNVIVHSATGFKQVSVALMRPV

SEQ ID NO: 27161 - protein, 25 aa, synthetic construct
  source 1..25: note = Seed: YGFLNVIVHSATGFKQSSKALQRPV
YGFLNVIVHSATGFKQVSVALNRPV

SEQ ID NO: 27162 - protein, 25 aa, synthetic construct
  source 1..25: note = Seed: YGFLNVIVHSATGFKQSSKALQRPV
YGFLNVIVHSATGFKQVSVALPRPV

SEQ ID NO: 27163 - protein, 25 aa, synthetic construct
  source 1..25: note = Seed: YGFLNVIVHSATGFKQSSKALQRPV
YGFLNVIVHSATGFKQVSVALQRPV

SEQ ID NO: 27164 - protein, 25 aa, synthetic construct
  source 1..25: note = Seed: YGFLNVIVHSATGFKQSSKALQRPV
YGFLNVIVHSATGFKQVSVALSRPV

SEQ ID NO: 27165 - protein, 25 aa, synthetic construct
  source 1..25: note = Seed: YGFLNVIVHSATGFKQSSKALQRPV
YGFLNVIVHSATGFKQVSVALTRPV

SEQ ID NO: 27166 - protein, 25 aa, synthetic construct
  source 1..25: note = Seed: YGFLNVIVHSATGFKQSSKALQRPV
YGFLNVIVHSATGFKQVSVALVRPV

SEQ ID NO: 27167 - protein, 25 aa, synthetic construct
  source 1..25: note = Seed: YGFLNVIVHSATGFKQSSKALQRPV
YGFLNVIVHSATGFKQVSWALARPV

SEQ ID NO: 27168 - protein, 25 aa, synthetic construct
  source 1..25: note = Seed: YGFLNVIVHSATGFKQSSKALQRPV
YGFLNVIVHSATGFKQVSWALFRPV

SEQ ID NO: 27169 - protein, 25 aa, synthetic construct
  source 1..25: note = Seed: YGFLNVIVHSATGFKQSSKALQRPV
YGFLNVIVHSATGFKQVSWALIRPV

SEQ ID NO: 27170 - protein, 25 aa, synthetic construct
  source 1..25: note = Seed: YGFLNVIVHSATGFKQSSKALQRPV
YGFLNVIVHSATGFKQVSWALLRPV

SEQ ID NO: 27171 - protein, 25 aa, synthetic construct
  source 1..25: note = Seed: YGFLNVIVHSATGFKQSSKALQRPV
YGFLNVIVHSATGFKQVSWALMRPV

SEQ ID NO: 27172 - protein, 25 aa, synthetic construct
  source 1..25: note = Seed: YGFLNVIVHSATGFKQSSKALQRPV
YGFLNVIVHSATGFKQVSWALVRPV

SEQ ID NO: 27173 - protein, 25 aa, synthetic construct
  source 1..25: note = Seed: YGFLNVIVHSATGFKQSSKALQRPV
YGFLNVIVHSATGFKQVSWALYRPV

SEQ ID NO: 27174 - protein, 25 aa, synthetic construct
  source 1..25: note = Seed: YGFLNVIVHSATGFKQSSKALQRPV
YGFLNVIVHSATGFKQVSYALARPV

SEQ ID NO: 27175 - protein, 25 aa, synthetic construct
  source 1..25: note = Seed: YGFLNVIVHSATGFKQSSKALQRPV
YGFLNVIVHSATGFKQVSYALFRPV

SEQ ID NO: 27176 - protein, 25 aa, synthetic construct
  source 1..25: note = Seed: YGFLNVIVHSATGFKQSSKALQRPV
YGFLNVIVHSATGFKQVSYALIRPV

SEQ ID NO: 27177 - protein, 25 aa, synthetic construct
  source 1..25: note = Seed: YGFLNVIVHSATGFKQSSKALQRPV
YGFLNVIVHSATGFKQVSYALLRPV

SEQ ID NO: 27178 - protein, 25 aa, synthetic construct
  source 1..25: note = Seed: YGFLNVIVHSATGFKQSSKALQRPV
YGFLNVIVHSATGFKQVSYALMRPV

SEQ ID NO: 27179 - protein, 25 aa, synthetic construct
  source 1..25: note = Seed: YGFLNVIVHSATGFKQSSKALQRPV
YGFLNVIVHSATGFKQVSYALVRPV

SEQ ID NO: 27180 - protein, 25 aa, synthetic construct
  source 1..25: note = Seed: YGFLNVIVHSATGFKQSSKALQRPV
YGFLNVIVHSATGFKQVSYALWRPV

SEQ ID NO: 27181 - protein, 25 aa, synthetic construct
  source 1..25: note = Seed: YGFLNVIVHSATGFKQSSKALQRPV
YGFLNVIVHSATGFKQVSYALYRPV

SEQ ID NO: 27182 - protein, 25 aa, synthetic construct
  source 1..25: note = Seed: YGFLNVIVHSATGFKQSSKALQRPV
YGFLNVIVHSATGFKQWSAALARPV

SEQ ID NO: 27183 - protein, 25 aa, synthetic construct
  source 1..25: note = Seed: YGFLNVIVHSATGFKQSSKALQRPV
YGFLNVIVHSATGFKQWSAALFRPV

SEQ ID NO: 27184 - protein, 25 aa, synthetic construct
  source 1..25: note = Seed: YGFLNVIVHSATGFKQSSKALQRPV
YGFLNVIVHSATGFKQWSAALGRPV

SEQ ID NO: 27185 - protein, 25 aa, synthetic construct
  source 1..25: note = Seed: YGFLNVIVHSATGFKQSSKALQRPV
YGFLNVIVHSATGFKQWSAALHRPV

SEQ ID NO: 27186 - protein, 25 aa, synthetic construct
  source 1..25: note = Seed: YGFLNVIVHSATGFKQSSKALQRPV
YGFLNVIVHSATGFKQWSAALIRPV

SEQ ID NO: 27187 - protein, 25 aa, synthetic construct
  source 1..25: note = Seed: YGFLNVIVHSATGFKQSSKALQRPV
YGFLNVIVHSATGFKQWSAALLRPV

SEQ ID NO: 27188 - protein, 25 aa, synthetic construct
  source 1..25: note = Seed: YGFLNVIVHSATGFKQSSKALQRPV
YGFLNVIVHSATGFKQWSAALMRPV

SEQ ID NO: 27189 - protein, 25 aa, synthetic construct
  source 1..25: note = Seed: YGFLNVIVHSATGFKQSSKALQRPV
YGFLNVIVHSATGFKQWSAALNRPV

SEQ ID NO: 27190 - protein, 25 aa, synthetic construct
  source 1..25: note = Seed: YGFLNVIVHSATGFKQSSKALQRPV
YGFLNVIVHSATGFKQWSAALPRPV

SEQ ID NO: 27191 - protein, 25 aa, synthetic construct
  source 1..25: note = Seed: YGFLNVIVHSATGFKQSSKALQRPV
YGFLNVIVHSATGFKQWSAALSRPV

SEQ ID NO: 27192 - protein, 25 aa, synthetic construct
  source 1..25: note = Seed: YGFLNVIVHSATGFKQSSKALQRPV
YGFLNVIVHSATGFKQWSAALTRPV

SEQ ID NO: 27193 - protein, 25 aa, synthetic construct
  source 1..25: note = Seed: YGFLNVIVHSATGFKQSSKALQRPV
YGFLNVIVHSATGFKQWSAALVRPV

SEQ ID NO: 27194 - protein, 25 aa, synthetic construct
  source 1..25: note = Seed: YGFLNVIVHSATGFKQSSKALQRPV
YGFLNVIVHSATGFKQWSFALARPV

SEQ ID NO: 27195 - protein, 25 aa, synthetic construct
  source 1..25: note = Seed: YGFLNVIVHSATGFKQSSKALQRPV
YGFLNVIVHSATGFKQWSFALFRPV

SEQ ID NO: 27196 - protein, 25 aa, synthetic construct
  source 1..25: note = Seed: YGFLNVIVHSATGFKQSSKALQRPV
YGFLNVIVHSATGFKQWSFALIRPV

SEQ ID NO: 27197 - protein, 25 aa, synthetic construct
  source 1..25: note = Seed: YGFLNVIVHSATGFKQSSKALQRPV
YGFLNVIVHSATGFKQWSFALLRPV

SEQ ID NO: 27198 - protein, 25 aa, synthetic construct
  source 1..25: note = Seed: YGFLNVIVHSATGFKQSSKALQRPV
YGFLNVIVHSATGFKQWSFALMRPV

SEQ ID NO: 27199 - protein, 25 aa, synthetic construct
  source 1..25: note = Seed: YGFLNVIVHSATGFKQSSKALQRPV
YGFLNVIVHSATGFKQWSFALVRPV

SEQ ID NO: 27200 - protein, 25 aa, synthetic construct
  source 1..25: note = Seed: YGFLNVIVHSATGFKQSSKALQRPV
YGFLNVIVHSATGFKQWSFALWRPV

SEQ ID NO: 27201 - protein, 25 aa, synthetic construct
  source 1..25: note = Seed: YGFLNVIVHSATGFKQSSKALQRPV
YGFLNVIVHSATGFKQWSFALYRPV

SEQ ID NO: 27202 - protein, 25 aa, synthetic construct
  source 1..25: note = Seed: YGFLNVIVHSATGFKQSSKALQRPV
YGFLNVIVHSATGFKQWSGALARPV

SEQ ID NO: 27203 - protein, 25 aa, synthetic construct
  source 1..25: note = Seed: YGFLNVIVHSATGFKQSSKALQRPV
YGFLNVIVHSATGFKQWSHALFRPV

SEQ ID NO: 27204 - protein, 25 aa, synthetic construct
  source 1..25: note = Seed: YGFLNVIVHSATGFKQSSKALQRPV
YGFLNVIVHSATGFKQWSIALARPV

SEQ ID NO: 27205 - protein, 25 aa, synthetic construct
  source 1..25: note = Seed: YGFLNVIVHSATGFKQSSKALQRPV
YGFLNVIVHSATGFKQWSIALFRPV

SEQ ID NO: 27206 - protein, 25 aa, synthetic construct
  source 1..25: note = Seed: YGFLNVIVHSATGFKQSSKALQRPV
YGFLNVIVHSATGFKQWSIALMRPV

SEQ ID NO: 27207 - protein, 25 aa, synthetic construct
  source 1..25: note = Seed: YGFLNVIVHSATGFKQSSKALQRPV
YGFLNVIVHSATGFKQWSIALNRPV

SEQ ID NO: 27208 - protein, 25 aa, synthetic construct
  source 1..25: note = Seed: YGFLNVIVHSATGFKQSSKALQRPV
YGFLNVIVHSATGFKQWSIALSRPV

SEQ ID NO: 27209 - protein, 25 aa, synthetic construct
  source 1..25: note = Seed: YGFLNVIVHSATGFKQSSKALQRPV
YGFLNVIVHSATGFKQWSIALTRPV

SEQ ID NO: 27210 - protein, 25 aa, synthetic construct
  source 1..25: note = Seed: YGFLNVIVHSATGFKQSSKALQRPV
YGFLNVIVHSATGFKQWSIALVRPV

SEQ ID NO: 27211 - protein, 25 aa, synthetic construct
  source 1..25: note = Seed: YGFLNVIVHSATGFKQSSKALQRPV
YGFLNVIVHSATGFKQWSKALRRPV

SEQ ID NO: 27212 - protein, 25 aa, synthetic construct
  source 1..25: note = Seed: YGFLNVIVHSATGFKQSSKALQRPV
YGFLNVIVHSATGFKQWSLALARPV

SEQ ID NO: 27213 - protein, 25 aa, synthetic construct
  source 1..25: note = Seed: YGFLNVIVHSATGFKQSSKALQRPV
YGFLNVIVHSATGFKQWSLALFRPV

SEQ ID NO: 27214 - protein, 25 aa, synthetic construct
  source 1..25: note = Seed: YGFLNVIVHSATGFKQSSKALQRPV
YGFLNVIVHSATGFKQWSLALLRPV

SEQ ID NO: 27215 - protein, 25 aa, synthetic construct
  source 1..25: note = Seed: YGFLNVIVHSATGFKQSSKALQRPV
YGFLNVIVHSATGFKQWSLALNRPV

SEQ ID NO: 27216 - protein, 25 aa, synthetic construct
  source 1..25: note = Seed: YGFLNVIVHSATGFKQSSKALQRPV
YGFLNVIVHSATGFKQWSLALSRPV

SEQ ID NO: 27217 - protein, 25 aa, synthetic construct
  source 1..25: note = Seed: YGFLNVIVHSATGFKQSSKALQRPV
YGFLNVIVHSATGFKQWSLALTRPV

SEQ ID NO: 27218 - protein, 25 aa, synthetic construct
  source 1..25: note = Seed: YGFLNVIVHSATGFKQSSKALQRPV
YGFLNVIVHSATGFKQWSLALVRPV

SEQ ID NO: 27219 - protein, 25 aa, synthetic construct
  source 1..25: note = Seed: YGFLNVIVHSATGFKQSSKALQRPV
YGFLNVIVHSATGFKQWSLALYRPV

SEQ ID NO: 27220 - protein, 25 aa, synthetic construct
  source 1..25: note = Seed: YGFLNVIVHSATGFKQSSKALQRPV
YGFLNVIVHSATGFKQWSMALARPV

SEQ ID NO: 27221 - protein, 25 aa, synthetic construct
  source 1..25: note = Seed: YGFLNVIVHSATGFKQSSKALQRPV
YGFLNVIVHSATGFKQWSMALFRPV

SEQ ID NO: 27222 - protein, 25 aa, synthetic construct
  source 1..25: note = Seed: YGFLNVIVHSATGFKQSSKALQRPV
YGFLNVIVHSATGFKQWSMALIRPV

SEQ ID NO: 27223 - protein, 25 aa, synthetic construct
  source 1..25: note = Seed: YGFLNVIVHSATGFKQSSKALQRPV
YGFLNVIVHSATGFKQWSMALNRPV

SEQ ID NO: 27224 - protein, 25 aa, synthetic construct
  source 1..25: note = Seed: YGFLNVIVHSATGFKQSSKALQRPV
YGFLNVIVHSATGFKQWSMALSRPV

SEQ ID NO: 27225 - protein, 25 aa, synthetic construct
  source 1..25: note = Seed: YGFLNVIVHSATGFKQSSKALQRPV
YGFLNVIVHSATGFKQWSMALTRPV

SEQ ID NO: 27226 - protein, 25 aa, synthetic construct
  source 1..25: note = Seed: YGFLNVIVHSATGFKQSSKALQRPV
YGFLNVIVHSATGFKQWSMALVRPV

SEQ ID NO: 27227 - protein, 25 aa, synthetic construct
  source 1..25: note = Seed: YGFLNVIVHSATGFKQSSKALQRPV
YGFLNVIVHSATGFKQWSNALARPV

SEQ ID NO: 27228 - protein, 25 aa, synthetic construct
  source 1..25: note = Seed: YGFLNVIVHSATGFKQSSKALQRPV
YGFLNVIVHSATGFKQWSPALARPV

SEQ ID NO: 27229 - protein, 25 aa, synthetic construct
  source 1..25: note = Seed: YGFLNVIVHSATGFKQSSKALQRPV
YGFLNVIVHSATGFKQWSPALIRPV

SEQ ID NO: 27230 - protein, 25 aa, synthetic construct
  source 1..25: note = Seed: YGFLNVIVHSATGFKQSSKALQRPV
YGFLNVIVHSATGFKQWSPALMRPV

SEQ ID NO: 27231 - protein, 25 aa, synthetic construct
  source 1..25: note = Seed: YGFLNVIVHSATGFKQSSKALQRPV
YGFLNVIVHSATGFKQWSPALNRPV

SEQ ID NO: 27232 - protein, 25 aa, synthetic construct
  source 1..25: note = Seed: YGFLNVIVHSATGFKQSSKALQRPV
YGFLNVIVHSATGFKQWSPALSRPV

SEQ ID NO: 27233 - protein, 25 aa, synthetic construct
  source 1..25: note = Seed: YGFLNVIVHSATGFKQSSKALQRPV
YGFLNVIVHSATGFKQWSPALTRPV

SEQ ID NO: 27234 - protein, 25 aa, synthetic construct
  source 1..25: note = Seed: YGFLNVIVHSATGFKQSSKALQRPV
YGFLNVIVHSATGFKQWSPALVRPV

SEQ ID NO: 27235 - protein, 25 aa, synthetic construct
  source 1..25: note = Seed: YGFLNVIVHSATGFKQSSKALQRPV
YGFLNVIVHSATGFKQWSRALRRPV

SEQ ID NO: 27236 - protein, 25 aa, synthetic construct
  source 1..25: note = Seed: YGFLNVIVHSATGFKQSSKALQRPV
YGFLNVIVHSATGFKQWSRALYRPV

SEQ ID NO: 27237 - protein, 25 aa, synthetic construct
  source 1..25: note = Seed: YGFLNVIVHSATGFKQSSKALQRPV
YGFLNVIVHSATGFKQWSSALARPV

SEQ ID NO: 27238 - protein, 25 aa, synthetic construct
  source 1..25: note = Seed: YGFLNVIVHSATGFKQSSKALQRPV
YGFLNVIVHSATGFKQWSSALNRPV

SEQ ID NO: 27239 - protein, 25 aa, synthetic construct
  source 1..25: note = Seed: YGFLNVIVHSATGFKQSSKALQRPV
YGFLNVIVHSATGFKQWSSALSRPV

SEQ ID NO: 27240 - protein, 25 aa, synthetic construct
  source 1..25: note = Seed: YGFLNVIVHSATGFKQSSKALQRPV
YGFLNVIVHSATGFKQWSSALTRPV

SEQ ID NO: 27241 - protein, 25 aa, synthetic construct
  source 1..25: note = Seed: YGFLNVIVHSATGFKQSSKALQRPV
YGFLNVIVHSATGFKQWSSALVRPV

SEQ ID NO: 27242 - protein, 25 aa, synthetic construct
  source 1..25: note = Seed: YGFLNVIVHSATGFKQSSKALQRPV
YGFLNVIVHSATGFKQWSTALARPV

SEQ ID NO: 27243 - protein, 25 aa, synthetic construct
  source 1..25: note = Seed: YGFLNVIVHSATGFKQSSKALQRPV
YGFLNVIVHSATGFKQWSTALFRPV

SEQ ID NO: 27244 - protein, 25 aa, synthetic construct
  source 1..25: note = Seed: YGFLNVIVHSATGFKQSSKALQRPV
YGFLNVIVHSATGFKQWSTALIRPV

SEQ ID NO: 27245 - protein, 25 aa, synthetic construct
  source 1..25: note = Seed: YGFLNVIVHSATGFKQSSKALQRPV
YGFLNVIVHSATGFKQWSTALMRPV

SEQ ID NO: 27246 - protein, 25 aa, synthetic construct
  source 1..25: note = Seed: YGFLNVIVHSATGFKQSSKALQRPV
YGFLNVIVHSATGFKQWSTALNRPV

SEQ ID NO: 27247 - protein, 25 aa, synthetic construct
  source 1..25: note = Seed: YGFLNVIVHSATGFKQSSKALQRPV
YGFLNVIVHSATGFKQWSTALSRPV

SEQ ID NO: 27248 - protein, 25 aa, synthetic construct
  source 1..25: note = Seed: YGFLNVIVHSATGFKQSSKALQRPV
YGFLNVIVHSATGFKQWSTALTRPV

SEQ ID NO: 27249 - protein, 25 aa, synthetic construct
  source 1..25: note = Seed: YGFLNVIVHSATGFKQSSKALQRPV
YGFLNVIVHSATGFKQWSTALVRPV

SEQ ID NO: 27250 - protein, 25 aa, synthetic construct
  source 1..25: note = Seed: YGFLNVIVHSATGFKQSSKALQRPV
YGFLNVIVHSATGFKQWSVALARPV

SEQ ID NO: 27251 - protein, 25 aa, synthetic construct
  source 1..25: note = Seed: YGFLNVIVHSATGFKQSSKALQRPV
YGFLNVIVHSATGFKQWSVALFRPV

SEQ ID NO: 27252 - protein, 25 aa, synthetic construct
  source 1..25: note = Seed: YGFLNVIVHSATGFKQSSKALQRPV
YGFLNVIVHSATGFKQWSVALGRPV

SEQ ID NO: 27253 - protein, 25 aa, synthetic construct
  source 1..25: note = Seed: YGFLNVIVHSATGFKQSSKALQRPV
YGFLNVIVHSATGFKQWSVALHRPV

SEQ ID NO: 27254 - protein, 25 aa, synthetic construct
  source 1..25: note = Seed: YGFLNVIVHSATGFKQSSKALQRPV
YGFLNVIVHSATGFKQWSVALIRPV

SEQ ID NO: 27255 - protein, 25 aa, synthetic construct
  source 1..25: note = Seed: YGFLNVIVHSATGFKQSSKALQRPV
YGFLNVIVHSATGFKQWSVALMRPV

SEQ ID NO: 27256 - protein, 25 aa, synthetic construct
  source 1..25: note = Seed: YGFLNVIVHSATGFKQSSKALQRPV
YGFLNVIVHSATGFKQWSVALNRPV

SEQ ID NO: 27257 - protein, 25 aa, synthetic construct
  source 1..25: note = Seed: YGFLNVIVHSATGFKQSSKALQRPV
YGFLNVIVHSATGFKQWSVALSRPV

SEQ ID NO: 27258 - protein, 25 aa, synthetic construct
  source 1..25: note = Seed: YGFLNVIVHSATGFKQSSKALQRPV
YGFLNVIVHSATGFKQWSVALTRPV

SEQ ID NO: 27259 - protein, 25 aa, synthetic construct
  source 1..25: note = Seed: YGFLNVIVHSATGFKQSSKALQRPV
YGFLNVIVHSATGFKQWSVALVRPV

SEQ ID NO: 27260 - protein, 25 aa, synthetic construct
  source 1..25: note = Seed: YGFLNVIVHSATGFKQSSKALQRPV
YGFLNVIVHSATGFKQWSWALFRPV

SEQ ID NO: 27261 - protein, 25 aa, synthetic construct
  source 1..25: note = Seed: YGFLNVIVHSATGFKQSSKALQRPV
YGFLNVIVHSATGFKQWSWALIRPV

SEQ ID NO: 27262 - protein, 25 aa, synthetic construct
  source 1..25: note = Seed: YGFLNVIVHSATGFKQSSKALQRPV
YGFLNVIVHSATGFKQWSWALLRPV

SEQ ID NO: 27263 - protein, 25 aa, synthetic construct
  source 1..25: note = Seed: YGFLNVIVHSATGFKQSSKALQRPV
YGFLNVIVHSATGFKQWSWALYRPV

SEQ ID NO: 27264 - protein, 25 aa, synthetic construct
  source 1..25: note = Seed: YGFLNVIVHSATGFKQSSKALQRPV
YGFLNVIVHSATGFKQWSYALARPV

SEQ ID NO: 27265 - protein, 25 aa, synthetic construct
  source 1..25: note = Seed: YGFLNVIVHSATGFKQSSKALQRPV
YGFLNVIVHSATGFKQWSYALFRPV

SEQ ID NO: 27266 - protein, 25 aa, synthetic construct
  source 1..25: note = Seed: YGFLNVIVHSATGFKQSSKALQRPV
YGFLNVIVHSATGFKQWSYALIRPV

SEQ ID NO: 27267 - protein, 25 aa, synthetic construct
  source 1..25: note = Seed: YGFLNVIVHSATGFKQSSKALQRPV
YGFLNVIVHSATGFKQWSYALLRPV

SEQ ID NO: 27268 - protein, 25 aa, synthetic construct
  source 1..25: note = Seed: YGFLNVIVHSATGFKQSSKALQRPV
YGFLNVIVHSATGFKQWSYALMRPV

SEQ ID NO: 27269 - protein, 25 aa, synthetic construct
  source 1..25: note = Seed: YGFLNVIVHSATGFKQSSKALQRPV
YGFLNVIVHSATGFKQWSYALVRPV

SEQ ID NO: 27270 - protein, 25 aa, synthetic construct
  source 1..25: note = Seed: YGFLNVIVHSATGFKQSSKALQRPV
YGFLNVIVHSATGFKQWSYALWRPV

SEQ ID NO: 27271 - protein, 25 aa, synthetic construct
  source 1..25: note = Seed: YGFLNVIVHSATGFKQSSKALQRPV
YGFLNVIVHSATGFKQWSYALYRPV

SEQ ID NO: 27272 - protein, 25 aa, synthetic construct
  source 1..25: note = Seed: YGFLNVIVHSATGFKQSSKALQRPV
YGFLNVIVHSATGFKQYSAALARPV

SEQ ID NO: 27273 - protein, 25 aa, synthetic construct
  source 1..25: note = Seed: YGFLNVIVHSATGFKQSSKALQRPV
YGFLNVIVHSATGFKQYSAALGRPV

SEQ ID NO: 27274 - protein, 25 aa, synthetic construct
  source 1..25: note = Seed: YGFLNVIVHSATGFKQSSKALQRPV
YGFLNVIVHSATGFKQYSAALIRPV

SEQ ID NO: 27275 - protein, 25 aa, synthetic construct
  source 1..25: note = Seed: YGFLNVIVHSATGFKQSSKALQRPV
YGFLNVIVHSATGFKQYSAALMRPV

SEQ ID NO: 27276 - protein, 25 aa, synthetic construct
  source 1..25: note = Seed: YGFLNVIVHSATGFKQSSKALQRPV
YGFLNVIVHSATGFKQYSAALNRPV

SEQ ID NO: 27277 - protein, 25 aa, synthetic construct
  source 1..25: note = Seed: YGFLNVIVHSATGFKQSSKALQRPV
YGFLNVIVHSATGFKQYSAALSRPV

SEQ ID NO: 27278 - protein, 25 aa, synthetic construct
  source 1..25: note = Seed: YGFLNVIVHSATGFKQSSKALQRPV
YGFLNVIVHSATGFKQYSAALTRPV

SEQ ID NO: 27279 - protein, 25 aa, synthetic construct
  source 1..25: note = Seed: YGFLNVIVHSATGFKQSSKALQRPV
YGFLNVIVHSATGFKQYSAALVRPV

SEQ ID NO: 27280 - protein, 25 aa, synthetic construct
  source 1..25: note = Seed: YGFLNVIVHSATGFKQSSKALQRPV
YGFLNVIVHSATGFKQYSFALFRPV

SEQ ID NO: 27281 - protein, 25 aa, synthetic construct
  source 1..25: note = Seed: YGFLNVIVHSATGFKQSSKALQRPV
YGFLNVIVHSATGFKQYSFALIRPV

SEQ ID NO: 27282 - protein, 25 aa, synthetic construct
  source 1..25: note = Seed: YGFLNVIVHSATGFKQSSKALQRPV
YGFLNVIVHSATGFKQYSFALLRPV

SEQ ID NO: 27283 - protein, 25 aa, synthetic construct
  source 1..25: note = Seed: YGFLNVIVHSATGFKQSSKALQRPV
YGFLNVIVHSATGFKQYSFALMRPV

SEQ ID NO: 27284 - protein, 25 aa, synthetic construct
  source 1..25: note = Seed: YGFLNVIVHSATGFKQSSKALQRPV
YGFLNVIVHSATGFKQYSFALSRPV

SEQ ID NO: 27285 - protein, 25 aa, synthetic construct
  source 1..25: note = Seed: YGFLNVIVHSATGFKQSSKALQRPV
YGFLNVIVHSATGFKQYSFALVRPV

SEQ ID NO: 27286 - protein, 25 aa, synthetic construct
  source 1..25: note = Seed: YGFLNVIVHSATGFKQSSKALQRPV
YGFLNVIVHSATGFKQYSFALWRPV

SEQ ID NO: 27287 - protein, 25 aa, synthetic construct
  source 1..25: note = Seed: YGFLNVIVHSATGFKQSSKALQRPV
YGFLNVIVHSATGFKQYSFALYRPV

SEQ ID NO: 27288 - protein, 25 aa, synthetic construct
  source 1..25: note = Seed: YGFLNVIVHSATGFKQSSKALQRPV
YGFLNVIVHSATGFKQYSGALARPV

SEQ ID NO: 27289 - protein, 25 aa, synthetic construct
  source 1..25: note = Seed: YGFLNVIVHSATGFKQSSKALQRPV
YGFLNVIVHSATGFKQYSHALARPV

SEQ ID NO: 27290 - protein, 25 aa, synthetic construct
  source 1..25: note = Seed: YGFLNVIVHSATGFKQSSKALQRPV
YGFLNVIVHSATGFKQYSHALFRPV

SEQ ID NO: 27291 - protein, 25 aa, synthetic construct
  source 1..25: note = Seed: YGFLNVIVHSATGFKQSSKALQRPV
YGFLNVIVHSATGFKQYSIALARPV

SEQ ID NO: 27292 - protein, 25 aa, synthetic construct
  source 1..25: note = Seed: YGFLNVIVHSATGFKQSSKALQRPV
YGFLNVIVHSATGFKQYSIALGRPV

SEQ ID NO: 27293 - protein, 25 aa, synthetic construct
  source 1..25: note = Seed: YGFLNVIVHSATGFKQSSKALQRPV
YGFLNVIVHSATGFKQYSIALIRPV

SEQ ID NO: 27294 - protein, 25 aa, synthetic construct
  source 1..25: note = Seed: YGFLNVIVHSATGFKQSSKALQRPV
YGFLNVIVHSATGFKQYSIALNRPV

SEQ ID NO: 27295 - protein, 25 aa, synthetic construct
  source 1..25: note = Seed: YGFLNVIVHSATGFKQSSKALQRPV
YGFLNVIVHSATGFKQYSIALSRPV

SEQ ID NO: 27296 - protein, 25 aa, synthetic construct
  source 1..25: note = Seed: YGFLNVIVHSATGFKQSSKALQRPV
YGFLNVIVHSATGFKQYSIALTRPV

SEQ ID NO: 27297 - protein, 25 aa, synthetic construct
  source 1..25: note = Seed: YGFLNVIVHSATGFKQSSKALQRPV
YGFLNVIVHSATGFKQYSIALVRPV

SEQ ID NO: 27298 - protein, 25 aa, synthetic construct
  source 1..25: note = Seed: YGFLNVIVHSATGFKQSSKALQRPV
YGFLNVIVHSATGFKQYSIALYRPV

SEQ ID NO: 27299 - protein, 25 aa, synthetic construct
  source 1..25: note = Seed: YGFLNVIVHSATGFKQSSKALQRPV
YGFLNVIVHSATGFKQYSKALARPV

SEQ ID NO: 27300 - protein, 25 aa, synthetic construct
  source 1..25: note = Seed: YGFLNVIVHSATGFKQSSKALQRPV
YGFLNVIVHSATGFKQYSLALARPV

SEQ ID NO: 27301 - protein, 25 aa, synthetic construct
  source 1..25: note = Seed: YGFLNVIVHSATGFKQSSKALQRPV
YGFLNVIVHSATGFKQYSLALFRPV

SEQ ID NO: 27302 - protein, 25 aa, synthetic construct
  source 1..25: note = Seed: YGFLNVIVHSATGFKQSSKALQRPV
YGFLNVIVHSATGFKQYSLALGRPV

SEQ ID NO: 27303 - protein, 25 aa, synthetic construct
  source 1..25: note = Seed: YGFLNVIVHSATGFKQSSKALQRPV
YGFLNVIVHSATGFKQYSLALLRPV

SEQ ID NO: 27304 - protein, 25 aa, synthetic construct
  source 1..25: note = Seed: YGFLNVIVHSATGFKQSSKALQRPV
YGFLNVIVHSATGFKQYSLALNRPV

SEQ ID NO: 27305 - protein, 25 aa, synthetic construct
  source 1..25: note = Seed: YGFLNVIVHSATGFKQSSKALQRPV
YGFLNVIVHSATGFKQYSLALSRPV

SEQ ID NO: 27306 - protein, 25 aa, synthetic construct
  source 1..25: note = Seed: YGFLNVIVHSATGFKQSSKALQRPV
YGFLNVIVHSATGFKQYSLALTRPV

SEQ ID NO: 27307 - protein, 25 aa, synthetic construct
  source 1..25: note = Seed: YGFLNVIVHSATGFKQSSKALQRPV
YGFLNVIVHSATGFKQYSLALVRPV

SEQ ID NO: 27308 - protein, 25 aa, synthetic construct
  source 1..25: note = Seed: YGFLNVIVHSATGFKQSSKALQRPV
YGFLNVIVHSATGFKQYSLALYRPV

SEQ ID NO: 27309 - protein, 25 aa, synthetic construct
  source 1..25: note = Seed: YGFLNVIVHSATGFKQSSKALQRPV
YGFLNVIVHSATGFKQYSMALFRPV

SEQ ID NO: 27310 - protein, 25 aa, synthetic construct
  source 1..25: note = Seed: YGFLNVIVHSATGFKQSSKALQRPV
YGFLNVIVHSATGFKQYSMALGRPV

SEQ ID NO: 27311 - protein, 25 aa, synthetic construct
  source 1..25: note = Seed: YGFLNVIVHSATGFKQSSKALQRPV
YGFLNVIVHSATGFKQYSMALLRPV

SEQ ID NO: 27312 - protein, 25 aa, synthetic construct
  source 1..25: note = Seed: YGFLNVIVHSATGFKQSSKALQRPV
YGFLNVIVHSATGFKQYSMALNRPV

SEQ ID NO: 27313 - protein, 25 aa, synthetic construct
  source 1..25: note = Seed: YGFLNVIVHSATGFKQSSKALQRPV
YGFLNVIVHSATGFKQYSMALSRPV

SEQ ID NO: 27314 - protein, 25 aa, synthetic construct
  source 1..25: note = Seed: YGFLNVIVHSATGFKQSSKALQRPV
YGFLNVIVHSATGFKQYSMALYRPV

SEQ ID NO: 27315 - protein, 25 aa, synthetic construct
  source 1..25: note = Seed: YGFLNVIVHSATGFKQSSKALQRPV
YGFLNVIVHSATGFKQYSNALARPV

SEQ ID NO: 27316 - protein, 25 aa, synthetic construct
  source 1..25: note = Seed: YGFLNVIVHSATGFKQSSKALQRPV
YGFLNVIVHSATGFKQYSPALARPV

SEQ ID NO: 27317 - protein, 25 aa, synthetic construct
  source 1..25: note = Seed: YGFLNVIVHSATGFKQSSKALQRPV
YGFLNVIVHSATGFKQYSPALNRPV

SEQ ID NO: 27318 - protein, 25 aa, synthetic construct
  source 1..25: note = Seed: YGFLNVIVHSATGFKQSSKALQRPV
YGFLNVIVHSATGFKQYSPALSRPV

SEQ ID NO: 27319 - protein, 25 aa, synthetic construct
  source 1..25: note = Seed: YGFLNVIVHSATGFKQSSKALQRPV
YGFLNVIVHSATGFKQYSQALARPV

SEQ ID NO: 27320 - protein, 25 aa, synthetic construct
  source 1..25: note = Seed: YGFLNVIVHSATGFKQSSKALQRPV
YGFLNVIVHSATGFKQYSQALFRPV

SEQ ID NO: 27321 - protein, 25 aa, synthetic construct
  source 1..25: note = Seed: YGFLNVIVHSATGFKQSSKALQRPV
YGFLNVIVHSATGFKQYSRALARPV

SEQ ID NO: 27322 - protein, 25 aa, synthetic construct
  source 1..25: note = Seed: YGFLNVIVHSATGFKQSSKALQRPV
YGFLNVIVHSATGFKQYSRALRRPV

SEQ ID NO: 27323 - protein, 25 aa, synthetic construct
  source 1..25: note = Seed: YGFLNVIVHSATGFKQSSKALQRPV
YGFLNVIVHSATGFKQYSSALARPV

SEQ ID NO: 27324 - protein, 25 aa, synthetic construct
  source 1..25: note = Seed: YGFLNVIVHSATGFKQSSKALQRPV
YGFLNVIVHSATGFKQYSSALSRPV

SEQ ID NO: 27325 - protein, 25 aa, synthetic construct
  source 1..25: note = Seed: YGFLNVIVHSATGFKQSSKALQRPV
YGFLNVIVHSATGFKQYSSALTRPV

SEQ ID NO: 27326 - protein, 25 aa, synthetic construct
  source 1..25: note = Seed: YGFLNVIVHSATGFKQSSKALQRPV
YGFLNVIVHSATGFKQYSSALVRPV

SEQ ID NO: 27327 - protein, 25 aa, synthetic construct
  source 1..25: note = Seed: YGFLNVIVHSATGFKQSSKALQRPV
YGFLNVIVHSATGFKQYSTALARPV

SEQ ID NO: 27328 - protein, 25 aa, synthetic construct
  source 1..25: note = Seed: YGFLNVIVHSATGFKQSSKALQRPV
YGFLNVIVHSATGFKQYSTALNRPV

SEQ ID NO: 27329 - protein, 25 aa, synthetic construct
  source 1..25: note = Seed: YGFLNVIVHSATGFKQSSKALQRPV
YGFLNVIVHSATGFKQYSTALSRPV

SEQ ID NO: 27330 - protein, 25 aa, synthetic construct
  source 1..25: note = Seed: YGFLNVIVHSATGFKQSSKALQRPV
YGFLNVIVHSATGFKQYSTALTRPV

SEQ ID NO: 27331 - protein, 25 aa, synthetic construct
  source 1..25: note = Seed: YGFLNVIVHSATGFKQSSKALQRPV
YGFLNVIVHSATGFKQYSVALARPV

SEQ ID NO: 27332 - protein, 25 aa, synthetic construct
  source 1..25: note = Seed: YGFLNVIVHSATGFKQSSKALQRPV
YGFLNVIVHSATGFKQYSVALGRPV

SEQ ID NO: 27333 - protein, 25 aa, synthetic construct
  source 1..25: note = Seed: YGFLNVIVHSATGFKQSSKALQRPV
YGFLNVIVHSATGFKQYSVALHRPV

SEQ ID NO: 27334 - protein, 25 aa, synthetic construct
  source 1..25: note = Seed: YGFLNVIVHSATGFKQSSKALQRPV
YGFLNVIVHSATGFKQYSVALNRPV

SEQ ID NO: 27335 - protein, 25 aa, synthetic construct
  source 1..25: note = Seed: YGFLNVIVHSATGFKQSSKALQRPV
YGFLNVIVHSATGFKQYSVALPRPV

SEQ ID NO: 27336 - protein, 25 aa, synthetic construct
  source 1..25: note = Seed: YGFLNVIVHSATGFKQSSKALQRPV
YGFLNVIVHSATGFKQYSVALSRPV

SEQ ID NO: 27337 - protein, 25 aa, synthetic construct
  source 1..25: note = Seed: YGFLNVIVHSATGFKQSSKALQRPV
YGFLNVIVHSATGFKQYSVALTRPV

SEQ ID NO: 27338 - protein, 25 aa, synthetic construct
  source 1..25: note = Seed: YGFLNVIVHSATGFKQSSKALQRPV
YGFLNVIVHSATGFKQYSVALVRPV

SEQ ID NO: 27339 - protein, 25 aa, synthetic construct
  source 1..25: note = Seed: YGFLNVIVHSATGFKQSSKALQRPV
YGFLNVIVHSATGFKQYSWALIRPV

SEQ ID NO: 27340 - protein, 25 aa, synthetic construct
  source 1..25: note = Seed: YGFLNVIVHSATGFKQSSKALQRPV
YGFLNVIVHSATGFKQYSWALLRPV

SEQ ID NO: 27341 - protein, 25 aa, synthetic construct
  source 1..25: note = Seed: YGFLNVIVHSATGFKQSSKALQRPV
YGFLNVIVHSATGFKQYSWALYRPV

SEQ ID NO: 27342 - protein, 25 aa, synthetic construct
  source 1..25: note = Seed: YGFLNVIVHSATGFKQSSKALQRPV
YGFLNVIVHSATGFKQYSYALFRPV

SEQ ID NO: 27343 - protein, 25 aa, synthetic construct
  source 1..25: note = Seed: YGFLNVIVHSATGFKQSSKALQRPV
YGFLNVIVHSATGFKQYSYALIRPV

SEQ ID NO: 27344 - protein, 25 aa, synthetic construct
  source 1..25: note = Seed: YGFLNVIVHSATGFKQSSKALQRPV
YGFLNVIVHSATGFKQYSYALLRPV

SEQ ID NO: 27345 - protein, 25 aa, synthetic construct
  source 1..25: note = Seed: YGFLNVIVHSATGFKQSSKALQRPV
YGFLNVIVHSATGFKQYSYALMRPV

SEQ ID NO: 27346 - protein, 25 aa, synthetic construct
  source 1..25: note = Seed: YGFLNVIVHSATGFKQSSKALQRPV
YGFLNVIVHSATGFKQYSYALWRPV

SEQ ID NO: 27347 - protein, 25 aa, synthetic construct
  source 1..25: note = Seed: YGFLNVIVHSATGFKQSSKALQRPV
YGFLNVIVHSATGFKQYSYALYRPV

SEQ ID NO: 27348 - protein, 25 aa, synthetic construct
  source 1..25: note = Seed: YGFLNVIVHSATGFKQSSKALQRPV
YGFLNVIVHSATGHKQFSFALIRPV

SEQ ID NO: 27349 - protein, 25 aa, synthetic construct
  source 1..25: note = Seed: YGFLNVIVHSATGFKQSSKALQRPV
YGFLNVIVHSATGHKQFSFALLRPV

SEQ ID NO: 27350 - protein, 25 aa, synthetic construct
  source 1..25: note = Seed: YGFLNVIVHSATGFKQSSKALQRPV
YGFLNVIVHSATGHKQFSFALMRPV

SEQ ID NO: 27351 - protein, 25 aa, synthetic construct
  source 1..25: note = Seed: YGFLNVIVHSATGFKQSSKALQRPV
YGFLNVIVHSATGHKQFSPALARPV

SEQ ID NO: 27352 - protein, 25 aa, synthetic construct
  source 1..25: note = Seed: YGFLNVIVHSATGFKQSSKALQRPV
YGFLNVIVHSATGHKQISRALRRPV

SEQ ID NO: 27353 - protein, 25 aa, synthetic construct
  source 1..25: note = Seed: YGFLNVIVHSATGFKQSSKALQRPV
YGFLNVIVHSATGHKQLSAALARPV

SEQ ID NO: 27354 - protein, 25 aa, synthetic construct
  source 1..25: note = Seed: YGFLNVIVHSATGFKQSSKALQRPV
YGFLNVIVHSATGIKQASAALARPV

SEQ ID NO: 27355 - protein, 25 aa, synthetic construct
  source 1..25: note = Seed: YGFLNVIVHSATGFKQSSKALQRPV
YGFLNVIVHSATGIKQASAALFRPV

SEQ ID NO: 27356 - protein, 25 aa, synthetic construct
  source 1..25: note = Seed: YGFLNVIVHSATGFKQSSKALQRPV
YGFLNVIVHSATGIKQASAALHRPV

SEQ ID NO: 27357 - protein, 25 aa, synthetic construct
  source 1..25: note = Seed: YGFLNVIVHSATGFKQSSKALQRPV
YGFLNVIVHSATGIKQASAALIRPV

SEQ ID NO: 27358 - protein, 25 aa, synthetic construct
  source 1..25: note = Seed: YGFLNVIVHSATGFKQSSKALQRPV
YGFLNVIVHSATGIKQASAALLRPV

SEQ ID NO: 27359 - protein, 25 aa, synthetic construct
  source 1..25: note = Seed: YGFLNVIVHSATGFKQSSKALQRPV
YGFLNVIVHSATGIKQASAALMRPV

SEQ ID NO: 27360 - protein, 25 aa, synthetic construct
  source 1..25: note = Seed: YGFLNVIVHSATGFKQSSKALQRPV
YGFLNVIVHSATGIKQASAALNRPV

SEQ ID NO: 27361 - protein, 25 aa, synthetic construct
  source 1..25: note = Seed: YGFLNVIVHSATGFKQSSKALQRPV
YGFLNVIVHSATGIKQASAALQRPV

SEQ ID NO: 27362 - protein, 25 aa, synthetic construct
  source 1..25: note = Seed: YGFLNVIVHSATGFKQSSKALQRPV
YGFLNVIVHSATGIKQASAALRRPV

SEQ ID NO: 27363 - protein, 25 aa, synthetic construct
  source 1..25: note = Seed: YGFLNVIVHSATGFKQSSKALQRPV
YGFLNVIVHSATGIKQASAALSRPV

SEQ ID NO: 27364 - protein, 25 aa, synthetic construct
  source 1..25: note = Seed: YGFLNVIVHSATGFKQSSKALQRPV
YGFLNVIVHSATGIKQASAALTRPV

SEQ ID NO: 27365 - protein, 25 aa, synthetic construct
  source 1..25: note = Seed: YGFLNVIVHSATGFKQSSKALQRPV
YGFLNVIVHSATGIKQASAALVRPV

SEQ ID NO: 27366 - protein, 25 aa, synthetic construct
  source 1..25: note = Seed: YGFLNVIVHSATGFKQSSKALQRPV
YGFLNVIVHSATGIKQASAALYRPV

SEQ ID NO: 27367 - protein, 25 aa, synthetic construct
  source 1..25: note = Seed: YGFLNVIVHSATGFKQSSKALQRPV
YGFLNVIVHSATGIKQASFALFRPV

SEQ ID NO: 27368 - protein, 25 aa, synthetic construct
  source 1..25: note = Seed: YGFLNVIVHSATGFKQSSKALQRPV
YGFLNVIVHSATGIKQASFALIRPV

SEQ ID NO: 27369 - protein, 25 aa, synthetic construct
  source 1..25: note = Seed: YGFLNVIVHSATGFKQSSKALQRPV
YGFLNVIVHSATGIKQASFALLRPV

SEQ ID NO: 27370 - protein, 25 aa, synthetic construct
  source 1..25: note = Seed: YGFLNVIVHSATGFKQSSKALQRPV
YGFLNVIVHSATGIKQASFALVRPV

SEQ ID NO: 27371 - protein, 25 aa, synthetic construct
  source 1..25: note = Seed: YGFLNVIVHSATGFKQSSKALQRPV
YGFLNVIVHSATGIKQASGALIRPV

SEQ ID NO: 27372 - protein, 25 aa, synthetic construct
  source 1..25: note = Seed: YGFLNVIVHSATGFKQSSKALQRPV
YGFLNVIVHSATGIKQASGALNRPV

SEQ ID NO: 27373 - protein, 25 aa, synthetic construct
  source 1..25: note = Seed: YGFLNVIVHSATGFKQSSKALQRPV
YGFLNVIVHSATGIKQASGALVRPV

SEQ ID NO: 27374 - protein, 25 aa, synthetic construct
  source 1..25: note = Seed: YGFLNVIVHSATGFKQSSKALQRPV
YGFLNVIVHSATGIKQASIALARPV

SEQ ID NO: 27375 - protein, 25 aa, synthetic construct
  source 1..25: note = Seed: YGFLNVIVHSATGFKQSSKALQRPV
YGFLNVIVHSATGIKQASIALNRPV

SEQ ID NO: 27376 - protein, 25 aa, synthetic construct
  source 1..25: note = Seed: YGFLNVIVHSATGFKQSSKALQRPV
YGFLNVIVHSATGIKQASIALSRPV

SEQ ID NO: 27377 - protein, 25 aa, synthetic construct
  source 1..25: note = Seed: YGFLNVIVHSATGFKQSSKALQRPV
YGFLNVIVHSATGIKQASKALARPV

SEQ ID NO: 27378 - protein, 25 aa, synthetic construct
  source 1..25: note = Seed: YGFLNVIVHSATGFKQSSKALQRPV
YGFLNVIVHSATGIKQASKALFRPV

SEQ ID NO: 27379 - protein, 25 aa, synthetic construct
  source 1..25: note = Seed: YGFLNVIVHSATGFKQSSKALQRPV
YGFLNVIVHSATGIKQASKALGRPV

SEQ ID NO: 27380 - protein, 25 aa, synthetic construct
  source 1..25: note = Seed: YGFLNVIVHSATGFKQSSKALQRPV
YGFLNVIVHSATGIKQASKALHRPV

SEQ ID NO: 27381 - protein, 25 aa, synthetic construct
  source 1..25: note = Seed: YGFLNVIVHSATGFKQSSKALQRPV
YGFLNVIVHSATGIKQASKALIRPV

SEQ ID NO: 27382 - protein, 25 aa, synthetic construct
  source 1..25: note = Seed: YGFLNVIVHSATGFKQSSKALQRPV
YGFLNVIVHSATGIKQASKALKRPV

SEQ ID NO: 27383 - protein, 25 aa, synthetic construct
  source 1..25: note = Seed: YGFLNVIVHSATGFKQSSKALQRPV
YGFLNVIVHSATGIKQASKALLRPV

SEQ ID NO: 27384 - protein, 25 aa, synthetic construct
  source 1..25: note = Seed: YGFLNVIVHSATGFKQSSKALQRPV
YGFLNVIVHSATGIKQASKALMRPV

SEQ ID NO: 27385 - protein, 25 aa, synthetic construct
  source 1..25: note = Seed: YGFLNVIVHSATGFKQSSKALQRPV
YGFLNVIVHSATGIKQASKALQRPV

SEQ ID NO: 27386 - protein, 25 aa, synthetic construct
  source 1..25: note = Seed: YGFLNVIVHSATGFKQSSKALQRPV
YGFLNVIVHSATGIKQASKALRRPV

SEQ ID NO: 27387 - protein, 25 aa, synthetic construct
  source 1..25: note = Seed: YGFLNVIVHSATGFKQSSKALQRPV
YGFLNVIVHSATGIKQASKALSRPV

SEQ ID NO: 27388 - protein, 25 aa, synthetic construct
  source 1..25: note = Seed: YGFLNVIVHSATGFKQSSKALQRPV
YGFLNVIVHSATGIKQASKALTRPV

SEQ ID NO: 27389 - protein, 25 aa, synthetic construct
  source 1..25: note = Seed: YGFLNVIVHSATGFKQSSKALQRPV
YGFLNVIVHSATGIKQASKALVRPV

SEQ ID NO: 27390 - protein, 25 aa, synthetic construct
  source 1..25: note = Seed: YGFLNVIVHSATGFKQSSKALQRPV
YGFLNVIVHSATGIKQASKALYRPV

SEQ ID NO: 27391 - protein, 25 aa, synthetic construct
  source 1..25: note = Seed: YGFLNVIVHSATGFKQSSKALQRPV
YGFLNVIVHSATGIKQASLALNRPV

SEQ ID NO: 27392 - protein, 25 aa, synthetic construct
  source 1..25: note = Seed: YGFLNVIVHSATGFKQSSKALQRPV
YGFLNVIVHSATGIKQASNALFRPV

SEQ ID NO: 27393 - protein, 25 aa, synthetic construct
  source 1..25: note = Seed: YGFLNVIVHSATGFKQSSKALQRPV
YGFLNVIVHSATGIKQASNALIRPV

SEQ ID NO: 27394 - protein, 25 aa, synthetic construct
  source 1..25: note = Seed: YGFLNVIVHSATGFKQSSKALQRPV
YGFLNVIVHSATGIKQASNALLRPV

SEQ ID NO: 27395 - protein, 25 aa, synthetic construct
  source 1..25: note = Seed: YGFLNVIVHSATGFKQSSKALQRPV
YGFLNVIVHSATGIKQASNALSRPV

SEQ ID NO: 27396 - protein, 25 aa, synthetic construct
  source 1..25: note = Seed: YGFLNVIVHSATGFKQSSKALQRPV
YGFLNVIVHSATGIKQASNALVRPV

SEQ ID NO: 27397 - protein, 25 aa, synthetic construct
  source 1..25: note = Seed: YGFLNVIVHSATGFKQSSKALQRPV
YGFLNVIVHSATGIKQASNALYRPV

SEQ ID NO: 27398 - protein, 25 aa, synthetic construct
  source 1..25: note = Seed: YGFLNVIVHSATGFKQSSKALQRPV
YGFLNVIVHSATGIKQASPALARPV

SEQ ID NO: 27399 - protein, 25 aa, synthetic construct
  source 1..25: note = Seed: YGFLNVIVHSATGFKQSSKALQRPV
YGFLNVIVHSATGIKQASPALIRPV

SEQ ID NO: 27400 - protein, 25 aa, synthetic construct
  source 1..25: note = Seed: YGFLNVIVHSATGFKQSSKALQRPV
YGFLNVIVHSATGIKQASPALMRPV

SEQ ID NO: 27401 - protein, 25 aa, synthetic construct
  source 1..25: note = Seed: YGFLNVIVHSATGFKQSSKALQRPV
YGFLNVIVHSATGIKQASPALNRPV

SEQ ID NO: 27402 - protein, 25 aa, synthetic construct
  source 1..25: note = Seed: YGFLNVIVHSATGFKQSSKALQRPV
YGFLNVIVHSATGIKQASPALQRPV

SEQ ID NO: 27403 - protein, 25 aa, synthetic construct
  source 1..25: note = Seed: YGFLNVIVHSATGFKQSSKALQRPV
YGFLNVIVHSATGIKQASPALSRPV

SEQ ID NO: 27404 - protein, 25 aa, synthetic construct
  source 1..25: note = Seed: YGFLNVIVHSATGFKQSSKALQRPV
YGFLNVIVHSATGIKQASPALTRPV

SEQ ID NO: 27405 - protein, 25 aa, synthetic construct
  source 1..25: note = Seed: YGFLNVIVHSATGFKQSSKALQRPV
YGFLNVIVHSATGIKQASPALVRPV

SEQ ID NO: 27406 - protein, 25 aa, synthetic construct
  source 1..25: note = Seed: YGFLNVIVHSATGFKQSSKALQRPV
YGFLNVIVHSATGIKQASRALARPV

SEQ ID NO: 27407 - protein, 25 aa, synthetic construct
  source 1..25: note = Seed: YGFLNVIVHSATGFKQSSKALQRPV
YGFLNVIVHSATGIKQASRALFRPV

SEQ ID NO: 27408 - protein, 25 aa, synthetic construct
  source 1..25: note = Seed: YGFLNVIVHSATGFKQSSKALQRPV
YGFLNVIVHSATGIKQASRALGRPV

SEQ ID NO: 27409 - protein, 25 aa, synthetic construct
  source 1..25: note = Seed: YGFLNVIVHSATGFKQSSKALQRPV
YGFLNVIVHSATGIKQASRALHRPV

SEQ ID NO: 27410 - protein, 25 aa, synthetic construct
  source 1..25: note = Seed: YGFLNVIVHSATGFKQSSKALQRPV
YGFLNVIVHSATGIKQASRALIRPV

SEQ ID NO: 27411 - protein, 25 aa, synthetic construct
  source 1..25: note = Seed: YGFLNVIVHSATGFKQSSKALQRPV
YGFLNVIVHSATGIKQASRALKRPV

SEQ ID NO: 27412 - protein, 25 aa, synthetic construct
  source 1..25: note = Seed: YGFLNVIVHSATGFKQSSKALQRPV
YGFLNVIVHSATGIKQASRALLRPV

SEQ ID NO: 27413 - protein, 25 aa, synthetic construct
  source 1..25: note = Seed: YGFLNVIVHSATGFKQSSKALQRPV
YGFLNVIVHSATGIKQASRALMRPV

SEQ ID NO: 27414 - protein, 25 aa, synthetic construct
  source 1..25: note = Seed: YGFLNVIVHSATGFKQSSKALQRPV
YGFLNVIVHSATGIKQASRALNRPV

SEQ ID NO: 27415 - protein, 25 aa, synthetic construct
  source 1..25: note = Seed: YGFLNVIVHSATGFKQSSKALQRPV
YGFLNVIVHSATGIKQASRALQRPV

SEQ ID NO: 27416 - protein, 25 aa, synthetic construct
  source 1..25: note = Seed: YGFLNVIVHSATGFKQSSKALQRPV
YGFLNVIVHSATGIKQASRALRRPV

SEQ ID NO: 27417 - protein, 25 aa, synthetic construct
  source 1..25: note = Seed: YGFLNVIVHSATGFKQSSKALQRPV
YGFLNVIVHSATGIKQASRALSRPV

SEQ ID NO: 27418 - protein, 25 aa, synthetic construct
  source 1..25: note = Seed: YGFLNVIVHSATGFKQSSKALQRPV
YGFLNVIVHSATGIKQASRALTRPV

SEQ ID NO: 27419 - protein, 25 aa, synthetic construct
  source 1..25: note = Seed: YGFLNVIVHSATGFKQSSKALQRPV
YGFLNVIVHSATGIKQASRALVRPV

SEQ ID NO: 27420 - protein, 25 aa, synthetic construct
  source 1..25: note = Seed: YGFLNVIVHSATGFKQSSKALQRPV
YGFLNVIVHSATGIKQASRALYRPV

SEQ ID NO: 27421 - protein, 25 aa, synthetic construct
  source 1..25: note = Seed: YGFLNVIVHSATGFKQSSKALQRPV
YGFLNVIVHSATGIKQASSALARPV

SEQ ID NO: 27422 - protein, 25 aa, synthetic construct
  source 1..25: note = Seed: YGFLNVIVHSATGFKQSSKALQRPV
YGFLNVIVHSATGIKQASSALFRPV

SEQ ID NO: 27423 - protein, 25 aa, synthetic construct
  source 1..25: note = Seed: YGFLNVIVHSATGFKQSSKALQRPV
YGFLNVIVHSATGIKQASSALIRPV

SEQ ID NO: 27424 - protein, 25 aa, synthetic construct
  source 1..25: note = Seed: YGFLNVIVHSATGFKQSSKALQRPV
YGFLNVIVHSATGIKQASSALLRPV

SEQ ID NO: 27425 - protein, 25 aa, synthetic construct
  source 1..25: note = Seed: YGFLNVIVHSATGFKQSSKALQRPV
YGFLNVIVHSATGIKQASSALNRPV

SEQ ID NO: 27426 - protein, 25 aa, synthetic construct
  source 1..25: note = Seed: YGFLNVIVHSATGFKQSSKALQRPV
YGFLNVIVHSATGIKQASSALSRPV

SEQ ID NO: 27427 - protein, 25 aa, synthetic construct
  source 1..25: note = Seed: YGFLNVIVHSATGFKQSSKALQRPV
YGFLNVIVHSATGIKQASSALVRPV

SEQ ID NO: 27428 - protein, 25 aa, synthetic construct
  source 1..25: note = Seed: YGFLNVIVHSATGFKQSSKALQRPV
YGFLNVIVHSATGIKQASTALARPV

SEQ ID NO: 27429 - protein, 25 aa, synthetic construct
  source 1..25: note = Seed: YGFLNVIVHSATGFKQSSKALQRPV
YGFLNVIVHSATGIKQASTALIRPV

SEQ ID NO: 27430 - protein, 25 aa, synthetic construct
  source 1..25: note = Seed: YGFLNVIVHSATGFKQSSKALQRPV
YGFLNVIVHSATGIKQASTALNRPV

SEQ ID NO: 27431 - protein, 25 aa, synthetic construct
  source 1..25: note = Seed: YGFLNVIVHSATGFKQSSKALQRPV
YGFLNVIVHSATGIKQASTALSRPV

SEQ ID NO: 27432 - protein, 25 aa, synthetic construct
  source 1..25: note = Seed: YGFLNVIVHSATGFKQSSKALQRPV
YGFLNVIVHSATGIKQASTALVRPV

SEQ ID NO: 27433 - protein, 25 aa, synthetic construct
  source 1..25: note = Seed: YGFLNVIVHSATGFKQSSKALQRPV
YGFLNVIVHSATGIKQASVALARPV

SEQ ID NO: 27434 - protein, 25 aa, synthetic construct
  source 1..25: note = Seed: YGFLNVIVHSATGFKQSSKALQRPV
YGFLNVIVHSATGIKQASVALHRPV

SEQ ID NO: 27435 - protein, 25 aa, synthetic construct
  source 1..25: note = Seed: YGFLNVIVHSATGFKQSSKALQRPV
YGFLNVIVHSATGIKQASVALNRPV

SEQ ID NO: 27436 - protein, 25 aa, synthetic construct
  source 1..25: note = Seed: YGFLNVIVHSATGFKQSSKALQRPV
YGFLNVIVHSATGIKQASVALSRPV

SEQ ID NO: 27437 - protein, 25 aa, synthetic construct
  source 1..25: note = Seed: YGFLNVIVHSATGFKQSSKALQRPV
YGFLNVIVHSATGIKQASVALTRPV

SEQ ID NO: 27438 - protein, 25 aa, synthetic construct
  source 1..25: note = Seed: YGFLNVIVHSATGFKQSSKALQRPV
YGFLNVIVHSATGIKQCSFALFRPV

SEQ ID NO: 27439 - protein, 25 aa, synthetic construct
  source 1..25: note = Seed: YGFLNVIVHSATGFKQSSKALQRPV
YGFLNVIVHSATGIKQCSKALARPV

SEQ ID NO: 27440 - protein, 25 aa, synthetic construct
  source 1..25: note = Seed: YGFLNVIVHSATGFKQSSKALQRPV
YGFLNVIVHSATGIKQCSKALSRPV

SEQ ID NO: 27441 - protein, 25 aa, synthetic construct
  source 1..25: note = Seed: YGFLNVIVHSATGFKQSSKALQRPV
YGFLNVIVHSATGIKQCSRALARPV

SEQ ID NO: 27442 - protein, 25 aa, synthetic construct
  source 1..25: note = Seed: YGFLNVIVHSATGFKQSSKALQRPV
YGFLNVIVHSATGIKQCSRALGRPV

SEQ ID NO: 27443 - protein, 25 aa, synthetic construct
  source 1..25: note = Seed: YGFLNVIVHSATGFKQSSKALQRPV
YGFLNVIVHSATGIKQCSRALQRPV

SEQ ID NO: 27444 - protein, 25 aa, synthetic construct
  source 1..25: note = Seed: YGFLNVIVHSATGFKQSSKALQRPV
YGFLNVIVHSATGIKQCSRALSRPV

SEQ ID NO: 27445 - protein, 25 aa, synthetic construct
  source 1..25: note = Seed: YGFLNVIVHSATGFKQSSKALQRPV
YGFLNVIVHSATGIKQDSAALFRPV

SEQ ID NO: 27446 - protein, 25 aa, synthetic construct
  source 1..25: note = Seed: YGFLNVIVHSATGFKQSSKALQRPV
YGFLNVIVHSATGIKQDSAALIRPV

SEQ ID NO: 27447 - protein, 25 aa, synthetic construct
  source 1..25: note = Seed: YGFLNVIVHSATGFKQSSKALQRPV
YGFLNVIVHSATGIKQDSAALLRPV

SEQ ID NO: 27448 - protein, 25 aa, synthetic construct
  source 1..25: note = Seed: YGFLNVIVHSATGFKQSSKALQRPV
YGFLNVIVHSATGIKQDSAALVRPV

SEQ ID NO: 27449 - protein, 25 aa, synthetic construct
  source 1..25: note = Seed: YGFLNVIVHSATGFKQSSKALQRPV
YGFLNVIVHSATGIKQDSAALYRPV

SEQ ID NO: 27450 - protein, 25 aa, synthetic construct
  source 1..25: note = Seed: YGFLNVIVHSATGFKQSSKALQRPV
YGFLNVIVHSATGIKQDSGALIRPV

SEQ ID NO: 27451 - protein, 25 aa, synthetic construct
  source 1..25: note = Seed: YGFLNVIVHSATGFKQSSKALQRPV
YGFLNVIVHSATGIKQDSGALVRPV

SEQ ID NO: 27452 - protein, 25 aa, synthetic construct
  source 1..25: note = Seed: YGFLNVIVHSATGFKQSSKALQRPV
YGFLNVIVHSATGIKQDSIALIRPV

SEQ ID NO: 27453 - protein, 25 aa, synthetic construct
  source 1..25: note = Seed: YGFLNVIVHSATGFKQSSKALQRPV
YGFLNVIVHSATGIKQDSIALVRPV

SEQ ID NO: 27454 - protein, 25 aa, synthetic construct
  source 1..25: note = Seed: YGFLNVIVHSATGFKQSSKALQRPV
YGFLNVIVHSATGIKQDSNALARPV

SEQ ID NO: 27455 - protein, 25 aa, synthetic construct
  source 1..25: note = Seed: YGFLNVIVHSATGFKQSSKALQRPV
YGFLNVIVHSATGIKQDSNALIRPV

SEQ ID NO: 27456 - protein, 25 aa, synthetic construct
  source 1..25: note = Seed: YGFLNVIVHSATGFKQSSKALQRPV
YGFLNVIVHSATGIKQDSNALSRPV

SEQ ID NO: 27457 - protein, 25 aa, synthetic construct
  source 1..25: note = Seed: YGFLNVIVHSATGFKQSSKALQRPV
YGFLNVIVHSATGIKQDSNALVRPV

SEQ ID NO: 27458 - protein, 25 aa, synthetic construct
  source 1..25: note = Seed: YGFLNVIVHSATGFKQSSKALQRPV
YGFLNVIVHSATGIKQDSPALIRPV

SEQ ID NO: 27459 - protein, 25 aa, synthetic construct
  source 1..25: note = Seed: YGFLNVIVHSATGFKQSSKALQRPV
YGFLNVIVHSATGIKQDSPALVRPV

SEQ ID NO: 27460 - protein, 25 aa, synthetic construct
  source 1..25: note = Seed: YGFLNVIVHSATGFKQSSKALQRPV
YGFLNVIVHSATGIKQDSSALIRPV

SEQ ID NO: 27461 - protein, 25 aa, synthetic construct
  source 1..25: note = Seed: YGFLNVIVHSATGFKQSSKALQRPV
YGFLNVIVHSATGIKQDSSALVRPV

SEQ ID NO: 27462 - protein, 25 aa, synthetic construct
  source 1..25: note = Seed: YGFLNVIVHSATGFKQSSKALQRPV
YGFLNVIVHSATGIKQDSTALARPV

SEQ ID NO: 27463 - protein, 25 aa, synthetic construct
  source 1..25: note = Seed: YGFLNVIVHSATGFKQSSKALQRPV
YGFLNVIVHSATGIKQDSTALIRPV

SEQ ID NO: 27464 - protein, 25 aa, synthetic construct
  source 1..25: note = Seed: YGFLNVIVHSATGFKQSSKALQRPV
YGFLNVIVHSATGIKQDSTALSRPV

SEQ ID NO: 27465 - protein, 25 aa, synthetic construct
  source 1..25: note = Seed: YGFLNVIVHSATGFKQSSKALQRPV
YGFLNVIVHSATGIKQDSTALVRPV

SEQ ID NO: 27466 - protein, 25 aa, synthetic construct
  source 1..25: note = Seed: YGFLNVIVHSATGFKQSSKALQRPV
YGFLNVIVHSATGIKQDSVALIRPV

SEQ ID NO: 27467 - protein, 25 aa, synthetic construct
  source 1..25: note = Seed: YGFLNVIVHSATGFKQSSKALQRPV
YGFLNVIVHSATGIKQDSVALVRPV

SEQ ID NO: 27468 - protein, 25 aa, synthetic construct
  source 1..25: note = Seed: YGFLNVIVHSATGFKQSSKALQRPV
YGFLNVIVHSATGIKQESAALIRPV

SEQ ID NO: 27469 - protein, 25 aa, synthetic construct
  source 1..25: note = Seed: YGFLNVIVHSATGFKQSSKALQRPV
YGFLNVIVHSATGIKQESFALFRPV

SEQ ID NO: 27470 - protein, 25 aa, synthetic construct
  source 1..25: note = Seed: YGFLNVIVHSATGFKQSSKALQRPV
YGFLNVIVHSATGIKQESFALIRPV

SEQ ID NO: 27471 - protein, 25 aa, synthetic construct
  source 1..25: note = Seed: YGFLNVIVHSATGFKQSSKALQRPV
YGFLNVIVHSATGIKQESFALLRPV

SEQ ID NO: 27472 - protein, 25 aa, synthetic construct
  source 1..25: note = Seed: YGFLNVIVHSATGFKQSSKALQRPV
YGFLNVIVHSATGIKQESFALVRPV

SEQ ID NO: 27473 - protein, 25 aa, synthetic construct
  source 1..25: note = Seed: YGFLNVIVHSATGFKQSSKALQRPV
YGFLNVIVHSATGIKQESNALIRPV

SEQ ID NO: 27474 - protein, 25 aa, synthetic construct
  source 1..25: note = Seed: YGFLNVIVHSATGFKQSSKALQRPV
YGFLNVIVHSATGIKQFSAALARPV

SEQ ID NO: 27475 - protein, 25 aa, synthetic construct
  source 1..25: note = Seed: YGFLNVIVHSATGFKQSSKALQRPV
YGFLNVIVHSATGIKQFSAALFRPV

SEQ ID NO: 27476 - protein, 25 aa, synthetic construct
  source 1..25: note = Seed: YGFLNVIVHSATGFKQSSKALQRPV
YGFLNVIVHSATGIKQFSAALGRPV

SEQ ID NO: 27477 - protein, 25 aa, synthetic construct
  source 1..25: note = Seed: YGFLNVIVHSATGFKQSSKALQRPV
YGFLNVIVHSATGIKQFSAALIRPV

SEQ ID NO: 27478 - protein, 25 aa, synthetic construct
  source 1..25: note = Seed: YGFLNVIVHSATGFKQSSKALQRPV
YGFLNVIVHSATGIKQFSAALLRPV

SEQ ID NO: 27479 - protein, 25 aa, synthetic construct
  source 1..25: note = Seed: YGFLNVIVHSATGFKQSSKALQRPV
YGFLNVIVHSATGIKQFSAALNRPV

SEQ ID NO: 27480 - protein, 25 aa, synthetic construct
  source 1..25: note = Seed: YGFLNVIVHSATGFKQSSKALQRPV
YGFLNVIVHSATGIKQFSAALPRPV

SEQ ID NO: 27481 - protein, 25 aa, synthetic construct
  source 1..25: note = Seed: YGFLNVIVHSATGFKQSSKALQRPV
YGFLNVIVHSATGIKQFSAALRRPV

SEQ ID NO: 27482 - protein, 25 aa, synthetic construct
  source 1..25: note = Seed: YGFLNVIVHSATGFKQSSKALQRPV
YGFLNVIVHSATGIKQFSAALSRPV

SEQ ID NO: 27483 - protein, 25 aa, synthetic construct
  source 1..25: note = Seed: YGFLNVIVHSATGFKQSSKALQRPV
YGFLNVIVHSATGIKQFSAALTRPV

SEQ ID NO: 27484 - protein, 25 aa, synthetic construct
  source 1..25: note = Seed: YGFLNVIVHSATGFKQSSKALQRPV
YGFLNVIVHSATGIKQFSAALVRPV

SEQ ID NO: 27485 - protein, 25 aa, synthetic construct
  source 1..25: note = Seed: YGFLNVIVHSATGFKQSSKALQRPV
YGFLNVIVHSATGIKQFSAALWRPV

SEQ ID NO: 27486 - protein, 25 aa, synthetic construct
  source 1..25: note = Seed: YGFLNVIVHSATGFKQSSKALQRPV
YGFLNVIVHSATGIKQFSAALYRPV

SEQ ID NO: 27487 - protein, 25 aa, synthetic construct
  source 1..25: note = Seed: YGFLNVIVHSATGFKQSSKALQRPV
YGFLNVIVHSATGIKQFSEALFRPV

SEQ ID NO: 27488 - protein, 25 aa, synthetic construct
  source 1..25: note = Seed: YGFLNVIVHSATGFKQSSKALQRPV
YGFLNVIVHSATGIKQFSFALERPV

SEQ ID NO: 27489 - protein, 25 aa, synthetic construct
  source 1..25: note = Seed: YGFLNVIVHSATGFKQSSKALQRPV
YGFLNVIVHSATGIKQFSFALFRPV

SEQ ID NO: 27490 - protein, 25 aa, synthetic construct
  source 1..25: note = Seed: YGFLNVIVHSATGFKQSSKALQRPV
YGFLNVIVHSATGIKQFSFALIRPV

SEQ ID NO: 27491 - protein, 25 aa, synthetic construct
  source 1..25: note = Seed: YGFLNVIVHSATGFKQSSKALQRPV
YGFLNVIVHSATGIKQFSFALLRPV

SEQ ID NO: 27492 - protein, 25 aa, synthetic construct
  source 1..25: note = Seed: YGFLNVIVHSATGFKQSSKALQRPV
YGFLNVIVHSATGIKQFSFALMRPV

SEQ ID NO: 27493 - protein, 25 aa, synthetic construct
  source 1..25: note = Seed: YGFLNVIVHSATGFKQSSKALQRPV
YGFLNVIVHSATGIKQFSFALVRPV

SEQ ID NO: 27494 - protein, 25 aa, synthetic construct
  source 1..25: note = Seed: YGFLNVIVHSATGFKQSSKALQRPV
YGFLNVIVHSATGIKQFSFALWRPV

SEQ ID NO: 27495 - protein, 25 aa, synthetic construct
  source 1..25: note = Seed: YGFLNVIVHSATGFKQSSKALQRPV
YGFLNVIVHSATGIKQFSFALYRPV

SEQ ID NO: 27496 - protein, 25 aa, synthetic construct
  source 1..25: note = Seed: YGFLNVIVHSATGFKQSSKALQRPV
YGFLNVIVHSATGIKQFSGALARPV

SEQ ID NO: 27497 - protein, 25 aa, synthetic construct
  source 1..25: note = Seed: YGFLNVIVHSATGFKQSSKALQRPV
YGFLNVIVHSATGIKQFSHALARPV

SEQ ID NO: 27498 - protein, 25 aa, synthetic construct
  source 1..25: note = Seed: YGFLNVIVHSATGFKQSSKALQRPV
YGFLNVIVHSATGIKQFSHALFRPV

SEQ ID NO: 27499 - protein, 25 aa, synthetic construct
  source 1..25: note = Seed: YGFLNVIVHSATGFKQSSKALQRPV
YGFLNVIVHSATGIKQFSHALRRPV

SEQ ID NO: 27500 - protein, 25 aa, synthetic construct
  source 1..25: note = Seed: YGFLNVIVHSATGFKQSSKALQRPV
YGFLNVIVHSATGIKQFSHALSRPV

SEQ ID NO: 27501 - protein, 25 aa, synthetic construct
  source 1..25: note = Seed: YGFLNVIVHSATGFKQSSKALQRPV
YGFLNVIVHSATGIKQFSIALARPV

SEQ ID NO: 27502 - protein, 25 aa, synthetic construct
  source 1..25: note = Seed: YGFLNVIVHSATGFKQSSKALQRPV
YGFLNVIVHSATGIKQFSIALFRPV

SEQ ID NO: 27503 - protein, 25 aa, synthetic construct
  source 1..25: note = Seed: YGFLNVIVHSATGFKQSSKALQRPV
YGFLNVIVHSATGIKQFSIALGRPV

SEQ ID NO: 27504 - protein, 25 aa, synthetic construct
  source 1..25: note = Seed: YGFLNVIVHSATGFKQSSKALQRPV
YGFLNVIVHSATGIKQFSIALLRPV

SEQ ID NO: 27505 - protein, 25 aa, synthetic construct
  source 1..25: note = Seed: YGFLNVIVHSATGFKQSSKALQRPV
YGFLNVIVHSATGIKQFSIALMRPV

SEQ ID NO: 27506 - protein, 25 aa, synthetic construct
  source 1..25: note = Seed: YGFLNVIVHSATGFKQSSKALQRPV
YGFLNVIVHSATGIKQFSIALNRPV

SEQ ID NO: 27507 - protein, 25 aa, synthetic construct
  source 1..25: note = Seed: YGFLNVIVHSATGFKQSSKALQRPV
YGFLNVIVHSATGIKQFSIALRRPV

SEQ ID NO: 27508 - protein, 25 aa, synthetic construct
  source 1..25: note = Seed: YGFLNVIVHSATGFKQSSKALQRPV
YGFLNVIVHSATGIKQFSIALSRPV

SEQ ID NO: 27509 - protein, 25 aa, synthetic construct
  source 1..25: note = Seed: YGFLNVIVHSATGFKQSSKALQRPV
YGFLNVIVHSATGIKQFSIALTRPV

SEQ ID NO: 27510 - protein, 25 aa, synthetic construct
  source 1..25: note = Seed: YGFLNVIVHSATGFKQSSKALQRPV
YGFLNVIVHSATGIKQFSIALVRPV

SEQ ID NO: 27511 - protein, 25 aa, synthetic construct
  source 1..25: note = Seed: YGFLNVIVHSATGFKQSSKALQRPV
YGFLNVIVHSATGIKQFSIALYRPV

SEQ ID NO: 27512 - protein, 25 aa, synthetic construct
  source 1..25: note = Seed: YGFLNVIVHSATGFKQSSKALQRPV
YGFLNVIVHSATGIKQFSKALARPV

SEQ ID NO: 27513 - protein, 25 aa, synthetic construct
  source 1..25: note = Seed: YGFLNVIVHSATGFKQSSKALQRPV
YGFLNVIVHSATGIKQFSKALFRPV

SEQ ID NO: 27514 - protein, 25 aa, synthetic construct
  source 1..25: note = Seed: YGFLNVIVHSATGFKQSSKALQRPV
YGFLNVIVHSATGIKQFSKALGRPV

SEQ ID NO: 27515 - protein, 25 aa, synthetic construct
  source 1..25: note = Seed: YGFLNVIVHSATGFKQSSKALQRPV
YGFLNVIVHSATGIKQFSKALHRPV

SEQ ID NO: 27516 - protein, 25 aa, synthetic construct
  source 1..25: note = Seed: YGFLNVIVHSATGFKQSSKALQRPV
YGFLNVIVHSATGIKQFSKALIRPV

SEQ ID NO: 27517 - protein, 25 aa, synthetic construct
  source 1..25: note = Seed: YGFLNVIVHSATGFKQSSKALQRPV
YGFLNVIVHSATGIKQFSKALKRPV

SEQ ID NO: 27518 - protein, 25 aa, synthetic construct
  source 1..25: note = Seed: YGFLNVIVHSATGFKQSSKALQRPV
YGFLNVIVHSATGIKQFSKALLRPV

SEQ ID NO: 27519 - protein, 25 aa, synthetic construct
  source 1..25: note = Seed: YGFLNVIVHSATGFKQSSKALQRPV
YGFLNVIVHSATGIKQFSKALMRPV

SEQ ID NO: 27520 - protein, 25 aa, synthetic construct
  source 1..25: note = Seed: YGFLNVIVHSATGFKQSSKALQRPV
YGFLNVIVHSATGIKQFSKALNRPV

SEQ ID NO: 27521 - protein, 25 aa, synthetic construct
  source 1..25: note = Seed: YGFLNVIVHSATGFKQSSKALQRPV
YGFLNVIVHSATGIKQFSKALQRPV

SEQ ID NO: 27522 - protein, 25 aa, synthetic construct
  source 1..25: note = Seed: YGFLNVIVHSATGFKQSSKALQRPV
YGFLNVIVHSATGIKQFSKALRRPV

SEQ ID NO: 27523 - protein, 25 aa, synthetic construct
  source 1..25: note = Seed: YGFLNVIVHSATGFKQSSKALQRPV
YGFLNVIVHSATGIKQFSKALSRPV

SEQ ID NO: 27524 - protein, 25 aa, synthetic construct
  source 1..25: note = Seed: YGFLNVIVHSATGFKQSSKALQRPV
YGFLNVIVHSATGIKQFSKALTRPV

SEQ ID NO: 27525 - protein, 25 aa, synthetic construct
  source 1..25: note = Seed: YGFLNVIVHSATGFKQSSKALQRPV
YGFLNVIVHSATGIKQFSKALVRPV

SEQ ID NO: 27526 - protein, 25 aa, synthetic construct
  source 1..25: note = Seed: YGFLNVIVHSATGFKQSSKALQRPV
YGFLNVIVHSATGIKQFSKALYRPV

SEQ ID NO: 27527 - protein, 25 aa, synthetic construct
  source 1..25: note = Seed: YGFLNVIVHSATGFKQSSKALQRPV
YGFLNVIVHSATGIKQFSLALARPV

SEQ ID NO: 27528 - protein, 25 aa, synthetic construct
  source 1..25: note = Seed: YGFLNVIVHSATGFKQSSKALQRPV
YGFLNVIVHSATGIKQFSLALFRPV

SEQ ID NO: 27529 - protein, 25 aa, synthetic construct
  source 1..25: note = Seed: YGFLNVIVHSATGFKQSSKALQRPV
YGFLNVIVHSATGIKQFSLALGRPV

SEQ ID NO: 27530 - protein, 25 aa, synthetic construct
  source 1..25: note = Seed: YGFLNVIVHSATGFKQSSKALQRPV
YGFLNVIVHSATGIKQFSLALLRPV

SEQ ID NO: 27531 - protein, 25 aa, synthetic construct
  source 1..25: note = Seed: YGFLNVIVHSATGFKQSSKALQRPV
YGFLNVIVHSATGIKQFSLALMRPV

SEQ ID NO: 27532 - protein, 25 aa, synthetic construct
  source 1..25: note = Seed: YGFLNVIVHSATGFKQSSKALQRPV
YGFLNVIVHSATGIKQFSLALNRPV

SEQ ID NO: 27533 - protein, 25 aa, synthetic construct
  source 1..25: note = Seed: YGFLNVIVHSATGFKQSSKALQRPV
YGFLNVIVHSATGIKQFSLALRRPV

SEQ ID NO: 27534 - protein, 25 aa, synthetic construct
  source 1..25: note = Seed: YGFLNVIVHSATGFKQSSKALQRPV
YGFLNVIVHSATGIKQFSLALSRPV

SEQ ID NO: 27535 - protein, 25 aa, synthetic construct
  source 1..25: note = Seed: YGFLNVIVHSATGFKQSSKALQRPV
YGFLNVIVHSATGIKQFSLALYRPV

SEQ ID NO: 27536 - protein, 25 aa, synthetic construct
  source 1..25: note = Seed: YGFLNVIVHSATGFKQSSKALQRPV
YGFLNVIVHSATGIKQFSMALFRPV

SEQ ID NO: 27537 - protein, 25 aa, synthetic construct
  source 1..25: note = Seed: YGFLNVIVHSATGFKQSSKALQRPV
YGFLNVIVHSATGIKQFSMALGRPV

SEQ ID NO: 27538 - protein, 25 aa, synthetic construct
  source 1..25: note = Seed: YGFLNVIVHSATGFKQSSKALQRPV
YGFLNVIVHSATGIKQFSMALLRPV

SEQ ID NO: 27539 - protein, 25 aa, synthetic construct
  source 1..25: note = Seed: YGFLNVIVHSATGFKQSSKALQRPV
YGFLNVIVHSATGIKQFSMALMRPV

SEQ ID NO: 27540 - protein, 25 aa, synthetic construct
  source 1..25: note = Seed: YGFLNVIVHSATGFKQSSKALQRPV
YGFLNVIVHSATGIKQFSMALNRPV

SEQ ID NO: 27541 - protein, 25 aa, synthetic construct
  source 1..25: note = Seed: YGFLNVIVHSATGFKQSSKALQRPV
YGFLNVIVHSATGIKQFSMALRRPV

SEQ ID NO: 27542 - protein, 25 aa, synthetic construct
  source 1..25: note = Seed: YGFLNVIVHSATGFKQSSKALQRPV
YGFLNVIVHSATGIKQFSMALSRPV

SEQ ID NO: 27543 - protein, 25 aa, synthetic construct
  source 1..25: note = Seed: YGFLNVIVHSATGFKQSSKALQRPV
YGFLNVIVHSATGIKQFSMALYRPV

SEQ ID NO: 27544 - protein, 25 aa, synthetic construct
  source 1..25: note = Seed: YGFLNVIVHSATGFKQSSKALQRPV
YGFLNVIVHSATGIKQFSNALARPV

SEQ ID NO: 27545 - protein, 25 aa, synthetic construct
  source 1..25: note = Seed: YGFLNVIVHSATGFKQSSKALQRPV
YGFLNVIVHSATGIKQFSNALRRPV

SEQ ID NO: 27546 - protein, 25 aa, synthetic construct
  source 1..25: note = Seed: YGFLNVIVHSATGFKQSSKALQRPV
YGFLNVIVHSATGIKQFSPALARPV

SEQ ID NO: 27547 - protein, 25 aa, synthetic construct
  source 1..25: note = Seed: YGFLNVIVHSATGFKQSSKALQRPV
YGFLNVIVHSATGIKQFSPALNRPV

SEQ ID NO: 27548 - protein, 25 aa, synthetic construct
  source 1..25: note = Seed: YGFLNVIVHSATGFKQSSKALQRPV
YGFLNVIVHSATGIKQFSPALRRPV

SEQ ID NO: 27549 - protein, 25 aa, synthetic construct
  source 1..25: note = Seed: YGFLNVIVHSATGFKQSSKALQRPV
YGFLNVIVHSATGIKQFSPALSRPV

SEQ ID NO: 27550 - protein, 25 aa, synthetic construct
  source 1..25: note = Seed: YGFLNVIVHSATGFKQSSKALQRPV
YGFLNVIVHSATGIKQFSPALTRPV

SEQ ID NO: 27551 - protein, 25 aa, synthetic construct
  source 1..25: note = Seed: YGFLNVIVHSATGFKQSSKALQRPV
YGFLNVIVHSATGIKQFSPALVRPV

SEQ ID NO: 27552 - protein, 25 aa, synthetic construct
  source 1..25: note = Seed: YGFLNVIVHSATGFKQSSKALQRPV
YGFLNVIVHSATGIKQFSRALARPV

SEQ ID NO: 27553 - protein, 25 aa, synthetic construct
  source 1..25: note = Seed: YGFLNVIVHSATGFKQSSKALQRPV
YGFLNVIVHSATGIKQFSRALERPV

SEQ ID NO: 27554 - protein, 25 aa, synthetic construct
  source 1..25: note = Seed: YGFLNVIVHSATGFKQSSKALQRPV
YGFLNVIVHSATGIKQFSRALFRPV

SEQ ID NO: 27555 - protein, 25 aa, synthetic construct
  source 1..25: note = Seed: YGFLNVIVHSATGFKQSSKALQRPV
YGFLNVIVHSATGIKQFSRALGRPV

SEQ ID NO: 27556 - protein, 25 aa, synthetic construct
  source 1..25: note = Seed: YGFLNVIVHSATGFKQSSKALQRPV
YGFLNVIVHSATGIKQFSRALHRPV

SEQ ID NO: 27557 - protein, 25 aa, synthetic construct
  source 1..25: note = Seed: YGFLNVIVHSATGFKQSSKALQRPV
YGFLNVIVHSATGIKQFSRALIRPV

SEQ ID NO: 27558 - protein, 25 aa, synthetic construct
  source 1..25: note = Seed: YGFLNVIVHSATGFKQSSKALQRPV
YGFLNVIVHSATGIKQFSRALKRPV

SEQ ID NO: 27559 - protein, 25 aa, synthetic construct
  source 1..25: note = Seed: YGFLNVIVHSATGFKQSSKALQRPV
YGFLNVIVHSATGIKQFSRALLRPV

SEQ ID NO: 27560 - protein, 25 aa, synthetic construct
  source 1..25: note = Seed: YGFLNVIVHSATGFKQSSKALQRPV
YGFLNVIVHSATGIKQFSRALMRPV

SEQ ID NO: 27561 - protein, 25 aa, synthetic construct
  source 1..25: note = Seed: YGFLNVIVHSATGFKQSSKALQRPV
YGFLNVIVHSATGIKQFSRALNRPV

SEQ ID NO: 27562 - protein, 25 aa, synthetic construct
  source 1..25: note = Seed: YGFLNVIVHSATGFKQSSKALQRPV
YGFLNVIVHSATGIKQFSRALQRPV

SEQ ID NO: 27563 - protein, 25 aa, synthetic construct
  source 1..25: note = Seed: YGFLNVIVHSATGFKQSSKALQRPV
YGFLNVIVHSATGIKQFSRALRRPV

SEQ ID NO: 27564 - protein, 25 aa, synthetic construct
  source 1..25: note = Seed: YGFLNVIVHSATGFKQSSKALQRPV
YGFLNVIVHSATGIKQFSRALSRPV

SEQ ID NO: 27565 - protein, 25 aa, synthetic construct
  source 1..25: note = Seed: YGFLNVIVHSATGFKQSSKALQRPV
YGFLNVIVHSATGIKQFSRALTRPV

SEQ ID NO: 27566 - protein, 25 aa, synthetic construct
  source 1..25: note = Seed: YGFLNVIVHSATGFKQSSKALQRPV
YGFLNVIVHSATGIKQFSRALVRPV

SEQ ID NO: 27567 - protein, 25 aa, synthetic construct
  source 1..25: note = Seed: YGFLNVIVHSATGFKQSSKALQRPV
YGFLNVIVHSATGIKQFSRALYRPV

SEQ ID NO: 27568 - protein, 25 aa, synthetic construct
  source 1..25: note = Seed: YGFLNVIVHSATGFKQSSKALQRPV
YGFLNVIVHSATGIKQFSSALARPV

SEQ ID NO: 27569 - protein, 25 aa, synthetic construct
  source 1..25: note = Seed: YGFLNVIVHSATGFKQSSKALQRPV
YGFLNVIVHSATGIKQFSSALFRPV

SEQ ID NO: 27570 - protein, 25 aa, synthetic construct
  source 1..25: note = Seed: YGFLNVIVHSATGFKQSSKALQRPV
YGFLNVIVHSATGIKQFSSALRRPV

SEQ ID NO: 27571 - protein, 25 aa, synthetic construct
  source 1..25: note = Seed: YGFLNVIVHSATGFKQSSKALQRPV
YGFLNVIVHSATGIKQFSSALSRPV

SEQ ID NO: 27572 - protein, 25 aa, synthetic construct
  source 1..25: note = Seed: YGFLNVIVHSATGFKQSSKALQRPV
YGFLNVIVHSATGIKQFSSALTRPV

SEQ ID NO: 27573 - protein, 25 aa, synthetic construct
  source 1..25: note = Seed: YGFLNVIVHSATGFKQSSKALQRPV
YGFLNVIVHSATGIKQFSSALVRPV

SEQ ID NO: 27574 - protein, 25 aa, synthetic construct
  source 1..25: note = Seed: YGFLNVIVHSATGFKQSSKALQRPV
YGFLNVIVHSATGIKQFSSALYRPV

SEQ ID NO: 27575 - protein, 25 aa, synthetic construct
  source 1..25: note = Seed: YGFLNVIVHSATGFKQSSKALQRPV
YGFLNVIVHSATGIKQFSTALARPV

SEQ ID NO: 27576 - protein, 25 aa, synthetic construct
  source 1..25: note = Seed: YGFLNVIVHSATGFKQSSKALQRPV
YGFLNVIVHSATGIKQFSTALFRPV

SEQ ID NO: 27577 - protein, 25 aa, synthetic construct
  source 1..25: note = Seed: YGFLNVIVHSATGFKQSSKALQRPV
YGFLNVIVHSATGIKQFSTALNRPV

SEQ ID NO: 27578 - protein, 25 aa, synthetic construct
  source 1..25: note = Seed: YGFLNVIVHSATGFKQSSKALQRPV
YGFLNVIVHSATGIKQFSTALRRPV

SEQ ID NO: 27579 - protein, 25 aa, synthetic construct
  source 1..25: note = Seed: YGFLNVIVHSATGFKQSSKALQRPV
YGFLNVIVHSATGIKQFSTALSRPV

SEQ ID NO: 27580 - protein, 25 aa, synthetic construct
  source 1..25: note = Seed: YGFLNVIVHSATGFKQSSKALQRPV
YGFLNVIVHSATGIKQFSTALTRPV

SEQ ID NO: 27581 - protein, 25 aa, synthetic construct
  source 1..25: note = Seed: YGFLNVIVHSATGFKQSSKALQRPV
YGFLNVIVHSATGIKQFSTALYRPV

SEQ ID NO: 27582 - protein, 25 aa, synthetic construct
  source 1..25: note = Seed: YGFLNVIVHSATGFKQSSKALQRPV
YGFLNVIVHSATGIKQFSVALARPV

SEQ ID NO: 27583 - protein, 25 aa, synthetic construct
  source 1..25: note = Seed: YGFLNVIVHSATGFKQSSKALQRPV
YGFLNVIVHSATGIKQFSVALFRPV

SEQ ID NO: 27584 - protein, 25 aa, synthetic construct
  source 1..25: note = Seed: YGFLNVIVHSATGFKQSSKALQRPV
YGFLNVIVHSATGIKQFSVALLRPV

SEQ ID NO: 27585 - protein, 25 aa, synthetic construct
  source 1..25: note = Seed: YGFLNVIVHSATGFKQSSKALQRPV
YGFLNVIVHSATGIKQFSVALNRPV

SEQ ID NO: 27586 - protein, 25 aa, synthetic construct
  source 1..25: note = Seed: YGFLNVIVHSATGFKQSSKALQRPV
YGFLNVIVHSATGIKQFSVALRRPV

SEQ ID NO: 27587 - protein, 25 aa, synthetic construct
  source 1..25: note = Seed: YGFLNVIVHSATGFKQSSKALQRPV
YGFLNVIVHSATGIKQFSVALSRPV

SEQ ID NO: 27588 - protein, 25 aa, synthetic construct
  source 1..25: note = Seed: YGFLNVIVHSATGFKQSSKALQRPV
YGFLNVIVHSATGIKQFSVALTRPV

SEQ ID NO: 27589 - protein, 25 aa, synthetic construct
  source 1..25: note = Seed: YGFLNVIVHSATGFKQSSKALQRPV
YGFLNVIVHSATGIKQFSVALVRPV

SEQ ID NO: 27590 - protein, 25 aa, synthetic construct
  source 1..25: note = Seed: YGFLNVIVHSATGFKQSSKALQRPV
YGFLNVIVHSATGIKQFSVALYRPV

SEQ ID NO: 27591 - protein, 25 aa, synthetic construct
  source 1..25: note = Seed: YGFLNVIVHSATGFKQSSKALQRPV
YGFLNVIVHSATGIKQFSWALFRPV

SEQ ID NO: 27592 - protein, 25 aa, synthetic construct
  source 1..25: note = Seed: YGFLNVIVHSATGFKQSSKALQRPV
YGFLNVIVHSATGIKQFSWALIRPV

SEQ ID NO: 27593 - protein, 25 aa, synthetic construct
  source 1..25: note = Seed: YGFLNVIVHSATGFKQSSKALQRPV
YGFLNVIVHSATGIKQFSWALLRPV

SEQ ID NO: 27594 - protein, 25 aa, synthetic construct
  source 1..25: note = Seed: YGFLNVIVHSATGFKQSSKALQRPV
YGFLNVIVHSATGIKQFSWALMRPV

SEQ ID NO: 27595 - protein, 25 aa, synthetic construct
  source 1..25: note = Seed: YGFLNVIVHSATGFKQSSKALQRPV
YGFLNVIVHSATGIKQFSWALVRPV

SEQ ID NO: 27596 - protein, 25 aa, synthetic construct
  source 1..25: note = Seed: YGFLNVIVHSATGFKQSSKALQRPV
YGFLNVIVHSATGIKQFSWALYRPV

SEQ ID NO: 27597 - protein, 25 aa, synthetic construct
  source 1..25: note = Seed: YGFLNVIVHSATGFKQSSKALQRPV
YGFLNVIVHSATGIKQFSYALFRPV

SEQ ID NO: 27598 - protein, 25 aa, synthetic construct
  source 1..25: note = Seed: YGFLNVIVHSATGFKQSSKALQRPV
YGFLNVIVHSATGIKQFSYALIRPV

SEQ ID NO: 27599 - protein, 25 aa, synthetic construct
  source 1..25: note = Seed: YGFLNVIVHSATGFKQSSKALQRPV
YGFLNVIVHSATGIKQFSYALLRPV

SEQ ID NO: 27600 - protein, 25 aa, synthetic construct
  source 1..25: note = Seed: YGFLNVIVHSATGFKQSSKALQRPV
YGFLNVIVHSATGIKQFSYALMRPV

SEQ ID NO: 27601 - protein, 25 aa, synthetic construct
  source 1..25: note = Seed: YGFLNVIVHSATGFKQSSKALQRPV
YGFLNVIVHSATGIKQFSYALVRPV

SEQ ID NO: 27602 - protein, 25 aa, synthetic construct
  source 1..25: note = Seed: YGFLNVIVHSATGFKQSSKALQRPV
YGFLNVIVHSATGIKQFSYALWRPV

SEQ ID NO: 27603 - protein, 25 aa, synthetic construct
  source 1..25: note = Seed: YGFLNVIVHSATGFKQSSKALQRPV
YGFLNVIVHSATGIKQFSYALYRPV

SEQ ID NO: 27604 - protein, 25 aa, synthetic construct
  source 1..25: note = Seed: YGFLNVIVHSATGFKQSSKALQRPV
YGFLNVIVHSATGIKQGSAALIRPV

SEQ ID NO: 27605 - protein, 25 aa, synthetic construct
  source 1..25: note = Seed: YGFLNVIVHSATGFKQSSKALQRPV
YGFLNVIVHSATGIKQGSNALIRPV

SEQ ID NO: 27606 - protein, 25 aa, synthetic construct
  source 1..25: note = Seed: YGFLNVIVHSATGFKQSSKALQRPV
YGFLNVIVHSATGIKQHSAALFRPV

SEQ ID NO: 27607 - protein, 25 aa, synthetic construct
  source 1..25: note = Seed: YGFLNVIVHSATGFKQSSKALQRPV
YGFLNVIVHSATGIKQHSAALIRPV

SEQ ID NO: 27608 - protein, 25 aa, synthetic construct
  source 1..25: note = Seed: YGFLNVIVHSATGFKQSSKALQRPV
YGFLNVIVHSATGIKQHSAALKRPV

SEQ ID NO: 27609 - protein, 25 aa, synthetic construct
  source 1..25: note = Seed: YGFLNVIVHSATGFKQSSKALQRPV
YGFLNVIVHSATGIKQHSAALLRPV

SEQ ID NO: 27610 - protein, 25 aa, synthetic construct
  source 1..25: note = Seed: YGFLNVIVHSATGFKQSSKALQRPV
YGFLNVIVHSATGIKQHSAALRRPV

SEQ ID NO: 27611 - protein, 25 aa, synthetic construct
  source 1..25: note = Seed: YGFLNVIVHSATGFKQSSKALQRPV
YGFLNVIVHSATGIKQHSAALVRPV

SEQ ID NO: 27612 - protein, 25 aa, synthetic construct
  source 1..25: note = Seed: YGFLNVIVHSATGFKQSSKALQRPV
YGFLNVIVHSATGIKQHSAALYRPV

SEQ ID NO: 27613 - protein, 25 aa, synthetic construct
  source 1..25: note = Seed: YGFLNVIVHSATGFKQSSKALQRPV
YGFLNVIVHSATGIKQHSFALFRPV

SEQ ID NO: 27614 - protein, 25 aa, synthetic construct
  source 1..25: note = Seed: YGFLNVIVHSATGFKQSSKALQRPV
YGFLNVIVHSATGIKQHSFALLRPV

SEQ ID NO: 27615 - protein, 25 aa, synthetic construct
  source 1..25: note = Seed: YGFLNVIVHSATGFKQSSKALQRPV
YGFLNVIVHSATGIKQHSGALIRPV

SEQ ID NO: 27616 - protein, 25 aa, synthetic construct
  source 1..25: note = Seed: YGFLNVIVHSATGFKQSSKALQRPV
YGFLNVIVHSATGIKQHSGALRRPV

SEQ ID NO: 27617 - protein, 25 aa, synthetic construct
  source 1..25: note = Seed: YGFLNVIVHSATGFKQSSKALQRPV
YGFLNVIVHSATGIKQHSGALVRPV

SEQ ID NO: 27618 - protein, 25 aa, synthetic construct
  source 1..25: note = Seed: YGFLNVIVHSATGFKQSSKALQRPV
YGFLNVIVHSATGIKQHSHALRRPV

SEQ ID NO: 27619 - protein, 25 aa, synthetic construct
  source 1..25: note = Seed: YGFLNVIVHSATGFKQSSKALQRPV
YGFLNVIVHSATGIKQHSHALYRPV

SEQ ID NO: 27620 - protein, 25 aa, synthetic construct
  source 1..25: note = Seed: YGFLNVIVHSATGFKQSSKALQRPV
YGFLNVIVHSATGIKQHSIALRRPV

SEQ ID NO: 27621 - protein, 25 aa, synthetic construct
  source 1..25: note = Seed: YGFLNVIVHSATGFKQSSKALQRPV
YGFLNVIVHSATGIKQHSIALYRPV

SEQ ID NO: 27622 - protein, 25 aa, synthetic construct
  source 1..25: note = Seed: YGFLNVIVHSATGFKQSSKALQRPV
YGFLNVIVHSATGIKQHSKALARPV

SEQ ID NO: 27623 - protein, 25 aa, synthetic construct
  source 1..25: note = Seed: YGFLNVIVHSATGFKQSSKALQRPV
YGFLNVIVHSATGIKQHSKALFRPV

SEQ ID NO: 27624 - protein, 25 aa, synthetic construct
  source 1..25: note = Seed: YGFLNVIVHSATGFKQSSKALQRPV
YGFLNVIVHSATGIKQHSKALHRPV

SEQ ID NO: 27625 - protein, 25 aa, synthetic construct
  source 1..25: note = Seed: YGFLNVIVHSATGFKQSSKALQRPV
YGFLNVIVHSATGIKQHSKALIRPV

SEQ ID NO: 27626 - protein, 25 aa, synthetic construct
  source 1..25: note = Seed: YGFLNVIVHSATGFKQSSKALQRPV
YGFLNVIVHSATGIKQHSKALKRPV

SEQ ID NO: 27627 - protein, 25 aa, synthetic construct
  source 1..25: note = Seed: YGFLNVIVHSATGFKQSSKALQRPV
YGFLNVIVHSATGIKQHSKALLRPV

SEQ ID NO: 27628 - protein, 25 aa, synthetic construct
  source 1..25: note = Seed: YGFLNVIVHSATGFKQSSKALQRPV
YGFLNVIVHSATGIKQHSKALMRPV

SEQ ID NO: 27629 - protein, 25 aa, synthetic construct
  source 1..25: note = Seed: YGFLNVIVHSATGFKQSSKALQRPV
YGFLNVIVHSATGIKQHSKALRRPV

SEQ ID NO: 27630 - protein, 25 aa, synthetic construct
  source 1..25: note = Seed: YGFLNVIVHSATGFKQSSKALQRPV
YGFLNVIVHSATGIKQHSKALSRPV

SEQ ID NO: 27631 - protein, 25 aa, synthetic construct
  source 1..25: note = Seed: YGFLNVIVHSATGFKQSSKALQRPV
YGFLNVIVHSATGIKQHSKALVRPV

SEQ ID NO: 27632 - protein, 25 aa, synthetic construct
  source 1..25: note = Seed: YGFLNVIVHSATGFKQSSKALQRPV
YGFLNVIVHSATGIKQHSKALWRPV

SEQ ID NO: 27633 - protein, 25 aa, synthetic construct
  source 1..25: note = Seed: YGFLNVIVHSATGFKQSSKALQRPV
YGFLNVIVHSATGIKQHSKALYRPV

SEQ ID NO: 27634 - protein, 25 aa, synthetic construct
  source 1..25: note = Seed: YGFLNVIVHSATGFKQSSKALQRPV
YGFLNVIVHSATGIKQHSLALRRPV

SEQ ID NO: 27635 - protein, 25 aa, synthetic construct
  source 1..25: note = Seed: YGFLNVIVHSATGFKQSSKALQRPV
YGFLNVIVHSATGIKQHSMALRRPV

SEQ ID NO: 27636 - protein, 25 aa, synthetic construct
  source 1..25: note = Seed: YGFLNVIVHSATGFKQSSKALQRPV
YGFLNVIVHSATGIKQHSNALFRPV

SEQ ID NO: 27637 - protein, 25 aa, synthetic construct
  source 1..25: note = Seed: YGFLNVIVHSATGFKQSSKALQRPV
YGFLNVIVHSATGIKQHSNALIRPV

SEQ ID NO: 27638 - protein, 25 aa, synthetic construct
  source 1..25: note = Seed: YGFLNVIVHSATGFKQSSKALQRPV
YGFLNVIVHSATGIKQHSNALLRPV

SEQ ID NO: 27639 - protein, 25 aa, synthetic construct
  source 1..25: note = Seed: YGFLNVIVHSATGFKQSSKALQRPV
YGFLNVIVHSATGIKQHSNALRRPV

SEQ ID NO: 27640 - protein, 25 aa, synthetic construct
  source 1..25: note = Seed: YGFLNVIVHSATGFKQSSKALQRPV
YGFLNVIVHSATGIKQHSNALVRPV

SEQ ID NO: 27641 - protein, 25 aa, synthetic construct
  source 1..25: note = Seed: YGFLNVIVHSATGFKQSSKALQRPV
YGFLNVIVHSATGIKQHSNALYRPV

SEQ ID NO: 27642 - protein, 25 aa, synthetic construct
  source 1..25: note = Seed: YGFLNVIVHSATGFKQSSKALQRPV
YGFLNVIVHSATGIKQHSPALIRPV

SEQ ID NO: 27643 - protein, 25 aa, synthetic construct
  source 1..25: note = Seed: YGFLNVIVHSATGFKQSSKALQRPV
YGFLNVIVHSATGIKQHSPALRRPV

SEQ ID NO: 27644 - protein, 25 aa, synthetic construct
  source 1..25: note = Seed: YGFLNVIVHSATGFKQSSKALQRPV
YGFLNVIVHSATGIKQHSPALVRPV

SEQ ID NO: 27645 - protein, 25 aa, synthetic construct
  source 1..25: note = Seed: YGFLNVIVHSATGFKQSSKALQRPV
YGFLNVIVHSATGIKQHSPALYRPV

SEQ ID NO: 27646 - protein, 25 aa, synthetic construct
  source 1..25: note = Seed: YGFLNVIVHSATGFKQSSKALQRPV
YGFLNVIVHSATGIKQHSRALARPV

SEQ ID NO: 27647 - protein, 25 aa, synthetic construct
  source 1..25: note = Seed: YGFLNVIVHSATGFKQSSKALQRPV
YGFLNVIVHSATGIKQHSRALFRPV

SEQ ID NO: 27648 - protein, 25 aa, synthetic construct
  source 1..25: note = Seed: YGFLNVIVHSATGFKQSSKALQRPV
YGFLNVIVHSATGIKQHSRALHRPV

SEQ ID NO: 27649 - protein, 25 aa, synthetic construct
  source 1..25: note = Seed: YGFLNVIVHSATGFKQSSKALQRPV
YGFLNVIVHSATGIKQHSRALIRPV

SEQ ID NO: 27650 - protein, 25 aa, synthetic construct
  source 1..25: note = Seed: YGFLNVIVHSATGFKQSSKALQRPV
YGFLNVIVHSATGIKQHSRALKRPV

SEQ ID NO: 27651 - protein, 25 aa, synthetic construct
  source 1..25: note = Seed: YGFLNVIVHSATGFKQSSKALQRPV
YGFLNVIVHSATGIKQHSRALLRPV

SEQ ID NO: 27652 - protein, 25 aa, synthetic construct
  source 1..25: note = Seed: YGFLNVIVHSATGFKQSSKALQRPV
YGFLNVIVHSATGIKQHSRALMRPV

SEQ ID NO: 27653 - protein, 25 aa, synthetic construct
  source 1..25: note = Seed: YGFLNVIVHSATGFKQSSKALQRPV
YGFLNVIVHSATGIKQHSRALRRPV

SEQ ID NO: 27654 - protein, 25 aa, synthetic construct
  source 1..25: note = Seed: YGFLNVIVHSATGFKQSSKALQRPV
YGFLNVIVHSATGIKQHSRALSRPV

SEQ ID NO: 27655 - protein, 25 aa, synthetic construct
  source 1..25: note = Seed: YGFLNVIVHSATGFKQSSKALQRPV
YGFLNVIVHSATGIKQHSRALTRPV

SEQ ID NO: 27656 - protein, 25 aa, synthetic construct
  source 1..25: note = Seed: YGFLNVIVHSATGFKQSSKALQRPV
YGFLNVIVHSATGIKQHSRALVRPV

SEQ ID NO: 27657 - protein, 25 aa, synthetic construct
  source 1..25: note = Seed: YGFLNVIVHSATGFKQSSKALQRPV
YGFLNVIVHSATGIKQHSRALWRPV

SEQ ID NO: 27658 - protein, 25 aa, synthetic construct
  source 1..25: note = Seed: YGFLNVIVHSATGFKQSSKALQRPV
YGFLNVIVHSATGIKQHSRALYRPV

SEQ ID NO: 27659 - protein, 25 aa, synthetic construct
  source 1..25: note = Seed: YGFLNVIVHSATGFKQSSKALQRPV
YGFLNVIVHSATGIKQHSSALFRPV

SEQ ID NO: 27660 - protein, 25 aa, synthetic construct
  source 1..25: note = Seed: YGFLNVIVHSATGFKQSSKALQRPV
YGFLNVIVHSATGIKQHSSALIRPV

SEQ ID NO: 27661 - protein, 25 aa, synthetic construct
  source 1..25: note = Seed: YGFLNVIVHSATGFKQSSKALQRPV
YGFLNVIVHSATGIKQHSSALRRPV

SEQ ID NO: 27662 - protein, 25 aa, synthetic construct
  source 1..25: note = Seed: YGFLNVIVHSATGFKQSSKALQRPV
YGFLNVIVHSATGIKQHSSALVRPV

SEQ ID NO: 27663 - protein, 25 aa, synthetic construct
  source 1..25: note = Seed: YGFLNVIVHSATGFKQSSKALQRPV
YGFLNVIVHSATGIKQHSSALYRPV

SEQ ID NO: 27664 - protein, 25 aa, synthetic construct
  source 1..25: note = Seed: YGFLNVIVHSATGFKQSSKALQRPV
YGFLNVIVHSATGIKQHSTALIRPV

SEQ ID NO: 27665 - protein, 25 aa, synthetic construct
  source 1..25: note = Seed: YGFLNVIVHSATGFKQSSKALQRPV
YGFLNVIVHSATGIKQHSTALRRPV

SEQ ID NO: 27666 - protein, 25 aa, synthetic construct
  source 1..25: note = Seed: YGFLNVIVHSATGFKQSSKALQRPV
YGFLNVIVHSATGIKQHSTALVRPV

SEQ ID NO: 27667 - protein, 25 aa, synthetic construct
  source 1..25: note = Seed: YGFLNVIVHSATGFKQSSKALQRPV
YGFLNVIVHSATGIKQHSTALYRPV

SEQ ID NO: 27668 - protein, 25 aa, synthetic construct
  source 1..25: note = Seed: YGFLNVIVHSATGFKQSSKALQRPV
YGFLNVIVHSATGIKQHSVALKRPV

SEQ ID NO: 27669 - protein, 25 aa, synthetic construct
  source 1..25: note = Seed: YGFLNVIVHSATGFKQSSKALQRPV
YGFLNVIVHSATGIKQHSVALRRPV

SEQ ID NO: 27670 - protein, 25 aa, synthetic construct
  source 1..25: note = Seed: YGFLNVIVHSATGFKQSSKALQRPV
YGFLNVIVHSATGIKQHSVALYRPV

SEQ ID NO: 27671 - protein, 25 aa, synthetic construct
  source 1..25: note = Seed: YGFLNVIVHSATGFKQSSKALQRPV
YGFLNVIVHSATGIKQISAALARPV

SEQ ID NO: 27672 - protein, 25 aa, synthetic construct
  source 1..25: note = Seed: YGFLNVIVHSATGFKQSSKALQRPV
YGFLNVIVHSATGIKQISAALGRPV

SEQ ID NO: 27673 - protein, 25 aa, synthetic construct
  source 1..25: note = Seed: YGFLNVIVHSATGFKQSSKALQRPV
YGFLNVIVHSATGIKQISAALHRPV

SEQ ID NO: 27674 - protein, 25 aa, synthetic construct
  source 1..25: note = Seed: YGFLNVIVHSATGFKQSSKALQRPV
YGFLNVIVHSATGIKQISAALIRPV

SEQ ID NO: 27675 - protein, 25 aa, synthetic construct
  source 1..25: note = Seed: YGFLNVIVHSATGFKQSSKALQRPV
YGFLNVIVHSATGIKQISAALKRPV

SEQ ID NO: 27676 - protein, 25 aa, synthetic construct
  source 1..25: note = Seed: YGFLNVIVHSATGFKQSSKALQRPV
YGFLNVIVHSATGIKQISAALLRPV

SEQ ID NO: 27677 - protein, 25 aa, synthetic construct
  source 1..25: note = Seed: YGFLNVIVHSATGFKQSSKALQRPV
YGFLNVIVHSATGIKQISAALMRPV

SEQ ID NO: 27678 - protein, 25 aa, synthetic construct
  source 1..25: note = Seed: YGFLNVIVHSATGFKQSSKALQRPV
YGFLNVIVHSATGIKQISAALNRPV

SEQ ID NO: 27679 - protein, 25 aa, synthetic construct
  source 1..25: note = Seed: YGFLNVIVHSATGFKQSSKALQRPV
YGFLNVIVHSATGIKQISAALQRPV

SEQ ID NO: 27680 - protein, 25 aa, synthetic construct
  source 1..25: note = Seed: YGFLNVIVHSATGFKQSSKALQRPV
YGFLNVIVHSATGIKQISAALRRPV

SEQ ID NO: 27681 - protein, 25 aa, synthetic construct
  source 1..25: note = Seed: YGFLNVIVHSATGFKQSSKALQRPV
YGFLNVIVHSATGIKQISAALSRPV

SEQ ID NO: 27682 - protein, 25 aa, synthetic construct
  source 1..25: note = Seed: YGFLNVIVHSATGFKQSSKALQRPV
YGFLNVIVHSATGIKQISAALTRPV

SEQ ID NO: 27683 - protein, 25 aa, synthetic construct
  source 1..25: note = Seed: YGFLNVIVHSATGFKQSSKALQRPV
YGFLNVIVHSATGIKQISAALVRPV

SEQ ID NO: 27684 - protein, 25 aa, synthetic construct
  source 1..25: note = Seed: YGFLNVIVHSATGFKQSSKALQRPV
YGFLNVIVHSATGIKQISAALYRPV

SEQ ID NO: 27685 - protein, 25 aa, synthetic construct
  source 1..25: note = Seed: YGFLNVIVHSATGFKQSSKALQRPV
YGFLNVIVHSATGIKQISFALERPV

SEQ ID NO: 27686 - protein, 25 aa, synthetic construct
  source 1..25: note = Seed: YGFLNVIVHSATGFKQSSKALQRPV
YGFLNVIVHSATGIKQISFALFRPV

SEQ ID NO: 27687 - protein, 25 aa, synthetic construct
  source 1..25: note = Seed: YGFLNVIVHSATGFKQSSKALQRPV
YGFLNVIVHSATGIKQISFALIRPV

SEQ ID NO: 27688 - protein, 25 aa, synthetic construct
  source 1..25: note = Seed: YGFLNVIVHSATGFKQSSKALQRPV
YGFLNVIVHSATGIKQISFALLRPV

SEQ ID NO: 27689 - protein, 25 aa, synthetic construct
  source 1..25: note = Seed: YGFLNVIVHSATGFKQSSKALQRPV
YGFLNVIVHSATGIKQISFALMRPV

SEQ ID NO: 27690 - protein, 25 aa, synthetic construct
  source 1..25: note = Seed: YGFLNVIVHSATGFKQSSKALQRPV
YGFLNVIVHSATGIKQISFALRRPV

SEQ ID NO: 27691 - protein, 25 aa, synthetic construct
  source 1..25: note = Seed: YGFLNVIVHSATGFKQSSKALQRPV
YGFLNVIVHSATGIKQISFALVRPV

SEQ ID NO: 27692 - protein, 25 aa, synthetic construct
  source 1..25: note = Seed: YGFLNVIVHSATGFKQSSKALQRPV
YGFLNVIVHSATGIKQISFALWRPV

SEQ ID NO: 27693 - protein, 25 aa, synthetic construct
  source 1..25: note = Seed: YGFLNVIVHSATGFKQSSKALQRPV
YGFLNVIVHSATGIKQISFALYRPV

SEQ ID NO: 27694 - protein, 25 aa, synthetic construct
  source 1..25: note = Seed: YGFLNVIVHSATGFKQSSKALQRPV
YGFLNVIVHSATGIKQISGALARPV

SEQ ID NO: 27695 - protein, 25 aa, synthetic construct
  source 1..25: note = Seed: YGFLNVIVHSATGFKQSSKALQRPV
YGFLNVIVHSATGIKQISGALIRPV

SEQ ID NO: 27696 - protein, 25 aa, synthetic construct
  source 1..25: note = Seed: YGFLNVIVHSATGFKQSSKALQRPV
YGFLNVIVHSATGIKQISGALNRPV

SEQ ID NO: 27697 - protein, 25 aa, synthetic construct
  source 1..25: note = Seed: YGFLNVIVHSATGFKQSSKALQRPV
YGFLNVIVHSATGIKQISGALRRPV

SEQ ID NO: 27698 - protein, 25 aa, synthetic construct
  source 1..25: note = Seed: YGFLNVIVHSATGFKQSSKALQRPV
YGFLNVIVHSATGIKQISGALSRPV

SEQ ID NO: 27699 - protein, 25 aa, synthetic construct
  source 1..25: note = Seed: YGFLNVIVHSATGFKQSSKALQRPV
YGFLNVIVHSATGIKQISGALVRPV

SEQ ID NO: 27700 - protein, 25 aa, synthetic construct
  source 1..25: note = Seed: YGFLNVIVHSATGFKQSSKALQRPV
YGFLNVIVHSATGIKQISHALARPV

SEQ ID NO: 27701 - protein, 25 aa, synthetic construct
  source 1..25: note = Seed: YGFLNVIVHSATGFKQSSKALQRPV
YGFLNVIVHSATGIKQISHALFRPV

SEQ ID NO: 27702 - protein, 25 aa, synthetic construct
  source 1..25: note = Seed: YGFLNVIVHSATGFKQSSKALQRPV
YGFLNVIVHSATGIKQISHALKRPV

SEQ ID NO: 27703 - protein, 25 aa, synthetic construct
  source 1..25: note = Seed: YGFLNVIVHSATGFKQSSKALQRPV
YGFLNVIVHSATGIKQISHALRRPV

SEQ ID NO: 27704 - protein, 25 aa, synthetic construct
  source 1..25: note = Seed: YGFLNVIVHSATGFKQSSKALQRPV
YGFLNVIVHSATGIKQISHALSRPV

SEQ ID NO: 27705 - protein, 25 aa, synthetic construct
  source 1..25: note = Seed: YGFLNVIVHSATGFKQSSKALQRPV
YGFLNVIVHSATGIKQISHALYRPV

SEQ ID NO: 27706 - protein, 25 aa, synthetic construct
  source 1..25: note = Seed: YGFLNVIVHSATGFKQSSKALQRPV
YGFLNVIVHSATGIKQISIALARPV

SEQ ID NO: 27707 - protein, 25 aa, synthetic construct
  source 1..25: note = Seed: YGFLNVIVHSATGFKQSSKALQRPV
YGFLNVIVHSATGIKQISIALKRPV

SEQ ID NO: 27708 - protein, 25 aa, synthetic construct
  source 1..25: note = Seed: YGFLNVIVHSATGFKQSSKALQRPV
YGFLNVIVHSATGIKQISIALNRPV

SEQ ID NO: 27709 - protein, 25 aa, synthetic construct
  source 1..25: note = Seed: YGFLNVIVHSATGFKQSSKALQRPV
YGFLNVIVHSATGIKQISIALRRPV

SEQ ID NO: 27710 - protein, 25 aa, synthetic construct
  source 1..25: note = Seed: YGFLNVIVHSATGFKQSSKALQRPV
YGFLNVIVHSATGIKQISIALSRPV

SEQ ID NO: 27711 - protein, 25 aa, synthetic construct
  source 1..25: note = Seed: YGFLNVIVHSATGFKQSSKALQRPV
YGFLNVIVHSATGIKQISKALARPV

SEQ ID NO: 27712 - protein, 25 aa, synthetic construct
  source 1..25: note = Seed: YGFLNVIVHSATGFKQSSKALQRPV
YGFLNVIVHSATGIKQISKALFRPV

SEQ ID NO: 27713 - protein, 25 aa, synthetic construct
  source 1..25: note = Seed: YGFLNVIVHSATGFKQSSKALQRPV
YGFLNVIVHSATGIKQISKALGRPV

SEQ ID NO: 27714 - protein, 25 aa, synthetic construct
  source 1..25: note = Seed: YGFLNVIVHSATGFKQSSKALQRPV
YGFLNVIVHSATGIKQISKALHRPV

SEQ ID NO: 27715 - protein, 25 aa, synthetic construct
  source 1..25: note = Seed: YGFLNVIVHSATGFKQSSKALQRPV
YGFLNVIVHSATGIKQISKALIRPV

SEQ ID NO: 27716 - protein, 25 aa, synthetic construct
  source 1..25: note = Seed: YGFLNVIVHSATGFKQSSKALQRPV
YGFLNVIVHSATGIKQISKALKRPV

SEQ ID NO: 27717 - protein, 25 aa, synthetic construct
  source 1..25: note = Seed: YGFLNVIVHSATGFKQSSKALQRPV
YGFLNVIVHSATGIKQISKALLRPV

SEQ ID NO: 27718 - protein, 25 aa, synthetic construct
  source 1..25: note = Seed: YGFLNVIVHSATGFKQSSKALQRPV
YGFLNVIVHSATGIKQISKALMRPV

SEQ ID NO: 27719 - protein, 25 aa, synthetic construct
  source 1..25: note = Seed: YGFLNVIVHSATGFKQSSKALQRPV
YGFLNVIVHSATGIKQISKALNRPV

SEQ ID NO: 27720 - protein, 25 aa, synthetic construct
  source 1..25: note = Seed: YGFLNVIVHSATGFKQSSKALQRPV
YGFLNVIVHSATGIKQISKALPRPV

SEQ ID NO: 27721 - protein, 25 aa, synthetic construct
  source 1..25: note = Seed: YGFLNVIVHSATGFKQSSKALQRPV
YGFLNVIVHSATGIKQISKALQRPV

SEQ ID NO: 27722 - protein, 25 aa, synthetic construct
  source 1..25: note = Seed: YGFLNVIVHSATGFKQSSKALQRPV
YGFLNVIVHSATGIKQISKALRRPV

SEQ ID NO: 27723 - protein, 25 aa, synthetic construct
  source 1..25: note = Seed: YGFLNVIVHSATGFKQSSKALQRPV
YGFLNVIVHSATGIKQISKALSRPV

SEQ ID NO: 27724 - protein, 25 aa, synthetic construct
  source 1..25: note = Seed: YGFLNVIVHSATGFKQSSKALQRPV
YGFLNVIVHSATGIKQISKALTRPV

SEQ ID NO: 27725 - protein, 25 aa, synthetic construct
  source 1..25: note = Seed: YGFLNVIVHSATGFKQSSKALQRPV
YGFLNVIVHSATGIKQISKALVRPV

SEQ ID NO: 27726 - protein, 25 aa, synthetic construct
  source 1..25: note = Seed: YGFLNVIVHSATGFKQSSKALQRPV
YGFLNVIVHSATGIKQISKALYRPV

SEQ ID NO: 27727 - protein, 25 aa, synthetic construct
  source 1..25: note = Seed: YGFLNVIVHSATGFKQSSKALQRPV
YGFLNVIVHSATGIKQISLALARPV

SEQ ID NO: 27728 - protein, 25 aa, synthetic construct
  source 1..25: note = Seed: YGFLNVIVHSATGFKQSSKALQRPV
YGFLNVIVHSATGIKQISLALFRPV

SEQ ID NO: 27729 - protein, 25 aa, synthetic construct
  source 1..25: note = Seed: YGFLNVIVHSATGFKQSSKALQRPV
YGFLNVIVHSATGIKQISLALKRPV

SEQ ID NO: 27730 - protein, 25 aa, synthetic construct
  source 1..25: note = Seed: YGFLNVIVHSATGFKQSSKALQRPV
YGFLNVIVHSATGIKQISLALNRPV

SEQ ID NO: 27731 - protein, 25 aa, synthetic construct
  source 1..25: note = Seed: YGFLNVIVHSATGFKQSSKALQRPV
YGFLNVIVHSATGIKQISLALRRPV

SEQ ID NO: 27732 - protein, 25 aa, synthetic construct
  source 1..25: note = Seed: YGFLNVIVHSATGFKQSSKALQRPV
YGFLNVIVHSATGIKQISLALSRPV

SEQ ID NO: 27733 - protein, 25 aa, synthetic construct
  source 1..25: note = Seed: YGFLNVIVHSATGFKQSSKALQRPV
YGFLNVIVHSATGIKQISMALARPV

SEQ ID NO: 27734 - protein, 25 aa, synthetic construct
  source 1..25: note = Seed: YGFLNVIVHSATGFKQSSKALQRPV
YGFLNVIVHSATGIKQISMALFRPV

SEQ ID NO: 27735 - protein, 25 aa, synthetic construct
  source 1..25: note = Seed: YGFLNVIVHSATGFKQSSKALQRPV
YGFLNVIVHSATGIKQISMALKRPV

SEQ ID NO: 27736 - protein, 25 aa, synthetic construct
  source 1..25: note = Seed: YGFLNVIVHSATGFKQSSKALQRPV
YGFLNVIVHSATGIKQISMALNRPV

SEQ ID NO: 27737 - protein, 25 aa, synthetic construct
  source 1..25: note = Seed: YGFLNVIVHSATGFKQSSKALQRPV
YGFLNVIVHSATGIKQISMALRRPV

SEQ ID NO: 27738 - protein, 25 aa, synthetic construct
  source 1..25: note = Seed: YGFLNVIVHSATGFKQSSKALQRPV
YGFLNVIVHSATGIKQISMALSRPV

SEQ ID NO: 27739 - protein, 25 aa, synthetic construct
  source 1..25: note = Seed: YGFLNVIVHSATGFKQSSKALQRPV
YGFLNVIVHSATGIKQISNALARPV

SEQ ID NO: 27740 - protein, 25 aa, synthetic construct
  source 1..25: note = Seed: YGFLNVIVHSATGFKQSSKALQRPV
YGFLNVIVHSATGIKQISNALFRPV

SEQ ID NO: 27741 - protein, 25 aa, synthetic construct
  source 1..25: note = Seed: YGFLNVIVHSATGFKQSSKALQRPV
YGFLNVIVHSATGIKQISNALGRPV

SEQ ID NO: 27742 - protein, 25 aa, synthetic construct
  source 1..25: note = Seed: YGFLNVIVHSATGFKQSSKALQRPV
YGFLNVIVHSATGIKQISNALIRPV

SEQ ID NO: 27743 - protein, 25 aa, synthetic construct
  source 1..25: note = Seed: YGFLNVIVHSATGFKQSSKALQRPV
YGFLNVIVHSATGIKQISNALLRPV

SEQ ID NO: 27744 - protein, 25 aa, synthetic construct
  source 1..25: note = Seed: YGFLNVIVHSATGFKQSSKALQRPV
YGFLNVIVHSATGIKQISNALNRPV

SEQ ID NO: 27745 - protein, 25 aa, synthetic construct
  source 1..25: note = Seed: YGFLNVIVHSATGFKQSSKALQRPV
YGFLNVIVHSATGIKQISNALRRPV

SEQ ID NO: 27746 - protein, 25 aa, synthetic construct
  source 1..25: note = Seed: YGFLNVIVHSATGFKQSSKALQRPV
YGFLNVIVHSATGIKQISNALSRPV

SEQ ID NO: 27747 - protein, 25 aa, synthetic construct
  source 1..25: note = Seed: YGFLNVIVHSATGFKQSSKALQRPV
YGFLNVIVHSATGIKQISNALVRPV

SEQ ID NO: 27748 - protein, 25 aa, synthetic construct
  source 1..25: note = Seed: YGFLNVIVHSATGFKQSSKALQRPV
YGFLNVIVHSATGIKQISNALYRPV

SEQ ID NO: 27749 - protein, 25 aa, synthetic construct
  source 1..25: note = Seed: YGFLNVIVHSATGFKQSSKALQRPV
YGFLNVIVHSATGIKQISPALARPV

SEQ ID NO: 27750 - protein, 25 aa, synthetic construct
  source 1..25: note = Seed: YGFLNVIVHSATGFKQSSKALQRPV
YGFLNVIVHSATGIKQISPALGRPV

SEQ ID NO: 27751 - protein, 25 aa, synthetic construct
  source 1..25: note = Seed: YGFLNVIVHSATGFKQSSKALQRPV
YGFLNVIVHSATGIKQISPALHRPV

SEQ ID NO: 27752 - protein, 25 aa, synthetic construct
  source 1..25: note = Seed: YGFLNVIVHSATGFKQSSKALQRPV
YGFLNVIVHSATGIKQISPALIRPV

SEQ ID NO: 27753 - protein, 25 aa, synthetic construct
  source 1..25: note = Seed: YGFLNVIVHSATGFKQSSKALQRPV
YGFLNVIVHSATGIKQISPALKRPV

SEQ ID NO: 27754 - protein, 25 aa, synthetic construct
  source 1..25: note = Seed: YGFLNVIVHSATGFKQSSKALQRPV
YGFLNVIVHSATGIKQISPALLRPV

SEQ ID NO: 27755 - protein, 25 aa, synthetic construct
  source 1..25: note = Seed: YGFLNVIVHSATGFKQSSKALQRPV
YGFLNVIVHSATGIKQISPALMRPV

SEQ ID NO: 27756 - protein, 25 aa, synthetic construct
  source 1..25: note = Seed: YGFLNVIVHSATGFKQSSKALQRPV
YGFLNVIVHSATGIKQISPALNRPV

SEQ ID NO: 27757 - protein, 25 aa, synthetic construct
  source 1..25: note = Seed: YGFLNVIVHSATGFKQSSKALQRPV
YGFLNVIVHSATGIKQISPALQRPV

SEQ ID NO: 27758 - protein, 25 aa, synthetic construct
  source 1..25: note = Seed: YGFLNVIVHSATGFKQSSKALQRPV
YGFLNVIVHSATGIKQISPALRRPV

SEQ ID NO: 27759 - protein, 25 aa, synthetic construct
  source 1..25: note = Seed: YGFLNVIVHSATGFKQSSKALQRPV
YGFLNVIVHSATGIKQISPALSRPV

SEQ ID NO: 27760 - protein, 25 aa, synthetic construct
  source 1..25: note = Seed: YGFLNVIVHSATGFKQSSKALQRPV
YGFLNVIVHSATGIKQISPALTRPV

SEQ ID NO: 27761 - protein, 25 aa, synthetic construct
  source 1..25: note = Seed: YGFLNVIVHSATGFKQSSKALQRPV
YGFLNVIVHSATGIKQISPALVRPV

SEQ ID NO: 27762 - protein, 25 aa, synthetic construct
  source 1..25: note = Seed: YGFLNVIVHSATGFKQSSKALQRPV
YGFLNVIVHSATGIKQISPALYRPV

SEQ ID NO: 27763 - protein, 25 aa, synthetic construct
  source 1..25: note = Seed: YGFLNVIVHSATGFKQSSKALQRPV
YGFLNVIVHSATGIKQISQALRRPV

SEQ ID NO: 27764 - protein, 25 aa, synthetic construct
  source 1..25: note = Seed: YGFLNVIVHSATGFKQSSKALQRPV
YGFLNVIVHSATGIKQISRALARPV

SEQ ID NO: 27765 - protein, 25 aa, synthetic construct
  source 1..25: note = Seed: YGFLNVIVHSATGFKQSSKALQRPV
YGFLNVIVHSATGIKQISRALERPV

SEQ ID NO: 27766 - protein, 25 aa, synthetic construct
  source 1..25: note = Seed: YGFLNVIVHSATGFKQSSKALQRPV
YGFLNVIVHSATGIKQISRALFRPV

SEQ ID NO: 27767 - protein, 25 aa, synthetic construct
  source 1..25: note = Seed: YGFLNVIVHSATGFKQSSKALQRPV
YGFLNVIVHSATGIKQISRALGRPV

SEQ ID NO: 27768 - protein, 25 aa, synthetic construct
  source 1..25: note = Seed: YGFLNVIVHSATGFKQSSKALQRPV
YGFLNVIVHSATGIKQISRALHRPV

SEQ ID NO: 27769 - protein, 25 aa, synthetic construct
  source 1..25: note = Seed: YGFLNVIVHSATGFKQSSKALQRPV
YGFLNVIVHSATGIKQISRALIRPV

SEQ ID NO: 27770 - protein, 25 aa, synthetic construct
  source 1..25: note = Seed: YGFLNVIVHSATGFKQSSKALQRPV
YGFLNVIVHSATGIKQISRALKRPV

SEQ ID NO: 27771 - protein, 25 aa, synthetic construct
  source 1..25: note = Seed: YGFLNVIVHSATGFKQSSKALQRPV
YGFLNVIVHSATGIKQISRALLRPV

SEQ ID NO: 27772 - protein, 25 aa, synthetic construct
  source 1..25: note = Seed: YGFLNVIVHSATGFKQSSKALQRPV
YGFLNVIVHSATGIKQISRALMRPV

SEQ ID NO: 27773 - protein, 25 aa, synthetic construct
  source 1..25: note = Seed: YGFLNVIVHSATGFKQSSKALQRPV
YGFLNVIVHSATGIKQISRALNRPV

SEQ ID NO: 27774 - protein, 25 aa, synthetic construct
  source 1..25: note = Seed: YGFLNVIVHSATGFKQSSKALQRPV
YGFLNVIVHSATGIKQISRALPRPV

SEQ ID NO: 27775 - protein, 25 aa, synthetic construct
  source 1..25: note = Seed: YGFLNVIVHSATGFKQSSKALQRPV
YGFLNVIVHSATGIKQISRALQRPV

SEQ ID NO: 27776 - protein, 25 aa, synthetic construct
  source 1..25: note = Seed: YGFLNVIVHSATGFKQSSKALQRPV
YGFLNVIVHSATGIKQISRALRRPV

SEQ ID NO: 27777 - protein, 25 aa, synthetic construct
  source 1..25: note = Seed: YGFLNVIVHSATGFKQSSKALQRPV
YGFLNVIVHSATGIKQISRALSRPV

SEQ ID NO: 27778 - protein, 25 aa, synthetic construct
  source 1..25: note = Seed: YGFLNVIVHSATGFKQSSKALQRPV
YGFLNVIVHSATGIKQISRALTRPV

SEQ ID NO: 27779 - protein, 25 aa, synthetic construct
  source 1..25: note = Seed: YGFLNVIVHSATGFKQSSKALQRPV
YGFLNVIVHSATGIKQISRALVRPV

SEQ ID NO: 27780 - protein, 25 aa, synthetic construct
  source 1..25: note = Seed: YGFLNVIVHSATGFKQSSKALQRPV
YGFLNVIVHSATGIKQISRALYRPV

SEQ ID NO: 27781 - protein, 25 aa, synthetic construct
  source 1..25: note = Seed: YGFLNVIVHSATGFKQSSKALQRPV
YGFLNVIVHSATGIKQISSALARPV

SEQ ID NO: 27782 - protein, 25 aa, synthetic construct
  source 1..25: note = Seed: YGFLNVIVHSATGFKQSSKALQRPV
YGFLNVIVHSATGIKQISSALFRPV

SEQ ID NO: 27783 - protein, 25 aa, synthetic construct
  source 1..25: note = Seed: YGFLNVIVHSATGFKQSSKALQRPV
YGFLNVIVHSATGIKQISSALGRPV

SEQ ID NO: 27784 - protein, 25 aa, synthetic construct
  source 1..25: note = Seed: YGFLNVIVHSATGFKQSSKALQRPV
YGFLNVIVHSATGIKQISSALHRPV

SEQ ID NO: 27785 - protein, 25 aa, synthetic construct
  source 1..25: note = Seed: YGFLNVIVHSATGFKQSSKALQRPV
YGFLNVIVHSATGIKQISSALIRPV

SEQ ID NO: 27786 - protein, 25 aa, synthetic construct
  source 1..25: note = Seed: YGFLNVIVHSATGFKQSSKALQRPV
YGFLNVIVHSATGIKQISSALKRPV

SEQ ID NO: 27787 - protein, 25 aa, synthetic construct
  source 1..25: note = Seed: YGFLNVIVHSATGFKQSSKALQRPV
YGFLNVIVHSATGIKQISSALMRPV

SEQ ID NO: 27788 - protein, 25 aa, synthetic construct
  source 1..25: note = Seed: YGFLNVIVHSATGFKQSSKALQRPV
YGFLNVIVHSATGIKQISSALNRPV

SEQ ID NO: 27789 - protein, 25 aa, synthetic construct
  source 1..25: note = Seed: YGFLNVIVHSATGFKQSSKALQRPV
YGFLNVIVHSATGIKQISSALRRPV

SEQ ID NO: 27790 - protein, 25 aa, synthetic construct
  source 1..25: note = Seed: YGFLNVIVHSATGFKQSSKALQRPV
YGFLNVIVHSATGIKQISSALSRPV

SEQ ID NO: 27791 - protein, 25 aa, synthetic construct
  source 1..25: note = Seed: YGFLNVIVHSATGFKQSSKALQRPV
YGFLNVIVHSATGIKQISSALTRPV

SEQ ID NO: 27792 - protein, 25 aa, synthetic construct
  source 1..25: note = Seed: YGFLNVIVHSATGFKQSSKALQRPV
YGFLNVIVHSATGIKQISSALVRPV

SEQ ID NO: 27793 - protein, 25 aa, synthetic construct
  source 1..25: note = Seed: YGFLNVIVHSATGFKQSSKALQRPV
YGFLNVIVHSATGIKQISSALYRPV

SEQ ID NO: 27794 - protein, 25 aa, synthetic construct
  source 1..25: note = Seed: YGFLNVIVHSATGFKQSSKALQRPV
YGFLNVIVHSATGIKQISTALARPV

SEQ ID NO: 27795 - protein, 25 aa, synthetic construct
  source 1..25: note = Seed: YGFLNVIVHSATGFKQSSKALQRPV
YGFLNVIVHSATGIKQISTALGRPV

SEQ ID NO: 27796 - protein, 25 aa, synthetic construct
  source 1..25: note = Seed: YGFLNVIVHSATGFKQSSKALQRPV
YGFLNVIVHSATGIKQISTALHRPV

SEQ ID NO: 27797 - protein, 25 aa, synthetic construct
  source 1..25: note = Seed: YGFLNVIVHSATGFKQSSKALQRPV
YGFLNVIVHSATGIKQISTALIRPV

SEQ ID NO: 27798 - protein, 25 aa, synthetic construct
  source 1..25: note = Seed: YGFLNVIVHSATGFKQSSKALQRPV
YGFLNVIVHSATGIKQISTALMRPV

SEQ ID NO: 27799 - protein, 25 aa, synthetic construct
  source 1..25: note = Seed: YGFLNVIVHSATGFKQSSKALQRPV
YGFLNVIVHSATGIKQISTALNRPV

SEQ ID NO: 27800 - protein, 25 aa, synthetic construct
  source 1..25: note = Seed: YGFLNVIVHSATGFKQSSKALQRPV
YGFLNVIVHSATGIKQISTALRRPV

SEQ ID NO: 27801 - protein, 25 aa, synthetic construct
  source 1..25: note = Seed: YGFLNVIVHSATGFKQSSKALQRPV
YGFLNVIVHSATGIKQISTALSRPV

SEQ ID NO: 27802 - protein, 25 aa, synthetic construct
  source 1..25: note = Seed: YGFLNVIVHSATGFKQSSKALQRPV
YGFLNVIVHSATGIKQISTALTRPV

SEQ ID NO: 27803 - protein, 25 aa, synthetic construct
  source 1..25: note = Seed: YGFLNVIVHSATGFKQSSKALQRPV
YGFLNVIVHSATGIKQISTALVRPV

SEQ ID NO: 27804 - protein, 25 aa, synthetic construct
  source 1..25: note = Seed: YGFLNVIVHSATGFKQSSKALQRPV
YGFLNVIVHSATGIKQISVALARPV

SEQ ID NO: 27805 - protein, 25 aa, synthetic construct
  source 1..25: note = Seed: YGFLNVIVHSATGFKQSSKALQRPV
YGFLNVIVHSATGIKQISVALHRPV

SEQ ID NO: 27806 - protein, 25 aa, synthetic construct
  source 1..25: note = Seed: YGFLNVIVHSATGFKQSSKALQRPV
YGFLNVIVHSATGIKQISVALKRPV

SEQ ID NO: 27807 - protein, 25 aa, synthetic construct
  source 1..25: note = Seed: YGFLNVIVHSATGFKQSSKALQRPV
YGFLNVIVHSATGIKQISVALNRPV

SEQ ID NO: 27808 - protein, 25 aa, synthetic construct
  source 1..25: note = Seed: YGFLNVIVHSATGFKQSSKALQRPV
YGFLNVIVHSATGIKQISVALRRPV

SEQ ID NO: 27809 - protein, 25 aa, synthetic construct
  source 1..25: note = Seed: YGFLNVIVHSATGFKQSSKALQRPV
YGFLNVIVHSATGIKQISVALSRPV

SEQ ID NO: 27810 - protein, 25 aa, synthetic construct
  source 1..25: note = Seed: YGFLNVIVHSATGFKQSSKALQRPV
YGFLNVIVHSATGIKQISVALTRPV

SEQ ID NO: 27811 - protein, 25 aa, synthetic construct
  source 1..25: note = Seed: YGFLNVIVHSATGFKQSSKALQRPV
YGFLNVIVHSATGIKQISWALFRPV

SEQ ID NO: 27812 - protein, 25 aa, synthetic construct
  source 1..25: note = Seed: YGFLNVIVHSATGFKQSSKALQRPV
YGFLNVIVHSATGIKQISWALKRPV

SEQ ID NO: 27813 - protein, 25 aa, synthetic construct
  source 1..25: note = Seed: YGFLNVIVHSATGFKQSSKALQRPV
YGFLNVIVHSATGIKQISWALLRPV

SEQ ID NO: 27814 - protein, 25 aa, synthetic construct
  source 1..25: note = Seed: YGFLNVIVHSATGFKQSSKALQRPV
YGFLNVIVHSATGIKQISWALRRPV

SEQ ID NO: 27815 - protein, 25 aa, synthetic construct
  source 1..25: note = Seed: YGFLNVIVHSATGFKQSSKALQRPV
YGFLNVIVHSATGIKQISWALYRPV

SEQ ID NO: 27816 - protein, 25 aa, synthetic construct
  source 1..25: note = Seed: YGFLNVIVHSATGFKQSSKALQRPV
YGFLNVIVHSATGIKQISYALARPV

SEQ ID NO: 27817 - protein, 25 aa, synthetic construct
  source 1..25: note = Seed: YGFLNVIVHSATGFKQSSKALQRPV
YGFLNVIVHSATGIKQISYALFRPV

SEQ ID NO: 27818 - protein, 25 aa, synthetic construct
  source 1..25: note = Seed: YGFLNVIVHSATGFKQSSKALQRPV
YGFLNVIVHSATGIKQISYALIRPV

SEQ ID NO: 27819 - protein, 25 aa, synthetic construct
  source 1..25: note = Seed: YGFLNVIVHSATGFKQSSKALQRPV
YGFLNVIVHSATGIKQISYALKRPV

SEQ ID NO: 27820 - protein, 25 aa, synthetic construct
  source 1..25: note = Seed: YGFLNVIVHSATGFKQSSKALQRPV
YGFLNVIVHSATGIKQISYALLRPV

SEQ ID NO: 27821 - protein, 25 aa, synthetic construct
  source 1..25: note = Seed: YGFLNVIVHSATGFKQSSKALQRPV
YGFLNVIVHSATGIKQISYALMRPV

SEQ ID NO: 27822 - protein, 25 aa, synthetic construct
  source 1..25: note = Seed: YGFLNVIVHSATGFKQSSKALQRPV
YGFLNVIVHSATGIKQISYALRRPV

SEQ ID NO: 27823 - protein, 25 aa, synthetic construct
  source 1..25: note = Seed: YGFLNVIVHSATGFKQSSKALQRPV
YGFLNVIVHSATGIKQISYALWRPV

SEQ ID NO: 27824 - protein, 25 aa, synthetic construct
  source 1..25: note = Seed: YGFLNVIVHSATGFKQSSKALQRPV
YGFLNVIVHSATGIKQISYALYRPV

SEQ ID NO: 27825 - protein, 25 aa, synthetic construct
  source 1..25: note = Seed: YGFLNVIVHSATGFKQSSKALQRPV
YGFLNVIVHSATGIKQKSAALIRPV

SEQ ID NO: 27826 - protein, 25 aa, synthetic construct
  source 1..25: note = Seed: YGFLNVIVHSATGFKQSSKALQRPV
YGFLNVIVHSATGIKQKSAALRRPV

SEQ ID NO: 27827 - protein, 25 aa, synthetic construct
  source 1..25: note = Seed: YGFLNVIVHSATGFKQSSKALQRPV
YGFLNVIVHSATGIKQKSAALYRPV

SEQ ID NO: 27828 - protein, 25 aa, synthetic construct
  source 1..25: note = Seed: YGFLNVIVHSATGFKQSSKALQRPV
YGFLNVIVHSATGIKQKSKALARPV

SEQ ID NO: 27829 - protein, 25 aa, synthetic construct
  source 1..25: note = Seed: YGFLNVIVHSATGFKQSSKALQRPV
YGFLNVIVHSATGIKQKSKALFRPV

SEQ ID NO: 27830 - protein, 25 aa, synthetic construct
  source 1..25: note = Seed: YGFLNVIVHSATGFKQSSKALQRPV
YGFLNVIVHSATGIKQKSKALMRPV

SEQ ID NO: 27831 - protein, 25 aa, synthetic construct
  source 1..25: note = Seed: YGFLNVIVHSATGFKQSSKALQRPV
YGFLNVIVHSATGIKQKSKALRRPV

SEQ ID NO: 27832 - protein, 25 aa, synthetic construct
  source 1..25: note = Seed: YGFLNVIVHSATGFKQSSKALQRPV
YGFLNVIVHSATGIKQKSKALSRPV

SEQ ID NO: 27833 - protein, 25 aa, synthetic construct
  source 1..25: note = Seed: YGFLNVIVHSATGFKQSSKALQRPV
YGFLNVIVHSATGIKQKSKALVRPV

SEQ ID NO: 27834 - protein, 25 aa, synthetic construct
  source 1..25: note = Seed: YGFLNVIVHSATGFKQSSKALQRPV
YGFLNVIVHSATGIKQKSKALYRPV

SEQ ID NO: 27835 - protein, 25 aa, synthetic construct
  source 1..25: note = Seed: YGFLNVIVHSATGFKQSSKALQRPV
YGFLNVIVHSATGIKQKSNALIRPV

SEQ ID NO: 27836 - protein, 25 aa, synthetic construct
  source 1..25: note = Seed: YGFLNVIVHSATGFKQSSKALQRPV
YGFLNVIVHSATGIKQKSNALVRPV

SEQ ID NO: 27837 - protein, 25 aa, synthetic construct
  source 1..25: note = Seed: YGFLNVIVHSATGFKQSSKALQRPV
YGFLNVIVHSATGIKQKSNALYRPV

SEQ ID NO: 27838 - protein, 25 aa, synthetic construct
  source 1..25: note = Seed: YGFLNVIVHSATGFKQSSKALQRPV
YGFLNVIVHSATGIKQKSRALARPV

SEQ ID NO: 27839 - protein, 25 aa, synthetic construct
  source 1..25: note = Seed: YGFLNVIVHSATGFKQSSKALQRPV
YGFLNVIVHSATGIKQKSRALFRPV

SEQ ID NO: 27840 - protein, 25 aa, synthetic construct
  source 1..25: note = Seed: YGFLNVIVHSATGFKQSSKALQRPV
YGFLNVIVHSATGIKQKSRALHRPV

SEQ ID NO: 27841 - protein, 25 aa, synthetic construct
  source 1..25: note = Seed: YGFLNVIVHSATGFKQSSKALQRPV
YGFLNVIVHSATGIKQKSRALIRPV

SEQ ID NO: 27842 - protein, 25 aa, synthetic construct
  source 1..25: note = Seed: YGFLNVIVHSATGFKQSSKALQRPV
YGFLNVIVHSATGIKQKSRALKRPV

SEQ ID NO: 27843 - protein, 25 aa, synthetic construct
  source 1..25: note = Seed: YGFLNVIVHSATGFKQSSKALQRPV
YGFLNVIVHSATGIKQKSRALLRPV

SEQ ID NO: 27844 - protein, 25 aa, synthetic construct
  source 1..25: note = Seed: YGFLNVIVHSATGFKQSSKALQRPV
YGFLNVIVHSATGIKQKSRALMRPV

SEQ ID NO: 27845 - protein, 25 aa, synthetic construct
  source 1..25: note = Seed: YGFLNVIVHSATGFKQSSKALQRPV
YGFLNVIVHSATGIKQKSRALQRPV

SEQ ID NO: 27846 - protein, 25 aa, synthetic construct
  source 1..25: note = Seed: YGFLNVIVHSATGFKQSSKALQRPV
YGFLNVIVHSATGIKQKSRALRRPV

SEQ ID NO: 27847 - protein, 25 aa, synthetic construct
  source 1..25: note = Seed: YGFLNVIVHSATGFKQSSKALQRPV
YGFLNVIVHSATGIKQKSRALSRPV

SEQ ID NO: 27848 - protein, 25 aa, synthetic construct
  source 1..25: note = Seed: YGFLNVIVHSATGFKQSSKALQRPV
YGFLNVIVHSATGIKQKSRALVRPV

SEQ ID NO: 27849 - protein, 25 aa, synthetic construct
  source 1..25: note = Seed: YGFLNVIVHSATGFKQSSKALQRPV
YGFLNVIVHSATGIKQKSRALYRPV

SEQ ID NO: 27850 - protein, 25 aa, synthetic construct
  source 1..25: note = Seed: YGFLNVIVHSATGFKQSSKALQRPV
YGFLNVIVHSATGIKQKSSALIRPV

SEQ ID NO: 27851 - protein, 25 aa, synthetic construct
  source 1..25: note = Seed: YGFLNVIVHSATGFKQSSKALQRPV
YGFLNVIVHSATGIKQKSSALRRPV

SEQ ID NO: 27852 - protein, 25 aa, synthetic construct
  source 1..25: note = Seed: YGFLNVIVHSATGFKQSSKALQRPV
YGFLNVIVHSATGIKQKSSALYRPV

SEQ ID NO: 27853 - protein, 25 aa, synthetic construct
  source 1..25: note = Seed: YGFLNVIVHSATGFKQSSKALQRPV
YGFLNVIVHSATGIKQKSTALYRPV

SEQ ID NO: 27854 - protein, 25 aa, synthetic construct
  source 1..25: note = Seed: YGFLNVIVHSATGFKQSSKALQRPV
YGFLNVIVHSATGIKQKSVALRRPV

SEQ ID NO: 27855 - protein, 25 aa, synthetic construct
  source 1..25: note = Seed: YGFLNVIVHSATGFKQSSKALQRPV
YGFLNVIVHSATGIKQLSAALARPV

SEQ ID NO: 27856 - protein, 25 aa, synthetic construct
  source 1..25: note = Seed: YGFLNVIVHSATGFKQSSKALQRPV
YGFLNVIVHSATGIKQLSAALDRPV

SEQ ID NO: 27857 - protein, 25 aa, synthetic construct
  source 1..25: note = Seed: YGFLNVIVHSATGFKQSSKALQRPV
YGFLNVIVHSATGIKQLSAALERPV

SEQ ID NO: 27858 - protein, 25 aa, synthetic construct
  source 1..25: note = Seed: YGFLNVIVHSATGFKQSSKALQRPV
YGFLNVIVHSATGIKQLSAALGRPV

SEQ ID NO: 27859 - protein, 25 aa, synthetic construct
  source 1..25: note = Seed: YGFLNVIVHSATGFKQSSKALQRPV
YGFLNVIVHSATGIKQLSAALHRPV

SEQ ID NO: 27860 - protein, 25 aa, synthetic construct
  source 1..25: note = Seed: YGFLNVIVHSATGFKQSSKALQRPV
YGFLNVIVHSATGIKQLSAALIRPV

SEQ ID NO: 27861 - protein, 25 aa, synthetic construct
  source 1..25: note = Seed: YGFLNVIVHSATGFKQSSKALQRPV
YGFLNVIVHSATGIKQLSAALLRPV

SEQ ID NO: 27862 - protein, 25 aa, synthetic construct
  source 1..25: note = Seed: YGFLNVIVHSATGFKQSSKALQRPV
YGFLNVIVHSATGIKQLSAALMRPV

SEQ ID NO: 27863 - protein, 25 aa, synthetic construct
  source 1..25: note = Seed: YGFLNVIVHSATGFKQSSKALQRPV
YGFLNVIVHSATGIKQLSAALNRPV

SEQ ID NO: 27864 - protein, 25 aa, synthetic construct
  source 1..25: note = Seed: YGFLNVIVHSATGFKQSSKALQRPV
YGFLNVIVHSATGIKQLSAALPRPV

SEQ ID NO: 27865 - protein, 25 aa, synthetic construct
  source 1..25: note = Seed: YGFLNVIVHSATGFKQSSKALQRPV
YGFLNVIVHSATGIKQLSAALQRPV

SEQ ID NO: 27866 - protein, 25 aa, synthetic construct
  source 1..25: note = Seed: YGFLNVIVHSATGFKQSSKALQRPV
YGFLNVIVHSATGIKQLSAALRRPV

SEQ ID NO: 27867 - protein, 25 aa, synthetic construct
  source 1..25: note = Seed: YGFLNVIVHSATGFKQSSKALQRPV
YGFLNVIVHSATGIKQLSAALSRPV

SEQ ID NO: 27868 - protein, 25 aa, synthetic construct
  source 1..25: note = Seed: YGFLNVIVHSATGFKQSSKALQRPV
YGFLNVIVHSATGIKQLSAALTRPV

SEQ ID NO: 27869 - protein, 25 aa, synthetic construct
  source 1..25: note = Seed: YGFLNVIVHSATGFKQSSKALQRPV
YGFLNVIVHSATGIKQLSAALVRPV

SEQ ID NO: 27870 - protein, 25 aa, synthetic construct
  source 1..25: note = Seed: YGFLNVIVHSATGFKQSSKALQRPV
YGFLNVIVHSATGIKQLSFALFRPV

SEQ ID NO: 27871 - protein, 25 aa, synthetic construct
  source 1..25: note = Seed: YGFLNVIVHSATGFKQSSKALQRPV
YGFLNVIVHSATGIKQLSFALIRPV

SEQ ID NO: 27872 - protein, 25 aa, synthetic construct
  source 1..25: note = Seed: YGFLNVIVHSATGFKQSSKALQRPV
YGFLNVIVHSATGIKQLSFALLRPV

SEQ ID NO: 27873 - protein, 25 aa, synthetic construct
  source 1..25: note = Seed: YGFLNVIVHSATGFKQSSKALQRPV
YGFLNVIVHSATGIKQLSFALMRPV

SEQ ID NO: 27874 - protein, 25 aa, synthetic construct
  source 1..25: note = Seed: YGFLNVIVHSATGFKQSSKALQRPV
YGFLNVIVHSATGIKQLSFALRRPV

SEQ ID NO: 27875 - protein, 25 aa, synthetic construct
  source 1..25: note = Seed: YGFLNVIVHSATGFKQSSKALQRPV
YGFLNVIVHSATGIKQLSFALVRPV

SEQ ID NO: 27876 - protein, 25 aa, synthetic construct
  source 1..25: note = Seed: YGFLNVIVHSATGFKQSSKALQRPV
YGFLNVIVHSATGIKQLSFALWRPV

SEQ ID NO: 27877 - protein, 25 aa, synthetic construct
  source 1..25: note = Seed: YGFLNVIVHSATGFKQSSKALQRPV
YGFLNVIVHSATGIKQLSFALYRPV

SEQ ID NO: 27878 - protein, 25 aa, synthetic construct
  source 1..25: note = Seed: YGFLNVIVHSATGFKQSSKALQRPV
YGFLNVIVHSATGIKQLSGALARPV

SEQ ID NO: 27879 - protein, 25 aa, synthetic construct
  source 1..25: note = Seed: YGFLNVIVHSATGFKQSSKALQRPV
YGFLNVIVHSATGIKQLSGALIRPV

SEQ ID NO: 27880 - protein, 25 aa, synthetic construct
  source 1..25: note = Seed: YGFLNVIVHSATGFKQSSKALQRPV
YGFLNVIVHSATGIKQLSGALNRPV

SEQ ID NO: 27881 - protein, 25 aa, synthetic construct
  source 1..25: note = Seed: YGFLNVIVHSATGFKQSSKALQRPV
YGFLNVIVHSATGIKQLSGALSRPV

SEQ ID NO: 27882 - protein, 25 aa, synthetic construct
  source 1..25: note = Seed: YGFLNVIVHSATGFKQSSKALQRPV
YGFLNVIVHSATGIKQLSGALTRPV

SEQ ID NO: 27883 - protein, 25 aa, synthetic construct
  source 1..25: note = Seed: YGFLNVIVHSATGFKQSSKALQRPV
YGFLNVIVHSATGIKQLSGALVRPV

SEQ ID NO: 27884 - protein, 25 aa, synthetic construct
  source 1..25: note = Seed: YGFLNVIVHSATGFKQSSKALQRPV
YGFLNVIVHSATGIKQLSHALARPV

SEQ ID NO: 27885 - protein, 25 aa, synthetic construct
  source 1..25: note = Seed: YGFLNVIVHSATGFKQSSKALQRPV
YGFLNVIVHSATGIKQLSHALFRPV

SEQ ID NO: 27886 - protein, 25 aa, synthetic construct
  source 1..25: note = Seed: YGFLNVIVHSATGFKQSSKALQRPV
YGFLNVIVHSATGIKQLSHALGRPV

SEQ ID NO: 27887 - protein, 25 aa, synthetic construct
  source 1..25: note = Seed: YGFLNVIVHSATGFKQSSKALQRPV
YGFLNVIVHSATGIKQLSHALRRPV

SEQ ID NO: 27888 - protein, 25 aa, synthetic construct
  source 1..25: note = Seed: YGFLNVIVHSATGFKQSSKALQRPV
YGFLNVIVHSATGIKQLSHALSRPV

SEQ ID NO: 27889 - protein, 25 aa, synthetic construct
  source 1..25: note = Seed: YGFLNVIVHSATGFKQSSKALQRPV
YGFLNVIVHSATGIKQLSIALARPV

SEQ ID NO: 27890 - protein, 25 aa, synthetic construct
  source 1..25: note = Seed: YGFLNVIVHSATGFKQSSKALQRPV
YGFLNVIVHSATGIKQLSIALFRPV

SEQ ID NO: 27891 - protein, 25 aa, synthetic construct
  source 1..25: note = Seed: YGFLNVIVHSATGFKQSSKALQRPV
YGFLNVIVHSATGIKQLSIALGRPV

SEQ ID NO: 27892 - protein, 25 aa, synthetic construct
  source 1..25: note = Seed: YGFLNVIVHSATGFKQSSKALQRPV
YGFLNVIVHSATGIKQLSIALHRPV

SEQ ID NO: 27893 - protein, 25 aa, synthetic construct
  source 1..25: note = Seed: YGFLNVIVHSATGFKQSSKALQRPV
YGFLNVIVHSATGIKQLSIALKRPV

SEQ ID NO: 27894 - protein, 25 aa, synthetic construct
  source 1..25: note = Seed: YGFLNVIVHSATGFKQSSKALQRPV
YGFLNVIVHSATGIKQLSIALMRPV

SEQ ID NO: 27895 - protein, 25 aa, synthetic construct
  source 1..25: note = Seed: YGFLNVIVHSATGFKQSSKALQRPV
YGFLNVIVHSATGIKQLSIALNRPV

SEQ ID NO: 27896 - protein, 25 aa, synthetic construct
  source 1..25: note = Seed: YGFLNVIVHSATGFKQSSKALQRPV
YGFLNVIVHSATGIKQLSIALRRPV

SEQ ID NO: 27897 - protein, 25 aa, synthetic construct
  source 1..25: note = Seed: YGFLNVIVHSATGFKQSSKALQRPV
YGFLNVIVHSATGIKQLSIALSRPV

SEQ ID NO: 27898 - protein, 25 aa, synthetic construct
  source 1..25: note = Seed: YGFLNVIVHSATGFKQSSKALQRPV
YGFLNVIVHSATGIKQLSIALTRPV

SEQ ID NO: 27899 - protein, 25 aa, synthetic construct
  source 1..25: note = Seed: YGFLNVIVHSATGFKQSSKALQRPV
YGFLNVIVHSATGIKQLSKALARPV

SEQ ID NO: 27900 - protein, 25 aa, synthetic construct
  source 1..25: note = Seed: YGFLNVIVHSATGFKQSSKALQRPV
YGFLNVIVHSATGIKQLSKALCRPV

SEQ ID NO: 27901 - protein, 25 aa, synthetic construct
  source 1..25: note = Seed: YGFLNVIVHSATGFKQSSKALQRPV
YGFLNVIVHSATGIKQLSKALFRPV

SEQ ID NO: 27902 - protein, 25 aa, synthetic construct
  source 1..25: note = Seed: YGFLNVIVHSATGFKQSSKALQRPV
YGFLNVIVHSATGIKQLSKALGRPV

SEQ ID NO: 27903 - protein, 25 aa, synthetic construct
  source 1..25: note = Seed: YGFLNVIVHSATGFKQSSKALQRPV
YGFLNVIVHSATGIKQLSKALHRPV

SEQ ID NO: 27904 - protein, 25 aa, synthetic construct
  source 1..25: note = Seed: YGFLNVIVHSATGFKQSSKALQRPV
YGFLNVIVHSATGIKQLSKALIRPV

SEQ ID NO: 27905 - protein, 25 aa, synthetic construct
  source 1..25: note = Seed: YGFLNVIVHSATGFKQSSKALQRPV
YGFLNVIVHSATGIKQLSKALKRPV

SEQ ID NO: 27906 - protein, 25 aa, synthetic construct
  source 1..25: note = Seed: YGFLNVIVHSATGFKQSSKALQRPV
YGFLNVIVHSATGIKQLSKALLRPV

SEQ ID NO: 27907 - protein, 25 aa, synthetic construct
  source 1..25: note = Seed: YGFLNVIVHSATGFKQSSKALQRPV
YGFLNVIVHSATGIKQLSKALMRPV

SEQ ID NO: 27908 - protein, 25 aa, synthetic construct
  source 1..25: note = Seed: YGFLNVIVHSATGFKQSSKALQRPV
YGFLNVIVHSATGIKQLSKALNRPV

SEQ ID NO: 27909 - protein, 25 aa, synthetic construct
  source 1..25: note = Seed: YGFLNVIVHSATGFKQSSKALQRPV
YGFLNVIVHSATGIKQLSKALPRPV

SEQ ID NO: 27910 - protein, 25 aa, synthetic construct
  source 1..25: note = Seed: YGFLNVIVHSATGFKQSSKALQRPV
YGFLNVIVHSATGIKQLSKALQRPV

SEQ ID NO: 27911 - protein, 25 aa, synthetic construct
  source 1..25: note = Seed: YGFLNVIVHSATGFKQSSKALQRPV
YGFLNVIVHSATGIKQLSKALRRPV

SEQ ID NO: 27912 - protein, 25 aa, synthetic construct
  source 1..25: note = Seed: YGFLNVIVHSATGFKQSSKALQRPV
YGFLNVIVHSATGIKQLSKALSRPV

SEQ ID NO: 27913 - protein, 25 aa, synthetic construct
  source 1..25: note = Seed: YGFLNVIVHSATGFKQSSKALQRPV
YGFLNVIVHSATGIKQLSKALTRPV

SEQ ID NO: 27914 - protein, 25 aa, synthetic construct
  source 1..25: note = Seed: YGFLNVIVHSATGFKQSSKALQRPV
YGFLNVIVHSATGIKQLSKALVRPV

SEQ ID NO: 27915 - protein, 25 aa, synthetic construct
  source 1..25: note = Seed: YGFLNVIVHSATGFKQSSKALQRPV
YGFLNVIVHSATGIKQLSKALYRPV

SEQ ID NO: 27916 - protein, 25 aa, synthetic construct
  source 1..25: note = Seed: YGFLNVIVHSATGFKQSSKALQRPV
YGFLNVIVHSATGIKQLSLALARPV

SEQ ID NO: 27917 - protein, 25 aa, synthetic construct
  source 1..25: note = Seed: YGFLNVIVHSATGFKQSSKALQRPV
YGFLNVIVHSATGIKQLSLALFRPV

SEQ ID NO: 27918 - protein, 25 aa, synthetic construct
  source 1..25: note = Seed: YGFLNVIVHSATGFKQSSKALQRPV
YGFLNVIVHSATGIKQLSLALKRPV

SEQ ID NO: 27919 - protein, 25 aa, synthetic construct
  source 1..25: note = Seed: YGFLNVIVHSATGFKQSSKALQRPV
YGFLNVIVHSATGIKQLSLALNRPV

SEQ ID NO: 27920 - protein, 25 aa, synthetic construct
  source 1..25: note = Seed: YGFLNVIVHSATGFKQSSKALQRPV
YGFLNVIVHSATGIKQLSLALRRPV

SEQ ID NO: 27921 - protein, 25 aa, synthetic construct
  source 1..25: note = Seed: YGFLNVIVHSATGFKQSSKALQRPV
YGFLNVIVHSATGIKQLSLALSRPV

SEQ ID NO: 27922 - protein, 25 aa, synthetic construct
  source 1..25: note = Seed: YGFLNVIVHSATGFKQSSKALQRPV
YGFLNVIVHSATGIKQLSMALARPV

SEQ ID NO: 27923 - protein, 25 aa, synthetic construct
  source 1..25: note = Seed: YGFLNVIVHSATGFKQSSKALQRPV
YGFLNVIVHSATGIKQLSMALFRPV

SEQ ID NO: 27924 - protein, 25 aa, synthetic construct
  source 1..25: note = Seed: YGFLNVIVHSATGFKQSSKALQRPV
YGFLNVIVHSATGIKQLSMALKRPV

SEQ ID NO: 27925 - protein, 25 aa, synthetic construct
  source 1..25: note = Seed: YGFLNVIVHSATGFKQSSKALQRPV
YGFLNVIVHSATGIKQLSMALNRPV

SEQ ID NO: 27926 - protein, 25 aa, synthetic construct
  source 1..25: note = Seed: YGFLNVIVHSATGFKQSSKALQRPV
YGFLNVIVHSATGIKQLSMALRRPV

SEQ ID NO: 27927 - protein, 25 aa, synthetic construct
  source 1..25: note = Seed: YGFLNVIVHSATGFKQSSKALQRPV
YGFLNVIVHSATGIKQLSMALSRPV

SEQ ID NO: 27928 - protein, 25 aa, synthetic construct
  source 1..25: note = Seed: YGFLNVIVHSATGFKQSSKALQRPV
YGFLNVIVHSATGIKQLSNALARPV

SEQ ID NO: 27929 - protein, 25 aa, synthetic construct
  source 1..25: note = Seed: YGFLNVIVHSATGFKQSSKALQRPV
YGFLNVIVHSATGIKQLSNALNRPV

SEQ ID NO: 27930 - protein, 25 aa, synthetic construct
  source 1..25: note = Seed: YGFLNVIVHSATGFKQSSKALQRPV
YGFLNVIVHSATGIKQLSNALSRPV

SEQ ID NO: 27931 - protein, 25 aa, synthetic construct
  source 1..25: note = Seed: YGFLNVIVHSATGFKQSSKALQRPV
YGFLNVIVHSATGIKQLSNALTRPV

SEQ ID NO: 27932 - protein, 25 aa, synthetic construct
  source 1..25: note = Seed: YGFLNVIVHSATGFKQSSKALQRPV
YGFLNVIVHSATGIKQLSNALVRPV

SEQ ID NO: 27933 - protein, 25 aa, synthetic construct
  source 1..25: note = Seed: YGFLNVIVHSATGFKQSSKALQRPV
YGFLNVIVHSATGIKQLSPALARPV

SEQ ID NO: 27934 - protein, 25 aa, synthetic construct
  source 1..25: note = Seed: YGFLNVIVHSATGFKQSSKALQRPV
YGFLNVIVHSATGIKQLSPALCRPV

SEQ ID NO: 27935 - protein, 25 aa, synthetic construct
  source 1..25: note = Seed: YGFLNVIVHSATGFKQSSKALQRPV
YGFLNVIVHSATGIKQLSPALDRPV

SEQ ID NO: 27936 - protein, 25 aa, synthetic construct
  source 1..25: note = Seed: YGFLNVIVHSATGFKQSSKALQRPV
YGFLNVIVHSATGIKQLSPALERPV

SEQ ID NO: 27937 - protein, 25 aa, synthetic construct
  source 1..25: note = Seed: YGFLNVIVHSATGFKQSSKALQRPV
YGFLNVIVHSATGIKQLSPALGRPV

SEQ ID NO: 27938 - protein, 25 aa, synthetic construct
  source 1..25: note = Seed: YGFLNVIVHSATGFKQSSKALQRPV
YGFLNVIVHSATGIKQLSPALHRPV

SEQ ID NO: 27939 - protein, 25 aa, synthetic construct
  source 1..25: note = Seed: YGFLNVIVHSATGFKQSSKALQRPV
YGFLNVIVHSATGIKQLSPALIRPV

SEQ ID NO: 27940 - protein, 25 aa, synthetic construct
  source 1..25: note = Seed: YGFLNVIVHSATGFKQSSKALQRPV
YGFLNVIVHSATGIKQLSPALLRPV

SEQ ID NO: 27941 - protein, 25 aa, synthetic construct
  source 1..25: note = Seed: YGFLNVIVHSATGFKQSSKALQRPV
YGFLNVIVHSATGIKQLSPALMRPV

SEQ ID NO: 27942 - protein, 25 aa, synthetic construct
  source 1..25: note = Seed: YGFLNVIVHSATGFKQSSKALQRPV
YGFLNVIVHSATGIKQLSPALNRPV

SEQ ID NO: 27943 - protein, 25 aa, synthetic construct
  source 1..25: note = Seed: YGFLNVIVHSATGFKQSSKALQRPV
YGFLNVIVHSATGIKQLSPALPRPV

SEQ ID NO: 27944 - protein, 25 aa, synthetic construct
  source 1..25: note = Seed: YGFLNVIVHSATGFKQSSKALQRPV
YGFLNVIVHSATGIKQLSPALQRPV

SEQ ID NO: 27945 - protein, 25 aa, synthetic construct
  source 1..25: note = Seed: YGFLNVIVHSATGFKQSSKALQRPV
YGFLNVIVHSATGIKQLSPALRRPV

SEQ ID NO: 27946 - protein, 25 aa, synthetic construct
  source 1..25: note = Seed: YGFLNVIVHSATGFKQSSKALQRPV
YGFLNVIVHSATGIKQLSPALSRPV

SEQ ID NO: 27947 - protein, 25 aa, synthetic construct
  source 1..25: note = Seed: YGFLNVIVHSATGFKQSSKALQRPV
YGFLNVIVHSATGIKQLSPALTRPV

SEQ ID NO: 27948 - protein, 25 aa, synthetic construct
  source 1..25: note = Seed: YGFLNVIVHSATGFKQSSKALQRPV
YGFLNVIVHSATGIKQLSPALVRPV

SEQ ID NO: 27949 - protein, 25 aa, synthetic construct
  source 1..25: note = Seed: YGFLNVIVHSATGFKQSSKALQRPV
YGFLNVIVHSATGIKQLSRALARPV

SEQ ID NO: 27950 - protein, 25 aa, synthetic construct
  source 1..25: note = Seed: YGFLNVIVHSATGFKQSSKALQRPV
YGFLNVIVHSATGIKQLSRALCRPV

SEQ ID NO: 27951 - protein, 25 aa, synthetic construct
  source 1..25: note = Seed: YGFLNVIVHSATGFKQSSKALQRPV
YGFLNVIVHSATGIKQLSRALERPV

SEQ ID NO: 27952 - protein, 25 aa, synthetic construct
  source 1..25: note = Seed: YGFLNVIVHSATGFKQSSKALQRPV
YGFLNVIVHSATGIKQLSRALFRPV

SEQ ID NO: 27953 - protein, 25 aa, synthetic construct
  source 1..25: note = Seed: YGFLNVIVHSATGFKQSSKALQRPV
YGFLNVIVHSATGIKQLSRALGRPV

SEQ ID NO: 27954 - protein, 25 aa, synthetic construct
  source 1..25: note = Seed: YGFLNVIVHSATGFKQSSKALQRPV
YGFLNVIVHSATGIKQLSRALHRPV

SEQ ID NO: 27955 - protein, 25 aa, synthetic construct
  source 1..25: note = Seed: YGFLNVIVHSATGFKQSSKALQRPV
YGFLNVIVHSATGIKQLSRALIRPV

SEQ ID NO: 27956 - protein, 25 aa, synthetic construct
  source 1..25: note = Seed: YGFLNVIVHSATGFKQSSKALQRPV
YGFLNVIVHSATGIKQLSRALKRPV

SEQ ID NO: 27957 - protein, 25 aa, synthetic construct
  source 1..25: note = Seed: YGFLNVIVHSATGFKQSSKALQRPV
YGFLNVIVHSATGIKQLSRALLRPV

SEQ ID NO: 27958 - protein, 25 aa, synthetic construct
  source 1..25: note = Seed: YGFLNVIVHSATGFKQSSKALQRPV
YGFLNVIVHSATGIKQLSRALMRPV

SEQ ID NO: 27959 - protein, 25 aa, synthetic construct
  source 1..25: note = Seed: YGFLNVIVHSATGFKQSSKALQRPV
YGFLNVIVHSATGIKQLSRALNRPV

SEQ ID NO: 27960 - protein, 25 aa, synthetic construct
  source 1..25: note = Seed: YGFLNVIVHSATGFKQSSKALQRPV
YGFLNVIVHSATGIKQLSRALPRPV

SEQ ID NO: 27961 - protein, 25 aa, synthetic construct
  source 1..25: note = Seed: YGFLNVIVHSATGFKQSSKALQRPV
YGFLNVIVHSATGIKQLSRALQRPV

SEQ ID NO: 27962 - protein, 25 aa, synthetic construct
  source 1..25: note = Seed: YGFLNVIVHSATGFKQSSKALQRPV
YGFLNVIVHSATGIKQLSRALRRPV

SEQ ID NO: 27963 - protein, 25 aa, synthetic construct
  source 1..25: note = Seed: YGFLNVIVHSATGFKQSSKALQRPV
YGFLNVIVHSATGIKQLSRALSRPV

SEQ ID NO: 27964 - protein, 25 aa, synthetic construct
  source 1..25: note = Seed: YGFLNVIVHSATGFKQSSKALQRPV
YGFLNVIVHSATGIKQLSRALTRPV

SEQ ID NO: 27965 - protein, 25 aa, synthetic construct
  source 1..25: note = Seed: YGFLNVIVHSATGFKQSSKALQRPV
YGFLNVIVHSATGIKQLSRALVRPV

SEQ ID NO: 27966 - protein, 25 aa, synthetic construct
  source 1..25: note = Seed: YGFLNVIVHSATGFKQSSKALQRPV
YGFLNVIVHSATGIKQLSRALYRPV

SEQ ID NO: 27967 - protein, 25 aa, synthetic construct
  source 1..25: note = Seed: YGFLNVIVHSATGFKQSSKALQRPV
YGFLNVIVHSATGIKQLSSALARPV

SEQ ID NO: 27968 - protein, 25 aa, synthetic construct
  source 1..25: note = Seed: YGFLNVIVHSATGFKQSSKALQRPV
YGFLNVIVHSATGIKQLSSALGRPV

SEQ ID NO: 27969 - protein, 25 aa, synthetic construct
  source 1..25: note = Seed: YGFLNVIVHSATGFKQSSKALQRPV
YGFLNVIVHSATGIKQLSSALHRPV

SEQ ID NO: 27970 - protein, 25 aa, synthetic construct
  source 1..25: note = Seed: YGFLNVIVHSATGFKQSSKALQRPV
YGFLNVIVHSATGIKQLSSALIRPV

SEQ ID NO: 27971 - protein, 25 aa, synthetic construct
  source 1..25: note = Seed: YGFLNVIVHSATGFKQSSKALQRPV
YGFLNVIVHSATGIKQLSSALLRPV

SEQ ID NO: 27972 - protein, 25 aa, synthetic construct
  source 1..25: note = Seed: YGFLNVIVHSATGFKQSSKALQRPV
YGFLNVIVHSATGIKQLSSALMRPV

SEQ ID NO: 27973 - protein, 25 aa, synthetic construct
  source 1..25: note = Seed: YGFLNVIVHSATGFKQSSKALQRPV
YGFLNVIVHSATGIKQLSSALNRPV

SEQ ID NO: 27974 - protein, 25 aa, synthetic construct
  source 1..25: note = Seed: YGFLNVIVHSATGFKQSSKALQRPV
YGFLNVIVHSATGIKQLSSALQRPV

SEQ ID NO: 27975 - protein, 25 aa, synthetic construct
  source 1..25: note = Seed: YGFLNVIVHSATGFKQSSKALQRPV
YGFLNVIVHSATGIKQLSSALRRPV

SEQ ID NO: 27976 - protein, 25 aa, synthetic construct
  source 1..25: note = Seed: YGFLNVIVHSATGFKQSSKALQRPV
YGFLNVIVHSATGIKQLSSALSRPV

SEQ ID NO: 27977 - protein, 25 aa, synthetic construct
  source 1..25: note = Seed: YGFLNVIVHSATGFKQSSKALQRPV
YGFLNVIVHSATGIKQLSSALTRPV

SEQ ID NO: 27978 - protein, 25 aa, synthetic construct
  source 1..25: note = Seed: YGFLNVIVHSATGFKQSSKALQRPV
YGFLNVIVHSATGIKQLSSALVRPV

SEQ ID NO: 27979 - protein, 25 aa, synthetic construct
  source 1..25: note = Seed: YGFLNVIVHSATGFKQSSKALQRPV
YGFLNVIVHSATGIKQLSTALARPV

SEQ ID NO: 27980 - protein, 25 aa, synthetic construct
  source 1..25: note = Seed: YGFLNVIVHSATGFKQSSKALQRPV
YGFLNVIVHSATGIKQLSTALGRPV

SEQ ID NO: 27981 - protein, 25 aa, synthetic construct
  source 1..25: note = Seed: YGFLNVIVHSATGFKQSSKALQRPV
YGFLNVIVHSATGIKQLSTALHRPV

SEQ ID NO: 27982 - protein, 25 aa, synthetic construct
  source 1..25: note = Seed: YGFLNVIVHSATGFKQSSKALQRPV
YGFLNVIVHSATGIKQLSTALIRPV

SEQ ID NO: 27983 - protein, 25 aa, synthetic construct
  source 1..25: note = Seed: YGFLNVIVHSATGFKQSSKALQRPV
YGFLNVIVHSATGIKQLSTALLRPV

SEQ ID NO: 27984 - protein, 25 aa, synthetic construct
  source 1..25: note = Seed: YGFLNVIVHSATGFKQSSKALQRPV
YGFLNVIVHSATGIKQLSTALMRPV

SEQ ID NO: 27985 - protein, 25 aa, synthetic construct
  source 1..25: note = Seed: YGFLNVIVHSATGFKQSSKALQRPV
YGFLNVIVHSATGIKQLSTALNRPV

SEQ ID NO: 27986 - protein, 25 aa, synthetic construct
  source 1..25: note = Seed: YGFLNVIVHSATGFKQSSKALQRPV
YGFLNVIVHSATGIKQLSTALQRPV

SEQ ID NO: 27987 - protein, 25 aa, synthetic construct
  source 1..25: note = Seed: YGFLNVIVHSATGFKQSSKALQRPV
YGFLNVIVHSATGIKQLSTALRRPV

SEQ ID NO: 27988 - protein, 25 aa, synthetic construct
  source 1..25: note = Seed: YGFLNVIVHSATGFKQSSKALQRPV
YGFLNVIVHSATGIKQLSTALSRPV

SEQ ID NO: 27989 - protein, 25 aa, synthetic construct
  source 1..25: note = Seed: YGFLNVIVHSATGFKQSSKALQRPV
YGFLNVIVHSATGIKQLSTALTRPV

SEQ ID NO: 27990 - protein, 25 aa, synthetic construct
  source 1..25: note = Seed: YGFLNVIVHSATGFKQSSKALQRPV
YGFLNVIVHSATGIKQLSTALVRPV

SEQ ID NO: 27991 - protein, 25 aa, synthetic construct
  source 1..25: note = Seed: YGFLNVIVHSATGFKQSSKALQRPV
YGFLNVIVHSATGIKQLSVALARPV

SEQ ID NO: 27992 - protein, 25 aa, synthetic construct
  source 1..25: note = Seed: YGFLNVIVHSATGFKQSSKALQRPV
YGFLNVIVHSATGIKQLSVALGRPV

SEQ ID NO: 27993 - protein, 25 aa, synthetic construct
  source 1..25: note = Seed: YGFLNVIVHSATGFKQSSKALQRPV
YGFLNVIVHSATGIKQLSVALHRPV

SEQ ID NO: 27994 - protein, 25 aa, synthetic construct
  source 1..25: note = Seed: YGFLNVIVHSATGFKQSSKALQRPV
YGFLNVIVHSATGIKQLSVALKRPV

SEQ ID NO: 27995 - protein, 25 aa, synthetic construct
  source 1..25: note = Seed: YGFLNVIVHSATGFKQSSKALQRPV
YGFLNVIVHSATGIKQLSVALMRPV

SEQ ID NO: 27996 - protein, 25 aa, synthetic construct
  source 1..25: note = Seed: YGFLNVIVHSATGFKQSSKALQRPV
YGFLNVIVHSATGIKQLSVALNRPV

SEQ ID NO: 27997 - protein, 25 aa, synthetic construct
  source 1..25: note = Seed: YGFLNVIVHSATGFKQSSKALQRPV
YGFLNVIVHSATGIKQLSVALQRPV

SEQ ID NO: 27998 - protein, 25 aa, synthetic construct
  source 1..25: note = Seed: YGFLNVIVHSATGFKQSSKALQRPV
YGFLNVIVHSATGIKQLSVALRRPV

SEQ ID NO: 27999 - protein, 25 aa, synthetic construct
  source 1..25: note = Seed: YGFLNVIVHSATGFKQSSKALQRPV
YGFLNVIVHSATGIKQLSVALSRPV

SEQ ID NO: 28000 - protein, 25 aa, synthetic construct
  source 1..25: note = Seed: YGFLNVIVHSATGFKQSSKALQRPV
YGFLNVIVHSATGIKQLSVALTRPV

SEQ ID NO: 28001 - protein, 25 aa, synthetic construct
  source 1..25: note = Seed: YGFLNVIVHSATGFKQSSKALQRPV
YGFLNVIVHSATGIKQLSVALVRPV

SEQ ID NO: 28002 - protein, 25 aa, synthetic construct
  source 1..25: note = Seed: YGFLNVIVHSATGFKQSSKALQRPV
YGFLNVIVHSATGIKQLSWALFRPV

SEQ ID NO: 28003 - protein, 25 aa, synthetic construct
  source 1..25: note = Seed: YGFLNVIVHSATGFKQSSKALQRPV
YGFLNVIVHSATGIKQLSWALLRPV

SEQ ID NO: 28004 - protein, 25 aa, synthetic construct
  source 1..25: note = Seed: YGFLNVIVHSATGFKQSSKALQRPV
YGFLNVIVHSATGIKQLSWALRRPV

SEQ ID NO: 28005 - protein, 25 aa, synthetic construct
  source 1..25: note = Seed: YGFLNVIVHSATGFKQSSKALQRPV
YGFLNVIVHSATGIKQLSWALYRPV

SEQ ID NO: 28006 - protein, 25 aa, synthetic construct
  source 1..25: note = Seed: YGFLNVIVHSATGFKQSSKALQRPV
YGFLNVIVHSATGIKQLSYALARPV

SEQ ID NO: 28007 - protein, 25 aa, synthetic construct
  source 1..25: note = Seed: YGFLNVIVHSATGFKQSSKALQRPV
YGFLNVIVHSATGIKQLSYALFRPV

SEQ ID NO: 28008 - protein, 25 aa, synthetic construct
  source 1..25: note = Seed: YGFLNVIVHSATGFKQSSKALQRPV
YGFLNVIVHSATGIKQLSYALIRPV

SEQ ID NO: 28009 - protein, 25 aa, synthetic construct
  source 1..25: note = Seed: YGFLNVIVHSATGFKQSSKALQRPV
YGFLNVIVHSATGIKQLSYALLRPV

SEQ ID NO: 28010 - protein, 25 aa, synthetic construct
  source 1..25: note = Seed: YGFLNVIVHSATGFKQSSKALQRPV
YGFLNVIVHSATGIKQLSYALMRPV

SEQ ID NO: 28011 - protein, 25 aa, synthetic construct
  source 1..25: note = Seed: YGFLNVIVHSATGFKQSSKALQRPV
YGFLNVIVHSATGIKQLSYALRRPV

SEQ ID NO: 28012 - protein, 25 aa, synthetic construct
  source 1..25: note = Seed: YGFLNVIVHSATGFKQSSKALQRPV
YGFLNVIVHSATGIKQLSYALWRPV

SEQ ID NO: 28013 - protein, 25 aa, synthetic construct
  source 1..25: note = Seed: YGFLNVIVHSATGFKQSSKALQRPV
YGFLNVIVHSATGIKQLSYALYRPV

SEQ ID NO: 28014 - protein, 25 aa, synthetic construct
  source 1..25: note = Seed: YGFLNVIVHSATGFKQSSKALQRPV
YGFLNVIVHSATGIKQMSAALARPV

SEQ ID NO: 28015 - protein, 25 aa, synthetic construct
  source 1..25: note = Seed: YGFLNVIVHSATGFKQSSKALQRPV
YGFLNVIVHSATGIKQMSAALDRPV

SEQ ID NO: 28016 - protein, 25 aa, synthetic construct
  source 1..25: note = Seed: YGFLNVIVHSATGFKQSSKALQRPV
YGFLNVIVHSATGIKQMSAALERPV

SEQ ID NO: 28017 - protein, 25 aa, synthetic construct
  source 1..25: note = Seed: YGFLNVIVHSATGFKQSSKALQRPV
YGFLNVIVHSATGIKQMSAALGRPV

SEQ ID NO: 28018 - protein, 25 aa, synthetic construct
  source 1..25: note = Seed: YGFLNVIVHSATGFKQSSKALQRPV
YGFLNVIVHSATGIKQMSAALHRPV

SEQ ID NO: 28019 - protein, 25 aa, synthetic construct
  source 1..25: note = Seed: YGFLNVIVHSATGFKQSSKALQRPV
YGFLNVIVHSATGIKQMSAALIRPV

SEQ ID NO: 28020 - protein, 25 aa, synthetic construct
  source 1..25: note = Seed: YGFLNVIVHSATGFKQSSKALQRPV
YGFLNVIVHSATGIKQMSAALLRPV

SEQ ID NO: 28021 - protein, 25 aa, synthetic construct
  source 1..25: note = Seed: YGFLNVIVHSATGFKQSSKALQRPV
YGFLNVIVHSATGIKQMSAALMRPV

SEQ ID NO: 28022 - protein, 25 aa, synthetic construct
  source 1..25: note = Seed: YGFLNVIVHSATGFKQSSKALQRPV
YGFLNVIVHSATGIKQMSAALNRPV

SEQ ID NO: 28023 - protein, 25 aa, synthetic construct
  source 1..25: note = Seed: YGFLNVIVHSATGFKQSSKALQRPV
YGFLNVIVHSATGIKQMSAALPRPV

SEQ ID NO: 28024 - protein, 25 aa, synthetic construct
  source 1..25: note = Seed: YGFLNVIVHSATGFKQSSKALQRPV
YGFLNVIVHSATGIKQMSAALQRPV

SEQ ID NO: 28025 - protein, 25 aa, synthetic construct
  source 1..25: note = Seed: YGFLNVIVHSATGFKQSSKALQRPV
YGFLNVIVHSATGIKQMSAALRRPV

SEQ ID NO: 28026 - protein, 25 aa, synthetic construct
  source 1..25: note = Seed: YGFLNVIVHSATGFKQSSKALQRPV
YGFLNVIVHSATGIKQMSAALSRPV

SEQ ID NO: 28027 - protein, 25 aa, synthetic construct
  source 1..25: note = Seed: YGFLNVIVHSATGFKQSSKALQRPV
YGFLNVIVHSATGIKQMSAALTRPV

SEQ ID NO: 28028 - protein, 25 aa, synthetic construct
  source 1..25: note = Seed: YGFLNVIVHSATGFKQSSKALQRPV
YGFLNVIVHSATGIKQMSAALVRPV

SEQ ID NO: 28029 - protein, 25 aa, synthetic construct
  source 1..25: note = Seed: YGFLNVIVHSATGFKQSSKALQRPV
YGFLNVIVHSATGIKQMSFALFRPV

SEQ ID NO: 28030 - protein, 25 aa, synthetic construct
  source 1..25: note = Seed: YGFLNVIVHSATGFKQSSKALQRPV
YGFLNVIVHSATGIKQMSFALIRPV

SEQ ID NO: 28031 - protein, 25 aa, synthetic construct
  source 1..25: note = Seed: YGFLNVIVHSATGFKQSSKALQRPV
YGFLNVIVHSATGIKQMSFALLRPV

SEQ ID NO: 28032 - protein, 25 aa, synthetic construct
  source 1..25: note = Seed: YGFLNVIVHSATGFKQSSKALQRPV
YGFLNVIVHSATGIKQMSFALMRPV

SEQ ID NO: 28033 - protein, 25 aa, synthetic construct
  source 1..25: note = Seed: YGFLNVIVHSATGFKQSSKALQRPV
YGFLNVIVHSATGIKQMSFALVRPV

SEQ ID NO: 28034 - protein, 25 aa, synthetic construct
  source 1..25: note = Seed: YGFLNVIVHSATGFKQSSKALQRPV
YGFLNVIVHSATGIKQMSFALYRPV

SEQ ID NO: 28035 - protein, 25 aa, synthetic construct
  source 1..25: note = Seed: YGFLNVIVHSATGFKQSSKALQRPV
YGFLNVIVHSATGIKQMSGALARPV

SEQ ID NO: 28036 - protein, 25 aa, synthetic construct
  source 1..25: note = Seed: YGFLNVIVHSATGFKQSSKALQRPV
YGFLNVIVHSATGIKQMSGALIRPV

SEQ ID NO: 28037 - protein, 25 aa, synthetic construct
  source 1..25: note = Seed: YGFLNVIVHSATGFKQSSKALQRPV
YGFLNVIVHSATGIKQMSGALLRPV

SEQ ID NO: 28038 - protein, 25 aa, synthetic construct
  source 1..25: note = Seed: YGFLNVIVHSATGFKQSSKALQRPV
YGFLNVIVHSATGIKQMSGALMRPV

SEQ ID NO: 28039 - protein, 25 aa, synthetic construct
  source 1..25: note = Seed: YGFLNVIVHSATGFKQSSKALQRPV
YGFLNVIVHSATGIKQMSGALNRPV

SEQ ID NO: 28040 - protein, 25 aa, synthetic construct
  source 1..25: note = Seed: YGFLNVIVHSATGFKQSSKALQRPV
YGFLNVIVHSATGIKQMSGALSRPV

SEQ ID NO: 28041 - protein, 25 aa, synthetic construct
  source 1..25: note = Seed: YGFLNVIVHSATGFKQSSKALQRPV
YGFLNVIVHSATGIKQMSGALTRPV

SEQ ID NO: 28042 - protein, 25 aa, synthetic construct
  source 1..25: note = Seed: YGFLNVIVHSATGFKQSSKALQRPV
YGFLNVIVHSATGIKQMSGALVRPV

SEQ ID NO: 28043 - protein, 25 aa, synthetic construct
  source 1..25: note = Seed: YGFLNVIVHSATGFKQSSKALQRPV
YGFLNVIVHSATGIKQMSHALARPV

SEQ ID NO: 28044 - protein, 25 aa, synthetic construct
  source 1..25: note = Seed: YGFLNVIVHSATGFKQSSKALQRPV
YGFLNVIVHSATGIKQMSHALGRPV

SEQ ID NO: 28045 - protein, 25 aa, synthetic construct
  source 1..25: note = Seed: YGFLNVIVHSATGFKQSSKALQRPV
YGFLNVIVHSATGIKQMSHALHRPV

SEQ ID NO: 28046 - protein, 25 aa, synthetic construct
  source 1..25: note = Seed: YGFLNVIVHSATGFKQSSKALQRPV
YGFLNVIVHSATGIKQMSHALKRPV

SEQ ID NO: 28047 - protein, 25 aa, synthetic construct
  source 1..25: note = Seed: YGFLNVIVHSATGFKQSSKALQRPV
YGFLNVIVHSATGIKQMSHALRRPV

SEQ ID NO: 28048 - protein, 25 aa, synthetic construct
  source 1..25: note = Seed: YGFLNVIVHSATGFKQSSKALQRPV
YGFLNVIVHSATGIKQMSHALSRPV

SEQ ID NO: 28049 - protein, 25 aa, synthetic construct
  source 1..25: note = Seed: YGFLNVIVHSATGFKQSSKALQRPV
YGFLNVIVHSATGIKQMSHALYRPV

SEQ ID NO: 28050 - protein, 25 aa, synthetic construct
  source 1..25: note = Seed: YGFLNVIVHSATGFKQSSKALQRPV
YGFLNVIVHSATGIKQMSIALARPV

SEQ ID NO: 28051 - protein, 25 aa, synthetic construct
  source 1..25: note = Seed: YGFLNVIVHSATGFKQSSKALQRPV
YGFLNVIVHSATGIKQMSIALGRPV

SEQ ID NO: 28052 - protein, 25 aa, synthetic construct
  source 1..25: note = Seed: YGFLNVIVHSATGFKQSSKALQRPV
YGFLNVIVHSATGIKQMSIALHRPV

SEQ ID NO: 28053 - protein, 25 aa, synthetic construct
  source 1..25: note = Seed: YGFLNVIVHSATGFKQSSKALQRPV
YGFLNVIVHSATGIKQMSIALIRPV

SEQ ID NO: 28054 - protein, 25 aa, synthetic construct
  source 1..25: note = Seed: YGFLNVIVHSATGFKQSSKALQRPV
YGFLNVIVHSATGIKQMSIALKRPV

SEQ ID NO: 28055 - protein, 25 aa, synthetic construct
  source 1..25: note = Seed: YGFLNVIVHSATGFKQSSKALQRPV
YGFLNVIVHSATGIKQMSIALMRPV

SEQ ID NO: 28056 - protein, 25 aa, synthetic construct
  source 1..25: note = Seed: YGFLNVIVHSATGFKQSSKALQRPV
YGFLNVIVHSATGIKQMSIALNRPV

SEQ ID NO: 28057 - protein, 25 aa, synthetic construct
  source 1..25: note = Seed: YGFLNVIVHSATGFKQSSKALQRPV
YGFLNVIVHSATGIKQMSIALQRPV

SEQ ID NO: 28058 - protein, 25 aa, synthetic construct
  source 1..25: note = Seed: YGFLNVIVHSATGFKQSSKALQRPV
YGFLNVIVHSATGIKQMSIALRRPV

SEQ ID NO: 28059 - protein, 25 aa, synthetic construct
  source 1..25: note = Seed: YGFLNVIVHSATGFKQSSKALQRPV
YGFLNVIVHSATGIKQMSIALSRPV

SEQ ID NO: 28060 - protein, 25 aa, synthetic construct
  source 1..25: note = Seed: YGFLNVIVHSATGFKQSSKALQRPV
YGFLNVIVHSATGIKQMSIALTRPV

SEQ ID NO: 28061 - protein, 25 aa, synthetic construct
  source 1..25: note = Seed: YGFLNVIVHSATGFKQSSKALQRPV
YGFLNVIVHSATGIKQMSIALVRPV

SEQ ID NO: 28062 - protein, 25 aa, synthetic construct
  source 1..25: note = Seed: YGFLNVIVHSATGFKQSSKALQRPV
YGFLNVIVHSATGIKQMSKALARPV

SEQ ID NO: 28063 - protein, 25 aa, synthetic construct
  source 1..25: note = Seed: YGFLNVIVHSATGFKQSSKALQRPV
YGFLNVIVHSATGIKQMSKALCRPV

SEQ ID NO: 28064 - protein, 25 aa, synthetic construct
  source 1..25: note = Seed: YGFLNVIVHSATGFKQSSKALQRPV
YGFLNVIVHSATGIKQMSKALERPV

SEQ ID NO: 28065 - protein, 25 aa, synthetic construct
  source 1..25: note = Seed: YGFLNVIVHSATGFKQSSKALQRPV
YGFLNVIVHSATGIKQMSKALFRPV

SEQ ID NO: 28066 - protein, 25 aa, synthetic construct
  source 1..25: note = Seed: YGFLNVIVHSATGFKQSSKALQRPV
YGFLNVIVHSATGIKQMSKALGRPV

SEQ ID NO: 28067 - protein, 25 aa, synthetic construct
  source 1..25: note = Seed: YGFLNVIVHSATGFKQSSKALQRPV
YGFLNVIVHSATGIKQMSKALHRPV

SEQ ID NO: 28068 - protein, 25 aa, synthetic construct
  source 1..25: note = Seed: YGFLNVIVHSATGFKQSSKALQRPV
YGFLNVIVHSATGIKQMSKALIRPV

SEQ ID NO: 28069 - protein, 25 aa, synthetic construct
  source 1..25: note = Seed: YGFLNVIVHSATGFKQSSKALQRPV
YGFLNVIVHSATGIKQMSKALKRPV

SEQ ID NO: 28070 - protein, 25 aa, synthetic construct
  source 1..25: note = Seed: YGFLNVIVHSATGFKQSSKALQRPV
YGFLNVIVHSATGIKQMSKALLRPV

SEQ ID NO: 28071 - protein, 25 aa, synthetic construct
  source 1..25: note = Seed: YGFLNVIVHSATGFKQSSKALQRPV
YGFLNVIVHSATGIKQMSKALMRPV

SEQ ID NO: 28072 - protein, 25 aa, synthetic construct
  source 1..25: note = Seed: YGFLNVIVHSATGFKQSSKALQRPV
YGFLNVIVHSATGIKQMSKALNRPV

SEQ ID NO: 28073 - protein, 25 aa, synthetic construct
  source 1..25: note = Seed: YGFLNVIVHSATGFKQSSKALQRPV
YGFLNVIVHSATGIKQMSKALPRPV

SEQ ID NO: 28074 - protein, 25 aa, synthetic construct
  source 1..25: note = Seed: YGFLNVIVHSATGFKQSSKALQRPV
YGFLNVIVHSATGIKQMSKALQRPV

SEQ ID NO: 28075 - protein, 25 aa, synthetic construct
  source 1..25: note = Seed: YGFLNVIVHSATGFKQSSKALQRPV
YGFLNVIVHSATGIKQMSKALRRPV

SEQ ID NO: 28076 - protein, 25 aa, synthetic construct
  source 1..25: note = Seed: YGFLNVIVHSATGFKQSSKALQRPV
YGFLNVIVHSATGIKQMSKALSRPV

SEQ ID NO: 28077 - protein, 25 aa, synthetic construct
  source 1..25: note = Seed: YGFLNVIVHSATGFKQSSKALQRPV
YGFLNVIVHSATGIKQMSKALTRPV

SEQ ID NO: 28078 - protein, 25 aa, synthetic construct
  source 1..25: note = Seed: YGFLNVIVHSATGFKQSSKALQRPV
YGFLNVIVHSATGIKQMSKALVRPV

SEQ ID NO: 28079 - protein, 25 aa, synthetic construct
  source 1..25: note = Seed: YGFLNVIVHSATGFKQSSKALQRPV
YGFLNVIVHSATGIKQMSKALYRPV

SEQ ID NO: 28080 - protein, 25 aa, synthetic construct
  source 1..25: note = Seed: YGFLNVIVHSATGFKQSSKALQRPV
YGFLNVIVHSATGIKQMSLALARPV

SEQ ID NO: 28081 - protein, 25 aa, synthetic construct
  source 1..25: note = Seed: YGFLNVIVHSATGFKQSSKALQRPV
YGFLNVIVHSATGIKQMSLALFRPV

SEQ ID NO: 28082 - protein, 25 aa, synthetic construct
  source 1..25: note = Seed: YGFLNVIVHSATGFKQSSKALQRPV
YGFLNVIVHSATGIKQMSLALHRPV

SEQ ID NO: 28083 - protein, 25 aa, synthetic construct
  source 1..25: note = Seed: YGFLNVIVHSATGFKQSSKALQRPV
YGFLNVIVHSATGIKQMSLALKRPV

SEQ ID NO: 28084 - protein, 25 aa, synthetic construct
  source 1..25: note = Seed: YGFLNVIVHSATGFKQSSKALQRPV
YGFLNVIVHSATGIKQMSLALNRPV

SEQ ID NO: 28085 - protein, 25 aa, synthetic construct
  source 1..25: note = Seed: YGFLNVIVHSATGFKQSSKALQRPV
YGFLNVIVHSATGIKQMSLALRRPV

SEQ ID NO: 28086 - protein, 25 aa, synthetic construct
  source 1..25: note = Seed: YGFLNVIVHSATGFKQSSKALQRPV
YGFLNVIVHSATGIKQMSLALSRPV

SEQ ID NO: 28087 - protein, 25 aa, synthetic construct
  source 1..25: note = Seed: YGFLNVIVHSATGFKQSSKALQRPV
YGFLNVIVHSATGIKQMSLALTRPV

SEQ ID NO: 28088 - protein, 25 aa, synthetic construct
  source 1..25: note = Seed: YGFLNVIVHSATGFKQSSKALQRPV
YGFLNVIVHSATGIKQMSMALARPV

SEQ ID NO: 28089 - protein, 25 aa, synthetic construct
  source 1..25: note = Seed: YGFLNVIVHSATGFKQSSKALQRPV
YGFLNVIVHSATGIKQMSMALFRPV

SEQ ID NO: 28090 - protein, 25 aa, synthetic construct
  source 1..25: note = Seed: YGFLNVIVHSATGFKQSSKALQRPV
YGFLNVIVHSATGIKQMSMALIRPV

SEQ ID NO: 28091 - protein, 25 aa, synthetic construct
  source 1..25: note = Seed: YGFLNVIVHSATGFKQSSKALQRPV
YGFLNVIVHSATGIKQMSMALMRPV

SEQ ID NO: 28092 - protein, 25 aa, synthetic construct
  source 1..25: note = Seed: YGFLNVIVHSATGFKQSSKALQRPV
YGFLNVIVHSATGIKQMSMALNRPV

SEQ ID NO: 28093 - protein, 25 aa, synthetic construct
  source 1..25: note = Seed: YGFLNVIVHSATGFKQSSKALQRPV
YGFLNVIVHSATGIKQMSMALRRPV

SEQ ID NO: 28094 - protein, 25 aa, synthetic construct
  source 1..25: note = Seed: YGFLNVIVHSATGFKQSSKALQRPV
YGFLNVIVHSATGIKQMSMALSRPV

SEQ ID NO: 28095 - protein, 25 aa, synthetic construct
  source 1..25: note = Seed: YGFLNVIVHSATGFKQSSKALQRPV
YGFLNVIVHSATGIKQMSMALTRPV

SEQ ID NO: 28096 - protein, 25 aa, synthetic construct
  source 1..25: note = Seed: YGFLNVIVHSATGFKQSSKALQRPV
YGFLNVIVHSATGIKQMSMALVRPV

SEQ ID NO: 28097 - protein, 25 aa, synthetic construct
  source 1..25: note = Seed: YGFLNVIVHSATGFKQSSKALQRPV
YGFLNVIVHSATGIKQMSNALARPV

SEQ ID NO: 28098 - protein, 25 aa, synthetic construct
  source 1..25: note = Seed: YGFLNVIVHSATGFKQSSKALQRPV
YGFLNVIVHSATGIKQMSNALGRPV

SEQ ID NO: 28099 - protein, 25 aa, synthetic construct
  source 1..25: note = Seed: YGFLNVIVHSATGFKQSSKALQRPV
YGFLNVIVHSATGIKQMSNALIRPV

SEQ ID NO: 28100 - protein, 25 aa, synthetic construct
  source 1..25: note = Seed: YGFLNVIVHSATGFKQSSKALQRPV
YGFLNVIVHSATGIKQMSNALMRPV

SEQ ID NO: 28101 - protein, 25 aa, synthetic construct
  source 1..25: note = Seed: YGFLNVIVHSATGFKQSSKALQRPV
YGFLNVIVHSATGIKQMSNALNRPV

SEQ ID NO: 28102 - protein, 25 aa, synthetic construct
  source 1..25: note = Seed: YGFLNVIVHSATGFKQSSKALQRPV
YGFLNVIVHSATGIKQMSNALQRPV

SEQ ID NO: 28103 - protein, 25 aa, synthetic construct
  source 1..25: note = Seed: YGFLNVIVHSATGFKQSSKALQRPV
YGFLNVIVHSATGIKQMSNALRRPV

SEQ ID NO: 28104 - protein, 25 aa, synthetic construct
  source 1..25: note = Seed: YGFLNVIVHSATGFKQSSKALQRPV
YGFLNVIVHSATGIKQMSNALSRPV

SEQ ID NO: 28105 - protein, 25 aa, synthetic construct
  source 1..25: note = Seed: YGFLNVIVHSATGFKQSSKALQRPV
YGFLNVIVHSATGIKQMSNALTRPV

SEQ ID NO: 28106 - protein, 25 aa, synthetic construct
  source 1..25: note = Seed: YGFLNVIVHSATGFKQSSKALQRPV
YGFLNVIVHSATGIKQMSNALVRPV

SEQ ID NO: 28107 - protein, 25 aa, synthetic construct
  source 1..25: note = Seed: YGFLNVIVHSATGFKQSSKALQRPV
YGFLNVIVHSATGIKQMSPALARPV

SEQ ID NO: 28108 - protein, 25 aa, synthetic construct
  source 1..25: note = Seed: YGFLNVIVHSATGFKQSSKALQRPV
YGFLNVIVHSATGIKQMSPALCRPV

SEQ ID NO: 28109 - protein, 25 aa, synthetic construct
  source 1..25: note = Seed: YGFLNVIVHSATGFKQSSKALQRPV
YGFLNVIVHSATGIKQMSPALDRPV

SEQ ID NO: 28110 - protein, 25 aa, synthetic construct
  source 1..25: note = Seed: YGFLNVIVHSATGFKQSSKALQRPV
YGFLNVIVHSATGIKQMSPALERPV

SEQ ID NO: 28111 - protein, 25 aa, synthetic construct
  source 1..25: note = Seed: YGFLNVIVHSATGFKQSSKALQRPV
YGFLNVIVHSATGIKQMSPALGRPV

SEQ ID NO: 28112 - protein, 25 aa, synthetic construct
  source 1..25: note = Seed: YGFLNVIVHSATGFKQSSKALQRPV
YGFLNVIVHSATGIKQMSPALHRPV

SEQ ID NO: 28113 - protein, 25 aa, synthetic construct
  source 1..25: note = Seed: YGFLNVIVHSATGFKQSSKALQRPV
YGFLNVIVHSATGIKQMSPALIRPV

SEQ ID NO: 28114 - protein, 25 aa, synthetic construct
  source 1..25: note = Seed: YGFLNVIVHSATGFKQSSKALQRPV
YGFLNVIVHSATGIKQMSPALLRPV

SEQ ID NO: 28115 - protein, 25 aa, synthetic construct
  source 1..25: note = Seed: YGFLNVIVHSATGFKQSSKALQRPV
YGFLNVIVHSATGIKQMSPALMRPV

SEQ ID NO: 28116 - protein, 25 aa, synthetic construct
  source 1..25: note = Seed: YGFLNVIVHSATGFKQSSKALQRPV
YGFLNVIVHSATGIKQMSPALNRPV

SEQ ID NO: 28117 - protein, 25 aa, synthetic construct
  source 1..25: note = Seed: YGFLNVIVHSATGFKQSSKALQRPV
YGFLNVIVHSATGIKQMSPALPRPV

SEQ ID NO: 28118 - protein, 25 aa, synthetic construct
  source 1..25: note = Seed: YGFLNVIVHSATGFKQSSKALQRPV
YGFLNVIVHSATGIKQMSPALQRPV

SEQ ID NO: 28119 - protein, 25 aa, synthetic construct
  source 1..25: note = Seed: YGFLNVIVHSATGFKQSSKALQRPV
YGFLNVIVHSATGIKQMSPALRRPV

SEQ ID NO: 28120 - protein, 25 aa, synthetic construct
  source 1..25: note = Seed: YGFLNVIVHSATGFKQSSKALQRPV
YGFLNVIVHSATGIKQMSPALSRPV

SEQ ID NO: 28121 - protein, 25 aa, synthetic construct
  source 1..25: note = Seed: YGFLNVIVHSATGFKQSSKALQRPV
YGFLNVIVHSATGIKQMSPALTRPV

SEQ ID NO: 28122 - protein, 25 aa, synthetic construct
  source 1..25: note = Seed: YGFLNVIVHSATGFKQSSKALQRPV
YGFLNVIVHSATGIKQMSPALVRPV

SEQ ID NO: 28123 - protein, 25 aa, synthetic construct
  source 1..25: note = Seed: YGFLNVIVHSATGFKQSSKALQRPV
YGFLNVIVHSATGIKQMSRALARPV

SEQ ID NO: 28124 - protein, 25 aa, synthetic construct
  source 1..25: note = Seed: YGFLNVIVHSATGFKQSSKALQRPV
YGFLNVIVHSATGIKQMSRALCRPV

SEQ ID NO: 28125 - protein, 25 aa, synthetic construct
  source 1..25: note = Seed: YGFLNVIVHSATGFKQSSKALQRPV
YGFLNVIVHSATGIKQMSRALDRPV

SEQ ID NO: 28126 - protein, 25 aa, synthetic construct
  source 1..25: note = Seed: YGFLNVIVHSATGFKQSSKALQRPV
YGFLNVIVHSATGIKQMSRALERPV

SEQ ID NO: 28127 - protein, 25 aa, synthetic construct
  source 1..25: note = Seed: YGFLNVIVHSATGFKQSSKALQRPV
YGFLNVIVHSATGIKQMSRALFRPV

SEQ ID NO: 28128 - protein, 25 aa, synthetic construct
  source 1..25: note = Seed: YGFLNVIVHSATGFKQSSKALQRPV
YGFLNVIVHSATGIKQMSRALGRPV

SEQ ID NO: 28129 - protein, 25 aa, synthetic construct
  source 1..25: note = Seed: YGFLNVIVHSATGFKQSSKALQRPV
YGFLNVIVHSATGIKQMSRALHRPV

SEQ ID NO: 28130 - protein, 25 aa, synthetic construct
  source 1..25: note = Seed: YGFLNVIVHSATGFKQSSKALQRPV
YGFLNVIVHSATGIKQMSRALIRPV

SEQ ID NO: 28131 - protein, 25 aa, synthetic construct
  source 1..25: note = Seed: YGFLNVIVHSATGFKQSSKALQRPV
YGFLNVIVHSATGIKQMSRALKRPV

SEQ ID NO: 28132 - protein, 25 aa, synthetic construct
  source 1..25: note = Seed: YGFLNVIVHSATGFKQSSKALQRPV
YGFLNVIVHSATGIKQMSRALLRPV

SEQ ID NO: 28133 - protein, 25 aa, synthetic construct
  source 1..25: note = Seed: YGFLNVIVHSATGFKQSSKALQRPV
YGFLNVIVHSATGIKQMSRALMRPV

SEQ ID NO: 28134 - protein, 25 aa, synthetic construct
  source 1..25: note = Seed: YGFLNVIVHSATGFKQSSKALQRPV
YGFLNVIVHSATGIKQMSRALNRPV

SEQ ID NO: 28135 - protein, 25 aa, synthetic construct
  source 1..25: note = Seed: YGFLNVIVHSATGFKQSSKALQRPV
YGFLNVIVHSATGIKQMSRALPRPV

SEQ ID NO: 28136 - protein, 25 aa, synthetic construct
  source 1..25: note = Seed: YGFLNVIVHSATGFKQSSKALQRPV
YGFLNVIVHSATGIKQMSRALQRPV

SEQ ID NO: 28137 - protein, 25 aa, synthetic construct
  source 1..25: note = Seed: YGFLNVIVHSATGFKQSSKALQRPV
YGFLNVIVHSATGIKQMSRALRRPV

SEQ ID NO: 28138 - protein, 25 aa, synthetic construct
  source 1..25: note = Seed: YGFLNVIVHSATGFKQSSKALQRPV
YGFLNVIVHSATGIKQMSRALSRPV

SEQ ID NO: 28139 - protein, 25 aa, synthetic construct
  source 1..25: note = Seed: YGFLNVIVHSATGFKQSSKALQRPV
YGFLNVIVHSATGIKQMSRALTRPV

SEQ ID NO: 28140 - protein, 25 aa, synthetic construct
  source 1..25: note = Seed: YGFLNVIVHSATGFKQSSKALQRPV
YGFLNVIVHSATGIKQMSRALVRPV

SEQ ID NO: 28141 - protein, 25 aa, synthetic construct
  source 1..25: note = Seed: YGFLNVIVHSATGFKQSSKALQRPV
YGFLNVIVHSATGIKQMSRALWRPV

SEQ ID NO: 28142 - protein, 25 aa, synthetic construct
  source 1..25: note = Seed: YGFLNVIVHSATGFKQSSKALQRPV
YGFLNVIVHSATGIKQMSRALYRPV

SEQ ID NO: 28143 - protein, 25 aa, synthetic construct
  source 1..25: note = Seed: YGFLNVIVHSATGFKQSSKALQRPV
YGFLNVIVHSATGIKQMSSALARPV

SEQ ID NO: 28144 - protein, 25 aa, synthetic construct
  source 1..25: note = Seed: YGFLNVIVHSATGFKQSSKALQRPV
YGFLNVIVHSATGIKQMSSALGRPV

SEQ ID NO: 28145 - protein, 25 aa, synthetic construct
  source 1..25: note = Seed: YGFLNVIVHSATGFKQSSKALQRPV
YGFLNVIVHSATGIKQMSSALHRPV

SEQ ID NO: 28146 - protein, 25 aa, synthetic construct
  source 1..25: note = Seed: YGFLNVIVHSATGFKQSSKALQRPV
YGFLNVIVHSATGIKQMSSALIRPV

SEQ ID NO: 28147 - protein, 25 aa, synthetic construct
  source 1..25: note = Seed: YGFLNVIVHSATGFKQSSKALQRPV
YGFLNVIVHSATGIKQMSSALLRPV

SEQ ID NO: 28148 - protein, 25 aa, synthetic construct
  source 1..25: note = Seed: YGFLNVIVHSATGFKQSSKALQRPV
YGFLNVIVHSATGIKQMSSALMRPV

SEQ ID NO: 28149 - protein, 25 aa, synthetic construct
  source 1..25: note = Seed: YGFLNVIVHSATGFKQSSKALQRPV
YGFLNVIVHSATGIKQMSSALNRPV

SEQ ID NO: 28150 - protein, 25 aa, synthetic construct
  source 1..25: note = Seed: YGFLNVIVHSATGFKQSSKALQRPV
YGFLNVIVHSATGIKQMSSALQRPV

SEQ ID NO: 28151 - protein, 25 aa, synthetic construct
  source 1..25: note = Seed: YGFLNVIVHSATGFKQSSKALQRPV
YGFLNVIVHSATGIKQMSSALRRPV

SEQ ID NO: 28152 - protein, 25 aa, synthetic construct
  source 1..25: note = Seed: YGFLNVIVHSATGFKQSSKALQRPV
YGFLNVIVHSATGIKQMSSALSRPV

SEQ ID NO: 28153 - protein, 25 aa, synthetic construct
  source 1..25: note = Seed: YGFLNVIVHSATGFKQSSKALQRPV
YGFLNVIVHSATGIKQMSSALTRPV

SEQ ID NO: 28154 - protein, 25 aa, synthetic construct
  source 1..25: note = Seed: YGFLNVIVHSATGFKQSSKALQRPV
YGFLNVIVHSATGIKQMSSALVRPV

SEQ ID NO: 28155 - protein, 25 aa, synthetic construct
  source 1..25: note = Seed: YGFLNVIVHSATGFKQSSKALQRPV
YGFLNVIVHSATGIKQMSTALARPV

SEQ ID NO: 28156 - protein, 25 aa, synthetic construct
  source 1..25: note = Seed: YGFLNVIVHSATGFKQSSKALQRPV
YGFLNVIVHSATGIKQMSTALGRPV

SEQ ID NO: 28157 - protein, 25 aa, synthetic construct
  source 1..25: note = Seed: YGFLNVIVHSATGFKQSSKALQRPV
YGFLNVIVHSATGIKQMSTALHRPV

SEQ ID NO: 28158 - protein, 25 aa, synthetic construct
  source 1..25: note = Seed: YGFLNVIVHSATGFKQSSKALQRPV
YGFLNVIVHSATGIKQMSTALIRPV

SEQ ID NO: 28159 - protein, 25 aa, synthetic construct
  source 1..25: note = Seed: YGFLNVIVHSATGFKQSSKALQRPV
YGFLNVIVHSATGIKQMSTALLRPV

SEQ ID NO: 28160 - protein, 25 aa, synthetic construct
  source 1..25: note = Seed: YGFLNVIVHSATGFKQSSKALQRPV
YGFLNVIVHSATGIKQMSTALMRPV

SEQ ID NO: 28161 - protein, 25 aa, synthetic construct
  source 1..25: note = Seed: YGFLNVIVHSATGFKQSSKALQRPV
YGFLNVIVHSATGIKQMSTALNRPV

SEQ ID NO: 28162 - protein, 25 aa, synthetic construct
  source 1..25: note = Seed: YGFLNVIVHSATGFKQSSKALQRPV
YGFLNVIVHSATGIKQMSTALQRPV

SEQ ID NO: 28163 - protein, 25 aa, synthetic construct
  source 1..25: note = Seed: YGFLNVIVHSATGFKQSSKALQRPV
YGFLNVIVHSATGIKQMSTALRRPV

SEQ ID NO: 28164 - protein, 25 aa, synthetic construct
  source 1..25: note = Seed: YGFLNVIVHSATGFKQSSKALQRPV
YGFLNVIVHSATGIKQMSTALSRPV

SEQ ID NO: 28165 - protein, 25 aa, synthetic construct
  source 1..25: note = Seed: YGFLNVIVHSATGFKQSSKALQRPV
YGFLNVIVHSATGIKQMSTALTRPV

SEQ ID NO: 28166 - protein, 25 aa, synthetic construct
  source 1..25: note = Seed: YGFLNVIVHSATGFKQSSKALQRPV
YGFLNVIVHSATGIKQMSTALVRPV

SEQ ID NO: 28167 - protein, 25 aa, synthetic construct
  source 1..25: note = Seed: YGFLNVIVHSATGFKQSSKALQRPV
YGFLNVIVHSATGIKQMSVALARPV

SEQ ID NO: 28168 - protein, 25 aa, synthetic construct
  source 1..25: note = Seed: YGFLNVIVHSATGFKQSSKALQRPV
YGFLNVIVHSATGIKQMSVALDRPV

SEQ ID NO: 28169 - protein, 25 aa, synthetic construct
  source 1..25: note = Seed: YGFLNVIVHSATGFKQSSKALQRPV
YGFLNVIVHSATGIKQMSVALERPV

SEQ ID NO: 28170 - protein, 25 aa, synthetic construct
  source 1..25: note = Seed: YGFLNVIVHSATGFKQSSKALQRPV
YGFLNVIVHSATGIKQMSVALGRPV

SEQ ID NO: 28171 - protein, 25 aa, synthetic construct
  source 1..25: note = Seed: YGFLNVIVHSATGFKQSSKALQRPV
YGFLNVIVHSATGIKQMSVALHRPV

SEQ ID NO: 28172 - protein, 25 aa, synthetic construct
  source 1..25: note = Seed: YGFLNVIVHSATGFKQSSKALQRPV
YGFLNVIVHSATGIKQMSVALIRPV

SEQ ID NO: 28173 - protein, 25 aa, synthetic construct
  source 1..25: note = Seed: YGFLNVIVHSATGFKQSSKALQRPV
YGFLNVIVHSATGIKQMSVALKRPV

SEQ ID NO: 28174 - protein, 25 aa, synthetic construct
  source 1..25: note = Seed: YGFLNVIVHSATGFKQSSKALQRPV
YGFLNVIVHSATGIKQMSVALLRPV

SEQ ID NO: 28175 - protein, 25 aa, synthetic construct
  source 1..25: note = Seed: YGFLNVIVHSATGFKQSSKALQRPV
YGFLNVIVHSATGIKQMSVALMRPV

SEQ ID NO: 28176 - protein, 25 aa, synthetic construct
  source 1..25: note = Seed: YGFLNVIVHSATGFKQSSKALQRPV
YGFLNVIVHSATGIKQMSVALNRPV

SEQ ID NO: 28177 - protein, 25 aa, synthetic construct
  source 1..25: note = Seed: YGFLNVIVHSATGFKQSSKALQRPV
YGFLNVIVHSATGIKQMSVALPRPV

SEQ ID NO: 28178 - protein, 25 aa, synthetic construct
  source 1..25: note = Seed: YGFLNVIVHSATGFKQSSKALQRPV
YGFLNVIVHSATGIKQMSVALQRPV

SEQ ID NO: 28179 - protein, 25 aa, synthetic construct
  source 1..25: note = Seed: YGFLNVIVHSATGFKQSSKALQRPV
YGFLNVIVHSATGIKQMSVALRRPV

SEQ ID NO: 28180 - protein, 25 aa, synthetic construct
  source 1..25: note = Seed: YGFLNVIVHSATGFKQSSKALQRPV
YGFLNVIVHSATGIKQMSVALSRPV

SEQ ID NO: 28181 - protein, 25 aa, synthetic construct
  source 1..25: note = Seed: YGFLNVIVHSATGFKQSSKALQRPV
YGFLNVIVHSATGIKQMSVALTRPV

SEQ ID NO: 28182 - protein, 25 aa, synthetic construct
  source 1..25: note = Seed: YGFLNVIVHSATGFKQSSKALQRPV
YGFLNVIVHSATGIKQMSVALVRPV

SEQ ID NO: 28183 - protein, 25 aa, synthetic construct
  source 1..25: note = Seed: YGFLNVIVHSATGFKQSSKALQRPV
YGFLNVIVHSATGIKQMSWALFRPV

SEQ ID NO: 28184 - protein, 25 aa, synthetic construct
  source 1..25: note = Seed: YGFLNVIVHSATGFKQSSKALQRPV
YGFLNVIVHSATGIKQMSWALRRPV

SEQ ID NO: 28185 - protein, 25 aa, synthetic construct
  source 1..25: note = Seed: YGFLNVIVHSATGFKQSSKALQRPV
YGFLNVIVHSATGIKQMSYALARPV

SEQ ID NO: 28186 - protein, 25 aa, synthetic construct
  source 1..25: note = Seed: YGFLNVIVHSATGFKQSSKALQRPV
YGFLNVIVHSATGIKQMSYALFRPV

SEQ ID NO: 28187 - protein, 25 aa, synthetic construct
  source 1..25: note = Seed: YGFLNVIVHSATGFKQSSKALQRPV
YGFLNVIVHSATGIKQMSYALLRPV

SEQ ID NO: 28188 - protein, 25 aa, synthetic construct
  source 1..25: note = Seed: YGFLNVIVHSATGFKQSSKALQRPV
YGFLNVIVHSATGIKQNSAALARPV

SEQ ID NO: 28189 - protein, 25 aa, synthetic construct
  source 1..25: note = Seed: YGFLNVIVHSATGFKQSSKALQRPV
YGFLNVIVHSATGIKQNSAALCRPV

SEQ ID NO: 28190 - protein, 25 aa, synthetic construct
  source 1..25: note = Seed: YGFLNVIVHSATGFKQSSKALQRPV
YGFLNVIVHSATGIKQNSAALDRPV

SEQ ID NO: 28191 - protein, 25 aa, synthetic construct
  source 1..25: note = Seed: YGFLNVIVHSATGFKQSSKALQRPV
YGFLNVIVHSATGIKQNSAALERPV

SEQ ID NO: 28192 - protein, 25 aa, synthetic construct
  source 1..25: note = Seed: YGFLNVIVHSATGFKQSSKALQRPV
YGFLNVIVHSATGIKQNSAALFRPV

SEQ ID NO: 28193 - protein, 25 aa, synthetic construct
  source 1..25: note = Seed: YGFLNVIVHSATGFKQSSKALQRPV
YGFLNVIVHSATGIKQNSAALGRPV

SEQ ID NO: 28194 - protein, 25 aa, synthetic construct
  source 1..25: note = Seed: YGFLNVIVHSATGFKQSSKALQRPV
YGFLNVIVHSATGIKQNSAALHRPV

SEQ ID NO: 28195 - protein, 25 aa, synthetic construct
  source 1..25: note = Seed: YGFLNVIVHSATGFKQSSKALQRPV
YGFLNVIVHSATGIKQNSAALIRPV

SEQ ID NO: 28196 - protein, 25 aa, synthetic construct
  source 1..25: note = Seed: YGFLNVIVHSATGFKQSSKALQRPV
YGFLNVIVHSATGIKQNSAALKRPV

SEQ ID NO: 28197 - protein, 25 aa, synthetic construct
  source 1..25: note = Seed: YGFLNVIVHSATGFKQSSKALQRPV
YGFLNVIVHSATGIKQNSAALLRPV

SEQ ID NO: 28198 - protein, 25 aa, synthetic construct
  source 1..25: note = Seed: YGFLNVIVHSATGFKQSSKALQRPV
YGFLNVIVHSATGIKQNSAALMRPV

SEQ ID NO: 28199 - protein, 25 aa, synthetic construct
  source 1..25: note = Seed: YGFLNVIVHSATGFKQSSKALQRPV
YGFLNVIVHSATGIKQNSAALNRPV

SEQ ID NO: 28200 - protein, 25 aa, synthetic construct
  source 1..25: note = Seed: YGFLNVIVHSATGFKQSSKALQRPV
YGFLNVIVHSATGIKQNSAALPRPV

SEQ ID NO: 28201 - protein, 25 aa, synthetic construct
  source 1..25: note = Seed: YGFLNVIVHSATGFKQSSKALQRPV
YGFLNVIVHSATGIKQNSAALQRPV

SEQ ID NO: 28202 - protein, 25 aa, synthetic construct
  source 1..25: note = Seed: YGFLNVIVHSATGFKQSSKALQRPV
YGFLNVIVHSATGIKQNSAALRRPV

SEQ ID NO: 28203 - protein, 25 aa, synthetic construct
  source 1..25: note = Seed: YGFLNVIVHSATGFKQSSKALQRPV
YGFLNVIVHSATGIKQNSAALSRPV

SEQ ID NO: 28204 - protein, 25 aa, synthetic construct
  source 1..25: note = Seed: YGFLNVIVHSATGFKQSSKALQRPV
YGFLNVIVHSATGIKQNSAALTRPV

SEQ ID NO: 28205 - protein, 25 aa, synthetic construct
  source 1..25: note = Seed: YGFLNVIVHSATGFKQSSKALQRPV
YGFLNVIVHSATGIKQNSAALVRPV

SEQ ID NO: 28206 - protein, 25 aa, synthetic construct
  source 1..25: note = Seed: YGFLNVIVHSATGFKQSSKALQRPV
YGFLNVIVHSATGIKQNSAALWRPV

SEQ ID NO: 28207 - protein, 25 aa, synthetic construct
  source 1..25: note = Seed: YGFLNVIVHSATGFKQSSKALQRPV
YGFLNVIVHSATGIKQNSAALYRPV

SEQ ID NO: 28208 - protein, 25 aa, synthetic construct
  source 1..25: note = Seed: YGFLNVIVHSATGFKQSSKALQRPV
YGFLNVIVHSATGIKQNSCALFRPV

SEQ ID NO: 28209 - protein, 25 aa, synthetic construct
  source 1..25: note = Seed: YGFLNVIVHSATGFKQSSKALQRPV
YGFLNVIVHSATGIKQNSCALIRPV

SEQ ID NO: 28210 - protein, 25 aa, synthetic construct
  source 1..25: note = Seed: YGFLNVIVHSATGFKQSSKALQRPV
YGFLNVIVHSATGIKQNSCALLRPV

SEQ ID NO: 28211 - protein, 25 aa, synthetic construct
  source 1..25: note = Seed: YGFLNVIVHSATGFKQSSKALQRPV
YGFLNVIVHSATGIKQNSCALMRPV

SEQ ID NO: 28212 - protein, 25 aa, synthetic construct
  source 1..25: note = Seed: YGFLNVIVHSATGFKQSSKALQRPV
YGFLNVIVHSATGIKQNSCALVRPV

SEQ ID NO: 28213 - protein, 25 aa, synthetic construct
  source 1..25: note = Seed: YGFLNVIVHSATGFKQSSKALQRPV
YGFLNVIVHSATGIKQNSCALYRPV

SEQ ID NO: 28214 - protein, 25 aa, synthetic construct
  source 1..25: note = Seed: YGFLNVIVHSATGFKQSSKALQRPV
YGFLNVIVHSATGIKQNSDALFRPV

SEQ ID NO: 28215 - protein, 25 aa, synthetic construct
  source 1..25: note = Seed: YGFLNVIVHSATGFKQSSKALQRPV
YGFLNVIVHSATGIKQNSDALIRPV

SEQ ID NO: 28216 - protein, 25 aa, synthetic construct
  source 1..25: note = Seed: YGFLNVIVHSATGFKQSSKALQRPV
YGFLNVIVHSATGIKQNSDALLRPV

SEQ ID NO: 28217 - protein, 25 aa, synthetic construct
  source 1..25: note = Seed: YGFLNVIVHSATGFKQSSKALQRPV
YGFLNVIVHSATGIKQNSDALMRPV

SEQ ID NO: 28218 - protein, 25 aa, synthetic construct
  source 1..25: note = Seed: YGFLNVIVHSATGFKQSSKALQRPV
YGFLNVIVHSATGIKQNSDALVRPV

SEQ ID NO: 28219 - protein, 25 aa, synthetic construct
  source 1..25: note = Seed: YGFLNVIVHSATGFKQSSKALQRPV
YGFLNVIVHSATGIKQNSDALYRPV

SEQ ID NO: 28220 - protein, 25 aa, synthetic construct
  source 1..25: note = Seed: YGFLNVIVHSATGFKQSSKALQRPV
YGFLNVIVHSATGIKQNSEALFRPV

SEQ ID NO: 28221 - protein, 25 aa, synthetic construct
  source 1..25: note = Seed: YGFLNVIVHSATGFKQSSKALQRPV
YGFLNVIVHSATGIKQNSEALIRPV

SEQ ID NO: 28222 - protein, 25 aa, synthetic construct
  source 1..25: note = Seed: YGFLNVIVHSATGFKQSSKALQRPV
YGFLNVIVHSATGIKQNSEALLRPV

SEQ ID NO: 28223 - protein, 25 aa, synthetic construct
  source 1..25: note = Seed: YGFLNVIVHSATGFKQSSKALQRPV
YGFLNVIVHSATGIKQNSEALVRPV

SEQ ID NO: 28224 - protein, 25 aa, synthetic construct
  source 1..25: note = Seed: YGFLNVIVHSATGFKQSSKALQRPV
YGFLNVIVHSATGIKQNSEALYRPV

SEQ ID NO: 28225 - protein, 25 aa, synthetic construct
  source 1..25: note = Seed: YGFLNVIVHSATGFKQSSKALQRPV
YGFLNVIVHSATGIKQNSFALARPV

SEQ ID NO: 28226 - protein, 25 aa, synthetic construct
  source 1..25: note = Seed: YGFLNVIVHSATGFKQSSKALQRPV
YGFLNVIVHSATGIKQNSFALFRPV

SEQ ID NO: 28227 - protein, 25 aa, synthetic construct
  source 1..25: note = Seed: YGFLNVIVHSATGFKQSSKALQRPV
YGFLNVIVHSATGIKQNSFALIRPV

SEQ ID NO: 28228 - protein, 25 aa, synthetic construct
  source 1..25: note = Seed: YGFLNVIVHSATGFKQSSKALQRPV
YGFLNVIVHSATGIKQNSFALLRPV

SEQ ID NO: 28229 - protein, 25 aa, synthetic construct
  source 1..25: note = Seed: YGFLNVIVHSATGFKQSSKALQRPV
YGFLNVIVHSATGIKQNSFALMRPV

SEQ ID NO: 28230 - protein, 25 aa, synthetic construct
  source 1..25: note = Seed: YGFLNVIVHSATGFKQSSKALQRPV
YGFLNVIVHSATGIKQNSFALVRPV

SEQ ID NO: 28231 - protein, 25 aa, synthetic construct
  source 1..25: note = Seed: YGFLNVIVHSATGFKQSSKALQRPV
YGFLNVIVHSATGIKQNSFALYRPV

SEQ ID NO: 28232 - protein, 25 aa, synthetic construct
  source 1..25: note = Seed: YGFLNVIVHSATGFKQSSKALQRPV
YGFLNVIVHSATGIKQNSGALARPV

SEQ ID NO: 28233 - protein, 25 aa, synthetic construct
  source 1..25: note = Seed: YGFLNVIVHSATGFKQSSKALQRPV
YGFLNVIVHSATGIKQNSGALFRPV

SEQ ID NO: 28234 - protein, 25 aa, synthetic construct
  source 1..25: note = Seed: YGFLNVIVHSATGFKQSSKALQRPV
YGFLNVIVHSATGIKQNSGALGRPV

SEQ ID NO: 28235 - protein, 25 aa, synthetic construct
  source 1..25: note = Seed: YGFLNVIVHSATGFKQSSKALQRPV
YGFLNVIVHSATGIKQNSGALHRPV

SEQ ID NO: 28236 - protein, 25 aa, synthetic construct
  source 1..25: note = Seed: YGFLNVIVHSATGFKQSSKALQRPV
YGFLNVIVHSATGIKQNSGALIRPV

SEQ ID NO: 28237 - protein, 25 aa, synthetic construct
  source 1..25: note = Seed: YGFLNVIVHSATGFKQSSKALQRPV
YGFLNVIVHSATGIKQNSGALLRPV

SEQ ID NO: 28238 - protein, 25 aa, synthetic construct
  source 1..25: note = Seed: YGFLNVIVHSATGFKQSSKALQRPV
YGFLNVIVHSATGIKQNSGALMRPV

SEQ ID NO: 28239 - protein, 25 aa, synthetic construct
  source 1..25: note = Seed: YGFLNVIVHSATGFKQSSKALQRPV
YGFLNVIVHSATGIKQNSGALNRPV

SEQ ID NO: 28240 - protein, 25 aa, synthetic construct
  source 1..25: note = Seed: YGFLNVIVHSATGFKQSSKALQRPV
YGFLNVIVHSATGIKQNSGALQRPV

SEQ ID NO: 28241 - protein, 25 aa, synthetic construct
  source 1..25: note = Seed: YGFLNVIVHSATGFKQSSKALQRPV
YGFLNVIVHSATGIKQNSGALSRPV

SEQ ID NO: 28242 - protein, 25 aa, synthetic construct
  source 1..25: note = Seed: YGFLNVIVHSATGFKQSSKALQRPV
YGFLNVIVHSATGIKQNSGALTRPV

SEQ ID NO: 28243 - protein, 25 aa, synthetic construct
  source 1..25: note = Seed: YGFLNVIVHSATGFKQSSKALQRPV
YGFLNVIVHSATGIKQNSGALVRPV

SEQ ID NO: 28244 - protein, 25 aa, synthetic construct
  source 1..25: note = Seed: YGFLNVIVHSATGFKQSSKALQRPV
YGFLNVIVHSATGIKQNSGALWRPV

SEQ ID NO: 28245 - protein, 25 aa, synthetic construct
  source 1..25: note = Seed: YGFLNVIVHSATGFKQSSKALQRPV
YGFLNVIVHSATGIKQNSGALYRPV

SEQ ID NO: 28246 - protein, 25 aa, synthetic construct
  source 1..25: note = Seed: YGFLNVIVHSATGFKQSSKALQRPV
YGFLNVIVHSATGIKQNSHALARPV

SEQ ID NO: 28247 - protein, 25 aa, synthetic construct
  source 1..25: note = Seed: YGFLNVIVHSATGFKQSSKALQRPV
YGFLNVIVHSATGIKQNSHALFRPV

SEQ ID NO: 28248 - protein, 25 aa, synthetic construct
  source 1..25: note = Seed: YGFLNVIVHSATGFKQSSKALQRPV
YGFLNVIVHSATGIKQNSHALIRPV

SEQ ID NO: 28249 - protein, 25 aa, synthetic construct
  source 1..25: note = Seed: YGFLNVIVHSATGFKQSSKALQRPV
YGFLNVIVHSATGIKQNSHALLRPV

SEQ ID NO: 28250 - protein, 25 aa, synthetic construct
  source 1..25: note = Seed: YGFLNVIVHSATGFKQSSKALQRPV
YGFLNVIVHSATGIKQNSHALMRPV

SEQ ID NO: 28251 - protein, 25 aa, synthetic construct
  source 1..25: note = Seed: YGFLNVIVHSATGFKQSSKALQRPV
YGFLNVIVHSATGIKQNSHALSRPV

SEQ ID NO: 28252 - protein, 25 aa, synthetic construct
  source 1..25: note = Seed: YGFLNVIVHSATGFKQSSKALQRPV
YGFLNVIVHSATGIKQNSHALTRPV

SEQ ID NO: 28253 - protein, 25 aa, synthetic construct
  source 1..25: note = Seed: YGFLNVIVHSATGFKQSSKALQRPV
YGFLNVIVHSATGIKQNSHALVRPV

SEQ ID NO: 28254 - protein, 25 aa, synthetic construct
  source 1..25: note = Seed: YGFLNVIVHSATGFKQSSKALQRPV
YGFLNVIVHSATGIKQNSHALWRPV

SEQ ID NO: 28255 - protein, 25 aa, synthetic construct
  source 1..25: note = Seed: YGFLNVIVHSATGFKQSSKALQRPV
YGFLNVIVHSATGIKQNSHALYRPV

SEQ ID NO: 28256 - protein, 25 aa, synthetic construct
  source 1..25: note = Seed: YGFLNVIVHSATGFKQSSKALQRPV
YGFLNVIVHSATGIKQNSIALARPV

SEQ ID NO: 28257 - protein, 25 aa, synthetic construct
  source 1..25: note = Seed: YGFLNVIVHSATGFKQSSKALQRPV
YGFLNVIVHSATGIKQNSIALCRPV

SEQ ID NO: 28258 - protein, 25 aa, synthetic construct
  source 1..25: note = Seed: YGFLNVIVHSATGFKQSSKALQRPV
YGFLNVIVHSATGIKQNSIALFRPV

SEQ ID NO: 28259 - protein, 25 aa, synthetic construct
  source 1..25: note = Seed: YGFLNVIVHSATGFKQSSKALQRPV
YGFLNVIVHSATGIKQNSIALGRPV

SEQ ID NO: 28260 - protein, 25 aa, synthetic construct
  source 1..25: note = Seed: YGFLNVIVHSATGFKQSSKALQRPV
YGFLNVIVHSATGIKQNSIALHRPV

SEQ ID NO: 28261 - protein, 25 aa, synthetic construct
  source 1..25: note = Seed: YGFLNVIVHSATGFKQSSKALQRPV
YGFLNVIVHSATGIKQNSIALIRPV

SEQ ID NO: 28262 - protein, 25 aa, synthetic construct
  source 1..25: note = Seed: YGFLNVIVHSATGFKQSSKALQRPV
YGFLNVIVHSATGIKQNSIALLRPV

SEQ ID NO: 28263 - protein, 25 aa, synthetic construct
  source 1..25: note = Seed: YGFLNVIVHSATGFKQSSKALQRPV
YGFLNVIVHSATGIKQNSIALMRPV

SEQ ID NO: 28264 - protein, 25 aa, synthetic construct
  source 1..25: note = Seed: YGFLNVIVHSATGFKQSSKALQRPV
YGFLNVIVHSATGIKQNSIALNRPV

SEQ ID NO: 28265 - protein, 25 aa, synthetic construct
  source 1..25: note = Seed: YGFLNVIVHSATGFKQSSKALQRPV
YGFLNVIVHSATGIKQNSIALQRPV

SEQ ID NO: 28266 - protein, 25 aa, synthetic construct
  source 1..25: note = Seed: YGFLNVIVHSATGFKQSSKALQRPV
YGFLNVIVHSATGIKQNSIALRRPV

SEQ ID NO: 28267 - protein, 25 aa, synthetic construct
  source 1..25: note = Seed: YGFLNVIVHSATGFKQSSKALQRPV
YGFLNVIVHSATGIKQNSIALSRPV

SEQ ID NO: 28268 - protein, 25 aa, synthetic construct
  source 1..25: note = Seed: YGFLNVIVHSATGFKQSSKALQRPV
YGFLNVIVHSATGIKQNSIALTRPV

SEQ ID NO: 28269 - protein, 25 aa, synthetic construct
  source 1..25: note = Seed: YGFLNVIVHSATGFKQSSKALQRPV
YGFLNVIVHSATGIKQNSIALVRPV

SEQ ID NO: 28270 - protein, 25 aa, synthetic construct
  source 1..25: note = Seed: YGFLNVIVHSATGFKQSSKALQRPV
YGFLNVIVHSATGIKQNSIALWRPV

SEQ ID NO: 28271 - protein, 25 aa, synthetic construct
  source 1..25: note = Seed: YGFLNVIVHSATGFKQSSKALQRPV
YGFLNVIVHSATGIKQNSIALYRPV

SEQ ID NO: 28272 - protein, 25 aa, synthetic construct
  source 1..25: note = Seed: YGFLNVIVHSATGFKQSSKALQRPV
YGFLNVIVHSATGIKQNSKALFRPV

SEQ ID NO: 28273 - protein, 25 aa, synthetic construct
  source 1..25: note = Seed: YGFLNVIVHSATGFKQSSKALQRPV
YGFLNVIVHSATGIKQNSKALIRPV

SEQ ID NO: 28274 - protein, 25 aa, synthetic construct
  source 1..25: note = Seed: YGFLNVIVHSATGFKQSSKALQRPV
YGFLNVIVHSATGIKQNSKALLRPV

SEQ ID NO: 28275 - protein, 25 aa, synthetic construct
  source 1..25: note = Seed: YGFLNVIVHSATGFKQSSKALQRPV
YGFLNVIVHSATGIKQNSKALVRPV

SEQ ID NO: 28276 - protein, 25 aa, synthetic construct
  source 1..25: note = Seed: YGFLNVIVHSATGFKQSSKALQRPV
YGFLNVIVHSATGIKQNSKALYRPV

SEQ ID NO: 28277 - protein, 25 aa, synthetic construct
  source 1..25: note = Seed: YGFLNVIVHSATGFKQSSKALQRPV
YGFLNVIVHSATGIKQNSLALARPV

SEQ ID NO: 28278 - protein, 25 aa, synthetic construct
  source 1..25: note = Seed: YGFLNVIVHSATGFKQSSKALQRPV
YGFLNVIVHSATGIKQNSLALFRPV

SEQ ID NO: 28279 - protein, 25 aa, synthetic construct
  source 1..25: note = Seed: YGFLNVIVHSATGFKQSSKALQRPV
YGFLNVIVHSATGIKQNSLALIRPV

SEQ ID NO: 28280 - protein, 25 aa, synthetic construct
  source 1..25: note = Seed: YGFLNVIVHSATGFKQSSKALQRPV
YGFLNVIVHSATGIKQNSLALLRPV

SEQ ID NO: 28281 - protein, 25 aa, synthetic construct
  source 1..25: note = Seed: YGFLNVIVHSATGFKQSSKALQRPV
YGFLNVIVHSATGIKQNSLALMRPV

SEQ ID NO: 28282 - protein, 25 aa, synthetic construct
  source 1..25: note = Seed: YGFLNVIVHSATGFKQSSKALQRPV
YGFLNVIVHSATGIKQNSLALNRPV

SEQ ID NO: 28283 - protein, 25 aa, synthetic construct
  source 1..25: note = Seed: YGFLNVIVHSATGFKQSSKALQRPV
YGFLNVIVHSATGIKQNSLALSRPV

SEQ ID NO: 28284 - protein, 25 aa, synthetic construct
  source 1..25: note = Seed: YGFLNVIVHSATGFKQSSKALQRPV
YGFLNVIVHSATGIKQNSLALTRPV

SEQ ID NO: 28285 - protein, 25 aa, synthetic construct
  source 1..25: note = Seed: YGFLNVIVHSATGFKQSSKALQRPV
YGFLNVIVHSATGIKQNSLALVRPV

SEQ ID NO: 28286 - protein, 25 aa, synthetic construct
  source 1..25: note = Seed: YGFLNVIVHSATGFKQSSKALQRPV
YGFLNVIVHSATGIKQNSLALYRPV

SEQ ID NO: 28287 - protein, 25 aa, synthetic construct
  source 1..25: note = Seed: YGFLNVIVHSATGFKQSSKALQRPV
YGFLNVIVHSATGIKQNSMALARPV

SEQ ID NO: 28288 - protein, 25 aa, synthetic construct
  source 1..25: note = Seed: YGFLNVIVHSATGFKQSSKALQRPV
YGFLNVIVHSATGIKQNSMALFRPV

SEQ ID NO: 28289 - protein, 25 aa, synthetic construct
  source 1..25: note = Seed: YGFLNVIVHSATGFKQSSKALQRPV
YGFLNVIVHSATGIKQNSMALIRPV

SEQ ID NO: 28290 - protein, 25 aa, synthetic construct
  source 1..25: note = Seed: YGFLNVIVHSATGFKQSSKALQRPV
YGFLNVIVHSATGIKQNSMALLRPV

SEQ ID NO: 28291 - protein, 25 aa, synthetic construct
  source 1..25: note = Seed: YGFLNVIVHSATGFKQSSKALQRPV
YGFLNVIVHSATGIKQNSMALMRPV

SEQ ID NO: 28292 - protein, 25 aa, synthetic construct
  source 1..25: note = Seed: YGFLNVIVHSATGFKQSSKALQRPV
YGFLNVIVHSATGIKQNSMALNRPV

SEQ ID NO: 28293 - protein, 25 aa, synthetic construct
  source 1..25: note = Seed: YGFLNVIVHSATGFKQSSKALQRPV
YGFLNVIVHSATGIKQNSMALSRPV

SEQ ID NO: 28294 - protein, 25 aa, synthetic construct
  source 1..25: note = Seed: YGFLNVIVHSATGFKQSSKALQRPV
YGFLNVIVHSATGIKQNSMALTRPV

SEQ ID NO: 28295 - protein, 25 aa, synthetic construct
  source 1..25: note = Seed: YGFLNVIVHSATGFKQSSKALQRPV
YGFLNVIVHSATGIKQNSMALVRPV

SEQ ID NO: 28296 - protein, 25 aa, synthetic construct
  source 1..25: note = Seed: YGFLNVIVHSATGFKQSSKALQRPV
YGFLNVIVHSATGIKQNSMALYRPV

SEQ ID NO: 28297 - protein, 25 aa, synthetic construct
  source 1..25: note = Seed: YGFLNVIVHSATGFKQSSKALQRPV
YGFLNVIVHSATGIKQNSNALARPV

SEQ ID NO: 28298 - protein, 25 aa, synthetic construct
  source 1..25: note = Seed: YGFLNVIVHSATGFKQSSKALQRPV
YGFLNVIVHSATGIKQNSNALCRPV

SEQ ID NO: 28299 - protein, 25 aa, synthetic construct
  source 1..25: note = Seed: YGFLNVIVHSATGFKQSSKALQRPV
YGFLNVIVHSATGIKQNSNALERPV

SEQ ID NO: 28300 - protein, 25 aa, synthetic construct
  source 1..25: note = Seed: YGFLNVIVHSATGFKQSSKALQRPV
YGFLNVIVHSATGIKQNSNALFRPV

SEQ ID NO: 28301 - protein, 25 aa, synthetic construct
  source 1..25: note = Seed: YGFLNVIVHSATGFKQSSKALQRPV
YGFLNVIVHSATGIKQNSNALGRPV

SEQ ID NO: 28302 - protein, 25 aa, synthetic construct
  source 1..25: note = Seed: YGFLNVIVHSATGFKQSSKALQRPV
YGFLNVIVHSATGIKQNSNALHRPV

SEQ ID NO: 28303 - protein, 25 aa, synthetic construct
  source 1..25: note = Seed: YGFLNVIVHSATGFKQSSKALQRPV
YGFLNVIVHSATGIKQNSNALIRPV

SEQ ID NO: 28304 - protein, 25 aa, synthetic construct
  source 1..25: note = Seed: YGFLNVIVHSATGFKQSSKALQRPV
YGFLNVIVHSATGIKQNSNALKRPV

SEQ ID NO: 28305 - protein, 25 aa, synthetic construct
  source 1..25: note = Seed: YGFLNVIVHSATGFKQSSKALQRPV
YGFLNVIVHSATGIKQNSNALLRPV

SEQ ID NO: 28306 - protein, 25 aa, synthetic construct
  source 1..25: note = Seed: YGFLNVIVHSATGFKQSSKALQRPV
YGFLNVIVHSATGIKQNSNALMRPV

SEQ ID NO: 28307 - protein, 25 aa, synthetic construct
  source 1..25: note = Seed: YGFLNVIVHSATGFKQSSKALQRPV
YGFLNVIVHSATGIKQNSNALNRPV

SEQ ID NO: 28308 - protein, 25 aa, synthetic construct
  source 1..25: note = Seed: YGFLNVIVHSATGFKQSSKALQRPV
YGFLNVIVHSATGIKQNSNALPRPV

SEQ ID NO: 28309 - protein, 25 aa, synthetic construct
  source 1..25: note = Seed: YGFLNVIVHSATGFKQSSKALQRPV
YGFLNVIVHSATGIKQNSNALQRPV

SEQ ID NO: 28310 - protein, 25 aa, synthetic construct
  source 1..25: note = Seed: YGFLNVIVHSATGFKQSSKALQRPV
YGFLNVIVHSATGIKQNSNALRRPV

SEQ ID NO: 28311 - protein, 25 aa, synthetic construct
  source 1..25: note = Seed: YGFLNVIVHSATGFKQSSKALQRPV
YGFLNVIVHSATGIKQNSNALSRPV

SEQ ID NO: 28312 - protein, 25 aa, synthetic construct
  source 1..25: note = Seed: YGFLNVIVHSATGFKQSSKALQRPV
YGFLNVIVHSATGIKQNSNALTRPV

SEQ ID NO: 28313 - protein, 25 aa, synthetic construct
  source 1..25: note = Seed: YGFLNVIVHSATGFKQSSKALQRPV
YGFLNVIVHSATGIKQNSNALVRPV

SEQ ID NO: 28314 - protein, 25 aa, synthetic construct
  source 1..25: note = Seed: YGFLNVIVHSATGFKQSSKALQRPV
YGFLNVIVHSATGIKQNSNALWRPV

SEQ ID NO: 28315 - protein, 25 aa, synthetic construct
  source 1..25: note = Seed: YGFLNVIVHSATGFKQSSKALQRPV
YGFLNVIVHSATGIKQNSNALYRPV

SEQ ID NO: 28316 - protein, 25 aa, synthetic construct
  source 1..25: note = Seed: YGFLNVIVHSATGFKQSSKALQRPV
YGFLNVIVHSATGIKQNSPALARPV

SEQ ID NO: 28317 - protein, 25 aa, synthetic construct
  source 1..25: note = Seed: YGFLNVIVHSATGFKQSSKALQRPV
YGFLNVIVHSATGIKQNSPALCRPV

SEQ ID NO: 28318 - protein, 25 aa, synthetic construct
  source 1..25: note = Seed: YGFLNVIVHSATGFKQSSKALQRPV
YGFLNVIVHSATGIKQNSPALFRPV

SEQ ID NO: 28319 - protein, 25 aa, synthetic construct
  source 1..25: note = Seed: YGFLNVIVHSATGFKQSSKALQRPV
YGFLNVIVHSATGIKQNSPALGRPV

SEQ ID NO: 28320 - protein, 25 aa, synthetic construct
  source 1..25: note = Seed: YGFLNVIVHSATGFKQSSKALQRPV
YGFLNVIVHSATGIKQNSPALHRPV

SEQ ID NO: 28321 - protein, 25 aa, synthetic construct
  source 1..25: note = Seed: YGFLNVIVHSATGFKQSSKALQRPV
YGFLNVIVHSATGIKQNSPALIRPV

SEQ ID NO: 28322 - protein, 25 aa, synthetic construct
  source 1..25: note = Seed: YGFLNVIVHSATGFKQSSKALQRPV
YGFLNVIVHSATGIKQNSPALLRPV

SEQ ID NO: 28323 - protein, 25 aa, synthetic construct
  source 1..25: note = Seed: YGFLNVIVHSATGFKQSSKALQRPV
YGFLNVIVHSATGIKQNSPALMRPV

SEQ ID NO: 28324 - protein, 25 aa, synthetic construct
  source 1..25: note = Seed: YGFLNVIVHSATGFKQSSKALQRPV
YGFLNVIVHSATGIKQNSPALNRPV

SEQ ID NO: 28325 - protein, 25 aa, synthetic construct
  source 1..25: note = Seed: YGFLNVIVHSATGFKQSSKALQRPV
YGFLNVIVHSATGIKQNSPALPRPV

SEQ ID NO: 28326 - protein, 25 aa, synthetic construct
  source 1..25: note = Seed: YGFLNVIVHSATGFKQSSKALQRPV
YGFLNVIVHSATGIKQNSPALQRPV

SEQ ID NO: 28327 - protein, 25 aa, synthetic construct
  source 1..25: note = Seed: YGFLNVIVHSATGFKQSSKALQRPV
YGFLNVIVHSATGIKQNSPALRRPV

SEQ ID NO: 28328 - protein, 25 aa, synthetic construct
  source 1..25: note = Seed: YGFLNVIVHSATGFKQSSKALQRPV
YGFLNVIVHSATGIKQNSPALSRPV

SEQ ID NO: 28329 - protein, 25 aa, synthetic construct
  source 1..25: note = Seed: YGFLNVIVHSATGFKQSSKALQRPV
YGFLNVIVHSATGIKQNSPALTRPV

SEQ ID NO: 28330 - protein, 25 aa, synthetic construct
  source 1..25: note = Seed: YGFLNVIVHSATGFKQSSKALQRPV
YGFLNVIVHSATGIKQNSPALVRPV

SEQ ID NO: 28331 - protein, 25 aa, synthetic construct
  source 1..25: note = Seed: YGFLNVIVHSATGFKQSSKALQRPV
YGFLNVIVHSATGIKQNSPALWRPV

SEQ ID NO: 28332 - protein, 25 aa, synthetic construct
  source 1..25: note = Seed: YGFLNVIVHSATGFKQSSKALQRPV
YGFLNVIVHSATGIKQNSPALYRPV

SEQ ID NO: 28333 - protein, 25 aa, synthetic construct
  source 1..25: note = Seed: YGFLNVIVHSATGFKQSSKALQRPV
YGFLNVIVHSATGIKQNSQALARPV

SEQ ID NO: 28334 - protein, 25 aa, synthetic construct
  source 1..25: note = Seed: YGFLNVIVHSATGFKQSSKALQRPV
YGFLNVIVHSATGIKQNSQALFRPV

SEQ ID NO: 28335 - protein, 25 aa, synthetic construct
  source 1..25: note = Seed: YGFLNVIVHSATGFKQSSKALQRPV
YGFLNVIVHSATGIKQNSQALIRPV

SEQ ID NO: 28336 - protein, 25 aa, synthetic construct
  source 1..25: note = Seed: YGFLNVIVHSATGFKQSSKALQRPV
YGFLNVIVHSATGIKQNSQALLRPV

SEQ ID NO: 28337 - protein, 25 aa, synthetic construct
  source 1..25: note = Seed: YGFLNVIVHSATGFKQSSKALQRPV
YGFLNVIVHSATGIKQNSQALMRPV

SEQ ID NO: 28338 - protein, 25 aa, synthetic construct
  source 1..25: note = Seed: YGFLNVIVHSATGFKQSSKALQRPV
YGFLNVIVHSATGIKQNSQALVRPV

SEQ ID NO: 28339 - protein, 25 aa, synthetic construct
  source 1..25: note = Seed: YGFLNVIVHSATGFKQSSKALQRPV
YGFLNVIVHSATGIKQNSQALYRPV

SEQ ID NO: 28340 - protein, 25 aa, synthetic construct
  source 1..25: note = Seed: YGFLNVIVHSATGFKQSSKALQRPV
YGFLNVIVHSATGIKQNSRALFRPV

SEQ ID NO: 28341 - protein, 25 aa, synthetic construct
  source 1..25: note = Seed: YGFLNVIVHSATGFKQSSKALQRPV
YGFLNVIVHSATGIKQNSRALIRPV

SEQ ID NO: 28342 - protein, 25 aa, synthetic construct
  source 1..25: note = Seed: YGFLNVIVHSATGFKQSSKALQRPV
YGFLNVIVHSATGIKQNSRALLRPV

SEQ ID NO: 28343 - protein, 25 aa, synthetic construct
  source 1..25: note = Seed: YGFLNVIVHSATGFKQSSKALQRPV
YGFLNVIVHSATGIKQNSRALRRPV

SEQ ID NO: 28344 - protein, 25 aa, synthetic construct
  source 1..25: note = Seed: YGFLNVIVHSATGFKQSSKALQRPV
YGFLNVIVHSATGIKQNSRALVRPV

SEQ ID NO: 28345 - protein, 25 aa, synthetic construct
  source 1..25: note = Seed: YGFLNVIVHSATGFKQSSKALQRPV
YGFLNVIVHSATGIKQNSRALYRPV

SEQ ID NO: 28346 - protein, 25 aa, synthetic construct
  source 1..25: note = Seed: YGFLNVIVHSATGFKQSSKALQRPV
YGFLNVIVHSATGIKQNSSALARPV

SEQ ID NO: 28347 - protein, 25 aa, synthetic construct
  source 1..25: note = Seed: YGFLNVIVHSATGFKQSSKALQRPV
YGFLNVIVHSATGIKQNSSALCRPV

SEQ ID NO: 28348 - protein, 25 aa, synthetic construct
  source 1..25: note = Seed: YGFLNVIVHSATGFKQSSKALQRPV
YGFLNVIVHSATGIKQNSSALERPV

SEQ ID NO: 28349 - protein, 25 aa, synthetic construct
  source 1..25: note = Seed: YGFLNVIVHSATGFKQSSKALQRPV
YGFLNVIVHSATGIKQNSSALFRPV

SEQ ID NO: 28350 - protein, 25 aa, synthetic construct
  source 1..25: note = Seed: YGFLNVIVHSATGFKQSSKALQRPV
YGFLNVIVHSATGIKQNSSALGRPV

SEQ ID NO: 28351 - protein, 25 aa, synthetic construct
  source 1..25: note = Seed: YGFLNVIVHSATGFKQSSKALQRPV
YGFLNVIVHSATGIKQNSSALHRPV

SEQ ID NO: 28352 - protein, 25 aa, synthetic construct
  source 1..25: note = Seed: YGFLNVIVHSATGFKQSSKALQRPV
YGFLNVIVHSATGIKQNSSALIRPV

SEQ ID NO: 28353 - protein, 25 aa, synthetic construct
  source 1..25: note = Seed: YGFLNVIVHSATGFKQSSKALQRPV
YGFLNVIVHSATGIKQNSSALKRPV

SEQ ID NO: 28354 - protein, 25 aa, synthetic construct
  source 1..25: note = Seed: YGFLNVIVHSATGFKQSSKALQRPV
YGFLNVIVHSATGIKQNSSALLRPV

SEQ ID NO: 28355 - protein, 25 aa, synthetic construct
  source 1..25: note = Seed: YGFLNVIVHSATGFKQSSKALQRPV
YGFLNVIVHSATGIKQNSSALMRPV

SEQ ID NO: 28356 - protein, 25 aa, synthetic construct
  source 1..25: note = Seed: YGFLNVIVHSATGFKQSSKALQRPV
YGFLNVIVHSATGIKQNSSALNRPV

SEQ ID NO: 28357 - protein, 25 aa, synthetic construct
  source 1..25: note = Seed: YGFLNVIVHSATGFKQSSKALQRPV
YGFLNVIVHSATGIKQNSSALPRPV

SEQ ID NO: 28358 - protein, 25 aa, synthetic construct
  source 1..25: note = Seed: YGFLNVIVHSATGFKQSSKALQRPV
YGFLNVIVHSATGIKQNSSALQRPV

SEQ ID NO: 28359 - protein, 25 aa, synthetic construct
  source 1..25: note = Seed: YGFLNVIVHSATGFKQSSKALQRPV
YGFLNVIVHSATGIKQNSSALRRPV

SEQ ID NO: 28360 - protein, 25 aa, synthetic construct
  source 1..25: note = Seed: YGFLNVIVHSATGFKQSSKALQRPV
YGFLNVIVHSATGIKQNSSALSRPV

SEQ ID NO: 28361 - protein, 25 aa, synthetic construct
  source 1..25: note = Seed: YGFLNVIVHSATGFKQSSKALQRPV
YGFLNVIVHSATGIKQNSSALTRPV

SEQ ID NO: 28362 - protein, 25 aa, synthetic construct
  source 1..25: note = Seed: YGFLNVIVHSATGFKQSSKALQRPV
YGFLNVIVHSATGIKQNSSALVRPV

SEQ ID NO: 28363 - protein, 25 aa, synthetic construct
  source 1..25: note = Seed: YGFLNVIVHSATGFKQSSKALQRPV
YGFLNVIVHSATGIKQNSSALWRPV

SEQ ID NO: 28364 - protein, 25 aa, synthetic construct
  source 1..25: note = Seed: YGFLNVIVHSATGFKQSSKALQRPV
YGFLNVIVHSATGIKQNSSALYRPV

SEQ ID NO: 28365 - protein, 25 aa, synthetic construct
  source 1..25: note = Seed: YGFLNVIVHSATGFKQSSKALQRPV
YGFLNVIVHSATGIKQNSTALARPV

SEQ ID NO: 28366 - protein, 25 aa, synthetic construct
  source 1..25: note = Seed: YGFLNVIVHSATGFKQSSKALQRPV
YGFLNVIVHSATGIKQNSTALFRPV

SEQ ID NO: 28367 - protein, 25 aa, synthetic construct
  source 1..25: note = Seed: YGFLNVIVHSATGFKQSSKALQRPV
YGFLNVIVHSATGIKQNSTALHRPV

SEQ ID NO: 28368 - protein, 25 aa, synthetic construct
  source 1..25: note = Seed: YGFLNVIVHSATGFKQSSKALQRPV
YGFLNVIVHSATGIKQNSTALIRPV

SEQ ID NO: 28369 - protein, 25 aa, synthetic construct
  source 1..25: note = Seed: YGFLNVIVHSATGFKQSSKALQRPV
YGFLNVIVHSATGIKQNSTALLRPV

SEQ ID NO: 28370 - protein, 25 aa, synthetic construct
  source 1..25: note = Seed: YGFLNVIVHSATGFKQSSKALQRPV
YGFLNVIVHSATGIKQNSTALMRPV

SEQ ID NO: 28371 - protein, 25 aa, synthetic construct
  source 1..25: note = Seed: YGFLNVIVHSATGFKQSSKALQRPV
YGFLNVIVHSATGIKQNSTALNRPV

SEQ ID NO: 28372 - protein, 25 aa, synthetic construct
  source 1..25: note = Seed: YGFLNVIVHSATGFKQSSKALQRPV
YGFLNVIVHSATGIKQNSTALQRPV

SEQ ID NO: 28373 - protein, 25 aa, synthetic construct
  source 1..25: note = Seed: YGFLNVIVHSATGFKQSSKALQRPV
YGFLNVIVHSATGIKQNSTALSRPV

SEQ ID NO: 28374 - protein, 25 aa, synthetic construct
  source 1..25: note = Seed: YGFLNVIVHSATGFKQSSKALQRPV
YGFLNVIVHSATGIKQNSTALTRPV

SEQ ID NO: 28375 - protein, 25 aa, synthetic construct
  source 1..25: note = Seed: YGFLNVIVHSATGFKQSSKALQRPV
YGFLNVIVHSATGIKQNSTALVRPV

SEQ ID NO: 28376 - protein, 25 aa, synthetic construct
  source 1..25: note = Seed: YGFLNVIVHSATGFKQSSKALQRPV
YGFLNVIVHSATGIKQNSTALWRPV

SEQ ID NO: 28377 - protein, 25 aa, synthetic construct
  source 1..25: note = Seed: YGFLNVIVHSATGFKQSSKALQRPV
YGFLNVIVHSATGIKQNSTALYRPV

SEQ ID NO: 28378 - protein, 25 aa, synthetic construct
  source 1..25: note = Seed: YGFLNVIVHSATGFKQSSKALQRPV
YGFLNVIVHSATGIKQNSVALARPV

SEQ ID NO: 28379 - protein, 25 aa, synthetic construct
  source 1..25: note = Seed: YGFLNVIVHSATGFKQSSKALQRPV
YGFLNVIVHSATGIKQNSVALFRPV

SEQ ID NO: 28380 - protein, 25 aa, synthetic construct
  source 1..25: note = Seed: YGFLNVIVHSATGFKQSSKALQRPV
YGFLNVIVHSATGIKQNSVALGRPV

SEQ ID NO: 28381 - protein, 25 aa, synthetic construct
  source 1..25: note = Seed: YGFLNVIVHSATGFKQSSKALQRPV
YGFLNVIVHSATGIKQNSVALHRPV

SEQ ID NO: 28382 - protein, 25 aa, synthetic construct
  source 1..25: note = Seed: YGFLNVIVHSATGFKQSSKALQRPV
YGFLNVIVHSATGIKQNSVALIRPV

SEQ ID NO: 28383 - protein, 25 aa, synthetic construct
  source 1..25: note = Seed: YGFLNVIVHSATGFKQSSKALQRPV
YGFLNVIVHSATGIKQNSVALLRPV

SEQ ID NO: 28384 - protein, 25 aa, synthetic construct
  source 1..25: note = Seed: YGFLNVIVHSATGFKQSSKALQRPV
YGFLNVIVHSATGIKQNSVALMRPV

SEQ ID NO: 28385 - protein, 25 aa, synthetic construct
  source 1..25: note = Seed: YGFLNVIVHSATGFKQSSKALQRPV
YGFLNVIVHSATGIKQNSVALNRPV

SEQ ID NO: 28386 - protein, 25 aa, synthetic construct
  source 1..25: note = Seed: YGFLNVIVHSATGFKQSSKALQRPV
YGFLNVIVHSATGIKQNSVALQRPV

SEQ ID NO: 28387 - protein, 25 aa, synthetic construct
  source 1..25: note = Seed: YGFLNVIVHSATGFKQSSKALQRPV
YGFLNVIVHSATGIKQNSVALRRPV

SEQ ID NO: 28388 - protein, 25 aa, synthetic construct
  source 1..25: note = Seed: YGFLNVIVHSATGFKQSSKALQRPV
YGFLNVIVHSATGIKQNSVALSRPV

SEQ ID NO: 28389 - protein, 25 aa, synthetic construct
  source 1..25: note = Seed: YGFLNVIVHSATGFKQSSKALQRPV
YGFLNVIVHSATGIKQNSVALTRPV

SEQ ID NO: 28390 - protein, 25 aa, synthetic construct
  source 1..25: note = Seed: YGFLNVIVHSATGFKQSSKALQRPV
YGFLNVIVHSATGIKQNSVALVRPV

SEQ ID NO: 28391 - protein, 25 aa, synthetic construct
  source 1..25: note = Seed: YGFLNVIVHSATGFKQSSKALQRPV
YGFLNVIVHSATGIKQNSVALWRPV

SEQ ID NO: 28392 - protein, 25 aa, synthetic construct
  source 1..25: note = Seed: YGFLNVIVHSATGFKQSSKALQRPV
YGFLNVIVHSATGIKQNSVALYRPV

SEQ ID NO: 28393 - protein, 25 aa, synthetic construct
  source 1..25: note = Seed: YGFLNVIVHSATGFKQSSKALQRPV
YGFLNVIVHSATGIKQNSWALIRPV

SEQ ID NO: 28394 - protein, 25 aa, synthetic construct
  source 1..25: note = Seed: YGFLNVIVHSATGFKQSSKALQRPV
YGFLNVIVHSATGIKQNSWALLRPV

SEQ ID NO: 28395 - protein, 25 aa, synthetic construct
  source 1..25: note = Seed: YGFLNVIVHSATGFKQSSKALQRPV
YGFLNVIVHSATGIKQNSWALMRPV

SEQ ID NO: 28396 - protein, 25 aa, synthetic construct
  source 1..25: note = Seed: YGFLNVIVHSATGFKQSSKALQRPV
YGFLNVIVHSATGIKQNSWALVRPV

SEQ ID NO: 28397 - protein, 25 aa, synthetic construct
  source 1..25: note = Seed: YGFLNVIVHSATGFKQSSKALQRPV
YGFLNVIVHSATGIKQNSWALYRPV

SEQ ID NO: 28398 - protein, 25 aa, synthetic construct
  source 1..25: note = Seed: YGFLNVIVHSATGFKQSSKALQRPV
YGFLNVIVHSATGIKQNSYALARPV

SEQ ID NO: 28399 - protein, 25 aa, synthetic construct
  source 1..25: note = Seed: YGFLNVIVHSATGFKQSSKALQRPV
YGFLNVIVHSATGIKQNSYALFRPV

SEQ ID NO: 28400 - protein, 25 aa, synthetic construct
  source 1..25: note = Seed: YGFLNVIVHSATGFKQSSKALQRPV
YGFLNVIVHSATGIKQNSYALIRPV

SEQ ID NO: 28401 - protein, 25 aa, synthetic construct
  source 1..25: note = Seed: YGFLNVIVHSATGFKQSSKALQRPV
YGFLNVIVHSATGIKQNSYALLRPV

SEQ ID NO: 28402 - protein, 25 aa, synthetic construct
  source 1..25: note = Seed: YGFLNVIVHSATGFKQSSKALQRPV
YGFLNVIVHSATGIKQNSYALMRPV

SEQ ID NO: 28403 - protein, 25 aa, synthetic construct
  source 1..25: note = Seed: YGFLNVIVHSATGFKQSSKALQRPV
YGFLNVIVHSATGIKQNSYALVRPV

SEQ ID NO: 28404 - protein, 25 aa, synthetic construct
  source 1..25: note = Seed: YGFLNVIVHSATGFKQSSKALQRPV
YGFLNVIVHSATGIKQNSYALYRPV

SEQ ID NO: 28405 - protein, 25 aa, synthetic construct
  source 1..25: note = Seed: YGFLNVIVHSATGFKQSSKALQRPV
YGFLNVIVHSATGIKQQSAALARPV

SEQ ID NO: 28406 - protein, 25 aa, synthetic construct
  source 1..25: note = Seed: YGFLNVIVHSATGFKQSSKALQRPV
YGFLNVIVHSATGIKQQSAALFRPV

SEQ ID NO: 28407 - protein, 25 aa, synthetic construct
  source 1..25: note = Seed: YGFLNVIVHSATGFKQSSKALQRPV
YGFLNVIVHSATGIKQQSAALIRPV

SEQ ID NO: 28408 - protein, 25 aa, synthetic construct
  source 1..25: note = Seed: YGFLNVIVHSATGFKQSSKALQRPV
YGFLNVIVHSATGIKQQSAALLRPV

SEQ ID NO: 28409 - protein, 25 aa, synthetic construct
  source 1..25: note = Seed: YGFLNVIVHSATGFKQSSKALQRPV
YGFLNVIVHSATGIKQQSAALNRPV

SEQ ID NO: 28410 - protein, 25 aa, synthetic construct
  source 1..25: note = Seed: YGFLNVIVHSATGFKQSSKALQRPV
YGFLNVIVHSATGIKQQSAALSRPV

SEQ ID NO: 28411 - protein, 25 aa, synthetic construct
  source 1..25: note = Seed: YGFLNVIVHSATGFKQSSKALQRPV
YGFLNVIVHSATGIKQQSAALVRPV

SEQ ID NO: 28412 - protein, 25 aa, synthetic construct
  source 1..25: note = Seed: YGFLNVIVHSATGFKQSSKALQRPV
YGFLNVIVHSATGIKQQSFALFRPV

SEQ ID NO: 28413 - protein, 25 aa, synthetic construct
  source 1..25: note = Seed: YGFLNVIVHSATGFKQSSKALQRPV
YGFLNVIVHSATGIKQQSFALIRPV

SEQ ID NO: 28414 - protein, 25 aa, synthetic construct
  source 1..25: note = Seed: YGFLNVIVHSATGFKQSSKALQRPV
YGFLNVIVHSATGIKQQSFALLRPV

SEQ ID NO: 28415 - protein, 25 aa, synthetic construct
  source 1..25: note = Seed: YGFLNVIVHSATGFKQSSKALQRPV
YGFLNVIVHSATGIKQQSGALIRPV

SEQ ID NO: 28416 - protein, 25 aa, synthetic construct
  source 1..25: note = Seed: YGFLNVIVHSATGFKQSSKALQRPV
YGFLNVIVHSATGIKQQSGALVRPV

SEQ ID NO: 28417 - protein, 25 aa, synthetic construct
  source 1..25: note = Seed: YGFLNVIVHSATGFKQSSKALQRPV
YGFLNVIVHSATGIKQQSIALARPV

SEQ ID NO: 28418 - protein, 25 aa, synthetic construct
  source 1..25: note = Seed: YGFLNVIVHSATGFKQSSKALQRPV
YGFLNVIVHSATGIKQQSIALNRPV

SEQ ID NO: 28419 - protein, 25 aa, synthetic construct
  source 1..25: note = Seed: YGFLNVIVHSATGFKQSSKALQRPV
YGFLNVIVHSATGIKQQSIALSRPV

SEQ ID NO: 28420 - protein, 25 aa, synthetic construct
  source 1..25: note = Seed: YGFLNVIVHSATGFKQSSKALQRPV
YGFLNVIVHSATGIKQQSKALARPV

SEQ ID NO: 28421 - protein, 25 aa, synthetic construct
  source 1..25: note = Seed: YGFLNVIVHSATGFKQSSKALQRPV
YGFLNVIVHSATGIKQQSKALFRPV

SEQ ID NO: 28422 - protein, 25 aa, synthetic construct
  source 1..25: note = Seed: YGFLNVIVHSATGFKQSSKALQRPV
YGFLNVIVHSATGIKQQSKALIRPV

SEQ ID NO: 28423 - protein, 25 aa, synthetic construct
  source 1..25: note = Seed: YGFLNVIVHSATGFKQSSKALQRPV
YGFLNVIVHSATGIKQQSKALQRPV

SEQ ID NO: 28424 - protein, 25 aa, synthetic construct
  source 1..25: note = Seed: YGFLNVIVHSATGFKQSSKALQRPV
YGFLNVIVHSATGIKQQSKALRRPV

SEQ ID NO: 28425 - protein, 25 aa, synthetic construct
  source 1..25: note = Seed: YGFLNVIVHSATGFKQSSKALQRPV
YGFLNVIVHSATGIKQQSKALSRPV

SEQ ID NO: 28426 - protein, 25 aa, synthetic construct
  source 1..25: note = Seed: YGFLNVIVHSATGFKQSSKALQRPV
YGFLNVIVHSATGIKQQSKALVRPV

SEQ ID NO: 28427 - protein, 25 aa, synthetic construct
  source 1..25: note = Seed: YGFLNVIVHSATGFKQSSKALQRPV
YGFLNVIVHSATGIKQQSKALYRPV

SEQ ID NO: 28428 - protein, 25 aa, synthetic construct
  source 1..25: note = Seed: YGFLNVIVHSATGFKQSSKALQRPV
YGFLNVIVHSATGIKQQSNALFRPV

SEQ ID NO: 28429 - protein, 25 aa, synthetic construct
  source 1..25: note = Seed: YGFLNVIVHSATGFKQSSKALQRPV
YGFLNVIVHSATGIKQQSNALIRPV

SEQ ID NO: 28430 - protein, 25 aa, synthetic construct
  source 1..25: note = Seed: YGFLNVIVHSATGFKQSSKALQRPV
YGFLNVIVHSATGIKQQSNALLRPV

SEQ ID NO: 28431 - protein, 25 aa, synthetic construct
  source 1..25: note = Seed: YGFLNVIVHSATGFKQSSKALQRPV
YGFLNVIVHSATGIKQQSNALVRPV

SEQ ID NO: 28432 - protein, 25 aa, synthetic construct
  source 1..25: note = Seed: YGFLNVIVHSATGFKQSSKALQRPV
YGFLNVIVHSATGIKQQSPALARPV

SEQ ID NO: 28433 - protein, 25 aa, synthetic construct
  source 1..25: note = Seed: YGFLNVIVHSATGFKQSSKALQRPV
YGFLNVIVHSATGIKQQSPALIRPV

SEQ ID NO: 28434 - protein, 25 aa, synthetic construct
  source 1..25: note = Seed: YGFLNVIVHSATGFKQSSKALQRPV
YGFLNVIVHSATGIKQQSPALNRPV

SEQ ID NO: 28435 - protein, 25 aa, synthetic construct
  source 1..25: note = Seed: YGFLNVIVHSATGFKQSSKALQRPV
YGFLNVIVHSATGIKQQSPALSRPV

SEQ ID NO: 28436 - protein, 25 aa, synthetic construct
  source 1..25: note = Seed: YGFLNVIVHSATGFKQSSKALQRPV
YGFLNVIVHSATGIKQQSPALVRPV

SEQ ID NO: 28437 - protein, 25 aa, synthetic construct
  source 1..25: note = Seed: YGFLNVIVHSATGFKQSSKALQRPV
YGFLNVIVHSATGIKQQSRALARPV

SEQ ID NO: 28438 - protein, 25 aa, synthetic construct
  source 1..25: note = Seed: YGFLNVIVHSATGFKQSSKALQRPV
YGFLNVIVHSATGIKQQSRALFRPV

SEQ ID NO: 28439 - protein, 25 aa, synthetic construct
  source 1..25: note = Seed: YGFLNVIVHSATGFKQSSKALQRPV
YGFLNVIVHSATGIKQQSRALGRPV

SEQ ID NO: 28440 - protein, 25 aa, synthetic construct
  source 1..25: note = Seed: YGFLNVIVHSATGFKQSSKALQRPV
YGFLNVIVHSATGIKQQSRALHRPV

SEQ ID NO: 28441 - protein, 25 aa, synthetic construct
  source 1..25: note = Seed: YGFLNVIVHSATGFKQSSKALQRPV
YGFLNVIVHSATGIKQQSRALIRPV

SEQ ID NO: 28442 - protein, 25 aa, synthetic construct
  source 1..25: note = Seed: YGFLNVIVHSATGFKQSSKALQRPV
YGFLNVIVHSATGIKQQSRALLRPV

SEQ ID NO: 28443 - protein, 25 aa, synthetic construct
  source 1..25: note = Seed: YGFLNVIVHSATGFKQSSKALQRPV
YGFLNVIVHSATGIKQQSRALMRPV

SEQ ID NO: 28444 - protein, 25 aa, synthetic construct
  source 1..25: note = Seed: YGFLNVIVHSATGFKQSSKALQRPV
YGFLNVIVHSATGIKQQSRALQRPV

SEQ ID NO: 28445 - protein, 25 aa, synthetic construct
  source 1..25: note = Seed: YGFLNVIVHSATGFKQSSKALQRPV
YGFLNVIVHSATGIKQQSRALRRPV

SEQ ID NO: 28446 - protein, 25 aa, synthetic construct
  source 1..25: note = Seed: YGFLNVIVHSATGFKQSSKALQRPV
YGFLNVIVHSATGIKQQSRALSRPV

SEQ ID NO: 28447 - protein, 25 aa, synthetic construct
  source 1..25: note = Seed: YGFLNVIVHSATGFKQSSKALQRPV
YGFLNVIVHSATGIKQQSRALTRPV

SEQ ID NO: 28448 - protein, 25 aa, synthetic construct
  source 1..25: note = Seed: YGFLNVIVHSATGFKQSSKALQRPV
YGFLNVIVHSATGIKQQSRALVRPV

SEQ ID NO: 28449 - protein, 25 aa, synthetic construct
  source 1..25: note = Seed: YGFLNVIVHSATGFKQSSKALQRPV
YGFLNVIVHSATGIKQQSRALYRPV

SEQ ID NO: 28450 - protein, 25 aa, synthetic construct
  source 1..25: note = Seed: YGFLNVIVHSATGFKQSSKALQRPV
YGFLNVIVHSATGIKQQSSALIRPV

SEQ ID NO: 28451 - protein, 25 aa, synthetic construct
  source 1..25: note = Seed: YGFLNVIVHSATGFKQSSKALQRPV
YGFLNVIVHSATGIKQQSSALVRPV

SEQ ID NO: 28452 - protein, 25 aa, synthetic construct
  source 1..25: note = Seed: YGFLNVIVHSATGFKQSSKALQRPV
YGFLNVIVHSATGIKQQSTALIRPV

SEQ ID NO: 28453 - protein, 25 aa, synthetic construct
  source 1..25: note = Seed: YGFLNVIVHSATGFKQSSKALQRPV
YGFLNVIVHSATGIKQQSTALVRPV

SEQ ID NO: 28454 - protein, 25 aa, synthetic construct
  source 1..25: note = Seed: YGFLNVIVHSATGFKQSSKALQRPV
YGFLNVIVHSATGIKQQSVALARPV

SEQ ID NO: 28455 - protein, 25 aa, synthetic construct
  source 1..25: note = Seed: YGFLNVIVHSATGFKQSSKALQRPV
YGFLNVIVHSATGIKQQSVALNRPV

SEQ ID NO: 28456 - protein, 25 aa, synthetic construct
  source 1..25: note = Seed: YGFLNVIVHSATGFKQSSKALQRPV
YGFLNVIVHSATGIKQQSVALSRPV

SEQ ID NO: 28457 - protein, 25 aa, synthetic construct
  source 1..25: note = Seed: YGFLNVIVHSATGFKQSSKALQRPV
YGFLNVIVHSATGIKQRSAALRRPV

SEQ ID NO: 28458 - protein, 25 aa, synthetic construct
  source 1..25: note = Seed: YGFLNVIVHSATGFKQSSKALQRPV
YGFLNVIVHSATGIKQRSAALYRPV

SEQ ID NO: 28459 - protein, 25 aa, synthetic construct
  source 1..25: note = Seed: YGFLNVIVHSATGFKQSSKALQRPV
YGFLNVIVHSATGIKQRSIALRRPV

SEQ ID NO: 28460 - protein, 25 aa, synthetic construct
  source 1..25: note = Seed: YGFLNVIVHSATGFKQSSKALQRPV
YGFLNVIVHSATGIKQRSKALARPV

SEQ ID NO: 28461 - protein, 25 aa, synthetic construct
  source 1..25: note = Seed: YGFLNVIVHSATGFKQSSKALQRPV
YGFLNVIVHSATGIKQRSKALFRPV

SEQ ID NO: 28462 - protein, 25 aa, synthetic construct
  source 1..25: note = Seed: YGFLNVIVHSATGFKQSSKALQRPV
YGFLNVIVHSATGIKQRSKALHRPV

SEQ ID NO: 28463 - protein, 25 aa, synthetic construct
  source 1..25: note = Seed: YGFLNVIVHSATGFKQSSKALQRPV
YGFLNVIVHSATGIKQRSKALIRPV

SEQ ID NO: 28464 - protein, 25 aa, synthetic construct
  source 1..25: note = Seed: YGFLNVIVHSATGFKQSSKALQRPV
YGFLNVIVHSATGIKQRSKALKRPV

SEQ ID NO: 28465 - protein, 25 aa, synthetic construct
  source 1..25: note = Seed: YGFLNVIVHSATGFKQSSKALQRPV
YGFLNVIVHSATGIKQRSKALLRPV

SEQ ID NO: 28466 - protein, 25 aa, synthetic construct
  source 1..25: note = Seed: YGFLNVIVHSATGFKQSSKALQRPV
YGFLNVIVHSATGIKQRSKALMRPV

SEQ ID NO: 28467 - protein, 25 aa, synthetic construct
  source 1..25: note = Seed: YGFLNVIVHSATGFKQSSKALQRPV
YGFLNVIVHSATGIKQRSKALRRPV

SEQ ID NO: 28468 - protein, 25 aa, synthetic construct
  source 1..25: note = Seed: YGFLNVIVHSATGFKQSSKALQRPV
YGFLNVIVHSATGIKQRSKALSRPV

SEQ ID NO: 28469 - protein, 25 aa, synthetic construct
  source 1..25: note = Seed: YGFLNVIVHSATGFKQSSKALQRPV
YGFLNVIVHSATGIKQRSKALVRPV

SEQ ID NO: 28470 - protein, 25 aa, synthetic construct
  source 1..25: note = Seed: YGFLNVIVHSATGFKQSSKALQRPV
YGFLNVIVHSATGIKQRSKALYRPV

SEQ ID NO: 28471 - protein, 25 aa, synthetic construct
  source 1..25: note = Seed: YGFLNVIVHSATGFKQSSKALQRPV
YGFLNVIVHSATGIKQRSNALRRPV

SEQ ID NO: 28472 - protein, 25 aa, synthetic construct
  source 1..25: note = Seed: YGFLNVIVHSATGFKQSSKALQRPV
YGFLNVIVHSATGIKQRSNALYRPV

SEQ ID NO: 28473 - protein, 25 aa, synthetic construct
  source 1..25: note = Seed: YGFLNVIVHSATGFKQSSKALQRPV
YGFLNVIVHSATGIKQRSPALRRPV

SEQ ID NO: 28474 - protein, 25 aa, synthetic construct
  source 1..25: note = Seed: YGFLNVIVHSATGFKQSSKALQRPV
YGFLNVIVHSATGIKQRSPALYRPV

SEQ ID NO: 28475 - protein, 25 aa, synthetic construct
  source 1..25: note = Seed: YGFLNVIVHSATGFKQSSKALQRPV
YGFLNVIVHSATGIKQRSRALARPV

SEQ ID NO: 28476 - protein, 25 aa, synthetic construct
  source 1..25: note = Seed: YGFLNVIVHSATGFKQSSKALQRPV
YGFLNVIVHSATGIKQRSRALFRPV

SEQ ID NO: 28477 - protein, 25 aa, synthetic construct
  source 1..25: note = Seed: YGFLNVIVHSATGFKQSSKALQRPV
YGFLNVIVHSATGIKQRSRALGRPV

SEQ ID NO: 28478 - protein, 25 aa, synthetic construct
  source 1..25: note = Seed: YGFLNVIVHSATGFKQSSKALQRPV
YGFLNVIVHSATGIKQRSRALHRPV

SEQ ID NO: 28479 - protein, 25 aa, synthetic construct
  source 1..25: note = Seed: YGFLNVIVHSATGFKQSSKALQRPV
YGFLNVIVHSATGIKQRSRALIRPV

SEQ ID NO: 28480 - protein, 25 aa, synthetic construct
  source 1..25: note = Seed: YGFLNVIVHSATGFKQSSKALQRPV
YGFLNVIVHSATGIKQRSRALKRPV

SEQ ID NO: 28481 - protein, 25 aa, synthetic construct
  source 1..25: note = Seed: YGFLNVIVHSATGFKQSSKALQRPV
YGFLNVIVHSATGIKQRSRALLRPV

SEQ ID NO: 28482 - protein, 25 aa, synthetic construct
  source 1..25: note = Seed: YGFLNVIVHSATGFKQSSKALQRPV
YGFLNVIVHSATGIKQRSRALMRPV

SEQ ID NO: 28483 - protein, 25 aa, synthetic construct
  source 1..25: note = Seed: YGFLNVIVHSATGFKQSSKALQRPV
YGFLNVIVHSATGIKQRSRALQRPV

SEQ ID NO: 28484 - protein, 25 aa, synthetic construct
  source 1..25: note = Seed: YGFLNVIVHSATGFKQSSKALQRPV
YGFLNVIVHSATGIKQRSRALRRPV

SEQ ID NO: 28485 - protein, 25 aa, synthetic construct
  source 1..25: note = Seed: YGFLNVIVHSATGFKQSSKALQRPV
YGFLNVIVHSATGIKQRSRALSRPV

SEQ ID NO: 28486 - protein, 25 aa, synthetic construct
  source 1..25: note = Seed: YGFLNVIVHSATGFKQSSKALQRPV
YGFLNVIVHSATGIKQRSRALVRPV

SEQ ID NO: 28487 - protein, 25 aa, synthetic construct
  source 1..25: note = Seed: YGFLNVIVHSATGFKQSSKALQRPV
YGFLNVIVHSATGIKQRSRALWRPV

SEQ ID NO: 28488 - protein, 25 aa, synthetic construct
  source 1..25: note = Seed: YGFLNVIVHSATGFKQSSKALQRPV
YGFLNVIVHSATGIKQRSRALYRPV

SEQ ID NO: 28489 - protein, 25 aa, synthetic construct
  source 1..25: note = Seed: YGFLNVIVHSATGFKQSSKALQRPV
YGFLNVIVHSATGIKQRSSALRRPV

SEQ ID NO: 28490 - protein, 25 aa, synthetic construct
  source 1..25: note = Seed: YGFLNVIVHSATGFKQSSKALQRPV
YGFLNVIVHSATGIKQRSSALYRPV

SEQ ID NO: 28491 - protein, 25 aa, synthetic construct
  source 1..25: note = Seed: YGFLNVIVHSATGFKQSSKALQRPV
YGFLNVIVHSATGIKQRSTALRRPV

SEQ ID NO: 28492 - protein, 25 aa, synthetic construct
  source 1..25: note = Seed: YGFLNVIVHSATGFKQSSKALQRPV
YGFLNVIVHSATGIKQRSTALYRPV

SEQ ID NO: 28493 - protein, 25 aa, synthetic construct
  source 1..25: note = Seed: YGFLNVIVHSATGFKQSSKALQRPV
YGFLNVIVHSATGIKQRSVALRRPV

SEQ ID NO: 28494 - protein, 25 aa, synthetic construct
  source 1..25: note = Seed: YGFLNVIVHSATGFKQSSKALQRPV
YGFLNVIVHSATGIKQSSAALARPV

SEQ ID NO: 28495 - protein, 25 aa, synthetic construct
  source 1..25: note = Seed: YGFLNVIVHSATGFKQSSKALQRPV
YGFLNVIVHSATGIKQSSAALFRPV

SEQ ID NO: 28496 - protein, 25 aa, synthetic construct
  source 1..25: note = Seed: YGFLNVIVHSATGFKQSSKALQRPV
YGFLNVIVHSATGIKQSSAALIRPV

SEQ ID NO: 28497 - protein, 25 aa, synthetic construct
  source 1..25: note = Seed: YGFLNVIVHSATGFKQSSKALQRPV
YGFLNVIVHSATGIKQSSAALLRPV

SEQ ID NO: 28498 - protein, 25 aa, synthetic construct
  source 1..25: note = Seed: YGFLNVIVHSATGFKQSSKALQRPV
YGFLNVIVHSATGIKQSSAALMRPV

SEQ ID NO: 28499 - protein, 25 aa, synthetic construct
  source 1..25: note = Seed: YGFLNVIVHSATGFKQSSKALQRPV
YGFLNVIVHSATGIKQSSAALNRPV

SEQ ID NO: 28500 - protein, 25 aa, synthetic construct
  source 1..25: note = Seed: YGFLNVIVHSATGFKQSSKALQRPV
YGFLNVIVHSATGIKQSSAALRRPV

SEQ ID NO: 28501 - protein, 25 aa, synthetic construct
  source 1..25: note = Seed: YGFLNVIVHSATGFKQSSKALQRPV
YGFLNVIVHSATGIKQSSAALSRPV

SEQ ID NO: 28502 - protein, 25 aa, synthetic construct
  source 1..25: note = Seed: YGFLNVIVHSATGFKQSSKALQRPV
YGFLNVIVHSATGIKQSSAALVRPV

SEQ ID NO: 28503 - protein, 25 aa, synthetic construct
  source 1..25: note = Seed: YGFLNVIVHSATGFKQSSKALQRPV
YGFLNVIVHSATGIKQSSAALYRPV

SEQ ID NO: 28504 - protein, 25 aa, synthetic construct
  source 1..25: note = Seed: YGFLNVIVHSATGFKQSSKALQRPV
YGFLNVIVHSATGIKQSSFALFRPV

SEQ ID NO: 28505 - protein, 25 aa, synthetic construct
  source 1..25: note = Seed: YGFLNVIVHSATGFKQSSKALQRPV
YGFLNVIVHSATGIKQSSFALIRPV

SEQ ID NO: 28506 - protein, 25 aa, synthetic construct
  source 1..25: note = Seed: YGFLNVIVHSATGFKQSSKALQRPV
YGFLNVIVHSATGIKQSSFALLRPV

SEQ ID NO: 28507 - protein, 25 aa, synthetic construct
  source 1..25: note = Seed: YGFLNVIVHSATGFKQSSKALQRPV
YGFLNVIVHSATGIKQSSFALVRPV

SEQ ID NO: 28508 - protein, 25 aa, synthetic construct
  source 1..25: note = Seed: YGFLNVIVHSATGFKQSSKALQRPV
YGFLNVIVHSATGIKQSSGALFRPV

SEQ ID NO: 28509 - protein, 25 aa, synthetic construct
  source 1..25: note = Seed: YGFLNVIVHSATGFKQSSKALQRPV
YGFLNVIVHSATGIKQSSGALIRPV

SEQ ID NO: 28510 - protein, 25 aa, synthetic construct
  source 1..25: note = Seed: YGFLNVIVHSATGFKQSSKALQRPV
YGFLNVIVHSATGIKQSSGALLRPV

SEQ ID NO: 28511 - protein, 25 aa, synthetic construct
  source 1..25: note = Seed: YGFLNVIVHSATGFKQSSKALQRPV
YGFLNVIVHSATGIKQSSGALMRPV

SEQ ID NO: 28512 - protein, 25 aa, synthetic construct
  source 1..25: note = Seed: YGFLNVIVHSATGFKQSSKALQRPV
YGFLNVIVHSATGIKQSSGALVRPV

SEQ ID NO: 28513 - protein, 25 aa, synthetic construct
  source 1..25: note = Seed: YGFLNVIVHSATGFKQSSKALQRPV
YGFLNVIVHSATGIKQSSGALYRPV

SEQ ID NO: 28514 - protein, 25 aa, synthetic construct
  source 1..25: note = Seed: YGFLNVIVHSATGFKQSSKALQRPV
YGFLNVIVHSATGIKQSSHALIRPV

SEQ ID NO: 28515 - protein, 25 aa, synthetic construct
  source 1..25: note = Seed: YGFLNVIVHSATGFKQSSKALQRPV
YGFLNVIVHSATGIKQSSHALVRPV

SEQ ID NO: 28516 - protein, 25 aa, synthetic construct
  source 1..25: note = Seed: YGFLNVIVHSATGFKQSSKALQRPV
YGFLNVIVHSATGIKQSSIALIRPV

SEQ ID NO: 28517 - protein, 25 aa, synthetic construct
  source 1..25: note = Seed: YGFLNVIVHSATGFKQSSKALQRPV
YGFLNVIVHSATGIKQSSIALVRPV

SEQ ID NO: 28518 - protein, 25 aa, synthetic construct
  source 1..25: note = Seed: YGFLNVIVHSATGFKQSSKALQRPV
YGFLNVIVHSATGIKQSSKALARPV

SEQ ID NO: 28519 - protein, 25 aa, synthetic construct
  source 1..25: note = Seed: YGFLNVIVHSATGFKQSSKALQRPV
YGFLNVIVHSATGIKQSSKALRRPV

SEQ ID NO: 28520 - protein, 25 aa, synthetic construct
  source 1..25: note = Seed: YGFLNVIVHSATGFKQSSKALQRPV
YGFLNVIVHSATGIKQSSKALSRPV

SEQ ID NO: 28521 - protein, 25 aa, synthetic construct
  source 1..25: note = Seed: YGFLNVIVHSATGFKQSSKALQRPV
YGFLNVIVHSATGIKQSSKALYRPV

SEQ ID NO: 28522 - protein, 25 aa, synthetic construct
  source 1..25: note = Seed: YGFLNVIVHSATGFKQSSKALQRPV
YGFLNVIVHSATGIKQSSNALFRPV

SEQ ID NO: 28523 - protein, 25 aa, synthetic construct
  source 1..25: note = Seed: YGFLNVIVHSATGFKQSSKALQRPV
YGFLNVIVHSATGIKQSSNALIRPV

SEQ ID NO: 28524 - protein, 25 aa, synthetic construct
  source 1..25: note = Seed: YGFLNVIVHSATGFKQSSKALQRPV
YGFLNVIVHSATGIKQSSNALLRPV

SEQ ID NO: 28525 - protein, 25 aa, synthetic construct
  source 1..25: note = Seed: YGFLNVIVHSATGFKQSSKALQRPV
YGFLNVIVHSATGIKQSSNALMRPV

SEQ ID NO: 28526 - protein, 25 aa, synthetic construct
  source 1..25: note = Seed: YGFLNVIVHSATGFKQSSKALQRPV
YGFLNVIVHSATGIKQSSNALVRPV

SEQ ID NO: 28527 - protein, 25 aa, synthetic construct
  source 1..25: note = Seed: YGFLNVIVHSATGFKQSSKALQRPV
YGFLNVIVHSATGIKQSSNALYRPV

SEQ ID NO: 28528 - protein, 25 aa, synthetic construct
  source 1..25: note = Seed: YGFLNVIVHSATGFKQSSKALQRPV
YGFLNVIVHSATGIKQSSPALFRPV

SEQ ID NO: 28529 - protein, 25 aa, synthetic construct
  source 1..25: note = Seed: YGFLNVIVHSATGFKQSSKALQRPV
YGFLNVIVHSATGIKQSSPALIRPV

SEQ ID NO: 28530 - protein, 25 aa, synthetic construct
  source 1..25: note = Seed: YGFLNVIVHSATGFKQSSKALQRPV
YGFLNVIVHSATGIKQSSPALLRPV

SEQ ID NO: 28531 - protein, 25 aa, synthetic construct
  source 1..25: note = Seed: YGFLNVIVHSATGFKQSSKALQRPV
YGFLNVIVHSATGIKQSSPALMRPV

SEQ ID NO: 28532 - protein, 25 aa, synthetic construct
  source 1..25: note = Seed: YGFLNVIVHSATGFKQSSKALQRPV
YGFLNVIVHSATGIKQSSPALVRPV

SEQ ID NO: 28533 - protein, 25 aa, synthetic construct
  source 1..25: note = Seed: YGFLNVIVHSATGFKQSSKALQRPV
YGFLNVIVHSATGIKQSSPALYRPV

SEQ ID NO: 28534 - protein, 25 aa, synthetic construct
  source 1..25: note = Seed: YGFLNVIVHSATGFKQSSKALQRPV
YGFLNVIVHSATGIKQSSRALARPV

SEQ ID NO: 28535 - protein, 25 aa, synthetic construct
  source 1..25: note = Seed: YGFLNVIVHSATGFKQSSKALQRPV
YGFLNVIVHSATGIKQSSRALFRPV

SEQ ID NO: 28536 - protein, 25 aa, synthetic construct
  source 1..25: note = Seed: YGFLNVIVHSATGFKQSSKALQRPV
YGFLNVIVHSATGIKQSSRALGRPV

SEQ ID NO: 28537 - protein, 25 aa, synthetic construct
  source 1..25: note = Seed: YGFLNVIVHSATGFKQSSKALQRPV
YGFLNVIVHSATGIKQSSRALHRPV

SEQ ID NO: 28538 - protein, 25 aa, synthetic construct
  source 1..25: note = Seed: YGFLNVIVHSATGFKQSSKALQRPV
YGFLNVIVHSATGIKQSSRALKRPV

SEQ ID NO: 28539 - protein, 25 aa, synthetic construct
  source 1..25: note = Seed: YGFLNVIVHSATGFKQSSKALQRPV
YGFLNVIVHSATGIKQSSRALMRPV

SEQ ID NO: 28540 - protein, 25 aa, synthetic construct
  source 1..25: note = Seed: YGFLNVIVHSATGFKQSSKALQRPV
YGFLNVIVHSATGIKQSSRALQRPV

SEQ ID NO: 28541 - protein, 25 aa, synthetic construct
  source 1..25: note = Seed: YGFLNVIVHSATGFKQSSKALQRPV
YGFLNVIVHSATGIKQSSRALRRPV

SEQ ID NO: 28542 - protein, 25 aa, synthetic construct
  source 1..25: note = Seed: YGFLNVIVHSATGFKQSSKALQRPV
YGFLNVIVHSATGIKQSSRALSRPV

SEQ ID NO: 28543 - protein, 25 aa, synthetic construct
  source 1..25: note = Seed: YGFLNVIVHSATGFKQSSKALQRPV
YGFLNVIVHSATGIKQSSRALVRPV

SEQ ID NO: 28544 - protein, 25 aa, synthetic construct
  source 1..25: note = Seed: YGFLNVIVHSATGFKQSSKALQRPV
YGFLNVIVHSATGIKQSSRALYRPV

SEQ ID NO: 28545 - protein, 25 aa, synthetic construct
  source 1..25: note = Seed: YGFLNVIVHSATGFKQSSKALQRPV
YGFLNVIVHSATGIKQSSSALFRPV

SEQ ID NO: 28546 - protein, 25 aa, synthetic construct
  source 1..25: note = Seed: YGFLNVIVHSATGFKQSSKALQRPV
YGFLNVIVHSATGIKQSSSALIRPV

SEQ ID NO: 28547 - protein, 25 aa, synthetic construct
  source 1..25: note = Seed: YGFLNVIVHSATGFKQSSKALQRPV
YGFLNVIVHSATGIKQSSSALLRPV

SEQ ID NO: 28548 - protein, 25 aa, synthetic construct
  source 1..25: note = Seed: YGFLNVIVHSATGFKQSSKALQRPV
YGFLNVIVHSATGIKQSSSALMRPV

SEQ ID NO: 28549 - protein, 25 aa, synthetic construct
  source 1..25: note = Seed: YGFLNVIVHSATGFKQSSKALQRPV
YGFLNVIVHSATGIKQSSSALVRPV

SEQ ID NO: 28550 - protein, 25 aa, synthetic construct
  source 1..25: note = Seed: YGFLNVIVHSATGFKQSSKALQRPV
YGFLNVIVHSATGIKQSSSALYRPV

SEQ ID NO: 28551 - protein, 25 aa, synthetic construct
  source 1..25: note = Seed: YGFLNVIVHSATGFKQSSKALQRPV
YGFLNVIVHSATGIKQSSTALFRPV

SEQ ID NO: 28552 - protein, 25 aa, synthetic construct
  source 1..25: note = Seed: YGFLNVIVHSATGFKQSSKALQRPV
YGFLNVIVHSATGIKQSSTALIRPV

SEQ ID NO: 28553 - protein, 25 aa, synthetic construct
  source 1..25: note = Seed: YGFLNVIVHSATGFKQSSKALQRPV
YGFLNVIVHSATGIKQSSTALLRPV

SEQ ID NO: 28554 - protein, 25 aa, synthetic construct
  source 1..25: note = Seed: YGFLNVIVHSATGFKQSSKALQRPV
YGFLNVIVHSATGIKQSSTALVRPV

SEQ ID NO: 28555 - protein, 25 aa, synthetic construct
  source 1..25: note = Seed: YGFLNVIVHSATGFKQSSKALQRPV
YGFLNVIVHSATGIKQSSTALYRPV

SEQ ID NO: 28556 - protein, 25 aa, synthetic construct
  source 1..25: note = Seed: YGFLNVIVHSATGFKQSSKALQRPV
YGFLNVIVHSATGIKQSSVALIRPV

SEQ ID NO: 28557 - protein, 25 aa, synthetic construct
  source 1..25: note = Seed: YGFLNVIVHSATGFKQSSKALQRPV
YGFLNVIVHSATGIKQSSVALVRPV

SEQ ID NO: 28558 - protein, 25 aa, synthetic construct
  source 1..25: note = Seed: YGFLNVIVHSATGFKQSSKALQRPV
YGFLNVIVHSATGIKQTSAALARPV

SEQ ID NO: 28559 - protein, 25 aa, synthetic construct
  source 1..25: note = Seed: YGFLNVIVHSATGFKQSSKALQRPV
YGFLNVIVHSATGIKQTSAALFRPV

SEQ ID NO: 28560 - protein, 25 aa, synthetic construct
  source 1..25: note = Seed: YGFLNVIVHSATGFKQSSKALQRPV
YGFLNVIVHSATGIKQTSAALIRPV

SEQ ID NO: 28561 - protein, 25 aa, synthetic construct
  source 1..25: note = Seed: YGFLNVIVHSATGFKQSSKALQRPV
YGFLNVIVHSATGIKQTSAALLRPV

SEQ ID NO: 28562 - protein, 25 aa, synthetic construct
  source 1..25: note = Seed: YGFLNVIVHSATGFKQSSKALQRPV
YGFLNVIVHSATGIKQTSAALNRPV

SEQ ID NO: 28563 - protein, 25 aa, synthetic construct
  source 1..25: note = Seed: YGFLNVIVHSATGFKQSSKALQRPV
YGFLNVIVHSATGIKQTSAALVRPV

SEQ ID NO: 28564 - protein, 25 aa, synthetic construct
  source 1..25: note = Seed: YGFLNVIVHSATGFKQSSKALQRPV
YGFLNVIVHSATGIKQTSAALYRPV

SEQ ID NO: 28565 - protein, 25 aa, synthetic construct
  source 1..25: note = Seed: YGFLNVIVHSATGFKQSSKALQRPV
YGFLNVIVHSATGIKQTSFALFRPV

SEQ ID NO: 28566 - protein, 25 aa, synthetic construct
  source 1..25: note = Seed: YGFLNVIVHSATGFKQSSKALQRPV
YGFLNVIVHSATGIKQTSFALIRPV

SEQ ID NO: 28567 - protein, 25 aa, synthetic construct
  source 1..25: note = Seed: YGFLNVIVHSATGFKQSSKALQRPV
YGFLNVIVHSATGIKQTSFALLRPV

SEQ ID NO: 28568 - protein, 25 aa, synthetic construct
  source 1..25: note = Seed: YGFLNVIVHSATGFKQSSKALQRPV
YGFLNVIVHSATGIKQTSFALMRPV

SEQ ID NO: 28569 - protein, 25 aa, synthetic construct
  source 1..25: note = Seed: YGFLNVIVHSATGFKQSSKALQRPV
YGFLNVIVHSATGIKQTSFALVRPV

SEQ ID NO: 28570 - protein, 25 aa, synthetic construct
  source 1..25: note = Seed: YGFLNVIVHSATGFKQSSKALQRPV
YGFLNVIVHSATGIKQTSFALYRPV

SEQ ID NO: 28571 - protein, 25 aa, synthetic construct
  source 1..25: note = Seed: YGFLNVIVHSATGFKQSSKALQRPV
YGFLNVIVHSATGIKQTSGALIRPV

SEQ ID NO: 28572 - protein, 25 aa, synthetic construct
  source 1..25: note = Seed: YGFLNVIVHSATGFKQSSKALQRPV
YGFLNVIVHSATGIKQTSGALVRPV

SEQ ID NO: 28573 - protein, 25 aa, synthetic construct
  source 1..25: note = Seed: YGFLNVIVHSATGFKQSSKALQRPV
YGFLNVIVHSATGIKQTSKALARPV

SEQ ID NO: 28574 - protein, 25 aa, synthetic construct
  source 1..25: note = Seed: YGFLNVIVHSATGFKQSSKALQRPV
YGFLNVIVHSATGIKQTSKALRRPV

SEQ ID NO: 28575 - protein, 25 aa, synthetic construct
  source 1..25: note = Seed: YGFLNVIVHSATGFKQSSKALQRPV
YGFLNVIVHSATGIKQTSKALSRPV

SEQ ID NO: 28576 - protein, 25 aa, synthetic construct
  source 1..25: note = Seed: YGFLNVIVHSATGFKQSSKALQRPV
YGFLNVIVHSATGIKQTSNALFRPV

SEQ ID NO: 28577 - protein, 25 aa, synthetic construct
  source 1..25: note = Seed: YGFLNVIVHSATGFKQSSKALQRPV
YGFLNVIVHSATGIKQTSNALIRPV

SEQ ID NO: 28578 - protein, 25 aa, synthetic construct
  source 1..25: note = Seed: YGFLNVIVHSATGFKQSSKALQRPV
YGFLNVIVHSATGIKQTSNALLRPV

SEQ ID NO: 28579 - protein, 25 aa, synthetic construct
  source 1..25: note = Seed: YGFLNVIVHSATGFKQSSKALQRPV
YGFLNVIVHSATGIKQTSNALVRPV

SEQ ID NO: 28580 - protein, 25 aa, synthetic construct
  source 1..25: note = Seed: YGFLNVIVHSATGFKQSSKALQRPV
YGFLNVIVHSATGIKQTSNALYRPV

SEQ ID NO: 28581 - protein, 25 aa, synthetic construct
  source 1..25: note = Seed: YGFLNVIVHSATGFKQSSKALQRPV
YGFLNVIVHSATGIKQTSPALIRPV

SEQ ID NO: 28582 - protein, 25 aa, synthetic construct
  source 1..25: note = Seed: YGFLNVIVHSATGFKQSSKALQRPV
YGFLNVIVHSATGIKQTSPALVRPV

SEQ ID NO: 28583 - protein, 25 aa, synthetic construct
  source 1..25: note = Seed: YGFLNVIVHSATGFKQSSKALQRPV
YGFLNVIVHSATGIKQTSRALARPV

SEQ ID NO: 28584 - protein, 25 aa, synthetic construct
  source 1..25: note = Seed: YGFLNVIVHSATGFKQSSKALQRPV
YGFLNVIVHSATGIKQTSRALGRPV

SEQ ID NO: 28585 - protein, 25 aa, synthetic construct
  source 1..25: note = Seed: YGFLNVIVHSATGFKQSSKALQRPV
YGFLNVIVHSATGIKQTSRALHRPV

SEQ ID NO: 28586 - protein, 25 aa, synthetic construct
  source 1..25: note = Seed: YGFLNVIVHSATGFKQSSKALQRPV
YGFLNVIVHSATGIKQTSRALKRPV

SEQ ID NO: 28587 - protein, 25 aa, synthetic construct
  source 1..25: note = Seed: YGFLNVIVHSATGFKQSSKALQRPV
YGFLNVIVHSATGIKQTSRALQRPV

SEQ ID NO: 28588 - protein, 25 aa, synthetic construct
  source 1..25: note = Seed: YGFLNVIVHSATGFKQSSKALQRPV
YGFLNVIVHSATGIKQTSRALRRPV

SEQ ID NO: 28589 - protein, 25 aa, synthetic construct
  source 1..25: note = Seed: YGFLNVIVHSATGFKQSSKALQRPV
YGFLNVIVHSATGIKQTSRALSRPV

SEQ ID NO: 28590 - protein, 25 aa, synthetic construct
  source 1..25: note = Seed: YGFLNVIVHSATGFKQSSKALQRPV
YGFLNVIVHSATGIKQTSRALYRPV

SEQ ID NO: 28591 - protein, 25 aa, synthetic construct
  source 1..25: note = Seed: YGFLNVIVHSATGFKQSSKALQRPV
YGFLNVIVHSATGIKQTSSALIRPV

SEQ ID NO: 28592 - protein, 25 aa, synthetic construct
  source 1..25: note = Seed: YGFLNVIVHSATGFKQSSKALQRPV
YGFLNVIVHSATGIKQTSSALVRPV

SEQ ID NO: 28593 - protein, 25 aa, synthetic construct
  source 1..25: note = Seed: YGFLNVIVHSATGFKQSSKALQRPV
YGFLNVIVHSATGIKQTSTALIRPV

SEQ ID NO: 28594 - protein, 25 aa, synthetic construct
  source 1..25: note = Seed: YGFLNVIVHSATGFKQSSKALQRPV
YGFLNVIVHSATGIKQVSAALARPV

SEQ ID NO: 28595 - protein, 25 aa, synthetic construct
  source 1..25: note = Seed: YGFLNVIVHSATGFKQSSKALQRPV
YGFLNVIVHSATGIKQVSAALFRPV

SEQ ID NO: 28596 - protein, 25 aa, synthetic construct
  source 1..25: note = Seed: YGFLNVIVHSATGFKQSSKALQRPV
YGFLNVIVHSATGIKQVSAALIRPV

SEQ ID NO: 28597 - protein, 25 aa, synthetic construct
  source 1..25: note = Seed: YGFLNVIVHSATGFKQSSKALQRPV
YGFLNVIVHSATGIKQVSAALNRPV

SEQ ID NO: 28598 - protein, 25 aa, synthetic construct
  source 1..25: note = Seed: YGFLNVIVHSATGFKQSSKALQRPV
YGFLNVIVHSATGIKQVSAALRRPV

SEQ ID NO: 28599 - protein, 25 aa, synthetic construct
  source 1..25: note = Seed: YGFLNVIVHSATGFKQSSKALQRPV
YGFLNVIVHSATGIKQVSAALSRPV

SEQ ID NO: 28600 - protein, 25 aa, synthetic construct
  source 1..25: note = Seed: YGFLNVIVHSATGFKQSSKALQRPV
YGFLNVIVHSATGIKQVSAALTRPV

SEQ ID NO: 28601 - protein, 25 aa, synthetic construct
  source 1..25: note = Seed: YGFLNVIVHSATGFKQSSKALQRPV
YGFLNVIVHSATGIKQVSAALVRPV

SEQ ID NO: 28602 - protein, 25 aa, synthetic construct
  source 1..25: note = Seed: YGFLNVIVHSATGFKQSSKALQRPV
YGFLNVIVHSATGIKQVSFALERPV

SEQ ID NO: 28603 - protein, 25 aa, synthetic construct
  source 1..25: note = Seed: YGFLNVIVHSATGFKQSSKALQRPV
YGFLNVIVHSATGIKQVSFALFRPV

SEQ ID NO: 28604 - protein, 25 aa, synthetic construct
  source 1..25: note = Seed: YGFLNVIVHSATGFKQSSKALQRPV
YGFLNVIVHSATGIKQVSFALIRPV

SEQ ID NO: 28605 - protein, 25 aa, synthetic construct
  source 1..25: note = Seed: YGFLNVIVHSATGFKQSSKALQRPV
YGFLNVIVHSATGIKQVSFALLRPV

SEQ ID NO: 28606 - protein, 25 aa, synthetic construct
  source 1..25: note = Seed: YGFLNVIVHSATGFKQSSKALQRPV
YGFLNVIVHSATGIKQVSFALMRPV

SEQ ID NO: 28607 - protein, 25 aa, synthetic construct
  source 1..25: note = Seed: YGFLNVIVHSATGFKQSSKALQRPV
YGFLNVIVHSATGIKQVSFALVRPV

SEQ ID NO: 28608 - protein, 25 aa, synthetic construct
  source 1..25: note = Seed: YGFLNVIVHSATGFKQSSKALQRPV
YGFLNVIVHSATGIKQVSFALYRPV

SEQ ID NO: 28609 - protein, 25 aa, synthetic construct
  source 1..25: note = Seed: YGFLNVIVHSATGFKQSSKALQRPV
YGFLNVIVHSATGIKQVSGALARPV

SEQ ID NO: 28610 - protein, 25 aa, synthetic construct
  source 1..25: note = Seed: YGFLNVIVHSATGFKQSSKALQRPV
YGFLNVIVHSATGIKQVSGALIRPV

SEQ ID NO: 28611 - protein, 25 aa, synthetic construct
  source 1..25: note = Seed: YGFLNVIVHSATGFKQSSKALQRPV
YGFLNVIVHSATGIKQVSGALVRPV

SEQ ID NO: 28612 - protein, 25 aa, synthetic construct
  source 1..25: note = Seed: YGFLNVIVHSATGFKQSSKALQRPV
YGFLNVIVHSATGIKQVSHALRRPV

SEQ ID NO: 28613 - protein, 25 aa, synthetic construct
  source 1..25: note = Seed: YGFLNVIVHSATGFKQSSKALQRPV
YGFLNVIVHSATGIKQVSIALFRPV

SEQ ID NO: 28614 - protein, 25 aa, synthetic construct
  source 1..25: note = Seed: YGFLNVIVHSATGFKQSSKALQRPV
YGFLNVIVHSATGIKQVSIALNRPV

SEQ ID NO: 28615 - protein, 25 aa, synthetic construct
  source 1..25: note = Seed: YGFLNVIVHSATGFKQSSKALQRPV
YGFLNVIVHSATGIKQVSIALRRPV

SEQ ID NO: 28616 - protein, 25 aa, synthetic construct
  source 1..25: note = Seed: YGFLNVIVHSATGFKQSSKALQRPV
YGFLNVIVHSATGIKQVSKALARPV

SEQ ID NO: 28617 - protein, 25 aa, synthetic construct
  source 1..25: note = Seed: YGFLNVIVHSATGFKQSSKALQRPV
YGFLNVIVHSATGIKQVSKALFRPV

SEQ ID NO: 28618 - protein, 25 aa, synthetic construct
  source 1..25: note = Seed: YGFLNVIVHSATGFKQSSKALQRPV
YGFLNVIVHSATGIKQVSKALGRPV

SEQ ID NO: 28619 - protein, 25 aa, synthetic construct
  source 1..25: note = Seed: YGFLNVIVHSATGFKQSSKALQRPV
YGFLNVIVHSATGIKQVSKALHRPV

SEQ ID NO: 28620 - protein, 25 aa, synthetic construct
  source 1..25: note = Seed: YGFLNVIVHSATGFKQSSKALQRPV
YGFLNVIVHSATGIKQVSKALIRPV

SEQ ID NO: 28621 - protein, 25 aa, synthetic construct
  source 1..25: note = Seed: YGFLNVIVHSATGFKQSSKALQRPV
YGFLNVIVHSATGIKQVSKALKRPV

SEQ ID NO: 28622 - protein, 25 aa, synthetic construct
  source 1..25: note = Seed: YGFLNVIVHSATGFKQSSKALQRPV
YGFLNVIVHSATGIKQVSKALLRPV

SEQ ID NO: 28623 - protein, 25 aa, synthetic construct
  source 1..25: note = Seed: YGFLNVIVHSATGFKQSSKALQRPV
YGFLNVIVHSATGIKQVSKALMRPV

SEQ ID NO: 28624 - protein, 25 aa, synthetic construct
  source 1..25: note = Seed: YGFLNVIVHSATGFKQSSKALQRPV
YGFLNVIVHSATGIKQVSKALNRPV

SEQ ID NO: 28625 - protein, 25 aa, synthetic construct
  source 1..25: note = Seed: YGFLNVIVHSATGFKQSSKALQRPV
YGFLNVIVHSATGIKQVSKALQRPV

SEQ ID NO: 28626 - protein, 25 aa, synthetic construct
  source 1..25: note = Seed: YGFLNVIVHSATGFKQSSKALQRPV
YGFLNVIVHSATGIKQVSKALRRPV

SEQ ID NO: 28627 - protein, 25 aa, synthetic construct
  source 1..25: note = Seed: YGFLNVIVHSATGFKQSSKALQRPV
YGFLNVIVHSATGIKQVSKALSRPV

SEQ ID NO: 28628 - protein, 25 aa, synthetic construct
  source 1..25: note = Seed: YGFLNVIVHSATGFKQSSKALQRPV
YGFLNVIVHSATGIKQVSKALTRPV

SEQ ID NO: 28629 - protein, 25 aa, synthetic construct
  source 1..25: note = Seed: YGFLNVIVHSATGFKQSSKALQRPV
YGFLNVIVHSATGIKQVSKALVRPV

SEQ ID NO: 28630 - protein, 25 aa, synthetic construct
  source 1..25: note = Seed: YGFLNVIVHSATGFKQSSKALQRPV
YGFLNVIVHSATGIKQVSKALYRPV

SEQ ID NO: 28631 - protein, 25 aa, synthetic construct
  source 1..25: note = Seed: YGFLNVIVHSATGFKQSSKALQRPV
YGFLNVIVHSATGIKQVSLALFRPV

SEQ ID NO: 28632 - protein, 25 aa, synthetic construct
  source 1..25: note = Seed: YGFLNVIVHSATGFKQSSKALQRPV
YGFLNVIVHSATGIKQVSLALRRPV

SEQ ID NO: 28633 - protein, 25 aa, synthetic construct
  source 1..25: note = Seed: YGFLNVIVHSATGFKQSSKALQRPV
YGFLNVIVHSATGIKQVSMALFRPV

SEQ ID NO: 28634 - protein, 25 aa, synthetic construct
  source 1..25: note = Seed: YGFLNVIVHSATGFKQSSKALQRPV
YGFLNVIVHSATGIKQVSMALKRPV

SEQ ID NO: 28635 - protein, 25 aa, synthetic construct
  source 1..25: note = Seed: YGFLNVIVHSATGFKQSSKALQRPV
YGFLNVIVHSATGIKQVSMALRRPV

SEQ ID NO: 28636 - protein, 25 aa, synthetic construct
  source 1..25: note = Seed: YGFLNVIVHSATGFKQSSKALQRPV
YGFLNVIVHSATGIKQVSNALARPV

SEQ ID NO: 28637 - protein, 25 aa, synthetic construct
  source 1..25: note = Seed: YGFLNVIVHSATGFKQSSKALQRPV
YGFLNVIVHSATGIKQVSNALFRPV

SEQ ID NO: 28638 - protein, 25 aa, synthetic construct
  source 1..25: note = Seed: YGFLNVIVHSATGFKQSSKALQRPV
YGFLNVIVHSATGIKQVSNALIRPV

SEQ ID NO: 28639 - protein, 25 aa, synthetic construct
  source 1..25: note = Seed: YGFLNVIVHSATGFKQSSKALQRPV
YGFLNVIVHSATGIKQVSNALLRPV

SEQ ID NO: 28640 - protein, 25 aa, synthetic construct
  source 1..25: note = Seed: YGFLNVIVHSATGFKQSSKALQRPV
YGFLNVIVHSATGIKQVSNALRRPV

SEQ ID NO: 28641 - protein, 25 aa, synthetic construct
  source 1..25: note = Seed: YGFLNVIVHSATGFKQSSKALQRPV
YGFLNVIVHSATGIKQVSNALSRPV

SEQ ID NO: 28642 - protein, 25 aa, synthetic construct
  source 1..25: note = Seed: YGFLNVIVHSATGFKQSSKALQRPV
YGFLNVIVHSATGIKQVSNALVRPV

SEQ ID NO: 28643 - protein, 25 aa, synthetic construct
  source 1..25: note = Seed: YGFLNVIVHSATGFKQSSKALQRPV
YGFLNVIVHSATGIKQVSNALYRPV

SEQ ID NO: 28644 - protein, 25 aa, synthetic construct
  source 1..25: note = Seed: YGFLNVIVHSATGFKQSSKALQRPV
YGFLNVIVHSATGIKQVSPALARPV

SEQ ID NO: 28645 - protein, 25 aa, synthetic construct
  source 1..25: note = Seed: YGFLNVIVHSATGFKQSSKALQRPV
YGFLNVIVHSATGIKQVSPALIRPV

SEQ ID NO: 28646 - protein, 25 aa, synthetic construct
  source 1..25: note = Seed: YGFLNVIVHSATGFKQSSKALQRPV
YGFLNVIVHSATGIKQVSPALNRPV

SEQ ID NO: 28647 - protein, 25 aa, synthetic construct
  source 1..25: note = Seed: YGFLNVIVHSATGFKQSSKALQRPV
YGFLNVIVHSATGIKQVSPALRRPV

SEQ ID NO: 28648 - protein, 25 aa, synthetic construct
  source 1..25: note = Seed: YGFLNVIVHSATGFKQSSKALQRPV
YGFLNVIVHSATGIKQVSPALSRPV

SEQ ID NO: 28649 - protein, 25 aa, synthetic construct
  source 1..25: note = Seed: YGFLNVIVHSATGFKQSSKALQRPV
YGFLNVIVHSATGIKQVSPALTRPV

SEQ ID NO: 28650 - protein, 25 aa, synthetic construct
  source 1..25: note = Seed: YGFLNVIVHSATGFKQSSKALQRPV
YGFLNVIVHSATGIKQVSPALVRPV

SEQ ID NO: 28651 - protein, 25 aa, synthetic construct
  source 1..25: note = Seed: YGFLNVIVHSATGFKQSSKALQRPV
YGFLNVIVHSATGIKQVSRALARPV

SEQ ID NO: 28652 - protein, 25 aa, synthetic construct
  source 1..25: note = Seed: YGFLNVIVHSATGFKQSSKALQRPV
YGFLNVIVHSATGIKQVSRALFRPV

SEQ ID NO: 28653 - protein, 25 aa, synthetic construct
  source 1..25: note = Seed: YGFLNVIVHSATGFKQSSKALQRPV
YGFLNVIVHSATGIKQVSRALGRPV

SEQ ID NO: 28654 - protein, 25 aa, synthetic construct
  source 1..25: note = Seed: YGFLNVIVHSATGFKQSSKALQRPV
YGFLNVIVHSATGIKQVSRALHRPV

SEQ ID NO: 28655 - protein, 25 aa, synthetic construct
  source 1..25: note = Seed: YGFLNVIVHSATGFKQSSKALQRPV
YGFLNVIVHSATGIKQVSRALIRPV

SEQ ID NO: 28656 - protein, 25 aa, synthetic construct
  source 1..25: note = Seed: YGFLNVIVHSATGFKQSSKALQRPV
YGFLNVIVHSATGIKQVSRALKRPV

SEQ ID NO: 28657 - protein, 25 aa, synthetic construct
  source 1..25: note = Seed: YGFLNVIVHSATGFKQSSKALQRPV
YGFLNVIVHSATGIKQVSRALLRPV

SEQ ID NO: 28658 - protein, 25 aa, synthetic construct
  source 1..25: note = Seed: YGFLNVIVHSATGFKQSSKALQRPV
YGFLNVIVHSATGIKQVSRALMRPV

SEQ ID NO: 28659 - protein, 25 aa, synthetic construct
  source 1..25: note = Seed: YGFLNVIVHSATGFKQSSKALQRPV
YGFLNVIVHSATGIKQVSRALNRPV

SEQ ID NO: 28660 - protein, 25 aa, synthetic construct
  source 1..25: note = Seed: YGFLNVIVHSATGFKQSSKALQRPV
YGFLNVIVHSATGIKQVSRALPRPV

SEQ ID NO: 28661 - protein, 25 aa, synthetic construct
  source 1..25: note = Seed: YGFLNVIVHSATGFKQSSKALQRPV
YGFLNVIVHSATGIKQVSRALQRPV

SEQ ID NO: 28662 - protein, 25 aa, synthetic construct
  source 1..25: note = Seed: YGFLNVIVHSATGFKQSSKALQRPV
YGFLNVIVHSATGIKQVSRALRRPV

SEQ ID NO: 28663 - protein, 25 aa, synthetic construct
  source 1..25: note = Seed: YGFLNVIVHSATGFKQSSKALQRPV
YGFLNVIVHSATGIKQVSRALSRPV

SEQ ID NO: 28664 - protein, 25 aa, synthetic construct
  source 1..25: note = Seed: YGFLNVIVHSATGFKQSSKALQRPV
YGFLNVIVHSATGIKQVSRALTRPV

SEQ ID NO: 28665 - protein, 25 aa, synthetic construct
  source 1..25: note = Seed: YGFLNVIVHSATGFKQSSKALQRPV
YGFLNVIVHSATGIKQVSRALVRPV

SEQ ID NO: 28666 - protein, 25 aa, synthetic construct
  source 1..25: note = Seed: YGFLNVIVHSATGFKQSSKALQRPV
YGFLNVIVHSATGIKQVSRALYRPV

SEQ ID NO: 28667 - protein, 25 aa, synthetic construct
  source 1..25: note = Seed: YGFLNVIVHSATGFKQSSKALQRPV
YGFLNVIVHSATGIKQVSSALARPV

SEQ ID NO: 28668 - protein, 25 aa, synthetic construct
  source 1..25: note = Seed: YGFLNVIVHSATGFKQSSKALQRPV
YGFLNVIVHSATGIKQVSSALIRPV

SEQ ID NO: 28669 - protein, 25 aa, synthetic construct
  source 1..25: note = Seed: YGFLNVIVHSATGFKQSSKALQRPV
YGFLNVIVHSATGIKQVSSALNRPV

SEQ ID NO: 28670 - protein, 25 aa, synthetic construct
  source 1..25: note = Seed: YGFLNVIVHSATGFKQSSKALQRPV
YGFLNVIVHSATGIKQVSSALRRPV

SEQ ID NO: 28671 - protein, 25 aa, synthetic construct
  source 1..25: note = Seed: YGFLNVIVHSATGFKQSSKALQRPV
YGFLNVIVHSATGIKQVSSALSRPV

SEQ ID NO: 28672 - protein, 25 aa, synthetic construct
  source 1..25: note = Seed: YGFLNVIVHSATGFKQSSKALQRPV
YGFLNVIVHSATGIKQVSSALVRPV

SEQ ID NO: 28673 - protein, 25 aa, synthetic construct
  source 1..25: note = Seed: YGFLNVIVHSATGFKQSSKALQRPV
YGFLNVIVHSATGIKQVSTALARPV

SEQ ID NO: 28674 - protein, 25 aa, synthetic construct
  source 1..25: note = Seed: YGFLNVIVHSATGFKQSSKALQRPV
YGFLNVIVHSATGIKQVSTALNRPV

SEQ ID NO: 28675 - protein, 25 aa, synthetic construct
  source 1..25: note = Seed: YGFLNVIVHSATGFKQSSKALQRPV
YGFLNVIVHSATGIKQVSTALRRPV

SEQ ID NO: 28676 - protein, 25 aa, synthetic construct
  source 1..25: note = Seed: YGFLNVIVHSATGFKQSSKALQRPV
YGFLNVIVHSATGIKQVSTALSRPV

SEQ ID NO: 28677 - protein, 25 aa, synthetic construct
  source 1..25: note = Seed: YGFLNVIVHSATGFKQSSKALQRPV
YGFLNVIVHSATGIKQVSVALARPV

SEQ ID NO: 28678 - protein, 25 aa, synthetic construct
  source 1..25: note = Seed: YGFLNVIVHSATGFKQSSKALQRPV
YGFLNVIVHSATGIKQVSVALFRPV

SEQ ID NO: 28679 - protein, 25 aa, synthetic construct
  source 1..25: note = Seed: YGFLNVIVHSATGFKQSSKALQRPV
YGFLNVIVHSATGIKQVSVALNRPV

SEQ ID NO: 28680 - protein, 25 aa, synthetic construct
  source 1..25: note = Seed: YGFLNVIVHSATGFKQSSKALQRPV
YGFLNVIVHSATGIKQVSVALRRPV

SEQ ID NO: 28681 - protein, 25 aa, synthetic construct
  source 1..25: note = Seed: YGFLNVIVHSATGFKQSSKALQRPV
YGFLNVIVHSATGIKQVSVALSRPV

SEQ ID NO: 28682 - protein, 25 aa, synthetic construct
  source 1..25: note = Seed: YGFLNVIVHSATGFKQSSKALQRPV
YGFLNVIVHSATGIKQVSWALFRPV

SEQ ID NO: 28683 - protein, 25 aa, synthetic construct
  source 1..25: note = Seed: YGFLNVIVHSATGFKQSSKALQRPV
YGFLNVIVHSATGIKQVSWALRRPV

SEQ ID NO: 28684 - protein, 25 aa, synthetic construct
  source 1..25: note = Seed: YGFLNVIVHSATGFKQSSKALQRPV
YGFLNVIVHSATGIKQVSYALFRPV

SEQ ID NO: 28685 - protein, 25 aa, synthetic construct
  source 1..25: note = Seed: YGFLNVIVHSATGFKQSSKALQRPV
YGFLNVIVHSATGIKQVSYALLRPV

SEQ ID NO: 28686 - protein, 25 aa, synthetic construct
  source 1..25: note = Seed: YGFLNVIVHSATGFKQSSKALQRPV
YGFLNVIVHSATGIKQVSYALYRPV

SEQ ID NO: 28687 - protein, 25 aa, synthetic construct
  source 1..25: note = Seed: YGFLNVIVHSATGFKQSSKALQRPV
YGFLNVIVHSATGIKQWSAALARPV

SEQ ID NO: 28688 - protein, 25 aa, synthetic construct
  source 1..25: note = Seed: YGFLNVIVHSATGFKQSSKALQRPV
YGFLNVIVHSATGIKQWSAALRRPV

SEQ ID NO: 28689 - protein, 25 aa, synthetic construct
  source 1..25: note = Seed: YGFLNVIVHSATGFKQSSKALQRPV
YGFLNVIVHSATGIKQWSAALSRPV

SEQ ID NO: 28690 - protein, 25 aa, synthetic construct
  source 1..25: note = Seed: YGFLNVIVHSATGFKQSSKALQRPV
YGFLNVIVHSATGIKQWSAALYRPV

SEQ ID NO: 28691 - protein, 25 aa, synthetic construct
  source 1..25: note = Seed: YGFLNVIVHSATGFKQSSKALQRPV
YGFLNVIVHSATGIKQWSFALFRPV

SEQ ID NO: 28692 - protein, 25 aa, synthetic construct
  source 1..25: note = Seed: YGFLNVIVHSATGFKQSSKALQRPV
YGFLNVIVHSATGIKQWSFALIRPV

SEQ ID NO: 28693 - protein, 25 aa, synthetic construct
  source 1..25: note = Seed: YGFLNVIVHSATGFKQSSKALQRPV
YGFLNVIVHSATGIKQWSFALLRPV

SEQ ID NO: 28694 - protein, 25 aa, synthetic construct
  source 1..25: note = Seed: YGFLNVIVHSATGFKQSSKALQRPV
YGFLNVIVHSATGIKQWSFALMRPV

SEQ ID NO: 28695 - protein, 25 aa, synthetic construct
  source 1..25: note = Seed: YGFLNVIVHSATGFKQSSKALQRPV
YGFLNVIVHSATGIKQWSFALYRPV

SEQ ID NO: 28696 - protein, 25 aa, synthetic construct
  source 1..25: note = Seed: YGFLNVIVHSATGFKQSSKALQRPV
YGFLNVIVHSATGIKQWSHALRRPV

SEQ ID NO: 28697 - protein, 25 aa, synthetic construct
  source 1..25: note = Seed: YGFLNVIVHSATGFKQSSKALQRPV
YGFLNVIVHSATGIKQWSHALYRPV

SEQ ID NO: 28698 - protein, 25 aa, synthetic construct
  source 1..25: note = Seed: YGFLNVIVHSATGFKQSSKALQRPV
YGFLNVIVHSATGIKQWSIALARPV

SEQ ID NO: 28699 - protein, 25 aa, synthetic construct
  source 1..25: note = Seed: YGFLNVIVHSATGFKQSSKALQRPV
YGFLNVIVHSATGIKQWSIALRRPV

SEQ ID NO: 28700 - protein, 25 aa, synthetic construct
  source 1..25: note = Seed: YGFLNVIVHSATGFKQSSKALQRPV
YGFLNVIVHSATGIKQWSIALSRPV

SEQ ID NO: 28701 - protein, 25 aa, synthetic construct
  source 1..25: note = Seed: YGFLNVIVHSATGFKQSSKALQRPV
YGFLNVIVHSATGIKQWSKALARPV

SEQ ID NO: 28702 - protein, 25 aa, synthetic construct
  source 1..25: note = Seed: YGFLNVIVHSATGFKQSSKALQRPV
YGFLNVIVHSATGIKQWSKALFRPV

SEQ ID NO: 28703 - protein, 25 aa, synthetic construct
  source 1..25: note = Seed: YGFLNVIVHSATGFKQSSKALQRPV
YGFLNVIVHSATGIKQWSKALHRPV

SEQ ID NO: 28704 - protein, 25 aa, synthetic construct
  source 1..25: note = Seed: YGFLNVIVHSATGFKQSSKALQRPV
YGFLNVIVHSATGIKQWSKALIRPV

SEQ ID NO: 28705 - protein, 25 aa, synthetic construct
  source 1..25: note = Seed: YGFLNVIVHSATGFKQSSKALQRPV
YGFLNVIVHSATGIKQWSKALKRPV

SEQ ID NO: 28706 - protein, 25 aa, synthetic construct
  source 1..25: note = Seed: YGFLNVIVHSATGFKQSSKALQRPV
YGFLNVIVHSATGIKQWSKALLRPV

SEQ ID NO: 28707 - protein, 25 aa, synthetic construct
  source 1..25: note = Seed: YGFLNVIVHSATGFKQSSKALQRPV
YGFLNVIVHSATGIKQWSKALMRPV

SEQ ID NO: 28708 - protein, 25 aa, synthetic construct
  source 1..25: note = Seed: YGFLNVIVHSATGFKQSSKALQRPV
YGFLNVIVHSATGIKQWSKALRRPV

SEQ ID NO: 28709 - protein, 25 aa, synthetic construct
  source 1..25: note = Seed: YGFLNVIVHSATGFKQSSKALQRPV
YGFLNVIVHSATGIKQWSKALSRPV

SEQ ID NO: 28710 - protein, 25 aa, synthetic construct
  source 1..25: note = Seed: YGFLNVIVHSATGFKQSSKALQRPV
YGFLNVIVHSATGIKQWSKALVRPV

SEQ ID NO: 28711 - protein, 25 aa, synthetic construct
  source 1..25: note = Seed: YGFLNVIVHSATGFKQSSKALQRPV
YGFLNVIVHSATGIKQWSKALYRPV

SEQ ID NO: 28712 - protein, 25 aa, synthetic construct
  source 1..25: note = Seed: YGFLNVIVHSATGFKQSSKALQRPV
YGFLNVIVHSATGIKQWSLALARPV

SEQ ID NO: 28713 - protein, 25 aa, synthetic construct
  source 1..25: note = Seed: YGFLNVIVHSATGFKQSSKALQRPV
YGFLNVIVHSATGIKQWSLALFRPV

SEQ ID NO: 28714 - protein, 25 aa, synthetic construct
  source 1..25: note = Seed: YGFLNVIVHSATGFKQSSKALQRPV
YGFLNVIVHSATGIKQWSLALSRPV

SEQ ID NO: 28715 - protein, 25 aa, synthetic construct
  source 1..25: note = Seed: YGFLNVIVHSATGFKQSSKALQRPV
YGFLNVIVHSATGIKQWSMALARPV

SEQ ID NO: 28716 - protein, 25 aa, synthetic construct
  source 1..25: note = Seed: YGFLNVIVHSATGFKQSSKALQRPV
YGFLNVIVHSATGIKQWSMALRRPV

SEQ ID NO: 28717 - protein, 25 aa, synthetic construct
  source 1..25: note = Seed: YGFLNVIVHSATGFKQSSKALQRPV
YGFLNVIVHSATGIKQWSMALSRPV

SEQ ID NO: 28718 - protein, 25 aa, synthetic construct
  source 1..25: note = Seed: YGFLNVIVHSATGFKQSSKALQRPV
YGFLNVIVHSATGIKQWSNALYRPV

SEQ ID NO: 28719 - protein, 25 aa, synthetic construct
  source 1..25: note = Seed: YGFLNVIVHSATGFKQSSKALQRPV
YGFLNVIVHSATGIKQWSPALARPV

SEQ ID NO: 28720 - protein, 25 aa, synthetic construct
  source 1..25: note = Seed: YGFLNVIVHSATGFKQSSKALQRPV
YGFLNVIVHSATGIKQWSPALRRPV

SEQ ID NO: 28721 - protein, 25 aa, synthetic construct
  source 1..25: note = Seed: YGFLNVIVHSATGFKQSSKALQRPV
YGFLNVIVHSATGIKQWSRALARPV

SEQ ID NO: 28722 - protein, 25 aa, synthetic construct
  source 1..25: note = Seed: YGFLNVIVHSATGFKQSSKALQRPV
YGFLNVIVHSATGIKQWSRALFRPV

SEQ ID NO: 28723 - protein, 25 aa, synthetic construct
  source 1..25: note = Seed: YGFLNVIVHSATGFKQSSKALQRPV
YGFLNVIVHSATGIKQWSRALGRPV

SEQ ID NO: 28724 - protein, 25 aa, synthetic construct
  source 1..25: note = Seed: YGFLNVIVHSATGFKQSSKALQRPV
YGFLNVIVHSATGIKQWSRALHRPV

SEQ ID NO: 28725 - protein, 25 aa, synthetic construct
  source 1..25: note = Seed: YGFLNVIVHSATGFKQSSKALQRPV
YGFLNVIVHSATGIKQWSRALIRPV

SEQ ID NO: 28726 - protein, 25 aa, synthetic construct
  source 1..25: note = Seed: YGFLNVIVHSATGFKQSSKALQRPV
YGFLNVIVHSATGIKQWSRALKRPV

SEQ ID NO: 28727 - protein, 25 aa, synthetic construct
  source 1..25: note = Seed: YGFLNVIVHSATGFKQSSKALQRPV
YGFLNVIVHSATGIKQWSRALLRPV

SEQ ID NO: 28728 - protein, 25 aa, synthetic construct
  source 1..25: note = Seed: YGFLNVIVHSATGFKQSSKALQRPV
YGFLNVIVHSATGIKQWSRALMRPV

SEQ ID NO: 28729 - protein, 25 aa, synthetic construct
  source 1..25: note = Seed: YGFLNVIVHSATGFKQSSKALQRPV
YGFLNVIVHSATGIKQWSRALQRPV

SEQ ID NO: 28730 - protein, 25 aa, synthetic construct
  source 1..25: note = Seed: YGFLNVIVHSATGFKQSSKALQRPV
YGFLNVIVHSATGIKQWSRALRRPV

SEQ ID NO: 28731 - protein, 25 aa, synthetic construct
  source 1..25: note = Seed: YGFLNVIVHSATGFKQSSKALQRPV
YGFLNVIVHSATGIKQWSRALSRPV

SEQ ID NO: 28732 - protein, 25 aa, synthetic construct
  source 1..25: note = Seed: YGFLNVIVHSATGFKQSSKALQRPV
YGFLNVIVHSATGIKQWSRALVRPV

SEQ ID NO: 28733 - protein, 25 aa, synthetic construct
  source 1..25: note = Seed: YGFLNVIVHSATGFKQSSKALQRPV
YGFLNVIVHSATGIKQWSRALYRPV

SEQ ID NO: 28734 - protein, 25 aa, synthetic construct
  source 1..25: note = Seed: YGFLNVIVHSATGFKQSSKALQRPV
YGFLNVIVHSATGIKQWSSALARPV

SEQ ID NO: 28735 - protein, 25 aa, synthetic construct
  source 1..25: note = Seed: YGFLNVIVHSATGFKQSSKALQRPV
YGFLNVIVHSATGIKQWSSALRRPV

SEQ ID NO: 28736 - protein, 25 aa, synthetic construct
  source 1..25: note = Seed: YGFLNVIVHSATGFKQSSKALQRPV
YGFLNVIVHSATGIKQWSSALYRPV

SEQ ID NO: 28737 - protein, 25 aa, synthetic construct
  source 1..25: note = Seed: YGFLNVIVHSATGFKQSSKALQRPV
YGFLNVIVHSATGIKQWSTALARPV

SEQ ID NO: 28738 - protein, 25 aa, synthetic construct
  source 1..25: note = Seed: YGFLNVIVHSATGFKQSSKALQRPV
YGFLNVIVHSATGIKQWSTALRRPV

SEQ ID NO: 28739 - protein, 25 aa, synthetic construct
  source 1..25: note = Seed: YGFLNVIVHSATGFKQSSKALQRPV
YGFLNVIVHSATGIKQWSTALYRPV

SEQ ID NO: 28740 - protein, 25 aa, synthetic construct
  source 1..25: note = Seed: YGFLNVIVHSATGFKQSSKALQRPV
YGFLNVIVHSATGIKQWSVALARPV

SEQ ID NO: 28741 - protein, 25 aa, synthetic construct
  source 1..25: note = Seed: YGFLNVIVHSATGFKQSSKALQRPV
YGFLNVIVHSATGIKQWSVALRRPV

SEQ ID NO: 28742 - protein, 25 aa, synthetic construct
  source 1..25: note = Seed: YGFLNVIVHSATGFKQSSKALQRPV
YGFLNVIVHSATGIKQWSVALSRPV

SEQ ID NO: 28743 - protein, 25 aa, synthetic construct
  source 1..25: note = Seed: YGFLNVIVHSATGFKQSSKALQRPV
YGFLNVIVHSATGIKQWSWALFRPV

SEQ ID NO: 28744 - protein, 25 aa, synthetic construct
  source 1..25: note = Seed: YGFLNVIVHSATGFKQSSKALQRPV
YGFLNVIVHSATGIKQWSYALFRPV

SEQ ID NO: 28745 - protein, 25 aa, synthetic construct
  source 1..25: note = Seed: YGFLNVIVHSATGFKQSSKALQRPV
YGFLNVIVHSATGIKQWSYALLRPV

SEQ ID NO: 28746 - protein, 25 aa, synthetic construct
  source 1..25: note = Seed: YGFLNVIVHSATGFKQSSKALQRPV
YGFLNVIVHSATGIKQWSYALYRPV

SEQ ID NO: 28747 - protein, 25 aa, synthetic construct
  source 1..25: note = Seed: YGFLNVIVHSATGFKQSSKALQRPV
YGFLNVIVHSATGIKQYSAALARPV

SEQ ID NO: 28748 - protein, 25 aa, synthetic construct
  source 1..25: note = Seed: YGFLNVIVHSATGFKQSSKALQRPV
YGFLNVIVHSATGIKQYSAALRRPV

SEQ ID NO: 28749 - protein, 25 aa, synthetic construct
  source 1..25: note = Seed: YGFLNVIVHSATGFKQSSKALQRPV
YGFLNVIVHSATGIKQYSAALSRPV

SEQ ID NO: 28750 - protein, 25 aa, synthetic construct
  source 1..25: note = Seed: YGFLNVIVHSATGFKQSSKALQRPV
YGFLNVIVHSATGIKQYSFALFRPV

SEQ ID NO: 28751 - protein, 25 aa, synthetic construct
  source 1..25: note = Seed: YGFLNVIVHSATGFKQSSKALQRPV
YGFLNVIVHSATGIKQYSFALLRPV

SEQ ID NO: 28752 - protein, 25 aa, synthetic construct
  source 1..25: note = Seed: YGFLNVIVHSATGFKQSSKALQRPV
YGFLNVIVHSATGIKQYSFALMRPV

SEQ ID NO: 28753 - protein, 25 aa, synthetic construct
  source 1..25: note = Seed: YGFLNVIVHSATGFKQSSKALQRPV
YGFLNVIVHSATGIKQYSFALYRPV

SEQ ID NO: 28754 - protein, 25 aa, synthetic construct
  source 1..25: note = Seed: YGFLNVIVHSATGFKQSSKALQRPV
YGFLNVIVHSATGIKQYSIALARPV

SEQ ID NO: 28755 - protein, 25 aa, synthetic construct
  source 1..25: note = Seed: YGFLNVIVHSATGFKQSSKALQRPV
YGFLNVIVHSATGIKQYSIALRRPV

SEQ ID NO: 28756 - protein, 25 aa, synthetic construct
  source 1..25: note = Seed: YGFLNVIVHSATGFKQSSKALQRPV
YGFLNVIVHSATGIKQYSIALSRPV

SEQ ID NO: 28757 - protein, 25 aa, synthetic construct
  source 1..25: note = Seed: YGFLNVIVHSATGFKQSSKALQRPV
YGFLNVIVHSATGIKQYSKALHRPV

SEQ ID NO: 28758 - protein, 25 aa, synthetic construct
  source 1..25: note = Seed: YGFLNVIVHSATGFKQSSKALQRPV
YGFLNVIVHSATGIKQYSKALKRPV

SEQ ID NO: 28759 - protein, 25 aa, synthetic construct
  source 1..25: note = Seed: YGFLNVIVHSATGFKQSSKALQRPV
YGFLNVIVHSATGIKQYSKALRRPV

SEQ ID NO: 28760 - protein, 25 aa, synthetic construct
  source 1..25: note = Seed: YGFLNVIVHSATGFKQSSKALQRPV
YGFLNVIVHSATGIKQYSKALYRPV

SEQ ID NO: 28761 - protein, 25 aa, synthetic construct
  source 1..25: note = Seed: YGFLNVIVHSATGFKQSSKALQRPV
YGFLNVIVHSATGIKQYSLALFRPV

SEQ ID NO: 28762 - protein, 25 aa, synthetic construct
  source 1..25: note = Seed: YGFLNVIVHSATGFKQSSKALQRPV
YGFLNVIVHSATGIKQYSPALARPV

SEQ ID NO: 28763 - protein, 25 aa, synthetic construct
  source 1..25: note = Seed: YGFLNVIVHSATGFKQSSKALQRPV
YGFLNVIVHSATGIKQYSPALRRPV

SEQ ID NO: 28764 - protein, 25 aa, synthetic construct
  source 1..25: note = Seed: YGFLNVIVHSATGFKQSSKALQRPV
YGFLNVIVHSATGIKQYSRALARPV

SEQ ID NO: 28765 - protein, 25 aa, synthetic construct
  source 1..25: note = Seed: YGFLNVIVHSATGFKQSSKALQRPV
YGFLNVIVHSATGIKQYSRALHRPV

SEQ ID NO: 28766 - protein, 25 aa, synthetic construct
  source 1..25: note = Seed: YGFLNVIVHSATGFKQSSKALQRPV
YGFLNVIVHSATGIKQYSRALKRPV

SEQ ID NO: 28767 - protein, 25 aa, synthetic construct
  source 1..25: note = Seed: YGFLNVIVHSATGFKQSSKALQRPV
YGFLNVIVHSATGIKQYSRALRRPV

SEQ ID NO: 28768 - protein, 25 aa, synthetic construct
  source 1..25: note = Seed: YGFLNVIVHSATGFKQSSKALQRPV
YGFLNVIVHSATGIKQYSRALSRPV

SEQ ID NO: 28769 - protein, 25 aa, synthetic construct
  source 1..25: note = Seed: YGFLNVIVHSATGFKQSSKALQRPV
YGFLNVIVHSATGIKQYSRALYRPV

SEQ ID NO: 28770 - protein, 25 aa, synthetic construct
  source 1..25: note = Seed: YGFLNVIVHSATGFKQSSKALQRPV
YGFLNVIVHSATGIKQYSSALARPV

SEQ ID NO: 28771 - protein, 25 aa, synthetic construct
  source 1..25: note = Seed: YGFLNVIVHSATGFKQSSKALQRPV
YGFLNVIVHSATGIKQYSSALRRPV

SEQ ID NO: 28772 - protein, 25 aa, synthetic construct
  source 1..25: note = Seed: YGFLNVIVHSATGFKQSSKALQRPV
YGFLNVIVHSATGIKQYSSALSRPV

SEQ ID NO: 28773 - protein, 25 aa, synthetic construct
  source 1..25: note = Seed: YGFLNVIVHSATGFKQSSKALQRPV
YGFLNVIVHSATGIKQYSTALARPV

SEQ ID NO: 28774 - protein, 25 aa, synthetic construct
  source 1..25: note = Seed: YGFLNVIVHSATGFKQSSKALQRPV
YGFLNVIVHSATGIKQYSTALSRPV

SEQ ID NO: 28775 - protein, 25 aa, synthetic construct
  source 1..25: note = Seed: YGFLNVIVHSATGFKQSSKALQRPV
YGFLNVIVHSATGIKQYSVALARPV

SEQ ID NO: 28776 - protein, 25 aa, synthetic construct
  source 1..25: note = Seed: YGFLNVIVHSATGFKQSSKALQRPV
YGFLNVIVHSATGIKQYSVALRRPV

SEQ ID NO: 28777 - protein, 25 aa, synthetic construct
  source 1..25: note = Seed: YGFLNVIVHSATGFKQSSKALQRPV
YGFLNVIVHSATGIKQYSVALSRPV

SEQ ID NO: 28778 - protein, 25 aa, synthetic construct
  source 1..25: note = Seed: YGFLNVIVHSATGFKQSSKALQRPV
YGFLNVIVHSATGIKQYSWALYRPV

SEQ ID NO: 28779 - protein, 25 aa, synthetic construct
  source 1..25: note = Seed: YGFLNVIVHSATGFKQSSKALQRPV
YGFLNVIVHSATGIKQYSYALFRPV

SEQ ID NO: 28780 - protein, 25 aa, synthetic construct
  source 1..25: note = Seed: YGFLNVIVHSATGFKQSSKALQRPV
YGFLNVIVHSATGIKQYSYALLRPV

SEQ ID NO: 28781 - protein, 25 aa, synthetic construct
  source 1..25: note = Seed: YGFLNVIVHSATGFKQSSKALQRPV
YGFLNVIVHSATGIKQYSYALWRPV

SEQ ID NO: 28782 - protein, 25 aa, synthetic construct
  source 1..25: note = Seed: YGFLNVIVHSATGFKQSSKALQRPV
YGFLNVIVHSATGIKQYSYALYRPV

SEQ ID NO: 28783 - protein, 25 aa, synthetic construct
  source 1..25: note = Seed: YGFLNVIVHSATGFKQSSKALQRPV
YGFLNVIVHSATGKKQFSFALIRPV

SEQ ID NO: 28784 - protein, 25 aa, synthetic construct
  source 1..25: note = Seed: YGFLNVIVHSATGFKQSSKALQRPV
YGFLNVIVHSATGKKQFSLALIRPV

SEQ ID NO: 28785 - protein, 25 aa, synthetic construct
  source 1..25: note = Seed: YGFLNVIVHSATGFKQSSKALQRPV
YGFLNVIVHSATGKKQISFALFRPV

SEQ ID NO: 28786 - protein, 25 aa, synthetic construct
  source 1..25: note = Seed: YGFLNVIVHSATGFKQSSKALQRPV
YGFLNVIVHSATGKKQISFALLRPV

SEQ ID NO: 28787 - protein, 25 aa, synthetic construct
  source 1..25: note = Seed: YGFLNVIVHSATGFKQSSKALQRPV
YGFLNVIVHSATGKKQLSAALARPV

SEQ ID NO: 28788 - protein, 25 aa, synthetic construct
  source 1..25: note = Seed: YGFLNVIVHSATGFKQSSKALQRPV
YGFLNVIVHSATGKKQLSFALLRPV

SEQ ID NO: 28789 - protein, 25 aa, synthetic construct
  source 1..25: note = Seed: YGFLNVIVHSATGFKQSSKALQRPV
YGFLNVIVHSATGKKQWSLALFRPV

SEQ ID NO: 28790 - protein, 25 aa, synthetic construct
  source 1..25: note = Seed: YGFLNVIVHSATGFKQSSKALQRPV
YGFLNVIVHSATGLKQASAALARPV

SEQ ID NO: 28791 - protein, 25 aa, synthetic construct
  source 1..25: note = Seed: YGFLNVIVHSATGFKQSSKALQRPV
YGFLNVIVHSATGLKQASAALHRPV

SEQ ID NO: 28792 - protein, 25 aa, synthetic construct
  source 1..25: note = Seed: YGFLNVIVHSATGFKQSSKALQRPV
YGFLNVIVHSATGLKQASAALIRPV

SEQ ID NO: 28793 - protein, 25 aa, synthetic construct
  source 1..25: note = Seed: YGFLNVIVHSATGFKQSSKALQRPV
YGFLNVIVHSATGLKQASAALMRPV

SEQ ID NO: 28794 - protein, 25 aa, synthetic construct
  source 1..25: note = Seed: YGFLNVIVHSATGFKQSSKALQRPV
YGFLNVIVHSATGLKQASAALNRPV

SEQ ID NO: 28795 - protein, 25 aa, synthetic construct
  source 1..25: note = Seed: YGFLNVIVHSATGFKQSSKALQRPV
YGFLNVIVHSATGLKQASAALQRPV

SEQ ID NO: 28796 - protein, 25 aa, synthetic construct
  source 1..25: note = Seed: YGFLNVIVHSATGFKQSSKALQRPV
YGFLNVIVHSATGLKQASAALSRPV

SEQ ID NO: 28797 - protein, 25 aa, synthetic construct
  source 1..25: note = Seed: YGFLNVIVHSATGFKQSSKALQRPV
YGFLNVIVHSATGLKQASAALTRPV

SEQ ID NO: 28798 - protein, 25 aa, synthetic construct
  source 1..25: note = Seed: YGFLNVIVHSATGFKQSSKALQRPV
YGFLNVIVHSATGLKQASAALVRPV

SEQ ID NO: 28799 - protein, 25 aa, synthetic construct
  source 1..25: note = Seed: YGFLNVIVHSATGFKQSSKALQRPV
YGFLNVIVHSATGLKQASFALFRPV

SEQ ID NO: 28800 - protein, 25 aa, synthetic construct
  source 1..25: note = Seed: YGFLNVIVHSATGFKQSSKALQRPV
YGFLNVIVHSATGLKQASFALIRPV

SEQ ID NO: 28801 - protein, 25 aa, synthetic construct
  source 1..25: note = Seed: YGFLNVIVHSATGFKQSSKALQRPV
YGFLNVIVHSATGLKQASFALLRPV

SEQ ID NO: 28802 - protein, 25 aa, synthetic construct
  source 1..25: note = Seed: YGFLNVIVHSATGFKQSSKALQRPV
YGFLNVIVHSATGLKQASFALVRPV

SEQ ID NO: 28803 - protein, 25 aa, synthetic construct
  source 1..25: note = Seed: YGFLNVIVHSATGFKQSSKALQRPV
YGFLNVIVHSATGLKQASGALARPV

SEQ ID NO: 28804 - protein, 25 aa, synthetic construct
  source 1..25: note = Seed: YGFLNVIVHSATGFKQSSKALQRPV
YGFLNVIVHSATGLKQASGALNRPV

SEQ ID NO: 28805 - protein, 25 aa, synthetic construct
  source 1..25: note = Seed: YGFLNVIVHSATGFKQSSKALQRPV
YGFLNVIVHSATGLKQASIALARPV

SEQ ID NO: 28806 - protein, 25 aa, synthetic construct
  source 1..25: note = Seed: YGFLNVIVHSATGFKQSSKALQRPV
YGFLNVIVHSATGLKQASIALNRPV

SEQ ID NO: 28807 - protein, 25 aa, synthetic construct
  source 1..25: note = Seed: YGFLNVIVHSATGFKQSSKALQRPV
YGFLNVIVHSATGLKQASIALSRPV

SEQ ID NO: 28808 - protein, 25 aa, synthetic construct
  source 1..25: note = Seed: YGFLNVIVHSATGFKQSSKALQRPV
YGFLNVIVHSATGLKQASKALARPV

SEQ ID NO: 28809 - protein, 25 aa, synthetic construct
  source 1..25: note = Seed: YGFLNVIVHSATGFKQSSKALQRPV
YGFLNVIVHSATGLKQASKALGRPV

SEQ ID NO: 28810 - protein, 25 aa, synthetic construct
  source 1..25: note = Seed: YGFLNVIVHSATGFKQSSKALQRPV
YGFLNVIVHSATGLKQASKALHRPV

SEQ ID NO: 28811 - protein, 25 aa, synthetic construct
  source 1..25: note = Seed: YGFLNVIVHSATGFKQSSKALQRPV
YGFLNVIVHSATGLKQASKALKRPV

SEQ ID NO: 28812 - protein, 25 aa, synthetic construct
  source 1..25: note = Seed: YGFLNVIVHSATGFKQSSKALQRPV
YGFLNVIVHSATGLKQASKALQRPV

SEQ ID NO: 28813 - protein, 25 aa, synthetic construct
  source 1..25: note = Seed: YGFLNVIVHSATGFKQSSKALQRPV
YGFLNVIVHSATGLKQASKALRRPV

SEQ ID NO: 28814 - protein, 25 aa, synthetic construct
  source 1..25: note = Seed: YGFLNVIVHSATGFKQSSKALQRPV
YGFLNVIVHSATGLKQASKALSRPV

SEQ ID NO: 28815 - protein, 25 aa, synthetic construct
  source 1..25: note = Seed: YGFLNVIVHSATGFKQSSKALQRPV
YGFLNVIVHSATGLKQASKALTRPV

SEQ ID NO: 28816 - protein, 25 aa, synthetic construct
  source 1..25: note = Seed: YGFLNVIVHSATGFKQSSKALQRPV
YGFLNVIVHSATGLKQASKALYRPV

SEQ ID NO: 28817 - protein, 25 aa, synthetic construct
  source 1..25: note = Seed: YGFLNVIVHSATGFKQSSKALQRPV
YGFLNVIVHSATGLKQASLALNRPV

SEQ ID NO: 28818 - protein, 25 aa, synthetic construct
  source 1..25: note = Seed: YGFLNVIVHSATGFKQSSKALQRPV
YGFLNVIVHSATGLKQASNALIRPV

SEQ ID NO: 28819 - protein, 25 aa, synthetic construct
  source 1..25: note = Seed: YGFLNVIVHSATGFKQSSKALQRPV
YGFLNVIVHSATGLKQASNALVRPV

SEQ ID NO: 28820 - protein, 25 aa, synthetic construct
  source 1..25: note = Seed: YGFLNVIVHSATGFKQSSKALQRPV
YGFLNVIVHSATGLKQASPALARPV

SEQ ID NO: 28821 - protein, 25 aa, synthetic construct
  source 1..25: note = Seed: YGFLNVIVHSATGFKQSSKALQRPV
YGFLNVIVHSATGLKQASPALMRPV

SEQ ID NO: 28822 - protein, 25 aa, synthetic construct
  source 1..25: note = Seed: YGFLNVIVHSATGFKQSSKALQRPV
YGFLNVIVHSATGLKQASPALNRPV

SEQ ID NO: 28823 - protein, 25 aa, synthetic construct
  source 1..25: note = Seed: YGFLNVIVHSATGFKQSSKALQRPV
YGFLNVIVHSATGLKQASPALQRPV

SEQ ID NO: 28824 - protein, 25 aa, synthetic construct
  source 1..25: note = Seed: YGFLNVIVHSATGFKQSSKALQRPV
YGFLNVIVHSATGLKQASPALSRPV

SEQ ID NO: 28825 - protein, 25 aa, synthetic construct
  source 1..25: note = Seed: YGFLNVIVHSATGFKQSSKALQRPV
YGFLNVIVHSATGLKQASPALTRPV

SEQ ID NO: 28826 - protein, 25 aa, synthetic construct
  source 1..25: note = Seed: YGFLNVIVHSATGFKQSSKALQRPV
YGFLNVIVHSATGLKQASPALVRPV

SEQ ID NO: 28827 - protein, 25 aa, synthetic construct
  source 1..25: note = Seed: YGFLNVIVHSATGFKQSSKALQRPV
YGFLNVIVHSATGLKQASRALARPV

SEQ ID NO: 28828 - protein, 25 aa, synthetic construct
  source 1..25: note = Seed: YGFLNVIVHSATGFKQSSKALQRPV
YGFLNVIVHSATGLKQASRALFRPV

SEQ ID NO: 28829 - protein, 25 aa, synthetic construct
  source 1..25: note = Seed: YGFLNVIVHSATGFKQSSKALQRPV
YGFLNVIVHSATGLKQASRALGRPV

SEQ ID NO: 28830 - protein, 25 aa, synthetic construct
  source 1..25: note = Seed: YGFLNVIVHSATGFKQSSKALQRPV
YGFLNVIVHSATGLKQASRALHRPV

SEQ ID NO: 28831 - protein, 25 aa, synthetic construct
  source 1..25: note = Seed: YGFLNVIVHSATGFKQSSKALQRPV
YGFLNVIVHSATGLKQASRALKRPV

SEQ ID NO: 28832 - protein, 25 aa, synthetic construct
  source 1..25: note = Seed: YGFLNVIVHSATGFKQSSKALQRPV
YGFLNVIVHSATGLKQASRALMRPV

SEQ ID NO: 28833 - protein, 25 aa, synthetic construct
  source 1..25: note = Seed: YGFLNVIVHSATGFKQSSKALQRPV
YGFLNVIVHSATGLKQASRALQRPV

SEQ ID NO: 28834 - protein, 25 aa, synthetic construct
  source 1..25: note = Seed: YGFLNVIVHSATGFKQSSKALQRPV
YGFLNVIVHSATGLKQASRALRRPV

SEQ ID NO: 28835 - protein, 25 aa, synthetic construct
  source 1..25: note = Seed: YGFLNVIVHSATGFKQSSKALQRPV
YGFLNVIVHSATGLKQASRALSRPV

SEQ ID NO: 28836 - protein, 25 aa, synthetic construct
  source 1..25: note = Seed: YGFLNVIVHSATGFKQSSKALQRPV
YGFLNVIVHSATGLKQASRALTRPV

SEQ ID NO: 28837 - protein, 25 aa, synthetic construct
  source 1..25: note = Seed: YGFLNVIVHSATGFKQSSKALQRPV
YGFLNVIVHSATGLKQASRALVRPV

SEQ ID NO: 28838 - protein, 25 aa, synthetic construct
  source 1..25: note = Seed: YGFLNVIVHSATGFKQSSKALQRPV
YGFLNVIVHSATGLKQASRALYRPV

SEQ ID NO: 28839 - protein, 25 aa, synthetic construct
  source 1..25: note = Seed: YGFLNVIVHSATGFKQSSKALQRPV
YGFLNVIVHSATGLKQASSALARPV

SEQ ID NO: 28840 - protein, 25 aa, synthetic construct
  source 1..25: note = Seed: YGFLNVIVHSATGFKQSSKALQRPV
YGFLNVIVHSATGLKQASSALNRPV

SEQ ID NO: 28841 - protein, 25 aa, synthetic construct
  source 1..25: note = Seed: YGFLNVIVHSATGFKQSSKALQRPV
YGFLNVIVHSATGLKQASSALSRPV

SEQ ID NO: 28842 - protein, 25 aa, synthetic construct
  source 1..25: note = Seed: YGFLNVIVHSATGFKQSSKALQRPV
YGFLNVIVHSATGLKQASTALARPV

SEQ ID NO: 28843 - protein, 25 aa, synthetic construct
  source 1..25: note = Seed: YGFLNVIVHSATGFKQSSKALQRPV
YGFLNVIVHSATGLKQASTALNRPV

SEQ ID NO: 28844 - protein, 25 aa, synthetic construct
  source 1..25: note = Seed: YGFLNVIVHSATGFKQSSKALQRPV
YGFLNVIVHSATGLKQASTALSRPV

SEQ ID NO: 28845 - protein, 25 aa, synthetic construct
  source 1..25: note = Seed: YGFLNVIVHSATGFKQSSKALQRPV
YGFLNVIVHSATGLKQASVALARPV

SEQ ID NO: 28846 - protein, 25 aa, synthetic construct
  source 1..25: note = Seed: YGFLNVIVHSATGFKQSSKALQRPV
YGFLNVIVHSATGLKQASVALNRPV

SEQ ID NO: 28847 - protein, 25 aa, synthetic construct
  source 1..25: note = Seed: YGFLNVIVHSATGFKQSSKALQRPV
YGFLNVIVHSATGLKQASVALSRPV

SEQ ID NO: 28848 - protein, 25 aa, synthetic construct
  source 1..25: note = Seed: YGFLNVIVHSATGFKQSSKALQRPV
YGFLNVIVHSATGLKQASVALTRPV

SEQ ID NO: 28849 - protein, 25 aa, synthetic construct
  source 1..25: note = Seed: YGFLNVIVHSATGFKQSSKALQRPV
YGFLNVIVHSATGLKQCSFALFRPV

SEQ ID NO: 28850 - protein, 25 aa, synthetic construct
  source 1..25: note = Seed: YGFLNVIVHSATGFKQSSKALQRPV
YGFLNVIVHSATGLKQCSRALARPV

SEQ ID NO: 28851 - protein, 25 aa, synthetic construct
  source 1..25: note = Seed: YGFLNVIVHSATGFKQSSKALQRPV
YGFLNVIVHSATGLKQCSRALSRPV

SEQ ID NO: 28852 - protein, 25 aa, synthetic construct
  source 1..25: note = Seed: YGFLNVIVHSATGFKQSSKALQRPV
YGFLNVIVHSATGLKQDSAALIRPV

SEQ ID NO: 28853 - protein, 25 aa, synthetic construct
  source 1..25: note = Seed: YGFLNVIVHSATGFKQSSKALQRPV
YGFLNVIVHSATGLKQDSAALVRPV

SEQ ID NO: 28854 - protein, 25 aa, synthetic construct
  source 1..25: note = Seed: YGFLNVIVHSATGFKQSSKALQRPV
YGFLNVIVHSATGLKQDSNALARPV

SEQ ID NO: 28855 - protein, 25 aa, synthetic construct
  source 1..25: note = Seed: YGFLNVIVHSATGFKQSSKALQRPV
YGFLNVIVHSATGLKQDSTALARPV

SEQ ID NO: 28856 - protein, 25 aa, synthetic construct
  source 1..25: note = Seed: YGFLNVIVHSATGFKQSSKALQRPV
YGFLNVIVHSATGLKQESFALFRPV

SEQ ID NO: 28857 - protein, 25 aa, synthetic construct
  source 1..25: note = Seed: YGFLNVIVHSATGFKQSSKALQRPV
YGFLNVIVHSATGLKQESFALIRPV

SEQ ID NO: 28858 - protein, 25 aa, synthetic construct
  source 1..25: note = Seed: YGFLNVIVHSATGFKQSSKALQRPV
YGFLNVIVHSATGLKQESFALLRPV

SEQ ID NO: 28859 - protein, 25 aa, synthetic construct
  source 1..25: note = Seed: YGFLNVIVHSATGFKQSSKALQRPV
YGFLNVIVHSATGLKQESFALVRPV

SEQ ID NO: 28860 - protein, 25 aa, synthetic construct
  source 1..25: note = Seed: YGFLNVIVHSATGFKQSSKALQRPV
YGFLNVIVHSATGLKQFSAALARPV

SEQ ID NO: 28861 - protein, 25 aa, synthetic construct
  source 1..25: note = Seed: YGFLNVIVHSATGFKQSSKALQRPV
YGFLNVIVHSATGLKQFSAALFRPV

SEQ ID NO: 28862 - protein, 25 aa, synthetic construct
  source 1..25: note = Seed: YGFLNVIVHSATGFKQSSKALQRPV
YGFLNVIVHSATGLKQFSAALGRPV

SEQ ID NO: 28863 - protein, 25 aa, synthetic construct
  source 1..25: note = Seed: YGFLNVIVHSATGFKQSSKALQRPV
YGFLNVIVHSATGLKQFSAALIRPV

SEQ ID NO: 28864 - protein, 25 aa, synthetic construct
  source 1..25: note = Seed: YGFLNVIVHSATGFKQSSKALQRPV
YGFLNVIVHSATGLKQFSAALNRPV

SEQ ID NO: 28865 - protein, 25 aa, synthetic construct
  source 1..25: note = Seed: YGFLNVIVHSATGFKQSSKALQRPV
YGFLNVIVHSATGLKQFSAALRRPV

SEQ ID NO: 28866 - protein, 25 aa, synthetic construct
  source 1..25: note = Seed: YGFLNVIVHSATGFKQSSKALQRPV
YGFLNVIVHSATGLKQFSAALSRPV

SEQ ID NO: 28867 - protein, 25 aa, synthetic construct
  source 1..25: note = Seed: YGFLNVIVHSATGFKQSSKALQRPV
YGFLNVIVHSATGLKQFSAALTRPV

SEQ ID NO: 28868 - protein, 25 aa, synthetic construct
  source 1..25: note = Seed: YGFLNVIVHSATGFKQSSKALQRPV
YGFLNVIVHSATGLKQFSAALVRPV

SEQ ID NO: 28869 - protein, 25 aa, synthetic construct
  source 1..25: note = Seed: YGFLNVIVHSATGFKQSSKALQRPV
YGFLNVIVHSATGLKQFSAALYRPV

SEQ ID NO: 28870 - protein, 25 aa, synthetic construct
  source 1..25: note = Seed: YGFLNVIVHSATGFKQSSKALQRPV
YGFLNVIVHSATGLKQFSEALFRPV

SEQ ID NO: 28871 - protein, 25 aa, synthetic construct
  source 1..25: note = Seed: YGFLNVIVHSATGFKQSSKALQRPV
YGFLNVIVHSATGLKQFSFALFRPV

SEQ ID NO: 28872 - protein, 25 aa, synthetic construct
  source 1..25: note = Seed: YGFLNVIVHSATGFKQSSKALQRPV
YGFLNVIVHSATGLKQFSFALIRPV

SEQ ID NO: 28873 - protein, 25 aa, synthetic construct
  source 1..25: note = Seed: YGFLNVIVHSATGFKQSSKALQRPV
YGFLNVIVHSATGLKQFSFALLRPV

SEQ ID NO: 28874 - protein, 25 aa, synthetic construct
  source 1..25: note = Seed: YGFLNVIVHSATGFKQSSKALQRPV
YGFLNVIVHSATGLKQFSFALMRPV

SEQ ID NO: 28875 - protein, 25 aa, synthetic construct
  source 1..25: note = Seed: YGFLNVIVHSATGFKQSSKALQRPV
YGFLNVIVHSATGLKQFSFALVRPV

SEQ ID NO: 28876 - protein, 25 aa, synthetic construct
  source 1..25: note = Seed: YGFLNVIVHSATGFKQSSKALQRPV
YGFLNVIVHSATGLKQFSFALWRPV

SEQ ID NO: 28877 - protein, 25 aa, synthetic construct
  source 1..25: note = Seed: YGFLNVIVHSATGFKQSSKALQRPV
YGFLNVIVHSATGLKQFSFALYRPV

SEQ ID NO: 28878 - protein, 25 aa, synthetic construct
  source 1..25: note = Seed: YGFLNVIVHSATGFKQSSKALQRPV
YGFLNVIVHSATGLKQFSGALARPV

SEQ ID NO: 28879 - protein, 25 aa, synthetic construct
  source 1..25: note = Seed: YGFLNVIVHSATGFKQSSKALQRPV
YGFLNVIVHSATGLKQFSHALARPV

SEQ ID NO: 28880 - protein, 25 aa, synthetic construct
  source 1..25: note = Seed: YGFLNVIVHSATGFKQSSKALQRPV
YGFLNVIVHSATGLKQFSHALFRPV

SEQ ID NO: 28881 - protein, 25 aa, synthetic construct
  source 1..25: note = Seed: YGFLNVIVHSATGFKQSSKALQRPV
YGFLNVIVHSATGLKQFSHALRRPV

SEQ ID NO: 28882 - protein, 25 aa, synthetic construct
  source 1..25: note = Seed: YGFLNVIVHSATGFKQSSKALQRPV
YGFLNVIVHSATGLKQFSIALARPV

SEQ ID NO: 28883 - protein, 25 aa, synthetic construct
  source 1..25: note = Seed: YGFLNVIVHSATGFKQSSKALQRPV
YGFLNVIVHSATGLKQFSIALFRPV

SEQ ID NO: 28884 - protein, 25 aa, synthetic construct
  source 1..25: note = Seed: YGFLNVIVHSATGFKQSSKALQRPV
YGFLNVIVHSATGLKQFSIALGRPV

SEQ ID NO: 28885 - protein, 25 aa, synthetic construct
  source 1..25: note = Seed: YGFLNVIVHSATGFKQSSKALQRPV
YGFLNVIVHSATGLKQFSIALLRPV

SEQ ID NO: 28886 - protein, 25 aa, synthetic construct
  source 1..25: note = Seed: YGFLNVIVHSATGFKQSSKALQRPV
YGFLNVIVHSATGLKQFSIALMRPV

SEQ ID NO: 28887 - protein, 25 aa, synthetic construct
  source 1..25: note = Seed: YGFLNVIVHSATGFKQSSKALQRPV
YGFLNVIVHSATGLKQFSIALNRPV

SEQ ID NO: 28888 - protein, 25 aa, synthetic construct
  source 1..25: note = Seed: YGFLNVIVHSATGFKQSSKALQRPV
YGFLNVIVHSATGLKQFSIALRRPV

SEQ ID NO: 28889 - protein, 25 aa, synthetic construct
  source 1..25: note = Seed: YGFLNVIVHSATGFKQSSKALQRPV
YGFLNVIVHSATGLKQFSIALSRPV

SEQ ID NO: 28890 - protein, 25 aa, synthetic construct
  source 1..25: note = Seed: YGFLNVIVHSATGFKQSSKALQRPV
YGFLNVIVHSATGLKQFSIALTRPV

SEQ ID NO: 28891 - protein, 25 aa, synthetic construct
  source 1..25: note = Seed: YGFLNVIVHSATGFKQSSKALQRPV
YGFLNVIVHSATGLKQFSIALVRPV

SEQ ID NO: 28892 - protein, 25 aa, synthetic construct
  source 1..25: note = Seed: YGFLNVIVHSATGFKQSSKALQRPV
YGFLNVIVHSATGLKQFSIALYRPV

SEQ ID NO: 28893 - protein, 25 aa, synthetic construct
  source 1..25: note = Seed: YGFLNVIVHSATGFKQSSKALQRPV
YGFLNVIVHSATGLKQFSKALARPV

SEQ ID NO: 28894 - protein, 25 aa, synthetic construct
  source 1..25: note = Seed: YGFLNVIVHSATGFKQSSKALQRPV
YGFLNVIVHSATGLKQFSKALFRPV

SEQ ID NO: 28895 - protein, 25 aa, synthetic construct
  source 1..25: note = Seed: YGFLNVIVHSATGFKQSSKALQRPV
YGFLNVIVHSATGLKQFSKALGRPV

SEQ ID NO: 28896 - protein, 25 aa, synthetic construct
  source 1..25: note = Seed: YGFLNVIVHSATGFKQSSKALQRPV
YGFLNVIVHSATGLKQFSKALHRPV

SEQ ID NO: 28897 - protein, 25 aa, synthetic construct
  source 1..25: note = Seed: YGFLNVIVHSATGFKQSSKALQRPV
YGFLNVIVHSATGLKQFSKALIRPV

SEQ ID NO: 28898 - protein, 25 aa, synthetic construct
  source 1..25: note = Seed: YGFLNVIVHSATGFKQSSKALQRPV
YGFLNVIVHSATGLKQFSKALKRPV

SEQ ID NO: 28899 - protein, 25 aa, synthetic construct
  source 1..25: note = Seed: YGFLNVIVHSATGFKQSSKALQRPV
YGFLNVIVHSATGLKQFSKALLRPV

SEQ ID NO: 28900 - protein, 25 aa, synthetic construct
  source 1..25: note = Seed: YGFLNVIVHSATGFKQSSKALQRPV
YGFLNVIVHSATGLKQFSKALMRPV

SEQ ID NO: 28901 - protein, 25 aa, synthetic construct
  source 1..25: note = Seed: YGFLNVIVHSATGFKQSSKALQRPV
YGFLNVIVHSATGLKQFSKALQRPV

SEQ ID NO: 28902 - protein, 25 aa, synthetic construct
  source 1..25: note = Seed: YGFLNVIVHSATGFKQSSKALQRPV
YGFLNVIVHSATGLKQFSKALRRPV

SEQ ID NO: 28903 - protein, 25 aa, synthetic construct
  source 1..25: note = Seed: YGFLNVIVHSATGFKQSSKALQRPV
YGFLNVIVHSATGLKQFSKALSRPV

SEQ ID NO: 28904 - protein, 25 aa, synthetic construct
  source 1..25: note = Seed: YGFLNVIVHSATGFKQSSKALQRPV
YGFLNVIVHSATGLKQFSKALTRPV

SEQ ID NO: 28905 - protein, 25 aa, synthetic construct
  source 1..25: note = Seed: YGFLNVIVHSATGFKQSSKALQRPV
YGFLNVIVHSATGLKQFSKALVRPV

SEQ ID NO: 28906 - protein, 25 aa, synthetic construct
  source 1..25: note = Seed: YGFLNVIVHSATGFKQSSKALQRPV
YGFLNVIVHSATGLKQFSKALYRPV

SEQ ID NO: 28907 - protein, 25 aa, synthetic construct
  source 1..25: note = Seed: YGFLNVIVHSATGFKQSSKALQRPV
YGFLNVIVHSATGLKQFSLALARPV

SEQ ID NO: 28908 - protein, 25 aa, synthetic construct
  source 1..25: note = Seed: YGFLNVIVHSATGFKQSSKALQRPV
YGFLNVIVHSATGLKQFSLALFRPV

SEQ ID NO: 28909 - protein, 25 aa, synthetic construct
  source 1..25: note = Seed: YGFLNVIVHSATGFKQSSKALQRPV
YGFLNVIVHSATGLKQFSLALGRPV

SEQ ID NO: 28910 - protein, 25 aa, synthetic construct
  source 1..25: note = Seed: YGFLNVIVHSATGFKQSSKALQRPV
YGFLNVIVHSATGLKQFSLALIRPV

SEQ ID NO: 28911 - protein, 25 aa, synthetic construct
  source 1..25: note = Seed: YGFLNVIVHSATGFKQSSKALQRPV
YGFLNVIVHSATGLKQFSLALLRPV

SEQ ID NO: 28912 - protein, 25 aa, synthetic construct
  source 1..25: note = Seed: YGFLNVIVHSATGFKQSSKALQRPV
YGFLNVIVHSATGLKQFSLALMRPV

SEQ ID NO: 28913 - protein, 25 aa, synthetic construct
  source 1..25: note = Seed: YGFLNVIVHSATGFKQSSKALQRPV
YGFLNVIVHSATGLKQFSLALNRPV

SEQ ID NO: 28914 - protein, 25 aa, synthetic construct
  source 1..25: note = Seed: YGFLNVIVHSATGFKQSSKALQRPV
YGFLNVIVHSATGLKQFSLALSRPV

SEQ ID NO: 28915 - protein, 25 aa, synthetic construct
  source 1..25: note = Seed: YGFLNVIVHSATGFKQSSKALQRPV
YGFLNVIVHSATGLKQFSLALYRPV

SEQ ID NO: 28916 - protein, 25 aa, synthetic construct
  source 1..25: note = Seed: YGFLNVIVHSATGFKQSSKALQRPV
YGFLNVIVHSATGLKQFSMALGRPV

SEQ ID NO: 28917 - protein, 25 aa, synthetic construct
  source 1..25: note = Seed: YGFLNVIVHSATGFKQSSKALQRPV
YGFLNVIVHSATGLKQFSMALLRPV

SEQ ID NO: 28918 - protein, 25 aa, synthetic construct
  source 1..25: note = Seed: YGFLNVIVHSATGFKQSSKALQRPV
YGFLNVIVHSATGLKQFSMALMRPV

SEQ ID NO: 28919 - protein, 25 aa, synthetic construct
  source 1..25: note = Seed: YGFLNVIVHSATGFKQSSKALQRPV
YGFLNVIVHSATGLKQFSMALNRPV

SEQ ID NO: 28920 - protein, 25 aa, synthetic construct
  source 1..25: note = Seed: YGFLNVIVHSATGFKQSSKALQRPV
YGFLNVIVHSATGLKQFSMALRRPV

SEQ ID NO: 28921 - protein, 25 aa, synthetic construct
  source 1..25: note = Seed: YGFLNVIVHSATGFKQSSKALQRPV
YGFLNVIVHSATGLKQFSMALYRPV

SEQ ID NO: 28922 - protein, 25 aa, synthetic construct
  source 1..25: note = Seed: YGFLNVIVHSATGFKQSSKALQRPV
YGFLNVIVHSATGLKQFSPALARPV

SEQ ID NO: 28923 - protein, 25 aa, synthetic construct
  source 1..25: note = Seed: YGFLNVIVHSATGFKQSSKALQRPV
YGFLNVIVHSATGLKQFSPALNRPV

SEQ ID NO: 28924 - protein, 25 aa, synthetic construct
  source 1..25: note = Seed: YGFLNVIVHSATGFKQSSKALQRPV
YGFLNVIVHSATGLKQFSPALRRPV

SEQ ID NO: 28925 - protein, 25 aa, synthetic construct
  source 1..25: note = Seed: YGFLNVIVHSATGFKQSSKALQRPV
YGFLNVIVHSATGLKQFSPALSRPV

SEQ ID NO: 28926 - protein, 25 aa, synthetic construct
  source 1..25: note = Seed: YGFLNVIVHSATGFKQSSKALQRPV
YGFLNVIVHSATGLKQFSPALTRPV

SEQ ID NO: 28927 - protein, 25 aa, synthetic construct
  source 1..25: note = Seed: YGFLNVIVHSATGFKQSSKALQRPV
YGFLNVIVHSATGLKQFSRALARPV

SEQ ID NO: 28928 - protein, 25 aa, synthetic construct
  source 1..25: note = Seed: YGFLNVIVHSATGFKQSSKALQRPV
YGFLNVIVHSATGLKQFSRALFRPV

SEQ ID NO: 28929 - protein, 25 aa, synthetic construct
  source 1..25: note = Seed: YGFLNVIVHSATGFKQSSKALQRPV
YGFLNVIVHSATGLKQFSRALGRPV

SEQ ID NO: 28930 - protein, 25 aa, synthetic construct
  source 1..25: note = Seed: YGFLNVIVHSATGFKQSSKALQRPV
YGFLNVIVHSATGLKQFSRALHRPV

SEQ ID NO: 28931 - protein, 25 aa, synthetic construct
  source 1..25: note = Seed: YGFLNVIVHSATGFKQSSKALQRPV
YGFLNVIVHSATGLKQFSRALKRPV

SEQ ID NO: 28932 - protein, 25 aa, synthetic construct
  source 1..25: note = Seed: YGFLNVIVHSATGFKQSSKALQRPV
YGFLNVIVHSATGLKQFSRALMRPV

SEQ ID NO: 28933 - protein, 25 aa, synthetic construct
  source 1..25: note = Seed: YGFLNVIVHSATGFKQSSKALQRPV
YGFLNVIVHSATGLKQFSRALNRPV

SEQ ID NO: 28934 - protein, 25 aa, synthetic construct
  source 1..25: note = Seed: YGFLNVIVHSATGFKQSSKALQRPV
YGFLNVIVHSATGLKQFSRALQRPV

SEQ ID NO: 28935 - protein, 25 aa, synthetic construct
  source 1..25: note = Seed: YGFLNVIVHSATGFKQSSKALQRPV
YGFLNVIVHSATGLKQFSRALRRPV

SEQ ID NO: 28936 - protein, 25 aa, synthetic construct
  source 1..25: note = Seed: YGFLNVIVHSATGFKQSSKALQRPV
YGFLNVIVHSATGLKQFSRALSRPV

SEQ ID NO: 28937 - protein, 25 aa, synthetic construct
  source 1..25: note = Seed: YGFLNVIVHSATGFKQSSKALQRPV
YGFLNVIVHSATGLKQFSRALTRPV

SEQ ID NO: 28938 - protein, 25 aa, synthetic construct
  source 1..25: note = Seed: YGFLNVIVHSATGFKQSSKALQRPV
YGFLNVIVHSATGLKQFSRALVRPV

SEQ ID NO: 28939 - protein, 25 aa, synthetic construct
  source 1..25: note = Seed: YGFLNVIVHSATGFKQSSKALQRPV
YGFLNVIVHSATGLKQFSRALYRPV

SEQ ID NO: 28940 - protein, 25 aa, synthetic construct
  source 1..25: note = Seed: YGFLNVIVHSATGFKQSSKALQRPV
YGFLNVIVHSATGLKQFSSALARPV

SEQ ID NO: 28941 - protein, 25 aa, synthetic construct
  source 1..25: note = Seed: YGFLNVIVHSATGFKQSSKALQRPV
YGFLNVIVHSATGLKQFSSALFRPV

SEQ ID NO: 28942 - protein, 25 aa, synthetic construct
  source 1..25: note = Seed: YGFLNVIVHSATGFKQSSKALQRPV
YGFLNVIVHSATGLKQFSSALRRPV

SEQ ID NO: 28943 - protein, 25 aa, synthetic construct
  source 1..25: note = Seed: YGFLNVIVHSATGFKQSSKALQRPV
YGFLNVIVHSATGLKQFSSALSRPV

SEQ ID NO: 28944 - protein, 25 aa, synthetic construct
  source 1..25: note = Seed: YGFLNVIVHSATGFKQSSKALQRPV
YGFLNVIVHSATGLKQFSSALVRPV

SEQ ID NO: 28945 - protein, 25 aa, synthetic construct
  source 1..25: note = Seed: YGFLNVIVHSATGFKQSSKALQRPV
YGFLNVIVHSATGLKQFSTALARPV

SEQ ID NO: 28946 - protein, 25 aa, synthetic construct
  source 1..25: note = Seed: YGFLNVIVHSATGFKQSSKALQRPV
YGFLNVIVHSATGLKQFSTALFRPV

SEQ ID NO: 28947 - protein, 25 aa, synthetic construct
  source 1..25: note = Seed: YGFLNVIVHSATGFKQSSKALQRPV
YGFLNVIVHSATGLKQFSTALNRPV

SEQ ID NO: 28948 - protein, 25 aa, synthetic construct
  source 1..25: note = Seed: YGFLNVIVHSATGFKQSSKALQRPV
YGFLNVIVHSATGLKQFSTALRRPV

SEQ ID NO: 28949 - protein, 25 aa, synthetic construct
  source 1..25: note = Seed: YGFLNVIVHSATGFKQSSKALQRPV
YGFLNVIVHSATGLKQFSTALSRPV

SEQ ID NO: 28950 - protein, 25 aa, synthetic construct
  source 1..25: note = Seed: YGFLNVIVHSATGFKQSSKALQRPV
YGFLNVIVHSATGLKQFSTALTRPV

SEQ ID NO: 28951 - protein, 25 aa, synthetic construct
  source 1..25: note = Seed: YGFLNVIVHSATGFKQSSKALQRPV
YGFLNVIVHSATGLKQFSTALYRPV

SEQ ID NO: 28952 - protein, 25 aa, synthetic construct
  source 1..25: note = Seed: YGFLNVIVHSATGFKQSSKALQRPV
YGFLNVIVHSATGLKQFSVALARPV

SEQ ID NO: 28953 - protein, 25 aa, synthetic construct
  source 1..25: note = Seed: YGFLNVIVHSATGFKQSSKALQRPV
YGFLNVIVHSATGLKQFSVALFRPV

SEQ ID NO: 28954 - protein, 25 aa, synthetic construct
  source 1..25: note = Seed: YGFLNVIVHSATGFKQSSKALQRPV
YGFLNVIVHSATGLKQFSVALLRPV

SEQ ID NO: 28955 - protein, 25 aa, synthetic construct
  source 1..25: note = Seed: YGFLNVIVHSATGFKQSSKALQRPV
YGFLNVIVHSATGLKQFSVALNRPV

SEQ ID NO: 28956 - protein, 25 aa, synthetic construct
  source 1..25: note = Seed: YGFLNVIVHSATGFKQSSKALQRPV
YGFLNVIVHSATGLKQFSVALRRPV

SEQ ID NO: 28957 - protein, 25 aa, synthetic construct
  source 1..25: note = Seed: YGFLNVIVHSATGFKQSSKALQRPV
YGFLNVIVHSATGLKQFSVALSRPV

SEQ ID NO: 28958 - protein, 25 aa, synthetic construct
  source 1..25: note = Seed: YGFLNVIVHSATGFKQSSKALQRPV
YGFLNVIVHSATGLKQFSVALTRPV

SEQ ID NO: 28959 - protein, 25 aa, synthetic construct
  source 1..25: note = Seed: YGFLNVIVHSATGFKQSSKALQRPV
YGFLNVIVHSATGLKQFSVALVRPV

SEQ ID NO: 28960 - protein, 25 aa, synthetic construct
  source 1..25: note = Seed: YGFLNVIVHSATGFKQSSKALQRPV
YGFLNVIVHSATGLKQFSWALIRPV

SEQ ID NO: 28961 - protein, 25 aa, synthetic construct
  source 1..25: note = Seed: YGFLNVIVHSATGFKQSSKALQRPV
YGFLNVIVHSATGLKQFSWALLRPV

SEQ ID NO: 28962 - protein, 25 aa, synthetic construct
  source 1..25: note = Seed: YGFLNVIVHSATGFKQSSKALQRPV
YGFLNVIVHSATGLKQFSWALMRPV

SEQ ID NO: 28963 - protein, 25 aa, synthetic construct
  source 1..25: note = Seed: YGFLNVIVHSATGFKQSSKALQRPV
YGFLNVIVHSATGLKQFSWALVRPV

SEQ ID NO: 28964 - protein, 25 aa, synthetic construct
  source 1..25: note = Seed: YGFLNVIVHSATGFKQSSKALQRPV
YGFLNVIVHSATGLKQFSWALYRPV

SEQ ID NO: 28965 - protein, 25 aa, synthetic construct
  source 1..25: note = Seed: YGFLNVIVHSATGFKQSSKALQRPV
YGFLNVIVHSATGLKQFSYALIRPV

SEQ ID NO: 28966 - protein, 25 aa, synthetic construct
  source 1..25: note = Seed: YGFLNVIVHSATGFKQSSKALQRPV
YGFLNVIVHSATGLKQFSYALLRPV

SEQ ID NO: 28967 - protein, 25 aa, synthetic construct
  source 1..25: note = Seed: YGFLNVIVHSATGFKQSSKALQRPV
YGFLNVIVHSATGLKQFSYALMRPV

SEQ ID NO: 28968 - protein, 25 aa, synthetic construct
  source 1..25: note = Seed: YGFLNVIVHSATGFKQSSKALQRPV
YGFLNVIVHSATGLKQFSYALVRPV

SEQ ID NO: 28969 - protein, 25 aa, synthetic construct
  source 1..25: note = Seed: YGFLNVIVHSATGFKQSSKALQRPV
YGFLNVIVHSATGLKQFSYALWRPV

SEQ ID NO: 28970 - protein, 25 aa, synthetic construct
  source 1..25: note = Seed: YGFLNVIVHSATGFKQSSKALQRPV
YGFLNVIVHSATGLKQFSYALYRPV

SEQ ID NO: 28971 - protein, 25 aa, synthetic construct
  source 1..25: note = Seed: YGFLNVIVHSATGFKQSSKALQRPV
YGFLNVIVHSATGLKQHSAALRRPV

SEQ ID NO: 28972 - protein, 25 aa, synthetic construct
  source 1..25: note = Seed: YGFLNVIVHSATGFKQSSKALQRPV
YGFLNVIVHSATGLKQHSIALRRPV

SEQ ID NO: 28973 - protein, 25 aa, synthetic construct
  source 1..25: note = Seed: YGFLNVIVHSATGFKQSSKALQRPV
YGFLNVIVHSATGLKQHSKALFRPV

SEQ ID NO: 28974 - protein, 25 aa, synthetic construct
  source 1..25: note = Seed: YGFLNVIVHSATGFKQSSKALQRPV
YGFLNVIVHSATGLKQHSKALMRPV

SEQ ID NO: 28975 - protein, 25 aa, synthetic construct
  source 1..25: note = Seed: YGFLNVIVHSATGFKQSSKALQRPV
YGFLNVIVHSATGLKQHSKALRRPV

SEQ ID NO: 28976 - protein, 25 aa, synthetic construct
  source 1..25: note = Seed: YGFLNVIVHSATGFKQSSKALQRPV
YGFLNVIVHSATGLKQHSKALYRPV

SEQ ID NO: 28977 - protein, 25 aa, synthetic construct
  source 1..25: note = Seed: YGFLNVIVHSATGFKQSSKALQRPV
YGFLNVIVHSATGLKQHSPALRRPV

SEQ ID NO: 28978 - protein, 25 aa, synthetic construct
  source 1..25: note = Seed: YGFLNVIVHSATGFKQSSKALQRPV
YGFLNVIVHSATGLKQHSRALARPV

SEQ ID NO: 28979 - protein, 25 aa, synthetic construct
  source 1..25: note = Seed: YGFLNVIVHSATGFKQSSKALQRPV
YGFLNVIVHSATGLKQHSRALFRPV

SEQ ID NO: 28980 - protein, 25 aa, synthetic construct
  source 1..25: note = Seed: YGFLNVIVHSATGFKQSSKALQRPV
YGFLNVIVHSATGLKQHSRALIRPV

SEQ ID NO: 28981 - protein, 25 aa, synthetic construct
  source 1..25: note = Seed: YGFLNVIVHSATGFKQSSKALQRPV
YGFLNVIVHSATGLKQHSRALKRPV

SEQ ID NO: 28982 - protein, 25 aa, synthetic construct
  source 1..25: note = Seed: YGFLNVIVHSATGFKQSSKALQRPV
YGFLNVIVHSATGLKQHSRALLRPV

SEQ ID NO: 28983 - protein, 25 aa, synthetic construct
  source 1..25: note = Seed: YGFLNVIVHSATGFKQSSKALQRPV
YGFLNVIVHSATGLKQHSRALMRPV

SEQ ID NO: 28984 - protein, 25 aa, synthetic construct
  source 1..25: note = Seed: YGFLNVIVHSATGFKQSSKALQRPV
YGFLNVIVHSATGLKQHSRALRRPV

SEQ ID NO: 28985 - protein, 25 aa, synthetic construct
  source 1..25: note = Seed: YGFLNVIVHSATGFKQSSKALQRPV
YGFLNVIVHSATGLKQHSRALSRPV

SEQ ID NO: 28986 - protein, 25 aa, synthetic construct
  source 1..25: note = Seed: YGFLNVIVHSATGFKQSSKALQRPV
YGFLNVIVHSATGLKQHSRALVRPV

SEQ ID NO: 28987 - protein, 25 aa, synthetic construct
  source 1..25: note = Seed: YGFLNVIVHSATGFKQSSKALQRPV
YGFLNVIVHSATGLKQHSRALYRPV

SEQ ID NO: 28988 - protein, 25 aa, synthetic construct
  source 1..25: note = Seed: YGFLNVIVHSATGFKQSSKALQRPV
YGFLNVIVHSATGLKQHSSALRRPV

SEQ ID NO: 28989 - protein, 25 aa, synthetic construct
  source 1..25: note = Seed: YGFLNVIVHSATGFKQSSKALQRPV
YGFLNVIVHSATGLKQHSTALRRPV

SEQ ID NO: 28990 - protein, 25 aa, synthetic construct
  source 1..25: note = Seed: YGFLNVIVHSATGFKQSSKALQRPV
YGFLNVIVHSATGLKQHSVALRRPV

SEQ ID NO: 28991 - protein, 25 aa, synthetic construct
  source 1..25: note = Seed: YGFLNVIVHSATGFKQSSKALQRPV
YGFLNVIVHSATGLKQISAALARPV

SEQ ID NO: 28992 - protein, 25 aa, synthetic construct
  source 1..25: note = Seed: YGFLNVIVHSATGFKQSSKALQRPV
YGFLNVIVHSATGLKQISAALGRPV

SEQ ID NO: 28993 - protein, 25 aa, synthetic construct
  source 1..25: note = Seed: YGFLNVIVHSATGFKQSSKALQRPV
YGFLNVIVHSATGLKQISAALHRPV

SEQ ID NO: 28994 - protein, 25 aa, synthetic construct
  source 1..25: note = Seed: YGFLNVIVHSATGFKQSSKALQRPV
YGFLNVIVHSATGLKQISAALIRPV

SEQ ID NO: 28995 - protein, 25 aa, synthetic construct
  source 1..25: note = Seed: YGFLNVIVHSATGFKQSSKALQRPV
YGFLNVIVHSATGLKQISAALKRPV

SEQ ID NO: 28996 - protein, 25 aa, synthetic construct
  source 1..25: note = Seed: YGFLNVIVHSATGFKQSSKALQRPV
YGFLNVIVHSATGLKQISAALLRPV

SEQ ID NO: 28997 - protein, 25 aa, synthetic construct
  source 1..25: note = Seed: YGFLNVIVHSATGFKQSSKALQRPV
YGFLNVIVHSATGLKQISAALMRPV

SEQ ID NO: 28998 - protein, 25 aa, synthetic construct
  source 1..25: note = Seed: YGFLNVIVHSATGFKQSSKALQRPV
YGFLNVIVHSATGLKQISAALNRPV

SEQ ID NO: 28999 - protein, 25 aa, synthetic construct
  source 1..25: note = Seed: YGFLNVIVHSATGFKQSSKALQRPV
YGFLNVIVHSATGLKQISAALQRPV

SEQ ID NO: 29000 - protein, 25 aa, synthetic construct
  source 1..25: note = Seed: YGFLNVIVHSATGFKQSSKALQRPV
YGFLNVIVHSATGLKQISAALRRPV

SEQ ID NO: 29001 - protein, 25 aa, synthetic construct
  source 1..25: note = Seed: YGFLNVIVHSATGFKQSSKALQRPV
YGFLNVIVHSATGLKQISAALSRPV

SEQ ID NO: 29002 - protein, 25 aa, synthetic construct
  source 1..25: note = Seed: YGFLNVIVHSATGFKQSSKALQRPV
YGFLNVIVHSATGLKQISAALTRPV

SEQ ID NO: 29003 - protein, 25 aa, synthetic construct
  source 1..25: note = Seed: YGFLNVIVHSATGFKQSSKALQRPV
YGFLNVIVHSATGLKQISAALVRPV

SEQ ID NO: 29004 - protein, 25 aa, synthetic construct
  source 1..25: note = Seed: YGFLNVIVHSATGFKQSSKALQRPV
YGFLNVIVHSATGLKQISFALERPV

SEQ ID NO: 29005 - protein, 25 aa, synthetic construct
  source 1..25: note = Seed: YGFLNVIVHSATGFKQSSKALQRPV
YGFLNVIVHSATGLKQISFALFRPV

SEQ ID NO: 29006 - protein, 25 aa, synthetic construct
  source 1..25: note = Seed: YGFLNVIVHSATGFKQSSKALQRPV
YGFLNVIVHSATGLKQISFALIRPV

SEQ ID NO: 29007 - protein, 25 aa, synthetic construct
  source 1..25: note = Seed: YGFLNVIVHSATGFKQSSKALQRPV
YGFLNVIVHSATGLKQISFALLRPV

SEQ ID NO: 29008 - protein, 25 aa, synthetic construct
  source 1..25: note = Seed: YGFLNVIVHSATGFKQSSKALQRPV
YGFLNVIVHSATGLKQISFALMRPV

SEQ ID NO: 29009 - protein, 25 aa, synthetic construct
  source 1..25: note = Seed: YGFLNVIVHSATGFKQSSKALQRPV
YGFLNVIVHSATGLKQISFALRRPV

SEQ ID NO: 29010 - protein, 25 aa, synthetic construct
  source 1..25: note = Seed: YGFLNVIVHSATGFKQSSKALQRPV
YGFLNVIVHSATGLKQISFALVRPV

SEQ ID NO: 29011 - protein, 25 aa, synthetic construct
  source 1..25: note = Seed: YGFLNVIVHSATGFKQSSKALQRPV
YGFLNVIVHSATGLKQISFALYRPV

SEQ ID NO: 29012 - protein, 25 aa, synthetic construct
  source 1..25: note = Seed: YGFLNVIVHSATGFKQSSKALQRPV
YGFLNVIVHSATGLKQISGALARPV

SEQ ID NO: 29013 - protein, 25 aa, synthetic construct
  source 1..25: note = Seed: YGFLNVIVHSATGFKQSSKALQRPV
YGFLNVIVHSATGLKQISGALNRPV

SEQ ID NO: 29014 - protein, 25 aa, synthetic construct
  source 1..25: note = Seed: YGFLNVIVHSATGFKQSSKALQRPV
YGFLNVIVHSATGLKQISGALSRPV

SEQ ID NO: 29015 - protein, 25 aa, synthetic construct
  source 1..25: note = Seed: YGFLNVIVHSATGFKQSSKALQRPV
YGFLNVIVHSATGLKQISHALRRPV

SEQ ID NO: 29016 - protein, 25 aa, synthetic construct
  source 1..25: note = Seed: YGFLNVIVHSATGFKQSSKALQRPV
YGFLNVIVHSATGLKQISIALARPV

SEQ ID NO: 29017 - protein, 25 aa, synthetic construct
  source 1..25: note = Seed: YGFLNVIVHSATGFKQSSKALQRPV
YGFLNVIVHSATGLKQISIALKRPV

SEQ ID NO: 29018 - protein, 25 aa, synthetic construct
  source 1..25: note = Seed: YGFLNVIVHSATGFKQSSKALQRPV
YGFLNVIVHSATGLKQISIALNRPV

SEQ ID NO: 29019 - protein, 25 aa, synthetic construct
  source 1..25: note = Seed: YGFLNVIVHSATGFKQSSKALQRPV
YGFLNVIVHSATGLKQISIALRRPV

SEQ ID NO: 29020 - protein, 25 aa, synthetic construct
  source 1..25: note = Seed: YGFLNVIVHSATGFKQSSKALQRPV
YGFLNVIVHSATGLKQISIALSRPV

SEQ ID NO: 29021 - protein, 25 aa, synthetic construct
  source 1..25: note = Seed: YGFLNVIVHSATGFKQSSKALQRPV
YGFLNVIVHSATGLKQISKALARPV

SEQ ID NO: 29022 - protein, 25 aa, synthetic construct
  source 1..25: note = Seed: YGFLNVIVHSATGFKQSSKALQRPV
YGFLNVIVHSATGLKQISKALFRPV

SEQ ID NO: 29023 - protein, 25 aa, synthetic construct
  source 1..25: note = Seed: YGFLNVIVHSATGFKQSSKALQRPV
YGFLNVIVHSATGLKQISKALGRPV

SEQ ID NO: 29024 - protein, 25 aa, synthetic construct
  source 1..25: note = Seed: YGFLNVIVHSATGFKQSSKALQRPV
YGFLNVIVHSATGLKQISKALHRPV

SEQ ID NO: 29025 - protein, 25 aa, synthetic construct
  source 1..25: note = Seed: YGFLNVIVHSATGFKQSSKALQRPV
YGFLNVIVHSATGLKQISKALIRPV

SEQ ID NO: 29026 - protein, 25 aa, synthetic construct
  source 1..25: note = Seed: YGFLNVIVHSATGFKQSSKALQRPV
YGFLNVIVHSATGLKQISKALKRPV

SEQ ID NO: 29027 - protein, 25 aa, synthetic construct
  source 1..25: note = Seed: YGFLNVIVHSATGFKQSSKALQRPV
YGFLNVIVHSATGLKQISKALLRPV

SEQ ID NO: 29028 - protein, 25 aa, synthetic construct
  source 1..25: note = Seed: YGFLNVIVHSATGFKQSSKALQRPV
YGFLNVIVHSATGLKQISKALMRPV

SEQ ID NO: 29029 - protein, 25 aa, synthetic construct
  source 1..25: note = Seed: YGFLNVIVHSATGFKQSSKALQRPV
YGFLNVIVHSATGLKQISKALNRPV

SEQ ID NO: 29030 - protein, 25 aa, synthetic construct
  source 1..25: note = Seed: YGFLNVIVHSATGFKQSSKALQRPV
YGFLNVIVHSATGLKQISKALPRPV

SEQ ID NO: 29031 - protein, 25 aa, synthetic construct
  source 1..25: note = Seed: YGFLNVIVHSATGFKQSSKALQRPV
YGFLNVIVHSATGLKQISKALQRPV

SEQ ID NO: 29032 - protein, 25 aa, synthetic construct
  source 1..25: note = Seed: YGFLNVIVHSATGFKQSSKALQRPV
YGFLNVIVHSATGLKQISKALRRPV

SEQ ID NO: 29033 - protein, 25 aa, synthetic construct
  source 1..25: note = Seed: YGFLNVIVHSATGFKQSSKALQRPV
YGFLNVIVHSATGLKQISKALSRPV

SEQ ID NO: 29034 - protein, 25 aa, synthetic construct
  source 1..25: note = Seed: YGFLNVIVHSATGFKQSSKALQRPV
YGFLNVIVHSATGLKQISKALTRPV

SEQ ID NO: 29035 - protein, 25 aa, synthetic construct
  source 1..25: note = Seed: YGFLNVIVHSATGFKQSSKALQRPV
YGFLNVIVHSATGLKQISKALVRPV

SEQ ID NO: 29036 - protein, 25 aa, synthetic construct
  source 1..25: note = Seed: YGFLNVIVHSATGFKQSSKALQRPV
YGFLNVIVHSATGLKQISKALYRPV

SEQ ID NO: 29037 - protein, 25 aa, synthetic construct
  source 1..25: note = Seed: YGFLNVIVHSATGFKQSSKALQRPV
YGFLNVIVHSATGLKQISLALARPV

SEQ ID NO: 29038 - protein, 25 aa, synthetic construct
  source 1..25: note = Seed: YGFLNVIVHSATGFKQSSKALQRPV
YGFLNVIVHSATGLKQISLALFRPV

SEQ ID NO: 29039 - protein, 25 aa, synthetic construct
  source 1..25: note = Seed: YGFLNVIVHSATGFKQSSKALQRPV
YGFLNVIVHSATGLKQISLALKRPV

SEQ ID NO: 29040 - protein, 25 aa, synthetic construct
  source 1..25: note = Seed: YGFLNVIVHSATGFKQSSKALQRPV
YGFLNVIVHSATGLKQISLALNRPV

SEQ ID NO: 29041 - protein, 25 aa, synthetic construct
  source 1..25: note = Seed: YGFLNVIVHSATGFKQSSKALQRPV
YGFLNVIVHSATGLKQISLALRRPV

SEQ ID NO: 29042 - protein, 25 aa, synthetic construct
  source 1..25: note = Seed: YGFLNVIVHSATGFKQSSKALQRPV
YGFLNVIVHSATGLKQISLALSRPV

SEQ ID NO: 29043 - protein, 25 aa, synthetic construct
  source 1..25: note = Seed: YGFLNVIVHSATGFKQSSKALQRPV
YGFLNVIVHSATGLKQISMALARPV

SEQ ID NO: 29044 - protein, 25 aa, synthetic construct
  source 1..25: note = Seed: YGFLNVIVHSATGFKQSSKALQRPV
YGFLNVIVHSATGLKQISMALFRPV

SEQ ID NO: 29045 - protein, 25 aa, synthetic construct
  source 1..25: note = Seed: YGFLNVIVHSATGFKQSSKALQRPV
YGFLNVIVHSATGLKQISMALKRPV

SEQ ID NO: 29046 - protein, 25 aa, synthetic construct
  source 1..25: note = Seed: YGFLNVIVHSATGFKQSSKALQRPV
YGFLNVIVHSATGLKQISMALNRPV

SEQ ID NO: 29047 - protein, 25 aa, synthetic construct
  source 1..25: note = Seed: YGFLNVIVHSATGFKQSSKALQRPV
YGFLNVIVHSATGLKQISMALRRPV

SEQ ID NO: 29048 - protein, 25 aa, synthetic construct
  source 1..25: note = Seed: YGFLNVIVHSATGFKQSSKALQRPV
YGFLNVIVHSATGLKQISMALSRPV

SEQ ID NO: 29049 - protein, 25 aa, synthetic construct
  source 1..25: note = Seed: YGFLNVIVHSATGFKQSSKALQRPV
YGFLNVIVHSATGLKQISNALARPV

SEQ ID NO: 29050 - protein, 25 aa, synthetic construct
  source 1..25: note = Seed: YGFLNVIVHSATGFKQSSKALQRPV
YGFLNVIVHSATGLKQISNALIRPV

SEQ ID NO: 29051 - protein, 25 aa, synthetic construct
  source 1..25: note = Seed: YGFLNVIVHSATGFKQSSKALQRPV
YGFLNVIVHSATGLKQISNALNRPV

SEQ ID NO: 29052 - protein, 25 aa, synthetic construct
  source 1..25: note = Seed: YGFLNVIVHSATGFKQSSKALQRPV
YGFLNVIVHSATGLKQISNALRRPV

SEQ ID NO: 29053 - protein, 25 aa, synthetic construct
  source 1..25: note = Seed: YGFLNVIVHSATGFKQSSKALQRPV
YGFLNVIVHSATGLKQISNALSRPV

SEQ ID NO: 29054 - protein, 25 aa, synthetic construct
  source 1..25: note = Seed: YGFLNVIVHSATGFKQSSKALQRPV
YGFLNVIVHSATGLKQISNALVRPV

SEQ ID NO: 29055 - protein, 25 aa, synthetic construct
  source 1..25: note = Seed: YGFLNVIVHSATGFKQSSKALQRPV
YGFLNVIVHSATGLKQISPALARPV

SEQ ID NO: 29056 - protein, 25 aa, synthetic construct
  source 1..25: note = Seed: YGFLNVIVHSATGFKQSSKALQRPV
YGFLNVIVHSATGLKQISPALGRPV

SEQ ID NO: 29057 - protein, 25 aa, synthetic construct
  source 1..25: note = Seed: YGFLNVIVHSATGFKQSSKALQRPV
YGFLNVIVHSATGLKQISPALHRPV

SEQ ID NO: 29058 - protein, 25 aa, synthetic construct
  source 1..25: note = Seed: YGFLNVIVHSATGFKQSSKALQRPV
YGFLNVIVHSATGLKQISPALIRPV

SEQ ID NO: 29059 - protein, 25 aa, synthetic construct
  source 1..25: note = Seed: YGFLNVIVHSATGFKQSSKALQRPV
YGFLNVIVHSATGLKQISPALMRPV

SEQ ID NO: 29060 - protein, 25 aa, synthetic construct
  source 1..25: note = Seed: YGFLNVIVHSATGFKQSSKALQRPV
YGFLNVIVHSATGLKQISPALNRPV

SEQ ID NO: 29061 - protein, 25 aa, synthetic construct
  source 1..25: note = Seed: YGFLNVIVHSATGFKQSSKALQRPV
YGFLNVIVHSATGLKQISPALQRPV

SEQ ID NO: 29062 - protein, 25 aa, synthetic construct
  source 1..25: note = Seed: YGFLNVIVHSATGFKQSSKALQRPV
YGFLNVIVHSATGLKQISPALRRPV

SEQ ID NO: 29063 - protein, 25 aa, synthetic construct
  source 1..25: note = Seed: YGFLNVIVHSATGFKQSSKALQRPV
YGFLNVIVHSATGLKQISPALSRPV

SEQ ID NO: 29064 - protein, 25 aa, synthetic construct
  source 1..25: note = Seed: YGFLNVIVHSATGFKQSSKALQRPV
YGFLNVIVHSATGLKQISPALTRPV

SEQ ID NO: 29065 - protein, 25 aa, synthetic construct
  source 1..25: note = Seed: YGFLNVIVHSATGFKQSSKALQRPV
YGFLNVIVHSATGLKQISPALVRPV

SEQ ID NO: 29066 - protein, 25 aa, synthetic construct
  source 1..25: note = Seed: YGFLNVIVHSATGFKQSSKALQRPV
YGFLNVIVHSATGLKQISQALRRPV

SEQ ID NO: 29067 - protein, 25 aa, synthetic construct
  source 1..25: note = Seed: YGFLNVIVHSATGFKQSSKALQRPV
YGFLNVIVHSATGLKQISRALARPV

SEQ ID NO: 29068 - protein, 25 aa, synthetic construct
  source 1..25: note = Seed: YGFLNVIVHSATGFKQSSKALQRPV
YGFLNVIVHSATGLKQISRALFRPV

SEQ ID NO: 29069 - protein, 25 aa, synthetic construct
  source 1..25: note = Seed: YGFLNVIVHSATGFKQSSKALQRPV
YGFLNVIVHSATGLKQISRALGRPV

SEQ ID NO: 29070 - protein, 25 aa, synthetic construct
  source 1..25: note = Seed: YGFLNVIVHSATGFKQSSKALQRPV
YGFLNVIVHSATGLKQISRALHRPV

SEQ ID NO: 29071 - protein, 25 aa, synthetic construct
  source 1..25: note = Seed: YGFLNVIVHSATGFKQSSKALQRPV
YGFLNVIVHSATGLKQISRALIRPV

SEQ ID NO: 29072 - protein, 25 aa, synthetic construct
  source 1..25: note = Seed: YGFLNVIVHSATGFKQSSKALQRPV
YGFLNVIVHSATGLKQISRALKRPV

SEQ ID NO: 29073 - protein, 25 aa, synthetic construct
  source 1..25: note = Seed: YGFLNVIVHSATGFKQSSKALQRPV
YGFLNVIVHSATGLKQISRALLRPV

SEQ ID NO: 29074 - protein, 25 aa, synthetic construct
  source 1..25: note = Seed: YGFLNVIVHSATGFKQSSKALQRPV
YGFLNVIVHSATGLKQISRALMRPV

SEQ ID NO: 29075 - protein, 25 aa, synthetic construct
  source 1..25: note = Seed: YGFLNVIVHSATGFKQSSKALQRPV
YGFLNVIVHSATGLKQISRALNRPV

SEQ ID NO: 29076 - protein, 25 aa, synthetic construct
  source 1..25: note = Seed: YGFLNVIVHSATGFKQSSKALQRPV
YGFLNVIVHSATGLKQISRALPRPV

SEQ ID NO: 29077 - protein, 25 aa, synthetic construct
  source 1..25: note = Seed: YGFLNVIVHSATGFKQSSKALQRPV
YGFLNVIVHSATGLKQISRALQRPV

SEQ ID NO: 29078 - protein, 25 aa, synthetic construct
  source 1..25: note = Seed: YGFLNVIVHSATGFKQSSKALQRPV
YGFLNVIVHSATGLKQISRALRRPV

SEQ ID NO: 29079 - protein, 25 aa, synthetic construct
  source 1..25: note = Seed: YGFLNVIVHSATGFKQSSKALQRPV
YGFLNVIVHSATGLKQISRALSRPV

SEQ ID NO: 29080 - protein, 25 aa, synthetic construct
  source 1..25: note = Seed: YGFLNVIVHSATGFKQSSKALQRPV
YGFLNVIVHSATGLKQISRALTRPV

SEQ ID NO: 29081 - protein, 25 aa, synthetic construct
  source 1..25: note = Seed: YGFLNVIVHSATGFKQSSKALQRPV
YGFLNVIVHSATGLKQISRALVRPV

SEQ ID NO: 29082 - protein, 25 aa, synthetic construct
  source 1..25: note = Seed: YGFLNVIVHSATGFKQSSKALQRPV
YGFLNVIVHSATGLKQISRALYRPV

SEQ ID NO: 29083 - protein, 25 aa, synthetic construct
  source 1..25: note = Seed: YGFLNVIVHSATGFKQSSKALQRPV
YGFLNVIVHSATGLKQISSALARPV

SEQ ID NO: 29084 - protein, 25 aa, synthetic construct
  source 1..25: note = Seed: YGFLNVIVHSATGFKQSSKALQRPV
YGFLNVIVHSATGLKQISSALNRPV

SEQ ID NO: 29085 - protein, 25 aa, synthetic construct
  source 1..25: note = Seed: YGFLNVIVHSATGFKQSSKALQRPV
YGFLNVIVHSATGLKQISSALRRPV

SEQ ID NO: 29086 - protein, 25 aa, synthetic construct
  source 1..25: note = Seed: YGFLNVIVHSATGFKQSSKALQRPV
YGFLNVIVHSATGLKQISSALSRPV

SEQ ID NO: 29087 - protein, 25 aa, synthetic construct
  source 1..25: note = Seed: YGFLNVIVHSATGFKQSSKALQRPV
YGFLNVIVHSATGLKQISSALTRPV

SEQ ID NO: 29088 - protein, 25 aa, synthetic construct
  source 1..25: note = Seed: YGFLNVIVHSATGFKQSSKALQRPV
YGFLNVIVHSATGLKQISSALVRPV

SEQ ID NO: 29089 - protein, 25 aa, synthetic construct
  source 1..25: note = Seed: YGFLNVIVHSATGFKQSSKALQRPV
YGFLNVIVHSATGLKQISTALARPV

SEQ ID NO: 29090 - protein, 25 aa, synthetic construct
  source 1..25: note = Seed: YGFLNVIVHSATGFKQSSKALQRPV
YGFLNVIVHSATGLKQISTALGRPV

SEQ ID NO: 29091 - protein, 25 aa, synthetic construct
  source 1..25: note = Seed: YGFLNVIVHSATGFKQSSKALQRPV
YGFLNVIVHSATGLKQISTALHRPV

SEQ ID NO: 29092 - protein, 25 aa, synthetic construct
  source 1..25: note = Seed: YGFLNVIVHSATGFKQSSKALQRPV
YGFLNVIVHSATGLKQISTALMRPV

SEQ ID NO: 29093 - protein, 25 aa, synthetic construct
  source 1..25: note = Seed: YGFLNVIVHSATGFKQSSKALQRPV
YGFLNVIVHSATGLKQISTALNRPV

SEQ ID NO: 29094 - protein, 25 aa, synthetic construct
  source 1..25: note = Seed: YGFLNVIVHSATGFKQSSKALQRPV
YGFLNVIVHSATGLKQISTALRRPV

SEQ ID NO: 29095 - protein, 25 aa, synthetic construct
  source 1..25: note = Seed: YGFLNVIVHSATGFKQSSKALQRPV
YGFLNVIVHSATGLKQISTALSRPV

SEQ ID NO: 29096 - protein, 25 aa, synthetic construct
  source 1..25: note = Seed: YGFLNVIVHSATGFKQSSKALQRPV
YGFLNVIVHSATGLKQISTALTRPV

SEQ ID NO: 29097 - protein, 25 aa, synthetic construct
  source 1..25: note = Seed: YGFLNVIVHSATGFKQSSKALQRPV
YGFLNVIVHSATGLKQISTALVRPV

SEQ ID NO: 29098 - protein, 25 aa, synthetic construct
  source 1..25: note = Seed: YGFLNVIVHSATGFKQSSKALQRPV
YGFLNVIVHSATGLKQISVALARPV

SEQ ID NO: 29099 - protein, 25 aa, synthetic construct
  source 1..25: note = Seed: YGFLNVIVHSATGFKQSSKALQRPV
YGFLNVIVHSATGLKQISVALGRPV

SEQ ID NO: 29100 - protein, 25 aa, synthetic construct
  source 1..25: note = Seed: YGFLNVIVHSATGFKQSSKALQRPV
YGFLNVIVHSATGLKQISVALHRPV

SEQ ID NO: 29101 - protein, 25 aa, synthetic construct
  source 1..25: note = Seed: YGFLNVIVHSATGFKQSSKALQRPV
YGFLNVIVHSATGLKQISVALKRPV

SEQ ID NO: 29102 - protein, 25 aa, synthetic construct
  source 1..25: note = Seed: YGFLNVIVHSATGFKQSSKALQRPV
YGFLNVIVHSATGLKQISVALNRPV

SEQ ID NO: 29103 - protein, 25 aa, synthetic construct
  source 1..25: note = Seed: YGFLNVIVHSATGFKQSSKALQRPV
YGFLNVIVHSATGLKQISVALRRPV

SEQ ID NO: 29104 - protein, 25 aa, synthetic construct
  source 1..25: note = Seed: YGFLNVIVHSATGFKQSSKALQRPV
YGFLNVIVHSATGLKQISVALSRPV

SEQ ID NO: 29105 - protein, 25 aa, synthetic construct
  source 1..25: note = Seed: YGFLNVIVHSATGFKQSSKALQRPV
YGFLNVIVHSATGLKQISVALTRPV

SEQ ID NO: 29106 - protein, 25 aa, synthetic construct
  source 1..25: note = Seed: YGFLNVIVHSATGFKQSSKALQRPV
YGFLNVIVHSATGLKQISWALFRPV

SEQ ID NO: 29107 - protein, 25 aa, synthetic construct
  source 1..25: note = Seed: YGFLNVIVHSATGFKQSSKALQRPV
YGFLNVIVHSATGLKQISWALLRPV

SEQ ID NO: 29108 - protein, 25 aa, synthetic construct
  source 1..25: note = Seed: YGFLNVIVHSATGFKQSSKALQRPV
YGFLNVIVHSATGLKQISWALRRPV

SEQ ID NO: 29109 - protein, 25 aa, synthetic construct
  source 1..25: note = Seed: YGFLNVIVHSATGFKQSSKALQRPV
YGFLNVIVHSATGLKQISWALYRPV

SEQ ID NO: 29110 - protein, 25 aa, synthetic construct
  source 1..25: note = Seed: YGFLNVIVHSATGFKQSSKALQRPV
YGFLNVIVHSATGLKQISYALARPV

SEQ ID NO: 29111 - protein, 25 aa, synthetic construct
  source 1..25: note = Seed: YGFLNVIVHSATGFKQSSKALQRPV
YGFLNVIVHSATGLKQISYALFRPV

SEQ ID NO: 29112 - protein, 25 aa, synthetic construct
  source 1..25: note = Seed: YGFLNVIVHSATGFKQSSKALQRPV
YGFLNVIVHSATGLKQISYALIRPV

SEQ ID NO: 29113 - protein, 25 aa, synthetic construct
  source 1..25: note = Seed: YGFLNVIVHSATGFKQSSKALQRPV
YGFLNVIVHSATGLKQISYALLRPV

SEQ ID NO: 29114 - protein, 25 aa, synthetic construct
  source 1..25: note = Seed: YGFLNVIVHSATGFKQSSKALQRPV
YGFLNVIVHSATGLKQISYALRRPV

SEQ ID NO: 29115 - protein, 25 aa, synthetic construct
  source 1..25: note = Seed: YGFLNVIVHSATGFKQSSKALQRPV
YGFLNVIVHSATGLKQISYALVRPV

SEQ ID NO: 29116 - protein, 25 aa, synthetic construct
  source 1..25: note = Seed: YGFLNVIVHSATGFKQSSKALQRPV
YGFLNVIVHSATGLKQISYALWRPV

SEQ ID NO: 29117 - protein, 25 aa, synthetic construct
  source 1..25: note = Seed: YGFLNVIVHSATGFKQSSKALQRPV
YGFLNVIVHSATGLKQISYALYRPV

SEQ ID NO: 29118 - protein, 25 aa, synthetic construct
  source 1..25: note = Seed: YGFLNVIVHSATGFKQSSKALQRPV
YGFLNVIVHSATGLKQKSKALRRPV

SEQ ID NO: 29119 - protein, 25 aa, synthetic construct
  source 1..25: note = Seed: YGFLNVIVHSATGFKQSSKALQRPV
YGFLNVIVHSATGLKQKSKALYRPV

SEQ ID NO: 29120 - protein, 25 aa, synthetic construct
  source 1..25: note = Seed: YGFLNVIVHSATGFKQSSKALQRPV
YGFLNVIVHSATGLKQKSRALARPV

SEQ ID NO: 29121 - protein, 25 aa, synthetic construct
  source 1..25: note = Seed: YGFLNVIVHSATGFKQSSKALQRPV
YGFLNVIVHSATGLKQKSRALFRPV

SEQ ID NO: 29122 - protein, 25 aa, synthetic construct
  source 1..25: note = Seed: YGFLNVIVHSATGFKQSSKALQRPV
YGFLNVIVHSATGLKQKSRALRRPV

SEQ ID NO: 29123 - protein, 25 aa, synthetic construct
  source 1..25: note = Seed: YGFLNVIVHSATGFKQSSKALQRPV
YGFLNVIVHSATGLKQKSRALSRPV

SEQ ID NO: 29124 - protein, 25 aa, synthetic construct
  source 1..25: note = Seed: YGFLNVIVHSATGFKQSSKALQRPV
YGFLNVIVHSATGLKQKSRALYRPV

SEQ ID NO: 29125 - protein, 25 aa, synthetic construct
  source 1..25: note = Seed: YGFLNVIVHSATGFKQSSKALQRPV
YGFLNVIVHSATGLKQLSAALARPV

SEQ ID NO: 29126 - protein, 25 aa, synthetic construct
  source 1..25: note = Seed: YGFLNVIVHSATGFKQSSKALQRPV
YGFLNVIVHSATGLKQLSAALDRPV

SEQ ID NO: 29127 - protein, 25 aa, synthetic construct
  source 1..25: note = Seed: YGFLNVIVHSATGFKQSSKALQRPV
YGFLNVIVHSATGLKQLSAALERPV

SEQ ID NO: 29128 - protein, 25 aa, synthetic construct
  source 1..25: note = Seed: YGFLNVIVHSATGFKQSSKALQRPV
YGFLNVIVHSATGLKQLSAALGRPV

SEQ ID NO: 29129 - protein, 25 aa, synthetic construct
  source 1..25: note = Seed: YGFLNVIVHSATGFKQSSKALQRPV
YGFLNVIVHSATGLKQLSAALHRPV

SEQ ID NO: 29130 - protein, 25 aa, synthetic construct
  source 1..25: note = Seed: YGFLNVIVHSATGFKQSSKALQRPV
YGFLNVIVHSATGLKQLSAALIRPV

SEQ ID NO: 29131 - protein, 25 aa, synthetic construct
  source 1..25: note = Seed: YGFLNVIVHSATGFKQSSKALQRPV
YGFLNVIVHSATGLKQLSAALLRPV

SEQ ID NO: 29132 - protein, 25 aa, synthetic construct
  source 1..25: note = Seed: YGFLNVIVHSATGFKQSSKALQRPV
YGFLNVIVHSATGLKQLSAALMRPV

SEQ ID NO: 29133 - protein, 25 aa, synthetic construct
  source 1..25: note = Seed: YGFLNVIVHSATGFKQSSKALQRPV
YGFLNVIVHSATGLKQLSAALNRPV

SEQ ID NO: 29134 - protein, 25 aa, synthetic construct
  source 1..25: note = Seed: YGFLNVIVHSATGFKQSSKALQRPV
YGFLNVIVHSATGLKQLSAALPRPV

SEQ ID NO: 29135 - protein, 25 aa, synthetic construct
  source 1..25: note = Seed: YGFLNVIVHSATGFKQSSKALQRPV
YGFLNVIVHSATGLKQLSAALQRPV

SEQ ID NO: 29136 - protein, 25 aa, synthetic construct
  source 1..25: note = Seed: YGFLNVIVHSATGFKQSSKALQRPV
YGFLNVIVHSATGLKQLSAALRRPV

SEQ ID NO: 29137 - protein, 25 aa, synthetic construct
  source 1..25: note = Seed: YGFLNVIVHSATGFKQSSKALQRPV
YGFLNVIVHSATGLKQLSAALSRPV

SEQ ID NO: 29138 - protein, 25 aa, synthetic construct
  source 1..25: note = Seed: YGFLNVIVHSATGFKQSSKALQRPV
YGFLNVIVHSATGLKQLSAALTRPV

SEQ ID NO: 29139 - protein, 25 aa, synthetic construct
  source 1..25: note = Seed: YGFLNVIVHSATGFKQSSKALQRPV
YGFLNVIVHSATGLKQLSAALVRPV

SEQ ID NO: 29140 - protein, 25 aa, synthetic construct
  source 1..25: note = Seed: YGFLNVIVHSATGFKQSSKALQRPV
YGFLNVIVHSATGLKQLSFALFRPV

SEQ ID NO: 29141 - protein, 25 aa, synthetic construct
  source 1..25: note = Seed: YGFLNVIVHSATGFKQSSKALQRPV
YGFLNVIVHSATGLKQLSFALIRPV

SEQ ID NO: 29142 - protein, 25 aa, synthetic construct
  source 1..25: note = Seed: YGFLNVIVHSATGFKQSSKALQRPV
YGFLNVIVHSATGLKQLSFALLRPV

SEQ ID NO: 29143 - protein, 25 aa, synthetic construct
  source 1..25: note = Seed: YGFLNVIVHSATGFKQSSKALQRPV
YGFLNVIVHSATGLKQLSFALMRPV

SEQ ID NO: 29144 - protein, 25 aa, synthetic construct
  source 1..25: note = Seed: YGFLNVIVHSATGFKQSSKALQRPV
YGFLNVIVHSATGLKQLSFALVRPV

SEQ ID NO: 29145 - protein, 25 aa, synthetic construct
  source 1..25: note = Seed: YGFLNVIVHSATGFKQSSKALQRPV
YGFLNVIVHSATGLKQLSFALYRPV

SEQ ID NO: 29146 - protein, 25 aa, synthetic construct
  source 1..25: note = Seed: YGFLNVIVHSATGFKQSSKALQRPV
YGFLNVIVHSATGLKQLSGALARPV

SEQ ID NO: 29147 - protein, 25 aa, synthetic construct
  source 1..25: note = Seed: YGFLNVIVHSATGFKQSSKALQRPV
YGFLNVIVHSATGLKQLSGALIRPV

SEQ ID NO: 29148 - protein, 25 aa, synthetic construct
  source 1..25: note = Seed: YGFLNVIVHSATGFKQSSKALQRPV
YGFLNVIVHSATGLKQLSGALNRPV

SEQ ID NO: 29149 - protein, 25 aa, synthetic construct
  source 1..25: note = Seed: YGFLNVIVHSATGFKQSSKALQRPV
YGFLNVIVHSATGLKQLSGALSRPV

SEQ ID NO: 29150 - protein, 25 aa, synthetic construct
  source 1..25: note = Seed: YGFLNVIVHSATGFKQSSKALQRPV
YGFLNVIVHSATGLKQLSGALTRPV

SEQ ID NO: 29151 - protein, 25 aa, synthetic construct
  source 1..25: note = Seed: YGFLNVIVHSATGFKQSSKALQRPV
YGFLNVIVHSATGLKQLSGALVRPV

SEQ ID NO: 29152 - protein, 25 aa, synthetic construct
  source 1..25: note = Seed: YGFLNVIVHSATGFKQSSKALQRPV
YGFLNVIVHSATGLKQLSHALARPV

SEQ ID NO: 29153 - protein, 25 aa, synthetic construct
  source 1..25: note = Seed: YGFLNVIVHSATGFKQSSKALQRPV
YGFLNVIVHSATGLKQLSHALSRPV

SEQ ID NO: 29154 - protein, 25 aa, synthetic construct
  source 1..25: note = Seed: YGFLNVIVHSATGFKQSSKALQRPV
YGFLNVIVHSATGLKQLSIALARPV

SEQ ID NO: 29155 - protein, 25 aa, synthetic construct
  source 1..25: note = Seed: YGFLNVIVHSATGFKQSSKALQRPV
YGFLNVIVHSATGLKQLSIALGRPV

SEQ ID NO: 29156 - protein, 25 aa, synthetic construct
  source 1..25: note = Seed: YGFLNVIVHSATGFKQSSKALQRPV
YGFLNVIVHSATGLKQLSIALHRPV

SEQ ID NO: 29157 - protein, 25 aa, synthetic construct
  source 1..25: note = Seed: YGFLNVIVHSATGFKQSSKALQRPV
YGFLNVIVHSATGLKQLSIALKRPV

SEQ ID NO: 29158 - protein, 25 aa, synthetic construct
  source 1..25: note = Seed: YGFLNVIVHSATGFKQSSKALQRPV
YGFLNVIVHSATGLKQLSIALMRPV

SEQ ID NO: 29159 - protein, 25 aa, synthetic construct
  source 1..25: note = Seed: YGFLNVIVHSATGFKQSSKALQRPV
YGFLNVIVHSATGLKQLSIALNRPV

SEQ ID NO: 29160 - protein, 25 aa, synthetic construct
  source 1..25: note = Seed: YGFLNVIVHSATGFKQSSKALQRPV
YGFLNVIVHSATGLKQLSIALRRPV

SEQ ID NO: 29161 - protein, 25 aa, synthetic construct
  source 1..25: note = Seed: YGFLNVIVHSATGFKQSSKALQRPV
YGFLNVIVHSATGLKQLSIALSRPV

SEQ ID NO: 29162 - protein, 25 aa, synthetic construct
  source 1..25: note = Seed: YGFLNVIVHSATGFKQSSKALQRPV
YGFLNVIVHSATGLKQLSIALTRPV

SEQ ID NO: 29163 - protein, 25 aa, synthetic construct
  source 1..25: note = Seed: YGFLNVIVHSATGFKQSSKALQRPV
YGFLNVIVHSATGLKQLSIALVRPV

SEQ ID NO: 29164 - protein, 25 aa, synthetic construct
  source 1..25: note = Seed: YGFLNVIVHSATGFKQSSKALQRPV
YGFLNVIVHSATGLKQLSKALARPV

SEQ ID NO: 29165 - protein, 25 aa, synthetic construct
  source 1..25: note = Seed: YGFLNVIVHSATGFKQSSKALQRPV
YGFLNVIVHSATGLKQLSKALFRPV

SEQ ID NO: 29166 - protein, 25 aa, synthetic construct
  source 1..25: note = Seed: YGFLNVIVHSATGFKQSSKALQRPV
YGFLNVIVHSATGLKQLSKALGRPV

SEQ ID NO: 29167 - protein, 25 aa, synthetic construct
  source 1..25: note = Seed: YGFLNVIVHSATGFKQSSKALQRPV
YGFLNVIVHSATGLKQLSKALHRPV

SEQ ID NO: 29168 - protein, 25 aa, synthetic construct
  source 1..25: note = Seed: YGFLNVIVHSATGFKQSSKALQRPV
YGFLNVIVHSATGLKQLSKALIRPV

SEQ ID NO: 29169 - protein, 25 aa, synthetic construct
  source 1..25: note = Seed: YGFLNVIVHSATGFKQSSKALQRPV
YGFLNVIVHSATGLKQLSKALKRPV

SEQ ID NO: 29170 - protein, 25 aa, synthetic construct
  source 1..25: note = Seed: YGFLNVIVHSATGFKQSSKALQRPV
YGFLNVIVHSATGLKQLSKALLRPV

SEQ ID NO: 29171 - protein, 25 aa, synthetic construct
  source 1..25: note = Seed: YGFLNVIVHSATGFKQSSKALQRPV
YGFLNVIVHSATGLKQLSKALMRPV

SEQ ID NO: 29172 - protein, 25 aa, synthetic construct
  source 1..25: note = Seed: YGFLNVIVHSATGFKQSSKALQRPV
YGFLNVIVHSATGLKQLSKALNRPV

SEQ ID NO: 29173 - protein, 25 aa, synthetic construct
  source 1..25: note = Seed: YGFLNVIVHSATGFKQSSKALQRPV
YGFLNVIVHSATGLKQLSKALPRPV

SEQ ID NO: 29174 - protein, 25 aa, synthetic construct
  source 1..25: note = Seed: YGFLNVIVHSATGFKQSSKALQRPV
YGFLNVIVHSATGLKQLSKALQRPV

SEQ ID NO: 29175 - protein, 25 aa, synthetic construct
  source 1..25: note = Seed: YGFLNVIVHSATGFKQSSKALQRPV
YGFLNVIVHSATGLKQLSKALRRPV

SEQ ID NO: 29176 - protein, 25 aa, synthetic construct
  source 1..25: note = Seed: YGFLNVIVHSATGFKQSSKALQRPV
YGFLNVIVHSATGLKQLSKALSRPV

SEQ ID NO: 29177 - protein, 25 aa, synthetic construct
  source 1..25: note = Seed: YGFLNVIVHSATGFKQSSKALQRPV
YGFLNVIVHSATGLKQLSKALTRPV

SEQ ID NO: 29178 - protein, 25 aa, synthetic construct
  source 1..25: note = Seed: YGFLNVIVHSATGFKQSSKALQRPV
YGFLNVIVHSATGLKQLSKALVRPV

SEQ ID NO: 29179 - protein, 25 aa, synthetic construct
  source 1..25: note = Seed: YGFLNVIVHSATGFKQSSKALQRPV
YGFLNVIVHSATGLKQLSKALYRPV

SEQ ID NO: 29180 - protein, 25 aa, synthetic construct
  source 1..25: note = Seed: YGFLNVIVHSATGFKQSSKALQRPV
YGFLNVIVHSATGLKQLSLALARPV

SEQ ID NO: 29181 - protein, 25 aa, synthetic construct
  source 1..25: note = Seed: YGFLNVIVHSATGFKQSSKALQRPV
YGFLNVIVHSATGLKQLSLALFRPV

SEQ ID NO: 29182 - protein, 25 aa, synthetic construct
  source 1..25: note = Seed: YGFLNVIVHSATGFKQSSKALQRPV
YGFLNVIVHSATGLKQLSLALLRPV

SEQ ID NO: 29183 - protein, 25 aa, synthetic construct
  source 1..25: note = Seed: YGFLNVIVHSATGFKQSSKALQRPV
YGFLNVIVHSATGLKQLSLALNRPV

SEQ ID NO: 29184 - protein, 25 aa, synthetic construct
  source 1..25: note = Seed: YGFLNVIVHSATGFKQSSKALQRPV
YGFLNVIVHSATGLKQLSLALRRPV

SEQ ID NO: 29185 - protein, 25 aa, synthetic construct
  source 1..25: note = Seed: YGFLNVIVHSATGFKQSSKALQRPV
YGFLNVIVHSATGLKQLSLALSRPV

SEQ ID NO: 29186 - protein, 25 aa, synthetic construct
  source 1..25: note = Seed: YGFLNVIVHSATGFKQSSKALQRPV
YGFLNVIVHSATGLKQLSMALARPV

SEQ ID NO: 29187 - protein, 25 aa, synthetic construct
  source 1..25: note = Seed: YGFLNVIVHSATGFKQSSKALQRPV
YGFLNVIVHSATGLKQLSMALFRPV

SEQ ID NO: 29188 - protein, 25 aa, synthetic construct
  source 1..25: note = Seed: YGFLNVIVHSATGFKQSSKALQRPV
YGFLNVIVHSATGLKQLSMALNRPV

SEQ ID NO: 29189 - protein, 25 aa, synthetic construct
  source 1..25: note = Seed: YGFLNVIVHSATGFKQSSKALQRPV
YGFLNVIVHSATGLKQLSMALRRPV

SEQ ID NO: 29190 - protein, 25 aa, synthetic construct
  source 1..25: note = Seed: YGFLNVIVHSATGFKQSSKALQRPV
YGFLNVIVHSATGLKQLSMALSRPV

SEQ ID NO: 29191 - protein, 25 aa, synthetic construct
  source 1..25: note = Seed: YGFLNVIVHSATGFKQSSKALQRPV
YGFLNVIVHSATGLKQLSMALVRPV

SEQ ID NO: 29192 - protein, 25 aa, synthetic construct
  source 1..25: note = Seed: YGFLNVIVHSATGFKQSSKALQRPV
YGFLNVIVHSATGLKQLSNALARPV

SEQ ID NO: 29193 - protein, 25 aa, synthetic construct
  source 1..25: note = Seed: YGFLNVIVHSATGFKQSSKALQRPV
YGFLNVIVHSATGLKQLSNALNRPV

SEQ ID NO: 29194 - protein, 25 aa, synthetic construct
  source 1..25: note = Seed: YGFLNVIVHSATGFKQSSKALQRPV
YGFLNVIVHSATGLKQLSNALSRPV

SEQ ID NO: 29195 - protein, 25 aa, synthetic construct
  source 1..25: note = Seed: YGFLNVIVHSATGFKQSSKALQRPV
YGFLNVIVHSATGLKQLSNALTRPV

SEQ ID NO: 29196 - protein, 25 aa, synthetic construct
  source 1..25: note = Seed: YGFLNVIVHSATGFKQSSKALQRPV
YGFLNVIVHSATGLKQLSNALVRPV

SEQ ID NO: 29197 - protein, 25 aa, synthetic construct
  source 1..25: note = Seed: YGFLNVIVHSATGFKQSSKALQRPV
YGFLNVIVHSATGLKQLSPALARPV

SEQ ID NO: 29198 - protein, 25 aa, synthetic construct
  source 1..25: note = Seed: YGFLNVIVHSATGFKQSSKALQRPV
YGFLNVIVHSATGLKQLSPALCRPV

SEQ ID NO: 29199 - protein, 25 aa, synthetic construct
  source 1..25: note = Seed: YGFLNVIVHSATGFKQSSKALQRPV
YGFLNVIVHSATGLKQLSPALDRPV

SEQ ID NO: 29200 - protein, 25 aa, synthetic construct
  source 1..25: note = Seed: YGFLNVIVHSATGFKQSSKALQRPV
YGFLNVIVHSATGLKQLSPALERPV

SEQ ID NO: 29201 - protein, 25 aa, synthetic construct
  source 1..25: note = Seed: YGFLNVIVHSATGFKQSSKALQRPV
YGFLNVIVHSATGLKQLSPALGRPV

SEQ ID NO: 29202 - protein, 25 aa, synthetic construct
  source 1..25: note = Seed: YGFLNVIVHSATGFKQSSKALQRPV
YGFLNVIVHSATGLKQLSPALHRPV

SEQ ID NO: 29203 - protein, 25 aa, synthetic construct
  source 1..25: note = Seed: YGFLNVIVHSATGFKQSSKALQRPV
YGFLNVIVHSATGLKQLSPALIRPV

SEQ ID NO: 29204 - protein, 25 aa, synthetic construct
  source 1..25: note = Seed: YGFLNVIVHSATGFKQSSKALQRPV
YGFLNVIVHSATGLKQLSPALLRPV

SEQ ID NO: 29205 - protein, 25 aa, synthetic construct
  source 1..25: note = Seed: YGFLNVIVHSATGFKQSSKALQRPV
YGFLNVIVHSATGLKQLSPALMRPV

SEQ ID NO: 29206 - protein, 25 aa, synthetic construct
  source 1..25: note = Seed: YGFLNVIVHSATGFKQSSKALQRPV
YGFLNVIVHSATGLKQLSPALNRPV

SEQ ID NO: 29207 - protein, 25 aa, synthetic construct
  source 1..25: note = Seed: YGFLNVIVHSATGFKQSSKALQRPV
YGFLNVIVHSATGLKQLSPALPRPV

SEQ ID NO: 29208 - protein, 25 aa, synthetic construct
  source 1..25: note = Seed: YGFLNVIVHSATGFKQSSKALQRPV
YGFLNVIVHSATGLKQLSPALQRPV

SEQ ID NO: 29209 - protein, 25 aa, synthetic construct
  source 1..25: note = Seed: YGFLNVIVHSATGFKQSSKALQRPV
YGFLNVIVHSATGLKQLSPALSRPV

SEQ ID NO: 29210 - protein, 25 aa, synthetic construct
  source 1..25: note = Seed: YGFLNVIVHSATGFKQSSKALQRPV
YGFLNVIVHSATGLKQLSPALTRPV

SEQ ID NO: 29211 - protein, 25 aa, synthetic construct
  source 1..25: note = Seed: YGFLNVIVHSATGFKQSSKALQRPV
YGFLNVIVHSATGLKQLSPALVRPV

SEQ ID NO: 29212 - protein, 25 aa, synthetic construct
  source 1..25: note = Seed: YGFLNVIVHSATGFKQSSKALQRPV
YGFLNVIVHSATGLKQLSRALARPV

SEQ ID NO: 29213 - protein, 25 aa, synthetic construct
  source 1..25: note = Seed: YGFLNVIVHSATGFKQSSKALQRPV
YGFLNVIVHSATGLKQLSRALCRPV

SEQ ID NO: 29214 - protein, 25 aa, synthetic construct
  source 1..25: note = Seed: YGFLNVIVHSATGFKQSSKALQRPV
YGFLNVIVHSATGLKQLSRALERPV

SEQ ID NO: 29215 - protein, 25 aa, synthetic construct
  source 1..25: note = Seed: YGFLNVIVHSATGFKQSSKALQRPV
YGFLNVIVHSATGLKQLSRALFRPV

SEQ ID NO: 29216 - protein, 25 aa, synthetic construct
  source 1..25: note = Seed: YGFLNVIVHSATGFKQSSKALQRPV
YGFLNVIVHSATGLKQLSRALGRPV

SEQ ID NO: 29217 - protein, 25 aa, synthetic construct
  source 1..25: note = Seed: YGFLNVIVHSATGFKQSSKALQRPV
YGFLNVIVHSATGLKQLSRALHRPV

SEQ ID NO: 29218 - protein, 25 aa, synthetic construct
  source 1..25: note = Seed: YGFLNVIVHSATGFKQSSKALQRPV
YGFLNVIVHSATGLKQLSRALIRPV

SEQ ID NO: 29219 - protein, 25 aa, synthetic construct
  source 1..25: note = Seed: YGFLNVIVHSATGFKQSSKALQRPV
YGFLNVIVHSATGLKQLSRALKRPV

SEQ ID NO: 29220 - protein, 25 aa, synthetic construct
  source 1..25: note = Seed: YGFLNVIVHSATGFKQSSKALQRPV
YGFLNVIVHSATGLKQLSRALLRPV

SEQ ID NO: 29221 - protein, 25 aa, synthetic construct
  source 1..25: note = Seed: YGFLNVIVHSATGFKQSSKALQRPV
YGFLNVIVHSATGLKQLSRALMRPV

SEQ ID NO: 29222 - protein, 25 aa, synthetic construct
  source 1..25: note = Seed: YGFLNVIVHSATGFKQSSKALQRPV
YGFLNVIVHSATGLKQLSRALNRPV

SEQ ID NO: 29223 - protein, 25 aa, synthetic construct
  source 1..25: note = Seed: YGFLNVIVHSATGFKQSSKALQRPV
YGFLNVIVHSATGLKQLSRALPRPV

SEQ ID NO: 29224 - protein, 25 aa, synthetic construct
  source 1..25: note = Seed: YGFLNVIVHSATGFKQSSKALQRPV
YGFLNVIVHSATGLKQLSRALQRPV

SEQ ID NO: 29225 - protein, 25 aa, synthetic construct
  source 1..25: note = Seed: YGFLNVIVHSATGFKQSSKALQRPV
YGFLNVIVHSATGLKQLSRALRRPV

SEQ ID NO: 29226 - protein, 25 aa, synthetic construct
  source 1..25: note = Seed: YGFLNVIVHSATGFKQSSKALQRPV
YGFLNVIVHSATGLKQLSRALSRPV

SEQ ID NO: 29227 - protein, 25 aa, synthetic construct
  source 1..25: note = Seed: YGFLNVIVHSATGFKQSSKALQRPV
YGFLNVIVHSATGLKQLSRALTRPV

SEQ ID NO: 29228 - protein, 25 aa, synthetic construct
  source 1..25: note = Seed: YGFLNVIVHSATGFKQSSKALQRPV
YGFLNVIVHSATGLKQLSRALVRPV

SEQ ID NO: 29229 - protein, 25 aa, synthetic construct
  source 1..25: note = Seed: YGFLNVIVHSATGFKQSSKALQRPV
YGFLNVIVHSATGLKQLSRALYRPV

SEQ ID NO: 29230 - protein, 25 aa, synthetic construct
  source 1..25: note = Seed: YGFLNVIVHSATGFKQSSKALQRPV
YGFLNVIVHSATGLKQLSSALARPV

SEQ ID NO: 29231 - protein, 25 aa, synthetic construct
  source 1..25: note = Seed: YGFLNVIVHSATGFKQSSKALQRPV
YGFLNVIVHSATGLKQLSSALGRPV

SEQ ID NO: 29232 - protein, 25 aa, synthetic construct
  source 1..25: note = Seed: YGFLNVIVHSATGFKQSSKALQRPV
YGFLNVIVHSATGLKQLSSALHRPV

SEQ ID NO: 29233 - protein, 25 aa, synthetic construct
  source 1..25: note = Seed: YGFLNVIVHSATGFKQSSKALQRPV
YGFLNVIVHSATGLKQLSSALIRPV

SEQ ID NO: 29234 - protein, 25 aa, synthetic construct
  source 1..25: note = Seed: YGFLNVIVHSATGFKQSSKALQRPV
YGFLNVIVHSATGLKQLSSALLRPV

SEQ ID NO: 29235 - protein, 25 aa, synthetic construct
  source 1..25: note = Seed: YGFLNVIVHSATGFKQSSKALQRPV
YGFLNVIVHSATGLKQLSSALMRPV

SEQ ID NO: 29236 - protein, 25 aa, synthetic construct
  source 1..25: note = Seed: YGFLNVIVHSATGFKQSSKALQRPV
YGFLNVIVHSATGLKQLSSALNRPV

SEQ ID NO: 29237 - protein, 25 aa, synthetic construct
  source 1..25: note = Seed: YGFLNVIVHSATGFKQSSKALQRPV
YGFLNVIVHSATGLKQLSSALQRPV

SEQ ID NO: 29238 - protein, 25 aa, synthetic construct
  source 1..25: note = Seed: YGFLNVIVHSATGFKQSSKALQRPV
YGFLNVIVHSATGLKQLSSALSRPV

SEQ ID NO: 29239 - protein, 25 aa, synthetic construct
  source 1..25: note = Seed: YGFLNVIVHSATGFKQSSKALQRPV
YGFLNVIVHSATGLKQLSSALTRPV

SEQ ID NO: 29240 - protein, 25 aa, synthetic construct
  source 1..25: note = Seed: YGFLNVIVHSATGFKQSSKALQRPV
YGFLNVIVHSATGLKQLSSALVRPV

SEQ ID NO: 29241 - protein, 25 aa, synthetic construct
  source 1..25: note = Seed: YGFLNVIVHSATGFKQSSKALQRPV
YGFLNVIVHSATGLKQLSTALARPV

SEQ ID NO: 29242 - protein, 25 aa, synthetic construct
  source 1..25: note = Seed: YGFLNVIVHSATGFKQSSKALQRPV
YGFLNVIVHSATGLKQLSTALGRPV

SEQ ID NO: 29243 - protein, 25 aa, synthetic construct
  source 1..25: note = Seed: YGFLNVIVHSATGFKQSSKALQRPV
YGFLNVIVHSATGLKQLSTALHRPV

SEQ ID NO: 29244 - protein, 25 aa, synthetic construct
  source 1..25: note = Seed: YGFLNVIVHSATGFKQSSKALQRPV
YGFLNVIVHSATGLKQLSTALIRPV

SEQ ID NO: 29245 - protein, 25 aa, synthetic construct
  source 1..25: note = Seed: YGFLNVIVHSATGFKQSSKALQRPV
YGFLNVIVHSATGLKQLSTALLRPV

SEQ ID NO: 29246 - protein, 25 aa, synthetic construct
  source 1..25: note = Seed: YGFLNVIVHSATGFKQSSKALQRPV
YGFLNVIVHSATGLKQLSTALMRPV

SEQ ID NO: 29247 - protein, 25 aa, synthetic construct
  source 1..25: note = Seed: YGFLNVIVHSATGFKQSSKALQRPV
YGFLNVIVHSATGLKQLSTALNRPV

SEQ ID NO: 29248 - protein, 25 aa, synthetic construct
  source 1..25: note = Seed: YGFLNVIVHSATGFKQSSKALQRPV
YGFLNVIVHSATGLKQLSTALPRPV

SEQ ID NO: 29249 - protein, 25 aa, synthetic construct
  source 1..25: note = Seed: YGFLNVIVHSATGFKQSSKALQRPV
YGFLNVIVHSATGLKQLSTALQRPV

SEQ ID NO: 29250 - protein, 25 aa, synthetic construct
  source 1..25: note = Seed: YGFLNVIVHSATGFKQSSKALQRPV
YGFLNVIVHSATGLKQLSTALSRPV

SEQ ID NO: 29251 - protein, 25 aa, synthetic construct
  source 1..25: note = Seed: YGFLNVIVHSATGFKQSSKALQRPV
YGFLNVIVHSATGLKQLSTALTRPV

SEQ ID NO: 29252 - protein, 25 aa, synthetic construct
  source 1..25: note = Seed: YGFLNVIVHSATGFKQSSKALQRPV
YGFLNVIVHSATGLKQLSTALVRPV

SEQ ID NO: 29253 - protein, 25 aa, synthetic construct
  source 1..25: note = Seed: YGFLNVIVHSATGFKQSSKALQRPV
YGFLNVIVHSATGLKQLSVALARPV

SEQ ID NO: 29254 - protein, 25 aa, synthetic construct
  source 1..25: note = Seed: YGFLNVIVHSATGFKQSSKALQRPV
YGFLNVIVHSATGLKQLSVALGRPV

SEQ ID NO: 29255 - protein, 25 aa, synthetic construct
  source 1..25: note = Seed: YGFLNVIVHSATGFKQSSKALQRPV
YGFLNVIVHSATGLKQLSVALHRPV

SEQ ID NO: 29256 - protein, 25 aa, synthetic construct
  source 1..25: note = Seed: YGFLNVIVHSATGFKQSSKALQRPV
YGFLNVIVHSATGLKQLSVALIRPV

SEQ ID NO: 29257 - protein, 25 aa, synthetic construct
  source 1..25: note = Seed: YGFLNVIVHSATGFKQSSKALQRPV
YGFLNVIVHSATGLKQLSVALMRPV

SEQ ID NO: 29258 - protein, 25 aa, synthetic construct
  source 1..25: note = Seed: YGFLNVIVHSATGFKQSSKALQRPV
YGFLNVIVHSATGLKQLSVALNRPV

SEQ ID NO: 29259 - protein, 25 aa, synthetic construct
  source 1..25: note = Seed: YGFLNVIVHSATGFKQSSKALQRPV
YGFLNVIVHSATGLKQLSVALPRPV

SEQ ID NO: 29260 - protein, 25 aa, synthetic construct
  source 1..25: note = Seed: YGFLNVIVHSATGFKQSSKALQRPV
YGFLNVIVHSATGLKQLSVALQRPV

SEQ ID NO: 29261 - protein, 25 aa, synthetic construct
  source 1..25: note = Seed: YGFLNVIVHSATGFKQSSKALQRPV
YGFLNVIVHSATGLKQLSVALRRPV

SEQ ID NO: 29262 - protein, 25 aa, synthetic construct
  source 1..25: note = Seed: YGFLNVIVHSATGFKQSSKALQRPV
YGFLNVIVHSATGLKQLSVALSRPV

SEQ ID NO: 29263 - protein, 25 aa, synthetic construct
  source 1..25: note = Seed: YGFLNVIVHSATGFKQSSKALQRPV
YGFLNVIVHSATGLKQLSVALTRPV

SEQ ID NO: 29264 - protein, 25 aa, synthetic construct
  source 1..25: note = Seed: YGFLNVIVHSATGFKQSSKALQRPV
YGFLNVIVHSATGLKQLSVALVRPV

SEQ ID NO: 29265 - protein, 25 aa, synthetic construct
  source 1..25: note = Seed: YGFLNVIVHSATGFKQSSKALQRPV
YGFLNVIVHSATGLKQLSWALFRPV

SEQ ID NO: 29266 - protein, 25 aa, synthetic construct
  source 1..25: note = Seed: YGFLNVIVHSATGFKQSSKALQRPV
YGFLNVIVHSATGLKQLSWALLRPV

SEQ ID NO: 29267 - protein, 25 aa, synthetic construct
  source 1..25: note = Seed: YGFLNVIVHSATGFKQSSKALQRPV
YGFLNVIVHSATGLKQLSWALRRPV

SEQ ID NO: 29268 - protein, 25 aa, synthetic construct
  source 1..25: note = Seed: YGFLNVIVHSATGFKQSSKALQRPV
YGFLNVIVHSATGLKQLSWALYRPV

SEQ ID NO: 29269 - protein, 25 aa, synthetic construct
  source 1..25: note = Seed: YGFLNVIVHSATGFKQSSKALQRPV
YGFLNVIVHSATGLKQLSYALARPV

SEQ ID NO: 29270 - protein, 25 aa, synthetic construct
  source 1..25: note = Seed: YGFLNVIVHSATGFKQSSKALQRPV
YGFLNVIVHSATGLKQLSYALFRPV

SEQ ID NO: 29271 - protein, 25 aa, synthetic construct
  source 1..25: note = Seed: YGFLNVIVHSATGFKQSSKALQRPV
YGFLNVIVHSATGLKQLSYALIRPV

SEQ ID NO: 29272 - protein, 25 aa, synthetic construct
  source 1..25: note = Seed: YGFLNVIVHSATGFKQSSKALQRPV
YGFLNVIVHSATGLKQLSYALLRPV

SEQ ID NO: 29273 - protein, 25 aa, synthetic construct
  source 1..25: note = Seed: YGFLNVIVHSATGFKQSSKALQRPV
YGFLNVIVHSATGLKQLSYALMRPV

SEQ ID NO: 29274 - protein, 25 aa, synthetic construct
  source 1..25: note = Seed: YGFLNVIVHSATGFKQSSKALQRPV
YGFLNVIVHSATGLKQLSYALWRPV

SEQ ID NO: 29275 - protein, 25 aa, synthetic construct
  source 1..25: note = Seed: YGFLNVIVHSATGFKQSSKALQRPV
YGFLNVIVHSATGLKQLSYALYRPV

SEQ ID NO: 29276 - protein, 25 aa, synthetic construct
  source 1..25: note = Seed: YGFLNVIVHSATGFKQSSKALQRPV
YGFLNVIVHSATGLKQMSAALARPV

SEQ ID NO: 29277 - protein, 25 aa, synthetic construct
  source 1..25: note = Seed: YGFLNVIVHSATGFKQSSKALQRPV
YGFLNVIVHSATGLKQMSAALCRPV

SEQ ID NO: 29278 - protein, 25 aa, synthetic construct
  source 1..25: note = Seed: YGFLNVIVHSATGFKQSSKALQRPV
YGFLNVIVHSATGLKQMSAALDRPV

SEQ ID NO: 29279 - protein, 25 aa, synthetic construct
  source 1..25: note = Seed: YGFLNVIVHSATGFKQSSKALQRPV
YGFLNVIVHSATGLKQMSAALERPV

SEQ ID NO: 29280 - protein, 25 aa, synthetic construct
  source 1..25: note = Seed: YGFLNVIVHSATGFKQSSKALQRPV
YGFLNVIVHSATGLKQMSAALGRPV

SEQ ID NO: 29281 - protein, 25 aa, synthetic construct
  source 1..25: note = Seed: YGFLNVIVHSATGFKQSSKALQRPV
YGFLNVIVHSATGLKQMSAALHRPV

SEQ ID NO: 29282 - protein, 25 aa, synthetic construct
  source 1..25: note = Seed: YGFLNVIVHSATGFKQSSKALQRPV
YGFLNVIVHSATGLKQMSAALIRPV

SEQ ID NO: 29283 - protein, 25 aa, synthetic construct
  source 1..25: note = Seed: YGFLNVIVHSATGFKQSSKALQRPV
YGFLNVIVHSATGLKQMSAALLRPV

SEQ ID NO: 29284 - protein, 25 aa, synthetic construct
  source 1..25: note = Seed: YGFLNVIVHSATGFKQSSKALQRPV
YGFLNVIVHSATGLKQMSAALMRPV

SEQ ID NO: 29285 - protein, 25 aa, synthetic construct
  source 1..25: note = Seed: YGFLNVIVHSATGFKQSSKALQRPV
YGFLNVIVHSATGLKQMSAALNRPV

SEQ ID NO: 29286 - protein, 25 aa, synthetic construct
  source 1..25: note = Seed: YGFLNVIVHSATGFKQSSKALQRPV
YGFLNVIVHSATGLKQMSAALPRPV

SEQ ID NO: 29287 - protein, 25 aa, synthetic construct
  source 1..25: note = Seed: YGFLNVIVHSATGFKQSSKALQRPV
YGFLNVIVHSATGLKQMSAALQRPV

SEQ ID NO: 29288 - protein, 25 aa, synthetic construct
  source 1..25: note = Seed: YGFLNVIVHSATGFKQSSKALQRPV
YGFLNVIVHSATGLKQMSAALRRPV

SEQ ID NO: 29289 - protein, 25 aa, synthetic construct
  source 1..25: note = Seed: YGFLNVIVHSATGFKQSSKALQRPV
YGFLNVIVHSATGLKQMSAALSRPV

SEQ ID NO: 29290 - protein, 25 aa, synthetic construct
  source 1..25: note = Seed: YGFLNVIVHSATGFKQSSKALQRPV
YGFLNVIVHSATGLKQMSAALTRPV

SEQ ID NO: 29291 - protein, 25 aa, synthetic construct
  source 1..25: note = Seed: YGFLNVIVHSATGFKQSSKALQRPV
YGFLNVIVHSATGLKQMSAALVRPV

SEQ ID NO: 29292 - protein, 25 aa, synthetic construct
  source 1..25: note = Seed: YGFLNVIVHSATGFKQSSKALQRPV
YGFLNVIVHSATGLKQMSFALFRPV

SEQ ID NO: 29293 - protein, 25 aa, synthetic construct
  source 1..25: note = Seed: YGFLNVIVHSATGFKQSSKALQRPV
YGFLNVIVHSATGLKQMSFALIRPV

SEQ ID NO: 29294 - protein, 25 aa, synthetic construct
  source 1..25: note = Seed: YGFLNVIVHSATGFKQSSKALQRPV
YGFLNVIVHSATGLKQMSFALLRPV

SEQ ID NO: 29295 - protein, 25 aa, synthetic construct
  source 1..25: note = Seed: YGFLNVIVHSATGFKQSSKALQRPV
YGFLNVIVHSATGLKQMSFALMRPV

SEQ ID NO: 29296 - protein, 25 aa, synthetic construct
  source 1..25: note = Seed: YGFLNVIVHSATGFKQSSKALQRPV
YGFLNVIVHSATGLKQMSFALVRPV

SEQ ID NO: 29297 - protein, 25 aa, synthetic construct
  source 1..25: note = Seed: YGFLNVIVHSATGFKQSSKALQRPV
YGFLNVIVHSATGLKQMSFALYRPV

SEQ ID NO: 29298 - protein, 25 aa, synthetic construct
  source 1..25: note = Seed: YGFLNVIVHSATGFKQSSKALQRPV
YGFLNVIVHSATGLKQMSGALARPV

SEQ ID NO: 29299 - protein, 25 aa, synthetic construct
  source 1..25: note = Seed: YGFLNVIVHSATGFKQSSKALQRPV
YGFLNVIVHSATGLKQMSGALIRPV

SEQ ID NO: 29300 - protein, 25 aa, synthetic construct
  source 1..25: note = Seed: YGFLNVIVHSATGFKQSSKALQRPV
YGFLNVIVHSATGLKQMSGALLRPV

SEQ ID NO: 29301 - protein, 25 aa, synthetic construct
  source 1..25: note = Seed: YGFLNVIVHSATGFKQSSKALQRPV
YGFLNVIVHSATGLKQMSGALMRPV

SEQ ID NO: 29302 - protein, 25 aa, synthetic construct
  source 1..25: note = Seed: YGFLNVIVHSATGFKQSSKALQRPV
YGFLNVIVHSATGLKQMSGALNRPV

SEQ ID NO: 29303 - protein, 25 aa, synthetic construct
  source 1..25: note = Seed: YGFLNVIVHSATGFKQSSKALQRPV
YGFLNVIVHSATGLKQMSGALSRPV

SEQ ID NO: 29304 - protein, 25 aa, synthetic construct
  source 1..25: note = Seed: YGFLNVIVHSATGFKQSSKALQRPV
YGFLNVIVHSATGLKQMSGALTRPV

SEQ ID NO: 29305 - protein, 25 aa, synthetic construct
  source 1..25: note = Seed: YGFLNVIVHSATGFKQSSKALQRPV
YGFLNVIVHSATGLKQMSGALVRPV

SEQ ID NO: 29306 - protein, 25 aa, synthetic construct
  source 1..25: note = Seed: YGFLNVIVHSATGFKQSSKALQRPV
YGFLNVIVHSATGLKQMSHALARPV

SEQ ID NO: 29307 - protein, 25 aa, synthetic construct
  source 1..25: note = Seed: YGFLNVIVHSATGFKQSSKALQRPV
YGFLNVIVHSATGLKQMSHALRRPV

SEQ ID NO: 29308 - protein, 25 aa, synthetic construct
  source 1..25: note = Seed: YGFLNVIVHSATGFKQSSKALQRPV
YGFLNVIVHSATGLKQMSHALSRPV

SEQ ID NO: 29309 - protein, 25 aa, synthetic construct
  source 1..25: note = Seed: YGFLNVIVHSATGFKQSSKALQRPV
YGFLNVIVHSATGLKQMSIALARPV

SEQ ID NO: 29310 - protein, 25 aa, synthetic construct
  source 1..25: note = Seed: YGFLNVIVHSATGFKQSSKALQRPV
YGFLNVIVHSATGLKQMSIALGRPV

SEQ ID NO: 29311 - protein, 25 aa, synthetic construct
  source 1..25: note = Seed: YGFLNVIVHSATGFKQSSKALQRPV
YGFLNVIVHSATGLKQMSIALHRPV

SEQ ID NO: 29312 - protein, 25 aa, synthetic construct
  source 1..25: note = Seed: YGFLNVIVHSATGFKQSSKALQRPV
YGFLNVIVHSATGLKQMSIALIRPV

SEQ ID NO: 29313 - protein, 25 aa, synthetic construct
  source 1..25: note = Seed: YGFLNVIVHSATGFKQSSKALQRPV
YGFLNVIVHSATGLKQMSIALKRPV

SEQ ID NO: 29314 - protein, 25 aa, synthetic construct
  source 1..25: note = Seed: YGFLNVIVHSATGFKQSSKALQRPV
YGFLNVIVHSATGLKQMSIALLRPV

SEQ ID NO: 29315 - protein, 25 aa, synthetic construct
  source 1..25: note = Seed: YGFLNVIVHSATGFKQSSKALQRPV
YGFLNVIVHSATGLKQMSIALMRPV

SEQ ID NO: 29316 - protein, 25 aa, synthetic construct
  source 1..25: note = Seed: YGFLNVIVHSATGFKQSSKALQRPV
YGFLNVIVHSATGLKQMSIALNRPV

SEQ ID NO: 29317 - protein, 25 aa, synthetic construct
  source 1..25: note = Seed: YGFLNVIVHSATGFKQSSKALQRPV
YGFLNVIVHSATGLKQMSIALPRPV

SEQ ID NO: 29318 - protein, 25 aa, synthetic construct
  source 1..25: note = Seed: YGFLNVIVHSATGFKQSSKALQRPV
YGFLNVIVHSATGLKQMSIALQRPV

SEQ ID NO: 29319 - protein, 25 aa, synthetic construct
  source 1..25: note = Seed: YGFLNVIVHSATGFKQSSKALQRPV
YGFLNVIVHSATGLKQMSIALRRPV

SEQ ID NO: 29320 - protein, 25 aa, synthetic construct
  source 1..25: note = Seed: YGFLNVIVHSATGFKQSSKALQRPV
YGFLNVIVHSATGLKQMSIALSRPV

SEQ ID NO: 29321 - protein, 25 aa, synthetic construct
  source 1..25: note = Seed: YGFLNVIVHSATGFKQSSKALQRPV
YGFLNVIVHSATGLKQMSIALTRPV

SEQ ID NO: 29322 - protein, 25 aa, synthetic construct
  source 1..25: note = Seed: YGFLNVIVHSATGFKQSSKALQRPV
YGFLNVIVHSATGLKQMSIALVRPV

SEQ ID NO: 29323 - protein, 25 aa, synthetic construct
  source 1..25: note = Seed: YGFLNVIVHSATGFKQSSKALQRPV
YGFLNVIVHSATGLKQMSKALARPV

SEQ ID NO: 29324 - protein, 25 aa, synthetic construct
  source 1..25: note = Seed: YGFLNVIVHSATGFKQSSKALQRPV
YGFLNVIVHSATGLKQMSKALCRPV

SEQ ID NO: 29325 - protein, 25 aa, synthetic construct
  source 1..25: note = Seed: YGFLNVIVHSATGFKQSSKALQRPV
YGFLNVIVHSATGLKQMSKALFRPV

SEQ ID NO: 29326 - protein, 25 aa, synthetic construct
  source 1..25: note = Seed: YGFLNVIVHSATGFKQSSKALQRPV
YGFLNVIVHSATGLKQMSKALGRPV

SEQ ID NO: 29327 - protein, 25 aa, synthetic construct
  source 1..25: note = Seed: YGFLNVIVHSATGFKQSSKALQRPV
YGFLNVIVHSATGLKQMSKALHRPV

SEQ ID NO: 29328 - protein, 25 aa, synthetic construct
  source 1..25: note = Seed: YGFLNVIVHSATGFKQSSKALQRPV
YGFLNVIVHSATGLKQMSKALIRPV

SEQ ID NO: 29329 - protein, 25 aa, synthetic construct
  source 1..25: note = Seed: YGFLNVIVHSATGFKQSSKALQRPV
YGFLNVIVHSATGLKQMSKALKRPV

SEQ ID NO: 29330 - protein, 25 aa, synthetic construct
  source 1..25: note = Seed: YGFLNVIVHSATGFKQSSKALQRPV
YGFLNVIVHSATGLKQMSKALLRPV

SEQ ID NO: 29331 - protein, 25 aa, synthetic construct
  source 1..25: note = Seed: YGFLNVIVHSATGFKQSSKALQRPV
YGFLNVIVHSATGLKQMSKALMRPV

SEQ ID NO: 29332 - protein, 25 aa, synthetic construct
  source 1..25: note = Seed: YGFLNVIVHSATGFKQSSKALQRPV
YGFLNVIVHSATGLKQMSKALNRPV

SEQ ID NO: 29333 - protein, 25 aa, synthetic construct
  source 1..25: note = Seed: YGFLNVIVHSATGFKQSSKALQRPV
YGFLNVIVHSATGLKQMSKALPRPV

SEQ ID NO: 29334 - protein, 25 aa, synthetic construct
  source 1..25: note = Seed: YGFLNVIVHSATGFKQSSKALQRPV
YGFLNVIVHSATGLKQMSKALQRPV

SEQ ID NO: 29335 - protein, 25 aa, synthetic construct
  source 1..25: note = Seed: YGFLNVIVHSATGFKQSSKALQRPV
YGFLNVIVHSATGLKQMSKALRRPV

SEQ ID NO: 29336 - protein, 25 aa, synthetic construct
  source 1..25: note = Seed: YGFLNVIVHSATGFKQSSKALQRPV
YGFLNVIVHSATGLKQMSKALSRPV

SEQ ID NO: 29337 - protein, 25 aa, synthetic construct
  source 1..25: note = Seed: YGFLNVIVHSATGFKQSSKALQRPV
YGFLNVIVHSATGLKQMSKALTRPV

SEQ ID NO: 29338 - protein, 25 aa, synthetic construct
  source 1..25: note = Seed: YGFLNVIVHSATGFKQSSKALQRPV
YGFLNVIVHSATGLKQMSKALVRPV

SEQ ID NO: 29339 - protein, 25 aa, synthetic construct
  source 1..25: note = Seed: YGFLNVIVHSATGFKQSSKALQRPV
YGFLNVIVHSATGLKQMSKALYRPV

SEQ ID NO: 29340 - protein, 25 aa, synthetic construct
  source 1..25: note = Seed: YGFLNVIVHSATGFKQSSKALQRPV
YGFLNVIVHSATGLKQMSLALARPV

SEQ ID NO: 29341 - protein, 25 aa, synthetic construct
  source 1..25: note = Seed: YGFLNVIVHSATGFKQSSKALQRPV
YGFLNVIVHSATGLKQMSLALFRPV

SEQ ID NO: 29342 - protein, 25 aa, synthetic construct
  source 1..25: note = Seed: YGFLNVIVHSATGFKQSSKALQRPV
YGFLNVIVHSATGLKQMSLALHRPV

SEQ ID NO: 29343 - protein, 25 aa, synthetic construct
  source 1..25: note = Seed: YGFLNVIVHSATGFKQSSKALQRPV
YGFLNVIVHSATGLKQMSLALKRPV

SEQ ID NO: 29344 - protein, 25 aa, synthetic construct
  source 1..25: note = Seed: YGFLNVIVHSATGFKQSSKALQRPV
YGFLNVIVHSATGLKQMSLALNRPV

SEQ ID NO: 29345 - protein, 25 aa, synthetic construct
  source 1..25: note = Seed: YGFLNVIVHSATGFKQSSKALQRPV
YGFLNVIVHSATGLKQMSLALRRPV

SEQ ID NO: 29346 - protein, 25 aa, synthetic construct
  source 1..25: note = Seed: YGFLNVIVHSATGFKQSSKALQRPV
YGFLNVIVHSATGLKQMSLALSRPV

SEQ ID NO: 29347 - protein, 25 aa, synthetic construct
  source 1..25: note = Seed: YGFLNVIVHSATGFKQSSKALQRPV
YGFLNVIVHSATGLKQMSLALTRPV

SEQ ID NO: 29348 - protein, 25 aa, synthetic construct
  source 1..25: note = Seed: YGFLNVIVHSATGFKQSSKALQRPV
YGFLNVIVHSATGLKQMSMALARPV

SEQ ID NO: 29349 - protein, 25 aa, synthetic construct
  source 1..25: note = Seed: YGFLNVIVHSATGFKQSSKALQRPV
YGFLNVIVHSATGLKQMSMALIRPV

SEQ ID NO: 29350 - protein, 25 aa, synthetic construct
  source 1..25: note = Seed: YGFLNVIVHSATGFKQSSKALQRPV
YGFLNVIVHSATGLKQMSMALNRPV

SEQ ID NO: 29351 - protein, 25 aa, synthetic construct
  source 1..25: note = Seed: YGFLNVIVHSATGFKQSSKALQRPV
YGFLNVIVHSATGLKQMSMALRRPV

SEQ ID NO: 29352 - protein, 25 aa, synthetic construct
  source 1..25: note = Seed: YGFLNVIVHSATGFKQSSKALQRPV
YGFLNVIVHSATGLKQMSMALSRPV

SEQ ID NO: 29353 - protein, 25 aa, synthetic construct
  source 1..25: note = Seed: YGFLNVIVHSATGFKQSSKALQRPV
YGFLNVIVHSATGLKQMSMALTRPV

SEQ ID NO: 29354 - protein, 25 aa, synthetic construct
  source 1..25: note = Seed: YGFLNVIVHSATGFKQSSKALQRPV
YGFLNVIVHSATGLKQMSMALVRPV

SEQ ID NO: 29355 - protein, 25 aa, synthetic construct
  source 1..25: note = Seed: YGFLNVIVHSATGFKQSSKALQRPV
YGFLNVIVHSATGLKQMSNALARPV

SEQ ID NO: 29356 - protein, 25 aa, synthetic construct
  source 1..25: note = Seed: YGFLNVIVHSATGFKQSSKALQRPV
YGFLNVIVHSATGLKQMSNALMRPV

SEQ ID NO: 29357 - protein, 25 aa, synthetic construct
  source 1..25: note = Seed: YGFLNVIVHSATGFKQSSKALQRPV
YGFLNVIVHSATGLKQMSNALNRPV

SEQ ID NO: 29358 - protein, 25 aa, synthetic construct
  source 1..25: note = Seed: YGFLNVIVHSATGFKQSSKALQRPV
YGFLNVIVHSATGLKQMSNALSRPV

SEQ ID NO: 29359 - protein, 25 aa, synthetic construct
  source 1..25: note = Seed: YGFLNVIVHSATGFKQSSKALQRPV
YGFLNVIVHSATGLKQMSNALTRPV

SEQ ID NO: 29360 - protein, 25 aa, synthetic construct
  source 1..25: note = Seed: YGFLNVIVHSATGFKQSSKALQRPV
YGFLNVIVHSATGLKQMSNALVRPV

SEQ ID NO: 29361 - protein, 25 aa, synthetic construct
  source 1..25: note = Seed: YGFLNVIVHSATGFKQSSKALQRPV
YGFLNVIVHSATGLKQMSPALARPV

SEQ ID NO: 29362 - protein, 25 aa, synthetic construct
  source 1..25: note = Seed: YGFLNVIVHSATGFKQSSKALQRPV
YGFLNVIVHSATGLKQMSPALCRPV

SEQ ID NO: 29363 - protein, 25 aa, synthetic construct
  source 1..25: note = Seed: YGFLNVIVHSATGFKQSSKALQRPV
YGFLNVIVHSATGLKQMSPALDRPV

SEQ ID NO: 29364 - protein, 25 aa, synthetic construct
  source 1..25: note = Seed: YGFLNVIVHSATGFKQSSKALQRPV
YGFLNVIVHSATGLKQMSPALERPV

SEQ ID NO: 29365 - protein, 25 aa, synthetic construct
  source 1..25: note = Seed: YGFLNVIVHSATGFKQSSKALQRPV
YGFLNVIVHSATGLKQMSPALGRPV

SEQ ID NO: 29366 - protein, 25 aa, synthetic construct
  source 1..25: note = Seed: YGFLNVIVHSATGFKQSSKALQRPV
YGFLNVIVHSATGLKQMSPALHRPV

SEQ ID NO: 29367 - protein, 25 aa, synthetic construct
  source 1..25: note = Seed: YGFLNVIVHSATGFKQSSKALQRPV
YGFLNVIVHSATGLKQMSPALIRPV

SEQ ID NO: 29368 - protein, 25 aa, synthetic construct
  source 1..25: note = Seed: YGFLNVIVHSATGFKQSSKALQRPV
YGFLNVIVHSATGLKQMSPALLRPV

SEQ ID NO: 29369 - protein, 25 aa, synthetic construct
  source 1..25: note = Seed: YGFLNVIVHSATGFKQSSKALQRPV
YGFLNVIVHSATGLKQMSPALMRPV

SEQ ID NO: 29370 - protein, 25 aa, synthetic construct
  source 1..25: note = Seed: YGFLNVIVHSATGFKQSSKALQRPV
YGFLNVIVHSATGLKQMSPALNRPV

SEQ ID NO: 29371 - protein, 25 aa, synthetic construct
  source 1..25: note = Seed: YGFLNVIVHSATGFKQSSKALQRPV
YGFLNVIVHSATGLKQMSPALPRPV

SEQ ID NO: 29372 - protein, 25 aa, synthetic construct
  source 1..25: note = Seed: YGFLNVIVHSATGFKQSSKALQRPV
YGFLNVIVHSATGLKQMSPALQRPV

SEQ ID NO: 29373 - protein, 25 aa, synthetic construct
  source 1..25: note = Seed: YGFLNVIVHSATGFKQSSKALQRPV
YGFLNVIVHSATGLKQMSPALSRPV

SEQ ID NO: 29374 - protein, 25 aa, synthetic construct
  source 1..25: note = Seed: YGFLNVIVHSATGFKQSSKALQRPV
YGFLNVIVHSATGLKQMSPALTRPV

SEQ ID NO: 29375 - protein, 25 aa, synthetic construct
  source 1..25: note = Seed: YGFLNVIVHSATGFKQSSKALQRPV
YGFLNVIVHSATGLKQMSPALVRPV

SEQ ID NO: 29376 - protein, 25 aa, synthetic construct
  source 1..25: note = Seed: YGFLNVIVHSATGFKQSSKALQRPV
YGFLNVIVHSATGLKQMSRALARPV

SEQ ID NO: 29377 - protein, 25 aa, synthetic construct
  source 1..25: note = Seed: YGFLNVIVHSATGFKQSSKALQRPV
YGFLNVIVHSATGLKQMSRALCRPV

SEQ ID NO: 29378 - protein, 25 aa, synthetic construct
  source 1..25: note = Seed: YGFLNVIVHSATGFKQSSKALQRPV
YGFLNVIVHSATGLKQMSRALERPV

SEQ ID NO: 29379 - protein, 25 aa, synthetic construct
  source 1..25: note = Seed: YGFLNVIVHSATGFKQSSKALQRPV
YGFLNVIVHSATGLKQMSRALFRPV

SEQ ID NO: 29380 - protein, 25 aa, synthetic construct
  source 1..25: note = Seed: YGFLNVIVHSATGFKQSSKALQRPV
YGFLNVIVHSATGLKQMSRALGRPV

SEQ ID NO: 29381 - protein, 25 aa, synthetic construct
  source 1..25: note = Seed: YGFLNVIVHSATGFKQSSKALQRPV
YGFLNVIVHSATGLKQMSRALHRPV

SEQ ID NO: 29382 - protein, 25 aa, synthetic construct
  source 1..25: note = Seed: YGFLNVIVHSATGFKQSSKALQRPV
YGFLNVIVHSATGLKQMSRALIRPV

SEQ ID NO: 29383 - protein, 25 aa, synthetic construct
  source 1..25: note = Seed: YGFLNVIVHSATGFKQSSKALQRPV
YGFLNVIVHSATGLKQMSRALKRPV

SEQ ID NO: 29384 - protein, 25 aa, synthetic construct
  source 1..25: note = Seed: YGFLNVIVHSATGFKQSSKALQRPV
YGFLNVIVHSATGLKQMSRALLRPV

SEQ ID NO: 29385 - protein, 25 aa, synthetic construct
  source 1..25: note = Seed: YGFLNVIVHSATGFKQSSKALQRPV
YGFLNVIVHSATGLKQMSRALMRPV

SEQ ID NO: 29386 - protein, 25 aa, synthetic construct
  source 1..25: note = Seed: YGFLNVIVHSATGFKQSSKALQRPV
YGFLNVIVHSATGLKQMSRALNRPV

SEQ ID NO: 29387 - protein, 25 aa, synthetic construct
  source 1..25: note = Seed: YGFLNVIVHSATGFKQSSKALQRPV
YGFLNVIVHSATGLKQMSRALPRPV

SEQ ID NO: 29388 - protein, 25 aa, synthetic construct
  source 1..25: note = Seed: YGFLNVIVHSATGFKQSSKALQRPV
YGFLNVIVHSATGLKQMSRALQRPV

SEQ ID NO: 29389 - protein, 25 aa, synthetic construct
  source 1..25: note = Seed: YGFLNVIVHSATGFKQSSKALQRPV
YGFLNVIVHSATGLKQMSRALRRPV

SEQ ID NO: 29390 - protein, 25 aa, synthetic construct
  source 1..25: note = Seed: YGFLNVIVHSATGFKQSSKALQRPV
YGFLNVIVHSATGLKQMSRALSRPV

SEQ ID NO: 29391 - protein, 25 aa, synthetic construct
  source 1..25: note = Seed: YGFLNVIVHSATGFKQSSKALQRPV
YGFLNVIVHSATGLKQMSRALTRPV

SEQ ID NO: 29392 - protein, 25 aa, synthetic construct
  source 1..25: note = Seed: YGFLNVIVHSATGFKQSSKALQRPV
YGFLNVIVHSATGLKQMSRALVRPV

SEQ ID NO: 29393 - protein, 25 aa, synthetic construct
  source 1..25: note = Seed: YGFLNVIVHSATGFKQSSKALQRPV
YGFLNVIVHSATGLKQMSRALWRPV

SEQ ID NO: 29394 - protein, 25 aa, synthetic construct
  source 1..25: note = Seed: YGFLNVIVHSATGFKQSSKALQRPV
YGFLNVIVHSATGLKQMSRALYRPV

SEQ ID NO: 29395 - protein, 25 aa, synthetic construct
  source 1..25: note = Seed: YGFLNVIVHSATGFKQSSKALQRPV
YGFLNVIVHSATGLKQMSSALARPV

SEQ ID NO: 29396 - protein, 25 aa, synthetic construct
  source 1..25: note = Seed: YGFLNVIVHSATGFKQSSKALQRPV
YGFLNVIVHSATGLKQMSSALGRPV

SEQ ID NO: 29397 - protein, 25 aa, synthetic construct
  source 1..25: note = Seed: YGFLNVIVHSATGFKQSSKALQRPV
YGFLNVIVHSATGLKQMSSALHRPV

SEQ ID NO: 29398 - protein, 25 aa, synthetic construct
  source 1..25: note = Seed: YGFLNVIVHSATGFKQSSKALQRPV
YGFLNVIVHSATGLKQMSSALIRPV

SEQ ID NO: 29399 - protein, 25 aa, synthetic construct
  source 1..25: note = Seed: YGFLNVIVHSATGFKQSSKALQRPV
YGFLNVIVHSATGLKQMSSALLRPV

SEQ ID NO: 29400 - protein, 25 aa, synthetic construct
  source 1..25: note = Seed: YGFLNVIVHSATGFKQSSKALQRPV
YGFLNVIVHSATGLKQMSSALMRPV

SEQ ID NO: 29401 - protein, 25 aa, synthetic construct
  source 1..25: note = Seed: YGFLNVIVHSATGFKQSSKALQRPV
YGFLNVIVHSATGLKQMSSALNRPV

SEQ ID NO: 29402 - protein, 25 aa, synthetic construct
  source 1..25: note = Seed: YGFLNVIVHSATGFKQSSKALQRPV
YGFLNVIVHSATGLKQMSSALQRPV

SEQ ID NO: 29403 - protein, 25 aa, synthetic construct
  source 1..25: note = Seed: YGFLNVIVHSATGFKQSSKALQRPV
YGFLNVIVHSATGLKQMSSALSRPV

SEQ ID NO: 29404 - protein, 25 aa, synthetic construct
  source 1..25: note = Seed: YGFLNVIVHSATGFKQSSKALQRPV
YGFLNVIVHSATGLKQMSSALTRPV

SEQ ID NO: 29405 - protein, 25 aa, synthetic construct
  source 1..25: note = Seed: YGFLNVIVHSATGFKQSSKALQRPV
YGFLNVIVHSATGLKQMSSALVRPV

SEQ ID NO: 29406 - protein, 25 aa, synthetic construct
  source 1..25: note = Seed: YGFLNVIVHSATGFKQSSKALQRPV
YGFLNVIVHSATGLKQMSTALARPV

SEQ ID NO: 29407 - protein, 25 aa, synthetic construct
  source 1..25: note = Seed: YGFLNVIVHSATGFKQSSKALQRPV
YGFLNVIVHSATGLKQMSTALGRPV

SEQ ID NO: 29408 - protein, 25 aa, synthetic construct
  source 1..25: note = Seed: YGFLNVIVHSATGFKQSSKALQRPV
YGFLNVIVHSATGLKQMSTALHRPV

SEQ ID NO: 29409 - protein, 25 aa, synthetic construct
  source 1..25: note = Seed: YGFLNVIVHSATGFKQSSKALQRPV
YGFLNVIVHSATGLKQMSTALIRPV

SEQ ID NO: 29410 - protein, 25 aa, synthetic construct
  source 1..25: note = Seed: YGFLNVIVHSATGFKQSSKALQRPV
YGFLNVIVHSATGLKQMSTALLRPV

SEQ ID NO: 29411 - protein, 25 aa, synthetic construct
  source 1..25: note = Seed: YGFLNVIVHSATGFKQSSKALQRPV
YGFLNVIVHSATGLKQMSTALMRPV

SEQ ID NO: 29412 - protein, 25 aa, synthetic construct
  source 1..25: note = Seed: YGFLNVIVHSATGFKQSSKALQRPV
YGFLNVIVHSATGLKQMSTALNRPV

SEQ ID NO: 29413 - protein, 25 aa, synthetic construct
  source 1..25: note = Seed: YGFLNVIVHSATGFKQSSKALQRPV
YGFLNVIVHSATGLKQMSTALQRPV

SEQ ID NO: 29414 - protein, 25 aa, synthetic construct
  source 1..25: note = Seed: YGFLNVIVHSATGFKQSSKALQRPV
YGFLNVIVHSATGLKQMSTALSRPV

SEQ ID NO: 29415 - protein, 25 aa, synthetic construct
  source 1..25: note = Seed: YGFLNVIVHSATGFKQSSKALQRPV
YGFLNVIVHSATGLKQMSTALTRPV

SEQ ID NO: 29416 - protein, 25 aa, synthetic construct
  source 1..25: note = Seed: YGFLNVIVHSATGFKQSSKALQRPV
YGFLNVIVHSATGLKQMSTALVRPV

SEQ ID NO: 29417 - protein, 25 aa, synthetic construct
  source 1..25: note = Seed: YGFLNVIVHSATGFKQSSKALQRPV
YGFLNVIVHSATGLKQMSVALARPV

SEQ ID NO: 29418 - protein, 25 aa, synthetic construct
  source 1..25: note = Seed: YGFLNVIVHSATGFKQSSKALQRPV
YGFLNVIVHSATGLKQMSVALDRPV

SEQ ID NO: 29419 - protein, 25 aa, synthetic construct
  source 1..25: note = Seed: YGFLNVIVHSATGFKQSSKALQRPV
YGFLNVIVHSATGLKQMSVALERPV

SEQ ID NO: 29420 - protein, 25 aa, synthetic construct
  source 1..25: note = Seed: YGFLNVIVHSATGFKQSSKALQRPV
YGFLNVIVHSATGLKQMSVALGRPV

SEQ ID NO: 29421 - protein, 25 aa, synthetic construct
  source 1..25: note = Seed: YGFLNVIVHSATGFKQSSKALQRPV
YGFLNVIVHSATGLKQMSVALHRPV

SEQ ID NO: 29422 - protein, 25 aa, synthetic construct
  source 1..25: note = Seed: YGFLNVIVHSATGFKQSSKALQRPV
YGFLNVIVHSATGLKQMSVALIRPV

SEQ ID NO: 29423 - protein, 25 aa, synthetic construct
  source 1..25: note = Seed: YGFLNVIVHSATGFKQSSKALQRPV
YGFLNVIVHSATGLKQMSVALKRPV

SEQ ID NO: 29424 - protein, 25 aa, synthetic construct
  source 1..25: note = Seed: YGFLNVIVHSATGFKQSSKALQRPV
YGFLNVIVHSATGLKQMSVALLRPV

SEQ ID NO: 29425 - protein, 25 aa, synthetic construct
  source 1..25: note = Seed: YGFLNVIVHSATGFKQSSKALQRPV
YGFLNVIVHSATGLKQMSVALMRPV

SEQ ID NO: 29426 - protein, 25 aa, synthetic construct
  source 1..25: note = Seed: YGFLNVIVHSATGFKQSSKALQRPV
YGFLNVIVHSATGLKQMSVALNRPV

SEQ ID NO: 29427 - protein, 25 aa, synthetic construct
  source 1..25: note = Seed: YGFLNVIVHSATGFKQSSKALQRPV
YGFLNVIVHSATGLKQMSVALPRPV

SEQ ID NO: 29428 - protein, 25 aa, synthetic construct
  source 1..25: note = Seed: YGFLNVIVHSATGFKQSSKALQRPV
YGFLNVIVHSATGLKQMSVALQRPV

SEQ ID NO: 29429 - protein, 25 aa, synthetic construct
  source 1..25: note = Seed: YGFLNVIVHSATGFKQSSKALQRPV
YGFLNVIVHSATGLKQMSVALRRPV

SEQ ID NO: 29430 - protein, 25 aa, synthetic construct
  source 1..25: note = Seed: YGFLNVIVHSATGFKQSSKALQRPV
YGFLNVIVHSATGLKQMSVALSRPV

SEQ ID NO: 29431 - protein, 25 aa, synthetic construct
  source 1..25: note = Seed: YGFLNVIVHSATGFKQSSKALQRPV
YGFLNVIVHSATGLKQMSVALTRPV

SEQ ID NO: 29432 - protein, 25 aa, synthetic construct
  source 1..25: note = Seed: YGFLNVIVHSATGFKQSSKALQRPV
YGFLNVIVHSATGLKQMSVALVRPV

SEQ ID NO: 29433 - protein, 25 aa, synthetic construct
  source 1..25: note = Seed: YGFLNVIVHSATGFKQSSKALQRPV
YGFLNVIVHSATGLKQMSWALFRPV

SEQ ID NO: 29434 - protein, 25 aa, synthetic construct
  source 1..25: note = Seed: YGFLNVIVHSATGFKQSSKALQRPV
YGFLNVIVHSATGLKQMSWALRRPV

SEQ ID NO: 29435 - protein, 25 aa, synthetic construct
  source 1..25: note = Seed: YGFLNVIVHSATGFKQSSKALQRPV
YGFLNVIVHSATGLKQMSYALARPV

SEQ ID NO: 29436 - protein, 25 aa, synthetic construct
  source 1..25: note = Seed: YGFLNVIVHSATGFKQSSKALQRPV
YGFLNVIVHSATGLKQMSYALFRPV

SEQ ID NO: 29437 - protein, 25 aa, synthetic construct
  source 1..25: note = Seed: YGFLNVIVHSATGFKQSSKALQRPV
YGFLNVIVHSATGLKQMSYALLRPV

SEQ ID NO: 29438 - protein, 25 aa, synthetic construct
  source 1..25: note = Seed: YGFLNVIVHSATGFKQSSKALQRPV
YGFLNVIVHSATGLKQNSAALARPV

SEQ ID NO: 29439 - protein, 25 aa, synthetic construct
  source 1..25: note = Seed: YGFLNVIVHSATGFKQSSKALQRPV
YGFLNVIVHSATGLKQNSAALFRPV

SEQ ID NO: 29440 - protein, 25 aa, synthetic construct
  source 1..25: note = Seed: YGFLNVIVHSATGFKQSSKALQRPV
YGFLNVIVHSATGLKQNSAALGRPV

SEQ ID NO: 29441 - protein, 25 aa, synthetic construct
  source 1..25: note = Seed: YGFLNVIVHSATGFKQSSKALQRPV
YGFLNVIVHSATGLKQNSAALHRPV

SEQ ID NO: 29442 - protein, 25 aa, synthetic construct
  source 1..25: note = Seed: YGFLNVIVHSATGFKQSSKALQRPV
YGFLNVIVHSATGLKQNSAALIRPV

SEQ ID NO: 29443 - protein, 25 aa, synthetic construct
  source 1..25: note = Seed: YGFLNVIVHSATGFKQSSKALQRPV
YGFLNVIVHSATGLKQNSAALLRPV

SEQ ID NO: 29444 - protein, 25 aa, synthetic construct
  source 1..25: note = Seed: YGFLNVIVHSATGFKQSSKALQRPV
YGFLNVIVHSATGLKQNSAALMRPV

SEQ ID NO: 29445 - protein, 25 aa, synthetic construct
  source 1..25: note = Seed: YGFLNVIVHSATGFKQSSKALQRPV
YGFLNVIVHSATGLKQNSAALNRPV

SEQ ID NO: 29446 - protein, 25 aa, synthetic construct
  source 1..25: note = Seed: YGFLNVIVHSATGFKQSSKALQRPV
YGFLNVIVHSATGLKQNSAALQRPV

SEQ ID NO: 29447 - protein, 25 aa, synthetic construct
  source 1..25: note = Seed: YGFLNVIVHSATGFKQSSKALQRPV
YGFLNVIVHSATGLKQNSAALSRPV

SEQ ID NO: 29448 - protein, 25 aa, synthetic construct
  source 1..25: note = Seed: YGFLNVIVHSATGFKQSSKALQRPV
YGFLNVIVHSATGLKQNSAALTRPV

SEQ ID NO: 29449 - protein, 25 aa, synthetic construct
  source 1..25: note = Seed: YGFLNVIVHSATGFKQSSKALQRPV
YGFLNVIVHSATGLKQNSAALVRPV

SEQ ID NO: 29450 - protein, 25 aa, synthetic construct
  source 1..25: note = Seed: YGFLNVIVHSATGFKQSSKALQRPV
YGFLNVIVHSATGLKQNSAALWRPV

SEQ ID NO: 29451 - protein, 25 aa, synthetic construct
  source 1..25: note = Seed: YGFLNVIVHSATGFKQSSKALQRPV
YGFLNVIVHSATGLKQNSAALYRPV

SEQ ID NO: 29452 - protein, 25 aa, synthetic construct
  source 1..25: note = Seed: YGFLNVIVHSATGFKQSSKALQRPV
YGFLNVIVHSATGLKQNSCALIRPV

SEQ ID NO: 29453 - protein, 25 aa, synthetic construct
  source 1..25: note = Seed: YGFLNVIVHSATGFKQSSKALQRPV
YGFLNVIVHSATGLKQNSCALVRPV

SEQ ID NO: 29454 - protein, 25 aa, synthetic construct
  source 1..25: note = Seed: YGFLNVIVHSATGFKQSSKALQRPV
YGFLNVIVHSATGLKQNSDALIRPV

SEQ ID NO: 29455 - protein, 25 aa, synthetic construct
  source 1..25: note = Seed: YGFLNVIVHSATGFKQSSKALQRPV
YGFLNVIVHSATGLKQNSDALVRPV

SEQ ID NO: 29456 - protein, 25 aa, synthetic construct
  source 1..25: note = Seed: YGFLNVIVHSATGFKQSSKALQRPV
YGFLNVIVHSATGLKQNSEALIRPV

SEQ ID NO: 29457 - protein, 25 aa, synthetic construct
  source 1..25: note = Seed: YGFLNVIVHSATGFKQSSKALQRPV
YGFLNVIVHSATGLKQNSEALVRPV

SEQ ID NO: 29458 - protein, 25 aa, synthetic construct
  source 1..25: note = Seed: YGFLNVIVHSATGFKQSSKALQRPV
YGFLNVIVHSATGLKQNSGALARPV

SEQ ID NO: 29459 - protein, 25 aa, synthetic construct
  source 1..25: note = Seed: YGFLNVIVHSATGFKQSSKALQRPV
YGFLNVIVHSATGLKQNSGALFRPV

SEQ ID NO: 29460 - protein, 25 aa, synthetic construct
  source 1..25: note = Seed: YGFLNVIVHSATGFKQSSKALQRPV
YGFLNVIVHSATGLKQNSGALIRPV

SEQ ID NO: 29461 - protein, 25 aa, synthetic construct
  source 1..25: note = Seed: YGFLNVIVHSATGFKQSSKALQRPV
YGFLNVIVHSATGLKQNSGALLRPV

SEQ ID NO: 29462 - protein, 25 aa, synthetic construct
  source 1..25: note = Seed: YGFLNVIVHSATGFKQSSKALQRPV
YGFLNVIVHSATGLKQNSGALMRPV

SEQ ID NO: 29463 - protein, 25 aa, synthetic construct
  source 1..25: note = Seed: YGFLNVIVHSATGFKQSSKALQRPV
YGFLNVIVHSATGLKQNSGALSRPV

SEQ ID NO: 29464 - protein, 25 aa, synthetic construct
  source 1..25: note = Seed: YGFLNVIVHSATGFKQSSKALQRPV
YGFLNVIVHSATGLKQNSGALTRPV

SEQ ID NO: 29465 - protein, 25 aa, synthetic construct
  source 1..25: note = Seed: YGFLNVIVHSATGFKQSSKALQRPV
YGFLNVIVHSATGLKQNSGALVRPV

SEQ ID NO: 29466 - protein, 25 aa, synthetic construct
  source 1..25: note = Seed: YGFLNVIVHSATGFKQSSKALQRPV
YGFLNVIVHSATGLKQNSGALYRPV

SEQ ID NO: 29467 - protein, 25 aa, synthetic construct
  source 1..25: note = Seed: YGFLNVIVHSATGFKQSSKALQRPV
YGFLNVIVHSATGLKQNSHALFRPV

SEQ ID NO: 29468 - protein, 25 aa, synthetic construct
  source 1..25: note = Seed: YGFLNVIVHSATGFKQSSKALQRPV
YGFLNVIVHSATGLKQNSHALIRPV

SEQ ID NO: 29469 - protein, 25 aa, synthetic construct
  source 1..25: note = Seed: YGFLNVIVHSATGFKQSSKALQRPV
YGFLNVIVHSATGLKQNSHALLRPV

SEQ ID NO: 29470 - protein, 25 aa, synthetic construct
  source 1..25: note = Seed: YGFLNVIVHSATGFKQSSKALQRPV
YGFLNVIVHSATGLKQNSHALVRPV

SEQ ID NO: 29471 - protein, 25 aa, synthetic construct
  source 1..25: note = Seed: YGFLNVIVHSATGFKQSSKALQRPV
YGFLNVIVHSATGLKQNSHALYRPV

SEQ ID NO: 29472 - protein, 25 aa, synthetic construct
  source 1..25: note = Seed: YGFLNVIVHSATGFKQSSKALQRPV
YGFLNVIVHSATGLKQNSIALARPV

SEQ ID NO: 29473 - protein, 25 aa, synthetic construct
  source 1..25: note = Seed: YGFLNVIVHSATGFKQSSKALQRPV
YGFLNVIVHSATGLKQNSIALFRPV

SEQ ID NO: 29474 - protein, 25 aa, synthetic construct
  source 1..25: note = Seed: YGFLNVIVHSATGFKQSSKALQRPV
YGFLNVIVHSATGLKQNSIALIRPV

SEQ ID NO: 29475 - protein, 25 aa, synthetic construct
  source 1..25: note = Seed: YGFLNVIVHSATGFKQSSKALQRPV
YGFLNVIVHSATGLKQNSIALLRPV

SEQ ID NO: 29476 - protein, 25 aa, synthetic construct
  source 1..25: note = Seed: YGFLNVIVHSATGFKQSSKALQRPV
YGFLNVIVHSATGLKQNSIALMRPV

SEQ ID NO: 29477 - protein, 25 aa, synthetic construct
  source 1..25: note = Seed: YGFLNVIVHSATGFKQSSKALQRPV
YGFLNVIVHSATGLKQNSIALSRPV

SEQ ID NO: 29478 - protein, 25 aa, synthetic construct
  source 1..25: note = Seed: YGFLNVIVHSATGFKQSSKALQRPV
YGFLNVIVHSATGLKQNSIALTRPV

SEQ ID NO: 29479 - protein, 25 aa, synthetic construct
  source 1..25: note = Seed: YGFLNVIVHSATGFKQSSKALQRPV
YGFLNVIVHSATGLKQNSIALVRPV

SEQ ID NO: 29480 - protein, 25 aa, synthetic construct
  source 1..25: note = Seed: YGFLNVIVHSATGFKQSSKALQRPV
YGFLNVIVHSATGLKQNSIALWRPV

SEQ ID NO: 29481 - protein, 25 aa, synthetic construct
  source 1..25: note = Seed: YGFLNVIVHSATGFKQSSKALQRPV
YGFLNVIVHSATGLKQNSIALYRPV

SEQ ID NO: 29482 - protein, 25 aa, synthetic construct
  source 1..25: note = Seed: YGFLNVIVHSATGFKQSSKALQRPV
YGFLNVIVHSATGLKQNSKALIRPV

SEQ ID NO: 29483 - protein, 25 aa, synthetic construct
  source 1..25: note = Seed: YGFLNVIVHSATGFKQSSKALQRPV
YGFLNVIVHSATGLKQNSKALVRPV

SEQ ID NO: 29484 - protein, 25 aa, synthetic construct
  source 1..25: note = Seed: YGFLNVIVHSATGFKQSSKALQRPV
YGFLNVIVHSATGLKQNSLALARPV

SEQ ID NO: 29485 - protein, 25 aa, synthetic construct
  source 1..25: note = Seed: YGFLNVIVHSATGFKQSSKALQRPV
YGFLNVIVHSATGLKQNSLALFRPV

SEQ ID NO: 29486 - protein, 25 aa, synthetic construct
  source 1..25: note = Seed: YGFLNVIVHSATGFKQSSKALQRPV
YGFLNVIVHSATGLKQNSLALIRPV

SEQ ID NO: 29487 - protein, 25 aa, synthetic construct
  source 1..25: note = Seed: YGFLNVIVHSATGFKQSSKALQRPV
YGFLNVIVHSATGLKQNSLALLRPV

SEQ ID NO: 29488 - protein, 25 aa, synthetic construct
  source 1..25: note = Seed: YGFLNVIVHSATGFKQSSKALQRPV
YGFLNVIVHSATGLKQNSLALMRPV

SEQ ID NO: 29489 - protein, 25 aa, synthetic construct
  source 1..25: note = Seed: YGFLNVIVHSATGFKQSSKALQRPV
YGFLNVIVHSATGLKQNSLALVRPV

SEQ ID NO: 29490 - protein, 25 aa, synthetic construct
  source 1..25: note = Seed: YGFLNVIVHSATGFKQSSKALQRPV
YGFLNVIVHSATGLKQNSLALYRPV

SEQ ID NO: 29491 - protein, 25 aa, synthetic construct
  source 1..25: note = Seed: YGFLNVIVHSATGFKQSSKALQRPV
YGFLNVIVHSATGLKQNSMALARPV

SEQ ID NO: 29492 - protein, 25 aa, synthetic construct
  source 1..25: note = Seed: YGFLNVIVHSATGFKQSSKALQRPV
YGFLNVIVHSATGLKQNSMALFRPV

SEQ ID NO: 29493 - protein, 25 aa, synthetic construct
  source 1..25: note = Seed: YGFLNVIVHSATGFKQSSKALQRPV
YGFLNVIVHSATGLKQNSMALIRPV

SEQ ID NO: 29494 - protein, 25 aa, synthetic construct
  source 1..25: note = Seed: YGFLNVIVHSATGFKQSSKALQRPV
YGFLNVIVHSATGLKQNSMALLRPV

SEQ ID NO: 29495 - protein, 25 aa, synthetic construct
  source 1..25: note = Seed: YGFLNVIVHSATGFKQSSKALQRPV
YGFLNVIVHSATGLKQNSMALMRPV

SEQ ID NO: 29496 - protein, 25 aa, synthetic construct
  source 1..25: note = Seed: YGFLNVIVHSATGFKQSSKALQRPV
YGFLNVIVHSATGLKQNSMALVRPV

SEQ ID NO: 29497 - protein, 25 aa, synthetic construct
  source 1..25: note = Seed: YGFLNVIVHSATGFKQSSKALQRPV
YGFLNVIVHSATGLKQNSMALYRPV

SEQ ID NO: 29498 - protein, 25 aa, synthetic construct
  source 1..25: note = Seed: YGFLNVIVHSATGFKQSSKALQRPV
YGFLNVIVHSATGLKQNSNALARPV

SEQ ID NO: 29499 - protein, 25 aa, synthetic construct
  source 1..25: note = Seed: YGFLNVIVHSATGFKQSSKALQRPV
YGFLNVIVHSATGLKQNSNALFRPV

SEQ ID NO: 29500 - protein, 25 aa, synthetic construct
  source 1..25: note = Seed: YGFLNVIVHSATGFKQSSKALQRPV
YGFLNVIVHSATGLKQNSNALIRPV

SEQ ID NO: 29501 - protein, 25 aa, synthetic construct
  source 1..25: note = Seed: YGFLNVIVHSATGFKQSSKALQRPV
YGFLNVIVHSATGLKQNSNALLRPV

SEQ ID NO: 29502 - protein, 25 aa, synthetic construct
  source 1..25: note = Seed: YGFLNVIVHSATGFKQSSKALQRPV
YGFLNVIVHSATGLKQNSNALMRPV

SEQ ID NO: 29503 - protein, 25 aa, synthetic construct
  source 1..25: note = Seed: YGFLNVIVHSATGFKQSSKALQRPV
YGFLNVIVHSATGLKQNSNALSRPV

SEQ ID NO: 29504 - protein, 25 aa, synthetic construct
  source 1..25: note = Seed: YGFLNVIVHSATGFKQSSKALQRPV
YGFLNVIVHSATGLKQNSNALTRPV

SEQ ID NO: 29505 - protein, 25 aa, synthetic construct
  source 1..25: note = Seed: YGFLNVIVHSATGFKQSSKALQRPV
YGFLNVIVHSATGLKQNSNALVRPV

SEQ ID NO: 29506 - protein, 25 aa, synthetic construct
  source 1..25: note = Seed: YGFLNVIVHSATGFKQSSKALQRPV
YGFLNVIVHSATGLKQNSNALWRPV

SEQ ID NO: 29507 - protein, 25 aa, synthetic construct
  source 1..25: note = Seed: YGFLNVIVHSATGFKQSSKALQRPV
YGFLNVIVHSATGLKQNSNALYRPV

SEQ ID NO: 29508 - protein, 25 aa, synthetic construct
  source 1..25: note = Seed: YGFLNVIVHSATGFKQSSKALQRPV
YGFLNVIVHSATGLKQNSPALARPV

SEQ ID NO: 29509 - protein, 25 aa, synthetic construct
  source 1..25: note = Seed: YGFLNVIVHSATGFKQSSKALQRPV
YGFLNVIVHSATGLKQNSPALFRPV

SEQ ID NO: 29510 - protein, 25 aa, synthetic construct
  source 1..25: note = Seed: YGFLNVIVHSATGFKQSSKALQRPV
YGFLNVIVHSATGLKQNSPALIRPV

SEQ ID NO: 29511 - protein, 25 aa, synthetic construct
  source 1..25: note = Seed: YGFLNVIVHSATGFKQSSKALQRPV
YGFLNVIVHSATGLKQNSPALLRPV

SEQ ID NO: 29512 - protein, 25 aa, synthetic construct
  source 1..25: note = Seed: YGFLNVIVHSATGFKQSSKALQRPV
YGFLNVIVHSATGLKQNSPALMRPV

SEQ ID NO: 29513 - protein, 25 aa, synthetic construct
  source 1..25: note = Seed: YGFLNVIVHSATGFKQSSKALQRPV
YGFLNVIVHSATGLKQNSPALSRPV

SEQ ID NO: 29514 - protein, 25 aa, synthetic construct
  source 1..25: note = Seed: YGFLNVIVHSATGFKQSSKALQRPV
YGFLNVIVHSATGLKQNSPALTRPV

SEQ ID NO: 29515 - protein, 25 aa, synthetic construct
  source 1..25: note = Seed: YGFLNVIVHSATGFKQSSKALQRPV
YGFLNVIVHSATGLKQNSPALVRPV

SEQ ID NO: 29516 - protein, 25 aa, synthetic construct
  source 1..25: note = Seed: YGFLNVIVHSATGFKQSSKALQRPV
YGFLNVIVHSATGLKQNSPALWRPV

SEQ ID NO: 29517 - protein, 25 aa, synthetic construct
  source 1..25: note = Seed: YGFLNVIVHSATGFKQSSKALQRPV
YGFLNVIVHSATGLKQNSPALYRPV

SEQ ID NO: 29518 - protein, 25 aa, synthetic construct
  source 1..25: note = Seed: YGFLNVIVHSATGFKQSSKALQRPV
YGFLNVIVHSATGLKQNSQALIRPV

SEQ ID NO: 29519 - protein, 25 aa, synthetic construct
  source 1..25: note = Seed: YGFLNVIVHSATGFKQSSKALQRPV
YGFLNVIVHSATGLKQNSQALVRPV

SEQ ID NO: 29520 - protein, 25 aa, synthetic construct
  source 1..25: note = Seed: YGFLNVIVHSATGFKQSSKALQRPV
YGFLNVIVHSATGLKQNSSALARPV

SEQ ID NO: 29521 - protein, 25 aa, synthetic construct
  source 1..25: note = Seed: YGFLNVIVHSATGFKQSSKALQRPV
YGFLNVIVHSATGLKQNSSALFRPV

SEQ ID NO: 29522 - protein, 25 aa, synthetic construct
  source 1..25: note = Seed: YGFLNVIVHSATGFKQSSKALQRPV
YGFLNVIVHSATGLKQNSSALIRPV

SEQ ID NO: 29523 - protein, 25 aa, synthetic construct
  source 1..25: note = Seed: YGFLNVIVHSATGFKQSSKALQRPV
YGFLNVIVHSATGLKQNSSALLRPV

SEQ ID NO: 29524 - protein, 25 aa, synthetic construct
  source 1..25: note = Seed: YGFLNVIVHSATGFKQSSKALQRPV
YGFLNVIVHSATGLKQNSSALMRPV

SEQ ID NO: 29525 - protein, 25 aa, synthetic construct
  source 1..25: note = Seed: YGFLNVIVHSATGFKQSSKALQRPV
YGFLNVIVHSATGLKQNSSALNRPV

SEQ ID NO: 29526 - protein, 25 aa, synthetic construct
  source 1..25: note = Seed: YGFLNVIVHSATGFKQSSKALQRPV
YGFLNVIVHSATGLKQNSSALSRPV

SEQ ID NO: 29527 - protein, 25 aa, synthetic construct
  source 1..25: note = Seed: YGFLNVIVHSATGFKQSSKALQRPV
YGFLNVIVHSATGLKQNSSALTRPV

SEQ ID NO: 29528 - protein, 25 aa, synthetic construct
  source 1..25: note = Seed: YGFLNVIVHSATGFKQSSKALQRPV
YGFLNVIVHSATGLKQNSSALVRPV

SEQ ID NO: 29529 - protein, 25 aa, synthetic construct
  source 1..25: note = Seed: YGFLNVIVHSATGFKQSSKALQRPV
YGFLNVIVHSATGLKQNSSALWRPV

SEQ ID NO: 29530 - protein, 25 aa, synthetic construct
  source 1..25: note = Seed: YGFLNVIVHSATGFKQSSKALQRPV
YGFLNVIVHSATGLKQNSSALYRPV

SEQ ID NO: 29531 - protein, 25 aa, synthetic construct
  source 1..25: note = Seed: YGFLNVIVHSATGFKQSSKALQRPV
YGFLNVIVHSATGLKQNSTALARPV

SEQ ID NO: 29532 - protein, 25 aa, synthetic construct
  source 1..25: note = Seed: YGFLNVIVHSATGFKQSSKALQRPV
YGFLNVIVHSATGLKQNSTALFRPV

SEQ ID NO: 29533 - protein, 25 aa, synthetic construct
  source 1..25: note = Seed: YGFLNVIVHSATGFKQSSKALQRPV
YGFLNVIVHSATGLKQNSTALIRPV

SEQ ID NO: 29534 - protein, 25 aa, synthetic construct
  source 1..25: note = Seed: YGFLNVIVHSATGFKQSSKALQRPV
YGFLNVIVHSATGLKQNSTALLRPV

SEQ ID NO: 29535 - protein, 25 aa, synthetic construct
  source 1..25: note = Seed: YGFLNVIVHSATGFKQSSKALQRPV
YGFLNVIVHSATGLKQNSTALMRPV

SEQ ID NO: 29536 - protein, 25 aa, synthetic construct
  source 1..25: note = Seed: YGFLNVIVHSATGFKQSSKALQRPV
YGFLNVIVHSATGLKQNSTALSRPV

SEQ ID NO: 29537 - protein, 25 aa, synthetic construct
  source 1..25: note = Seed: YGFLNVIVHSATGFKQSSKALQRPV
YGFLNVIVHSATGLKQNSTALTRPV

SEQ ID NO: 29538 - protein, 25 aa, synthetic construct
  source 1..25: note = Seed: YGFLNVIVHSATGFKQSSKALQRPV
YGFLNVIVHSATGLKQNSTALVRPV

SEQ ID NO: 29539 - protein, 25 aa, synthetic construct
  source 1..25: note = Seed: YGFLNVIVHSATGFKQSSKALQRPV
YGFLNVIVHSATGLKQNSTALWRPV

SEQ ID NO: 29540 - protein, 25 aa, synthetic construct
  source 1..25: note = Seed: YGFLNVIVHSATGFKQSSKALQRPV
YGFLNVIVHSATGLKQNSTALYRPV

SEQ ID NO: 29541 - protein, 25 aa, synthetic construct
  source 1..25: note = Seed: YGFLNVIVHSATGFKQSSKALQRPV
YGFLNVIVHSATGLKQNSVALARPV

SEQ ID NO: 29542 - protein, 25 aa, synthetic construct
  source 1..25: note = Seed: YGFLNVIVHSATGFKQSSKALQRPV
YGFLNVIVHSATGLKQNSVALFRPV

SEQ ID NO: 29543 - protein, 25 aa, synthetic construct
  source 1..25: note = Seed: YGFLNVIVHSATGFKQSSKALQRPV
YGFLNVIVHSATGLKQNSVALIRPV

SEQ ID NO: 29544 - protein, 25 aa, synthetic construct
  source 1..25: note = Seed: YGFLNVIVHSATGFKQSSKALQRPV
YGFLNVIVHSATGLKQNSVALLRPV

SEQ ID NO: 29545 - protein, 25 aa, synthetic construct
  source 1..25: note = Seed: YGFLNVIVHSATGFKQSSKALQRPV
YGFLNVIVHSATGLKQNSVALMRPV

SEQ ID NO: 29546 - protein, 25 aa, synthetic construct
  source 1..25: note = Seed: YGFLNVIVHSATGFKQSSKALQRPV
YGFLNVIVHSATGLKQNSVALSRPV

SEQ ID NO: 29547 - protein, 25 aa, synthetic construct
  source 1..25: note = Seed: YGFLNVIVHSATGFKQSSKALQRPV
YGFLNVIVHSATGLKQNSVALTRPV

SEQ ID NO: 29548 - protein, 25 aa, synthetic construct
  source 1..25: note = Seed: YGFLNVIVHSATGFKQSSKALQRPV
YGFLNVIVHSATGLKQNSVALVRPV

SEQ ID NO: 29549 - protein, 25 aa, synthetic construct
  source 1..25: note = Seed: YGFLNVIVHSATGFKQSSKALQRPV
YGFLNVIVHSATGLKQNSVALWRPV

SEQ ID NO: 29550 - protein, 25 aa, synthetic construct
  source 1..25: note = Seed: YGFLNVIVHSATGFKQSSKALQRPV
YGFLNVIVHSATGLKQNSVALYRPV

SEQ ID NO: 29551 - protein, 25 aa, synthetic construct
  source 1..25: note = Seed: YGFLNVIVHSATGFKQSSKALQRPV
YGFLNVIVHSATGLKQNSWALIRPV

SEQ ID NO: 29552 - protein, 25 aa, synthetic construct
  source 1..25: note = Seed: YGFLNVIVHSATGFKQSSKALQRPV
YGFLNVIVHSATGLKQNSWALVRPV

SEQ ID NO: 29553 - protein, 25 aa, synthetic construct
  source 1..25: note = Seed: YGFLNVIVHSATGFKQSSKALQRPV
YGFLNVIVHSATGLKQNSYALIRPV

SEQ ID NO: 29554 - protein, 25 aa, synthetic construct
  source 1..25: note = Seed: YGFLNVIVHSATGFKQSSKALQRPV
YGFLNVIVHSATGLKQNSYALVRPV

SEQ ID NO: 29555 - protein, 25 aa, synthetic construct
  source 1..25: note = Seed: YGFLNVIVHSATGFKQSSKALQRPV
YGFLNVIVHSATGLKQQSAALARPV

SEQ ID NO: 29556 - protein, 25 aa, synthetic construct
  source 1..25: note = Seed: YGFLNVIVHSATGFKQSSKALQRPV
YGFLNVIVHSATGLKQQSAALNRPV

SEQ ID NO: 29557 - protein, 25 aa, synthetic construct
  source 1..25: note = Seed: YGFLNVIVHSATGFKQSSKALQRPV
YGFLNVIVHSATGLKQQSAALSRPV

SEQ ID NO: 29558 - protein, 25 aa, synthetic construct
  source 1..25: note = Seed: YGFLNVIVHSATGFKQSSKALQRPV
YGFLNVIVHSATGLKQQSFALFRPV

SEQ ID NO: 29559 - protein, 25 aa, synthetic construct
  source 1..25: note = Seed: YGFLNVIVHSATGFKQSSKALQRPV
YGFLNVIVHSATGLKQQSIALARPV

SEQ ID NO: 29560 - protein, 25 aa, synthetic construct
  source 1..25: note = Seed: YGFLNVIVHSATGFKQSSKALQRPV
YGFLNVIVHSATGLKQQSKALARPV

SEQ ID NO: 29561 - protein, 25 aa, synthetic construct
  source 1..25: note = Seed: YGFLNVIVHSATGFKQSSKALQRPV
YGFLNVIVHSATGLKQQSKALSRPV

SEQ ID NO: 29562 - protein, 25 aa, synthetic construct
  source 1..25: note = Seed: YGFLNVIVHSATGFKQSSKALQRPV
YGFLNVIVHSATGLKQQSPALARPV

SEQ ID NO: 29563 - protein, 25 aa, synthetic construct
  source 1..25: note = Seed: YGFLNVIVHSATGFKQSSKALQRPV
YGFLNVIVHSATGLKQQSPALNRPV

SEQ ID NO: 29564 - protein, 25 aa, synthetic construct
  source 1..25: note = Seed: YGFLNVIVHSATGFKQSSKALQRPV
YGFLNVIVHSATGLKQQSPALSRPV

SEQ ID NO: 29565 - protein, 25 aa, synthetic construct
  source 1..25: note = Seed: YGFLNVIVHSATGFKQSSKALQRPV
YGFLNVIVHSATGLKQQSRALARPV

SEQ ID NO: 29566 - protein, 25 aa, synthetic construct
  source 1..25: note = Seed: YGFLNVIVHSATGFKQSSKALQRPV
YGFLNVIVHSATGLKQQSRALGRPV

SEQ ID NO: 29567 - protein, 25 aa, synthetic construct
  source 1..25: note = Seed: YGFLNVIVHSATGFKQSSKALQRPV
YGFLNVIVHSATGLKQQSRALHRPV

SEQ ID NO: 29568 - protein, 25 aa, synthetic construct
  source 1..25: note = Seed: YGFLNVIVHSATGFKQSSKALQRPV
YGFLNVIVHSATGLKQQSRALQRPV

SEQ ID NO: 29569 - protein, 25 aa, synthetic construct
  source 1..25: note = Seed: YGFLNVIVHSATGFKQSSKALQRPV
YGFLNVIVHSATGLKQQSRALRRPV

SEQ ID NO: 29570 - protein, 25 aa, synthetic construct
  source 1..25: note = Seed: YGFLNVIVHSATGFKQSSKALQRPV
YGFLNVIVHSATGLKQQSRALSRPV

SEQ ID NO: 29571 - protein, 25 aa, synthetic construct
  source 1..25: note = Seed: YGFLNVIVHSATGFKQSSKALQRPV
YGFLNVIVHSATGLKQQSRALYRPV

SEQ ID NO: 29572 - protein, 25 aa, synthetic construct
  source 1..25: note = Seed: YGFLNVIVHSATGFKQSSKALQRPV
YGFLNVIVHSATGLKQQSVALARPV

SEQ ID NO: 29573 - protein, 25 aa, synthetic construct
  source 1..25: note = Seed: YGFLNVIVHSATGFKQSSKALQRPV
YGFLNVIVHSATGLKQQSVALNRPV

SEQ ID NO: 29574 - protein, 25 aa, synthetic construct
  source 1..25: note = Seed: YGFLNVIVHSATGFKQSSKALQRPV
YGFLNVIVHSATGLKQQSVALSRPV

SEQ ID NO: 29575 - protein, 25 aa, synthetic construct
  source 1..25: note = Seed: YGFLNVIVHSATGFKQSSKALQRPV
YGFLNVIVHSATGLKQRSAALRRPV

SEQ ID NO: 29576 - protein, 25 aa, synthetic construct
  source 1..25: note = Seed: YGFLNVIVHSATGFKQSSKALQRPV
YGFLNVIVHSATGLKQRSKALFRPV

SEQ ID NO: 29577 - protein, 25 aa, synthetic construct
  source 1..25: note = Seed: YGFLNVIVHSATGFKQSSKALQRPV
YGFLNVIVHSATGLKQRSKALRRPV

SEQ ID NO: 29578 - protein, 25 aa, synthetic construct
  source 1..25: note = Seed: YGFLNVIVHSATGFKQSSKALQRPV
YGFLNVIVHSATGLKQRSKALYRPV

SEQ ID NO: 29579 - protein, 25 aa, synthetic construct
  source 1..25: note = Seed: YGFLNVIVHSATGFKQSSKALQRPV
YGFLNVIVHSATGLKQRSRALARPV

SEQ ID NO: 29580 - protein, 25 aa, synthetic construct
  source 1..25: note = Seed: YGFLNVIVHSATGFKQSSKALQRPV
YGFLNVIVHSATGLKQRSRALFRPV

SEQ ID NO: 29581 - protein, 25 aa, synthetic construct
  source 1..25: note = Seed: YGFLNVIVHSATGFKQSSKALQRPV
YGFLNVIVHSATGLKQRSRALHRPV

SEQ ID NO: 29582 - protein, 25 aa, synthetic construct
  source 1..25: note = Seed: YGFLNVIVHSATGFKQSSKALQRPV
YGFLNVIVHSATGLKQRSRALIRPV

SEQ ID NO: 29583 - protein, 25 aa, synthetic construct
  source 1..25: note = Seed: YGFLNVIVHSATGFKQSSKALQRPV
YGFLNVIVHSATGLKQRSRALMRPV

SEQ ID NO: 29584 - protein, 25 aa, synthetic construct
  source 1..25: note = Seed: YGFLNVIVHSATGFKQSSKALQRPV
YGFLNVIVHSATGLKQRSRALRRPV

SEQ ID NO: 29585 - protein, 25 aa, synthetic construct
  source 1..25: note = Seed: YGFLNVIVHSATGFKQSSKALQRPV
YGFLNVIVHSATGLKQRSRALSRPV

SEQ ID NO: 29586 - protein, 25 aa, synthetic construct
  source 1..25: note = Seed: YGFLNVIVHSATGFKQSSKALQRPV
YGFLNVIVHSATGLKQRSRALVRPV

SEQ ID NO: 29587 - protein, 25 aa, synthetic construct
  source 1..25: note = Seed: YGFLNVIVHSATGFKQSSKALQRPV
YGFLNVIVHSATGLKQRSRALYRPV

SEQ ID NO: 29588 - protein, 25 aa, synthetic construct
  source 1..25: note = Seed: YGFLNVIVHSATGFKQSSKALQRPV
YGFLNVIVHSATGLKQSSAALFRPV

SEQ ID NO: 29589 - protein, 25 aa, synthetic construct
  source 1..25: note = Seed: YGFLNVIVHSATGFKQSSKALQRPV
YGFLNVIVHSATGLKQSSAALIRPV

SEQ ID NO: 29590 - protein, 25 aa, synthetic construct
  source 1..25: note = Seed: YGFLNVIVHSATGFKQSSKALQRPV
YGFLNVIVHSATGLKQSSAALLRPV

SEQ ID NO: 29591 - protein, 25 aa, synthetic construct
  source 1..25: note = Seed: YGFLNVIVHSATGFKQSSKALQRPV
YGFLNVIVHSATGLKQSSAALNRPV

SEQ ID NO: 29592 - protein, 25 aa, synthetic construct
  source 1..25: note = Seed: YGFLNVIVHSATGFKQSSKALQRPV
YGFLNVIVHSATGLKQSSAALVRPV

SEQ ID NO: 29593 - protein, 25 aa, synthetic construct
  source 1..25: note = Seed: YGFLNVIVHSATGFKQSSKALQRPV
YGFLNVIVHSATGLKQSSAALYRPV

SEQ ID NO: 29594 - protein, 25 aa, synthetic construct
  source 1..25: note = Seed: YGFLNVIVHSATGFKQSSKALQRPV
YGFLNVIVHSATGLKQSSFALFRPV

SEQ ID NO: 29595 - protein, 25 aa, synthetic construct
  source 1..25: note = Seed: YGFLNVIVHSATGFKQSSKALQRPV
YGFLNVIVHSATGLKQSSFALIRPV

SEQ ID NO: 29596 - protein, 25 aa, synthetic construct
  source 1..25: note = Seed: YGFLNVIVHSATGFKQSSKALQRPV
YGFLNVIVHSATGLKQSSFALLRPV

SEQ ID NO: 29597 - protein, 25 aa, synthetic construct
  source 1..25: note = Seed: YGFLNVIVHSATGFKQSSKALQRPV
YGFLNVIVHSATGLKQSSFALVRPV

SEQ ID NO: 29598 - protein, 25 aa, synthetic construct
  source 1..25: note = Seed: YGFLNVIVHSATGFKQSSKALQRPV
YGFLNVIVHSATGLKQSSGALIRPV

SEQ ID NO: 29599 - protein, 25 aa, synthetic construct
  source 1..25: note = Seed: YGFLNVIVHSATGFKQSSKALQRPV
YGFLNVIVHSATGLKQSSGALVRPV

SEQ ID NO: 29600 - protein, 25 aa, synthetic construct
  source 1..25: note = Seed: YGFLNVIVHSATGFKQSSKALQRPV
YGFLNVIVHSATGLKQSSKALARPV

SEQ ID NO: 29601 - protein, 25 aa, synthetic construct
  source 1..25: note = Seed: YGFLNVIVHSATGFKQSSKALQRPV
YGFLNVIVHSATGLKQSSKALSRPV

SEQ ID NO: 29602 - protein, 25 aa, synthetic construct
  source 1..25: note = Seed: YGFLNVIVHSATGFKQSSKALQRPV
YGFLNVIVHSATGLKQSSNALFRPV

SEQ ID NO: 29603 - protein, 25 aa, synthetic construct
  source 1..25: note = Seed: YGFLNVIVHSATGFKQSSKALQRPV
YGFLNVIVHSATGLKQSSNALIRPV

SEQ ID NO: 29604 - protein, 25 aa, synthetic construct
  source 1..25: note = Seed: YGFLNVIVHSATGFKQSSKALQRPV
YGFLNVIVHSATGLKQSSNALVRPV

SEQ ID NO: 29605 - protein, 25 aa, synthetic construct
  source 1..25: note = Seed: YGFLNVIVHSATGFKQSSKALQRPV
YGFLNVIVHSATGLKQSSNALYRPV

SEQ ID NO: 29606 - protein, 25 aa, synthetic construct
  source 1..25: note = Seed: YGFLNVIVHSATGFKQSSKALQRPV
YGFLNVIVHSATGLKQSSPALIRPV

SEQ ID NO: 29607 - protein, 25 aa, synthetic construct
  source 1..25: note = Seed: YGFLNVIVHSATGFKQSSKALQRPV
YGFLNVIVHSATGLKQSSPALVRPV

SEQ ID NO: 29608 - protein, 25 aa, synthetic construct
  source 1..25: note = Seed: YGFLNVIVHSATGFKQSSKALQRPV
YGFLNVIVHSATGLKQSSRALARPV

SEQ ID NO: 29609 - protein, 25 aa, synthetic construct
  source 1..25: note = Seed: YGFLNVIVHSATGFKQSSKALQRPV
YGFLNVIVHSATGLKQSSRALRRPV

SEQ ID NO: 29610 - protein, 25 aa, synthetic construct
  source 1..25: note = Seed: YGFLNVIVHSATGFKQSSKALQRPV
YGFLNVIVHSATGLKQSSRALSRPV

SEQ ID NO: 29611 - protein, 25 aa, synthetic construct
  source 1..25: note = Seed: YGFLNVIVHSATGFKQSSKALQRPV
YGFLNVIVHSATGLKQSSRALYRPV

SEQ ID NO: 29612 - protein, 25 aa, synthetic construct
  source 1..25: note = Seed: YGFLNVIVHSATGFKQSSKALQRPV
YGFLNVIVHSATGLKQSSSALIRPV

SEQ ID NO: 29613 - protein, 25 aa, synthetic construct
  source 1..25: note = Seed: YGFLNVIVHSATGFKQSSKALQRPV
YGFLNVIVHSATGLKQSSSALVRPV

SEQ ID NO: 29614 - protein, 25 aa, synthetic construct
  source 1..25: note = Seed: YGFLNVIVHSATGFKQSSKALQRPV
YGFLNVIVHSATGLKQSSTALIRPV

SEQ ID NO: 29615 - protein, 25 aa, synthetic construct
  source 1..25: note = Seed: YGFLNVIVHSATGFKQSSKALQRPV
YGFLNVIVHSATGLKQTSAALIRPV

SEQ ID NO: 29616 - protein, 25 aa, synthetic construct
  source 1..25: note = Seed: YGFLNVIVHSATGFKQSSKALQRPV
YGFLNVIVHSATGLKQTSAALNRPV

SEQ ID NO: 29617 - protein, 25 aa, synthetic construct
  source 1..25: note = Seed: YGFLNVIVHSATGFKQSSKALQRPV
YGFLNVIVHSATGLKQTSFALFRPV

SEQ ID NO: 29618 - protein, 25 aa, synthetic construct
  source 1..25: note = Seed: YGFLNVIVHSATGFKQSSKALQRPV
YGFLNVIVHSATGLKQTSFALIRPV

SEQ ID NO: 29619 - protein, 25 aa, synthetic construct
  source 1..25: note = Seed: YGFLNVIVHSATGFKQSSKALQRPV
YGFLNVIVHSATGLKQTSFALLRPV

SEQ ID NO: 29620 - protein, 25 aa, synthetic construct
  source 1..25: note = Seed: YGFLNVIVHSATGFKQSSKALQRPV
YGFLNVIVHSATGLKQTSFALMRPV

SEQ ID NO: 29621 - protein, 25 aa, synthetic construct
  source 1..25: note = Seed: YGFLNVIVHSATGFKQSSKALQRPV
YGFLNVIVHSATGLKQTSFALVRPV

SEQ ID NO: 29622 - protein, 25 aa, synthetic construct
  source 1..25: note = Seed: YGFLNVIVHSATGFKQSSKALQRPV
YGFLNVIVHSATGLKQTSFALYRPV

SEQ ID NO: 29623 - protein, 25 aa, synthetic construct
  source 1..25: note = Seed: YGFLNVIVHSATGFKQSSKALQRPV
YGFLNVIVHSATGLKQTSKALSRPV

SEQ ID NO: 29624 - protein, 25 aa, synthetic construct
  source 1..25: note = Seed: YGFLNVIVHSATGFKQSSKALQRPV
YGFLNVIVHSATGLKQTSRALARPV

SEQ ID NO: 29625 - protein, 25 aa, synthetic construct
  source 1..25: note = Seed: YGFLNVIVHSATGFKQSSKALQRPV
YGFLNVIVHSATGLKQTSRALRRPV

SEQ ID NO: 29626 - protein, 25 aa, synthetic construct
  source 1..25: note = Seed: YGFLNVIVHSATGFKQSSKALQRPV
YGFLNVIVHSATGLKQTSRALSRPV

SEQ ID NO: 29627 - protein, 25 aa, synthetic construct
  source 1..25: note = Seed: YGFLNVIVHSATGFKQSSKALQRPV
YGFLNVIVHSATGLKQVSAALARPV

SEQ ID NO: 29628 - protein, 25 aa, synthetic construct
  source 1..25: note = Seed: YGFLNVIVHSATGFKQSSKALQRPV
YGFLNVIVHSATGLKQVSAALNRPV

SEQ ID NO: 29629 - protein, 25 aa, synthetic construct
  source 1..25: note = Seed: YGFLNVIVHSATGFKQSSKALQRPV
YGFLNVIVHSATGLKQVSAALRRPV

SEQ ID NO: 29630 - protein, 25 aa, synthetic construct
  source 1..25: note = Seed: YGFLNVIVHSATGFKQSSKALQRPV
YGFLNVIVHSATGLKQVSAALSRPV

SEQ ID NO: 29631 - protein, 25 aa, synthetic construct
  source 1..25: note = Seed: YGFLNVIVHSATGFKQSSKALQRPV
YGFLNVIVHSATGLKQVSAALTRPV

SEQ ID NO: 29632 - protein, 25 aa, synthetic construct
  source 1..25: note = Seed: YGFLNVIVHSATGFKQSSKALQRPV
YGFLNVIVHSATGLKQVSFALFRPV

SEQ ID NO: 29633 - protein, 25 aa, synthetic construct
  source 1..25: note = Seed: YGFLNVIVHSATGFKQSSKALQRPV
YGFLNVIVHSATGLKQVSFALIRPV

SEQ ID NO: 29634 - protein, 25 aa, synthetic construct
  source 1..25: note = Seed: YGFLNVIVHSATGFKQSSKALQRPV
YGFLNVIVHSATGLKQVSFALLRPV

SEQ ID NO: 29635 - protein, 25 aa, synthetic construct
  source 1..25: note = Seed: YGFLNVIVHSATGFKQSSKALQRPV
YGFLNVIVHSATGLKQVSFALMRPV

SEQ ID NO: 29636 - protein, 25 aa, synthetic construct
  source 1..25: note = Seed: YGFLNVIVHSATGFKQSSKALQRPV
YGFLNVIVHSATGLKQVSFALVRPV

SEQ ID NO: 29637 - protein, 25 aa, synthetic construct
  source 1..25: note = Seed: YGFLNVIVHSATGFKQSSKALQRPV
YGFLNVIVHSATGLKQVSFALYRPV

SEQ ID NO: 29638 - protein, 25 aa, synthetic construct
  source 1..25: note = Seed: YGFLNVIVHSATGFKQSSKALQRPV
YGFLNVIVHSATGLKQVSGALARPV

SEQ ID NO: 29639 - protein, 25 aa, synthetic construct
  source 1..25: note = Seed: YGFLNVIVHSATGFKQSSKALQRPV
YGFLNVIVHSATGLKQVSIALARPV

SEQ ID NO: 29640 - protein, 25 aa, synthetic construct
  source 1..25: note = Seed: YGFLNVIVHSATGFKQSSKALQRPV
YGFLNVIVHSATGLKQVSIALFRPV

SEQ ID NO: 29641 - protein, 25 aa, synthetic construct
  source 1..25: note = Seed: YGFLNVIVHSATGFKQSSKALQRPV
YGFLNVIVHSATGLKQVSIALNRPV

SEQ ID NO: 29642 - protein, 25 aa, synthetic construct
  source 1..25: note = Seed: YGFLNVIVHSATGFKQSSKALQRPV
YGFLNVIVHSATGLKQVSIALRRPV

SEQ ID NO: 29643 - protein, 25 aa, synthetic construct
  source 1..25: note = Seed: YGFLNVIVHSATGFKQSSKALQRPV
YGFLNVIVHSATGLKQVSKALARPV

SEQ ID NO: 29644 - protein, 25 aa, synthetic construct
  source 1..25: note = Seed: YGFLNVIVHSATGFKQSSKALQRPV
YGFLNVIVHSATGLKQVSKALGRPV

SEQ ID NO: 29645 - protein, 25 aa, synthetic construct
  source 1..25: note = Seed: YGFLNVIVHSATGFKQSSKALQRPV
YGFLNVIVHSATGLKQVSKALHRPV

SEQ ID NO: 29646 - protein, 25 aa, synthetic construct
  source 1..25: note = Seed: YGFLNVIVHSATGFKQSSKALQRPV
YGFLNVIVHSATGLKQVSKALKRPV

SEQ ID NO: 29647 - protein, 25 aa, synthetic construct
  source 1..25: note = Seed: YGFLNVIVHSATGFKQSSKALQRPV
YGFLNVIVHSATGLKQVSKALMRPV

SEQ ID NO: 29648 - protein, 25 aa, synthetic construct
  source 1..25: note = Seed: YGFLNVIVHSATGFKQSSKALQRPV
YGFLNVIVHSATGLKQVSKALNRPV

SEQ ID NO: 29649 - protein, 25 aa, synthetic construct
  source 1..25: note = Seed: YGFLNVIVHSATGFKQSSKALQRPV
YGFLNVIVHSATGLKQVSKALQRPV

SEQ ID NO: 29650 - protein, 25 aa, synthetic construct
  source 1..25: note = Seed: YGFLNVIVHSATGFKQSSKALQRPV
YGFLNVIVHSATGLKQVSKALRRPV

SEQ ID NO: 29651 - protein, 25 aa, synthetic construct
  source 1..25: note = Seed: YGFLNVIVHSATGFKQSSKALQRPV
YGFLNVIVHSATGLKQVSKALSRPV

SEQ ID NO: 29652 - protein, 25 aa, synthetic construct
  source 1..25: note = Seed: YGFLNVIVHSATGFKQSSKALQRPV
YGFLNVIVHSATGLKQVSKALTRPV

SEQ ID NO: 29653 - protein, 25 aa, synthetic construct
  source 1..25: note = Seed: YGFLNVIVHSATGFKQSSKALQRPV
YGFLNVIVHSATGLKQVSKALVRPV

SEQ ID NO: 29654 - protein, 25 aa, synthetic construct
  source 1..25: note = Seed: YGFLNVIVHSATGFKQSSKALQRPV
YGFLNVIVHSATGLKQVSKALYRPV

SEQ ID NO: 29655 - protein, 25 aa, synthetic construct
  source 1..25: note = Seed: YGFLNVIVHSATGFKQSSKALQRPV
YGFLNVIVHSATGLKQVSLALFRPV

SEQ ID NO: 29656 - protein, 25 aa, synthetic construct
  source 1..25: note = Seed: YGFLNVIVHSATGFKQSSKALQRPV
YGFLNVIVHSATGLKQVSLALRRPV

SEQ ID NO: 29657 - protein, 25 aa, synthetic construct
  source 1..25: note = Seed: YGFLNVIVHSATGFKQSSKALQRPV
YGFLNVIVHSATGLKQVSMALARPV

SEQ ID NO: 29658 - protein, 25 aa, synthetic construct
  source 1..25: note = Seed: YGFLNVIVHSATGFKQSSKALQRPV
YGFLNVIVHSATGLKQVSMALFRPV

SEQ ID NO: 29659 - protein, 25 aa, synthetic construct
  source 1..25: note = Seed: YGFLNVIVHSATGFKQSSKALQRPV
YGFLNVIVHSATGLKQVSMALRRPV

SEQ ID NO: 29660 - protein, 25 aa, synthetic construct
  source 1..25: note = Seed: YGFLNVIVHSATGFKQSSKALQRPV
YGFLNVIVHSATGLKQVSPALARPV

SEQ ID NO: 29661 - protein, 25 aa, synthetic construct
  source 1..25: note = Seed: YGFLNVIVHSATGFKQSSKALQRPV
YGFLNVIVHSATGLKQVSPALNRPV

SEQ ID NO: 29662 - protein, 25 aa, synthetic construct
  source 1..25: note = Seed: YGFLNVIVHSATGFKQSSKALQRPV
YGFLNVIVHSATGLKQVSPALSRPV

SEQ ID NO: 29663 - protein, 25 aa, synthetic construct
  source 1..25: note = Seed: YGFLNVIVHSATGFKQSSKALQRPV
YGFLNVIVHSATGLKQVSPALTRPV

SEQ ID NO: 29664 - protein, 25 aa, synthetic construct
  source 1..25: note = Seed: YGFLNVIVHSATGFKQSSKALQRPV
YGFLNVIVHSATGLKQVSRALARPV

SEQ ID NO: 29665 - protein, 25 aa, synthetic construct
  source 1..25: note = Seed: YGFLNVIVHSATGFKQSSKALQRPV
YGFLNVIVHSATGLKQVSRALGRPV

SEQ ID NO: 29666 - protein, 25 aa, synthetic construct
  source 1..25: note = Seed: YGFLNVIVHSATGFKQSSKALQRPV
YGFLNVIVHSATGLKQVSRALHRPV

SEQ ID NO: 29667 - protein, 25 aa, synthetic construct
  source 1..25: note = Seed: YGFLNVIVHSATGFKQSSKALQRPV
YGFLNVIVHSATGLKQVSRALIRPV

SEQ ID NO: 29668 - protein, 25 aa, synthetic construct
  source 1..25: note = Seed: YGFLNVIVHSATGFKQSSKALQRPV
YGFLNVIVHSATGLKQVSRALKRPV

SEQ ID NO: 29669 - protein, 25 aa, synthetic construct
  source 1..25: note = Seed: YGFLNVIVHSATGFKQSSKALQRPV
YGFLNVIVHSATGLKQVSRALLRPV

SEQ ID NO: 29670 - protein, 25 aa, synthetic construct
  source 1..25: note = Seed: YGFLNVIVHSATGFKQSSKALQRPV
YGFLNVIVHSATGLKQVSRALMRPV

SEQ ID NO: 29671 - protein, 25 aa, synthetic construct
  source 1..25: note = Seed: YGFLNVIVHSATGFKQSSKALQRPV
YGFLNVIVHSATGLKQVSRALNRPV

SEQ ID NO: 29672 - protein, 25 aa, synthetic construct
  source 1..25: note = Seed: YGFLNVIVHSATGFKQSSKALQRPV
YGFLNVIVHSATGLKQVSRALPRPV

SEQ ID NO: 29673 - protein, 25 aa, synthetic construct
  source 1..25: note = Seed: YGFLNVIVHSATGFKQSSKALQRPV
YGFLNVIVHSATGLKQVSRALQRPV

SEQ ID NO: 29674 - protein, 25 aa, synthetic construct
  source 1..25: note = Seed: YGFLNVIVHSATGFKQSSKALQRPV
YGFLNVIVHSATGLKQVSRALRRPV

SEQ ID NO: 29675 - protein, 25 aa, synthetic construct
  source 1..25: note = Seed: YGFLNVIVHSATGFKQSSKALQRPV
YGFLNVIVHSATGLKQVSRALSRPV

SEQ ID NO: 29676 - protein, 25 aa, synthetic construct
  source 1..25: note = Seed: YGFLNVIVHSATGFKQSSKALQRPV
YGFLNVIVHSATGLKQVSRALTRPV

SEQ ID NO: 29677 - protein, 25 aa, synthetic construct
  source 1..25: note = Seed: YGFLNVIVHSATGFKQSSKALQRPV
YGFLNVIVHSATGLKQVSRALVRPV

SEQ ID NO: 29678 - protein, 25 aa, synthetic construct
  source 1..25: note = Seed: YGFLNVIVHSATGFKQSSKALQRPV
YGFLNVIVHSATGLKQVSRALYRPV

SEQ ID NO: 29679 - protein, 25 aa, synthetic construct
  source 1..25: note = Seed: YGFLNVIVHSATGFKQSSKALQRPV
YGFLNVIVHSATGLKQVSSALARPV

SEQ ID NO: 29680 - protein, 25 aa, synthetic construct
  source 1..25: note = Seed: YGFLNVIVHSATGFKQSSKALQRPV
YGFLNVIVHSATGLKQVSSALNRPV

SEQ ID NO: 29681 - protein, 25 aa, synthetic construct
  source 1..25: note = Seed: YGFLNVIVHSATGFKQSSKALQRPV
YGFLNVIVHSATGLKQVSSALSRPV

SEQ ID NO: 29682 - protein, 25 aa, synthetic construct
  source 1..25: note = Seed: YGFLNVIVHSATGFKQSSKALQRPV
YGFLNVIVHSATGLKQVSTALARPV

SEQ ID NO: 29683 - protein, 25 aa, synthetic construct
  source 1..25: note = Seed: YGFLNVIVHSATGFKQSSKALQRPV
YGFLNVIVHSATGLKQVSTALNRPV

SEQ ID NO: 29684 - protein, 25 aa, synthetic construct
  source 1..25: note = Seed: YGFLNVIVHSATGFKQSSKALQRPV
YGFLNVIVHSATGLKQVSTALSRPV

SEQ ID NO: 29685 - protein, 25 aa, synthetic construct
  source 1..25: note = Seed: YGFLNVIVHSATGFKQSSKALQRPV
YGFLNVIVHSATGLKQVSVALARPV

SEQ ID NO: 29686 - protein, 25 aa, synthetic construct
  source 1..25: note = Seed: YGFLNVIVHSATGFKQSSKALQRPV
YGFLNVIVHSATGLKQVSVALNRPV

SEQ ID NO: 29687 - protein, 25 aa, synthetic construct
  source 1..25: note = Seed: YGFLNVIVHSATGFKQSSKALQRPV
YGFLNVIVHSATGLKQVSVALRRPV

SEQ ID NO: 29688 - protein, 25 aa, synthetic construct
  source 1..25: note = Seed: YGFLNVIVHSATGFKQSSKALQRPV
YGFLNVIVHSATGLKQVSVALSRPV

SEQ ID NO: 29689 - protein, 25 aa, synthetic construct
  source 1..25: note = Seed: YGFLNVIVHSATGFKQSSKALQRPV
YGFLNVIVHSATGLKQVSWALFRPV

SEQ ID NO: 29690 - protein, 25 aa, synthetic construct
  source 1..25: note = Seed: YGFLNVIVHSATGFKQSSKALQRPV
YGFLNVIVHSATGLKQVSWALRRPV

SEQ ID NO: 29691 - protein, 25 aa, synthetic construct
  source 1..25: note = Seed: YGFLNVIVHSATGFKQSSKALQRPV
YGFLNVIVHSATGLKQVSYALFRPV

SEQ ID NO: 29692 - protein, 25 aa, synthetic construct
  source 1..25: note = Seed: YGFLNVIVHSATGFKQSSKALQRPV
YGFLNVIVHSATGLKQVSYALLRPV

SEQ ID NO: 29693 - protein, 25 aa, synthetic construct
  source 1..25: note = Seed: YGFLNVIVHSATGFKQSSKALQRPV
YGFLNVIVHSATGLKQVSYALYRPV

SEQ ID NO: 29694 - protein, 25 aa, synthetic construct
  source 1..25: note = Seed: YGFLNVIVHSATGFKQSSKALQRPV
YGFLNVIVHSATGLKQWSAALARPV

SEQ ID NO: 29695 - protein, 25 aa, synthetic construct
  source 1..25: note = Seed: YGFLNVIVHSATGFKQSSKALQRPV
YGFLNVIVHSATGLKQWSAALRRPV

SEQ ID NO: 29696 - protein, 25 aa, synthetic construct
  source 1..25: note = Seed: YGFLNVIVHSATGFKQSSKALQRPV
YGFLNVIVHSATGLKQWSAALSRPV

SEQ ID NO: 29697 - protein, 25 aa, synthetic construct
  source 1..25: note = Seed: YGFLNVIVHSATGFKQSSKALQRPV
YGFLNVIVHSATGLKQWSFALFRPV

SEQ ID NO: 29698 - protein, 25 aa, synthetic construct
  source 1..25: note = Seed: YGFLNVIVHSATGFKQSSKALQRPV
YGFLNVIVHSATGLKQWSFALIRPV

SEQ ID NO: 29699 - protein, 25 aa, synthetic construct
  source 1..25: note = Seed: YGFLNVIVHSATGFKQSSKALQRPV
YGFLNVIVHSATGLKQWSFALLRPV

SEQ ID NO: 29700 - protein, 25 aa, synthetic construct
  source 1..25: note = Seed: YGFLNVIVHSATGFKQSSKALQRPV
YGFLNVIVHSATGLKQWSFALMRPV

SEQ ID NO: 29701 - protein, 25 aa, synthetic construct
  source 1..25: note = Seed: YGFLNVIVHSATGFKQSSKALQRPV
YGFLNVIVHSATGLKQWSFALYRPV

SEQ ID NO: 29702 - protein, 25 aa, synthetic construct
  source 1..25: note = Seed: YGFLNVIVHSATGFKQSSKALQRPV
YGFLNVIVHSATGLKQWSIALARPV

SEQ ID NO: 29703 - protein, 25 aa, synthetic construct
  source 1..25: note = Seed: YGFLNVIVHSATGFKQSSKALQRPV
YGFLNVIVHSATGLKQWSIALRRPV

SEQ ID NO: 29704 - protein, 25 aa, synthetic construct
  source 1..25: note = Seed: YGFLNVIVHSATGFKQSSKALQRPV
YGFLNVIVHSATGLKQWSIALSRPV

SEQ ID NO: 29705 - protein, 25 aa, synthetic construct
  source 1..25: note = Seed: YGFLNVIVHSATGFKQSSKALQRPV
YGFLNVIVHSATGLKQWSKALARPV

SEQ ID NO: 29706 - protein, 25 aa, synthetic construct
  source 1..25: note = Seed: YGFLNVIVHSATGFKQSSKALQRPV
YGFLNVIVHSATGLKQWSKALFRPV

SEQ ID NO: 29707 - protein, 25 aa, synthetic construct
  source 1..25: note = Seed: YGFLNVIVHSATGFKQSSKALQRPV
YGFLNVIVHSATGLKQWSKALHRPV

SEQ ID NO: 29708 - protein, 25 aa, synthetic construct
  source 1..25: note = Seed: YGFLNVIVHSATGFKQSSKALQRPV
YGFLNVIVHSATGLKQWSKALIRPV

SEQ ID NO: 29709 - protein, 25 aa, synthetic construct
  source 1..25: note = Seed: YGFLNVIVHSATGFKQSSKALQRPV
YGFLNVIVHSATGLKQWSKALKRPV

SEQ ID NO: 29710 - protein, 25 aa, synthetic construct
  source 1..25: note = Seed: YGFLNVIVHSATGFKQSSKALQRPV
YGFLNVIVHSATGLKQWSKALLRPV

SEQ ID NO: 29711 - protein, 25 aa, synthetic construct
  source 1..25: note = Seed: YGFLNVIVHSATGFKQSSKALQRPV
YGFLNVIVHSATGLKQWSKALMRPV

SEQ ID NO: 29712 - protein, 25 aa, synthetic construct
  source 1..25: note = Seed: YGFLNVIVHSATGFKQSSKALQRPV
YGFLNVIVHSATGLKQWSKALRRPV

SEQ ID NO: 29713 - protein, 25 aa, synthetic construct
  source 1..25: note = Seed: YGFLNVIVHSATGFKQSSKALQRPV
YGFLNVIVHSATGLKQWSKALSRPV

SEQ ID NO: 29714 - protein, 25 aa, synthetic construct
  source 1..25: note = Seed: YGFLNVIVHSATGFKQSSKALQRPV
YGFLNVIVHSATGLKQWSKALVRPV

SEQ ID NO: 29715 - protein, 25 aa, synthetic construct
  source 1..25: note = Seed: YGFLNVIVHSATGFKQSSKALQRPV
YGFLNVIVHSATGLKQWSKALYRPV

SEQ ID NO: 29716 - protein, 25 aa, synthetic construct
  source 1..25: note = Seed: YGFLNVIVHSATGFKQSSKALQRPV
YGFLNVIVHSATGLKQWSLALARPV

SEQ ID NO: 29717 - protein, 25 aa, synthetic construct
  source 1..25: note = Seed: YGFLNVIVHSATGFKQSSKALQRPV
YGFLNVIVHSATGLKQWSLALFRPV

SEQ ID NO: 29718 - protein, 25 aa, synthetic construct
  source 1..25: note = Seed: YGFLNVIVHSATGFKQSSKALQRPV
YGFLNVIVHSATGLKQWSLALSRPV

SEQ ID NO: 29719 - protein, 25 aa, synthetic construct
  source 1..25: note = Seed: YGFLNVIVHSATGFKQSSKALQRPV
YGFLNVIVHSATGLKQWSMALARPV

SEQ ID NO: 29720 - protein, 25 aa, synthetic construct
  source 1..25: note = Seed: YGFLNVIVHSATGFKQSSKALQRPV
YGFLNVIVHSATGLKQWSMALSRPV

SEQ ID NO: 29721 - protein, 25 aa, synthetic construct
  source 1..25: note = Seed: YGFLNVIVHSATGFKQSSKALQRPV
YGFLNVIVHSATGLKQWSRALARPV

SEQ ID NO: 29722 - protein, 25 aa, synthetic construct
  source 1..25: note = Seed: YGFLNVIVHSATGFKQSSKALQRPV
YGFLNVIVHSATGLKQWSRALFRPV

SEQ ID NO: 29723 - protein, 25 aa, synthetic construct
  source 1..25: note = Seed: YGFLNVIVHSATGFKQSSKALQRPV
YGFLNVIVHSATGLKQWSRALGRPV

SEQ ID NO: 29724 - protein, 25 aa, synthetic construct
  source 1..25: note = Seed: YGFLNVIVHSATGFKQSSKALQRPV
YGFLNVIVHSATGLKQWSRALHRPV

SEQ ID NO: 29725 - protein, 25 aa, synthetic construct
  source 1..25: note = Seed: YGFLNVIVHSATGFKQSSKALQRPV
YGFLNVIVHSATGLKQWSRALIRPV

SEQ ID NO: 29726 - protein, 25 aa, synthetic construct
  source 1..25: note = Seed: YGFLNVIVHSATGFKQSSKALQRPV
YGFLNVIVHSATGLKQWSRALKRPV

SEQ ID NO: 29727 - protein, 25 aa, synthetic construct
  source 1..25: note = Seed: YGFLNVIVHSATGFKQSSKALQRPV
YGFLNVIVHSATGLKQWSRALLRPV

SEQ ID NO: 29728 - protein, 25 aa, synthetic construct
  source 1..25: note = Seed: YGFLNVIVHSATGFKQSSKALQRPV
YGFLNVIVHSATGLKQWSRALMRPV

SEQ ID NO: 29729 - protein, 25 aa, synthetic construct
  source 1..25: note = Seed: YGFLNVIVHSATGFKQSSKALQRPV
YGFLNVIVHSATGLKQWSRALQRPV

SEQ ID NO: 29730 - protein, 25 aa, synthetic construct
  source 1..25: note = Seed: YGFLNVIVHSATGFKQSSKALQRPV
YGFLNVIVHSATGLKQWSRALRRPV

SEQ ID NO: 29731 - protein, 25 aa, synthetic construct
  source 1..25: note = Seed: YGFLNVIVHSATGFKQSSKALQRPV
YGFLNVIVHSATGLKQWSRALSRPV

SEQ ID NO: 29732 - protein, 25 aa, synthetic construct
  source 1..25: note = Seed: YGFLNVIVHSATGFKQSSKALQRPV
YGFLNVIVHSATGLKQWSRALVRPV

SEQ ID NO: 29733 - protein, 25 aa, synthetic construct
  source 1..25: note = Seed: YGFLNVIVHSATGFKQSSKALQRPV
YGFLNVIVHSATGLKQWSRALYRPV

SEQ ID NO: 29734 - protein, 25 aa, synthetic construct
  source 1..25: note = Seed: YGFLNVIVHSATGFKQSSKALQRPV
YGFLNVIVHSATGLKQWSTALRRPV

SEQ ID NO: 29735 - protein, 25 aa, synthetic construct
  source 1..25: note = Seed: YGFLNVIVHSATGFKQSSKALQRPV
YGFLNVIVHSATGLKQWSVALARPV

SEQ ID NO: 29736 - protein, 25 aa, synthetic construct
  source 1..25: note = Seed: YGFLNVIVHSATGFKQSSKALQRPV
YGFLNVIVHSATGLKQWSVALRRPV

SEQ ID NO: 29737 - protein, 25 aa, synthetic construct
  source 1..25: note = Seed: YGFLNVIVHSATGFKQSSKALQRPV
YGFLNVIVHSATGLKQWSVALSRPV

SEQ ID NO: 29738 - protein, 25 aa, synthetic construct
  source 1..25: note = Seed: YGFLNVIVHSATGFKQSSKALQRPV
YGFLNVIVHSATGLKQWSWALFRPV

SEQ ID NO: 29739 - protein, 25 aa, synthetic construct
  source 1..25: note = Seed: YGFLNVIVHSATGFKQSSKALQRPV
YGFLNVIVHSATGLKQWSYALFRPV

SEQ ID NO: 29740 - protein, 25 aa, synthetic construct
  source 1..25: note = Seed: YGFLNVIVHSATGFKQSSKALQRPV
YGFLNVIVHSATGLKQWSYALLRPV

SEQ ID NO: 29741 - protein, 25 aa, synthetic construct
  source 1..25: note = Seed: YGFLNVIVHSATGFKQSSKALQRPV
YGFLNVIVHSATGLKQWSYALYRPV

SEQ ID NO: 29742 - protein, 25 aa, synthetic construct
  source 1..25: note = Seed: YGFLNVIVHSATGFKQSSKALQRPV
YGFLNVIVHSATGLKQYSAALARPV

SEQ ID NO: 29743 - protein, 25 aa, synthetic construct
  source 1..25: note = Seed: YGFLNVIVHSATGFKQSSKALQRPV
YGFLNVIVHSATGLKQYSAALSRPV

SEQ ID NO: 29744 - protein, 25 aa, synthetic construct
  source 1..25: note = Seed: YGFLNVIVHSATGFKQSSKALQRPV
YGFLNVIVHSATGLKQYSFALFRPV

SEQ ID NO: 29745 - protein, 25 aa, synthetic construct
  source 1..25: note = Seed: YGFLNVIVHSATGFKQSSKALQRPV
YGFLNVIVHSATGLKQYSFALLRPV

SEQ ID NO: 29746 - protein, 25 aa, synthetic construct
  source 1..25: note = Seed: YGFLNVIVHSATGFKQSSKALQRPV
YGFLNVIVHSATGLKQYSFALMRPV

SEQ ID NO: 29747 - protein, 25 aa, synthetic construct
  source 1..25: note = Seed: YGFLNVIVHSATGFKQSSKALQRPV
YGFLNVIVHSATGLKQYSFALYRPV

SEQ ID NO: 29748 - protein, 25 aa, synthetic construct
  source 1..25: note = Seed: YGFLNVIVHSATGFKQSSKALQRPV
YGFLNVIVHSATGLKQYSIALARPV

SEQ ID NO: 29749 - protein, 25 aa, synthetic construct
  source 1..25: note = Seed: YGFLNVIVHSATGFKQSSKALQRPV
YGFLNVIVHSATGLKQYSIALSRPV

SEQ ID NO: 29750 - protein, 25 aa, synthetic construct
  source 1..25: note = Seed: YGFLNVIVHSATGFKQSSKALQRPV
YGFLNVIVHSATGLKQYSKALKRPV

SEQ ID NO: 29751 - protein, 25 aa, synthetic construct
  source 1..25: note = Seed: YGFLNVIVHSATGFKQSSKALQRPV
YGFLNVIVHSATGLKQYSKALRRPV

SEQ ID NO: 29752 - protein, 25 aa, synthetic construct
  source 1..25: note = Seed: YGFLNVIVHSATGFKQSSKALQRPV
YGFLNVIVHSATGLKQYSKALSRPV

SEQ ID NO: 29753 - protein, 25 aa, synthetic construct
  source 1..25: note = Seed: YGFLNVIVHSATGFKQSSKALQRPV
YGFLNVIVHSATGLKQYSLALFRPV

SEQ ID NO: 29754 - protein, 25 aa, synthetic construct
  source 1..25: note = Seed: YGFLNVIVHSATGFKQSSKALQRPV
YGFLNVIVHSATGLKQYSPALARPV

SEQ ID NO: 29755 - protein, 25 aa, synthetic construct
  source 1..25: note = Seed: YGFLNVIVHSATGFKQSSKALQRPV
YGFLNVIVHSATGLKQYSRALARPV

SEQ ID NO: 29756 - protein, 25 aa, synthetic construct
  source 1..25: note = Seed: YGFLNVIVHSATGFKQSSKALQRPV
YGFLNVIVHSATGLKQYSRALHRPV

SEQ ID NO: 29757 - protein, 25 aa, synthetic construct
  source 1..25: note = Seed: YGFLNVIVHSATGFKQSSKALQRPV
YGFLNVIVHSATGLKQYSRALKRPV

SEQ ID NO: 29758 - protein, 25 aa, synthetic construct
  source 1..25: note = Seed: YGFLNVIVHSATGFKQSSKALQRPV
YGFLNVIVHSATGLKQYSRALRRPV

SEQ ID NO: 29759 - protein, 25 aa, synthetic construct
  source 1..25: note = Seed: YGFLNVIVHSATGFKQSSKALQRPV
YGFLNVIVHSATGLKQYSRALSRPV

SEQ ID NO: 29760 - protein, 25 aa, synthetic construct
  source 1..25: note = Seed: YGFLNVIVHSATGFKQSSKALQRPV
YGFLNVIVHSATGLKQYSRALYRPV

SEQ ID NO: 29761 - protein, 25 aa, synthetic construct
  source 1..25: note = Seed: YGFLNVIVHSATGFKQSSKALQRPV
YGFLNVIVHSATGLKQYSSALARPV

SEQ ID NO: 29762 - protein, 25 aa, synthetic construct
  source 1..25: note = Seed: YGFLNVIVHSATGFKQSSKALQRPV
YGFLNVIVHSATGLKQYSTALARPV

SEQ ID NO: 29763 - protein, 25 aa, synthetic construct
  source 1..25: note = Seed: YGFLNVIVHSATGFKQSSKALQRPV
YGFLNVIVHSATGLKQYSVALARPV

SEQ ID NO: 29764 - protein, 25 aa, synthetic construct
  source 1..25: note = Seed: YGFLNVIVHSATGFKQSSKALQRPV
YGFLNVIVHSATGLKQYSVALSRPV

SEQ ID NO: 29765 - protein, 25 aa, synthetic construct
  source 1..25: note = Seed: YGFLNVIVHSATGFKQSSKALQRPV
YGFLNVIVHSATGLKQYSYALLRPV

SEQ ID NO: 29766 - protein, 25 aa, synthetic construct
  source 1..25: note = Seed: YGFLNVIVHSATGFKQSSKALQRPV
YGFLNVIVHSATGLKQYSYALWRPV

SEQ ID NO: 29767 - protein, 25 aa, synthetic construct
  source 1..25: note = Seed: YGFLNVIVHSATGFKQSSKALQRPV
YGFLNVIVHSATGLKQYSYALYRPV

SEQ ID NO: 29768 - protein, 25 aa, synthetic construct
  source 1..25: note = Seed: YGFLNVIVHSATGFKQSSKALQRPV
YGFLNVIVHSATGMKQASAALARPV

SEQ ID NO: 29769 - protein, 25 aa, synthetic construct
  source 1..25: note = Seed: YGFLNVIVHSATGFKQSSKALQRPV
YGFLNVIVHSATGMKQASAALNRPV

SEQ ID NO: 29770 - protein, 25 aa, synthetic construct
  source 1..25: note = Seed: YGFLNVIVHSATGFKQSSKALQRPV
YGFLNVIVHSATGMKQASAALSRPV

SEQ ID NO: 29771 - protein, 25 aa, synthetic construct
  source 1..25: note = Seed: YGFLNVIVHSATGFKQSSKALQRPV
YGFLNVIVHSATGMKQASIALARPV

SEQ ID NO: 29772 - protein, 25 aa, synthetic construct
  source 1..25: note = Seed: YGFLNVIVHSATGFKQSSKALQRPV
YGFLNVIVHSATGMKQASIALNRPV

SEQ ID NO: 29773 - protein, 25 aa, synthetic construct
  source 1..25: note = Seed: YGFLNVIVHSATGFKQSSKALQRPV
YGFLNVIVHSATGMKQASIALSRPV

SEQ ID NO: 29774 - protein, 25 aa, synthetic construct
  source 1..25: note = Seed: YGFLNVIVHSATGFKQSSKALQRPV
YGFLNVIVHSATGMKQASKALARPV

SEQ ID NO: 29775 - protein, 25 aa, synthetic construct
  source 1..25: note = Seed: YGFLNVIVHSATGFKQSSKALQRPV
YGFLNVIVHSATGMKQASKALSRPV

SEQ ID NO: 29776 - protein, 25 aa, synthetic construct
  source 1..25: note = Seed: YGFLNVIVHSATGFKQSSKALQRPV
YGFLNVIVHSATGMKQASPALARPV

SEQ ID NO: 29777 - protein, 25 aa, synthetic construct
  source 1..25: note = Seed: YGFLNVIVHSATGFKQSSKALQRPV
YGFLNVIVHSATGMKQASPALNRPV

SEQ ID NO: 29778 - protein, 25 aa, synthetic construct
  source 1..25: note = Seed: YGFLNVIVHSATGFKQSSKALQRPV
YGFLNVIVHSATGMKQASPALSRPV

SEQ ID NO: 29779 - protein, 25 aa, synthetic construct
  source 1..25: note = Seed: YGFLNVIVHSATGFKQSSKALQRPV
YGFLNVIVHSATGMKQASRALARPV

SEQ ID NO: 29780 - protein, 25 aa, synthetic construct
  source 1..25: note = Seed: YGFLNVIVHSATGFKQSSKALQRPV
YGFLNVIVHSATGMKQASRALGRPV

SEQ ID NO: 29781 - protein, 25 aa, synthetic construct
  source 1..25: note = Seed: YGFLNVIVHSATGFKQSSKALQRPV
YGFLNVIVHSATGMKQASRALHRPV

SEQ ID NO: 29782 - protein, 25 aa, synthetic construct
  source 1..25: note = Seed: YGFLNVIVHSATGFKQSSKALQRPV
YGFLNVIVHSATGMKQASRALKRPV

SEQ ID NO: 29783 - protein, 25 aa, synthetic construct
  source 1..25: note = Seed: YGFLNVIVHSATGFKQSSKALQRPV
YGFLNVIVHSATGMKQASRALQRPV

SEQ ID NO: 29784 - protein, 25 aa, synthetic construct
  source 1..25: note = Seed: YGFLNVIVHSATGFKQSSKALQRPV
YGFLNVIVHSATGMKQASRALRRPV

SEQ ID NO: 29785 - protein, 25 aa, synthetic construct
  source 1..25: note = Seed: YGFLNVIVHSATGFKQSSKALQRPV
YGFLNVIVHSATGMKQASRALSRPV

SEQ ID NO: 29786 - protein, 25 aa, synthetic construct
  source 1..25: note = Seed: YGFLNVIVHSATGFKQSSKALQRPV
YGFLNVIVHSATGMKQASRALYRPV

SEQ ID NO: 29787 - protein, 25 aa, synthetic construct
  source 1..25: note = Seed: YGFLNVIVHSATGFKQSSKALQRPV
YGFLNVIVHSATGMKQASSALARPV

SEQ ID NO: 29788 - protein, 25 aa, synthetic construct
  source 1..25: note = Seed: YGFLNVIVHSATGFKQSSKALQRPV
YGFLNVIVHSATGMKQASSALNRPV

SEQ ID NO: 29789 - protein, 25 aa, synthetic construct
  source 1..25: note = Seed: YGFLNVIVHSATGFKQSSKALQRPV
YGFLNVIVHSATGMKQASSALSRPV

SEQ ID NO: 29790 - protein, 25 aa, synthetic construct
  source 1..25: note = Seed: YGFLNVIVHSATGFKQSSKALQRPV
YGFLNVIVHSATGMKQASTALARPV

SEQ ID NO: 29791 - protein, 25 aa, synthetic construct
  source 1..25: note = Seed: YGFLNVIVHSATGFKQSSKALQRPV
YGFLNVIVHSATGMKQASTALNRPV

SEQ ID NO: 29792 - protein, 25 aa, synthetic construct
  source 1..25: note = Seed: YGFLNVIVHSATGFKQSSKALQRPV
YGFLNVIVHSATGMKQASTALSRPV

SEQ ID NO: 29793 - protein, 25 aa, synthetic construct
  source 1..25: note = Seed: YGFLNVIVHSATGFKQSSKALQRPV
YGFLNVIVHSATGMKQASVALARPV

SEQ ID NO: 29794 - protein, 25 aa, synthetic construct
  source 1..25: note = Seed: YGFLNVIVHSATGFKQSSKALQRPV
YGFLNVIVHSATGMKQASVALNRPV

SEQ ID NO: 29795 - protein, 25 aa, synthetic construct
  source 1..25: note = Seed: YGFLNVIVHSATGFKQSSKALQRPV
YGFLNVIVHSATGMKQASVALSRPV

SEQ ID NO: 29796 - protein, 25 aa, synthetic construct
  source 1..25: note = Seed: YGFLNVIVHSATGFKQSSKALQRPV
YGFLNVIVHSATGMKQFSAALARPV

SEQ ID NO: 29797 - protein, 25 aa, synthetic construct
  source 1..25: note = Seed: YGFLNVIVHSATGFKQSSKALQRPV
YGFLNVIVHSATGMKQFSAALFRPV

SEQ ID NO: 29798 - protein, 25 aa, synthetic construct
  source 1..25: note = Seed: YGFLNVIVHSATGFKQSSKALQRPV
YGFLNVIVHSATGMKQFSAALGRPV

SEQ ID NO: 29799 - protein, 25 aa, synthetic construct
  source 1..25: note = Seed: YGFLNVIVHSATGFKQSSKALQRPV
YGFLNVIVHSATGMKQFSAALIRPV

SEQ ID NO: 29800 - protein, 25 aa, synthetic construct
  source 1..25: note = Seed: YGFLNVIVHSATGFKQSSKALQRPV
YGFLNVIVHSATGMKQFSAALNRPV

SEQ ID NO: 29801 - protein, 25 aa, synthetic construct
  source 1..25: note = Seed: YGFLNVIVHSATGFKQSSKALQRPV
YGFLNVIVHSATGMKQFSAALRRPV

SEQ ID NO: 29802 - protein, 25 aa, synthetic construct
  source 1..25: note = Seed: YGFLNVIVHSATGFKQSSKALQRPV
YGFLNVIVHSATGMKQFSAALSRPV

SEQ ID NO: 29803 - protein, 25 aa, synthetic construct
  source 1..25: note = Seed: YGFLNVIVHSATGFKQSSKALQRPV
YGFLNVIVHSATGMKQFSAALTRPV

SEQ ID NO: 29804 - protein, 25 aa, synthetic construct
  source 1..25: note = Seed: YGFLNVIVHSATGFKQSSKALQRPV
YGFLNVIVHSATGMKQFSAALVRPV

SEQ ID NO: 29805 - protein, 25 aa, synthetic construct
  source 1..25: note = Seed: YGFLNVIVHSATGFKQSSKALQRPV
YGFLNVIVHSATGMKQFSFALFRPV

SEQ ID NO: 29806 - protein, 25 aa, synthetic construct
  source 1..25: note = Seed: YGFLNVIVHSATGFKQSSKALQRPV
YGFLNVIVHSATGMKQFSFALIRPV

SEQ ID NO: 29807 - protein, 25 aa, synthetic construct
  source 1..25: note = Seed: YGFLNVIVHSATGFKQSSKALQRPV
YGFLNVIVHSATGMKQFSFALLRPV

SEQ ID NO: 29808 - protein, 25 aa, synthetic construct
  source 1..25: note = Seed: YGFLNVIVHSATGFKQSSKALQRPV
YGFLNVIVHSATGMKQFSFALMRPV

SEQ ID NO: 29809 - protein, 25 aa, synthetic construct
  source 1..25: note = Seed: YGFLNVIVHSATGFKQSSKALQRPV
YGFLNVIVHSATGMKQFSFALVRPV

SEQ ID NO: 29810 - protein, 25 aa, synthetic construct
  source 1..25: note = Seed: YGFLNVIVHSATGFKQSSKALQRPV
YGFLNVIVHSATGMKQFSFALWRPV

SEQ ID NO: 29811 - protein, 25 aa, synthetic construct
  source 1..25: note = Seed: YGFLNVIVHSATGFKQSSKALQRPV
YGFLNVIVHSATGMKQFSFALYRPV

SEQ ID NO: 29812 - protein, 25 aa, synthetic construct
  source 1..25: note = Seed: YGFLNVIVHSATGFKQSSKALQRPV
YGFLNVIVHSATGMKQFSGALARPV

SEQ ID NO: 29813 - protein, 25 aa, synthetic construct
  source 1..25: note = Seed: YGFLNVIVHSATGFKQSSKALQRPV
YGFLNVIVHSATGMKQFSHALARPV

SEQ ID NO: 29814 - protein, 25 aa, synthetic construct
  source 1..25: note = Seed: YGFLNVIVHSATGFKQSSKALQRPV
YGFLNVIVHSATGMKQFSHALSRPV

SEQ ID NO: 29815 - protein, 25 aa, synthetic construct
  source 1..25: note = Seed: YGFLNVIVHSATGFKQSSKALQRPV
YGFLNVIVHSATGMKQFSIALARPV

SEQ ID NO: 29816 - protein, 25 aa, synthetic construct
  source 1..25: note = Seed: YGFLNVIVHSATGFKQSSKALQRPV
YGFLNVIVHSATGMKQFSIALFRPV

SEQ ID NO: 29817 - protein, 25 aa, synthetic construct
  source 1..25: note = Seed: YGFLNVIVHSATGFKQSSKALQRPV
YGFLNVIVHSATGMKQFSIALGRPV

SEQ ID NO: 29818 - protein, 25 aa, synthetic construct
  source 1..25: note = Seed: YGFLNVIVHSATGFKQSSKALQRPV
YGFLNVIVHSATGMKQFSIALLRPV

SEQ ID NO: 29819 - protein, 25 aa, synthetic construct
  source 1..25: note = Seed: YGFLNVIVHSATGFKQSSKALQRPV
YGFLNVIVHSATGMKQFSIALNRPV

SEQ ID NO: 29820 - protein, 25 aa, synthetic construct
  source 1..25: note = Seed: YGFLNVIVHSATGFKQSSKALQRPV
YGFLNVIVHSATGMKQFSIALRRPV

SEQ ID NO: 29821 - protein, 25 aa, synthetic construct
  source 1..25: note = Seed: YGFLNVIVHSATGFKQSSKALQRPV
YGFLNVIVHSATGMKQFSIALSRPV

SEQ ID NO: 29822 - protein, 25 aa, synthetic construct
  source 1..25: note = Seed: YGFLNVIVHSATGFKQSSKALQRPV
YGFLNVIVHSATGMKQFSIALTRPV

SEQ ID NO: 29823 - protein, 25 aa, synthetic construct
  source 1..25: note = Seed: YGFLNVIVHSATGFKQSSKALQRPV
YGFLNVIVHSATGMKQFSIALVRPV

SEQ ID NO: 29824 - protein, 25 aa, synthetic construct
  source 1..25: note = Seed: YGFLNVIVHSATGFKQSSKALQRPV
YGFLNVIVHSATGMKQFSKALARPV

SEQ ID NO: 29825 - protein, 25 aa, synthetic construct
  source 1..25: note = Seed: YGFLNVIVHSATGFKQSSKALQRPV
YGFLNVIVHSATGMKQFSKALFRPV

SEQ ID NO: 29826 - protein, 25 aa, synthetic construct
  source 1..25: note = Seed: YGFLNVIVHSATGFKQSSKALQRPV
YGFLNVIVHSATGMKQFSKALGRPV

SEQ ID NO: 29827 - protein, 25 aa, synthetic construct
  source 1..25: note = Seed: YGFLNVIVHSATGFKQSSKALQRPV
YGFLNVIVHSATGMKQFSKALHRPV

SEQ ID NO: 29828 - protein, 25 aa, synthetic construct
  source 1..25: note = Seed: YGFLNVIVHSATGFKQSSKALQRPV
YGFLNVIVHSATGMKQFSKALIRPV

SEQ ID NO: 29829 - protein, 25 aa, synthetic construct
  source 1..25: note = Seed: YGFLNVIVHSATGFKQSSKALQRPV
YGFLNVIVHSATGMKQFSKALKRPV

SEQ ID NO: 29830 - protein, 25 aa, synthetic construct
  source 1..25: note = Seed: YGFLNVIVHSATGFKQSSKALQRPV
YGFLNVIVHSATGMKQFSKALLRPV

SEQ ID NO: 29831 - protein, 25 aa, synthetic construct
  source 1..25: note = Seed: YGFLNVIVHSATGFKQSSKALQRPV
YGFLNVIVHSATGMKQFSKALMRPV

SEQ ID NO: 29832 - protein, 25 aa, synthetic construct
  source 1..25: note = Seed: YGFLNVIVHSATGFKQSSKALQRPV
YGFLNVIVHSATGMKQFSKALQRPV

SEQ ID NO: 29833 - protein, 25 aa, synthetic construct
  source 1..25: note = Seed: YGFLNVIVHSATGFKQSSKALQRPV
YGFLNVIVHSATGMKQFSKALRRPV

SEQ ID NO: 29834 - protein, 25 aa, synthetic construct
  source 1..25: note = Seed: YGFLNVIVHSATGFKQSSKALQRPV
YGFLNVIVHSATGMKQFSKALSRPV

SEQ ID NO: 29835 - protein, 25 aa, synthetic construct
  source 1..25: note = Seed: YGFLNVIVHSATGFKQSSKALQRPV
YGFLNVIVHSATGMKQFSKALTRPV

SEQ ID NO: 29836 - protein, 25 aa, synthetic construct
  source 1..25: note = Seed: YGFLNVIVHSATGFKQSSKALQRPV
YGFLNVIVHSATGMKQFSKALVRPV

SEQ ID NO: 29837 - protein, 25 aa, synthetic construct
  source 1..25: note = Seed: YGFLNVIVHSATGFKQSSKALQRPV
YGFLNVIVHSATGMKQFSKALYRPV

SEQ ID NO: 29838 - protein, 25 aa, synthetic construct
  source 1..25: note = Seed: YGFLNVIVHSATGFKQSSKALQRPV
YGFLNVIVHSATGMKQFSLALARPV

SEQ ID NO: 29839 - protein, 25 aa, synthetic construct
  source 1..25: note = Seed: YGFLNVIVHSATGFKQSSKALQRPV
YGFLNVIVHSATGMKQFSLALFRPV

SEQ ID NO: 29840 - protein, 25 aa, synthetic construct
  source 1..25: note = Seed: YGFLNVIVHSATGFKQSSKALQRPV
YGFLNVIVHSATGMKQFSLALGRPV

SEQ ID NO: 29841 - protein, 25 aa, synthetic construct
  source 1..25: note = Seed: YGFLNVIVHSATGFKQSSKALQRPV
YGFLNVIVHSATGMKQFSLALIRPV

SEQ ID NO: 29842 - protein, 25 aa, synthetic construct
  source 1..25: note = Seed: YGFLNVIVHSATGFKQSSKALQRPV
YGFLNVIVHSATGMKQFSLALLRPV

SEQ ID NO: 29843 - protein, 25 aa, synthetic construct
  source 1..25: note = Seed: YGFLNVIVHSATGFKQSSKALQRPV
YGFLNVIVHSATGMKQFSLALMRPV

SEQ ID NO: 29844 - protein, 25 aa, synthetic construct
  source 1..25: note = Seed: YGFLNVIVHSATGFKQSSKALQRPV
YGFLNVIVHSATGMKQFSLALNRPV

SEQ ID NO: 29845 - protein, 25 aa, synthetic construct
  source 1..25: note = Seed: YGFLNVIVHSATGFKQSSKALQRPV
YGFLNVIVHSATGMKQFSLALRRPV

SEQ ID NO: 29846 - protein, 25 aa, synthetic construct
  source 1..25: note = Seed: YGFLNVIVHSATGFKQSSKALQRPV
YGFLNVIVHSATGMKQFSLALSRPV

SEQ ID NO: 29847 - protein, 25 aa, synthetic construct
  source 1..25: note = Seed: YGFLNVIVHSATGFKQSSKALQRPV
YGFLNVIVHSATGMKQFSLALYRPV

SEQ ID NO: 29848 - protein, 25 aa, synthetic construct
  source 1..25: note = Seed: YGFLNVIVHSATGFKQSSKALQRPV
YGFLNVIVHSATGMKQFSMALFRPV

SEQ ID NO: 29849 - protein, 25 aa, synthetic construct
  source 1..25: note = Seed: YGFLNVIVHSATGFKQSSKALQRPV
YGFLNVIVHSATGMKQFSMALGRPV

SEQ ID NO: 29850 - protein, 25 aa, synthetic construct
  source 1..25: note = Seed: YGFLNVIVHSATGFKQSSKALQRPV
YGFLNVIVHSATGMKQFSMALLRPV

SEQ ID NO: 29851 - protein, 25 aa, synthetic construct
  source 1..25: note = Seed: YGFLNVIVHSATGFKQSSKALQRPV
YGFLNVIVHSATGMKQFSMALMRPV

SEQ ID NO: 29852 - protein, 25 aa, synthetic construct
  source 1..25: note = Seed: YGFLNVIVHSATGFKQSSKALQRPV
YGFLNVIVHSATGMKQFSMALNRPV

SEQ ID NO: 29853 - protein, 25 aa, synthetic construct
  source 1..25: note = Seed: YGFLNVIVHSATGFKQSSKALQRPV
YGFLNVIVHSATGMKQFSMALRRPV

SEQ ID NO: 29854 - protein, 25 aa, synthetic construct
  source 1..25: note = Seed: YGFLNVIVHSATGFKQSSKALQRPV
YGFLNVIVHSATGMKQFSMALSRPV

SEQ ID NO: 29855 - protein, 25 aa, synthetic construct
  source 1..25: note = Seed: YGFLNVIVHSATGFKQSSKALQRPV
YGFLNVIVHSATGMKQFSNALARPV

SEQ ID NO: 29856 - protein, 25 aa, synthetic construct
  source 1..25: note = Seed: YGFLNVIVHSATGFKQSSKALQRPV
YGFLNVIVHSATGMKQFSPALARPV

SEQ ID NO: 29857 - protein, 25 aa, synthetic construct
  source 1..25: note = Seed: YGFLNVIVHSATGFKQSSKALQRPV
YGFLNVIVHSATGMKQFSPALNRPV

SEQ ID NO: 29858 - protein, 25 aa, synthetic construct
  source 1..25: note = Seed: YGFLNVIVHSATGFKQSSKALQRPV
YGFLNVIVHSATGMKQFSPALSRPV

SEQ ID NO: 29859 - protein, 25 aa, synthetic construct
  source 1..25: note = Seed: YGFLNVIVHSATGFKQSSKALQRPV
YGFLNVIVHSATGMKQFSPALTRPV

SEQ ID NO: 29860 - protein, 25 aa, synthetic construct
  source 1..25: note = Seed: YGFLNVIVHSATGFKQSSKALQRPV
YGFLNVIVHSATGMKQFSRALARPV

SEQ ID NO: 29861 - protein, 25 aa, synthetic construct
  source 1..25: note = Seed: YGFLNVIVHSATGFKQSSKALQRPV
YGFLNVIVHSATGMKQFSRALFRPV

SEQ ID NO: 29862 - protein, 25 aa, synthetic construct
  source 1..25: note = Seed: YGFLNVIVHSATGFKQSSKALQRPV
YGFLNVIVHSATGMKQFSRALGRPV

SEQ ID NO: 29863 - protein, 25 aa, synthetic construct
  source 1..25: note = Seed: YGFLNVIVHSATGFKQSSKALQRPV
YGFLNVIVHSATGMKQFSRALHRPV

SEQ ID NO: 29864 - protein, 25 aa, synthetic construct
  source 1..25: note = Seed: YGFLNVIVHSATGFKQSSKALQRPV
YGFLNVIVHSATGMKQFSRALIRPV

SEQ ID NO: 29865 - protein, 25 aa, synthetic construct
  source 1..25: note = Seed: YGFLNVIVHSATGFKQSSKALQRPV
YGFLNVIVHSATGMKQFSRALKRPV

SEQ ID NO: 29866 - protein, 25 aa, synthetic construct
  source 1..25: note = Seed: YGFLNVIVHSATGFKQSSKALQRPV
YGFLNVIVHSATGMKQFSRALMRPV

SEQ ID NO: 29867 - protein, 25 aa, synthetic construct
  source 1..25: note = Seed: YGFLNVIVHSATGFKQSSKALQRPV
YGFLNVIVHSATGMKQFSRALQRPV

SEQ ID NO: 29868 - protein, 25 aa, synthetic construct
  source 1..25: note = Seed: YGFLNVIVHSATGFKQSSKALQRPV
YGFLNVIVHSATGMKQFSRALRRPV

SEQ ID NO: 29869 - protein, 25 aa, synthetic construct
  source 1..25: note = Seed: YGFLNVIVHSATGFKQSSKALQRPV
YGFLNVIVHSATGMKQFSRALSRPV

SEQ ID NO: 29870 - protein, 25 aa, synthetic construct
  source 1..25: note = Seed: YGFLNVIVHSATGFKQSSKALQRPV
YGFLNVIVHSATGMKQFSRALTRPV

SEQ ID NO: 29871 - protein, 25 aa, synthetic construct
  source 1..25: note = Seed: YGFLNVIVHSATGFKQSSKALQRPV
YGFLNVIVHSATGMKQFSRALVRPV

SEQ ID NO: 29872 - protein, 25 aa, synthetic construct
  source 1..25: note = Seed: YGFLNVIVHSATGFKQSSKALQRPV
YGFLNVIVHSATGMKQFSRALYRPV

SEQ ID NO: 29873 - protein, 25 aa, synthetic construct
  source 1..25: note = Seed: YGFLNVIVHSATGFKQSSKALQRPV
YGFLNVIVHSATGMKQFSSALARPV

SEQ ID NO: 29874 - protein, 25 aa, synthetic construct
  source 1..25: note = Seed: YGFLNVIVHSATGFKQSSKALQRPV
YGFLNVIVHSATGMKQFSSALSRPV

SEQ ID NO: 29875 - protein, 25 aa, synthetic construct
  source 1..25: note = Seed: YGFLNVIVHSATGFKQSSKALQRPV
YGFLNVIVHSATGMKQFSSALTRPV

SEQ ID NO: 29876 - protein, 25 aa, synthetic construct
  source 1..25: note = Seed: YGFLNVIVHSATGFKQSSKALQRPV
YGFLNVIVHSATGMKQFSSALVRPV

SEQ ID NO: 29877 - protein, 25 aa, synthetic construct
  source 1..25: note = Seed: YGFLNVIVHSATGFKQSSKALQRPV
YGFLNVIVHSATGMKQFSTALARPV

SEQ ID NO: 29878 - protein, 25 aa, synthetic construct
  source 1..25: note = Seed: YGFLNVIVHSATGFKQSSKALQRPV
YGFLNVIVHSATGMKQFSTALFRPV

SEQ ID NO: 29879 - protein, 25 aa, synthetic construct
  source 1..25: note = Seed: YGFLNVIVHSATGFKQSSKALQRPV
YGFLNVIVHSATGMKQFSTALNRPV

SEQ ID NO: 29880 - protein, 25 aa, synthetic construct
  source 1..25: note = Seed: YGFLNVIVHSATGFKQSSKALQRPV
YGFLNVIVHSATGMKQFSTALSRPV

SEQ ID NO: 29881 - protein, 25 aa, synthetic construct
  source 1..25: note = Seed: YGFLNVIVHSATGFKQSSKALQRPV
YGFLNVIVHSATGMKQFSTALTRPV

SEQ ID NO: 29882 - protein, 25 aa, synthetic construct
  source 1..25: note = Seed: YGFLNVIVHSATGFKQSSKALQRPV
YGFLNVIVHSATGMKQFSVALARPV

SEQ ID NO: 29883 - protein, 25 aa, synthetic construct
  source 1..25: note = Seed: YGFLNVIVHSATGFKQSSKALQRPV
YGFLNVIVHSATGMKQFSVALFRPV

SEQ ID NO: 29884 - protein, 25 aa, synthetic construct
  source 1..25: note = Seed: YGFLNVIVHSATGFKQSSKALQRPV
YGFLNVIVHSATGMKQFSVALGRPV

SEQ ID NO: 29885 - protein, 25 aa, synthetic construct
  source 1..25: note = Seed: YGFLNVIVHSATGFKQSSKALQRPV
YGFLNVIVHSATGMKQFSVALLRPV

SEQ ID NO: 29886 - protein, 25 aa, synthetic construct
  source 1..25: note = Seed: YGFLNVIVHSATGFKQSSKALQRPV
YGFLNVIVHSATGMKQFSVALNRPV

SEQ ID NO: 29887 - protein, 25 aa, synthetic construct
  source 1..25: note = Seed: YGFLNVIVHSATGFKQSSKALQRPV
YGFLNVIVHSATGMKQFSVALRRPV

SEQ ID NO: 29888 - protein, 25 aa, synthetic construct
  source 1..25: note = Seed: YGFLNVIVHSATGFKQSSKALQRPV
YGFLNVIVHSATGMKQFSVALSRPV

SEQ ID NO: 29889 - protein, 25 aa, synthetic construct
  source 1..25: note = Seed: YGFLNVIVHSATGFKQSSKALQRPV
YGFLNVIVHSATGMKQFSVALTRPV

SEQ ID NO: 29890 - protein, 25 aa, synthetic construct
  source 1..25: note = Seed: YGFLNVIVHSATGFKQSSKALQRPV
YGFLNVIVHSATGMKQFSVALVRPV

SEQ ID NO: 29891 - protein, 25 aa, synthetic construct
  source 1..25: note = Seed: YGFLNVIVHSATGFKQSSKALQRPV
YGFLNVIVHSATGMKQFSWALIRPV

SEQ ID NO: 29892 - protein, 25 aa, synthetic construct
  source 1..25: note = Seed: YGFLNVIVHSATGFKQSSKALQRPV
YGFLNVIVHSATGMKQFSWALLRPV

SEQ ID NO: 29893 - protein, 25 aa, synthetic construct
  source 1..25: note = Seed: YGFLNVIVHSATGFKQSSKALQRPV
YGFLNVIVHSATGMKQFSWALMRPV

SEQ ID NO: 29894 - protein, 25 aa, synthetic construct
  source 1..25: note = Seed: YGFLNVIVHSATGFKQSSKALQRPV
YGFLNVIVHSATGMKQFSYALIRPV

SEQ ID NO: 29895 - protein, 25 aa, synthetic construct
  source 1..25: note = Seed: YGFLNVIVHSATGFKQSSKALQRPV
YGFLNVIVHSATGMKQFSYALLRPV

SEQ ID NO: 29896 - protein, 25 aa, synthetic construct
  source 1..25: note = Seed: YGFLNVIVHSATGFKQSSKALQRPV
YGFLNVIVHSATGMKQFSYALMRPV

SEQ ID NO: 29897 - protein, 25 aa, synthetic construct
  source 1..25: note = Seed: YGFLNVIVHSATGFKQSSKALQRPV
YGFLNVIVHSATGMKQFSYALVRPV

SEQ ID NO: 29898 - protein, 25 aa, synthetic construct
  source 1..25: note = Seed: YGFLNVIVHSATGFKQSSKALQRPV
YGFLNVIVHSATGMKQFSYALYRPV

SEQ ID NO: 29899 - protein, 25 aa, synthetic construct
  source 1..25: note = Seed: YGFLNVIVHSATGFKQSSKALQRPV
YGFLNVIVHSATGMKQHSAALRRPV

SEQ ID NO: 29900 - protein, 25 aa, synthetic construct
  source 1..25: note = Seed: YGFLNVIVHSATGFKQSSKALQRPV
YGFLNVIVHSATGMKQHSIALRRPV

SEQ ID NO: 29901 - protein, 25 aa, synthetic construct
  source 1..25: note = Seed: YGFLNVIVHSATGFKQSSKALQRPV
YGFLNVIVHSATGMKQHSKALRRPV

SEQ ID NO: 29902 - protein, 25 aa, synthetic construct
  source 1..25: note = Seed: YGFLNVIVHSATGFKQSSKALQRPV
YGFLNVIVHSATGMKQHSKALYRPV

SEQ ID NO: 29903 - protein, 25 aa, synthetic construct
  source 1..25: note = Seed: YGFLNVIVHSATGFKQSSKALQRPV
YGFLNVIVHSATGMKQHSRALFRPV

SEQ ID NO: 29904 - protein, 25 aa, synthetic construct
  source 1..25: note = Seed: YGFLNVIVHSATGFKQSSKALQRPV
YGFLNVIVHSATGMKQHSRALRRPV

SEQ ID NO: 29905 - protein, 25 aa, synthetic construct
  source 1..25: note = Seed: YGFLNVIVHSATGFKQSSKALQRPV
YGFLNVIVHSATGMKQHSRALYRPV

SEQ ID NO: 29906 - protein, 25 aa, synthetic construct
  source 1..25: note = Seed: YGFLNVIVHSATGFKQSSKALQRPV
YGFLNVIVHSATGMKQHSVALRRPV

SEQ ID NO: 29907 - protein, 25 aa, synthetic construct
  source 1..25: note = Seed: YGFLNVIVHSATGFKQSSKALQRPV
YGFLNVIVHSATGMKQISAALARPV

SEQ ID NO: 29908 - protein, 25 aa, synthetic construct
  source 1..25: note = Seed: YGFLNVIVHSATGFKQSSKALQRPV
YGFLNVIVHSATGMKQISAALHRPV

SEQ ID NO: 29909 - protein, 25 aa, synthetic construct
  source 1..25: note = Seed: YGFLNVIVHSATGFKQSSKALQRPV
YGFLNVIVHSATGMKQISAALIRPV

SEQ ID NO: 29910 - protein, 25 aa, synthetic construct
  source 1..25: note = Seed: YGFLNVIVHSATGFKQSSKALQRPV
YGFLNVIVHSATGMKQISAALLRPV

SEQ ID NO: 29911 - protein, 25 aa, synthetic construct
  source 1..25: note = Seed: YGFLNVIVHSATGFKQSSKALQRPV
YGFLNVIVHSATGMKQISAALMRPV

SEQ ID NO: 29912 - protein, 25 aa, synthetic construct
  source 1..25: note = Seed: YGFLNVIVHSATGFKQSSKALQRPV
YGFLNVIVHSATGMKQISAALNRPV

SEQ ID NO: 29913 - protein, 25 aa, synthetic construct
  source 1..25: note = Seed: YGFLNVIVHSATGFKQSSKALQRPV
YGFLNVIVHSATGMKQISAALRRPV

SEQ ID NO: 29914 - protein, 25 aa, synthetic construct
  source 1..25: note = Seed: YGFLNVIVHSATGFKQSSKALQRPV
YGFLNVIVHSATGMKQISAALSRPV

SEQ ID NO: 29915 - protein, 25 aa, synthetic construct
  source 1..25: note = Seed: YGFLNVIVHSATGFKQSSKALQRPV
YGFLNVIVHSATGMKQISAALTRPV

SEQ ID NO: 29916 - protein, 25 aa, synthetic construct
  source 1..25: note = Seed: YGFLNVIVHSATGFKQSSKALQRPV
YGFLNVIVHSATGMKQISAALVRPV

SEQ ID NO: 29917 - protein, 25 aa, synthetic construct
  source 1..25: note = Seed: YGFLNVIVHSATGFKQSSKALQRPV
YGFLNVIVHSATGMKQISFALARPV

SEQ ID NO: 29918 - protein, 25 aa, synthetic construct
  source 1..25: note = Seed: YGFLNVIVHSATGFKQSSKALQRPV
YGFLNVIVHSATGMKQISFALFRPV

SEQ ID NO: 29919 - protein, 25 aa, synthetic construct
  source 1..25: note = Seed: YGFLNVIVHSATGFKQSSKALQRPV
YGFLNVIVHSATGMKQISFALIRPV

SEQ ID NO: 29920 - protein, 25 aa, synthetic construct
  source 1..25: note = Seed: YGFLNVIVHSATGFKQSSKALQRPV
YGFLNVIVHSATGMKQISFALLRPV

SEQ ID NO: 29921 - protein, 25 aa, synthetic construct
  source 1..25: note = Seed: YGFLNVIVHSATGFKQSSKALQRPV
YGFLNVIVHSATGMKQISFALMRPV

SEQ ID NO: 29922 - protein, 25 aa, synthetic construct
  source 1..25: note = Seed: YGFLNVIVHSATGFKQSSKALQRPV
YGFLNVIVHSATGMKQISFALVRPV

SEQ ID NO: 29923 - protein, 25 aa, synthetic construct
  source 1..25: note = Seed: YGFLNVIVHSATGFKQSSKALQRPV
YGFLNVIVHSATGMKQISFALYRPV

SEQ ID NO: 29924 - protein, 25 aa, synthetic construct
  source 1..25: note = Seed: YGFLNVIVHSATGFKQSSKALQRPV
YGFLNVIVHSATGMKQISGALARPV

SEQ ID NO: 29925 - protein, 25 aa, synthetic construct
  source 1..25: note = Seed: YGFLNVIVHSATGFKQSSKALQRPV
YGFLNVIVHSATGMKQISGALNRPV

SEQ ID NO: 29926 - protein, 25 aa, synthetic construct
  source 1..25: note = Seed: YGFLNVIVHSATGFKQSSKALQRPV
YGFLNVIVHSATGMKQISGALSRPV

SEQ ID NO: 29927 - protein, 25 aa, synthetic construct
  source 1..25: note = Seed: YGFLNVIVHSATGFKQSSKALQRPV
YGFLNVIVHSATGMKQISHALRRPV

SEQ ID NO: 29928 - protein, 25 aa, synthetic construct
  source 1..25: note = Seed: YGFLNVIVHSATGFKQSSKALQRPV
YGFLNVIVHSATGMKQISIALARPV

SEQ ID NO: 29929 - protein, 25 aa, synthetic construct
  source 1..25: note = Seed: YGFLNVIVHSATGFKQSSKALQRPV
YGFLNVIVHSATGMKQISIALKRPV

SEQ ID NO: 29930 - protein, 25 aa, synthetic construct
  source 1..25: note = Seed: YGFLNVIVHSATGFKQSSKALQRPV
YGFLNVIVHSATGMKQISIALNRPV

SEQ ID NO: 29931 - protein, 25 aa, synthetic construct
  source 1..25: note = Seed: YGFLNVIVHSATGFKQSSKALQRPV
YGFLNVIVHSATGMKQISIALRRPV

SEQ ID NO: 29932 - protein, 25 aa, synthetic construct
  source 1..25: note = Seed: YGFLNVIVHSATGFKQSSKALQRPV
YGFLNVIVHSATGMKQISIALSRPV

SEQ ID NO: 29933 - protein, 25 aa, synthetic construct
  source 1..25: note = Seed: YGFLNVIVHSATGFKQSSKALQRPV
YGFLNVIVHSATGMKQISIALTRPV

SEQ ID NO: 29934 - protein, 25 aa, synthetic construct
  source 1..25: note = Seed: YGFLNVIVHSATGFKQSSKALQRPV
YGFLNVIVHSATGMKQISKALARPV

SEQ ID NO: 29935 - protein, 25 aa, synthetic construct
  source 1..25: note = Seed: YGFLNVIVHSATGFKQSSKALQRPV
YGFLNVIVHSATGMKQISKALFRPV

SEQ ID NO: 29936 - protein, 25 aa, synthetic construct
  source 1..25: note = Seed: YGFLNVIVHSATGFKQSSKALQRPV
YGFLNVIVHSATGMKQISKALGRPV

SEQ ID NO: 29937 - protein, 25 aa, synthetic construct
  source 1..25: note = Seed: YGFLNVIVHSATGFKQSSKALQRPV
YGFLNVIVHSATGMKQISKALHRPV

SEQ ID NO: 29938 - protein, 25 aa, synthetic construct
  source 1..25: note = Seed: YGFLNVIVHSATGFKQSSKALQRPV
YGFLNVIVHSATGMKQISKALIRPV

SEQ ID NO: 29939 - protein, 25 aa, synthetic construct
  source 1..25: note = Seed: YGFLNVIVHSATGFKQSSKALQRPV
YGFLNVIVHSATGMKQISKALKRPV

SEQ ID NO: 29940 - protein, 25 aa, synthetic construct
  source 1..25: note = Seed: YGFLNVIVHSATGFKQSSKALQRPV
YGFLNVIVHSATGMKQISKALLRPV

SEQ ID NO: 29941 - protein, 25 aa, synthetic construct
  source 1..25: note = Seed: YGFLNVIVHSATGFKQSSKALQRPV
YGFLNVIVHSATGMKQISKALMRPV

SEQ ID NO: 29942 - protein, 25 aa, synthetic construct
  source 1..25: note = Seed: YGFLNVIVHSATGFKQSSKALQRPV
YGFLNVIVHSATGMKQISKALNRPV

SEQ ID NO: 29943 - protein, 25 aa, synthetic construct
  source 1..25: note = Seed: YGFLNVIVHSATGFKQSSKALQRPV
YGFLNVIVHSATGMKQISKALQRPV

SEQ ID NO: 29944 - protein, 25 aa, synthetic construct
  source 1..25: note = Seed: YGFLNVIVHSATGFKQSSKALQRPV
YGFLNVIVHSATGMKQISKALRRPV

SEQ ID NO: 29945 - protein, 25 aa, synthetic construct
  source 1..25: note = Seed: YGFLNVIVHSATGFKQSSKALQRPV
YGFLNVIVHSATGMKQISKALSRPV

SEQ ID NO: 29946 - protein, 25 aa, synthetic construct
  source 1..25: note = Seed: YGFLNVIVHSATGFKQSSKALQRPV
YGFLNVIVHSATGMKQISKALTRPV

SEQ ID NO: 29947 - protein, 25 aa, synthetic construct
  source 1..25: note = Seed: YGFLNVIVHSATGFKQSSKALQRPV
YGFLNVIVHSATGMKQISKALVRPV

SEQ ID NO: 29948 - protein, 25 aa, synthetic construct
  source 1..25: note = Seed: YGFLNVIVHSATGFKQSSKALQRPV
YGFLNVIVHSATGMKQISKALYRPV

SEQ ID NO: 29949 - protein, 25 aa, synthetic construct
  source 1..25: note = Seed: YGFLNVIVHSATGFKQSSKALQRPV
YGFLNVIVHSATGMKQISLALARPV

SEQ ID NO: 29950 - protein, 25 aa, synthetic construct
  source 1..25: note = Seed: YGFLNVIVHSATGFKQSSKALQRPV
YGFLNVIVHSATGMKQISLALFRPV

SEQ ID NO: 29951 - protein, 25 aa, synthetic construct
  source 1..25: note = Seed: YGFLNVIVHSATGFKQSSKALQRPV
YGFLNVIVHSATGMKQISLALNRPV

SEQ ID NO: 29952 - protein, 25 aa, synthetic construct
  source 1..25: note = Seed: YGFLNVIVHSATGFKQSSKALQRPV
YGFLNVIVHSATGMKQISLALRRPV

SEQ ID NO: 29953 - protein, 25 aa, synthetic construct
  source 1..25: note = Seed: YGFLNVIVHSATGFKQSSKALQRPV
YGFLNVIVHSATGMKQISLALSRPV

SEQ ID NO: 29954 - protein, 25 aa, synthetic construct
  source 1..25: note = Seed: YGFLNVIVHSATGFKQSSKALQRPV
YGFLNVIVHSATGMKQISMALARPV

SEQ ID NO: 29955 - protein, 25 aa, synthetic construct
  source 1..25: note = Seed: YGFLNVIVHSATGFKQSSKALQRPV
YGFLNVIVHSATGMKQISMALNRPV

SEQ ID NO: 29956 - protein, 25 aa, synthetic construct
  source 1..25: note = Seed: YGFLNVIVHSATGFKQSSKALQRPV
YGFLNVIVHSATGMKQISMALRRPV

SEQ ID NO: 29957 - protein, 25 aa, synthetic construct
  source 1..25: note = Seed: YGFLNVIVHSATGFKQSSKALQRPV
YGFLNVIVHSATGMKQISMALSRPV

SEQ ID NO: 29958 - protein, 25 aa, synthetic construct
  source 1..25: note = Seed: YGFLNVIVHSATGFKQSSKALQRPV
YGFLNVIVHSATGMKQISNALARPV

SEQ ID NO: 29959 - protein, 25 aa, synthetic construct
  source 1..25: note = Seed: YGFLNVIVHSATGFKQSSKALQRPV
YGFLNVIVHSATGMKQISPALARPV

SEQ ID NO: 29960 - protein, 25 aa, synthetic construct
  source 1..25: note = Seed: YGFLNVIVHSATGFKQSSKALQRPV
YGFLNVIVHSATGMKQISPALIRPV

SEQ ID NO: 29961 - protein, 25 aa, synthetic construct
  source 1..25: note = Seed: YGFLNVIVHSATGFKQSSKALQRPV
YGFLNVIVHSATGMKQISPALMRPV

SEQ ID NO: 29962 - protein, 25 aa, synthetic construct
  source 1..25: note = Seed: YGFLNVIVHSATGFKQSSKALQRPV
YGFLNVIVHSATGMKQISPALNRPV

SEQ ID NO: 29963 - protein, 25 aa, synthetic construct
  source 1..25: note = Seed: YGFLNVIVHSATGFKQSSKALQRPV
YGFLNVIVHSATGMKQISPALRRPV

SEQ ID NO: 29964 - protein, 25 aa, synthetic construct
  source 1..25: note = Seed: YGFLNVIVHSATGFKQSSKALQRPV
YGFLNVIVHSATGMKQISPALSRPV

SEQ ID NO: 29965 - protein, 25 aa, synthetic construct
  source 1..25: note = Seed: YGFLNVIVHSATGFKQSSKALQRPV
YGFLNVIVHSATGMKQISPALTRPV

SEQ ID NO: 29966 - protein, 25 aa, synthetic construct
  source 1..25: note = Seed: YGFLNVIVHSATGFKQSSKALQRPV
YGFLNVIVHSATGMKQISPALVRPV

SEQ ID NO: 29967 - protein, 25 aa, synthetic construct
  source 1..25: note = Seed: YGFLNVIVHSATGFKQSSKALQRPV
YGFLNVIVHSATGMKQISRALARPV

SEQ ID NO: 29968 - protein, 25 aa, synthetic construct
  source 1..25: note = Seed: YGFLNVIVHSATGFKQSSKALQRPV
YGFLNVIVHSATGMKQISRALFRPV

SEQ ID NO: 29969 - protein, 25 aa, synthetic construct
  source 1..25: note = Seed: YGFLNVIVHSATGFKQSSKALQRPV
YGFLNVIVHSATGMKQISRALGRPV

SEQ ID NO: 29970 - protein, 25 aa, synthetic construct
  source 1..25: note = Seed: YGFLNVIVHSATGFKQSSKALQRPV
YGFLNVIVHSATGMKQISRALHRPV

SEQ ID NO: 29971 - protein, 25 aa, synthetic construct
  source 1..25: note = Seed: YGFLNVIVHSATGFKQSSKALQRPV
YGFLNVIVHSATGMKQISRALIRPV

SEQ ID NO: 29972 - protein, 25 aa, synthetic construct
  source 1..25: note = Seed: YGFLNVIVHSATGFKQSSKALQRPV
YGFLNVIVHSATGMKQISRALKRPV

SEQ ID NO: 29973 - protein, 25 aa, synthetic construct
  source 1..25: note = Seed: YGFLNVIVHSATGFKQSSKALQRPV
YGFLNVIVHSATGMKQISRALLRPV

SEQ ID NO: 29974 - protein, 25 aa, synthetic construct
  source 1..25: note = Seed: YGFLNVIVHSATGFKQSSKALQRPV
YGFLNVIVHSATGMKQISRALMRPV

SEQ ID NO: 29975 - protein, 25 aa, synthetic construct
  source 1..25: note = Seed: YGFLNVIVHSATGFKQSSKALQRPV
YGFLNVIVHSATGMKQISRALNRPV

SEQ ID NO: 29976 - protein, 25 aa, synthetic construct
  source 1..25: note = Seed: YGFLNVIVHSATGFKQSSKALQRPV
YGFLNVIVHSATGMKQISRALPRPV

SEQ ID NO: 29977 - protein, 25 aa, synthetic construct
  source 1..25: note = Seed: YGFLNVIVHSATGFKQSSKALQRPV
YGFLNVIVHSATGMKQISRALQRPV

SEQ ID NO: 29978 - protein, 25 aa, synthetic construct
  source 1..25: note = Seed: YGFLNVIVHSATGFKQSSKALQRPV
YGFLNVIVHSATGMKQISRALRRPV

SEQ ID NO: 29979 - protein, 25 aa, synthetic construct
  source 1..25: note = Seed: YGFLNVIVHSATGFKQSSKALQRPV
YGFLNVIVHSATGMKQISRALSRPV

SEQ ID NO: 29980 - protein, 25 aa, synthetic construct
  source 1..25: note = Seed: YGFLNVIVHSATGFKQSSKALQRPV
YGFLNVIVHSATGMKQISRALTRPV

SEQ ID NO: 29981 - protein, 25 aa, synthetic construct
  source 1..25: note = Seed: YGFLNVIVHSATGFKQSSKALQRPV
YGFLNVIVHSATGMKQISRALVRPV

SEQ ID NO: 29982 - protein, 25 aa, synthetic construct
  source 1..25: note = Seed: YGFLNVIVHSATGFKQSSKALQRPV
YGFLNVIVHSATGMKQISRALYRPV

SEQ ID NO: 29983 - protein, 25 aa, synthetic construct
  source 1..25: note = Seed: YGFLNVIVHSATGFKQSSKALQRPV
YGFLNVIVHSATGMKQISSALARPV

SEQ ID NO: 29984 - protein, 25 aa, synthetic construct
  source 1..25: note = Seed: YGFLNVIVHSATGFKQSSKALQRPV
YGFLNVIVHSATGMKQISSALNRPV

SEQ ID NO: 29985 - protein, 25 aa, synthetic construct
  source 1..25: note = Seed: YGFLNVIVHSATGFKQSSKALQRPV
YGFLNVIVHSATGMKQISSALRRPV

SEQ ID NO: 29986 - protein, 25 aa, synthetic construct
  source 1..25: note = Seed: YGFLNVIVHSATGFKQSSKALQRPV
YGFLNVIVHSATGMKQISSALSRPV

SEQ ID NO: 29987 - protein, 25 aa, synthetic construct
  source 1..25: note = Seed: YGFLNVIVHSATGFKQSSKALQRPV
YGFLNVIVHSATGMKQISSALTRPV

SEQ ID NO: 29988 - protein, 25 aa, synthetic construct
  source 1..25: note = Seed: YGFLNVIVHSATGFKQSSKALQRPV
YGFLNVIVHSATGMKQISTALARPV

SEQ ID NO: 29989 - protein, 25 aa, synthetic construct
  source 1..25: note = Seed: YGFLNVIVHSATGFKQSSKALQRPV
YGFLNVIVHSATGMKQISTALNRPV

SEQ ID NO: 29990 - protein, 25 aa, synthetic construct
  source 1..25: note = Seed: YGFLNVIVHSATGFKQSSKALQRPV
YGFLNVIVHSATGMKQISTALRRPV

SEQ ID NO: 29991 - protein, 25 aa, synthetic construct
  source 1..25: note = Seed: YGFLNVIVHSATGFKQSSKALQRPV
YGFLNVIVHSATGMKQISTALSRPV

SEQ ID NO: 29992 - protein, 25 aa, synthetic construct
  source 1..25: note = Seed: YGFLNVIVHSATGFKQSSKALQRPV
YGFLNVIVHSATGMKQISTALTRPV

SEQ ID NO: 29993 - protein, 25 aa, synthetic construct
  source 1..25: note = Seed: YGFLNVIVHSATGFKQSSKALQRPV
YGFLNVIVHSATGMKQISTALVRPV

SEQ ID NO: 29994 - protein, 25 aa, synthetic construct
  source 1..25: note = Seed: YGFLNVIVHSATGFKQSSKALQRPV
YGFLNVIVHSATGMKQISVALARPV

SEQ ID NO: 29995 - protein, 25 aa, synthetic construct
  source 1..25: note = Seed: YGFLNVIVHSATGFKQSSKALQRPV
YGFLNVIVHSATGMKQISVALKRPV

SEQ ID NO: 29996 - protein, 25 aa, synthetic construct
  source 1..25: note = Seed: YGFLNVIVHSATGFKQSSKALQRPV
YGFLNVIVHSATGMKQISVALNRPV

SEQ ID NO: 29997 - protein, 25 aa, synthetic construct
  source 1..25: note = Seed: YGFLNVIVHSATGFKQSSKALQRPV
YGFLNVIVHSATGMKQISVALRRPV

SEQ ID NO: 29998 - protein, 25 aa, synthetic construct
  source 1..25: note = Seed: YGFLNVIVHSATGFKQSSKALQRPV
YGFLNVIVHSATGMKQISVALSRPV

SEQ ID NO: 29999 - protein, 25 aa, synthetic construct
  source 1..25: note = Seed: YGFLNVIVHSATGFKQSSKALQRPV
YGFLNVIVHSATGMKQISVALTRPV

SEQ ID NO: 30000 - protein, 25 aa, synthetic construct
  source 1..25: note = Seed: YGFLNVIVHSATGFKQSSKALQRPV
YGFLNVIVHSATGMKQISWALRRPV

SEQ ID NO: 30001 - protein, 25 aa, synthetic construct
  source 1..25: note = Seed: YGFLNVIVHSATGFKQSSKALQRPV
YGFLNVIVHSATGMKQISYALARPV

SEQ ID NO: 30002 - protein, 25 aa, synthetic construct
  source 1..25: note = Seed: YGFLNVIVHSATGFKQSSKALQRPV
YGFLNVIVHSATGMKQISYALLRPV

SEQ ID NO: 30003 - protein, 25 aa, synthetic construct
  source 1..25: note = Seed: YGFLNVIVHSATGFKQSSKALQRPV
YGFLNVIVHSATGMKQISYALRRPV

SEQ ID NO: 30004 - protein, 25 aa, synthetic construct
  source 1..25: note = Seed: YGFLNVIVHSATGFKQSSKALQRPV
YGFLNVIVHSATGMKQISYALWRPV

SEQ ID NO: 30005 - protein, 25 aa, synthetic construct
  source 1..25: note = Seed: YGFLNVIVHSATGFKQSSKALQRPV
YGFLNVIVHSATGMKQISYALYRPV

SEQ ID NO: 30006 - protein, 25 aa, synthetic construct
  source 1..25: note = Seed: YGFLNVIVHSATGFKQSSKALQRPV
YGFLNVIVHSATGMKQKSRALYRPV

SEQ ID NO: 30007 - protein, 25 aa, synthetic construct
  source 1..25: note = Seed: YGFLNVIVHSATGFKQSSKALQRPV
YGFLNVIVHSATGMKQLSAALARPV

SEQ ID NO: 30008 - protein, 25 aa, synthetic construct
  source 1..25: note = Seed: YGFLNVIVHSATGFKQSSKALQRPV
YGFLNVIVHSATGMKQLSAALDRPV

SEQ ID NO: 30009 - protein, 25 aa, synthetic construct
  source 1..25: note = Seed: YGFLNVIVHSATGFKQSSKALQRPV
YGFLNVIVHSATGMKQLSAALGRPV

SEQ ID NO: 30010 - protein, 25 aa, synthetic construct
  source 1..25: note = Seed: YGFLNVIVHSATGFKQSSKALQRPV
YGFLNVIVHSATGMKQLSAALHRPV

SEQ ID NO: 30011 - protein, 25 aa, synthetic construct
  source 1..25: note = Seed: YGFLNVIVHSATGFKQSSKALQRPV
YGFLNVIVHSATGMKQLSAALIRPV

SEQ ID NO: 30012 - protein, 25 aa, synthetic construct
  source 1..25: note = Seed: YGFLNVIVHSATGFKQSSKALQRPV
YGFLNVIVHSATGMKQLSAALLRPV

SEQ ID NO: 30013 - protein, 25 aa, synthetic construct
  source 1..25: note = Seed: YGFLNVIVHSATGFKQSSKALQRPV
YGFLNVIVHSATGMKQLSAALMRPV

SEQ ID NO: 30014 - protein, 25 aa, synthetic construct
  source 1..25: note = Seed: YGFLNVIVHSATGFKQSSKALQRPV
YGFLNVIVHSATGMKQLSAALNRPV

SEQ ID NO: 30015 - protein, 25 aa, synthetic construct
  source 1..25: note = Seed: YGFLNVIVHSATGFKQSSKALQRPV
YGFLNVIVHSATGMKQLSAALPRPV

SEQ ID NO: 30016 - protein, 25 aa, synthetic construct
  source 1..25: note = Seed: YGFLNVIVHSATGFKQSSKALQRPV
YGFLNVIVHSATGMKQLSAALQRPV

SEQ ID NO: 30017 - protein, 25 aa, synthetic construct
  source 1..25: note = Seed: YGFLNVIVHSATGFKQSSKALQRPV
YGFLNVIVHSATGMKQLSAALSRPV

SEQ ID NO: 30018 - protein, 25 aa, synthetic construct
  source 1..25: note = Seed: YGFLNVIVHSATGFKQSSKALQRPV
YGFLNVIVHSATGMKQLSAALTRPV

SEQ ID NO: 30019 - protein, 25 aa, synthetic construct
  source 1..25: note = Seed: YGFLNVIVHSATGFKQSSKALQRPV
YGFLNVIVHSATGMKQLSAALVRPV

SEQ ID NO: 30020 - protein, 25 aa, synthetic construct
  source 1..25: note = Seed: YGFLNVIVHSATGFKQSSKALQRPV
YGFLNVIVHSATGMKQLSFALARPV

SEQ ID NO: 30021 - protein, 25 aa, synthetic construct
  source 1..25: note = Seed: YGFLNVIVHSATGFKQSSKALQRPV
YGFLNVIVHSATGMKQLSFALFRPV

SEQ ID NO: 30022 - protein, 25 aa, synthetic construct
  source 1..25: note = Seed: YGFLNVIVHSATGFKQSSKALQRPV
YGFLNVIVHSATGMKQLSFALIRPV

SEQ ID NO: 30023 - protein, 25 aa, synthetic construct
  source 1..25: note = Seed: YGFLNVIVHSATGFKQSSKALQRPV
YGFLNVIVHSATGMKQLSFALLRPV

SEQ ID NO: 30024 - protein, 25 aa, synthetic construct
  source 1..25: note = Seed: YGFLNVIVHSATGFKQSSKALQRPV
YGFLNVIVHSATGMKQLSFALMRPV

SEQ ID NO: 30025 - protein, 25 aa, synthetic construct
  source 1..25: note = Seed: YGFLNVIVHSATGFKQSSKALQRPV
YGFLNVIVHSATGMKQLSFALVRPV

SEQ ID NO: 30026 - protein, 25 aa, synthetic construct
  source 1..25: note = Seed: YGFLNVIVHSATGFKQSSKALQRPV
YGFLNVIVHSATGMKQLSFALYRPV

SEQ ID NO: 30027 - protein, 25 aa, synthetic construct
  source 1..25: note = Seed: YGFLNVIVHSATGFKQSSKALQRPV
YGFLNVIVHSATGMKQLSGALARPV

SEQ ID NO: 30028 - protein, 25 aa, synthetic construct
  source 1..25: note = Seed: YGFLNVIVHSATGFKQSSKALQRPV
YGFLNVIVHSATGMKQLSGALNRPV

SEQ ID NO: 30029 - protein, 25 aa, synthetic construct
  source 1..25: note = Seed: YGFLNVIVHSATGFKQSSKALQRPV
YGFLNVIVHSATGMKQLSGALSRPV

SEQ ID NO: 30030 - protein, 25 aa, synthetic construct
  source 1..25: note = Seed: YGFLNVIVHSATGFKQSSKALQRPV
YGFLNVIVHSATGMKQLSGALTRPV

SEQ ID NO: 30031 - protein, 25 aa, synthetic construct
  source 1..25: note = Seed: YGFLNVIVHSATGFKQSSKALQRPV
YGFLNVIVHSATGMKQLSGALVRPV

SEQ ID NO: 30032 - protein, 25 aa, synthetic construct
  source 1..25: note = Seed: YGFLNVIVHSATGFKQSSKALQRPV
YGFLNVIVHSATGMKQLSIALARPV

SEQ ID NO: 30033 - protein, 25 aa, synthetic construct
  source 1..25: note = Seed: YGFLNVIVHSATGFKQSSKALQRPV
YGFLNVIVHSATGMKQLSIALGRPV

SEQ ID NO: 30034 - protein, 25 aa, synthetic construct
  source 1..25: note = Seed: YGFLNVIVHSATGFKQSSKALQRPV
YGFLNVIVHSATGMKQLSIALHRPV

SEQ ID NO: 30035 - protein, 25 aa, synthetic construct
  source 1..25: note = Seed: YGFLNVIVHSATGFKQSSKALQRPV
YGFLNVIVHSATGMKQLSIALIRPV

SEQ ID NO: 30036 - protein, 25 aa, synthetic construct
  source 1..25: note = Seed: YGFLNVIVHSATGFKQSSKALQRPV
YGFLNVIVHSATGMKQLSIALKRPV

SEQ ID NO: 30037 - protein, 25 aa, synthetic construct
  source 1..25: note = Seed: YGFLNVIVHSATGFKQSSKALQRPV
YGFLNVIVHSATGMKQLSIALMRPV

SEQ ID NO: 30038 - protein, 25 aa, synthetic construct
  source 1..25: note = Seed: YGFLNVIVHSATGFKQSSKALQRPV
YGFLNVIVHSATGMKQLSIALNRPV

SEQ ID NO: 30039 - protein, 25 aa, synthetic construct
  source 1..25: note = Seed: YGFLNVIVHSATGFKQSSKALQRPV
YGFLNVIVHSATGMKQLSIALRRPV

SEQ ID NO: 30040 - protein, 25 aa, synthetic construct
  source 1..25: note = Seed: YGFLNVIVHSATGFKQSSKALQRPV
YGFLNVIVHSATGMKQLSIALSRPV

SEQ ID NO: 30041 - protein, 25 aa, synthetic construct
  source 1..25: note = Seed: YGFLNVIVHSATGFKQSSKALQRPV
YGFLNVIVHSATGMKQLSIALTRPV

SEQ ID NO: 30042 - protein, 25 aa, synthetic construct
  source 1..25: note = Seed: YGFLNVIVHSATGFKQSSKALQRPV
YGFLNVIVHSATGMKQLSIALVRPV

SEQ ID NO: 30043 - protein, 25 aa, synthetic construct
  source 1..25: note = Seed: YGFLNVIVHSATGFKQSSKALQRPV
YGFLNVIVHSATGMKQLSKALARPV

SEQ ID NO: 30044 - protein, 25 aa, synthetic construct
  source 1..25: note = Seed: YGFLNVIVHSATGFKQSSKALQRPV
YGFLNVIVHSATGMKQLSKALGRPV

SEQ ID NO: 30045 - protein, 25 aa, synthetic construct
  source 1..25: note = Seed: YGFLNVIVHSATGFKQSSKALQRPV
YGFLNVIVHSATGMKQLSKALHRPV

SEQ ID NO: 30046 - protein, 25 aa, synthetic construct
  source 1..25: note = Seed: YGFLNVIVHSATGFKQSSKALQRPV
YGFLNVIVHSATGMKQLSKALIRPV

SEQ ID NO: 30047 - protein, 25 aa, synthetic construct
  source 1..25: note = Seed: YGFLNVIVHSATGFKQSSKALQRPV
YGFLNVIVHSATGMKQLSKALKRPV

SEQ ID NO: 30048 - protein, 25 aa, synthetic construct
  source 1..25: note = Seed: YGFLNVIVHSATGFKQSSKALQRPV
YGFLNVIVHSATGMKQLSKALLRPV

SEQ ID NO: 30049 - protein, 25 aa, synthetic construct
  source 1..25: note = Seed: YGFLNVIVHSATGFKQSSKALQRPV
YGFLNVIVHSATGMKQLSKALMRPV

SEQ ID NO: 30050 - protein, 25 aa, synthetic construct
  source 1..25: note = Seed: YGFLNVIVHSATGFKQSSKALQRPV
YGFLNVIVHSATGMKQLSKALNRPV

SEQ ID NO: 30051 - protein, 25 aa, synthetic construct
  source 1..25: note = Seed: YGFLNVIVHSATGFKQSSKALQRPV
YGFLNVIVHSATGMKQLSKALQRPV

SEQ ID NO: 30052 - protein, 25 aa, synthetic construct
  source 1..25: note = Seed: YGFLNVIVHSATGFKQSSKALQRPV
YGFLNVIVHSATGMKQLSKALRRPV

SEQ ID NO: 30053 - protein, 25 aa, synthetic construct
  source 1..25: note = Seed: YGFLNVIVHSATGFKQSSKALQRPV
YGFLNVIVHSATGMKQLSKALSRPV

SEQ ID NO: 30054 - protein, 25 aa, synthetic construct
  source 1..25: note = Seed: YGFLNVIVHSATGFKQSSKALQRPV
YGFLNVIVHSATGMKQLSKALTRPV

SEQ ID NO: 30055 - protein, 25 aa, synthetic construct
  source 1..25: note = Seed: YGFLNVIVHSATGFKQSSKALQRPV
YGFLNVIVHSATGMKQLSKALVRPV

SEQ ID NO: 30056 - protein, 25 aa, synthetic construct
  source 1..25: note = Seed: YGFLNVIVHSATGFKQSSKALQRPV
YGFLNVIVHSATGMKQLSKALYRPV

SEQ ID NO: 30057 - protein, 25 aa, synthetic construct
  source 1..25: note = Seed: YGFLNVIVHSATGFKQSSKALQRPV
YGFLNVIVHSATGMKQLSLALARPV

SEQ ID NO: 30058 - protein, 25 aa, synthetic construct
  source 1..25: note = Seed: YGFLNVIVHSATGFKQSSKALQRPV
YGFLNVIVHSATGMKQLSLALFRPV

SEQ ID NO: 30059 - protein, 25 aa, synthetic construct
  source 1..25: note = Seed: YGFLNVIVHSATGFKQSSKALQRPV
YGFLNVIVHSATGMKQLSLALNRPV

SEQ ID NO: 30060 - protein, 25 aa, synthetic construct
  source 1..25: note = Seed: YGFLNVIVHSATGFKQSSKALQRPV
YGFLNVIVHSATGMKQLSLALRRPV

SEQ ID NO: 30061 - protein, 25 aa, synthetic construct
  source 1..25: note = Seed: YGFLNVIVHSATGFKQSSKALQRPV
YGFLNVIVHSATGMKQLSLALSRPV

SEQ ID NO: 30062 - protein, 25 aa, synthetic construct
  source 1..25: note = Seed: YGFLNVIVHSATGFKQSSKALQRPV
YGFLNVIVHSATGMKQLSLALTRPV

SEQ ID NO: 30063 - protein, 25 aa, synthetic construct
  source 1..25: note = Seed: YGFLNVIVHSATGFKQSSKALQRPV
YGFLNVIVHSATGMKQLSLALVRPV

SEQ ID NO: 30064 - protein, 25 aa, synthetic construct
  source 1..25: note = Seed: YGFLNVIVHSATGFKQSSKALQRPV
YGFLNVIVHSATGMKQLSMALARPV

SEQ ID NO: 30065 - protein, 25 aa, synthetic construct
  source 1..25: note = Seed: YGFLNVIVHSATGFKQSSKALQRPV
YGFLNVIVHSATGMKQLSMALFRPV

SEQ ID NO: 30066 - protein, 25 aa, synthetic construct
  source 1..25: note = Seed: YGFLNVIVHSATGFKQSSKALQRPV
YGFLNVIVHSATGMKQLSMALNRPV

SEQ ID NO: 30067 - protein, 25 aa, synthetic construct
  source 1..25: note = Seed: YGFLNVIVHSATGFKQSSKALQRPV
YGFLNVIVHSATGMKQLSMALSRPV

SEQ ID NO: 30068 - protein, 25 aa, synthetic construct
  source 1..25: note = Seed: YGFLNVIVHSATGFKQSSKALQRPV
YGFLNVIVHSATGMKQLSMALTRPV

SEQ ID NO: 30069 - protein, 25 aa, synthetic construct
  source 1..25: note = Seed: YGFLNVIVHSATGFKQSSKALQRPV
YGFLNVIVHSATGMKQLSMALVRPV

SEQ ID NO: 30070 - protein, 25 aa, synthetic construct
  source 1..25: note = Seed: YGFLNVIVHSATGFKQSSKALQRPV
YGFLNVIVHSATGMKQLSNALARPV

SEQ ID NO: 30071 - protein, 25 aa, synthetic construct
  source 1..25: note = Seed: YGFLNVIVHSATGFKQSSKALQRPV
YGFLNVIVHSATGMKQLSNALNRPV

SEQ ID NO: 30072 - protein, 25 aa, synthetic construct
  source 1..25: note = Seed: YGFLNVIVHSATGFKQSSKALQRPV
YGFLNVIVHSATGMKQLSNALSRPV

SEQ ID NO: 30073 - protein, 25 aa, synthetic construct
  source 1..25: note = Seed: YGFLNVIVHSATGFKQSSKALQRPV
YGFLNVIVHSATGMKQLSPALARPV

SEQ ID NO: 30074 - protein, 25 aa, synthetic construct
  source 1..25: note = Seed: YGFLNVIVHSATGFKQSSKALQRPV
YGFLNVIVHSATGMKQLSPALGRPV

SEQ ID NO: 30075 - protein, 25 aa, synthetic construct
  source 1..25: note = Seed: YGFLNVIVHSATGFKQSSKALQRPV
YGFLNVIVHSATGMKQLSPALHRPV

SEQ ID NO: 30076 - protein, 25 aa, synthetic construct
  source 1..25: note = Seed: YGFLNVIVHSATGFKQSSKALQRPV
YGFLNVIVHSATGMKQLSPALIRPV

SEQ ID NO: 30077 - protein, 25 aa, synthetic construct
  source 1..25: note = Seed: YGFLNVIVHSATGFKQSSKALQRPV
YGFLNVIVHSATGMKQLSPALLRPV

SEQ ID NO: 30078 - protein, 25 aa, synthetic construct
  source 1..25: note = Seed: YGFLNVIVHSATGFKQSSKALQRPV
YGFLNVIVHSATGMKQLSPALMRPV

SEQ ID NO: 30079 - protein, 25 aa, synthetic construct
  source 1..25: note = Seed: YGFLNVIVHSATGFKQSSKALQRPV
YGFLNVIVHSATGMKQLSPALNRPV

SEQ ID NO: 30080 - protein, 25 aa, synthetic construct
  source 1..25: note = Seed: YGFLNVIVHSATGFKQSSKALQRPV
YGFLNVIVHSATGMKQLSPALQRPV

SEQ ID NO: 30081 - protein, 25 aa, synthetic construct
  source 1..25: note = Seed: YGFLNVIVHSATGFKQSSKALQRPV
YGFLNVIVHSATGMKQLSPALSRPV

SEQ ID NO: 30082 - protein, 25 aa, synthetic construct
  source 1..25: note = Seed: YGFLNVIVHSATGFKQSSKALQRPV
YGFLNVIVHSATGMKQLSPALTRPV

SEQ ID NO: 30083 - protein, 25 aa, synthetic construct
  source 1..25: note = Seed: YGFLNVIVHSATGFKQSSKALQRPV
YGFLNVIVHSATGMKQLSPALVRPV

SEQ ID NO: 30084 - protein, 25 aa, synthetic construct
  source 1..25: note = Seed: YGFLNVIVHSATGFKQSSKALQRPV
YGFLNVIVHSATGMKQLSRALARPV

SEQ ID NO: 30085 - protein, 25 aa, synthetic construct
  source 1..25: note = Seed: YGFLNVIVHSATGFKQSSKALQRPV
YGFLNVIVHSATGMKQLSRALCRPV

SEQ ID NO: 30086 - protein, 25 aa, synthetic construct
  source 1..25: note = Seed: YGFLNVIVHSATGFKQSSKALQRPV
YGFLNVIVHSATGMKQLSRALFRPV

SEQ ID NO: 30087 - protein, 25 aa, synthetic construct
  source 1..25: note = Seed: YGFLNVIVHSATGFKQSSKALQRPV
YGFLNVIVHSATGMKQLSRALGRPV

SEQ ID NO: 30088 - protein, 25 aa, synthetic construct
  source 1..25: note = Seed: YGFLNVIVHSATGFKQSSKALQRPV
YGFLNVIVHSATGMKQLSRALHRPV

SEQ ID NO: 30089 - protein, 25 aa, synthetic construct
  source 1..25: note = Seed: YGFLNVIVHSATGFKQSSKALQRPV
YGFLNVIVHSATGMKQLSRALIRPV

SEQ ID NO: 30090 - protein, 25 aa, synthetic construct
  source 1..25: note = Seed: YGFLNVIVHSATGFKQSSKALQRPV
YGFLNVIVHSATGMKQLSRALKRPV

SEQ ID NO: 30091 - protein, 25 aa, synthetic construct
  source 1..25: note = Seed: YGFLNVIVHSATGFKQSSKALQRPV
YGFLNVIVHSATGMKQLSRALLRPV

SEQ ID NO: 30092 - protein, 25 aa, synthetic construct
  source 1..25: note = Seed: YGFLNVIVHSATGFKQSSKALQRPV
YGFLNVIVHSATGMKQLSRALMRPV

SEQ ID NO: 30093 - protein, 25 aa, synthetic construct
  source 1..25: note = Seed: YGFLNVIVHSATGFKQSSKALQRPV
YGFLNVIVHSATGMKQLSRALNRPV

SEQ ID NO: 30094 - protein, 25 aa, synthetic construct
  source 1..25: note = Seed: YGFLNVIVHSATGFKQSSKALQRPV
YGFLNVIVHSATGMKQLSRALPRPV

SEQ ID NO: 30095 - protein, 25 aa, synthetic construct
  source 1..25: note = Seed: YGFLNVIVHSATGFKQSSKALQRPV
YGFLNVIVHSATGMKQLSRALQRPV

SEQ ID NO: 30096 - protein, 25 aa, synthetic construct
  source 1..25: note = Seed: YGFLNVIVHSATGFKQSSKALQRPV
YGFLNVIVHSATGMKQLSRALRRPV

SEQ ID NO: 30097 - protein, 25 aa, synthetic construct
  source 1..25: note = Seed: YGFLNVIVHSATGFKQSSKALQRPV
YGFLNVIVHSATGMKQLSRALSRPV

SEQ ID NO: 30098 - protein, 25 aa, synthetic construct
  source 1..25: note = Seed: YGFLNVIVHSATGFKQSSKALQRPV
YGFLNVIVHSATGMKQLSRALTRPV

SEQ ID NO: 30099 - protein, 25 aa, synthetic construct
  source 1..25: note = Seed: YGFLNVIVHSATGFKQSSKALQRPV
YGFLNVIVHSATGMKQLSRALVRPV

SEQ ID NO: 30100 - protein, 25 aa, synthetic construct
  source 1..25: note = Seed: YGFLNVIVHSATGFKQSSKALQRPV
YGFLNVIVHSATGMKQLSRALYRPV

SEQ ID NO: 30101 - protein, 25 aa, synthetic construct
  source 1..25: note = Seed: YGFLNVIVHSATGFKQSSKALQRPV
YGFLNVIVHSATGMKQLSSALARPV

SEQ ID NO: 30102 - protein, 25 aa, synthetic construct
  source 1..25: note = Seed: YGFLNVIVHSATGFKQSSKALQRPV
YGFLNVIVHSATGMKQLSSALGRPV

SEQ ID NO: 30103 - protein, 25 aa, synthetic construct
  source 1..25: note = Seed: YGFLNVIVHSATGFKQSSKALQRPV
YGFLNVIVHSATGMKQLSSALHRPV

SEQ ID NO: 30104 - protein, 25 aa, synthetic construct
  source 1..25: note = Seed: YGFLNVIVHSATGFKQSSKALQRPV
YGFLNVIVHSATGMKQLSSALIRPV

SEQ ID NO: 30105 - protein, 25 aa, synthetic construct
  source 1..25: note = Seed: YGFLNVIVHSATGFKQSSKALQRPV
YGFLNVIVHSATGMKQLSSALLRPV

SEQ ID NO: 30106 - protein, 25 aa, synthetic construct
  source 1..25: note = Seed: YGFLNVIVHSATGFKQSSKALQRPV
YGFLNVIVHSATGMKQLSSALMRPV

SEQ ID NO: 30107 - protein, 25 aa, synthetic construct
  source 1..25: note = Seed: YGFLNVIVHSATGFKQSSKALQRPV
YGFLNVIVHSATGMKQLSSALNRPV

SEQ ID NO: 30108 - protein, 25 aa, synthetic construct
  source 1..25: note = Seed: YGFLNVIVHSATGFKQSSKALQRPV
YGFLNVIVHSATGMKQLSSALSRPV

SEQ ID NO: 30109 - protein, 25 aa, synthetic construct
  source 1..25: note = Seed: YGFLNVIVHSATGFKQSSKALQRPV
YGFLNVIVHSATGMKQLSSALTRPV

SEQ ID NO: 30110 - protein, 25 aa, synthetic construct
  source 1..25: note = Seed: YGFLNVIVHSATGFKQSSKALQRPV
YGFLNVIVHSATGMKQLSSALVRPV

SEQ ID NO: 30111 - protein, 25 aa, synthetic construct
  source 1..25: note = Seed: YGFLNVIVHSATGFKQSSKALQRPV
YGFLNVIVHSATGMKQLSTALARPV

SEQ ID NO: 30112 - protein, 25 aa, synthetic construct
  source 1..25: note = Seed: YGFLNVIVHSATGFKQSSKALQRPV
YGFLNVIVHSATGMKQLSTALGRPV

SEQ ID NO: 30113 - protein, 25 aa, synthetic construct
  source 1..25: note = Seed: YGFLNVIVHSATGFKQSSKALQRPV
YGFLNVIVHSATGMKQLSTALHRPV

SEQ ID NO: 30114 - protein, 25 aa, synthetic construct
  source 1..25: note = Seed: YGFLNVIVHSATGFKQSSKALQRPV
YGFLNVIVHSATGMKQLSTALIRPV

SEQ ID NO: 30115 - protein, 25 aa, synthetic construct
  source 1..25: note = Seed: YGFLNVIVHSATGFKQSSKALQRPV
YGFLNVIVHSATGMKQLSTALLRPV

SEQ ID NO: 30116 - protein, 25 aa, synthetic construct
  source 1..25: note = Seed: YGFLNVIVHSATGFKQSSKALQRPV
YGFLNVIVHSATGMKQLSTALMRPV

SEQ ID NO: 30117 - protein, 25 aa, synthetic construct
  source 1..25: note = Seed: YGFLNVIVHSATGFKQSSKALQRPV
YGFLNVIVHSATGMKQLSTALNRPV

SEQ ID NO: 30118 - protein, 25 aa, synthetic construct
  source 1..25: note = Seed: YGFLNVIVHSATGFKQSSKALQRPV
YGFLNVIVHSATGMKQLSTALSRPV

SEQ ID NO: 30119 - protein, 25 aa, synthetic construct
  source 1..25: note = Seed: YGFLNVIVHSATGFKQSSKALQRPV
YGFLNVIVHSATGMKQLSTALTRPV

SEQ ID NO: 30120 - protein, 25 aa, synthetic construct
  source 1..25: note = Seed: YGFLNVIVHSATGFKQSSKALQRPV
YGFLNVIVHSATGMKQLSTALVRPV

SEQ ID NO: 30121 - protein, 25 aa, synthetic construct
  source 1..25: note = Seed: YGFLNVIVHSATGFKQSSKALQRPV
YGFLNVIVHSATGMKQLSVALARPV

SEQ ID NO: 30122 - protein, 25 aa, synthetic construct
  source 1..25: note = Seed: YGFLNVIVHSATGFKQSSKALQRPV
YGFLNVIVHSATGMKQLSVALGRPV

SEQ ID NO: 30123 - protein, 25 aa, synthetic construct
  source 1..25: note = Seed: YGFLNVIVHSATGFKQSSKALQRPV
YGFLNVIVHSATGMKQLSVALHRPV

SEQ ID NO: 30124 - protein, 25 aa, synthetic construct
  source 1..25: note = Seed: YGFLNVIVHSATGFKQSSKALQRPV
YGFLNVIVHSATGMKQLSVALIRPV

SEQ ID NO: 30125 - protein, 25 aa, synthetic construct
  source 1..25: note = Seed: YGFLNVIVHSATGFKQSSKALQRPV
YGFLNVIVHSATGMKQLSVALMRPV

SEQ ID NO: 30126 - protein, 25 aa, synthetic construct
  source 1..25: note = Seed: YGFLNVIVHSATGFKQSSKALQRPV
YGFLNVIVHSATGMKQLSVALNRPV

SEQ ID NO: 30127 - protein, 25 aa, synthetic construct
  source 1..25: note = Seed: YGFLNVIVHSATGFKQSSKALQRPV
YGFLNVIVHSATGMKQLSVALQRPV

SEQ ID NO: 30128 - protein, 25 aa, synthetic construct
  source 1..25: note = Seed: YGFLNVIVHSATGFKQSSKALQRPV
YGFLNVIVHSATGMKQLSVALRRPV

SEQ ID NO: 30129 - protein, 25 aa, synthetic construct
  source 1..25: note = Seed: YGFLNVIVHSATGFKQSSKALQRPV
YGFLNVIVHSATGMKQLSVALSRPV

SEQ ID NO: 30130 - protein, 25 aa, synthetic construct
  source 1..25: note = Seed: YGFLNVIVHSATGFKQSSKALQRPV
YGFLNVIVHSATGMKQLSVALTRPV

SEQ ID NO: 30131 - protein, 25 aa, synthetic construct
  source 1..25: note = Seed: YGFLNVIVHSATGFKQSSKALQRPV
YGFLNVIVHSATGMKQLSVALVRPV

SEQ ID NO: 30132 - protein, 25 aa, synthetic construct
  source 1..25: note = Seed: YGFLNVIVHSATGFKQSSKALQRPV
YGFLNVIVHSATGMKQLSWALRRPV

SEQ ID NO: 30133 - protein, 25 aa, synthetic construct
  source 1..25: note = Seed: YGFLNVIVHSATGFKQSSKALQRPV
YGFLNVIVHSATGMKQLSYALARPV

SEQ ID NO: 30134 - protein, 25 aa, synthetic construct
  source 1..25: note = Seed: YGFLNVIVHSATGFKQSSKALQRPV
YGFLNVIVHSATGMKQLSYALLRPV

SEQ ID NO: 30135 - protein, 25 aa, synthetic construct
  source 1..25: note = Seed: YGFLNVIVHSATGFKQSSKALQRPV
YGFLNVIVHSATGMKQLSYALRRPV

SEQ ID NO: 30136 - protein, 25 aa, synthetic construct
  source 1..25: note = Seed: YGFLNVIVHSATGFKQSSKALQRPV
YGFLNVIVHSATGMKQLSYALWRPV

SEQ ID NO: 30137 - protein, 25 aa, synthetic construct
  source 1..25: note = Seed: YGFLNVIVHSATGFKQSSKALQRPV
YGFLNVIVHSATGMKQMSAALARPV

SEQ ID NO: 30138 - protein, 25 aa, synthetic construct
  source 1..25: note = Seed: YGFLNVIVHSATGFKQSSKALQRPV
YGFLNVIVHSATGMKQMSAALDRPV

SEQ ID NO: 30139 - protein, 25 aa, synthetic construct
  source 1..25: note = Seed: YGFLNVIVHSATGFKQSSKALQRPV
YGFLNVIVHSATGMKQMSAALERPV

SEQ ID NO: 30140 - protein, 25 aa, synthetic construct
  source 1..25: note = Seed: YGFLNVIVHSATGFKQSSKALQRPV
YGFLNVIVHSATGMKQMSAALGRPV

SEQ ID NO: 30141 - protein, 25 aa, synthetic construct
  source 1..25: note = Seed: YGFLNVIVHSATGFKQSSKALQRPV
YGFLNVIVHSATGMKQMSAALHRPV

SEQ ID NO: 30142 - protein, 25 aa, synthetic construct
  source 1..25: note = Seed: YGFLNVIVHSATGFKQSSKALQRPV
YGFLNVIVHSATGMKQMSAALIRPV

SEQ ID NO: 30143 - protein, 25 aa, synthetic construct
  source 1..25: note = Seed: YGFLNVIVHSATGFKQSSKALQRPV
YGFLNVIVHSATGMKQMSAALLRPV

SEQ ID NO: 30144 - protein, 25 aa, synthetic construct
  source 1..25: note = Seed: YGFLNVIVHSATGFKQSSKALQRPV
YGFLNVIVHSATGMKQMSAALMRPV

SEQ ID NO: 30145 - protein, 25 aa, synthetic construct
  source 1..25: note = Seed: YGFLNVIVHSATGFKQSSKALQRPV
YGFLNVIVHSATGMKQMSAALNRPV

SEQ ID NO: 30146 - protein, 25 aa, synthetic construct
  source 1..25: note = Seed: YGFLNVIVHSATGFKQSSKALQRPV
YGFLNVIVHSATGMKQMSAALPRPV

SEQ ID NO: 30147 - protein, 25 aa, synthetic construct
  source 1..25: note = Seed: YGFLNVIVHSATGFKQSSKALQRPV
YGFLNVIVHSATGMKQMSAALQRPV

SEQ ID NO: 30148 - protein, 25 aa, synthetic construct
  source 1..25: note = Seed: YGFLNVIVHSATGFKQSSKALQRPV
YGFLNVIVHSATGMKQMSAALSRPV

SEQ ID NO: 30149 - protein, 25 aa, synthetic construct
  source 1..25: note = Seed: YGFLNVIVHSATGFKQSSKALQRPV
YGFLNVIVHSATGMKQMSAALTRPV

SEQ ID NO: 30150 - protein, 25 aa, synthetic construct
  source 1..25: note = Seed: YGFLNVIVHSATGFKQSSKALQRPV
YGFLNVIVHSATGMKQMSAALVRPV

SEQ ID NO: 30151 - protein, 25 aa, synthetic construct
  source 1..25: note = Seed: YGFLNVIVHSATGFKQSSKALQRPV
YGFLNVIVHSATGMKQMSFALFRPV

SEQ ID NO: 30152 - protein, 25 aa, synthetic construct
  source 1..25: note = Seed: YGFLNVIVHSATGFKQSSKALQRPV
YGFLNVIVHSATGMKQMSFALIRPV

SEQ ID NO: 30153 - protein, 25 aa, synthetic construct
  source 1..25: note = Seed: YGFLNVIVHSATGFKQSSKALQRPV
YGFLNVIVHSATGMKQMSFALLRPV

SEQ ID NO: 30154 - protein, 25 aa, synthetic construct
  source 1..25: note = Seed: YGFLNVIVHSATGFKQSSKALQRPV
YGFLNVIVHSATGMKQMSGALARPV

SEQ ID NO: 30155 - protein, 25 aa, synthetic construct
  source 1..25: note = Seed: YGFLNVIVHSATGFKQSSKALQRPV
YGFLNVIVHSATGMKQMSGALIRPV

SEQ ID NO: 30156 - protein, 25 aa, synthetic construct
  source 1..25: note = Seed: YGFLNVIVHSATGFKQSSKALQRPV
YGFLNVIVHSATGMKQMSGALMRPV

SEQ ID NO: 30157 - protein, 25 aa, synthetic construct
  source 1..25: note = Seed: YGFLNVIVHSATGFKQSSKALQRPV
YGFLNVIVHSATGMKQMSGALNRPV

SEQ ID NO: 30158 - protein, 25 aa, synthetic construct
  source 1..25: note = Seed: YGFLNVIVHSATGFKQSSKALQRPV
YGFLNVIVHSATGMKQMSGALSRPV

SEQ ID NO: 30159 - protein, 25 aa, synthetic construct
  source 1..25: note = Seed: YGFLNVIVHSATGFKQSSKALQRPV
YGFLNVIVHSATGMKQMSGALTRPV

SEQ ID NO: 30160 - protein, 25 aa, synthetic construct
  source 1..25: note = Seed: YGFLNVIVHSATGFKQSSKALQRPV
YGFLNVIVHSATGMKQMSGALVRPV

SEQ ID NO: 30161 - protein, 25 aa, synthetic construct
  source 1..25: note = Seed: YGFLNVIVHSATGFKQSSKALQRPV
YGFLNVIVHSATGMKQMSHALARPV

SEQ ID NO: 30162 - protein, 25 aa, synthetic construct
  source 1..25: note = Seed: YGFLNVIVHSATGFKQSSKALQRPV
YGFLNVIVHSATGMKQMSIALARPV

SEQ ID NO: 30163 - protein, 25 aa, synthetic construct
  source 1..25: note = Seed: YGFLNVIVHSATGFKQSSKALQRPV
YGFLNVIVHSATGMKQMSIALGRPV

SEQ ID NO: 30164 - protein, 25 aa, synthetic construct
  source 1..25: note = Seed: YGFLNVIVHSATGFKQSSKALQRPV
YGFLNVIVHSATGMKQMSIALHRPV

SEQ ID NO: 30165 - protein, 25 aa, synthetic construct
  source 1..25: note = Seed: YGFLNVIVHSATGFKQSSKALQRPV
YGFLNVIVHSATGMKQMSIALIRPV

SEQ ID NO: 30166 - protein, 25 aa, synthetic construct
  source 1..25: note = Seed: YGFLNVIVHSATGFKQSSKALQRPV
YGFLNVIVHSATGMKQMSIALKRPV

SEQ ID NO: 30167 - protein, 25 aa, synthetic construct
  source 1..25: note = Seed: YGFLNVIVHSATGFKQSSKALQRPV
YGFLNVIVHSATGMKQMSIALLRPV

SEQ ID NO: 30168 - protein, 25 aa, synthetic construct
  source 1..25: note = Seed: YGFLNVIVHSATGFKQSSKALQRPV
YGFLNVIVHSATGMKQMSIALMRPV

SEQ ID NO: 30169 - protein, 25 aa, synthetic construct
  source 1..25: note = Seed: YGFLNVIVHSATGFKQSSKALQRPV
YGFLNVIVHSATGMKQMSIALNRPV

SEQ ID NO: 30170 - protein, 25 aa, synthetic construct
  source 1..25: note = Seed: YGFLNVIVHSATGFKQSSKALQRPV
YGFLNVIVHSATGMKQMSIALQRPV

SEQ ID NO: 30171 - protein, 25 aa, synthetic construct
  source 1..25: note = Seed: YGFLNVIVHSATGFKQSSKALQRPV
YGFLNVIVHSATGMKQMSIALRRPV

SEQ ID NO: 30172 - protein, 25 aa, synthetic construct
  source 1..25: note = Seed: YGFLNVIVHSATGFKQSSKALQRPV
YGFLNVIVHSATGMKQMSIALSRPV

SEQ ID NO: 30173 - protein, 25 aa, synthetic construct
  source 1..25: note = Seed: YGFLNVIVHSATGFKQSSKALQRPV
YGFLNVIVHSATGMKQMSIALTRPV

SEQ ID NO: 30174 - protein, 25 aa, synthetic construct
  source 1..25: note = Seed: YGFLNVIVHSATGFKQSSKALQRPV
YGFLNVIVHSATGMKQMSIALVRPV

SEQ ID NO: 30175 - protein, 25 aa, synthetic construct
  source 1..25: note = Seed: YGFLNVIVHSATGFKQSSKALQRPV
YGFLNVIVHSATGMKQMSKALARPV

SEQ ID NO: 30176 - protein, 25 aa, synthetic construct
  source 1..25: note = Seed: YGFLNVIVHSATGFKQSSKALQRPV
YGFLNVIVHSATGMKQMSKALCRPV

SEQ ID NO: 30177 - protein, 25 aa, synthetic construct
  source 1..25: note = Seed: YGFLNVIVHSATGFKQSSKALQRPV
YGFLNVIVHSATGMKQMSKALFRPV

SEQ ID NO: 30178 - protein, 25 aa, synthetic construct
  source 1..25: note = Seed: YGFLNVIVHSATGFKQSSKALQRPV
YGFLNVIVHSATGMKQMSKALGRPV

SEQ ID NO: 30179 - protein, 25 aa, synthetic construct
  source 1..25: note = Seed: YGFLNVIVHSATGFKQSSKALQRPV
YGFLNVIVHSATGMKQMSKALHRPV

SEQ ID NO: 30180 - protein, 25 aa, synthetic construct
  source 1..25: note = Seed: YGFLNVIVHSATGFKQSSKALQRPV
YGFLNVIVHSATGMKQMSKALIRPV

SEQ ID NO: 30181 - protein, 25 aa, synthetic construct
  source 1..25: note = Seed: YGFLNVIVHSATGFKQSSKALQRPV
YGFLNVIVHSATGMKQMSKALKRPV

SEQ ID NO: 30182 - protein, 25 aa, synthetic construct
  source 1..25: note = Seed: YGFLNVIVHSATGFKQSSKALQRPV
YGFLNVIVHSATGMKQMSKALLRPV

SEQ ID NO: 30183 - protein, 25 aa, synthetic construct
  source 1..25: note = Seed: YGFLNVIVHSATGFKQSSKALQRPV
YGFLNVIVHSATGMKQMSKALMRPV

SEQ ID NO: 30184 - protein, 25 aa, synthetic construct
  source 1..25: note = Seed: YGFLNVIVHSATGFKQSSKALQRPV
YGFLNVIVHSATGMKQMSKALNRPV

SEQ ID NO: 30185 - protein, 25 aa, synthetic construct
  source 1..25: note = Seed: YGFLNVIVHSATGFKQSSKALQRPV
YGFLNVIVHSATGMKQMSKALPRPV

SEQ ID NO: 30186 - protein, 25 aa, synthetic construct
  source 1..25: note = Seed: YGFLNVIVHSATGFKQSSKALQRPV
YGFLNVIVHSATGMKQMSKALQRPV

SEQ ID NO: 30187 - protein, 25 aa, synthetic construct
  source 1..25: note = Seed: YGFLNVIVHSATGFKQSSKALQRPV
YGFLNVIVHSATGMKQMSKALRRPV

SEQ ID NO: 30188 - protein, 25 aa, synthetic construct
  source 1..25: note = Seed: YGFLNVIVHSATGFKQSSKALQRPV
YGFLNVIVHSATGMKQMSKALSRPV

SEQ ID NO: 30189 - protein, 25 aa, synthetic construct
  source 1..25: note = Seed: YGFLNVIVHSATGFKQSSKALQRPV
YGFLNVIVHSATGMKQMSKALTRPV

SEQ ID NO: 30190 - protein, 25 aa, synthetic construct
  source 1..25: note = Seed: YGFLNVIVHSATGFKQSSKALQRPV
YGFLNVIVHSATGMKQMSKALVRPV

SEQ ID NO: 30191 - protein, 25 aa, synthetic construct
  source 1..25: note = Seed: YGFLNVIVHSATGFKQSSKALQRPV
YGFLNVIVHSATGMKQMSKALYRPV

SEQ ID NO: 30192 - protein, 25 aa, synthetic construct
  source 1..25: note = Seed: YGFLNVIVHSATGFKQSSKALQRPV
YGFLNVIVHSATGMKQMSLALARPV

SEQ ID NO: 30193 - protein, 25 aa, synthetic construct
  source 1..25: note = Seed: YGFLNVIVHSATGFKQSSKALQRPV
YGFLNVIVHSATGMKQMSLALFRPV

SEQ ID NO: 30194 - protein, 25 aa, synthetic construct
  source 1..25: note = Seed: YGFLNVIVHSATGFKQSSKALQRPV
YGFLNVIVHSATGMKQMSLALIRPV

SEQ ID NO: 30195 - protein, 25 aa, synthetic construct
  source 1..25: note = Seed: YGFLNVIVHSATGFKQSSKALQRPV
YGFLNVIVHSATGMKQMSLALMRPV

SEQ ID NO: 30196 - protein, 25 aa, synthetic construct
  source 1..25: note = Seed: YGFLNVIVHSATGFKQSSKALQRPV
YGFLNVIVHSATGMKQMSLALNRPV

SEQ ID NO: 30197 - protein, 25 aa, synthetic construct
  source 1..25: note = Seed: YGFLNVIVHSATGFKQSSKALQRPV
YGFLNVIVHSATGMKQMSLALRRPV

SEQ ID NO: 30198 - protein, 25 aa, synthetic construct
  source 1..25: note = Seed: YGFLNVIVHSATGFKQSSKALQRPV
YGFLNVIVHSATGMKQMSLALSRPV

SEQ ID NO: 30199 - protein, 25 aa, synthetic construct
  source 1..25: note = Seed: YGFLNVIVHSATGFKQSSKALQRPV
YGFLNVIVHSATGMKQMSLALTRPV

SEQ ID NO: 30200 - protein, 25 aa, synthetic construct
  source 1..25: note = Seed: YGFLNVIVHSATGFKQSSKALQRPV
YGFLNVIVHSATGMKQMSLALVRPV

SEQ ID NO: 30201 - protein, 25 aa, synthetic construct
  source 1..25: note = Seed: YGFLNVIVHSATGFKQSSKALQRPV
YGFLNVIVHSATGMKQMSMALARPV

SEQ ID NO: 30202 - protein, 25 aa, synthetic construct
  source 1..25: note = Seed: YGFLNVIVHSATGFKQSSKALQRPV
YGFLNVIVHSATGMKQMSMALIRPV

SEQ ID NO: 30203 - protein, 25 aa, synthetic construct
  source 1..25: note = Seed: YGFLNVIVHSATGFKQSSKALQRPV
YGFLNVIVHSATGMKQMSMALMRPV

SEQ ID NO: 30204 - protein, 25 aa, synthetic construct
  source 1..25: note = Seed: YGFLNVIVHSATGFKQSSKALQRPV
YGFLNVIVHSATGMKQMSMALNRPV

SEQ ID NO: 30205 - protein, 25 aa, synthetic construct
  source 1..25: note = Seed: YGFLNVIVHSATGFKQSSKALQRPV
YGFLNVIVHSATGMKQMSMALRRPV

SEQ ID NO: 30206 - protein, 25 aa, synthetic construct
  source 1..25: note = Seed: YGFLNVIVHSATGFKQSSKALQRPV
YGFLNVIVHSATGMKQMSMALSRPV

SEQ ID NO: 30207 - protein, 25 aa, synthetic construct
  source 1..25: note = Seed: YGFLNVIVHSATGFKQSSKALQRPV
YGFLNVIVHSATGMKQMSMALTRPV

SEQ ID NO: 30208 - protein, 25 aa, synthetic construct
  source 1..25: note = Seed: YGFLNVIVHSATGFKQSSKALQRPV
YGFLNVIVHSATGMKQMSMALVRPV

SEQ ID NO: 30209 - protein, 25 aa, synthetic construct
  source 1..25: note = Seed: YGFLNVIVHSATGFKQSSKALQRPV
YGFLNVIVHSATGMKQMSNALARPV

SEQ ID NO: 30210 - protein, 25 aa, synthetic construct
  source 1..25: note = Seed: YGFLNVIVHSATGFKQSSKALQRPV
YGFLNVIVHSATGMKQMSNALNRPV

SEQ ID NO: 30211 - protein, 25 aa, synthetic construct
  source 1..25: note = Seed: YGFLNVIVHSATGFKQSSKALQRPV
YGFLNVIVHSATGMKQMSNALSRPV

SEQ ID NO: 30212 - protein, 25 aa, synthetic construct
  source 1..25: note = Seed: YGFLNVIVHSATGFKQSSKALQRPV
YGFLNVIVHSATGMKQMSNALTRPV

SEQ ID NO: 30213 - protein, 25 aa, synthetic construct
  source 1..25: note = Seed: YGFLNVIVHSATGFKQSSKALQRPV
YGFLNVIVHSATGMKQMSNALVRPV

SEQ ID NO: 30214 - protein, 25 aa, synthetic construct
  source 1..25: note = Seed: YGFLNVIVHSATGFKQSSKALQRPV
YGFLNVIVHSATGMKQMSPALARPV

SEQ ID NO: 30215 - protein, 25 aa, synthetic construct
  source 1..25: note = Seed: YGFLNVIVHSATGFKQSSKALQRPV
YGFLNVIVHSATGMKQMSPALGRPV

SEQ ID NO: 30216 - protein, 25 aa, synthetic construct
  source 1..25: note = Seed: YGFLNVIVHSATGFKQSSKALQRPV
YGFLNVIVHSATGMKQMSPALHRPV

SEQ ID NO: 30217 - protein, 25 aa, synthetic construct
  source 1..25: note = Seed: YGFLNVIVHSATGFKQSSKALQRPV
YGFLNVIVHSATGMKQMSPALIRPV

SEQ ID NO: 30218 - protein, 25 aa, synthetic construct
  source 1..25: note = Seed: YGFLNVIVHSATGFKQSSKALQRPV
YGFLNVIVHSATGMKQMSPALLRPV

SEQ ID NO: 30219 - protein, 25 aa, synthetic construct
  source 1..25: note = Seed: YGFLNVIVHSATGFKQSSKALQRPV
YGFLNVIVHSATGMKQMSPALMRPV

SEQ ID NO: 30220 - protein, 25 aa, synthetic construct
  source 1..25: note = Seed: YGFLNVIVHSATGFKQSSKALQRPV
YGFLNVIVHSATGMKQMSPALNRPV

SEQ ID NO: 30221 - protein, 25 aa, synthetic construct
  source 1..25: note = Seed: YGFLNVIVHSATGFKQSSKALQRPV
YGFLNVIVHSATGMKQMSPALQRPV

SEQ ID NO: 30222 - protein, 25 aa, synthetic construct
  source 1..25: note = Seed: YGFLNVIVHSATGFKQSSKALQRPV
YGFLNVIVHSATGMKQMSPALSRPV

SEQ ID NO: 30223 - protein, 25 aa, synthetic construct
  source 1..25: note = Seed: YGFLNVIVHSATGFKQSSKALQRPV
YGFLNVIVHSATGMKQMSPALTRPV

SEQ ID NO: 30224 - protein, 25 aa, synthetic construct
  source 1..25: note = Seed: YGFLNVIVHSATGFKQSSKALQRPV
YGFLNVIVHSATGMKQMSPALVRPV

SEQ ID NO: 30225 - protein, 25 aa, synthetic construct
  source 1..25: note = Seed: YGFLNVIVHSATGFKQSSKALQRPV
YGFLNVIVHSATGMKQMSRALARPV

SEQ ID NO: 30226 - protein, 25 aa, synthetic construct
  source 1..25: note = Seed: YGFLNVIVHSATGFKQSSKALQRPV
YGFLNVIVHSATGMKQMSRALCRPV

SEQ ID NO: 30227 - protein, 25 aa, synthetic construct
  source 1..25: note = Seed: YGFLNVIVHSATGFKQSSKALQRPV
YGFLNVIVHSATGMKQMSRALFRPV

SEQ ID NO: 30228 - protein, 25 aa, synthetic construct
  source 1..25: note = Seed: YGFLNVIVHSATGFKQSSKALQRPV
YGFLNVIVHSATGMKQMSRALGRPV

SEQ ID NO: 30229 - protein, 25 aa, synthetic construct
  source 1..25: note = Seed: YGFLNVIVHSATGFKQSSKALQRPV
YGFLNVIVHSATGMKQMSRALHRPV

SEQ ID NO: 30230 - protein, 25 aa, synthetic construct
  source 1..25: note = Seed: YGFLNVIVHSATGFKQSSKALQRPV
YGFLNVIVHSATGMKQMSRALIRPV

SEQ ID NO: 30231 - protein, 25 aa, synthetic construct
  source 1..25: note = Seed: YGFLNVIVHSATGFKQSSKALQRPV
YGFLNVIVHSATGMKQMSRALKRPV

SEQ ID NO: 30232 - protein, 25 aa, synthetic construct
  source 1..25: note = Seed: YGFLNVIVHSATGFKQSSKALQRPV
YGFLNVIVHSATGMKQMSRALLRPV

SEQ ID NO: 30233 - protein, 25 aa, synthetic construct
  source 1..25: note = Seed: YGFLNVIVHSATGFKQSSKALQRPV
YGFLNVIVHSATGMKQMSRALMRPV

SEQ ID NO: 30234 - protein, 25 aa, synthetic construct
  source 1..25: note = Seed: YGFLNVIVHSATGFKQSSKALQRPV
YGFLNVIVHSATGMKQMSRALNRPV

SEQ ID NO: 30235 - protein, 25 aa, synthetic construct
  source 1..25: note = Seed: YGFLNVIVHSATGFKQSSKALQRPV
YGFLNVIVHSATGMKQMSRALPRPV

SEQ ID NO: 30236 - protein, 25 aa, synthetic construct
  source 1..25: note = Seed: YGFLNVIVHSATGFKQSSKALQRPV
YGFLNVIVHSATGMKQMSRALQRPV

SEQ ID NO: 30237 - protein, 25 aa, synthetic construct
  source 1..25: note = Seed: YGFLNVIVHSATGFKQSSKALQRPV
YGFLNVIVHSATGMKQMSRALRRPV

SEQ ID NO: 30238 - protein, 25 aa, synthetic construct
  source 1..25: note = Seed: YGFLNVIVHSATGFKQSSKALQRPV
YGFLNVIVHSATGMKQMSRALSRPV

SEQ ID NO: 30239 - protein, 25 aa, synthetic construct
  source 1..25: note = Seed: YGFLNVIVHSATGFKQSSKALQRPV
YGFLNVIVHSATGMKQMSRALTRPV

SEQ ID NO: 30240 - protein, 25 aa, synthetic construct
  source 1..25: note = Seed: YGFLNVIVHSATGFKQSSKALQRPV
YGFLNVIVHSATGMKQMSRALVRPV

SEQ ID NO: 30241 - protein, 25 aa, synthetic construct
  source 1..25: note = Seed: YGFLNVIVHSATGFKQSSKALQRPV
YGFLNVIVHSATGMKQMSRALYRPV

SEQ ID NO: 30242 - protein, 25 aa, synthetic construct
  source 1..25: note = Seed: YGFLNVIVHSATGFKQSSKALQRPV
YGFLNVIVHSATGMKQMSSALARPV

SEQ ID NO: 30243 - protein, 25 aa, synthetic construct
  source 1..25: note = Seed: YGFLNVIVHSATGFKQSSKALQRPV
YGFLNVIVHSATGMKQMSSALHRPV

SEQ ID NO: 30244 - protein, 25 aa, synthetic construct
  source 1..25: note = Seed: YGFLNVIVHSATGFKQSSKALQRPV
YGFLNVIVHSATGMKQMSSALIRPV

SEQ ID NO: 30245 - protein, 25 aa, synthetic construct
  source 1..25: note = Seed: YGFLNVIVHSATGFKQSSKALQRPV
YGFLNVIVHSATGMKQMSSALLRPV

SEQ ID NO: 30246 - protein, 25 aa, synthetic construct
  source 1..25: note = Seed: YGFLNVIVHSATGFKQSSKALQRPV
YGFLNVIVHSATGMKQMSSALMRPV

SEQ ID NO: 30247 - protein, 25 aa, synthetic construct
  source 1..25: note = Seed: YGFLNVIVHSATGFKQSSKALQRPV
YGFLNVIVHSATGMKQMSSALNRPV

SEQ ID NO: 30248 - protein, 25 aa, synthetic construct
  source 1..25: note = Seed: YGFLNVIVHSATGFKQSSKALQRPV
YGFLNVIVHSATGMKQMSSALQRPV

SEQ ID NO: 30249 - protein, 25 aa, synthetic construct
  source 1..25: note = Seed: YGFLNVIVHSATGFKQSSKALQRPV
YGFLNVIVHSATGMKQMSSALSRPV

SEQ ID NO: 30250 - protein, 25 aa, synthetic construct
  source 1..25: note = Seed: YGFLNVIVHSATGFKQSSKALQRPV
YGFLNVIVHSATGMKQMSSALTRPV

SEQ ID NO: 30251 - protein, 25 aa, synthetic construct
  source 1..25: note = Seed: YGFLNVIVHSATGFKQSSKALQRPV
YGFLNVIVHSATGMKQMSSALVRPV

SEQ ID NO: 30252 - protein, 25 aa, synthetic construct
  source 1..25: note = Seed: YGFLNVIVHSATGFKQSSKALQRPV
YGFLNVIVHSATGMKQMSTALARPV

SEQ ID NO: 30253 - protein, 25 aa, synthetic construct
  source 1..25: note = Seed: YGFLNVIVHSATGFKQSSKALQRPV
YGFLNVIVHSATGMKQMSTALGRPV

SEQ ID NO: 30254 - protein, 25 aa, synthetic construct
  source 1..25: note = Seed: YGFLNVIVHSATGFKQSSKALQRPV
YGFLNVIVHSATGMKQMSTALHRPV

SEQ ID NO: 30255 - protein, 25 aa, synthetic construct
  source 1..25: note = Seed: YGFLNVIVHSATGFKQSSKALQRPV
YGFLNVIVHSATGMKQMSTALIRPV

SEQ ID NO: 30256 - protein, 25 aa, synthetic construct
  source 1..25: note = Seed: YGFLNVIVHSATGFKQSSKALQRPV
YGFLNVIVHSATGMKQMSTALLRPV

SEQ ID NO: 30257 - protein, 25 aa, synthetic construct
  source 1..25: note = Seed: YGFLNVIVHSATGFKQSSKALQRPV
YGFLNVIVHSATGMKQMSTALMRPV

SEQ ID NO: 30258 - protein, 25 aa, synthetic construct
  source 1..25: note = Seed: YGFLNVIVHSATGFKQSSKALQRPV
YGFLNVIVHSATGMKQMSTALNRPV

SEQ ID NO: 30259 - protein, 25 aa, synthetic construct
  source 1..25: note = Seed: YGFLNVIVHSATGFKQSSKALQRPV
YGFLNVIVHSATGMKQMSTALQRPV

SEQ ID NO: 30260 - protein, 25 aa, synthetic construct
  source 1..25: note = Seed: YGFLNVIVHSATGFKQSSKALQRPV
YGFLNVIVHSATGMKQMSTALSRPV

SEQ ID NO: 30261 - protein, 25 aa, synthetic construct
  source 1..25: note = Seed: YGFLNVIVHSATGFKQSSKALQRPV
YGFLNVIVHSATGMKQMSTALTRPV

SEQ ID NO: 30262 - protein, 25 aa, synthetic construct
  source 1..25: note = Seed: YGFLNVIVHSATGFKQSSKALQRPV
YGFLNVIVHSATGMKQMSTALVRPV

SEQ ID NO: 30263 - protein, 25 aa, synthetic construct
  source 1..25: note = Seed: YGFLNVIVHSATGFKQSSKALQRPV
YGFLNVIVHSATGMKQMSVALARPV

SEQ ID NO: 30264 - protein, 25 aa, synthetic construct
  source 1..25: note = Seed: YGFLNVIVHSATGFKQSSKALQRPV
YGFLNVIVHSATGMKQMSVALGRPV

SEQ ID NO: 30265 - protein, 25 aa, synthetic construct
  source 1..25: note = Seed: YGFLNVIVHSATGFKQSSKALQRPV
YGFLNVIVHSATGMKQMSVALHRPV

SEQ ID NO: 30266 - protein, 25 aa, synthetic construct
  source 1..25: note = Seed: YGFLNVIVHSATGFKQSSKALQRPV
YGFLNVIVHSATGMKQMSVALIRPV

SEQ ID NO: 30267 - protein, 25 aa, synthetic construct
  source 1..25: note = Seed: YGFLNVIVHSATGFKQSSKALQRPV
YGFLNVIVHSATGMKQMSVALLRPV

SEQ ID NO: 30268 - protein, 25 aa, synthetic construct
  source 1..25: note = Seed: YGFLNVIVHSATGFKQSSKALQRPV
YGFLNVIVHSATGMKQMSVALMRPV

SEQ ID NO: 30269 - protein, 25 aa, synthetic construct
  source 1..25: note = Seed: YGFLNVIVHSATGFKQSSKALQRPV
YGFLNVIVHSATGMKQMSVALNRPV

SEQ ID NO: 30270 - protein, 25 aa, synthetic construct
  source 1..25: note = Seed: YGFLNVIVHSATGFKQSSKALQRPV
YGFLNVIVHSATGMKQMSVALQRPV

SEQ ID NO: 30271 - protein, 25 aa, synthetic construct
  source 1..25: note = Seed: YGFLNVIVHSATGFKQSSKALQRPV
YGFLNVIVHSATGMKQMSVALRRPV

SEQ ID NO: 30272 - protein, 25 aa, synthetic construct
  source 1..25: note = Seed: YGFLNVIVHSATGFKQSSKALQRPV
YGFLNVIVHSATGMKQMSVALSRPV

SEQ ID NO: 30273 - protein, 25 aa, synthetic construct
  source 1..25: note = Seed: YGFLNVIVHSATGFKQSSKALQRPV
YGFLNVIVHSATGMKQMSVALTRPV

SEQ ID NO: 30274 - protein, 25 aa, synthetic construct
  source 1..25: note = Seed: YGFLNVIVHSATGFKQSSKALQRPV
YGFLNVIVHSATGMKQMSVALVRPV

SEQ ID NO: 30275 - protein, 25 aa, synthetic construct
  source 1..25: note = Seed: YGFLNVIVHSATGFKQSSKALQRPV
YGFLNVIVHSATGMKQMSWALFRPV

SEQ ID NO: 30276 - protein, 25 aa, synthetic construct
  source 1..25: note = Seed: YGFLNVIVHSATGFKQSSKALQRPV
YGFLNVIVHSATGMKQMSYALARPV

SEQ ID NO: 30277 - protein, 25 aa, synthetic construct
  source 1..25: note = Seed: YGFLNVIVHSATGFKQSSKALQRPV
YGFLNVIVHSATGMKQMSYALFRPV

SEQ ID NO: 30278 - protein, 25 aa, synthetic construct
  source 1..25: note = Seed: YGFLNVIVHSATGFKQSSKALQRPV
YGFLNVIVHSATGMKQNSAALARPV

SEQ ID NO: 30279 - protein, 25 aa, synthetic construct
  source 1..25: note = Seed: YGFLNVIVHSATGFKQSSKALQRPV
YGFLNVIVHSATGMKQNSAALFRPV

SEQ ID NO: 30280 - protein, 25 aa, synthetic construct
  source 1..25: note = Seed: YGFLNVIVHSATGFKQSSKALQRPV
YGFLNVIVHSATGMKQNSAALIRPV

SEQ ID NO: 30281 - protein, 25 aa, synthetic construct
  source 1..25: note = Seed: YGFLNVIVHSATGFKQSSKALQRPV
YGFLNVIVHSATGMKQNSAALLRPV

SEQ ID NO: 30282 - protein, 25 aa, synthetic construct
  source 1..25: note = Seed: YGFLNVIVHSATGFKQSSKALQRPV
YGFLNVIVHSATGMKQNSAALMRPV

SEQ ID NO: 30283 - protein, 25 aa, synthetic construct
  source 1..25: note = Seed: YGFLNVIVHSATGFKQSSKALQRPV
YGFLNVIVHSATGMKQNSAALTRPV

SEQ ID NO: 30284 - protein, 25 aa, synthetic construct
  source 1..25: note = Seed: YGFLNVIVHSATGFKQSSKALQRPV
YGFLNVIVHSATGMKQNSAALVRPV

SEQ ID NO: 30285 - protein, 25 aa, synthetic construct
  source 1..25: note = Seed: YGFLNVIVHSATGFKQSSKALQRPV
YGFLNVIVHSATGMKQNSAALYRPV

SEQ ID NO: 30286 - protein, 25 aa, synthetic construct
  source 1..25: note = Seed: YGFLNVIVHSATGFKQSSKALQRPV
YGFLNVIVHSATGMKQNSGALFRPV

SEQ ID NO: 30287 - protein, 25 aa, synthetic construct
  source 1..25: note = Seed: YGFLNVIVHSATGFKQSSKALQRPV
YGFLNVIVHSATGMKQNSGALIRPV

SEQ ID NO: 30288 - protein, 25 aa, synthetic construct
  source 1..25: note = Seed: YGFLNVIVHSATGFKQSSKALQRPV
YGFLNVIVHSATGMKQNSGALLRPV

SEQ ID NO: 30289 - protein, 25 aa, synthetic construct
  source 1..25: note = Seed: YGFLNVIVHSATGFKQSSKALQRPV
YGFLNVIVHSATGMKQNSGALMRPV

SEQ ID NO: 30290 - protein, 25 aa, synthetic construct
  source 1..25: note = Seed: YGFLNVIVHSATGFKQSSKALQRPV
YGFLNVIVHSATGMKQNSGALVRPV

SEQ ID NO: 30291 - protein, 25 aa, synthetic construct
  source 1..25: note = Seed: YGFLNVIVHSATGFKQSSKALQRPV
YGFLNVIVHSATGMKQNSGALYRPV

SEQ ID NO: 30292 - protein, 25 aa, synthetic construct
  source 1..25: note = Seed: YGFLNVIVHSATGFKQSSKALQRPV
YGFLNVIVHSATGMKQNSHALIRPV

SEQ ID NO: 30293 - protein, 25 aa, synthetic construct
  source 1..25: note = Seed: YGFLNVIVHSATGFKQSSKALQRPV
YGFLNVIVHSATGMKQNSIALFRPV

SEQ ID NO: 30294 - protein, 25 aa, synthetic construct
  source 1..25: note = Seed: YGFLNVIVHSATGFKQSSKALQRPV
YGFLNVIVHSATGMKQNSIALIRPV

SEQ ID NO: 30295 - protein, 25 aa, synthetic construct
  source 1..25: note = Seed: YGFLNVIVHSATGFKQSSKALQRPV
YGFLNVIVHSATGMKQNSIALLRPV

SEQ ID NO: 30296 - protein, 25 aa, synthetic construct
  source 1..25: note = Seed: YGFLNVIVHSATGFKQSSKALQRPV
YGFLNVIVHSATGMKQNSIALMRPV

SEQ ID NO: 30297 - protein, 25 aa, synthetic construct
  source 1..25: note = Seed: YGFLNVIVHSATGFKQSSKALQRPV
YGFLNVIVHSATGMKQNSIALVRPV

SEQ ID NO: 30298 - protein, 25 aa, synthetic construct
  source 1..25: note = Seed: YGFLNVIVHSATGFKQSSKALQRPV
YGFLNVIVHSATGMKQNSIALYRPV

SEQ ID NO: 30299 - protein, 25 aa, synthetic construct
  source 1..25: note = Seed: YGFLNVIVHSATGFKQSSKALQRPV
YGFLNVIVHSATGMKQNSLALIRPV

SEQ ID NO: 30300 - protein, 25 aa, synthetic construct
  source 1..25: note = Seed: YGFLNVIVHSATGFKQSSKALQRPV
YGFLNVIVHSATGMKQNSLALVRPV

SEQ ID NO: 30301 - protein, 25 aa, synthetic construct
  source 1..25: note = Seed: YGFLNVIVHSATGFKQSSKALQRPV
YGFLNVIVHSATGMKQNSMALIRPV

SEQ ID NO: 30302 - protein, 25 aa, synthetic construct
  source 1..25: note = Seed: YGFLNVIVHSATGFKQSSKALQRPV
YGFLNVIVHSATGMKQNSMALVRPV

SEQ ID NO: 30303 - protein, 25 aa, synthetic construct
  source 1..25: note = Seed: YGFLNVIVHSATGFKQSSKALQRPV
YGFLNVIVHSATGMKQNSNALARPV

SEQ ID NO: 30304 - protein, 25 aa, synthetic construct
  source 1..25: note = Seed: YGFLNVIVHSATGFKQSSKALQRPV
YGFLNVIVHSATGMKQNSNALFRPV

SEQ ID NO: 30305 - protein, 25 aa, synthetic construct
  source 1..25: note = Seed: YGFLNVIVHSATGFKQSSKALQRPV
YGFLNVIVHSATGMKQNSNALIRPV

SEQ ID NO: 30306 - protein, 25 aa, synthetic construct
  source 1..25: note = Seed: YGFLNVIVHSATGFKQSSKALQRPV
YGFLNVIVHSATGMKQNSNALLRPV

SEQ ID NO: 30307 - protein, 25 aa, synthetic construct
  source 1..25: note = Seed: YGFLNVIVHSATGFKQSSKALQRPV
YGFLNVIVHSATGMKQNSNALMRPV

SEQ ID NO: 30308 - protein, 25 aa, synthetic construct
  source 1..25: note = Seed: YGFLNVIVHSATGFKQSSKALQRPV
YGFLNVIVHSATGMKQNSNALVRPV

SEQ ID NO: 30309 - protein, 25 aa, synthetic construct
  source 1..25: note = Seed: YGFLNVIVHSATGFKQSSKALQRPV
YGFLNVIVHSATGMKQNSNALYRPV

SEQ ID NO: 30310 - protein, 25 aa, synthetic construct
  source 1..25: note = Seed: YGFLNVIVHSATGFKQSSKALQRPV
YGFLNVIVHSATGMKQNSPALFRPV

SEQ ID NO: 30311 - protein, 25 aa, synthetic construct
  source 1..25: note = Seed: YGFLNVIVHSATGFKQSSKALQRPV
YGFLNVIVHSATGMKQNSPALIRPV

SEQ ID NO: 30312 - protein, 25 aa, synthetic construct
  source 1..25: note = Seed: YGFLNVIVHSATGFKQSSKALQRPV
YGFLNVIVHSATGMKQNSPALLRPV

SEQ ID NO: 30313 - protein, 25 aa, synthetic construct
  source 1..25: note = Seed: YGFLNVIVHSATGFKQSSKALQRPV
YGFLNVIVHSATGMKQNSPALMRPV

SEQ ID NO: 30314 - protein, 25 aa, synthetic construct
  source 1..25: note = Seed: YGFLNVIVHSATGFKQSSKALQRPV
YGFLNVIVHSATGMKQNSPALVRPV

SEQ ID NO: 30315 - protein, 25 aa, synthetic construct
  source 1..25: note = Seed: YGFLNVIVHSATGFKQSSKALQRPV
YGFLNVIVHSATGMKQNSPALYRPV

SEQ ID NO: 30316 - protein, 25 aa, synthetic construct
  source 1..25: note = Seed: YGFLNVIVHSATGFKQSSKALQRPV
YGFLNVIVHSATGMKQNSSALARPV

SEQ ID NO: 30317 - protein, 25 aa, synthetic construct
  source 1..25: note = Seed: YGFLNVIVHSATGFKQSSKALQRPV
YGFLNVIVHSATGMKQNSSALFRPV

SEQ ID NO: 30318 - protein, 25 aa, synthetic construct
  source 1..25: note = Seed: YGFLNVIVHSATGFKQSSKALQRPV
YGFLNVIVHSATGMKQNSSALIRPV

SEQ ID NO: 30319 - protein, 25 aa, synthetic construct
  source 1..25: note = Seed: YGFLNVIVHSATGFKQSSKALQRPV
YGFLNVIVHSATGMKQNSSALLRPV

SEQ ID NO: 30320 - protein, 25 aa, synthetic construct
  source 1..25: note = Seed: YGFLNVIVHSATGFKQSSKALQRPV
YGFLNVIVHSATGMKQNSSALMRPV

SEQ ID NO: 30321 - protein, 25 aa, synthetic construct
  source 1..25: note = Seed: YGFLNVIVHSATGFKQSSKALQRPV
YGFLNVIVHSATGMKQNSSALVRPV

SEQ ID NO: 30322 - protein, 25 aa, synthetic construct
  source 1..25: note = Seed: YGFLNVIVHSATGFKQSSKALQRPV
YGFLNVIVHSATGMKQNSSALYRPV

SEQ ID NO: 30323 - protein, 25 aa, synthetic construct
  source 1..25: note = Seed: YGFLNVIVHSATGFKQSSKALQRPV
YGFLNVIVHSATGMKQNSTALFRPV

SEQ ID NO: 30324 - protein, 25 aa, synthetic construct
  source 1..25: note = Seed: YGFLNVIVHSATGFKQSSKALQRPV
YGFLNVIVHSATGMKQNSTALIRPV

SEQ ID NO: 30325 - protein, 25 aa, synthetic construct
  source 1..25: note = Seed: YGFLNVIVHSATGFKQSSKALQRPV
YGFLNVIVHSATGMKQNSTALLRPV

SEQ ID NO: 30326 - protein, 25 aa, synthetic construct
  source 1..25: note = Seed: YGFLNVIVHSATGFKQSSKALQRPV
YGFLNVIVHSATGMKQNSTALVRPV

SEQ ID NO: 30327 - protein, 25 aa, synthetic construct
  source 1..25: note = Seed: YGFLNVIVHSATGFKQSSKALQRPV
YGFLNVIVHSATGMKQNSTALYRPV

SEQ ID NO: 30328 - protein, 25 aa, synthetic construct
  source 1..25: note = Seed: YGFLNVIVHSATGFKQSSKALQRPV
YGFLNVIVHSATGMKQNSVALFRPV

SEQ ID NO: 30329 - protein, 25 aa, synthetic construct
  source 1..25: note = Seed: YGFLNVIVHSATGFKQSSKALQRPV
YGFLNVIVHSATGMKQNSVALIRPV

SEQ ID NO: 30330 - protein, 25 aa, synthetic construct
  source 1..25: note = Seed: YGFLNVIVHSATGFKQSSKALQRPV
YGFLNVIVHSATGMKQNSVALLRPV

SEQ ID NO: 30331 - protein, 25 aa, synthetic construct
  source 1..25: note = Seed: YGFLNVIVHSATGFKQSSKALQRPV
YGFLNVIVHSATGMKQNSVALMRPV

SEQ ID NO: 30332 - protein, 25 aa, synthetic construct
  source 1..25: note = Seed: YGFLNVIVHSATGFKQSSKALQRPV
YGFLNVIVHSATGMKQNSVALVRPV

SEQ ID NO: 30333 - protein, 25 aa, synthetic construct
  source 1..25: note = Seed: YGFLNVIVHSATGFKQSSKALQRPV
YGFLNVIVHSATGMKQNSVALYRPV

SEQ ID NO: 30334 - protein, 25 aa, synthetic construct
  source 1..25: note = Seed: YGFLNVIVHSATGFKQSSKALQRPV
YGFLNVIVHSATGMKQQSAALARPV

SEQ ID NO: 30335 - protein, 25 aa, synthetic construct
  source 1..25: note = Seed: YGFLNVIVHSATGFKQSSKALQRPV
YGFLNVIVHSATGMKQQSAALNRPV

SEQ ID NO: 30336 - protein, 25 aa, synthetic construct
  source 1..25: note = Seed: YGFLNVIVHSATGFKQSSKALQRPV
YGFLNVIVHSATGMKQQSAALSRPV

SEQ ID NO: 30337 - protein, 25 aa, synthetic construct
  source 1..25: note = Seed: YGFLNVIVHSATGFKQSSKALQRPV
YGFLNVIVHSATGMKQQSRALARPV

SEQ ID NO: 30338 - protein, 25 aa, synthetic construct
  source 1..25: note = Seed: YGFLNVIVHSATGFKQSSKALQRPV
YGFLNVIVHSATGMKQQSRALSRPV

SEQ ID NO: 30339 - protein, 25 aa, synthetic construct
  source 1..25: note = Seed: YGFLNVIVHSATGFKQSSKALQRPV
YGFLNVIVHSATGMKQRSKALRRPV

SEQ ID NO: 30340 - protein, 25 aa, synthetic construct
  source 1..25: note = Seed: YGFLNVIVHSATGFKQSSKALQRPV
YGFLNVIVHSATGMKQRSKALYRPV

SEQ ID NO: 30341 - protein, 25 aa, synthetic construct
  source 1..25: note = Seed: YGFLNVIVHSATGFKQSSKALQRPV
YGFLNVIVHSATGMKQRSRALFRPV

SEQ ID NO: 30342 - protein, 25 aa, synthetic construct
  source 1..25: note = Seed: YGFLNVIVHSATGFKQSSKALQRPV
YGFLNVIVHSATGMKQRSRALIRPV

SEQ ID NO: 30343 - protein, 25 aa, synthetic construct
  source 1..25: note = Seed: YGFLNVIVHSATGFKQSSKALQRPV
YGFLNVIVHSATGMKQRSRALRRPV

SEQ ID NO: 30344 - protein, 25 aa, synthetic construct
  source 1..25: note = Seed: YGFLNVIVHSATGFKQSSKALQRPV
YGFLNVIVHSATGMKQRSRALVRPV

SEQ ID NO: 30345 - protein, 25 aa, synthetic construct
  source 1..25: note = Seed: YGFLNVIVHSATGFKQSSKALQRPV
YGFLNVIVHSATGMKQRSRALYRPV

SEQ ID NO: 30346 - protein, 25 aa, synthetic construct
  source 1..25: note = Seed: YGFLNVIVHSATGFKQSSKALQRPV
YGFLNVIVHSATGMKQSSAALIRPV

SEQ ID NO: 30347 - protein, 25 aa, synthetic construct
  source 1..25: note = Seed: YGFLNVIVHSATGFKQSSKALQRPV
YGFLNVIVHSATGMKQSSRALRRPV

SEQ ID NO: 30348 - protein, 25 aa, synthetic construct
  source 1..25: note = Seed: YGFLNVIVHSATGFKQSSKALQRPV
YGFLNVIVHSATGMKQTSFALFRPV

SEQ ID NO: 30349 - protein, 25 aa, synthetic construct
  source 1..25: note = Seed: YGFLNVIVHSATGFKQSSKALQRPV
YGFLNVIVHSATGMKQTSFALIRPV

SEQ ID NO: 30350 - protein, 25 aa, synthetic construct
  source 1..25: note = Seed: YGFLNVIVHSATGFKQSSKALQRPV
YGFLNVIVHSATGMKQTSFALLRPV

SEQ ID NO: 30351 - protein, 25 aa, synthetic construct
  source 1..25: note = Seed: YGFLNVIVHSATGFKQSSKALQRPV
YGFLNVIVHSATGMKQTSFALVRPV

SEQ ID NO: 30352 - protein, 25 aa, synthetic construct
  source 1..25: note = Seed: YGFLNVIVHSATGFKQSSKALQRPV
YGFLNVIVHSATGMKQVSAALARPV

SEQ ID NO: 30353 - protein, 25 aa, synthetic construct
  source 1..25: note = Seed: YGFLNVIVHSATGFKQSSKALQRPV
YGFLNVIVHSATGMKQVSAALNRPV

SEQ ID NO: 30354 - protein, 25 aa, synthetic construct
  source 1..25: note = Seed: YGFLNVIVHSATGFKQSSKALQRPV
YGFLNVIVHSATGMKQVSAALSRPV

SEQ ID NO: 30355 - protein, 25 aa, synthetic construct
  source 1..25: note = Seed: YGFLNVIVHSATGFKQSSKALQRPV
YGFLNVIVHSATGMKQVSFALFRPV

SEQ ID NO: 30356 - protein, 25 aa, synthetic construct
  source 1..25: note = Seed: YGFLNVIVHSATGFKQSSKALQRPV
YGFLNVIVHSATGMKQVSFALIRPV

SEQ ID NO: 30357 - protein, 25 aa, synthetic construct
  source 1..25: note = Seed: YGFLNVIVHSATGFKQSSKALQRPV
YGFLNVIVHSATGMKQVSFALLRPV

SEQ ID NO: 30358 - protein, 25 aa, synthetic construct
  source 1..25: note = Seed: YGFLNVIVHSATGFKQSSKALQRPV
YGFLNVIVHSATGMKQVSFALVRPV

SEQ ID NO: 30359 - protein, 25 aa, synthetic construct
  source 1..25: note = Seed: YGFLNVIVHSATGFKQSSKALQRPV
YGFLNVIVHSATGMKQVSFALYRPV

SEQ ID NO: 30360 - protein, 25 aa, synthetic construct
  source 1..25: note = Seed: YGFLNVIVHSATGFKQSSKALQRPV
YGFLNVIVHSATGMKQVSIALARPV

SEQ ID NO: 30361 - protein, 25 aa, synthetic construct
  source 1..25: note = Seed: YGFLNVIVHSATGFKQSSKALQRPV
YGFLNVIVHSATGMKQVSIALRRPV

SEQ ID NO: 30362 - protein, 25 aa, synthetic construct
  source 1..25: note = Seed: YGFLNVIVHSATGFKQSSKALQRPV
YGFLNVIVHSATGMKQVSKALARPV

SEQ ID NO: 30363 - protein, 25 aa, synthetic construct
  source 1..25: note = Seed: YGFLNVIVHSATGFKQSSKALQRPV
YGFLNVIVHSATGMKQVSKALGRPV

SEQ ID NO: 30364 - protein, 25 aa, synthetic construct
  source 1..25: note = Seed: YGFLNVIVHSATGFKQSSKALQRPV
YGFLNVIVHSATGMKQVSKALHRPV

SEQ ID NO: 30365 - protein, 25 aa, synthetic construct
  source 1..25: note = Seed: YGFLNVIVHSATGFKQSSKALQRPV
YGFLNVIVHSATGMKQVSKALKRPV

SEQ ID NO: 30366 - protein, 25 aa, synthetic construct
  source 1..25: note = Seed: YGFLNVIVHSATGFKQSSKALQRPV
YGFLNVIVHSATGMKQVSKALQRPV

SEQ ID NO: 30367 - protein, 25 aa, synthetic construct
  source 1..25: note = Seed: YGFLNVIVHSATGFKQSSKALQRPV
YGFLNVIVHSATGMKQVSKALRRPV

SEQ ID NO: 30368 - protein, 25 aa, synthetic construct
  source 1..25: note = Seed: YGFLNVIVHSATGFKQSSKALQRPV
YGFLNVIVHSATGMKQVSKALSRPV

SEQ ID NO: 30369 - protein, 25 aa, synthetic construct
  source 1..25: note = Seed: YGFLNVIVHSATGFKQSSKALQRPV
YGFLNVIVHSATGMKQVSKALTRPV

SEQ ID NO: 30370 - protein, 25 aa, synthetic construct
  source 1..25: note = Seed: YGFLNVIVHSATGFKQSSKALQRPV
YGFLNVIVHSATGMKQVSKALYRPV

SEQ ID NO: 30371 - protein, 25 aa, synthetic construct
  source 1..25: note = Seed: YGFLNVIVHSATGFKQSSKALQRPV
YGFLNVIVHSATGMKQVSLALFRPV

SEQ ID NO: 30372 - protein, 25 aa, synthetic construct
  source 1..25: note = Seed: YGFLNVIVHSATGFKQSSKALQRPV
YGFLNVIVHSATGMKQVSLALRRPV

SEQ ID NO: 30373 - protein, 25 aa, synthetic construct
  source 1..25: note = Seed: YGFLNVIVHSATGFKQSSKALQRPV
YGFLNVIVHSATGMKQVSMALFRPV

SEQ ID NO: 30374 - protein, 25 aa, synthetic construct
  source 1..25: note = Seed: YGFLNVIVHSATGFKQSSKALQRPV
YGFLNVIVHSATGMKQVSPALARPV

SEQ ID NO: 30375 - protein, 25 aa, synthetic construct
  source 1..25: note = Seed: YGFLNVIVHSATGFKQSSKALQRPV
YGFLNVIVHSATGMKQVSPALNRPV

SEQ ID NO: 30376 - protein, 25 aa, synthetic construct
  source 1..25: note = Seed: YGFLNVIVHSATGFKQSSKALQRPV
YGFLNVIVHSATGMKQVSPALSRPV

SEQ ID NO: 30377 - protein, 25 aa, synthetic construct
  source 1..25: note = Seed: YGFLNVIVHSATGFKQSSKALQRPV
YGFLNVIVHSATGMKQVSRALARPV

SEQ ID NO: 30378 - protein, 25 aa, synthetic construct
  source 1..25: note = Seed: YGFLNVIVHSATGFKQSSKALQRPV
YGFLNVIVHSATGMKQVSRALGRPV

SEQ ID NO: 30379 - protein, 25 aa, synthetic construct
  source 1..25: note = Seed: YGFLNVIVHSATGFKQSSKALQRPV
YGFLNVIVHSATGMKQVSRALHRPV

SEQ ID NO: 30380 - protein, 25 aa, synthetic construct
  source 1..25: note = Seed: YGFLNVIVHSATGFKQSSKALQRPV
YGFLNVIVHSATGMKQVSRALKRPV

SEQ ID NO: 30381 - protein, 25 aa, synthetic construct
  source 1..25: note = Seed: YGFLNVIVHSATGFKQSSKALQRPV
YGFLNVIVHSATGMKQVSRALMRPV

SEQ ID NO: 30382 - protein, 25 aa, synthetic construct
  source 1..25: note = Seed: YGFLNVIVHSATGFKQSSKALQRPV
YGFLNVIVHSATGMKQVSRALQRPV

SEQ ID NO: 30383 - protein, 25 aa, synthetic construct
  source 1..25: note = Seed: YGFLNVIVHSATGFKQSSKALQRPV
YGFLNVIVHSATGMKQVSRALRRPV

SEQ ID NO: 30384 - protein, 25 aa, synthetic construct
  source 1..25: note = Seed: YGFLNVIVHSATGFKQSSKALQRPV
YGFLNVIVHSATGMKQVSRALSRPV

SEQ ID NO: 30385 - protein, 25 aa, synthetic construct
  source 1..25: note = Seed: YGFLNVIVHSATGFKQSSKALQRPV
YGFLNVIVHSATGMKQVSRALTRPV

SEQ ID NO: 30386 - protein, 25 aa, synthetic construct
  source 1..25: note = Seed: YGFLNVIVHSATGFKQSSKALQRPV
YGFLNVIVHSATGMKQVSRALVRPV

SEQ ID NO: 30387 - protein, 25 aa, synthetic construct
  source 1..25: note = Seed: YGFLNVIVHSATGFKQSSKALQRPV
YGFLNVIVHSATGMKQVSRALYRPV

SEQ ID NO: 30388 - protein, 25 aa, synthetic construct
  source 1..25: note = Seed: YGFLNVIVHSATGFKQSSKALQRPV
YGFLNVIVHSATGMKQVSSALARPV

SEQ ID NO: 30389 - protein, 25 aa, synthetic construct
  source 1..25: note = Seed: YGFLNVIVHSATGFKQSSKALQRPV
YGFLNVIVHSATGMKQVSSALNRPV

SEQ ID NO: 30390 - protein, 25 aa, synthetic construct
  source 1..25: note = Seed: YGFLNVIVHSATGFKQSSKALQRPV
YGFLNVIVHSATGMKQVSSALSRPV

SEQ ID NO: 30391 - protein, 25 aa, synthetic construct
  source 1..25: note = Seed: YGFLNVIVHSATGFKQSSKALQRPV
YGFLNVIVHSATGMKQVSTALARPV

SEQ ID NO: 30392 - protein, 25 aa, synthetic construct
  source 1..25: note = Seed: YGFLNVIVHSATGFKQSSKALQRPV
YGFLNVIVHSATGMKQVSTALNRPV

SEQ ID NO: 30393 - protein, 25 aa, synthetic construct
  source 1..25: note = Seed: YGFLNVIVHSATGFKQSSKALQRPV
YGFLNVIVHSATGMKQVSTALSRPV

SEQ ID NO: 30394 - protein, 25 aa, synthetic construct
  source 1..25: note = Seed: YGFLNVIVHSATGFKQSSKALQRPV
YGFLNVIVHSATGMKQVSVALARPV

SEQ ID NO: 30395 - protein, 25 aa, synthetic construct
  source 1..25: note = Seed: YGFLNVIVHSATGFKQSSKALQRPV
YGFLNVIVHSATGMKQVSVALNRPV

SEQ ID NO: 30396 - protein, 25 aa, synthetic construct
  source 1..25: note = Seed: YGFLNVIVHSATGFKQSSKALQRPV
YGFLNVIVHSATGMKQVSVALSRPV

SEQ ID NO: 30397 - protein, 25 aa, synthetic construct
  source 1..25: note = Seed: YGFLNVIVHSATGFKQSSKALQRPV
YGFLNVIVHSATGMKQVSWALFRPV

SEQ ID NO: 30398 - protein, 25 aa, synthetic construct
  source 1..25: note = Seed: YGFLNVIVHSATGFKQSSKALQRPV
YGFLNVIVHSATGMKQVSYALFRPV

SEQ ID NO: 30399 - protein, 25 aa, synthetic construct
  source 1..25: note = Seed: YGFLNVIVHSATGFKQSSKALQRPV
YGFLNVIVHSATGMKQVSYALYRPV

SEQ ID NO: 30400 - protein, 25 aa, synthetic construct
  source 1..25: note = Seed: YGFLNVIVHSATGFKQSSKALQRPV
YGFLNVIVHSATGMKQWSAALARPV

SEQ ID NO: 30401 - protein, 25 aa, synthetic construct
  source 1..25: note = Seed: YGFLNVIVHSATGFKQSSKALQRPV
YGFLNVIVHSATGMKQWSAALRRPV

SEQ ID NO: 30402 - protein, 25 aa, synthetic construct
  source 1..25: note = Seed: YGFLNVIVHSATGFKQSSKALQRPV
YGFLNVIVHSATGMKQWSAALSRPV

SEQ ID NO: 30403 - protein, 25 aa, synthetic construct
  source 1..25: note = Seed: YGFLNVIVHSATGFKQSSKALQRPV
YGFLNVIVHSATGMKQWSFALFRPV

SEQ ID NO: 30404 - protein, 25 aa, synthetic construct
  source 1..25: note = Seed: YGFLNVIVHSATGFKQSSKALQRPV
YGFLNVIVHSATGMKQWSFALLRPV

SEQ ID NO: 30405 - protein, 25 aa, synthetic construct
  source 1..25: note = Seed: YGFLNVIVHSATGFKQSSKALQRPV
YGFLNVIVHSATGMKQWSFALYRPV

SEQ ID NO: 30406 - protein, 25 aa, synthetic construct
  source 1..25: note = Seed: YGFLNVIVHSATGFKQSSKALQRPV
YGFLNVIVHSATGMKQWSIALARPV

SEQ ID NO: 30407 - protein, 25 aa, synthetic construct
  source 1..25: note = Seed: YGFLNVIVHSATGFKQSSKALQRPV
YGFLNVIVHSATGMKQWSIALSRPV

SEQ ID NO: 30408 - protein, 25 aa, synthetic construct
  source 1..25: note = Seed: YGFLNVIVHSATGFKQSSKALQRPV
YGFLNVIVHSATGMKQWSKALARPV

SEQ ID NO: 30409 - protein, 25 aa, synthetic construct
  source 1..25: note = Seed: YGFLNVIVHSATGFKQSSKALQRPV
YGFLNVIVHSATGMKQWSKALFRPV

SEQ ID NO: 30410 - protein, 25 aa, synthetic construct
  source 1..25: note = Seed: YGFLNVIVHSATGFKQSSKALQRPV
YGFLNVIVHSATGMKQWSKALRRPV

SEQ ID NO: 30411 - protein, 25 aa, synthetic construct
  source 1..25: note = Seed: YGFLNVIVHSATGFKQSSKALQRPV
YGFLNVIVHSATGMKQWSKALYRPV

SEQ ID NO: 30412 - protein, 25 aa, synthetic construct
  source 1..25: note = Seed: YGFLNVIVHSATGFKQSSKALQRPV
YGFLNVIVHSATGMKQWSLALARPV

SEQ ID NO: 30413 - protein, 25 aa, synthetic construct
  source 1..25: note = Seed: YGFLNVIVHSATGFKQSSKALQRPV
YGFLNVIVHSATGMKQWSLALSRPV

SEQ ID NO: 30414 - protein, 25 aa, synthetic construct
  source 1..25: note = Seed: YGFLNVIVHSATGFKQSSKALQRPV
YGFLNVIVHSATGMKQWSMALSRPV

SEQ ID NO: 30415 - protein, 25 aa, synthetic construct
  source 1..25: note = Seed: YGFLNVIVHSATGFKQSSKALQRPV
YGFLNVIVHSATGMKQWSRALARPV

SEQ ID NO: 30416 - protein, 25 aa, synthetic construct
  source 1..25: note = Seed: YGFLNVIVHSATGFKQSSKALQRPV
YGFLNVIVHSATGMKQWSRALFRPV

SEQ ID NO: 30417 - protein, 25 aa, synthetic construct
  source 1..25: note = Seed: YGFLNVIVHSATGFKQSSKALQRPV
YGFLNVIVHSATGMKQWSRALHRPV

SEQ ID NO: 30418 - protein, 25 aa, synthetic construct
  source 1..25: note = Seed: YGFLNVIVHSATGFKQSSKALQRPV
YGFLNVIVHSATGMKQWSRALIRPV

SEQ ID NO: 30419 - protein, 25 aa, synthetic construct
  source 1..25: note = Seed: YGFLNVIVHSATGFKQSSKALQRPV
YGFLNVIVHSATGMKQWSRALKRPV

SEQ ID NO: 30420 - protein, 25 aa, synthetic construct
  source 1..25: note = Seed: YGFLNVIVHSATGFKQSSKALQRPV
YGFLNVIVHSATGMKQWSRALLRPV

SEQ ID NO: 30421 - protein, 25 aa, synthetic construct
  source 1..25: note = Seed: YGFLNVIVHSATGFKQSSKALQRPV
YGFLNVIVHSATGMKQWSRALMRPV

SEQ ID NO: 30422 - protein, 25 aa, synthetic construct
  source 1..25: note = Seed: YGFLNVIVHSATGFKQSSKALQRPV
YGFLNVIVHSATGMKQWSRALRRPV

SEQ ID NO: 30423 - protein, 25 aa, synthetic construct
  source 1..25: note = Seed: YGFLNVIVHSATGFKQSSKALQRPV
YGFLNVIVHSATGMKQWSRALSRPV

SEQ ID NO: 30424 - protein, 25 aa, synthetic construct
  source 1..25: note = Seed: YGFLNVIVHSATGFKQSSKALQRPV
YGFLNVIVHSATGMKQWSRALVRPV

SEQ ID NO: 30425 - protein, 25 aa, synthetic construct
  source 1..25: note = Seed: YGFLNVIVHSATGFKQSSKALQRPV
YGFLNVIVHSATGMKQWSRALYRPV

SEQ ID NO: 30426 - protein, 25 aa, synthetic construct
  source 1..25: note = Seed: YGFLNVIVHSATGFKQSSKALQRPV
YGFLNVIVHSATGMKQWSSALARPV

SEQ ID NO: 30427 - protein, 25 aa, synthetic construct
  source 1..25: note = Seed: YGFLNVIVHSATGFKQSSKALQRPV
YGFLNVIVHSATGMKQWSTALARPV

SEQ ID NO: 30428 - protein, 25 aa, synthetic construct
  source 1..25: note = Seed: YGFLNVIVHSATGFKQSSKALQRPV
YGFLNVIVHSATGMKQWSVALARPV

SEQ ID NO: 30429 - protein, 25 aa, synthetic construct
  source 1..25: note = Seed: YGFLNVIVHSATGFKQSSKALQRPV
YGFLNVIVHSATGMKQWSVALSRPV

SEQ ID NO: 30430 - protein, 25 aa, synthetic construct
  source 1..25: note = Seed: YGFLNVIVHSATGFKQSSKALQRPV
YGFLNVIVHSATGMKQWSYALYRPV

SEQ ID NO: 30431 - protein, 25 aa, synthetic construct
  source 1..25: note = Seed: YGFLNVIVHSATGFKQSSKALQRPV
YGFLNVIVHSATGMKQYSAALARPV

SEQ ID NO: 30432 - protein, 25 aa, synthetic construct
  source 1..25: note = Seed: YGFLNVIVHSATGFKQSSKALQRPV
YGFLNVIVHSATGMKQYSAALSRPV

SEQ ID NO: 30433 - protein, 25 aa, synthetic construct
  source 1..25: note = Seed: YGFLNVIVHSATGFKQSSKALQRPV
YGFLNVIVHSATGMKQYSFALFRPV

SEQ ID NO: 30434 - protein, 25 aa, synthetic construct
  source 1..25: note = Seed: YGFLNVIVHSATGFKQSSKALQRPV
YGFLNVIVHSATGMKQYSFALLRPV

SEQ ID NO: 30435 - protein, 25 aa, synthetic construct
  source 1..25: note = Seed: YGFLNVIVHSATGFKQSSKALQRPV
YGFLNVIVHSATGMKQYSFALYRPV

SEQ ID NO: 30436 - protein, 25 aa, synthetic construct
  source 1..25: note = Seed: YGFLNVIVHSATGFKQSSKALQRPV
YGFLNVIVHSATGMKQYSIALARPV

SEQ ID NO: 30437 - protein, 25 aa, synthetic construct
  source 1..25: note = Seed: YGFLNVIVHSATGFKQSSKALQRPV
YGFLNVIVHSATGMKQYSIALSRPV

SEQ ID NO: 30438 - protein, 25 aa, synthetic construct
  source 1..25: note = Seed: YGFLNVIVHSATGFKQSSKALQRPV
YGFLNVIVHSATGMKQYSIALTRPV

SEQ ID NO: 30439 - protein, 25 aa, synthetic construct
  source 1..25: note = Seed: YGFLNVIVHSATGFKQSSKALQRPV
YGFLNVIVHSATGMKQYSKALRRPV

SEQ ID NO: 30440 - protein, 25 aa, synthetic construct
  source 1..25: note = Seed: YGFLNVIVHSATGFKQSSKALQRPV
YGFLNVIVHSATGMKQYSLALGRPV

SEQ ID NO: 30441 - protein, 25 aa, synthetic construct
  source 1..25: note = Seed: YGFLNVIVHSATGFKQSSKALQRPV
YGFLNVIVHSATGMKQYSLALSRPV

SEQ ID NO: 30442 - protein, 25 aa, synthetic construct
  source 1..25: note = Seed: YGFLNVIVHSATGFKQSSKALQRPV
YGFLNVIVHSATGMKQYSPALARPV

SEQ ID NO: 30443 - protein, 25 aa, synthetic construct
  source 1..25: note = Seed: YGFLNVIVHSATGFKQSSKALQRPV
YGFLNVIVHSATGMKQYSRALRRPV

SEQ ID NO: 30444 - protein, 25 aa, synthetic construct
  source 1..25: note = Seed: YGFLNVIVHSATGFKQSSKALQRPV
YGFLNVIVHSATGMKQYSRALYRPV

SEQ ID NO: 30445 - protein, 25 aa, synthetic construct
  source 1..25: note = Seed: YGFLNVIVHSATGFKQSSKALQRPV
YGFLNVIVHSATGMKQYSSALARPV

SEQ ID NO: 30446 - protein, 25 aa, synthetic construct
  source 1..25: note = Seed: YGFLNVIVHSATGFKQSSKALQRPV
YGFLNVIVHSATGMKQYSSALSRPV

SEQ ID NO: 30447 - protein, 25 aa, synthetic construct
  source 1..25: note = Seed: YGFLNVIVHSATGFKQSSKALQRPV
YGFLNVIVHSATGMKQYSTALARPV

SEQ ID NO: 30448 - protein, 25 aa, synthetic construct
  source 1..25: note = Seed: YGFLNVIVHSATGFKQSSKALQRPV
YGFLNVIVHSATGMKQYSVALARPV

SEQ ID NO: 30449 - protein, 25 aa, synthetic construct
  source 1..25: note = Seed: YGFLNVIVHSATGFKQSSKALQRPV
YGFLNVIVHSATGMKQYSVALSRPV

SEQ ID NO: 30450 - protein, 25 aa, synthetic construct
  source 1..25: note = Seed: YGFLNVIVHSATGFKQSSKALQRPV
YGFLNVIVHSATGMKQYSVALTRPV

SEQ ID NO: 30451 - protein, 25 aa, synthetic construct
  source 1..25: note = Seed: YGFLNVIVHSATGFKQSSKALQRPV
YGFLNVIVHSATGQKQFSFALIRPV

SEQ ID NO: 30452 - protein, 25 aa, synthetic construct
  source 1..25: note = Seed: YGFLNVIVHSATGFKQSSKALQRPV
YGFLNVIVHSATGQKQFSFALMRPV

SEQ ID NO: 30453 - protein, 25 aa, synthetic construct
  source 1..25: note = Seed: YGFLNVIVHSATGFKQSSKALQRPV
YGFLNVIVHSATGQKQFSLALLRPV

SEQ ID NO: 30454 - protein, 25 aa, synthetic construct
  source 1..25: note = Seed: YGFLNVIVHSATGFKQSSKALQRPV
YGFLNVIVHSATGQKQISRALRRPV

SEQ ID NO: 30455 - protein, 25 aa, synthetic construct
  source 1..25: note = Seed: YGFLNVIVHSATGFKQSSKALQRPV
YGFLNVIVHSATGRKQFSFALIRPV

SEQ ID NO: 30456 - protein, 25 aa, synthetic construct
  source 1..25: note = Seed: YGFLNVIVHSATGFKQSSKALQRPV
YGFLNVIVHSATGRKQFSFALLRPV

SEQ ID NO: 30457 - protein, 25 aa, synthetic construct
  source 1..25: note = Seed: YGFLNVIVHSATGFKQSSKALQRPV
YGFLNVIVHSATGRKQFSFALMRPV

SEQ ID NO: 30458 - protein, 25 aa, synthetic construct
  source 1..25: note = Seed: YGFLNVIVHSATGFKQSSKALQRPV
YGFLNVIVHSATGRKQFSFALVRPV

SEQ ID NO: 30459 - protein, 25 aa, synthetic construct
  source 1..25: note = Seed: YGFLNVIVHSATGFKQSSKALQRPV
YGFLNVIVHSATGRKQFSIALLRPV

SEQ ID NO: 30460 - protein, 25 aa, synthetic construct
  source 1..25: note = Seed: YGFLNVIVHSATGFKQSSKALQRPV
YGFLNVIVHSATGRKQFSIALMRPV

SEQ ID NO: 30461 - protein, 25 aa, synthetic construct
  source 1..25: note = Seed: YGFLNVIVHSATGFKQSSKALQRPV
YGFLNVIVHSATGRKQFSLALIRPV

SEQ ID NO: 30462 - protein, 25 aa, synthetic construct
  source 1..25: note = Seed: YGFLNVIVHSATGFKQSSKALQRPV
YGFLNVIVHSATGRKQFSLALLRPV

SEQ ID NO: 30463 - protein, 25 aa, synthetic construct
  source 1..25: note = Seed: YGFLNVIVHSATGFKQSSKALQRPV
YGFLNVIVHSATGRKQFSLALMRPV

SEQ ID NO: 30464 - protein, 25 aa, synthetic construct
  source 1..25: note = Seed: YGFLNVIVHSATGFKQSSKALQRPV
YGFLNVIVHSATGRKQFSMALIRPV

SEQ ID NO: 30465 - protein, 25 aa, synthetic construct
  source 1..25: note = Seed: YGFLNVIVHSATGFKQSSKALQRPV
YGFLNVIVHSATGRKQFSMALMRPV

SEQ ID NO: 30466 - protein, 25 aa, synthetic construct
  source 1..25: note = Seed: YGFLNVIVHSATGFKQSSKALQRPV
YGFLNVIVHSATGRKQISAALARPV

SEQ ID NO: 30467 - protein, 25 aa, synthetic construct
  source 1..25: note = Seed: YGFLNVIVHSATGFKQSSKALQRPV
YGFLNVIVHSATGRKQISFALFRPV

SEQ ID NO: 30468 - protein, 25 aa, synthetic construct
  source 1..25: note = Seed: YGFLNVIVHSATGFKQSSKALQRPV
YGFLNVIVHSATGRKQISFALIRPV

SEQ ID NO: 30469 - protein, 25 aa, synthetic construct
  source 1..25: note = Seed: YGFLNVIVHSATGFKQSSKALQRPV
YGFLNVIVHSATGRKQISFALLRPV

SEQ ID NO: 30470 - protein, 25 aa, synthetic construct
  source 1..25: note = Seed: YGFLNVIVHSATGFKQSSKALQRPV
YGFLNVIVHSATGRKQISFALVRPV

SEQ ID NO: 30471 - protein, 25 aa, synthetic construct
  source 1..25: note = Seed: YGFLNVIVHSATGFKQSSKALQRPV
YGFLNVIVHSATGRKQISLALFRPV

SEQ ID NO: 30472 - protein, 25 aa, synthetic construct
  source 1..25: note = Seed: YGFLNVIVHSATGFKQSSKALQRPV
YGFLNVIVHSATGRKQISMALFRPV

SEQ ID NO: 30473 - protein, 25 aa, synthetic construct
  source 1..25: note = Seed: YGFLNVIVHSATGFKQSSKALQRPV
YGFLNVIVHSATGRKQISSALARPV

SEQ ID NO: 30474 - protein, 25 aa, synthetic construct
  source 1..25: note = Seed: YGFLNVIVHSATGFKQSSKALQRPV
YGFLNVIVHSATGRKQISYALLRPV

SEQ ID NO: 30475 - protein, 25 aa, synthetic construct
  source 1..25: note = Seed: YGFLNVIVHSATGFKQSSKALQRPV
YGFLNVIVHSATGRKQLSAALARPV

SEQ ID NO: 30476 - protein, 25 aa, synthetic construct
  source 1..25: note = Seed: YGFLNVIVHSATGFKQSSKALQRPV
YGFLNVIVHSATGRKQLSFALFRPV

SEQ ID NO: 30477 - protein, 25 aa, synthetic construct
  source 1..25: note = Seed: YGFLNVIVHSATGFKQSSKALQRPV
YGFLNVIVHSATGRKQLSFALIRPV

SEQ ID NO: 30478 - protein, 25 aa, synthetic construct
  source 1..25: note = Seed: YGFLNVIVHSATGFKQSSKALQRPV
YGFLNVIVHSATGRKQLSFALLRPV

SEQ ID NO: 30479 - protein, 25 aa, synthetic construct
  source 1..25: note = Seed: YGFLNVIVHSATGFKQSSKALQRPV
YGFLNVIVHSATGRKQLSLALFRPV

SEQ ID NO: 30480 - protein, 25 aa, synthetic construct
  source 1..25: note = Seed: YGFLNVIVHSATGFKQSSKALQRPV
YGFLNVIVHSATGRKQLSSALARPV

SEQ ID NO: 30481 - protein, 25 aa, synthetic construct
  source 1..25: note = Seed: YGFLNVIVHSATGFKQSSKALQRPV
YGFLNVIVHSATGRKQLSVALARPV

SEQ ID NO: 30482 - protein, 25 aa, synthetic construct
  source 1..25: note = Seed: YGFLNVIVHSATGFKQSSKALQRPV
YGFLNVIVHSATGRKQMSFALFRPV

SEQ ID NO: 30483 - protein, 25 aa, synthetic construct
  source 1..25: note = Seed: YGFLNVIVHSATGFKQSSKALQRPV
YGFLNVIVHSATGRKQVSFALFRPV

SEQ ID NO: 30484 - protein, 25 aa, synthetic construct
  source 1..25: note = Seed: YGFLNVIVHSATGFKQSSKALQRPV
YGFLNVIVHSATGRKQWSIALFRPV

SEQ ID NO: 30485 - protein, 25 aa, synthetic construct
  source 1..25: note = Seed: YGFLNVIVHSATGFKQSSKALQRPV
YGFLNVIVHSATGRKQWSLALFRPV

SEQ ID NO: 30486 - protein, 25 aa, synthetic construct
  source 1..25: note = Seed: YGFLNVIVHSATGFKQSSKALQRPV
YGFLNVIVHSATGRKQWSVALFRPV

SEQ ID NO: 30487 - protein, 25 aa, synthetic construct
  source 1..25: note = Seed: YGFLNVIVHSATGFKQSSKALQRPV
YGFLNVIVHSATGRKQYSFALLRPV

SEQ ID NO: 30488 - protein, 25 aa, synthetic construct
  source 1..25: note = Seed: YGFLNVIVHSATGFKQSSKALQRPV
YGFLNVIVHSATGSKQISRALRRPV

SEQ ID NO: 30489 - protein, 25 aa, synthetic construct
  source 1..25: note = Seed: YGFLNVIVHSATGFKQSSKALQRPV
YGFLNVIVHSATGTKQFSVALSRPV

SEQ ID NO: 30490 - protein, 25 aa, synthetic construct
  source 1..25: note = Seed: YGFLNVIVHSATGFKQSSKALQRPV
YGFLNVIVHSATGTKQISRALRRPV

SEQ ID NO: 30491 - protein, 25 aa, synthetic construct
  source 1..25: note = Seed: YGFLNVIVHSATGFKQSSKALQRPV
YGFLNVIVHSATGVKQASAALARPV

SEQ ID NO: 30492 - protein, 25 aa, synthetic construct
  source 1..25: note = Seed: YGFLNVIVHSATGFKQSSKALQRPV
YGFLNVIVHSATGVKQASAALIRPV

SEQ ID NO: 30493 - protein, 25 aa, synthetic construct
  source 1..25: note = Seed: YGFLNVIVHSATGFKQSSKALQRPV
YGFLNVIVHSATGVKQASAALNRPV

SEQ ID NO: 30494 - protein, 25 aa, synthetic construct
  source 1..25: note = Seed: YGFLNVIVHSATGFKQSSKALQRPV
YGFLNVIVHSATGVKQASAALSRPV

SEQ ID NO: 30495 - protein, 25 aa, synthetic construct
  source 1..25: note = Seed: YGFLNVIVHSATGFKQSSKALQRPV
YGFLNVIVHSATGVKQASKALARPV

SEQ ID NO: 30496 - protein, 25 aa, synthetic construct
  source 1..25: note = Seed: YGFLNVIVHSATGFKQSSKALQRPV
YGFLNVIVHSATGVKQASKALRRPV

SEQ ID NO: 30497 - protein, 25 aa, synthetic construct
  source 1..25: note = Seed: YGFLNVIVHSATGFKQSSKALQRPV
YGFLNVIVHSATGVKQASKALSRPV

SEQ ID NO: 30498 - protein, 25 aa, synthetic construct
  source 1..25: note = Seed: YGFLNVIVHSATGFKQSSKALQRPV
YGFLNVIVHSATGVKQASKALYRPV

SEQ ID NO: 30499 - protein, 25 aa, synthetic construct
  source 1..25: note = Seed: YGFLNVIVHSATGFKQSSKALQRPV
YGFLNVIVHSATGVKQASPALARPV

SEQ ID NO: 30500 - protein, 25 aa, synthetic construct
  source 1..25: note = Seed: YGFLNVIVHSATGFKQSSKALQRPV
YGFLNVIVHSATGVKQASRALARPV

SEQ ID NO: 30501 - protein, 25 aa, synthetic construct
  source 1..25: note = Seed: YGFLNVIVHSATGFKQSSKALQRPV
YGFLNVIVHSATGVKQASRALQRPV

SEQ ID NO: 30502 - protein, 25 aa, synthetic construct
  source 1..25: note = Seed: YGFLNVIVHSATGFKQSSKALQRPV
YGFLNVIVHSATGVKQASRALRRPV

SEQ ID NO: 30503 - protein, 25 aa, synthetic construct
  source 1..25: note = Seed: YGFLNVIVHSATGFKQSSKALQRPV
YGFLNVIVHSATGVKQASRALSRPV

SEQ ID NO: 30504 - protein, 25 aa, synthetic construct
  source 1..25: note = Seed: YGFLNVIVHSATGFKQSSKALQRPV
YGFLNVIVHSATGVKQASRALYRPV

SEQ ID NO: 30505 - protein, 25 aa, synthetic construct
  source 1..25: note = Seed: YGFLNVIVHSATGFKQSSKALQRPV
YGFLNVIVHSATGVKQASVALNRPV

SEQ ID NO: 30506 - protein, 25 aa, synthetic construct
  source 1..25: note = Seed: YGFLNVIVHSATGFKQSSKALQRPV
YGFLNVIVHSATGVKQASVALSRPV

SEQ ID NO: 30507 - protein, 25 aa, synthetic construct
  source 1..25: note = Seed: YGFLNVIVHSATGFKQSSKALQRPV
YGFLNVIVHSATGVKQESFALLRPV

SEQ ID NO: 30508 - protein, 25 aa, synthetic construct
  source 1..25: note = Seed: YGFLNVIVHSATGFKQSSKALQRPV
YGFLNVIVHSATGVKQFSAALARPV

SEQ ID NO: 30509 - protein, 25 aa, synthetic construct
  source 1..25: note = Seed: YGFLNVIVHSATGFKQSSKALQRPV
YGFLNVIVHSATGVKQFSAALFRPV

SEQ ID NO: 30510 - protein, 25 aa, synthetic construct
  source 1..25: note = Seed: YGFLNVIVHSATGFKQSSKALQRPV
YGFLNVIVHSATGVKQFSAALGRPV

SEQ ID NO: 30511 - protein, 25 aa, synthetic construct
  source 1..25: note = Seed: YGFLNVIVHSATGFKQSSKALQRPV
YGFLNVIVHSATGVKQFSAALIRPV

SEQ ID NO: 30512 - protein, 25 aa, synthetic construct
  source 1..25: note = Seed: YGFLNVIVHSATGFKQSSKALQRPV
YGFLNVIVHSATGVKQFSAALNRPV

SEQ ID NO: 30513 - protein, 25 aa, synthetic construct
  source 1..25: note = Seed: YGFLNVIVHSATGFKQSSKALQRPV
YGFLNVIVHSATGVKQFSAALRRPV

SEQ ID NO: 30514 - protein, 25 aa, synthetic construct
  source 1..25: note = Seed: YGFLNVIVHSATGFKQSSKALQRPV
YGFLNVIVHSATGVKQFSAALSRPV

SEQ ID NO: 30515 - protein, 25 aa, synthetic construct
  source 1..25: note = Seed: YGFLNVIVHSATGFKQSSKALQRPV
YGFLNVIVHSATGVKQFSAALTRPV

SEQ ID NO: 30516 - protein, 25 aa, synthetic construct
  source 1..25: note = Seed: YGFLNVIVHSATGFKQSSKALQRPV
YGFLNVIVHSATGVKQFSAALVRPV

SEQ ID NO: 30517 - protein, 25 aa, synthetic construct
  source 1..25: note = Seed: YGFLNVIVHSATGFKQSSKALQRPV
YGFLNVIVHSATGVKQFSFALIRPV

SEQ ID NO: 30518 - protein, 25 aa, synthetic construct
  source 1..25: note = Seed: YGFLNVIVHSATGFKQSSKALQRPV
YGFLNVIVHSATGVKQFSFALLRPV

SEQ ID NO: 30519 - protein, 25 aa, synthetic construct
  source 1..25: note = Seed: YGFLNVIVHSATGFKQSSKALQRPV
YGFLNVIVHSATGVKQFSFALMRPV

SEQ ID NO: 30520 - protein, 25 aa, synthetic construct
  source 1..25: note = Seed: YGFLNVIVHSATGFKQSSKALQRPV
YGFLNVIVHSATGVKQFSFALVRPV

SEQ ID NO: 30521 - protein, 25 aa, synthetic construct
  source 1..25: note = Seed: YGFLNVIVHSATGFKQSSKALQRPV
YGFLNVIVHSATGVKQFSFALYRPV

SEQ ID NO: 30522 - protein, 25 aa, synthetic construct
  source 1..25: note = Seed: YGFLNVIVHSATGFKQSSKALQRPV
YGFLNVIVHSATGVKQFSGALARPV

SEQ ID NO: 30523 - protein, 25 aa, synthetic construct
  source 1..25: note = Seed: YGFLNVIVHSATGFKQSSKALQRPV
YGFLNVIVHSATGVKQFSHALFRPV

SEQ ID NO: 30524 - protein, 25 aa, synthetic construct
  source 1..25: note = Seed: YGFLNVIVHSATGFKQSSKALQRPV
YGFLNVIVHSATGVKQFSHALRRPV

SEQ ID NO: 30525 - protein, 25 aa, synthetic construct
  source 1..25: note = Seed: YGFLNVIVHSATGFKQSSKALQRPV
YGFLNVIVHSATGVKQFSIALARPV

SEQ ID NO: 30526 - protein, 25 aa, synthetic construct
  source 1..25: note = Seed: YGFLNVIVHSATGFKQSSKALQRPV
YGFLNVIVHSATGVKQFSIALFRPV

SEQ ID NO: 30527 - protein, 25 aa, synthetic construct
  source 1..25: note = Seed: YGFLNVIVHSATGFKQSSKALQRPV
YGFLNVIVHSATGVKQFSIALLRPV

SEQ ID NO: 30528 - protein, 25 aa, synthetic construct
  source 1..25: note = Seed: YGFLNVIVHSATGFKQSSKALQRPV
YGFLNVIVHSATGVKQFSIALNRPV

SEQ ID NO: 30529 - protein, 25 aa, synthetic construct
  source 1..25: note = Seed: YGFLNVIVHSATGFKQSSKALQRPV
YGFLNVIVHSATGVKQFSIALRRPV

SEQ ID NO: 30530 - protein, 25 aa, synthetic construct
  source 1..25: note = Seed: YGFLNVIVHSATGFKQSSKALQRPV
YGFLNVIVHSATGVKQFSIALSRPV

SEQ ID NO: 30531 - protein, 25 aa, synthetic construct
  source 1..25: note = Seed: YGFLNVIVHSATGFKQSSKALQRPV
YGFLNVIVHSATGVKQFSIALYRPV

SEQ ID NO: 30532 - protein, 25 aa, synthetic construct
  source 1..25: note = Seed: YGFLNVIVHSATGFKQSSKALQRPV
YGFLNVIVHSATGVKQFSKALARPV

SEQ ID NO: 30533 - protein, 25 aa, synthetic construct
  source 1..25: note = Seed: YGFLNVIVHSATGFKQSSKALQRPV
YGFLNVIVHSATGVKQFSKALGRPV

SEQ ID NO: 30534 - protein, 25 aa, synthetic construct
  source 1..25: note = Seed: YGFLNVIVHSATGFKQSSKALQRPV
YGFLNVIVHSATGVKQFSKALHRPV

SEQ ID NO: 30535 - protein, 25 aa, synthetic construct
  source 1..25: note = Seed: YGFLNVIVHSATGFKQSSKALQRPV
YGFLNVIVHSATGVKQFSKALKRPV

SEQ ID NO: 30536 - protein, 25 aa, synthetic construct
  source 1..25: note = Seed: YGFLNVIVHSATGFKQSSKALQRPV
YGFLNVIVHSATGVKQFSKALRRPV

SEQ ID NO: 30537 - protein, 25 aa, synthetic construct
  source 1..25: note = Seed: YGFLNVIVHSATGFKQSSKALQRPV
YGFLNVIVHSATGVKQFSKALSRPV

SEQ ID NO: 30538 - protein, 25 aa, synthetic construct
  source 1..25: note = Seed: YGFLNVIVHSATGFKQSSKALQRPV
YGFLNVIVHSATGVKQFSKALYRPV

SEQ ID NO: 30539 - protein, 25 aa, synthetic construct
  source 1..25: note = Seed: YGFLNVIVHSATGFKQSSKALQRPV
YGFLNVIVHSATGVKQFSLALFRPV

SEQ ID NO: 30540 - protein, 25 aa, synthetic construct
  source 1..25: note = Seed: YGFLNVIVHSATGFKQSSKALQRPV
YGFLNVIVHSATGVKQFSLALLRPV

SEQ ID NO: 30541 - protein, 25 aa, synthetic construct
  source 1..25: note = Seed: YGFLNVIVHSATGFKQSSKALQRPV
YGFLNVIVHSATGVKQFSLALMRPV

SEQ ID NO: 30542 - protein, 25 aa, synthetic construct
  source 1..25: note = Seed: YGFLNVIVHSATGFKQSSKALQRPV
YGFLNVIVHSATGVKQFSLALNRPV

SEQ ID NO: 30543 - protein, 25 aa, synthetic construct
  source 1..25: note = Seed: YGFLNVIVHSATGFKQSSKALQRPV
YGFLNVIVHSATGVKQFSLALYRPV

SEQ ID NO: 30544 - protein, 25 aa, synthetic construct
  source 1..25: note = Seed: YGFLNVIVHSATGFKQSSKALQRPV
YGFLNVIVHSATGVKQFSMALLRPV

SEQ ID NO: 30545 - protein, 25 aa, synthetic construct
  source 1..25: note = Seed: YGFLNVIVHSATGFKQSSKALQRPV
YGFLNVIVHSATGVKQFSMALRRPV

SEQ ID NO: 30546 - protein, 25 aa, synthetic construct
  source 1..25: note = Seed: YGFLNVIVHSATGFKQSSKALQRPV
YGFLNVIVHSATGVKQFSMALYRPV

SEQ ID NO: 30547 - protein, 25 aa, synthetic construct
  source 1..25: note = Seed: YGFLNVIVHSATGFKQSSKALQRPV
YGFLNVIVHSATGVKQFSPALARPV

SEQ ID NO: 30548 - protein, 25 aa, synthetic construct
  source 1..25: note = Seed: YGFLNVIVHSATGFKQSSKALQRPV
YGFLNVIVHSATGVKQFSPALRRPV

SEQ ID NO: 30549 - protein, 25 aa, synthetic construct
  source 1..25: note = Seed: YGFLNVIVHSATGFKQSSKALQRPV
YGFLNVIVHSATGVKQFSPALSRPV

SEQ ID NO: 30550 - protein, 25 aa, synthetic construct
  source 1..25: note = Seed: YGFLNVIVHSATGFKQSSKALQRPV
YGFLNVIVHSATGVKQFSRALARPV

SEQ ID NO: 30551 - protein, 25 aa, synthetic construct
  source 1..25: note = Seed: YGFLNVIVHSATGFKQSSKALQRPV
YGFLNVIVHSATGVKQFSRALGRPV

SEQ ID NO: 30552 - protein, 25 aa, synthetic construct
  source 1..25: note = Seed: YGFLNVIVHSATGFKQSSKALQRPV
YGFLNVIVHSATGVKQFSRALHRPV

SEQ ID NO: 30553 - protein, 25 aa, synthetic construct
  source 1..25: note = Seed: YGFLNVIVHSATGFKQSSKALQRPV
YGFLNVIVHSATGVKQFSRALKRPV

SEQ ID NO: 30554 - protein, 25 aa, synthetic construct
  source 1..25: note = Seed: YGFLNVIVHSATGFKQSSKALQRPV
YGFLNVIVHSATGVKQFSRALMRPV

SEQ ID NO: 30555 - protein, 25 aa, synthetic construct
  source 1..25: note = Seed: YGFLNVIVHSATGFKQSSKALQRPV
YGFLNVIVHSATGVKQFSRALQRPV

SEQ ID NO: 30556 - protein, 25 aa, synthetic construct
  source 1..25: note = Seed: YGFLNVIVHSATGFKQSSKALQRPV
YGFLNVIVHSATGVKQFSRALRRPV

SEQ ID NO: 30557 - protein, 25 aa, synthetic construct
  source 1..25: note = Seed: YGFLNVIVHSATGFKQSSKALQRPV
YGFLNVIVHSATGVKQFSRALSRPV

SEQ ID NO: 30558 - protein, 25 aa, synthetic construct
  source 1..25: note = Seed: YGFLNVIVHSATGFKQSSKALQRPV
YGFLNVIVHSATGVKQFSRALYRPV

SEQ ID NO: 30559 - protein, 25 aa, synthetic construct
  source 1..25: note = Seed: YGFLNVIVHSATGFKQSSKALQRPV
YGFLNVIVHSATGVKQFSSALARPV

SEQ ID NO: 30560 - protein, 25 aa, synthetic construct
  source 1..25: note = Seed: YGFLNVIVHSATGFKQSSKALQRPV
YGFLNVIVHSATGVKQFSSALRRPV

SEQ ID NO: 30561 - protein, 25 aa, synthetic construct
  source 1..25: note = Seed: YGFLNVIVHSATGFKQSSKALQRPV
YGFLNVIVHSATGVKQFSSALSRPV

SEQ ID NO: 30562 - protein, 25 aa, synthetic construct
  source 1..25: note = Seed: YGFLNVIVHSATGFKQSSKALQRPV
YGFLNVIVHSATGVKQFSTALARPV

SEQ ID NO: 30563 - protein, 25 aa, synthetic construct
  source 1..25: note = Seed: YGFLNVIVHSATGFKQSSKALQRPV
YGFLNVIVHSATGVKQFSTALFRPV

SEQ ID NO: 30564 - protein, 25 aa, synthetic construct
  source 1..25: note = Seed: YGFLNVIVHSATGFKQSSKALQRPV
YGFLNVIVHSATGVKQFSTALRRPV

SEQ ID NO: 30565 - protein, 25 aa, synthetic construct
  source 1..25: note = Seed: YGFLNVIVHSATGFKQSSKALQRPV
YGFLNVIVHSATGVKQFSTALSRPV

SEQ ID NO: 30566 - protein, 25 aa, synthetic construct
  source 1..25: note = Seed: YGFLNVIVHSATGFKQSSKALQRPV
YGFLNVIVHSATGVKQFSTALTRPV

SEQ ID NO: 30567 - protein, 25 aa, synthetic construct
  source 1..25: note = Seed: YGFLNVIVHSATGFKQSSKALQRPV
YGFLNVIVHSATGVKQFSVALARPV

SEQ ID NO: 30568 - protein, 25 aa, synthetic construct
  source 1..25: note = Seed: YGFLNVIVHSATGFKQSSKALQRPV
YGFLNVIVHSATGVKQFSVALFRPV

SEQ ID NO: 30569 - protein, 25 aa, synthetic construct
  source 1..25: note = Seed: YGFLNVIVHSATGFKQSSKALQRPV
YGFLNVIVHSATGVKQFSVALNRPV

SEQ ID NO: 30570 - protein, 25 aa, synthetic construct
  source 1..25: note = Seed: YGFLNVIVHSATGFKQSSKALQRPV
YGFLNVIVHSATGVKQFSVALRRPV

SEQ ID NO: 30571 - protein, 25 aa, synthetic construct
  source 1..25: note = Seed: YGFLNVIVHSATGFKQSSKALQRPV
YGFLNVIVHSATGVKQFSVALSRPV

SEQ ID NO: 30572 - protein, 25 aa, synthetic construct
  source 1..25: note = Seed: YGFLNVIVHSATGFKQSSKALQRPV
YGFLNVIVHSATGVKQFSVALTRPV

SEQ ID NO: 30573 - protein, 25 aa, synthetic construct
  source 1..25: note = Seed: YGFLNVIVHSATGFKQSSKALQRPV
YGFLNVIVHSATGVKQFSWALIRPV

SEQ ID NO: 30574 - protein, 25 aa, synthetic construct
  source 1..25: note = Seed: YGFLNVIVHSATGFKQSSKALQRPV
YGFLNVIVHSATGVKQFSWALLRPV

SEQ ID NO: 30575 - protein, 25 aa, synthetic construct
  source 1..25: note = Seed: YGFLNVIVHSATGFKQSSKALQRPV
YGFLNVIVHSATGVKQFSWALMRPV

SEQ ID NO: 30576 - protein, 25 aa, synthetic construct
  source 1..25: note = Seed: YGFLNVIVHSATGFKQSSKALQRPV
YGFLNVIVHSATGVKQFSWALYRPV

SEQ ID NO: 30577 - protein, 25 aa, synthetic construct
  source 1..25: note = Seed: YGFLNVIVHSATGFKQSSKALQRPV
YGFLNVIVHSATGVKQFSYALIRPV

SEQ ID NO: 30578 - protein, 25 aa, synthetic construct
  source 1..25: note = Seed: YGFLNVIVHSATGFKQSSKALQRPV
YGFLNVIVHSATGVKQFSYALLRPV

SEQ ID NO: 30579 - protein, 25 aa, synthetic construct
  source 1..25: note = Seed: YGFLNVIVHSATGFKQSSKALQRPV
YGFLNVIVHSATGVKQFSYALMRPV

SEQ ID NO: 30580 - protein, 25 aa, synthetic construct
  source 1..25: note = Seed: YGFLNVIVHSATGFKQSSKALQRPV
YGFLNVIVHSATGVKQFSYALVRPV

SEQ ID NO: 30581 - protein, 25 aa, synthetic construct
  source 1..25: note = Seed: YGFLNVIVHSATGFKQSSKALQRPV
YGFLNVIVHSATGVKQFSYALYRPV

SEQ ID NO: 30582 - protein, 25 aa, synthetic construct
  source 1..25: note = Seed: YGFLNVIVHSATGFKQSSKALQRPV
YGFLNVIVHSATGVKQHSAALRRPV

SEQ ID NO: 30583 - protein, 25 aa, synthetic construct
  source 1..25: note = Seed: YGFLNVIVHSATGFKQSSKALQRPV
YGFLNVIVHSATGVKQHSKALRRPV

SEQ ID NO: 30584 - protein, 25 aa, synthetic construct
  source 1..25: note = Seed: YGFLNVIVHSATGFKQSSKALQRPV
YGFLNVIVHSATGVKQHSKALYRPV

SEQ ID NO: 30585 - protein, 25 aa, synthetic construct
  source 1..25: note = Seed: YGFLNVIVHSATGFKQSSKALQRPV
YGFLNVIVHSATGVKQHSRALFRPV

SEQ ID NO: 30586 - protein, 25 aa, synthetic construct
  source 1..25: note = Seed: YGFLNVIVHSATGFKQSSKALQRPV
YGFLNVIVHSATGVKQHSRALIRPV

SEQ ID NO: 30587 - protein, 25 aa, synthetic construct
  source 1..25: note = Seed: YGFLNVIVHSATGFKQSSKALQRPV
YGFLNVIVHSATGVKQHSRALRRPV

SEQ ID NO: 30588 - protein, 25 aa, synthetic construct
  source 1..25: note = Seed: YGFLNVIVHSATGFKQSSKALQRPV
YGFLNVIVHSATGVKQHSRALVRPV

SEQ ID NO: 30589 - protein, 25 aa, synthetic construct
  source 1..25: note = Seed: YGFLNVIVHSATGFKQSSKALQRPV
YGFLNVIVHSATGVKQHSRALYRPV

SEQ ID NO: 30590 - protein, 25 aa, synthetic construct
  source 1..25: note = Seed: YGFLNVIVHSATGFKQSSKALQRPV
YGFLNVIVHSATGVKQHSVALRRPV

SEQ ID NO: 30591 - protein, 25 aa, synthetic construct
  source 1..25: note = Seed: YGFLNVIVHSATGFKQSSKALQRPV
YGFLNVIVHSATGVKQISAALARPV

SEQ ID NO: 30592 - protein, 25 aa, synthetic construct
  source 1..25: note = Seed: YGFLNVIVHSATGFKQSSKALQRPV
YGFLNVIVHSATGVKQISAALNRPV

SEQ ID NO: 30593 - protein, 25 aa, synthetic construct
  source 1..25: note = Seed: YGFLNVIVHSATGFKQSSKALQRPV
YGFLNVIVHSATGVKQISAALRRPV

SEQ ID NO: 30594 - protein, 25 aa, synthetic construct
  source 1..25: note = Seed: YGFLNVIVHSATGFKQSSKALQRPV
YGFLNVIVHSATGVKQISAALSRPV

SEQ ID NO: 30595 - protein, 25 aa, synthetic construct
  source 1..25: note = Seed: YGFLNVIVHSATGFKQSSKALQRPV
YGFLNVIVHSATGVKQISAALTRPV

SEQ ID NO: 30596 - protein, 25 aa, synthetic construct
  source 1..25: note = Seed: YGFLNVIVHSATGFKQSSKALQRPV
YGFLNVIVHSATGVKQISAALVRPV

SEQ ID NO: 30597 - protein, 25 aa, synthetic construct
  source 1..25: note = Seed: YGFLNVIVHSATGFKQSSKALQRPV
YGFLNVIVHSATGVKQISFALFRPV

SEQ ID NO: 30598 - protein, 25 aa, synthetic construct
  source 1..25: note = Seed: YGFLNVIVHSATGFKQSSKALQRPV
YGFLNVIVHSATGVKQISFALIRPV

SEQ ID NO: 30599 - protein, 25 aa, synthetic construct
  source 1..25: note = Seed: YGFLNVIVHSATGFKQSSKALQRPV
YGFLNVIVHSATGVKQISFALLRPV

SEQ ID NO: 30600 - protein, 25 aa, synthetic construct
  source 1..25: note = Seed: YGFLNVIVHSATGFKQSSKALQRPV
YGFLNVIVHSATGVKQISFALMRPV

SEQ ID NO: 30601 - protein, 25 aa, synthetic construct
  source 1..25: note = Seed: YGFLNVIVHSATGFKQSSKALQRPV
YGFLNVIVHSATGVKQISFALVRPV

SEQ ID NO: 30602 - protein, 25 aa, synthetic construct
  source 1..25: note = Seed: YGFLNVIVHSATGFKQSSKALQRPV
YGFLNVIVHSATGVKQISFALYRPV

SEQ ID NO: 30603 - protein, 25 aa, synthetic construct
  source 1..25: note = Seed: YGFLNVIVHSATGFKQSSKALQRPV
YGFLNVIVHSATGVKQISGALARPV

SEQ ID NO: 30604 - protein, 25 aa, synthetic construct
  source 1..25: note = Seed: YGFLNVIVHSATGFKQSSKALQRPV
YGFLNVIVHSATGVKQISHALRRPV

SEQ ID NO: 30605 - protein, 25 aa, synthetic construct
  source 1..25: note = Seed: YGFLNVIVHSATGFKQSSKALQRPV
YGFLNVIVHSATGVKQISIALARPV

SEQ ID NO: 30606 - protein, 25 aa, synthetic construct
  source 1..25: note = Seed: YGFLNVIVHSATGFKQSSKALQRPV
YGFLNVIVHSATGVKQISIALKRPV

SEQ ID NO: 30607 - protein, 25 aa, synthetic construct
  source 1..25: note = Seed: YGFLNVIVHSATGFKQSSKALQRPV
YGFLNVIVHSATGVKQISIALNRPV

SEQ ID NO: 30608 - protein, 25 aa, synthetic construct
  source 1..25: note = Seed: YGFLNVIVHSATGFKQSSKALQRPV
YGFLNVIVHSATGVKQISIALRRPV

SEQ ID NO: 30609 - protein, 25 aa, synthetic construct
  source 1..25: note = Seed: YGFLNVIVHSATGFKQSSKALQRPV
YGFLNVIVHSATGVKQISIALSRPV

SEQ ID NO: 30610 - protein, 25 aa, synthetic construct
  source 1..25: note = Seed: YGFLNVIVHSATGFKQSSKALQRPV
YGFLNVIVHSATGVKQISKALARPV

SEQ ID NO: 30611 - protein, 25 aa, synthetic construct
  source 1..25: note = Seed: YGFLNVIVHSATGFKQSSKALQRPV
YGFLNVIVHSATGVKQISKALGRPV

SEQ ID NO: 30612 - protein, 25 aa, synthetic construct
  source 1..25: note = Seed: YGFLNVIVHSATGFKQSSKALQRPV
YGFLNVIVHSATGVKQISKALHRPV

SEQ ID NO: 30613 - protein, 25 aa, synthetic construct
  source 1..25: note = Seed: YGFLNVIVHSATGFKQSSKALQRPV
YGFLNVIVHSATGVKQISKALIRPV

SEQ ID NO: 30614 - protein, 25 aa, synthetic construct
  source 1..25: note = Seed: YGFLNVIVHSATGFKQSSKALQRPV
YGFLNVIVHSATGVKQISKALKRPV

SEQ ID NO: 30615 - protein, 25 aa, synthetic construct
  source 1..25: note = Seed: YGFLNVIVHSATGFKQSSKALQRPV
YGFLNVIVHSATGVKQISKALLRPV

SEQ ID NO: 30616 - protein, 25 aa, synthetic construct
  source 1..25: note = Seed: YGFLNVIVHSATGFKQSSKALQRPV
YGFLNVIVHSATGVKQISKALMRPV

SEQ ID NO: 30617 - protein, 25 aa, synthetic construct
  source 1..25: note = Seed: YGFLNVIVHSATGFKQSSKALQRPV
YGFLNVIVHSATGVKQISKALQRPV

SEQ ID NO: 30618 - protein, 25 aa, synthetic construct
  source 1..25: note = Seed: YGFLNVIVHSATGFKQSSKALQRPV
YGFLNVIVHSATGVKQISKALRRPV

SEQ ID NO: 30619 - protein, 25 aa, synthetic construct
  source 1..25: note = Seed: YGFLNVIVHSATGFKQSSKALQRPV
YGFLNVIVHSATGVKQISKALSRPV

SEQ ID NO: 30620 - protein, 25 aa, synthetic construct
  source 1..25: note = Seed: YGFLNVIVHSATGFKQSSKALQRPV
YGFLNVIVHSATGVKQISKALTRPV

SEQ ID NO: 30621 - protein, 25 aa, synthetic construct
  source 1..25: note = Seed: YGFLNVIVHSATGFKQSSKALQRPV
YGFLNVIVHSATGVKQISKALVRPV

SEQ ID NO: 30622 - protein, 25 aa, synthetic construct
  source 1..25: note = Seed: YGFLNVIVHSATGFKQSSKALQRPV
YGFLNVIVHSATGVKQISKALYRPV

SEQ ID NO: 30623 - protein, 25 aa, synthetic construct
  source 1..25: note = Seed: YGFLNVIVHSATGFKQSSKALQRPV
YGFLNVIVHSATGVKQISLALARPV

SEQ ID NO: 30624 - protein, 25 aa, synthetic construct
  source 1..25: note = Seed: YGFLNVIVHSATGFKQSSKALQRPV
YGFLNVIVHSATGVKQISLALRRPV

SEQ ID NO: 30625 - protein, 25 aa, synthetic construct
  source 1..25: note = Seed: YGFLNVIVHSATGFKQSSKALQRPV
YGFLNVIVHSATGVKQISMALARPV

SEQ ID NO: 30626 - protein, 25 aa, synthetic construct
  source 1..25: note = Seed: YGFLNVIVHSATGFKQSSKALQRPV
YGFLNVIVHSATGVKQISMALRRPV

SEQ ID NO: 30627 - protein, 25 aa, synthetic construct
  source 1..25: note = Seed: YGFLNVIVHSATGFKQSSKALQRPV
YGFLNVIVHSATGVKQISNALRRPV

SEQ ID NO: 30628 - protein, 25 aa, synthetic construct
  source 1..25: note = Seed: YGFLNVIVHSATGFKQSSKALQRPV
YGFLNVIVHSATGVKQISPALARPV

SEQ ID NO: 30629 - protein, 25 aa, synthetic construct
  source 1..25: note = Seed: YGFLNVIVHSATGFKQSSKALQRPV
YGFLNVIVHSATGVKQISPALNRPV

SEQ ID NO: 30630 - protein, 25 aa, synthetic construct
  source 1..25: note = Seed: YGFLNVIVHSATGFKQSSKALQRPV
YGFLNVIVHSATGVKQISPALRRPV

SEQ ID NO: 30631 - protein, 25 aa, synthetic construct
  source 1..25: note = Seed: YGFLNVIVHSATGFKQSSKALQRPV
YGFLNVIVHSATGVKQISPALSRPV

SEQ ID NO: 30632 - protein, 25 aa, synthetic construct
  source 1..25: note = Seed: YGFLNVIVHSATGFKQSSKALQRPV
YGFLNVIVHSATGVKQISPALTRPV

SEQ ID NO: 30633 - protein, 25 aa, synthetic construct
  source 1..25: note = Seed: YGFLNVIVHSATGFKQSSKALQRPV
YGFLNVIVHSATGVKQISRALARPV

SEQ ID NO: 30634 - protein, 25 aa, synthetic construct
  source 1..25: note = Seed: YGFLNVIVHSATGFKQSSKALQRPV
YGFLNVIVHSATGVKQISRALFRPV

SEQ ID NO: 30635 - protein, 25 aa, synthetic construct
  source 1..25: note = Seed: YGFLNVIVHSATGFKQSSKALQRPV
YGFLNVIVHSATGVKQISRALGRPV

SEQ ID NO: 30636 - protein, 25 aa, synthetic construct
  source 1..25: note = Seed: YGFLNVIVHSATGFKQSSKALQRPV
YGFLNVIVHSATGVKQISRALHRPV

SEQ ID NO: 30637 - protein, 25 aa, synthetic construct
  source 1..25: note = Seed: YGFLNVIVHSATGFKQSSKALQRPV
YGFLNVIVHSATGVKQISRALIRPV

SEQ ID NO: 30638 - protein, 25 aa, synthetic construct
  source 1..25: note = Seed: YGFLNVIVHSATGFKQSSKALQRPV
YGFLNVIVHSATGVKQISRALKRPV

SEQ ID NO: 30639 - protein, 25 aa, synthetic construct
  source 1..25: note = Seed: YGFLNVIVHSATGFKQSSKALQRPV
YGFLNVIVHSATGVKQISRALLRPV

SEQ ID NO: 30640 - protein, 25 aa, synthetic construct
  source 1..25: note = Seed: YGFLNVIVHSATGFKQSSKALQRPV
YGFLNVIVHSATGVKQISRALMRPV

SEQ ID NO: 30641 - protein, 25 aa, synthetic construct
  source 1..25: note = Seed: YGFLNVIVHSATGFKQSSKALQRPV
YGFLNVIVHSATGVKQISRALNRPV

SEQ ID NO: 30642 - protein, 25 aa, synthetic construct
  source 1..25: note = Seed: YGFLNVIVHSATGFKQSSKALQRPV
YGFLNVIVHSATGVKQISRALQRPV

SEQ ID NO: 30643 - protein, 25 aa, synthetic construct
  source 1..25: note = Seed: YGFLNVIVHSATGFKQSSKALQRPV
YGFLNVIVHSATGVKQISRALRRPV

SEQ ID NO: 30644 - protein, 25 aa, synthetic construct
  source 1..25: note = Seed: YGFLNVIVHSATGFKQSSKALQRPV
YGFLNVIVHSATGVKQISRALSRPV

SEQ ID NO: 30645 - protein, 25 aa, synthetic construct
  source 1..25: note = Seed: YGFLNVIVHSATGFKQSSKALQRPV
YGFLNVIVHSATGVKQISRALTRPV

SEQ ID NO: 30646 - protein, 25 aa, synthetic construct
  source 1..25: note = Seed: YGFLNVIVHSATGFKQSSKALQRPV
YGFLNVIVHSATGVKQISRALVRPV

SEQ ID NO: 30647 - protein, 25 aa, synthetic construct
  source 1..25: note = Seed: YGFLNVIVHSATGFKQSSKALQRPV
YGFLNVIVHSATGVKQISRALYRPV

SEQ ID NO: 30648 - protein, 25 aa, synthetic construct
  source 1..25: note = Seed: YGFLNVIVHSATGFKQSSKALQRPV
YGFLNVIVHSATGVKQISSALARPV

SEQ ID NO: 30649 - protein, 25 aa, synthetic construct
  source 1..25: note = Seed: YGFLNVIVHSATGFKQSSKALQRPV
YGFLNVIVHSATGVKQISSALNRPV

SEQ ID NO: 30650 - protein, 25 aa, synthetic construct
  source 1..25: note = Seed: YGFLNVIVHSATGFKQSSKALQRPV
YGFLNVIVHSATGVKQISSALRRPV

SEQ ID NO: 30651 - protein, 25 aa, synthetic construct
  source 1..25: note = Seed: YGFLNVIVHSATGFKQSSKALQRPV
YGFLNVIVHSATGVKQISSALSRPV

SEQ ID NO: 30652 - protein, 25 aa, synthetic construct
  source 1..25: note = Seed: YGFLNVIVHSATGFKQSSKALQRPV
YGFLNVIVHSATGVKQISTALARPV

SEQ ID NO: 30653 - protein, 25 aa, synthetic construct
  source 1..25: note = Seed: YGFLNVIVHSATGFKQSSKALQRPV
YGFLNVIVHSATGVKQISTALNRPV

SEQ ID NO: 30654 - protein, 25 aa, synthetic construct
  source 1..25: note = Seed: YGFLNVIVHSATGFKQSSKALQRPV
YGFLNVIVHSATGVKQISTALRRPV

SEQ ID NO: 30655 - protein, 25 aa, synthetic construct
  source 1..25: note = Seed: YGFLNVIVHSATGFKQSSKALQRPV
YGFLNVIVHSATGVKQISTALSRPV

SEQ ID NO: 30656 - protein, 25 aa, synthetic construct
  source 1..25: note = Seed: YGFLNVIVHSATGFKQSSKALQRPV
YGFLNVIVHSATGVKQISVALARPV

SEQ ID NO: 30657 - protein, 25 aa, synthetic construct
  source 1..25: note = Seed: YGFLNVIVHSATGFKQSSKALQRPV
YGFLNVIVHSATGVKQISVALKRPV

SEQ ID NO: 30658 - protein, 25 aa, synthetic construct
  source 1..25: note = Seed: YGFLNVIVHSATGFKQSSKALQRPV
YGFLNVIVHSATGVKQISVALNRPV

SEQ ID NO: 30659 - protein, 25 aa, synthetic construct
  source 1..25: note = Seed: YGFLNVIVHSATGFKQSSKALQRPV
YGFLNVIVHSATGVKQISVALRRPV

SEQ ID NO: 30660 - protein, 25 aa, synthetic construct
  source 1..25: note = Seed: YGFLNVIVHSATGFKQSSKALQRPV
YGFLNVIVHSATGVKQISVALSRPV

SEQ ID NO: 30661 - protein, 25 aa, synthetic construct
  source 1..25: note = Seed: YGFLNVIVHSATGFKQSSKALQRPV
YGFLNVIVHSATGVKQISWALYRPV

SEQ ID NO: 30662 - protein, 25 aa, synthetic construct
  source 1..25: note = Seed: YGFLNVIVHSATGFKQSSKALQRPV
YGFLNVIVHSATGVKQISYALLRPV

SEQ ID NO: 30663 - protein, 25 aa, synthetic construct
  source 1..25: note = Seed: YGFLNVIVHSATGFKQSSKALQRPV
YGFLNVIVHSATGVKQISYALRRPV

SEQ ID NO: 30664 - protein, 25 aa, synthetic construct
  source 1..25: note = Seed: YGFLNVIVHSATGFKQSSKALQRPV
YGFLNVIVHSATGVKQISYALYRPV

SEQ ID NO: 30665 - protein, 25 aa, synthetic construct
  source 1..25: note = Seed: YGFLNVIVHSATGFKQSSKALQRPV
YGFLNVIVHSATGVKQKSRALYRPV

SEQ ID NO: 30666 - protein, 25 aa, synthetic construct
  source 1..25: note = Seed: YGFLNVIVHSATGFKQSSKALQRPV
YGFLNVIVHSATGVKQLSAALARPV

SEQ ID NO: 30667 - protein, 25 aa, synthetic construct
  source 1..25: note = Seed: YGFLNVIVHSATGFKQSSKALQRPV
YGFLNVIVHSATGVKQLSAALHRPV

SEQ ID NO: 30668 - protein, 25 aa, synthetic construct
  source 1..25: note = Seed: YGFLNVIVHSATGFKQSSKALQRPV
YGFLNVIVHSATGVKQLSAALIRPV

SEQ ID NO: 30669 - protein, 25 aa, synthetic construct
  source 1..25: note = Seed: YGFLNVIVHSATGFKQSSKALQRPV
YGFLNVIVHSATGVKQLSAALLRPV

SEQ ID NO: 30670 - protein, 25 aa, synthetic construct
  source 1..25: note = Seed: YGFLNVIVHSATGFKQSSKALQRPV
YGFLNVIVHSATGVKQLSAALMRPV

SEQ ID NO: 30671 - protein, 25 aa, synthetic construct
  source 1..25: note = Seed: YGFLNVIVHSATGFKQSSKALQRPV
YGFLNVIVHSATGVKQLSAALNRPV

SEQ ID NO: 30672 - protein, 25 aa, synthetic construct
  source 1..25: note = Seed: YGFLNVIVHSATGFKQSSKALQRPV
YGFLNVIVHSATGVKQLSAALSRPV

SEQ ID NO: 30673 - protein, 25 aa, synthetic construct
  source 1..25: note = Seed: YGFLNVIVHSATGFKQSSKALQRPV
YGFLNVIVHSATGVKQLSAALTRPV

SEQ ID NO: 30674 - protein, 25 aa, synthetic construct
  source 1..25: note = Seed: YGFLNVIVHSATGFKQSSKALQRPV
YGFLNVIVHSATGVKQLSAALVRPV

SEQ ID NO: 30675 - protein, 25 aa, synthetic construct
  source 1..25: note = Seed: YGFLNVIVHSATGFKQSSKALQRPV
YGFLNVIVHSATGVKQLSFALFRPV

SEQ ID NO: 30676 - protein, 25 aa, synthetic construct
  source 1..25: note = Seed: YGFLNVIVHSATGFKQSSKALQRPV
YGFLNVIVHSATGVKQLSFALIRPV

SEQ ID NO: 30677 - protein, 25 aa, synthetic construct
  source 1..25: note = Seed: YGFLNVIVHSATGFKQSSKALQRPV
YGFLNVIVHSATGVKQLSFALLRPV

SEQ ID NO: 30678 - protein, 25 aa, synthetic construct
  source 1..25: note = Seed: YGFLNVIVHSATGFKQSSKALQRPV
YGFLNVIVHSATGVKQLSFALMRPV

SEQ ID NO: 30679 - protein, 25 aa, synthetic construct
  source 1..25: note = Seed: YGFLNVIVHSATGFKQSSKALQRPV
YGFLNVIVHSATGVKQLSFALVRPV

SEQ ID NO: 30680 - protein, 25 aa, synthetic construct
  source 1..25: note = Seed: YGFLNVIVHSATGFKQSSKALQRPV
YGFLNVIVHSATGVKQLSFALYRPV

SEQ ID NO: 30681 - protein, 25 aa, synthetic construct
  source 1..25: note = Seed: YGFLNVIVHSATGFKQSSKALQRPV
YGFLNVIVHSATGVKQLSGALARPV

SEQ ID NO: 30682 - protein, 25 aa, synthetic construct
  source 1..25: note = Seed: YGFLNVIVHSATGFKQSSKALQRPV
YGFLNVIVHSATGVKQLSGALNRPV

SEQ ID NO: 30683 - protein, 25 aa, synthetic construct
  source 1..25: note = Seed: YGFLNVIVHSATGFKQSSKALQRPV
YGFLNVIVHSATGVKQLSGALSRPV

SEQ ID NO: 30684 - protein, 25 aa, synthetic construct
  source 1..25: note = Seed: YGFLNVIVHSATGFKQSSKALQRPV
YGFLNVIVHSATGVKQLSIALARPV

SEQ ID NO: 30685 - protein, 25 aa, synthetic construct
  source 1..25: note = Seed: YGFLNVIVHSATGFKQSSKALQRPV
YGFLNVIVHSATGVKQLSIALNRPV

SEQ ID NO: 30686 - protein, 25 aa, synthetic construct
  source 1..25: note = Seed: YGFLNVIVHSATGFKQSSKALQRPV
YGFLNVIVHSATGVKQLSIALRRPV

SEQ ID NO: 30687 - protein, 25 aa, synthetic construct
  source 1..25: note = Seed: YGFLNVIVHSATGFKQSSKALQRPV
YGFLNVIVHSATGVKQLSIALSRPV

SEQ ID NO: 30688 - protein, 25 aa, synthetic construct
  source 1..25: note = Seed: YGFLNVIVHSATGFKQSSKALQRPV
YGFLNVIVHSATGVKQLSIALTRPV

SEQ ID NO: 30689 - protein, 25 aa, synthetic construct
  source 1..25: note = Seed: YGFLNVIVHSATGFKQSSKALQRPV
YGFLNVIVHSATGVKQLSKALARPV

SEQ ID NO: 30690 - protein, 25 aa, synthetic construct
  source 1..25: note = Seed: YGFLNVIVHSATGFKQSSKALQRPV
YGFLNVIVHSATGVKQLSKALGRPV

SEQ ID NO: 30691 - protein, 25 aa, synthetic construct
  source 1..25: note = Seed: YGFLNVIVHSATGFKQSSKALQRPV
YGFLNVIVHSATGVKQLSKALHRPV

SEQ ID NO: 30692 - protein, 25 aa, synthetic construct
  source 1..25: note = Seed: YGFLNVIVHSATGFKQSSKALQRPV
YGFLNVIVHSATGVKQLSKALKRPV

SEQ ID NO: 30693 - protein, 25 aa, synthetic construct
  source 1..25: note = Seed: YGFLNVIVHSATGFKQSSKALQRPV
YGFLNVIVHSATGVKQLSKALMRPV

SEQ ID NO: 30694 - protein, 25 aa, synthetic construct
  source 1..25: note = Seed: YGFLNVIVHSATGFKQSSKALQRPV
YGFLNVIVHSATGVKQLSKALNRPV

SEQ ID NO: 30695 - protein, 25 aa, synthetic construct
  source 1..25: note = Seed: YGFLNVIVHSATGFKQSSKALQRPV
YGFLNVIVHSATGVKQLSKALQRPV

SEQ ID NO: 30696 - protein, 25 aa, synthetic construct
  source 1..25: note = Seed: YGFLNVIVHSATGFKQSSKALQRPV
YGFLNVIVHSATGVKQLSKALRRPV

SEQ ID NO: 30697 - protein, 25 aa, synthetic construct
  source 1..25: note = Seed: YGFLNVIVHSATGFKQSSKALQRPV
YGFLNVIVHSATGVKQLSKALSRPV

SEQ ID NO: 30698 - protein, 25 aa, synthetic construct
  source 1..25: note = Seed: YGFLNVIVHSATGFKQSSKALQRPV
YGFLNVIVHSATGVKQLSKALTRPV

SEQ ID NO: 30699 - protein, 25 aa, synthetic construct
  source 1..25: note = Seed: YGFLNVIVHSATGFKQSSKALQRPV
YGFLNVIVHSATGVKQLSKALVRPV

SEQ ID NO: 30700 - protein, 25 aa, synthetic construct
  source 1..25: note = Seed: YGFLNVIVHSATGFKQSSKALQRPV
YGFLNVIVHSATGVKQLSKALYRPV

SEQ ID NO: 30701 - protein, 25 aa, synthetic construct
  source 1..25: note = Seed: YGFLNVIVHSATGFKQSSKALQRPV
YGFLNVIVHSATGVKQLSLALARPV

SEQ ID NO: 30702 - protein, 25 aa, synthetic construct
  source 1..25: note = Seed: YGFLNVIVHSATGFKQSSKALQRPV
YGFLNVIVHSATGVKQLSLALFRPV

SEQ ID NO: 30703 - protein, 25 aa, synthetic construct
  source 1..25: note = Seed: YGFLNVIVHSATGFKQSSKALQRPV
YGFLNVIVHSATGVKQLSLALNRPV

SEQ ID NO: 30704 - protein, 25 aa, synthetic construct
  source 1..25: note = Seed: YGFLNVIVHSATGFKQSSKALQRPV
YGFLNVIVHSATGVKQLSLALRRPV

SEQ ID NO: 30705 - protein, 25 aa, synthetic construct
  source 1..25: note = Seed: YGFLNVIVHSATGFKQSSKALQRPV
YGFLNVIVHSATGVKQLSLALSRPV

SEQ ID NO: 30706 - protein, 25 aa, synthetic construct
  source 1..25: note = Seed: YGFLNVIVHSATGFKQSSKALQRPV
YGFLNVIVHSATGVKQLSMALARPV

SEQ ID NO: 30707 - protein, 25 aa, synthetic construct
  source 1..25: note = Seed: YGFLNVIVHSATGFKQSSKALQRPV
YGFLNVIVHSATGVKQLSMALRRPV

SEQ ID NO: 30708 - protein, 25 aa, synthetic construct
  source 1..25: note = Seed: YGFLNVIVHSATGFKQSSKALQRPV
YGFLNVIVHSATGVKQLSMALSRPV

SEQ ID NO: 30709 - protein, 25 aa, synthetic construct
  source 1..25: note = Seed: YGFLNVIVHSATGFKQSSKALQRPV
YGFLNVIVHSATGVKQLSNALARPV

SEQ ID NO: 30710 - protein, 25 aa, synthetic construct
  source 1..25: note = Seed: YGFLNVIVHSATGFKQSSKALQRPV
YGFLNVIVHSATGVKQLSPALARPV

SEQ ID NO: 30711 - protein, 25 aa, synthetic construct
  source 1..25: note = Seed: YGFLNVIVHSATGFKQSSKALQRPV
YGFLNVIVHSATGVKQLSPALHRPV

SEQ ID NO: 30712 - protein, 25 aa, synthetic construct
  source 1..25: note = Seed: YGFLNVIVHSATGFKQSSKALQRPV
YGFLNVIVHSATGVKQLSPALIRPV

SEQ ID NO: 30713 - protein, 25 aa, synthetic construct
  source 1..25: note = Seed: YGFLNVIVHSATGFKQSSKALQRPV
YGFLNVIVHSATGVKQLSPALLRPV

SEQ ID NO: 30714 - protein, 25 aa, synthetic construct
  source 1..25: note = Seed: YGFLNVIVHSATGFKQSSKALQRPV
YGFLNVIVHSATGVKQLSPALMRPV

SEQ ID NO: 30715 - protein, 25 aa, synthetic construct
  source 1..25: note = Seed: YGFLNVIVHSATGFKQSSKALQRPV
YGFLNVIVHSATGVKQLSPALNRPV

SEQ ID NO: 30716 - protein, 25 aa, synthetic construct
  source 1..25: note = Seed: YGFLNVIVHSATGFKQSSKALQRPV
YGFLNVIVHSATGVKQLSPALSRPV

SEQ ID NO: 30717 - protein, 25 aa, synthetic construct
  source 1..25: note = Seed: YGFLNVIVHSATGFKQSSKALQRPV
YGFLNVIVHSATGVKQLSPALTRPV

SEQ ID NO: 30718 - protein, 25 aa, synthetic construct
  source 1..25: note = Seed: YGFLNVIVHSATGFKQSSKALQRPV
YGFLNVIVHSATGVKQLSPALVRPV

SEQ ID NO: 30719 - protein, 25 aa, synthetic construct
  source 1..25: note = Seed: YGFLNVIVHSATGFKQSSKALQRPV
YGFLNVIVHSATGVKQLSRALARPV

SEQ ID NO: 30720 - protein, 25 aa, synthetic construct
  source 1..25: note = Seed: YGFLNVIVHSATGFKQSSKALQRPV
YGFLNVIVHSATGVKQLSRALGRPV

SEQ ID NO: 30721 - protein, 25 aa, synthetic construct
  source 1..25: note = Seed: YGFLNVIVHSATGFKQSSKALQRPV
YGFLNVIVHSATGVKQLSRALHRPV

SEQ ID NO: 30722 - protein, 25 aa, synthetic construct
  source 1..25: note = Seed: YGFLNVIVHSATGFKQSSKALQRPV
YGFLNVIVHSATGVKQLSRALIRPV

SEQ ID NO: 30723 - protein, 25 aa, synthetic construct
  source 1..25: note = Seed: YGFLNVIVHSATGFKQSSKALQRPV
YGFLNVIVHSATGVKQLSRALKRPV

SEQ ID NO: 30724 - protein, 25 aa, synthetic construct
  source 1..25: note = Seed: YGFLNVIVHSATGFKQSSKALQRPV
YGFLNVIVHSATGVKQLSRALLRPV

SEQ ID NO: 30725 - protein, 25 aa, synthetic construct
  source 1..25: note = Seed: YGFLNVIVHSATGFKQSSKALQRPV
YGFLNVIVHSATGVKQLSRALMRPV

SEQ ID NO: 30726 - protein, 25 aa, synthetic construct
  source 1..25: note = Seed: YGFLNVIVHSATGFKQSSKALQRPV
YGFLNVIVHSATGVKQLSRALNRPV

SEQ ID NO: 30727 - protein, 25 aa, synthetic construct
  source 1..25: note = Seed: YGFLNVIVHSATGFKQSSKALQRPV
YGFLNVIVHSATGVKQLSRALPRPV

SEQ ID NO: 30728 - protein, 25 aa, synthetic construct
  source 1..25: note = Seed: YGFLNVIVHSATGFKQSSKALQRPV
YGFLNVIVHSATGVKQLSRALQRPV

SEQ ID NO: 30729 - protein, 25 aa, synthetic construct
  source 1..25: note = Seed: YGFLNVIVHSATGFKQSSKALQRPV
YGFLNVIVHSATGVKQLSRALRRPV

SEQ ID NO: 30730 - protein, 25 aa, synthetic construct
  source 1..25: note = Seed: YGFLNVIVHSATGFKQSSKALQRPV
YGFLNVIVHSATGVKQLSRALSRPV

SEQ ID NO: 30731 - protein, 25 aa, synthetic construct
  source 1..25: note = Seed: YGFLNVIVHSATGFKQSSKALQRPV
YGFLNVIVHSATGVKQLSRALTRPV

SEQ ID NO: 30732 - protein, 25 aa, synthetic construct
  source 1..25: note = Seed: YGFLNVIVHSATGFKQSSKALQRPV
YGFLNVIVHSATGVKQLSRALVRPV

SEQ ID NO: 30733 - protein, 25 aa, synthetic construct
  source 1..25: note = Seed: YGFLNVIVHSATGFKQSSKALQRPV
YGFLNVIVHSATGVKQLSRALYRPV

SEQ ID NO: 30734 - protein, 25 aa, synthetic construct
  source 1..25: note = Seed: YGFLNVIVHSATGFKQSSKALQRPV
YGFLNVIVHSATGVKQLSSALARPV

SEQ ID NO: 30735 - protein, 25 aa, synthetic construct
  source 1..25: note = Seed: YGFLNVIVHSATGFKQSSKALQRPV
YGFLNVIVHSATGVKQLSSALNRPV

SEQ ID NO: 30736 - protein, 25 aa, synthetic construct
  source 1..25: note = Seed: YGFLNVIVHSATGFKQSSKALQRPV
YGFLNVIVHSATGVKQLSSALSRPV

SEQ ID NO: 30737 - protein, 25 aa, synthetic construct
  source 1..25: note = Seed: YGFLNVIVHSATGFKQSSKALQRPV
YGFLNVIVHSATGVKQLSSALTRPV

SEQ ID NO: 30738 - protein, 25 aa, synthetic construct
  source 1..25: note = Seed: YGFLNVIVHSATGFKQSSKALQRPV
YGFLNVIVHSATGVKQLSSALVRPV

SEQ ID NO: 30739 - protein, 25 aa, synthetic construct
  source 1..25: note = Seed: YGFLNVIVHSATGFKQSSKALQRPV
YGFLNVIVHSATGVKQLSTALARPV

SEQ ID NO: 30740 - protein, 25 aa, synthetic construct
  source 1..25: note = Seed: YGFLNVIVHSATGFKQSSKALQRPV
YGFLNVIVHSATGVKQLSTALMRPV

SEQ ID NO: 30741 - protein, 25 aa, synthetic construct
  source 1..25: note = Seed: YGFLNVIVHSATGFKQSSKALQRPV
YGFLNVIVHSATGVKQLSTALNRPV

SEQ ID NO: 30742 - protein, 25 aa, synthetic construct
  source 1..25: note = Seed: YGFLNVIVHSATGFKQSSKALQRPV
YGFLNVIVHSATGVKQLSTALSRPV

SEQ ID NO: 30743 - protein, 25 aa, synthetic construct
  source 1..25: note = Seed: YGFLNVIVHSATGFKQSSKALQRPV
YGFLNVIVHSATGVKQLSTALTRPV

SEQ ID NO: 30744 - protein, 25 aa, synthetic construct
  source 1..25: note = Seed: YGFLNVIVHSATGFKQSSKALQRPV
YGFLNVIVHSATGVKQLSTALVRPV

SEQ ID NO: 30745 - protein, 25 aa, synthetic construct
  source 1..25: note = Seed: YGFLNVIVHSATGFKQSSKALQRPV
YGFLNVIVHSATGVKQLSVALARPV

SEQ ID NO: 30746 - protein, 25 aa, synthetic construct
  source 1..25: note = Seed: YGFLNVIVHSATGFKQSSKALQRPV
YGFLNVIVHSATGVKQLSVALHRPV

SEQ ID NO: 30747 - protein, 25 aa, synthetic construct
  source 1..25: note = Seed: YGFLNVIVHSATGFKQSSKALQRPV
YGFLNVIVHSATGVKQLSVALNRPV

SEQ ID NO: 30748 - protein, 25 aa, synthetic construct
  source 1..25: note = Seed: YGFLNVIVHSATGFKQSSKALQRPV
YGFLNVIVHSATGVKQLSVALRRPV

SEQ ID NO: 30749 - protein, 25 aa, synthetic construct
  source 1..25: note = Seed: YGFLNVIVHSATGFKQSSKALQRPV
YGFLNVIVHSATGVKQLSVALSRPV

SEQ ID NO: 30750 - protein, 25 aa, synthetic construct
  source 1..25: note = Seed: YGFLNVIVHSATGFKQSSKALQRPV
YGFLNVIVHSATGVKQLSVALTRPV

SEQ ID NO: 30751 - protein, 25 aa, synthetic construct
  source 1..25: note = Seed: YGFLNVIVHSATGFKQSSKALQRPV
YGFLNVIVHSATGVKQLSWALYRPV

SEQ ID NO: 30752 - protein, 25 aa, synthetic construct
  source 1..25: note = Seed: YGFLNVIVHSATGFKQSSKALQRPV
YGFLNVIVHSATGVKQLSYALLRPV

SEQ ID NO: 30753 - protein, 25 aa, synthetic construct
  source 1..25: note = Seed: YGFLNVIVHSATGFKQSSKALQRPV
YGFLNVIVHSATGVKQLSYALYRPV

SEQ ID NO: 30754 - protein, 25 aa, synthetic construct
  source 1..25: note = Seed: YGFLNVIVHSATGFKQSSKALQRPV
YGFLNVIVHSATGVKQMSAALARPV

SEQ ID NO: 30755 - protein, 25 aa, synthetic construct
  source 1..25: note = Seed: YGFLNVIVHSATGFKQSSKALQRPV
YGFLNVIVHSATGVKQMSAALHRPV

SEQ ID NO: 30756 - protein, 25 aa, synthetic construct
  source 1..25: note = Seed: YGFLNVIVHSATGFKQSSKALQRPV
YGFLNVIVHSATGVKQMSAALIRPV

SEQ ID NO: 30757 - protein, 25 aa, synthetic construct
  source 1..25: note = Seed: YGFLNVIVHSATGFKQSSKALQRPV
YGFLNVIVHSATGVKQMSAALLRPV

SEQ ID NO: 30758 - protein, 25 aa, synthetic construct
  source 1..25: note = Seed: YGFLNVIVHSATGFKQSSKALQRPV
YGFLNVIVHSATGVKQMSAALMRPV

SEQ ID NO: 30759 - protein, 25 aa, synthetic construct
  source 1..25: note = Seed: YGFLNVIVHSATGFKQSSKALQRPV
YGFLNVIVHSATGVKQMSAALNRPV

SEQ ID NO: 30760 - protein, 25 aa, synthetic construct
  source 1..25: note = Seed: YGFLNVIVHSATGFKQSSKALQRPV
YGFLNVIVHSATGVKQMSAALQRPV

SEQ ID NO: 30761 - protein, 25 aa, synthetic construct
  source 1..25: note = Seed: YGFLNVIVHSATGFKQSSKALQRPV
YGFLNVIVHSATGVKQMSAALRRPV

SEQ ID NO: 30762 - protein, 25 aa, synthetic construct
  source 1..25: note = Seed: YGFLNVIVHSATGFKQSSKALQRPV
YGFLNVIVHSATGVKQMSAALSRPV

SEQ ID NO: 30763 - protein, 25 aa, synthetic construct
  source 1..25: note = Seed: YGFLNVIVHSATGFKQSSKALQRPV
YGFLNVIVHSATGVKQMSAALTRPV

SEQ ID NO: 30764 - protein, 25 aa, synthetic construct
  source 1..25: note = Seed: YGFLNVIVHSATGFKQSSKALQRPV
YGFLNVIVHSATGVKQMSAALVRPV

SEQ ID NO: 30765 - protein, 25 aa, synthetic construct
  source 1..25: note = Seed: YGFLNVIVHSATGFKQSSKALQRPV
YGFLNVIVHSATGVKQMSFALFRPV

SEQ ID NO: 30766 - protein, 25 aa, synthetic construct
  source 1..25: note = Seed: YGFLNVIVHSATGFKQSSKALQRPV
YGFLNVIVHSATGVKQMSFALIRPV

SEQ ID NO: 30767 - protein, 25 aa, synthetic construct
  source 1..25: note = Seed: YGFLNVIVHSATGFKQSSKALQRPV
YGFLNVIVHSATGVKQMSFALLRPV

SEQ ID NO: 30768 - protein, 25 aa, synthetic construct
  source 1..25: note = Seed: YGFLNVIVHSATGFKQSSKALQRPV
YGFLNVIVHSATGVKQMSFALYRPV

SEQ ID NO: 30769 - protein, 25 aa, synthetic construct
  source 1..25: note = Seed: YGFLNVIVHSATGFKQSSKALQRPV
YGFLNVIVHSATGVKQMSGALARPV

SEQ ID NO: 30770 - protein, 25 aa, synthetic construct
  source 1..25: note = Seed: YGFLNVIVHSATGFKQSSKALQRPV
YGFLNVIVHSATGVKQMSGALNRPV

SEQ ID NO: 30771 - protein, 25 aa, synthetic construct
  source 1..25: note = Seed: YGFLNVIVHSATGFKQSSKALQRPV
YGFLNVIVHSATGVKQMSGALSRPV

SEQ ID NO: 30772 - protein, 25 aa, synthetic construct
  source 1..25: note = Seed: YGFLNVIVHSATGFKQSSKALQRPV
YGFLNVIVHSATGVKQMSIALARPV

SEQ ID NO: 30773 - protein, 25 aa, synthetic construct
  source 1..25: note = Seed: YGFLNVIVHSATGFKQSSKALQRPV
YGFLNVIVHSATGVKQMSIALNRPV

SEQ ID NO: 30774 - protein, 25 aa, synthetic construct
  source 1..25: note = Seed: YGFLNVIVHSATGFKQSSKALQRPV
YGFLNVIVHSATGVKQMSIALRRPV

SEQ ID NO: 30775 - protein, 25 aa, synthetic construct
  source 1..25: note = Seed: YGFLNVIVHSATGFKQSSKALQRPV
YGFLNVIVHSATGVKQMSIALSRPV

SEQ ID NO: 30776 - protein, 25 aa, synthetic construct
  source 1..25: note = Seed: YGFLNVIVHSATGFKQSSKALQRPV
YGFLNVIVHSATGVKQMSIALTRPV

SEQ ID NO: 30777 - protein, 25 aa, synthetic construct
  source 1..25: note = Seed: YGFLNVIVHSATGFKQSSKALQRPV
YGFLNVIVHSATGVKQMSKALARPV

SEQ ID NO: 30778 - protein, 25 aa, synthetic construct
  source 1..25: note = Seed: YGFLNVIVHSATGFKQSSKALQRPV
YGFLNVIVHSATGVKQMSKALGRPV

SEQ ID NO: 30779 - protein, 25 aa, synthetic construct
  source 1..25: note = Seed: YGFLNVIVHSATGFKQSSKALQRPV
YGFLNVIVHSATGVKQMSKALHRPV

SEQ ID NO: 30780 - protein, 25 aa, synthetic construct
  source 1..25: note = Seed: YGFLNVIVHSATGFKQSSKALQRPV
YGFLNVIVHSATGVKQMSKALIRPV

SEQ ID NO: 30781 - protein, 25 aa, synthetic construct
  source 1..25: note = Seed: YGFLNVIVHSATGFKQSSKALQRPV
YGFLNVIVHSATGVKQMSKALKRPV

SEQ ID NO: 30782 - protein, 25 aa, synthetic construct
  source 1..25: note = Seed: YGFLNVIVHSATGFKQSSKALQRPV
YGFLNVIVHSATGVKQMSKALLRPV

SEQ ID NO: 30783 - protein, 25 aa, synthetic construct
  source 1..25: note = Seed: YGFLNVIVHSATGFKQSSKALQRPV
YGFLNVIVHSATGVKQMSKALMRPV

SEQ ID NO: 30784 - protein, 25 aa, synthetic construct
  source 1..25: note = Seed: YGFLNVIVHSATGFKQSSKALQRPV
YGFLNVIVHSATGVKQMSKALNRPV

SEQ ID NO: 30785 - protein, 25 aa, synthetic construct
  source 1..25: note = Seed: YGFLNVIVHSATGFKQSSKALQRPV
YGFLNVIVHSATGVKQMSKALPRPV

SEQ ID NO: 30786 - protein, 25 aa, synthetic construct
  source 1..25: note = Seed: YGFLNVIVHSATGFKQSSKALQRPV
YGFLNVIVHSATGVKQMSKALQRPV

SEQ ID NO: 30787 - protein, 25 aa, synthetic construct
  source 1..25: note = Seed: YGFLNVIVHSATGFKQSSKALQRPV
YGFLNVIVHSATGVKQMSKALRRPV

SEQ ID NO: 30788 - protein, 25 aa, synthetic construct
  source 1..25: note = Seed: YGFLNVIVHSATGFKQSSKALQRPV
YGFLNVIVHSATGVKQMSKALSRPV

SEQ ID NO: 30789 - protein, 25 aa, synthetic construct
  source 1..25: note = Seed: YGFLNVIVHSATGFKQSSKALQRPV
YGFLNVIVHSATGVKQMSKALTRPV

SEQ ID NO: 30790 - protein, 25 aa, synthetic construct
  source 1..25: note = Seed: YGFLNVIVHSATGFKQSSKALQRPV
YGFLNVIVHSATGVKQMSKALVRPV

SEQ ID NO: 30791 - protein, 25 aa, synthetic construct
  source 1..25: note = Seed: YGFLNVIVHSATGFKQSSKALQRPV
YGFLNVIVHSATGVKQMSKALYRPV

SEQ ID NO: 30792 - protein, 25 aa, synthetic construct
  source 1..25: note = Seed: YGFLNVIVHSATGFKQSSKALQRPV
YGFLNVIVHSATGVKQMSLALARPV

SEQ ID NO: 30793 - protein, 25 aa, synthetic construct
  source 1..25: note = Seed: YGFLNVIVHSATGFKQSSKALQRPV
YGFLNVIVHSATGVKQMSLALFRPV

SEQ ID NO: 30794 - protein, 25 aa, synthetic construct
  source 1..25: note = Seed: YGFLNVIVHSATGFKQSSKALQRPV
YGFLNVIVHSATGVKQMSLALNRPV

SEQ ID NO: 30795 - protein, 25 aa, synthetic construct
  source 1..25: note = Seed: YGFLNVIVHSATGFKQSSKALQRPV
YGFLNVIVHSATGVKQMSLALSRPV

SEQ ID NO: 30796 - protein, 25 aa, synthetic construct
  source 1..25: note = Seed: YGFLNVIVHSATGFKQSSKALQRPV
YGFLNVIVHSATGVKQMSMALARPV

SEQ ID NO: 30797 - protein, 25 aa, synthetic construct
  source 1..25: note = Seed: YGFLNVIVHSATGFKQSSKALQRPV
YGFLNVIVHSATGVKQMSMALNRPV

SEQ ID NO: 30798 - protein, 25 aa, synthetic construct
  source 1..25: note = Seed: YGFLNVIVHSATGFKQSSKALQRPV
YGFLNVIVHSATGVKQMSMALRRPV

SEQ ID NO: 30799 - protein, 25 aa, synthetic construct
  source 1..25: note = Seed: YGFLNVIVHSATGFKQSSKALQRPV
YGFLNVIVHSATGVKQMSMALSRPV

SEQ ID NO: 30800 - protein, 25 aa, synthetic construct
  source 1..25: note = Seed: YGFLNVIVHSATGFKQSSKALQRPV
YGFLNVIVHSATGVKQMSNALARPV

SEQ ID NO: 30801 - protein, 25 aa, synthetic construct
  source 1..25: note = Seed: YGFLNVIVHSATGFKQSSKALQRPV
YGFLNVIVHSATGVKQMSNALSRPV

SEQ ID NO: 30802 - protein, 25 aa, synthetic construct
  source 1..25: note = Seed: YGFLNVIVHSATGFKQSSKALQRPV
YGFLNVIVHSATGVKQMSPALARPV

SEQ ID NO: 30803 - protein, 25 aa, synthetic construct
  source 1..25: note = Seed: YGFLNVIVHSATGFKQSSKALQRPV
YGFLNVIVHSATGVKQMSPALHRPV

SEQ ID NO: 30804 - protein, 25 aa, synthetic construct
  source 1..25: note = Seed: YGFLNVIVHSATGFKQSSKALQRPV
YGFLNVIVHSATGVKQMSPALIRPV

SEQ ID NO: 30805 - protein, 25 aa, synthetic construct
  source 1..25: note = Seed: YGFLNVIVHSATGFKQSSKALQRPV
YGFLNVIVHSATGVKQMSPALLRPV

SEQ ID NO: 30806 - protein, 25 aa, synthetic construct
  source 1..25: note = Seed: YGFLNVIVHSATGFKQSSKALQRPV
YGFLNVIVHSATGVKQMSPALMRPV

SEQ ID NO: 30807 - protein, 25 aa, synthetic construct
  source 1..25: note = Seed: YGFLNVIVHSATGFKQSSKALQRPV
YGFLNVIVHSATGVKQMSPALNRPV

SEQ ID NO: 30808 - protein, 25 aa, synthetic construct
  source 1..25: note = Seed: YGFLNVIVHSATGFKQSSKALQRPV
YGFLNVIVHSATGVKQMSPALQRPV

SEQ ID NO: 30809 - protein, 25 aa, synthetic construct
  source 1..25: note = Seed: YGFLNVIVHSATGFKQSSKALQRPV
YGFLNVIVHSATGVKQMSPALSRPV

SEQ ID NO: 30810 - protein, 25 aa, synthetic construct
  source 1..25: note = Seed: YGFLNVIVHSATGFKQSSKALQRPV
YGFLNVIVHSATGVKQMSPALTRPV

SEQ ID NO: 30811 - protein, 25 aa, synthetic construct
  source 1..25: note = Seed: YGFLNVIVHSATGFKQSSKALQRPV
YGFLNVIVHSATGVKQMSPALVRPV

SEQ ID NO: 30812 - protein, 25 aa, synthetic construct
  source 1..25: note = Seed: YGFLNVIVHSATGFKQSSKALQRPV
YGFLNVIVHSATGVKQMSRALARPV

SEQ ID NO: 30813 - protein, 25 aa, synthetic construct
  source 1..25: note = Seed: YGFLNVIVHSATGFKQSSKALQRPV
YGFLNVIVHSATGVKQMSRALFRPV

SEQ ID NO: 30814 - protein, 25 aa, synthetic construct
  source 1..25: note = Seed: YGFLNVIVHSATGFKQSSKALQRPV
YGFLNVIVHSATGVKQMSRALGRPV

SEQ ID NO: 30815 - protein, 25 aa, synthetic construct
  source 1..25: note = Seed: YGFLNVIVHSATGFKQSSKALQRPV
YGFLNVIVHSATGVKQMSRALHRPV

SEQ ID NO: 30816 - protein, 25 aa, synthetic construct
  source 1..25: note = Seed: YGFLNVIVHSATGFKQSSKALQRPV
YGFLNVIVHSATGVKQMSRALIRPV

SEQ ID NO: 30817 - protein, 25 aa, synthetic construct
  source 1..25: note = Seed: YGFLNVIVHSATGFKQSSKALQRPV
YGFLNVIVHSATGVKQMSRALKRPV

SEQ ID NO: 30818 - protein, 25 aa, synthetic construct
  source 1..25: note = Seed: YGFLNVIVHSATGFKQSSKALQRPV
YGFLNVIVHSATGVKQMSRALLRPV

SEQ ID NO: 30819 - protein, 25 aa, synthetic construct
  source 1..25: note = Seed: YGFLNVIVHSATGFKQSSKALQRPV
YGFLNVIVHSATGVKQMSRALMRPV

SEQ ID NO: 30820 - protein, 25 aa, synthetic construct
  source 1..25: note = Seed: YGFLNVIVHSATGFKQSSKALQRPV
YGFLNVIVHSATGVKQMSRALNRPV

SEQ ID NO: 30821 - protein, 25 aa, synthetic construct
  source 1..25: note = Seed: YGFLNVIVHSATGFKQSSKALQRPV
YGFLNVIVHSATGVKQMSRALPRPV

SEQ ID NO: 30822 - protein, 25 aa, synthetic construct
  source 1..25: note = Seed: YGFLNVIVHSATGFKQSSKALQRPV
YGFLNVIVHSATGVKQMSRALQRPV

SEQ ID NO: 30823 - protein, 25 aa, synthetic construct
  source 1..25: note = Seed: YGFLNVIVHSATGFKQSSKALQRPV
YGFLNVIVHSATGVKQMSRALRRPV

SEQ ID NO: 30824 - protein, 25 aa, synthetic construct
  source 1..25: note = Seed: YGFLNVIVHSATGFKQSSKALQRPV
YGFLNVIVHSATGVKQMSRALSRPV

SEQ ID NO: 30825 - protein, 25 aa, synthetic construct
  source 1..25: note = Seed: YGFLNVIVHSATGFKQSSKALQRPV
YGFLNVIVHSATGVKQMSRALTRPV

SEQ ID NO: 30826 - protein, 25 aa, synthetic construct
  source 1..25: note = Seed: YGFLNVIVHSATGFKQSSKALQRPV
YGFLNVIVHSATGVKQMSRALVRPV

SEQ ID NO: 30827 - protein, 25 aa, synthetic construct
  source 1..25: note = Seed: YGFLNVIVHSATGFKQSSKALQRPV
YGFLNVIVHSATGVKQMSRALYRPV

SEQ ID NO: 30828 - protein, 25 aa, synthetic construct
  source 1..25: note = Seed: YGFLNVIVHSATGFKQSSKALQRPV
YGFLNVIVHSATGVKQMSSALARPV

SEQ ID NO: 30829 - protein, 25 aa, synthetic construct
  source 1..25: note = Seed: YGFLNVIVHSATGFKQSSKALQRPV
YGFLNVIVHSATGVKQMSSALMRPV

SEQ ID NO: 30830 - protein, 25 aa, synthetic construct
  source 1..25: note = Seed: YGFLNVIVHSATGFKQSSKALQRPV
YGFLNVIVHSATGVKQMSSALNRPV

SEQ ID NO: 30831 - protein, 25 aa, synthetic construct
  source 1..25: note = Seed: YGFLNVIVHSATGFKQSSKALQRPV
YGFLNVIVHSATGVKQMSSALSRPV

SEQ ID NO: 30832 - protein, 25 aa, synthetic construct
  source 1..25: note = Seed: YGFLNVIVHSATGFKQSSKALQRPV
YGFLNVIVHSATGVKQMSSALTRPV

SEQ ID NO: 30833 - protein, 25 aa, synthetic construct
  source 1..25: note = Seed: YGFLNVIVHSATGFKQSSKALQRPV
YGFLNVIVHSATGVKQMSSALVRPV

SEQ ID NO: 30834 - protein, 25 aa, synthetic construct
  source 1..25: note = Seed: YGFLNVIVHSATGFKQSSKALQRPV
YGFLNVIVHSATGVKQMSTALARPV

SEQ ID NO: 30835 - protein, 25 aa, synthetic construct
  source 1..25: note = Seed: YGFLNVIVHSATGFKQSSKALQRPV
YGFLNVIVHSATGVKQMSTALMRPV

SEQ ID NO: 30836 - protein, 25 aa, synthetic construct
  source 1..25: note = Seed: YGFLNVIVHSATGFKQSSKALQRPV
YGFLNVIVHSATGVKQMSTALNRPV

SEQ ID NO: 30837 - protein, 25 aa, synthetic construct
  source 1..25: note = Seed: YGFLNVIVHSATGFKQSSKALQRPV
YGFLNVIVHSATGVKQMSTALSRPV

SEQ ID NO: 30838 - protein, 25 aa, synthetic construct
  source 1..25: note = Seed: YGFLNVIVHSATGFKQSSKALQRPV
YGFLNVIVHSATGVKQMSTALTRPV

SEQ ID NO: 30839 - protein, 25 aa, synthetic construct
  source 1..25: note = Seed: YGFLNVIVHSATGFKQSSKALQRPV
YGFLNVIVHSATGVKQMSTALVRPV

SEQ ID NO: 30840 - protein, 25 aa, synthetic construct
  source 1..25: note = Seed: YGFLNVIVHSATGFKQSSKALQRPV
YGFLNVIVHSATGVKQMSVALARPV

SEQ ID NO: 30841 - protein, 25 aa, synthetic construct
  source 1..25: note = Seed: YGFLNVIVHSATGFKQSSKALQRPV
YGFLNVIVHSATGVKQMSVALHRPV

SEQ ID NO: 30842 - protein, 25 aa, synthetic construct
  source 1..25: note = Seed: YGFLNVIVHSATGFKQSSKALQRPV
YGFLNVIVHSATGVKQMSVALMRPV

SEQ ID NO: 30843 - protein, 25 aa, synthetic construct
  source 1..25: note = Seed: YGFLNVIVHSATGFKQSSKALQRPV
YGFLNVIVHSATGVKQMSVALNRPV

SEQ ID NO: 30844 - protein, 25 aa, synthetic construct
  source 1..25: note = Seed: YGFLNVIVHSATGFKQSSKALQRPV
YGFLNVIVHSATGVKQMSVALRRPV

SEQ ID NO: 30845 - protein, 25 aa, synthetic construct
  source 1..25: note = Seed: YGFLNVIVHSATGFKQSSKALQRPV
YGFLNVIVHSATGVKQMSVALSRPV

SEQ ID NO: 30846 - protein, 25 aa, synthetic construct
  source 1..25: note = Seed: YGFLNVIVHSATGFKQSSKALQRPV
YGFLNVIVHSATGVKQMSVALTRPV

SEQ ID NO: 30847 - protein, 25 aa, synthetic construct
  source 1..25: note = Seed: YGFLNVIVHSATGFKQSSKALQRPV
YGFLNVIVHSATGVKQMSVALVRPV

SEQ ID NO: 30848 - protein, 25 aa, synthetic construct
  source 1..25: note = Seed: YGFLNVIVHSATGFKQSSKALQRPV
YGFLNVIVHSATGVKQMSWALFRPV

SEQ ID NO: 30849 - protein, 25 aa, synthetic construct
  source 1..25: note = Seed: YGFLNVIVHSATGFKQSSKALQRPV
YGFLNVIVHSATGVKQMSYALFRPV

SEQ ID NO: 30850 - protein, 25 aa, synthetic construct
  source 1..25: note = Seed: YGFLNVIVHSATGFKQSSKALQRPV
YGFLNVIVHSATGVKQNSAALARPV

SEQ ID NO: 30851 - protein, 25 aa, synthetic construct
  source 1..25: note = Seed: YGFLNVIVHSATGFKQSSKALQRPV
YGFLNVIVHSATGVKQNSAALFRPV

SEQ ID NO: 30852 - protein, 25 aa, synthetic construct
  source 1..25: note = Seed: YGFLNVIVHSATGFKQSSKALQRPV
YGFLNVIVHSATGVKQNSAALIRPV

SEQ ID NO: 30853 - protein, 25 aa, synthetic construct
  source 1..25: note = Seed: YGFLNVIVHSATGFKQSSKALQRPV
YGFLNVIVHSATGVKQNSAALLRPV

SEQ ID NO: 30854 - protein, 25 aa, synthetic construct
  source 1..25: note = Seed: YGFLNVIVHSATGFKQSSKALQRPV
YGFLNVIVHSATGVKQNSAALMRPV

SEQ ID NO: 30855 - protein, 25 aa, synthetic construct
  source 1..25: note = Seed: YGFLNVIVHSATGFKQSSKALQRPV
YGFLNVIVHSATGVKQNSAALSRPV

SEQ ID NO: 30856 - protein, 25 aa, synthetic construct
  source 1..25: note = Seed: YGFLNVIVHSATGFKQSSKALQRPV
YGFLNVIVHSATGVKQNSAALTRPV

SEQ ID NO: 30857 - protein, 25 aa, synthetic construct
  source 1..25: note = Seed: YGFLNVIVHSATGFKQSSKALQRPV
YGFLNVIVHSATGVKQNSAALVRPV

SEQ ID NO: 30858 - protein, 25 aa, synthetic construct
  source 1..25: note = Seed: YGFLNVIVHSATGFKQSSKALQRPV
YGFLNVIVHSATGVKQNSAALWRPV

SEQ ID NO: 30859 - protein, 25 aa, synthetic construct
  source 1..25: note = Seed: YGFLNVIVHSATGFKQSSKALQRPV
YGFLNVIVHSATGVKQNSAALYRPV

SEQ ID NO: 30860 - protein, 25 aa, synthetic construct
  source 1..25: note = Seed: YGFLNVIVHSATGFKQSSKALQRPV
YGFLNVIVHSATGVKQNSCALIRPV

SEQ ID NO: 30861 - protein, 25 aa, synthetic construct
  source 1..25: note = Seed: YGFLNVIVHSATGFKQSSKALQRPV
YGFLNVIVHSATGVKQNSGALARPV

SEQ ID NO: 30862 - protein, 25 aa, synthetic construct
  source 1..25: note = Seed: YGFLNVIVHSATGFKQSSKALQRPV
YGFLNVIVHSATGVKQNSGALFRPV

SEQ ID NO: 30863 - protein, 25 aa, synthetic construct
  source 1..25: note = Seed: YGFLNVIVHSATGFKQSSKALQRPV
YGFLNVIVHSATGVKQNSGALIRPV

SEQ ID NO: 30864 - protein, 25 aa, synthetic construct
  source 1..25: note = Seed: YGFLNVIVHSATGFKQSSKALQRPV
YGFLNVIVHSATGVKQNSGALLRPV

SEQ ID NO: 30865 - protein, 25 aa, synthetic construct
  source 1..25: note = Seed: YGFLNVIVHSATGFKQSSKALQRPV
YGFLNVIVHSATGVKQNSGALMRPV

SEQ ID NO: 30866 - protein, 25 aa, synthetic construct
  source 1..25: note = Seed: YGFLNVIVHSATGFKQSSKALQRPV
YGFLNVIVHSATGVKQNSGALVRPV

SEQ ID NO: 30867 - protein, 25 aa, synthetic construct
  source 1..25: note = Seed: YGFLNVIVHSATGFKQSSKALQRPV
YGFLNVIVHSATGVKQNSGALYRPV

SEQ ID NO: 30868 - protein, 25 aa, synthetic construct
  source 1..25: note = Seed: YGFLNVIVHSATGFKQSSKALQRPV
YGFLNVIVHSATGVKQNSHALFRPV

SEQ ID NO: 30869 - protein, 25 aa, synthetic construct
  source 1..25: note = Seed: YGFLNVIVHSATGFKQSSKALQRPV
YGFLNVIVHSATGVKQNSHALIRPV

SEQ ID NO: 30870 - protein, 25 aa, synthetic construct
  source 1..25: note = Seed: YGFLNVIVHSATGFKQSSKALQRPV
YGFLNVIVHSATGVKQNSHALLRPV

SEQ ID NO: 30871 - protein, 25 aa, synthetic construct
  source 1..25: note = Seed: YGFLNVIVHSATGFKQSSKALQRPV
YGFLNVIVHSATGVKQNSHALVRPV

SEQ ID NO: 30872 - protein, 25 aa, synthetic construct
  source 1..25: note = Seed: YGFLNVIVHSATGFKQSSKALQRPV
YGFLNVIVHSATGVKQNSIALARPV

SEQ ID NO: 30873 - protein, 25 aa, synthetic construct
  source 1..25: note = Seed: YGFLNVIVHSATGFKQSSKALQRPV
YGFLNVIVHSATGVKQNSIALFRPV

SEQ ID NO: 30874 - protein, 25 aa, synthetic construct
  source 1..25: note = Seed: YGFLNVIVHSATGFKQSSKALQRPV
YGFLNVIVHSATGVKQNSIALIRPV

SEQ ID NO: 30875 - protein, 25 aa, synthetic construct
  source 1..25: note = Seed: YGFLNVIVHSATGFKQSSKALQRPV
YGFLNVIVHSATGVKQNSIALLRPV

SEQ ID NO: 30876 - protein, 25 aa, synthetic construct
  source 1..25: note = Seed: YGFLNVIVHSATGFKQSSKALQRPV
YGFLNVIVHSATGVKQNSIALMRPV

SEQ ID NO: 30877 - protein, 25 aa, synthetic construct
  source 1..25: note = Seed: YGFLNVIVHSATGFKQSSKALQRPV
YGFLNVIVHSATGVKQNSIALVRPV

SEQ ID NO: 30878 - protein, 25 aa, synthetic construct
  source 1..25: note = Seed: YGFLNVIVHSATGFKQSSKALQRPV
YGFLNVIVHSATGVKQNSIALYRPV

SEQ ID NO: 30879 - protein, 25 aa, synthetic construct
  source 1..25: note = Seed: YGFLNVIVHSATGFKQSSKALQRPV
YGFLNVIVHSATGVKQNSLALFRPV

SEQ ID NO: 30880 - protein, 25 aa, synthetic construct
  source 1..25: note = Seed: YGFLNVIVHSATGFKQSSKALQRPV
YGFLNVIVHSATGVKQNSLALIRPV

SEQ ID NO: 30881 - protein, 25 aa, synthetic construct
  source 1..25: note = Seed: YGFLNVIVHSATGFKQSSKALQRPV
YGFLNVIVHSATGVKQNSLALLRPV

SEQ ID NO: 30882 - protein, 25 aa, synthetic construct
  source 1..25: note = Seed: YGFLNVIVHSATGFKQSSKALQRPV
YGFLNVIVHSATGVKQNSLALVRPV

SEQ ID NO: 30883 - protein, 25 aa, synthetic construct
  source 1..25: note = Seed: YGFLNVIVHSATGFKQSSKALQRPV
YGFLNVIVHSATGVKQNSLALYRPV

SEQ ID NO: 30884 - protein, 25 aa, synthetic construct
  source 1..25: note = Seed: YGFLNVIVHSATGFKQSSKALQRPV
YGFLNVIVHSATGVKQNSMALFRPV

SEQ ID NO: 30885 - protein, 25 aa, synthetic construct
  source 1..25: note = Seed: YGFLNVIVHSATGFKQSSKALQRPV
YGFLNVIVHSATGVKQNSMALIRPV

SEQ ID NO: 30886 - protein, 25 aa, synthetic construct
  source 1..25: note = Seed: YGFLNVIVHSATGFKQSSKALQRPV
YGFLNVIVHSATGVKQNSMALLRPV

SEQ ID NO: 30887 - protein, 25 aa, synthetic construct
  source 1..25: note = Seed: YGFLNVIVHSATGFKQSSKALQRPV
YGFLNVIVHSATGVKQNSMALMRPV

SEQ ID NO: 30888 - protein, 25 aa, synthetic construct
  source 1..25: note = Seed: YGFLNVIVHSATGFKQSSKALQRPV
YGFLNVIVHSATGVKQNSMALVRPV

SEQ ID NO: 30889 - protein, 25 aa, synthetic construct
  source 1..25: note = Seed: YGFLNVIVHSATGFKQSSKALQRPV
YGFLNVIVHSATGVKQNSMALYRPV

SEQ ID NO: 30890 - protein, 25 aa, synthetic construct
  source 1..25: note = Seed: YGFLNVIVHSATGFKQSSKALQRPV
YGFLNVIVHSATGVKQNSNALARPV

SEQ ID NO: 30891 - protein, 25 aa, synthetic construct
  source 1..25: note = Seed: YGFLNVIVHSATGFKQSSKALQRPV
YGFLNVIVHSATGVKQNSNALFRPV

SEQ ID NO: 30892 - protein, 25 aa, synthetic construct
  source 1..25: note = Seed: YGFLNVIVHSATGFKQSSKALQRPV
YGFLNVIVHSATGVKQNSNALIRPV

SEQ ID NO: 30893 - protein, 25 aa, synthetic construct
  source 1..25: note = Seed: YGFLNVIVHSATGFKQSSKALQRPV
YGFLNVIVHSATGVKQNSNALLRPV

SEQ ID NO: 30894 - protein, 25 aa, synthetic construct
  source 1..25: note = Seed: YGFLNVIVHSATGFKQSSKALQRPV
YGFLNVIVHSATGVKQNSNALMRPV

SEQ ID NO: 30895 - protein, 25 aa, synthetic construct
  source 1..25: note = Seed: YGFLNVIVHSATGFKQSSKALQRPV
YGFLNVIVHSATGVKQNSNALSRPV

SEQ ID NO: 30896 - protein, 25 aa, synthetic construct
  source 1..25: note = Seed: YGFLNVIVHSATGFKQSSKALQRPV
YGFLNVIVHSATGVKQNSNALTRPV

SEQ ID NO: 30897 - protein, 25 aa, synthetic construct
  source 1..25: note = Seed: YGFLNVIVHSATGFKQSSKALQRPV
YGFLNVIVHSATGVKQNSNALVRPV

SEQ ID NO: 30898 - protein, 25 aa, synthetic construct
  source 1..25: note = Seed: YGFLNVIVHSATGFKQSSKALQRPV
YGFLNVIVHSATGVKQNSNALWRPV

SEQ ID NO: 30899 - protein, 25 aa, synthetic construct
  source 1..25: note = Seed: YGFLNVIVHSATGFKQSSKALQRPV
YGFLNVIVHSATGVKQNSNALYRPV

SEQ ID NO: 30900 - protein, 25 aa, synthetic construct
  source 1..25: note = Seed: YGFLNVIVHSATGFKQSSKALQRPV
YGFLNVIVHSATGVKQNSPALARPV

SEQ ID NO: 30901 - protein, 25 aa, synthetic construct
  source 1..25: note = Seed: YGFLNVIVHSATGFKQSSKALQRPV
YGFLNVIVHSATGVKQNSPALFRPV

SEQ ID NO: 30902 - protein, 25 aa, synthetic construct
  source 1..25: note = Seed: YGFLNVIVHSATGFKQSSKALQRPV
YGFLNVIVHSATGVKQNSPALIRPV

SEQ ID NO: 30903 - protein, 25 aa, synthetic construct
  source 1..25: note = Seed: YGFLNVIVHSATGFKQSSKALQRPV
YGFLNVIVHSATGVKQNSPALLRPV

SEQ ID NO: 30904 - protein, 25 aa, synthetic construct
  source 1..25: note = Seed: YGFLNVIVHSATGFKQSSKALQRPV
YGFLNVIVHSATGVKQNSPALMRPV

SEQ ID NO: 30905 - protein, 25 aa, synthetic construct
  source 1..25: note = Seed: YGFLNVIVHSATGFKQSSKALQRPV
YGFLNVIVHSATGVKQNSPALVRPV

SEQ ID NO: 30906 - protein, 25 aa, synthetic construct
  source 1..25: note = Seed: YGFLNVIVHSATGFKQSSKALQRPV
YGFLNVIVHSATGVKQNSPALWRPV

SEQ ID NO: 30907 - protein, 25 aa, synthetic construct
  source 1..25: note = Seed: YGFLNVIVHSATGFKQSSKALQRPV
YGFLNVIVHSATGVKQNSPALYRPV

SEQ ID NO: 30908 - protein, 25 aa, synthetic construct
  source 1..25: note = Seed: YGFLNVIVHSATGFKQSSKALQRPV
YGFLNVIVHSATGVKQNSQALIRPV

SEQ ID NO: 30909 - protein, 25 aa, synthetic construct
  source 1..25: note = Seed: YGFLNVIVHSATGFKQSSKALQRPV
YGFLNVIVHSATGVKQNSQALVRPV

SEQ ID NO: 30910 - protein, 25 aa, synthetic construct
  source 1..25: note = Seed: YGFLNVIVHSATGFKQSSKALQRPV
YGFLNVIVHSATGVKQNSSALARPV

SEQ ID NO: 30911 - protein, 25 aa, synthetic construct
  source 1..25: note = Seed: YGFLNVIVHSATGFKQSSKALQRPV
YGFLNVIVHSATGVKQNSSALFRPV

SEQ ID NO: 30912 - protein, 25 aa, synthetic construct
  source 1..25: note = Seed: YGFLNVIVHSATGFKQSSKALQRPV
YGFLNVIVHSATGVKQNSSALIRPV

SEQ ID NO: 30913 - protein, 25 aa, synthetic construct
  source 1..25: note = Seed: YGFLNVIVHSATGFKQSSKALQRPV
YGFLNVIVHSATGVKQNSSALLRPV

SEQ ID NO: 30914 - protein, 25 aa, synthetic construct
  source 1..25: note = Seed: YGFLNVIVHSATGFKQSSKALQRPV
YGFLNVIVHSATGVKQNSSALMRPV

SEQ ID NO: 30915 - protein, 25 aa, synthetic construct
  source 1..25: note = Seed: YGFLNVIVHSATGFKQSSKALQRPV
YGFLNVIVHSATGVKQNSSALSRPV

SEQ ID NO: 30916 - protein, 25 aa, synthetic construct
  source 1..25: note = Seed: YGFLNVIVHSATGFKQSSKALQRPV
YGFLNVIVHSATGVKQNSSALTRPV

SEQ ID NO: 30917 - protein, 25 aa, synthetic construct
  source 1..25: note = Seed: YGFLNVIVHSATGFKQSSKALQRPV
YGFLNVIVHSATGVKQNSSALVRPV

SEQ ID NO: 30918 - protein, 25 aa, synthetic construct
  source 1..25: note = Seed: YGFLNVIVHSATGFKQSSKALQRPV
YGFLNVIVHSATGVKQNSSALWRPV

SEQ ID NO: 30919 - protein, 25 aa, synthetic construct
  source 1..25: note = Seed: YGFLNVIVHSATGFKQSSKALQRPV
YGFLNVIVHSATGVKQNSSALYRPV

SEQ ID NO: 30920 - protein, 25 aa, synthetic construct
  source 1..25: note = Seed: YGFLNVIVHSATGFKQSSKALQRPV
YGFLNVIVHSATGVKQNSTALARPV

SEQ ID NO: 30921 - protein, 25 aa, synthetic construct
  source 1..25: note = Seed: YGFLNVIVHSATGFKQSSKALQRPV
YGFLNVIVHSATGVKQNSTALFRPV

SEQ ID NO: 30922 - protein, 25 aa, synthetic construct
  source 1..25: note = Seed: YGFLNVIVHSATGFKQSSKALQRPV
YGFLNVIVHSATGVKQNSTALIRPV

SEQ ID NO: 30923 - protein, 25 aa, synthetic construct
  source 1..25: note = Seed: YGFLNVIVHSATGFKQSSKALQRPV
YGFLNVIVHSATGVKQNSTALLRPV

SEQ ID NO: 30924 - protein, 25 aa, synthetic construct
  source 1..25: note = Seed: YGFLNVIVHSATGFKQSSKALQRPV
YGFLNVIVHSATGVKQNSTALMRPV

SEQ ID NO: 30925 - protein, 25 aa, synthetic construct
  source 1..25: note = Seed: YGFLNVIVHSATGFKQSSKALQRPV
YGFLNVIVHSATGVKQNSTALVRPV

SEQ ID NO: 30926 - protein, 25 aa, synthetic construct
  source 1..25: note = Seed: YGFLNVIVHSATGFKQSSKALQRPV
YGFLNVIVHSATGVKQNSTALYRPV

SEQ ID NO: 30927 - protein, 25 aa, synthetic construct
  source 1..25: note = Seed: YGFLNVIVHSATGFKQSSKALQRPV
YGFLNVIVHSATGVKQNSVALARPV

SEQ ID NO: 30928 - protein, 25 aa, synthetic construct
  source 1..25: note = Seed: YGFLNVIVHSATGFKQSSKALQRPV
YGFLNVIVHSATGVKQNSVALFRPV

SEQ ID NO: 30929 - protein, 25 aa, synthetic construct
  source 1..25: note = Seed: YGFLNVIVHSATGFKQSSKALQRPV
YGFLNVIVHSATGVKQNSVALIRPV

SEQ ID NO: 30930 - protein, 25 aa, synthetic construct
  source 1..25: note = Seed: YGFLNVIVHSATGFKQSSKALQRPV
YGFLNVIVHSATGVKQNSVALLRPV

SEQ ID NO: 30931 - protein, 25 aa, synthetic construct
  source 1..25: note = Seed: YGFLNVIVHSATGFKQSSKALQRPV
YGFLNVIVHSATGVKQNSVALMRPV

SEQ ID NO: 30932 - protein, 25 aa, synthetic construct
  source 1..25: note = Seed: YGFLNVIVHSATGFKQSSKALQRPV
YGFLNVIVHSATGVKQNSVALVRPV

SEQ ID NO: 30933 - protein, 25 aa, synthetic construct
  source 1..25: note = Seed: YGFLNVIVHSATGFKQSSKALQRPV
YGFLNVIVHSATGVKQNSVALYRPV

SEQ ID NO: 30934 - protein, 25 aa, synthetic construct
  source 1..25: note = Seed: YGFLNVIVHSATGFKQSSKALQRPV
YGFLNVIVHSATGVKQNSYALIRPV

SEQ ID NO: 30935 - protein, 25 aa, synthetic construct
  source 1..25: note = Seed: YGFLNVIVHSATGFKQSSKALQRPV
YGFLNVIVHSATGVKQNSYALVRPV

SEQ ID NO: 30936 - protein, 25 aa, synthetic construct
  source 1..25: note = Seed: YGFLNVIVHSATGFKQSSKALQRPV
YGFLNVIVHSATGVKQRSRALFRPV

SEQ ID NO: 30937 - protein, 25 aa, synthetic construct
  source 1..25: note = Seed: YGFLNVIVHSATGFKQSSKALQRPV
YGFLNVIVHSATGVKQRSRALMRPV

SEQ ID NO: 30938 - protein, 25 aa, synthetic construct
  source 1..25: note = Seed: YGFLNVIVHSATGFKQSSKALQRPV
YGFLNVIVHSATGVKQRSRALRRPV

SEQ ID NO: 30939 - protein, 25 aa, synthetic construct
  source 1..25: note = Seed: YGFLNVIVHSATGFKQSSKALQRPV
YGFLNVIVHSATGVKQRSRALVRPV

SEQ ID NO: 30940 - protein, 25 aa, synthetic construct
  source 1..25: note = Seed: YGFLNVIVHSATGFKQSSKALQRPV
YGFLNVIVHSATGVKQRSRALYRPV

SEQ ID NO: 30941 - protein, 25 aa, synthetic construct
  source 1..25: note = Seed: YGFLNVIVHSATGFKQSSKALQRPV
YGFLNVIVHSATGVKQSSAALIRPV

SEQ ID NO: 30942 - protein, 25 aa, synthetic construct
  source 1..25: note = Seed: YGFLNVIVHSATGFKQSSKALQRPV
YGFLNVIVHSATGVKQSSAALVRPV

SEQ ID NO: 30943 - protein, 25 aa, synthetic construct
  source 1..25: note = Seed: YGFLNVIVHSATGFKQSSKALQRPV
YGFLNVIVHSATGVKQSSFALFRPV

SEQ ID NO: 30944 - protein, 25 aa, synthetic construct
  source 1..25: note = Seed: YGFLNVIVHSATGFKQSSKALQRPV
YGFLNVIVHSATGVKQSSFALLRPV

SEQ ID NO: 30945 - protein, 25 aa, synthetic construct
  source 1..25: note = Seed: YGFLNVIVHSATGFKQSSKALQRPV
YGFLNVIVHSATGVKQSSNALIRPV

SEQ ID NO: 30946 - protein, 25 aa, synthetic construct
  source 1..25: note = Seed: YGFLNVIVHSATGFKQSSKALQRPV
YGFLNVIVHSATGVKQSSNALVRPV

SEQ ID NO: 30947 - protein, 25 aa, synthetic construct
  source 1..25: note = Seed: YGFLNVIVHSATGFKQSSKALQRPV
YGFLNVIVHSATGVKQSSPALIRPV

SEQ ID NO: 30948 - protein, 25 aa, synthetic construct
  source 1..25: note = Seed: YGFLNVIVHSATGFKQSSKALQRPV
YGFLNVIVHSATGVKQSSRALRRPV

SEQ ID NO: 30949 - protein, 25 aa, synthetic construct
  source 1..25: note = Seed: YGFLNVIVHSATGFKQSSKALQRPV
YGFLNVIVHSATGVKQSSSALIRPV

SEQ ID NO: 30950 - protein, 25 aa, synthetic construct
  source 1..25: note = Seed: YGFLNVIVHSATGFKQSSKALQRPV
YGFLNVIVHSATGVKQSSSALVRPV

SEQ ID NO: 30951 - protein, 25 aa, synthetic construct
  source 1..25: note = Seed: YGFLNVIVHSATGFKQSSKALQRPV
YGFLNVIVHSATGVKQTSFALFRPV

SEQ ID NO: 30952 - protein, 25 aa, synthetic construct
  source 1..25: note = Seed: YGFLNVIVHSATGFKQSSKALQRPV
YGFLNVIVHSATGVKQTSFALIRPV

SEQ ID NO: 30953 - protein, 25 aa, synthetic construct
  source 1..25: note = Seed: YGFLNVIVHSATGFKQSSKALQRPV
YGFLNVIVHSATGVKQTSFALLRPV

SEQ ID NO: 30954 - protein, 25 aa, synthetic construct
  source 1..25: note = Seed: YGFLNVIVHSATGFKQSSKALQRPV
YGFLNVIVHSATGVKQTSFALVRPV

SEQ ID NO: 30955 - protein, 25 aa, synthetic construct
  source 1..25: note = Seed: YGFLNVIVHSATGFKQSSKALQRPV
YGFLNVIVHSATGVKQVSAALARPV

SEQ ID NO: 30956 - protein, 25 aa, synthetic construct
  source 1..25: note = Seed: YGFLNVIVHSATGFKQSSKALQRPV
YGFLNVIVHSATGVKQVSAALNRPV

SEQ ID NO: 30957 - protein, 25 aa, synthetic construct
  source 1..25: note = Seed: YGFLNVIVHSATGFKQSSKALQRPV
YGFLNVIVHSATGVKQVSFALFRPV

SEQ ID NO: 30958 - protein, 25 aa, synthetic construct
  source 1..25: note = Seed: YGFLNVIVHSATGFKQSSKALQRPV
YGFLNVIVHSATGVKQVSFALIRPV

SEQ ID NO: 30959 - protein, 25 aa, synthetic construct
  source 1..25: note = Seed: YGFLNVIVHSATGFKQSSKALQRPV
YGFLNVIVHSATGVKQVSFALLRPV

SEQ ID NO: 30960 - protein, 25 aa, synthetic construct
  source 1..25: note = Seed: YGFLNVIVHSATGFKQSSKALQRPV
YGFLNVIVHSATGVKQVSFALVRPV

SEQ ID NO: 30961 - protein, 25 aa, synthetic construct
  source 1..25: note = Seed: YGFLNVIVHSATGFKQSSKALQRPV
YGFLNVIVHSATGVKQVSFALYRPV

SEQ ID NO: 30962 - protein, 25 aa, synthetic construct
  source 1..25: note = Seed: YGFLNVIVHSATGFKQSSKALQRPV
YGFLNVIVHSATGVKQVSIALRRPV

SEQ ID NO: 30963 - protein, 25 aa, synthetic construct
  source 1..25: note = Seed: YGFLNVIVHSATGFKQSSKALQRPV
YGFLNVIVHSATGVKQVSKALARPV

SEQ ID NO: 30964 - protein, 25 aa, synthetic construct
  source 1..25: note = Seed: YGFLNVIVHSATGFKQSSKALQRPV
YGFLNVIVHSATGVKQVSKALGRPV

SEQ ID NO: 30965 - protein, 25 aa, synthetic construct
  source 1..25: note = Seed: YGFLNVIVHSATGFKQSSKALQRPV
YGFLNVIVHSATGVKQVSKALHRPV

SEQ ID NO: 30966 - protein, 25 aa, synthetic construct
  source 1..25: note = Seed: YGFLNVIVHSATGFKQSSKALQRPV
YGFLNVIVHSATGVKQVSKALKRPV

SEQ ID NO: 30967 - protein, 25 aa, synthetic construct
  source 1..25: note = Seed: YGFLNVIVHSATGFKQSSKALQRPV
YGFLNVIVHSATGVKQVSKALQRPV

SEQ ID NO: 30968 - protein, 25 aa, synthetic construct
  source 1..25: note = Seed: YGFLNVIVHSATGFKQSSKALQRPV
YGFLNVIVHSATGVKQVSKALRRPV

SEQ ID NO: 30969 - protein, 25 aa, synthetic construct
  source 1..25: note = Seed: YGFLNVIVHSATGFKQSSKALQRPV
YGFLNVIVHSATGVKQVSKALSRPV

SEQ ID NO: 30970 - protein, 25 aa, synthetic construct
  source 1..25: note = Seed: YGFLNVIVHSATGFKQSSKALQRPV
YGFLNVIVHSATGVKQVSKALYRPV

SEQ ID NO: 30971 - protein, 25 aa, synthetic construct
  source 1..25: note = Seed: YGFLNVIVHSATGFKQSSKALQRPV
YGFLNVIVHSATGVKQVSLALFRPV

SEQ ID NO: 30972 - protein, 25 aa, synthetic construct
  source 1..25: note = Seed: YGFLNVIVHSATGFKQSSKALQRPV
YGFLNVIVHSATGVKQVSLALRRPV

SEQ ID NO: 30973 - protein, 25 aa, synthetic construct
  source 1..25: note = Seed: YGFLNVIVHSATGFKQSSKALQRPV
YGFLNVIVHSATGVKQVSMALRRPV

SEQ ID NO: 30974 - protein, 25 aa, synthetic construct
  source 1..25: note = Seed: YGFLNVIVHSATGFKQSSKALQRPV
YGFLNVIVHSATGVKQVSPALARPV

SEQ ID NO: 30975 - protein, 25 aa, synthetic construct
  source 1..25: note = Seed: YGFLNVIVHSATGFKQSSKALQRPV
YGFLNVIVHSATGVKQVSPALNRPV

SEQ ID NO: 30976 - protein, 25 aa, synthetic construct
  source 1..25: note = Seed: YGFLNVIVHSATGFKQSSKALQRPV
YGFLNVIVHSATGVKQVSRALARPV

SEQ ID NO: 30977 - protein, 25 aa, synthetic construct
  source 1..25: note = Seed: YGFLNVIVHSATGFKQSSKALQRPV
YGFLNVIVHSATGVKQVSRALGRPV

SEQ ID NO: 30978 - protein, 25 aa, synthetic construct
  source 1..25: note = Seed: YGFLNVIVHSATGFKQSSKALQRPV
YGFLNVIVHSATGVKQVSRALHRPV

SEQ ID NO: 30979 - protein, 25 aa, synthetic construct
  source 1..25: note = Seed: YGFLNVIVHSATGFKQSSKALQRPV
YGFLNVIVHSATGVKQVSRALKRPV

SEQ ID NO: 30980 - protein, 25 aa, synthetic construct
  source 1..25: note = Seed: YGFLNVIVHSATGFKQSSKALQRPV
YGFLNVIVHSATGVKQVSRALMRPV

SEQ ID NO: 30981 - protein, 25 aa, synthetic construct
  source 1..25: note = Seed: YGFLNVIVHSATGFKQSSKALQRPV
YGFLNVIVHSATGVKQVSRALQRPV

SEQ ID NO: 30982 - protein, 25 aa, synthetic construct
  source 1..25: note = Seed: YGFLNVIVHSATGFKQSSKALQRPV
YGFLNVIVHSATGVKQVSRALRRPV

SEQ ID NO: 30983 - protein, 25 aa, synthetic construct
  source 1..25: note = Seed: YGFLNVIVHSATGFKQSSKALQRPV
YGFLNVIVHSATGVKQVSRALSRPV

SEQ ID NO: 30984 - protein, 25 aa, synthetic construct
  source 1..25: note = Seed: YGFLNVIVHSATGFKQSSKALQRPV
YGFLNVIVHSATGVKQVSRALTRPV

SEQ ID NO: 30985 - protein, 25 aa, synthetic construct
  source 1..25: note = Seed: YGFLNVIVHSATGFKQSSKALQRPV
YGFLNVIVHSATGVKQVSRALYRPV

SEQ ID NO: 30986 - protein, 25 aa, synthetic construct
  source 1..25: note = Seed: YGFLNVIVHSATGFKQSSKALQRPV
YGFLNVIVHSATGVKQVSWALFRPV

SEQ ID NO: 30987 - protein, 25 aa, synthetic construct
  source 1..25: note = Seed: YGFLNVIVHSATGFKQSSKALQRPV
YGFLNVIVHSATGVKQVSYALFRPV

SEQ ID NO: 30988 - protein, 25 aa, synthetic construct
  source 1..25: note = Seed: YGFLNVIVHSATGFKQSSKALQRPV
YGFLNVIVHSATGVKQVSYALYRPV

SEQ ID NO: 30989 - protein, 25 aa, synthetic construct
  source 1..25: note = Seed: YGFLNVIVHSATGFKQSSKALQRPV
YGFLNVIVHSATGVKQWSAALARPV

SEQ ID NO: 30990 - protein, 25 aa, synthetic construct
  source 1..25: note = Seed: YGFLNVIVHSATGFKQSSKALQRPV
YGFLNVIVHSATGVKQWSFALFRPV

SEQ ID NO: 30991 - protein, 25 aa, synthetic construct
  source 1..25: note = Seed: YGFLNVIVHSATGFKQSSKALQRPV
YGFLNVIVHSATGVKQWSFALLRPV

SEQ ID NO: 30992 - protein, 25 aa, synthetic construct
  source 1..25: note = Seed: YGFLNVIVHSATGFKQSSKALQRPV
YGFLNVIVHSATGVKQWSFALYRPV

SEQ ID NO: 30993 - protein, 25 aa, synthetic construct
  source 1..25: note = Seed: YGFLNVIVHSATGFKQSSKALQRPV
YGFLNVIVHSATGVKQWSIALARPV

SEQ ID NO: 30994 - protein, 25 aa, synthetic construct
  source 1..25: note = Seed: YGFLNVIVHSATGFKQSSKALQRPV
YGFLNVIVHSATGVKQWSIALSRPV

SEQ ID NO: 30995 - protein, 25 aa, synthetic construct
  source 1..25: note = Seed: YGFLNVIVHSATGFKQSSKALQRPV
YGFLNVIVHSATGVKQWSKALRRPV

SEQ ID NO: 30996 - protein, 25 aa, synthetic construct
  source 1..25: note = Seed: YGFLNVIVHSATGFKQSSKALQRPV
YGFLNVIVHSATGVKQWSKALYRPV

SEQ ID NO: 30997 - protein, 25 aa, synthetic construct
  source 1..25: note = Seed: YGFLNVIVHSATGFKQSSKALQRPV
YGFLNVIVHSATGVKQWSLALARPV

SEQ ID NO: 30998 - protein, 25 aa, synthetic construct
  source 1..25: note = Seed: YGFLNVIVHSATGFKQSSKALQRPV
YGFLNVIVHSATGVKQWSRALARPV

SEQ ID NO: 30999 - protein, 25 aa, synthetic construct
  source 1..25: note = Seed: YGFLNVIVHSATGFKQSSKALQRPV
YGFLNVIVHSATGVKQWSRALFRPV

SEQ ID NO: 31000 - protein, 25 aa, synthetic construct
  source 1..25: note = Seed: YGFLNVIVHSATGFKQSSKALQRPV
YGFLNVIVHSATGVKQWSRALKRPV

SEQ ID NO: 31001 - protein, 25 aa, synthetic construct
  source 1..25: note = Seed: YGFLNVIVHSATGFKQSSKALQRPV
YGFLNVIVHSATGVKQWSRALRRPV

SEQ ID NO: 31002 - protein, 25 aa, synthetic construct
  source 1..25: note = Seed: YGFLNVIVHSATGFKQSSKALQRPV
YGFLNVIVHSATGVKQWSRALVRPV

SEQ ID NO: 31003 - protein, 25 aa, synthetic construct
  source 1..25: note = Seed: YGFLNVIVHSATGFKQSSKALQRPV
YGFLNVIVHSATGVKQWSRALYRPV

SEQ ID NO: 31004 - protein, 25 aa, synthetic construct
  source 1..25: note = Seed: YGFLNVIVHSATGFKQSSKALQRPV
YGFLNVIVHSATGVKQWSVALARPV

SEQ ID NO: 31005 - protein, 25 aa, synthetic construct
  source 1..25: note = Seed: YGFLNVIVHSATGFKQSSKALQRPV
YGFLNVIVHSATGVKQWSYALFRPV

SEQ ID NO: 31006 - protein, 25 aa, synthetic construct
  source 1..25: note = Seed: YGFLNVIVHSATGFKQSSKALQRPV
YGFLNVIVHSATGVKQWSYALYRPV

SEQ ID NO: 31007 - protein, 25 aa, synthetic construct
  source 1..25: note = Seed: YGFLNVIVHSATGFKQSSKALQRPV
YGFLNVIVHSATGVKQYSAALARPV

SEQ ID NO: 31008 - protein, 25 aa, synthetic construct
  source 1..25: note = Seed: YGFLNVIVHSATGFKQSSKALQRPV
YGFLNVIVHSATGVKQYSAALSRPV

SEQ ID NO: 31009 - protein, 25 aa, synthetic construct
  source 1..25: note = Seed: YGFLNVIVHSATGFKQSSKALQRPV
YGFLNVIVHSATGVKQYSFALLRPV

SEQ ID NO: 31010 - protein, 25 aa, synthetic construct
  source 1..25: note = Seed: YGFLNVIVHSATGFKQSSKALQRPV
YGFLNVIVHSATGVKQYSFALYRPV

SEQ ID NO: 31011 - protein, 25 aa, synthetic construct
  source 1..25: note = Seed: YGFLNVIVHSATGFKQSSKALQRPV
YGFLNVIVHSATGVKQYSKALRRPV

SEQ ID NO: 31012 - protein, 25 aa, synthetic construct
  source 1..25: note = Seed: YGFLNVIVHSATGFKQSSKALQRPV
YGFLNVIVHSATGVKQYSRALRRPV

SEQ ID NO: 31013 - protein, 25 aa, synthetic construct
  source 1..25: note = Seed: YGFLNVIVHSATGFKQSSKALQRPV
YGFLNVIVHSATGVKQYSSALARPV

SEQ ID NO: 31014 - protein, 25 aa, synthetic construct
  source 1..25: note = Seed: YGFLNVIVHSATGFKQSSKALQRPV
YGFLNVIVHSATGVKQYSTALARPV

SEQ ID NO: 31015 - protein, 25 aa, synthetic construct
  source 1..25: note = Seed: YGFLNVIVHSATGFKQSSKALQRPV
YGFLNVIVHSATGVKQYSVALARPV

SEQ ID NO: 31016 - protein, 25 aa, synthetic construct
  source 1..25: note = Seed: YGFLNVIVHSATGFKQSSKALQRPV
YGFLNVIVHSATGVKQYSVALSRPV

SEQ ID NO: 31017 - protein, 25 aa, synthetic construct
  source 1..25: note = Seed: YGFLNVIVHSATGFKQSSKALQRPV
YGFLNVIVHSATGVKQYSYALLRPV

SEQ ID NO: 31018 - protein, 25 aa, synthetic construct
  source 1..25: note = Seed: YGFLNVIVHSATGFKQSSKALQRPV
YGFLNVIVHSATGWKQASAALARPV

SEQ ID NO: 31019 - protein, 25 aa, synthetic construct
  source 1..25: note = Seed: YGFLNVIVHSATGFKQSSKALQRPV
YGFLNVIVHSATGWKQASAALDRPV

SEQ ID NO: 31020 - protein, 25 aa, synthetic construct
  source 1..25: note = Seed: YGFLNVIVHSATGFKQSSKALQRPV
YGFLNVIVHSATGWKQASAALERPV

SEQ ID NO: 31021 - protein, 25 aa, synthetic construct
  source 1..25: note = Seed: YGFLNVIVHSATGFKQSSKALQRPV
YGFLNVIVHSATGWKQASAALGRPV

SEQ ID NO: 31022 - protein, 25 aa, synthetic construct
  source 1..25: note = Seed: YGFLNVIVHSATGFKQSSKALQRPV
YGFLNVIVHSATGWKQASAALHRPV

SEQ ID NO: 31023 - protein, 25 aa, synthetic construct
  source 1..25: note = Seed: YGFLNVIVHSATGFKQSSKALQRPV
YGFLNVIVHSATGWKQASAALIRPV

SEQ ID NO: 31024 - protein, 25 aa, synthetic construct
  source 1..25: note = Seed: YGFLNVIVHSATGFKQSSKALQRPV
YGFLNVIVHSATGWKQASAALLRPV

SEQ ID NO: 31025 - protein, 25 aa, synthetic construct
  source 1..25: note = Seed: YGFLNVIVHSATGFKQSSKALQRPV
YGFLNVIVHSATGWKQASAALMRPV

SEQ ID NO: 31026 - protein, 25 aa, synthetic construct
  source 1..25: note = Seed: YGFLNVIVHSATGFKQSSKALQRPV
YGFLNVIVHSATGWKQASAALNRPV

SEQ ID NO: 31027 - protein, 25 aa, synthetic construct
  source 1..25: note = Seed: YGFLNVIVHSATGFKQSSKALQRPV
YGFLNVIVHSATGWKQASAALQRPV

SEQ ID NO: 31028 - protein, 25 aa, synthetic construct
  source 1..25: note = Seed: YGFLNVIVHSATGFKQSSKALQRPV
YGFLNVIVHSATGWKQASAALSRPV

SEQ ID NO: 31029 - protein, 25 aa, synthetic construct
  source 1..25: note = Seed: YGFLNVIVHSATGFKQSSKALQRPV
YGFLNVIVHSATGWKQASAALTRPV

SEQ ID NO: 31030 - protein, 25 aa, synthetic construct
  source 1..25: note = Seed: YGFLNVIVHSATGFKQSSKALQRPV
YGFLNVIVHSATGWKQASAALVRPV

SEQ ID NO: 31031 - protein, 25 aa, synthetic construct
  source 1..25: note = Seed: YGFLNVIVHSATGFKQSSKALQRPV
YGFLNVIVHSATGWKQASGALARPV

SEQ ID NO: 31032 - protein, 25 aa, synthetic construct
  source 1..25: note = Seed: YGFLNVIVHSATGFKQSSKALQRPV
YGFLNVIVHSATGWKQASGALNRPV

SEQ ID NO: 31033 - protein, 25 aa, synthetic construct
  source 1..25: note = Seed: YGFLNVIVHSATGFKQSSKALQRPV
YGFLNVIVHSATGWKQASGALSRPV

SEQ ID NO: 31034 - protein, 25 aa, synthetic construct
  source 1..25: note = Seed: YGFLNVIVHSATGFKQSSKALQRPV
YGFLNVIVHSATGWKQASIALARPV

SEQ ID NO: 31035 - protein, 25 aa, synthetic construct
  source 1..25: note = Seed: YGFLNVIVHSATGFKQSSKALQRPV
YGFLNVIVHSATGWKQASIALGRPV

SEQ ID NO: 31036 - protein, 25 aa, synthetic construct
  source 1..25: note = Seed: YGFLNVIVHSATGFKQSSKALQRPV
YGFLNVIVHSATGWKQASIALHRPV

SEQ ID NO: 31037 - protein, 25 aa, synthetic construct
  source 1..25: note = Seed: YGFLNVIVHSATGFKQSSKALQRPV
YGFLNVIVHSATGWKQASIALMRPV

SEQ ID NO: 31038 - protein, 25 aa, synthetic construct
  source 1..25: note = Seed: YGFLNVIVHSATGFKQSSKALQRPV
YGFLNVIVHSATGWKQASIALNRPV

SEQ ID NO: 31039 - protein, 25 aa, synthetic construct
  source 1..25: note = Seed: YGFLNVIVHSATGFKQSSKALQRPV
YGFLNVIVHSATGWKQASIALQRPV

SEQ ID NO: 31040 - protein, 25 aa, synthetic construct
  source 1..25: note = Seed: YGFLNVIVHSATGFKQSSKALQRPV
YGFLNVIVHSATGWKQASIALSRPV

SEQ ID NO: 31041 - protein, 25 aa, synthetic construct
  source 1..25: note = Seed: YGFLNVIVHSATGFKQSSKALQRPV
YGFLNVIVHSATGWKQASIALTRPV

SEQ ID NO: 31042 - protein, 25 aa, synthetic construct
  source 1..25: note = Seed: YGFLNVIVHSATGFKQSSKALQRPV
YGFLNVIVHSATGWKQASIALVRPV

SEQ ID NO: 31043 - protein, 25 aa, synthetic construct
  source 1..25: note = Seed: YGFLNVIVHSATGFKQSSKALQRPV
YGFLNVIVHSATGWKQASKALARPV

SEQ ID NO: 31044 - protein, 25 aa, synthetic construct
  source 1..25: note = Seed: YGFLNVIVHSATGFKQSSKALQRPV
YGFLNVIVHSATGWKQASKALSRPV

SEQ ID NO: 31045 - protein, 25 aa, synthetic construct
  source 1..25: note = Seed: YGFLNVIVHSATGFKQSSKALQRPV
YGFLNVIVHSATGWKQASLALARPV

SEQ ID NO: 31046 - protein, 25 aa, synthetic construct
  source 1..25: note = Seed: YGFLNVIVHSATGFKQSSKALQRPV
YGFLNVIVHSATGWKQASLALNRPV

SEQ ID NO: 31047 - protein, 25 aa, synthetic construct
  source 1..25: note = Seed: YGFLNVIVHSATGFKQSSKALQRPV
YGFLNVIVHSATGWKQASMALARPV

SEQ ID NO: 31048 - protein, 25 aa, synthetic construct
  source 1..25: note = Seed: YGFLNVIVHSATGFKQSSKALQRPV
YGFLNVIVHSATGWKQASMALNRPV

SEQ ID NO: 31049 - protein, 25 aa, synthetic construct
  source 1..25: note = Seed: YGFLNVIVHSATGFKQSSKALQRPV
YGFLNVIVHSATGWKQASNALARPV

SEQ ID NO: 31050 - protein, 25 aa, synthetic construct
  source 1..25: note = Seed: YGFLNVIVHSATGFKQSSKALQRPV
YGFLNVIVHSATGWKQASNALNRPV

SEQ ID NO: 31051 - protein, 25 aa, synthetic construct
  source 1..25: note = Seed: YGFLNVIVHSATGFKQSSKALQRPV
YGFLNVIVHSATGWKQASNALSRPV

SEQ ID NO: 31052 - protein, 25 aa, synthetic construct
  source 1..25: note = Seed: YGFLNVIVHSATGFKQSSKALQRPV
YGFLNVIVHSATGWKQASPALARPV

SEQ ID NO: 31053 - protein, 25 aa, synthetic construct
  source 1..25: note = Seed: YGFLNVIVHSATGFKQSSKALQRPV
YGFLNVIVHSATGWKQASPALGRPV

SEQ ID NO: 31054 - protein, 25 aa, synthetic construct
  source 1..25: note = Seed: YGFLNVIVHSATGFKQSSKALQRPV
YGFLNVIVHSATGWKQASPALHRPV

SEQ ID NO: 31055 - protein, 25 aa, synthetic construct
  source 1..25: note = Seed: YGFLNVIVHSATGFKQSSKALQRPV
YGFLNVIVHSATGWKQASPALIRPV

SEQ ID NO: 31056 - protein, 25 aa, synthetic construct
  source 1..25: note = Seed: YGFLNVIVHSATGFKQSSKALQRPV
YGFLNVIVHSATGWKQASPALLRPV

SEQ ID NO: 31057 - protein, 25 aa, synthetic construct
  source 1..25: note = Seed: YGFLNVIVHSATGFKQSSKALQRPV
YGFLNVIVHSATGWKQASPALMRPV

SEQ ID NO: 31058 - protein, 25 aa, synthetic construct
  source 1..25: note = Seed: YGFLNVIVHSATGFKQSSKALQRPV
YGFLNVIVHSATGWKQASPALNRPV

SEQ ID NO: 31059 - protein, 25 aa, synthetic construct
  source 1..25: note = Seed: YGFLNVIVHSATGFKQSSKALQRPV
YGFLNVIVHSATGWKQASPALQRPV

SEQ ID NO: 31060 - protein, 25 aa, synthetic construct
  source 1..25: note = Seed: YGFLNVIVHSATGFKQSSKALQRPV
YGFLNVIVHSATGWKQASPALSRPV

SEQ ID NO: 31061 - protein, 25 aa, synthetic construct
  source 1..25: note = Seed: YGFLNVIVHSATGFKQSSKALQRPV
YGFLNVIVHSATGWKQASPALTRPV

SEQ ID NO: 31062 - protein, 25 aa, synthetic construct
  source 1..25: note = Seed: YGFLNVIVHSATGFKQSSKALQRPV
YGFLNVIVHSATGWKQASPALVRPV

SEQ ID NO: 31063 - protein, 25 aa, synthetic construct
  source 1..25: note = Seed: YGFLNVIVHSATGFKQSSKALQRPV
YGFLNVIVHSATGWKQASRALARPV

SEQ ID NO: 31064 - protein, 25 aa, synthetic construct
  source 1..25: note = Seed: YGFLNVIVHSATGFKQSSKALQRPV
YGFLNVIVHSATGWKQASRALGRPV

SEQ ID NO: 31065 - protein, 25 aa, synthetic construct
  source 1..25: note = Seed: YGFLNVIVHSATGFKQSSKALQRPV
YGFLNVIVHSATGWKQASRALQRPV

SEQ ID NO: 31066 - protein, 25 aa, synthetic construct
  source 1..25: note = Seed: YGFLNVIVHSATGFKQSSKALQRPV
YGFLNVIVHSATGWKQASRALSRPV

SEQ ID NO: 31067 - protein, 25 aa, synthetic construct
  source 1..25: note = Seed: YGFLNVIVHSATGFKQSSKALQRPV
YGFLNVIVHSATGWKQASSALARPV

SEQ ID NO: 31068 - protein, 25 aa, synthetic construct
  source 1..25: note = Seed: YGFLNVIVHSATGFKQSSKALQRPV
YGFLNVIVHSATGWKQASSALGRPV

SEQ ID NO: 31069 - protein, 25 aa, synthetic construct
  source 1..25: note = Seed: YGFLNVIVHSATGFKQSSKALQRPV
YGFLNVIVHSATGWKQASSALIRPV

SEQ ID NO: 31070 - protein, 25 aa, synthetic construct
  source 1..25: note = Seed: YGFLNVIVHSATGFKQSSKALQRPV
YGFLNVIVHSATGWKQASSALLRPV

SEQ ID NO: 31071 - protein, 25 aa, synthetic construct
  source 1..25: note = Seed: YGFLNVIVHSATGFKQSSKALQRPV
YGFLNVIVHSATGWKQASSALMRPV

SEQ ID NO: 31072 - protein, 25 aa, synthetic construct
  source 1..25: note = Seed: YGFLNVIVHSATGFKQSSKALQRPV
YGFLNVIVHSATGWKQASSALNRPV

SEQ ID NO: 31073 - protein, 25 aa, synthetic construct
  source 1..25: note = Seed: YGFLNVIVHSATGFKQSSKALQRPV
YGFLNVIVHSATGWKQASSALQRPV

SEQ ID NO: 31074 - protein, 25 aa, synthetic construct
  source 1..25: note = Seed: YGFLNVIVHSATGFKQSSKALQRPV
YGFLNVIVHSATGWKQASSALSRPV

SEQ ID NO: 31075 - protein, 25 aa, synthetic construct
  source 1..25: note = Seed: YGFLNVIVHSATGFKQSSKALQRPV
YGFLNVIVHSATGWKQASSALTRPV

SEQ ID NO: 31076 - protein, 25 aa, synthetic construct
  source 1..25: note = Seed: YGFLNVIVHSATGFKQSSKALQRPV
YGFLNVIVHSATGWKQASSALVRPV

SEQ ID NO: 31077 - protein, 25 aa, synthetic construct
  source 1..25: note = Seed: YGFLNVIVHSATGFKQSSKALQRPV
YGFLNVIVHSATGWKQASTALARPV

SEQ ID NO: 31078 - protein, 25 aa, synthetic construct
  source 1..25: note = Seed: YGFLNVIVHSATGFKQSSKALQRPV
YGFLNVIVHSATGWKQASTALGRPV

SEQ ID NO: 31079 - protein, 25 aa, synthetic construct
  source 1..25: note = Seed: YGFLNVIVHSATGFKQSSKALQRPV
YGFLNVIVHSATGWKQASTALHRPV

SEQ ID NO: 31080 - protein, 25 aa, synthetic construct
  source 1..25: note = Seed: YGFLNVIVHSATGFKQSSKALQRPV
YGFLNVIVHSATGWKQASTALIRPV

SEQ ID NO: 31081 - protein, 25 aa, synthetic construct
  source 1..25: note = Seed: YGFLNVIVHSATGFKQSSKALQRPV
YGFLNVIVHSATGWKQASTALLRPV

SEQ ID NO: 31082 - protein, 25 aa, synthetic construct
  source 1..25: note = Seed: YGFLNVIVHSATGFKQSSKALQRPV
YGFLNVIVHSATGWKQASTALMRPV

SEQ ID NO: 31083 - protein, 25 aa, synthetic construct
  source 1..25: note = Seed: YGFLNVIVHSATGFKQSSKALQRPV
YGFLNVIVHSATGWKQASTALNRPV

SEQ ID NO: 31084 - protein, 25 aa, synthetic construct
  source 1..25: note = Seed: YGFLNVIVHSATGFKQSSKALQRPV
YGFLNVIVHSATGWKQASTALQRPV

SEQ ID NO: 31085 - protein, 25 aa, synthetic construct
  source 1..25: note = Seed: YGFLNVIVHSATGFKQSSKALQRPV
YGFLNVIVHSATGWKQASTALSRPV

SEQ ID NO: 31086 - protein, 25 aa, synthetic construct
  source 1..25: note = Seed: YGFLNVIVHSATGFKQSSKALQRPV
YGFLNVIVHSATGWKQASTALTRPV

SEQ ID NO: 31087 - protein, 25 aa, synthetic construct
  source 1..25: note = Seed: YGFLNVIVHSATGFKQSSKALQRPV
YGFLNVIVHSATGWKQASTALVRPV

SEQ ID NO: 31088 - protein, 25 aa, synthetic construct
  source 1..25: note = Seed: YGFLNVIVHSATGFKQSSKALQRPV
YGFLNVIVHSATGWKQASVALARPV

SEQ ID NO: 31089 - protein, 25 aa, synthetic construct
  source 1..25: note = Seed: YGFLNVIVHSATGFKQSSKALQRPV
YGFLNVIVHSATGWKQASVALGRPV

SEQ ID NO: 31090 - protein, 25 aa, synthetic construct
  source 1..25: note = Seed: YGFLNVIVHSATGFKQSSKALQRPV
YGFLNVIVHSATGWKQASVALHRPV

SEQ ID NO: 31091 - protein, 25 aa, synthetic construct
  source 1..25: note = Seed: YGFLNVIVHSATGFKQSSKALQRPV
YGFLNVIVHSATGWKQASVALIRPV

SEQ ID NO: 31092 - protein, 25 aa, synthetic construct
  source 1..25: note = Seed: YGFLNVIVHSATGFKQSSKALQRPV
YGFLNVIVHSATGWKQASVALMRPV

SEQ ID NO: 31093 - protein, 25 aa, synthetic construct
  source 1..25: note = Seed: YGFLNVIVHSATGFKQSSKALQRPV
YGFLNVIVHSATGWKQASVALNRPV

SEQ ID NO: 31094 - protein, 25 aa, synthetic construct
  source 1..25: note = Seed: YGFLNVIVHSATGFKQSSKALQRPV
YGFLNVIVHSATGWKQASVALQRPV

SEQ ID NO: 31095 - protein, 25 aa, synthetic construct
  source 1..25: note = Seed: YGFLNVIVHSATGFKQSSKALQRPV
YGFLNVIVHSATGWKQASVALSRPV

SEQ ID NO: 31096 - protein, 25 aa, synthetic construct
  source 1..25: note = Seed: YGFLNVIVHSATGFKQSSKALQRPV
YGFLNVIVHSATGWKQASVALTRPV

SEQ ID NO: 31097 - protein, 25 aa, synthetic construct
  source 1..25: note = Seed: YGFLNVIVHSATGFKQSSKALQRPV
YGFLNVIVHSATGWKQASVALVRPV

SEQ ID NO: 31098 - protein, 25 aa, synthetic construct
  source 1..25: note = Seed: YGFLNVIVHSATGFKQSSKALQRPV
YGFLNVIVHSATGWKQDSNALARPV

SEQ ID NO: 31099 - protein, 25 aa, synthetic construct
  source 1..25: note = Seed: YGFLNVIVHSATGFKQSSKALQRPV
YGFLNVIVHSATGWKQDSTALARPV

SEQ ID NO: 31100 - protein, 25 aa, synthetic construct
  source 1..25: note = Seed: YGFLNVIVHSATGFKQSSKALQRPV
YGFLNVIVHSATGWKQDSTALSRPV

SEQ ID NO: 31101 - protein, 25 aa, synthetic construct
  source 1..25: note = Seed: YGFLNVIVHSATGFKQSSKALQRPV
YGFLNVIVHSATGWKQESAALARPV

SEQ ID NO: 31102 - protein, 25 aa, synthetic construct
  source 1..25: note = Seed: YGFLNVIVHSATGFKQSSKALQRPV
YGFLNVIVHSATGWKQESAALSRPV

SEQ ID NO: 31103 - protein, 25 aa, synthetic construct
  source 1..25: note = Seed: YGFLNVIVHSATGFKQSSKALQRPV
YGFLNVIVHSATGWKQESTALARPV

SEQ ID NO: 31104 - protein, 25 aa, synthetic construct
  source 1..25: note = Seed: YGFLNVIVHSATGFKQSSKALQRPV
YGFLNVIVHSATGWKQESVALARPV

SEQ ID NO: 31105 - protein, 25 aa, synthetic construct
  source 1..25: note = Seed: YGFLNVIVHSATGFKQSSKALQRPV
YGFLNVIVHSATGWKQFSAALARPV

SEQ ID NO: 31106 - protein, 25 aa, synthetic construct
  source 1..25: note = Seed: YGFLNVIVHSATGFKQSSKALQRPV
YGFLNVIVHSATGWKQFSAALGRPV

SEQ ID NO: 31107 - protein, 25 aa, synthetic construct
  source 1..25: note = Seed: YGFLNVIVHSATGFKQSSKALQRPV
YGFLNVIVHSATGWKQFSAALIRPV

SEQ ID NO: 31108 - protein, 25 aa, synthetic construct
  source 1..25: note = Seed: YGFLNVIVHSATGFKQSSKALQRPV
YGFLNVIVHSATGWKQFSAALNRPV

SEQ ID NO: 31109 - protein, 25 aa, synthetic construct
  source 1..25: note = Seed: YGFLNVIVHSATGFKQSSKALQRPV
YGFLNVIVHSATGWKQFSAALPRPV

SEQ ID NO: 31110 - protein, 25 aa, synthetic construct
  source 1..25: note = Seed: YGFLNVIVHSATGFKQSSKALQRPV
YGFLNVIVHSATGWKQFSAALQRPV

SEQ ID NO: 31111 - protein, 25 aa, synthetic construct
  source 1..25: note = Seed: YGFLNVIVHSATGFKQSSKALQRPV
YGFLNVIVHSATGWKQFSAALSRPV

SEQ ID NO: 31112 - protein, 25 aa, synthetic construct
  source 1..25: note = Seed: YGFLNVIVHSATGFKQSSKALQRPV
YGFLNVIVHSATGWKQFSAALTRPV

SEQ ID NO: 31113 - protein, 25 aa, synthetic construct
  source 1..25: note = Seed: YGFLNVIVHSATGFKQSSKALQRPV
YGFLNVIVHSATGWKQFSAALVRPV

SEQ ID NO: 31114 - protein, 25 aa, synthetic construct
  source 1..25: note = Seed: YGFLNVIVHSATGFKQSSKALQRPV
YGFLNVIVHSATGWKQFSAALWRPV

SEQ ID NO: 31115 - protein, 25 aa, synthetic construct
  source 1..25: note = Seed: YGFLNVIVHSATGFKQSSKALQRPV
YGFLNVIVHSATGWKQFSAALYRPV

SEQ ID NO: 31116 - protein, 25 aa, synthetic construct
  source 1..25: note = Seed: YGFLNVIVHSATGFKQSSKALQRPV
YGFLNVIVHSATGWKQFSDALFRPV

SEQ ID NO: 31117 - protein, 25 aa, synthetic construct
  source 1..25: note = Seed: YGFLNVIVHSATGFKQSSKALQRPV
YGFLNVIVHSATGWKQFSEALFRPV

SEQ ID NO: 31118 - protein, 25 aa, synthetic construct
  source 1..25: note = Seed: YGFLNVIVHSATGFKQSSKALQRPV
YGFLNVIVHSATGWKQFSFALFRPV

SEQ ID NO: 31119 - protein, 25 aa, synthetic construct
  source 1..25: note = Seed: YGFLNVIVHSATGFKQSSKALQRPV
YGFLNVIVHSATGWKQFSFALIRPV

SEQ ID NO: 31120 - protein, 25 aa, synthetic construct
  source 1..25: note = Seed: YGFLNVIVHSATGFKQSSKALQRPV
YGFLNVIVHSATGWKQFSFALLRPV

SEQ ID NO: 31121 - protein, 25 aa, synthetic construct
  source 1..25: note = Seed: YGFLNVIVHSATGFKQSSKALQRPV
YGFLNVIVHSATGWKQFSFALMRPV

SEQ ID NO: 31122 - protein, 25 aa, synthetic construct
  source 1..25: note = Seed: YGFLNVIVHSATGFKQSSKALQRPV
YGFLNVIVHSATGWKQFSFALVRPV

SEQ ID NO: 31123 - protein, 25 aa, synthetic construct
  source 1..25: note = Seed: YGFLNVIVHSATGFKQSSKALQRPV
YGFLNVIVHSATGWKQFSFALWRPV

SEQ ID NO: 31124 - protein, 25 aa, synthetic construct
  source 1..25: note = Seed: YGFLNVIVHSATGFKQSSKALQRPV
YGFLNVIVHSATGWKQFSFALYRPV

SEQ ID NO: 31125 - protein, 25 aa, synthetic construct
  source 1..25: note = Seed: YGFLNVIVHSATGFKQSSKALQRPV
YGFLNVIVHSATGWKQFSGALARPV

SEQ ID NO: 31126 - protein, 25 aa, synthetic construct
  source 1..25: note = Seed: YGFLNVIVHSATGFKQSSKALQRPV
YGFLNVIVHSATGWKQFSHALARPV

SEQ ID NO: 31127 - protein, 25 aa, synthetic construct
  source 1..25: note = Seed: YGFLNVIVHSATGFKQSSKALQRPV
YGFLNVIVHSATGWKQFSHALFRPV

SEQ ID NO: 31128 - protein, 25 aa, synthetic construct
  source 1..25: note = Seed: YGFLNVIVHSATGFKQSSKALQRPV
YGFLNVIVHSATGWKQFSIALARPV

SEQ ID NO: 31129 - protein, 25 aa, synthetic construct
  source 1..25: note = Seed: YGFLNVIVHSATGFKQSSKALQRPV
YGFLNVIVHSATGWKQFSIALLRPV

SEQ ID NO: 31130 - protein, 25 aa, synthetic construct
  source 1..25: note = Seed: YGFLNVIVHSATGFKQSSKALQRPV
YGFLNVIVHSATGWKQFSIALNRPV

SEQ ID NO: 31131 - protein, 25 aa, synthetic construct
  source 1..25: note = Seed: YGFLNVIVHSATGFKQSSKALQRPV
YGFLNVIVHSATGWKQFSIALPRPV

SEQ ID NO: 31132 - protein, 25 aa, synthetic construct
  source 1..25: note = Seed: YGFLNVIVHSATGFKQSSKALQRPV
YGFLNVIVHSATGWKQFSIALSRPV

SEQ ID NO: 31133 - protein, 25 aa, synthetic construct
  source 1..25: note = Seed: YGFLNVIVHSATGFKQSSKALQRPV
YGFLNVIVHSATGWKQFSIALTRPV

SEQ ID NO: 31134 - protein, 25 aa, synthetic construct
  source 1..25: note = Seed: YGFLNVIVHSATGFKQSSKALQRPV
YGFLNVIVHSATGWKQFSIALVRPV

SEQ ID NO: 31135 - protein, 25 aa, synthetic construct
  source 1..25: note = Seed: YGFLNVIVHSATGFKQSSKALQRPV
YGFLNVIVHSATGWKQFSIALYRPV

SEQ ID NO: 31136 - protein, 25 aa, synthetic construct
  source 1..25: note = Seed: YGFLNVIVHSATGFKQSSKALQRPV
YGFLNVIVHSATGWKQFSKALFRPV

SEQ ID NO: 31137 - protein, 25 aa, synthetic construct
  source 1..25: note = Seed: YGFLNVIVHSATGFKQSSKALQRPV
YGFLNVIVHSATGWKQFSLALARPV

SEQ ID NO: 31138 - protein, 25 aa, synthetic construct
  source 1..25: note = Seed: YGFLNVIVHSATGFKQSSKALQRPV
YGFLNVIVHSATGWKQFSLALLRPV

SEQ ID NO: 31139 - protein, 25 aa, synthetic construct
  source 1..25: note = Seed: YGFLNVIVHSATGFKQSSKALQRPV
YGFLNVIVHSATGWKQFSLALNRPV

SEQ ID NO: 31140 - protein, 25 aa, synthetic construct
  source 1..25: note = Seed: YGFLNVIVHSATGFKQSSKALQRPV
YGFLNVIVHSATGWKQFSLALSRPV

SEQ ID NO: 31141 - protein, 25 aa, synthetic construct
  source 1..25: note = Seed: YGFLNVIVHSATGFKQSSKALQRPV
YGFLNVIVHSATGWKQFSLALTRPV

SEQ ID NO: 31142 - protein, 25 aa, synthetic construct
  source 1..25: note = Seed: YGFLNVIVHSATGFKQSSKALQRPV
YGFLNVIVHSATGWKQFSLALVRPV

SEQ ID NO: 31143 - protein, 25 aa, synthetic construct
  source 1..25: note = Seed: YGFLNVIVHSATGFKQSSKALQRPV
YGFLNVIVHSATGWKQFSLALWRPV

SEQ ID NO: 31144 - protein, 25 aa, synthetic construct
  source 1..25: note = Seed: YGFLNVIVHSATGFKQSSKALQRPV
YGFLNVIVHSATGWKQFSLALYRPV

SEQ ID NO: 31145 - protein, 25 aa, synthetic construct
  source 1..25: note = Seed: YGFLNVIVHSATGFKQSSKALQRPV
YGFLNVIVHSATGWKQFSMALGRPV

SEQ ID NO: 31146 - protein, 25 aa, synthetic construct
  source 1..25: note = Seed: YGFLNVIVHSATGFKQSSKALQRPV
YGFLNVIVHSATGWKQFSMALLRPV

SEQ ID NO: 31147 - protein, 25 aa, synthetic construct
  source 1..25: note = Seed: YGFLNVIVHSATGFKQSSKALQRPV
YGFLNVIVHSATGWKQFSMALNRPV

SEQ ID NO: 31148 - protein, 25 aa, synthetic construct
  source 1..25: note = Seed: YGFLNVIVHSATGFKQSSKALQRPV
YGFLNVIVHSATGWKQFSMALSRPV

SEQ ID NO: 31149 - protein, 25 aa, synthetic construct
  source 1..25: note = Seed: YGFLNVIVHSATGFKQSSKALQRPV
YGFLNVIVHSATGWKQFSMALYRPV

SEQ ID NO: 31150 - protein, 25 aa, synthetic construct
  source 1..25: note = Seed: YGFLNVIVHSATGFKQSSKALQRPV
YGFLNVIVHSATGWKQFSNALARPV

SEQ ID NO: 31151 - protein, 25 aa, synthetic construct
  source 1..25: note = Seed: YGFLNVIVHSATGFKQSSKALQRPV
YGFLNVIVHSATGWKQFSPALARPV

SEQ ID NO: 31152 - protein, 25 aa, synthetic construct
  source 1..25: note = Seed: YGFLNVIVHSATGFKQSSKALQRPV
YGFLNVIVHSATGWKQFSPALFRPV

SEQ ID NO: 31153 - protein, 25 aa, synthetic construct
  source 1..25: note = Seed: YGFLNVIVHSATGFKQSSKALQRPV
YGFLNVIVHSATGWKQFSPALNRPV

SEQ ID NO: 31154 - protein, 25 aa, synthetic construct
  source 1..25: note = Seed: YGFLNVIVHSATGFKQSSKALQRPV
YGFLNVIVHSATGWKQFSPALSRPV

SEQ ID NO: 31155 - protein, 25 aa, synthetic construct
  source 1..25: note = Seed: YGFLNVIVHSATGFKQSSKALQRPV
YGFLNVIVHSATGWKQFSPALTRPV

SEQ ID NO: 31156 - protein, 25 aa, synthetic construct
  source 1..25: note = Seed: YGFLNVIVHSATGFKQSSKALQRPV
YGFLNVIVHSATGWKQFSPALVRPV

SEQ ID NO: 31157 - protein, 25 aa, synthetic construct
  source 1..25: note = Seed: YGFLNVIVHSATGFKQSSKALQRPV
YGFLNVIVHSATGWKQFSQALARPV

SEQ ID NO: 31158 - protein, 25 aa, synthetic construct
  source 1..25: note = Seed: YGFLNVIVHSATGFKQSSKALQRPV
YGFLNVIVHSATGWKQFSRALARPV

SEQ ID NO: 31159 - protein, 25 aa, synthetic construct
  source 1..25: note = Seed: YGFLNVIVHSATGFKQSSKALQRPV
YGFLNVIVHSATGWKQFSSALARPV

SEQ ID NO: 31160 - protein, 25 aa, synthetic construct
  source 1..25: note = Seed: YGFLNVIVHSATGFKQSSKALQRPV
YGFLNVIVHSATGWKQFSSALNRPV

SEQ ID NO: 31161 - protein, 25 aa, synthetic construct
  source 1..25: note = Seed: YGFLNVIVHSATGFKQSSKALQRPV
YGFLNVIVHSATGWKQFSSALSRPV

SEQ ID NO: 31162 - protein, 25 aa, synthetic construct
  source 1..25: note = Seed: YGFLNVIVHSATGFKQSSKALQRPV
YGFLNVIVHSATGWKQFSSALTRPV

SEQ ID NO: 31163 - protein, 25 aa, synthetic construct
  source 1..25: note = Seed: YGFLNVIVHSATGFKQSSKALQRPV
YGFLNVIVHSATGWKQFSSALVRPV

SEQ ID NO: 31164 - protein, 25 aa, synthetic construct
  source 1..25: note = Seed: YGFLNVIVHSATGFKQSSKALQRPV
YGFLNVIVHSATGWKQFSSALYRPV

SEQ ID NO: 31165 - protein, 25 aa, synthetic construct
  source 1..25: note = Seed: YGFLNVIVHSATGFKQSSKALQRPV
YGFLNVIVHSATGWKQFSTALARPV

SEQ ID NO: 31166 - protein, 25 aa, synthetic construct
  source 1..25: note = Seed: YGFLNVIVHSATGFKQSSKALQRPV
YGFLNVIVHSATGWKQFSTALNRPV

SEQ ID NO: 31167 - protein, 25 aa, synthetic construct
  source 1..25: note = Seed: YGFLNVIVHSATGFKQSSKALQRPV
YGFLNVIVHSATGWKQFSTALSRPV

SEQ ID NO: 31168 - protein, 25 aa, synthetic construct
  source 1..25: note = Seed: YGFLNVIVHSATGFKQSSKALQRPV
YGFLNVIVHSATGWKQFSTALTRPV

SEQ ID NO: 31169 - protein, 25 aa, synthetic construct
  source 1..25: note = Seed: YGFLNVIVHSATGFKQSSKALQRPV
YGFLNVIVHSATGWKQFSTALVRPV

SEQ ID NO: 31170 - protein, 25 aa, synthetic construct
  source 1..25: note = Seed: YGFLNVIVHSATGFKQSSKALQRPV
YGFLNVIVHSATGWKQFSTALYRPV

SEQ ID NO: 31171 - protein, 25 aa, synthetic construct
  source 1..25: note = Seed: YGFLNVIVHSATGFKQSSKALQRPV
YGFLNVIVHSATGWKQFSVALARPV

SEQ ID NO: 31172 - protein, 25 aa, synthetic construct
  source 1..25: note = Seed: YGFLNVIVHSATGFKQSSKALQRPV
YGFLNVIVHSATGWKQFSVALFRPV

SEQ ID NO: 31173 - protein, 25 aa, synthetic construct
  source 1..25: note = Seed: YGFLNVIVHSATGFKQSSKALQRPV
YGFLNVIVHSATGWKQFSVALGRPV

SEQ ID NO: 31174 - protein, 25 aa, synthetic construct
  source 1..25: note = Seed: YGFLNVIVHSATGFKQSSKALQRPV
YGFLNVIVHSATGWKQFSVALNRPV

SEQ ID NO: 31175 - protein, 25 aa, synthetic construct
  source 1..25: note = Seed: YGFLNVIVHSATGFKQSSKALQRPV
YGFLNVIVHSATGWKQFSVALPRPV

SEQ ID NO: 31176 - protein, 25 aa, synthetic construct
  source 1..25: note = Seed: YGFLNVIVHSATGFKQSSKALQRPV
YGFLNVIVHSATGWKQFSVALSRPV

SEQ ID NO: 31177 - protein, 25 aa, synthetic construct
  source 1..25: note = Seed: YGFLNVIVHSATGFKQSSKALQRPV
YGFLNVIVHSATGWKQFSVALTRPV

SEQ ID NO: 31178 - protein, 25 aa, synthetic construct
  source 1..25: note = Seed: YGFLNVIVHSATGFKQSSKALQRPV
YGFLNVIVHSATGWKQFSVALVRPV

SEQ ID NO: 31179 - protein, 25 aa, synthetic construct
  source 1..25: note = Seed: YGFLNVIVHSATGFKQSSKALQRPV
YGFLNVIVHSATGWKQFSVALYRPV

SEQ ID NO: 31180 - protein, 25 aa, synthetic construct
  source 1..25: note = Seed: YGFLNVIVHSATGFKQSSKALQRPV
YGFLNVIVHSATGWKQFSWALIRPV

SEQ ID NO: 31181 - protein, 25 aa, synthetic construct
  source 1..25: note = Seed: YGFLNVIVHSATGFKQSSKALQRPV
YGFLNVIVHSATGWKQFSWALLRPV

SEQ ID NO: 31182 - protein, 25 aa, synthetic construct
  source 1..25: note = Seed: YGFLNVIVHSATGFKQSSKALQRPV
YGFLNVIVHSATGWKQFSWALWRPV

SEQ ID NO: 31183 - protein, 25 aa, synthetic construct
  source 1..25: note = Seed: YGFLNVIVHSATGFKQSSKALQRPV
YGFLNVIVHSATGWKQFSWALYRPV

SEQ ID NO: 31184 - protein, 25 aa, synthetic construct
  source 1..25: note = Seed: YGFLNVIVHSATGFKQSSKALQRPV
YGFLNVIVHSATGWKQFSYALIRPV

SEQ ID NO: 31185 - protein, 25 aa, synthetic construct
  source 1..25: note = Seed: YGFLNVIVHSATGFKQSSKALQRPV
YGFLNVIVHSATGWKQFSYALLRPV

SEQ ID NO: 31186 - protein, 25 aa, synthetic construct
  source 1..25: note = Seed: YGFLNVIVHSATGFKQSSKALQRPV
YGFLNVIVHSATGWKQFSYALMRPV

SEQ ID NO: 31187 - protein, 25 aa, synthetic construct
  source 1..25: note = Seed: YGFLNVIVHSATGFKQSSKALQRPV
YGFLNVIVHSATGWKQFSYALSRPV

SEQ ID NO: 31188 - protein, 25 aa, synthetic construct
  source 1..25: note = Seed: YGFLNVIVHSATGFKQSSKALQRPV
YGFLNVIVHSATGWKQFSYALVRPV

SEQ ID NO: 31189 - protein, 25 aa, synthetic construct
  source 1..25: note = Seed: YGFLNVIVHSATGFKQSSKALQRPV
YGFLNVIVHSATGWKQFSYALWRPV

SEQ ID NO: 31190 - protein, 25 aa, synthetic construct
  source 1..25: note = Seed: YGFLNVIVHSATGFKQSSKALQRPV
YGFLNVIVHSATGWKQFSYALYRPV

SEQ ID NO: 31191 - protein, 25 aa, synthetic construct
  source 1..25: note = Seed: YGFLNVIVHSATGFKQSSKALQRPV
YGFLNVIVHSATGWKQISAALARPV

SEQ ID NO: 31192 - protein, 25 aa, synthetic construct
  source 1..25: note = Seed: YGFLNVIVHSATGFKQSSKALQRPV
YGFLNVIVHSATGWKQISAALDRPV

SEQ ID NO: 31193 - protein, 25 aa, synthetic construct
  source 1..25: note = Seed: YGFLNVIVHSATGFKQSSKALQRPV
YGFLNVIVHSATGWKQISAALERPV

SEQ ID NO: 31194 - protein, 25 aa, synthetic construct
  source 1..25: note = Seed: YGFLNVIVHSATGFKQSSKALQRPV
YGFLNVIVHSATGWKQISAALGRPV

SEQ ID NO: 31195 - protein, 25 aa, synthetic construct
  source 1..25: note = Seed: YGFLNVIVHSATGFKQSSKALQRPV
YGFLNVIVHSATGWKQISAALHRPV

SEQ ID NO: 31196 - protein, 25 aa, synthetic construct
  source 1..25: note = Seed: YGFLNVIVHSATGFKQSSKALQRPV
YGFLNVIVHSATGWKQISAALIRPV

SEQ ID NO: 31197 - protein, 25 aa, synthetic construct
  source 1..25: note = Seed: YGFLNVIVHSATGFKQSSKALQRPV
YGFLNVIVHSATGWKQISAALLRPV

SEQ ID NO: 31198 - protein, 25 aa, synthetic construct
  source 1..25: note = Seed: YGFLNVIVHSATGFKQSSKALQRPV
YGFLNVIVHSATGWKQISAALMRPV

SEQ ID NO: 31199 - protein, 25 aa, synthetic construct
  source 1..25: note = Seed: YGFLNVIVHSATGFKQSSKALQRPV
YGFLNVIVHSATGWKQISAALNRPV

SEQ ID NO: 31200 - protein, 25 aa, synthetic construct
  source 1..25: note = Seed: YGFLNVIVHSATGFKQSSKALQRPV
YGFLNVIVHSATGWKQISAALPRPV

SEQ ID NO: 31201 - protein, 25 aa, synthetic construct
  source 1..25: note = Seed: YGFLNVIVHSATGFKQSSKALQRPV
YGFLNVIVHSATGWKQISAALQRPV

SEQ ID NO: 31202 - protein, 25 aa, synthetic construct
  source 1..25: note = Seed: YGFLNVIVHSATGFKQSSKALQRPV
YGFLNVIVHSATGWKQISAALSRPV

SEQ ID NO: 31203 - protein, 25 aa, synthetic construct
  source 1..25: note = Seed: YGFLNVIVHSATGFKQSSKALQRPV
YGFLNVIVHSATGWKQISAALTRPV

SEQ ID NO: 31204 - protein, 25 aa, synthetic construct
  source 1..25: note = Seed: YGFLNVIVHSATGFKQSSKALQRPV
YGFLNVIVHSATGWKQISAALVRPV

SEQ ID NO: 31205 - protein, 25 aa, synthetic construct
  source 1..25: note = Seed: YGFLNVIVHSATGFKQSSKALQRPV
YGFLNVIVHSATGWKQISFALFRPV

SEQ ID NO: 31206 - protein, 25 aa, synthetic construct
  source 1..25: note = Seed: YGFLNVIVHSATGFKQSSKALQRPV
YGFLNVIVHSATGWKQISFALIRPV

SEQ ID NO: 31207 - protein, 25 aa, synthetic construct
  source 1..25: note = Seed: YGFLNVIVHSATGFKQSSKALQRPV
YGFLNVIVHSATGWKQISFALLRPV

SEQ ID NO: 31208 - protein, 25 aa, synthetic construct
  source 1..25: note = Seed: YGFLNVIVHSATGFKQSSKALQRPV
YGFLNVIVHSATGWKQISFALMRPV

SEQ ID NO: 31209 - protein, 25 aa, synthetic construct
  source 1..25: note = Seed: YGFLNVIVHSATGFKQSSKALQRPV
YGFLNVIVHSATGWKQISFALVRPV

SEQ ID NO: 31210 - protein, 25 aa, synthetic construct
  source 1..25: note = Seed: YGFLNVIVHSATGFKQSSKALQRPV
YGFLNVIVHSATGWKQISFALYRPV

SEQ ID NO: 31211 - protein, 25 aa, synthetic construct
  source 1..25: note = Seed: YGFLNVIVHSATGFKQSSKALQRPV
YGFLNVIVHSATGWKQISGALARPV

SEQ ID NO: 31212 - protein, 25 aa, synthetic construct
  source 1..25: note = Seed: YGFLNVIVHSATGFKQSSKALQRPV
YGFLNVIVHSATGWKQISGALNRPV

SEQ ID NO: 31213 - protein, 25 aa, synthetic construct
  source 1..25: note = Seed: YGFLNVIVHSATGFKQSSKALQRPV
YGFLNVIVHSATGWKQISGALSRPV

SEQ ID NO: 31214 - protein, 25 aa, synthetic construct
  source 1..25: note = Seed: YGFLNVIVHSATGFKQSSKALQRPV
YGFLNVIVHSATGWKQISGALTRPV

SEQ ID NO: 31215 - protein, 25 aa, synthetic construct
  source 1..25: note = Seed: YGFLNVIVHSATGFKQSSKALQRPV
YGFLNVIVHSATGWKQISGALVRPV

SEQ ID NO: 31216 - protein, 25 aa, synthetic construct
  source 1..25: note = Seed: YGFLNVIVHSATGFKQSSKALQRPV
YGFLNVIVHSATGWKQISIALARPV

SEQ ID NO: 31217 - protein, 25 aa, synthetic construct
  source 1..25: note = Seed: YGFLNVIVHSATGFKQSSKALQRPV
YGFLNVIVHSATGWKQISIALGRPV

SEQ ID NO: 31218 - protein, 25 aa, synthetic construct
  source 1..25: note = Seed: YGFLNVIVHSATGFKQSSKALQRPV
YGFLNVIVHSATGWKQISIALHRPV

SEQ ID NO: 31219 - protein, 25 aa, synthetic construct
  source 1..25: note = Seed: YGFLNVIVHSATGFKQSSKALQRPV
YGFLNVIVHSATGWKQISIALNRPV

SEQ ID NO: 31220 - protein, 25 aa, synthetic construct
  source 1..25: note = Seed: YGFLNVIVHSATGFKQSSKALQRPV
YGFLNVIVHSATGWKQISIALRRPV

SEQ ID NO: 31221 - protein, 25 aa, synthetic construct
  source 1..25: note = Seed: YGFLNVIVHSATGFKQSSKALQRPV
YGFLNVIVHSATGWKQISIALSRPV

SEQ ID NO: 31222 - protein, 25 aa, synthetic construct
  source 1..25: note = Seed: YGFLNVIVHSATGFKQSSKALQRPV
YGFLNVIVHSATGWKQISIALTRPV

SEQ ID NO: 31223 - protein, 25 aa, synthetic construct
  source 1..25: note = Seed: YGFLNVIVHSATGFKQSSKALQRPV
YGFLNVIVHSATGWKQISKALARPV

SEQ ID NO: 31224 - protein, 25 aa, synthetic construct
  source 1..25: note = Seed: YGFLNVIVHSATGFKQSSKALQRPV
YGFLNVIVHSATGWKQISKALGRPV

SEQ ID NO: 31225 - protein, 25 aa, synthetic construct
  source 1..25: note = Seed: YGFLNVIVHSATGFKQSSKALQRPV
YGFLNVIVHSATGWKQISKALHRPV

SEQ ID NO: 31226 - protein, 25 aa, synthetic construct
  source 1..25: note = Seed: YGFLNVIVHSATGFKQSSKALQRPV
YGFLNVIVHSATGWKQISKALNRPV

SEQ ID NO: 31227 - protein, 25 aa, synthetic construct
  source 1..25: note = Seed: YGFLNVIVHSATGFKQSSKALQRPV
YGFLNVIVHSATGWKQISKALQRPV

SEQ ID NO: 31228 - protein, 25 aa, synthetic construct
  source 1..25: note = Seed: YGFLNVIVHSATGFKQSSKALQRPV
YGFLNVIVHSATGWKQISKALRRPV

SEQ ID NO: 31229 - protein, 25 aa, synthetic construct
  source 1..25: note = Seed: YGFLNVIVHSATGFKQSSKALQRPV
YGFLNVIVHSATGWKQISKALSRPV

SEQ ID NO: 31230 - protein, 25 aa, synthetic construct
  source 1..25: note = Seed: YGFLNVIVHSATGFKQSSKALQRPV
YGFLNVIVHSATGWKQISKALTRPV

SEQ ID NO: 31231 - protein, 25 aa, synthetic construct
  source 1..25: note = Seed: YGFLNVIVHSATGFKQSSKALQRPV
YGFLNVIVHSATGWKQISLALARPV

SEQ ID NO: 31232 - protein, 25 aa, synthetic construct
  source 1..25: note = Seed: YGFLNVIVHSATGFKQSSKALQRPV
YGFLNVIVHSATGWKQISLALFRPV

SEQ ID NO: 31233 - protein, 25 aa, synthetic construct
  source 1..25: note = Seed: YGFLNVIVHSATGFKQSSKALQRPV
YGFLNVIVHSATGWKQISLALNRPV

SEQ ID NO: 31234 - protein, 25 aa, synthetic construct
  source 1..25: note = Seed: YGFLNVIVHSATGFKQSSKALQRPV
YGFLNVIVHSATGWKQISLALRRPV

SEQ ID NO: 31235 - protein, 25 aa, synthetic construct
  source 1..25: note = Seed: YGFLNVIVHSATGFKQSSKALQRPV
YGFLNVIVHSATGWKQISLALSRPV

SEQ ID NO: 31236 - protein, 25 aa, synthetic construct
  source 1..25: note = Seed: YGFLNVIVHSATGFKQSSKALQRPV
YGFLNVIVHSATGWKQISMALARPV

SEQ ID NO: 31237 - protein, 25 aa, synthetic construct
  source 1..25: note = Seed: YGFLNVIVHSATGFKQSSKALQRPV
YGFLNVIVHSATGWKQISMALNRPV

SEQ ID NO: 31238 - protein, 25 aa, synthetic construct
  source 1..25: note = Seed: YGFLNVIVHSATGFKQSSKALQRPV
YGFLNVIVHSATGWKQISMALSRPV

SEQ ID NO: 31239 - protein, 25 aa, synthetic construct
  source 1..25: note = Seed: YGFLNVIVHSATGFKQSSKALQRPV
YGFLNVIVHSATGWKQISNALARPV

SEQ ID NO: 31240 - protein, 25 aa, synthetic construct
  source 1..25: note = Seed: YGFLNVIVHSATGFKQSSKALQRPV
YGFLNVIVHSATGWKQISNALGRPV

SEQ ID NO: 31241 - protein, 25 aa, synthetic construct
  source 1..25: note = Seed: YGFLNVIVHSATGFKQSSKALQRPV
YGFLNVIVHSATGWKQISNALNRPV

SEQ ID NO: 31242 - protein, 25 aa, synthetic construct
  source 1..25: note = Seed: YGFLNVIVHSATGFKQSSKALQRPV
YGFLNVIVHSATGWKQISNALSRPV

SEQ ID NO: 31243 - protein, 25 aa, synthetic construct
  source 1..25: note = Seed: YGFLNVIVHSATGFKQSSKALQRPV
YGFLNVIVHSATGWKQISNALTRPV

SEQ ID NO: 31244 - protein, 25 aa, synthetic construct
  source 1..25: note = Seed: YGFLNVIVHSATGFKQSSKALQRPV
YGFLNVIVHSATGWKQISNALVRPV

SEQ ID NO: 31245 - protein, 25 aa, synthetic construct
  source 1..25: note = Seed: YGFLNVIVHSATGFKQSSKALQRPV
YGFLNVIVHSATGWKQISPALARPV

SEQ ID NO: 31246 - protein, 25 aa, synthetic construct
  source 1..25: note = Seed: YGFLNVIVHSATGFKQSSKALQRPV
YGFLNVIVHSATGWKQISPALDRPV

SEQ ID NO: 31247 - protein, 25 aa, synthetic construct
  source 1..25: note = Seed: YGFLNVIVHSATGFKQSSKALQRPV
YGFLNVIVHSATGWKQISPALGRPV

SEQ ID NO: 31248 - protein, 25 aa, synthetic construct
  source 1..25: note = Seed: YGFLNVIVHSATGFKQSSKALQRPV
YGFLNVIVHSATGWKQISPALHRPV

SEQ ID NO: 31249 - protein, 25 aa, synthetic construct
  source 1..25: note = Seed: YGFLNVIVHSATGFKQSSKALQRPV
YGFLNVIVHSATGWKQISPALIRPV

SEQ ID NO: 31250 - protein, 25 aa, synthetic construct
  source 1..25: note = Seed: YGFLNVIVHSATGFKQSSKALQRPV
YGFLNVIVHSATGWKQISPALLRPV

SEQ ID NO: 31251 - protein, 25 aa, synthetic construct
  source 1..25: note = Seed: YGFLNVIVHSATGFKQSSKALQRPV
YGFLNVIVHSATGWKQISPALMRPV

SEQ ID NO: 31252 - protein, 25 aa, synthetic construct
  source 1..25: note = Seed: YGFLNVIVHSATGFKQSSKALQRPV
YGFLNVIVHSATGWKQISPALNRPV

SEQ ID NO: 31253 - protein, 25 aa, synthetic construct
  source 1..25: note = Seed: YGFLNVIVHSATGFKQSSKALQRPV
YGFLNVIVHSATGWKQISPALPRPV

SEQ ID NO: 31254 - protein, 25 aa, synthetic construct
  source 1..25: note = Seed: YGFLNVIVHSATGFKQSSKALQRPV
YGFLNVIVHSATGWKQISPALQRPV

SEQ ID NO: 31255 - protein, 25 aa, synthetic construct
  source 1..25: note = Seed: YGFLNVIVHSATGFKQSSKALQRPV
YGFLNVIVHSATGWKQISPALSRPV

SEQ ID NO: 31256 - protein, 25 aa, synthetic construct
  source 1..25: note = Seed: YGFLNVIVHSATGFKQSSKALQRPV
YGFLNVIVHSATGWKQISPALTRPV

SEQ ID NO: 31257 - protein, 25 aa, synthetic construct
  source 1..25: note = Seed: YGFLNVIVHSATGFKQSSKALQRPV
YGFLNVIVHSATGWKQISPALVRPV

SEQ ID NO: 31258 - protein, 25 aa, synthetic construct
  source 1..25: note = Seed: YGFLNVIVHSATGFKQSSKALQRPV
YGFLNVIVHSATGWKQISRALARPV

SEQ ID NO: 31259 - protein, 25 aa, synthetic construct
  source 1..25: note = Seed: YGFLNVIVHSATGFKQSSKALQRPV
YGFLNVIVHSATGWKQISRALGRPV

SEQ ID NO: 31260 - protein, 25 aa, synthetic construct
  source 1..25: note = Seed: YGFLNVIVHSATGFKQSSKALQRPV
YGFLNVIVHSATGWKQISRALHRPV

SEQ ID NO: 31261 - protein, 25 aa, synthetic construct
  source 1..25: note = Seed: YGFLNVIVHSATGFKQSSKALQRPV
YGFLNVIVHSATGWKQISRALKRPV

SEQ ID NO: 31262 - protein, 25 aa, synthetic construct
  source 1..25: note = Seed: YGFLNVIVHSATGFKQSSKALQRPV
YGFLNVIVHSATGWKQISRALNRPV

SEQ ID NO: 31263 - protein, 25 aa, synthetic construct
  source 1..25: note = Seed: YGFLNVIVHSATGFKQSSKALQRPV
YGFLNVIVHSATGWKQISRALQRPV

SEQ ID NO: 31264 - protein, 25 aa, synthetic construct
  source 1..25: note = Seed: YGFLNVIVHSATGFKQSSKALQRPV
YGFLNVIVHSATGWKQISRALRRPV

SEQ ID NO: 31265 - protein, 25 aa, synthetic construct
  source 1..25: note = Seed: YGFLNVIVHSATGFKQSSKALQRPV
YGFLNVIVHSATGWKQISRALSRPV

SEQ ID NO: 31266 - protein, 25 aa, synthetic construct
  source 1..25: note = Seed: YGFLNVIVHSATGFKQSSKALQRPV
YGFLNVIVHSATGWKQISRALTRPV

SEQ ID NO: 31267 - protein, 25 aa, synthetic construct
  source 1..25: note = Seed: YGFLNVIVHSATGFKQSSKALQRPV
YGFLNVIVHSATGWKQISSALARPV

SEQ ID NO: 31268 - protein, 25 aa, synthetic construct
  source 1..25: note = Seed: YGFLNVIVHSATGFKQSSKALQRPV
YGFLNVIVHSATGWKQISSALGRPV

SEQ ID NO: 31269 - protein, 25 aa, synthetic construct
  source 1..25: note = Seed: YGFLNVIVHSATGFKQSSKALQRPV
YGFLNVIVHSATGWKQISSALHRPV

SEQ ID NO: 31270 - protein, 25 aa, synthetic construct
  source 1..25: note = Seed: YGFLNVIVHSATGFKQSSKALQRPV
YGFLNVIVHSATGWKQISSALIRPV

SEQ ID NO: 31271 - protein, 25 aa, synthetic construct
  source 1..25: note = Seed: YGFLNVIVHSATGFKQSSKALQRPV
YGFLNVIVHSATGWKQISSALLRPV

SEQ ID NO: 31272 - protein, 25 aa, synthetic construct
  source 1..25: note = Seed: YGFLNVIVHSATGFKQSSKALQRPV
YGFLNVIVHSATGWKQISSALMRPV

SEQ ID NO: 31273 - protein, 25 aa, synthetic construct
  source 1..25: note = Seed: YGFLNVIVHSATGFKQSSKALQRPV
YGFLNVIVHSATGWKQISSALNRPV

SEQ ID NO: 31274 - protein, 25 aa, synthetic construct
  source 1..25: note = Seed: YGFLNVIVHSATGFKQSSKALQRPV
YGFLNVIVHSATGWKQISSALQRPV

SEQ ID NO: 31275 - protein, 25 aa, synthetic construct
  source 1..25: note = Seed: YGFLNVIVHSATGFKQSSKALQRPV
YGFLNVIVHSATGWKQISSALSRPV

SEQ ID NO: 31276 - protein, 25 aa, synthetic construct
  source 1..25: note = Seed: YGFLNVIVHSATGFKQSSKALQRPV
YGFLNVIVHSATGWKQISSALTRPV

SEQ ID NO: 31277 - protein, 25 aa, synthetic construct
  source 1..25: note = Seed: YGFLNVIVHSATGFKQSSKALQRPV
YGFLNVIVHSATGWKQISSALVRPV

SEQ ID NO: 31278 - protein, 25 aa, synthetic construct
  source 1..25: note = Seed: YGFLNVIVHSATGFKQSSKALQRPV
YGFLNVIVHSATGWKQISTALARPV

SEQ ID NO: 31279 - protein, 25 aa, synthetic construct
  source 1..25: note = Seed: YGFLNVIVHSATGFKQSSKALQRPV
YGFLNVIVHSATGWKQISTALGRPV

SEQ ID NO: 31280 - protein, 25 aa, synthetic construct
  source 1..25: note = Seed: YGFLNVIVHSATGFKQSSKALQRPV
YGFLNVIVHSATGWKQISTALHRPV

SEQ ID NO: 31281 - protein, 25 aa, synthetic construct
  source 1..25: note = Seed: YGFLNVIVHSATGFKQSSKALQRPV
YGFLNVIVHSATGWKQISTALIRPV

SEQ ID NO: 31282 - protein, 25 aa, synthetic construct
  source 1..25: note = Seed: YGFLNVIVHSATGFKQSSKALQRPV
YGFLNVIVHSATGWKQISTALLRPV

SEQ ID NO: 31283 - protein, 25 aa, synthetic construct
  source 1..25: note = Seed: YGFLNVIVHSATGFKQSSKALQRPV
YGFLNVIVHSATGWKQISTALMRPV

SEQ ID NO: 31284 - protein, 25 aa, synthetic construct
  source 1..25: note = Seed: YGFLNVIVHSATGFKQSSKALQRPV
YGFLNVIVHSATGWKQISTALNRPV

SEQ ID NO: 31285 - protein, 25 aa, synthetic construct
  source 1..25: note = Seed: YGFLNVIVHSATGFKQSSKALQRPV
YGFLNVIVHSATGWKQISTALPRPV

SEQ ID NO: 31286 - protein, 25 aa, synthetic construct
  source 1..25: note = Seed: YGFLNVIVHSATGFKQSSKALQRPV
YGFLNVIVHSATGWKQISTALQRPV

SEQ ID NO: 31287 - protein, 25 aa, synthetic construct
  source 1..25: note = Seed: YGFLNVIVHSATGFKQSSKALQRPV
YGFLNVIVHSATGWKQISTALSRPV

SEQ ID NO: 31288 - protein, 25 aa, synthetic construct
  source 1..25: note = Seed: YGFLNVIVHSATGFKQSSKALQRPV
YGFLNVIVHSATGWKQISTALTRPV

SEQ ID NO: 31289 - protein, 25 aa, synthetic construct
  source 1..25: note = Seed: YGFLNVIVHSATGFKQSSKALQRPV
YGFLNVIVHSATGWKQISTALVRPV

SEQ ID NO: 31290 - protein, 25 aa, synthetic construct
  source 1..25: note = Seed: YGFLNVIVHSATGFKQSSKALQRPV
YGFLNVIVHSATGWKQISVALARPV

SEQ ID NO: 31291 - protein, 25 aa, synthetic construct
  source 1..25: note = Seed: YGFLNVIVHSATGFKQSSKALQRPV
YGFLNVIVHSATGWKQISVALGRPV

SEQ ID NO: 31292 - protein, 25 aa, synthetic construct
  source 1..25: note = Seed: YGFLNVIVHSATGFKQSSKALQRPV
YGFLNVIVHSATGWKQISVALHRPV

SEQ ID NO: 31293 - protein, 25 aa, synthetic construct
  source 1..25: note = Seed: YGFLNVIVHSATGFKQSSKALQRPV
YGFLNVIVHSATGWKQISVALMRPV

SEQ ID NO: 31294 - protein, 25 aa, synthetic construct
  source 1..25: note = Seed: YGFLNVIVHSATGFKQSSKALQRPV
YGFLNVIVHSATGWKQISVALNRPV

SEQ ID NO: 31295 - protein, 25 aa, synthetic construct
  source 1..25: note = Seed: YGFLNVIVHSATGFKQSSKALQRPV
YGFLNVIVHSATGWKQISVALQRPV

SEQ ID NO: 31296 - protein, 25 aa, synthetic construct
  source 1..25: note = Seed: YGFLNVIVHSATGFKQSSKALQRPV
YGFLNVIVHSATGWKQISVALSRPV

SEQ ID NO: 31297 - protein, 25 aa, synthetic construct
  source 1..25: note = Seed: YGFLNVIVHSATGFKQSSKALQRPV
YGFLNVIVHSATGWKQISVALTRPV

SEQ ID NO: 31298 - protein, 25 aa, synthetic construct
  source 1..25: note = Seed: YGFLNVIVHSATGFKQSSKALQRPV
YGFLNVIVHSATGWKQISVALVRPV

SEQ ID NO: 31299 - protein, 25 aa, synthetic construct
  source 1..25: note = Seed: YGFLNVIVHSATGFKQSSKALQRPV
YGFLNVIVHSATGWKQISYALARPV

SEQ ID NO: 31300 - protein, 25 aa, synthetic construct
  source 1..25: note = Seed: YGFLNVIVHSATGFKQSSKALQRPV
YGFLNVIVHSATGWKQISYALFRPV

SEQ ID NO: 31301 - protein, 25 aa, synthetic construct
  source 1..25: note = Seed: YGFLNVIVHSATGFKQSSKALQRPV
YGFLNVIVHSATGWKQISYALLRPV

SEQ ID NO: 31302 - protein, 25 aa, synthetic construct
  source 1..25: note = Seed: YGFLNVIVHSATGFKQSSKALQRPV
YGFLNVIVHSATGWKQISYALWRPV

SEQ ID NO: 31303 - protein, 25 aa, synthetic construct
  source 1..25: note = Seed: YGFLNVIVHSATGFKQSSKALQRPV
YGFLNVIVHSATGWKQISYALYRPV

SEQ ID NO: 31304 - protein, 25 aa, synthetic construct
  source 1..25: note = Seed: YGFLNVIVHSATGFKQSSKALQRPV
YGFLNVIVHSATGWKQLSAALARPV

SEQ ID NO: 31305 - protein, 25 aa, synthetic construct
  source 1..25: note = Seed: YGFLNVIVHSATGFKQSSKALQRPV
YGFLNVIVHSATGWKQLSAALDRPV

SEQ ID NO: 31306 - protein, 25 aa, synthetic construct
  source 1..25: note = Seed: YGFLNVIVHSATGFKQSSKALQRPV
YGFLNVIVHSATGWKQLSAALERPV

SEQ ID NO: 31307 - protein, 25 aa, synthetic construct
  source 1..25: note = Seed: YGFLNVIVHSATGFKQSSKALQRPV
YGFLNVIVHSATGWKQLSAALFRPV

SEQ ID NO: 31308 - protein, 25 aa, synthetic construct
  source 1..25: note = Seed: YGFLNVIVHSATGFKQSSKALQRPV
YGFLNVIVHSATGWKQLSAALGRPV

SEQ ID NO: 31309 - protein, 25 aa, synthetic construct
  source 1..25: note = Seed: YGFLNVIVHSATGFKQSSKALQRPV
YGFLNVIVHSATGWKQLSAALHRPV

SEQ ID NO: 31310 - protein, 25 aa, synthetic construct
  source 1..25: note = Seed: YGFLNVIVHSATGFKQSSKALQRPV
YGFLNVIVHSATGWKQLSAALIRPV

SEQ ID NO: 31311 - protein, 25 aa, synthetic construct
  source 1..25: note = Seed: YGFLNVIVHSATGFKQSSKALQRPV
YGFLNVIVHSATGWKQLSAALLRPV

SEQ ID NO: 31312 - protein, 25 aa, synthetic construct
  source 1..25: note = Seed: YGFLNVIVHSATGFKQSSKALQRPV
YGFLNVIVHSATGWKQLSAALMRPV

SEQ ID NO: 31313 - protein, 25 aa, synthetic construct
  source 1..25: note = Seed: YGFLNVIVHSATGFKQSSKALQRPV
YGFLNVIVHSATGWKQLSAALNRPV

SEQ ID NO: 31314 - protein, 25 aa, synthetic construct
  source 1..25: note = Seed: YGFLNVIVHSATGFKQSSKALQRPV
YGFLNVIVHSATGWKQLSAALPRPV

SEQ ID NO: 31315 - protein, 25 aa, synthetic construct
  source 1..25: note = Seed: YGFLNVIVHSATGFKQSSKALQRPV
YGFLNVIVHSATGWKQLSAALQRPV

SEQ ID NO: 31316 - protein, 25 aa, synthetic construct
  source 1..25: note = Seed: YGFLNVIVHSATGFKQSSKALQRPV
YGFLNVIVHSATGWKQLSAALSRPV

SEQ ID NO: 31317 - protein, 25 aa, synthetic construct
  source 1..25: note = Seed: YGFLNVIVHSATGFKQSSKALQRPV
YGFLNVIVHSATGWKQLSAALTRPV

SEQ ID NO: 31318 - protein, 25 aa, synthetic construct
  source 1..25: note = Seed: YGFLNVIVHSATGFKQSSKALQRPV
YGFLNVIVHSATGWKQLSAALVRPV

SEQ ID NO: 31319 - protein, 25 aa, synthetic construct
  source 1..25: note = Seed: YGFLNVIVHSATGFKQSSKALQRPV
YGFLNVIVHSATGWKQLSFALFRPV

SEQ ID NO: 31320 - protein, 25 aa, synthetic construct
  source 1..25: note = Seed: YGFLNVIVHSATGFKQSSKALQRPV
YGFLNVIVHSATGWKQLSFALIRPV

SEQ ID NO: 31321 - protein, 25 aa, synthetic construct
  source 1..25: note = Seed: YGFLNVIVHSATGFKQSSKALQRPV
YGFLNVIVHSATGWKQLSFALLRPV

SEQ ID NO: 31322 - protein, 25 aa, synthetic construct
  source 1..25: note = Seed: YGFLNVIVHSATGFKQSSKALQRPV
YGFLNVIVHSATGWKQLSFALMRPV

SEQ ID NO: 31323 - protein, 25 aa, synthetic construct
  source 1..25: note = Seed: YGFLNVIVHSATGFKQSSKALQRPV
YGFLNVIVHSATGWKQLSFALVRPV

SEQ ID NO: 31324 - protein, 25 aa, synthetic construct
  source 1..25: note = Seed: YGFLNVIVHSATGFKQSSKALQRPV
YGFLNVIVHSATGWKQLSFALYRPV

SEQ ID NO: 31325 - protein, 25 aa, synthetic construct
  source 1..25: note = Seed: YGFLNVIVHSATGFKQSSKALQRPV
YGFLNVIVHSATGWKQLSGALARPV

SEQ ID NO: 31326 - protein, 25 aa, synthetic construct
  source 1..25: note = Seed: YGFLNVIVHSATGFKQSSKALQRPV
YGFLNVIVHSATGWKQLSGALGRPV

SEQ ID NO: 31327 - protein, 25 aa, synthetic construct
  source 1..25: note = Seed: YGFLNVIVHSATGFKQSSKALQRPV
YGFLNVIVHSATGWKQLSGALIRPV

SEQ ID NO: 31328 - protein, 25 aa, synthetic construct
  source 1..25: note = Seed: YGFLNVIVHSATGFKQSSKALQRPV
YGFLNVIVHSATGWKQLSGALLRPV

SEQ ID NO: 31329 - protein, 25 aa, synthetic construct
  source 1..25: note = Seed: YGFLNVIVHSATGFKQSSKALQRPV
YGFLNVIVHSATGWKQLSGALMRPV

SEQ ID NO: 31330 - protein, 25 aa, synthetic construct
  source 1..25: note = Seed: YGFLNVIVHSATGFKQSSKALQRPV
YGFLNVIVHSATGWKQLSGALNRPV

SEQ ID NO: 31331 - protein, 25 aa, synthetic construct
  source 1..25: note = Seed: YGFLNVIVHSATGFKQSSKALQRPV
YGFLNVIVHSATGWKQLSGALQRPV

SEQ ID NO: 31332 - protein, 25 aa, synthetic construct
  source 1..25: note = Seed: YGFLNVIVHSATGFKQSSKALQRPV
YGFLNVIVHSATGWKQLSGALSRPV

SEQ ID NO: 31333 - protein, 25 aa, synthetic construct
  source 1..25: note = Seed: YGFLNVIVHSATGFKQSSKALQRPV
YGFLNVIVHSATGWKQLSGALTRPV

SEQ ID NO: 31334 - protein, 25 aa, synthetic construct
  source 1..25: note = Seed: YGFLNVIVHSATGFKQSSKALQRPV
YGFLNVIVHSATGWKQLSGALVRPV

SEQ ID NO: 31335 - protein, 25 aa, synthetic construct
  source 1..25: note = Seed: YGFLNVIVHSATGFKQSSKALQRPV
YGFLNVIVHSATGWKQLSIALARPV

SEQ ID NO: 31336 - protein, 25 aa, synthetic construct
  source 1..25: note = Seed: YGFLNVIVHSATGFKQSSKALQRPV
YGFLNVIVHSATGWKQLSIALDRPV

SEQ ID NO: 31337 - protein, 25 aa, synthetic construct
  source 1..25: note = Seed: YGFLNVIVHSATGFKQSSKALQRPV
YGFLNVIVHSATGWKQLSIALGRPV

SEQ ID NO: 31338 - protein, 25 aa, synthetic construct
  source 1..25: note = Seed: YGFLNVIVHSATGFKQSSKALQRPV
YGFLNVIVHSATGWKQLSIALHRPV

SEQ ID NO: 31339 - protein, 25 aa, synthetic construct
  source 1..25: note = Seed: YGFLNVIVHSATGFKQSSKALQRPV
YGFLNVIVHSATGWKQLSIALMRPV

SEQ ID NO: 31340 - protein, 25 aa, synthetic construct
  source 1..25: note = Seed: YGFLNVIVHSATGFKQSSKALQRPV
YGFLNVIVHSATGWKQLSIALNRPV

SEQ ID NO: 31341 - protein, 25 aa, synthetic construct
  source 1..25: note = Seed: YGFLNVIVHSATGFKQSSKALQRPV
YGFLNVIVHSATGWKQLSIALQRPV

SEQ ID NO: 31342 - protein, 25 aa, synthetic construct
  source 1..25: note = Seed: YGFLNVIVHSATGFKQSSKALQRPV
YGFLNVIVHSATGWKQLSIALSRPV

SEQ ID NO: 31343 - protein, 25 aa, synthetic construct
  source 1..25: note = Seed: YGFLNVIVHSATGFKQSSKALQRPV
YGFLNVIVHSATGWKQLSIALTRPV

SEQ ID NO: 31344 - protein, 25 aa, synthetic construct
  source 1..25: note = Seed: YGFLNVIVHSATGFKQSSKALQRPV
YGFLNVIVHSATGWKQLSIALVRPV

SEQ ID NO: 31345 - protein, 25 aa, synthetic construct
  source 1..25: note = Seed: YGFLNVIVHSATGFKQSSKALQRPV
YGFLNVIVHSATGWKQLSKALARPV

SEQ ID NO: 31346 - protein, 25 aa, synthetic construct
  source 1..25: note = Seed: YGFLNVIVHSATGFKQSSKALQRPV
YGFLNVIVHSATGWKQLSKALGRPV

SEQ ID NO: 31347 - protein, 25 aa, synthetic construct
  source 1..25: note = Seed: YGFLNVIVHSATGFKQSSKALQRPV
YGFLNVIVHSATGWKQLSKALHRPV

SEQ ID NO: 31348 - protein, 25 aa, synthetic construct
  source 1..25: note = Seed: YGFLNVIVHSATGFKQSSKALQRPV
YGFLNVIVHSATGWKQLSKALNRPV

SEQ ID NO: 31349 - protein, 25 aa, synthetic construct
  source 1..25: note = Seed: YGFLNVIVHSATGFKQSSKALQRPV
YGFLNVIVHSATGWKQLSKALQRPV

SEQ ID NO: 31350 - protein, 25 aa, synthetic construct
  source 1..25: note = Seed: YGFLNVIVHSATGFKQSSKALQRPV
YGFLNVIVHSATGWKQLSKALSRPV

SEQ ID NO: 31351 - protein, 25 aa, synthetic construct
  source 1..25: note = Seed: YGFLNVIVHSATGFKQSSKALQRPV
YGFLNVIVHSATGWKQLSKALTRPV

SEQ ID NO: 31352 - protein, 25 aa, synthetic construct
  source 1..25: note = Seed: YGFLNVIVHSATGFKQSSKALQRPV
YGFLNVIVHSATGWKQLSLALARPV

SEQ ID NO: 31353 - protein, 25 aa, synthetic construct
  source 1..25: note = Seed: YGFLNVIVHSATGFKQSSKALQRPV
YGFLNVIVHSATGWKQLSLALFRPV

SEQ ID NO: 31354 - protein, 25 aa, synthetic construct
  source 1..25: note = Seed: YGFLNVIVHSATGFKQSSKALQRPV
YGFLNVIVHSATGWKQLSLALNRPV

SEQ ID NO: 31355 - protein, 25 aa, synthetic construct
  source 1..25: note = Seed: YGFLNVIVHSATGFKQSSKALQRPV
YGFLNVIVHSATGWKQLSLALSRPV

SEQ ID NO: 31356 - protein, 25 aa, synthetic construct
  source 1..25: note = Seed: YGFLNVIVHSATGFKQSSKALQRPV
YGFLNVIVHSATGWKQLSMALARPV

SEQ ID NO: 31357 - protein, 25 aa, synthetic construct
  source 1..25: note = Seed: YGFLNVIVHSATGFKQSSKALQRPV
YGFLNVIVHSATGWKQLSMALNRPV

SEQ ID NO: 31358 - protein, 25 aa, synthetic construct
  source 1..25: note = Seed: YGFLNVIVHSATGFKQSSKALQRPV
YGFLNVIVHSATGWKQLSMALSRPV

SEQ ID NO: 31359 - protein, 25 aa, synthetic construct
  source 1..25: note = Seed: YGFLNVIVHSATGFKQSSKALQRPV
YGFLNVIVHSATGWKQLSMALTRPV

SEQ ID NO: 31360 - protein, 25 aa, synthetic construct
  source 1..25: note = Seed: YGFLNVIVHSATGFKQSSKALQRPV
YGFLNVIVHSATGWKQLSNALARPV

SEQ ID NO: 31361 - protein, 25 aa, synthetic construct
  source 1..25: note = Seed: YGFLNVIVHSATGFKQSSKALQRPV
YGFLNVIVHSATGWKQLSNALGRPV

SEQ ID NO: 31362 - protein, 25 aa, synthetic construct
  source 1..25: note = Seed: YGFLNVIVHSATGFKQSSKALQRPV
YGFLNVIVHSATGWKQLSNALIRPV

SEQ ID NO: 31363 - protein, 25 aa, synthetic construct
  source 1..25: note = Seed: YGFLNVIVHSATGFKQSSKALQRPV
YGFLNVIVHSATGWKQLSNALMRPV

SEQ ID NO: 31364 - protein, 25 aa, synthetic construct
  source 1..25: note = Seed: YGFLNVIVHSATGFKQSSKALQRPV
YGFLNVIVHSATGWKQLSNALNRPV

SEQ ID NO: 31365 - protein, 25 aa, synthetic construct
  source 1..25: note = Seed: YGFLNVIVHSATGFKQSSKALQRPV
YGFLNVIVHSATGWKQLSNALSRPV

SEQ ID NO: 31366 - protein, 25 aa, synthetic construct
  source 1..25: note = Seed: YGFLNVIVHSATGFKQSSKALQRPV
YGFLNVIVHSATGWKQLSNALTRPV

SEQ ID NO: 31367 - protein, 25 aa, synthetic construct
  source 1..25: note = Seed: YGFLNVIVHSATGFKQSSKALQRPV
YGFLNVIVHSATGWKQLSNALVRPV

SEQ ID NO: 31368 - protein, 25 aa, synthetic construct
  source 1..25: note = Seed: YGFLNVIVHSATGFKQSSKALQRPV
YGFLNVIVHSATGWKQLSPALARPV

SEQ ID NO: 31369 - protein, 25 aa, synthetic construct
  source 1..25: note = Seed: YGFLNVIVHSATGFKQSSKALQRPV
YGFLNVIVHSATGWKQLSPALCRPV

SEQ ID NO: 31370 - protein, 25 aa, synthetic construct
  source 1..25: note = Seed: YGFLNVIVHSATGFKQSSKALQRPV
YGFLNVIVHSATGWKQLSPALDRPV

SEQ ID NO: 31371 - protein, 25 aa, synthetic construct
  source 1..25: note = Seed: YGFLNVIVHSATGFKQSSKALQRPV
YGFLNVIVHSATGWKQLSPALERPV

SEQ ID NO: 31372 - protein, 25 aa, synthetic construct
  source 1..25: note = Seed: YGFLNVIVHSATGFKQSSKALQRPV
YGFLNVIVHSATGWKQLSPALGRPV

SEQ ID NO: 31373 - protein, 25 aa, synthetic construct
  source 1..25: note = Seed: YGFLNVIVHSATGFKQSSKALQRPV
YGFLNVIVHSATGWKQLSPALHRPV

SEQ ID NO: 31374 - protein, 25 aa, synthetic construct
  source 1..25: note = Seed: YGFLNVIVHSATGFKQSSKALQRPV
YGFLNVIVHSATGWKQLSPALIRPV

SEQ ID NO: 31375 - protein, 25 aa, synthetic construct
  source 1..25: note = Seed: YGFLNVIVHSATGFKQSSKALQRPV
YGFLNVIVHSATGWKQLSPALLRPV

SEQ ID NO: 31376 - protein, 25 aa, synthetic construct
  source 1..25: note = Seed: YGFLNVIVHSATGFKQSSKALQRPV
YGFLNVIVHSATGWKQLSPALMRPV

SEQ ID NO: 31377 - protein, 25 aa, synthetic construct
  source 1..25: note = Seed: YGFLNVIVHSATGFKQSSKALQRPV
YGFLNVIVHSATGWKQLSPALNRPV

SEQ ID NO: 31378 - protein, 25 aa, synthetic construct
  source 1..25: note = Seed: YGFLNVIVHSATGFKQSSKALQRPV
YGFLNVIVHSATGWKQLSPALPRPV

SEQ ID NO: 31379 - protein, 25 aa, synthetic construct
  source 1..25: note = Seed: YGFLNVIVHSATGFKQSSKALQRPV
YGFLNVIVHSATGWKQLSPALQRPV

SEQ ID NO: 31380 - protein, 25 aa, synthetic construct
  source 1..25: note = Seed: YGFLNVIVHSATGFKQSSKALQRPV
YGFLNVIVHSATGWKQLSPALSRPV

SEQ ID NO: 31381 - protein, 25 aa, synthetic construct
  source 1..25: note = Seed: YGFLNVIVHSATGFKQSSKALQRPV
YGFLNVIVHSATGWKQLSPALTRPV

SEQ ID NO: 31382 - protein, 25 aa, synthetic construct
  source 1..25: note = Seed: YGFLNVIVHSATGFKQSSKALQRPV
YGFLNVIVHSATGWKQLSPALVRPV

SEQ ID NO: 31383 - protein, 25 aa, synthetic construct
  source 1..25: note = Seed: YGFLNVIVHSATGFKQSSKALQRPV
YGFLNVIVHSATGWKQLSRALARPV

SEQ ID NO: 31384 - protein, 25 aa, synthetic construct
  source 1..25: note = Seed: YGFLNVIVHSATGFKQSSKALQRPV
YGFLNVIVHSATGWKQLSRALGRPV

SEQ ID NO: 31385 - protein, 25 aa, synthetic construct
  source 1..25: note = Seed: YGFLNVIVHSATGFKQSSKALQRPV
YGFLNVIVHSATGWKQLSRALHRPV

SEQ ID NO: 31386 - protein, 25 aa, synthetic construct
  source 1..25: note = Seed: YGFLNVIVHSATGFKQSSKALQRPV
YGFLNVIVHSATGWKQLSRALKRPV

SEQ ID NO: 31387 - protein, 25 aa, synthetic construct
  source 1..25: note = Seed: YGFLNVIVHSATGFKQSSKALQRPV
YGFLNVIVHSATGWKQLSRALNRPV

SEQ ID NO: 31388 - protein, 25 aa, synthetic construct
  source 1..25: note = Seed: YGFLNVIVHSATGFKQSSKALQRPV
YGFLNVIVHSATGWKQLSRALPRPV

SEQ ID NO: 31389 - protein, 25 aa, synthetic construct
  source 1..25: note = Seed: YGFLNVIVHSATGFKQSSKALQRPV
YGFLNVIVHSATGWKQLSRALQRPV

SEQ ID NO: 31390 - protein, 25 aa, synthetic construct
  source 1..25: note = Seed: YGFLNVIVHSATGFKQSSKALQRPV
YGFLNVIVHSATGWKQLSRALRRPV

SEQ ID NO: 31391 - protein, 25 aa, synthetic construct
  source 1..25: note = Seed: YGFLNVIVHSATGFKQSSKALQRPV
YGFLNVIVHSATGWKQLSRALSRPV

SEQ ID NO: 31392 - protein, 25 aa, synthetic construct
  source 1..25: note = Seed: YGFLNVIVHSATGFKQSSKALQRPV
YGFLNVIVHSATGWKQLSRALTRPV

SEQ ID NO: 31393 - protein, 25 aa, synthetic construct
  source 1..25: note = Seed: YGFLNVIVHSATGFKQSSKALQRPV
YGFLNVIVHSATGWKQLSRALVRPV

SEQ ID NO: 31394 - protein, 25 aa, synthetic construct
  source 1..25: note = Seed: YGFLNVIVHSATGFKQSSKALQRPV
YGFLNVIVHSATGWKQLSSALARPV

SEQ ID NO: 31395 - protein, 25 aa, synthetic construct
  source 1..25: note = Seed: YGFLNVIVHSATGFKQSSKALQRPV
YGFLNVIVHSATGWKQLSSALDRPV

SEQ ID NO: 31396 - protein, 25 aa, synthetic construct
  source 1..25: note = Seed: YGFLNVIVHSATGFKQSSKALQRPV
YGFLNVIVHSATGWKQLSSALERPV

SEQ ID NO: 31397 - protein, 25 aa, synthetic construct
  source 1..25: note = Seed: YGFLNVIVHSATGFKQSSKALQRPV
YGFLNVIVHSATGWKQLSSALGRPV

SEQ ID NO: 31398 - protein, 25 aa, synthetic construct
  source 1..25: note = Seed: YGFLNVIVHSATGFKQSSKALQRPV
YGFLNVIVHSATGWKQLSSALHRPV

SEQ ID NO: 31399 - protein, 25 aa, synthetic construct
  source 1..25: note = Seed: YGFLNVIVHSATGFKQSSKALQRPV
YGFLNVIVHSATGWKQLSSALIRPV

SEQ ID NO: 31400 - protein, 25 aa, synthetic construct
  source 1..25: note = Seed: YGFLNVIVHSATGFKQSSKALQRPV
YGFLNVIVHSATGWKQLSSALLRPV

SEQ ID NO: 31401 - protein, 25 aa, synthetic construct
  source 1..25: note = Seed: YGFLNVIVHSATGFKQSSKALQRPV
YGFLNVIVHSATGWKQLSSALMRPV

SEQ ID NO: 31402 - protein, 25 aa, synthetic construct
  source 1..25: note = Seed: YGFLNVIVHSATGFKQSSKALQRPV
YGFLNVIVHSATGWKQLSSALNRPV

SEQ ID NO: 31403 - protein, 25 aa, synthetic construct
  source 1..25: note = Seed: YGFLNVIVHSATGFKQSSKALQRPV
YGFLNVIVHSATGWKQLSSALPRPV

SEQ ID NO: 31404 - protein, 25 aa, synthetic construct
  source 1..25: note = Seed: YGFLNVIVHSATGFKQSSKALQRPV
YGFLNVIVHSATGWKQLSSALQRPV

SEQ ID NO: 31405 - protein, 25 aa, synthetic construct
  source 1..25: note = Seed: YGFLNVIVHSATGFKQSSKALQRPV
YGFLNVIVHSATGWKQLSSALSRPV

SEQ ID NO: 31406 - protein, 25 aa, synthetic construct
  source 1..25: note = Seed: YGFLNVIVHSATGFKQSSKALQRPV
YGFLNVIVHSATGWKQLSSALTRPV

SEQ ID NO: 31407 - protein, 25 aa, synthetic construct
  source 1..25: note = Seed: YGFLNVIVHSATGFKQSSKALQRPV
YGFLNVIVHSATGWKQLSSALVRPV

SEQ ID NO: 31408 - protein, 25 aa, synthetic construct
  source 1..25: note = Seed: YGFLNVIVHSATGFKQSSKALQRPV
YGFLNVIVHSATGWKQLSTALARPV

SEQ ID NO: 31409 - protein, 25 aa, synthetic construct
  source 1..25: note = Seed: YGFLNVIVHSATGFKQSSKALQRPV
YGFLNVIVHSATGWKQLSTALDRPV

SEQ ID NO: 31410 - protein, 25 aa, synthetic construct
  source 1..25: note = Seed: YGFLNVIVHSATGFKQSSKALQRPV
YGFLNVIVHSATGWKQLSTALERPV

SEQ ID NO: 31411 - protein, 25 aa, synthetic construct
  source 1..25: note = Seed: YGFLNVIVHSATGFKQSSKALQRPV
YGFLNVIVHSATGWKQLSTALGRPV

SEQ ID NO: 31412 - protein, 25 aa, synthetic construct
  source 1..25: note = Seed: YGFLNVIVHSATGFKQSSKALQRPV
YGFLNVIVHSATGWKQLSTALHRPV

SEQ ID NO: 31413 - protein, 25 aa, synthetic construct
  source 1..25: note = Seed: YGFLNVIVHSATGFKQSSKALQRPV
YGFLNVIVHSATGWKQLSTALIRPV

SEQ ID NO: 31414 - protein, 25 aa, synthetic construct
  source 1..25: note = Seed: YGFLNVIVHSATGFKQSSKALQRPV
YGFLNVIVHSATGWKQLSTALLRPV

SEQ ID NO: 31415 - protein, 25 aa, synthetic construct
  source 1..25: note = Seed: YGFLNVIVHSATGFKQSSKALQRPV
YGFLNVIVHSATGWKQLSTALMRPV

SEQ ID NO: 31416 - protein, 25 aa, synthetic construct
  source 1..25: note = Seed: YGFLNVIVHSATGFKQSSKALQRPV
YGFLNVIVHSATGWKQLSTALNRPV

SEQ ID NO: 31417 - protein, 25 aa, synthetic construct
  source 1..25: note = Seed: YGFLNVIVHSATGFKQSSKALQRPV
YGFLNVIVHSATGWKQLSTALPRPV

SEQ ID NO: 31418 - protein, 25 aa, synthetic construct
  source 1..25: note = Seed: YGFLNVIVHSATGFKQSSKALQRPV
YGFLNVIVHSATGWKQLSTALQRPV

SEQ ID NO: 31419 - protein, 25 aa, synthetic construct
  source 1..25: note = Seed: YGFLNVIVHSATGFKQSSKALQRPV
YGFLNVIVHSATGWKQLSTALSRPV

SEQ ID NO: 31420 - protein, 25 aa, synthetic construct
  source 1..25: note = Seed: YGFLNVIVHSATGFKQSSKALQRPV
YGFLNVIVHSATGWKQLSTALTRPV

SEQ ID NO: 31421 - protein, 25 aa, synthetic construct
  source 1..25: note = Seed: YGFLNVIVHSATGFKQSSKALQRPV
YGFLNVIVHSATGWKQLSTALVRPV

SEQ ID NO: 31422 - protein, 25 aa, synthetic construct
  source 1..25: note = Seed: YGFLNVIVHSATGFKQSSKALQRPV
YGFLNVIVHSATGWKQLSVALARPV

SEQ ID NO: 31423 - protein, 25 aa, synthetic construct
  source 1..25: note = Seed: YGFLNVIVHSATGFKQSSKALQRPV
YGFLNVIVHSATGWKQLSVALDRPV

SEQ ID NO: 31424 - protein, 25 aa, synthetic construct
  source 1..25: note = Seed: YGFLNVIVHSATGFKQSSKALQRPV
YGFLNVIVHSATGWKQLSVALERPV

SEQ ID NO: 31425 - protein, 25 aa, synthetic construct
  source 1..25: note = Seed: YGFLNVIVHSATGFKQSSKALQRPV
YGFLNVIVHSATGWKQLSVALGRPV

SEQ ID NO: 31426 - protein, 25 aa, synthetic construct
  source 1..25: note = Seed: YGFLNVIVHSATGFKQSSKALQRPV
YGFLNVIVHSATGWKQLSVALHRPV

SEQ ID NO: 31427 - protein, 25 aa, synthetic construct
  source 1..25: note = Seed: YGFLNVIVHSATGFKQSSKALQRPV
YGFLNVIVHSATGWKQLSVALIRPV

SEQ ID NO: 31428 - protein, 25 aa, synthetic construct
  source 1..25: note = Seed: YGFLNVIVHSATGFKQSSKALQRPV
YGFLNVIVHSATGWKQLSVALLRPV

SEQ ID NO: 31429 - protein, 25 aa, synthetic construct
  source 1..25: note = Seed: YGFLNVIVHSATGFKQSSKALQRPV
YGFLNVIVHSATGWKQLSVALMRPV

SEQ ID NO: 31430 - protein, 25 aa, synthetic construct
  source 1..25: note = Seed: YGFLNVIVHSATGFKQSSKALQRPV
YGFLNVIVHSATGWKQLSVALNRPV

SEQ ID NO: 31431 - protein, 25 aa, synthetic construct
  source 1..25: note = Seed: YGFLNVIVHSATGFKQSSKALQRPV
YGFLNVIVHSATGWKQLSVALPRPV

SEQ ID NO: 31432 - protein, 25 aa, synthetic construct
  source 1..25: note = Seed: YGFLNVIVHSATGFKQSSKALQRPV
YGFLNVIVHSATGWKQLSVALQRPV

SEQ ID NO: 31433 - protein, 25 aa, synthetic construct
  source 1..25: note = Seed: YGFLNVIVHSATGFKQSSKALQRPV
YGFLNVIVHSATGWKQLSVALSRPV

SEQ ID NO: 31434 - protein, 25 aa, synthetic construct
  source 1..25: note = Seed: YGFLNVIVHSATGFKQSSKALQRPV
YGFLNVIVHSATGWKQLSVALTRPV

SEQ ID NO: 31435 - protein, 25 aa, synthetic construct
  source 1..25: note = Seed: YGFLNVIVHSATGFKQSSKALQRPV
YGFLNVIVHSATGWKQLSVALVRPV

SEQ ID NO: 31436 - protein, 25 aa, synthetic construct
  source 1..25: note = Seed: YGFLNVIVHSATGFKQSSKALQRPV
YGFLNVIVHSATGWKQLSWALFRPV

SEQ ID NO: 31437 - protein, 25 aa, synthetic construct
  source 1..25: note = Seed: YGFLNVIVHSATGFKQSSKALQRPV
YGFLNVIVHSATGWKQLSYALLRPV

SEQ ID NO: 31438 - protein, 25 aa, synthetic construct
  source 1..25: note = Seed: YGFLNVIVHSATGFKQSSKALQRPV
YGFLNVIVHSATGWKQLSYALWRPV

SEQ ID NO: 31439 - protein, 25 aa, synthetic construct
  source 1..25: note = Seed: YGFLNVIVHSATGFKQSSKALQRPV
YGFLNVIVHSATGWKQLSYALYRPV

SEQ ID NO: 31440 - protein, 25 aa, synthetic construct
  source 1..25: note = Seed: YGFLNVIVHSATGFKQSSKALQRPV
YGFLNVIVHSATGWKQMSAALARPV

SEQ ID NO: 31441 - protein, 25 aa, synthetic construct
  source 1..25: note = Seed: YGFLNVIVHSATGFKQSSKALQRPV
YGFLNVIVHSATGWKQMSAALDRPV

SEQ ID NO: 31442 - protein, 25 aa, synthetic construct
  source 1..25: note = Seed: YGFLNVIVHSATGFKQSSKALQRPV
YGFLNVIVHSATGWKQMSAALERPV

SEQ ID NO: 31443 - protein, 25 aa, synthetic construct
  source 1..25: note = Seed: YGFLNVIVHSATGFKQSSKALQRPV
YGFLNVIVHSATGWKQMSAALGRPV

SEQ ID NO: 31444 - protein, 25 aa, synthetic construct
  source 1..25: note = Seed: YGFLNVIVHSATGFKQSSKALQRPV
YGFLNVIVHSATGWKQMSAALHRPV

SEQ ID NO: 31445 - protein, 25 aa, synthetic construct
  source 1..25: note = Seed: YGFLNVIVHSATGFKQSSKALQRPV
YGFLNVIVHSATGWKQMSAALIRPV

SEQ ID NO: 31446 - protein, 25 aa, synthetic construct
  source 1..25: note = Seed: YGFLNVIVHSATGFKQSSKALQRPV
YGFLNVIVHSATGWKQMSAALLRPV

SEQ ID NO: 31447 - protein, 25 aa, synthetic construct
  source 1..25: note = Seed: YGFLNVIVHSATGFKQSSKALQRPV
YGFLNVIVHSATGWKQMSAALMRPV

SEQ ID NO: 31448 - protein, 25 aa, synthetic construct
  source 1..25: note = Seed: YGFLNVIVHSATGFKQSSKALQRPV
YGFLNVIVHSATGWKQMSAALNRPV

SEQ ID NO: 31449 - protein, 25 aa, synthetic construct
  source 1..25: note = Seed: YGFLNVIVHSATGFKQSSKALQRPV
YGFLNVIVHSATGWKQMSAALPRPV

SEQ ID NO: 31450 - protein, 25 aa, synthetic construct
  source 1..25: note = Seed: YGFLNVIVHSATGFKQSSKALQRPV
YGFLNVIVHSATGWKQMSAALQRPV

SEQ ID NO: 31451 - protein, 25 aa, synthetic construct
  source 1..25: note = Seed: YGFLNVIVHSATGFKQSSKALQRPV
YGFLNVIVHSATGWKQMSAALSRPV

SEQ ID NO: 31452 - protein, 25 aa, synthetic construct
  source 1..25: note = Seed: YGFLNVIVHSATGFKQSSKALQRPV
YGFLNVIVHSATGWKQMSAALTRPV

SEQ ID NO: 31453 - protein, 25 aa, synthetic construct
  source 1..25: note = Seed: YGFLNVIVHSATGFKQSSKALQRPV
YGFLNVIVHSATGWKQMSAALVRPV

SEQ ID NO: 31454 - protein, 25 aa, synthetic construct
  source 1..25: note = Seed: YGFLNVIVHSATGFKQSSKALQRPV
YGFLNVIVHSATGWKQMSFALFRPV

SEQ ID NO: 31455 - protein, 25 aa, synthetic construct
  source 1..25: note = Seed: YGFLNVIVHSATGFKQSSKALQRPV
YGFLNVIVHSATGWKQMSFALLRPV

SEQ ID NO: 31456 - protein, 25 aa, synthetic construct
  source 1..25: note = Seed: YGFLNVIVHSATGFKQSSKALQRPV
YGFLNVIVHSATGWKQMSGALARPV

SEQ ID NO: 31457 - protein, 25 aa, synthetic construct
  source 1..25: note = Seed: YGFLNVIVHSATGFKQSSKALQRPV
YGFLNVIVHSATGWKQMSGALGRPV

SEQ ID NO: 31458 - protein, 25 aa, synthetic construct
  source 1..25: note = Seed: YGFLNVIVHSATGFKQSSKALQRPV
YGFLNVIVHSATGWKQMSGALHRPV

SEQ ID NO: 31459 - protein, 25 aa, synthetic construct
  source 1..25: note = Seed: YGFLNVIVHSATGFKQSSKALQRPV
YGFLNVIVHSATGWKQMSGALIRPV

SEQ ID NO: 31460 - protein, 25 aa, synthetic construct
  source 1..25: note = Seed: YGFLNVIVHSATGFKQSSKALQRPV
YGFLNVIVHSATGWKQMSGALLRPV

SEQ ID NO: 31461 - protein, 25 aa, synthetic construct
  source 1..25: note = Seed: YGFLNVIVHSATGFKQSSKALQRPV
YGFLNVIVHSATGWKQMSGALMRPV

SEQ ID NO: 31462 - protein, 25 aa, synthetic construct
  source 1..25: note = Seed: YGFLNVIVHSATGFKQSSKALQRPV
YGFLNVIVHSATGWKQMSGALNRPV

SEQ ID NO: 31463 - protein, 25 aa, synthetic construct
  source 1..25: note = Seed: YGFLNVIVHSATGFKQSSKALQRPV
YGFLNVIVHSATGWKQMSGALQRPV

SEQ ID NO: 31464 - protein, 25 aa, synthetic construct
  source 1..25: note = Seed: YGFLNVIVHSATGFKQSSKALQRPV
YGFLNVIVHSATGWKQMSGALSRPV

SEQ ID NO: 31465 - protein, 25 aa, synthetic construct
  source 1..25: note = Seed: YGFLNVIVHSATGFKQSSKALQRPV
YGFLNVIVHSATGWKQMSGALTRPV

SEQ ID NO: 31466 - protein, 25 aa, synthetic construct
  source 1..25: note = Seed: YGFLNVIVHSATGFKQSSKALQRPV
YGFLNVIVHSATGWKQMSGALVRPV

SEQ ID NO: 31467 - protein, 25 aa, synthetic construct
  source 1..25: note = Seed: YGFLNVIVHSATGFKQSSKALQRPV
YGFLNVIVHSATGWKQMSIALARPV

SEQ ID NO: 31468 - protein, 25 aa, synthetic construct
  source 1..25: note = Seed: YGFLNVIVHSATGFKQSSKALQRPV
YGFLNVIVHSATGWKQMSIALDRPV

SEQ ID NO: 31469 - protein, 25 aa, synthetic construct
  source 1..25: note = Seed: YGFLNVIVHSATGFKQSSKALQRPV
YGFLNVIVHSATGWKQMSIALERPV

SEQ ID NO: 31470 - protein, 25 aa, synthetic construct
  source 1..25: note = Seed: YGFLNVIVHSATGFKQSSKALQRPV
YGFLNVIVHSATGWKQMSIALGRPV

SEQ ID NO: 31471 - protein, 25 aa, synthetic construct
  source 1..25: note = Seed: YGFLNVIVHSATGFKQSSKALQRPV
YGFLNVIVHSATGWKQMSIALHRPV

SEQ ID NO: 31472 - protein, 25 aa, synthetic construct
  source 1..25: note = Seed: YGFLNVIVHSATGFKQSSKALQRPV
YGFLNVIVHSATGWKQMSIALIRPV

SEQ ID NO: 31473 - protein, 25 aa, synthetic construct
  source 1..25: note = Seed: YGFLNVIVHSATGFKQSSKALQRPV
YGFLNVIVHSATGWKQMSIALLRPV

SEQ ID NO: 31474 - protein, 25 aa, synthetic construct
  source 1..25: note = Seed: YGFLNVIVHSATGFKQSSKALQRPV
YGFLNVIVHSATGWKQMSIALMRPV

SEQ ID NO: 31475 - protein, 25 aa, synthetic construct
  source 1..25: note = Seed: YGFLNVIVHSATGFKQSSKALQRPV
YGFLNVIVHSATGWKQMSIALNRPV

SEQ ID NO: 31476 - protein, 25 aa, synthetic construct
  source 1..25: note = Seed: YGFLNVIVHSATGFKQSSKALQRPV
YGFLNVIVHSATGWKQMSIALPRPV

SEQ ID NO: 31477 - protein, 25 aa, synthetic construct
  source 1..25: note = Seed: YGFLNVIVHSATGFKQSSKALQRPV
YGFLNVIVHSATGWKQMSIALQRPV

SEQ ID NO: 31478 - protein, 25 aa, synthetic construct
  source 1..25: note = Seed: YGFLNVIVHSATGFKQSSKALQRPV
YGFLNVIVHSATGWKQMSIALSRPV

SEQ ID NO: 31479 - protein, 25 aa, synthetic construct
  source 1..25: note = Seed: YGFLNVIVHSATGFKQSSKALQRPV
YGFLNVIVHSATGWKQMSIALTRPV

SEQ ID NO: 31480 - protein, 25 aa, synthetic construct
  source 1..25: note = Seed: YGFLNVIVHSATGFKQSSKALQRPV
YGFLNVIVHSATGWKQMSIALVRPV

SEQ ID NO: 31481 - protein, 25 aa, synthetic construct
  source 1..25: note = Seed: YGFLNVIVHSATGFKQSSKALQRPV
YGFLNVIVHSATGWKQMSKALARPV

SEQ ID NO: 31482 - protein, 25 aa, synthetic construct
  source 1..25: note = Seed: YGFLNVIVHSATGFKQSSKALQRPV
YGFLNVIVHSATGWKQMSKALGRPV

SEQ ID NO: 31483 - protein, 25 aa, synthetic construct
  source 1..25: note = Seed: YGFLNVIVHSATGFKQSSKALQRPV
YGFLNVIVHSATGWKQMSKALHRPV

SEQ ID NO: 31484 - protein, 25 aa, synthetic construct
  source 1..25: note = Seed: YGFLNVIVHSATGFKQSSKALQRPV
YGFLNVIVHSATGWKQMSKALMRPV

SEQ ID NO: 31485 - protein, 25 aa, synthetic construct
  source 1..25: note = Seed: YGFLNVIVHSATGFKQSSKALQRPV
YGFLNVIVHSATGWKQMSKALNRPV

SEQ ID NO: 31486 - protein, 25 aa, synthetic construct
  source 1..25: note = Seed: YGFLNVIVHSATGFKQSSKALQRPV
YGFLNVIVHSATGWKQMSKALQRPV

SEQ ID NO: 31487 - protein, 25 aa, synthetic construct
  source 1..25: note = Seed: YGFLNVIVHSATGFKQSSKALQRPV
YGFLNVIVHSATGWKQMSKALRRPV

SEQ ID NO: 31488 - protein, 25 aa, synthetic construct
  source 1..25: note = Seed: YGFLNVIVHSATGFKQSSKALQRPV
YGFLNVIVHSATGWKQMSKALSRPV

SEQ ID NO: 31489 - protein, 25 aa, synthetic construct
  source 1..25: note = Seed: YGFLNVIVHSATGFKQSSKALQRPV
YGFLNVIVHSATGWKQMSKALTRPV

SEQ ID NO: 31490 - protein, 25 aa, synthetic construct
  source 1..25: note = Seed: YGFLNVIVHSATGFKQSSKALQRPV
YGFLNVIVHSATGWKQMSKALVRPV

SEQ ID NO: 31491 - protein, 25 aa, synthetic construct
  source 1..25: note = Seed: YGFLNVIVHSATGFKQSSKALQRPV
YGFLNVIVHSATGWKQMSLALARPV

SEQ ID NO: 31492 - protein, 25 aa, synthetic construct
  source 1..25: note = Seed: YGFLNVIVHSATGFKQSSKALQRPV
YGFLNVIVHSATGWKQMSLALFRPV

SEQ ID NO: 31493 - protein, 25 aa, synthetic construct
  source 1..25: note = Seed: YGFLNVIVHSATGFKQSSKALQRPV
YGFLNVIVHSATGWKQMSLALHRPV

SEQ ID NO: 31494 - protein, 25 aa, synthetic construct
  source 1..25: note = Seed: YGFLNVIVHSATGFKQSSKALQRPV
YGFLNVIVHSATGWKQMSLALNRPV

SEQ ID NO: 31495 - protein, 25 aa, synthetic construct
  source 1..25: note = Seed: YGFLNVIVHSATGFKQSSKALQRPV
YGFLNVIVHSATGWKQMSLALSRPV

SEQ ID NO: 31496 - protein, 25 aa, synthetic construct
  source 1..25: note = Seed: YGFLNVIVHSATGFKQSSKALQRPV
YGFLNVIVHSATGWKQMSLALTRPV

SEQ ID NO: 31497 - protein, 25 aa, synthetic construct
  source 1..25: note = Seed: YGFLNVIVHSATGFKQSSKALQRPV
YGFLNVIVHSATGWKQMSMALARPV

SEQ ID NO: 31498 - protein, 25 aa, synthetic construct
  source 1..25: note = Seed: YGFLNVIVHSATGFKQSSKALQRPV
YGFLNVIVHSATGWKQMSMALHRPV

SEQ ID NO: 31499 - protein, 25 aa, synthetic construct
  source 1..25: note = Seed: YGFLNVIVHSATGFKQSSKALQRPV
YGFLNVIVHSATGWKQMSMALNRPV

SEQ ID NO: 31500 - protein, 25 aa, synthetic construct
  source 1..25: note = Seed: YGFLNVIVHSATGFKQSSKALQRPV
YGFLNVIVHSATGWKQMSMALSRPV

SEQ ID NO: 31501 - protein, 25 aa, synthetic construct
  source 1..25: note = Seed: YGFLNVIVHSATGFKQSSKALQRPV
YGFLNVIVHSATGWKQMSMALTRPV

SEQ ID NO: 31502 - protein, 25 aa, synthetic construct
  source 1..25: note = Seed: YGFLNVIVHSATGFKQSSKALQRPV
YGFLNVIVHSATGWKQMSMALVRPV

SEQ ID NO: 31503 - protein, 25 aa, synthetic construct
  source 1..25: note = Seed: YGFLNVIVHSATGFKQSSKALQRPV
YGFLNVIVHSATGWKQMSNALARPV

SEQ ID NO: 31504 - protein, 25 aa, synthetic construct
  source 1..25: note = Seed: YGFLNVIVHSATGFKQSSKALQRPV
YGFLNVIVHSATGWKQMSNALGRPV

SEQ ID NO: 31505 - protein, 25 aa, synthetic construct
  source 1..25: note = Seed: YGFLNVIVHSATGFKQSSKALQRPV
YGFLNVIVHSATGWKQMSNALIRPV

SEQ ID NO: 31506 - protein, 25 aa, synthetic construct
  source 1..25: note = Seed: YGFLNVIVHSATGFKQSSKALQRPV
YGFLNVIVHSATGWKQMSNALLRPV

SEQ ID NO: 31507 - protein, 25 aa, synthetic construct
  source 1..25: note = Seed: YGFLNVIVHSATGFKQSSKALQRPV
YGFLNVIVHSATGWKQMSNALMRPV

SEQ ID NO: 31508 - protein, 25 aa, synthetic construct
  source 1..25: note = Seed: YGFLNVIVHSATGFKQSSKALQRPV
YGFLNVIVHSATGWKQMSNALNRPV

SEQ ID NO: 31509 - protein, 25 aa, synthetic construct
  source 1..25: note = Seed: YGFLNVIVHSATGFKQSSKALQRPV
YGFLNVIVHSATGWKQMSNALQRPV

SEQ ID NO: 31510 - protein, 25 aa, synthetic construct
  source 1..25: note = Seed: YGFLNVIVHSATGFKQSSKALQRPV
YGFLNVIVHSATGWKQMSNALSRPV

SEQ ID NO: 31511 - protein, 25 aa, synthetic construct
  source 1..25: note = Seed: YGFLNVIVHSATGFKQSSKALQRPV
YGFLNVIVHSATGWKQMSNALTRPV

SEQ ID NO: 31512 - protein, 25 aa, synthetic construct
  source 1..25: note = Seed: YGFLNVIVHSATGFKQSSKALQRPV
YGFLNVIVHSATGWKQMSNALVRPV

SEQ ID NO: 31513 - protein, 25 aa, synthetic construct
  source 1..25: note = Seed: YGFLNVIVHSATGFKQSSKALQRPV
YGFLNVIVHSATGWKQMSPALARPV

SEQ ID NO: 31514 - protein, 25 aa, synthetic construct
  source 1..25: note = Seed: YGFLNVIVHSATGFKQSSKALQRPV
YGFLNVIVHSATGWKQMSPALCRPV

SEQ ID NO: 31515 - protein, 25 aa, synthetic construct
  source 1..25: note = Seed: YGFLNVIVHSATGFKQSSKALQRPV
YGFLNVIVHSATGWKQMSPALDRPV

SEQ ID NO: 31516 - protein, 25 aa, synthetic construct
  source 1..25: note = Seed: YGFLNVIVHSATGFKQSSKALQRPV
YGFLNVIVHSATGWKQMSPALERPV

SEQ ID NO: 31517 - protein, 25 aa, synthetic construct
  source 1..25: note = Seed: YGFLNVIVHSATGFKQSSKALQRPV
YGFLNVIVHSATGWKQMSPALGRPV

SEQ ID NO: 31518 - protein, 25 aa, synthetic construct
  source 1..25: note = Seed: YGFLNVIVHSATGFKQSSKALQRPV
YGFLNVIVHSATGWKQMSPALHRPV

SEQ ID NO: 31519 - protein, 25 aa, synthetic construct
  source 1..25: note = Seed: YGFLNVIVHSATGFKQSSKALQRPV
YGFLNVIVHSATGWKQMSPALIRPV

SEQ ID NO: 31520 - protein, 25 aa, synthetic construct
  source 1..25: note = Seed: YGFLNVIVHSATGFKQSSKALQRPV
YGFLNVIVHSATGWKQMSPALLRPV

SEQ ID NO: 31521 - protein, 25 aa, synthetic construct
  source 1..25: note = Seed: YGFLNVIVHSATGFKQSSKALQRPV
YGFLNVIVHSATGWKQMSPALMRPV

SEQ ID NO: 31522 - protein, 25 aa, synthetic construct
  source 1..25: note = Seed: YGFLNVIVHSATGFKQSSKALQRPV
YGFLNVIVHSATGWKQMSPALNRPV

SEQ ID NO: 31523 - protein, 25 aa, synthetic construct
  source 1..25: note = Seed: YGFLNVIVHSATGFKQSSKALQRPV
YGFLNVIVHSATGWKQMSPALPRPV

SEQ ID NO: 31524 - protein, 25 aa, synthetic construct
  source 1..25: note = Seed: YGFLNVIVHSATGFKQSSKALQRPV
YGFLNVIVHSATGWKQMSPALQRPV

SEQ ID NO: 31525 - protein, 25 aa, synthetic construct
  source 1..25: note = Seed: YGFLNVIVHSATGFKQSSKALQRPV
YGFLNVIVHSATGWKQMSPALSRPV

SEQ ID NO: 31526 - protein, 25 aa, synthetic construct
  source 1..25: note = Seed: YGFLNVIVHSATGFKQSSKALQRPV
YGFLNVIVHSATGWKQMSPALTRPV

SEQ ID NO: 31527 - protein, 25 aa, synthetic construct
  source 1..25: note = Seed: YGFLNVIVHSATGFKQSSKALQRPV
YGFLNVIVHSATGWKQMSPALVRPV

SEQ ID NO: 31528 - protein, 25 aa, synthetic construct
  source 1..25: note = Seed: YGFLNVIVHSATGFKQSSKALQRPV
YGFLNVIVHSATGWKQMSRALARPV

SEQ ID NO: 31529 - protein, 25 aa, synthetic construct
  source 1..25: note = Seed: YGFLNVIVHSATGFKQSSKALQRPV
YGFLNVIVHSATGWKQMSRALGRPV

SEQ ID NO: 31530 - protein, 25 aa, synthetic construct
  source 1..25: note = Seed: YGFLNVIVHSATGFKQSSKALQRPV
YGFLNVIVHSATGWKQMSRALHRPV

SEQ ID NO: 31531 - protein, 25 aa, synthetic construct
  source 1..25: note = Seed: YGFLNVIVHSATGFKQSSKALQRPV
YGFLNVIVHSATGWKQMSRALKRPV

SEQ ID NO: 31532 - protein, 25 aa, synthetic construct
  source 1..25: note = Seed: YGFLNVIVHSATGFKQSSKALQRPV
YGFLNVIVHSATGWKQMSRALMRPV

SEQ ID NO: 31533 - protein, 25 aa, synthetic construct
  source 1..25: note = Seed: YGFLNVIVHSATGFKQSSKALQRPV
YGFLNVIVHSATGWKQMSRALNRPV

SEQ ID NO: 31534 - protein, 25 aa, synthetic construct
  source 1..25: note = Seed: YGFLNVIVHSATGFKQSSKALQRPV
YGFLNVIVHSATGWKQMSRALPRPV

SEQ ID NO: 31535 - protein, 25 aa, synthetic construct
  source 1..25: note = Seed: YGFLNVIVHSATGFKQSSKALQRPV
YGFLNVIVHSATGWKQMSRALQRPV

SEQ ID NO: 31536 - protein, 25 aa, synthetic construct
  source 1..25: note = Seed: YGFLNVIVHSATGFKQSSKALQRPV
YGFLNVIVHSATGWKQMSRALRRPV

SEQ ID NO: 31537 - protein, 25 aa, synthetic construct
  source 1..25: note = Seed: YGFLNVIVHSATGFKQSSKALQRPV
YGFLNVIVHSATGWKQMSRALSRPV

SEQ ID NO: 31538 - protein, 25 aa, synthetic construct
  source 1..25: note = Seed: YGFLNVIVHSATGFKQSSKALQRPV
YGFLNVIVHSATGWKQMSRALTRPV

SEQ ID NO: 31539 - protein, 25 aa, synthetic construct
  source 1..25: note = Seed: YGFLNVIVHSATGFKQSSKALQRPV
YGFLNVIVHSATGWKQMSRALVRPV

SEQ ID NO: 31540 - protein, 25 aa, synthetic construct
  source 1..25: note = Seed: YGFLNVIVHSATGFKQSSKALQRPV
YGFLNVIVHSATGWKQMSSALARPV

SEQ ID NO: 31541 - protein, 25 aa, synthetic construct
  source 1..25: note = Seed: YGFLNVIVHSATGFKQSSKALQRPV
YGFLNVIVHSATGWKQMSSALDRPV

SEQ ID NO: 31542 - protein, 25 aa, synthetic construct
  source 1..25: note = Seed: YGFLNVIVHSATGFKQSSKALQRPV
YGFLNVIVHSATGWKQMSSALERPV

SEQ ID NO: 31543 - protein, 25 aa, synthetic construct
  source 1..25: note = Seed: YGFLNVIVHSATGFKQSSKALQRPV
YGFLNVIVHSATGWKQMSSALGRPV

SEQ ID NO: 31544 - protein, 25 aa, synthetic construct
  source 1..25: note = Seed: YGFLNVIVHSATGFKQSSKALQRPV
YGFLNVIVHSATGWKQMSSALHRPV

SEQ ID NO: 31545 - protein, 25 aa, synthetic construct
  source 1..25: note = Seed: YGFLNVIVHSATGFKQSSKALQRPV
YGFLNVIVHSATGWKQMSSALIRPV

SEQ ID NO: 31546 - protein, 25 aa, synthetic construct
  source 1..25: note = Seed: YGFLNVIVHSATGFKQSSKALQRPV
YGFLNVIVHSATGWKQMSSALLRPV

SEQ ID NO: 31547 - protein, 25 aa, synthetic construct
  source 1..25: note = Seed: YGFLNVIVHSATGFKQSSKALQRPV
YGFLNVIVHSATGWKQMSSALMRPV

SEQ ID NO: 31548 - protein, 25 aa, synthetic construct
  source 1..25: note = Seed: YGFLNVIVHSATGFKQSSKALQRPV
YGFLNVIVHSATGWKQMSSALNRPV

SEQ ID NO: 31549 - protein, 25 aa, synthetic construct
  source 1..25: note = Seed: YGFLNVIVHSATGFKQSSKALQRPV
YGFLNVIVHSATGWKQMSSALPRPV

SEQ ID NO: 31550 - protein, 25 aa, synthetic construct
  source 1..25: note = Seed: YGFLNVIVHSATGFKQSSKALQRPV
YGFLNVIVHSATGWKQMSSALQRPV

SEQ ID NO: 31551 - protein, 25 aa, synthetic construct
  source 1..25: note = Seed: YGFLNVIVHSATGFKQSSKALQRPV
YGFLNVIVHSATGWKQMSSALSRPV

SEQ ID NO: 31552 - protein, 25 aa, synthetic construct
  source 1..25: note = Seed: YGFLNVIVHSATGFKQSSKALQRPV
YGFLNVIVHSATGWKQMSSALTRPV

SEQ ID NO: 31553 - protein, 25 aa, synthetic construct
  source 1..25: note = Seed: YGFLNVIVHSATGFKQSSKALQRPV
YGFLNVIVHSATGWKQMSSALVRPV

SEQ ID NO: 31554 - protein, 25 aa, synthetic construct
  source 1..25: note = Seed: YGFLNVIVHSATGFKQSSKALQRPV
YGFLNVIVHSATGWKQMSTALARPV

SEQ ID NO: 31555 - protein, 25 aa, synthetic construct
  source 1..25: note = Seed: YGFLNVIVHSATGFKQSSKALQRPV
YGFLNVIVHSATGWKQMSTALCRPV

SEQ ID NO: 31556 - protein, 25 aa, synthetic construct
  source 1..25: note = Seed: YGFLNVIVHSATGFKQSSKALQRPV
YGFLNVIVHSATGWKQMSTALDRPV

SEQ ID NO: 31557 - protein, 25 aa, synthetic construct
  source 1..25: note = Seed: YGFLNVIVHSATGFKQSSKALQRPV
YGFLNVIVHSATGWKQMSTALERPV

SEQ ID NO: 31558 - protein, 25 aa, synthetic construct
  source 1..25: note = Seed: YGFLNVIVHSATGFKQSSKALQRPV
YGFLNVIVHSATGWKQMSTALGRPV

SEQ ID NO: 31559 - protein, 25 aa, synthetic construct
  source 1..25: note = Seed: YGFLNVIVHSATGFKQSSKALQRPV
YGFLNVIVHSATGWKQMSTALHRPV

SEQ ID NO: 31560 - protein, 25 aa, synthetic construct
  source 1..25: note = Seed: YGFLNVIVHSATGFKQSSKALQRPV
YGFLNVIVHSATGWKQMSTALIRPV

SEQ ID NO: 31561 - protein, 25 aa, synthetic construct
  source 1..25: note = Seed: YGFLNVIVHSATGFKQSSKALQRPV
YGFLNVIVHSATGWKQMSTALLRPV

SEQ ID NO: 31562 - protein, 25 aa, synthetic construct
  source 1..25: note = Seed: YGFLNVIVHSATGFKQSSKALQRPV
YGFLNVIVHSATGWKQMSTALMRPV

SEQ ID NO: 31563 - protein, 25 aa, synthetic construct
  source 1..25: note = Seed: YGFLNVIVHSATGFKQSSKALQRPV
YGFLNVIVHSATGWKQMSTALNRPV

SEQ ID NO: 31564 - protein, 25 aa, synthetic construct
  source 1..25: note = Seed: YGFLNVIVHSATGFKQSSKALQRPV
YGFLNVIVHSATGWKQMSTALPRPV

SEQ ID NO: 31565 - protein, 25 aa, synthetic construct
  source 1..25: note = Seed: YGFLNVIVHSATGFKQSSKALQRPV
YGFLNVIVHSATGWKQMSTALQRPV

SEQ ID NO: 31566 - protein, 25 aa, synthetic construct
  source 1..25: note = Seed: YGFLNVIVHSATGFKQSSKALQRPV
YGFLNVIVHSATGWKQMSTALSRPV

SEQ ID NO: 31567 - protein, 25 aa, synthetic construct
  source 1..25: note = Seed: YGFLNVIVHSATGFKQSSKALQRPV
YGFLNVIVHSATGWKQMSTALTRPV

SEQ ID NO: 31568 - protein, 25 aa, synthetic construct
  source 1..25: note = Seed: YGFLNVIVHSATGFKQSSKALQRPV
YGFLNVIVHSATGWKQMSTALVRPV

SEQ ID NO: 31569 - protein, 25 aa, synthetic construct
  source 1..25: note = Seed: YGFLNVIVHSATGFKQSSKALQRPV
YGFLNVIVHSATGWKQMSVALARPV

SEQ ID NO: 31570 - protein, 25 aa, synthetic construct
  source 1..25: note = Seed: YGFLNVIVHSATGFKQSSKALQRPV
YGFLNVIVHSATGWKQMSVALDRPV

SEQ ID NO: 31571 - protein, 25 aa, synthetic construct
  source 1..25: note = Seed: YGFLNVIVHSATGFKQSSKALQRPV
YGFLNVIVHSATGWKQMSVALERPV

SEQ ID NO: 31572 - protein, 25 aa, synthetic construct
  source 1..25: note = Seed: YGFLNVIVHSATGFKQSSKALQRPV
YGFLNVIVHSATGWKQMSVALGRPV

SEQ ID NO: 31573 - protein, 25 aa, synthetic construct
  source 1..25: note = Seed: YGFLNVIVHSATGFKQSSKALQRPV
YGFLNVIVHSATGWKQMSVALHRPV

SEQ ID NO: 31574 - protein, 25 aa, synthetic construct
  source 1..25: note = Seed: YGFLNVIVHSATGFKQSSKALQRPV
YGFLNVIVHSATGWKQMSVALIRPV

SEQ ID NO: 31575 - protein, 25 aa, synthetic construct
  source 1..25: note = Seed: YGFLNVIVHSATGFKQSSKALQRPV
YGFLNVIVHSATGWKQMSVALLRPV

SEQ ID NO: 31576 - protein, 25 aa, synthetic construct
  source 1..25: note = Seed: YGFLNVIVHSATGFKQSSKALQRPV
YGFLNVIVHSATGWKQMSVALMRPV

SEQ ID NO: 31577 - protein, 25 aa, synthetic construct
  source 1..25: note = Seed: YGFLNVIVHSATGFKQSSKALQRPV
YGFLNVIVHSATGWKQMSVALNRPV

SEQ ID NO: 31578 - protein, 25 aa, synthetic construct
  source 1..25: note = Seed: YGFLNVIVHSATGFKQSSKALQRPV
YGFLNVIVHSATGWKQMSVALPRPV

SEQ ID NO: 31579 - protein, 25 aa, synthetic construct
  source 1..25: note = Seed: YGFLNVIVHSATGFKQSSKALQRPV
YGFLNVIVHSATGWKQMSVALQRPV

SEQ ID NO: 31580 - protein, 25 aa, synthetic construct
  source 1..25: note = Seed: YGFLNVIVHSATGFKQSSKALQRPV
YGFLNVIVHSATGWKQMSVALSRPV

SEQ ID NO: 31581 - protein, 25 aa, synthetic construct
  source 1..25: note = Seed: YGFLNVIVHSATGFKQSSKALQRPV
YGFLNVIVHSATGWKQMSVALTRPV

SEQ ID NO: 31582 - protein, 25 aa, synthetic construct
  source 1..25: note = Seed: YGFLNVIVHSATGFKQSSKALQRPV
YGFLNVIVHSATGWKQMSVALVRPV

SEQ ID NO: 31583 - protein, 25 aa, synthetic construct
  source 1..25: note = Seed: YGFLNVIVHSATGFKQSSKALQRPV
YGFLNVIVHSATGWKQMSWALFRPV

SEQ ID NO: 31584 - protein, 25 aa, synthetic construct
  source 1..25: note = Seed: YGFLNVIVHSATGFKQSSKALQRPV
YGFLNVIVHSATGWKQMSYALFRPV

SEQ ID NO: 31585 - protein, 25 aa, synthetic construct
  source 1..25: note = Seed: YGFLNVIVHSATGFKQSSKALQRPV
YGFLNVIVHSATGWKQNSAALFRPV

SEQ ID NO: 31586 - protein, 25 aa, synthetic construct
  source 1..25: note = Seed: YGFLNVIVHSATGFKQSSKALQRPV
YGFLNVIVHSATGWKQNSAALIRPV

SEQ ID NO: 31587 - protein, 25 aa, synthetic construct
  source 1..25: note = Seed: YGFLNVIVHSATGFKQSSKALQRPV
YGFLNVIVHSATGWKQNSAALLRPV

SEQ ID NO: 31588 - protein, 25 aa, synthetic construct
  source 1..25: note = Seed: YGFLNVIVHSATGFKQSSKALQRPV
YGFLNVIVHSATGWKQNSAALMRPV

SEQ ID NO: 31589 - protein, 25 aa, synthetic construct
  source 1..25: note = Seed: YGFLNVIVHSATGFKQSSKALQRPV
YGFLNVIVHSATGWKQNSAALVRPV

SEQ ID NO: 31590 - protein, 25 aa, synthetic construct
  source 1..25: note = Seed: YGFLNVIVHSATGFKQSSKALQRPV
YGFLNVIVHSATGWKQNSAALYRPV

SEQ ID NO: 31591 - protein, 25 aa, synthetic construct
  source 1..25: note = Seed: YGFLNVIVHSATGFKQSSKALQRPV
YGFLNVIVHSATGWKQNSGALIRPV

SEQ ID NO: 31592 - protein, 25 aa, synthetic construct
  source 1..25: note = Seed: YGFLNVIVHSATGFKQSSKALQRPV
YGFLNVIVHSATGWKQNSIALIRPV

SEQ ID NO: 31593 - protein, 25 aa, synthetic construct
  source 1..25: note = Seed: YGFLNVIVHSATGFKQSSKALQRPV
YGFLNVIVHSATGWKQNSIALVRPV

SEQ ID NO: 31594 - protein, 25 aa, synthetic construct
  source 1..25: note = Seed: YGFLNVIVHSATGFKQSSKALQRPV
YGFLNVIVHSATGWKQNSIALYRPV

SEQ ID NO: 31595 - protein, 25 aa, synthetic construct
  source 1..25: note = Seed: YGFLNVIVHSATGFKQSSKALQRPV
YGFLNVIVHSATGWKQNSNALFRPV

SEQ ID NO: 31596 - protein, 25 aa, synthetic construct
  source 1..25: note = Seed: YGFLNVIVHSATGFKQSSKALQRPV
YGFLNVIVHSATGWKQNSNALIRPV

SEQ ID NO: 31597 - protein, 25 aa, synthetic construct
  source 1..25: note = Seed: YGFLNVIVHSATGFKQSSKALQRPV
YGFLNVIVHSATGWKQNSNALLRPV

SEQ ID NO: 31598 - protein, 25 aa, synthetic construct
  source 1..25: note = Seed: YGFLNVIVHSATGFKQSSKALQRPV
YGFLNVIVHSATGWKQNSNALVRPV

SEQ ID NO: 31599 - protein, 25 aa, synthetic construct
  source 1..25: note = Seed: YGFLNVIVHSATGFKQSSKALQRPV
YGFLNVIVHSATGWKQNSNALYRPV

SEQ ID NO: 31600 - protein, 25 aa, synthetic construct
  source 1..25: note = Seed: YGFLNVIVHSATGFKQSSKALQRPV
YGFLNVIVHSATGWKQNSPALIRPV

SEQ ID NO: 31601 - protein, 25 aa, synthetic construct
  source 1..25: note = Seed: YGFLNVIVHSATGFKQSSKALQRPV
YGFLNVIVHSATGWKQNSPALVRPV

SEQ ID NO: 31602 - protein, 25 aa, synthetic construct
  source 1..25: note = Seed: YGFLNVIVHSATGFKQSSKALQRPV
YGFLNVIVHSATGWKQNSSALFRPV

SEQ ID NO: 31603 - protein, 25 aa, synthetic construct
  source 1..25: note = Seed: YGFLNVIVHSATGFKQSSKALQRPV
YGFLNVIVHSATGWKQNSSALIRPV

SEQ ID NO: 31604 - protein, 25 aa, synthetic construct
  source 1..25: note = Seed: YGFLNVIVHSATGFKQSSKALQRPV
YGFLNVIVHSATGWKQNSSALLRPV

SEQ ID NO: 31605 - protein, 25 aa, synthetic construct
  source 1..25: note = Seed: YGFLNVIVHSATGFKQSSKALQRPV
YGFLNVIVHSATGWKQNSSALVRPV

SEQ ID NO: 31606 - protein, 25 aa, synthetic construct
  source 1..25: note = Seed: YGFLNVIVHSATGFKQSSKALQRPV
YGFLNVIVHSATGWKQNSSALYRPV

SEQ ID NO: 31607 - protein, 25 aa, synthetic construct
  source 1..25: note = Seed: YGFLNVIVHSATGFKQSSKALQRPV
YGFLNVIVHSATGWKQNSTALIRPV

SEQ ID NO: 31608 - protein, 25 aa, synthetic construct
  source 1..25: note = Seed: YGFLNVIVHSATGFKQSSKALQRPV
YGFLNVIVHSATGWKQNSTALVRPV

SEQ ID NO: 31609 - protein, 25 aa, synthetic construct
  source 1..25: note = Seed: YGFLNVIVHSATGFKQSSKALQRPV
YGFLNVIVHSATGWKQNSTALYRPV

SEQ ID NO: 31610 - protein, 25 aa, synthetic construct
  source 1..25: note = Seed: YGFLNVIVHSATGFKQSSKALQRPV
YGFLNVIVHSATGWKQNSVALIRPV

SEQ ID NO: 31611 - protein, 25 aa, synthetic construct
  source 1..25: note = Seed: YGFLNVIVHSATGFKQSSKALQRPV
YGFLNVIVHSATGWKQNSVALLRPV

SEQ ID NO: 31612 - protein, 25 aa, synthetic construct
  source 1..25: note = Seed: YGFLNVIVHSATGFKQSSKALQRPV
YGFLNVIVHSATGWKQNSVALVRPV

SEQ ID NO: 31613 - protein, 25 aa, synthetic construct
  source 1..25: note = Seed: YGFLNVIVHSATGFKQSSKALQRPV
YGFLNVIVHSATGWKQNSVALYRPV

SEQ ID NO: 31614 - protein, 25 aa, synthetic construct
  source 1..25: note = Seed: YGFLNVIVHSATGFKQSSKALQRPV
YGFLNVIVHSATGWKQQSAALARPV

SEQ ID NO: 31615 - protein, 25 aa, synthetic construct
  source 1..25: note = Seed: YGFLNVIVHSATGFKQSSKALQRPV
YGFLNVIVHSATGWKQQSAALNRPV

SEQ ID NO: 31616 - protein, 25 aa, synthetic construct
  source 1..25: note = Seed: YGFLNVIVHSATGFKQSSKALQRPV
YGFLNVIVHSATGWKQQSAALQRPV

SEQ ID NO: 31617 - protein, 25 aa, synthetic construct
  source 1..25: note = Seed: YGFLNVIVHSATGFKQSSKALQRPV
YGFLNVIVHSATGWKQQSAALSRPV

SEQ ID NO: 31618 - protein, 25 aa, synthetic construct
  source 1..25: note = Seed: YGFLNVIVHSATGFKQSSKALQRPV
YGFLNVIVHSATGWKQQSAALTRPV

SEQ ID NO: 31619 - protein, 25 aa, synthetic construct
  source 1..25: note = Seed: YGFLNVIVHSATGFKQSSKALQRPV
YGFLNVIVHSATGWKQQSIALARPV

SEQ ID NO: 31620 - protein, 25 aa, synthetic construct
  source 1..25: note = Seed: YGFLNVIVHSATGFKQSSKALQRPV
YGFLNVIVHSATGWKQQSIALNRPV

SEQ ID NO: 31621 - protein, 25 aa, synthetic construct
  source 1..25: note = Seed: YGFLNVIVHSATGFKQSSKALQRPV
YGFLNVIVHSATGWKQQSIALSRPV

SEQ ID NO: 31622 - protein, 25 aa, synthetic construct
  source 1..25: note = Seed: YGFLNVIVHSATGFKQSSKALQRPV
YGFLNVIVHSATGWKQQSPALARPV

SEQ ID NO: 31623 - protein, 25 aa, synthetic construct
  source 1..25: note = Seed: YGFLNVIVHSATGFKQSSKALQRPV
YGFLNVIVHSATGWKQQSPALNRPV

SEQ ID NO: 31624 - protein, 25 aa, synthetic construct
  source 1..25: note = Seed: YGFLNVIVHSATGFKQSSKALQRPV
YGFLNVIVHSATGWKQQSPALSRPV

SEQ ID NO: 31625 - protein, 25 aa, synthetic construct
  source 1..25: note = Seed: YGFLNVIVHSATGFKQSSKALQRPV
YGFLNVIVHSATGWKQQSSALARPV

SEQ ID NO: 31626 - protein, 25 aa, synthetic construct
  source 1..25: note = Seed: YGFLNVIVHSATGFKQSSKALQRPV
YGFLNVIVHSATGWKQQSSALNRPV

SEQ ID NO: 31627 - protein, 25 aa, synthetic construct
  source 1..25: note = Seed: YGFLNVIVHSATGFKQSSKALQRPV
YGFLNVIVHSATGWKQQSSALSRPV

SEQ ID NO: 31628 - protein, 25 aa, synthetic construct
  source 1..25: note = Seed: YGFLNVIVHSATGFKQSSKALQRPV
YGFLNVIVHSATGWKQQSTALARPV

SEQ ID NO: 31629 - protein, 25 aa, synthetic construct
  source 1..25: note = Seed: YGFLNVIVHSATGFKQSSKALQRPV
YGFLNVIVHSATGWKQQSTALNRPV

SEQ ID NO: 31630 - protein, 25 aa, synthetic construct
  source 1..25: note = Seed: YGFLNVIVHSATGFKQSSKALQRPV
YGFLNVIVHSATGWKQQSTALSRPV

SEQ ID NO: 31631 - protein, 25 aa, synthetic construct
  source 1..25: note = Seed: YGFLNVIVHSATGFKQSSKALQRPV
YGFLNVIVHSATGWKQQSVALARPV

SEQ ID NO: 31632 - protein, 25 aa, synthetic construct
  source 1..25: note = Seed: YGFLNVIVHSATGFKQSSKALQRPV
YGFLNVIVHSATGWKQQSVALNRPV

SEQ ID NO: 31633 - protein, 25 aa, synthetic construct
  source 1..25: note = Seed: YGFLNVIVHSATGFKQSSKALQRPV
YGFLNVIVHSATGWKQQSVALSRPV

SEQ ID NO: 31634 - protein, 25 aa, synthetic construct
  source 1..25: note = Seed: YGFLNVIVHSATGFKQSSKALQRPV
YGFLNVIVHSATGWKQSSAALARPV

SEQ ID NO: 31635 - protein, 25 aa, synthetic construct
  source 1..25: note = Seed: YGFLNVIVHSATGFKQSSKALQRPV
YGFLNVIVHSATGWKQSSAALNRPV

SEQ ID NO: 31636 - protein, 25 aa, synthetic construct
  source 1..25: note = Seed: YGFLNVIVHSATGFKQSSKALQRPV
YGFLNVIVHSATGWKQSSAALSRPV

SEQ ID NO: 31637 - protein, 25 aa, synthetic construct
  source 1..25: note = Seed: YGFLNVIVHSATGFKQSSKALQRPV
YGFLNVIVHSATGWKQSSFALLRPV

SEQ ID NO: 31638 - protein, 25 aa, synthetic construct
  source 1..25: note = Seed: YGFLNVIVHSATGFKQSSKALQRPV
YGFLNVIVHSATGWKQSSPALARPV

SEQ ID NO: 31639 - protein, 25 aa, synthetic construct
  source 1..25: note = Seed: YGFLNVIVHSATGFKQSSKALQRPV
YGFLNVIVHSATGWKQSSPALNRPV

SEQ ID NO: 31640 - protein, 25 aa, synthetic construct
  source 1..25: note = Seed: YGFLNVIVHSATGFKQSSKALQRPV
YGFLNVIVHSATGWKQSSTALARPV

SEQ ID NO: 31641 - protein, 25 aa, synthetic construct
  source 1..25: note = Seed: YGFLNVIVHSATGFKQSSKALQRPV
YGFLNVIVHSATGWKQSSTALNRPV

SEQ ID NO: 31642 - protein, 25 aa, synthetic construct
  source 1..25: note = Seed: YGFLNVIVHSATGFKQSSKALQRPV
YGFLNVIVHSATGWKQSSVALARPV

SEQ ID NO: 31643 - protein, 25 aa, synthetic construct
  source 1..25: note = Seed: YGFLNVIVHSATGFKQSSKALQRPV
YGFLNVIVHSATGWKQSSVALNRPV

SEQ ID NO: 31644 - protein, 25 aa, synthetic construct
  source 1..25: note = Seed: YGFLNVIVHSATGFKQSSKALQRPV
YGFLNVIVHSATGWKQSSVALSRPV

SEQ ID NO: 31645 - protein, 25 aa, synthetic construct
  source 1..25: note = Seed: YGFLNVIVHSATGFKQSSKALQRPV
YGFLNVIVHSATGWKQTSAALARPV

SEQ ID NO: 31646 - protein, 25 aa, synthetic construct
  source 1..25: note = Seed: YGFLNVIVHSATGFKQSSKALQRPV
YGFLNVIVHSATGWKQTSAALNRPV

SEQ ID NO: 31647 - protein, 25 aa, synthetic construct
  source 1..25: note = Seed: YGFLNVIVHSATGFKQSSKALQRPV
YGFLNVIVHSATGWKQTSAALSRPV

SEQ ID NO: 31648 - protein, 25 aa, synthetic construct
  source 1..25: note = Seed: YGFLNVIVHSATGFKQSSKALQRPV
YGFLNVIVHSATGWKQTSFALFRPV

SEQ ID NO: 31649 - protein, 25 aa, synthetic construct
  source 1..25: note = Seed: YGFLNVIVHSATGFKQSSKALQRPV
YGFLNVIVHSATGWKQTSFALIRPV

SEQ ID NO: 31650 - protein, 25 aa, synthetic construct
  source 1..25: note = Seed: YGFLNVIVHSATGFKQSSKALQRPV
YGFLNVIVHSATGWKQTSFALLRPV

SEQ ID NO: 31651 - protein, 25 aa, synthetic construct
  source 1..25: note = Seed: YGFLNVIVHSATGFKQSSKALQRPV
YGFLNVIVHSATGWKQTSFALVRPV

SEQ ID NO: 31652 - protein, 25 aa, synthetic construct
  source 1..25: note = Seed: YGFLNVIVHSATGFKQSSKALQRPV
YGFLNVIVHSATGWKQTSPALARPV

SEQ ID NO: 31653 - protein, 25 aa, synthetic construct
  source 1..25: note = Seed: YGFLNVIVHSATGFKQSSKALQRPV
YGFLNVIVHSATGWKQVSAALARPV

SEQ ID NO: 31654 - protein, 25 aa, synthetic construct
  source 1..25: note = Seed: YGFLNVIVHSATGFKQSSKALQRPV
YGFLNVIVHSATGWKQVSAALGRPV

SEQ ID NO: 31655 - protein, 25 aa, synthetic construct
  source 1..25: note = Seed: YGFLNVIVHSATGFKQSSKALQRPV
YGFLNVIVHSATGWKQVSAALHRPV

SEQ ID NO: 31656 - protein, 25 aa, synthetic construct
  source 1..25: note = Seed: YGFLNVIVHSATGFKQSSKALQRPV
YGFLNVIVHSATGWKQVSAALMRPV

SEQ ID NO: 31657 - protein, 25 aa, synthetic construct
  source 1..25: note = Seed: YGFLNVIVHSATGFKQSSKALQRPV
YGFLNVIVHSATGWKQVSAALNRPV

SEQ ID NO: 31658 - protein, 25 aa, synthetic construct
  source 1..25: note = Seed: YGFLNVIVHSATGFKQSSKALQRPV
YGFLNVIVHSATGWKQVSAALQRPV

SEQ ID NO: 31659 - protein, 25 aa, synthetic construct
  source 1..25: note = Seed: YGFLNVIVHSATGFKQSSKALQRPV
YGFLNVIVHSATGWKQVSAALSRPV

SEQ ID NO: 31660 - protein, 25 aa, synthetic construct
  source 1..25: note = Seed: YGFLNVIVHSATGFKQSSKALQRPV
YGFLNVIVHSATGWKQVSAALTRPV

SEQ ID NO: 31661 - protein, 25 aa, synthetic construct
  source 1..25: note = Seed: YGFLNVIVHSATGFKQSSKALQRPV
YGFLNVIVHSATGWKQVSAALVRPV

SEQ ID NO: 31662 - protein, 25 aa, synthetic construct
  source 1..25: note = Seed: YGFLNVIVHSATGFKQSSKALQRPV
YGFLNVIVHSATGWKQVSFALFRPV

SEQ ID NO: 31663 - protein, 25 aa, synthetic construct
  source 1..25: note = Seed: YGFLNVIVHSATGFKQSSKALQRPV
YGFLNVIVHSATGWKQVSFALIRPV

SEQ ID NO: 31664 - protein, 25 aa, synthetic construct
  source 1..25: note = Seed: YGFLNVIVHSATGFKQSSKALQRPV
YGFLNVIVHSATGWKQVSFALLRPV

SEQ ID NO: 31665 - protein, 25 aa, synthetic construct
  source 1..25: note = Seed: YGFLNVIVHSATGFKQSSKALQRPV
YGFLNVIVHSATGWKQVSFALVRPV

SEQ ID NO: 31666 - protein, 25 aa, synthetic construct
  source 1..25: note = Seed: YGFLNVIVHSATGFKQSSKALQRPV
YGFLNVIVHSATGWKQVSFALYRPV

SEQ ID NO: 31667 - protein, 25 aa, synthetic construct
  source 1..25: note = Seed: YGFLNVIVHSATGFKQSSKALQRPV
YGFLNVIVHSATGWKQVSGALARPV

SEQ ID NO: 31668 - protein, 25 aa, synthetic construct
  source 1..25: note = Seed: YGFLNVIVHSATGFKQSSKALQRPV
YGFLNVIVHSATGWKQVSGALNRPV

SEQ ID NO: 31669 - protein, 25 aa, synthetic construct
  source 1..25: note = Seed: YGFLNVIVHSATGFKQSSKALQRPV
YGFLNVIVHSATGWKQVSGALSRPV

SEQ ID NO: 31670 - protein, 25 aa, synthetic construct
  source 1..25: note = Seed: YGFLNVIVHSATGFKQSSKALQRPV
YGFLNVIVHSATGWKQVSIALARPV

SEQ ID NO: 31671 - protein, 25 aa, synthetic construct
  source 1..25: note = Seed: YGFLNVIVHSATGFKQSSKALQRPV
YGFLNVIVHSATGWKQVSIALFRPV

SEQ ID NO: 31672 - protein, 25 aa, synthetic construct
  source 1..25: note = Seed: YGFLNVIVHSATGFKQSSKALQRPV
YGFLNVIVHSATGWKQVSIALNRPV

SEQ ID NO: 31673 - protein, 25 aa, synthetic construct
  source 1..25: note = Seed: YGFLNVIVHSATGFKQSSKALQRPV
YGFLNVIVHSATGWKQVSIALSRPV

SEQ ID NO: 31674 - protein, 25 aa, synthetic construct
  source 1..25: note = Seed: YGFLNVIVHSATGFKQSSKALQRPV
YGFLNVIVHSATGWKQVSKALARPV

SEQ ID NO: 31675 - protein, 25 aa, synthetic construct
  source 1..25: note = Seed: YGFLNVIVHSATGFKQSSKALQRPV
YGFLNVIVHSATGWKQVSKALGRPV

SEQ ID NO: 31676 - protein, 25 aa, synthetic construct
  source 1..25: note = Seed: YGFLNVIVHSATGFKQSSKALQRPV
YGFLNVIVHSATGWKQVSKALSRPV

SEQ ID NO: 31677 - protein, 25 aa, synthetic construct
  source 1..25: note = Seed: YGFLNVIVHSATGFKQSSKALQRPV
YGFLNVIVHSATGWKQVSKALTRPV

SEQ ID NO: 31678 - protein, 25 aa, synthetic construct
  source 1..25: note = Seed: YGFLNVIVHSATGFKQSSKALQRPV
YGFLNVIVHSATGWKQVSLALFRPV

SEQ ID NO: 31679 - protein, 25 aa, synthetic construct
  source 1..25: note = Seed: YGFLNVIVHSATGFKQSSKALQRPV
YGFLNVIVHSATGWKQVSMALFRPV

SEQ ID NO: 31680 - protein, 25 aa, synthetic construct
  source 1..25: note = Seed: YGFLNVIVHSATGFKQSSKALQRPV
YGFLNVIVHSATGWKQVSNALARPV

SEQ ID NO: 31681 - protein, 25 aa, synthetic construct
  source 1..25: note = Seed: YGFLNVIVHSATGFKQSSKALQRPV
YGFLNVIVHSATGWKQVSNALNRPV

SEQ ID NO: 31682 - protein, 25 aa, synthetic construct
  source 1..25: note = Seed: YGFLNVIVHSATGFKQSSKALQRPV
YGFLNVIVHSATGWKQVSNALSRPV

SEQ ID NO: 31683 - protein, 25 aa, synthetic construct
  source 1..25: note = Seed: YGFLNVIVHSATGFKQSSKALQRPV
YGFLNVIVHSATGWKQVSPALARPV

SEQ ID NO: 31684 - protein, 25 aa, synthetic construct
  source 1..25: note = Seed: YGFLNVIVHSATGFKQSSKALQRPV
YGFLNVIVHSATGWKQVSPALGRPV

SEQ ID NO: 31685 - protein, 25 aa, synthetic construct
  source 1..25: note = Seed: YGFLNVIVHSATGFKQSSKALQRPV
YGFLNVIVHSATGWKQVSPALMRPV

SEQ ID NO: 31686 - protein, 25 aa, synthetic construct
  source 1..25: note = Seed: YGFLNVIVHSATGFKQSSKALQRPV
YGFLNVIVHSATGWKQVSPALNRPV

SEQ ID NO: 31687 - protein, 25 aa, synthetic construct
  source 1..25: note = Seed: YGFLNVIVHSATGFKQSSKALQRPV
YGFLNVIVHSATGWKQVSPALQRPV

SEQ ID NO: 31688 - protein, 25 aa, synthetic construct
  source 1..25: note = Seed: YGFLNVIVHSATGFKQSSKALQRPV
YGFLNVIVHSATGWKQVSPALSRPV

SEQ ID NO: 31689 - protein, 25 aa, synthetic construct
  source 1..25: note = Seed: YGFLNVIVHSATGFKQSSKALQRPV
YGFLNVIVHSATGWKQVSPALTRPV

SEQ ID NO: 31690 - protein, 25 aa, synthetic construct
  source 1..25: note = Seed: YGFLNVIVHSATGFKQSSKALQRPV
YGFLNVIVHSATGWKQVSPALVRPV

SEQ ID NO: 31691 - protein, 25 aa, synthetic construct
  source 1..25: note = Seed: YGFLNVIVHSATGFKQSSKALQRPV
YGFLNVIVHSATGWKQVSRALARPV

SEQ ID NO: 31692 - protein, 25 aa, synthetic construct
  source 1..25: note = Seed: YGFLNVIVHSATGFKQSSKALQRPV
YGFLNVIVHSATGWKQVSRALGRPV

SEQ ID NO: 31693 - protein, 25 aa, synthetic construct
  source 1..25: note = Seed: YGFLNVIVHSATGFKQSSKALQRPV
YGFLNVIVHSATGWKQVSRALHRPV

SEQ ID NO: 31694 - protein, 25 aa, synthetic construct
  source 1..25: note = Seed: YGFLNVIVHSATGFKQSSKALQRPV
YGFLNVIVHSATGWKQVSRALQRPV

SEQ ID NO: 31695 - protein, 25 aa, synthetic construct
  source 1..25: note = Seed: YGFLNVIVHSATGFKQSSKALQRPV
YGFLNVIVHSATGWKQVSRALSRPV

SEQ ID NO: 31696 - protein, 25 aa, synthetic construct
  source 1..25: note = Seed: YGFLNVIVHSATGFKQSSKALQRPV
YGFLNVIVHSATGWKQVSRALTRPV

SEQ ID NO: 31697 - protein, 25 aa, synthetic construct
  source 1..25: note = Seed: YGFLNVIVHSATGFKQSSKALQRPV
YGFLNVIVHSATGWKQVSSALARPV

SEQ ID NO: 31698 - protein, 25 aa, synthetic construct
  source 1..25: note = Seed: YGFLNVIVHSATGFKQSSKALQRPV
YGFLNVIVHSATGWKQVSSALGRPV

SEQ ID NO: 31699 - protein, 25 aa, synthetic construct
  source 1..25: note = Seed: YGFLNVIVHSATGFKQSSKALQRPV
YGFLNVIVHSATGWKQVSSALNRPV

SEQ ID NO: 31700 - protein, 25 aa, synthetic construct
  source 1..25: note = Seed: YGFLNVIVHSATGFKQSSKALQRPV
YGFLNVIVHSATGWKQVSSALSRPV

SEQ ID NO: 31701 - protein, 25 aa, synthetic construct
  source 1..25: note = Seed: YGFLNVIVHSATGFKQSSKALQRPV
YGFLNVIVHSATGWKQVSSALTRPV

SEQ ID NO: 31702 - protein, 25 aa, synthetic construct
  source 1..25: note = Seed: YGFLNVIVHSATGFKQSSKALQRPV
YGFLNVIVHSATGWKQVSTALARPV

SEQ ID NO: 31703 - protein, 25 aa, synthetic construct
  source 1..25: note = Seed: YGFLNVIVHSATGFKQSSKALQRPV
YGFLNVIVHSATGWKQVSTALGRPV

SEQ ID NO: 31704 - protein, 25 aa, synthetic construct
  source 1..25: note = Seed: YGFLNVIVHSATGFKQSSKALQRPV
YGFLNVIVHSATGWKQVSTALMRPV

SEQ ID NO: 31705 - protein, 25 aa, synthetic construct
  source 1..25: note = Seed: YGFLNVIVHSATGFKQSSKALQRPV
YGFLNVIVHSATGWKQVSTALNRPV

SEQ ID NO: 31706 - protein, 25 aa, synthetic construct
  source 1..25: note = Seed: YGFLNVIVHSATGFKQSSKALQRPV
YGFLNVIVHSATGWKQVSTALSRPV

SEQ ID NO: 31707 - protein, 25 aa, synthetic construct
  source 1..25: note = Seed: YGFLNVIVHSATGFKQSSKALQRPV
YGFLNVIVHSATGWKQVSTALTRPV

SEQ ID NO: 31708 - protein, 25 aa, synthetic construct
  source 1..25: note = Seed: YGFLNVIVHSATGFKQSSKALQRPV
YGFLNVIVHSATGWKQVSTALVRPV

SEQ ID NO: 31709 - protein, 25 aa, synthetic construct
  source 1..25: note = Seed: YGFLNVIVHSATGFKQSSKALQRPV
YGFLNVIVHSATGWKQVSVALARPV

SEQ ID NO: 31710 - protein, 25 aa, synthetic construct
  source 1..25: note = Seed: YGFLNVIVHSATGFKQSSKALQRPV
YGFLNVIVHSATGWKQVSVALNRPV

SEQ ID NO: 31711 - protein, 25 aa, synthetic construct
  source 1..25: note = Seed: YGFLNVIVHSATGFKQSSKALQRPV
YGFLNVIVHSATGWKQVSVALSRPV

SEQ ID NO: 31712 - protein, 25 aa, synthetic construct
  source 1..25: note = Seed: YGFLNVIVHSATGFKQSSKALQRPV
YGFLNVIVHSATGWKQVSWALFRPV

SEQ ID NO: 31713 - protein, 25 aa, synthetic construct
  source 1..25: note = Seed: YGFLNVIVHSATGFKQSSKALQRPV
YGFLNVIVHSATGWKQVSYALFRPV

SEQ ID NO: 31714 - protein, 25 aa, synthetic construct
  source 1..25: note = Seed: YGFLNVIVHSATGFKQSSKALQRPV
YGFLNVIVHSATGWKQVSYALYRPV

SEQ ID NO: 31715 - protein, 25 aa, synthetic construct
  source 1..25: note = Seed: YGFLNVIVHSATGFKQSSKALQRPV
YGFLNVIVHSATGWKQWSAALARPV

SEQ ID NO: 31716 - protein, 25 aa, synthetic construct
  source 1..25: note = Seed: YGFLNVIVHSATGFKQSSKALQRPV
YGFLNVIVHSATGWKQWSAALSRPV

SEQ ID NO: 31717 - protein, 25 aa, synthetic construct
  source 1..25: note = Seed: YGFLNVIVHSATGFKQSSKALQRPV
YGFLNVIVHSATGWKQWSFALFRPV

SEQ ID NO: 31718 - protein, 25 aa, synthetic construct
  source 1..25: note = Seed: YGFLNVIVHSATGFKQSSKALQRPV
YGFLNVIVHSATGWKQWSFALLRPV

SEQ ID NO: 31719 - protein, 25 aa, synthetic construct
  source 1..25: note = Seed: YGFLNVIVHSATGFKQSSKALQRPV
YGFLNVIVHSATGWKQWSFALYRPV

SEQ ID NO: 31720 - protein, 25 aa, synthetic construct
  source 1..25: note = Seed: YGFLNVIVHSATGFKQSSKALQRPV
YGFLNVIVHSATGWKQWSIALARPV

SEQ ID NO: 31721 - protein, 25 aa, synthetic construct
  source 1..25: note = Seed: YGFLNVIVHSATGFKQSSKALQRPV
YGFLNVIVHSATGWKQWSIALSRPV

SEQ ID NO: 31722 - protein, 25 aa, synthetic construct
  source 1..25: note = Seed: YGFLNVIVHSATGFKQSSKALQRPV
YGFLNVIVHSATGWKQWSLALARPV

SEQ ID NO: 31723 - protein, 25 aa, synthetic construct
  source 1..25: note = Seed: YGFLNVIVHSATGFKQSSKALQRPV
YGFLNVIVHSATGWKQWSLALFRPV

SEQ ID NO: 31724 - protein, 25 aa, synthetic construct
  source 1..25: note = Seed: YGFLNVIVHSATGFKQSSKALQRPV
YGFLNVIVHSATGWKQWSMALARPV

SEQ ID NO: 31725 - protein, 25 aa, synthetic construct
  source 1..25: note = Seed: YGFLNVIVHSATGFKQSSKALQRPV
YGFLNVIVHSATGWKQWSTALARPV

SEQ ID NO: 31726 - protein, 25 aa, synthetic construct
  source 1..25: note = Seed: YGFLNVIVHSATGFKQSSKALQRPV
YGFLNVIVHSATGWKQWSVALARPV

SEQ ID NO: 31727 - protein, 25 aa, synthetic construct
  source 1..25: note = Seed: YGFLNVIVHSATGFKQSSKALQRPV
YGFLNVIVHSATGWKQWSVALSRPV

SEQ ID NO: 31728 - protein, 25 aa, synthetic construct
  source 1..25: note = Seed: YGFLNVIVHSATGFKQSSKALQRPV
YGFLNVIVHSATGWKQWSWALFRPV

SEQ ID NO: 31729 - protein, 25 aa, synthetic construct
  source 1..25: note = Seed: YGFLNVIVHSATGFKQSSKALQRPV
YGFLNVIVHSATGWKQWSYALYRPV

SEQ ID NO: 31730 - protein, 25 aa, synthetic construct
  source 1..25: note = Seed: YGFLNVIVHSATGFKQSSKALQRPV
YGFLNVIVHSATGWKQYSAALARPV

SEQ ID NO: 31731 - protein, 25 aa, synthetic construct
  source 1..25: note = Seed: YGFLNVIVHSATGFKQSSKALQRPV
YGFLNVIVHSATGWKQYSAALSRPV

SEQ ID NO: 31732 - protein, 25 aa, synthetic construct
  source 1..25: note = Seed: YGFLNVIVHSATGFKQSSKALQRPV
YGFLNVIVHSATGWKQYSAALTRPV

SEQ ID NO: 31733 - protein, 25 aa, synthetic construct
  source 1..25: note = Seed: YGFLNVIVHSATGFKQSSKALQRPV
YGFLNVIVHSATGWKQYSAALVRPV

SEQ ID NO: 31734 - protein, 25 aa, synthetic construct
  source 1..25: note = Seed: YGFLNVIVHSATGFKQSSKALQRPV
YGFLNVIVHSATGWKQYSFALLRPV

SEQ ID NO: 31735 - protein, 25 aa, synthetic construct
  source 1..25: note = Seed: YGFLNVIVHSATGFKQSSKALQRPV
YGFLNVIVHSATGWKQYSFALYRPV

SEQ ID NO: 31736 - protein, 25 aa, synthetic construct
  source 1..25: note = Seed: YGFLNVIVHSATGFKQSSKALQRPV
YGFLNVIVHSATGWKQYSIALARPV

SEQ ID NO: 31737 - protein, 25 aa, synthetic construct
  source 1..25: note = Seed: YGFLNVIVHSATGFKQSSKALQRPV
YGFLNVIVHSATGWKQYSIALSRPV

SEQ ID NO: 31738 - protein, 25 aa, synthetic construct
  source 1..25: note = Seed: YGFLNVIVHSATGFKQSSKALQRPV
YGFLNVIVHSATGWKQYSIALTRPV

SEQ ID NO: 31739 - protein, 25 aa, synthetic construct
  source 1..25: note = Seed: YGFLNVIVHSATGFKQSSKALQRPV
YGFLNVIVHSATGWKQYSLALFRPV

SEQ ID NO: 31740 - protein, 25 aa, synthetic construct
  source 1..25: note = Seed: YGFLNVIVHSATGFKQSSKALQRPV
YGFLNVIVHSATGWKQYSLALSRPV

SEQ ID NO: 31741 - protein, 25 aa, synthetic construct
  source 1..25: note = Seed: YGFLNVIVHSATGFKQSSKALQRPV
YGFLNVIVHSATGWKQYSSALARPV

SEQ ID NO: 31742 - protein, 25 aa, synthetic construct
  source 1..25: note = Seed: YGFLNVIVHSATGFKQSSKALQRPV
YGFLNVIVHSATGWKQYSTALARPV

SEQ ID NO: 31743 - protein, 25 aa, synthetic construct
  source 1..25: note = Seed: YGFLNVIVHSATGFKQSSKALQRPV
YGFLNVIVHSATGWKQYSVALARPV

SEQ ID NO: 31744 - protein, 25 aa, synthetic construct
  source 1..25: note = Seed: YGFLNVIVHSATGFKQSSKALQRPV
YGFLNVIVHSATGWKQYSVALSRPV

SEQ ID NO: 31745 - protein, 25 aa, synthetic construct
  source 1..25: note = Seed: YGFLNVIVHSATGFKQSSKALQRPV
YGFLNVIVHSATGWKQYSVALTRPV

SEQ ID NO: 31746 - protein, 25 aa, synthetic construct
  source 1..25: note = Seed: YGFLNVIVHSATGFKQSSKALQRPV
YGFLNVIVHSATGWKQYSYALYRPV

SEQ ID NO: 31747 - protein, 25 aa, synthetic construct
  source 1..25: note = Seed: YGFLNVIVHSATGFKQSSKALQRPV
YGFLNVIVHSATGYKQASAALARPV

SEQ ID NO: 31748 - protein, 25 aa, synthetic construct
  source 1..25: note = Seed: YGFLNVIVHSATGFKQSSKALQRPV
YGFLNVIVHSATGYKQASAALCRPV

SEQ ID NO: 31749 - protein, 25 aa, synthetic construct
  source 1..25: note = Seed: YGFLNVIVHSATGFKQSSKALQRPV
YGFLNVIVHSATGYKQASAALDRPV

SEQ ID NO: 31750 - protein, 25 aa, synthetic construct
  source 1..25: note = Seed: YGFLNVIVHSATGFKQSSKALQRPV
YGFLNVIVHSATGYKQASAALERPV

SEQ ID NO: 31751 - protein, 25 aa, synthetic construct
  source 1..25: note = Seed: YGFLNVIVHSATGFKQSSKALQRPV
YGFLNVIVHSATGYKQASAALFRPV

SEQ ID NO: 31752 - protein, 25 aa, synthetic construct
  source 1..25: note = Seed: YGFLNVIVHSATGFKQSSKALQRPV
YGFLNVIVHSATGYKQASAALGRPV

SEQ ID NO: 31753 - protein, 25 aa, synthetic construct
  source 1..25: note = Seed: YGFLNVIVHSATGFKQSSKALQRPV
YGFLNVIVHSATGYKQASAALHRPV

SEQ ID NO: 31754 - protein, 25 aa, synthetic construct
  source 1..25: note = Seed: YGFLNVIVHSATGFKQSSKALQRPV
YGFLNVIVHSATGYKQASAALIRPV

SEQ ID NO: 31755 - protein, 25 aa, synthetic construct
  source 1..25: note = Seed: YGFLNVIVHSATGFKQSSKALQRPV
YGFLNVIVHSATGYKQASAALKRPV

SEQ ID NO: 31756 - protein, 25 aa, synthetic construct
  source 1..25: note = Seed: YGFLNVIVHSATGFKQSSKALQRPV
YGFLNVIVHSATGYKQASAALLRPV

SEQ ID NO: 31757 - protein, 25 aa, synthetic construct
  source 1..25: note = Seed: YGFLNVIVHSATGFKQSSKALQRPV
YGFLNVIVHSATGYKQASAALMRPV

SEQ ID NO: 31758 - protein, 25 aa, synthetic construct
  source 1..25: note = Seed: YGFLNVIVHSATGFKQSSKALQRPV
YGFLNVIVHSATGYKQASAALNRPV

SEQ ID NO: 31759 - protein, 25 aa, synthetic construct
  source 1..25: note = Seed: YGFLNVIVHSATGFKQSSKALQRPV
YGFLNVIVHSATGYKQASAALPRPV

SEQ ID NO: 31760 - protein, 25 aa, synthetic construct
  source 1..25: note = Seed: YGFLNVIVHSATGFKQSSKALQRPV
YGFLNVIVHSATGYKQASAALQRPV

SEQ ID NO: 31761 - protein, 25 aa, synthetic construct
  source 1..25: note = Seed: YGFLNVIVHSATGFKQSSKALQRPV
YGFLNVIVHSATGYKQASAALRRPV

SEQ ID NO: 31762 - protein, 25 aa, synthetic construct
  source 1..25: note = Seed: YGFLNVIVHSATGFKQSSKALQRPV
YGFLNVIVHSATGYKQASAALSRPV

SEQ ID NO: 31763 - protein, 25 aa, synthetic construct
  source 1..25: note = Seed: YGFLNVIVHSATGFKQSSKALQRPV
YGFLNVIVHSATGYKQASAALTRPV

SEQ ID NO: 31764 - protein, 25 aa, synthetic construct
  source 1..25: note = Seed: YGFLNVIVHSATGFKQSSKALQRPV
YGFLNVIVHSATGYKQASAALVRPV

SEQ ID NO: 31765 - protein, 25 aa, synthetic construct
  source 1..25: note = Seed: YGFLNVIVHSATGFKQSSKALQRPV
YGFLNVIVHSATGYKQASAALWRPV

SEQ ID NO: 31766 - protein, 25 aa, synthetic construct
  source 1..25: note = Seed: YGFLNVIVHSATGFKQSSKALQRPV
YGFLNVIVHSATGYKQASAALYRPV

SEQ ID NO: 31767 - protein, 25 aa, synthetic construct
  source 1..25: note = Seed: YGFLNVIVHSATGFKQSSKALQRPV
YGFLNVIVHSATGYKQASCALARPV

SEQ ID NO: 31768 - protein, 25 aa, synthetic construct
  source 1..25: note = Seed: YGFLNVIVHSATGFKQSSKALQRPV
YGFLNVIVHSATGYKQASCALNRPV

SEQ ID NO: 31769 - protein, 25 aa, synthetic construct
  source 1..25: note = Seed: YGFLNVIVHSATGFKQSSKALQRPV
YGFLNVIVHSATGYKQASEALARPV

SEQ ID NO: 31770 - protein, 25 aa, synthetic construct
  source 1..25: note = Seed: YGFLNVIVHSATGFKQSSKALQRPV
YGFLNVIVHSATGYKQASEALSRPV

SEQ ID NO: 31771 - protein, 25 aa, synthetic construct
  source 1..25: note = Seed: YGFLNVIVHSATGFKQSSKALQRPV
YGFLNVIVHSATGYKQASFALFRPV

SEQ ID NO: 31772 - protein, 25 aa, synthetic construct
  source 1..25: note = Seed: YGFLNVIVHSATGFKQSSKALQRPV
YGFLNVIVHSATGYKQASFALIRPV

SEQ ID NO: 31773 - protein, 25 aa, synthetic construct
  source 1..25: note = Seed: YGFLNVIVHSATGFKQSSKALQRPV
YGFLNVIVHSATGYKQASFALLRPV

SEQ ID NO: 31774 - protein, 25 aa, synthetic construct
  source 1..25: note = Seed: YGFLNVIVHSATGFKQSSKALQRPV
YGFLNVIVHSATGYKQASFALVRPV

SEQ ID NO: 31775 - protein, 25 aa, synthetic construct
  source 1..25: note = Seed: YGFLNVIVHSATGFKQSSKALQRPV
YGFLNVIVHSATGYKQASGALARPV

SEQ ID NO: 31776 - protein, 25 aa, synthetic construct
  source 1..25: note = Seed: YGFLNVIVHSATGFKQSSKALQRPV
YGFLNVIVHSATGYKQASGALERPV

SEQ ID NO: 31777 - protein, 25 aa, synthetic construct
  source 1..25: note = Seed: YGFLNVIVHSATGFKQSSKALQRPV
YGFLNVIVHSATGYKQASGALGRPV

SEQ ID NO: 31778 - protein, 25 aa, synthetic construct
  source 1..25: note = Seed: YGFLNVIVHSATGFKQSSKALQRPV
YGFLNVIVHSATGYKQASGALHRPV

SEQ ID NO: 31779 - protein, 25 aa, synthetic construct
  source 1..25: note = Seed: YGFLNVIVHSATGFKQSSKALQRPV
YGFLNVIVHSATGYKQASGALIRPV

SEQ ID NO: 31780 - protein, 25 aa, synthetic construct
  source 1..25: note = Seed: YGFLNVIVHSATGFKQSSKALQRPV
YGFLNVIVHSATGYKQASGALLRPV

SEQ ID NO: 31781 - protein, 25 aa, synthetic construct
  source 1..25: note = Seed: YGFLNVIVHSATGFKQSSKALQRPV
YGFLNVIVHSATGYKQASGALMRPV

SEQ ID NO: 31782 - protein, 25 aa, synthetic construct
  source 1..25: note = Seed: YGFLNVIVHSATGFKQSSKALQRPV
YGFLNVIVHSATGYKQASGALNRPV

SEQ ID NO: 31783 - protein, 25 aa, synthetic construct
  source 1..25: note = Seed: YGFLNVIVHSATGFKQSSKALQRPV
YGFLNVIVHSATGYKQASGALQRPV

SEQ ID NO: 31784 - protein, 25 aa, synthetic construct
  source 1..25: note = Seed: YGFLNVIVHSATGFKQSSKALQRPV
YGFLNVIVHSATGYKQASGALSRPV

SEQ ID NO: 31785 - protein, 25 aa, synthetic construct
  source 1..25: note = Seed: YGFLNVIVHSATGFKQSSKALQRPV
YGFLNVIVHSATGYKQASGALTRPV

SEQ ID NO: 31786 - protein, 25 aa, synthetic construct
  source 1..25: note = Seed: YGFLNVIVHSATGFKQSSKALQRPV
YGFLNVIVHSATGYKQASGALVRPV

SEQ ID NO: 31787 - protein, 25 aa, synthetic construct
  source 1..25: note = Seed: YGFLNVIVHSATGFKQSSKALQRPV
YGFLNVIVHSATGYKQASHALARPV

SEQ ID NO: 31788 - protein, 25 aa, synthetic construct
  source 1..25: note = Seed: YGFLNVIVHSATGFKQSSKALQRPV
YGFLNVIVHSATGYKQASIALARPV

SEQ ID NO: 31789 - protein, 25 aa, synthetic construct
  source 1..25: note = Seed: YGFLNVIVHSATGFKQSSKALQRPV
YGFLNVIVHSATGYKQASIALCRPV

SEQ ID NO: 31790 - protein, 25 aa, synthetic construct
  source 1..25: note = Seed: YGFLNVIVHSATGFKQSSKALQRPV
YGFLNVIVHSATGYKQASIALDRPV

SEQ ID NO: 31791 - protein, 25 aa, synthetic construct
  source 1..25: note = Seed: YGFLNVIVHSATGFKQSSKALQRPV
YGFLNVIVHSATGYKQASIALERPV

SEQ ID NO: 31792 - protein, 25 aa, synthetic construct
  source 1..25: note = Seed: YGFLNVIVHSATGFKQSSKALQRPV
YGFLNVIVHSATGYKQASIALGRPV

SEQ ID NO: 31793 - protein, 25 aa, synthetic construct
  source 1..25: note = Seed: YGFLNVIVHSATGFKQSSKALQRPV
YGFLNVIVHSATGYKQASIALHRPV

SEQ ID NO: 31794 - protein, 25 aa, synthetic construct
  source 1..25: note = Seed: YGFLNVIVHSATGFKQSSKALQRPV
YGFLNVIVHSATGYKQASIALIRPV

SEQ ID NO: 31795 - protein, 25 aa, synthetic construct
  source 1..25: note = Seed: YGFLNVIVHSATGFKQSSKALQRPV
YGFLNVIVHSATGYKQASIALKRPV

SEQ ID NO: 31796 - protein, 25 aa, synthetic construct
  source 1..25: note = Seed: YGFLNVIVHSATGFKQSSKALQRPV
YGFLNVIVHSATGYKQASIALLRPV

SEQ ID NO: 31797 - protein, 25 aa, synthetic construct
  source 1..25: note = Seed: YGFLNVIVHSATGFKQSSKALQRPV
YGFLNVIVHSATGYKQASIALMRPV

SEQ ID NO: 31798 - protein, 25 aa, synthetic construct
  source 1..25: note = Seed: YGFLNVIVHSATGFKQSSKALQRPV
YGFLNVIVHSATGYKQASIALNRPV

SEQ ID NO: 31799 - protein, 25 aa, synthetic construct
  source 1..25: note = Seed: YGFLNVIVHSATGFKQSSKALQRPV
YGFLNVIVHSATGYKQASIALPRPV

SEQ ID NO: 31800 - protein, 25 aa, synthetic construct
  source 1..25: note = Seed: YGFLNVIVHSATGFKQSSKALQRPV
YGFLNVIVHSATGYKQASIALQRPV

SEQ ID NO: 31801 - protein, 25 aa, synthetic construct
  source 1..25: note = Seed: YGFLNVIVHSATGFKQSSKALQRPV
YGFLNVIVHSATGYKQASIALSRPV

SEQ ID NO: 31802 - protein, 25 aa, synthetic construct
  source 1..25: note = Seed: YGFLNVIVHSATGFKQSSKALQRPV
YGFLNVIVHSATGYKQASIALTRPV

SEQ ID NO: 31803 - protein, 25 aa, synthetic construct
  source 1..25: note = Seed: YGFLNVIVHSATGFKQSSKALQRPV
YGFLNVIVHSATGYKQASIALVRPV

SEQ ID NO: 31804 - protein, 25 aa, synthetic construct
  source 1..25: note = Seed: YGFLNVIVHSATGFKQSSKALQRPV
YGFLNVIVHSATGYKQASKALARPV

SEQ ID NO: 31805 - protein, 25 aa, synthetic construct
  source 1..25: note = Seed: YGFLNVIVHSATGFKQSSKALQRPV
YGFLNVIVHSATGYKQASKALGRPV

SEQ ID NO: 31806 - protein, 25 aa, synthetic construct
  source 1..25: note = Seed: YGFLNVIVHSATGFKQSSKALQRPV
YGFLNVIVHSATGYKQASKALHRPV

SEQ ID NO: 31807 - protein, 25 aa, synthetic construct
  source 1..25: note = Seed: YGFLNVIVHSATGFKQSSKALQRPV
YGFLNVIVHSATGYKQASKALNRPV

SEQ ID NO: 31808 - protein, 25 aa, synthetic construct
  source 1..25: note = Seed: YGFLNVIVHSATGFKQSSKALQRPV
YGFLNVIVHSATGYKQASKALQRPV

SEQ ID NO: 31809 - protein, 25 aa, synthetic construct
  source 1..25: note = Seed: YGFLNVIVHSATGFKQSSKALQRPV
YGFLNVIVHSATGYKQASKALSRPV

SEQ ID NO: 31810 - protein, 25 aa, synthetic construct
  source 1..25: note = Seed: YGFLNVIVHSATGFKQSSKALQRPV
YGFLNVIVHSATGYKQASKALTRPV

SEQ ID NO: 31811 - protein, 25 aa, synthetic construct
  source 1..25: note = Seed: YGFLNVIVHSATGFKQSSKALQRPV
YGFLNVIVHSATGYKQASKALVRPV

SEQ ID NO: 31812 - protein, 25 aa, synthetic construct
  source 1..25: note = Seed: YGFLNVIVHSATGFKQSSKALQRPV
YGFLNVIVHSATGYKQASLALARPV

SEQ ID NO: 31813 - protein, 25 aa, synthetic construct
  source 1..25: note = Seed: YGFLNVIVHSATGFKQSSKALQRPV
YGFLNVIVHSATGYKQASLALGRPV

SEQ ID NO: 31814 - protein, 25 aa, synthetic construct
  source 1..25: note = Seed: YGFLNVIVHSATGFKQSSKALQRPV
YGFLNVIVHSATGYKQASLALHRPV

SEQ ID NO: 31815 - protein, 25 aa, synthetic construct
  source 1..25: note = Seed: YGFLNVIVHSATGFKQSSKALQRPV
YGFLNVIVHSATGYKQASLALIRPV

SEQ ID NO: 31816 - protein, 25 aa, synthetic construct
  source 1..25: note = Seed: YGFLNVIVHSATGFKQSSKALQRPV
YGFLNVIVHSATGYKQASLALLRPV

SEQ ID NO: 31817 - protein, 25 aa, synthetic construct
  source 1..25: note = Seed: YGFLNVIVHSATGFKQSSKALQRPV
YGFLNVIVHSATGYKQASLALMRPV

SEQ ID NO: 31818 - protein, 25 aa, synthetic construct
  source 1..25: note = Seed: YGFLNVIVHSATGFKQSSKALQRPV
YGFLNVIVHSATGYKQASLALNRPV

SEQ ID NO: 31819 - protein, 25 aa, synthetic construct
  source 1..25: note = Seed: YGFLNVIVHSATGFKQSSKALQRPV
YGFLNVIVHSATGYKQASLALQRPV

SEQ ID NO: 31820 - protein, 25 aa, synthetic construct
  source 1..25: note = Seed: YGFLNVIVHSATGFKQSSKALQRPV
YGFLNVIVHSATGYKQASLALSRPV

SEQ ID NO: 31821 - protein, 25 aa, synthetic construct
  source 1..25: note = Seed: YGFLNVIVHSATGFKQSSKALQRPV
YGFLNVIVHSATGYKQASLALTRPV

SEQ ID NO: 31822 - protein, 25 aa, synthetic construct
  source 1..25: note = Seed: YGFLNVIVHSATGFKQSSKALQRPV
YGFLNVIVHSATGYKQASLALVRPV

SEQ ID NO: 31823 - protein, 25 aa, synthetic construct
  source 1..25: note = Seed: YGFLNVIVHSATGFKQSSKALQRPV
YGFLNVIVHSATGYKQASMALARPV

SEQ ID NO: 31824 - protein, 25 aa, synthetic construct
  source 1..25: note = Seed: YGFLNVIVHSATGFKQSSKALQRPV
YGFLNVIVHSATGYKQASMALGRPV

SEQ ID NO: 31825 - protein, 25 aa, synthetic construct
  source 1..25: note = Seed: YGFLNVIVHSATGFKQSSKALQRPV
YGFLNVIVHSATGYKQASMALHRPV

SEQ ID NO: 31826 - protein, 25 aa, synthetic construct
  source 1..25: note = Seed: YGFLNVIVHSATGFKQSSKALQRPV
YGFLNVIVHSATGYKQASMALIRPV

SEQ ID NO: 31827 - protein, 25 aa, synthetic construct
  source 1..25: note = Seed: YGFLNVIVHSATGFKQSSKALQRPV
YGFLNVIVHSATGYKQASMALLRPV

SEQ ID NO: 31828 - protein, 25 aa, synthetic construct
  source 1..25: note = Seed: YGFLNVIVHSATGFKQSSKALQRPV
YGFLNVIVHSATGYKQASMALMRPV

SEQ ID NO: 31829 - protein, 25 aa, synthetic construct
  source 1..25: note = Seed: YGFLNVIVHSATGFKQSSKALQRPV
YGFLNVIVHSATGYKQASMALNRPV

SEQ ID NO: 31830 - protein, 25 aa, synthetic construct
  source 1..25: note = Seed: YGFLNVIVHSATGFKQSSKALQRPV
YGFLNVIVHSATGYKQASMALQRPV

SEQ ID NO: 31831 - protein, 25 aa, synthetic construct
  source 1..25: note = Seed: YGFLNVIVHSATGFKQSSKALQRPV
YGFLNVIVHSATGYKQASMALSRPV

SEQ ID NO: 31832 - protein, 25 aa, synthetic construct
  source 1..25: note = Seed: YGFLNVIVHSATGFKQSSKALQRPV
YGFLNVIVHSATGYKQASMALTRPV

SEQ ID NO: 31833 - protein, 25 aa, synthetic construct
  source 1..25: note = Seed: YGFLNVIVHSATGFKQSSKALQRPV
YGFLNVIVHSATGYKQASMALVRPV

SEQ ID NO: 31834 - protein, 25 aa, synthetic construct
  source 1..25: note = Seed: YGFLNVIVHSATGFKQSSKALQRPV
YGFLNVIVHSATGYKQASNALARPV

SEQ ID NO: 31835 - protein, 25 aa, synthetic construct
  source 1..25: note = Seed: YGFLNVIVHSATGFKQSSKALQRPV
YGFLNVIVHSATGYKQASNALGRPV

SEQ ID NO: 31836 - protein, 25 aa, synthetic construct
  source 1..25: note = Seed: YGFLNVIVHSATGFKQSSKALQRPV
YGFLNVIVHSATGYKQASNALHRPV

SEQ ID NO: 31837 - protein, 25 aa, synthetic construct
  source 1..25: note = Seed: YGFLNVIVHSATGFKQSSKALQRPV
YGFLNVIVHSATGYKQASNALIRPV

SEQ ID NO: 31838 - protein, 25 aa, synthetic construct
  source 1..25: note = Seed: YGFLNVIVHSATGFKQSSKALQRPV
YGFLNVIVHSATGYKQASNALLRPV

SEQ ID NO: 31839 - protein, 25 aa, synthetic construct
  source 1..25: note = Seed: YGFLNVIVHSATGFKQSSKALQRPV
YGFLNVIVHSATGYKQASNALMRPV

SEQ ID NO: 31840 - protein, 25 aa, synthetic construct
  source 1..25: note = Seed: YGFLNVIVHSATGFKQSSKALQRPV
YGFLNVIVHSATGYKQASNALNRPV

SEQ ID NO: 31841 - protein, 25 aa, synthetic construct
  source 1..25: note = Seed: YGFLNVIVHSATGFKQSSKALQRPV
YGFLNVIVHSATGYKQASNALQRPV

SEQ ID NO: 31842 - protein, 25 aa, synthetic construct
  source 1..25: note = Seed: YGFLNVIVHSATGFKQSSKALQRPV
YGFLNVIVHSATGYKQASNALSRPV

SEQ ID NO: 31843 - protein, 25 aa, synthetic construct
  source 1..25: note = Seed: YGFLNVIVHSATGFKQSSKALQRPV
YGFLNVIVHSATGYKQASNALTRPV

SEQ ID NO: 31844 - protein, 25 aa, synthetic construct
  source 1..25: note = Seed: YGFLNVIVHSATGFKQSSKALQRPV
YGFLNVIVHSATGYKQASNALVRPV

SEQ ID NO: 31845 - protein, 25 aa, synthetic construct
  source 1..25: note = Seed: YGFLNVIVHSATGFKQSSKALQRPV
YGFLNVIVHSATGYKQASPALARPV

SEQ ID NO: 31846 - protein, 25 aa, synthetic construct
  source 1..25: note = Seed: YGFLNVIVHSATGFKQSSKALQRPV
YGFLNVIVHSATGYKQASPALCRPV

SEQ ID NO: 31847 - protein, 25 aa, synthetic construct
  source 1..25: note = Seed: YGFLNVIVHSATGFKQSSKALQRPV
YGFLNVIVHSATGYKQASPALDRPV

SEQ ID NO: 31848 - protein, 25 aa, synthetic construct
  source 1..25: note = Seed: YGFLNVIVHSATGFKQSSKALQRPV
YGFLNVIVHSATGYKQASPALERPV

SEQ ID NO: 31849 - protein, 25 aa, synthetic construct
  source 1..25: note = Seed: YGFLNVIVHSATGFKQSSKALQRPV
YGFLNVIVHSATGYKQASPALFRPV

SEQ ID NO: 31850 - protein, 25 aa, synthetic construct
  source 1..25: note = Seed: YGFLNVIVHSATGFKQSSKALQRPV
YGFLNVIVHSATGYKQASPALGRPV

SEQ ID NO: 31851 - protein, 25 aa, synthetic construct
  source 1..25: note = Seed: YGFLNVIVHSATGFKQSSKALQRPV
YGFLNVIVHSATGYKQASPALHRPV

SEQ ID NO: 31852 - protein, 25 aa, synthetic construct
  source 1..25: note = Seed: YGFLNVIVHSATGFKQSSKALQRPV
YGFLNVIVHSATGYKQASPALIRPV

SEQ ID NO: 31853 - protein, 25 aa, synthetic construct
  source 1..25: note = Seed: YGFLNVIVHSATGFKQSSKALQRPV
YGFLNVIVHSATGYKQASPALLRPV

SEQ ID NO: 31854 - protein, 25 aa, synthetic construct
  source 1..25: note = Seed: YGFLNVIVHSATGFKQSSKALQRPV
YGFLNVIVHSATGYKQASPALMRPV

SEQ ID NO: 31855 - protein, 25 aa, synthetic construct
  source 1..25: note = Seed: YGFLNVIVHSATGFKQSSKALQRPV
YGFLNVIVHSATGYKQASPALNRPV

SEQ ID NO: 31856 - protein, 25 aa, synthetic construct
  source 1..25: note = Seed: YGFLNVIVHSATGFKQSSKALQRPV
YGFLNVIVHSATGYKQASPALPRPV

SEQ ID NO: 31857 - protein, 25 aa, synthetic construct
  source 1..25: note = Seed: YGFLNVIVHSATGFKQSSKALQRPV
YGFLNVIVHSATGYKQASPALQRPV

SEQ ID NO: 31858 - protein, 25 aa, synthetic construct
  source 1..25: note = Seed: YGFLNVIVHSATGFKQSSKALQRPV
YGFLNVIVHSATGYKQASPALSRPV

SEQ ID NO: 31859 - protein, 25 aa, synthetic construct
  source 1..25: note = Seed: YGFLNVIVHSATGFKQSSKALQRPV
YGFLNVIVHSATGYKQASPALTRPV

SEQ ID NO: 31860 - protein, 25 aa, synthetic construct
  source 1..25: note = Seed: YGFLNVIVHSATGFKQSSKALQRPV
YGFLNVIVHSATGYKQASPALVRPV

SEQ ID NO: 31861 - protein, 25 aa, synthetic construct
  source 1..25: note = Seed: YGFLNVIVHSATGFKQSSKALQRPV
YGFLNVIVHSATGYKQASPALWRPV

SEQ ID NO: 31862 - protein, 25 aa, synthetic construct
  source 1..25: note = Seed: YGFLNVIVHSATGFKQSSKALQRPV
YGFLNVIVHSATGYKQASPALYRPV

SEQ ID NO: 31863 - protein, 25 aa, synthetic construct
  source 1..25: note = Seed: YGFLNVIVHSATGFKQSSKALQRPV
YGFLNVIVHSATGYKQASQALARPV

SEQ ID NO: 31864 - protein, 25 aa, synthetic construct
  source 1..25: note = Seed: YGFLNVIVHSATGFKQSSKALQRPV
YGFLNVIVHSATGYKQASQALNRPV

SEQ ID NO: 31865 - protein, 25 aa, synthetic construct
  source 1..25: note = Seed: YGFLNVIVHSATGFKQSSKALQRPV
YGFLNVIVHSATGYKQASQALSRPV

SEQ ID NO: 31866 - protein, 25 aa, synthetic construct
  source 1..25: note = Seed: YGFLNVIVHSATGFKQSSKALQRPV
YGFLNVIVHSATGYKQASQALTRPV

SEQ ID NO: 31867 - protein, 25 aa, synthetic construct
  source 1..25: note = Seed: YGFLNVIVHSATGFKQSSKALQRPV
YGFLNVIVHSATGYKQASRALARPV

SEQ ID NO: 31868 - protein, 25 aa, synthetic construct
  source 1..25: note = Seed: YGFLNVIVHSATGFKQSSKALQRPV
YGFLNVIVHSATGYKQASRALGRPV

SEQ ID NO: 31869 - protein, 25 aa, synthetic construct
  source 1..25: note = Seed: YGFLNVIVHSATGFKQSSKALQRPV
YGFLNVIVHSATGYKQASRALHRPV

SEQ ID NO: 31870 - protein, 25 aa, synthetic construct
  source 1..25: note = Seed: YGFLNVIVHSATGFKQSSKALQRPV
YGFLNVIVHSATGYKQASRALIRPV

SEQ ID NO: 31871 - protein, 25 aa, synthetic construct
  source 1..25: note = Seed: YGFLNVIVHSATGFKQSSKALQRPV
YGFLNVIVHSATGYKQASRALMRPV

SEQ ID NO: 31872 - protein, 25 aa, synthetic construct
  source 1..25: note = Seed: YGFLNVIVHSATGFKQSSKALQRPV
YGFLNVIVHSATGYKQASRALNRPV

SEQ ID NO: 31873 - protein, 25 aa, synthetic construct
  source 1..25: note = Seed: YGFLNVIVHSATGFKQSSKALQRPV
YGFLNVIVHSATGYKQASRALPRPV

SEQ ID NO: 31874 - protein, 25 aa, synthetic construct
  source 1..25: note = Seed: YGFLNVIVHSATGFKQSSKALQRPV
YGFLNVIVHSATGYKQASRALQRPV

SEQ ID NO: 31875 - protein, 25 aa, synthetic construct
  source 1..25: note = Seed: YGFLNVIVHSATGFKQSSKALQRPV
YGFLNVIVHSATGYKQASRALSRPV

SEQ ID NO: 31876 - protein, 25 aa, synthetic construct
  source 1..25: note = Seed: YGFLNVIVHSATGFKQSSKALQRPV
YGFLNVIVHSATGYKQASRALTRPV

SEQ ID NO: 31877 - protein, 25 aa, synthetic construct
  source 1..25: note = Seed: YGFLNVIVHSATGFKQSSKALQRPV
YGFLNVIVHSATGYKQASRALVRPV

SEQ ID NO: 31878 - protein, 25 aa, synthetic construct
  source 1..25: note = Seed: YGFLNVIVHSATGFKQSSKALQRPV
YGFLNVIVHSATGYKQASSALARPV

SEQ ID NO: 31879 - protein, 25 aa, synthetic construct
  source 1..25: note = Seed: YGFLNVIVHSATGFKQSSKALQRPV
YGFLNVIVHSATGYKQASSALCRPV

SEQ ID NO: 31880 - protein, 25 aa, synthetic construct
  source 1..25: note = Seed: YGFLNVIVHSATGFKQSSKALQRPV
YGFLNVIVHSATGYKQASSALDRPV

SEQ ID NO: 31881 - protein, 25 aa, synthetic construct
  source 1..25: note = Seed: YGFLNVIVHSATGFKQSSKALQRPV
YGFLNVIVHSATGYKQASSALERPV

SEQ ID NO: 31882 - protein, 25 aa, synthetic construct
  source 1..25: note = Seed: YGFLNVIVHSATGFKQSSKALQRPV
YGFLNVIVHSATGYKQASSALFRPV

SEQ ID NO: 31883 - protein, 25 aa, synthetic construct
  source 1..25: note = Seed: YGFLNVIVHSATGFKQSSKALQRPV
YGFLNVIVHSATGYKQASSALGRPV

SEQ ID NO: 31884 - protein, 25 aa, synthetic construct
  source 1..25: note = Seed: YGFLNVIVHSATGFKQSSKALQRPV
YGFLNVIVHSATGYKQASSALHRPV

SEQ ID NO: 31885 - protein, 25 aa, synthetic construct
  source 1..25: note = Seed: YGFLNVIVHSATGFKQSSKALQRPV
YGFLNVIVHSATGYKQASSALIRPV

SEQ ID NO: 31886 - protein, 25 aa, synthetic construct
  source 1..25: note = Seed: YGFLNVIVHSATGFKQSSKALQRPV
YGFLNVIVHSATGYKQASSALLRPV

SEQ ID NO: 31887 - protein, 25 aa, synthetic construct
  source 1..25: note = Seed: YGFLNVIVHSATGFKQSSKALQRPV
YGFLNVIVHSATGYKQASSALMRPV

SEQ ID NO: 31888 - protein, 25 aa, synthetic construct
  source 1..25: note = Seed: YGFLNVIVHSATGFKQSSKALQRPV
YGFLNVIVHSATGYKQASSALNRPV

SEQ ID NO: 31889 - protein, 25 aa, synthetic construct
  source 1..25: note = Seed: YGFLNVIVHSATGFKQSSKALQRPV
YGFLNVIVHSATGYKQASSALPRPV

SEQ ID NO: 31890 - protein, 25 aa, synthetic construct
  source 1..25: note = Seed: YGFLNVIVHSATGFKQSSKALQRPV
YGFLNVIVHSATGYKQASSALQRPV

SEQ ID NO: 31891 - protein, 25 aa, synthetic construct
  source 1..25: note = Seed: YGFLNVIVHSATGFKQSSKALQRPV
YGFLNVIVHSATGYKQASSALSRPV

SEQ ID NO: 31892 - protein, 25 aa, synthetic construct
  source 1..25: note = Seed: YGFLNVIVHSATGFKQSSKALQRPV
YGFLNVIVHSATGYKQASSALTRPV

SEQ ID NO: 31893 - protein, 25 aa, synthetic construct
  source 1..25: note = Seed: YGFLNVIVHSATGFKQSSKALQRPV
YGFLNVIVHSATGYKQASSALVRPV

SEQ ID NO: 31894 - protein, 25 aa, synthetic construct
  source 1..25: note = Seed: YGFLNVIVHSATGFKQSSKALQRPV
YGFLNVIVHSATGYKQASSALYRPV

SEQ ID NO: 31895 - protein, 25 aa, synthetic construct
  source 1..25: note = Seed: YGFLNVIVHSATGFKQSSKALQRPV
YGFLNVIVHSATGYKQASTALARPV

SEQ ID NO: 31896 - protein, 25 aa, synthetic construct
  source 1..25: note = Seed: YGFLNVIVHSATGFKQSSKALQRPV
YGFLNVIVHSATGYKQASTALCRPV

SEQ ID NO: 31897 - protein, 25 aa, synthetic construct
  source 1..25: note = Seed: YGFLNVIVHSATGFKQSSKALQRPV
YGFLNVIVHSATGYKQASTALDRPV

SEQ ID NO: 31898 - protein, 25 aa, synthetic construct
  source 1..25: note = Seed: YGFLNVIVHSATGFKQSSKALQRPV
YGFLNVIVHSATGYKQASTALERPV

SEQ ID NO: 31899 - protein, 25 aa, synthetic construct
  source 1..25: note = Seed: YGFLNVIVHSATGFKQSSKALQRPV
YGFLNVIVHSATGYKQASTALFRPV

SEQ ID NO: 31900 - protein, 25 aa, synthetic construct
  source 1..25: note = Seed: YGFLNVIVHSATGFKQSSKALQRPV
YGFLNVIVHSATGYKQASTALGRPV

SEQ ID NO: 31901 - protein, 25 aa, synthetic construct
  source 1..25: note = Seed: YGFLNVIVHSATGFKQSSKALQRPV
YGFLNVIVHSATGYKQASTALHRPV

SEQ ID NO: 31902 - protein, 25 aa, synthetic construct
  source 1..25: note = Seed: YGFLNVIVHSATGFKQSSKALQRPV
YGFLNVIVHSATGYKQASTALIRPV

SEQ ID NO: 31903 - protein, 25 aa, synthetic construct
  source 1..25: note = Seed: YGFLNVIVHSATGFKQSSKALQRPV
YGFLNVIVHSATGYKQASTALLRPV

SEQ ID NO: 31904 - protein, 25 aa, synthetic construct
  source 1..25: note = Seed: YGFLNVIVHSATGFKQSSKALQRPV
YGFLNVIVHSATGYKQASTALMRPV

SEQ ID NO: 31905 - protein, 25 aa, synthetic construct
  source 1..25: note = Seed: YGFLNVIVHSATGFKQSSKALQRPV
YGFLNVIVHSATGYKQASTALNRPV

SEQ ID NO: 31906 - protein, 25 aa, synthetic construct
  source 1..25: note = Seed: YGFLNVIVHSATGFKQSSKALQRPV
YGFLNVIVHSATGYKQASTALPRPV

SEQ ID NO: 31907 - protein, 25 aa, synthetic construct
  source 1..25: note = Seed: YGFLNVIVHSATGFKQSSKALQRPV
YGFLNVIVHSATGYKQASTALQRPV

SEQ ID NO: 31908 - protein, 25 aa, synthetic construct
  source 1..25: note = Seed: YGFLNVIVHSATGFKQSSKALQRPV
YGFLNVIVHSATGYKQASTALSRPV

SEQ ID NO: 31909 - protein, 25 aa, synthetic construct
  source 1..25: note = Seed: YGFLNVIVHSATGFKQSSKALQRPV
YGFLNVIVHSATGYKQASTALTRPV

SEQ ID NO: 31910 - protein, 25 aa, synthetic construct
  source 1..25: note = Seed: YGFLNVIVHSATGFKQSSKALQRPV
YGFLNVIVHSATGYKQASTALVRPV

SEQ ID NO: 31911 - protein, 25 aa, synthetic construct
  source 1..25: note = Seed: YGFLNVIVHSATGFKQSSKALQRPV
YGFLNVIVHSATGYKQASTALYRPV

SEQ ID NO: 31912 - protein, 25 aa, synthetic construct
  source 1..25: note = Seed: YGFLNVIVHSATGFKQSSKALQRPV
YGFLNVIVHSATGYKQASVALARPV

SEQ ID NO: 31913 - protein, 25 aa, synthetic construct
  source 1..25: note = Seed: YGFLNVIVHSATGFKQSSKALQRPV
YGFLNVIVHSATGYKQASVALCRPV

SEQ ID NO: 31914 - protein, 25 aa, synthetic construct
  source 1..25: note = Seed: YGFLNVIVHSATGFKQSSKALQRPV
YGFLNVIVHSATGYKQASVALDRPV

SEQ ID NO: 31915 - protein, 25 aa, synthetic construct
  source 1..25: note = Seed: YGFLNVIVHSATGFKQSSKALQRPV
YGFLNVIVHSATGYKQASVALERPV

SEQ ID NO: 31916 - protein, 25 aa, synthetic construct
  source 1..25: note = Seed: YGFLNVIVHSATGFKQSSKALQRPV
YGFLNVIVHSATGYKQASVALFRPV

SEQ ID NO: 31917 - protein, 25 aa, synthetic construct
  source 1..25: note = Seed: YGFLNVIVHSATGFKQSSKALQRPV
YGFLNVIVHSATGYKQASVALGRPV

SEQ ID NO: 31918 - protein, 25 aa, synthetic construct
  source 1..25: note = Seed: YGFLNVIVHSATGFKQSSKALQRPV
YGFLNVIVHSATGYKQASVALHRPV

SEQ ID NO: 31919 - protein, 25 aa, synthetic construct
  source 1..25: note = Seed: YGFLNVIVHSATGFKQSSKALQRPV
YGFLNVIVHSATGYKQASVALIRPV

SEQ ID NO: 31920 - protein, 25 aa, synthetic construct
  source 1..25: note = Seed: YGFLNVIVHSATGFKQSSKALQRPV
YGFLNVIVHSATGYKQASVALKRPV

SEQ ID NO: 31921 - protein, 25 aa, synthetic construct
  source 1..25: note = Seed: YGFLNVIVHSATGFKQSSKALQRPV
YGFLNVIVHSATGYKQASVALLRPV

SEQ ID NO: 31922 - protein, 25 aa, synthetic construct
  source 1..25: note = Seed: YGFLNVIVHSATGFKQSSKALQRPV
YGFLNVIVHSATGYKQASVALMRPV

SEQ ID NO: 31923 - protein, 25 aa, synthetic construct
  source 1..25: note = Seed: YGFLNVIVHSATGFKQSSKALQRPV
YGFLNVIVHSATGYKQASVALNRPV

SEQ ID NO: 31924 - protein, 25 aa, synthetic construct
  source 1..25: note = Seed: YGFLNVIVHSATGFKQSSKALQRPV
YGFLNVIVHSATGYKQASVALPRPV

SEQ ID NO: 31925 - protein, 25 aa, synthetic construct
  source 1..25: note = Seed: YGFLNVIVHSATGFKQSSKALQRPV
YGFLNVIVHSATGYKQASVALQRPV

SEQ ID NO: 31926 - protein, 25 aa, synthetic construct
  source 1..25: note = Seed: YGFLNVIVHSATGFKQSSKALQRPV
YGFLNVIVHSATGYKQASVALRRPV

SEQ ID NO: 31927 - protein, 25 aa, synthetic construct
  source 1..25: note = Seed: YGFLNVIVHSATGFKQSSKALQRPV
YGFLNVIVHSATGYKQASVALSRPV

SEQ ID NO: 31928 - protein, 25 aa, synthetic construct
  source 1..25: note = Seed: YGFLNVIVHSATGFKQSSKALQRPV
YGFLNVIVHSATGYKQASVALTRPV

SEQ ID NO: 31929 - protein, 25 aa, synthetic construct
  source 1..25: note = Seed: YGFLNVIVHSATGFKQSSKALQRPV
YGFLNVIVHSATGYKQASVALVRPV

SEQ ID NO: 31930 - protein, 25 aa, synthetic construct
  source 1..25: note = Seed: YGFLNVIVHSATGFKQSSKALQRPV
YGFLNVIVHSATGYKQASVALYRPV

SEQ ID NO: 31931 - protein, 25 aa, synthetic construct
  source 1..25: note = Seed: YGFLNVIVHSATGFKQSSKALQRPV
YGFLNVIVHSATGYKQCSAALARPV

SEQ ID NO: 31932 - protein, 25 aa, synthetic construct
  source 1..25: note = Seed: YGFLNVIVHSATGFKQSSKALQRPV
YGFLNVIVHSATGYKQCSAALNRPV

SEQ ID NO: 31933 - protein, 25 aa, synthetic construct
  source 1..25: note = Seed: YGFLNVIVHSATGFKQSSKALQRPV
YGFLNVIVHSATGYKQCSFALFRPV

SEQ ID NO: 31934 - protein, 25 aa, synthetic construct
  source 1..25: note = Seed: YGFLNVIVHSATGFKQSSKALQRPV
YGFLNVIVHSATGYKQCSRALARPV

SEQ ID NO: 31935 - protein, 25 aa, synthetic construct
  source 1..25: note = Seed: YGFLNVIVHSATGFKQSSKALQRPV
YGFLNVIVHSATGYKQDSAALARPV

SEQ ID NO: 31936 - protein, 25 aa, synthetic construct
  source 1..25: note = Seed: YGFLNVIVHSATGFKQSSKALQRPV
YGFLNVIVHSATGYKQDSNALARPV

SEQ ID NO: 31937 - protein, 25 aa, synthetic construct
  source 1..25: note = Seed: YGFLNVIVHSATGFKQSSKALQRPV
YGFLNVIVHSATGYKQDSNALGRPV

SEQ ID NO: 31938 - protein, 25 aa, synthetic construct
  source 1..25: note = Seed: YGFLNVIVHSATGFKQSSKALQRPV
YGFLNVIVHSATGYKQDSNALSRPV

SEQ ID NO: 31939 - protein, 25 aa, synthetic construct
  source 1..25: note = Seed: YGFLNVIVHSATGFKQSSKALQRPV
YGFLNVIVHSATGYKQDSSALARPV

SEQ ID NO: 31940 - protein, 25 aa, synthetic construct
  source 1..25: note = Seed: YGFLNVIVHSATGFKQSSKALQRPV
YGFLNVIVHSATGYKQDSSALSRPV

SEQ ID NO: 31941 - protein, 25 aa, synthetic construct
  source 1..25: note = Seed: YGFLNVIVHSATGFKQSSKALQRPV
YGFLNVIVHSATGYKQDSTALARPV

SEQ ID NO: 31942 - protein, 25 aa, synthetic construct
  source 1..25: note = Seed: YGFLNVIVHSATGFKQSSKALQRPV
YGFLNVIVHSATGYKQDSTALGRPV

SEQ ID NO: 31943 - protein, 25 aa, synthetic construct
  source 1..25: note = Seed: YGFLNVIVHSATGFKQSSKALQRPV
YGFLNVIVHSATGYKQDSTALQRPV

SEQ ID NO: 31944 - protein, 25 aa, synthetic construct
  source 1..25: note = Seed: YGFLNVIVHSATGFKQSSKALQRPV
YGFLNVIVHSATGYKQDSTALSRPV

SEQ ID NO: 31945 - protein, 25 aa, synthetic construct
  source 1..25: note = Seed: YGFLNVIVHSATGFKQSSKALQRPV
YGFLNVIVHSATGYKQDSTALTRPV

SEQ ID NO: 31946 - protein, 25 aa, synthetic construct
  source 1..25: note = Seed: YGFLNVIVHSATGFKQSSKALQRPV
YGFLNVIVHSATGYKQDSVALARPV

SEQ ID NO: 31947 - protein, 25 aa, synthetic construct
  source 1..25: note = Seed: YGFLNVIVHSATGFKQSSKALQRPV
YGFLNVIVHSATGYKQDSVALSRPV

SEQ ID NO: 31948 - protein, 25 aa, synthetic construct
  source 1..25: note = Seed: YGFLNVIVHSATGFKQSSKALQRPV
YGFLNVIVHSATGYKQESAALARPV

SEQ ID NO: 31949 - protein, 25 aa, synthetic construct
  source 1..25: note = Seed: YGFLNVIVHSATGFKQSSKALQRPV
YGFLNVIVHSATGYKQESAALGRPV

SEQ ID NO: 31950 - protein, 25 aa, synthetic construct
  source 1..25: note = Seed: YGFLNVIVHSATGFKQSSKALQRPV
YGFLNVIVHSATGYKQESAALHRPV

SEQ ID NO: 31951 - protein, 25 aa, synthetic construct
  source 1..25: note = Seed: YGFLNVIVHSATGFKQSSKALQRPV
YGFLNVIVHSATGYKQESAALIRPV

SEQ ID NO: 31952 - protein, 25 aa, synthetic construct
  source 1..25: note = Seed: YGFLNVIVHSATGFKQSSKALQRPV
YGFLNVIVHSATGYKQESAALLRPV

SEQ ID NO: 31953 - protein, 25 aa, synthetic construct
  source 1..25: note = Seed: YGFLNVIVHSATGFKQSSKALQRPV
YGFLNVIVHSATGYKQESAALMRPV

SEQ ID NO: 31954 - protein, 25 aa, synthetic construct
  source 1..25: note = Seed: YGFLNVIVHSATGFKQSSKALQRPV
YGFLNVIVHSATGYKQESAALNRPV

SEQ ID NO: 31955 - protein, 25 aa, synthetic construct
  source 1..25: note = Seed: YGFLNVIVHSATGFKQSSKALQRPV
YGFLNVIVHSATGYKQESAALQRPV

SEQ ID NO: 31956 - protein, 25 aa, synthetic construct
  source 1..25: note = Seed: YGFLNVIVHSATGFKQSSKALQRPV
YGFLNVIVHSATGYKQESAALSRPV

SEQ ID NO: 31957 - protein, 25 aa, synthetic construct
  source 1..25: note = Seed: YGFLNVIVHSATGFKQSSKALQRPV
YGFLNVIVHSATGYKQESAALTRPV

SEQ ID NO: 31958 - protein, 25 aa, synthetic construct
  source 1..25: note = Seed: YGFLNVIVHSATGFKQSSKALQRPV
YGFLNVIVHSATGYKQESAALVRPV

SEQ ID NO: 31959 - protein, 25 aa, synthetic construct
  source 1..25: note = Seed: YGFLNVIVHSATGFKQSSKALQRPV
YGFLNVIVHSATGYKQESFALFRPV

SEQ ID NO: 31960 - protein, 25 aa, synthetic construct
  source 1..25: note = Seed: YGFLNVIVHSATGFKQSSKALQRPV
YGFLNVIVHSATGYKQESFALIRPV

SEQ ID NO: 31961 - protein, 25 aa, synthetic construct
  source 1..25: note = Seed: YGFLNVIVHSATGFKQSSKALQRPV
YGFLNVIVHSATGYKQESFALLRPV

SEQ ID NO: 31962 - protein, 25 aa, synthetic construct
  source 1..25: note = Seed: YGFLNVIVHSATGFKQSSKALQRPV
YGFLNVIVHSATGYKQESFALVRPV

SEQ ID NO: 31963 - protein, 25 aa, synthetic construct
  source 1..25: note = Seed: YGFLNVIVHSATGFKQSSKALQRPV
YGFLNVIVHSATGYKQESGALARPV

SEQ ID NO: 31964 - protein, 25 aa, synthetic construct
  source 1..25: note = Seed: YGFLNVIVHSATGFKQSSKALQRPV
YGFLNVIVHSATGYKQESIALARPV

SEQ ID NO: 31965 - protein, 25 aa, synthetic construct
  source 1..25: note = Seed: YGFLNVIVHSATGFKQSSKALQRPV
YGFLNVIVHSATGYKQESIALNRPV

SEQ ID NO: 31966 - protein, 25 aa, synthetic construct
  source 1..25: note = Seed: YGFLNVIVHSATGFKQSSKALQRPV
YGFLNVIVHSATGYKQESIALSRPV

SEQ ID NO: 31967 - protein, 25 aa, synthetic construct
  source 1..25: note = Seed: YGFLNVIVHSATGFKQSSKALQRPV
YGFLNVIVHSATGYKQESIALTRPV

SEQ ID NO: 31968 - protein, 25 aa, synthetic construct
  source 1..25: note = Seed: YGFLNVIVHSATGFKQSSKALQRPV
YGFLNVIVHSATGYKQESNALARPV

SEQ ID NO: 31969 - protein, 25 aa, synthetic construct
  source 1..25: note = Seed: YGFLNVIVHSATGFKQSSKALQRPV
YGFLNVIVHSATGYKQESNALSRPV

SEQ ID NO: 31970 - protein, 25 aa, synthetic construct
  source 1..25: note = Seed: YGFLNVIVHSATGFKQSSKALQRPV
YGFLNVIVHSATGYKQESPALARPV

SEQ ID NO: 31971 - protein, 25 aa, synthetic construct
  source 1..25: note = Seed: YGFLNVIVHSATGFKQSSKALQRPV
YGFLNVIVHSATGYKQESPALGRPV

SEQ ID NO: 31972 - protein, 25 aa, synthetic construct
  source 1..25: note = Seed: YGFLNVIVHSATGFKQSSKALQRPV
YGFLNVIVHSATGYKQESPALMRPV

SEQ ID NO: 31973 - protein, 25 aa, synthetic construct
  source 1..25: note = Seed: YGFLNVIVHSATGFKQSSKALQRPV
YGFLNVIVHSATGYKQESPALNRPV

SEQ ID NO: 31974 - protein, 25 aa, synthetic construct
  source 1..25: note = Seed: YGFLNVIVHSATGFKQSSKALQRPV
YGFLNVIVHSATGYKQESPALSRPV

SEQ ID NO: 31975 - protein, 25 aa, synthetic construct
  source 1..25: note = Seed: YGFLNVIVHSATGFKQSSKALQRPV
YGFLNVIVHSATGYKQESPALTRPV

SEQ ID NO: 31976 - protein, 25 aa, synthetic construct
  source 1..25: note = Seed: YGFLNVIVHSATGFKQSSKALQRPV
YGFLNVIVHSATGYKQESPALVRPV

SEQ ID NO: 31977 - protein, 25 aa, synthetic construct
  source 1..25: note = Seed: YGFLNVIVHSATGFKQSSKALQRPV
YGFLNVIVHSATGYKQESSALARPV

SEQ ID NO: 31978 - protein, 25 aa, synthetic construct
  source 1..25: note = Seed: YGFLNVIVHSATGFKQSSKALQRPV
YGFLNVIVHSATGYKQESSALNRPV

SEQ ID NO: 31979 - protein, 25 aa, synthetic construct
  source 1..25: note = Seed: YGFLNVIVHSATGFKQSSKALQRPV
YGFLNVIVHSATGYKQESSALSRPV

SEQ ID NO: 31980 - protein, 25 aa, synthetic construct
  source 1..25: note = Seed: YGFLNVIVHSATGFKQSSKALQRPV
YGFLNVIVHSATGYKQESSALTRPV

SEQ ID NO: 31981 - protein, 25 aa, synthetic construct
  source 1..25: note = Seed: YGFLNVIVHSATGFKQSSKALQRPV
YGFLNVIVHSATGYKQESTALARPV

SEQ ID NO: 31982 - protein, 25 aa, synthetic construct
  source 1..25: note = Seed: YGFLNVIVHSATGFKQSSKALQRPV
YGFLNVIVHSATGYKQESTALNRPV

SEQ ID NO: 31983 - protein, 25 aa, synthetic construct
  source 1..25: note = Seed: YGFLNVIVHSATGFKQSSKALQRPV
YGFLNVIVHSATGYKQESTALSRPV

SEQ ID NO: 31984 - protein, 25 aa, synthetic construct
  source 1..25: note = Seed: YGFLNVIVHSATGFKQSSKALQRPV
YGFLNVIVHSATGYKQESTALTRPV

SEQ ID NO: 31985 - protein, 25 aa, synthetic construct
  source 1..25: note = Seed: YGFLNVIVHSATGFKQSSKALQRPV
YGFLNVIVHSATGYKQESTALVRPV

SEQ ID NO: 31986 - protein, 25 aa, synthetic construct
  source 1..25: note = Seed: YGFLNVIVHSATGFKQSSKALQRPV
YGFLNVIVHSATGYKQESVALARPV

SEQ ID NO: 31987 - protein, 25 aa, synthetic construct
  source 1..25: note = Seed: YGFLNVIVHSATGFKQSSKALQRPV
YGFLNVIVHSATGYKQESVALGRPV

SEQ ID NO: 31988 - protein, 25 aa, synthetic construct
  source 1..25: note = Seed: YGFLNVIVHSATGFKQSSKALQRPV
YGFLNVIVHSATGYKQESVALMRPV

SEQ ID NO: 31989 - protein, 25 aa, synthetic construct
  source 1..25: note = Seed: YGFLNVIVHSATGFKQSSKALQRPV
YGFLNVIVHSATGYKQESVALNRPV

SEQ ID NO: 31990 - protein, 25 aa, synthetic construct
  source 1..25: note = Seed: YGFLNVIVHSATGFKQSSKALQRPV
YGFLNVIVHSATGYKQESVALSRPV

SEQ ID NO: 31991 - protein, 25 aa, synthetic construct
  source 1..25: note = Seed: YGFLNVIVHSATGFKQSSKALQRPV
YGFLNVIVHSATGYKQESVALTRPV

SEQ ID NO: 31992 - protein, 25 aa, synthetic construct
  source 1..25: note = Seed: YGFLNVIVHSATGFKQSSKALQRPV
YGFLNVIVHSATGYKQESVALVRPV

SEQ ID NO: 31993 - protein, 25 aa, synthetic construct
  source 1..25: note = Seed: YGFLNVIVHSATGFKQSSKALQRPV
YGFLNVIVHSATGYKQFSAALARPV

SEQ ID NO: 31994 - protein, 25 aa, synthetic construct
  source 1..25: note = Seed: YGFLNVIVHSATGFKQSSKALQRPV
YGFLNVIVHSATGYKQFSAALCRPV

SEQ ID NO: 31995 - protein, 25 aa, synthetic construct
  source 1..25: note = Seed: YGFLNVIVHSATGFKQSSKALQRPV
YGFLNVIVHSATGYKQFSAALDRPV

SEQ ID NO: 31996 - protein, 25 aa, synthetic construct
  source 1..25: note = Seed: YGFLNVIVHSATGFKQSSKALQRPV
YGFLNVIVHSATGYKQFSAALERPV

SEQ ID NO: 31997 - protein, 25 aa, synthetic construct
  source 1..25: note = Seed: YGFLNVIVHSATGFKQSSKALQRPV
YGFLNVIVHSATGYKQFSAALGRPV

SEQ ID NO: 31998 - protein, 25 aa, synthetic construct
  source 1..25: note = Seed: YGFLNVIVHSATGFKQSSKALQRPV
YGFLNVIVHSATGYKQFSAALHRPV

SEQ ID NO: 31999 - protein, 25 aa, synthetic construct
  source 1..25: note = Seed: YGFLNVIVHSATGFKQSSKALQRPV
YGFLNVIVHSATGYKQFSAALIRPV

SEQ ID NO: 32000 - protein, 25 aa, synthetic construct
  source 1..25: note = Seed: YGFLNVIVHSATGFKQSSKALQRPV
YGFLNVIVHSATGYKQFSAALLRPV

SEQ ID NO: 32001 - protein, 25 aa, synthetic construct
  source 1..25: note = Seed: YGFLNVIVHSATGFKQSSKALQRPV
YGFLNVIVHSATGYKQFSAALMRPV

SEQ ID NO: 32002 - protein, 25 aa, synthetic construct
  source 1..25: note = Seed: YGFLNVIVHSATGFKQSSKALQRPV
YGFLNVIVHSATGYKQFSAALNRPV

SEQ ID NO: 32003 - protein, 25 aa, synthetic construct
  source 1..25: note = Seed: YGFLNVIVHSATGFKQSSKALQRPV
YGFLNVIVHSATGYKQFSAALPRPV

SEQ ID NO: 32004 - protein, 25 aa, synthetic construct
  source 1..25: note = Seed: YGFLNVIVHSATGFKQSSKALQRPV
YGFLNVIVHSATGYKQFSAALQRPV

SEQ ID NO: 32005 - protein, 25 aa, synthetic construct
  source 1..25: note = Seed: YGFLNVIVHSATGFKQSSKALQRPV
YGFLNVIVHSATGYKQFSAALSRPV

SEQ ID NO: 32006 - protein, 25 aa, synthetic construct
  source 1..25: note = Seed: YGFLNVIVHSATGFKQSSKALQRPV
YGFLNVIVHSATGYKQFSAALTRPV

SEQ ID NO: 32007 - protein, 25 aa, synthetic construct
  source 1..25: note = Seed: YGFLNVIVHSATGFKQSSKALQRPV
YGFLNVIVHSATGYKQFSAALVRPV

SEQ ID NO: 32008 - protein, 25 aa, synthetic construct
  source 1..25: note = Seed: YGFLNVIVHSATGFKQSSKALQRPV
YGFLNVIVHSATGYKQFSAALWRPV

SEQ ID NO: 32009 - protein, 25 aa, synthetic construct
  source 1..25: note = Seed: YGFLNVIVHSATGFKQSSKALQRPV
YGFLNVIVHSATGYKQFSAALYRPV

SEQ ID NO: 32010 - protein, 25 aa, synthetic construct
  source 1..25: note = Seed: YGFLNVIVHSATGFKQSSKALQRPV
YGFLNVIVHSATGYKQFSDALFRPV

SEQ ID NO: 32011 - protein, 25 aa, synthetic construct
  source 1..25: note = Seed: YGFLNVIVHSATGFKQSSKALQRPV
YGFLNVIVHSATGYKQFSEALARPV

SEQ ID NO: 32012 - protein, 25 aa, synthetic construct
  source 1..25: note = Seed: YGFLNVIVHSATGFKQSSKALQRPV
YGFLNVIVHSATGYKQFSEALFRPV

SEQ ID NO: 32013 - protein, 25 aa, synthetic construct
  source 1..25: note = Seed: YGFLNVIVHSATGFKQSSKALQRPV
YGFLNVIVHSATGYKQFSFALARPV

SEQ ID NO: 32014 - protein, 25 aa, synthetic construct
  source 1..25: note = Seed: YGFLNVIVHSATGFKQSSKALQRPV
YGFLNVIVHSATGYKQFSFALFRPV

SEQ ID NO: 32015 - protein, 25 aa, synthetic construct
  source 1..25: note = Seed: YGFLNVIVHSATGFKQSSKALQRPV
YGFLNVIVHSATGYKQFSFALIRPV

SEQ ID NO: 32016 - protein, 25 aa, synthetic construct
  source 1..25: note = Seed: YGFLNVIVHSATGFKQSSKALQRPV
YGFLNVIVHSATGYKQFSFALLRPV

SEQ ID NO: 32017 - protein, 25 aa, synthetic construct
  source 1..25: note = Seed: YGFLNVIVHSATGFKQSSKALQRPV
YGFLNVIVHSATGYKQFSFALMRPV

SEQ ID NO: 32018 - protein, 25 aa, synthetic construct
  source 1..25: note = Seed: YGFLNVIVHSATGFKQSSKALQRPV
YGFLNVIVHSATGYKQFSFALNRPV

SEQ ID NO: 32019 - protein, 25 aa, synthetic construct
  source 1..25: note = Seed: YGFLNVIVHSATGFKQSSKALQRPV
YGFLNVIVHSATGYKQFSFALSRPV

SEQ ID NO: 32020 - protein, 25 aa, synthetic construct
  source 1..25: note = Seed: YGFLNVIVHSATGFKQSSKALQRPV
YGFLNVIVHSATGYKQFSFALVRPV

SEQ ID NO: 32021 - protein, 25 aa, synthetic construct
  source 1..25: note = Seed: YGFLNVIVHSATGFKQSSKALQRPV
YGFLNVIVHSATGYKQFSFALWRPV

SEQ ID NO: 32022 - protein, 25 aa, synthetic construct
  source 1..25: note = Seed: YGFLNVIVHSATGFKQSSKALQRPV
YGFLNVIVHSATGYKQFSFALYRPV

SEQ ID NO: 32023 - protein, 25 aa, synthetic construct
  source 1..25: note = Seed: YGFLNVIVHSATGFKQSSKALQRPV
YGFLNVIVHSATGYKQFSGALARPV

SEQ ID NO: 32024 - protein, 25 aa, synthetic construct
  source 1..25: note = Seed: YGFLNVIVHSATGFKQSSKALQRPV
YGFLNVIVHSATGYKQFSGALGRPV

SEQ ID NO: 32025 - protein, 25 aa, synthetic construct
  source 1..25: note = Seed: YGFLNVIVHSATGFKQSSKALQRPV
YGFLNVIVHSATGYKQFSGALIRPV

SEQ ID NO: 32026 - protein, 25 aa, synthetic construct
  source 1..25: note = Seed: YGFLNVIVHSATGFKQSSKALQRPV
YGFLNVIVHSATGYKQFSGALLRPV

SEQ ID NO: 32027 - protein, 25 aa, synthetic construct
  source 1..25: note = Seed: YGFLNVIVHSATGFKQSSKALQRPV
YGFLNVIVHSATGYKQFSGALMRPV

SEQ ID NO: 32028 - protein, 25 aa, synthetic construct
  source 1..25: note = Seed: YGFLNVIVHSATGFKQSSKALQRPV
YGFLNVIVHSATGYKQFSGALNRPV

SEQ ID NO: 32029 - protein, 25 aa, synthetic construct
  source 1..25: note = Seed: YGFLNVIVHSATGFKQSSKALQRPV
YGFLNVIVHSATGYKQFSGALSRPV

SEQ ID NO: 32030 - protein, 25 aa, synthetic construct
  source 1..25: note = Seed: YGFLNVIVHSATGFKQSSKALQRPV
YGFLNVIVHSATGYKQFSGALTRPV

SEQ ID NO: 32031 - protein, 25 aa, synthetic construct
  source 1..25: note = Seed: YGFLNVIVHSATGFKQSSKALQRPV
YGFLNVIVHSATGYKQFSGALVRPV

SEQ ID NO: 32032 - protein, 25 aa, synthetic construct
  source 1..25: note = Seed: YGFLNVIVHSATGFKQSSKALQRPV
YGFLNVIVHSATGYKQFSHALARPV

SEQ ID NO: 32033 - protein, 25 aa, synthetic construct
  source 1..25: note = Seed: YGFLNVIVHSATGFKQSSKALQRPV
YGFLNVIVHSATGYKQFSHALSRPV

SEQ ID NO: 32034 - protein, 25 aa, synthetic construct
  source 1..25: note = Seed: YGFLNVIVHSATGFKQSSKALQRPV
YGFLNVIVHSATGYKQFSHALTRPV

SEQ ID NO: 32035 - protein, 25 aa, synthetic construct
  source 1..25: note = Seed: YGFLNVIVHSATGFKQSSKALQRPV
YGFLNVIVHSATGYKQFSHALVRPV

SEQ ID NO: 32036 - protein, 25 aa, synthetic construct
  source 1..25: note = Seed: YGFLNVIVHSATGFKQSSKALQRPV
YGFLNVIVHSATGYKQFSIALARPV

SEQ ID NO: 32037 - protein, 25 aa, synthetic construct
  source 1..25: note = Seed: YGFLNVIVHSATGFKQSSKALQRPV
YGFLNVIVHSATGYKQFSIALGRPV

SEQ ID NO: 32038 - protein, 25 aa, synthetic construct
  source 1..25: note = Seed: YGFLNVIVHSATGFKQSSKALQRPV
YGFLNVIVHSATGYKQFSIALHRPV

SEQ ID NO: 32039 - protein, 25 aa, synthetic construct
  source 1..25: note = Seed: YGFLNVIVHSATGFKQSSKALQRPV
YGFLNVIVHSATGYKQFSIALIRPV

SEQ ID NO: 32040 - protein, 25 aa, synthetic construct
  source 1..25: note = Seed: YGFLNVIVHSATGFKQSSKALQRPV
YGFLNVIVHSATGYKQFSIALLRPV

SEQ ID NO: 32041 - protein, 25 aa, synthetic construct
  source 1..25: note = Seed: YGFLNVIVHSATGFKQSSKALQRPV
YGFLNVIVHSATGYKQFSIALMRPV

SEQ ID NO: 32042 - protein, 25 aa, synthetic construct
  source 1..25: note = Seed: YGFLNVIVHSATGFKQSSKALQRPV
YGFLNVIVHSATGYKQFSIALNRPV

SEQ ID NO: 32043 - protein, 25 aa, synthetic construct
  source 1..25: note = Seed: YGFLNVIVHSATGFKQSSKALQRPV
YGFLNVIVHSATGYKQFSIALPRPV

SEQ ID NO: 32044 - protein, 25 aa, synthetic construct
  source 1..25: note = Seed: YGFLNVIVHSATGFKQSSKALQRPV
YGFLNVIVHSATGYKQFSIALQRPV

SEQ ID NO: 32045 - protein, 25 aa, synthetic construct
  source 1..25: note = Seed: YGFLNVIVHSATGFKQSSKALQRPV
YGFLNVIVHSATGYKQFSIALRRPV

SEQ ID NO: 32046 - protein, 25 aa, synthetic construct
  source 1..25: note = Seed: YGFLNVIVHSATGFKQSSKALQRPV
YGFLNVIVHSATGYKQFSIALSRPV

SEQ ID NO: 32047 - protein, 25 aa, synthetic construct
  source 1..25: note = Seed: YGFLNVIVHSATGFKQSSKALQRPV
YGFLNVIVHSATGYKQFSIALTRPV

SEQ ID NO: 32048 - protein, 25 aa, synthetic construct
  source 1..25: note = Seed: YGFLNVIVHSATGFKQSSKALQRPV
YGFLNVIVHSATGYKQFSIALVRPV

SEQ ID NO: 32049 - protein, 25 aa, synthetic construct
  source 1..25: note = Seed: YGFLNVIVHSATGFKQSSKALQRPV
YGFLNVIVHSATGYKQFSIALYRPV

SEQ ID NO: 32050 - protein, 25 aa, synthetic construct
  source 1..25: note = Seed: YGFLNVIVHSATGFKQSSKALQRPV
YGFLNVIVHSATGYKQFSKALARPV

SEQ ID NO: 32051 - protein, 25 aa, synthetic construct
  source 1..25: note = Seed: YGFLNVIVHSATGFKQSSKALQRPV
YGFLNVIVHSATGYKQFSKALFRPV

SEQ ID NO: 32052 - protein, 25 aa, synthetic construct
  source 1..25: note = Seed: YGFLNVIVHSATGFKQSSKALQRPV
YGFLNVIVHSATGYKQFSKALGRPV

SEQ ID NO: 32053 - protein, 25 aa, synthetic construct
  source 1..25: note = Seed: YGFLNVIVHSATGFKQSSKALQRPV
YGFLNVIVHSATGYKQFSKALRRPV

SEQ ID NO: 32054 - protein, 25 aa, synthetic construct
  source 1..25: note = Seed: YGFLNVIVHSATGFKQSSKALQRPV
YGFLNVIVHSATGYKQFSKALSRPV

SEQ ID NO: 32055 - protein, 25 aa, synthetic construct
  source 1..25: note = Seed: YGFLNVIVHSATGFKQSSKALQRPV
YGFLNVIVHSATGYKQFSLALARPV

SEQ ID NO: 32056 - protein, 25 aa, synthetic construct
  source 1..25: note = Seed: YGFLNVIVHSATGFKQSSKALQRPV
YGFLNVIVHSATGYKQFSLALFRPV

SEQ ID NO: 32057 - protein, 25 aa, synthetic construct
  source 1..25: note = Seed: YGFLNVIVHSATGFKQSSKALQRPV
YGFLNVIVHSATGYKQFSLALGRPV

SEQ ID NO: 32058 - protein, 25 aa, synthetic construct
  source 1..25: note = Seed: YGFLNVIVHSATGFKQSSKALQRPV
YGFLNVIVHSATGYKQFSLALHRPV

SEQ ID NO: 32059 - protein, 25 aa, synthetic construct
  source 1..25: note = Seed: YGFLNVIVHSATGFKQSSKALQRPV
YGFLNVIVHSATGYKQFSLALIRPV

SEQ ID NO: 32060 - protein, 25 aa, synthetic construct
  source 1..25: note = Seed: YGFLNVIVHSATGFKQSSKALQRPV
YGFLNVIVHSATGYKQFSLALLRPV

SEQ ID NO: 32061 - protein, 25 aa, synthetic construct
  source 1..25: note = Seed: YGFLNVIVHSATGFKQSSKALQRPV
YGFLNVIVHSATGYKQFSLALMRPV

SEQ ID NO: 32062 - protein, 25 aa, synthetic construct
  source 1..25: note = Seed: YGFLNVIVHSATGFKQSSKALQRPV
YGFLNVIVHSATGYKQFSLALNRPV

SEQ ID NO: 32063 - protein, 25 aa, synthetic construct
  source 1..25: note = Seed: YGFLNVIVHSATGFKQSSKALQRPV
YGFLNVIVHSATGYKQFSLALSRPV

SEQ ID NO: 32064 - protein, 25 aa, synthetic construct
  source 1..25: note = Seed: YGFLNVIVHSATGFKQSSKALQRPV
YGFLNVIVHSATGYKQFSLALTRPV

SEQ ID NO: 32065 - protein, 25 aa, synthetic construct
  source 1..25: note = Seed: YGFLNVIVHSATGFKQSSKALQRPV
YGFLNVIVHSATGYKQFSLALVRPV

SEQ ID NO: 32066 - protein, 25 aa, synthetic construct
  source 1..25: note = Seed: YGFLNVIVHSATGFKQSSKALQRPV
YGFLNVIVHSATGYKQFSLALWRPV

SEQ ID NO: 32067 - protein, 25 aa, synthetic construct
  source 1..25: note = Seed: YGFLNVIVHSATGFKQSSKALQRPV
YGFLNVIVHSATGYKQFSLALYRPV

SEQ ID NO: 32068 - protein, 25 aa, synthetic construct
  source 1..25: note = Seed: YGFLNVIVHSATGFKQSSKALQRPV
YGFLNVIVHSATGYKQFSMALARPV

SEQ ID NO: 32069 - protein, 25 aa, synthetic construct
  source 1..25: note = Seed: YGFLNVIVHSATGFKQSSKALQRPV
YGFLNVIVHSATGYKQFSMALGRPV

SEQ ID NO: 32070 - protein, 25 aa, synthetic construct
  source 1..25: note = Seed: YGFLNVIVHSATGFKQSSKALQRPV
YGFLNVIVHSATGYKQFSMALHRPV

SEQ ID NO: 32071 - protein, 25 aa, synthetic construct
  source 1..25: note = Seed: YGFLNVIVHSATGFKQSSKALQRPV
YGFLNVIVHSATGYKQFSMALIRPV

SEQ ID NO: 32072 - protein, 25 aa, synthetic construct
  source 1..25: note = Seed: YGFLNVIVHSATGFKQSSKALQRPV
YGFLNVIVHSATGYKQFSMALLRPV

SEQ ID NO: 32073 - protein, 25 aa, synthetic construct
  source 1..25: note = Seed: YGFLNVIVHSATGFKQSSKALQRPV
YGFLNVIVHSATGYKQFSMALMRPV

SEQ ID NO: 32074 - protein, 25 aa, synthetic construct
  source 1..25: note = Seed: YGFLNVIVHSATGFKQSSKALQRPV
YGFLNVIVHSATGYKQFSMALNRPV

SEQ ID NO: 32075 - protein, 25 aa, synthetic construct
  source 1..25: note = Seed: YGFLNVIVHSATGFKQSSKALQRPV
YGFLNVIVHSATGYKQFSMALRRPV

SEQ ID NO: 32076 - protein, 25 aa, synthetic construct
  source 1..25: note = Seed: YGFLNVIVHSATGFKQSSKALQRPV
YGFLNVIVHSATGYKQFSMALSRPV

SEQ ID NO: 32077 - protein, 25 aa, synthetic construct
  source 1..25: note = Seed: YGFLNVIVHSATGFKQSSKALQRPV
YGFLNVIVHSATGYKQFSMALTRPV

SEQ ID NO: 32078 - protein, 25 aa, synthetic construct
  source 1..25: note = Seed: YGFLNVIVHSATGFKQSSKALQRPV
YGFLNVIVHSATGYKQFSMALVRPV

SEQ ID NO: 32079 - protein, 25 aa, synthetic construct
  source 1..25: note = Seed: YGFLNVIVHSATGFKQSSKALQRPV
YGFLNVIVHSATGYKQFSMALWRPV

SEQ ID NO: 32080 - protein, 25 aa, synthetic construct
  source 1..25: note = Seed: YGFLNVIVHSATGFKQSSKALQRPV
YGFLNVIVHSATGYKQFSMALYRPV

SEQ ID NO: 32081 - protein, 25 aa, synthetic construct
  source 1..25: note = Seed: YGFLNVIVHSATGFKQSSKALQRPV
YGFLNVIVHSATGYKQFSNALARPV

SEQ ID NO: 32082 - protein, 25 aa, synthetic construct
  source 1..25: note = Seed: YGFLNVIVHSATGFKQSSKALQRPV
YGFLNVIVHSATGYKQFSNALNRPV

SEQ ID NO: 32083 - protein, 25 aa, synthetic construct
  source 1..25: note = Seed: YGFLNVIVHSATGFKQSSKALQRPV
YGFLNVIVHSATGYKQFSNALSRPV

SEQ ID NO: 32084 - protein, 25 aa, synthetic construct
  source 1..25: note = Seed: YGFLNVIVHSATGFKQSSKALQRPV
YGFLNVIVHSATGYKQFSNALTRPV

SEQ ID NO: 32085 - protein, 25 aa, synthetic construct
  source 1..25: note = Seed: YGFLNVIVHSATGFKQSSKALQRPV
YGFLNVIVHSATGYKQFSNALVRPV

SEQ ID NO: 32086 - protein, 25 aa, synthetic construct
  source 1..25: note = Seed: YGFLNVIVHSATGFKQSSKALQRPV
YGFLNVIVHSATGYKQFSPALARPV

SEQ ID NO: 32087 - protein, 25 aa, synthetic construct
  source 1..25: note = Seed: YGFLNVIVHSATGFKQSSKALQRPV
YGFLNVIVHSATGYKQFSPALDRPV

SEQ ID NO: 32088 - protein, 25 aa, synthetic construct
  source 1..25: note = Seed: YGFLNVIVHSATGFKQSSKALQRPV
YGFLNVIVHSATGYKQFSPALERPV

SEQ ID NO: 32089 - protein, 25 aa, synthetic construct
  source 1..25: note = Seed: YGFLNVIVHSATGFKQSSKALQRPV
YGFLNVIVHSATGYKQFSPALGRPV

SEQ ID NO: 32090 - protein, 25 aa, synthetic construct
  source 1..25: note = Seed: YGFLNVIVHSATGFKQSSKALQRPV
YGFLNVIVHSATGYKQFSPALHRPV

SEQ ID NO: 32091 - protein, 25 aa, synthetic construct
  source 1..25: note = Seed: YGFLNVIVHSATGFKQSSKALQRPV
YGFLNVIVHSATGYKQFSPALIRPV

SEQ ID NO: 32092 - protein, 25 aa, synthetic construct
  source 1..25: note = Seed: YGFLNVIVHSATGFKQSSKALQRPV
YGFLNVIVHSATGYKQFSPALLRPV

SEQ ID NO: 32093 - protein, 25 aa, synthetic construct
  source 1..25: note = Seed: YGFLNVIVHSATGFKQSSKALQRPV
YGFLNVIVHSATGYKQFSPALMRPV

SEQ ID NO: 32094 - protein, 25 aa, synthetic construct
  source 1..25: note = Seed: YGFLNVIVHSATGFKQSSKALQRPV
YGFLNVIVHSATGYKQFSPALNRPV

SEQ ID NO: 32095 - protein, 25 aa, synthetic construct
  source 1..25: note = Seed: YGFLNVIVHSATGFKQSSKALQRPV
YGFLNVIVHSATGYKQFSPALPRPV

SEQ ID NO: 32096 - protein, 25 aa, synthetic construct
  source 1..25: note = Seed: YGFLNVIVHSATGFKQSSKALQRPV
YGFLNVIVHSATGYKQFSPALQRPV

SEQ ID NO: 32097 - protein, 25 aa, synthetic construct
  source 1..25: note = Seed: YGFLNVIVHSATGFKQSSKALQRPV
YGFLNVIVHSATGYKQFSPALSRPV

SEQ ID NO: 32098 - protein, 25 aa, synthetic construct
  source 1..25: note = Seed: YGFLNVIVHSATGFKQSSKALQRPV
YGFLNVIVHSATGYKQFSPALTRPV

SEQ ID NO: 32099 - protein, 25 aa, synthetic construct
  source 1..25: note = Seed: YGFLNVIVHSATGFKQSSKALQRPV
YGFLNVIVHSATGYKQFSPALVRPV

SEQ ID NO: 32100 - protein, 25 aa, synthetic construct
  source 1..25: note = Seed: YGFLNVIVHSATGFKQSSKALQRPV
YGFLNVIVHSATGYKQFSQALARPV

SEQ ID NO: 32101 - protein, 25 aa, synthetic construct
  source 1..25: note = Seed: YGFLNVIVHSATGFKQSSKALQRPV
YGFLNVIVHSATGYKQFSQALSRPV

SEQ ID NO: 32102 - protein, 25 aa, synthetic construct
  source 1..25: note = Seed: YGFLNVIVHSATGFKQSSKALQRPV
YGFLNVIVHSATGYKQFSRALARPV

SEQ ID NO: 32103 - protein, 25 aa, synthetic construct
  source 1..25: note = Seed: YGFLNVIVHSATGFKQSSKALQRPV
YGFLNVIVHSATGYKQFSRALGRPV

SEQ ID NO: 32104 - protein, 25 aa, synthetic construct
  source 1..25: note = Seed: YGFLNVIVHSATGFKQSSKALQRPV
YGFLNVIVHSATGYKQFSRALHRPV

SEQ ID NO: 32105 - protein, 25 aa, synthetic construct
  source 1..25: note = Seed: YGFLNVIVHSATGFKQSSKALQRPV
YGFLNVIVHSATGYKQFSRALKRPV

SEQ ID NO: 32106 - protein, 25 aa, synthetic construct
  source 1..25: note = Seed: YGFLNVIVHSATGFKQSSKALQRPV
YGFLNVIVHSATGYKQFSRALQRPV

SEQ ID NO: 32107 - protein, 25 aa, synthetic construct
  source 1..25: note = Seed: YGFLNVIVHSATGFKQSSKALQRPV
YGFLNVIVHSATGYKQFSRALRRPV

SEQ ID NO: 32108 - protein, 25 aa, synthetic construct
  source 1..25: note = Seed: YGFLNVIVHSATGFKQSSKALQRPV
YGFLNVIVHSATGYKQFSRALSRPV

SEQ ID NO: 32109 - protein, 25 aa, synthetic construct
  source 1..25: note = Seed: YGFLNVIVHSATGFKQSSKALQRPV
YGFLNVIVHSATGYKQFSRALTRPV

SEQ ID NO: 32110 - protein, 25 aa, synthetic construct
  source 1..25: note = Seed: YGFLNVIVHSATGFKQSSKALQRPV
YGFLNVIVHSATGYKQFSRALVRPV

SEQ ID NO: 32111 - protein, 25 aa, synthetic construct
  source 1..25: note = Seed: YGFLNVIVHSATGFKQSSKALQRPV
YGFLNVIVHSATGYKQFSSALARPV

SEQ ID NO: 32112 - protein, 25 aa, synthetic construct
  source 1..25: note = Seed: YGFLNVIVHSATGFKQSSKALQRPV
YGFLNVIVHSATGYKQFSSALGRPV

SEQ ID NO: 32113 - protein, 25 aa, synthetic construct
  source 1..25: note = Seed: YGFLNVIVHSATGFKQSSKALQRPV
YGFLNVIVHSATGYKQFSSALHRPV

SEQ ID NO: 32114 - protein, 25 aa, synthetic construct
  source 1..25: note = Seed: YGFLNVIVHSATGFKQSSKALQRPV
YGFLNVIVHSATGYKQFSSALIRPV

SEQ ID NO: 32115 - protein, 25 aa, synthetic construct
  source 1..25: note = Seed: YGFLNVIVHSATGFKQSSKALQRPV
YGFLNVIVHSATGYKQFSSALLRPV

SEQ ID NO: 32116 - protein, 25 aa, synthetic construct
  source 1..25: note = Seed: YGFLNVIVHSATGFKQSSKALQRPV
YGFLNVIVHSATGYKQFSSALMRPV

SEQ ID NO: 32117 - protein, 25 aa, synthetic construct
  source 1..25: note = Seed: YGFLNVIVHSATGFKQSSKALQRPV
YGFLNVIVHSATGYKQFSSALNRPV

SEQ ID NO: 32118 - protein, 25 aa, synthetic construct
  source 1..25: note = Seed: YGFLNVIVHSATGFKQSSKALQRPV
YGFLNVIVHSATGYKQFSSALPRPV

SEQ ID NO: 32119 - protein, 25 aa, synthetic construct
  source 1..25: note = Seed: YGFLNVIVHSATGFKQSSKALQRPV
YGFLNVIVHSATGYKQFSSALQRPV

SEQ ID NO: 32120 - protein, 25 aa, synthetic construct
  source 1..25: note = Seed: YGFLNVIVHSATGFKQSSKALQRPV
YGFLNVIVHSATGYKQFSSALSRPV

SEQ ID NO: 32121 - protein, 25 aa, synthetic construct
  source 1..25: note = Seed: YGFLNVIVHSATGFKQSSKALQRPV
YGFLNVIVHSATGYKQFSSALTRPV

SEQ ID NO: 32122 - protein, 25 aa, synthetic construct
  source 1..25: note = Seed: YGFLNVIVHSATGFKQSSKALQRPV
YGFLNVIVHSATGYKQFSSALVRPV

SEQ ID NO: 32123 - protein, 25 aa, synthetic construct
  source 1..25: note = Seed: YGFLNVIVHSATGFKQSSKALQRPV
YGFLNVIVHSATGYKQFSTALARPV

SEQ ID NO: 32124 - protein, 25 aa, synthetic construct
  source 1..25: note = Seed: YGFLNVIVHSATGFKQSSKALQRPV
YGFLNVIVHSATGYKQFSTALGRPV

SEQ ID NO: 32125 - protein, 25 aa, synthetic construct
  source 1..25: note = Seed: YGFLNVIVHSATGFKQSSKALQRPV
YGFLNVIVHSATGYKQFSTALHRPV

SEQ ID NO: 32126 - protein, 25 aa, synthetic construct
  source 1..25: note = Seed: YGFLNVIVHSATGFKQSSKALQRPV
YGFLNVIVHSATGYKQFSTALIRPV

SEQ ID NO: 32127 - protein, 25 aa, synthetic construct
  source 1..25: note = Seed: YGFLNVIVHSATGFKQSSKALQRPV
YGFLNVIVHSATGYKQFSTALLRPV

SEQ ID NO: 32128 - protein, 25 aa, synthetic construct
  source 1..25: note = Seed: YGFLNVIVHSATGFKQSSKALQRPV
YGFLNVIVHSATGYKQFSTALMRPV

SEQ ID NO: 32129 - protein, 25 aa, synthetic construct
  source 1..25: note = Seed: YGFLNVIVHSATGFKQSSKALQRPV
YGFLNVIVHSATGYKQFSTALNRPV

SEQ ID NO: 32130 - protein, 25 aa, synthetic construct
  source 1..25: note = Seed: YGFLNVIVHSATGFKQSSKALQRPV
YGFLNVIVHSATGYKQFSTALPRPV

SEQ ID NO: 32131 - protein, 25 aa, synthetic construct
  source 1..25: note = Seed: YGFLNVIVHSATGFKQSSKALQRPV
YGFLNVIVHSATGYKQFSTALQRPV

SEQ ID NO: 32132 - protein, 25 aa, synthetic construct
  source 1..25: note = Seed: YGFLNVIVHSATGFKQSSKALQRPV
YGFLNVIVHSATGYKQFSTALSRPV

SEQ ID NO: 32133 - protein, 25 aa, synthetic construct
  source 1..25: note = Seed: YGFLNVIVHSATGFKQSSKALQRPV
YGFLNVIVHSATGYKQFSTALTRPV

SEQ ID NO: 32134 - protein, 25 aa, synthetic construct
  source 1..25: note = Seed: YGFLNVIVHSATGFKQSSKALQRPV
YGFLNVIVHSATGYKQFSTALVRPV

SEQ ID NO: 32135 - protein, 25 aa, synthetic construct
  source 1..25: note = Seed: YGFLNVIVHSATGFKQSSKALQRPV
YGFLNVIVHSATGYKQFSTALYRPV

SEQ ID NO: 32136 - protein, 25 aa, synthetic construct
  source 1..25: note = Seed: YGFLNVIVHSATGFKQSSKALQRPV
YGFLNVIVHSATGYKQFSVALARPV

SEQ ID NO: 32137 - protein, 25 aa, synthetic construct
  source 1..25: note = Seed: YGFLNVIVHSATGFKQSSKALQRPV
YGFLNVIVHSATGYKQFSVALDRPV

SEQ ID NO: 32138 - protein, 25 aa, synthetic construct
  source 1..25: note = Seed: YGFLNVIVHSATGFKQSSKALQRPV
YGFLNVIVHSATGYKQFSVALERPV

SEQ ID NO: 32139 - protein, 25 aa, synthetic construct
  source 1..25: note = Seed: YGFLNVIVHSATGFKQSSKALQRPV
YGFLNVIVHSATGYKQFSVALGRPV

SEQ ID NO: 32140 - protein, 25 aa, synthetic construct
  source 1..25: note = Seed: YGFLNVIVHSATGFKQSSKALQRPV
YGFLNVIVHSATGYKQFSVALHRPV

SEQ ID NO: 32141 - protein, 25 aa, synthetic construct
  source 1..25: note = Seed: YGFLNVIVHSATGFKQSSKALQRPV
YGFLNVIVHSATGYKQFSVALIRPV

SEQ ID NO: 32142 - protein, 25 aa, synthetic construct
  source 1..25: note = Seed: YGFLNVIVHSATGFKQSSKALQRPV
YGFLNVIVHSATGYKQFSVALLRPV

SEQ ID NO: 32143 - protein, 25 aa, synthetic construct
  source 1..25: note = Seed: YGFLNVIVHSATGFKQSSKALQRPV
YGFLNVIVHSATGYKQFSVALMRPV

SEQ ID NO: 32144 - protein, 25 aa, synthetic construct
  source 1..25: note = Seed: YGFLNVIVHSATGFKQSSKALQRPV
YGFLNVIVHSATGYKQFSVALNRPV

SEQ ID NO: 32145 - protein, 25 aa, synthetic construct
  source 1..25: note = Seed: YGFLNVIVHSATGFKQSSKALQRPV
YGFLNVIVHSATGYKQFSVALPRPV

SEQ ID NO: 32146 - protein, 25 aa, synthetic construct
  source 1..25: note = Seed: YGFLNVIVHSATGFKQSSKALQRPV
YGFLNVIVHSATGYKQFSVALQRPV

SEQ ID NO: 32147 - protein, 25 aa, synthetic construct
  source 1..25: note = Seed: YGFLNVIVHSATGFKQSSKALQRPV
YGFLNVIVHSATGYKQFSVALRRPV

SEQ ID NO: 32148 - protein, 25 aa, synthetic construct
  source 1..25: note = Seed: YGFLNVIVHSATGFKQSSKALQRPV
YGFLNVIVHSATGYKQFSVALSRPV

SEQ ID NO: 32149 - protein, 25 aa, synthetic construct
  source 1..25: note = Seed: YGFLNVIVHSATGFKQSSKALQRPV
YGFLNVIVHSATGYKQFSVALTRPV

SEQ ID NO: 32150 - protein, 25 aa, synthetic construct
  source 1..25: note = Seed: YGFLNVIVHSATGFKQSSKALQRPV
YGFLNVIVHSATGYKQFSVALVRPV

SEQ ID NO: 32151 - protein, 25 aa, synthetic construct
  source 1..25: note = Seed: YGFLNVIVHSATGFKQSSKALQRPV
YGFLNVIVHSATGYKQFSVALYRPV

SEQ ID NO: 32152 - protein, 25 aa, synthetic construct
  source 1..25: note = Seed: YGFLNVIVHSATGFKQSSKALQRPV
YGFLNVIVHSATGYKQFSWALARPV

SEQ ID NO: 32153 - protein, 25 aa, synthetic construct
  source 1..25: note = Seed: YGFLNVIVHSATGFKQSSKALQRPV
YGFLNVIVHSATGYKQFSWALIRPV

SEQ ID NO: 32154 - protein, 25 aa, synthetic construct
  source 1..25: note = Seed: YGFLNVIVHSATGFKQSSKALQRPV
YGFLNVIVHSATGYKQFSWALLRPV

SEQ ID NO: 32155 - protein, 25 aa, synthetic construct
  source 1..25: note = Seed: YGFLNVIVHSATGFKQSSKALQRPV
YGFLNVIVHSATGYKQFSWALSRPV

SEQ ID NO: 32156 - protein, 25 aa, synthetic construct
  source 1..25: note = Seed: YGFLNVIVHSATGFKQSSKALQRPV
YGFLNVIVHSATGYKQFSWALVRPV

SEQ ID NO: 32157 - protein, 25 aa, synthetic construct
  source 1..25: note = Seed: YGFLNVIVHSATGFKQSSKALQRPV
YGFLNVIVHSATGYKQFSWALWRPV

SEQ ID NO: 32158 - protein, 25 aa, synthetic construct
  source 1..25: note = Seed: YGFLNVIVHSATGFKQSSKALQRPV
YGFLNVIVHSATGYKQFSWALYRPV

SEQ ID NO: 32159 - protein, 25 aa, synthetic construct
  source 1..25: note = Seed: YGFLNVIVHSATGFKQSSKALQRPV
YGFLNVIVHSATGYKQFSYALARPV

SEQ ID NO: 32160 - protein, 25 aa, synthetic construct
  source 1..25: note = Seed: YGFLNVIVHSATGFKQSSKALQRPV
YGFLNVIVHSATGYKQFSYALGRPV

SEQ ID NO: 32161 - protein, 25 aa, synthetic construct
  source 1..25: note = Seed: YGFLNVIVHSATGFKQSSKALQRPV
YGFLNVIVHSATGYKQFSYALIRPV

SEQ ID NO: 32162 - protein, 25 aa, synthetic construct
  source 1..25: note = Seed: YGFLNVIVHSATGFKQSSKALQRPV
YGFLNVIVHSATGYKQFSYALLRPV

SEQ ID NO: 32163 - protein, 25 aa, synthetic construct
  source 1..25: note = Seed: YGFLNVIVHSATGFKQSSKALQRPV
YGFLNVIVHSATGYKQFSYALMRPV

SEQ ID NO: 32164 - protein, 25 aa, synthetic construct
  source 1..25: note = Seed: YGFLNVIVHSATGFKQSSKALQRPV
YGFLNVIVHSATGYKQFSYALNRPV

SEQ ID NO: 32165 - protein, 25 aa, synthetic construct
  source 1..25: note = Seed: YGFLNVIVHSATGFKQSSKALQRPV
YGFLNVIVHSATGYKQFSYALSRPV

SEQ ID NO: 32166 - protein, 25 aa, synthetic construct
  source 1..25: note = Seed: YGFLNVIVHSATGFKQSSKALQRPV
YGFLNVIVHSATGYKQFSYALVRPV

SEQ ID NO: 32167 - protein, 25 aa, synthetic construct
  source 1..25: note = Seed: YGFLNVIVHSATGFKQSSKALQRPV
YGFLNVIVHSATGYKQFSYALWRPV

SEQ ID NO: 32168 - protein, 25 aa, synthetic construct
  source 1..25: note = Seed: YGFLNVIVHSATGFKQSSKALQRPV
YGFLNVIVHSATGYKQFSYALYRPV

SEQ ID NO: 32169 - protein, 25 aa, synthetic construct
  source 1..25: note = Seed: YGFLNVIVHSATGFKQSSKALQRPV
YGFLNVIVHSATGYKQGSAALARPV

SEQ ID NO: 32170 - protein, 25 aa, synthetic construct
  source 1..25: note = Seed: YGFLNVIVHSATGFKQSSKALQRPV
YGFLNVIVHSATGYKQGSAALLRPV

SEQ ID NO: 32171 - protein, 25 aa, synthetic construct
  source 1..25: note = Seed: YGFLNVIVHSATGFKQSSKALQRPV
YGFLNVIVHSATGYKQGSAALMRPV

SEQ ID NO: 32172 - protein, 25 aa, synthetic construct
  source 1..25: note = Seed: YGFLNVIVHSATGFKQSSKALQRPV
YGFLNVIVHSATGYKQGSAALNRPV

SEQ ID NO: 32173 - protein, 25 aa, synthetic construct
  source 1..25: note = Seed: YGFLNVIVHSATGFKQSSKALQRPV
YGFLNVIVHSATGYKQGSAALSRPV

SEQ ID NO: 32174 - protein, 25 aa, synthetic construct
  source 1..25: note = Seed: YGFLNVIVHSATGFKQSSKALQRPV
YGFLNVIVHSATGYKQGSIALARPV

SEQ ID NO: 32175 - protein, 25 aa, synthetic construct
  source 1..25: note = Seed: YGFLNVIVHSATGFKQSSKALQRPV
YGFLNVIVHSATGYKQGSIALNRPV

SEQ ID NO: 32176 - protein, 25 aa, synthetic construct
  source 1..25: note = Seed: YGFLNVIVHSATGFKQSSKALQRPV
YGFLNVIVHSATGYKQGSIALSRPV

SEQ ID NO: 32177 - protein, 25 aa, synthetic construct
  source 1..25: note = Seed: YGFLNVIVHSATGFKQSSKALQRPV
YGFLNVIVHSATGYKQGSPALARPV

SEQ ID NO: 32178 - protein, 25 aa, synthetic construct
  source 1..25: note = Seed: YGFLNVIVHSATGFKQSSKALQRPV
YGFLNVIVHSATGYKQGSSALARPV

SEQ ID NO: 32179 - protein, 25 aa, synthetic construct
  source 1..25: note = Seed: YGFLNVIVHSATGFKQSSKALQRPV
YGFLNVIVHSATGYKQGSTALARPV

SEQ ID NO: 32180 - protein, 25 aa, synthetic construct
  source 1..25: note = Seed: YGFLNVIVHSATGFKQSSKALQRPV
YGFLNVIVHSATGYKQGSVALARPV

SEQ ID NO: 32181 - protein, 25 aa, synthetic construct
  source 1..25: note = Seed: YGFLNVIVHSATGFKQSSKALQRPV
YGFLNVIVHSATGYKQGSVALNRPV

SEQ ID NO: 32182 - protein, 25 aa, synthetic construct
  source 1..25: note = Seed: YGFLNVIVHSATGFKQSSKALQRPV
YGFLNVIVHSATGYKQGSVALSRPV

SEQ ID NO: 32183 - protein, 25 aa, synthetic construct
  source 1..25: note = Seed: YGFLNVIVHSATGFKQSSKALQRPV
YGFLNVIVHSATGYKQHSAALARPV

SEQ ID NO: 32184 - protein, 25 aa, synthetic construct
  source 1..25: note = Seed: YGFLNVIVHSATGFKQSSKALQRPV
YGFLNVIVHSATGYKQHSFALFRPV

SEQ ID NO: 32185 - protein, 25 aa, synthetic construct
  source 1..25: note = Seed: YGFLNVIVHSATGFKQSSKALQRPV
YGFLNVIVHSATGYKQHSFALLRPV

SEQ ID NO: 32186 - protein, 25 aa, synthetic construct
  source 1..25: note = Seed: YGFLNVIVHSATGFKQSSKALQRPV
YGFLNVIVHSATGYKQHSVALARPV

SEQ ID NO: 32187 - protein, 25 aa, synthetic construct
  source 1..25: note = Seed: YGFLNVIVHSATGFKQSSKALQRPV
YGFLNVIVHSATGYKQISAALARPV

SEQ ID NO: 32188 - protein, 25 aa, synthetic construct
  source 1..25: note = Seed: YGFLNVIVHSATGFKQSSKALQRPV
YGFLNVIVHSATGYKQISAALCRPV

SEQ ID NO: 32189 - protein, 25 aa, synthetic construct
  source 1..25: note = Seed: YGFLNVIVHSATGFKQSSKALQRPV
YGFLNVIVHSATGYKQISAALDRPV

SEQ ID NO: 32190 - protein, 25 aa, synthetic construct
  source 1..25: note = Seed: YGFLNVIVHSATGFKQSSKALQRPV
YGFLNVIVHSATGYKQISAALERPV

SEQ ID NO: 32191 - protein, 25 aa, synthetic construct
  source 1..25: note = Seed: YGFLNVIVHSATGFKQSSKALQRPV
YGFLNVIVHSATGYKQISAALFRPV

SEQ ID NO: 32192 - protein, 25 aa, synthetic construct
  source 1..25: note = Seed: YGFLNVIVHSATGFKQSSKALQRPV
YGFLNVIVHSATGYKQISAALGRPV

SEQ ID NO: 32193 - protein, 25 aa, synthetic construct
  source 1..25: note = Seed: YGFLNVIVHSATGFKQSSKALQRPV
YGFLNVIVHSATGYKQISAALHRPV

SEQ ID NO: 32194 - protein, 25 aa, synthetic construct
  source 1..25: note = Seed: YGFLNVIVHSATGFKQSSKALQRPV
YGFLNVIVHSATGYKQISAALIRPV

SEQ ID NO: 32195 - protein, 25 aa, synthetic construct
  source 1..25: note = Seed: YGFLNVIVHSATGFKQSSKALQRPV
YGFLNVIVHSATGYKQISAALKRPV

SEQ ID NO: 32196 - protein, 25 aa, synthetic construct
  source 1..25: note = Seed: YGFLNVIVHSATGFKQSSKALQRPV
YGFLNVIVHSATGYKQISAALLRPV

SEQ ID NO: 32197 - protein, 25 aa, synthetic construct
  source 1..25: note = Seed: YGFLNVIVHSATGFKQSSKALQRPV
YGFLNVIVHSATGYKQISAALMRPV

SEQ ID NO: 32198 - protein, 25 aa, synthetic construct
  source 1..25: note = Seed: YGFLNVIVHSATGFKQSSKALQRPV
YGFLNVIVHSATGYKQISAALNRPV

SEQ ID NO: 32199 - protein, 25 aa, synthetic construct
  source 1..25: note = Seed: YGFLNVIVHSATGFKQSSKALQRPV
YGFLNVIVHSATGYKQISAALPRPV

SEQ ID NO: 32200 - protein, 25 aa, synthetic construct
  source 1..25: note = Seed: YGFLNVIVHSATGFKQSSKALQRPV
YGFLNVIVHSATGYKQISAALQRPV

SEQ ID NO: 32201 - protein, 25 aa, synthetic construct
  source 1..25: note = Seed: YGFLNVIVHSATGFKQSSKALQRPV
YGFLNVIVHSATGYKQISAALRRPV

SEQ ID NO: 32202 - protein, 25 aa, synthetic construct
  source 1..25: note = Seed: YGFLNVIVHSATGFKQSSKALQRPV
YGFLNVIVHSATGYKQISAALSRPV

SEQ ID NO: 32203 - protein, 25 aa, synthetic construct
  source 1..25: note = Seed: YGFLNVIVHSATGFKQSSKALQRPV
YGFLNVIVHSATGYKQISAALTRPV

SEQ ID NO: 32204 - protein, 25 aa, synthetic construct
  source 1..25: note = Seed: YGFLNVIVHSATGFKQSSKALQRPV
YGFLNVIVHSATGYKQISAALVRPV

SEQ ID NO: 32205 - protein, 25 aa, synthetic construct
  source 1..25: note = Seed: YGFLNVIVHSATGFKQSSKALQRPV
YGFLNVIVHSATGYKQISAALWRPV

SEQ ID NO: 32206 - protein, 25 aa, synthetic construct
  source 1..25: note = Seed: YGFLNVIVHSATGFKQSSKALQRPV
YGFLNVIVHSATGYKQISAALYRPV

SEQ ID NO: 32207 - protein, 25 aa, synthetic construct
  source 1..25: note = Seed: YGFLNVIVHSATGFKQSSKALQRPV
YGFLNVIVHSATGYKQISCALARPV

SEQ ID NO: 32208 - protein, 25 aa, synthetic construct
  source 1..25: note = Seed: YGFLNVIVHSATGFKQSSKALQRPV
YGFLNVIVHSATGYKQISCALNRPV

SEQ ID NO: 32209 - protein, 25 aa, synthetic construct
  source 1..25: note = Seed: YGFLNVIVHSATGFKQSSKALQRPV
YGFLNVIVHSATGYKQISCALSRPV

SEQ ID NO: 32210 - protein, 25 aa, synthetic construct
  source 1..25: note = Seed: YGFLNVIVHSATGFKQSSKALQRPV
YGFLNVIVHSATGYKQISDALARPV

SEQ ID NO: 32211 - protein, 25 aa, synthetic construct
  source 1..25: note = Seed: YGFLNVIVHSATGFKQSSKALQRPV
YGFLNVIVHSATGYKQISEALARPV

SEQ ID NO: 32212 - protein, 25 aa, synthetic construct
  source 1..25: note = Seed: YGFLNVIVHSATGFKQSSKALQRPV
YGFLNVIVHSATGYKQISEALNRPV

SEQ ID NO: 32213 - protein, 25 aa, synthetic construct
  source 1..25: note = Seed: YGFLNVIVHSATGFKQSSKALQRPV
YGFLNVIVHSATGYKQISEALSRPV

SEQ ID NO: 32214 - protein, 25 aa, synthetic construct
  source 1..25: note = Seed: YGFLNVIVHSATGFKQSSKALQRPV
YGFLNVIVHSATGYKQISFALARPV

SEQ ID NO: 32215 - protein, 25 aa, synthetic construct
  source 1..25: note = Seed: YGFLNVIVHSATGFKQSSKALQRPV
YGFLNVIVHSATGYKQISFALFRPV

SEQ ID NO: 32216 - protein, 25 aa, synthetic construct
  source 1..25: note = Seed: YGFLNVIVHSATGFKQSSKALQRPV
YGFLNVIVHSATGYKQISFALIRPV

SEQ ID NO: 32217 - protein, 25 aa, synthetic construct
  source 1..25: note = Seed: YGFLNVIVHSATGFKQSSKALQRPV
YGFLNVIVHSATGYKQISFALLRPV

SEQ ID NO: 32218 - protein, 25 aa, synthetic construct
  source 1..25: note = Seed: YGFLNVIVHSATGFKQSSKALQRPV
YGFLNVIVHSATGYKQISFALMRPV

SEQ ID NO: 32219 - protein, 25 aa, synthetic construct
  source 1..25: note = Seed: YGFLNVIVHSATGFKQSSKALQRPV
YGFLNVIVHSATGYKQISFALNRPV

SEQ ID NO: 32220 - protein, 25 aa, synthetic construct
  source 1..25: note = Seed: YGFLNVIVHSATGFKQSSKALQRPV
YGFLNVIVHSATGYKQISFALSRPV

SEQ ID NO: 32221 - protein, 25 aa, synthetic construct
  source 1..25: note = Seed: YGFLNVIVHSATGFKQSSKALQRPV
YGFLNVIVHSATGYKQISFALVRPV

SEQ ID NO: 32222 - protein, 25 aa, synthetic construct
  source 1..25: note = Seed: YGFLNVIVHSATGFKQSSKALQRPV
YGFLNVIVHSATGYKQISFALWRPV

SEQ ID NO: 32223 - protein, 25 aa, synthetic construct
  source 1..25: note = Seed: YGFLNVIVHSATGFKQSSKALQRPV
YGFLNVIVHSATGYKQISFALYRPV

SEQ ID NO: 32224 - protein, 25 aa, synthetic construct
  source 1..25: note = Seed: YGFLNVIVHSATGFKQSSKALQRPV
YGFLNVIVHSATGYKQISGALARPV

SEQ ID NO: 32225 - protein, 25 aa, synthetic construct
  source 1..25: note = Seed: YGFLNVIVHSATGFKQSSKALQRPV
YGFLNVIVHSATGYKQISGALCRPV

SEQ ID NO: 32226 - protein, 25 aa, synthetic construct
  source 1..25: note = Seed: YGFLNVIVHSATGFKQSSKALQRPV
YGFLNVIVHSATGYKQISGALDRPV

SEQ ID NO: 32227 - protein, 25 aa, synthetic construct
  source 1..25: note = Seed: YGFLNVIVHSATGFKQSSKALQRPV
YGFLNVIVHSATGYKQISGALERPV

SEQ ID NO: 32228 - protein, 25 aa, synthetic construct
  source 1..25: note = Seed: YGFLNVIVHSATGFKQSSKALQRPV
YGFLNVIVHSATGYKQISGALGRPV

SEQ ID NO: 32229 - protein, 25 aa, synthetic construct
  source 1..25: note = Seed: YGFLNVIVHSATGFKQSSKALQRPV
YGFLNVIVHSATGYKQISGALHRPV

SEQ ID NO: 32230 - protein, 25 aa, synthetic construct
  source 1..25: note = Seed: YGFLNVIVHSATGFKQSSKALQRPV
YGFLNVIVHSATGYKQISGALIRPV

SEQ ID NO: 32231 - protein, 25 aa, synthetic construct
  source 1..25: note = Seed: YGFLNVIVHSATGFKQSSKALQRPV
YGFLNVIVHSATGYKQISGALLRPV

SEQ ID NO: 32232 - protein, 25 aa, synthetic construct
  source 1..25: note = Seed: YGFLNVIVHSATGFKQSSKALQRPV
YGFLNVIVHSATGYKQISGALMRPV

SEQ ID NO: 32233 - protein, 25 aa, synthetic construct
  source 1..25: note = Seed: YGFLNVIVHSATGFKQSSKALQRPV
YGFLNVIVHSATGYKQISGALNRPV

SEQ ID NO: 32234 - protein, 25 aa, synthetic construct
  source 1..25: note = Seed: YGFLNVIVHSATGFKQSSKALQRPV
YGFLNVIVHSATGYKQISGALPRPV

SEQ ID NO: 32235 - protein, 25 aa, synthetic construct
  source 1..25: note = Seed: YGFLNVIVHSATGFKQSSKALQRPV
YGFLNVIVHSATGYKQISGALQRPV

SEQ ID NO: 32236 - protein, 25 aa, synthetic construct
  source 1..25: note = Seed: YGFLNVIVHSATGFKQSSKALQRPV
YGFLNVIVHSATGYKQISGALSRPV

SEQ ID NO: 32237 - protein, 25 aa, synthetic construct
  source 1..25: note = Seed: YGFLNVIVHSATGFKQSSKALQRPV
YGFLNVIVHSATGYKQISGALTRPV

SEQ ID NO: 32238 - protein, 25 aa, synthetic construct
  source 1..25: note = Seed: YGFLNVIVHSATGFKQSSKALQRPV
YGFLNVIVHSATGYKQISGALVRPV

SEQ ID NO: 32239 - protein, 25 aa, synthetic construct
  source 1..25: note = Seed: YGFLNVIVHSATGFKQSSKALQRPV
YGFLNVIVHSATGYKQISHALARPV

SEQ ID NO: 32240 - protein, 25 aa, synthetic construct
  source 1..25: note = Seed: YGFLNVIVHSATGFKQSSKALQRPV
YGFLNVIVHSATGYKQISHALGRPV

SEQ ID NO: 32241 - protein, 25 aa, synthetic construct
  source 1..25: note = Seed: YGFLNVIVHSATGFKQSSKALQRPV
YGFLNVIVHSATGYKQISHALNRPV

SEQ ID NO: 32242 - protein, 25 aa, synthetic construct
  source 1..25: note = Seed: YGFLNVIVHSATGFKQSSKALQRPV
YGFLNVIVHSATGYKQISHALRRPV

SEQ ID NO: 32243 - protein, 25 aa, synthetic construct
  source 1..25: note = Seed: YGFLNVIVHSATGFKQSSKALQRPV
YGFLNVIVHSATGYKQISHALSRPV

SEQ ID NO: 32244 - protein, 25 aa, synthetic construct
  source 1..25: note = Seed: YGFLNVIVHSATGFKQSSKALQRPV
YGFLNVIVHSATGYKQISHALTRPV

SEQ ID NO: 32245 - protein, 25 aa, synthetic construct
  source 1..25: note = Seed: YGFLNVIVHSATGFKQSSKALQRPV
YGFLNVIVHSATGYKQISHALVRPV

SEQ ID NO: 32246 - protein, 25 aa, synthetic construct
  source 1..25: note = Seed: YGFLNVIVHSATGFKQSSKALQRPV
YGFLNVIVHSATGYKQISIALARPV

SEQ ID NO: 32247 - protein, 25 aa, synthetic construct
  source 1..25: note = Seed: YGFLNVIVHSATGFKQSSKALQRPV
YGFLNVIVHSATGYKQISIALDRPV

SEQ ID NO: 32248 - protein, 25 aa, synthetic construct
  source 1..25: note = Seed: YGFLNVIVHSATGFKQSSKALQRPV
YGFLNVIVHSATGYKQISIALERPV

SEQ ID NO: 32249 - protein, 25 aa, synthetic construct
  source 1..25: note = Seed: YGFLNVIVHSATGFKQSSKALQRPV
YGFLNVIVHSATGYKQISIALGRPV

SEQ ID NO: 32250 - protein, 25 aa, synthetic construct
  source 1..25: note = Seed: YGFLNVIVHSATGFKQSSKALQRPV
YGFLNVIVHSATGYKQISIALHRPV

SEQ ID NO: 32251 - protein, 25 aa, synthetic construct
  source 1..25: note = Seed: YGFLNVIVHSATGFKQSSKALQRPV
YGFLNVIVHSATGYKQISIALIRPV

SEQ ID NO: 32252 - protein, 25 aa, synthetic construct
  source 1..25: note = Seed: YGFLNVIVHSATGFKQSSKALQRPV
YGFLNVIVHSATGYKQISIALKRPV

SEQ ID NO: 32253 - protein, 25 aa, synthetic construct
  source 1..25: note = Seed: YGFLNVIVHSATGFKQSSKALQRPV
YGFLNVIVHSATGYKQISIALLRPV

SEQ ID NO: 32254 - protein, 25 aa, synthetic construct
  source 1..25: note = Seed: YGFLNVIVHSATGFKQSSKALQRPV
YGFLNVIVHSATGYKQISIALMRPV

SEQ ID NO: 32255 - protein, 25 aa, synthetic construct
  source 1..25: note = Seed: YGFLNVIVHSATGFKQSSKALQRPV
YGFLNVIVHSATGYKQISIALNRPV

SEQ ID NO: 32256 - protein, 25 aa, synthetic construct
  source 1..25: note = Seed: YGFLNVIVHSATGFKQSSKALQRPV
YGFLNVIVHSATGYKQISIALPRPV

SEQ ID NO: 32257 - protein, 25 aa, synthetic construct
  source 1..25: note = Seed: YGFLNVIVHSATGFKQSSKALQRPV
YGFLNVIVHSATGYKQISIALQRPV

SEQ ID NO: 32258 - protein, 25 aa, synthetic construct
  source 1..25: note = Seed: YGFLNVIVHSATGFKQSSKALQRPV
YGFLNVIVHSATGYKQISIALRRPV

SEQ ID NO: 32259 - protein, 25 aa, synthetic construct
  source 1..25: note = Seed: YGFLNVIVHSATGFKQSSKALQRPV
YGFLNVIVHSATGYKQISIALSRPV

SEQ ID NO: 32260 - protein, 25 aa, synthetic construct
  source 1..25: note = Seed: YGFLNVIVHSATGFKQSSKALQRPV
YGFLNVIVHSATGYKQISIALTRPV

SEQ ID NO: 32261 - protein, 25 aa, synthetic construct
  source 1..25: note = Seed: YGFLNVIVHSATGFKQSSKALQRPV
YGFLNVIVHSATGYKQISIALVRPV

SEQ ID NO: 32262 - protein, 25 aa, synthetic construct
  source 1..25: note = Seed: YGFLNVIVHSATGFKQSSKALQRPV
YGFLNVIVHSATGYKQISKALARPV

SEQ ID NO: 32263 - protein, 25 aa, synthetic construct
  source 1..25: note = Seed: YGFLNVIVHSATGFKQSSKALQRPV
YGFLNVIVHSATGYKQISKALGRPV

SEQ ID NO: 32264 - protein, 25 aa, synthetic construct
  source 1..25: note = Seed: YGFLNVIVHSATGFKQSSKALQRPV
YGFLNVIVHSATGYKQISKALHRPV

SEQ ID NO: 32265 - protein, 25 aa, synthetic construct
  source 1..25: note = Seed: YGFLNVIVHSATGFKQSSKALQRPV
YGFLNVIVHSATGYKQISKALIRPV

SEQ ID NO: 32266 - protein, 25 aa, synthetic construct
  source 1..25: note = Seed: YGFLNVIVHSATGFKQSSKALQRPV
YGFLNVIVHSATGYKQISKALKRPV

SEQ ID NO: 32267 - protein, 25 aa, synthetic construct
  source 1..25: note = Seed: YGFLNVIVHSATGFKQSSKALQRPV
YGFLNVIVHSATGYKQISKALLRPV

SEQ ID NO: 32268 - protein, 25 aa, synthetic construct
  source 1..25: note = Seed: YGFLNVIVHSATGFKQSSKALQRPV
YGFLNVIVHSATGYKQISKALMRPV

SEQ ID NO: 32269 - protein, 25 aa, synthetic construct
  source 1..25: note = Seed: YGFLNVIVHSATGFKQSSKALQRPV
YGFLNVIVHSATGYKQISKALNRPV

SEQ ID NO: 32270 - protein, 25 aa, synthetic construct
  source 1..25: note = Seed: YGFLNVIVHSATGFKQSSKALQRPV
YGFLNVIVHSATGYKQISKALPRPV

SEQ ID NO: 32271 - protein, 25 aa, synthetic construct
  source 1..25: note = Seed: YGFLNVIVHSATGFKQSSKALQRPV
YGFLNVIVHSATGYKQISKALQRPV

SEQ ID NO: 32272 - protein, 25 aa, synthetic construct
  source 1..25: note = Seed: YGFLNVIVHSATGFKQSSKALQRPV
YGFLNVIVHSATGYKQISKALRRPV

SEQ ID NO: 32273 - protein, 25 aa, synthetic construct
  source 1..25: note = Seed: YGFLNVIVHSATGFKQSSKALQRPV
YGFLNVIVHSATGYKQISKALSRPV

SEQ ID NO: 32274 - protein, 25 aa, synthetic construct
  source 1..25: note = Seed: YGFLNVIVHSATGFKQSSKALQRPV
YGFLNVIVHSATGYKQISKALTRPV

SEQ ID NO: 32275 - protein, 25 aa, synthetic construct
  source 1..25: note = Seed: YGFLNVIVHSATGFKQSSKALQRPV
YGFLNVIVHSATGYKQISKALVRPV

SEQ ID NO: 32276 - protein, 25 aa, synthetic construct
  source 1..25: note = Seed: YGFLNVIVHSATGFKQSSKALQRPV
YGFLNVIVHSATGYKQISKALYRPV

SEQ ID NO: 32277 - protein, 25 aa, synthetic construct
  source 1..25: note = Seed: YGFLNVIVHSATGFKQSSKALQRPV
YGFLNVIVHSATGYKQISLALARPV

SEQ ID NO: 32278 - protein, 25 aa, synthetic construct
  source 1..25: note = Seed: YGFLNVIVHSATGFKQSSKALQRPV
YGFLNVIVHSATGYKQISLALDRPV

SEQ ID NO: 32279 - protein, 25 aa, synthetic construct
  source 1..25: note = Seed: YGFLNVIVHSATGFKQSSKALQRPV
YGFLNVIVHSATGYKQISLALFRPV

SEQ ID NO: 32280 - protein, 25 aa, synthetic construct
  source 1..25: note = Seed: YGFLNVIVHSATGFKQSSKALQRPV
YGFLNVIVHSATGYKQISLALGRPV

SEQ ID NO: 32281 - protein, 25 aa, synthetic construct
  source 1..25: note = Seed: YGFLNVIVHSATGFKQSSKALQRPV
YGFLNVIVHSATGYKQISLALHRPV

SEQ ID NO: 32282 - protein, 25 aa, synthetic construct
  source 1..25: note = Seed: YGFLNVIVHSATGFKQSSKALQRPV
YGFLNVIVHSATGYKQISLALIRPV

SEQ ID NO: 32283 - protein, 25 aa, synthetic construct
  source 1..25: note = Seed: YGFLNVIVHSATGFKQSSKALQRPV
YGFLNVIVHSATGYKQISLALMRPV

SEQ ID NO: 32284 - protein, 25 aa, synthetic construct
  source 1..25: note = Seed: YGFLNVIVHSATGFKQSSKALQRPV
YGFLNVIVHSATGYKQISLALNRPV

SEQ ID NO: 32285 - protein, 25 aa, synthetic construct
  source 1..25: note = Seed: YGFLNVIVHSATGFKQSSKALQRPV
YGFLNVIVHSATGYKQISLALPRPV

SEQ ID NO: 32286 - protein, 25 aa, synthetic construct
  source 1..25: note = Seed: YGFLNVIVHSATGFKQSSKALQRPV
YGFLNVIVHSATGYKQISLALQRPV

SEQ ID NO: 32287 - protein, 25 aa, synthetic construct
  source 1..25: note = Seed: YGFLNVIVHSATGFKQSSKALQRPV
YGFLNVIVHSATGYKQISLALSRPV

SEQ ID NO: 32288 - protein, 25 aa, synthetic construct
  source 1..25: note = Seed: YGFLNVIVHSATGFKQSSKALQRPV
YGFLNVIVHSATGYKQISLALTRPV

SEQ ID NO: 32289 - protein, 25 aa, synthetic construct
  source 1..25: note = Seed: YGFLNVIVHSATGFKQSSKALQRPV
YGFLNVIVHSATGYKQISLALVRPV

SEQ ID NO: 32290 - protein, 25 aa, synthetic construct
  source 1..25: note = Seed: YGFLNVIVHSATGFKQSSKALQRPV
YGFLNVIVHSATGYKQISMALARPV

SEQ ID NO: 32291 - protein, 25 aa, synthetic construct
  source 1..25: note = Seed: YGFLNVIVHSATGFKQSSKALQRPV
YGFLNVIVHSATGYKQISMALFRPV

SEQ ID NO: 32292 - protein, 25 aa, synthetic construct
  source 1..25: note = Seed: YGFLNVIVHSATGFKQSSKALQRPV
YGFLNVIVHSATGYKQISMALGRPV

SEQ ID NO: 32293 - protein, 25 aa, synthetic construct
  source 1..25: note = Seed: YGFLNVIVHSATGFKQSSKALQRPV
YGFLNVIVHSATGYKQISMALHRPV

SEQ ID NO: 32294 - protein, 25 aa, synthetic construct
  source 1..25: note = Seed: YGFLNVIVHSATGFKQSSKALQRPV
YGFLNVIVHSATGYKQISMALIRPV

SEQ ID NO: 32295 - protein, 25 aa, synthetic construct
  source 1..25: note = Seed: YGFLNVIVHSATGFKQSSKALQRPV
YGFLNVIVHSATGYKQISMALLRPV

SEQ ID NO: 32296 - protein, 25 aa, synthetic construct
  source 1..25: note = Seed: YGFLNVIVHSATGFKQSSKALQRPV
YGFLNVIVHSATGYKQISMALMRPV

SEQ ID NO: 32297 - protein, 25 aa, synthetic construct
  source 1..25: note = Seed: YGFLNVIVHSATGFKQSSKALQRPV
YGFLNVIVHSATGYKQISMALNRPV

SEQ ID NO: 32298 - protein, 25 aa, synthetic construct
  source 1..25: note = Seed: YGFLNVIVHSATGFKQSSKALQRPV
YGFLNVIVHSATGYKQISMALPRPV

SEQ ID NO: 32299 - protein, 25 aa, synthetic construct
  source 1..25: note = Seed: YGFLNVIVHSATGFKQSSKALQRPV
YGFLNVIVHSATGYKQISMALQRPV

SEQ ID NO: 32300 - protein, 25 aa, synthetic construct
  source 1..25: note = Seed: YGFLNVIVHSATGFKQSSKALQRPV
YGFLNVIVHSATGYKQISMALRRPV

SEQ ID NO: 32301 - protein, 25 aa, synthetic construct
  source 1..25: note = Seed: YGFLNVIVHSATGFKQSSKALQRPV
YGFLNVIVHSATGYKQISMALSRPV

SEQ ID NO: 32302 - protein, 25 aa, synthetic construct
  source 1..25: note = Seed: YGFLNVIVHSATGFKQSSKALQRPV
YGFLNVIVHSATGYKQISMALTRPV

SEQ ID NO: 32303 - protein, 25 aa, synthetic construct
  source 1..25: note = Seed: YGFLNVIVHSATGFKQSSKALQRPV
YGFLNVIVHSATGYKQISMALVRPV

SEQ ID NO: 32304 - protein, 25 aa, synthetic construct
  source 1..25: note = Seed: YGFLNVIVHSATGFKQSSKALQRPV
YGFLNVIVHSATGYKQISNALARPV

SEQ ID NO: 32305 - protein, 25 aa, synthetic construct
  source 1..25: note = Seed: YGFLNVIVHSATGFKQSSKALQRPV
YGFLNVIVHSATGYKQISNALCRPV

SEQ ID NO: 32306 - protein, 25 aa, synthetic construct
  source 1..25: note = Seed: YGFLNVIVHSATGFKQSSKALQRPV
YGFLNVIVHSATGYKQISNALDRPV

SEQ ID NO: 32307 - protein, 25 aa, synthetic construct
  source 1..25: note = Seed: YGFLNVIVHSATGFKQSSKALQRPV
YGFLNVIVHSATGYKQISNALERPV

SEQ ID NO: 32308 - protein, 25 aa, synthetic construct
  source 1..25: note = Seed: YGFLNVIVHSATGFKQSSKALQRPV
YGFLNVIVHSATGYKQISNALGRPV

SEQ ID NO: 32309 - protein, 25 aa, synthetic construct
  source 1..25: note = Seed: YGFLNVIVHSATGFKQSSKALQRPV
YGFLNVIVHSATGYKQISNALHRPV

SEQ ID NO: 32310 - protein, 25 aa, synthetic construct
  source 1..25: note = Seed: YGFLNVIVHSATGFKQSSKALQRPV
YGFLNVIVHSATGYKQISNALIRPV

SEQ ID NO: 32311 - protein, 25 aa, synthetic construct
  source 1..25: note = Seed: YGFLNVIVHSATGFKQSSKALQRPV
YGFLNVIVHSATGYKQISNALLRPV

SEQ ID NO: 32312 - protein, 25 aa, synthetic construct
  source 1..25: note = Seed: YGFLNVIVHSATGFKQSSKALQRPV
YGFLNVIVHSATGYKQISNALMRPV

SEQ ID NO: 32313 - protein, 25 aa, synthetic construct
  source 1..25: note = Seed: YGFLNVIVHSATGFKQSSKALQRPV
YGFLNVIVHSATGYKQISNALNRPV

SEQ ID NO: 32314 - protein, 25 aa, synthetic construct
  source 1..25: note = Seed: YGFLNVIVHSATGFKQSSKALQRPV
YGFLNVIVHSATGYKQISNALPRPV

SEQ ID NO: 32315 - protein, 25 aa, synthetic construct
  source 1..25: note = Seed: YGFLNVIVHSATGFKQSSKALQRPV
YGFLNVIVHSATGYKQISNALQRPV

SEQ ID NO: 32316 - protein, 25 aa, synthetic construct
  source 1..25: note = Seed: YGFLNVIVHSATGFKQSSKALQRPV
YGFLNVIVHSATGYKQISNALSRPV

SEQ ID NO: 32317 - protein, 25 aa, synthetic construct
  source 1..25: note = Seed: YGFLNVIVHSATGFKQSSKALQRPV
YGFLNVIVHSATGYKQISNALTRPV

SEQ ID NO: 32318 - protein, 25 aa, synthetic construct
  source 1..25: note = Seed: YGFLNVIVHSATGFKQSSKALQRPV
YGFLNVIVHSATGYKQISNALVRPV

SEQ ID NO: 32319 - protein, 25 aa, synthetic construct
  source 1..25: note = Seed: YGFLNVIVHSATGFKQSSKALQRPV
YGFLNVIVHSATGYKQISPALARPV

SEQ ID NO: 32320 - protein, 25 aa, synthetic construct
  source 1..25: note = Seed: YGFLNVIVHSATGFKQSSKALQRPV
YGFLNVIVHSATGYKQISPALCRPV

SEQ ID NO: 32321 - protein, 25 aa, synthetic construct
  source 1..25: note = Seed: YGFLNVIVHSATGFKQSSKALQRPV
YGFLNVIVHSATGYKQISPALDRPV

SEQ ID NO: 32322 - protein, 25 aa, synthetic construct
  source 1..25: note = Seed: YGFLNVIVHSATGFKQSSKALQRPV
YGFLNVIVHSATGYKQISPALERPV

SEQ ID NO: 32323 - protein, 25 aa, synthetic construct
  source 1..25: note = Seed: YGFLNVIVHSATGFKQSSKALQRPV
YGFLNVIVHSATGYKQISPALFRPV

SEQ ID NO: 32324 - protein, 25 aa, synthetic construct
  source 1..25: note = Seed: YGFLNVIVHSATGFKQSSKALQRPV
YGFLNVIVHSATGYKQISPALGRPV

SEQ ID NO: 32325 - protein, 25 aa, synthetic construct
  source 1..25: note = Seed: YGFLNVIVHSATGFKQSSKALQRPV
YGFLNVIVHSATGYKQISPALHRPV

SEQ ID NO: 32326 - protein, 25 aa, synthetic construct
  source 1..25: note = Seed: YGFLNVIVHSATGFKQSSKALQRPV
YGFLNVIVHSATGYKQISPALIRPV

SEQ ID NO: 32327 - protein, 25 aa, synthetic construct
  source 1..25: note = Seed: YGFLNVIVHSATGFKQSSKALQRPV
YGFLNVIVHSATGYKQISPALKRPV

SEQ ID NO: 32328 - protein, 25 aa, synthetic construct
  source 1..25: note = Seed: YGFLNVIVHSATGFKQSSKALQRPV
YGFLNVIVHSATGYKQISPALLRPV

SEQ ID NO: 32329 - protein, 25 aa, synthetic construct
  source 1..25: note = Seed: YGFLNVIVHSATGFKQSSKALQRPV
YGFLNVIVHSATGYKQISPALMRPV

SEQ ID NO: 32330 - protein, 25 aa, synthetic construct
  source 1..25: note = Seed: YGFLNVIVHSATGFKQSSKALQRPV
YGFLNVIVHSATGYKQISPALNRPV

SEQ ID NO: 32331 - protein, 25 aa, synthetic construct
  source 1..25: note = Seed: YGFLNVIVHSATGFKQSSKALQRPV
YGFLNVIVHSATGYKQISPALPRPV

SEQ ID NO: 32332 - protein, 25 aa, synthetic construct
  source 1..25: note = Seed: YGFLNVIVHSATGFKQSSKALQRPV
YGFLNVIVHSATGYKQISPALQRPV

SEQ ID NO: 32333 - protein, 25 aa, synthetic construct
  source 1..25: note = Seed: YGFLNVIVHSATGFKQSSKALQRPV
YGFLNVIVHSATGYKQISPALRRPV

SEQ ID NO: 32334 - protein, 25 aa, synthetic construct
  source 1..25: note = Seed: YGFLNVIVHSATGFKQSSKALQRPV
YGFLNVIVHSATGYKQISPALSRPV

SEQ ID NO: 32335 - protein, 25 aa, synthetic construct
  source 1..25: note = Seed: YGFLNVIVHSATGFKQSSKALQRPV
YGFLNVIVHSATGYKQISPALTRPV

SEQ ID NO: 32336 - protein, 25 aa, synthetic construct
  source 1..25: note = Seed: YGFLNVIVHSATGFKQSSKALQRPV
YGFLNVIVHSATGYKQISPALVRPV

SEQ ID NO: 32337 - protein, 25 aa, synthetic construct
  source 1..25: note = Seed: YGFLNVIVHSATGFKQSSKALQRPV
YGFLNVIVHSATGYKQISPALWRPV

SEQ ID NO: 32338 - protein, 25 aa, synthetic construct
  source 1..25: note = Seed: YGFLNVIVHSATGFKQSSKALQRPV
YGFLNVIVHSATGYKQISPALYRPV

SEQ ID NO: 32339 - protein, 25 aa, synthetic construct
  source 1..25: note = Seed: YGFLNVIVHSATGFKQSSKALQRPV
YGFLNVIVHSATGYKQISQALARPV

SEQ ID NO: 32340 - protein, 25 aa, synthetic construct
  source 1..25: note = Seed: YGFLNVIVHSATGFKQSSKALQRPV
YGFLNVIVHSATGYKQISQALNRPV

SEQ ID NO: 32341 - protein, 25 aa, synthetic construct
  source 1..25: note = Seed: YGFLNVIVHSATGFKQSSKALQRPV
YGFLNVIVHSATGYKQISQALRRPV

SEQ ID NO: 32342 - protein, 25 aa, synthetic construct
  source 1..25: note = Seed: YGFLNVIVHSATGFKQSSKALQRPV
YGFLNVIVHSATGYKQISQALSRPV

SEQ ID NO: 32343 - protein, 25 aa, synthetic construct
  source 1..25: note = Seed: YGFLNVIVHSATGFKQSSKALQRPV
YGFLNVIVHSATGYKQISQALTRPV

SEQ ID NO: 32344 - protein, 25 aa, synthetic construct
  source 1..25: note = Seed: YGFLNVIVHSATGFKQSSKALQRPV
YGFLNVIVHSATGYKQISQALVRPV

SEQ ID NO: 32345 - protein, 25 aa, synthetic construct
  source 1..25: note = Seed: YGFLNVIVHSATGFKQSSKALQRPV
YGFLNVIVHSATGYKQISRALARPV

SEQ ID NO: 32346 - protein, 25 aa, synthetic construct
  source 1..25: note = Seed: YGFLNVIVHSATGFKQSSKALQRPV
YGFLNVIVHSATGYKQISRALCRPV

SEQ ID NO: 32347 - protein, 25 aa, synthetic construct
  source 1..25: note = Seed: YGFLNVIVHSATGFKQSSKALQRPV
YGFLNVIVHSATGYKQISRALERPV

SEQ ID NO: 32348 - protein, 25 aa, synthetic construct
  source 1..25: note = Seed: YGFLNVIVHSATGFKQSSKALQRPV
YGFLNVIVHSATGYKQISRALGRPV

SEQ ID NO: 32349 - protein, 25 aa, synthetic construct
  source 1..25: note = Seed: YGFLNVIVHSATGFKQSSKALQRPV
YGFLNVIVHSATGYKQISRALHRPV

SEQ ID NO: 32350 - protein, 25 aa, synthetic construct
  source 1..25: note = Seed: YGFLNVIVHSATGFKQSSKALQRPV
YGFLNVIVHSATGYKQISRALIRPV

SEQ ID NO: 32351 - protein, 25 aa, synthetic construct
  source 1..25: note = Seed: YGFLNVIVHSATGFKQSSKALQRPV
YGFLNVIVHSATGYKQISRALKRPV

SEQ ID NO: 32352 - protein, 25 aa, synthetic construct
  source 1..25: note = Seed: YGFLNVIVHSATGFKQSSKALQRPV
YGFLNVIVHSATGYKQISRALLRPV

SEQ ID NO: 32353 - protein, 25 aa, synthetic construct
  source 1..25: note = Seed: YGFLNVIVHSATGFKQSSKALQRPV
YGFLNVIVHSATGYKQISRALMRPV

SEQ ID NO: 32354 - protein, 25 aa, synthetic construct
  source 1..25: note = Seed: YGFLNVIVHSATGFKQSSKALQRPV
YGFLNVIVHSATGYKQISRALNRPV

SEQ ID NO: 32355 - protein, 25 aa, synthetic construct
  source 1..25: note = Seed: YGFLNVIVHSATGFKQSSKALQRPV
YGFLNVIVHSATGYKQISRALPRPV

SEQ ID NO: 32356 - protein, 25 aa, synthetic construct
  source 1..25: note = Seed: YGFLNVIVHSATGFKQSSKALQRPV
YGFLNVIVHSATGYKQISRALQRPV

SEQ ID NO: 32357 - protein, 25 aa, synthetic construct
  source 1..25: note = Seed: YGFLNVIVHSATGFKQSSKALQRPV
YGFLNVIVHSATGYKQISRALRRPV

SEQ ID NO: 32358 - protein, 25 aa, synthetic construct
  source 1..25: note = Seed: YGFLNVIVHSATGFKQSSKALQRPV
YGFLNVIVHSATGYKQISRALSRPV

SEQ ID NO: 32359 - protein, 25 aa, synthetic construct
  source 1..25: note = Seed: YGFLNVIVHSATGFKQSSKALQRPV
YGFLNVIVHSATGYKQISRALTRPV

SEQ ID NO: 32360 - protein, 25 aa, synthetic construct
  source 1..25: note = Seed: YGFLNVIVHSATGFKQSSKALQRPV
YGFLNVIVHSATGYKQISRALVRPV

SEQ ID NO: 32361 - protein, 25 aa, synthetic construct
  source 1..25: note = Seed: YGFLNVIVHSATGFKQSSKALQRPV
YGFLNVIVHSATGYKQISRALYRPV

SEQ ID NO: 32362 - protein, 25 aa, synthetic construct
  source 1..25: note = Seed: YGFLNVIVHSATGFKQSSKALQRPV
YGFLNVIVHSATGYKQISSALARPV

SEQ ID NO: 32363 - protein, 25 aa, synthetic construct
  source 1..25: note = Seed: YGFLNVIVHSATGFKQSSKALQRPV
YGFLNVIVHSATGYKQISSALCRPV

SEQ ID NO: 32364 - protein, 25 aa, synthetic construct
  source 1..25: note = Seed: YGFLNVIVHSATGFKQSSKALQRPV
YGFLNVIVHSATGYKQISSALDRPV

SEQ ID NO: 32365 - protein, 25 aa, synthetic construct
  source 1..25: note = Seed: YGFLNVIVHSATGFKQSSKALQRPV
YGFLNVIVHSATGYKQISSALERPV

SEQ ID NO: 32366 - protein, 25 aa, synthetic construct
  source 1..25: note = Seed: YGFLNVIVHSATGFKQSSKALQRPV
YGFLNVIVHSATGYKQISSALFRPV

SEQ ID NO: 32367 - protein, 25 aa, synthetic construct
  source 1..25: note = Seed: YGFLNVIVHSATGFKQSSKALQRPV
YGFLNVIVHSATGYKQISSALGRPV

SEQ ID NO: 32368 - protein, 25 aa, synthetic construct
  source 1..25: note = Seed: YGFLNVIVHSATGFKQSSKALQRPV
YGFLNVIVHSATGYKQISSALHRPV

SEQ ID NO: 32369 - protein, 25 aa, synthetic construct
  source 1..25: note = Seed: YGFLNVIVHSATGFKQSSKALQRPV
YGFLNVIVHSATGYKQISSALIRPV

SEQ ID NO: 32370 - protein, 25 aa, synthetic construct
  source 1..25: note = Seed: YGFLNVIVHSATGFKQSSKALQRPV
YGFLNVIVHSATGYKQISSALLRPV

SEQ ID NO: 32371 - protein, 25 aa, synthetic construct
  source 1..25: note = Seed: YGFLNVIVHSATGFKQSSKALQRPV
YGFLNVIVHSATGYKQISSALMRPV

SEQ ID NO: 32372 - protein, 25 aa, synthetic construct
  source 1..25: note = Seed: YGFLNVIVHSATGFKQSSKALQRPV
YGFLNVIVHSATGYKQISSALNRPV

SEQ ID NO: 32373 - protein, 25 aa, synthetic construct
  source 1..25: note = Seed: YGFLNVIVHSATGFKQSSKALQRPV
YGFLNVIVHSATGYKQISSALPRPV

SEQ ID NO: 32374 - protein, 25 aa, synthetic construct
  source 1..25: note = Seed: YGFLNVIVHSATGFKQSSKALQRPV
YGFLNVIVHSATGYKQISSALQRPV

SEQ ID NO: 32375 - protein, 25 aa, synthetic construct
  source 1..25: note = Seed: YGFLNVIVHSATGFKQSSKALQRPV
YGFLNVIVHSATGYKQISSALRRPV

SEQ ID NO: 32376 - protein, 25 aa, synthetic construct
  source 1..25: note = Seed: YGFLNVIVHSATGFKQSSKALQRPV
YGFLNVIVHSATGYKQISSALSRPV

SEQ ID NO: 32377 - protein, 25 aa, synthetic construct
  source 1..25: note = Seed: YGFLNVIVHSATGFKQSSKALQRPV
YGFLNVIVHSATGYKQISSALTRPV

SEQ ID NO: 32378 - protein, 25 aa, synthetic construct
  source 1..25: note = Seed: YGFLNVIVHSATGFKQSSKALQRPV
YGFLNVIVHSATGYKQISSALVRPV

SEQ ID NO: 32379 - protein, 25 aa, synthetic construct
  source 1..25: note = Seed: YGFLNVIVHSATGFKQSSKALQRPV
YGFLNVIVHSATGYKQISSALYRPV

SEQ ID NO: 32380 - protein, 25 aa, synthetic construct
  source 1..25: note = Seed: YGFLNVIVHSATGFKQSSKALQRPV
YGFLNVIVHSATGYKQISTALARPV

SEQ ID NO: 32381 - protein, 25 aa, synthetic construct
  source 1..25: note = Seed: YGFLNVIVHSATGFKQSSKALQRPV
YGFLNVIVHSATGYKQISTALCRPV

SEQ ID NO: 32382 - protein, 25 aa, synthetic construct
  source 1..25: note = Seed: YGFLNVIVHSATGFKQSSKALQRPV
YGFLNVIVHSATGYKQISTALDRPV

SEQ ID NO: 32383 - protein, 25 aa, synthetic construct
  source 1..25: note = Seed: YGFLNVIVHSATGFKQSSKALQRPV
YGFLNVIVHSATGYKQISTALERPV

SEQ ID NO: 32384 - protein, 25 aa, synthetic construct
  source 1..25: note = Seed: YGFLNVIVHSATGFKQSSKALQRPV
YGFLNVIVHSATGYKQISTALFRPV

SEQ ID NO: 32385 - protein, 25 aa, synthetic construct
  source 1..25: note = Seed: YGFLNVIVHSATGFKQSSKALQRPV
YGFLNVIVHSATGYKQISTALGRPV

SEQ ID NO: 32386 - protein, 25 aa, synthetic construct
  source 1..25: note = Seed: YGFLNVIVHSATGFKQSSKALQRPV
YGFLNVIVHSATGYKQISTALHRPV

SEQ ID NO: 32387 - protein, 25 aa, synthetic construct
  source 1..25: note = Seed: YGFLNVIVHSATGFKQSSKALQRPV
YGFLNVIVHSATGYKQISTALIRPV

SEQ ID NO: 32388 - protein, 25 aa, synthetic construct
  source 1..25: note = Seed: YGFLNVIVHSATGFKQSSKALQRPV
YGFLNVIVHSATGYKQISTALKRPV

SEQ ID NO: 32389 - protein, 25 aa, synthetic construct
  source 1..25: note = Seed: YGFLNVIVHSATGFKQSSKALQRPV
YGFLNVIVHSATGYKQISTALLRPV

SEQ ID NO: 32390 - protein, 25 aa, synthetic construct
  source 1..25: note = Seed: YGFLNVIVHSATGFKQSSKALQRPV
YGFLNVIVHSATGYKQISTALMRPV

SEQ ID NO: 32391 - protein, 25 aa, synthetic construct
  source 1..25: note = Seed: YGFLNVIVHSATGFKQSSKALQRPV
YGFLNVIVHSATGYKQISTALNRPV

SEQ ID NO: 32392 - protein, 25 aa, synthetic construct
  source 1..25: note = Seed: YGFLNVIVHSATGFKQSSKALQRPV
YGFLNVIVHSATGYKQISTALPRPV

SEQ ID NO: 32393 - protein, 25 aa, synthetic construct
  source 1..25: note = Seed: YGFLNVIVHSATGFKQSSKALQRPV
YGFLNVIVHSATGYKQISTALQRPV

SEQ ID NO: 32394 - protein, 25 aa, synthetic construct
  source 1..25: note = Seed: YGFLNVIVHSATGFKQSSKALQRPV
YGFLNVIVHSATGYKQISTALRRPV

SEQ ID NO: 32395 - protein, 25 aa, synthetic construct
  source 1..25: note = Seed: YGFLNVIVHSATGFKQSSKALQRPV
YGFLNVIVHSATGYKQISTALSRPV

SEQ ID NO: 32396 - protein, 25 aa, synthetic construct
  source 1..25: note = Seed: YGFLNVIVHSATGFKQSSKALQRPV
YGFLNVIVHSATGYKQISTALTRPV

SEQ ID NO: 32397 - protein, 25 aa, synthetic construct
  source 1..25: note = Seed: YGFLNVIVHSATGFKQSSKALQRPV
YGFLNVIVHSATGYKQISTALVRPV

SEQ ID NO: 32398 - protein, 25 aa, synthetic construct
  source 1..25: note = Seed: YGFLNVIVHSATGFKQSSKALQRPV
YGFLNVIVHSATGYKQISTALYRPV

SEQ ID NO: 32399 - protein, 25 aa, synthetic construct
  source 1..25: note = Seed: YGFLNVIVHSATGFKQSSKALQRPV
YGFLNVIVHSATGYKQISVALARPV

SEQ ID NO: 32400 - protein, 25 aa, synthetic construct
  source 1..25: note = Seed: YGFLNVIVHSATGFKQSSKALQRPV
YGFLNVIVHSATGYKQISVALCRPV

SEQ ID NO: 32401 - protein, 25 aa, synthetic construct
  source 1..25: note = Seed: YGFLNVIVHSATGFKQSSKALQRPV
YGFLNVIVHSATGYKQISVALDRPV

SEQ ID NO: 32402 - protein, 25 aa, synthetic construct
  source 1..25: note = Seed: YGFLNVIVHSATGFKQSSKALQRPV
YGFLNVIVHSATGYKQISVALERPV

SEQ ID NO: 32403 - protein, 25 aa, synthetic construct
  source 1..25: note = Seed: YGFLNVIVHSATGFKQSSKALQRPV
YGFLNVIVHSATGYKQISVALGRPV

SEQ ID NO: 32404 - protein, 25 aa, synthetic construct
  source 1..25: note = Seed: YGFLNVIVHSATGFKQSSKALQRPV
YGFLNVIVHSATGYKQISVALHRPV

SEQ ID NO: 32405 - protein, 25 aa, synthetic construct
  source 1..25: note = Seed: YGFLNVIVHSATGFKQSSKALQRPV
YGFLNVIVHSATGYKQISVALIRPV

SEQ ID NO: 32406 - protein, 25 aa, synthetic construct
  source 1..25: note = Seed: YGFLNVIVHSATGFKQSSKALQRPV
YGFLNVIVHSATGYKQISVALKRPV

SEQ ID NO: 32407 - protein, 25 aa, synthetic construct
  source 1..25: note = Seed: YGFLNVIVHSATGFKQSSKALQRPV
YGFLNVIVHSATGYKQISVALLRPV

SEQ ID NO: 32408 - protein, 25 aa, synthetic construct
  source 1..25: note = Seed: YGFLNVIVHSATGFKQSSKALQRPV
YGFLNVIVHSATGYKQISVALMRPV

SEQ ID NO: 32409 - protein, 25 aa, synthetic construct
  source 1..25: note = Seed: YGFLNVIVHSATGFKQSSKALQRPV
YGFLNVIVHSATGYKQISVALNRPV

SEQ ID NO: 32410 - protein, 25 aa, synthetic construct
  source 1..25: note = Seed: YGFLNVIVHSATGFKQSSKALQRPV
YGFLNVIVHSATGYKQISVALPRPV

SEQ ID NO: 32411 - protein, 25 aa, synthetic construct
  source 1..25: note = Seed: YGFLNVIVHSATGFKQSSKALQRPV
YGFLNVIVHSATGYKQISVALQRPV

SEQ ID NO: 32412 - protein, 25 aa, synthetic construct
  source 1..25: note = Seed: YGFLNVIVHSATGFKQSSKALQRPV
YGFLNVIVHSATGYKQISVALRRPV

SEQ ID NO: 32413 - protein, 25 aa, synthetic construct
  source 1..25: note = Seed: YGFLNVIVHSATGFKQSSKALQRPV
YGFLNVIVHSATGYKQISVALSRPV

SEQ ID NO: 32414 - protein, 25 aa, synthetic construct
  source 1..25: note = Seed: YGFLNVIVHSATGFKQSSKALQRPV
YGFLNVIVHSATGYKQISVALTRPV

SEQ ID NO: 32415 - protein, 25 aa, synthetic construct
  source 1..25: note = Seed: YGFLNVIVHSATGFKQSSKALQRPV
YGFLNVIVHSATGYKQISVALVRPV

SEQ ID NO: 32416 - protein, 25 aa, synthetic construct
  source 1..25: note = Seed: YGFLNVIVHSATGFKQSSKALQRPV
YGFLNVIVHSATGYKQISVALYRPV

SEQ ID NO: 32417 - protein, 25 aa, synthetic construct
  source 1..25: note = Seed: YGFLNVIVHSATGFKQSSKALQRPV
YGFLNVIVHSATGYKQISWALARPV

SEQ ID NO: 32418 - protein, 25 aa, synthetic construct
  source 1..25: note = Seed: YGFLNVIVHSATGFKQSSKALQRPV
YGFLNVIVHSATGYKQISWALFRPV

SEQ ID NO: 32419 - protein, 25 aa, synthetic construct
  source 1..25: note = Seed: YGFLNVIVHSATGFKQSSKALQRPV
YGFLNVIVHSATGYKQISWALLRPV

SEQ ID NO: 32420 - protein, 25 aa, synthetic construct
  source 1..25: note = Seed: YGFLNVIVHSATGFKQSSKALQRPV
YGFLNVIVHSATGYKQISWALNRPV

SEQ ID NO: 32421 - protein, 25 aa, synthetic construct
  source 1..25: note = Seed: YGFLNVIVHSATGFKQSSKALQRPV
YGFLNVIVHSATGYKQISWALSRPV

SEQ ID NO: 32422 - protein, 25 aa, synthetic construct
  source 1..25: note = Seed: YGFLNVIVHSATGFKQSSKALQRPV
YGFLNVIVHSATGYKQISWALYRPV

SEQ ID NO: 32423 - protein, 25 aa, synthetic construct
  source 1..25: note = Seed: YGFLNVIVHSATGFKQSSKALQRPV
YGFLNVIVHSATGYKQISYALARPV

SEQ ID NO: 32424 - protein, 25 aa, synthetic construct
  source 1..25: note = Seed: YGFLNVIVHSATGFKQSSKALQRPV
YGFLNVIVHSATGYKQISYALFRPV

SEQ ID NO: 32425 - protein, 25 aa, synthetic construct
  source 1..25: note = Seed: YGFLNVIVHSATGFKQSSKALQRPV
YGFLNVIVHSATGYKQISYALIRPV

SEQ ID NO: 32426 - protein, 25 aa, synthetic construct
  source 1..25: note = Seed: YGFLNVIVHSATGFKQSSKALQRPV
YGFLNVIVHSATGYKQISYALLRPV

SEQ ID NO: 32427 - protein, 25 aa, synthetic construct
  source 1..25: note = Seed: YGFLNVIVHSATGFKQSSKALQRPV
YGFLNVIVHSATGYKQISYALMRPV

SEQ ID NO: 32428 - protein, 25 aa, synthetic construct
  source 1..25: note = Seed: YGFLNVIVHSATGFKQSSKALQRPV
YGFLNVIVHSATGYKQISYALNRPV

SEQ ID NO: 32429 - protein, 25 aa, synthetic construct
  source 1..25: note = Seed: YGFLNVIVHSATGFKQSSKALQRPV
YGFLNVIVHSATGYKQISYALSRPV

SEQ ID NO: 32430 - protein, 25 aa, synthetic construct
  source 1..25: note = Seed: YGFLNVIVHSATGFKQSSKALQRPV
YGFLNVIVHSATGYKQISYALVRPV

SEQ ID NO: 32431 - protein, 25 aa, synthetic construct
  source 1..25: note = Seed: YGFLNVIVHSATGFKQSSKALQRPV
YGFLNVIVHSATGYKQISYALWRPV

SEQ ID NO: 32432 - protein, 25 aa, synthetic construct
  source 1..25: note = Seed: YGFLNVIVHSATGFKQSSKALQRPV
YGFLNVIVHSATGYKQISYALYRPV

SEQ ID NO: 32433 - protein, 25 aa, synthetic construct
  source 1..25: note = Seed: YGFLNVIVHSATGFKQSSKALQRPV
YGFLNVIVHSATGYKQLSAALARPV

SEQ ID NO: 32434 - protein, 25 aa, synthetic construct
  source 1..25: note = Seed: YGFLNVIVHSATGFKQSSKALQRPV
YGFLNVIVHSATGYKQLSAALCRPV

SEQ ID NO: 32435 - protein, 25 aa, synthetic construct
  source 1..25: note = Seed: YGFLNVIVHSATGFKQSSKALQRPV
YGFLNVIVHSATGYKQLSAALDRPV

SEQ ID NO: 32436 - protein, 25 aa, synthetic construct
  source 1..25: note = Seed: YGFLNVIVHSATGFKQSSKALQRPV
YGFLNVIVHSATGYKQLSAALERPV

SEQ ID NO: 32437 - protein, 25 aa, synthetic construct
  source 1..25: note = Seed: YGFLNVIVHSATGFKQSSKALQRPV
YGFLNVIVHSATGYKQLSAALFRPV

SEQ ID NO: 32438 - protein, 25 aa, synthetic construct
  source 1..25: note = Seed: YGFLNVIVHSATGFKQSSKALQRPV
YGFLNVIVHSATGYKQLSAALGRPV

SEQ ID NO: 32439 - protein, 25 aa, synthetic construct
  source 1..25: note = Seed: YGFLNVIVHSATGFKQSSKALQRPV
YGFLNVIVHSATGYKQLSAALHRPV

SEQ ID NO: 32440 - protein, 25 aa, synthetic construct
  source 1..25: note = Seed: YGFLNVIVHSATGFKQSSKALQRPV
YGFLNVIVHSATGYKQLSAALIRPV

SEQ ID NO: 32441 - protein, 25 aa, synthetic construct
  source 1..25: note = Seed: YGFLNVIVHSATGFKQSSKALQRPV
YGFLNVIVHSATGYKQLSAALKRPV

SEQ ID NO: 32442 - protein, 25 aa, synthetic construct
  source 1..25: note = Seed: YGFLNVIVHSATGFKQSSKALQRPV
YGFLNVIVHSATGYKQLSAALLRPV

SEQ ID NO: 32443 - protein, 25 aa, synthetic construct
  source 1..25: note = Seed: YGFLNVIVHSATGFKQSSKALQRPV
YGFLNVIVHSATGYKQLSAALMRPV

SEQ ID NO: 32444 - protein, 25 aa, synthetic construct
  source 1..25: note = Seed: YGFLNVIVHSATGFKQSSKALQRPV
YGFLNVIVHSATGYKQLSAALNRPV

SEQ ID NO: 32445 - protein, 25 aa, synthetic construct
  source 1..25: note = Seed: YGFLNVIVHSATGFKQSSKALQRPV
YGFLNVIVHSATGYKQLSAALPRPV

SEQ ID NO: 32446 - protein, 25 aa, synthetic construct
  source 1..25: note = Seed: YGFLNVIVHSATGFKQSSKALQRPV
YGFLNVIVHSATGYKQLSAALQRPV

SEQ ID NO: 32447 - protein, 25 aa, synthetic construct
  source 1..25: note = Seed: YGFLNVIVHSATGFKQSSKALQRPV
YGFLNVIVHSATGYKQLSAALRRPV

SEQ ID NO: 32448 - protein, 25 aa, synthetic construct
  source 1..25: note = Seed: YGFLNVIVHSATGFKQSSKALQRPV
YGFLNVIVHSATGYKQLSAALSRPV

SEQ ID NO: 32449 - protein, 25 aa, synthetic construct
  source 1..25: note = Seed: YGFLNVIVHSATGFKQSSKALQRPV
YGFLNVIVHSATGYKQLSAALTRPV

SEQ ID NO: 32450 - protein, 25 aa, synthetic construct
  source 1..25: note = Seed: YGFLNVIVHSATGFKQSSKALQRPV
YGFLNVIVHSATGYKQLSAALVRPV

SEQ ID NO: 32451 - protein, 25 aa, synthetic construct
  source 1..25: note = Seed: YGFLNVIVHSATGFKQSSKALQRPV
YGFLNVIVHSATGYKQLSAALWRPV

SEQ ID NO: 32452 - protein, 25 aa, synthetic construct
  source 1..25: note = Seed: YGFLNVIVHSATGFKQSSKALQRPV
YGFLNVIVHSATGYKQLSAALYRPV

SEQ ID NO: 32453 - protein, 25 aa, synthetic construct
  source 1..25: note = Seed: YGFLNVIVHSATGFKQSSKALQRPV
YGFLNVIVHSATGYKQLSCALARPV

SEQ ID NO: 32454 - protein, 25 aa, synthetic construct
  source 1..25: note = Seed: YGFLNVIVHSATGFKQSSKALQRPV
YGFLNVIVHSATGYKQLSCALNRPV

SEQ ID NO: 32455 - protein, 25 aa, synthetic construct
  source 1..25: note = Seed: YGFLNVIVHSATGFKQSSKALQRPV
YGFLNVIVHSATGYKQLSCALSRPV

SEQ ID NO: 32456 - protein, 25 aa, synthetic construct
  source 1..25: note = Seed: YGFLNVIVHSATGFKQSSKALQRPV
YGFLNVIVHSATGYKQLSDALARPV

SEQ ID NO: 32457 - protein, 25 aa, synthetic construct
  source 1..25: note = Seed: YGFLNVIVHSATGFKQSSKALQRPV
YGFLNVIVHSATGYKQLSDALSRPV

SEQ ID NO: 32458 - protein, 25 aa, synthetic construct
  source 1..25: note = Seed: YGFLNVIVHSATGFKQSSKALQRPV
YGFLNVIVHSATGYKQLSEALARPV

SEQ ID NO: 32459 - protein, 25 aa, synthetic construct
  source 1..25: note = Seed: YGFLNVIVHSATGFKQSSKALQRPV
YGFLNVIVHSATGYKQLSEALNRPV

SEQ ID NO: 32460 - protein, 25 aa, synthetic construct
  source 1..25: note = Seed: YGFLNVIVHSATGFKQSSKALQRPV
YGFLNVIVHSATGYKQLSEALSRPV

SEQ ID NO: 32461 - protein, 25 aa, synthetic construct
  source 1..25: note = Seed: YGFLNVIVHSATGFKQSSKALQRPV
YGFLNVIVHSATGYKQLSEALTRPV

SEQ ID NO: 32462 - protein, 25 aa, synthetic construct
  source 1..25: note = Seed: YGFLNVIVHSATGFKQSSKALQRPV
YGFLNVIVHSATGYKQLSEALVRPV

SEQ ID NO: 32463 - protein, 25 aa, synthetic construct
  source 1..25: note = Seed: YGFLNVIVHSATGFKQSSKALQRPV
YGFLNVIVHSATGYKQLSFALARPV

SEQ ID NO: 32464 - protein, 25 aa, synthetic construct
  source 1..25: note = Seed: YGFLNVIVHSATGFKQSSKALQRPV
YGFLNVIVHSATGYKQLSFALFRPV

SEQ ID NO: 32465 - protein, 25 aa, synthetic construct
  source 1..25: note = Seed: YGFLNVIVHSATGFKQSSKALQRPV
YGFLNVIVHSATGYKQLSFALIRPV

SEQ ID NO: 32466 - protein, 25 aa, synthetic construct
  source 1..25: note = Seed: YGFLNVIVHSATGFKQSSKALQRPV
YGFLNVIVHSATGYKQLSFALLRPV

SEQ ID NO: 32467 - protein, 25 aa, synthetic construct
  source 1..25: note = Seed: YGFLNVIVHSATGFKQSSKALQRPV
YGFLNVIVHSATGYKQLSFALMRPV

SEQ ID NO: 32468 - protein, 25 aa, synthetic construct
  source 1..25: note = Seed: YGFLNVIVHSATGFKQSSKALQRPV
YGFLNVIVHSATGYKQLSFALNRPV

SEQ ID NO: 32469 - protein, 25 aa, synthetic construct
  source 1..25: note = Seed: YGFLNVIVHSATGFKQSSKALQRPV
YGFLNVIVHSATGYKQLSFALSRPV

SEQ ID NO: 32470 - protein, 25 aa, synthetic construct
  source 1..25: note = Seed: YGFLNVIVHSATGFKQSSKALQRPV
YGFLNVIVHSATGYKQLSFALVRPV

SEQ ID NO: 32471 - protein, 25 aa, synthetic construct
  source 1..25: note = Seed: YGFLNVIVHSATGFKQSSKALQRPV
YGFLNVIVHSATGYKQLSFALWRPV

SEQ ID NO: 32472 - protein, 25 aa, synthetic construct
  source 1..25: note = Seed: YGFLNVIVHSATGFKQSSKALQRPV
YGFLNVIVHSATGYKQLSFALYRPV

SEQ ID NO: 32473 - protein, 25 aa, synthetic construct
  source 1..25: note = Seed: YGFLNVIVHSATGFKQSSKALQRPV
YGFLNVIVHSATGYKQLSGALARPV

SEQ ID NO: 32474 - protein, 25 aa, synthetic construct
  source 1..25: note = Seed: YGFLNVIVHSATGFKQSSKALQRPV
YGFLNVIVHSATGYKQLSGALCRPV

SEQ ID NO: 32475 - protein, 25 aa, synthetic construct
  source 1..25: note = Seed: YGFLNVIVHSATGFKQSSKALQRPV
YGFLNVIVHSATGYKQLSGALDRPV

SEQ ID NO: 32476 - protein, 25 aa, synthetic construct
  source 1..25: note = Seed: YGFLNVIVHSATGFKQSSKALQRPV
YGFLNVIVHSATGYKQLSGALERPV

SEQ ID NO: 32477 - protein, 25 aa, synthetic construct
  source 1..25: note = Seed: YGFLNVIVHSATGFKQSSKALQRPV
YGFLNVIVHSATGYKQLSGALFRPV

SEQ ID NO: 32478 - protein, 25 aa, synthetic construct
  source 1..25: note = Seed: YGFLNVIVHSATGFKQSSKALQRPV
YGFLNVIVHSATGYKQLSGALGRPV

SEQ ID NO: 32479 - protein, 25 aa, synthetic construct
  source 1..25: note = Seed: YGFLNVIVHSATGFKQSSKALQRPV
YGFLNVIVHSATGYKQLSGALHRPV

SEQ ID NO: 32480 - protein, 25 aa, synthetic construct
  source 1..25: note = Seed: YGFLNVIVHSATGFKQSSKALQRPV
YGFLNVIVHSATGYKQLSGALIRPV

SEQ ID NO: 32481 - protein, 25 aa, synthetic construct
  source 1..25: note = Seed: YGFLNVIVHSATGFKQSSKALQRPV
YGFLNVIVHSATGYKQLSGALLRPV

SEQ ID NO: 32482 - protein, 25 aa, synthetic construct
  source 1..25: note = Seed: YGFLNVIVHSATGFKQSSKALQRPV
YGFLNVIVHSATGYKQLSGALMRPV

SEQ ID NO: 32483 - protein, 25 aa, synthetic construct
  source 1..25: note = Seed: YGFLNVIVHSATGFKQSSKALQRPV
YGFLNVIVHSATGYKQLSGALNRPV

SEQ ID NO: 32484 - protein, 25 aa, synthetic construct
  source 1..25: note = Seed: YGFLNVIVHSATGFKQSSKALQRPV
YGFLNVIVHSATGYKQLSGALPRPV

SEQ ID NO: 32485 - protein, 25 aa, synthetic construct
  source 1..25: note = Seed: YGFLNVIVHSATGFKQSSKALQRPV
YGFLNVIVHSATGYKQLSGALQRPV

SEQ ID NO: 32486 - protein, 25 aa, synthetic construct
  source 1..25: note = Seed: YGFLNVIVHSATGFKQSSKALQRPV
YGFLNVIVHSATGYKQLSGALSRPV

SEQ ID NO: 32487 - protein, 25 aa, synthetic construct
  source 1..25: note = Seed: YGFLNVIVHSATGFKQSSKALQRPV
YGFLNVIVHSATGYKQLSGALTRPV

SEQ ID NO: 32488 - protein, 25 aa, synthetic construct
  source 1..25: note = Seed: YGFLNVIVHSATGFKQSSKALQRPV
YGFLNVIVHSATGYKQLSGALVRPV

SEQ ID NO: 32489 - protein, 25 aa, synthetic construct
  source 1..25: note = Seed: YGFLNVIVHSATGFKQSSKALQRPV
YGFLNVIVHSATGYKQLSGALYRPV

SEQ ID NO: 32490 - protein, 25 aa, synthetic construct
  source 1..25: note = Seed: YGFLNVIVHSATGFKQSSKALQRPV
YGFLNVIVHSATGYKQLSHALARPV

SEQ ID NO: 32491 - protein, 25 aa, synthetic construct
  source 1..25: note = Seed: YGFLNVIVHSATGFKQSSKALQRPV
YGFLNVIVHSATGYKQLSHALIRPV

SEQ ID NO: 32492 - protein, 25 aa, synthetic construct
  source 1..25: note = Seed: YGFLNVIVHSATGFKQSSKALQRPV
YGFLNVIVHSATGYKQLSHALMRPV

SEQ ID NO: 32493 - protein, 25 aa, synthetic construct
  source 1..25: note = Seed: YGFLNVIVHSATGFKQSSKALQRPV
YGFLNVIVHSATGYKQLSHALNRPV

SEQ ID NO: 32494 - protein, 25 aa, synthetic construct
  source 1..25: note = Seed: YGFLNVIVHSATGFKQSSKALQRPV
YGFLNVIVHSATGYKQLSHALRRPV

SEQ ID NO: 32495 - protein, 25 aa, synthetic construct
  source 1..25: note = Seed: YGFLNVIVHSATGFKQSSKALQRPV
YGFLNVIVHSATGYKQLSHALSRPV

SEQ ID NO: 32496 - protein, 25 aa, synthetic construct
  source 1..25: note = Seed: YGFLNVIVHSATGFKQSSKALQRPV
YGFLNVIVHSATGYKQLSHALTRPV

SEQ ID NO: 32497 - protein, 25 aa, synthetic construct
  source 1..25: note = Seed: YGFLNVIVHSATGFKQSSKALQRPV
YGFLNVIVHSATGYKQLSHALVRPV

SEQ ID NO: 32498 - protein, 25 aa, synthetic construct
  source 1..25: note = Seed: YGFLNVIVHSATGFKQSSKALQRPV
YGFLNVIVHSATGYKQLSIALARPV

SEQ ID NO: 32499 - protein, 25 aa, synthetic construct
  source 1..25: note = Seed: YGFLNVIVHSATGFKQSSKALQRPV
YGFLNVIVHSATGYKQLSIALCRPV

SEQ ID NO: 32500 - protein, 25 aa, synthetic construct
  source 1..25: note = Seed: YGFLNVIVHSATGFKQSSKALQRPV
YGFLNVIVHSATGYKQLSIALDRPV

SEQ ID NO: 32501 - protein, 25 aa, synthetic construct
  source 1..25: note = Seed: YGFLNVIVHSATGFKQSSKALQRPV
YGFLNVIVHSATGYKQLSIALERPV

SEQ ID NO: 32502 - protein, 25 aa, synthetic construct
  source 1..25: note = Seed: YGFLNVIVHSATGFKQSSKALQRPV
YGFLNVIVHSATGYKQLSIALGRPV

SEQ ID NO: 32503 - protein, 25 aa, synthetic construct
  source 1..25: note = Seed: YGFLNVIVHSATGFKQSSKALQRPV
YGFLNVIVHSATGYKQLSIALHRPV

SEQ ID NO: 32504 - protein, 25 aa, synthetic construct
  source 1..25: note = Seed: YGFLNVIVHSATGFKQSSKALQRPV
YGFLNVIVHSATGYKQLSIALIRPV

SEQ ID NO: 32505 - protein, 25 aa, synthetic construct
  source 1..25: note = Seed: YGFLNVIVHSATGFKQSSKALQRPV
YGFLNVIVHSATGYKQLSIALKRPV

SEQ ID NO: 32506 - protein, 25 aa, synthetic construct
  source 1..25: note = Seed: YGFLNVIVHSATGFKQSSKALQRPV
YGFLNVIVHSATGYKQLSIALLRPV

SEQ ID NO: 32507 - protein, 25 aa, synthetic construct
  source 1..25: note = Seed: YGFLNVIVHSATGFKQSSKALQRPV
YGFLNVIVHSATGYKQLSIALMRPV

SEQ ID NO: 32508 - protein, 25 aa, synthetic construct
  source 1..25: note = Seed: YGFLNVIVHSATGFKQSSKALQRPV
YGFLNVIVHSATGYKQLSIALNRPV

SEQ ID NO: 32509 - protein, 25 aa, synthetic construct
  source 1..25: note = Seed: YGFLNVIVHSATGFKQSSKALQRPV
YGFLNVIVHSATGYKQLSIALPRPV

SEQ ID NO: 32510 - protein, 25 aa, synthetic construct
  source 1..25: note = Seed: YGFLNVIVHSATGFKQSSKALQRPV
YGFLNVIVHSATGYKQLSIALQRPV

SEQ ID NO: 32511 - protein, 25 aa, synthetic construct
  source 1..25: note = Seed: YGFLNVIVHSATGFKQSSKALQRPV
YGFLNVIVHSATGYKQLSIALRRPV

SEQ ID NO: 32512 - protein, 25 aa, synthetic construct
  source 1..25: note = Seed: YGFLNVIVHSATGFKQSSKALQRPV
YGFLNVIVHSATGYKQLSIALSRPV

SEQ ID NO: 32513 - protein, 25 aa, synthetic construct
  source 1..25: note = Seed: YGFLNVIVHSATGFKQSSKALQRPV
YGFLNVIVHSATGYKQLSIALTRPV

SEQ ID NO: 32514 - protein, 25 aa, synthetic construct
  source 1..25: note = Seed: YGFLNVIVHSATGFKQSSKALQRPV
YGFLNVIVHSATGYKQLSIALVRPV

SEQ ID NO: 32515 - protein, 25 aa, synthetic construct
  source 1..25: note = Seed: YGFLNVIVHSATGFKQSSKALQRPV
YGFLNVIVHSATGYKQLSIALYRPV

SEQ ID NO: 32516 - protein, 25 aa, synthetic construct
  source 1..25: note = Seed: YGFLNVIVHSATGFKQSSKALQRPV
YGFLNVIVHSATGYKQLSKALARPV

SEQ ID NO: 32517 - protein, 25 aa, synthetic construct
  source 1..25: note = Seed: YGFLNVIVHSATGFKQSSKALQRPV
YGFLNVIVHSATGYKQLSKALGRPV

SEQ ID NO: 32518 - protein, 25 aa, synthetic construct
  source 1..25: note = Seed: YGFLNVIVHSATGFKQSSKALQRPV
YGFLNVIVHSATGYKQLSKALHRPV

SEQ ID NO: 32519 - protein, 25 aa, synthetic construct
  source 1..25: note = Seed: YGFLNVIVHSATGFKQSSKALQRPV
YGFLNVIVHSATGYKQLSKALIRPV

SEQ ID NO: 32520 - protein, 25 aa, synthetic construct
  source 1..25: note = Seed: YGFLNVIVHSATGFKQSSKALQRPV
YGFLNVIVHSATGYKQLSKALKRPV

SEQ ID NO: 32521 - protein, 25 aa, synthetic construct
  source 1..25: note = Seed: YGFLNVIVHSATGFKQSSKALQRPV
YGFLNVIVHSATGYKQLSKALLRPV

SEQ ID NO: 32522 - protein, 25 aa, synthetic construct
  source 1..25: note = Seed: YGFLNVIVHSATGFKQSSKALQRPV
YGFLNVIVHSATGYKQLSKALMRPV

SEQ ID NO: 32523 - protein, 25 aa, synthetic construct
  source 1..25: note = Seed: YGFLNVIVHSATGFKQSSKALQRPV
YGFLNVIVHSATGYKQLSKALNRPV

SEQ ID NO: 32524 - protein, 25 aa, synthetic construct
  source 1..25: note = Seed: YGFLNVIVHSATGFKQSSKALQRPV
YGFLNVIVHSATGYKQLSKALPRPV

SEQ ID NO: 32525 - protein, 25 aa, synthetic construct
  source 1..25: note = Seed: YGFLNVIVHSATGFKQSSKALQRPV
YGFLNVIVHSATGYKQLSKALQRPV

SEQ ID NO: 32526 - protein, 25 aa, synthetic construct
  source 1..25: note = Seed: YGFLNVIVHSATGFKQSSKALQRPV
YGFLNVIVHSATGYKQLSKALRRPV

SEQ ID NO: 32527 - protein, 25 aa, synthetic construct
  source 1..25: note = Seed: YGFLNVIVHSATGFKQSSKALQRPV
YGFLNVIVHSATGYKQLSKALSRPV

SEQ ID NO: 32528 - protein, 25 aa, synthetic construct
  source 1..25: note = Seed: YGFLNVIVHSATGFKQSSKALQRPV
YGFLNVIVHSATGYKQLSKALTRPV

SEQ ID NO: 32529 - protein, 25 aa, synthetic construct
  source 1..25: note = Seed: YGFLNVIVHSATGFKQSSKALQRPV
YGFLNVIVHSATGYKQLSKALVRPV

SEQ ID NO: 32530 - protein, 25 aa, synthetic construct
  source 1..25: note = Seed: YGFLNVIVHSATGFKQSSKALQRPV
YGFLNVIVHSATGYKQLSLALARPV

SEQ ID NO: 32531 - protein, 25 aa, synthetic construct
  source 1..25: note = Seed: YGFLNVIVHSATGFKQSSKALQRPV
YGFLNVIVHSATGYKQLSLALDRPV

SEQ ID NO: 32532 - protein, 25 aa, synthetic construct
  source 1..25: note = Seed: YGFLNVIVHSATGFKQSSKALQRPV
YGFLNVIVHSATGYKQLSLALFRPV

SEQ ID NO: 32533 - protein, 25 aa, synthetic construct
  source 1..25: note = Seed: YGFLNVIVHSATGFKQSSKALQRPV
YGFLNVIVHSATGYKQLSLALGRPV

SEQ ID NO: 32534 - protein, 25 aa, synthetic construct
  source 1..25: note = Seed: YGFLNVIVHSATGFKQSSKALQRPV
YGFLNVIVHSATGYKQLSLALHRPV

SEQ ID NO: 32535 - protein, 25 aa, synthetic construct
  source 1..25: note = Seed: YGFLNVIVHSATGFKQSSKALQRPV
YGFLNVIVHSATGYKQLSLALIRPV

SEQ ID NO: 32536 - protein, 25 aa, synthetic construct
  source 1..25: note = Seed: YGFLNVIVHSATGFKQSSKALQRPV
YGFLNVIVHSATGYKQLSLALLRPV

SEQ ID NO: 32537 - protein, 25 aa, synthetic construct
  source 1..25: note = Seed: YGFLNVIVHSATGFKQSSKALQRPV
YGFLNVIVHSATGYKQLSLALMRPV

SEQ ID NO: 32538 - protein, 25 aa, synthetic construct
  source 1..25: note = Seed: YGFLNVIVHSATGFKQSSKALQRPV
YGFLNVIVHSATGYKQLSLALNRPV

SEQ ID NO: 32539 - protein, 25 aa, synthetic construct
  source 1..25: note = Seed: YGFLNVIVHSATGFKQSSKALQRPV
YGFLNVIVHSATGYKQLSLALPRPV

SEQ ID NO: 32540 - protein, 25 aa, synthetic construct
  source 1..25: note = Seed: YGFLNVIVHSATGFKQSSKALQRPV
YGFLNVIVHSATGYKQLSLALQRPV

SEQ ID NO: 32541 - protein, 25 aa, synthetic construct
  source 1..25: note = Seed: YGFLNVIVHSATGFKQSSKALQRPV
YGFLNVIVHSATGYKQLSLALSRPV

SEQ ID NO: 32542 - protein, 25 aa, synthetic construct
  source 1..25: note = Seed: YGFLNVIVHSATGFKQSSKALQRPV
YGFLNVIVHSATGYKQLSLALTRPV

SEQ ID NO: 32543 - protein, 25 aa, synthetic construct
  source 1..25: note = Seed: YGFLNVIVHSATGFKQSSKALQRPV
YGFLNVIVHSATGYKQLSLALVRPV

SEQ ID NO: 32544 - protein, 25 aa, synthetic construct
  source 1..25: note = Seed: YGFLNVIVHSATGFKQSSKALQRPV
YGFLNVIVHSATGYKQLSMALARPV

SEQ ID NO: 32545 - protein, 25 aa, synthetic construct
  source 1..25: note = Seed: YGFLNVIVHSATGFKQSSKALQRPV
YGFLNVIVHSATGYKQLSMALDRPV

SEQ ID NO: 32546 - protein, 25 aa, synthetic construct
  source 1..25: note = Seed: YGFLNVIVHSATGFKQSSKALQRPV
YGFLNVIVHSATGYKQLSMALERPV

SEQ ID NO: 32547 - protein, 25 aa, synthetic construct
  source 1..25: note = Seed: YGFLNVIVHSATGFKQSSKALQRPV
YGFLNVIVHSATGYKQLSMALFRPV

SEQ ID NO: 32548 - protein, 25 aa, synthetic construct
  source 1..25: note = Seed: YGFLNVIVHSATGFKQSSKALQRPV
YGFLNVIVHSATGYKQLSMALGRPV

SEQ ID NO: 32549 - protein, 25 aa, synthetic construct
  source 1..25: note = Seed: YGFLNVIVHSATGFKQSSKALQRPV
YGFLNVIVHSATGYKQLSMALHRPV

SEQ ID NO: 32550 - protein, 25 aa, synthetic construct
  source 1..25: note = Seed: YGFLNVIVHSATGFKQSSKALQRPV
YGFLNVIVHSATGYKQLSMALIRPV

SEQ ID NO: 32551 - protein, 25 aa, synthetic construct
  source 1..25: note = Seed: YGFLNVIVHSATGFKQSSKALQRPV
YGFLNVIVHSATGYKQLSMALLRPV

SEQ ID NO: 32552 - protein, 25 aa, synthetic construct
  source 1..25: note = Seed: YGFLNVIVHSATGFKQSSKALQRPV
YGFLNVIVHSATGYKQLSMALMRPV

SEQ ID NO: 32553 - protein, 25 aa, synthetic construct
  source 1..25: note = Seed: YGFLNVIVHSATGFKQSSKALQRPV
YGFLNVIVHSATGYKQLSMALNRPV

SEQ ID NO: 32554 - protein, 25 aa, synthetic construct
  source 1..25: note = Seed: YGFLNVIVHSATGFKQSSKALQRPV
YGFLNVIVHSATGYKQLSMALPRPV

SEQ ID NO: 32555 - protein, 25 aa, synthetic construct
  source 1..25: note = Seed: YGFLNVIVHSATGFKQSSKALQRPV
YGFLNVIVHSATGYKQLSMALQRPV

SEQ ID NO: 32556 - protein, 25 aa, synthetic construct
  source 1..25: note = Seed: YGFLNVIVHSATGFKQSSKALQRPV
YGFLNVIVHSATGYKQLSMALSRPV

SEQ ID NO: 32557 - protein, 25 aa, synthetic construct
  source 1..25: note = Seed: YGFLNVIVHSATGFKQSSKALQRPV
YGFLNVIVHSATGYKQLSMALTRPV

SEQ ID NO: 32558 - protein, 25 aa, synthetic construct
  source 1..25: note = Seed: YGFLNVIVHSATGFKQSSKALQRPV
YGFLNVIVHSATGYKQLSMALVRPV

SEQ ID NO: 32559 - protein, 25 aa, synthetic construct
  source 1..25: note = Seed: YGFLNVIVHSATGFKQSSKALQRPV
YGFLNVIVHSATGYKQLSNALARPV

SEQ ID NO: 32560 - protein, 25 aa, synthetic construct
  source 1..25: note = Seed: YGFLNVIVHSATGFKQSSKALQRPV
YGFLNVIVHSATGYKQLSNALCRPV

SEQ ID NO: 32561 - protein, 25 aa, synthetic construct
  source 1..25: note = Seed: YGFLNVIVHSATGFKQSSKALQRPV
YGFLNVIVHSATGYKQLSNALDRPV

SEQ ID NO: 32562 - protein, 25 aa, synthetic construct
  source 1..25: note = Seed: YGFLNVIVHSATGFKQSSKALQRPV
YGFLNVIVHSATGYKQLSNALERPV

SEQ ID NO: 32563 - protein, 25 aa, synthetic construct
  source 1..25: note = Seed: YGFLNVIVHSATGFKQSSKALQRPV
YGFLNVIVHSATGYKQLSNALFRPV

SEQ ID NO: 32564 - protein, 25 aa, synthetic construct
  source 1..25: note = Seed: YGFLNVIVHSATGFKQSSKALQRPV
YGFLNVIVHSATGYKQLSNALGRPV

SEQ ID NO: 32565 - protein, 25 aa, synthetic construct
  source 1..25: note = Seed: YGFLNVIVHSATGFKQSSKALQRPV
YGFLNVIVHSATGYKQLSNALHRPV

SEQ ID NO: 32566 - protein, 25 aa, synthetic construct
  source 1..25: note = Seed: YGFLNVIVHSATGFKQSSKALQRPV
YGFLNVIVHSATGYKQLSNALIRPV

SEQ ID NO: 32567 - protein, 25 aa, synthetic construct
  source 1..25: note = Seed: YGFLNVIVHSATGFKQSSKALQRPV
YGFLNVIVHSATGYKQLSNALLRPV

SEQ ID NO: 32568 - protein, 25 aa, synthetic construct
  source 1..25: note = Seed: YGFLNVIVHSATGFKQSSKALQRPV
YGFLNVIVHSATGYKQLSNALMRPV

SEQ ID NO: 32569 - protein, 25 aa, synthetic construct
  source 1..25: note = Seed: YGFLNVIVHSATGFKQSSKALQRPV
YGFLNVIVHSATGYKQLSNALNRPV

SEQ ID NO: 32570 - protein, 25 aa, synthetic construct
  source 1..25: note = Seed: YGFLNVIVHSATGFKQSSKALQRPV
YGFLNVIVHSATGYKQLSNALPRPV

SEQ ID NO: 32571 - protein, 25 aa, synthetic construct
  source 1..25: note = Seed: YGFLNVIVHSATGFKQSSKALQRPV
YGFLNVIVHSATGYKQLSNALQRPV

SEQ ID NO: 32572 - protein, 25 aa, synthetic construct
  source 1..25: note = Seed: YGFLNVIVHSATGFKQSSKALQRPV
YGFLNVIVHSATGYKQLSNALSRPV

SEQ ID NO: 32573 - protein, 25 aa, synthetic construct
  source 1..25: note = Seed: YGFLNVIVHSATGFKQSSKALQRPV
YGFLNVIVHSATGYKQLSNALTRPV

SEQ ID NO: 32574 - protein, 25 aa, synthetic construct
  source 1..25: note = Seed: YGFLNVIVHSATGFKQSSKALQRPV
YGFLNVIVHSATGYKQLSNALVRPV

SEQ ID NO: 32575 - protein, 25 aa, synthetic construct
  source 1..25: note = Seed: YGFLNVIVHSATGFKQSSKALQRPV
YGFLNVIVHSATGYKQLSPALARPV

SEQ ID NO: 32576 - protein, 25 aa, synthetic construct
  source 1..25: note = Seed: YGFLNVIVHSATGFKQSSKALQRPV
YGFLNVIVHSATGYKQLSPALCRPV

SEQ ID NO: 32577 - protein, 25 aa, synthetic construct
  source 1..25: note = Seed: YGFLNVIVHSATGFKQSSKALQRPV
YGFLNVIVHSATGYKQLSPALDRPV

SEQ ID NO: 32578 - protein, 25 aa, synthetic construct
  source 1..25: note = Seed: YGFLNVIVHSATGFKQSSKALQRPV
YGFLNVIVHSATGYKQLSPALERPV

SEQ ID NO: 32579 - protein, 25 aa, synthetic construct
  source 1..25: note = Seed: YGFLNVIVHSATGFKQSSKALQRPV
YGFLNVIVHSATGYKQLSPALFRPV

SEQ ID NO: 32580 - protein, 25 aa, synthetic construct
  source 1..25: note = Seed: YGFLNVIVHSATGFKQSSKALQRPV
YGFLNVIVHSATGYKQLSPALGRPV

SEQ ID NO: 32581 - protein, 25 aa, synthetic construct
  source 1..25: note = Seed: YGFLNVIVHSATGFKQSSKALQRPV
YGFLNVIVHSATGYKQLSPALHRPV

SEQ ID NO: 32582 - protein, 25 aa, synthetic construct
  source 1..25: note = Seed: YGFLNVIVHSATGFKQSSKALQRPV
YGFLNVIVHSATGYKQLSPALIRPV

SEQ ID NO: 32583 - protein, 25 aa, synthetic construct
  source 1..25: note = Seed: YGFLNVIVHSATGFKQSSKALQRPV
YGFLNVIVHSATGYKQLSPALKRPV

SEQ ID NO: 32584 - protein, 25 aa, synthetic construct
  source 1..25: note = Seed: YGFLNVIVHSATGFKQSSKALQRPV
YGFLNVIVHSATGYKQLSPALLRPV

SEQ ID NO: 32585 - protein, 25 aa, synthetic construct
  source 1..25: note = Seed: YGFLNVIVHSATGFKQSSKALQRPV
YGFLNVIVHSATGYKQLSPALMRPV

SEQ ID NO: 32586 - protein, 25 aa, synthetic construct
  source 1..25: note = Seed: YGFLNVIVHSATGFKQSSKALQRPV
YGFLNVIVHSATGYKQLSPALNRPV

SEQ ID NO: 32587 - protein, 25 aa, synthetic construct
  source 1..25: note = Seed: YGFLNVIVHSATGFKQSSKALQRPV
YGFLNVIVHSATGYKQLSPALPRPV

SEQ ID NO: 32588 - protein, 25 aa, synthetic construct
  source 1..25: note = Seed: YGFLNVIVHSATGFKQSSKALQRPV
YGFLNVIVHSATGYKQLSPALQRPV

SEQ ID NO: 32589 - protein, 25 aa, synthetic construct
  source 1..25: note = Seed: YGFLNVIVHSATGFKQSSKALQRPV
YGFLNVIVHSATGYKQLSPALRRPV

SEQ ID NO: 32590 - protein, 25 aa, synthetic construct
  source 1..25: note = Seed: YGFLNVIVHSATGFKQSSKALQRPV
YGFLNVIVHSATGYKQLSPALSRPV

SEQ ID NO: 32591 - protein, 25 aa, synthetic construct
  source 1..25: note = Seed: YGFLNVIVHSATGFKQSSKALQRPV
YGFLNVIVHSATGYKQLSPALTRPV

SEQ ID NO: 32592 - protein, 25 aa, synthetic construct
  source 1..25: note = Seed: YGFLNVIVHSATGFKQSSKALQRPV
YGFLNVIVHSATGYKQLSPALVRPV

SEQ ID NO: 32593 - protein, 25 aa, synthetic construct
  source 1..25: note = Seed: YGFLNVIVHSATGFKQSSKALQRPV
YGFLNVIVHSATGYKQLSPALWRPV

SEQ ID NO: 32594 - protein, 25 aa, synthetic construct
  source 1..25: note = Seed: YGFLNVIVHSATGFKQSSKALQRPV
YGFLNVIVHSATGYKQLSPALYRPV

SEQ ID NO: 32595 - protein, 25 aa, synthetic construct
  source 1..25: note = Seed: YGFLNVIVHSATGFKQSSKALQRPV
YGFLNVIVHSATGYKQLSQALARPV

SEQ ID NO: 32596 - protein, 25 aa, synthetic construct
  source 1..25: note = Seed: YGFLNVIVHSATGFKQSSKALQRPV
YGFLNVIVHSATGYKQLSQALIRPV

SEQ ID NO: 32597 - protein, 25 aa, synthetic construct
  source 1..25: note = Seed: YGFLNVIVHSATGFKQSSKALQRPV
YGFLNVIVHSATGYKQLSQALMRPV

SEQ ID NO: 32598 - protein, 25 aa, synthetic construct
  source 1..25: note = Seed: YGFLNVIVHSATGFKQSSKALQRPV
YGFLNVIVHSATGYKQLSQALNRPV

SEQ ID NO: 32599 - protein, 25 aa, synthetic construct
  source 1..25: note = Seed: YGFLNVIVHSATGFKQSSKALQRPV
YGFLNVIVHSATGYKQLSQALSRPV

SEQ ID NO: 32600 - protein, 25 aa, synthetic construct
  source 1..25: note = Seed: YGFLNVIVHSATGFKQSSKALQRPV
YGFLNVIVHSATGYKQLSQALTRPV

SEQ ID NO: 32601 - protein, 25 aa, synthetic construct
  source 1..25: note = Seed: YGFLNVIVHSATGFKQSSKALQRPV
YGFLNVIVHSATGYKQLSQALVRPV

SEQ ID NO: 32602 - protein, 25 aa, synthetic construct
  source 1..25: note = Seed: YGFLNVIVHSATGFKQSSKALQRPV
YGFLNVIVHSATGYKQLSRALARPV

SEQ ID NO: 32603 - protein, 25 aa, synthetic construct
  source 1..25: note = Seed: YGFLNVIVHSATGFKQSSKALQRPV
YGFLNVIVHSATGYKQLSRALCRPV

SEQ ID NO: 32604 - protein, 25 aa, synthetic construct
  source 1..25: note = Seed: YGFLNVIVHSATGFKQSSKALQRPV
YGFLNVIVHSATGYKQLSRALERPV

SEQ ID NO: 32605 - protein, 25 aa, synthetic construct
  source 1..25: note = Seed: YGFLNVIVHSATGFKQSSKALQRPV
YGFLNVIVHSATGYKQLSRALGRPV

SEQ ID NO: 32606 - protein, 25 aa, synthetic construct
  source 1..25: note = Seed: YGFLNVIVHSATGFKQSSKALQRPV
YGFLNVIVHSATGYKQLSRALHRPV

SEQ ID NO: 32607 - protein, 25 aa, synthetic construct
  source 1..25: note = Seed: YGFLNVIVHSATGFKQSSKALQRPV
YGFLNVIVHSATGYKQLSRALIRPV

SEQ ID NO: 32608 - protein, 25 aa, synthetic construct
  source 1..25: note = Seed: YGFLNVIVHSATGFKQSSKALQRPV
YGFLNVIVHSATGYKQLSRALKRPV

SEQ ID NO: 32609 - protein, 25 aa, synthetic construct
  source 1..25: note = Seed: YGFLNVIVHSATGFKQSSKALQRPV
YGFLNVIVHSATGYKQLSRALLRPV

SEQ ID NO: 32610 - protein, 25 aa, synthetic construct
  source 1..25: note = Seed: YGFLNVIVHSATGFKQSSKALQRPV
YGFLNVIVHSATGYKQLSRALMRPV

SEQ ID NO: 32611 - protein, 25 aa, synthetic construct
  source 1..25: note = Seed: YGFLNVIVHSATGFKQSSKALQRPV
YGFLNVIVHSATGYKQLSRALNRPV

SEQ ID NO: 32612 - protein, 25 aa, synthetic construct
  source 1..25: note = Seed: YGFLNVIVHSATGFKQSSKALQRPV
YGFLNVIVHSATGYKQLSRALPRPV

SEQ ID NO: 32613 - protein, 25 aa, synthetic construct
  source 1..25: note = Seed: YGFLNVIVHSATGFKQSSKALQRPV
YGFLNVIVHSATGYKQLSRALQRPV

SEQ ID NO: 32614 - protein, 25 aa, synthetic construct
  source 1..25: note = Seed: YGFLNVIVHSATGFKQSSKALQRPV
YGFLNVIVHSATGYKQLSRALRRPV

SEQ ID NO: 32615 - protein, 25 aa, synthetic construct
  source 1..25: note = Seed: YGFLNVIVHSATGFKQSSKALQRPV
YGFLNVIVHSATGYKQLSRALSRPV

SEQ ID NO: 32616 - protein, 25 aa, synthetic construct
  source 1..25: note = Seed: YGFLNVIVHSATGFKQSSKALQRPV
YGFLNVIVHSATGYKQLSRALTRPV

SEQ ID NO: 32617 - protein, 25 aa, synthetic construct
  source 1..25: note = Seed: YGFLNVIVHSATGFKQSSKALQRPV
YGFLNVIVHSATGYKQLSRALVRPV

SEQ ID NO: 32618 - protein, 25 aa, synthetic construct
  source 1..25: note = Seed: YGFLNVIVHSATGFKQSSKALQRPV
YGFLNVIVHSATGYKQLSRALYRPV

SEQ ID NO: 32619 - protein, 25 aa, synthetic construct
  source 1..25: note = Seed: YGFLNVIVHSATGFKQSSKALQRPV
YGFLNVIVHSATGYKQLSSALARPV

SEQ ID NO: 32620 - protein, 25 aa, synthetic construct
  source 1..25: note = Seed: YGFLNVIVHSATGFKQSSKALQRPV
YGFLNVIVHSATGYKQLSSALCRPV

SEQ ID NO: 32621 - protein, 25 aa, synthetic construct
  source 1..25: note = Seed: YGFLNVIVHSATGFKQSSKALQRPV
YGFLNVIVHSATGYKQLSSALDRPV

SEQ ID NO: 32622 - protein, 25 aa, synthetic construct
  source 1..25: note = Seed: YGFLNVIVHSATGFKQSSKALQRPV
YGFLNVIVHSATGYKQLSSALERPV

SEQ ID NO: 32623 - protein, 25 aa, synthetic construct
  source 1..25: note = Seed: YGFLNVIVHSATGFKQSSKALQRPV
YGFLNVIVHSATGYKQLSSALFRPV

SEQ ID NO: 32624 - protein, 25 aa, synthetic construct
  source 1..25: note = Seed: YGFLNVIVHSATGFKQSSKALQRPV
YGFLNVIVHSATGYKQLSSALGRPV

SEQ ID NO: 32625 - protein, 25 aa, synthetic construct
  source 1..25: note = Seed: YGFLNVIVHSATGFKQSSKALQRPV
YGFLNVIVHSATGYKQLSSALHRPV

SEQ ID NO: 32626 - protein, 25 aa, synthetic construct
  source 1..25: note = Seed: YGFLNVIVHSATGFKQSSKALQRPV
YGFLNVIVHSATGYKQLSSALIRPV

SEQ ID NO: 32627 - protein, 25 aa, synthetic construct
  source 1..25: note = Seed: YGFLNVIVHSATGFKQSSKALQRPV
YGFLNVIVHSATGYKQLSSALKRPV

SEQ ID NO: 32628 - protein, 25 aa, synthetic construct
  source 1..25: note = Seed: YGFLNVIVHSATGFKQSSKALQRPV
YGFLNVIVHSATGYKQLSSALLRPV

SEQ ID NO: 32629 - protein, 25 aa, synthetic construct
  source 1..25: note = Seed: YGFLNVIVHSATGFKQSSKALQRPV
YGFLNVIVHSATGYKQLSSALMRPV

SEQ ID NO: 32630 - protein, 25 aa, synthetic construct
  source 1..25: note = Seed: YGFLNVIVHSATGFKQSSKALQRPV
YGFLNVIVHSATGYKQLSSALNRPV

SEQ ID NO: 32631 - protein, 25 aa, synthetic construct
  source 1..25: note = Seed: YGFLNVIVHSATGFKQSSKALQRPV
YGFLNVIVHSATGYKQLSSALPRPV

SEQ ID NO: 32632 - protein, 25 aa, synthetic construct
  source 1..25: note = Seed: YGFLNVIVHSATGFKQSSKALQRPV
YGFLNVIVHSATGYKQLSSALQRPV

SEQ ID NO: 32633 - protein, 25 aa, synthetic construct
  source 1..25: note = Seed: YGFLNVIVHSATGFKQSSKALQRPV
YGFLNVIVHSATGYKQLSSALRRPV

SEQ ID NO: 32634 - protein, 25 aa, synthetic construct
  source 1..25: note = Seed: YGFLNVIVHSATGFKQSSKALQRPV
YGFLNVIVHSATGYKQLSSALSRPV

SEQ ID NO: 32635 - protein, 25 aa, synthetic construct
  source 1..25: note = Seed: YGFLNVIVHSATGFKQSSKALQRPV
YGFLNVIVHSATGYKQLSSALTRPV

SEQ ID NO: 32636 - protein, 25 aa, synthetic construct
  source 1..25: note = Seed: YGFLNVIVHSATGFKQSSKALQRPV
YGFLNVIVHSATGYKQLSSALVRPV

SEQ ID NO: 32637 - protein, 25 aa, synthetic construct
  source 1..25: note = Seed: YGFLNVIVHSATGFKQSSKALQRPV
YGFLNVIVHSATGYKQLSSALYRPV

SEQ ID NO: 32638 - protein, 25 aa, synthetic construct
  source 1..25: note = Seed: YGFLNVIVHSATGFKQSSKALQRPV
YGFLNVIVHSATGYKQLSTALARPV

SEQ ID NO: 32639 - protein, 25 aa, synthetic construct
  source 1..25: note = Seed: YGFLNVIVHSATGFKQSSKALQRPV
YGFLNVIVHSATGYKQLSTALCRPV

SEQ ID NO: 32640 - protein, 25 aa, synthetic construct
  source 1..25: note = Seed: YGFLNVIVHSATGFKQSSKALQRPV
YGFLNVIVHSATGYKQLSTALDRPV

SEQ ID NO: 32641 - protein, 25 aa, synthetic construct
  source 1..25: note = Seed: YGFLNVIVHSATGFKQSSKALQRPV
YGFLNVIVHSATGYKQLSTALERPV

SEQ ID NO: 32642 - protein, 25 aa, synthetic construct
  source 1..25: note = Seed: YGFLNVIVHSATGFKQSSKALQRPV
YGFLNVIVHSATGYKQLSTALFRPV

SEQ ID NO: 32643 - protein, 25 aa, synthetic construct
  source 1..25: note = Seed: YGFLNVIVHSATGFKQSSKALQRPV
YGFLNVIVHSATGYKQLSTALGRPV

SEQ ID NO: 32644 - protein, 25 aa, synthetic construct
  source 1..25: note = Seed: YGFLNVIVHSATGFKQSSKALQRPV
YGFLNVIVHSATGYKQLSTALHRPV

SEQ ID NO: 32645 - protein, 25 aa, synthetic construct
  source 1..25: note = Seed: YGFLNVIVHSATGFKQSSKALQRPV
YGFLNVIVHSATGYKQLSTALIRPV

SEQ ID NO: 32646 - protein, 25 aa, synthetic construct
  source 1..25: note = Seed: YGFLNVIVHSATGFKQSSKALQRPV
YGFLNVIVHSATGYKQLSTALKRPV

SEQ ID NO: 32647 - protein, 25 aa, synthetic construct
  source 1..25: note = Seed: YGFLNVIVHSATGFKQSSKALQRPV
YGFLNVIVHSATGYKQLSTALLRPV

SEQ ID NO: 32648 - protein, 25 aa, synthetic construct
  source 1..25: note = Seed: YGFLNVIVHSATGFKQSSKALQRPV
YGFLNVIVHSATGYKQLSTALMRPV

SEQ ID NO: 32649 - protein, 25 aa, synthetic construct
  source 1..25: note = Seed: YGFLNVIVHSATGFKQSSKALQRPV
YGFLNVIVHSATGYKQLSTALNRPV

SEQ ID NO: 32650 - protein, 25 aa, synthetic construct
  source 1..25: note = Seed: YGFLNVIVHSATGFKQSSKALQRPV
YGFLNVIVHSATGYKQLSTALPRPV

SEQ ID NO: 32651 - protein, 25 aa, synthetic construct
  source 1..25: note = Seed: YGFLNVIVHSATGFKQSSKALQRPV
YGFLNVIVHSATGYKQLSTALQRPV

SEQ ID NO: 32652 - protein, 25 aa, synthetic construct
  source 1..25: note = Seed: YGFLNVIVHSATGFKQSSKALQRPV
YGFLNVIVHSATGYKQLSTALRRPV

SEQ ID NO: 32653 - protein, 25 aa, synthetic construct
  source 1..25: note = Seed: YGFLNVIVHSATGFKQSSKALQRPV
YGFLNVIVHSATGYKQLSTALSRPV

SEQ ID NO: 32654 - protein, 25 aa, synthetic construct
  source 1..25: note = Seed: YGFLNVIVHSATGFKQSSKALQRPV
YGFLNVIVHSATGYKQLSTALTRPV

SEQ ID NO: 32655 - protein, 25 aa, synthetic construct
  source 1..25: note = Seed: YGFLNVIVHSATGFKQSSKALQRPV
YGFLNVIVHSATGYKQLSTALVRPV

SEQ ID NO: 32656 - protein, 25 aa, synthetic construct
  source 1..25: note = Seed: YGFLNVIVHSATGFKQSSKALQRPV
YGFLNVIVHSATGYKQLSTALYRPV

SEQ ID NO: 32657 - protein, 25 aa, synthetic construct
  source 1..25: note = Seed: YGFLNVIVHSATGFKQSSKALQRPV
YGFLNVIVHSATGYKQLSVALARPV

SEQ ID NO: 32658 - protein, 25 aa, synthetic construct
  source 1..25: note = Seed: YGFLNVIVHSATGFKQSSKALQRPV
YGFLNVIVHSATGYKQLSVALCRPV

SEQ ID NO: 32659 - protein, 25 aa, synthetic construct
  source 1..25: note = Seed: YGFLNVIVHSATGFKQSSKALQRPV
YGFLNVIVHSATGYKQLSVALDRPV

SEQ ID NO: 32660 - protein, 25 aa, synthetic construct
  source 1..25: note = Seed: YGFLNVIVHSATGFKQSSKALQRPV
YGFLNVIVHSATGYKQLSVALERPV

SEQ ID NO: 32661 - protein, 25 aa, synthetic construct
  source 1..25: note = Seed: YGFLNVIVHSATGFKQSSKALQRPV
YGFLNVIVHSATGYKQLSVALFRPV

SEQ ID NO: 32662 - protein, 25 aa, synthetic construct
  source 1..25: note = Seed: YGFLNVIVHSATGFKQSSKALQRPV
YGFLNVIVHSATGYKQLSVALGRPV

SEQ ID NO: 32663 - protein, 25 aa, synthetic construct
  source 1..25: note = Seed: YGFLNVIVHSATGFKQSSKALQRPV
YGFLNVIVHSATGYKQLSVALHRPV

SEQ ID NO: 32664 - protein, 25 aa, synthetic construct
  source 1..25: note = Seed: YGFLNVIVHSATGFKQSSKALQRPV
YGFLNVIVHSATGYKQLSVALIRPV

SEQ ID NO: 32665 - protein, 25 aa, synthetic construct
  source 1..25: note = Seed: YGFLNVIVHSATGFKQSSKALQRPV
YGFLNVIVHSATGYKQLSVALKRPV

SEQ ID NO: 32666 - protein, 25 aa, synthetic construct
  source 1..25: note = Seed: YGFLNVIVHSATGFKQSSKALQRPV
YGFLNVIVHSATGYKQLSVALLRPV

SEQ ID NO: 32667 - protein, 25 aa, synthetic construct
  source 1..25: note = Seed: YGFLNVIVHSATGFKQSSKALQRPV
YGFLNVIVHSATGYKQLSVALMRPV

SEQ ID NO: 32668 - protein, 25 aa, synthetic construct
  source 1..25: note = Seed: YGFLNVIVHSATGFKQSSKALQRPV
YGFLNVIVHSATGYKQLSVALNRPV

SEQ ID NO: 32669 - protein, 25 aa, synthetic construct
  source 1..25: note = Seed: YGFLNVIVHSATGFKQSSKALQRPV
YGFLNVIVHSATGYKQLSVALPRPV

SEQ ID NO: 32670 - protein, 25 aa, synthetic construct
  source 1..25: note = Seed: YGFLNVIVHSATGFKQSSKALQRPV
YGFLNVIVHSATGYKQLSVALQRPV

SEQ ID NO: 32671 - protein, 25 aa, synthetic construct
  source 1..25: note = Seed: YGFLNVIVHSATGFKQSSKALQRPV
YGFLNVIVHSATGYKQLSVALRRPV

SEQ ID NO: 32672 - protein, 25 aa, synthetic construct
  source 1..25: note = Seed: YGFLNVIVHSATGFKQSSKALQRPV
YGFLNVIVHSATGYKQLSVALSRPV

SEQ ID NO: 32673 - protein, 25 aa, synthetic construct
  source 1..25: note = Seed: YGFLNVIVHSATGFKQSSKALQRPV
YGFLNVIVHSATGYKQLSVALTRPV

SEQ ID NO: 32674 - protein, 25 aa, synthetic construct
  source 1..25: note = Seed: YGFLNVIVHSATGFKQSSKALQRPV
YGFLNVIVHSATGYKQLSVALVRPV

SEQ ID NO: 32675 - protein, 25 aa, synthetic construct
  source 1..25: note = Seed: YGFLNVIVHSATGFKQSSKALQRPV
YGFLNVIVHSATGYKQLSVALYRPV

SEQ ID NO: 32676 - protein, 25 aa, synthetic construct
  source 1..25: note = Seed: YGFLNVIVHSATGFKQSSKALQRPV
YGFLNVIVHSATGYKQLSWALARPV

SEQ ID NO: 32677 - protein, 25 aa, synthetic construct
  source 1..25: note = Seed: YGFLNVIVHSATGFKQSSKALQRPV
YGFLNVIVHSATGYKQLSWALFRPV

SEQ ID NO: 32678 - protein, 25 aa, synthetic construct
  source 1..25: note = Seed: YGFLNVIVHSATGFKQSSKALQRPV
YGFLNVIVHSATGYKQLSWALLRPV

SEQ ID NO: 32679 - protein, 25 aa, synthetic construct
  source 1..25: note = Seed: YGFLNVIVHSATGFKQSSKALQRPV
YGFLNVIVHSATGYKQLSWALNRPV

SEQ ID NO: 32680 - protein, 25 aa, synthetic construct
  source 1..25: note = Seed: YGFLNVIVHSATGFKQSSKALQRPV
YGFLNVIVHSATGYKQLSWALSRPV

SEQ ID NO: 32681 - protein, 25 aa, synthetic construct
  source 1..25: note = Seed: YGFLNVIVHSATGFKQSSKALQRPV
YGFLNVIVHSATGYKQLSWALYRPV

SEQ ID NO: 32682 - protein, 25 aa, synthetic construct
  source 1..25: note = Seed: YGFLNVIVHSATGFKQSSKALQRPV
YGFLNVIVHSATGYKQLSYALARPV

SEQ ID NO: 32683 - protein, 25 aa, synthetic construct
  source 1..25: note = Seed: YGFLNVIVHSATGFKQSSKALQRPV
YGFLNVIVHSATGYKQLSYALFRPV

SEQ ID NO: 32684 - protein, 25 aa, synthetic construct
  source 1..25: note = Seed: YGFLNVIVHSATGFKQSSKALQRPV
YGFLNVIVHSATGYKQLSYALIRPV

SEQ ID NO: 32685 - protein, 25 aa, synthetic construct
  source 1..25: note = Seed: YGFLNVIVHSATGFKQSSKALQRPV
YGFLNVIVHSATGYKQLSYALLRPV

SEQ ID NO: 32686 - protein, 25 aa, synthetic construct
  source 1..25: note = Seed: YGFLNVIVHSATGFKQSSKALQRPV
YGFLNVIVHSATGYKQLSYALMRPV

SEQ ID NO: 32687 - protein, 25 aa, synthetic construct
  source 1..25: note = Seed: YGFLNVIVHSATGFKQSSKALQRPV
YGFLNVIVHSATGYKQLSYALNRPV

SEQ ID NO: 32688 - protein, 25 aa, synthetic construct
  source 1..25: note = Seed: YGFLNVIVHSATGFKQSSKALQRPV
YGFLNVIVHSATGYKQLSYALSRPV

SEQ ID NO: 32689 - protein, 25 aa, synthetic construct
  source 1..25: note = Seed: YGFLNVIVHSATGFKQSSKALQRPV
YGFLNVIVHSATGYKQLSYALWRPV

SEQ ID NO: 32690 - protein, 25 aa, synthetic construct
  source 1..25: note = Seed: YGFLNVIVHSATGFKQSSKALQRPV
YGFLNVIVHSATGYKQLSYALYRPV

SEQ ID NO: 32691 - protein, 25 aa, synthetic construct
  source 1..25: note = Seed: YGFLNVIVHSATGFKQSSKALQRPV
YGFLNVIVHSATGYKQMSAALARPV

SEQ ID NO: 32692 - protein, 25 aa, synthetic construct
  source 1..25: note = Seed: YGFLNVIVHSATGFKQSSKALQRPV
YGFLNVIVHSATGYKQMSAALCRPV

SEQ ID NO: 32693 - protein, 25 aa, synthetic construct
  source 1..25: note = Seed: YGFLNVIVHSATGFKQSSKALQRPV
YGFLNVIVHSATGYKQMSAALDRPV

SEQ ID NO: 32694 - protein, 25 aa, synthetic construct
  source 1..25: note = Seed: YGFLNVIVHSATGFKQSSKALQRPV
YGFLNVIVHSATGYKQMSAALERPV

SEQ ID NO: 32695 - protein, 25 aa, synthetic construct
  source 1..25: note = Seed: YGFLNVIVHSATGFKQSSKALQRPV
YGFLNVIVHSATGYKQMSAALFRPV

SEQ ID NO: 32696 - protein, 25 aa, synthetic construct
  source 1..25: note = Seed: YGFLNVIVHSATGFKQSSKALQRPV
YGFLNVIVHSATGYKQMSAALGRPV

SEQ ID NO: 32697 - protein, 25 aa, synthetic construct
  source 1..25: note = Seed: YGFLNVIVHSATGFKQSSKALQRPV
YGFLNVIVHSATGYKQMSAALHRPV

SEQ ID NO: 32698 - protein, 25 aa, synthetic construct
  source 1..25: note = Seed: YGFLNVIVHSATGFKQSSKALQRPV
YGFLNVIVHSATGYKQMSAALIRPV

SEQ ID NO: 32699 - protein, 25 aa, synthetic construct
  source 1..25: note = Seed: YGFLNVIVHSATGFKQSSKALQRPV
YGFLNVIVHSATGYKQMSAALKRPV

SEQ ID NO: 32700 - protein, 25 aa, synthetic construct
  source 1..25: note = Seed: YGFLNVIVHSATGFKQSSKALQRPV
YGFLNVIVHSATGYKQMSAALLRPV

SEQ ID NO: 32701 - protein, 25 aa, synthetic construct
  source 1..25: note = Seed: YGFLNVIVHSATGFKQSSKALQRPV
YGFLNVIVHSATGYKQMSAALMRPV

SEQ ID NO: 32702 - protein, 25 aa, synthetic construct
  source 1..25: note = Seed: YGFLNVIVHSATGFKQSSKALQRPV
YGFLNVIVHSATGYKQMSAALNRPV

SEQ ID NO: 32703 - protein, 25 aa, synthetic construct
  source 1..25: note = Seed: YGFLNVIVHSATGFKQSSKALQRPV
YGFLNVIVHSATGYKQMSAALPRPV

SEQ ID NO: 32704 - protein, 25 aa, synthetic construct
  source 1..25: note = Seed: YGFLNVIVHSATGFKQSSKALQRPV
YGFLNVIVHSATGYKQMSAALQRPV

SEQ ID NO: 32705 - protein, 25 aa, synthetic construct
  source 1..25: note = Seed: YGFLNVIVHSATGFKQSSKALQRPV
YGFLNVIVHSATGYKQMSAALRRPV

SEQ ID NO: 32706 - protein, 25 aa, synthetic construct
  source 1..25: note = Seed: YGFLNVIVHSATGFKQSSKALQRPV
YGFLNVIVHSATGYKQMSAALSRPV

SEQ ID NO: 32707 - protein, 25 aa, synthetic construct
  source 1..25: note = Seed: YGFLNVIVHSATGFKQSSKALQRPV
YGFLNVIVHSATGYKQMSAALTRPV

SEQ ID NO: 32708 - protein, 25 aa, synthetic construct
  source 1..25: note = Seed: YGFLNVIVHSATGFKQSSKALQRPV
YGFLNVIVHSATGYKQMSAALVRPV

SEQ ID NO: 32709 - protein, 25 aa, synthetic construct
  source 1..25: note = Seed: YGFLNVIVHSATGFKQSSKALQRPV
YGFLNVIVHSATGYKQMSAALWRPV

SEQ ID NO: 32710 - protein, 25 aa, synthetic construct
  source 1..25: note = Seed: YGFLNVIVHSATGFKQSSKALQRPV
YGFLNVIVHSATGYKQMSAALYRPV

SEQ ID NO: 32711 - protein, 25 aa, synthetic construct
  source 1..25: note = Seed: YGFLNVIVHSATGFKQSSKALQRPV
YGFLNVIVHSATGYKQMSCALARPV

SEQ ID NO: 32712 - protein, 25 aa, synthetic construct
  source 1..25: note = Seed: YGFLNVIVHSATGFKQSSKALQRPV
YGFLNVIVHSATGYKQMSCALNRPV

SEQ ID NO: 32713 - protein, 25 aa, synthetic construct
  source 1..25: note = Seed: YGFLNVIVHSATGFKQSSKALQRPV
YGFLNVIVHSATGYKQMSCALSRPV

SEQ ID NO: 32714 - protein, 25 aa, synthetic construct
  source 1..25: note = Seed: YGFLNVIVHSATGFKQSSKALQRPV
YGFLNVIVHSATGYKQMSCALTRPV

SEQ ID NO: 32715 - protein, 25 aa, synthetic construct
  source 1..25: note = Seed: YGFLNVIVHSATGFKQSSKALQRPV
YGFLNVIVHSATGYKQMSDALARPV

SEQ ID NO: 32716 - protein, 25 aa, synthetic construct
  source 1..25: note = Seed: YGFLNVIVHSATGFKQSSKALQRPV
YGFLNVIVHSATGYKQMSDALNRPV

SEQ ID NO: 32717 - protein, 25 aa, synthetic construct
  source 1..25: note = Seed: YGFLNVIVHSATGFKQSSKALQRPV
YGFLNVIVHSATGYKQMSDALSRPV

SEQ ID NO: 32718 - protein, 25 aa, synthetic construct
  source 1..25: note = Seed: YGFLNVIVHSATGFKQSSKALQRPV
YGFLNVIVHSATGYKQMSDALTRPV

SEQ ID NO: 32719 - protein, 25 aa, synthetic construct
  source 1..25: note = Seed: YGFLNVIVHSATGFKQSSKALQRPV
YGFLNVIVHSATGYKQMSDALVRPV

SEQ ID NO: 32720 - protein, 25 aa, synthetic construct
  source 1..25: note = Seed: YGFLNVIVHSATGFKQSSKALQRPV
YGFLNVIVHSATGYKQMSEALARPV

SEQ ID NO: 32721 - protein, 25 aa, synthetic construct
  source 1..25: note = Seed: YGFLNVIVHSATGFKQSSKALQRPV
YGFLNVIVHSATGYKQMSEALIRPV

SEQ ID NO: 32722 - protein, 25 aa, synthetic construct
  source 1..25: note = Seed: YGFLNVIVHSATGFKQSSKALQRPV
YGFLNVIVHSATGYKQMSEALLRPV

SEQ ID NO: 32723 - protein, 25 aa, synthetic construct
  source 1..25: note = Seed: YGFLNVIVHSATGFKQSSKALQRPV
YGFLNVIVHSATGYKQMSEALMRPV

SEQ ID NO: 32724 - protein, 25 aa, synthetic construct
  source 1..25: note = Seed: YGFLNVIVHSATGFKQSSKALQRPV
YGFLNVIVHSATGYKQMSEALNRPV

SEQ ID NO: 32725 - protein, 25 aa, synthetic construct
  source 1..25: note = Seed: YGFLNVIVHSATGFKQSSKALQRPV
YGFLNVIVHSATGYKQMSEALSRPV

SEQ ID NO: 32726 - protein, 25 aa, synthetic construct
  source 1..25: note = Seed: YGFLNVIVHSATGFKQSSKALQRPV
YGFLNVIVHSATGYKQMSEALTRPV

SEQ ID NO: 32727 - protein, 25 aa, synthetic construct
  source 1..25: note = Seed: YGFLNVIVHSATGFKQSSKALQRPV
YGFLNVIVHSATGYKQMSEALVRPV

SEQ ID NO: 32728 - protein, 25 aa, synthetic construct
  source 1..25: note = Seed: YGFLNVIVHSATGFKQSSKALQRPV
YGFLNVIVHSATGYKQMSFALARPV

SEQ ID NO: 32729 - protein, 25 aa, synthetic construct
  source 1..25: note = Seed: YGFLNVIVHSATGFKQSSKALQRPV
YGFLNVIVHSATGYKQMSFALFRPV

SEQ ID NO: 32730 - protein, 25 aa, synthetic construct
  source 1..25: note = Seed: YGFLNVIVHSATGFKQSSKALQRPV
YGFLNVIVHSATGYKQMSFALIRPV

SEQ ID NO: 32731 - protein, 25 aa, synthetic construct
  source 1..25: note = Seed: YGFLNVIVHSATGFKQSSKALQRPV
YGFLNVIVHSATGYKQMSFALLRPV

SEQ ID NO: 32732 - protein, 25 aa, synthetic construct
  source 1..25: note = Seed: YGFLNVIVHSATGFKQSSKALQRPV
YGFLNVIVHSATGYKQMSFALMRPV

SEQ ID NO: 32733 - protein, 25 aa, synthetic construct
  source 1..25: note = Seed: YGFLNVIVHSATGFKQSSKALQRPV
YGFLNVIVHSATGYKQMSFALNRPV

SEQ ID NO: 32734 - protein, 25 aa, synthetic construct
  source 1..25: note = Seed: YGFLNVIVHSATGFKQSSKALQRPV
YGFLNVIVHSATGYKQMSFALSRPV

SEQ ID NO: 32735 - protein, 25 aa, synthetic construct
  source 1..25: note = Seed: YGFLNVIVHSATGFKQSSKALQRPV
YGFLNVIVHSATGYKQMSFALVRPV

SEQ ID NO: 32736 - protein, 25 aa, synthetic construct
  source 1..25: note = Seed: YGFLNVIVHSATGFKQSSKALQRPV
YGFLNVIVHSATGYKQMSFALYRPV

SEQ ID NO: 32737 - protein, 25 aa, synthetic construct
  source 1..25: note = Seed: YGFLNVIVHSATGFKQSSKALQRPV
YGFLNVIVHSATGYKQMSGALARPV

SEQ ID NO: 32738 - protein, 25 aa, synthetic construct
  source 1..25: note = Seed: YGFLNVIVHSATGFKQSSKALQRPV
YGFLNVIVHSATGYKQMSGALCRPV

SEQ ID NO: 32739 - protein, 25 aa, synthetic construct
  source 1..25: note = Seed: YGFLNVIVHSATGFKQSSKALQRPV
YGFLNVIVHSATGYKQMSGALDRPV

SEQ ID NO: 32740 - protein, 25 aa, synthetic construct
  source 1..25: note = Seed: YGFLNVIVHSATGFKQSSKALQRPV
YGFLNVIVHSATGYKQMSGALERPV

SEQ ID NO: 32741 - protein, 25 aa, synthetic construct
  source 1..25: note = Seed: YGFLNVIVHSATGFKQSSKALQRPV
YGFLNVIVHSATGYKQMSGALFRPV

SEQ ID NO: 32742 - protein, 25 aa, synthetic construct
  source 1..25: note = Seed: YGFLNVIVHSATGFKQSSKALQRPV
YGFLNVIVHSATGYKQMSGALGRPV

SEQ ID NO: 32743 - protein, 25 aa, synthetic construct
  source 1..25: note = Seed: YGFLNVIVHSATGFKQSSKALQRPV
YGFLNVIVHSATGYKQMSGALHRPV

SEQ ID NO: 32744 - protein, 25 aa, synthetic construct
  source 1..25: note = Seed: YGFLNVIVHSATGFKQSSKALQRPV
YGFLNVIVHSATGYKQMSGALIRPV

SEQ ID NO: 32745 - protein, 25 aa, synthetic construct
  source 1..25: note = Seed: YGFLNVIVHSATGFKQSSKALQRPV
YGFLNVIVHSATGYKQMSGALLRPV

SEQ ID NO: 32746 - protein, 25 aa, synthetic construct
  source 1..25: note = Seed: YGFLNVIVHSATGFKQSSKALQRPV
YGFLNVIVHSATGYKQMSGALMRPV

SEQ ID NO: 32747 - protein, 25 aa, synthetic construct
  source 1..25: note = Seed: YGFLNVIVHSATGFKQSSKALQRPV
YGFLNVIVHSATGYKQMSGALNRPV

SEQ ID NO: 32748 - protein, 25 aa, synthetic construct
  source 1..25: note = Seed: YGFLNVIVHSATGFKQSSKALQRPV
YGFLNVIVHSATGYKQMSGALPRPV

SEQ ID NO: 32749 - protein, 25 aa, synthetic construct
  source 1..25: note = Seed: YGFLNVIVHSATGFKQSSKALQRPV
YGFLNVIVHSATGYKQMSGALQRPV

SEQ ID NO: 32750 - protein, 25 aa, synthetic construct
  source 1..25: note = Seed: YGFLNVIVHSATGFKQSSKALQRPV
YGFLNVIVHSATGYKQMSGALSRPV

SEQ ID NO: 32751 - protein, 25 aa, synthetic construct
  source 1..25: note = Seed: YGFLNVIVHSATGFKQSSKALQRPV
YGFLNVIVHSATGYKQMSGALTRPV

SEQ ID NO: 32752 - protein, 25 aa, synthetic construct
  source 1..25: note = Seed: YGFLNVIVHSATGFKQSSKALQRPV
YGFLNVIVHSATGYKQMSGALVRPV

SEQ ID NO: 32753 - protein, 25 aa, synthetic construct
  source 1..25: note = Seed: YGFLNVIVHSATGFKQSSKALQRPV
YGFLNVIVHSATGYKQMSGALYRPV

SEQ ID NO: 32754 - protein, 25 aa, synthetic construct
  source 1..25: note = Seed: YGFLNVIVHSATGFKQSSKALQRPV
YGFLNVIVHSATGYKQMSHALARPV

SEQ ID NO: 32755 - protein, 25 aa, synthetic construct
  source 1..25: note = Seed: YGFLNVIVHSATGFKQSSKALQRPV
YGFLNVIVHSATGYKQMSHALGRPV

SEQ ID NO: 32756 - protein, 25 aa, synthetic construct
  source 1..25: note = Seed: YGFLNVIVHSATGFKQSSKALQRPV
YGFLNVIVHSATGYKQMSHALIRPV

SEQ ID NO: 32757 - protein, 25 aa, synthetic construct
  source 1..25: note = Seed: YGFLNVIVHSATGFKQSSKALQRPV
YGFLNVIVHSATGYKQMSHALLRPV

SEQ ID NO: 32758 - protein, 25 aa, synthetic construct
  source 1..25: note = Seed: YGFLNVIVHSATGFKQSSKALQRPV
YGFLNVIVHSATGYKQMSHALMRPV

SEQ ID NO: 32759 - protein, 25 aa, synthetic construct
  source 1..25: note = Seed: YGFLNVIVHSATGFKQSSKALQRPV
YGFLNVIVHSATGYKQMSHALNRPV

SEQ ID NO: 32760 - protein, 25 aa, synthetic construct
  source 1..25: note = Seed: YGFLNVIVHSATGFKQSSKALQRPV
YGFLNVIVHSATGYKQMSHALSRPV

SEQ ID NO: 32761 - protein, 25 aa, synthetic construct
  source 1..25: note = Seed: YGFLNVIVHSATGFKQSSKALQRPV
YGFLNVIVHSATGYKQMSHALTRPV

SEQ ID NO: 32762 - protein, 25 aa, synthetic construct
  source 1..25: note = Seed: YGFLNVIVHSATGFKQSSKALQRPV
YGFLNVIVHSATGYKQMSHALVRPV

SEQ ID NO: 32763 - protein, 25 aa, synthetic construct
  source 1..25: note = Seed: YGFLNVIVHSATGFKQSSKALQRPV
YGFLNVIVHSATGYKQMSIALARPV

SEQ ID NO: 32764 - protein, 25 aa, synthetic construct
  source 1..25: note = Seed: YGFLNVIVHSATGFKQSSKALQRPV
YGFLNVIVHSATGYKQMSIALCRPV

SEQ ID NO: 32765 - protein, 25 aa, synthetic construct
  source 1..25: note = Seed: YGFLNVIVHSATGFKQSSKALQRPV
YGFLNVIVHSATGYKQMSIALDRPV

SEQ ID NO: 32766 - protein, 25 aa, synthetic construct
  source 1..25: note = Seed: YGFLNVIVHSATGFKQSSKALQRPV
YGFLNVIVHSATGYKQMSIALERPV

SEQ ID NO: 32767 - protein, 25 aa, synthetic construct
  source 1..25: note = Seed: YGFLNVIVHSATGFKQSSKALQRPV
YGFLNVIVHSATGYKQMSIALFRPV

SEQ ID NO: 32768 - protein, 25 aa, synthetic construct
  source 1..25: note = Seed: YGFLNVIVHSATGFKQSSKALQRPV
YGFLNVIVHSATGYKQMSIALGRPV

SEQ ID NO: 32769 - protein, 25 aa, synthetic construct
  source 1..25: note = Seed: YGFLNVIVHSATGFKQSSKALQRPV
YGFLNVIVHSATGYKQMSIALHRPV

SEQ ID NO: 32770 - protein, 25 aa, synthetic construct
  source 1..25: note = Seed: YGFLNVIVHSATGFKQSSKALQRPV
YGFLNVIVHSATGYKQMSIALIRPV

SEQ ID NO: 32771 - protein, 25 aa, synthetic construct
  source 1..25: note = Seed: YGFLNVIVHSATGFKQSSKALQRPV
YGFLNVIVHSATGYKQMSIALKRPV

SEQ ID NO: 32772 - protein, 25 aa, synthetic construct
  source 1..25: note = Seed: YGFLNVIVHSATGFKQSSKALQRPV
YGFLNVIVHSATGYKQMSIALLRPV

SEQ ID NO: 32773 - protein, 25 aa, synthetic construct
  source 1..25: note = Seed: YGFLNVIVHSATGFKQSSKALQRPV
YGFLNVIVHSATGYKQMSIALMRPV

SEQ ID NO: 32774 - protein, 25 aa, synthetic construct
  source 1..25: note = Seed: YGFLNVIVHSATGFKQSSKALQRPV
YGFLNVIVHSATGYKQMSIALNRPV

SEQ ID NO: 32775 - protein, 25 aa, synthetic construct
  source 1..25: note = Seed: YGFLNVIVHSATGFKQSSKALQRPV
YGFLNVIVHSATGYKQMSIALPRPV

SEQ ID NO: 32776 - protein, 25 aa, synthetic construct
  source 1..25: note = Seed: YGFLNVIVHSATGFKQSSKALQRPV
YGFLNVIVHSATGYKQMSIALQRPV

SEQ ID NO: 32777 - protein, 25 aa, synthetic construct
  source 1..25: note = Seed: YGFLNVIVHSATGFKQSSKALQRPV
YGFLNVIVHSATGYKQMSIALRRPV

SEQ ID NO: 32778 - protein, 25 aa, synthetic construct
  source 1..25: note = Seed: YGFLNVIVHSATGFKQSSKALQRPV
YGFLNVIVHSATGYKQMSIALSRPV

SEQ ID NO: 32779 - protein, 25 aa, synthetic construct
  source 1..25: note = Seed: YGFLNVIVHSATGFKQSSKALQRPV
YGFLNVIVHSATGYKQMSIALTRPV

SEQ ID NO: 32780 - protein, 25 aa, synthetic construct
  source 1..25: note = Seed: YGFLNVIVHSATGFKQSSKALQRPV
YGFLNVIVHSATGYKQMSIALVRPV

SEQ ID NO: 32781 - protein, 25 aa, synthetic construct
  source 1..25: note = Seed: YGFLNVIVHSATGFKQSSKALQRPV
YGFLNVIVHSATGYKQMSIALYRPV

SEQ ID NO: 32782 - protein, 25 aa, synthetic construct
  source 1..25: note = Seed: YGFLNVIVHSATGFKQSSKALQRPV
YGFLNVIVHSATGYKQMSKALARPV

SEQ ID NO: 32783 - protein, 25 aa, synthetic construct
  source 1..25: note = Seed: YGFLNVIVHSATGFKQSSKALQRPV
YGFLNVIVHSATGYKQMSKALCRPV

SEQ ID NO: 32784 - protein, 25 aa, synthetic construct
  source 1..25: note = Seed: YGFLNVIVHSATGFKQSSKALQRPV
YGFLNVIVHSATGYKQMSKALGRPV

SEQ ID NO: 32785 - protein, 25 aa, synthetic construct
  source 1..25: note = Seed: YGFLNVIVHSATGFKQSSKALQRPV
YGFLNVIVHSATGYKQMSKALHRPV

SEQ ID NO: 32786 - protein, 25 aa, synthetic construct
  source 1..25: note = Seed: YGFLNVIVHSATGFKQSSKALQRPV
YGFLNVIVHSATGYKQMSKALIRPV

SEQ ID NO: 32787 - protein, 25 aa, synthetic construct
  source 1..25: note = Seed: YGFLNVIVHSATGFKQSSKALQRPV
YGFLNVIVHSATGYKQMSKALKRPV

SEQ ID NO: 32788 - protein, 25 aa, synthetic construct
  source 1..25: note = Seed: YGFLNVIVHSATGFKQSSKALQRPV
YGFLNVIVHSATGYKQMSKALLRPV

SEQ ID NO: 32789 - protein, 25 aa, synthetic construct
  source 1..25: note = Seed: YGFLNVIVHSATGFKQSSKALQRPV
YGFLNVIVHSATGYKQMSKALMRPV

SEQ ID NO: 32790 - protein, 25 aa, synthetic construct
  source 1..25: note = Seed: YGFLNVIVHSATGFKQSSKALQRPV
YGFLNVIVHSATGYKQMSKALNRPV

SEQ ID NO: 32791 - protein, 25 aa, synthetic construct
  source 1..25: note = Seed: YGFLNVIVHSATGFKQSSKALQRPV
YGFLNVIVHSATGYKQMSKALPRPV

SEQ ID NO: 32792 - protein, 25 aa, synthetic construct
  source 1..25: note = Seed: YGFLNVIVHSATGFKQSSKALQRPV
YGFLNVIVHSATGYKQMSKALQRPV

SEQ ID NO: 32793 - protein, 25 aa, synthetic construct
  source 1..25: note = Seed: YGFLNVIVHSATGFKQSSKALQRPV
YGFLNVIVHSATGYKQMSKALRRPV

SEQ ID NO: 32794 - protein, 25 aa, synthetic construct
  source 1..25: note = Seed: YGFLNVIVHSATGFKQSSKALQRPV
YGFLNVIVHSATGYKQMSKALSRPV

SEQ ID NO: 32795 - protein, 25 aa, synthetic construct
  source 1..25: note = Seed: YGFLNVIVHSATGFKQSSKALQRPV
YGFLNVIVHSATGYKQMSKALTRPV

SEQ ID NO: 32796 - protein, 25 aa, synthetic construct
  source 1..25: note = Seed: YGFLNVIVHSATGFKQSSKALQRPV
YGFLNVIVHSATGYKQMSKALVRPV

SEQ ID NO: 32797 - protein, 25 aa, synthetic construct
  source 1..25: note = Seed: YGFLNVIVHSATGFKQSSKALQRPV
YGFLNVIVHSATGYKQMSKALYRPV

SEQ ID NO: 32798 - protein, 25 aa, synthetic construct
  source 1..25: note = Seed: YGFLNVIVHSATGFKQSSKALQRPV
YGFLNVIVHSATGYKQMSLALARPV

SEQ ID NO: 32799 - protein, 25 aa, synthetic construct
  source 1..25: note = Seed: YGFLNVIVHSATGFKQSSKALQRPV
YGFLNVIVHSATGYKQMSLALDRPV

SEQ ID NO: 32800 - protein, 25 aa, synthetic construct
  source 1..25: note = Seed: YGFLNVIVHSATGFKQSSKALQRPV
YGFLNVIVHSATGYKQMSLALERPV

SEQ ID NO: 32801 - protein, 25 aa, synthetic construct
  source 1..25: note = Seed: YGFLNVIVHSATGFKQSSKALQRPV
YGFLNVIVHSATGYKQMSLALFRPV

SEQ ID NO: 32802 - protein, 25 aa, synthetic construct
  source 1..25: note = Seed: YGFLNVIVHSATGFKQSSKALQRPV
YGFLNVIVHSATGYKQMSLALGRPV

SEQ ID NO: 32803 - protein, 25 aa, synthetic construct
  source 1..25: note = Seed: YGFLNVIVHSATGFKQSSKALQRPV
YGFLNVIVHSATGYKQMSLALHRPV

SEQ ID NO: 32804 - protein, 25 aa, synthetic construct
  source 1..25: note = Seed: YGFLNVIVHSATGFKQSSKALQRPV
YGFLNVIVHSATGYKQMSLALIRPV

SEQ ID NO: 32805 - protein, 25 aa, synthetic construct
  source 1..25: note = Seed: YGFLNVIVHSATGFKQSSKALQRPV
YGFLNVIVHSATGYKQMSLALKRPV

SEQ ID NO: 32806 - protein, 25 aa, synthetic construct
  source 1..25: note = Seed: YGFLNVIVHSATGFKQSSKALQRPV
YGFLNVIVHSATGYKQMSLALLRPV

SEQ ID NO: 32807 - protein, 25 aa, synthetic construct
  source 1..25: note = Seed: YGFLNVIVHSATGFKQSSKALQRPV
YGFLNVIVHSATGYKQMSLALMRPV

SEQ ID NO: 32808 - protein, 25 aa, synthetic construct
  source 1..25: note = Seed: YGFLNVIVHSATGFKQSSKALQRPV
YGFLNVIVHSATGYKQMSLALNRPV

SEQ ID NO: 32809 - protein, 25 aa, synthetic construct
  source 1..25: note = Seed: YGFLNVIVHSATGFKQSSKALQRPV
YGFLNVIVHSATGYKQMSLALPRPV

SEQ ID NO: 32810 - protein, 25 aa, synthetic construct
  source 1..25: note = Seed: YGFLNVIVHSATGFKQSSKALQRPV
YGFLNVIVHSATGYKQMSLALQRPV

SEQ ID NO: 32811 - protein, 25 aa, synthetic construct
  source 1..25: note = Seed: YGFLNVIVHSATGFKQSSKALQRPV
YGFLNVIVHSATGYKQMSLALRRPV

SEQ ID NO: 32812 - protein, 25 aa, synthetic construct
  source 1..25: note = Seed: YGFLNVIVHSATGFKQSSKALQRPV
YGFLNVIVHSATGYKQMSLALSRPV

SEQ ID NO: 32813 - protein, 25 aa, synthetic construct
  source 1..25: note = Seed: YGFLNVIVHSATGFKQSSKALQRPV
YGFLNVIVHSATGYKQMSLALTRPV

SEQ ID NO: 32814 - protein, 25 aa, synthetic construct
  source 1..25: note = Seed: YGFLNVIVHSATGFKQSSKALQRPV
YGFLNVIVHSATGYKQMSLALVRPV

SEQ ID NO: 32815 - protein, 25 aa, synthetic construct
  source 1..25: note = Seed: YGFLNVIVHSATGFKQSSKALQRPV
YGFLNVIVHSATGYKQMSMALARPV

SEQ ID NO: 32816 - protein, 25 aa, synthetic construct
  source 1..25: note = Seed: YGFLNVIVHSATGFKQSSKALQRPV
YGFLNVIVHSATGYKQMSMALDRPV

SEQ ID NO: 32817 - protein, 25 aa, synthetic construct
  source 1..25: note = Seed: YGFLNVIVHSATGFKQSSKALQRPV
YGFLNVIVHSATGYKQMSMALERPV

SEQ ID NO: 32818 - protein, 25 aa, synthetic construct
  source 1..25: note = Seed: YGFLNVIVHSATGFKQSSKALQRPV
YGFLNVIVHSATGYKQMSMALFRPV

SEQ ID NO: 32819 - protein, 25 aa, synthetic construct
  source 1..25: note = Seed: YGFLNVIVHSATGFKQSSKALQRPV
YGFLNVIVHSATGYKQMSMALGRPV

SEQ ID NO: 32820 - protein, 25 aa, synthetic construct
  source 1..25: note = Seed: YGFLNVIVHSATGFKQSSKALQRPV
YGFLNVIVHSATGYKQMSMALHRPV

SEQ ID NO: 32821 - protein, 25 aa, synthetic construct
  source 1..25: note = Seed: YGFLNVIVHSATGFKQSSKALQRPV
YGFLNVIVHSATGYKQMSMALIRPV

SEQ ID NO: 32822 - protein, 25 aa, synthetic construct
  source 1..25: note = Seed: YGFLNVIVHSATGFKQSSKALQRPV
YGFLNVIVHSATGYKQMSMALKRPV

SEQ ID NO: 32823 - protein, 25 aa, synthetic construct
  source 1..25: note = Seed: YGFLNVIVHSATGFKQSSKALQRPV
YGFLNVIVHSATGYKQMSMALLRPV

SEQ ID NO: 32824 - protein, 25 aa, synthetic construct
  source 1..25: note = Seed: YGFLNVIVHSATGFKQSSKALQRPV
YGFLNVIVHSATGYKQMSMALMRPV

SEQ ID NO: 32825 - protein, 25 aa, synthetic construct
  source 1..25: note = Seed: YGFLNVIVHSATGFKQSSKALQRPV
YGFLNVIVHSATGYKQMSMALNRPV

SEQ ID NO: 32826 - protein, 25 aa, synthetic construct
  source 1..25: note = Seed: YGFLNVIVHSATGFKQSSKALQRPV
YGFLNVIVHSATGYKQMSMALPRPV

SEQ ID NO: 32827 - protein, 25 aa, synthetic construct
  source 1..25: note = Seed: YGFLNVIVHSATGFKQSSKALQRPV
YGFLNVIVHSATGYKQMSMALQRPV

SEQ ID NO: 32828 - protein, 25 aa, synthetic construct
  source 1..25: note = Seed: YGFLNVIVHSATGFKQSSKALQRPV
YGFLNVIVHSATGYKQMSMALRRPV

SEQ ID NO: 32829 - protein, 25 aa, synthetic construct
  source 1..25: note = Seed: YGFLNVIVHSATGFKQSSKALQRPV
YGFLNVIVHSATGYKQMSMALSRPV

SEQ ID NO: 32830 - protein, 25 aa, synthetic construct
  source 1..25: note = Seed: YGFLNVIVHSATGFKQSSKALQRPV
YGFLNVIVHSATGYKQMSMALTRPV

SEQ ID NO: 32831 - protein, 25 aa, synthetic construct
  source 1..25: note = Seed: YGFLNVIVHSATGFKQSSKALQRPV
YGFLNVIVHSATGYKQMSMALVRPV

SEQ ID NO: 32832 - protein, 25 aa, synthetic construct
  source 1..25: note = Seed: YGFLNVIVHSATGFKQSSKALQRPV
YGFLNVIVHSATGYKQMSNALARPV

SEQ ID NO: 32833 - protein, 25 aa, synthetic construct
  source 1..25: note = Seed: YGFLNVIVHSATGFKQSSKALQRPV
YGFLNVIVHSATGYKQMSNALCRPV

SEQ ID NO: 32834 - protein, 25 aa, synthetic construct
  source 1..25: note = Seed: YGFLNVIVHSATGFKQSSKALQRPV
YGFLNVIVHSATGYKQMSNALDRPV

SEQ ID NO: 32835 - protein, 25 aa, synthetic construct
  source 1..25: note = Seed: YGFLNVIVHSATGFKQSSKALQRPV
YGFLNVIVHSATGYKQMSNALERPV

SEQ ID NO: 32836 - protein, 25 aa, synthetic construct
  source 1..25: note = Seed: YGFLNVIVHSATGFKQSSKALQRPV
YGFLNVIVHSATGYKQMSNALFRPV

SEQ ID NO: 32837 - protein, 25 aa, synthetic construct
  source 1..25: note = Seed: YGFLNVIVHSATGFKQSSKALQRPV
YGFLNVIVHSATGYKQMSNALGRPV

SEQ ID NO: 32838 - protein, 25 aa, synthetic construct
  source 1..25: note = Seed: YGFLNVIVHSATGFKQSSKALQRPV
YGFLNVIVHSATGYKQMSNALHRPV

SEQ ID NO: 32839 - protein, 25 aa, synthetic construct
  source 1..25: note = Seed: YGFLNVIVHSATGFKQSSKALQRPV
YGFLNVIVHSATGYKQMSNALIRPV

SEQ ID NO: 32840 - protein, 25 aa, synthetic construct
  source 1..25: note = Seed: YGFLNVIVHSATGFKQSSKALQRPV
YGFLNVIVHSATGYKQMSNALLRPV

SEQ ID NO: 32841 - protein, 25 aa, synthetic construct
  source 1..25: note = Seed: YGFLNVIVHSATGFKQSSKALQRPV
YGFLNVIVHSATGYKQMSNALMRPV

SEQ ID NO: 32842 - protein, 25 aa, synthetic construct
  source 1..25: note = Seed: YGFLNVIVHSATGFKQSSKALQRPV
YGFLNVIVHSATGYKQMSNALNRPV

SEQ ID NO: 32843 - protein, 25 aa, synthetic construct
  source 1..25: note = Seed: YGFLNVIVHSATGFKQSSKALQRPV
YGFLNVIVHSATGYKQMSNALPRPV

SEQ ID NO: 32844 - protein, 25 aa, synthetic construct
  source 1..25: note = Seed: YGFLNVIVHSATGFKQSSKALQRPV
YGFLNVIVHSATGYKQMSNALQRPV

SEQ ID NO: 32845 - protein, 25 aa, synthetic construct
  source 1..25: note = Seed: YGFLNVIVHSATGFKQSSKALQRPV
YGFLNVIVHSATGYKQMSNALSRPV

SEQ ID NO: 32846 - protein, 25 aa, synthetic construct
  source 1..25: note = Seed: YGFLNVIVHSATGFKQSSKALQRPV
YGFLNVIVHSATGYKQMSNALTRPV

SEQ ID NO: 32847 - protein, 25 aa, synthetic construct
  source 1..25: note = Seed: YGFLNVIVHSATGFKQSSKALQRPV
YGFLNVIVHSATGYKQMSNALVRPV

SEQ ID NO: 32848 - protein, 25 aa, synthetic construct
  source 1..25: note = Seed: YGFLNVIVHSATGFKQSSKALQRPV
YGFLNVIVHSATGYKQMSNALYRPV

SEQ ID NO: 32849 - protein, 25 aa, synthetic construct
  source 1..25: note = Seed: YGFLNVIVHSATGFKQSSKALQRPV
YGFLNVIVHSATGYKQMSPALARPV

SEQ ID NO: 32850 - protein, 25 aa, synthetic construct
  source 1..25: note = Seed: YGFLNVIVHSATGFKQSSKALQRPV
YGFLNVIVHSATGYKQMSPALCRPV

SEQ ID NO: 32851 - protein, 25 aa, synthetic construct
  source 1..25: note = Seed: YGFLNVIVHSATGFKQSSKALQRPV
YGFLNVIVHSATGYKQMSPALDRPV

SEQ ID NO: 32852 - protein, 25 aa, synthetic construct
  source 1..25: note = Seed: YGFLNVIVHSATGFKQSSKALQRPV
YGFLNVIVHSATGYKQMSPALERPV

SEQ ID NO: 32853 - protein, 25 aa, synthetic construct
  source 1..25: note = Seed: YGFLNVIVHSATGFKQSSKALQRPV
YGFLNVIVHSATGYKQMSPALFRPV

SEQ ID NO: 32854 - protein, 25 aa, synthetic construct
  source 1..25: note = Seed: YGFLNVIVHSATGFKQSSKALQRPV
YGFLNVIVHSATGYKQMSPALGRPV

SEQ ID NO: 32855 - protein, 25 aa, synthetic construct
  source 1..25: note = Seed: YGFLNVIVHSATGFKQSSKALQRPV
YGFLNVIVHSATGYKQMSPALHRPV

SEQ ID NO: 32856 - protein, 25 aa, synthetic construct
  source 1..25: note = Seed: YGFLNVIVHSATGFKQSSKALQRPV
YGFLNVIVHSATGYKQMSPALIRPV

SEQ ID NO: 32857 - protein, 25 aa, synthetic construct
  source 1..25: note = Seed: YGFLNVIVHSATGFKQSSKALQRPV
YGFLNVIVHSATGYKQMSPALKRPV

SEQ ID NO: 32858 - protein, 25 aa, synthetic construct
  source 1..25: note = Seed: YGFLNVIVHSATGFKQSSKALQRPV
YGFLNVIVHSATGYKQMSPALLRPV

SEQ ID NO: 32859 - protein, 25 aa, synthetic construct
  source 1..25: note = Seed: YGFLNVIVHSATGFKQSSKALQRPV
YGFLNVIVHSATGYKQMSPALMRPV

SEQ ID NO: 32860 - protein, 25 aa, synthetic construct
  source 1..25: note = Seed: YGFLNVIVHSATGFKQSSKALQRPV
YGFLNVIVHSATGYKQMSPALNRPV

SEQ ID NO: 32861 - protein, 25 aa, synthetic construct
  source 1..25: note = Seed: YGFLNVIVHSATGFKQSSKALQRPV
YGFLNVIVHSATGYKQMSPALPRPV

SEQ ID NO: 32862 - protein, 25 aa, synthetic construct
  source 1..25: note = Seed: YGFLNVIVHSATGFKQSSKALQRPV
YGFLNVIVHSATGYKQMSPALQRPV

SEQ ID NO: 32863 - protein, 25 aa, synthetic construct
  source 1..25: note = Seed: YGFLNVIVHSATGFKQSSKALQRPV
YGFLNVIVHSATGYKQMSPALRRPV

SEQ ID NO: 32864 - protein, 25 aa, synthetic construct
  source 1..25: note = Seed: YGFLNVIVHSATGFKQSSKALQRPV
YGFLNVIVHSATGYKQMSPALSRPV

SEQ ID NO: 32865 - protein, 25 aa, synthetic construct
  source 1..25: note = Seed: YGFLNVIVHSATGFKQSSKALQRPV
YGFLNVIVHSATGYKQMSPALTRPV

SEQ ID NO: 32866 - protein, 25 aa, synthetic construct
  source 1..25: note = Seed: YGFLNVIVHSATGFKQSSKALQRPV
YGFLNVIVHSATGYKQMSPALVRPV

SEQ ID NO: 32867 - protein, 25 aa, synthetic construct
  source 1..25: note = Seed: YGFLNVIVHSATGFKQSSKALQRPV
YGFLNVIVHSATGYKQMSPALWRPV

SEQ ID NO: 32868 - protein, 25 aa, synthetic construct
  source 1..25: note = Seed: YGFLNVIVHSATGFKQSSKALQRPV
YGFLNVIVHSATGYKQMSPALYRPV

SEQ ID NO: 32869 - protein, 25 aa, synthetic construct
  source 1..25: note = Seed: YGFLNVIVHSATGFKQSSKALQRPV
YGFLNVIVHSATGYKQMSQALARPV

SEQ ID NO: 32870 - protein, 25 aa, synthetic construct
  source 1..25: note = Seed: YGFLNVIVHSATGFKQSSKALQRPV
YGFLNVIVHSATGYKQMSQALIRPV

SEQ ID NO: 32871 - protein, 25 aa, synthetic construct
  source 1..25: note = Seed: YGFLNVIVHSATGFKQSSKALQRPV
YGFLNVIVHSATGYKQMSQALLRPV

SEQ ID NO: 32872 - protein, 25 aa, synthetic construct
  source 1..25: note = Seed: YGFLNVIVHSATGFKQSSKALQRPV
YGFLNVIVHSATGYKQMSQALMRPV

SEQ ID NO: 32873 - protein, 25 aa, synthetic construct
  source 1..25: note = Seed: YGFLNVIVHSATGFKQSSKALQRPV
YGFLNVIVHSATGYKQMSQALNRPV

SEQ ID NO: 32874 - protein, 25 aa, synthetic construct
  source 1..25: note = Seed: YGFLNVIVHSATGFKQSSKALQRPV
YGFLNVIVHSATGYKQMSQALSRPV

SEQ ID NO: 32875 - protein, 25 aa, synthetic construct
  source 1..25: note = Seed: YGFLNVIVHSATGFKQSSKALQRPV
YGFLNVIVHSATGYKQMSQALTRPV

SEQ ID NO: 32876 - protein, 25 aa, synthetic construct
  source 1..25: note = Seed: YGFLNVIVHSATGFKQSSKALQRPV
YGFLNVIVHSATGYKQMSQALVRPV

SEQ ID NO: 32877 - protein, 25 aa, synthetic construct
  source 1..25: note = Seed: YGFLNVIVHSATGFKQSSKALQRPV
YGFLNVIVHSATGYKQMSRALARPV

SEQ ID NO: 32878 - protein, 25 aa, synthetic construct
  source 1..25: note = Seed: YGFLNVIVHSATGFKQSSKALQRPV
YGFLNVIVHSATGYKQMSRALCRPV

SEQ ID NO: 32879 - protein, 25 aa, synthetic construct
  source 1..25: note = Seed: YGFLNVIVHSATGFKQSSKALQRPV
YGFLNVIVHSATGYKQMSRALERPV

SEQ ID NO: 32880 - protein, 25 aa, synthetic construct
  source 1..25: note = Seed: YGFLNVIVHSATGFKQSSKALQRPV
YGFLNVIVHSATGYKQMSRALFRPV

SEQ ID NO: 32881 - protein, 25 aa, synthetic construct
  source 1..25: note = Seed: YGFLNVIVHSATGFKQSSKALQRPV
YGFLNVIVHSATGYKQMSRALGRPV

SEQ ID NO: 32882 - protein, 25 aa, synthetic construct
  source 1..25: note = Seed: YGFLNVIVHSATGFKQSSKALQRPV
YGFLNVIVHSATGYKQMSRALHRPV

SEQ ID NO: 32883 - protein, 25 aa, synthetic construct
  source 1..25: note = Seed: YGFLNVIVHSATGFKQSSKALQRPV
YGFLNVIVHSATGYKQMSRALIRPV

SEQ ID NO: 32884 - protein, 25 aa, synthetic construct
  source 1..25: note = Seed: YGFLNVIVHSATGFKQSSKALQRPV
YGFLNVIVHSATGYKQMSRALKRPV

SEQ ID NO: 32885 - protein, 25 aa, synthetic construct
  source 1..25: note = Seed: YGFLNVIVHSATGFKQSSKALQRPV
YGFLNVIVHSATGYKQMSRALLRPV

SEQ ID NO: 32886 - protein, 25 aa, synthetic construct
  source 1..25: note = Seed: YGFLNVIVHSATGFKQSSKALQRPV
YGFLNVIVHSATGYKQMSRALMRPV

SEQ ID NO: 32887 - protein, 25 aa, synthetic construct
  source 1..25: note = Seed: YGFLNVIVHSATGFKQSSKALQRPV
YGFLNVIVHSATGYKQMSRALNRPV

SEQ ID NO: 32888 - protein, 25 aa, synthetic construct
  source 1..25: note = Seed: YGFLNVIVHSATGFKQSSKALQRPV
YGFLNVIVHSATGYKQMSRALPRPV

SEQ ID NO: 32889 - protein, 25 aa, synthetic construct
  source 1..25: note = Seed: YGFLNVIVHSATGFKQSSKALQRPV
YGFLNVIVHSATGYKQMSRALQRPV

SEQ ID NO: 32890 - protein, 25 aa, synthetic construct
  source 1..25: note = Seed: YGFLNVIVHSATGFKQSSKALQRPV
YGFLNVIVHSATGYKQMSRALRRPV

SEQ ID NO: 32891 - protein, 25 aa, synthetic construct
  source 1..25: note = Seed: YGFLNVIVHSATGFKQSSKALQRPV
YGFLNVIVHSATGYKQMSRALSRPV

SEQ ID NO: 32892 - protein, 25 aa, synthetic construct
  source 1..25: note = Seed: YGFLNVIVHSATGFKQSSKALQRPV
YGFLNVIVHSATGYKQMSRALTRPV

SEQ ID NO: 32893 - protein, 25 aa, synthetic construct
  source 1..25: note = Seed: YGFLNVIVHSATGFKQSSKALQRPV
YGFLNVIVHSATGYKQMSRALVRPV

SEQ ID NO: 32894 - protein, 25 aa, synthetic construct
  source 1..25: note = Seed: YGFLNVIVHSATGFKQSSKALQRPV
YGFLNVIVHSATGYKQMSRALYRPV

SEQ ID NO: 32895 - protein, 25 aa, synthetic construct
  source 1..25: note = Seed: YGFLNVIVHSATGFKQSSKALQRPV
YGFLNVIVHSATGYKQMSSALARPV

SEQ ID NO: 32896 - protein, 25 aa, synthetic construct
  source 1..25: note = Seed: YGFLNVIVHSATGFKQSSKALQRPV
YGFLNVIVHSATGYKQMSSALCRPV

SEQ ID NO: 32897 - protein, 25 aa, synthetic construct
  source 1..25: note = Seed: YGFLNVIVHSATGFKQSSKALQRPV
YGFLNVIVHSATGYKQMSSALDRPV

SEQ ID NO: 32898 - protein, 25 aa, synthetic construct
  source 1..25: note = Seed: YGFLNVIVHSATGFKQSSKALQRPV
YGFLNVIVHSATGYKQMSSALERPV

SEQ ID NO: 32899 - protein, 25 aa, synthetic construct
  source 1..25: note = Seed: YGFLNVIVHSATGFKQSSKALQRPV
YGFLNVIVHSATGYKQMSSALFRPV

SEQ ID NO: 32900 - protein, 25 aa, synthetic construct
  source 1..25: note = Seed: YGFLNVIVHSATGFKQSSKALQRPV
YGFLNVIVHSATGYKQMSSALGRPV

SEQ ID NO: 32901 - protein, 25 aa, synthetic construct
  source 1..25: note = Seed: YGFLNVIVHSATGFKQSSKALQRPV
YGFLNVIVHSATGYKQMSSALHRPV

SEQ ID NO: 32902 - protein, 25 aa, synthetic construct
  source 1..25: note = Seed: YGFLNVIVHSATGFKQSSKALQRPV
YGFLNVIVHSATGYKQMSSALIRPV

SEQ ID NO: 32903 - protein, 25 aa, synthetic construct
  source 1..25: note = Seed: YGFLNVIVHSATGFKQSSKALQRPV
YGFLNVIVHSATGYKQMSSALKRPV

SEQ ID NO: 32904 - protein, 25 aa, synthetic construct
  source 1..25: note = Seed: YGFLNVIVHSATGFKQSSKALQRPV
YGFLNVIVHSATGYKQMSSALLRPV

SEQ ID NO: 32905 - protein, 25 aa, synthetic construct
  source 1..25: note = Seed: YGFLNVIVHSATGFKQSSKALQRPV
YGFLNVIVHSATGYKQMSSALMRPV

SEQ ID NO: 32906 - protein, 25 aa, synthetic construct
  source 1..25: note = Seed: YGFLNVIVHSATGFKQSSKALQRPV
YGFLNVIVHSATGYKQMSSALNRPV

SEQ ID NO: 32907 - protein, 25 aa, synthetic construct
  source 1..25: note = Seed: YGFLNVIVHSATGFKQSSKALQRPV
YGFLNVIVHSATGYKQMSSALPRPV

SEQ ID NO: 32908 - protein, 25 aa, synthetic construct
  source 1..25: note = Seed: YGFLNVIVHSATGFKQSSKALQRPV
YGFLNVIVHSATGYKQMSSALQRPV

SEQ ID NO: 32909 - protein, 25 aa, synthetic construct
  source 1..25: note = Seed: YGFLNVIVHSATGFKQSSKALQRPV
YGFLNVIVHSATGYKQMSSALRRPV

SEQ ID NO: 32910 - protein, 25 aa, synthetic construct
  source 1..25: note = Seed: YGFLNVIVHSATGFKQSSKALQRPV
YGFLNVIVHSATGYKQMSSALSRPV

SEQ ID NO: 32911 - protein, 25 aa, synthetic construct
  source 1..25: note = Seed: YGFLNVIVHSATGFKQSSKALQRPV
YGFLNVIVHSATGYKQMSSALTRPV

SEQ ID NO: 32912 - protein, 25 aa, synthetic construct
  source 1..25: note = Seed: YGFLNVIVHSATGFKQSSKALQRPV
YGFLNVIVHSATGYKQMSSALVRPV

SEQ ID NO: 32913 - protein, 25 aa, synthetic construct
  source 1..25: note = Seed: YGFLNVIVHSATGFKQSSKALQRPV
YGFLNVIVHSATGYKQMSSALYRPV

SEQ ID NO: 32914 - protein, 25 aa, synthetic construct
  source 1..25: note = Seed: YGFLNVIVHSATGFKQSSKALQRPV
YGFLNVIVHSATGYKQMSTALARPV

SEQ ID NO: 32915 - protein, 25 aa, synthetic construct
  source 1..25: note = Seed: YGFLNVIVHSATGFKQSSKALQRPV
YGFLNVIVHSATGYKQMSTALCRPV

SEQ ID NO: 32916 - protein, 25 aa, synthetic construct
  source 1..25: note = Seed: YGFLNVIVHSATGFKQSSKALQRPV
YGFLNVIVHSATGYKQMSTALDRPV

SEQ ID NO: 32917 - protein, 25 aa, synthetic construct
  source 1..25: note = Seed: YGFLNVIVHSATGFKQSSKALQRPV
YGFLNVIVHSATGYKQMSTALERPV

SEQ ID NO: 32918 - protein, 25 aa, synthetic construct
  source 1..25: note = Seed: YGFLNVIVHSATGFKQSSKALQRPV
YGFLNVIVHSATGYKQMSTALFRPV

SEQ ID NO: 32919 - protein, 25 aa, synthetic construct
  source 1..25: note = Seed: YGFLNVIVHSATGFKQSSKALQRPV
YGFLNVIVHSATGYKQMSTALGRPV

SEQ ID NO: 32920 - protein, 25 aa, synthetic construct
  source 1..25: note = Seed: YGFLNVIVHSATGFKQSSKALQRPV
YGFLNVIVHSATGYKQMSTALHRPV

SEQ ID NO: 32921 - protein, 25 aa, synthetic construct
  source 1..25: note = Seed: YGFLNVIVHSATGFKQSSKALQRPV
YGFLNVIVHSATGYKQMSTALIRPV

SEQ ID NO: 32922 - protein, 25 aa, synthetic construct
  source 1..25: note = Seed: YGFLNVIVHSATGFKQSSKALQRPV
YGFLNVIVHSATGYKQMSTALKRPV

SEQ ID NO: 32923 - protein, 25 aa, synthetic construct
  source 1..25: note = Seed: YGFLNVIVHSATGFKQSSKALQRPV
YGFLNVIVHSATGYKQMSTALLRPV

SEQ ID NO: 32924 - protein, 25 aa, synthetic construct
  source 1..25: note = Seed: YGFLNVIVHSATGFKQSSKALQRPV
YGFLNVIVHSATGYKQMSTALMRPV

SEQ ID NO: 32925 - protein, 25 aa, synthetic construct
  source 1..25: note = Seed: YGFLNVIVHSATGFKQSSKALQRPV
YGFLNVIVHSATGYKQMSTALNRPV

SEQ ID NO: 32926 - protein, 25 aa, synthetic construct
  source 1..25: note = Seed: YGFLNVIVHSATGFKQSSKALQRPV
YGFLNVIVHSATGYKQMSTALPRPV

SEQ ID NO: 32927 - protein, 25 aa, synthetic construct
  source 1..25: note = Seed: YGFLNVIVHSATGFKQSSKALQRPV
YGFLNVIVHSATGYKQMSTALQRPV

SEQ ID NO: 32928 - protein, 25 aa, synthetic construct
  source 1..25: note = Seed: YGFLNVIVHSATGFKQSSKALQRPV
YGFLNVIVHSATGYKQMSTALRRPV

SEQ ID NO: 32929 - protein, 25 aa, synthetic construct
  source 1..25: note = Seed: YGFLNVIVHSATGFKQSSKALQRPV
YGFLNVIVHSATGYKQMSTALSRPV

SEQ ID NO: 32930 - protein, 25 aa, synthetic construct
  source 1..25: note = Seed: YGFLNVIVHSATGFKQSSKALQRPV
YGFLNVIVHSATGYKQMSTALTRPV

SEQ ID NO: 32931 - protein, 25 aa, synthetic construct
  source 1..25: note = Seed: YGFLNVIVHSATGFKQSSKALQRPV
YGFLNVIVHSATGYKQMSTALVRPV

SEQ ID NO: 32932 - protein, 25 aa, synthetic construct
  source 1..25: note = Seed: YGFLNVIVHSATGFKQSSKALQRPV
YGFLNVIVHSATGYKQMSTALWRPV

SEQ ID NO: 32933 - protein, 25 aa, synthetic construct
  source 1..25: note = Seed: YGFLNVIVHSATGFKQSSKALQRPV
YGFLNVIVHSATGYKQMSTALYRPV

SEQ ID NO: 32934 - protein, 25 aa, synthetic construct
  source 1..25: note = Seed: YGFLNVIVHSATGFKQSSKALQRPV
YGFLNVIVHSATGYKQMSVALARPV

SEQ ID NO: 32935 - protein, 25 aa, synthetic construct
  source 1..25: note = Seed: YGFLNVIVHSATGFKQSSKALQRPV
YGFLNVIVHSATGYKQMSVALCRPV

SEQ ID NO: 32936 - protein, 25 aa, synthetic construct
  source 1..25: note = Seed: YGFLNVIVHSATGFKQSSKALQRPV
YGFLNVIVHSATGYKQMSVALDRPV

SEQ ID NO: 32937 - protein, 25 aa, synthetic construct
  source 1..25: note = Seed: YGFLNVIVHSATGFKQSSKALQRPV
YGFLNVIVHSATGYKQMSVALERPV

SEQ ID NO: 32938 - protein, 25 aa, synthetic construct
  source 1..25: note = Seed: YGFLNVIVHSATGFKQSSKALQRPV
YGFLNVIVHSATGYKQMSVALFRPV

SEQ ID NO: 32939 - protein, 25 aa, synthetic construct
  source 1..25: note = Seed: YGFLNVIVHSATGFKQSSKALQRPV
YGFLNVIVHSATGYKQMSVALGRPV

SEQ ID NO: 32940 - protein, 25 aa, synthetic construct
  source 1..25: note = Seed: YGFLNVIVHSATGFKQSSKALQRPV
YGFLNVIVHSATGYKQMSVALHRPV

SEQ ID NO: 32941 - protein, 25 aa, synthetic construct
  source 1..25: note = Seed: YGFLNVIVHSATGFKQSSKALQRPV
YGFLNVIVHSATGYKQMSVALIRPV

SEQ ID NO: 32942 - protein, 25 aa, synthetic construct
  source 1..25: note = Seed: YGFLNVIVHSATGFKQSSKALQRPV
YGFLNVIVHSATGYKQMSVALKRPV

SEQ ID NO: 32943 - protein, 25 aa, synthetic construct
  source 1..25: note = Seed: YGFLNVIVHSATGFKQSSKALQRPV
YGFLNVIVHSATGYKQMSVALLRPV

SEQ ID NO: 32944 - protein, 25 aa, synthetic construct
  source 1..25: note = Seed: YGFLNVIVHSATGFKQSSKALQRPV
YGFLNVIVHSATGYKQMSVALMRPV

SEQ ID NO: 32945 - protein, 25 aa, synthetic construct
  source 1..25: note = Seed: YGFLNVIVHSATGFKQSSKALQRPV
YGFLNVIVHSATGYKQMSVALNRPV

SEQ ID NO: 32946 - protein, 25 aa, synthetic construct
  source 1..25: note = Seed: YGFLNVIVHSATGFKQSSKALQRPV
YGFLNVIVHSATGYKQMSVALPRPV

SEQ ID NO: 32947 - protein, 25 aa, synthetic construct
  source 1..25: note = Seed: YGFLNVIVHSATGFKQSSKALQRPV
YGFLNVIVHSATGYKQMSVALQRPV

SEQ ID NO: 32948 - protein, 25 aa, synthetic construct
  source 1..25: note = Seed: YGFLNVIVHSATGFKQSSKALQRPV
YGFLNVIVHSATGYKQMSVALRRPV

SEQ ID NO: 32949 - protein, 25 aa, synthetic construct
  source 1..25: note = Seed: YGFLNVIVHSATGFKQSSKALQRPV
YGFLNVIVHSATGYKQMSVALSRPV

SEQ ID NO: 32950 - protein, 25 aa, synthetic construct
  source 1..25: note = Seed: YGFLNVIVHSATGFKQSSKALQRPV
YGFLNVIVHSATGYKQMSVALTRPV

SEQ ID NO: 32951 - protein, 25 aa, synthetic construct
  source 1..25: note = Seed: YGFLNVIVHSATGFKQSSKALQRPV
YGFLNVIVHSATGYKQMSVALVRPV

SEQ ID NO: 32952 - protein, 25 aa, synthetic construct
  source 1..25: note = Seed: YGFLNVIVHSATGFKQSSKALQRPV
YGFLNVIVHSATGYKQMSVALYRPV

SEQ ID NO: 32953 - protein, 25 aa, synthetic construct
  source 1..25: note = Seed: YGFLNVIVHSATGFKQSSKALQRPV
YGFLNVIVHSATGYKQMSWALARPV

SEQ ID NO: 32954 - protein, 25 aa, synthetic construct
  source 1..25: note = Seed: YGFLNVIVHSATGFKQSSKALQRPV
YGFLNVIVHSATGYKQMSWALFRPV

SEQ ID NO: 32955 - protein, 25 aa, synthetic construct
  source 1..25: note = Seed: YGFLNVIVHSATGFKQSSKALQRPV
YGFLNVIVHSATGYKQMSWALMRPV

SEQ ID NO: 32956 - protein, 25 aa, synthetic construct
  source 1..25: note = Seed: YGFLNVIVHSATGFKQSSKALQRPV
YGFLNVIVHSATGYKQMSWALNRPV

SEQ ID NO: 32957 - protein, 25 aa, synthetic construct
  source 1..25: note = Seed: YGFLNVIVHSATGFKQSSKALQRPV
YGFLNVIVHSATGYKQMSWALSRPV

SEQ ID NO: 32958 - protein, 25 aa, synthetic construct
  source 1..25: note = Seed: YGFLNVIVHSATGFKQSSKALQRPV
YGFLNVIVHSATGYKQMSWALVRPV

SEQ ID NO: 32959 - protein, 25 aa, synthetic construct
  source 1..25: note = Seed: YGFLNVIVHSATGFKQSSKALQRPV
YGFLNVIVHSATGYKQMSYALARPV

SEQ ID NO: 32960 - protein, 25 aa, synthetic construct
  source 1..25: note = Seed: YGFLNVIVHSATGFKQSSKALQRPV
YGFLNVIVHSATGYKQMSYALFRPV

SEQ ID NO: 32961 - protein, 25 aa, synthetic construct
  source 1..25: note = Seed: YGFLNVIVHSATGFKQSSKALQRPV
YGFLNVIVHSATGYKQMSYALIRPV

SEQ ID NO: 32962 - protein, 25 aa, synthetic construct
  source 1..25: note = Seed: YGFLNVIVHSATGFKQSSKALQRPV
YGFLNVIVHSATGYKQMSYALLRPV

SEQ ID NO: 32963 - protein, 25 aa, synthetic construct
  source 1..25: note = Seed: YGFLNVIVHSATGFKQSSKALQRPV
YGFLNVIVHSATGYKQMSYALNRPV

SEQ ID NO: 32964 - protein, 25 aa, synthetic construct
  source 1..25: note = Seed: YGFLNVIVHSATGFKQSSKALQRPV
YGFLNVIVHSATGYKQMSYALSRPV

SEQ ID NO: 32965 - protein, 25 aa, synthetic construct
  source 1..25: note = Seed: YGFLNVIVHSATGFKQSSKALQRPV
YGFLNVIVHSATGYKQMSYALVRPV

SEQ ID NO: 32966 - protein, 25 aa, synthetic construct
  source 1..25: note = Seed: YGFLNVIVHSATGFKQSSKALQRPV
YGFLNVIVHSATGYKQMSYALYRPV

SEQ ID NO: 32967 - protein, 25 aa, synthetic construct
  source 1..25: note = Seed: YGFLNVIVHSATGFKQSSKALQRPV
YGFLNVIVHSATGYKQNSAALARPV

SEQ ID NO: 32968 - protein, 25 aa, synthetic construct
  source 1..25: note = Seed: YGFLNVIVHSATGFKQSSKALQRPV
YGFLNVIVHSATGYKQNSAALFRPV

SEQ ID NO: 32969 - protein, 25 aa, synthetic construct
  source 1..25: note = Seed: YGFLNVIVHSATGFKQSSKALQRPV
YGFLNVIVHSATGYKQNSAALIRPV

SEQ ID NO: 32970 - protein, 25 aa, synthetic construct
  source 1..25: note = Seed: YGFLNVIVHSATGFKQSSKALQRPV
YGFLNVIVHSATGYKQNSAALLRPV

SEQ ID NO: 32971 - protein, 25 aa, synthetic construct
  source 1..25: note = Seed: YGFLNVIVHSATGFKQSSKALQRPV
YGFLNVIVHSATGYKQNSAALMRPV

SEQ ID NO: 32972 - protein, 25 aa, synthetic construct
  source 1..25: note = Seed: YGFLNVIVHSATGFKQSSKALQRPV
YGFLNVIVHSATGYKQNSAALNRPV

SEQ ID NO: 32973 - protein, 25 aa, synthetic construct
  source 1..25: note = Seed: YGFLNVIVHSATGFKQSSKALQRPV
YGFLNVIVHSATGYKQNSAALVRPV

SEQ ID NO: 32974 - protein, 25 aa, synthetic construct
  source 1..25: note = Seed: YGFLNVIVHSATGFKQSSKALQRPV
YGFLNVIVHSATGYKQNSAALYRPV

SEQ ID NO: 32975 - protein, 25 aa, synthetic construct
  source 1..25: note = Seed: YGFLNVIVHSATGFKQSSKALQRPV
YGFLNVIVHSATGYKQNSGALFRPV

SEQ ID NO: 32976 - protein, 25 aa, synthetic construct
  source 1..25: note = Seed: YGFLNVIVHSATGFKQSSKALQRPV
YGFLNVIVHSATGYKQNSGALIRPV

SEQ ID NO: 32977 - protein, 25 aa, synthetic construct
  source 1..25: note = Seed: YGFLNVIVHSATGFKQSSKALQRPV
YGFLNVIVHSATGYKQNSGALLRPV

SEQ ID NO: 32978 - protein, 25 aa, synthetic construct
  source 1..25: note = Seed: YGFLNVIVHSATGFKQSSKALQRPV
YGFLNVIVHSATGYKQNSGALVRPV

SEQ ID NO: 32979 - protein, 25 aa, synthetic construct
  source 1..25: note = Seed: YGFLNVIVHSATGFKQSSKALQRPV
YGFLNVIVHSATGYKQNSGALYRPV

SEQ ID NO: 32980 - protein, 25 aa, synthetic construct
  source 1..25: note = Seed: YGFLNVIVHSATGFKQSSKALQRPV
YGFLNVIVHSATGYKQNSIALFRPV

SEQ ID NO: 32981 - protein, 25 aa, synthetic construct
  source 1..25: note = Seed: YGFLNVIVHSATGFKQSSKALQRPV
YGFLNVIVHSATGYKQNSIALIRPV

SEQ ID NO: 32982 - protein, 25 aa, synthetic construct
  source 1..25: note = Seed: YGFLNVIVHSATGFKQSSKALQRPV
YGFLNVIVHSATGYKQNSIALLRPV

SEQ ID NO: 32983 - protein, 25 aa, synthetic construct
  source 1..25: note = Seed: YGFLNVIVHSATGFKQSSKALQRPV
YGFLNVIVHSATGYKQNSIALMRPV

SEQ ID NO: 32984 - protein, 25 aa, synthetic construct
  source 1..25: note = Seed: YGFLNVIVHSATGFKQSSKALQRPV
YGFLNVIVHSATGYKQNSIALVRPV

SEQ ID NO: 32985 - protein, 25 aa, synthetic construct
  source 1..25: note = Seed: YGFLNVIVHSATGFKQSSKALQRPV
YGFLNVIVHSATGYKQNSIALYRPV

SEQ ID NO: 32986 - protein, 25 aa, synthetic construct
  source 1..25: note = Seed: YGFLNVIVHSATGFKQSSKALQRPV
YGFLNVIVHSATGYKQNSLALIRPV

SEQ ID NO: 32987 - protein, 25 aa, synthetic construct
  source 1..25: note = Seed: YGFLNVIVHSATGFKQSSKALQRPV
YGFLNVIVHSATGYKQNSMALIRPV

SEQ ID NO: 32988 - protein, 25 aa, synthetic construct
  source 1..25: note = Seed: YGFLNVIVHSATGFKQSSKALQRPV
YGFLNVIVHSATGYKQNSMALVRPV

SEQ ID NO: 32989 - protein, 25 aa, synthetic construct
  source 1..25: note = Seed: YGFLNVIVHSATGFKQSSKALQRPV
YGFLNVIVHSATGYKQNSNALFRPV

SEQ ID NO: 32990 - protein, 25 aa, synthetic construct
  source 1..25: note = Seed: YGFLNVIVHSATGFKQSSKALQRPV
YGFLNVIVHSATGYKQNSNALIRPV

SEQ ID NO: 32991 - protein, 25 aa, synthetic construct
  source 1..25: note = Seed: YGFLNVIVHSATGFKQSSKALQRPV
YGFLNVIVHSATGYKQNSNALLRPV

SEQ ID NO: 32992 - protein, 25 aa, synthetic construct
  source 1..25: note = Seed: YGFLNVIVHSATGFKQSSKALQRPV
YGFLNVIVHSATGYKQNSNALMRPV

SEQ ID NO: 32993 - protein, 25 aa, synthetic construct
  source 1..25: note = Seed: YGFLNVIVHSATGFKQSSKALQRPV
YGFLNVIVHSATGYKQNSNALVRPV

SEQ ID NO: 32994 - protein, 25 aa, synthetic construct
  source 1..25: note = Seed: YGFLNVIVHSATGFKQSSKALQRPV
YGFLNVIVHSATGYKQNSNALYRPV

SEQ ID NO: 32995 - protein, 25 aa, synthetic construct
  source 1..25: note = Seed: YGFLNVIVHSATGFKQSSKALQRPV
YGFLNVIVHSATGYKQNSPALFRPV

SEQ ID NO: 32996 - protein, 25 aa, synthetic construct
  source 1..25: note = Seed: YGFLNVIVHSATGFKQSSKALQRPV
YGFLNVIVHSATGYKQNSPALIRPV

SEQ ID NO: 32997 - protein, 25 aa, synthetic construct
  source 1..25: note = Seed: YGFLNVIVHSATGFKQSSKALQRPV
YGFLNVIVHSATGYKQNSPALLRPV

SEQ ID NO: 32998 - protein, 25 aa, synthetic construct
  source 1..25: note = Seed: YGFLNVIVHSATGFKQSSKALQRPV
YGFLNVIVHSATGYKQNSPALVRPV

SEQ ID NO: 32999 - protein, 25 aa, synthetic construct
  source 1..25: note = Seed: YGFLNVIVHSATGFKQSSKALQRPV
YGFLNVIVHSATGYKQNSPALYRPV

SEQ ID NO: 33000 - protein, 25 aa, synthetic construct
  source 1..25: note = Seed: YGFLNVIVHSATGFKQSSKALQRPV
YGFLNVIVHSATGYKQNSSALFRPV

SEQ ID NO: 33001 - protein, 25 aa, synthetic construct
  source 1..25: note = Seed: YGFLNVIVHSATGFKQSSKALQRPV
YGFLNVIVHSATGYKQNSSALIRPV

SEQ ID NO: 33002 - protein, 25 aa, synthetic construct
  source 1..25: note = Seed: YGFLNVIVHSATGFKQSSKALQRPV
YGFLNVIVHSATGYKQNSSALLRPV

SEQ ID NO: 33003 - protein, 25 aa, synthetic construct
  source 1..25: note = Seed: YGFLNVIVHSATGFKQSSKALQRPV
YGFLNVIVHSATGYKQNSSALMRPV

SEQ ID NO: 33004 - protein, 25 aa, synthetic construct
  source 1..25: note = Seed: YGFLNVIVHSATGFKQSSKALQRPV
YGFLNVIVHSATGYKQNSSALVRPV

SEQ ID NO: 33005 - protein, 25 aa, synthetic construct
  source 1..25: note = Seed: YGFLNVIVHSATGFKQSSKALQRPV
YGFLNVIVHSATGYKQNSSALYRPV

SEQ ID NO: 33006 - protein, 25 aa, synthetic construct
  source 1..25: note = Seed: YGFLNVIVHSATGFKQSSKALQRPV
YGFLNVIVHSATGYKQNSTALFRPV

SEQ ID NO: 33007 - protein, 25 aa, synthetic construct
  source 1..25: note = Seed: YGFLNVIVHSATGFKQSSKALQRPV
YGFLNVIVHSATGYKQNSTALIRPV

SEQ ID NO: 33008 - protein, 25 aa, synthetic construct
  source 1..25: note = Seed: YGFLNVIVHSATGFKQSSKALQRPV
YGFLNVIVHSATGYKQNSTALLRPV

SEQ ID NO: 33009 - protein, 25 aa, synthetic construct
  source 1..25: note = Seed: YGFLNVIVHSATGFKQSSKALQRPV
YGFLNVIVHSATGYKQNSTALVRPV

SEQ ID NO: 33010 - protein, 25 aa, synthetic construct
  source 1..25: note = Seed: YGFLNVIVHSATGFKQSSKALQRPV
YGFLNVIVHSATGYKQNSTALYRPV

SEQ ID NO: 33011 - protein, 25 aa, synthetic construct
  source 1..25: note = Seed: YGFLNVIVHSATGFKQSSKALQRPV
YGFLNVIVHSATGYKQNSVALARPV

SEQ ID NO: 33012 - protein, 25 aa, synthetic construct
  source 1..25: note = Seed: YGFLNVIVHSATGFKQSSKALQRPV
YGFLNVIVHSATGYKQNSVALFRPV

SEQ ID NO: 33013 - protein, 25 aa, synthetic construct
  source 1..25: note = Seed: YGFLNVIVHSATGFKQSSKALQRPV
YGFLNVIVHSATGYKQNSVALIRPV

SEQ ID NO: 33014 - protein, 25 aa, synthetic construct
  source 1..25: note = Seed: YGFLNVIVHSATGFKQSSKALQRPV
YGFLNVIVHSATGYKQNSVALLRPV

SEQ ID NO: 33015 - protein, 25 aa, synthetic construct
  source 1..25: note = Seed: YGFLNVIVHSATGFKQSSKALQRPV
YGFLNVIVHSATGYKQNSVALMRPV

SEQ ID NO: 33016 - protein, 25 aa, synthetic construct
  source 1..25: note = Seed: YGFLNVIVHSATGFKQSSKALQRPV
YGFLNVIVHSATGYKQNSVALNRPV

SEQ ID NO: 33017 - protein, 25 aa, synthetic construct
  source 1..25: note = Seed: YGFLNVIVHSATGFKQSSKALQRPV
YGFLNVIVHSATGYKQNSVALVRPV

SEQ ID NO: 33018 - protein, 25 aa, synthetic construct
  source 1..25: note = Seed: YGFLNVIVHSATGFKQSSKALQRPV
YGFLNVIVHSATGYKQNSVALYRPV

SEQ ID NO: 33019 - protein, 25 aa, synthetic construct
  source 1..25: note = Seed: YGFLNVIVHSATGFKQSSKALQRPV
YGFLNVIVHSATGYKQQSAALARPV

SEQ ID NO: 33020 - protein, 25 aa, synthetic construct
  source 1..25: note = Seed: YGFLNVIVHSATGFKQSSKALQRPV
YGFLNVIVHSATGYKQQSAALDRPV

SEQ ID NO: 33021 - protein, 25 aa, synthetic construct
  source 1..25: note = Seed: YGFLNVIVHSATGFKQSSKALQRPV
YGFLNVIVHSATGYKQQSAALERPV

SEQ ID NO: 33022 - protein, 25 aa, synthetic construct
  source 1..25: note = Seed: YGFLNVIVHSATGFKQSSKALQRPV
YGFLNVIVHSATGYKQQSAALGRPV

SEQ ID NO: 33023 - protein, 25 aa, synthetic construct
  source 1..25: note = Seed: YGFLNVIVHSATGFKQSSKALQRPV
YGFLNVIVHSATGYKQQSAALHRPV

SEQ ID NO: 33024 - protein, 25 aa, synthetic construct
  source 1..25: note = Seed: YGFLNVIVHSATGFKQSSKALQRPV
YGFLNVIVHSATGYKQQSAALIRPV

SEQ ID NO: 33025 - protein, 25 aa, synthetic construct
  source 1..25: note = Seed: YGFLNVIVHSATGFKQSSKALQRPV
YGFLNVIVHSATGYKQQSAALLRPV

SEQ ID NO: 33026 - protein, 25 aa, synthetic construct
  source 1..25: note = Seed: YGFLNVIVHSATGFKQSSKALQRPV
YGFLNVIVHSATGYKQQSAALMRPV

SEQ ID NO: 33027 - protein, 25 aa, synthetic construct
  source 1..25: note = Seed: YGFLNVIVHSATGFKQSSKALQRPV
YGFLNVIVHSATGYKQQSAALNRPV

SEQ ID NO: 33028 - protein, 25 aa, synthetic construct
  source 1..25: note = Seed: YGFLNVIVHSATGFKQSSKALQRPV
YGFLNVIVHSATGYKQQSAALPRPV

SEQ ID NO: 33029 - protein, 25 aa, synthetic construct
  source 1..25: note = Seed: YGFLNVIVHSATGFKQSSKALQRPV
YGFLNVIVHSATGYKQQSAALQRPV

SEQ ID NO: 33030 - protein, 25 aa, synthetic construct
  source 1..25: note = Seed: YGFLNVIVHSATGFKQSSKALQRPV
YGFLNVIVHSATGYKQQSAALSRPV

SEQ ID NO: 33031 - protein, 25 aa, synthetic construct
  source 1..25: note = Seed: YGFLNVIVHSATGFKQSSKALQRPV
YGFLNVIVHSATGYKQQSAALTRPV

SEQ ID NO: 33032 - protein, 25 aa, synthetic construct
  source 1..25: note = Seed: YGFLNVIVHSATGFKQSSKALQRPV
YGFLNVIVHSATGYKQQSAALVRPV

SEQ ID NO: 33033 - protein, 25 aa, synthetic construct
  source 1..25: note = Seed: YGFLNVIVHSATGFKQSSKALQRPV
YGFLNVIVHSATGYKQQSFALFRPV

SEQ ID NO: 33034 - protein, 25 aa, synthetic construct
  source 1..25: note = Seed: YGFLNVIVHSATGFKQSSKALQRPV
YGFLNVIVHSATGYKQQSFALLRPV

SEQ ID NO: 33035 - protein, 25 aa, synthetic construct
  source 1..25: note = Seed: YGFLNVIVHSATGFKQSSKALQRPV
YGFLNVIVHSATGYKQQSGALARPV

SEQ ID NO: 33036 - protein, 25 aa, synthetic construct
  source 1..25: note = Seed: YGFLNVIVHSATGFKQSSKALQRPV
YGFLNVIVHSATGYKQQSGALNRPV

SEQ ID NO: 33037 - protein, 25 aa, synthetic construct
  source 1..25: note = Seed: YGFLNVIVHSATGFKQSSKALQRPV
YGFLNVIVHSATGYKQQSGALSRPV

SEQ ID NO: 33038 - protein, 25 aa, synthetic construct
  source 1..25: note = Seed: YGFLNVIVHSATGFKQSSKALQRPV
YGFLNVIVHSATGYKQQSGALVRPV

SEQ ID NO: 33039 - protein, 25 aa, synthetic construct
  source 1..25: note = Seed: YGFLNVIVHSATGFKQSSKALQRPV
YGFLNVIVHSATGYKQQSIALARPV

SEQ ID NO: 33040 - protein, 25 aa, synthetic construct
  source 1..25: note = Seed: YGFLNVIVHSATGFKQSSKALQRPV
YGFLNVIVHSATGYKQQSIALGRPV

SEQ ID NO: 33041 - protein, 25 aa, synthetic construct
  source 1..25: note = Seed: YGFLNVIVHSATGFKQSSKALQRPV
YGFLNVIVHSATGYKQQSIALHRPV

SEQ ID NO: 33042 - protein, 25 aa, synthetic construct
  source 1..25: note = Seed: YGFLNVIVHSATGFKQSSKALQRPV
YGFLNVIVHSATGYKQQSIALIRPV

SEQ ID NO: 33043 - protein, 25 aa, synthetic construct
  source 1..25: note = Seed: YGFLNVIVHSATGFKQSSKALQRPV
YGFLNVIVHSATGYKQQSIALLRPV

SEQ ID NO: 33044 - protein, 25 aa, synthetic construct
  source 1..25: note = Seed: YGFLNVIVHSATGFKQSSKALQRPV
YGFLNVIVHSATGYKQQSIALMRPV

SEQ ID NO: 33045 - protein, 25 aa, synthetic construct
  source 1..25: note = Seed: YGFLNVIVHSATGFKQSSKALQRPV
YGFLNVIVHSATGYKQQSIALNRPV

SEQ ID NO: 33046 - protein, 25 aa, synthetic construct
  source 1..25: note = Seed: YGFLNVIVHSATGFKQSSKALQRPV
YGFLNVIVHSATGYKQQSIALQRPV

SEQ ID NO: 33047 - protein, 25 aa, synthetic construct
  source 1..25: note = Seed: YGFLNVIVHSATGFKQSSKALQRPV
YGFLNVIVHSATGYKQQSIALSRPV

SEQ ID NO: 33048 - protein, 25 aa, synthetic construct
  source 1..25: note = Seed: YGFLNVIVHSATGFKQSSKALQRPV
YGFLNVIVHSATGYKQQSIALTRPV

SEQ ID NO: 33049 - protein, 25 aa, synthetic construct
  source 1..25: note = Seed: YGFLNVIVHSATGFKQSSKALQRPV
YGFLNVIVHSATGYKQQSIALVRPV

SEQ ID NO: 33050 - protein, 25 aa, synthetic construct
  source 1..25: note = Seed: YGFLNVIVHSATGFKQSSKALQRPV
YGFLNVIVHSATGYKQQSKALARPV

SEQ ID NO: 33051 - protein, 25 aa, synthetic construct
  source 1..25: note = Seed: YGFLNVIVHSATGFKQSSKALQRPV
YGFLNVIVHSATGYKQQSKALSRPV

SEQ ID NO: 33052 - protein, 25 aa, synthetic construct
  source 1..25: note = Seed: YGFLNVIVHSATGFKQSSKALQRPV
YGFLNVIVHSATGYKQQSLALARPV

SEQ ID NO: 33053 - protein, 25 aa, synthetic construct
  source 1..25: note = Seed: YGFLNVIVHSATGFKQSSKALQRPV
YGFLNVIVHSATGYKQQSLALNRPV

SEQ ID NO: 33054 - protein, 25 aa, synthetic construct
  source 1..25: note = Seed: YGFLNVIVHSATGFKQSSKALQRPV
YGFLNVIVHSATGYKQQSLALSRPV

SEQ ID NO: 33055 - protein, 25 aa, synthetic construct
  source 1..25: note = Seed: YGFLNVIVHSATGFKQSSKALQRPV
YGFLNVIVHSATGYKQQSMALARPV

SEQ ID NO: 33056 - protein, 25 aa, synthetic construct
  source 1..25: note = Seed: YGFLNVIVHSATGFKQSSKALQRPV
YGFLNVIVHSATGYKQQSMALNRPV

SEQ ID NO: 33057 - protein, 25 aa, synthetic construct
  source 1..25: note = Seed: YGFLNVIVHSATGFKQSSKALQRPV
YGFLNVIVHSATGYKQQSMALSRPV

SEQ ID NO: 33058 - protein, 25 aa, synthetic construct
  source 1..25: note = Seed: YGFLNVIVHSATGFKQSSKALQRPV
YGFLNVIVHSATGYKQQSMALVRPV

SEQ ID NO: 33059 - protein, 25 aa, synthetic construct
  source 1..25: note = Seed: YGFLNVIVHSATGFKQSSKALQRPV
YGFLNVIVHSATGYKQQSNALARPV

SEQ ID NO: 33060 - protein, 25 aa, synthetic construct
  source 1..25: note = Seed: YGFLNVIVHSATGFKQSSKALQRPV
YGFLNVIVHSATGYKQQSNALNRPV

SEQ ID NO: 33061 - protein, 25 aa, synthetic construct
  source 1..25: note = Seed: YGFLNVIVHSATGFKQSSKALQRPV
YGFLNVIVHSATGYKQQSNALSRPV

SEQ ID NO: 33062 - protein, 25 aa, synthetic construct
  source 1..25: note = Seed: YGFLNVIVHSATGFKQSSKALQRPV
YGFLNVIVHSATGYKQQSNALVRPV

SEQ ID NO: 33063 - protein, 25 aa, synthetic construct
  source 1..25: note = Seed: YGFLNVIVHSATGFKQSSKALQRPV
YGFLNVIVHSATGYKQQSPALARPV

SEQ ID NO: 33064 - protein, 25 aa, synthetic construct
  source 1..25: note = Seed: YGFLNVIVHSATGFKQSSKALQRPV
YGFLNVIVHSATGYKQQSPALGRPV

SEQ ID NO: 33065 - protein, 25 aa, synthetic construct
  source 1..25: note = Seed: YGFLNVIVHSATGFKQSSKALQRPV
YGFLNVIVHSATGYKQQSPALHRPV

SEQ ID NO: 33066 - protein, 25 aa, synthetic construct
  source 1..25: note = Seed: YGFLNVIVHSATGFKQSSKALQRPV
YGFLNVIVHSATGYKQQSPALIRPV

SEQ ID NO: 33067 - protein, 25 aa, synthetic construct
  source 1..25: note = Seed: YGFLNVIVHSATGFKQSSKALQRPV
YGFLNVIVHSATGYKQQSPALLRPV

SEQ ID NO: 33068 - protein, 25 aa, synthetic construct
  source 1..25: note = Seed: YGFLNVIVHSATGFKQSSKALQRPV
YGFLNVIVHSATGYKQQSPALMRPV

SEQ ID NO: 33069 - protein, 25 aa, synthetic construct
  source 1..25: note = Seed: YGFLNVIVHSATGFKQSSKALQRPV
YGFLNVIVHSATGYKQQSPALNRPV

SEQ ID NO: 33070 - protein, 25 aa, synthetic construct
  source 1..25: note = Seed: YGFLNVIVHSATGFKQSSKALQRPV
YGFLNVIVHSATGYKQQSPALPRPV

SEQ ID NO: 33071 - protein, 25 aa, synthetic construct
  source 1..25: note = Seed: YGFLNVIVHSATGFKQSSKALQRPV
YGFLNVIVHSATGYKQQSPALQRPV

SEQ ID NO: 33072 - protein, 25 aa, synthetic construct
  source 1..25: note = Seed: YGFLNVIVHSATGFKQSSKALQRPV
YGFLNVIVHSATGYKQQSPALSRPV

SEQ ID NO: 33073 - protein, 25 aa, synthetic construct
  source 1..25: note = Seed: YGFLNVIVHSATGFKQSSKALQRPV
YGFLNVIVHSATGYKQQSPALTRPV

SEQ ID NO: 33074 - protein, 25 aa, synthetic construct
  source 1..25: note = Seed: YGFLNVIVHSATGFKQSSKALQRPV
YGFLNVIVHSATGYKQQSPALVRPV

SEQ ID NO: 33075 - protein, 25 aa, synthetic construct
  source 1..25: note = Seed: YGFLNVIVHSATGFKQSSKALQRPV
YGFLNVIVHSATGYKQQSRALARPV

SEQ ID NO: 33076 - protein, 25 aa, synthetic construct
  source 1..25: note = Seed: YGFLNVIVHSATGFKQSSKALQRPV
YGFLNVIVHSATGYKQQSRALGRPV

SEQ ID NO: 33077 - protein, 25 aa, synthetic construct
  source 1..25: note = Seed: YGFLNVIVHSATGFKQSSKALQRPV
YGFLNVIVHSATGYKQQSRALSRPV

SEQ ID NO: 33078 - protein, 25 aa, synthetic construct
  source 1..25: note = Seed: YGFLNVIVHSATGFKQSSKALQRPV
YGFLNVIVHSATGYKQQSSALARPV

SEQ ID NO: 33079 - protein, 25 aa, synthetic construct
  source 1..25: note = Seed: YGFLNVIVHSATGFKQSSKALQRPV
YGFLNVIVHSATGYKQQSSALGRPV

SEQ ID NO: 33080 - protein, 25 aa, synthetic construct
  source 1..25: note = Seed: YGFLNVIVHSATGFKQSSKALQRPV
YGFLNVIVHSATGYKQQSSALHRPV

SEQ ID NO: 33081 - protein, 25 aa, synthetic construct
  source 1..25: note = Seed: YGFLNVIVHSATGFKQSSKALQRPV
YGFLNVIVHSATGYKQQSSALIRPV

SEQ ID NO: 33082 - protein, 25 aa, synthetic construct
  source 1..25: note = Seed: YGFLNVIVHSATGFKQSSKALQRPV
YGFLNVIVHSATGYKQQSSALLRPV

SEQ ID NO: 33083 - protein, 25 aa, synthetic construct
  source 1..25: note = Seed: YGFLNVIVHSATGFKQSSKALQRPV
YGFLNVIVHSATGYKQQSSALMRPV

SEQ ID NO: 33084 - protein, 25 aa, synthetic construct
  source 1..25: note = Seed: YGFLNVIVHSATGFKQSSKALQRPV
YGFLNVIVHSATGYKQQSSALNRPV

SEQ ID NO: 33085 - protein, 25 aa, synthetic construct
  source 1..25: note = Seed: YGFLNVIVHSATGFKQSSKALQRPV
YGFLNVIVHSATGYKQQSSALQRPV

SEQ ID NO: 33086 - protein, 25 aa, synthetic construct
  source 1..25: note = Seed: YGFLNVIVHSATGFKQSSKALQRPV
YGFLNVIVHSATGYKQQSSALSRPV

SEQ ID NO: 33087 - protein, 25 aa, synthetic construct
  source 1..25: note = Seed: YGFLNVIVHSATGFKQSSKALQRPV
YGFLNVIVHSATGYKQQSSALTRPV

SEQ ID NO: 33088 - protein, 25 aa, synthetic construct
  source 1..25: note = Seed: YGFLNVIVHSATGFKQSSKALQRPV
YGFLNVIVHSATGYKQQSSALVRPV

SEQ ID NO: 33089 - protein, 25 aa, synthetic construct
  source 1..25: note = Seed: YGFLNVIVHSATGFKQSSKALQRPV
YGFLNVIVHSATGYKQQSTALARPV

SEQ ID NO: 33090 - protein, 25 aa, synthetic construct
  source 1..25: note = Seed: YGFLNVIVHSATGFKQSSKALQRPV
YGFLNVIVHSATGYKQQSTALGRPV

SEQ ID NO: 33091 - protein, 25 aa, synthetic construct
  source 1..25: note = Seed: YGFLNVIVHSATGFKQSSKALQRPV
YGFLNVIVHSATGYKQQSTALHRPV

SEQ ID NO: 33092 - protein, 25 aa, synthetic construct
  source 1..25: note = Seed: YGFLNVIVHSATGFKQSSKALQRPV
YGFLNVIVHSATGYKQQSTALIRPV

SEQ ID NO: 33093 - protein, 25 aa, synthetic construct
  source 1..25: note = Seed: YGFLNVIVHSATGFKQSSKALQRPV
YGFLNVIVHSATGYKQQSTALLRPV

SEQ ID NO: 33094 - protein, 25 aa, synthetic construct
  source 1..25: note = Seed: YGFLNVIVHSATGFKQSSKALQRPV
YGFLNVIVHSATGYKQQSTALMRPV

SEQ ID NO: 33095 - protein, 25 aa, synthetic construct
  source 1..25: note = Seed: YGFLNVIVHSATGFKQSSKALQRPV
YGFLNVIVHSATGYKQQSTALNRPV

SEQ ID NO: 33096 - protein, 25 aa, synthetic construct
  source 1..25: note = Seed: YGFLNVIVHSATGFKQSSKALQRPV
YGFLNVIVHSATGYKQQSTALQRPV

SEQ ID NO: 33097 - protein, 25 aa, synthetic construct
  source 1..25: note = Seed: YGFLNVIVHSATGFKQSSKALQRPV
YGFLNVIVHSATGYKQQSTALSRPV

SEQ ID NO: 33098 - protein, 25 aa, synthetic construct
  source 1..25: note = Seed: YGFLNVIVHSATGFKQSSKALQRPV
YGFLNVIVHSATGYKQQSTALTRPV

SEQ ID NO: 33099 - protein, 25 aa, synthetic construct
  source 1..25: note = Seed: YGFLNVIVHSATGFKQSSKALQRPV
YGFLNVIVHSATGYKQQSTALVRPV

SEQ ID NO: 33100 - protein, 25 aa, synthetic construct
  source 1..25: note = Seed: YGFLNVIVHSATGFKQSSKALQRPV
YGFLNVIVHSATGYKQQSVALARPV

SEQ ID NO: 33101 - protein, 25 aa, synthetic construct
  source 1..25: note = Seed: YGFLNVIVHSATGFKQSSKALQRPV
YGFLNVIVHSATGYKQQSVALDRPV

SEQ ID NO: 33102 - protein, 25 aa, synthetic construct
  source 1..25: note = Seed: YGFLNVIVHSATGFKQSSKALQRPV
YGFLNVIVHSATGYKQQSVALGRPV

SEQ ID NO: 33103 - protein, 25 aa, synthetic construct
  source 1..25: note = Seed: YGFLNVIVHSATGFKQSSKALQRPV
YGFLNVIVHSATGYKQQSVALHRPV

SEQ ID NO: 33104 - protein, 25 aa, synthetic construct
  source 1..25: note = Seed: YGFLNVIVHSATGFKQSSKALQRPV
YGFLNVIVHSATGYKQQSVALIRPV

SEQ ID NO: 33105 - protein, 25 aa, synthetic construct
  source 1..25: note = Seed: YGFLNVIVHSATGFKQSSKALQRPV
YGFLNVIVHSATGYKQQSVALLRPV

SEQ ID NO: 33106 - protein, 25 aa, synthetic construct
  source 1..25: note = Seed: YGFLNVIVHSATGFKQSSKALQRPV
YGFLNVIVHSATGYKQQSVALMRPV

SEQ ID NO: 33107 - protein, 25 aa, synthetic construct
  source 1..25: note = Seed: YGFLNVIVHSATGFKQSSKALQRPV
YGFLNVIVHSATGYKQQSVALNRPV

SEQ ID NO: 33108 - protein, 25 aa, synthetic construct
  source 1..25: note = Seed: YGFLNVIVHSATGFKQSSKALQRPV
YGFLNVIVHSATGYKQQSVALPRPV

SEQ ID NO: 33109 - protein, 25 aa, synthetic construct
  source 1..25: note = Seed: YGFLNVIVHSATGFKQSSKALQRPV
YGFLNVIVHSATGYKQQSVALQRPV

SEQ ID NO: 33110 - protein, 25 aa, synthetic construct
  source 1..25: note = Seed: YGFLNVIVHSATGFKQSSKALQRPV
YGFLNVIVHSATGYKQQSVALSRPV

SEQ ID NO: 33111 - protein, 25 aa, synthetic construct
  source 1..25: note = Seed: YGFLNVIVHSATGFKQSSKALQRPV
YGFLNVIVHSATGYKQQSVALTRPV

SEQ ID NO: 33112 - protein, 25 aa, synthetic construct
  source 1..25: note = Seed: YGFLNVIVHSATGFKQSSKALQRPV
YGFLNVIVHSATGYKQQSVALVRPV

SEQ ID NO: 33113 - protein, 25 aa, synthetic construct
  source 1..25: note = Seed: YGFLNVIVHSATGFKQSSKALQRPV
YGFLNVIVHSATGYKQRSKALRRPV

SEQ ID NO: 33114 - protein, 25 aa, synthetic construct
  source 1..25: note = Seed: YGFLNVIVHSATGFKQSSKALQRPV
YGFLNVIVHSATGYKQRSRALRRPV

SEQ ID NO: 33115 - protein, 25 aa, synthetic construct
  source 1..25: note = Seed: YGFLNVIVHSATGFKQSSKALQRPV
YGFLNVIVHSATGYKQSSAALARPV

SEQ ID NO: 33116 - protein, 25 aa, synthetic construct
  source 1..25: note = Seed: YGFLNVIVHSATGFKQSSKALQRPV
YGFLNVIVHSATGYKQSSAALDRPV

SEQ ID NO: 33117 - protein, 25 aa, synthetic construct
  source 1..25: note = Seed: YGFLNVIVHSATGFKQSSKALQRPV
YGFLNVIVHSATGYKQSSAALERPV

SEQ ID NO: 33118 - protein, 25 aa, synthetic construct
  source 1..25: note = Seed: YGFLNVIVHSATGFKQSSKALQRPV
YGFLNVIVHSATGYKQSSAALGRPV

SEQ ID NO: 33119 - protein, 25 aa, synthetic construct
  source 1..25: note = Seed: YGFLNVIVHSATGFKQSSKALQRPV
YGFLNVIVHSATGYKQSSAALHRPV

SEQ ID NO: 33120 - protein, 25 aa, synthetic construct
  source 1..25: note = Seed: YGFLNVIVHSATGFKQSSKALQRPV
YGFLNVIVHSATGYKQSSAALIRPV

SEQ ID NO: 33121 - protein, 25 aa, synthetic construct
  source 1..25: note = Seed: YGFLNVIVHSATGFKQSSKALQRPV
YGFLNVIVHSATGYKQSSAALLRPV

SEQ ID NO: 33122 - protein, 25 aa, synthetic construct
  source 1..25: note = Seed: YGFLNVIVHSATGFKQSSKALQRPV
YGFLNVIVHSATGYKQSSAALMRPV

SEQ ID NO: 33123 - protein, 25 aa, synthetic construct
  source 1..25: note = Seed: YGFLNVIVHSATGFKQSSKALQRPV
YGFLNVIVHSATGYKQSSAALNRPV

SEQ ID NO: 33124 - protein, 25 aa, synthetic construct
  source 1..25: note = Seed: YGFLNVIVHSATGFKQSSKALQRPV
YGFLNVIVHSATGYKQSSAALPRPV

SEQ ID NO: 33125 - protein, 25 aa, synthetic construct
  source 1..25: note = Seed: YGFLNVIVHSATGFKQSSKALQRPV
YGFLNVIVHSATGYKQSSAALQRPV

SEQ ID NO: 33126 - protein, 25 aa, synthetic construct
  source 1..25: note = Seed: YGFLNVIVHSATGFKQSSKALQRPV
YGFLNVIVHSATGYKQSSAALSRPV

SEQ ID NO: 33127 - protein, 25 aa, synthetic construct
  source 1..25: note = Seed: YGFLNVIVHSATGFKQSSKALQRPV
YGFLNVIVHSATGYKQSSAALTRPV

SEQ ID NO: 33128 - protein, 25 aa, synthetic construct
  source 1..25: note = Seed: YGFLNVIVHSATGFKQSSKALQRPV
YGFLNVIVHSATGYKQSSAALVRPV

SEQ ID NO: 33129 - protein, 25 aa, synthetic construct
  source 1..25: note = Seed: YGFLNVIVHSATGFKQSSKALQRPV
YGFLNVIVHSATGYKQSSFALFRPV

SEQ ID NO: 33130 - protein, 25 aa, synthetic construct
  source 1..25: note = Seed: YGFLNVIVHSATGFKQSSKALQRPV
YGFLNVIVHSATGYKQSSFALIRPV

SEQ ID NO: 33131 - protein, 25 aa, synthetic construct
  source 1..25: note = Seed: YGFLNVIVHSATGFKQSSKALQRPV
YGFLNVIVHSATGYKQSSFALLRPV

SEQ ID NO: 33132 - protein, 25 aa, synthetic construct
  source 1..25: note = Seed: YGFLNVIVHSATGFKQSSKALQRPV
YGFLNVIVHSATGYKQSSFALVRPV

SEQ ID NO: 33133 - protein, 25 aa, synthetic construct
  source 1..25: note = Seed: YGFLNVIVHSATGFKQSSKALQRPV
YGFLNVIVHSATGYKQSSGALARPV

SEQ ID NO: 33134 - protein, 25 aa, synthetic construct
  source 1..25: note = Seed: YGFLNVIVHSATGFKQSSKALQRPV
YGFLNVIVHSATGYKQSSGALNRPV

SEQ ID NO: 33135 - protein, 25 aa, synthetic construct
  source 1..25: note = Seed: YGFLNVIVHSATGFKQSSKALQRPV
YGFLNVIVHSATGYKQSSGALSRPV

SEQ ID NO: 33136 - protein, 25 aa, synthetic construct
  source 1..25: note = Seed: YGFLNVIVHSATGFKQSSKALQRPV
YGFLNVIVHSATGYKQSSIALARPV

SEQ ID NO: 33137 - protein, 25 aa, synthetic construct
  source 1..25: note = Seed: YGFLNVIVHSATGFKQSSKALQRPV
YGFLNVIVHSATGYKQSSIALIRPV

SEQ ID NO: 33138 - protein, 25 aa, synthetic construct
  source 1..25: note = Seed: YGFLNVIVHSATGFKQSSKALQRPV
YGFLNVIVHSATGYKQSSIALMRPV

SEQ ID NO: 33139 - protein, 25 aa, synthetic construct
  source 1..25: note = Seed: YGFLNVIVHSATGFKQSSKALQRPV
YGFLNVIVHSATGYKQSSIALNRPV

SEQ ID NO: 33140 - protein, 25 aa, synthetic construct
  source 1..25: note = Seed: YGFLNVIVHSATGFKQSSKALQRPV
YGFLNVIVHSATGYKQSSIALSRPV

SEQ ID NO: 33141 - protein, 25 aa, synthetic construct
  source 1..25: note = Seed: YGFLNVIVHSATGFKQSSKALQRPV
YGFLNVIVHSATGYKQSSIALTRPV

SEQ ID NO: 33142 - protein, 25 aa, synthetic construct
  source 1..25: note = Seed: YGFLNVIVHSATGFKQSSKALQRPV
YGFLNVIVHSATGYKQSSIALVRPV

SEQ ID NO: 33143 - protein, 25 aa, synthetic construct
  source 1..25: note = Seed: YGFLNVIVHSATGFKQSSKALQRPV
YGFLNVIVHSATGYKQSSKALARPV

SEQ ID NO: 33144 - protein, 25 aa, synthetic construct
  source 1..25: note = Seed: YGFLNVIVHSATGFKQSSKALQRPV
YGFLNVIVHSATGYKQSSKALSRPV

SEQ ID NO: 33145 - protein, 25 aa, synthetic construct
  source 1..25: note = Seed: YGFLNVIVHSATGFKQSSKALQRPV
YGFLNVIVHSATGYKQSSLALARPV

SEQ ID NO: 33146 - protein, 25 aa, synthetic construct
  source 1..25: note = Seed: YGFLNVIVHSATGFKQSSKALQRPV
YGFLNVIVHSATGYKQSSLALNRPV

SEQ ID NO: 33147 - protein, 25 aa, synthetic construct
  source 1..25: note = Seed: YGFLNVIVHSATGFKQSSKALQRPV
YGFLNVIVHSATGYKQSSLALSRPV

SEQ ID NO: 33148 - protein, 25 aa, synthetic construct
  source 1..25: note = Seed: YGFLNVIVHSATGFKQSSKALQRPV
YGFLNVIVHSATGYKQSSMALARPV

SEQ ID NO: 33149 - protein, 25 aa, synthetic construct
  source 1..25: note = Seed: YGFLNVIVHSATGFKQSSKALQRPV
YGFLNVIVHSATGYKQSSMALNRPV

SEQ ID NO: 33150 - protein, 25 aa, synthetic construct
  source 1..25: note = Seed: YGFLNVIVHSATGFKQSSKALQRPV
YGFLNVIVHSATGYKQSSMALSRPV

SEQ ID NO: 33151 - protein, 25 aa, synthetic construct
  source 1..25: note = Seed: YGFLNVIVHSATGFKQSSKALQRPV
YGFLNVIVHSATGYKQSSNALARPV

SEQ ID NO: 33152 - protein, 25 aa, synthetic construct
  source 1..25: note = Seed: YGFLNVIVHSATGFKQSSKALQRPV
YGFLNVIVHSATGYKQSSNALNRPV

SEQ ID NO: 33153 - protein, 25 aa, synthetic construct
  source 1..25: note = Seed: YGFLNVIVHSATGFKQSSKALQRPV
YGFLNVIVHSATGYKQSSNALSRPV

SEQ ID NO: 33154 - protein, 25 aa, synthetic construct
  source 1..25: note = Seed: YGFLNVIVHSATGFKQSSKALQRPV
YGFLNVIVHSATGYKQSSPALARPV

SEQ ID NO: 33155 - protein, 25 aa, synthetic construct
  source 1..25: note = Seed: YGFLNVIVHSATGFKQSSKALQRPV
YGFLNVIVHSATGYKQSSPALGRPV

SEQ ID NO: 33156 - protein, 25 aa, synthetic construct
  source 1..25: note = Seed: YGFLNVIVHSATGFKQSSKALQRPV
YGFLNVIVHSATGYKQSSPALHRPV

SEQ ID NO: 33157 - protein, 25 aa, synthetic construct
  source 1..25: note = Seed: YGFLNVIVHSATGFKQSSKALQRPV
YGFLNVIVHSATGYKQSSPALIRPV

SEQ ID NO: 33158 - protein, 25 aa, synthetic construct
  source 1..25: note = Seed: YGFLNVIVHSATGFKQSSKALQRPV
YGFLNVIVHSATGYKQSSPALLRPV

SEQ ID NO: 33159 - protein, 25 aa, synthetic construct
  source 1..25: note = Seed: YGFLNVIVHSATGFKQSSKALQRPV
YGFLNVIVHSATGYKQSSPALMRPV

SEQ ID NO: 33160 - protein, 25 aa, synthetic construct
  source 1..25: note = Seed: YGFLNVIVHSATGFKQSSKALQRPV
YGFLNVIVHSATGYKQSSPALNRPV

SEQ ID NO: 33161 - protein, 25 aa, synthetic construct
  source 1..25: note = Seed: YGFLNVIVHSATGFKQSSKALQRPV
YGFLNVIVHSATGYKQSSPALQRPV

SEQ ID NO: 33162 - protein, 25 aa, synthetic construct
  source 1..25: note = Seed: YGFLNVIVHSATGFKQSSKALQRPV
YGFLNVIVHSATGYKQSSPALSRPV

SEQ ID NO: 33163 - protein, 25 aa, synthetic construct
  source 1..25: note = Seed: YGFLNVIVHSATGFKQSSKALQRPV
YGFLNVIVHSATGYKQSSPALTRPV

SEQ ID NO: 33164 - protein, 25 aa, synthetic construct
  source 1..25: note = Seed: YGFLNVIVHSATGFKQSSKALQRPV
YGFLNVIVHSATGYKQSSPALVRPV

SEQ ID NO: 33165 - protein, 25 aa, synthetic construct
  source 1..25: note = Seed: YGFLNVIVHSATGFKQSSKALQRPV
YGFLNVIVHSATGYKQSSRALARPV

SEQ ID NO: 33166 - protein, 25 aa, synthetic construct
  source 1..25: note = Seed: YGFLNVIVHSATGFKQSSKALQRPV
YGFLNVIVHSATGYKQSSRALGRPV

SEQ ID NO: 33167 - protein, 25 aa, synthetic construct
  source 1..25: note = Seed: YGFLNVIVHSATGFKQSSKALQRPV
YGFLNVIVHSATGYKQSSRALSRPV

SEQ ID NO: 33168 - protein, 25 aa, synthetic construct
  source 1..25: note = Seed: YGFLNVIVHSATGFKQSSKALQRPV
YGFLNVIVHSATGYKQSSSALARPV

SEQ ID NO: 33169 - protein, 25 aa, synthetic construct
  source 1..25: note = Seed: YGFLNVIVHSATGFKQSSKALQRPV
YGFLNVIVHSATGYKQSSSALGRPV

SEQ ID NO: 33170 - protein, 25 aa, synthetic construct
  source 1..25: note = Seed: YGFLNVIVHSATGFKQSSKALQRPV
YGFLNVIVHSATGYKQSSSALIRPV

SEQ ID NO: 33171 - protein, 25 aa, synthetic construct
  source 1..25: note = Seed: YGFLNVIVHSATGFKQSSKALQRPV
YGFLNVIVHSATGYKQSSSALLRPV

SEQ ID NO: 33172 - protein, 25 aa, synthetic construct
  source 1..25: note = Seed: YGFLNVIVHSATGFKQSSKALQRPV
YGFLNVIVHSATGYKQSSSALMRPV

SEQ ID NO: 33173 - protein, 25 aa, synthetic construct
  source 1..25: note = Seed: YGFLNVIVHSATGFKQSSKALQRPV
YGFLNVIVHSATGYKQSSSALNRPV

SEQ ID NO: 33174 - protein, 25 aa, synthetic construct
  source 1..25: note = Seed: YGFLNVIVHSATGFKQSSKALQRPV
YGFLNVIVHSATGYKQSSSALQRPV

SEQ ID NO: 33175 - protein, 25 aa, synthetic construct
  source 1..25: note = Seed: YGFLNVIVHSATGFKQSSKALQRPV
YGFLNVIVHSATGYKQSSSALSRPV

SEQ ID NO: 33176 - protein, 25 aa, synthetic construct
  source 1..25: note = Seed: YGFLNVIVHSATGFKQSSKALQRPV
YGFLNVIVHSATGYKQSSSALTRPV

SEQ ID NO: 33177 - protein, 25 aa, synthetic construct
  source 1..25: note = Seed: YGFLNVIVHSATGFKQSSKALQRPV
YGFLNVIVHSATGYKQSSSALVRPV

SEQ ID NO: 33178 - protein, 25 aa, synthetic construct
  source 1..25: note = Seed: YGFLNVIVHSATGFKQSSKALQRPV
YGFLNVIVHSATGYKQSSTALARPV

SEQ ID NO: 33179 - protein, 25 aa, synthetic construct
  source 1..25: note = Seed: YGFLNVIVHSATGFKQSSKALQRPV
YGFLNVIVHSATGYKQSSTALIRPV

SEQ ID NO: 33180 - protein, 25 aa, synthetic construct
  source 1..25: note = Seed: YGFLNVIVHSATGFKQSSKALQRPV
YGFLNVIVHSATGYKQSSTALLRPV

SEQ ID NO: 33181 - protein, 25 aa, synthetic construct
  source 1..25: note = Seed: YGFLNVIVHSATGFKQSSKALQRPV
YGFLNVIVHSATGYKQSSTALMRPV

SEQ ID NO: 33182 - protein, 25 aa, synthetic construct
  source 1..25: note = Seed: YGFLNVIVHSATGFKQSSKALQRPV
YGFLNVIVHSATGYKQSSTALNRPV

SEQ ID NO: 33183 - protein, 25 aa, synthetic construct
  source 1..25: note = Seed: YGFLNVIVHSATGFKQSSKALQRPV
YGFLNVIVHSATGYKQSSTALQRPV

SEQ ID NO: 33184 - protein, 25 aa, synthetic construct
  source 1..25: note = Seed: YGFLNVIVHSATGFKQSSKALQRPV
YGFLNVIVHSATGYKQSSTALSRPV

SEQ ID NO: 33185 - protein, 25 aa, synthetic construct
  source 1..25: note = Seed: YGFLNVIVHSATGFKQSSKALQRPV
YGFLNVIVHSATGYKQSSTALTRPV

SEQ ID NO: 33186 - protein, 25 aa, synthetic construct
  source 1..25: note = Seed: YGFLNVIVHSATGFKQSSKALQRPV
YGFLNVIVHSATGYKQSSTALVRPV

SEQ ID NO: 33187 - protein, 25 aa, synthetic construct
  source 1..25: note = Seed: YGFLNVIVHSATGFKQSSKALQRPV
YGFLNVIVHSATGYKQSSVALARPV

SEQ ID NO: 33188 - protein, 25 aa, synthetic construct
  source 1..25: note = Seed: YGFLNVIVHSATGFKQSSKALQRPV
YGFLNVIVHSATGYKQSSVALGRPV

SEQ ID NO: 33189 - protein, 25 aa, synthetic construct
  source 1..25: note = Seed: YGFLNVIVHSATGFKQSSKALQRPV
YGFLNVIVHSATGYKQSSVALHRPV

SEQ ID NO: 33190 - protein, 25 aa, synthetic construct
  source 1..25: note = Seed: YGFLNVIVHSATGFKQSSKALQRPV
YGFLNVIVHSATGYKQSSVALIRPV

SEQ ID NO: 33191 - protein, 25 aa, synthetic construct
  source 1..25: note = Seed: YGFLNVIVHSATGFKQSSKALQRPV
YGFLNVIVHSATGYKQSSVALLRPV

SEQ ID NO: 33192 - protein, 25 aa, synthetic construct
  source 1..25: note = Seed: YGFLNVIVHSATGFKQSSKALQRPV
YGFLNVIVHSATGYKQSSVALMRPV

SEQ ID NO: 33193 - protein, 25 aa, synthetic construct
  source 1..25: note = Seed: YGFLNVIVHSATGFKQSSKALQRPV
YGFLNVIVHSATGYKQSSVALNRPV

SEQ ID NO: 33194 - protein, 25 aa, synthetic construct
  source 1..25: note = Seed: YGFLNVIVHSATGFKQSSKALQRPV
YGFLNVIVHSATGYKQSSVALQRPV

SEQ ID NO: 33195 - protein, 25 aa, synthetic construct
  source 1..25: note = Seed: YGFLNVIVHSATGFKQSSKALQRPV
YGFLNVIVHSATGYKQSSVALSRPV

SEQ ID NO: 33196 - protein, 25 aa, synthetic construct
  source 1..25: note = Seed: YGFLNVIVHSATGFKQSSKALQRPV
YGFLNVIVHSATGYKQSSVALTRPV

SEQ ID NO: 33197 - protein, 25 aa, synthetic construct
  source 1..25: note = Seed: YGFLNVIVHSATGFKQSSKALQRPV
YGFLNVIVHSATGYKQSSVALVRPV

SEQ ID NO: 33198 - protein, 25 aa, synthetic construct
  source 1..25: note = Seed: YGFLNVIVHSATGFKQSSKALQRPV
YGFLNVIVHSATGYKQTSAALARPV

SEQ ID NO: 33199 - protein, 25 aa, synthetic construct
  source 1..25: note = Seed: YGFLNVIVHSATGFKQSSKALQRPV
YGFLNVIVHSATGYKQTSAALGRPV

SEQ ID NO: 33200 - protein, 25 aa, synthetic construct
  source 1..25: note = Seed: YGFLNVIVHSATGFKQSSKALQRPV
YGFLNVIVHSATGYKQTSAALHRPV

SEQ ID NO: 33201 - protein, 25 aa, synthetic construct
  source 1..25: note = Seed: YGFLNVIVHSATGFKQSSKALQRPV
YGFLNVIVHSATGYKQTSAALIRPV

SEQ ID NO: 33202 - protein, 25 aa, synthetic construct
  source 1..25: note = Seed: YGFLNVIVHSATGFKQSSKALQRPV
YGFLNVIVHSATGYKQTSAALLRPV

SEQ ID NO: 33203 - protein, 25 aa, synthetic construct
  source 1..25: note = Seed: YGFLNVIVHSATGFKQSSKALQRPV
YGFLNVIVHSATGYKQTSAALMRPV

SEQ ID NO: 33204 - protein, 25 aa, synthetic construct
  source 1..25: note = Seed: YGFLNVIVHSATGFKQSSKALQRPV
YGFLNVIVHSATGYKQTSAALNRPV

SEQ ID NO: 33205 - protein, 25 aa, synthetic construct
  source 1..25: note = Seed: YGFLNVIVHSATGFKQSSKALQRPV
YGFLNVIVHSATGYKQTSAALQRPV

SEQ ID NO: 33206 - protein, 25 aa, synthetic construct
  source 1..25: note = Seed: YGFLNVIVHSATGFKQSSKALQRPV
YGFLNVIVHSATGYKQTSAALSRPV

SEQ ID NO: 33207 - protein, 25 aa, synthetic construct
  source 1..25: note = Seed: YGFLNVIVHSATGFKQSSKALQRPV
YGFLNVIVHSATGYKQTSAALTRPV

SEQ ID NO: 33208 - protein, 25 aa, synthetic construct
  source 1..25: note = Seed: YGFLNVIVHSATGFKQSSKALQRPV
YGFLNVIVHSATGYKQTSAALVRPV

SEQ ID NO: 33209 - protein, 25 aa, synthetic construct
  source 1..25: note = Seed: YGFLNVIVHSATGFKQSSKALQRPV
YGFLNVIVHSATGYKQTSFALFRPV

SEQ ID NO: 33210 - protein, 25 aa, synthetic construct
  source 1..25: note = Seed: YGFLNVIVHSATGFKQSSKALQRPV
YGFLNVIVHSATGYKQTSFALIRPV

SEQ ID NO: 33211 - protein, 25 aa, synthetic construct
  source 1..25: note = Seed: YGFLNVIVHSATGFKQSSKALQRPV
YGFLNVIVHSATGYKQTSFALLRPV

SEQ ID NO: 33212 - protein, 25 aa, synthetic construct
  source 1..25: note = Seed: YGFLNVIVHSATGFKQSSKALQRPV
YGFLNVIVHSATGYKQTSFALMRPV

SEQ ID NO: 33213 - protein, 25 aa, synthetic construct
  source 1..25: note = Seed: YGFLNVIVHSATGFKQSSKALQRPV
YGFLNVIVHSATGYKQTSFALVRPV

SEQ ID NO: 33214 - protein, 25 aa, synthetic construct
  source 1..25: note = Seed: YGFLNVIVHSATGFKQSSKALQRPV
YGFLNVIVHSATGYKQTSFALYRPV

SEQ ID NO: 33215 - protein, 25 aa, synthetic construct
  source 1..25: note = Seed: YGFLNVIVHSATGFKQSSKALQRPV
YGFLNVIVHSATGYKQTSGALARPV

SEQ ID NO: 33216 - protein, 25 aa, synthetic construct
  source 1..25: note = Seed: YGFLNVIVHSATGFKQSSKALQRPV
YGFLNVIVHSATGYKQTSGALNRPV

SEQ ID NO: 33217 - protein, 25 aa, synthetic construct
  source 1..25: note = Seed: YGFLNVIVHSATGFKQSSKALQRPV
YGFLNVIVHSATGYKQTSGALSRPV

SEQ ID NO: 33218 - protein, 25 aa, synthetic construct
  source 1..25: note = Seed: YGFLNVIVHSATGFKQSSKALQRPV
YGFLNVIVHSATGYKQTSIALARPV

SEQ ID NO: 33219 - protein, 25 aa, synthetic construct
  source 1..25: note = Seed: YGFLNVIVHSATGFKQSSKALQRPV
YGFLNVIVHSATGYKQTSIALNRPV

SEQ ID NO: 33220 - protein, 25 aa, synthetic construct
  source 1..25: note = Seed: YGFLNVIVHSATGFKQSSKALQRPV
YGFLNVIVHSATGYKQTSIALSRPV

SEQ ID NO: 33221 - protein, 25 aa, synthetic construct
  source 1..25: note = Seed: YGFLNVIVHSATGFKQSSKALQRPV
YGFLNVIVHSATGYKQTSIALTRPV

SEQ ID NO: 33222 - protein, 25 aa, synthetic construct
  source 1..25: note = Seed: YGFLNVIVHSATGFKQSSKALQRPV
YGFLNVIVHSATGYKQTSIALVRPV

SEQ ID NO: 33223 - protein, 25 aa, synthetic construct
  source 1..25: note = Seed: YGFLNVIVHSATGFKQSSKALQRPV
YGFLNVIVHSATGYKQTSKALARPV

SEQ ID NO: 33224 - protein, 25 aa, synthetic construct
  source 1..25: note = Seed: YGFLNVIVHSATGFKQSSKALQRPV
YGFLNVIVHSATGYKQTSKALSRPV

SEQ ID NO: 33225 - protein, 25 aa, synthetic construct
  source 1..25: note = Seed: YGFLNVIVHSATGFKQSSKALQRPV
YGFLNVIVHSATGYKQTSLALARPV

SEQ ID NO: 33226 - protein, 25 aa, synthetic construct
  source 1..25: note = Seed: YGFLNVIVHSATGFKQSSKALQRPV
YGFLNVIVHSATGYKQTSLALNRPV

SEQ ID NO: 33227 - protein, 25 aa, synthetic construct
  source 1..25: note = Seed: YGFLNVIVHSATGFKQSSKALQRPV
YGFLNVIVHSATGYKQTSLALSRPV

SEQ ID NO: 33228 - protein, 25 aa, synthetic construct
  source 1..25: note = Seed: YGFLNVIVHSATGFKQSSKALQRPV
YGFLNVIVHSATGYKQTSMALARPV

SEQ ID NO: 33229 - protein, 25 aa, synthetic construct
  source 1..25: note = Seed: YGFLNVIVHSATGFKQSSKALQRPV
YGFLNVIVHSATGYKQTSNALARPV

SEQ ID NO: 33230 - protein, 25 aa, synthetic construct
  source 1..25: note = Seed: YGFLNVIVHSATGFKQSSKALQRPV
YGFLNVIVHSATGYKQTSPALARPV

SEQ ID NO: 33231 - protein, 25 aa, synthetic construct
  source 1..25: note = Seed: YGFLNVIVHSATGFKQSSKALQRPV
YGFLNVIVHSATGYKQTSPALGRPV

SEQ ID NO: 33232 - protein, 25 aa, synthetic construct
  source 1..25: note = Seed: YGFLNVIVHSATGFKQSSKALQRPV
YGFLNVIVHSATGYKQTSPALIRPV

SEQ ID NO: 33233 - protein, 25 aa, synthetic construct
  source 1..25: note = Seed: YGFLNVIVHSATGFKQSSKALQRPV
YGFLNVIVHSATGYKQTSPALLRPV

SEQ ID NO: 33234 - protein, 25 aa, synthetic construct
  source 1..25: note = Seed: YGFLNVIVHSATGFKQSSKALQRPV
YGFLNVIVHSATGYKQTSPALMRPV

SEQ ID NO: 33235 - protein, 25 aa, synthetic construct
  source 1..25: note = Seed: YGFLNVIVHSATGFKQSSKALQRPV
YGFLNVIVHSATGYKQTSPALNRPV

SEQ ID NO: 33236 - protein, 25 aa, synthetic construct
  source 1..25: note = Seed: YGFLNVIVHSATGFKQSSKALQRPV
YGFLNVIVHSATGYKQTSPALQRPV

SEQ ID NO: 33237 - protein, 25 aa, synthetic construct
  source 1..25: note = Seed: YGFLNVIVHSATGFKQSSKALQRPV
YGFLNVIVHSATGYKQTSPALSRPV

SEQ ID NO: 33238 - protein, 25 aa, synthetic construct
  source 1..25: note = Seed: YGFLNVIVHSATGFKQSSKALQRPV
YGFLNVIVHSATGYKQTSPALTRPV

SEQ ID NO: 33239 - protein, 25 aa, synthetic construct
  source 1..25: note = Seed: YGFLNVIVHSATGFKQSSKALQRPV
YGFLNVIVHSATGYKQTSPALVRPV

SEQ ID NO: 33240 - protein, 25 aa, synthetic construct
  source 1..25: note = Seed: YGFLNVIVHSATGFKQSSKALQRPV
YGFLNVIVHSATGYKQTSRALARPV

SEQ ID NO: 33241 - protein, 25 aa, synthetic construct
  source 1..25: note = Seed: YGFLNVIVHSATGFKQSSKALQRPV
YGFLNVIVHSATGYKQTSRALGRPV

SEQ ID NO: 33242 - protein, 25 aa, synthetic construct
  source 1..25: note = Seed: YGFLNVIVHSATGFKQSSKALQRPV
YGFLNVIVHSATGYKQTSRALSRPV

SEQ ID NO: 33243 - protein, 25 aa, synthetic construct
  source 1..25: note = Seed: YGFLNVIVHSATGFKQSSKALQRPV
YGFLNVIVHSATGYKQTSRALTRPV

SEQ ID NO: 33244 - protein, 25 aa, synthetic construct
  source 1..25: note = Seed: YGFLNVIVHSATGFKQSSKALQRPV
YGFLNVIVHSATGYKQTSSALARPV

SEQ ID NO: 33245 - protein, 25 aa, synthetic construct
  source 1..25: note = Seed: YGFLNVIVHSATGFKQSSKALQRPV
YGFLNVIVHSATGYKQTSSALIRPV

SEQ ID NO: 33246 - protein, 25 aa, synthetic construct
  source 1..25: note = Seed: YGFLNVIVHSATGFKQSSKALQRPV
YGFLNVIVHSATGYKQTSSALLRPV

SEQ ID NO: 33247 - protein, 25 aa, synthetic construct
  source 1..25: note = Seed: YGFLNVIVHSATGFKQSSKALQRPV
YGFLNVIVHSATGYKQTSSALMRPV

SEQ ID NO: 33248 - protein, 25 aa, synthetic construct
  source 1..25: note = Seed: YGFLNVIVHSATGFKQSSKALQRPV
YGFLNVIVHSATGYKQTSSALNRPV

SEQ ID NO: 33249 - protein, 25 aa, synthetic construct
  source 1..25: note = Seed: YGFLNVIVHSATGFKQSSKALQRPV
YGFLNVIVHSATGYKQTSSALSRPV

SEQ ID NO: 33250 - protein, 25 aa, synthetic construct
  source 1..25: note = Seed: YGFLNVIVHSATGFKQSSKALQRPV
YGFLNVIVHSATGYKQTSSALTRPV

SEQ ID NO: 33251 - protein, 25 aa, synthetic construct
  source 1..25: note = Seed: YGFLNVIVHSATGFKQSSKALQRPV
YGFLNVIVHSATGYKQTSSALVRPV

SEQ ID NO: 33252 - protein, 25 aa, synthetic construct
  source 1..25: note = Seed: YGFLNVIVHSATGFKQSSKALQRPV
YGFLNVIVHSATGYKQTSTALARPV

SEQ ID NO: 33253 - protein, 25 aa, synthetic construct
  source 1..25: note = Seed: YGFLNVIVHSATGFKQSSKALQRPV
YGFLNVIVHSATGYKQTSTALIRPV

SEQ ID NO: 33254 - protein, 25 aa, synthetic construct
  source 1..25: note = Seed: YGFLNVIVHSATGFKQSSKALQRPV
YGFLNVIVHSATGYKQTSTALLRPV

SEQ ID NO: 33255 - protein, 25 aa, synthetic construct
  source 1..25: note = Seed: YGFLNVIVHSATGFKQSSKALQRPV
YGFLNVIVHSATGYKQTSTALMRPV

SEQ ID NO: 33256 - protein, 25 aa, synthetic construct
  source 1..25: note = Seed: YGFLNVIVHSATGFKQSSKALQRPV
YGFLNVIVHSATGYKQTSTALNRPV

SEQ ID NO: 33257 - protein, 25 aa, synthetic construct
  source 1..25: note = Seed: YGFLNVIVHSATGFKQSSKALQRPV
YGFLNVIVHSATGYKQTSTALSRPV

SEQ ID NO: 33258 - protein, 25 aa, synthetic construct
  source 1..25: note = Seed: YGFLNVIVHSATGFKQSSKALQRPV
YGFLNVIVHSATGYKQTSTALTRPV

SEQ ID NO: 33259 - protein, 25 aa, synthetic construct
  source 1..25: note = Seed: YGFLNVIVHSATGFKQSSKALQRPV
YGFLNVIVHSATGYKQTSTALVRPV

SEQ ID NO: 33260 - protein, 25 aa, synthetic construct
  source 1..25: note = Seed: YGFLNVIVHSATGFKQSSKALQRPV
YGFLNVIVHSATGYKQTSVALARPV

SEQ ID NO: 33261 - protein, 25 aa, synthetic construct
  source 1..25: note = Seed: YGFLNVIVHSATGFKQSSKALQRPV
YGFLNVIVHSATGYKQTSVALGRPV

SEQ ID NO: 33262 - protein, 25 aa, synthetic construct
  source 1..25: note = Seed: YGFLNVIVHSATGFKQSSKALQRPV
YGFLNVIVHSATGYKQTSVALIRPV

SEQ ID NO: 33263 - protein, 25 aa, synthetic construct
  source 1..25: note = Seed: YGFLNVIVHSATGFKQSSKALQRPV
YGFLNVIVHSATGYKQTSVALLRPV

SEQ ID NO: 33264 - protein, 25 aa, synthetic construct
  source 1..25: note = Seed: YGFLNVIVHSATGFKQSSKALQRPV
YGFLNVIVHSATGYKQTSVALMRPV

SEQ ID NO: 33265 - protein, 25 aa, synthetic construct
  source 1..25: note = Seed: YGFLNVIVHSATGFKQSSKALQRPV
YGFLNVIVHSATGYKQTSVALNRPV

SEQ ID NO: 33266 - protein, 25 aa, synthetic construct
  source 1..25: note = Seed: YGFLNVIVHSATGFKQSSKALQRPV
YGFLNVIVHSATGYKQTSVALSRPV

SEQ ID NO: 33267 - protein, 25 aa, synthetic construct
  source 1..25: note = Seed: YGFLNVIVHSATGFKQSSKALQRPV
YGFLNVIVHSATGYKQTSVALTRPV

SEQ ID NO: 33268 - protein, 25 aa, synthetic construct
  source 1..25: note = Seed: YGFLNVIVHSATGFKQSSKALQRPV
YGFLNVIVHSATGYKQTSVALVRPV

SEQ ID NO: 33269 - protein, 25 aa, synthetic construct
  source 1..25: note = Seed: YGFLNVIVHSATGFKQSSKALQRPV
YGFLNVIVHSATGYKQVSAALARPV

SEQ ID NO: 33270 - protein, 25 aa, synthetic construct
  source 1..25: note = Seed: YGFLNVIVHSATGFKQSSKALQRPV
YGFLNVIVHSATGYKQVSAALCRPV

SEQ ID NO: 33271 - protein, 25 aa, synthetic construct
  source 1..25: note = Seed: YGFLNVIVHSATGFKQSSKALQRPV
YGFLNVIVHSATGYKQVSAALDRPV

SEQ ID NO: 33272 - protein, 25 aa, synthetic construct
  source 1..25: note = Seed: YGFLNVIVHSATGFKQSSKALQRPV
YGFLNVIVHSATGYKQVSAALERPV

SEQ ID NO: 33273 - protein, 25 aa, synthetic construct
  source 1..25: note = Seed: YGFLNVIVHSATGFKQSSKALQRPV
YGFLNVIVHSATGYKQVSAALFRPV

SEQ ID NO: 33274 - protein, 25 aa, synthetic construct
  source 1..25: note = Seed: YGFLNVIVHSATGFKQSSKALQRPV
YGFLNVIVHSATGYKQVSAALGRPV

SEQ ID NO: 33275 - protein, 25 aa, synthetic construct
  source 1..25: note = Seed: YGFLNVIVHSATGFKQSSKALQRPV
YGFLNVIVHSATGYKQVSAALHRPV

SEQ ID NO: 33276 - protein, 25 aa, synthetic construct
  source 1..25: note = Seed: YGFLNVIVHSATGFKQSSKALQRPV
YGFLNVIVHSATGYKQVSAALIRPV

SEQ ID NO: 33277 - protein, 25 aa, synthetic construct
  source 1..25: note = Seed: YGFLNVIVHSATGFKQSSKALQRPV
YGFLNVIVHSATGYKQVSAALLRPV

SEQ ID NO: 33278 - protein, 25 aa, synthetic construct
  source 1..25: note = Seed: YGFLNVIVHSATGFKQSSKALQRPV
YGFLNVIVHSATGYKQVSAALMRPV

SEQ ID NO: 33279 - protein, 25 aa, synthetic construct
  source 1..25: note = Seed: YGFLNVIVHSATGFKQSSKALQRPV
YGFLNVIVHSATGYKQVSAALNRPV

SEQ ID NO: 33280 - protein, 25 aa, synthetic construct
  source 1..25: note = Seed: YGFLNVIVHSATGFKQSSKALQRPV
YGFLNVIVHSATGYKQVSAALPRPV

SEQ ID NO: 33281 - protein, 25 aa, synthetic construct
  source 1..25: note = Seed: YGFLNVIVHSATGFKQSSKALQRPV
YGFLNVIVHSATGYKQVSAALQRPV

SEQ ID NO: 33282 - protein, 25 aa, synthetic construct
  source 1..25: note = Seed: YGFLNVIVHSATGFKQSSKALQRPV
YGFLNVIVHSATGYKQVSAALSRPV

SEQ ID NO: 33283 - protein, 25 aa, synthetic construct
  source 1..25: note = Seed: YGFLNVIVHSATGFKQSSKALQRPV
YGFLNVIVHSATGYKQVSAALTRPV

SEQ ID NO: 33284 - protein, 25 aa, synthetic construct
  source 1..25: note = Seed: YGFLNVIVHSATGFKQSSKALQRPV
YGFLNVIVHSATGYKQVSAALVRPV

SEQ ID NO: 33285 - protein, 25 aa, synthetic construct
  source 1..25: note = Seed: YGFLNVIVHSATGFKQSSKALQRPV
YGFLNVIVHSATGYKQVSAALYRPV

SEQ ID NO: 33286 - protein, 25 aa, synthetic construct
  source 1..25: note = Seed: YGFLNVIVHSATGFKQSSKALQRPV
YGFLNVIVHSATGYKQVSFALFRPV

SEQ ID NO: 33287 - protein, 25 aa, synthetic construct
  source 1..25: note = Seed: YGFLNVIVHSATGFKQSSKALQRPV
YGFLNVIVHSATGYKQVSFALIRPV

SEQ ID NO: 33288 - protein, 25 aa, synthetic construct
  source 1..25: note = Seed: YGFLNVIVHSATGFKQSSKALQRPV
YGFLNVIVHSATGYKQVSFALLRPV

SEQ ID NO: 33289 - protein, 25 aa, synthetic construct
  source 1..25: note = Seed: YGFLNVIVHSATGFKQSSKALQRPV
YGFLNVIVHSATGYKQVSFALMRPV

SEQ ID NO: 33290 - protein, 25 aa, synthetic construct
  source 1..25: note = Seed: YGFLNVIVHSATGFKQSSKALQRPV
YGFLNVIVHSATGYKQVSFALVRPV

SEQ ID NO: 33291 - protein, 25 aa, synthetic construct
  source 1..25: note = Seed: YGFLNVIVHSATGFKQSSKALQRPV
YGFLNVIVHSATGYKQVSFALYRPV

SEQ ID NO: 33292 - protein, 25 aa, synthetic construct
  source 1..25: note = Seed: YGFLNVIVHSATGFKQSSKALQRPV
YGFLNVIVHSATGYKQVSGALARPV

SEQ ID NO: 33293 - protein, 25 aa, synthetic construct
  source 1..25: note = Seed: YGFLNVIVHSATGFKQSSKALQRPV
YGFLNVIVHSATGYKQVSGALDRPV

SEQ ID NO: 33294 - protein, 25 aa, synthetic construct
  source 1..25: note = Seed: YGFLNVIVHSATGFKQSSKALQRPV
YGFLNVIVHSATGYKQVSGALGRPV

SEQ ID NO: 33295 - protein, 25 aa, synthetic construct
  source 1..25: note = Seed: YGFLNVIVHSATGFKQSSKALQRPV
YGFLNVIVHSATGYKQVSGALHRPV

SEQ ID NO: 33296 - protein, 25 aa, synthetic construct
  source 1..25: note = Seed: YGFLNVIVHSATGFKQSSKALQRPV
YGFLNVIVHSATGYKQVSGALIRPV

SEQ ID NO: 33297 - protein, 25 aa, synthetic construct
  source 1..25: note = Seed: YGFLNVIVHSATGFKQSSKALQRPV
YGFLNVIVHSATGYKQVSGALLRPV

SEQ ID NO: 33298 - protein, 25 aa, synthetic construct
  source 1..25: note = Seed: YGFLNVIVHSATGFKQSSKALQRPV
YGFLNVIVHSATGYKQVSGALMRPV

SEQ ID NO: 33299 - protein, 25 aa, synthetic construct
  source 1..25: note = Seed: YGFLNVIVHSATGFKQSSKALQRPV
YGFLNVIVHSATGYKQVSGALNRPV

SEQ ID NO: 33300 - protein, 25 aa, synthetic construct
  source 1..25: note = Seed: YGFLNVIVHSATGFKQSSKALQRPV
YGFLNVIVHSATGYKQVSGALQRPV

SEQ ID NO: 33301 - protein, 25 aa, synthetic construct
  source 1..25: note = Seed: YGFLNVIVHSATGFKQSSKALQRPV
YGFLNVIVHSATGYKQVSGALSRPV

SEQ ID NO: 33302 - protein, 25 aa, synthetic construct
  source 1..25: note = Seed: YGFLNVIVHSATGFKQSSKALQRPV
YGFLNVIVHSATGYKQVSGALTRPV

SEQ ID NO: 33303 - protein, 25 aa, synthetic construct
  source 1..25: note = Seed: YGFLNVIVHSATGFKQSSKALQRPV
YGFLNVIVHSATGYKQVSGALVRPV

SEQ ID NO: 33304 - protein, 25 aa, synthetic construct
  source 1..25: note = Seed: YGFLNVIVHSATGFKQSSKALQRPV
YGFLNVIVHSATGYKQVSHALARPV

SEQ ID NO: 33305 - protein, 25 aa, synthetic construct
  source 1..25: note = Seed: YGFLNVIVHSATGFKQSSKALQRPV
YGFLNVIVHSATGYKQVSIALARPV

SEQ ID NO: 33306 - protein, 25 aa, synthetic construct
  source 1..25: note = Seed: YGFLNVIVHSATGFKQSSKALQRPV
YGFLNVIVHSATGYKQVSIALDRPV

SEQ ID NO: 33307 - protein, 25 aa, synthetic construct
  source 1..25: note = Seed: YGFLNVIVHSATGFKQSSKALQRPV
YGFLNVIVHSATGYKQVSIALFRPV

SEQ ID NO: 33308 - protein, 25 aa, synthetic construct
  source 1..25: note = Seed: YGFLNVIVHSATGFKQSSKALQRPV
YGFLNVIVHSATGYKQVSIALGRPV

SEQ ID NO: 33309 - protein, 25 aa, synthetic construct
  source 1..25: note = Seed: YGFLNVIVHSATGFKQSSKALQRPV
YGFLNVIVHSATGYKQVSIALHRPV

SEQ ID NO: 33310 - protein, 25 aa, synthetic construct
  source 1..25: note = Seed: YGFLNVIVHSATGFKQSSKALQRPV
YGFLNVIVHSATGYKQVSIALIRPV

SEQ ID NO: 33311 - protein, 25 aa, synthetic construct
  source 1..25: note = Seed: YGFLNVIVHSATGFKQSSKALQRPV
YGFLNVIVHSATGYKQVSIALLRPV

SEQ ID NO: 33312 - protein, 25 aa, synthetic construct
  source 1..25: note = Seed: YGFLNVIVHSATGFKQSSKALQRPV
YGFLNVIVHSATGYKQVSIALMRPV

SEQ ID NO: 33313 - protein, 25 aa, synthetic construct
  source 1..25: note = Seed: YGFLNVIVHSATGFKQSSKALQRPV
YGFLNVIVHSATGYKQVSIALNRPV

SEQ ID NO: 33314 - protein, 25 aa, synthetic construct
  source 1..25: note = Seed: YGFLNVIVHSATGFKQSSKALQRPV
YGFLNVIVHSATGYKQVSIALPRPV

SEQ ID NO: 33315 - protein, 25 aa, synthetic construct
  source 1..25: note = Seed: YGFLNVIVHSATGFKQSSKALQRPV
YGFLNVIVHSATGYKQVSIALQRPV

SEQ ID NO: 33316 - protein, 25 aa, synthetic construct
  source 1..25: note = Seed: YGFLNVIVHSATGFKQSSKALQRPV
YGFLNVIVHSATGYKQVSIALSRPV

SEQ ID NO: 33317 - protein, 25 aa, synthetic construct
  source 1..25: note = Seed: YGFLNVIVHSATGFKQSSKALQRPV
YGFLNVIVHSATGYKQVSIALTRPV

SEQ ID NO: 33318 - protein, 25 aa, synthetic construct
  source 1..25: note = Seed: YGFLNVIVHSATGFKQSSKALQRPV
YGFLNVIVHSATGYKQVSIALVRPV

SEQ ID NO: 33319 - protein, 25 aa, synthetic construct
  source 1..25: note = Seed: YGFLNVIVHSATGFKQSSKALQRPV
YGFLNVIVHSATGYKQVSKALARPV

SEQ ID NO: 33320 - protein, 25 aa, synthetic construct
  source 1..25: note = Seed: YGFLNVIVHSATGFKQSSKALQRPV
YGFLNVIVHSATGYKQVSKALGRPV

SEQ ID NO: 33321 - protein, 25 aa, synthetic construct
  source 1..25: note = Seed: YGFLNVIVHSATGFKQSSKALQRPV
YGFLNVIVHSATGYKQVSKALHRPV

SEQ ID NO: 33322 - protein, 25 aa, synthetic construct
  source 1..25: note = Seed: YGFLNVIVHSATGFKQSSKALQRPV
YGFLNVIVHSATGYKQVSKALMRPV

SEQ ID NO: 33323 - protein, 25 aa, synthetic construct
  source 1..25: note = Seed: YGFLNVIVHSATGFKQSSKALQRPV
YGFLNVIVHSATGYKQVSKALNRPV

SEQ ID NO: 33324 - protein, 25 aa, synthetic construct
  source 1..25: note = Seed: YGFLNVIVHSATGFKQSSKALQRPV
YGFLNVIVHSATGYKQVSKALPRPV

SEQ ID NO: 33325 - protein, 25 aa, synthetic construct
  source 1..25: note = Seed: YGFLNVIVHSATGFKQSSKALQRPV
YGFLNVIVHSATGYKQVSKALQRPV

SEQ ID NO: 33326 - protein, 25 aa, synthetic construct
  source 1..25: note = Seed: YGFLNVIVHSATGFKQSSKALQRPV
YGFLNVIVHSATGYKQVSKALRRPV

SEQ ID NO: 33327 - protein, 25 aa, synthetic construct
  source 1..25: note = Seed: YGFLNVIVHSATGFKQSSKALQRPV
YGFLNVIVHSATGYKQVSKALSRPV

SEQ ID NO: 33328 - protein, 25 aa, synthetic construct
  source 1..25: note = Seed: YGFLNVIVHSATGFKQSSKALQRPV
YGFLNVIVHSATGYKQVSKALTRPV

SEQ ID NO: 33329 - protein, 25 aa, synthetic construct
  source 1..25: note = Seed: YGFLNVIVHSATGFKQSSKALQRPV
YGFLNVIVHSATGYKQVSKALVRPV

SEQ ID NO: 33330 - protein, 25 aa, synthetic construct
  source 1..25: note = Seed: YGFLNVIVHSATGFKQSSKALQRPV
YGFLNVIVHSATGYKQVSLALARPV

SEQ ID NO: 33331 - protein, 25 aa, synthetic construct
  source 1..25: note = Seed: YGFLNVIVHSATGFKQSSKALQRPV
YGFLNVIVHSATGYKQVSLALFRPV

SEQ ID NO: 33332 - protein, 25 aa, synthetic construct
  source 1..25: note = Seed: YGFLNVIVHSATGFKQSSKALQRPV
YGFLNVIVHSATGYKQVSLALNRPV

SEQ ID NO: 33333 - protein, 25 aa, synthetic construct
  source 1..25: note = Seed: YGFLNVIVHSATGFKQSSKALQRPV
YGFLNVIVHSATGYKQVSLALSRPV

SEQ ID NO: 33334 - protein, 25 aa, synthetic construct
  source 1..25: note = Seed: YGFLNVIVHSATGFKQSSKALQRPV
YGFLNVIVHSATGYKQVSLALTRPV

SEQ ID NO: 33335 - protein, 25 aa, synthetic construct
  source 1..25: note = Seed: YGFLNVIVHSATGFKQSSKALQRPV
YGFLNVIVHSATGYKQVSMALARPV

SEQ ID NO: 33336 - protein, 25 aa, synthetic construct
  source 1..25: note = Seed: YGFLNVIVHSATGFKQSSKALQRPV
YGFLNVIVHSATGYKQVSMALFRPV

SEQ ID NO: 33337 - protein, 25 aa, synthetic construct
  source 1..25: note = Seed: YGFLNVIVHSATGFKQSSKALQRPV
YGFLNVIVHSATGYKQVSMALHRPV

SEQ ID NO: 33338 - protein, 25 aa, synthetic construct
  source 1..25: note = Seed: YGFLNVIVHSATGFKQSSKALQRPV
YGFLNVIVHSATGYKQVSMALMRPV

SEQ ID NO: 33339 - protein, 25 aa, synthetic construct
  source 1..25: note = Seed: YGFLNVIVHSATGFKQSSKALQRPV
YGFLNVIVHSATGYKQVSMALNRPV

SEQ ID NO: 33340 - protein, 25 aa, synthetic construct
  source 1..25: note = Seed: YGFLNVIVHSATGFKQSSKALQRPV
YGFLNVIVHSATGYKQVSMALSRPV

SEQ ID NO: 33341 - protein, 25 aa, synthetic construct
  source 1..25: note = Seed: YGFLNVIVHSATGFKQSSKALQRPV
YGFLNVIVHSATGYKQVSMALTRPV

SEQ ID NO: 33342 - protein, 25 aa, synthetic construct
  source 1..25: note = Seed: YGFLNVIVHSATGFKQSSKALQRPV
YGFLNVIVHSATGYKQVSMALVRPV

SEQ ID NO: 33343 - protein, 25 aa, synthetic construct
  source 1..25: note = Seed: YGFLNVIVHSATGFKQSSKALQRPV
YGFLNVIVHSATGYKQVSNALARPV

SEQ ID NO: 33344 - protein, 25 aa, synthetic construct
  source 1..25: note = Seed: YGFLNVIVHSATGFKQSSKALQRPV
YGFLNVIVHSATGYKQVSNALGRPV

SEQ ID NO: 33345 - protein, 25 aa, synthetic construct
  source 1..25: note = Seed: YGFLNVIVHSATGFKQSSKALQRPV
YGFLNVIVHSATGYKQVSNALIRPV

SEQ ID NO: 33346 - protein, 25 aa, synthetic construct
  source 1..25: note = Seed: YGFLNVIVHSATGFKQSSKALQRPV
YGFLNVIVHSATGYKQVSNALLRPV

SEQ ID NO: 33347 - protein, 25 aa, synthetic construct
  source 1..25: note = Seed: YGFLNVIVHSATGFKQSSKALQRPV
YGFLNVIVHSATGYKQVSNALMRPV

SEQ ID NO: 33348 - protein, 25 aa, synthetic construct
  source 1..25: note = Seed: YGFLNVIVHSATGFKQSSKALQRPV
YGFLNVIVHSATGYKQVSNALNRPV

SEQ ID NO: 33349 - protein, 25 aa, synthetic construct
  source 1..25: note = Seed: YGFLNVIVHSATGFKQSSKALQRPV
YGFLNVIVHSATGYKQVSNALQRPV

SEQ ID NO: 33350 - protein, 25 aa, synthetic construct
  source 1..25: note = Seed: YGFLNVIVHSATGFKQSSKALQRPV
YGFLNVIVHSATGYKQVSNALSRPV

SEQ ID NO: 33351 - protein, 25 aa, synthetic construct
  source 1..25: note = Seed: YGFLNVIVHSATGFKQSSKALQRPV
YGFLNVIVHSATGYKQVSNALTRPV

SEQ ID NO: 33352 - protein, 25 aa, synthetic construct
  source 1..25: note = Seed: YGFLNVIVHSATGFKQSSKALQRPV
YGFLNVIVHSATGYKQVSNALVRPV

SEQ ID NO: 33353 - protein, 25 aa, synthetic construct
  source 1..25: note = Seed: YGFLNVIVHSATGFKQSSKALQRPV
YGFLNVIVHSATGYKQVSPALARPV

SEQ ID NO: 33354 - protein, 25 aa, synthetic construct
  source 1..25: note = Seed: YGFLNVIVHSATGFKQSSKALQRPV
YGFLNVIVHSATGYKQVSPALCRPV

SEQ ID NO: 33355 - protein, 25 aa, synthetic construct
  source 1..25: note = Seed: YGFLNVIVHSATGFKQSSKALQRPV
YGFLNVIVHSATGYKQVSPALDRPV

SEQ ID NO: 33356 - protein, 25 aa, synthetic construct
  source 1..25: note = Seed: YGFLNVIVHSATGFKQSSKALQRPV
YGFLNVIVHSATGYKQVSPALERPV

SEQ ID NO: 33357 - protein, 25 aa, synthetic construct
  source 1..25: note = Seed: YGFLNVIVHSATGFKQSSKALQRPV
YGFLNVIVHSATGYKQVSPALFRPV

SEQ ID NO: 33358 - protein, 25 aa, synthetic construct
  source 1..25: note = Seed: YGFLNVIVHSATGFKQSSKALQRPV
YGFLNVIVHSATGYKQVSPALGRPV

SEQ ID NO: 33359 - protein, 25 aa, synthetic construct
  source 1..25: note = Seed: YGFLNVIVHSATGFKQSSKALQRPV
YGFLNVIVHSATGYKQVSPALHRPV

SEQ ID NO: 33360 - protein, 25 aa, synthetic construct
  source 1..25: note = Seed: YGFLNVIVHSATGFKQSSKALQRPV
YGFLNVIVHSATGYKQVSPALIRPV

SEQ ID NO: 33361 - protein, 25 aa, synthetic construct
  source 1..25: note = Seed: YGFLNVIVHSATGFKQSSKALQRPV
YGFLNVIVHSATGYKQVSPALLRPV

SEQ ID NO: 33362 - protein, 25 aa, synthetic construct
  source 1..25: note = Seed: YGFLNVIVHSATGFKQSSKALQRPV
YGFLNVIVHSATGYKQVSPALMRPV

SEQ ID NO: 33363 - protein, 25 aa, synthetic construct
  source 1..25: note = Seed: YGFLNVIVHSATGFKQSSKALQRPV
YGFLNVIVHSATGYKQVSPALNRPV

SEQ ID NO: 33364 - protein, 25 aa, synthetic construct
  source 1..25: note = Seed: YGFLNVIVHSATGFKQSSKALQRPV
YGFLNVIVHSATGYKQVSPALPRPV

SEQ ID NO: 33365 - protein, 25 aa, synthetic construct
  source 1..25: note = Seed: YGFLNVIVHSATGFKQSSKALQRPV
YGFLNVIVHSATGYKQVSPALQRPV

SEQ ID NO: 33366 - protein, 25 aa, synthetic construct
  source 1..25: note = Seed: YGFLNVIVHSATGFKQSSKALQRPV
YGFLNVIVHSATGYKQVSPALSRPV

SEQ ID NO: 33367 - protein, 25 aa, synthetic construct
  source 1..25: note = Seed: YGFLNVIVHSATGFKQSSKALQRPV
YGFLNVIVHSATGYKQVSPALTRPV

SEQ ID NO: 33368 - protein, 25 aa, synthetic construct
  source 1..25: note = Seed: YGFLNVIVHSATGFKQSSKALQRPV
YGFLNVIVHSATGYKQVSPALVRPV

SEQ ID NO: 33369 - protein, 25 aa, synthetic construct
  source 1..25: note = Seed: YGFLNVIVHSATGFKQSSKALQRPV
YGFLNVIVHSATGYKQVSPALWRPV

SEQ ID NO: 33370 - protein, 25 aa, synthetic construct
  source 1..25: note = Seed: YGFLNVIVHSATGFKQSSKALQRPV
YGFLNVIVHSATGYKQVSPALYRPV

SEQ ID NO: 33371 - protein, 25 aa, synthetic construct
  source 1..25: note = Seed: YGFLNVIVHSATGFKQSSKALQRPV
YGFLNVIVHSATGYKQVSQALARPV

SEQ ID NO: 33372 - protein, 25 aa, synthetic construct
  source 1..25: note = Seed: YGFLNVIVHSATGFKQSSKALQRPV
YGFLNVIVHSATGYKQVSQALSRPV

SEQ ID NO: 33373 - protein, 25 aa, synthetic construct
  source 1..25: note = Seed: YGFLNVIVHSATGFKQSSKALQRPV
YGFLNVIVHSATGYKQVSRALARPV

SEQ ID NO: 33374 - protein, 25 aa, synthetic construct
  source 1..25: note = Seed: YGFLNVIVHSATGFKQSSKALQRPV
YGFLNVIVHSATGYKQVSRALGRPV

SEQ ID NO: 33375 - protein, 25 aa, synthetic construct
  source 1..25: note = Seed: YGFLNVIVHSATGFKQSSKALQRPV
YGFLNVIVHSATGYKQVSRALHRPV

SEQ ID NO: 33376 - protein, 25 aa, synthetic construct
  source 1..25: note = Seed: YGFLNVIVHSATGFKQSSKALQRPV
YGFLNVIVHSATGYKQVSRALIRPV

SEQ ID NO: 33377 - protein, 25 aa, synthetic construct
  source 1..25: note = Seed: YGFLNVIVHSATGFKQSSKALQRPV
YGFLNVIVHSATGYKQVSRALKRPV

SEQ ID NO: 33378 - protein, 25 aa, synthetic construct
  source 1..25: note = Seed: YGFLNVIVHSATGFKQSSKALQRPV
YGFLNVIVHSATGYKQVSRALLRPV

SEQ ID NO: 33379 - protein, 25 aa, synthetic construct
  source 1..25: note = Seed: YGFLNVIVHSATGFKQSSKALQRPV
YGFLNVIVHSATGYKQVSRALMRPV

SEQ ID NO: 33380 - protein, 25 aa, synthetic construct
  source 1..25: note = Seed: YGFLNVIVHSATGFKQSSKALQRPV
YGFLNVIVHSATGYKQVSRALNRPV

SEQ ID NO: 33381 - protein, 25 aa, synthetic construct
  source 1..25: note = Seed: YGFLNVIVHSATGFKQSSKALQRPV
YGFLNVIVHSATGYKQVSRALPRPV

SEQ ID NO: 33382 - protein, 25 aa, synthetic construct
  source 1..25: note = Seed: YGFLNVIVHSATGFKQSSKALQRPV
YGFLNVIVHSATGYKQVSRALQRPV

SEQ ID NO: 33383 - protein, 25 aa, synthetic construct
  source 1..25: note = Seed: YGFLNVIVHSATGFKQSSKALQRPV
YGFLNVIVHSATGYKQVSRALRRPV

SEQ ID NO: 33384 - protein, 25 aa, synthetic construct
  source 1..25: note = Seed: YGFLNVIVHSATGFKQSSKALQRPV
YGFLNVIVHSATGYKQVSRALSRPV

SEQ ID NO: 33385 - protein, 25 aa, synthetic construct
  source 1..25: note = Seed: YGFLNVIVHSATGFKQSSKALQRPV
YGFLNVIVHSATGYKQVSRALTRPV

SEQ ID NO: 33386 - protein, 25 aa, synthetic construct
  source 1..25: note = Seed: YGFLNVIVHSATGFKQSSKALQRPV
YGFLNVIVHSATGYKQVSRALVRPV

SEQ ID NO: 33387 - protein, 25 aa, synthetic construct
  source 1..25: note = Seed: YGFLNVIVHSATGFKQSSKALQRPV
YGFLNVIVHSATGYKQVSSALARPV

SEQ ID NO: 33388 - protein, 25 aa, synthetic construct
  source 1..25: note = Seed: YGFLNVIVHSATGFKQSSKALQRPV
YGFLNVIVHSATGYKQVSSALCRPV

SEQ ID NO: 33389 - protein, 25 aa, synthetic construct
  source 1..25: note = Seed: YGFLNVIVHSATGFKQSSKALQRPV
YGFLNVIVHSATGYKQVSSALDRPV

SEQ ID NO: 33390 - protein, 25 aa, synthetic construct
  source 1..25: note = Seed: YGFLNVIVHSATGFKQSSKALQRPV
YGFLNVIVHSATGYKQVSSALERPV

SEQ ID NO: 33391 - protein, 25 aa, synthetic construct
  source 1..25: note = Seed: YGFLNVIVHSATGFKQSSKALQRPV
YGFLNVIVHSATGYKQVSSALGRPV

SEQ ID NO: 33392 - protein, 25 aa, synthetic construct
  source 1..25: note = Seed: YGFLNVIVHSATGFKQSSKALQRPV
YGFLNVIVHSATGYKQVSSALHRPV

SEQ ID NO: 33393 - protein, 25 aa, synthetic construct
  source 1..25: note = Seed: YGFLNVIVHSATGFKQSSKALQRPV
YGFLNVIVHSATGYKQVSSALIRPV

SEQ ID NO: 33394 - protein, 25 aa, synthetic construct
  source 1..25: note = Seed: YGFLNVIVHSATGFKQSSKALQRPV
YGFLNVIVHSATGYKQVSSALLRPV

SEQ ID NO: 33395 - protein, 25 aa, synthetic construct
  source 1..25: note = Seed: YGFLNVIVHSATGFKQSSKALQRPV
YGFLNVIVHSATGYKQVSSALMRPV

SEQ ID NO: 33396 - protein, 25 aa, synthetic construct
  source 1..25: note = Seed: YGFLNVIVHSATGFKQSSKALQRPV
YGFLNVIVHSATGYKQVSSALNRPV

SEQ ID NO: 33397 - protein, 25 aa, synthetic construct
  source 1..25: note = Seed: YGFLNVIVHSATGFKQSSKALQRPV
YGFLNVIVHSATGYKQVSSALPRPV

SEQ ID NO: 33398 - protein, 25 aa, synthetic construct
  source 1..25: note = Seed: YGFLNVIVHSATGFKQSSKALQRPV
YGFLNVIVHSATGYKQVSSALQRPV

SEQ ID NO: 33399 - protein, 25 aa, synthetic construct
  source 1..25: note = Seed: YGFLNVIVHSATGFKQSSKALQRPV
YGFLNVIVHSATGYKQVSSALSRPV

SEQ ID NO: 33400 - protein, 25 aa, synthetic construct
  source 1..25: note = Seed: YGFLNVIVHSATGFKQSSKALQRPV
YGFLNVIVHSATGYKQVSSALTRPV

SEQ ID NO: 33401 - protein, 25 aa, synthetic construct
  source 1..25: note = Seed: YGFLNVIVHSATGFKQSSKALQRPV
YGFLNVIVHSATGYKQVSSALVRPV

SEQ ID NO: 33402 - protein, 25 aa, synthetic construct
  source 1..25: note = Seed: YGFLNVIVHSATGFKQSSKALQRPV
YGFLNVIVHSATGYKQVSTALARPV

SEQ ID NO: 33403 - protein, 25 aa, synthetic construct
  source 1..25: note = Seed: YGFLNVIVHSATGFKQSSKALQRPV
YGFLNVIVHSATGYKQVSTALCRPV

SEQ ID NO: 33404 - protein, 25 aa, synthetic construct
  source 1..25: note = Seed: YGFLNVIVHSATGFKQSSKALQRPV
YGFLNVIVHSATGYKQVSTALDRPV

SEQ ID NO: 33405 - protein, 25 aa, synthetic construct
  source 1..25: note = Seed: YGFLNVIVHSATGFKQSSKALQRPV
YGFLNVIVHSATGYKQVSTALERPV

SEQ ID NO: 33406 - protein, 25 aa, synthetic construct
  source 1..25: note = Seed: YGFLNVIVHSATGFKQSSKALQRPV
YGFLNVIVHSATGYKQVSTALGRPV

SEQ ID NO: 33407 - protein, 25 aa, synthetic construct
  source 1..25: note = Seed: YGFLNVIVHSATGFKQSSKALQRPV
YGFLNVIVHSATGYKQVSTALHRPV

SEQ ID NO: 33408 - protein, 25 aa, synthetic construct
  source 1..25: note = Seed: YGFLNVIVHSATGFKQSSKALQRPV
YGFLNVIVHSATGYKQVSTALIRPV

SEQ ID NO: 33409 - protein, 25 aa, synthetic construct
  source 1..25: note = Seed: YGFLNVIVHSATGFKQSSKALQRPV
YGFLNVIVHSATGYKQVSTALLRPV

SEQ ID NO: 33410 - protein, 25 aa, synthetic construct
  source 1..25: note = Seed: YGFLNVIVHSATGFKQSSKALQRPV
YGFLNVIVHSATGYKQVSTALMRPV

SEQ ID NO: 33411 - protein, 25 aa, synthetic construct
  source 1..25: note = Seed: YGFLNVIVHSATGFKQSSKALQRPV
YGFLNVIVHSATGYKQVSTALNRPV

SEQ ID NO: 33412 - protein, 25 aa, synthetic construct
  source 1..25: note = Seed: YGFLNVIVHSATGFKQSSKALQRPV
YGFLNVIVHSATGYKQVSTALPRPV

SEQ ID NO: 33413 - protein, 25 aa, synthetic construct
  source 1..25: note = Seed: YGFLNVIVHSATGFKQSSKALQRPV
YGFLNVIVHSATGYKQVSTALQRPV

SEQ ID NO: 33414 - protein, 25 aa, synthetic construct
  source 1..25: note = Seed: YGFLNVIVHSATGFKQSSKALQRPV
YGFLNVIVHSATGYKQVSTALSRPV

SEQ ID NO: 33415 - protein, 25 aa, synthetic construct
  source 1..25: note = Seed: YGFLNVIVHSATGFKQSSKALQRPV
YGFLNVIVHSATGYKQVSTALTRPV

SEQ ID NO: 33416 - protein, 25 aa, synthetic construct
  source 1..25: note = Seed: YGFLNVIVHSATGFKQSSKALQRPV
YGFLNVIVHSATGYKQVSTALVRPV

SEQ ID NO: 33417 - protein, 25 aa, synthetic construct
  source 1..25: note = Seed: YGFLNVIVHSATGFKQSSKALQRPV
YGFLNVIVHSATGYKQVSTALYRPV

SEQ ID NO: 33418 - protein, 25 aa, synthetic construct
  source 1..25: note = Seed: YGFLNVIVHSATGFKQSSKALQRPV
YGFLNVIVHSATGYKQVSVALARPV

SEQ ID NO: 33419 - protein, 25 aa, synthetic construct
  source 1..25: note = Seed: YGFLNVIVHSATGFKQSSKALQRPV
YGFLNVIVHSATGYKQVSVALDRPV

SEQ ID NO: 33420 - protein, 25 aa, synthetic construct
  source 1..25: note = Seed: YGFLNVIVHSATGFKQSSKALQRPV
YGFLNVIVHSATGYKQVSVALERPV

SEQ ID NO: 33421 - protein, 25 aa, synthetic construct
  source 1..25: note = Seed: YGFLNVIVHSATGFKQSSKALQRPV
YGFLNVIVHSATGYKQVSVALFRPV

SEQ ID NO: 33422 - protein, 25 aa, synthetic construct
  source 1..25: note = Seed: YGFLNVIVHSATGFKQSSKALQRPV
YGFLNVIVHSATGYKQVSVALGRPV

SEQ ID NO: 33423 - protein, 25 aa, synthetic construct
  source 1..25: note = Seed: YGFLNVIVHSATGFKQSSKALQRPV
YGFLNVIVHSATGYKQVSVALHRPV

SEQ ID NO: 33424 - protein, 25 aa, synthetic construct
  source 1..25: note = Seed: YGFLNVIVHSATGFKQSSKALQRPV
YGFLNVIVHSATGYKQVSVALIRPV

SEQ ID NO: 33425 - protein, 25 aa, synthetic construct
  source 1..25: note = Seed: YGFLNVIVHSATGFKQSSKALQRPV
YGFLNVIVHSATGYKQVSVALLRPV

SEQ ID NO: 33426 - protein, 25 aa, synthetic construct
  source 1..25: note = Seed: YGFLNVIVHSATGFKQSSKALQRPV
YGFLNVIVHSATGYKQVSVALMRPV

SEQ ID NO: 33427 - protein, 25 aa, synthetic construct
  source 1..25: note = Seed: YGFLNVIVHSATGFKQSSKALQRPV
YGFLNVIVHSATGYKQVSVALNRPV

SEQ ID NO: 33428 - protein, 25 aa, synthetic construct
  source 1..25: note = Seed: YGFLNVIVHSATGFKQSSKALQRPV
YGFLNVIVHSATGYKQVSVALPRPV

SEQ ID NO: 33429 - protein, 25 aa, synthetic construct
  source 1..25: note = Seed: YGFLNVIVHSATGFKQSSKALQRPV
YGFLNVIVHSATGYKQVSVALQRPV

SEQ ID NO: 33430 - protein, 25 aa, synthetic construct
  source 1..25: note = Seed: YGFLNVIVHSATGFKQSSKALQRPV
YGFLNVIVHSATGYKQVSVALSRPV

SEQ ID NO: 33431 - protein, 25 aa, synthetic construct
  source 1..25: note = Seed: YGFLNVIVHSATGFKQSSKALQRPV
YGFLNVIVHSATGYKQVSVALTRPV

SEQ ID NO: 33432 - protein, 25 aa, synthetic construct
  source 1..25: note = Seed: YGFLNVIVHSATGFKQSSKALQRPV
YGFLNVIVHSATGYKQVSVALVRPV

SEQ ID NO: 33433 - protein, 25 aa, synthetic construct
  source 1..25: note = Seed: YGFLNVIVHSATGFKQSSKALQRPV
YGFLNVIVHSATGYKQVSWALARPV

SEQ ID NO: 33434 - protein, 25 aa, synthetic construct
  source 1..25: note = Seed: YGFLNVIVHSATGFKQSSKALQRPV
YGFLNVIVHSATGYKQVSWALFRPV

SEQ ID NO: 33435 - protein, 25 aa, synthetic construct
  source 1..25: note = Seed: YGFLNVIVHSATGFKQSSKALQRPV
YGFLNVIVHSATGYKQVSYALARPV

SEQ ID NO: 33436 - protein, 25 aa, synthetic construct
  source 1..25: note = Seed: YGFLNVIVHSATGFKQSSKALQRPV
YGFLNVIVHSATGYKQVSYALFRPV

SEQ ID NO: 33437 - protein, 25 aa, synthetic construct
  source 1..25: note = Seed: YGFLNVIVHSATGFKQSSKALQRPV
YGFLNVIVHSATGYKQVSYALLRPV

SEQ ID NO: 33438 - protein, 25 aa, synthetic construct
  source 1..25: note = Seed: YGFLNVIVHSATGFKQSSKALQRPV
YGFLNVIVHSATGYKQVSYALYRPV

SEQ ID NO: 33439 - protein, 25 aa, synthetic construct
  source 1..25: note = Seed: YGFLNVIVHSATGFKQSSKALQRPV
YGFLNVIVHSATGYKQWSAALARPV

SEQ ID NO: 33440 - protein, 25 aa, synthetic construct
  source 1..25: note = Seed: YGFLNVIVHSATGFKQSSKALQRPV
YGFLNVIVHSATGYKQWSAALFRPV

SEQ ID NO: 33441 - protein, 25 aa, synthetic construct
  source 1..25: note = Seed: YGFLNVIVHSATGFKQSSKALQRPV
YGFLNVIVHSATGYKQWSAALGRPV

SEQ ID NO: 33442 - protein, 25 aa, synthetic construct
  source 1..25: note = Seed: YGFLNVIVHSATGFKQSSKALQRPV
YGFLNVIVHSATGYKQWSAALIRPV

SEQ ID NO: 33443 - protein, 25 aa, synthetic construct
  source 1..25: note = Seed: YGFLNVIVHSATGFKQSSKALQRPV
YGFLNVIVHSATGYKQWSAALLRPV

SEQ ID NO: 33444 - protein, 25 aa, synthetic construct
  source 1..25: note = Seed: YGFLNVIVHSATGFKQSSKALQRPV
YGFLNVIVHSATGYKQWSAALMRPV

SEQ ID NO: 33445 - protein, 25 aa, synthetic construct
  source 1..25: note = Seed: YGFLNVIVHSATGFKQSSKALQRPV
YGFLNVIVHSATGYKQWSAALNRPV

SEQ ID NO: 33446 - protein, 25 aa, synthetic construct
  source 1..25: note = Seed: YGFLNVIVHSATGFKQSSKALQRPV
YGFLNVIVHSATGYKQWSAALSRPV

SEQ ID NO: 33447 - protein, 25 aa, synthetic construct
  source 1..25: note = Seed: YGFLNVIVHSATGFKQSSKALQRPV
YGFLNVIVHSATGYKQWSAALTRPV

SEQ ID NO: 33448 - protein, 25 aa, synthetic construct
  source 1..25: note = Seed: YGFLNVIVHSATGFKQSSKALQRPV
YGFLNVIVHSATGYKQWSAALVRPV

SEQ ID NO: 33449 - protein, 25 aa, synthetic construct
  source 1..25: note = Seed: YGFLNVIVHSATGFKQSSKALQRPV
YGFLNVIVHSATGYKQWSFALARPV

SEQ ID NO: 33450 - protein, 25 aa, synthetic construct
  source 1..25: note = Seed: YGFLNVIVHSATGFKQSSKALQRPV
YGFLNVIVHSATGYKQWSFALFRPV

SEQ ID NO: 33451 - protein, 25 aa, synthetic construct
  source 1..25: note = Seed: YGFLNVIVHSATGFKQSSKALQRPV
YGFLNVIVHSATGYKQWSFALIRPV

SEQ ID NO: 33452 - protein, 25 aa, synthetic construct
  source 1..25: note = Seed: YGFLNVIVHSATGFKQSSKALQRPV
YGFLNVIVHSATGYKQWSFALLRPV

SEQ ID NO: 33453 - protein, 25 aa, synthetic construct
  source 1..25: note = Seed: YGFLNVIVHSATGFKQSSKALQRPV
YGFLNVIVHSATGYKQWSFALMRPV

SEQ ID NO: 33454 - protein, 25 aa, synthetic construct
  source 1..25: note = Seed: YGFLNVIVHSATGFKQSSKALQRPV
YGFLNVIVHSATGYKQWSFALYRPV

SEQ ID NO: 33455 - protein, 25 aa, synthetic construct
  source 1..25: note = Seed: YGFLNVIVHSATGFKQSSKALQRPV
YGFLNVIVHSATGYKQWSGALARPV

SEQ ID NO: 33456 - protein, 25 aa, synthetic construct
  source 1..25: note = Seed: YGFLNVIVHSATGFKQSSKALQRPV
YGFLNVIVHSATGYKQWSIALARPV

SEQ ID NO: 33457 - protein, 25 aa, synthetic construct
  source 1..25: note = Seed: YGFLNVIVHSATGFKQSSKALQRPV
YGFLNVIVHSATGYKQWSIALNRPV

SEQ ID NO: 33458 - protein, 25 aa, synthetic construct
  source 1..25: note = Seed: YGFLNVIVHSATGFKQSSKALQRPV
YGFLNVIVHSATGYKQWSIALSRPV

SEQ ID NO: 33459 - protein, 25 aa, synthetic construct
  source 1..25: note = Seed: YGFLNVIVHSATGFKQSSKALQRPV
YGFLNVIVHSATGYKQWSIALTRPV

SEQ ID NO: 33460 - protein, 25 aa, synthetic construct
  source 1..25: note = Seed: YGFLNVIVHSATGFKQSSKALQRPV
YGFLNVIVHSATGYKQWSIALVRPV

SEQ ID NO: 33461 - protein, 25 aa, synthetic construct
  source 1..25: note = Seed: YGFLNVIVHSATGFKQSSKALQRPV
YGFLNVIVHSATGYKQWSLALARPV

SEQ ID NO: 33462 - protein, 25 aa, synthetic construct
  source 1..25: note = Seed: YGFLNVIVHSATGFKQSSKALQRPV
YGFLNVIVHSATGYKQWSLALFRPV

SEQ ID NO: 33463 - protein, 25 aa, synthetic construct
  source 1..25: note = Seed: YGFLNVIVHSATGFKQSSKALQRPV
YGFLNVIVHSATGYKQWSLALSRPV

SEQ ID NO: 33464 - protein, 25 aa, synthetic construct
  source 1..25: note = Seed: YGFLNVIVHSATGFKQSSKALQRPV
YGFLNVIVHSATGYKQWSLALTRPV

SEQ ID NO: 33465 - protein, 25 aa, synthetic construct
  source 1..25: note = Seed: YGFLNVIVHSATGFKQSSKALQRPV
YGFLNVIVHSATGYKQWSLALVRPV

SEQ ID NO: 33466 - protein, 25 aa, synthetic construct
  source 1..25: note = Seed: YGFLNVIVHSATGFKQSSKALQRPV
YGFLNVIVHSATGYKQWSMALARPV

SEQ ID NO: 33467 - protein, 25 aa, synthetic construct
  source 1..25: note = Seed: YGFLNVIVHSATGFKQSSKALQRPV
YGFLNVIVHSATGYKQWSMALIRPV

SEQ ID NO: 33468 - protein, 25 aa, synthetic construct
  source 1..25: note = Seed: YGFLNVIVHSATGFKQSSKALQRPV
YGFLNVIVHSATGYKQWSMALNRPV

SEQ ID NO: 33469 - protein, 25 aa, synthetic construct
  source 1..25: note = Seed: YGFLNVIVHSATGFKQSSKALQRPV
YGFLNVIVHSATGYKQWSMALSRPV

SEQ ID NO: 33470 - protein, 25 aa, synthetic construct
  source 1..25: note = Seed: YGFLNVIVHSATGFKQSSKALQRPV
YGFLNVIVHSATGYKQWSMALTRPV

SEQ ID NO: 33471 - protein, 25 aa, synthetic construct
  source 1..25: note = Seed: YGFLNVIVHSATGFKQSSKALQRPV
YGFLNVIVHSATGYKQWSMALVRPV

SEQ ID NO: 33472 - protein, 25 aa, synthetic construct
  source 1..25: note = Seed: YGFLNVIVHSATGFKQSSKALQRPV
YGFLNVIVHSATGYKQWSPALARPV

SEQ ID NO: 33473 - protein, 25 aa, synthetic construct
  source 1..25: note = Seed: YGFLNVIVHSATGFKQSSKALQRPV
YGFLNVIVHSATGYKQWSPALNRPV

SEQ ID NO: 33474 - protein, 25 aa, synthetic construct
  source 1..25: note = Seed: YGFLNVIVHSATGFKQSSKALQRPV
YGFLNVIVHSATGYKQWSPALSRPV

SEQ ID NO: 33475 - protein, 25 aa, synthetic construct
  source 1..25: note = Seed: YGFLNVIVHSATGFKQSSKALQRPV
YGFLNVIVHSATGYKQWSPALVRPV

SEQ ID NO: 33476 - protein, 25 aa, synthetic construct
  source 1..25: note = Seed: YGFLNVIVHSATGFKQSSKALQRPV
YGFLNVIVHSATGYKQWSSALARPV

SEQ ID NO: 33477 - protein, 25 aa, synthetic construct
  source 1..25: note = Seed: YGFLNVIVHSATGFKQSSKALQRPV
YGFLNVIVHSATGYKQWSSALNRPV

SEQ ID NO: 33478 - protein, 25 aa, synthetic construct
  source 1..25: note = Seed: YGFLNVIVHSATGFKQSSKALQRPV
YGFLNVIVHSATGYKQWSSALSRPV

SEQ ID NO: 33479 - protein, 25 aa, synthetic construct
  source 1..25: note = Seed: YGFLNVIVHSATGFKQSSKALQRPV
YGFLNVIVHSATGYKQWSSALVRPV

SEQ ID NO: 33480 - protein, 25 aa, synthetic construct
  source 1..25: note = Seed: YGFLNVIVHSATGFKQSSKALQRPV
YGFLNVIVHSATGYKQWSTALARPV

SEQ ID NO: 33481 - protein, 25 aa, synthetic construct
  source 1..25: note = Seed: YGFLNVIVHSATGFKQSSKALQRPV
YGFLNVIVHSATGYKQWSTALNRPV

SEQ ID NO: 33482 - protein, 25 aa, synthetic construct
  source 1..25: note = Seed: YGFLNVIVHSATGFKQSSKALQRPV
YGFLNVIVHSATGYKQWSTALSRPV

SEQ ID NO: 33483 - protein, 25 aa, synthetic construct
  source 1..25: note = Seed: YGFLNVIVHSATGFKQSSKALQRPV
YGFLNVIVHSATGYKQWSTALTRPV

SEQ ID NO: 33484 - protein, 25 aa, synthetic construct
  source 1..25: note = Seed: YGFLNVIVHSATGFKQSSKALQRPV
YGFLNVIVHSATGYKQWSTALVRPV

SEQ ID NO: 33485 - protein, 25 aa, synthetic construct
  source 1..25: note = Seed: YGFLNVIVHSATGFKQSSKALQRPV
YGFLNVIVHSATGYKQWSVALARPV

SEQ ID NO: 33486 - protein, 25 aa, synthetic construct
  source 1..25: note = Seed: YGFLNVIVHSATGFKQSSKALQRPV
YGFLNVIVHSATGYKQWSVALNRPV

SEQ ID NO: 33487 - protein, 25 aa, synthetic construct
  source 1..25: note = Seed: YGFLNVIVHSATGFKQSSKALQRPV
YGFLNVIVHSATGYKQWSVALSRPV

SEQ ID NO: 33488 - protein, 25 aa, synthetic construct
  source 1..25: note = Seed: YGFLNVIVHSATGFKQSSKALQRPV
YGFLNVIVHSATGYKQWSVALTRPV

SEQ ID NO: 33489 - protein, 25 aa, synthetic construct
  source 1..25: note = Seed: YGFLNVIVHSATGFKQSSKALQRPV
YGFLNVIVHSATGYKQWSVALVRPV

SEQ ID NO: 33490 - protein, 25 aa, synthetic construct
  source 1..25: note = Seed: YGFLNVIVHSATGFKQSSKALQRPV
YGFLNVIVHSATGYKQWSWALFRPV

SEQ ID NO: 33491 - protein, 25 aa, synthetic construct
  source 1..25: note = Seed: YGFLNVIVHSATGFKQSSKALQRPV
YGFLNVIVHSATGYKQWSYALARPV

SEQ ID NO: 33492 - protein, 25 aa, synthetic construct
  source 1..25: note = Seed: YGFLNVIVHSATGFKQSSKALQRPV
YGFLNVIVHSATGYKQWSYALLRPV

SEQ ID NO: 33493 - protein, 25 aa, synthetic construct
  source 1..25: note = Seed: YGFLNVIVHSATGFKQSSKALQRPV
YGFLNVIVHSATGYKQWSYALYRPV

SEQ ID NO: 33494 - protein, 25 aa, synthetic construct
  source 1..25: note = Seed: YGFLNVIVHSATGFKQSSKALQRPV
YGFLNVIVHSATGYKQYSAALARPV

SEQ ID NO: 33495 - protein, 25 aa, synthetic construct
  source 1..25: note = Seed: YGFLNVIVHSATGFKQSSKALQRPV
YGFLNVIVHSATGYKQYSAALGRPV

SEQ ID NO: 33496 - protein, 25 aa, synthetic construct
  source 1..25: note = Seed: YGFLNVIVHSATGFKQSSKALQRPV
YGFLNVIVHSATGYKQYSAALIRPV

SEQ ID NO: 33497 - protein, 25 aa, synthetic construct
  source 1..25: note = Seed: YGFLNVIVHSATGFKQSSKALQRPV
YGFLNVIVHSATGYKQYSAALNRPV

SEQ ID NO: 33498 - protein, 25 aa, synthetic construct
  source 1..25: note = Seed: YGFLNVIVHSATGFKQSSKALQRPV
YGFLNVIVHSATGYKQYSAALPRPV

SEQ ID NO: 33499 - protein, 25 aa, synthetic construct
  source 1..25: note = Seed: YGFLNVIVHSATGFKQSSKALQRPV
YGFLNVIVHSATGYKQYSAALSRPV

SEQ ID NO: 33500 - protein, 25 aa, synthetic construct
  source 1..25: note = Seed: YGFLNVIVHSATGFKQSSKALQRPV
YGFLNVIVHSATGYKQYSAALTRPV

SEQ ID NO: 33501 - protein, 25 aa, synthetic construct
  source 1..25: note = Seed: YGFLNVIVHSATGFKQSSKALQRPV
YGFLNVIVHSATGYKQYSAALVRPV

SEQ ID NO: 33502 - protein, 25 aa, synthetic construct
  source 1..25: note = Seed: YGFLNVIVHSATGFKQSSKALQRPV
YGFLNVIVHSATGYKQYSFALFRPV

SEQ ID NO: 33503 - protein, 25 aa, synthetic construct
  source 1..25: note = Seed: YGFLNVIVHSATGFKQSSKALQRPV
YGFLNVIVHSATGYKQYSFALIRPV

SEQ ID NO: 33504 - protein, 25 aa, synthetic construct
  source 1..25: note = Seed: YGFLNVIVHSATGFKQSSKALQRPV
YGFLNVIVHSATGYKQYSFALLRPV

SEQ ID NO: 33505 - protein, 25 aa, synthetic construct
  source 1..25: note = Seed: YGFLNVIVHSATGFKQSSKALQRPV
YGFLNVIVHSATGYKQYSFALMRPV

SEQ ID NO: 33506 - protein, 25 aa, synthetic construct
  source 1..25: note = Seed: YGFLNVIVHSATGFKQSSKALQRPV
YGFLNVIVHSATGYKQYSFALSRPV

SEQ ID NO: 33507 - protein, 25 aa, synthetic construct
  source 1..25: note = Seed: YGFLNVIVHSATGFKQSSKALQRPV
YGFLNVIVHSATGYKQYSFALYRPV

SEQ ID NO: 33508 - protein, 25 aa, synthetic construct
  source 1..25: note = Seed: YGFLNVIVHSATGFKQSSKALQRPV
YGFLNVIVHSATGYKQYSGALARPV

SEQ ID NO: 33509 - protein, 25 aa, synthetic construct
  source 1..25: note = Seed: YGFLNVIVHSATGFKQSSKALQRPV
YGFLNVIVHSATGYKQYSHALARPV

SEQ ID NO: 33510 - protein, 25 aa, synthetic construct
  source 1..25: note = Seed: YGFLNVIVHSATGFKQSSKALQRPV
YGFLNVIVHSATGYKQYSIALARPV

SEQ ID NO: 33511 - protein, 25 aa, synthetic construct
  source 1..25: note = Seed: YGFLNVIVHSATGFKQSSKALQRPV
YGFLNVIVHSATGYKQYSIALGRPV

SEQ ID NO: 33512 - protein, 25 aa, synthetic construct
  source 1..25: note = Seed: YGFLNVIVHSATGFKQSSKALQRPV
YGFLNVIVHSATGYKQYSIALIRPV

SEQ ID NO: 33513 - protein, 25 aa, synthetic construct
  source 1..25: note = Seed: YGFLNVIVHSATGFKQSSKALQRPV
YGFLNVIVHSATGYKQYSIALNRPV

SEQ ID NO: 33514 - protein, 25 aa, synthetic construct
  source 1..25: note = Seed: YGFLNVIVHSATGFKQSSKALQRPV
YGFLNVIVHSATGYKQYSIALSRPV

SEQ ID NO: 33515 - protein, 25 aa, synthetic construct
  source 1..25: note = Seed: YGFLNVIVHSATGFKQSSKALQRPV
YGFLNVIVHSATGYKQYSIALTRPV

SEQ ID NO: 33516 - protein, 25 aa, synthetic construct
  source 1..25: note = Seed: YGFLNVIVHSATGFKQSSKALQRPV
YGFLNVIVHSATGYKQYSIALVRPV

SEQ ID NO: 33517 - protein, 25 aa, synthetic construct
  source 1..25: note = Seed: YGFLNVIVHSATGFKQSSKALQRPV
YGFLNVIVHSATGYKQYSLALARPV

SEQ ID NO: 33518 - protein, 25 aa, synthetic construct
  source 1..25: note = Seed: YGFLNVIVHSATGFKQSSKALQRPV
YGFLNVIVHSATGYKQYSLALGRPV

SEQ ID NO: 33519 - protein, 25 aa, synthetic construct
  source 1..25: note = Seed: YGFLNVIVHSATGFKQSSKALQRPV
YGFLNVIVHSATGYKQYSLALNRPV

SEQ ID NO: 33520 - protein, 25 aa, synthetic construct
  source 1..25: note = Seed: YGFLNVIVHSATGFKQSSKALQRPV
YGFLNVIVHSATGYKQYSLALSRPV

SEQ ID NO: 33521 - protein, 25 aa, synthetic construct
  source 1..25: note = Seed: YGFLNVIVHSATGFKQSSKALQRPV
YGFLNVIVHSATGYKQYSLALTRPV

SEQ ID NO: 33522 - protein, 25 aa, synthetic construct
  source 1..25: note = Seed: YGFLNVIVHSATGFKQSSKALQRPV
YGFLNVIVHSATGYKQYSLALVRPV

SEQ ID NO: 33523 - protein, 25 aa, synthetic construct
  source 1..25: note = Seed: YGFLNVIVHSATGFKQSSKALQRPV
YGFLNVIVHSATGYKQYSMALGRPV

SEQ ID NO: 33524 - protein, 25 aa, synthetic construct
  source 1..25: note = Seed: YGFLNVIVHSATGFKQSSKALQRPV
YGFLNVIVHSATGYKQYSMALNRPV

SEQ ID NO: 33525 - protein, 25 aa, synthetic construct
  source 1..25: note = Seed: YGFLNVIVHSATGFKQSSKALQRPV
YGFLNVIVHSATGYKQYSMALSRPV

SEQ ID NO: 33526 - protein, 25 aa, synthetic construct
  source 1..25: note = Seed: YGFLNVIVHSATGFKQSSKALQRPV
YGFLNVIVHSATGYKQYSPALARPV

SEQ ID NO: 33527 - protein, 25 aa, synthetic construct
  source 1..25: note = Seed: YGFLNVIVHSATGFKQSSKALQRPV
YGFLNVIVHSATGYKQYSPALSRPV

SEQ ID NO: 33528 - protein, 25 aa, synthetic construct
  source 1..25: note = Seed: YGFLNVIVHSATGFKQSSKALQRPV
YGFLNVIVHSATGYKQYSQALARPV

SEQ ID NO: 33529 - protein, 25 aa, synthetic construct
  source 1..25: note = Seed: YGFLNVIVHSATGFKQSSKALQRPV
YGFLNVIVHSATGYKQYSRALARPV

SEQ ID NO: 33530 - protein, 25 aa, synthetic construct
  source 1..25: note = Seed: YGFLNVIVHSATGFKQSSKALQRPV
YGFLNVIVHSATGYKQYSSALARPV

SEQ ID NO: 33531 - protein, 25 aa, synthetic construct
  source 1..25: note = Seed: YGFLNVIVHSATGFKQSSKALQRPV
YGFLNVIVHSATGYKQYSSALSRPV

SEQ ID NO: 33532 - protein, 25 aa, synthetic construct
  source 1..25: note = Seed: YGFLNVIVHSATGFKQSSKALQRPV
YGFLNVIVHSATGYKQYSSALTRPV

SEQ ID NO: 33533 - protein, 25 aa, synthetic construct
  source 1..25: note = Seed: YGFLNVIVHSATGFKQSSKALQRPV
YGFLNVIVHSATGYKQYSSALVRPV

SEQ ID NO: 33534 - protein, 25 aa, synthetic construct
  source 1..25: note = Seed: YGFLNVIVHSATGFKQSSKALQRPV
YGFLNVIVHSATGYKQYSTALARPV

SEQ ID NO: 33535 - protein, 25 aa, synthetic construct
  source 1..25: note = Seed: YGFLNVIVHSATGFKQSSKALQRPV
YGFLNVIVHSATGYKQYSTALSRPV

SEQ ID NO: 33536 - protein, 25 aa, synthetic construct
  source 1..25: note = Seed: YGFLNVIVHSATGFKQSSKALQRPV
YGFLNVIVHSATGYKQYSTALTRPV

SEQ ID NO: 33537 - protein, 25 aa, synthetic construct
  source 1..25: note = Seed: YGFLNVIVHSATGFKQSSKALQRPV
YGFLNVIVHSATGYKQYSVALARPV

SEQ ID NO: 33538 - protein, 25 aa, synthetic construct
  source 1..25: note = Seed: YGFLNVIVHSATGFKQSSKALQRPV
YGFLNVIVHSATGYKQYSVALGRPV

SEQ ID NO: 33539 - protein, 25 aa, synthetic construct
  source 1..25: note = Seed: YGFLNVIVHSATGFKQSSKALQRPV
YGFLNVIVHSATGYKQYSVALIRPV

SEQ ID NO: 33540 - protein, 25 aa, synthetic construct
  source 1..25: note = Seed: YGFLNVIVHSATGFKQSSKALQRPV
YGFLNVIVHSATGYKQYSVALNRPV

SEQ ID NO: 33541 - protein, 25 aa, synthetic construct
  source 1..25: note = Seed: YGFLNVIVHSATGFKQSSKALQRPV
YGFLNVIVHSATGYKQYSVALPRPV

SEQ ID NO: 33542 - protein, 25 aa, synthetic construct
  source 1..25: note = Seed: YGFLNVIVHSATGFKQSSKALQRPV
YGFLNVIVHSATGYKQYSVALSRPV

SEQ ID NO: 33543 - protein, 25 aa, synthetic construct
  source 1..25: note = Seed: YGFLNVIVHSATGFKQSSKALQRPV
YGFLNVIVHSATGYKQYSVALTRPV

SEQ ID NO: 33544 - protein, 25 aa, synthetic construct
  source 1..25: note = Seed: YGFLNVIVHSATGFKQSSKALQRPV
YGFLNVIVHSATGYKQYSVALVRPV

SEQ ID NO: 33545 - protein, 25 aa, synthetic construct
  source 1..25: note = Seed: YGFLNVIVHSATGFKQSSKALQRPV
YGFLNVIVHSATGYKQYSYALLRPV

SEQ ID NO: 33546 - protein, 25 aa, synthetic construct
  source 1..25: note = Seed: YGFLNVIVHSATGFKQSSKALQRPV
YGFLNVIVHSATGYKQYSYALSRPV

SEQ ID NO: 33547 - protein, 25 aa, synthetic construct
  source 1..25: note = Seed: YGFLNVIVHSATGFKQSSKALQRPV
YGFLNVIVHSATGYKQYSYALWRPV

SEQ ID NO: 33548 - protein, 25 aa, synthetic construct
  source 1..25: note = Seed: YGFLNVIVHSATGFKQSSKALQRPV
YGFLNVIVHSATGYKQYSYALYRPV

SEQ ID NO: 33549 - protein, 19 aa, synthetic construct
  source 1..19: note = Seed: LQTVHSIPLTINKEEALQR
LQTVHSIPCTIFKFEAIQR

SEQ ID NO: 33550 - protein, 19 aa, synthetic construct
  source 1..19: note = Seed: LQTVHSIPLTINKEEALQR
LQTVHSIPCTIFKFEALQR

SEQ ID NO: 33551 - protein, 19 aa, synthetic construct
  source 1..19: note = Seed: LQTVHSIPLTINKEEALQR
LQTVHSIPCTIFKFEAVQR

SEQ ID NO: 33552 - protein, 19 aa, synthetic construct
  source 1..19: note = Seed: LQTVHSIPLTINKEEALQR
LQTVHSIPCTIIKFEAIQR

SEQ ID NO: 33553 - protein, 19 aa, synthetic construct
  source 1..19: note = Seed: LQTVHSIPLTINKEEALQR
LQTVHSIPCTIIKFEALQR

SEQ ID NO: 33554 - protein, 19 aa, synthetic construct
  source 1..19: note = Seed: LQTVHSIPLTINKEEALQR
LQTVHSIPCTIIKFEAVQR

SEQ ID NO: 33555 - protein, 19 aa, synthetic construct
  source 1..19: note = Seed: LQTVHSIPLTINKEEALQR
LQTVHSIPCTILKFEAIQR

SEQ ID NO: 33556 - protein, 19 aa, synthetic construct
  source 1..19: note = Seed: LQTVHSIPLTINKEEALQR
LQTVHSIPCTILKFEALQR

SEQ ID NO: 33557 - protein, 19 aa, synthetic construct
  source 1..19: note = Seed: LQTVHSIPLTINKEEALQR
LQTVHSIPCTILKFEAVQR

SEQ ID NO: 33558 - protein, 19 aa, synthetic construct
  source 1..19: note = Seed: LQTVHSIPLTINKEEALQR
LQTVHSIPCTITKFEALQR

SEQ ID NO: 33559 - protein, 19 aa, synthetic construct
  source 1..19: note = Seed: LQTVHSIPLTINKEEALQR
LQTVHSIPCTIVKFEAIQR

SEQ ID NO: 33560 - protein, 19 aa, synthetic construct
  source 1..19: note = Seed: LQTVHSIPLTINKEEALQR
LQTVHSIPCTIVKFEALQR

SEQ ID NO: 33561 - protein, 19 aa, synthetic construct
  source 1..19: note = Seed: LQTVHSIPLTINKEEALQR
LQTVHSIPCTIVKFEAVQR

SEQ ID NO: 33562 - protein, 19 aa, synthetic construct
  source 1..19: note = Seed: LQTVHSIPLTINKEEALQR
LQTVHSIPFTIAKAEAAQR

SEQ ID NO: 33563 - protein, 19 aa, synthetic construct
  source 1..19: note = Seed: LQTVHSIPLTINKEEALQR
LQTVHSIPFTIAKAEACQR

SEQ ID NO: 33564 - protein, 19 aa, synthetic construct
  source 1..19: note = Seed: LQTVHSIPLTINKEEALQR
LQTVHSIPFTIAKAEAFQR

SEQ ID NO: 33565 - protein, 19 aa, synthetic construct
  source 1..19: note = Seed: LQTVHSIPLTINKEEALQR
LQTVHSIPFTIAKAEAGQR

SEQ ID NO: 33566 - protein, 19 aa, synthetic construct
  source 1..19: note = Seed: LQTVHSIPLTINKEEALQR
LQTVHSIPFTIAKAEAIQR

SEQ ID NO: 33567 - protein, 19 aa, synthetic construct
  source 1..19: note = Seed: LQTVHSIPLTINKEEALQR
LQTVHSIPFTIAKAEALQR

SEQ ID NO: 33568 - protein, 19 aa, synthetic construct
  source 1..19: note = Seed: LQTVHSIPLTINKEEALQR
LQTVHSIPFTIAKAEAMQR

SEQ ID NO: 33569 - protein, 19 aa, synthetic construct
  source 1..19: note = Seed: LQTVHSIPLTINKEEALQR
LQTVHSIPFTIAKAEANQR

SEQ ID NO: 33570 - protein, 19 aa, synthetic construct
  source 1..19: note = Seed: LQTVHSIPLTINKEEALQR
LQTVHSIPFTIAKAEASQR

SEQ ID NO: 33571 - protein, 19 aa, synthetic construct
  source 1..19: note = Seed: LQTVHSIPLTINKEEALQR
LQTVHSIPFTIAKAEATQR

SEQ ID NO: 33572 - protein, 19 aa, synthetic construct
  source 1..19: note = Seed: LQTVHSIPLTINKEEALQR
LQTVHSIPFTIAKAEAVQR

SEQ ID NO: 33573 - protein, 19 aa, synthetic construct
  source 1..19: note = Seed: LQTVHSIPLTINKEEALQR
LQTVHSIPFTIAKFEAAQR

SEQ ID NO: 33574 - protein, 19 aa, synthetic construct
  source 1..19: note = Seed: LQTVHSIPLTINKEEALQR
LQTVHSIPFTIAKFEACQR

SEQ ID NO: 33575 - protein, 19 aa, synthetic construct
  source 1..19: note = Seed: LQTVHSIPLTINKEEALQR
LQTVHSIPFTIAKFEADQR

SEQ ID NO: 33576 - protein, 19 aa, synthetic construct
  source 1..19: note = Seed: LQTVHSIPLTINKEEALQR
LQTVHSIPFTIAKFEAEQR

SEQ ID NO: 33577 - protein, 19 aa, synthetic construct
  source 1..19: note = Seed: LQTVHSIPLTINKEEALQR
LQTVHSIPFTIAKFEAFQR

SEQ ID NO: 33578 - protein, 19 aa, synthetic construct
  source 1..19: note = Seed: LQTVHSIPLTINKEEALQR
LQTVHSIPFTIAKFEAGQR

SEQ ID NO: 33579 - protein, 19 aa, synthetic construct
  source 1..19: note = Seed: LQTVHSIPLTINKEEALQR
LQTVHSIPFTIAKFEAHQR

SEQ ID NO: 33580 - protein, 19 aa, synthetic construct
  source 1..19: note = Seed: LQTVHSIPLTINKEEALQR
LQTVHSIPFTIAKFEAIQR

SEQ ID NO: 33581 - protein, 19 aa, synthetic construct
  source 1..19: note = Seed: LQTVHSIPLTINKEEALQR
LQTVHSIPFTIAKFEALQR

SEQ ID NO: 33582 - protein, 19 aa, synthetic construct
  source 1..19: note = Seed: LQTVHSIPLTINKEEALQR
LQTVHSIPFTIAKFEAMQR

SEQ ID NO: 33583 - protein, 19 aa, synthetic construct
  source 1..19: note = Seed: LQTVHSIPLTINKEEALQR
LQTVHSIPFTIAKFEANQR

SEQ ID NO: 33584 - protein, 19 aa, synthetic construct
  source 1..19: note = Seed: LQTVHSIPLTINKEEALQR
LQTVHSIPFTIAKFEAPQR

SEQ ID NO: 33585 - protein, 19 aa, synthetic construct
  source 1..19: note = Seed: LQTVHSIPLTINKEEALQR
LQTVHSIPFTIAKFEAQQR

SEQ ID NO: 33586 - protein, 19 aa, synthetic construct
  source 1..19: note = Seed: LQTVHSIPLTINKEEALQR
LQTVHSIPFTIAKFEARQR

SEQ ID NO: 33587 - protein, 19 aa, synthetic construct
  source 1..19: note = Seed: LQTVHSIPLTINKEEALQR
LQTVHSIPFTIAKFEASQR

SEQ ID NO: 33588 - protein, 19 aa, synthetic construct
  source 1..19: note = Seed: LQTVHSIPLTINKEEALQR
LQTVHSIPFTIAKFEATQR

SEQ ID NO: 33589 - protein, 19 aa, synthetic construct
  source 1..19: note = Seed: LQTVHSIPLTINKEEALQR
LQTVHSIPFTIAKFEAVQR

SEQ ID NO: 33590 - protein, 19 aa, synthetic construct
  source 1..19: note = Seed: LQTVHSIPLTINKEEALQR
LQTVHSIPFTIAKFEAWQR

SEQ ID NO: 33591 - protein, 19 aa, synthetic construct
  source 1..19: note = Seed: LQTVHSIPLTINKEEALQR
LQTVHSIPFTIAKFEAYQR

SEQ ID NO: 33592 - protein, 19 aa, synthetic construct
  source 1..19: note = Seed: LQTVHSIPLTINKEEALQR
LQTVHSIPFTIAKGEAAQR

SEQ ID NO: 33593 - protein, 19 aa, synthetic construct
  source 1..19: note = Seed: LQTVHSIPLTINKEEALQR
LQTVHSIPFTIAKGEAGQR

SEQ ID NO: 33594 - protein, 19 aa, synthetic construct
  source 1..19: note = Seed: LQTVHSIPLTINKEEALQR
LQTVHSIPFTIAKGEAIQR

SEQ ID NO: 33595 - protein, 19 aa, synthetic construct
  source 1..19: note = Seed: LQTVHSIPLTINKEEALQR
LQTVHSIPFTIAKGEALQR

SEQ ID NO: 33596 - protein, 19 aa, synthetic construct
  source 1..19: note = Seed: LQTVHSIPLTINKEEALQR
LQTVHSIPFTIAKGEAMQR

SEQ ID NO: 33597 - protein, 19 aa, synthetic construct
  source 1..19: note = Seed: LQTVHSIPLTINKEEALQR
LQTVHSIPFTIAKGEASQR

SEQ ID NO: 33598 - protein, 19 aa, synthetic construct
  source 1..19: note = Seed: LQTVHSIPLTINKEEALQR
LQTVHSIPFTIAKGEATQR

SEQ ID NO: 33599 - protein, 19 aa, synthetic construct
  source 1..19: note = Seed: LQTVHSIPLTINKEEALQR
LQTVHSIPFTIAKGEAVQR

SEQ ID NO: 33600 - protein, 19 aa, synthetic construct
  source 1..19: note = Seed: LQTVHSIPLTINKEEALQR
LQTVHSIPFTIAKIEAFQR

SEQ ID NO: 33601 - protein, 19 aa, synthetic construct
  source 1..19: note = Seed: LQTVHSIPLTINKEEALQR
LQTVHSIPFTIAKIEAIQR

SEQ ID NO: 33602 - protein, 19 aa, synthetic construct
  source 1..19: note = Seed: LQTVHSIPLTINKEEALQR
LQTVHSIPFTIAKIEALQR

SEQ ID NO: 33603 - protein, 19 aa, synthetic construct
  source 1..19: note = Seed: LQTVHSIPLTINKEEALQR
LQTVHSIPFTIAKIEAMQR

SEQ ID NO: 33604 - protein, 19 aa, synthetic construct
  source 1..19: note = Seed: LQTVHSIPLTINKEEALQR
LQTVHSIPFTIAKIEAVQR

SEQ ID NO: 33605 - protein, 19 aa, synthetic construct
  source 1..19: note = Seed: LQTVHSIPLTINKEEALQR
LQTVHSIPFTIAKLEAFQR

SEQ ID NO: 33606 - protein, 19 aa, synthetic construct
  source 1..19: note = Seed: LQTVHSIPLTINKEEALQR
LQTVHSIPFTIAKLEAIQR

SEQ ID NO: 33607 - protein, 19 aa, synthetic construct
  source 1..19: note = Seed: LQTVHSIPLTINKEEALQR
LQTVHSIPFTIAKLEALQR

SEQ ID NO: 33608 - protein, 19 aa, synthetic construct
  source 1..19: note = Seed: LQTVHSIPLTINKEEALQR
LQTVHSIPFTIAKLEAMQR

SEQ ID NO: 33609 - protein, 19 aa, synthetic construct
  source 1..19: note = Seed: LQTVHSIPLTINKEEALQR
LQTVHSIPFTIAKLEATQR

SEQ ID NO: 33610 - protein, 19 aa, synthetic construct
  source 1..19: note = Seed: LQTVHSIPLTINKEEALQR
LQTVHSIPFTIAKLEAVQR

SEQ ID NO: 33611 - protein, 19 aa, synthetic construct
  source 1..19: note = Seed: LQTVHSIPLTINKEEALQR
LQTVHSIPFTIAKLEAYQR

SEQ ID NO: 33612 - protein, 19 aa, synthetic construct
  source 1..19: note = Seed: LQTVHSIPLTINKEEALQR
LQTVHSIPFTIAKMEAFQR

SEQ ID NO: 33613 - protein, 19 aa, synthetic construct
  source 1..19: note = Seed: LQTVHSIPLTINKEEALQR
LQTVHSIPFTIAKMEAIQR

SEQ ID NO: 33614 - protein, 19 aa, synthetic construct
  source 1..19: note = Seed: LQTVHSIPLTINKEEALQR
LQTVHSIPFTIAKMEALQR

SEQ ID NO: 33615 - protein, 19 aa, synthetic construct
  source 1..19: note = Seed: LQTVHSIPLTINKEEALQR
LQTVHSIPFTIAKMEAVQR

SEQ ID NO: 33616 - protein, 19 aa, synthetic construct
  source 1..19: note = Seed: LQTVHSIPLTINKEEALQR
LQTVHSIPFTIAKNEAAQR

SEQ ID NO: 33617 - protein, 19 aa, synthetic construct
  source 1..19: note = Seed: LQTVHSIPLTINKEEALQR
LQTVHSIPFTIAKNEAIQR

SEQ ID NO: 33618 - protein, 19 aa, synthetic construct
  source 1..19: note = Seed: LQTVHSIPLTINKEEALQR
LQTVHSIPFTIAKNEALQR

SEQ ID NO: 33619 - protein, 19 aa, synthetic construct
  source 1..19: note = Seed: LQTVHSIPLTINKEEALQR
LQTVHSIPFTIAKNEAMQR

SEQ ID NO: 33620 - protein, 19 aa, synthetic construct
  source 1..19: note = Seed: LQTVHSIPLTINKEEALQR
LQTVHSIPFTIAKNEASQR

SEQ ID NO: 33621 - protein, 19 aa, synthetic construct
  source 1..19: note = Seed: LQTVHSIPLTINKEEALQR
LQTVHSIPFTIAKNEATQR

SEQ ID NO: 33622 - protein, 19 aa, synthetic construct
  source 1..19: note = Seed: LQTVHSIPLTINKEEALQR
LQTVHSIPFTIAKNEAVQR

SEQ ID NO: 33623 - protein, 19 aa, synthetic construct
  source 1..19: note = Seed: LQTVHSIPLTINKEEALQR
LQTVHSIPFTIAKPEAAQR

SEQ ID NO: 33624 - protein, 19 aa, synthetic construct
  source 1..19: note = Seed: LQTVHSIPLTINKEEALQR
LQTVHSIPFTIAKPEAIQR

SEQ ID NO: 33625 - protein, 19 aa, synthetic construct
  source 1..19: note = Seed: LQTVHSIPLTINKEEALQR
LQTVHSIPFTIAKPEALQR

SEQ ID NO: 33626 - protein, 19 aa, synthetic construct
  source 1..19: note = Seed: LQTVHSIPLTINKEEALQR
LQTVHSIPFTIAKPEAMQR

SEQ ID NO: 33627 - protein, 19 aa, synthetic construct
  source 1..19: note = Seed: LQTVHSIPLTINKEEALQR
LQTVHSIPFTIAKPEASQR

SEQ ID NO: 33628 - protein, 19 aa, synthetic construct
  source 1..19: note = Seed: LQTVHSIPLTINKEEALQR
LQTVHSIPFTIAKPEATQR

SEQ ID NO: 33629 - protein, 19 aa, synthetic construct
  source 1..19: note = Seed: LQTVHSIPLTINKEEALQR
LQTVHSIPFTIAKPEAVQR

SEQ ID NO: 33630 - protein, 19 aa, synthetic construct
  source 1..19: note = Seed: LQTVHSIPLTINKEEALQR
LQTVHSIPFTIAKSEAAQR

SEQ ID NO: 33631 - protein, 19 aa, synthetic construct
  source 1..19: note = Seed: LQTVHSIPLTINKEEALQR
LQTVHSIPFTIAKSEAFQR

SEQ ID NO: 33632 - protein, 19 aa, synthetic construct
  source 1..19: note = Seed: LQTVHSIPLTINKEEALQR
LQTVHSIPFTIAKSEAGQR

SEQ ID NO: 33633 - protein, 19 aa, synthetic construct
  source 1..19: note = Seed: LQTVHSIPLTINKEEALQR
LQTVHSIPFTIAKSEAIQR

SEQ ID NO: 33634 - protein, 19 aa, synthetic construct
  source 1..19: note = Seed: LQTVHSIPLTINKEEALQR
LQTVHSIPFTIAKSEALQR

SEQ ID NO: 33635 - protein, 19 aa, synthetic construct
  source 1..19: note = Seed: LQTVHSIPLTINKEEALQR
LQTVHSIPFTIAKSEAMQR

SEQ ID NO: 33636 - protein, 19 aa, synthetic construct
  source 1..19: note = Seed: LQTVHSIPLTINKEEALQR
LQTVHSIPFTIAKSEASQR

SEQ ID NO: 33637 - protein, 19 aa, synthetic construct
  source 1..19: note = Seed: LQTVHSIPLTINKEEALQR
LQTVHSIPFTIAKSEATQR

SEQ ID NO: 33638 - protein, 19 aa, synthetic construct
  source 1..19: note = Seed: LQTVHSIPLTINKEEALQR
LQTVHSIPFTIAKSEAVQR

SEQ ID NO: 33639 - protein, 19 aa, synthetic construct
  source 1..19: note = Seed: LQTVHSIPLTINKEEALQR
LQTVHSIPFTIAKTEAAQR

SEQ ID NO: 33640 - protein, 19 aa, synthetic construct
  source 1..19: note = Seed: LQTVHSIPLTINKEEALQR
LQTVHSIPFTIAKTEAIQR

SEQ ID NO: 33641 - protein, 19 aa, synthetic construct
  source 1..19: note = Seed: LQTVHSIPLTINKEEALQR
LQTVHSIPFTIAKTEALQR

SEQ ID NO: 33642 - protein, 19 aa, synthetic construct
  source 1..19: note = Seed: LQTVHSIPLTINKEEALQR
LQTVHSIPFTIAKTEAMQR

SEQ ID NO: 33643 - protein, 19 aa, synthetic construct
  source 1..19: note = Seed: LQTVHSIPLTINKEEALQR
LQTVHSIPFTIAKTEASQR

SEQ ID NO: 33644 - protein, 19 aa, synthetic construct
  source 1..19: note = Seed: LQTVHSIPLTINKEEALQR
LQTVHSIPFTIAKTEATQR

SEQ ID NO: 33645 - protein, 19 aa, synthetic construct
  source 1..19: note = Seed: LQTVHSIPLTINKEEALQR
LQTVHSIPFTIAKTEAVQR

SEQ ID NO: 33646 - protein, 19 aa, synthetic construct
  source 1..19: note = Seed: LQTVHSIPLTINKEEALQR
LQTVHSIPFTIAKVEAAQR

SEQ ID NO: 33647 - protein, 19 aa, synthetic construct
  source 1..19: note = Seed: LQTVHSIPLTINKEEALQR
LQTVHSIPFTIAKVEAIQR

SEQ ID NO: 33648 - protein, 19 aa, synthetic construct
  source 1..19: note = Seed: LQTVHSIPLTINKEEALQR
LQTVHSIPFTIAKVEALQR

SEQ ID NO: 33649 - protein, 19 aa, synthetic construct
  source 1..19: note = Seed: LQTVHSIPLTINKEEALQR
LQTVHSIPFTIAKVEAMQR

SEQ ID NO: 33650 - protein, 19 aa, synthetic construct
  source 1..19: note = Seed: LQTVHSIPLTINKEEALQR
LQTVHSIPFTIAKVEAVQR

SEQ ID NO: 33651 - protein, 19 aa, synthetic construct
  source 1..19: note = Seed: LQTVHSIPLTINKEEALQR
LQTVHSIPFTIAKWEADQR

SEQ ID NO: 33652 - protein, 19 aa, synthetic construct
  source 1..19: note = Seed: LQTVHSIPLTINKEEALQR
LQTVHSIPFTIAKWEAFQR

SEQ ID NO: 33653 - protein, 19 aa, synthetic construct
  source 1..19: note = Seed: LQTVHSIPLTINKEEALQR
LQTVHSIPFTIAKWEAIQR

SEQ ID NO: 33654 - protein, 19 aa, synthetic construct
  source 1..19: note = Seed: LQTVHSIPLTINKEEALQR
LQTVHSIPFTIAKWEALQR

SEQ ID NO: 33655 - protein, 19 aa, synthetic construct
  source 1..19: note = Seed: LQTVHSIPLTINKEEALQR
LQTVHSIPFTIAKWEAMQR

SEQ ID NO: 33656 - protein, 19 aa, synthetic construct
  source 1..19: note = Seed: LQTVHSIPLTINKEEALQR
LQTVHSIPFTIAKWEAVQR

SEQ ID NO: 33657 - protein, 19 aa, synthetic construct
  source 1..19: note = Seed: LQTVHSIPLTINKEEALQR
LQTVHSIPFTIAKWEAYQR

SEQ ID NO: 33658 - protein, 19 aa, synthetic construct
  source 1..19: note = Seed: LQTVHSIPLTINKEEALQR
LQTVHSIPFTIAKYEAAQR

SEQ ID NO: 33659 - protein, 19 aa, synthetic construct
  source 1..19: note = Seed: LQTVHSIPLTINKEEALQR
LQTVHSIPFTIAKYEADQR

SEQ ID NO: 33660 - protein, 19 aa, synthetic construct
  source 1..19: note = Seed: LQTVHSIPLTINKEEALQR
LQTVHSIPFTIAKYEAFQR

SEQ ID NO: 33661 - protein, 19 aa, synthetic construct
  source 1..19: note = Seed: LQTVHSIPLTINKEEALQR
LQTVHSIPFTIAKYEAIQR

SEQ ID NO: 33662 - protein, 19 aa, synthetic construct
  source 1..19: note = Seed: LQTVHSIPLTINKEEALQR
LQTVHSIPFTIAKYEALQR

SEQ ID NO: 33663 - protein, 19 aa, synthetic construct
  source 1..19: note = Seed: LQTVHSIPLTINKEEALQR
LQTVHSIPFTIAKYEAMQR

SEQ ID NO: 33664 - protein, 19 aa, synthetic construct
  source 1..19: note = Seed: LQTVHSIPLTINKEEALQR
LQTVHSIPFTIAKYEANQR

SEQ ID NO: 33665 - protein, 19 aa, synthetic construct
  source 1..19: note = Seed: LQTVHSIPLTINKEEALQR
LQTVHSIPFTIAKYEASQR

SEQ ID NO: 33666 - protein, 19 aa, synthetic construct
  source 1..19: note = Seed: LQTVHSIPLTINKEEALQR
LQTVHSIPFTIAKYEATQR

SEQ ID NO: 33667 - protein, 19 aa, synthetic construct
  source 1..19: note = Seed: LQTVHSIPLTINKEEALQR
LQTVHSIPFTIAKYEAVQR

SEQ ID NO: 33668 - protein, 19 aa, synthetic construct
  source 1..19: note = Seed: LQTVHSIPLTINKEEALQR
LQTVHSIPFTIAKYEAYQR

SEQ ID NO: 33669 - protein, 19 aa, synthetic construct
  source 1..19: note = Seed: LQTVHSIPLTINKEEALQR
LQTVHSIPFTICKAEAIQR

SEQ ID NO: 33670 - protein, 19 aa, synthetic construct
  source 1..19: note = Seed: LQTVHSIPLTINKEEALQR
LQTVHSIPFTICKAEALQR

SEQ ID NO: 33671 - protein, 19 aa, synthetic construct
  source 1..19: note = Seed: LQTVHSIPLTINKEEALQR
LQTVHSIPFTICKAEAVQR

SEQ ID NO: 33672 - protein, 19 aa, synthetic construct
  source 1..19: note = Seed: LQTVHSIPLTINKEEALQR
LQTVHSIPFTICKFEAAQR

SEQ ID NO: 33673 - protein, 19 aa, synthetic construct
  source 1..19: note = Seed: LQTVHSIPLTINKEEALQR
LQTVHSIPFTICKFEAEQR

SEQ ID NO: 33674 - protein, 19 aa, synthetic construct
  source 1..19: note = Seed: LQTVHSIPLTINKEEALQR
LQTVHSIPFTICKFEAFQR

SEQ ID NO: 33675 - protein, 19 aa, synthetic construct
  source 1..19: note = Seed: LQTVHSIPLTINKEEALQR
LQTVHSIPFTICKFEAIQR

SEQ ID NO: 33676 - protein, 19 aa, synthetic construct
  source 1..19: note = Seed: LQTVHSIPLTINKEEALQR
LQTVHSIPFTICKFEALQR

SEQ ID NO: 33677 - protein, 19 aa, synthetic construct
  source 1..19: note = Seed: LQTVHSIPLTINKEEALQR
LQTVHSIPFTICKFEAMQR

SEQ ID NO: 33678 - protein, 19 aa, synthetic construct
  source 1..19: note = Seed: LQTVHSIPLTINKEEALQR
LQTVHSIPFTICKFEANQR

SEQ ID NO: 33679 - protein, 19 aa, synthetic construct
  source 1..19: note = Seed: LQTVHSIPLTINKEEALQR
LQTVHSIPFTICKFEASQR

SEQ ID NO: 33680 - protein, 19 aa, synthetic construct
  source 1..19: note = Seed: LQTVHSIPLTINKEEALQR
LQTVHSIPFTICKFEATQR

SEQ ID NO: 33681 - protein, 19 aa, synthetic construct
  source 1..19: note = Seed: LQTVHSIPLTINKEEALQR
LQTVHSIPFTICKFEAVQR

SEQ ID NO: 33682 - protein, 19 aa, synthetic construct
  source 1..19: note = Seed: LQTVHSIPLTINKEEALQR
LQTVHSIPFTICKFEAYQR

SEQ ID NO: 33683 - protein, 19 aa, synthetic construct
  source 1..19: note = Seed: LQTVHSIPLTINKEEALQR
LQTVHSIPFTICKGEALQR

SEQ ID NO: 33684 - protein, 19 aa, synthetic construct
  source 1..19: note = Seed: LQTVHSIPLTINKEEALQR
LQTVHSIPFTICKYEAIQR

SEQ ID NO: 33685 - protein, 19 aa, synthetic construct
  source 1..19: note = Seed: LQTVHSIPLTINKEEALQR
LQTVHSIPFTICKYEALQR

SEQ ID NO: 33686 - protein, 19 aa, synthetic construct
  source 1..19: note = Seed: LQTVHSIPLTINKEEALQR
LQTVHSIPFTICKYEAVQR

SEQ ID NO: 33687 - protein, 19 aa, synthetic construct
  source 1..19: note = Seed: LQTVHSIPLTINKEEALQR
LQTVHSIPFTIDKFEAAQR

SEQ ID NO: 33688 - protein, 19 aa, synthetic construct
  source 1..19: note = Seed: LQTVHSIPLTINKEEALQR
LQTVHSIPFTIDKFEADQR

SEQ ID NO: 33689 - protein, 19 aa, synthetic construct
  source 1..19: note = Seed: LQTVHSIPLTINKEEALQR
LQTVHSIPFTIDKFEAEQR

SEQ ID NO: 33690 - protein, 19 aa, synthetic construct
  source 1..19: note = Seed: LQTVHSIPLTINKEEALQR
LQTVHSIPFTIDKFEAFQR

SEQ ID NO: 33691 - protein, 19 aa, synthetic construct
  source 1..19: note = Seed: LQTVHSIPLTINKEEALQR
LQTVHSIPFTIDKFEAIQR

SEQ ID NO: 33692 - protein, 19 aa, synthetic construct
  source 1..19: note = Seed: LQTVHSIPLTINKEEALQR
LQTVHSIPFTIDKFEALQR

SEQ ID NO: 33693 - protein, 19 aa, synthetic construct
  source 1..19: note = Seed: LQTVHSIPLTINKEEALQR
LQTVHSIPFTIDKFEAMQR

SEQ ID NO: 33694 - protein, 19 aa, synthetic construct
  source 1..19: note = Seed: LQTVHSIPLTINKEEALQR
LQTVHSIPFTIDKFEANQR

SEQ ID NO: 33695 - protein, 19 aa, synthetic construct
  source 1..19: note = Seed: LQTVHSIPLTINKEEALQR
LQTVHSIPFTIDKFEASQR

SEQ ID NO: 33696 - protein, 19 aa, synthetic construct
  source 1..19: note = Seed: LQTVHSIPLTINKEEALQR
LQTVHSIPFTIDKFEATQR

SEQ ID NO: 33697 - protein, 19 aa, synthetic construct
  source 1..19: note = Seed: LQTVHSIPLTINKEEALQR
LQTVHSIPFTIDKFEAVQR

SEQ ID NO: 33698 - protein, 19 aa, synthetic construct
  source 1..19: note = Seed: LQTVHSIPLTINKEEALQR
LQTVHSIPFTIDKFEAWQR

SEQ ID NO: 33699 - protein, 19 aa, synthetic construct
  source 1..19: note = Seed: LQTVHSIPLTINKEEALQR
LQTVHSIPFTIDKFEAYQR

SEQ ID NO: 33700 - protein, 19 aa, synthetic construct
  source 1..19: note = Seed: LQTVHSIPLTINKEEALQR
LQTVHSIPFTIDKIEAFQR

SEQ ID NO: 33701 - protein, 19 aa, synthetic construct
  source 1..19: note = Seed: LQTVHSIPLTINKEEALQR
LQTVHSIPFTIDKIEAIQR

SEQ ID NO: 33702 - protein, 19 aa, synthetic construct
  source 1..19: note = Seed: LQTVHSIPLTINKEEALQR
LQTVHSIPFTIDKIEALQR

SEQ ID NO: 33703 - protein, 19 aa, synthetic construct
  source 1..19: note = Seed: LQTVHSIPLTINKEEALQR
LQTVHSIPFTIDKLEAFQR

SEQ ID NO: 33704 - protein, 19 aa, synthetic construct
  source 1..19: note = Seed: LQTVHSIPLTINKEEALQR
LQTVHSIPFTIDKLEAIQR

SEQ ID NO: 33705 - protein, 19 aa, synthetic construct
  source 1..19: note = Seed: LQTVHSIPLTINKEEALQR
LQTVHSIPFTIDKLEALQR

SEQ ID NO: 33706 - protein, 19 aa, synthetic construct
  source 1..19: note = Seed: LQTVHSIPLTINKEEALQR
LQTVHSIPFTIDKLEAVQR

SEQ ID NO: 33707 - protein, 19 aa, synthetic construct
  source 1..19: note = Seed: LQTVHSIPLTINKEEALQR
LQTVHSIPFTIDKMEALQR

SEQ ID NO: 33708 - protein, 19 aa, synthetic construct
  source 1..19: note = Seed: LQTVHSIPLTINKEEALQR
LQTVHSIPFTIDKWEAIQR

SEQ ID NO: 33709 - protein, 19 aa, synthetic construct
  source 1..19: note = Seed: LQTVHSIPLTINKEEALQR
LQTVHSIPFTIDKWEALQR

SEQ ID NO: 33710 - protein, 19 aa, synthetic construct
  source 1..19: note = Seed: LQTVHSIPLTINKEEALQR
LQTVHSIPFTIDKWEAVQR

SEQ ID NO: 33711 - protein, 19 aa, synthetic construct
  source 1..19: note = Seed: LQTVHSIPLTINKEEALQR
LQTVHSIPFTIDKYEAFQR

SEQ ID NO: 33712 - protein, 19 aa, synthetic construct
  source 1..19: note = Seed: LQTVHSIPLTINKEEALQR
LQTVHSIPFTIDKYEAIQR

SEQ ID NO: 33713 - protein, 19 aa, synthetic construct
  source 1..19: note = Seed: LQTVHSIPLTINKEEALQR
LQTVHSIPFTIDKYEALQR

SEQ ID NO: 33714 - protein, 19 aa, synthetic construct
  source 1..19: note = Seed: LQTVHSIPLTINKEEALQR
LQTVHSIPFTIDKYEAVQR

SEQ ID NO: 33715 - protein, 19 aa, synthetic construct
  source 1..19: note = Seed: LQTVHSIPLTINKEEALQR
LQTVHSIPFTIEKAEAAQR

SEQ ID NO: 33716 - protein, 19 aa, synthetic construct
  source 1..19: note = Seed: LQTVHSIPLTINKEEALQR
LQTVHSIPFTIEKAEAIQR

SEQ ID NO: 33717 - protein, 19 aa, synthetic construct
  source 1..19: note = Seed: LQTVHSIPLTINKEEALQR
LQTVHSIPFTIEKAEALQR

SEQ ID NO: 33718 - protein, 19 aa, synthetic construct
  source 1..19: note = Seed: LQTVHSIPLTINKEEALQR
LQTVHSIPFTIEKAEAVQR

SEQ ID NO: 33719 - protein, 19 aa, synthetic construct
  source 1..19: note = Seed: LQTVHSIPLTINKEEALQR
LQTVHSIPFTIEKFEAAQR

SEQ ID NO: 33720 - protein, 19 aa, synthetic construct
  source 1..19: note = Seed: LQTVHSIPLTINKEEALQR
LQTVHSIPFTIEKFEACQR

SEQ ID NO: 33721 - protein, 19 aa, synthetic construct
  source 1..19: note = Seed: LQTVHSIPLTINKEEALQR
LQTVHSIPFTIEKFEADQR

SEQ ID NO: 33722 - protein, 19 aa, synthetic construct
  source 1..19: note = Seed: LQTVHSIPLTINKEEALQR
LQTVHSIPFTIEKFEAEQR

SEQ ID NO: 33723 - protein, 19 aa, synthetic construct
  source 1..19: note = Seed: LQTVHSIPLTINKEEALQR
LQTVHSIPFTIEKFEAFQR

SEQ ID NO: 33724 - protein, 19 aa, synthetic construct
  source 1..19: note = Seed: LQTVHSIPLTINKEEALQR
LQTVHSIPFTIEKFEAGQR

SEQ ID NO: 33725 - protein, 19 aa, synthetic construct
  source 1..19: note = Seed: LQTVHSIPLTINKEEALQR
LQTVHSIPFTIEKFEAHQR

SEQ ID NO: 33726 - protein, 19 aa, synthetic construct
  source 1..19: note = Seed: LQTVHSIPLTINKEEALQR
LQTVHSIPFTIEKFEAIQR

SEQ ID NO: 33727 - protein, 19 aa, synthetic construct
  source 1..19: note = Seed: LQTVHSIPLTINKEEALQR
LQTVHSIPFTIEKFEAKQR

SEQ ID NO: 33728 - protein, 19 aa, synthetic construct
  source 1..19: note = Seed: LQTVHSIPLTINKEEALQR
LQTVHSIPFTIEKFEALQR

SEQ ID NO: 33729 - protein, 19 aa, synthetic construct
  source 1..19: note = Seed: LQTVHSIPLTINKEEALQR
LQTVHSIPFTIEKFEAMQR

SEQ ID NO: 33730 - protein, 19 aa, synthetic construct
  source 1..19: note = Seed: LQTVHSIPLTINKEEALQR
LQTVHSIPFTIEKFEANQR

SEQ ID NO: 33731 - protein, 19 aa, synthetic construct
  source 1..19: note = Seed: LQTVHSIPLTINKEEALQR
LQTVHSIPFTIEKFEAPQR

SEQ ID NO: 33732 - protein, 19 aa, synthetic construct
  source 1..19: note = Seed: LQTVHSIPLTINKEEALQR
LQTVHSIPFTIEKFEAQQR

SEQ ID NO: 33733 - protein, 19 aa, synthetic construct
  source 1..19: note = Seed: LQTVHSIPLTINKEEALQR
LQTVHSIPFTIEKFEARQR

SEQ ID NO: 33734 - protein, 19 aa, synthetic construct
  source 1..19: note = Seed: LQTVHSIPLTINKEEALQR
LQTVHSIPFTIEKFEASQR

SEQ ID NO: 33735 - protein, 19 aa, synthetic construct
  source 1..19: note = Seed: LQTVHSIPLTINKEEALQR
LQTVHSIPFTIEKFEATQR

SEQ ID NO: 33736 - protein, 19 aa, synthetic construct
  source 1..19: note = Seed: LQTVHSIPLTINKEEALQR
LQTVHSIPFTIEKFEAVQR

SEQ ID NO: 33737 - protein, 19 aa, synthetic construct
  source 1..19: note = Seed: LQTVHSIPLTINKEEALQR
LQTVHSIPFTIEKFEAWQR

SEQ ID NO: 33738 - protein, 19 aa, synthetic construct
  source 1..19: note = Seed: LQTVHSIPLTINKEEALQR
LQTVHSIPFTIEKFEAYQR

SEQ ID NO: 33739 - protein, 19 aa, synthetic construct
  source 1..19: note = Seed: LQTVHSIPLTINKEEALQR
LQTVHSIPFTIEKGEAAQR

SEQ ID NO: 33740 - protein, 19 aa, synthetic construct
  source 1..19: note = Seed: LQTVHSIPLTINKEEALQR
LQTVHSIPFTIEKGEAIQR

SEQ ID NO: 33741 - protein, 19 aa, synthetic construct
  source 1..19: note = Seed: LQTVHSIPLTINKEEALQR
LQTVHSIPFTIEKGEALQR

SEQ ID NO: 33742 - protein, 19 aa, synthetic construct
  source 1..19: note = Seed: LQTVHSIPLTINKEEALQR
LQTVHSIPFTIEKGEAVQR

SEQ ID NO: 33743 - protein, 19 aa, synthetic construct
  source 1..19: note = Seed: LQTVHSIPLTINKEEALQR
LQTVHSIPFTIEKIEAFQR

SEQ ID NO: 33744 - protein, 19 aa, synthetic construct
  source 1..19: note = Seed: LQTVHSIPLTINKEEALQR
LQTVHSIPFTIEKIEAIQR

SEQ ID NO: 33745 - protein, 19 aa, synthetic construct
  source 1..19: note = Seed: LQTVHSIPLTINKEEALQR
LQTVHSIPFTIEKIEALQR

SEQ ID NO: 33746 - protein, 19 aa, synthetic construct
  source 1..19: note = Seed: LQTVHSIPLTINKEEALQR
LQTVHSIPFTIEKIEAMQR

SEQ ID NO: 33747 - protein, 19 aa, synthetic construct
  source 1..19: note = Seed: LQTVHSIPLTINKEEALQR
LQTVHSIPFTIEKIEAVQR

SEQ ID NO: 33748 - protein, 19 aa, synthetic construct
  source 1..19: note = Seed: LQTVHSIPLTINKEEALQR
LQTVHSIPFTIEKIEAYQR

SEQ ID NO: 33749 - protein, 19 aa, synthetic construct
  source 1..19: note = Seed: LQTVHSIPLTINKEEALQR
LQTVHSIPFTIEKLEAFQR

SEQ ID NO: 33750 - protein, 19 aa, synthetic construct
  source 1..19: note = Seed: LQTVHSIPLTINKEEALQR
LQTVHSIPFTIEKLEAIQR

SEQ ID NO: 33751 - protein, 19 aa, synthetic construct
  source 1..19: note = Seed: LQTVHSIPLTINKEEALQR
LQTVHSIPFTIEKLEALQR

SEQ ID NO: 33752 - protein, 19 aa, synthetic construct
  source 1..19: note = Seed: LQTVHSIPLTINKEEALQR
LQTVHSIPFTIEKLEAMQR

SEQ ID NO: 33753 - protein, 19 aa, synthetic construct
  source 1..19: note = Seed: LQTVHSIPLTINKEEALQR
LQTVHSIPFTIEKLEATQR

SEQ ID NO: 33754 - protein, 19 aa, synthetic construct
  source 1..19: note = Seed: LQTVHSIPLTINKEEALQR
LQTVHSIPFTIEKLEAVQR

SEQ ID NO: 33755 - protein, 19 aa, synthetic construct
  source 1..19: note = Seed: LQTVHSIPLTINKEEALQR
LQTVHSIPFTIEKLEAWQR

SEQ ID NO: 33756 - protein, 19 aa, synthetic construct
  source 1..19: note = Seed: LQTVHSIPLTINKEEALQR
LQTVHSIPFTIEKLEAYQR

SEQ ID NO: 33757 - protein, 19 aa, synthetic construct
  source 1..19: note = Seed: LQTVHSIPLTINKEEALQR
LQTVHSIPFTIEKMEAFQR

SEQ ID NO: 33758 - protein, 19 aa, synthetic construct
  source 1..19: note = Seed: LQTVHSIPLTINKEEALQR
LQTVHSIPFTIEKMEAIQR

SEQ ID NO: 33759 - protein, 19 aa, synthetic construct
  source 1..19: note = Seed: LQTVHSIPLTINKEEALQR
LQTVHSIPFTIEKMEALQR

SEQ ID NO: 33760 - protein, 19 aa, synthetic construct
  source 1..19: note = Seed: LQTVHSIPLTINKEEALQR
LQTVHSIPFTIEKMEAMQR

SEQ ID NO: 33761 - protein, 19 aa, synthetic construct
  source 1..19: note = Seed: LQTVHSIPLTINKEEALQR
LQTVHSIPFTIEKMEAVQR

SEQ ID NO: 33762 - protein, 19 aa, synthetic construct
  source 1..19: note = Seed: LQTVHSIPLTINKEEALQR
LQTVHSIPFTIEKSEAAQR

SEQ ID NO: 33763 - protein, 19 aa, synthetic construct
  source 1..19: note = Seed: LQTVHSIPLTINKEEALQR
LQTVHSIPFTIEKSEAIQR

SEQ ID NO: 33764 - protein, 19 aa, synthetic construct
  source 1..19: note = Seed: LQTVHSIPLTINKEEALQR
LQTVHSIPFTIEKSEALQR

SEQ ID NO: 33765 - protein, 19 aa, synthetic construct
  source 1..19: note = Seed: LQTVHSIPLTINKEEALQR
LQTVHSIPFTIEKSEAVQR

SEQ ID NO: 33766 - protein, 19 aa, synthetic construct
  source 1..19: note = Seed: LQTVHSIPLTINKEEALQR
LQTVHSIPFTIEKVEAFQR

SEQ ID NO: 33767 - protein, 19 aa, synthetic construct
  source 1..19: note = Seed: LQTVHSIPLTINKEEALQR
LQTVHSIPFTIEKVEAIQR

SEQ ID NO: 33768 - protein, 19 aa, synthetic construct
  source 1..19: note = Seed: LQTVHSIPLTINKEEALQR
LQTVHSIPFTIEKVEALQR

SEQ ID NO: 33769 - protein, 19 aa, synthetic construct
  source 1..19: note = Seed: LQTVHSIPLTINKEEALQR
LQTVHSIPFTIEKVEAVQR

SEQ ID NO: 33770 - protein, 19 aa, synthetic construct
  source 1..19: note = Seed: LQTVHSIPLTINKEEALQR
LQTVHSIPFTIEKWEAFQR

SEQ ID NO: 33771 - protein, 19 aa, synthetic construct
  source 1..19: note = Seed: LQTVHSIPLTINKEEALQR
LQTVHSIPFTIEKWEAIQR

SEQ ID NO: 33772 - protein, 19 aa, synthetic construct
  source 1..19: note = Seed: LQTVHSIPLTINKEEALQR
LQTVHSIPFTIEKWEALQR

SEQ ID NO: 33773 - protein, 19 aa, synthetic construct
  source 1..19: note = Seed: LQTVHSIPLTINKEEALQR
LQTVHSIPFTIEKWEAMQR

SEQ ID NO: 33774 - protein, 19 aa, synthetic construct
  source 1..19: note = Seed: LQTVHSIPLTINKEEALQR
LQTVHSIPFTIEKWEAVQR

SEQ ID NO: 33775 - protein, 19 aa, synthetic construct
  source 1..19: note = Seed: LQTVHSIPLTINKEEALQR
LQTVHSIPFTIEKWEAYQR

SEQ ID NO: 33776 - protein, 19 aa, synthetic construct
  source 1..19: note = Seed: LQTVHSIPLTINKEEALQR
LQTVHSIPFTIEKYEAAQR

SEQ ID NO: 33777 - protein, 19 aa, synthetic construct
  source 1..19: note = Seed: LQTVHSIPLTINKEEALQR
LQTVHSIPFTIEKYEAFQR

SEQ ID NO: 33778 - protein, 19 aa, synthetic construct
  source 1..19: note = Seed: LQTVHSIPLTINKEEALQR
LQTVHSIPFTIEKYEAIQR

SEQ ID NO: 33779 - protein, 19 aa, synthetic construct
  source 1..19: note = Seed: LQTVHSIPLTINKEEALQR
LQTVHSIPFTIEKYEALQR

SEQ ID NO: 33780 - protein, 19 aa, synthetic construct
  source 1..19: note = Seed: LQTVHSIPLTINKEEALQR
LQTVHSIPFTIEKYEAMQR

SEQ ID NO: 33781 - protein, 19 aa, synthetic construct
  source 1..19: note = Seed: LQTVHSIPLTINKEEALQR
LQTVHSIPFTIEKYEATQR

SEQ ID NO: 33782 - protein, 19 aa, synthetic construct
  source 1..19: note = Seed: LQTVHSIPLTINKEEALQR
LQTVHSIPFTIEKYEAVQR

SEQ ID NO: 33783 - protein, 19 aa, synthetic construct
  source 1..19: note = Seed: LQTVHSIPLTINKEEALQR
LQTVHSIPFTIEKYEAYQR

SEQ ID NO: 33784 - protein, 19 aa, synthetic construct
  source 1..19: note = Seed: LQTVHSIPLTINKEEALQR
LQTVHSIPFTIFKAEAAQR

SEQ ID NO: 33785 - protein, 19 aa, synthetic construct
  source 1..19: note = Seed: LQTVHSIPLTINKEEALQR
LQTVHSIPFTIFKAEADQR

SEQ ID NO: 33786 - protein, 19 aa, synthetic construct
  source 1..19: note = Seed: LQTVHSIPLTINKEEALQR
LQTVHSIPFTIFKAEAFQR

SEQ ID NO: 33787 - protein, 19 aa, synthetic construct
  source 1..19: note = Seed: LQTVHSIPLTINKEEALQR
LQTVHSIPFTIFKAEAIQR

SEQ ID NO: 33788 - protein, 19 aa, synthetic construct
  source 1..19: note = Seed: LQTVHSIPLTINKEEALQR
LQTVHSIPFTIFKAEALQR

SEQ ID NO: 33789 - protein, 19 aa, synthetic construct
  source 1..19: note = Seed: LQTVHSIPLTINKEEALQR
LQTVHSIPFTIFKAEAMQR

SEQ ID NO: 33790 - protein, 19 aa, synthetic construct
  source 1..19: note = Seed: LQTVHSIPLTINKEEALQR
LQTVHSIPFTIFKAEATQR

SEQ ID NO: 33791 - protein, 19 aa, synthetic construct
  source 1..19: note = Seed: LQTVHSIPLTINKEEALQR
LQTVHSIPFTIFKAEAVQR

SEQ ID NO: 33792 - protein, 19 aa, synthetic construct
  source 1..19: note = Seed: LQTVHSIPLTINKEEALQR
LQTVHSIPFTIFKAEAYQR

SEQ ID NO: 33793 - protein, 19 aa, synthetic construct
  source 1..19: note = Seed: LQTVHSIPLTINKEEALQR
LQTVHSIPFTIFKDEAAQR

SEQ ID NO: 33794 - protein, 19 aa, synthetic construct
  source 1..19: note = Seed: LQTVHSIPLTINKEEALQR
LQTVHSIPFTIFKDEAFQR

SEQ ID NO: 33795 - protein, 19 aa, synthetic construct
  source 1..19: note = Seed: LQTVHSIPLTINKEEALQR
LQTVHSIPFTIFKDEAIQR

SEQ ID NO: 33796 - protein, 19 aa, synthetic construct
  source 1..19: note = Seed: LQTVHSIPLTINKEEALQR
LQTVHSIPFTIFKDEALQR

SEQ ID NO: 33797 - protein, 19 aa, synthetic construct
  source 1..19: note = Seed: LQTVHSIPLTINKEEALQR
LQTVHSIPFTIFKDEAMQR

SEQ ID NO: 33798 - protein, 19 aa, synthetic construct
  source 1..19: note = Seed: LQTVHSIPLTINKEEALQR
LQTVHSIPFTIFKDEAVQR

SEQ ID NO: 33799 - protein, 19 aa, synthetic construct
  source 1..19: note = Seed: LQTVHSIPLTINKEEALQR
LQTVHSIPFTIFKEEAIQR

SEQ ID NO: 33800 - protein, 19 aa, synthetic construct
  source 1..19: note = Seed: LQTVHSIPLTINKEEALQR
LQTVHSIPFTIFKEEALQR

SEQ ID NO: 33801 - protein, 19 aa, synthetic construct
  source 1..19: note = Seed: LQTVHSIPLTINKEEALQR
LQTVHSIPFTIFKEEAVQR

SEQ ID NO: 33802 - protein, 19 aa, synthetic construct
  source 1..19: note = Seed: LQTVHSIPLTINKEEALQR
LQTVHSIPFTIFKFEAAQR

SEQ ID NO: 33803 - protein, 19 aa, synthetic construct
  source 1..19: note = Seed: LQTVHSIPLTINKEEALQR
LQTVHSIPFTIFKFEACQR

SEQ ID NO: 33804 - protein, 19 aa, synthetic construct
  source 1..19: note = Seed: LQTVHSIPLTINKEEALQR
LQTVHSIPFTIFKFEADQR

SEQ ID NO: 33805 - protein, 19 aa, synthetic construct
  source 1..19: note = Seed: LQTVHSIPLTINKEEALQR
LQTVHSIPFTIFKFEAEQR

SEQ ID NO: 33806 - protein, 19 aa, synthetic construct
  source 1..19: note = Seed: LQTVHSIPLTINKEEALQR
LQTVHSIPFTIFKFEAFQR

SEQ ID NO: 33807 - protein, 19 aa, synthetic construct
  source 1..19: note = Seed: LQTVHSIPLTINKEEALQR
LQTVHSIPFTIFKFEAGQR

SEQ ID NO: 33808 - protein, 19 aa, synthetic construct
  source 1..19: note = Seed: LQTVHSIPLTINKEEALQR
LQTVHSIPFTIFKFEAHQR

SEQ ID NO: 33809 - protein, 19 aa, synthetic construct
  source 1..19: note = Seed: LQTVHSIPLTINKEEALQR
LQTVHSIPFTIFKFEAIQR

SEQ ID NO: 33810 - protein, 19 aa, synthetic construct
  source 1..19: note = Seed: LQTVHSIPLTINKEEALQR
LQTVHSIPFTIFKFEAKQR

SEQ ID NO: 33811 - protein, 19 aa, synthetic construct
  source 1..19: note = Seed: LQTVHSIPLTINKEEALQR
LQTVHSIPFTIFKFEALQR

SEQ ID NO: 33812 - protein, 19 aa, synthetic construct
  source 1..19: note = Seed: LQTVHSIPLTINKEEALQR
LQTVHSIPFTIFKFEAMQR

SEQ ID NO: 33813 - protein, 19 aa, synthetic construct
  source 1..19: note = Seed: LQTVHSIPLTINKEEALQR
LQTVHSIPFTIFKFEANQR

SEQ ID NO: 33814 - protein, 19 aa, synthetic construct
  source 1..19: note = Seed: LQTVHSIPLTINKEEALQR
LQTVHSIPFTIFKFEAPQR

SEQ ID NO: 33815 - protein, 19 aa, synthetic construct
  source 1..19: note = Seed: LQTVHSIPLTINKEEALQR
LQTVHSIPFTIFKFEAQQR

SEQ ID NO: 33816 - protein, 19 aa, synthetic construct
  source 1..19: note = Seed: LQTVHSIPLTINKEEALQR
LQTVHSIPFTIFKFEARQR

SEQ ID NO: 33817 - protein, 19 aa, synthetic construct
  source 1..19: note = Seed: LQTVHSIPLTINKEEALQR
LQTVHSIPFTIFKFEASQR

SEQ ID NO: 33818 - protein, 19 aa, synthetic construct
  source 1..19: note = Seed: LQTVHSIPLTINKEEALQR
LQTVHSIPFTIFKFEATQR

SEQ ID NO: 33819 - protein, 19 aa, synthetic construct
  source 1..19: note = Seed: LQTVHSIPLTINKEEALQR
LQTVHSIPFTIFKFEAVQR

SEQ ID NO: 33820 - protein, 19 aa, synthetic construct
  source 1..19: note = Seed: LQTVHSIPLTINKEEALQR
LQTVHSIPFTIFKFEAYQR

SEQ ID NO: 33821 - protein, 19 aa, synthetic construct
  source 1..19: note = Seed: LQTVHSIPLTINKEEALQR
LQTVHSIPFTIFKGEAAQR

SEQ ID NO: 33822 - protein, 19 aa, synthetic construct
  source 1..19: note = Seed: LQTVHSIPLTINKEEALQR
LQTVHSIPFTIFKGEAIQR

SEQ ID NO: 33823 - protein, 19 aa, synthetic construct
  source 1..19: note = Seed: LQTVHSIPLTINKEEALQR
LQTVHSIPFTIFKGEALQR

SEQ ID NO: 33824 - protein, 19 aa, synthetic construct
  source 1..19: note = Seed: LQTVHSIPLTINKEEALQR
LQTVHSIPFTIFKGEAVQR

SEQ ID NO: 33825 - protein, 19 aa, synthetic construct
  source 1..19: note = Seed: LQTVHSIPLTINKEEALQR
LQTVHSIPFTIFKHEADQR

SEQ ID NO: 33826 - protein, 19 aa, synthetic construct
  source 1..19: note = Seed: LQTVHSIPLTINKEEALQR
LQTVHSIPFTIFKHEAIQR

SEQ ID NO: 33827 - protein, 19 aa, synthetic construct
  source 1..19: note = Seed: LQTVHSIPLTINKEEALQR
LQTVHSIPFTIFKHEALQR

SEQ ID NO: 33828 - protein, 19 aa, synthetic construct
  source 1..19: note = Seed: LQTVHSIPLTINKEEALQR
LQTVHSIPFTIFKHEAMQR

SEQ ID NO: 33829 - protein, 19 aa, synthetic construct
  source 1..19: note = Seed: LQTVHSIPLTINKEEALQR
LQTVHSIPFTIFKHEAVQR

SEQ ID NO: 33830 - protein, 19 aa, synthetic construct
  source 1..19: note = Seed: LQTVHSIPLTINKEEALQR
LQTVHSIPFTIFKIEAAQR

SEQ ID NO: 33831 - protein, 19 aa, synthetic construct
  source 1..19: note = Seed: LQTVHSIPLTINKEEALQR
LQTVHSIPFTIFKIEADQR

SEQ ID NO: 33832 - protein, 19 aa, synthetic construct
  source 1..19: note = Seed: LQTVHSIPLTINKEEALQR
LQTVHSIPFTIFKIEAEQR

SEQ ID NO: 33833 - protein, 19 aa, synthetic construct
  source 1..19: note = Seed: LQTVHSIPLTINKEEALQR
LQTVHSIPFTIFKIEAFQR

SEQ ID NO: 33834 - protein, 19 aa, synthetic construct
  source 1..19: note = Seed: LQTVHSIPLTINKEEALQR
LQTVHSIPFTIFKIEAIQR

SEQ ID NO: 33835 - protein, 19 aa, synthetic construct
  source 1..19: note = Seed: LQTVHSIPLTINKEEALQR
LQTVHSIPFTIFKIEALQR

SEQ ID NO: 33836 - protein, 19 aa, synthetic construct
  source 1..19: note = Seed: LQTVHSIPLTINKEEALQR
LQTVHSIPFTIFKIEAMQR

SEQ ID NO: 33837 - protein, 19 aa, synthetic construct
  source 1..19: note = Seed: LQTVHSIPLTINKEEALQR
LQTVHSIPFTIFKIEANQR

SEQ ID NO: 33838 - protein, 19 aa, synthetic construct
  source 1..19: note = Seed: LQTVHSIPLTINKEEALQR
LQTVHSIPFTIFKIEAQQR

SEQ ID NO: 33839 - protein, 19 aa, synthetic construct
  source 1..19: note = Seed: LQTVHSIPLTINKEEALQR
LQTVHSIPFTIFKIEARQR

SEQ ID NO: 33840 - protein, 19 aa, synthetic construct
  source 1..19: note = Seed: LQTVHSIPLTINKEEALQR
LQTVHSIPFTIFKIEASQR

SEQ ID NO: 33841 - protein, 19 aa, synthetic construct
  source 1..19: note = Seed: LQTVHSIPLTINKEEALQR
LQTVHSIPFTIFKIEATQR

SEQ ID NO: 33842 - protein, 19 aa, synthetic construct
  source 1..19: note = Seed: LQTVHSIPLTINKEEALQR
LQTVHSIPFTIFKIEAVQR

SEQ ID NO: 33843 - protein, 19 aa, synthetic construct
  source 1..19: note = Seed: LQTVHSIPLTINKEEALQR
LQTVHSIPFTIFKIEAYQR

SEQ ID NO: 33844 - protein, 19 aa, synthetic construct
  source 1..19: note = Seed: LQTVHSIPLTINKEEALQR
LQTVHSIPFTIFKLEAAQR

SEQ ID NO: 33845 - protein, 19 aa, synthetic construct
  source 1..19: note = Seed: LQTVHSIPLTINKEEALQR
LQTVHSIPFTIFKLEACQR

SEQ ID NO: 33846 - protein, 19 aa, synthetic construct
  source 1..19: note = Seed: LQTVHSIPLTINKEEALQR
LQTVHSIPFTIFKLEADQR

SEQ ID NO: 33847 - protein, 19 aa, synthetic construct
  source 1..19: note = Seed: LQTVHSIPLTINKEEALQR
LQTVHSIPFTIFKLEAEQR

SEQ ID NO: 33848 - protein, 19 aa, synthetic construct
  source 1..19: note = Seed: LQTVHSIPLTINKEEALQR
LQTVHSIPFTIFKLEAFQR

SEQ ID NO: 33849 - protein, 19 aa, synthetic construct
  source 1..19: note = Seed: LQTVHSIPLTINKEEALQR
LQTVHSIPFTIFKLEAGQR

SEQ ID NO: 33850 - protein, 19 aa, synthetic construct
  source 1..19: note = Seed: LQTVHSIPLTINKEEALQR
LQTVHSIPFTIFKLEAHQR

SEQ ID NO: 33851 - protein, 19 aa, synthetic construct
  source 1..19: note = Seed: LQTVHSIPLTINKEEALQR
LQTVHSIPFTIFKLEAIQR

SEQ ID NO: 33852 - protein, 19 aa, synthetic construct
  source 1..19: note = Seed: LQTVHSIPLTINKEEALQR
LQTVHSIPFTIFKLEALQR

SEQ ID NO: 33853 - protein, 19 aa, synthetic construct
  source 1..19: note = Seed: LQTVHSIPLTINKEEALQR
LQTVHSIPFTIFKLEAMQR

SEQ ID NO: 33854 - protein, 19 aa, synthetic construct
  source 1..19: note = Seed: LQTVHSIPLTINKEEALQR
LQTVHSIPFTIFKLEANQR

SEQ ID NO: 33855 - protein, 19 aa, synthetic construct
  source 1..19: note = Seed: LQTVHSIPLTINKEEALQR
LQTVHSIPFTIFKLEAQQR

SEQ ID NO: 33856 - protein, 19 aa, synthetic construct
  source 1..19: note = Seed: LQTVHSIPLTINKEEALQR
LQTVHSIPFTIFKLEARQR

SEQ ID NO: 33857 - protein, 19 aa, synthetic construct
  source 1..19: note = Seed: LQTVHSIPLTINKEEALQR
LQTVHSIPFTIFKLEASQR

SEQ ID NO: 33858 - protein, 19 aa, synthetic construct
  source 1..19: note = Seed: LQTVHSIPLTINKEEALQR
LQTVHSIPFTIFKLEATQR

SEQ ID NO: 33859 - protein, 19 aa, synthetic construct
  source 1..19: note = Seed: LQTVHSIPLTINKEEALQR
LQTVHSIPFTIFKLEAVQR

SEQ ID NO: 33860 - protein, 19 aa, synthetic construct
  source 1..19: note = Seed: LQTVHSIPLTINKEEALQR
LQTVHSIPFTIFKLEAYQR

SEQ ID NO: 33861 - protein, 19 aa, synthetic construct
  source 1..19: note = Seed: LQTVHSIPLTINKEEALQR
LQTVHSIPFTIFKMEAAQR

SEQ ID NO: 33862 - protein, 19 aa, synthetic construct
  source 1..19: note = Seed: LQTVHSIPLTINKEEALQR
LQTVHSIPFTIFKMEADQR

SEQ ID NO: 33863 - protein, 19 aa, synthetic construct
  source 1..19: note = Seed: LQTVHSIPLTINKEEALQR
LQTVHSIPFTIFKMEAEQR

SEQ ID NO: 33864 - protein, 19 aa, synthetic construct
  source 1..19: note = Seed: LQTVHSIPLTINKEEALQR
LQTVHSIPFTIFKMEAFQR

SEQ ID NO: 33865 - protein, 19 aa, synthetic construct
  source 1..19: note = Seed: LQTVHSIPLTINKEEALQR
LQTVHSIPFTIFKMEAIQR

SEQ ID NO: 33866 - protein, 19 aa, synthetic construct
  source 1..19: note = Seed: LQTVHSIPLTINKEEALQR
LQTVHSIPFTIFKMEALQR

SEQ ID NO: 33867 - protein, 19 aa, synthetic construct
  source 1..19: note = Seed: LQTVHSIPLTINKEEALQR
LQTVHSIPFTIFKMEAMQR

SEQ ID NO: 33868 - protein, 19 aa, synthetic construct
  source 1..19: note = Seed: LQTVHSIPLTINKEEALQR
LQTVHSIPFTIFKMEANQR

SEQ ID NO: 33869 - protein, 19 aa, synthetic construct
  source 1..19: note = Seed: LQTVHSIPLTINKEEALQR
LQTVHSIPFTIFKMEARQR

SEQ ID NO: 33870 - protein, 19 aa, synthetic construct
  source 1..19: note = Seed: LQTVHSIPLTINKEEALQR
LQTVHSIPFTIFKMEASQR

SEQ ID NO: 33871 - protein, 19 aa, synthetic construct
  source 1..19: note = Seed: LQTVHSIPLTINKEEALQR
LQTVHSIPFTIFKMEATQR

SEQ ID NO: 33872 - protein, 19 aa, synthetic construct
  source 1..19: note = Seed: LQTVHSIPLTINKEEALQR
LQTVHSIPFTIFKMEAVQR

SEQ ID NO: 33873 - protein, 19 aa, synthetic construct
  source 1..19: note = Seed: LQTVHSIPLTINKEEALQR
LQTVHSIPFTIFKMEAYQR

SEQ ID NO: 33874 - protein, 19 aa, synthetic construct
  source 1..19: note = Seed: LQTVHSIPLTINKEEALQR
LQTVHSIPFTIFKNEAIQR

SEQ ID NO: 33875 - protein, 19 aa, synthetic construct
  source 1..19: note = Seed: LQTVHSIPLTINKEEALQR
LQTVHSIPFTIFKNEAVQR

SEQ ID NO: 33876 - protein, 19 aa, synthetic construct
  source 1..19: note = Seed: LQTVHSIPLTINKEEALQR
LQTVHSIPFTIFKPEAIQR

SEQ ID NO: 33877 - protein, 19 aa, synthetic construct
  source 1..19: note = Seed: LQTVHSIPLTINKEEALQR
LQTVHSIPFTIFKPEALQR

SEQ ID NO: 33878 - protein, 19 aa, synthetic construct
  source 1..19: note = Seed: LQTVHSIPLTINKEEALQR
LQTVHSIPFTIFKPEAVQR

SEQ ID NO: 33879 - protein, 19 aa, synthetic construct
  source 1..19: note = Seed: LQTVHSIPLTINKEEALQR
LQTVHSIPFTIFKQEAIQR

SEQ ID NO: 33880 - protein, 19 aa, synthetic construct
  source 1..19: note = Seed: LQTVHSIPLTINKEEALQR
LQTVHSIPFTIFKQEAVQR

SEQ ID NO: 33881 - protein, 19 aa, synthetic construct
  source 1..19: note = Seed: LQTVHSIPLTINKEEALQR
LQTVHSIPFTIFKSEAAQR

SEQ ID NO: 33882 - protein, 19 aa, synthetic construct
  source 1..19: note = Seed: LQTVHSIPLTINKEEALQR
LQTVHSIPFTIFKSEAIQR

SEQ ID NO: 33883 - protein, 19 aa, synthetic construct
  source 1..19: note = Seed: LQTVHSIPLTINKEEALQR
LQTVHSIPFTIFKSEALQR

SEQ ID NO: 33884 - protein, 19 aa, synthetic construct
  source 1..19: note = Seed: LQTVHSIPLTINKEEALQR
LQTVHSIPFTIFKSEAVQR

SEQ ID NO: 33885 - protein, 19 aa, synthetic construct
  source 1..19: note = Seed: LQTVHSIPLTINKEEALQR
LQTVHSIPFTIFKTEAIQR

SEQ ID NO: 33886 - protein, 19 aa, synthetic construct
  source 1..19: note = Seed: LQTVHSIPLTINKEEALQR
LQTVHSIPFTIFKTEALQR

SEQ ID NO: 33887 - protein, 19 aa, synthetic construct
  source 1..19: note = Seed: LQTVHSIPLTINKEEALQR
LQTVHSIPFTIFKTEAVQR

SEQ ID NO: 33888 - protein, 19 aa, synthetic construct
  source 1..19: note = Seed: LQTVHSIPLTINKEEALQR
LQTVHSIPFTIFKTEAYQR

SEQ ID NO: 33889 - protein, 19 aa, synthetic construct
  source 1..19: note = Seed: LQTVHSIPLTINKEEALQR
LQTVHSIPFTIFKVEAAQR

SEQ ID NO: 33890 - protein, 19 aa, synthetic construct
  source 1..19: note = Seed: LQTVHSIPLTINKEEALQR
LQTVHSIPFTIFKVEADQR

SEQ ID NO: 33891 - protein, 19 aa, synthetic construct
  source 1..19: note = Seed: LQTVHSIPLTINKEEALQR
LQTVHSIPFTIFKVEAEQR

SEQ ID NO: 33892 - protein, 19 aa, synthetic construct
  source 1..19: note = Seed: LQTVHSIPLTINKEEALQR
LQTVHSIPFTIFKVEAFQR

SEQ ID NO: 33893 - protein, 19 aa, synthetic construct
  source 1..19: note = Seed: LQTVHSIPLTINKEEALQR
LQTVHSIPFTIFKVEAIQR

SEQ ID NO: 33894 - protein, 19 aa, synthetic construct
  source 1..19: note = Seed: LQTVHSIPLTINKEEALQR
LQTVHSIPFTIFKVEALQR

SEQ ID NO: 33895 - protein, 19 aa, synthetic construct
  source 1..19: note = Seed: LQTVHSIPLTINKEEALQR
LQTVHSIPFTIFKVEAMQR

SEQ ID NO: 33896 - protein, 19 aa, synthetic construct
  source 1..19: note = Seed: LQTVHSIPLTINKEEALQR
LQTVHSIPFTIFKVEANQR

SEQ ID NO: 33897 - protein, 19 aa, synthetic construct
  source 1..19: note = Seed: LQTVHSIPLTINKEEALQR
LQTVHSIPFTIFKVEARQR

SEQ ID NO: 33898 - protein, 19 aa, synthetic construct
  source 1..19: note = Seed: LQTVHSIPLTINKEEALQR
LQTVHSIPFTIFKVEATQR

SEQ ID NO: 33899 - protein, 19 aa, synthetic construct
  source 1..19: note = Seed: LQTVHSIPLTINKEEALQR
LQTVHSIPFTIFKVEAVQR

SEQ ID NO: 33900 - protein, 19 aa, synthetic construct
  source 1..19: note = Seed: LQTVHSIPLTINKEEALQR
LQTVHSIPFTIFKVEAYQR

SEQ ID NO: 33901 - protein, 19 aa, synthetic construct
  source 1..19: note = Seed: LQTVHSIPLTINKEEALQR
LQTVHSIPFTIFKWEAAQR

SEQ ID NO: 33902 - protein, 19 aa, synthetic construct
  source 1..19: note = Seed: LQTVHSIPLTINKEEALQR
LQTVHSIPFTIFKWEACQR

SEQ ID NO: 33903 - protein, 19 aa, synthetic construct
  source 1..19: note = Seed: LQTVHSIPLTINKEEALQR
LQTVHSIPFTIFKWEADQR

SEQ ID NO: 33904 - protein, 19 aa, synthetic construct
  source 1..19: note = Seed: LQTVHSIPLTINKEEALQR
LQTVHSIPFTIFKWEAEQR

SEQ ID NO: 33905 - protein, 19 aa, synthetic construct
  source 1..19: note = Seed: LQTVHSIPLTINKEEALQR
LQTVHSIPFTIFKWEAFQR

SEQ ID NO: 33906 - protein, 19 aa, synthetic construct
  source 1..19: note = Seed: LQTVHSIPLTINKEEALQR
LQTVHSIPFTIFKWEAGQR

SEQ ID NO: 33907 - protein, 19 aa, synthetic construct
  source 1..19: note = Seed: LQTVHSIPLTINKEEALQR
LQTVHSIPFTIFKWEAHQR

SEQ ID NO: 33908 - protein, 19 aa, synthetic construct
  source 1..19: note = Seed: LQTVHSIPLTINKEEALQR
LQTVHSIPFTIFKWEAIQR

SEQ ID NO: 33909 - protein, 19 aa, synthetic construct
  source 1..19: note = Seed: LQTVHSIPLTINKEEALQR
LQTVHSIPFTIFKWEALQR

SEQ ID NO: 33910 - protein, 19 aa, synthetic construct
  source 1..19: note = Seed: LQTVHSIPLTINKEEALQR
LQTVHSIPFTIFKWEAMQR

SEQ ID NO: 33911 - protein, 19 aa, synthetic construct
  source 1..19: note = Seed: LQTVHSIPLTINKEEALQR
LQTVHSIPFTIFKWEANQR

SEQ ID NO: 33912 - protein, 19 aa, synthetic construct
  source 1..19: note = Seed: LQTVHSIPLTINKEEALQR
LQTVHSIPFTIFKWEAQQR

SEQ ID NO: 33913 - protein, 19 aa, synthetic construct
  source 1..19: note = Seed: LQTVHSIPLTINKEEALQR
LQTVHSIPFTIFKWEARQR

SEQ ID NO: 33914 - protein, 19 aa, synthetic construct
  source 1..19: note = Seed: LQTVHSIPLTINKEEALQR
LQTVHSIPFTIFKWEASQR

SEQ ID NO: 33915 - protein, 19 aa, synthetic construct
  source 1..19: note = Seed: LQTVHSIPLTINKEEALQR
LQTVHSIPFTIFKWEATQR

SEQ ID NO: 33916 - protein, 19 aa, synthetic construct
  source 1..19: note = Seed: LQTVHSIPLTINKEEALQR
LQTVHSIPFTIFKWEAVQR

SEQ ID NO: 33917 - protein, 19 aa, synthetic construct
  source 1..19: note = Seed: LQTVHSIPLTINKEEALQR
LQTVHSIPFTIFKWEAYQR

SEQ ID NO: 33918 - protein, 19 aa, synthetic construct
  source 1..19: note = Seed: LQTVHSIPLTINKEEALQR
LQTVHSIPFTIFKYEAAQR

SEQ ID NO: 33919 - protein, 19 aa, synthetic construct
  source 1..19: note = Seed: LQTVHSIPLTINKEEALQR
LQTVHSIPFTIFKYEACQR

SEQ ID NO: 33920 - protein, 19 aa, synthetic construct
  source 1..19: note = Seed: LQTVHSIPLTINKEEALQR
LQTVHSIPFTIFKYEADQR

SEQ ID NO: 33921 - protein, 19 aa, synthetic construct
  source 1..19: note = Seed: LQTVHSIPLTINKEEALQR
LQTVHSIPFTIFKYEAEQR

SEQ ID NO: 33922 - protein, 19 aa, synthetic construct
  source 1..19: note = Seed: LQTVHSIPLTINKEEALQR
LQTVHSIPFTIFKYEAFQR

SEQ ID NO: 33923 - protein, 19 aa, synthetic construct
  source 1..19: note = Seed: LQTVHSIPLTINKEEALQR
LQTVHSIPFTIFKYEAGQR

SEQ ID NO: 33924 - protein, 19 aa, synthetic construct
  source 1..19: note = Seed: LQTVHSIPLTINKEEALQR
LQTVHSIPFTIFKYEAHQR

SEQ ID NO: 33925 - protein, 19 aa, synthetic construct
  source 1..19: note = Seed: LQTVHSIPLTINKEEALQR
LQTVHSIPFTIFKYEAIQR

SEQ ID NO: 33926 - protein, 19 aa, synthetic construct
  source 1..19: note = Seed: LQTVHSIPLTINKEEALQR
LQTVHSIPFTIFKYEAKQR

SEQ ID NO: 33927 - protein, 19 aa, synthetic construct
  source 1..19: note = Seed: LQTVHSIPLTINKEEALQR
LQTVHSIPFTIFKYEALQR

SEQ ID NO: 33928 - protein, 19 aa, synthetic construct
  source 1..19: note = Seed: LQTVHSIPLTINKEEALQR
LQTVHSIPFTIFKYEAMQR

SEQ ID NO: 33929 - protein, 19 aa, synthetic construct
  source 1..19: note = Seed: LQTVHSIPLTINKEEALQR
LQTVHSIPFTIFKYEANQR

SEQ ID NO: 33930 - protein, 19 aa, synthetic construct
  source 1..19: note = Seed: LQTVHSIPLTINKEEALQR
LQTVHSIPFTIFKYEAPQR

SEQ ID NO: 33931 - protein, 19 aa, synthetic construct
  source 1..19: note = Seed: LQTVHSIPLTINKEEALQR
LQTVHSIPFTIFKYEAQQR

SEQ ID NO: 33932 - protein, 19 aa, synthetic construct
  source 1..19: note = Seed: LQTVHSIPLTINKEEALQR
LQTVHSIPFTIFKYEARQR

SEQ ID NO: 33933 - protein, 19 aa, synthetic construct
  source 1..19: note = Seed: LQTVHSIPLTINKEEALQR
LQTVHSIPFTIFKYEASQR

SEQ ID NO: 33934 - protein, 19 aa, synthetic construct
  source 1..19: note = Seed: LQTVHSIPLTINKEEALQR
LQTVHSIPFTIFKYEATQR

SEQ ID NO: 33935 - protein, 19 aa, synthetic construct
  source 1..19: note = Seed: LQTVHSIPLTINKEEALQR
LQTVHSIPFTIFKYEAVQR

SEQ ID NO: 33936 - protein, 19 aa, synthetic construct
  source 1..19: note = Seed: LQTVHSIPLTINKEEALQR
LQTVHSIPFTIFKYEAYQR

SEQ ID NO: 33937 - protein, 19 aa, synthetic construct
  source 1..19: note = Seed: LQTVHSIPLTINKEEALQR
LQTVHSIPFTIGKAEAAQR

SEQ ID NO: 33938 - protein, 19 aa, synthetic construct
  source 1..19: note = Seed: LQTVHSIPLTINKEEALQR
LQTVHSIPFTIGKAEAIQR

SEQ ID NO: 33939 - protein, 19 aa, synthetic construct
  source 1..19: note = Seed: LQTVHSIPLTINKEEALQR
LQTVHSIPFTIGKAEALQR

SEQ ID NO: 33940 - protein, 19 aa, synthetic construct
  source 1..19: note = Seed: LQTVHSIPLTINKEEALQR
LQTVHSIPFTIGKAEAMQR

SEQ ID NO: 33941 - protein, 19 aa, synthetic construct
  source 1..19: note = Seed: LQTVHSIPLTINKEEALQR
LQTVHSIPFTIGKAEAVQR

SEQ ID NO: 33942 - protein, 19 aa, synthetic construct
  source 1..19: note = Seed: LQTVHSIPLTINKEEALQR
LQTVHSIPFTIGKFEAFQR

SEQ ID NO: 33943 - protein, 19 aa, synthetic construct
  source 1..19: note = Seed: LQTVHSIPLTINKEEALQR
LQTVHSIPFTIGKFEAIQR

SEQ ID NO: 33944 - protein, 19 aa, synthetic construct
  source 1..19: note = Seed: LQTVHSIPLTINKEEALQR
LQTVHSIPFTIGKFEALQR

SEQ ID NO: 33945 - protein, 19 aa, synthetic construct
  source 1..19: note = Seed: LQTVHSIPLTINKEEALQR
LQTVHSIPFTIGKFEAMQR

SEQ ID NO: 33946 - protein, 19 aa, synthetic construct
  source 1..19: note = Seed: LQTVHSIPLTINKEEALQR
LQTVHSIPFTIGKFEAVQR

SEQ ID NO: 33947 - protein, 19 aa, synthetic construct
  source 1..19: note = Seed: LQTVHSIPLTINKEEALQR
LQTVHSIPFTIGKFEAYQR

SEQ ID NO: 33948 - protein, 19 aa, synthetic construct
  source 1..19: note = Seed: LQTVHSIPLTINKEEALQR
LQTVHSIPFTIGKGEAIQR

SEQ ID NO: 33949 - protein, 19 aa, synthetic construct
  source 1..19: note = Seed: LQTVHSIPLTINKEEALQR
LQTVHSIPFTIGKGEALQR

SEQ ID NO: 33950 - protein, 19 aa, synthetic construct
  source 1..19: note = Seed: LQTVHSIPLTINKEEALQR
LQTVHSIPFTIGKGEAVQR

SEQ ID NO: 33951 - protein, 19 aa, synthetic construct
  source 1..19: note = Seed: LQTVHSIPLTINKEEALQR
LQTVHSIPFTIGKSEAIQR

SEQ ID NO: 33952 - protein, 19 aa, synthetic construct
  source 1..19: note = Seed: LQTVHSIPLTINKEEALQR
LQTVHSIPFTIGKSEALQR

SEQ ID NO: 33953 - protein, 19 aa, synthetic construct
  source 1..19: note = Seed: LQTVHSIPLTINKEEALQR
LQTVHSIPFTIGKSEAVQR

SEQ ID NO: 33954 - protein, 19 aa, synthetic construct
  source 1..19: note = Seed: LQTVHSIPLTINKEEALQR
LQTVHSIPFTIHKAEAIQR

SEQ ID NO: 33955 - protein, 19 aa, synthetic construct
  source 1..19: note = Seed: LQTVHSIPLTINKEEALQR
LQTVHSIPFTIHKAEALQR

SEQ ID NO: 33956 - protein, 19 aa, synthetic construct
  source 1..19: note = Seed: LQTVHSIPLTINKEEALQR
LQTVHSIPFTIHKAEAVQR

SEQ ID NO: 33957 - protein, 19 aa, synthetic construct
  source 1..19: note = Seed: LQTVHSIPLTINKEEALQR
LQTVHSIPFTIHKFEAAQR

SEQ ID NO: 33958 - protein, 19 aa, synthetic construct
  source 1..19: note = Seed: LQTVHSIPLTINKEEALQR
LQTVHSIPFTIHKFEACQR

SEQ ID NO: 33959 - protein, 19 aa, synthetic construct
  source 1..19: note = Seed: LQTVHSIPLTINKEEALQR
LQTVHSIPFTIHKFEADQR

SEQ ID NO: 33960 - protein, 19 aa, synthetic construct
  source 1..19: note = Seed: LQTVHSIPLTINKEEALQR
LQTVHSIPFTIHKFEAEQR

SEQ ID NO: 33961 - protein, 19 aa, synthetic construct
  source 1..19: note = Seed: LQTVHSIPLTINKEEALQR
LQTVHSIPFTIHKFEAFQR

SEQ ID NO: 33962 - protein, 19 aa, synthetic construct
  source 1..19: note = Seed: LQTVHSIPLTINKEEALQR
LQTVHSIPFTIHKFEAHQR

SEQ ID NO: 33963 - protein, 19 aa, synthetic construct
  source 1..19: note = Seed: LQTVHSIPLTINKEEALQR
LQTVHSIPFTIHKFEAIQR

SEQ ID NO: 33964 - protein, 19 aa, synthetic construct
  source 1..19: note = Seed: LQTVHSIPLTINKEEALQR
LQTVHSIPFTIHKFEALQR

SEQ ID NO: 33965 - protein, 19 aa, synthetic construct
  source 1..19: note = Seed: LQTVHSIPLTINKEEALQR
LQTVHSIPFTIHKFEAMQR

SEQ ID NO: 33966 - protein, 19 aa, synthetic construct
  source 1..19: note = Seed: LQTVHSIPLTINKEEALQR
LQTVHSIPFTIHKFEANQR

SEQ ID NO: 33967 - protein, 19 aa, synthetic construct
  source 1..19: note = Seed: LQTVHSIPLTINKEEALQR
LQTVHSIPFTIHKFEAPQR

SEQ ID NO: 33968 - protein, 19 aa, synthetic construct
  source 1..19: note = Seed: LQTVHSIPLTINKEEALQR
LQTVHSIPFTIHKFEAQQR

SEQ ID NO: 33969 - protein, 19 aa, synthetic construct
  source 1..19: note = Seed: LQTVHSIPLTINKEEALQR
LQTVHSIPFTIHKFEARQR

SEQ ID NO: 33970 - protein, 19 aa, synthetic construct
  source 1..19: note = Seed: LQTVHSIPLTINKEEALQR
LQTVHSIPFTIHKFEASQR

SEQ ID NO: 33971 - protein, 19 aa, synthetic construct
  source 1..19: note = Seed: LQTVHSIPLTINKEEALQR
LQTVHSIPFTIHKFEATQR

SEQ ID NO: 33972 - protein, 19 aa, synthetic construct
  source 1..19: note = Seed: LQTVHSIPLTINKEEALQR
LQTVHSIPFTIHKFEAVQR

SEQ ID NO: 33973 - protein, 19 aa, synthetic construct
  source 1..19: note = Seed: LQTVHSIPLTINKEEALQR
LQTVHSIPFTIHKFEAWQR

SEQ ID NO: 33974 - protein, 19 aa, synthetic construct
  source 1..19: note = Seed: LQTVHSIPLTINKEEALQR
LQTVHSIPFTIHKFEAYQR

SEQ ID NO: 33975 - protein, 19 aa, synthetic construct
  source 1..19: note = Seed: LQTVHSIPLTINKEEALQR
LQTVHSIPFTIHKGEAIQR

SEQ ID NO: 33976 - protein, 19 aa, synthetic construct
  source 1..19: note = Seed: LQTVHSIPLTINKEEALQR
LQTVHSIPFTIHKIEAFQR

SEQ ID NO: 33977 - protein, 19 aa, synthetic construct
  source 1..19: note = Seed: LQTVHSIPLTINKEEALQR
LQTVHSIPFTIHKIEAIQR

SEQ ID NO: 33978 - protein, 19 aa, synthetic construct
  source 1..19: note = Seed: LQTVHSIPLTINKEEALQR
LQTVHSIPFTIHKIEALQR

SEQ ID NO: 33979 - protein, 19 aa, synthetic construct
  source 1..19: note = Seed: LQTVHSIPLTINKEEALQR
LQTVHSIPFTIHKIEAMQR

SEQ ID NO: 33980 - protein, 19 aa, synthetic construct
  source 1..19: note = Seed: LQTVHSIPLTINKEEALQR
LQTVHSIPFTIHKIEAVQR

SEQ ID NO: 33981 - protein, 19 aa, synthetic construct
  source 1..19: note = Seed: LQTVHSIPLTINKEEALQR
LQTVHSIPFTIHKLEAFQR

SEQ ID NO: 33982 - protein, 19 aa, synthetic construct
  source 1..19: note = Seed: LQTVHSIPLTINKEEALQR
LQTVHSIPFTIHKLEAIQR

SEQ ID NO: 33983 - protein, 19 aa, synthetic construct
  source 1..19: note = Seed: LQTVHSIPLTINKEEALQR
LQTVHSIPFTIHKLEALQR

SEQ ID NO: 33984 - protein, 19 aa, synthetic construct
  source 1..19: note = Seed: LQTVHSIPLTINKEEALQR
LQTVHSIPFTIHKLEAMQR

SEQ ID NO: 33985 - protein, 19 aa, synthetic construct
  source 1..19: note = Seed: LQTVHSIPLTINKEEALQR
LQTVHSIPFTIHKLEAVQR

SEQ ID NO: 33986 - protein, 19 aa, synthetic construct
  source 1..19: note = Seed: LQTVHSIPLTINKEEALQR
LQTVHSIPFTIHKMEAFQR

SEQ ID NO: 33987 - protein, 19 aa, synthetic construct
  source 1..19: note = Seed: LQTVHSIPLTINKEEALQR
LQTVHSIPFTIHKMEAIQR

SEQ ID NO: 33988 - protein, 19 aa, synthetic construct
  source 1..19: note = Seed: LQTVHSIPLTINKEEALQR
LQTVHSIPFTIHKMEALQR

SEQ ID NO: 33989 - protein, 19 aa, synthetic construct
  source 1..19: note = Seed: LQTVHSIPLTINKEEALQR
LQTVHSIPFTIHKMEAVQR

SEQ ID NO: 33990 - protein, 19 aa, synthetic construct
  source 1..19: note = Seed: LQTVHSIPLTINKEEALQR
LQTVHSIPFTIHKSEAIQR

SEQ ID NO: 33991 - protein, 19 aa, synthetic construct
  source 1..19: note = Seed: LQTVHSIPLTINKEEALQR
LQTVHSIPFTIHKSEALQR

SEQ ID NO: 33992 - protein, 19 aa, synthetic construct
  source 1..19: note = Seed: LQTVHSIPLTINKEEALQR
LQTVHSIPFTIHKSEAVQR

SEQ ID NO: 33993 - protein, 19 aa, synthetic construct
  source 1..19: note = Seed: LQTVHSIPLTINKEEALQR
LQTVHSIPFTIHKVEAIQR

SEQ ID NO: 33994 - protein, 19 aa, synthetic construct
  source 1..19: note = Seed: LQTVHSIPLTINKEEALQR
LQTVHSIPFTIHKVEALQR

SEQ ID NO: 33995 - protein, 19 aa, synthetic construct
  source 1..19: note = Seed: LQTVHSIPLTINKEEALQR
LQTVHSIPFTIHKWEAFQR

SEQ ID NO: 33996 - protein, 19 aa, synthetic construct
  source 1..19: note = Seed: LQTVHSIPLTINKEEALQR
LQTVHSIPFTIHKWEAIQR

SEQ ID NO: 33997 - protein, 19 aa, synthetic construct
  source 1..19: note = Seed: LQTVHSIPLTINKEEALQR
LQTVHSIPFTIHKWEALQR

SEQ ID NO: 33998 - protein, 19 aa, synthetic construct
  source 1..19: note = Seed: LQTVHSIPLTINKEEALQR
LQTVHSIPFTIHKWEAMQR

SEQ ID NO: 33999 - protein, 19 aa, synthetic construct
  source 1..19: note = Seed: LQTVHSIPLTINKEEALQR
LQTVHSIPFTIHKWEAVQR

SEQ ID NO: 34000 - protein, 19 aa, synthetic construct
  source 1..19: note = Seed: LQTVHSIPLTINKEEALQR
LQTVHSIPFTIHKYEAFQR

SEQ ID NO: 34001 - protein, 19 aa, synthetic construct
  source 1..19: note = Seed: LQTVHSIPLTINKEEALQR
LQTVHSIPFTIHKYEAIQR

SEQ ID NO: 34002 - protein, 19 aa, synthetic construct
  source 1..19: note = Seed: LQTVHSIPLTINKEEALQR
LQTVHSIPFTIHKYEALQR

SEQ ID NO: 34003 - protein, 19 aa, synthetic construct
  source 1..19: note = Seed: LQTVHSIPLTINKEEALQR
LQTVHSIPFTIHKYEAMQR

SEQ ID NO: 34004 - protein, 19 aa, synthetic construct
  source 1..19: note = Seed: LQTVHSIPLTINKEEALQR
LQTVHSIPFTIHKYEAVQR

SEQ ID NO: 34005 - protein, 19 aa, synthetic construct
  source 1..19: note = Seed: LQTVHSIPLTINKEEALQR
LQTVHSIPFTIIKAEAAQR

SEQ ID NO: 34006 - protein, 19 aa, synthetic construct
  source 1..19: note = Seed: LQTVHSIPLTINKEEALQR
LQTVHSIPFTIIKAEACQR

SEQ ID NO: 34007 - protein, 19 aa, synthetic construct
  source 1..19: note = Seed: LQTVHSIPLTINKEEALQR
LQTVHSIPFTIIKAEAFQR

SEQ ID NO: 34008 - protein, 19 aa, synthetic construct
  source 1..19: note = Seed: LQTVHSIPLTINKEEALQR
LQTVHSIPFTIIKAEAGQR

SEQ ID NO: 34009 - protein, 19 aa, synthetic construct
  source 1..19: note = Seed: LQTVHSIPLTINKEEALQR
LQTVHSIPFTIIKAEALQR

SEQ ID NO: 34010 - protein, 19 aa, synthetic construct
  source 1..19: note = Seed: LQTVHSIPLTINKEEALQR
LQTVHSIPFTIIKAEAMQR

SEQ ID NO: 34011 - protein, 19 aa, synthetic construct
  source 1..19: note = Seed: LQTVHSIPLTINKEEALQR
LQTVHSIPFTIIKAEANQR

SEQ ID NO: 34012 - protein, 19 aa, synthetic construct
  source 1..19: note = Seed: LQTVHSIPLTINKEEALQR
LQTVHSIPFTIIKAEASQR

SEQ ID NO: 34013 - protein, 19 aa, synthetic construct
  source 1..19: note = Seed: LQTVHSIPLTINKEEALQR
LQTVHSIPFTIIKAEATQR

SEQ ID NO: 34014 - protein, 19 aa, synthetic construct
  source 1..19: note = Seed: LQTVHSIPLTINKEEALQR
LQTVHSIPFTIIKFEAAQR

SEQ ID NO: 34015 - protein, 19 aa, synthetic construct
  source 1..19: note = Seed: LQTVHSIPLTINKEEALQR
LQTVHSIPFTIIKFEACQR

SEQ ID NO: 34016 - protein, 19 aa, synthetic construct
  source 1..19: note = Seed: LQTVHSIPLTINKEEALQR
LQTVHSIPFTIIKFEADQR

SEQ ID NO: 34017 - protein, 19 aa, synthetic construct
  source 1..19: note = Seed: LQTVHSIPLTINKEEALQR
LQTVHSIPFTIIKFEAEQR

SEQ ID NO: 34018 - protein, 19 aa, synthetic construct
  source 1..19: note = Seed: LQTVHSIPLTINKEEALQR
LQTVHSIPFTIIKFEAFQR

SEQ ID NO: 34019 - protein, 19 aa, synthetic construct
  source 1..19: note = Seed: LQTVHSIPLTINKEEALQR
LQTVHSIPFTIIKFEAGQR

SEQ ID NO: 34020 - protein, 19 aa, synthetic construct
  source 1..19: note = Seed: LQTVHSIPLTINKEEALQR
LQTVHSIPFTIIKFEAHQR

SEQ ID NO: 34021 - protein, 19 aa, synthetic construct
  source 1..19: note = Seed: LQTVHSIPLTINKEEALQR
LQTVHSIPFTIIKFEAIQR

SEQ ID NO: 34022 - protein, 19 aa, synthetic construct
  source 1..19: note = Seed: LQTVHSIPLTINKEEALQR
LQTVHSIPFTIIKFEAKQR

SEQ ID NO: 34023 - protein, 19 aa, synthetic construct
  source 1..19: note = Seed: LQTVHSIPLTINKEEALQR
LQTVHSIPFTIIKFEALQR

SEQ ID NO: 34024 - protein, 19 aa, synthetic construct
  source 1..19: note = Seed: LQTVHSIPLTINKEEALQR
LQTVHSIPFTIIKFEAMQR

SEQ ID NO: 34025 - protein, 19 aa, synthetic construct
  source 1..19: note = Seed: LQTVHSIPLTINKEEALQR
LQTVHSIPFTIIKFEANQR

SEQ ID NO: 34026 - protein, 19 aa, synthetic construct
  source 1..19: note = Seed: LQTVHSIPLTINKEEALQR
LQTVHSIPFTIIKFEAPQR

SEQ ID NO: 34027 - protein, 19 aa, synthetic construct
  source 1..19: note = Seed: LQTVHSIPLTINKEEALQR
LQTVHSIPFTIIKFEAQQR

SEQ ID NO: 34028 - protein, 19 aa, synthetic construct
  source 1..19: note = Seed: LQTVHSIPLTINKEEALQR
LQTVHSIPFTIIKFEARQR

SEQ ID NO: 34029 - protein, 19 aa, synthetic construct
  source 1..19: note = Seed: LQTVHSIPLTINKEEALQR
LQTVHSIPFTIIKFEASQR

SEQ ID NO: 34030 - protein, 19 aa, synthetic construct
  source 1..19: note = Seed: LQTVHSIPLTINKEEALQR
LQTVHSIPFTIIKFEATQR

SEQ ID NO: 34031 - protein, 19 aa, synthetic construct
  source 1..19: note = Seed: LQTVHSIPLTINKEEALQR
LQTVHSIPFTIIKFEAVQR

SEQ ID NO: 34032 - protein, 19 aa, synthetic construct
  source 1..19: note = Seed: LQTVHSIPLTINKEEALQR
LQTVHSIPFTIIKFEAYQR

SEQ ID NO: 34033 - protein, 19 aa, synthetic construct
  source 1..19: note = Seed: LQTVHSIPLTINKEEALQR
LQTVHSIPFTIIKGEAAQR

SEQ ID NO: 34034 - protein, 19 aa, synthetic construct
  source 1..19: note = Seed: LQTVHSIPLTINKEEALQR
LQTVHSIPFTIIKGEACQR

SEQ ID NO: 34035 - protein, 19 aa, synthetic construct
  source 1..19: note = Seed: LQTVHSIPLTINKEEALQR
LQTVHSIPFTIIKGEAGQR

SEQ ID NO: 34036 - protein, 19 aa, synthetic construct
  source 1..19: note = Seed: LQTVHSIPLTINKEEALQR
LQTVHSIPFTIIKGEAIQR

SEQ ID NO: 34037 - protein, 19 aa, synthetic construct
  source 1..19: note = Seed: LQTVHSIPLTINKEEALQR
LQTVHSIPFTIIKGEALQR

SEQ ID NO: 34038 - protein, 19 aa, synthetic construct
  source 1..19: note = Seed: LQTVHSIPLTINKEEALQR
LQTVHSIPFTIIKGEAMQR

SEQ ID NO: 34039 - protein, 19 aa, synthetic construct
  source 1..19: note = Seed: LQTVHSIPLTINKEEALQR
LQTVHSIPFTIIKGEANQR

SEQ ID NO: 34040 - protein, 19 aa, synthetic construct
  source 1..19: note = Seed: LQTVHSIPLTINKEEALQR
LQTVHSIPFTIIKGEASQR

SEQ ID NO: 34041 - protein, 19 aa, synthetic construct
  source 1..19: note = Seed: LQTVHSIPLTINKEEALQR
LQTVHSIPFTIIKGEATQR

SEQ ID NO: 34042 - protein, 19 aa, synthetic construct
  source 1..19: note = Seed: LQTVHSIPLTINKEEALQR
LQTVHSIPFTIIKGEAVQR

SEQ ID NO: 34043 - protein, 19 aa, synthetic construct
  source 1..19: note = Seed: LQTVHSIPLTINKEEALQR
LQTVHSIPFTIIKIEADQR

SEQ ID NO: 34044 - protein, 19 aa, synthetic construct
  source 1..19: note = Seed: LQTVHSIPLTINKEEALQR
LQTVHSIPFTIIKIEAEQR

SEQ ID NO: 34045 - protein, 19 aa, synthetic construct
  source 1..19: note = Seed: LQTVHSIPLTINKEEALQR
LQTVHSIPFTIIKIEAFQR

SEQ ID NO: 34046 - protein, 19 aa, synthetic construct
  source 1..19: note = Seed: LQTVHSIPLTINKEEALQR
LQTVHSIPFTIIKIEAIQR

SEQ ID NO: 34047 - protein, 19 aa, synthetic construct
  source 1..19: note = Seed: LQTVHSIPLTINKEEALQR
LQTVHSIPFTIIKIEALQR

SEQ ID NO: 34048 - protein, 19 aa, synthetic construct
  source 1..19: note = Seed: LQTVHSIPLTINKEEALQR
LQTVHSIPFTIIKIEAMQR

SEQ ID NO: 34049 - protein, 19 aa, synthetic construct
  source 1..19: note = Seed: LQTVHSIPLTINKEEALQR
LQTVHSIPFTIIKIEAVQR

SEQ ID NO: 34050 - protein, 19 aa, synthetic construct
  source 1..19: note = Seed: LQTVHSIPLTINKEEALQR
LQTVHSIPFTIIKIEAYQR

SEQ ID NO: 34051 - protein, 19 aa, synthetic construct
  source 1..19: note = Seed: LQTVHSIPLTINKEEALQR
LQTVHSIPFTIIKLEADQR

SEQ ID NO: 34052 - protein, 19 aa, synthetic construct
  source 1..19: note = Seed: LQTVHSIPLTINKEEALQR
LQTVHSIPFTIIKLEAEQR

SEQ ID NO: 34053 - protein, 19 aa, synthetic construct
  source 1..19: note = Seed: LQTVHSIPLTINKEEALQR
LQTVHSIPFTIIKLEAFQR

SEQ ID NO: 34054 - protein, 19 aa, synthetic construct
  source 1..19: note = Seed: LQTVHSIPLTINKEEALQR
LQTVHSIPFTIIKLEAIQR

SEQ ID NO: 34055 - protein, 19 aa, synthetic construct
  source 1..19: note = Seed: LQTVHSIPLTINKEEALQR
LQTVHSIPFTIIKLEALQR

SEQ ID NO: 34056 - protein, 19 aa, synthetic construct
  source 1..19: note = Seed: LQTVHSIPLTINKEEALQR
LQTVHSIPFTIIKLEAMQR

SEQ ID NO: 34057 - protein, 19 aa, synthetic construct
  source 1..19: note = Seed: LQTVHSIPLTINKEEALQR
LQTVHSIPFTIIKLEANQR

SEQ ID NO: 34058 - protein, 19 aa, synthetic construct
  source 1..19: note = Seed: LQTVHSIPLTINKEEALQR
LQTVHSIPFTIIKLEATQR

SEQ ID NO: 34059 - protein, 19 aa, synthetic construct
  source 1..19: note = Seed: LQTVHSIPLTINKEEALQR
LQTVHSIPFTIIKLEAVQR

SEQ ID NO: 34060 - protein, 19 aa, synthetic construct
  source 1..19: note = Seed: LQTVHSIPLTINKEEALQR
LQTVHSIPFTIIKLEAYQR

SEQ ID NO: 34061 - protein, 19 aa, synthetic construct
  source 1..19: note = Seed: LQTVHSIPLTINKEEALQR
LQTVHSIPFTIIKMEADQR

SEQ ID NO: 34062 - protein, 19 aa, synthetic construct
  source 1..19: note = Seed: LQTVHSIPLTINKEEALQR
LQTVHSIPFTIIKMEAIQR

SEQ ID NO: 34063 - protein, 19 aa, synthetic construct
  source 1..19: note = Seed: LQTVHSIPLTINKEEALQR
LQTVHSIPFTIIKMEAMQR

SEQ ID NO: 34064 - protein, 19 aa, synthetic construct
  source 1..19: note = Seed: LQTVHSIPLTINKEEALQR
LQTVHSIPFTIIKMEAVQR

SEQ ID NO: 34065 - protein, 19 aa, synthetic construct
  source 1..19: note = Seed: LQTVHSIPLTINKEEALQR
LQTVHSIPFTIIKNEAAQR

SEQ ID NO: 34066 - protein, 19 aa, synthetic construct
  source 1..19: note = Seed: LQTVHSIPLTINKEEALQR
LQTVHSIPFTIIKNEAGQR

SEQ ID NO: 34067 - protein, 19 aa, synthetic construct
  source 1..19: note = Seed: LQTVHSIPLTINKEEALQR
LQTVHSIPFTIIKNEAIQR

SEQ ID NO: 34068 - protein, 19 aa, synthetic construct
  source 1..19: note = Seed: LQTVHSIPLTINKEEALQR
LQTVHSIPFTIIKNEALQR

SEQ ID NO: 34069 - protein, 19 aa, synthetic construct
  source 1..19: note = Seed: LQTVHSIPLTINKEEALQR
LQTVHSIPFTIIKNEAMQR

SEQ ID NO: 34070 - protein, 19 aa, synthetic construct
  source 1..19: note = Seed: LQTVHSIPLTINKEEALQR
LQTVHSIPFTIIKNEASQR

SEQ ID NO: 34071 - protein, 19 aa, synthetic construct
  source 1..19: note = Seed: LQTVHSIPLTINKEEALQR
LQTVHSIPFTIIKNEATQR

SEQ ID NO: 34072 - protein, 19 aa, synthetic construct
  source 1..19: note = Seed: LQTVHSIPLTINKEEALQR
LQTVHSIPFTIIKNEAVQR

SEQ ID NO: 34073 - protein, 19 aa, synthetic construct
  source 1..19: note = Seed: LQTVHSIPLTINKEEALQR
LQTVHSIPFTIIKPEAAQR

SEQ ID NO: 34074 - protein, 19 aa, synthetic construct
  source 1..19: note = Seed: LQTVHSIPLTINKEEALQR
LQTVHSIPFTIIKPEAIQR

SEQ ID NO: 34075 - protein, 19 aa, synthetic construct
  source 1..19: note = Seed: LQTVHSIPLTINKEEALQR
LQTVHSIPFTIIKPEALQR

SEQ ID NO: 34076 - protein, 19 aa, synthetic construct
  source 1..19: note = Seed: LQTVHSIPLTINKEEALQR
LQTVHSIPFTIIKPEAMQR

SEQ ID NO: 34077 - protein, 19 aa, synthetic construct
  source 1..19: note = Seed: LQTVHSIPLTINKEEALQR
LQTVHSIPFTIIKPEASQR

SEQ ID NO: 34078 - protein, 19 aa, synthetic construct
  source 1..19: note = Seed: LQTVHSIPLTINKEEALQR
LQTVHSIPFTIIKPEATQR

SEQ ID NO: 34079 - protein, 19 aa, synthetic construct
  source 1..19: note = Seed: LQTVHSIPLTINKEEALQR
LQTVHSIPFTIIKPEAVQR

SEQ ID NO: 34080 - protein, 19 aa, synthetic construct
  source 1..19: note = Seed: LQTVHSIPLTINKEEALQR
LQTVHSIPFTIIKSEAAQR

SEQ ID NO: 34081 - protein, 19 aa, synthetic construct
  source 1..19: note = Seed: LQTVHSIPLTINKEEALQR
LQTVHSIPFTIIKSEACQR

SEQ ID NO: 34082 - protein, 19 aa, synthetic construct
  source 1..19: note = Seed: LQTVHSIPLTINKEEALQR
LQTVHSIPFTIIKSEAFQR

SEQ ID NO: 34083 - protein, 19 aa, synthetic construct
  source 1..19: note = Seed: LQTVHSIPLTINKEEALQR
LQTVHSIPFTIIKSEAGQR

SEQ ID NO: 34084 - protein, 19 aa, synthetic construct
  source 1..19: note = Seed: LQTVHSIPLTINKEEALQR
LQTVHSIPFTIIKSEAIQR

SEQ ID NO: 34085 - protein, 19 aa, synthetic construct
  source 1..19: note = Seed: LQTVHSIPLTINKEEALQR
LQTVHSIPFTIIKSEALQR

SEQ ID NO: 34086 - protein, 19 aa, synthetic construct
  source 1..19: note = Seed: LQTVHSIPLTINKEEALQR
LQTVHSIPFTIIKSEAMQR

SEQ ID NO: 34087 - protein, 19 aa, synthetic construct
  source 1..19: note = Seed: LQTVHSIPLTINKEEALQR
LQTVHSIPFTIIKSEASQR

SEQ ID NO: 34088 - protein, 19 aa, synthetic construct
  source 1..19: note = Seed: LQTVHSIPLTINKEEALQR
LQTVHSIPFTIIKSEATQR

SEQ ID NO: 34089 - protein, 19 aa, synthetic construct
  source 1..19: note = Seed: LQTVHSIPLTINKEEALQR
LQTVHSIPFTIIKSEAVQR

SEQ ID NO: 34090 - protein, 19 aa, synthetic construct
  source 1..19: note = Seed: LQTVHSIPLTINKEEALQR
LQTVHSIPFTIIKTEAAQR

SEQ ID NO: 34091 - protein, 19 aa, synthetic construct
  source 1..19: note = Seed: LQTVHSIPLTINKEEALQR
LQTVHSIPFTIIKTEAIQR

SEQ ID NO: 34092 - protein, 19 aa, synthetic construct
  source 1..19: note = Seed: LQTVHSIPLTINKEEALQR
LQTVHSIPFTIIKTEALQR

SEQ ID NO: 34093 - protein, 19 aa, synthetic construct
  source 1..19: note = Seed: LQTVHSIPLTINKEEALQR
LQTVHSIPFTIIKTEAMQR

SEQ ID NO: 34094 - protein, 19 aa, synthetic construct
  source 1..19: note = Seed: LQTVHSIPLTINKEEALQR
LQTVHSIPFTIIKTEASQR

SEQ ID NO: 34095 - protein, 19 aa, synthetic construct
  source 1..19: note = Seed: LQTVHSIPLTINKEEALQR
LQTVHSIPFTIIKTEATQR

SEQ ID NO: 34096 - protein, 19 aa, synthetic construct
  source 1..19: note = Seed: LQTVHSIPLTINKEEALQR
LQTVHSIPFTIIKTEAVQR

SEQ ID NO: 34097 - protein, 19 aa, synthetic construct
  source 1..19: note = Seed: LQTVHSIPLTINKEEALQR
LQTVHSIPFTIIKVEAAQR

SEQ ID NO: 34098 - protein, 19 aa, synthetic construct
  source 1..19: note = Seed: LQTVHSIPLTINKEEALQR
LQTVHSIPFTIIKVEAIQR

SEQ ID NO: 34099 - protein, 19 aa, synthetic construct
  source 1..19: note = Seed: LQTVHSIPLTINKEEALQR
LQTVHSIPFTIIKVEALQR

SEQ ID NO: 34100 - protein, 19 aa, synthetic construct
  source 1..19: note = Seed: LQTVHSIPLTINKEEALQR
LQTVHSIPFTIIKVEAMQR

SEQ ID NO: 34101 - protein, 19 aa, synthetic construct
  source 1..19: note = Seed: LQTVHSIPLTINKEEALQR
LQTVHSIPFTIIKVEATQR

SEQ ID NO: 34102 - protein, 19 aa, synthetic construct
  source 1..19: note = Seed: LQTVHSIPLTINKEEALQR
LQTVHSIPFTIIKVEAVQR

SEQ ID NO: 34103 - protein, 19 aa, synthetic construct
  source 1..19: note = Seed: LQTVHSIPLTINKEEALQR
LQTVHSIPFTIIKWEAAQR

SEQ ID NO: 34104 - protein, 19 aa, synthetic construct
  source 1..19: note = Seed: LQTVHSIPLTINKEEALQR
LQTVHSIPFTIIKWEADQR

SEQ ID NO: 34105 - protein, 19 aa, synthetic construct
  source 1..19: note = Seed: LQTVHSIPLTINKEEALQR
LQTVHSIPFTIIKWEAIQR

SEQ ID NO: 34106 - protein, 19 aa, synthetic construct
  source 1..19: note = Seed: LQTVHSIPLTINKEEALQR
LQTVHSIPFTIIKWEALQR

SEQ ID NO: 34107 - protein, 19 aa, synthetic construct
  source 1..19: note = Seed: LQTVHSIPLTINKEEALQR
LQTVHSIPFTIIKWEAMQR

SEQ ID NO: 34108 - protein, 19 aa, synthetic construct
  source 1..19: note = Seed: LQTVHSIPLTINKEEALQR
LQTVHSIPFTIIKWEANQR

SEQ ID NO: 34109 - protein, 19 aa, synthetic construct
  source 1..19: note = Seed: LQTVHSIPLTINKEEALQR
LQTVHSIPFTIIKWEATQR

SEQ ID NO: 34110 - protein, 19 aa, synthetic construct
  source 1..19: note = Seed: LQTVHSIPLTINKEEALQR
LQTVHSIPFTIIKWEAVQR

SEQ ID NO: 34111 - protein, 19 aa, synthetic construct
  source 1..19: note = Seed: LQTVHSIPLTINKEEALQR
LQTVHSIPFTIIKYEAAQR

SEQ ID NO: 34112 - protein, 19 aa, synthetic construct
  source 1..19: note = Seed: LQTVHSIPLTINKEEALQR
LQTVHSIPFTIIKYEADQR

SEQ ID NO: 34113 - protein, 19 aa, synthetic construct
  source 1..19: note = Seed: LQTVHSIPLTINKEEALQR
LQTVHSIPFTIIKYEAEQR

SEQ ID NO: 34114 - protein, 19 aa, synthetic construct
  source 1..19: note = Seed: LQTVHSIPLTINKEEALQR
LQTVHSIPFTIIKYEAFQR

SEQ ID NO: 34115 - protein, 19 aa, synthetic construct
  source 1..19: note = Seed: LQTVHSIPLTINKEEALQR
LQTVHSIPFTIIKYEAIQR

SEQ ID NO: 34116 - protein, 19 aa, synthetic construct
  source 1..19: note = Seed: LQTVHSIPLTINKEEALQR
LQTVHSIPFTIIKYEALQR

SEQ ID NO: 34117 - protein, 19 aa, synthetic construct
  source 1..19: note = Seed: LQTVHSIPLTINKEEALQR
LQTVHSIPFTIIKYEAMQR

SEQ ID NO: 34118 - protein, 19 aa, synthetic construct
  source 1..19: note = Seed: LQTVHSIPLTINKEEALQR
LQTVHSIPFTIIKYEANQR

SEQ ID NO: 34119 - protein, 19 aa, synthetic construct
  source 1..19: note = Seed: LQTVHSIPLTINKEEALQR
LQTVHSIPFTIIKYEASQR

SEQ ID NO: 34120 - protein, 19 aa, synthetic construct
  source 1..19: note = Seed: LQTVHSIPLTINKEEALQR
LQTVHSIPFTIIKYEATQR

SEQ ID NO: 34121 - protein, 19 aa, synthetic construct
  source 1..19: note = Seed: LQTVHSIPLTINKEEALQR
LQTVHSIPFTIIKYEAVQR

SEQ ID NO: 34122 - protein, 19 aa, synthetic construct
  source 1..19: note = Seed: LQTVHSIPLTINKEEALQR
LQTVHSIPFTIIKYEAYQR

SEQ ID NO: 34123 - protein, 19 aa, synthetic construct
  source 1..19: note = Seed: LQTVHSIPLTINKEEALQR
LQTVHSIPFTIKKFEAFQR

SEQ ID NO: 34124 - protein, 19 aa, synthetic construct
  source 1..19: note = Seed: LQTVHSIPLTINKEEALQR
LQTVHSIPFTIKKFEAIQR

SEQ ID NO: 34125 - protein, 19 aa, synthetic construct
  source 1..19: note = Seed: LQTVHSIPLTINKEEALQR
LQTVHSIPFTIKKFEALQR

SEQ ID NO: 34126 - protein, 19 aa, synthetic construct
  source 1..19: note = Seed: LQTVHSIPLTINKEEALQR
LQTVHSIPFTIKKFEAMQR

SEQ ID NO: 34127 - protein, 19 aa, synthetic construct
  source 1..19: note = Seed: LQTVHSIPLTINKEEALQR
LQTVHSIPFTIKKFEAVQR

SEQ ID NO: 34128 - protein, 19 aa, synthetic construct
  source 1..19: note = Seed: LQTVHSIPLTINKEEALQR
LQTVHSIPFTIKKFEAYQR

SEQ ID NO: 34129 - protein, 19 aa, synthetic construct
  source 1..19: note = Seed: LQTVHSIPLTINKEEALQR
LQTVHSIPFTILKAEAAQR

SEQ ID NO: 34130 - protein, 19 aa, synthetic construct
  source 1..19: note = Seed: LQTVHSIPLTINKEEALQR
LQTVHSIPFTILKAEACQR

SEQ ID NO: 34131 - protein, 19 aa, synthetic construct
  source 1..19: note = Seed: LQTVHSIPLTINKEEALQR
LQTVHSIPFTILKAEAFQR

SEQ ID NO: 34132 - protein, 19 aa, synthetic construct
  source 1..19: note = Seed: LQTVHSIPLTINKEEALQR
LQTVHSIPFTILKAEAGQR

SEQ ID NO: 34133 - protein, 19 aa, synthetic construct
  source 1..19: note = Seed: LQTVHSIPLTINKEEALQR
LQTVHSIPFTILKAEAHQR

SEQ ID NO: 34134 - protein, 19 aa, synthetic construct
  source 1..19: note = Seed: LQTVHSIPLTINKEEALQR
LQTVHSIPFTILKAEAIQR

SEQ ID NO: 34135 - protein, 19 aa, synthetic construct
  source 1..19: note = Seed: LQTVHSIPLTINKEEALQR
LQTVHSIPFTILKAEAKQR

SEQ ID NO: 34136 - protein, 19 aa, synthetic construct
  source 1..19: note = Seed: LQTVHSIPLTINKEEALQR
LQTVHSIPFTILKAEALQR

SEQ ID NO: 34137 - protein, 19 aa, synthetic construct
  source 1..19: note = Seed: LQTVHSIPLTINKEEALQR
LQTVHSIPFTILKAEAMQR

SEQ ID NO: 34138 - protein, 19 aa, synthetic construct
  source 1..19: note = Seed: LQTVHSIPLTINKEEALQR
LQTVHSIPFTILKAEANQR

SEQ ID NO: 34139 - protein, 19 aa, synthetic construct
  source 1..19: note = Seed: LQTVHSIPLTINKEEALQR
LQTVHSIPFTILKAEAPQR

SEQ ID NO: 34140 - protein, 19 aa, synthetic construct
  source 1..19: note = Seed: LQTVHSIPLTINKEEALQR
LQTVHSIPFTILKAEAQQR

SEQ ID NO: 34141 - protein, 19 aa, synthetic construct
  source 1..19: note = Seed: LQTVHSIPLTINKEEALQR
LQTVHSIPFTILKAEARQR

SEQ ID NO: 34142 - protein, 19 aa, synthetic construct
  source 1..19: note = Seed: LQTVHSIPLTINKEEALQR
LQTVHSIPFTILKAEASQR

SEQ ID NO: 34143 - protein, 19 aa, synthetic construct
  source 1..19: note = Seed: LQTVHSIPLTINKEEALQR
LQTVHSIPFTILKAEATQR

SEQ ID NO: 34144 - protein, 19 aa, synthetic construct
  source 1..19: note = Seed: LQTVHSIPLTINKEEALQR
LQTVHSIPFTILKAEAVQR

SEQ ID NO: 34145 - protein, 19 aa, synthetic construct
  source 1..19: note = Seed: LQTVHSIPLTINKEEALQR
LQTVHSIPFTILKAEAYQR

SEQ ID NO: 34146 - protein, 19 aa, synthetic construct
  source 1..19: note = Seed: LQTVHSIPLTINKEEALQR
LQTVHSIPFTILKFEAAQR

SEQ ID NO: 34147 - protein, 19 aa, synthetic construct
  source 1..19: note = Seed: LQTVHSIPLTINKEEALQR
LQTVHSIPFTILKFEADQR

SEQ ID NO: 34148 - protein, 19 aa, synthetic construct
  source 1..19: note = Seed: LQTVHSIPLTINKEEALQR
LQTVHSIPFTILKFEAEQR

SEQ ID NO: 34149 - protein, 19 aa, synthetic construct
  source 1..19: note = Seed: LQTVHSIPLTINKEEALQR
LQTVHSIPFTILKFEAFQR

SEQ ID NO: 34150 - protein, 19 aa, synthetic construct
  source 1..19: note = Seed: LQTVHSIPLTINKEEALQR
LQTVHSIPFTILKFEAGQR

SEQ ID NO: 34151 - protein, 19 aa, synthetic construct
  source 1..19: note = Seed: LQTVHSIPLTINKEEALQR
LQTVHSIPFTILKFEAHQR

SEQ ID NO: 34152 - protein, 19 aa, synthetic construct
  source 1..19: note = Seed: LQTVHSIPLTINKEEALQR
LQTVHSIPFTILKFEAIQR

SEQ ID NO: 34153 - protein, 19 aa, synthetic construct
  source 1..19: note = Seed: LQTVHSIPLTINKEEALQR
LQTVHSIPFTILKFEALQR

SEQ ID NO: 34154 - protein, 19 aa, synthetic construct
  source 1..19: note = Seed: LQTVHSIPLTINKEEALQR
LQTVHSIPFTILKFEAMQR

SEQ ID NO: 34155 - protein, 19 aa, synthetic construct
  source 1..19: note = Seed: LQTVHSIPLTINKEEALQR
LQTVHSIPFTILKFEANQR

SEQ ID NO: 34156 - protein, 19 aa, synthetic construct
  source 1..19: note = Seed: LQTVHSIPLTINKEEALQR
LQTVHSIPFTILKFEAQQR

SEQ ID NO: 34157 - protein, 19 aa, synthetic construct
  source 1..19: note = Seed: LQTVHSIPLTINKEEALQR
LQTVHSIPFTILKFEARQR

SEQ ID NO: 34158 - protein, 19 aa, synthetic construct
  source 1..19: note = Seed: LQTVHSIPLTINKEEALQR
LQTVHSIPFTILKFEASQR

SEQ ID NO: 34159 - protein, 19 aa, synthetic construct
  source 1..19: note = Seed: LQTVHSIPLTINKEEALQR
LQTVHSIPFTILKFEATQR

SEQ ID NO: 34160 - protein, 19 aa, synthetic construct
  source 1..19: note = Seed: LQTVHSIPLTINKEEALQR
LQTVHSIPFTILKFEAVQR

SEQ ID NO: 34161 - protein, 19 aa, synthetic construct
  source 1..19: note = Seed: LQTVHSIPLTINKEEALQR
LQTVHSIPFTILKFEAYQR

SEQ ID NO: 34162 - protein, 19 aa, synthetic construct
  source 1..19: note = Seed: LQTVHSIPLTINKEEALQR
LQTVHSIPFTILKGEAAQR

SEQ ID NO: 34163 - protein, 19 aa, synthetic construct
  source 1..19: note = Seed: LQTVHSIPLTINKEEALQR
LQTVHSIPFTILKGEACQR

SEQ ID NO: 34164 - protein, 19 aa, synthetic construct
  source 1..19: note = Seed: LQTVHSIPLTINKEEALQR
LQTVHSIPFTILKGEAFQR

SEQ ID NO: 34165 - protein, 19 aa, synthetic construct
  source 1..19: note = Seed: LQTVHSIPLTINKEEALQR
LQTVHSIPFTILKGEAGQR

SEQ ID NO: 34166 - protein, 19 aa, synthetic construct
  source 1..19: note = Seed: LQTVHSIPLTINKEEALQR
LQTVHSIPFTILKGEAHQR

SEQ ID NO: 34167 - protein, 19 aa, synthetic construct
  source 1..19: note = Seed: LQTVHSIPLTINKEEALQR
LQTVHSIPFTILKGEAIQR

SEQ ID NO: 34168 - protein, 19 aa, synthetic construct
  source 1..19: note = Seed: LQTVHSIPLTINKEEALQR
LQTVHSIPFTILKGEALQR

SEQ ID NO: 34169 - protein, 19 aa, synthetic construct
  source 1..19: note = Seed: LQTVHSIPLTINKEEALQR
LQTVHSIPFTILKGEAMQR

SEQ ID NO: 34170 - protein, 19 aa, synthetic construct
  source 1..19: note = Seed: LQTVHSIPLTINKEEALQR
LQTVHSIPFTILKGEANQR

SEQ ID NO: 34171 - protein, 19 aa, synthetic construct
  source 1..19: note = Seed: LQTVHSIPLTINKEEALQR
LQTVHSIPFTILKGEAPQR

SEQ ID NO: 34172 - protein, 19 aa, synthetic construct
  source 1..19: note = Seed: LQTVHSIPLTINKEEALQR
LQTVHSIPFTILKGEAQQR

SEQ ID NO: 34173 - protein, 19 aa, synthetic construct
  source 1..19: note = Seed: LQTVHSIPLTINKEEALQR
LQTVHSIPFTILKGEASQR

SEQ ID NO: 34174 - protein, 19 aa, synthetic construct
  source 1..19: note = Seed: LQTVHSIPLTINKEEALQR
LQTVHSIPFTILKGEATQR

SEQ ID NO: 34175 - protein, 19 aa, synthetic construct
  source 1..19: note = Seed: LQTVHSIPLTINKEEALQR
LQTVHSIPFTILKGEAVQR

SEQ ID NO: 34176 - protein, 19 aa, synthetic construct
  source 1..19: note = Seed: LQTVHSIPLTINKEEALQR
LQTVHSIPFTILKHEALQR

SEQ ID NO: 34177 - protein, 19 aa, synthetic construct
  source 1..19: note = Seed: LQTVHSIPLTINKEEALQR
LQTVHSIPFTILKHEAVQR

SEQ ID NO: 34178 - protein, 19 aa, synthetic construct
  source 1..19: note = Seed: LQTVHSIPLTINKEEALQR
LQTVHSIPFTILKIEAAQR

SEQ ID NO: 34179 - protein, 19 aa, synthetic construct
  source 1..19: note = Seed: LQTVHSIPLTINKEEALQR
LQTVHSIPFTILKIEAIQR

SEQ ID NO: 34180 - protein, 19 aa, synthetic construct
  source 1..19: note = Seed: LQTVHSIPLTINKEEALQR
LQTVHSIPFTILKIEALQR

SEQ ID NO: 34181 - protein, 19 aa, synthetic construct
  source 1..19: note = Seed: LQTVHSIPLTINKEEALQR
LQTVHSIPFTILKIEAMQR

SEQ ID NO: 34182 - protein, 19 aa, synthetic construct
  source 1..19: note = Seed: LQTVHSIPLTINKEEALQR
LQTVHSIPFTILKIEASQR

SEQ ID NO: 34183 - protein, 19 aa, synthetic construct
  source 1..19: note = Seed: LQTVHSIPLTINKEEALQR
LQTVHSIPFTILKIEATQR

SEQ ID NO: 34184 - protein, 19 aa, synthetic construct
  source 1..19: note = Seed: LQTVHSIPLTINKEEALQR
LQTVHSIPFTILKIEAVQR

SEQ ID NO: 34185 - protein, 19 aa, synthetic construct
  source 1..19: note = Seed: LQTVHSIPLTINKEEALQR
LQTVHSIPFTILKLEADQR

SEQ ID NO: 34186 - protein, 19 aa, synthetic construct
  source 1..19: note = Seed: LQTVHSIPLTINKEEALQR
LQTVHSIPFTILKLEAIQR

SEQ ID NO: 34187 - protein, 19 aa, synthetic construct
  source 1..19: note = Seed: LQTVHSIPLTINKEEALQR
LQTVHSIPFTILKLEALQR

SEQ ID NO: 34188 - protein, 19 aa, synthetic construct
  source 1..19: note = Seed: LQTVHSIPLTINKEEALQR
LQTVHSIPFTILKLEAMQR

SEQ ID NO: 34189 - protein, 19 aa, synthetic construct
  source 1..19: note = Seed: LQTVHSIPLTINKEEALQR
LQTVHSIPFTILKLEAVQR

SEQ ID NO: 34190 - protein, 19 aa, synthetic construct
  source 1..19: note = Seed: LQTVHSIPLTINKEEALQR
LQTVHSIPFTILKNEAAQR

SEQ ID NO: 34191 - protein, 19 aa, synthetic construct
  source 1..19: note = Seed: LQTVHSIPLTINKEEALQR
LQTVHSIPFTILKNEACQR

SEQ ID NO: 34192 - protein, 19 aa, synthetic construct
  source 1..19: note = Seed: LQTVHSIPLTINKEEALQR
LQTVHSIPFTILKNEAFQR

SEQ ID NO: 34193 - protein, 19 aa, synthetic construct
  source 1..19: note = Seed: LQTVHSIPLTINKEEALQR
LQTVHSIPFTILKNEAGQR

SEQ ID NO: 34194 - protein, 19 aa, synthetic construct
  source 1..19: note = Seed: LQTVHSIPLTINKEEALQR
LQTVHSIPFTILKNEAIQR

SEQ ID NO: 34195 - protein, 19 aa, synthetic construct
  source 1..19: note = Seed: LQTVHSIPLTINKEEALQR
LQTVHSIPFTILKNEALQR

SEQ ID NO: 34196 - protein, 19 aa, synthetic construct
  source 1..19: note = Seed: LQTVHSIPLTINKEEALQR
LQTVHSIPFTILKNEAMQR

SEQ ID NO: 34197 - protein, 19 aa, synthetic construct
  source 1..19: note = Seed: LQTVHSIPLTINKEEALQR
LQTVHSIPFTILKNEANQR

SEQ ID NO: 34198 - protein, 19 aa, synthetic construct
  source 1..19: note = Seed: LQTVHSIPLTINKEEALQR
LQTVHSIPFTILKNEASQR

SEQ ID NO: 34199 - protein, 19 aa, synthetic construct
  source 1..19: note = Seed: LQTVHSIPLTINKEEALQR
LQTVHSIPFTILKNEATQR

SEQ ID NO: 34200 - protein, 19 aa, synthetic construct
  source 1..19: note = Seed: LQTVHSIPLTINKEEALQR
LQTVHSIPFTILKNEAVQR

SEQ ID NO: 34201 - protein, 19 aa, synthetic construct
  source 1..19: note = Seed: LQTVHSIPLTINKEEALQR
LQTVHSIPFTILKPEAAQR

SEQ ID NO: 34202 - protein, 19 aa, synthetic construct
  source 1..19: note = Seed: LQTVHSIPLTINKEEALQR
LQTVHSIPFTILKPEACQR

SEQ ID NO: 34203 - protein, 19 aa, synthetic construct
  source 1..19: note = Seed: LQTVHSIPLTINKEEALQR
LQTVHSIPFTILKPEAFQR

SEQ ID NO: 34204 - protein, 19 aa, synthetic construct
  source 1..19: note = Seed: LQTVHSIPLTINKEEALQR
LQTVHSIPFTILKPEAGQR

SEQ ID NO: 34205 - protein, 19 aa, synthetic construct
  source 1..19: note = Seed: LQTVHSIPLTINKEEALQR
LQTVHSIPFTILKPEAIQR

SEQ ID NO: 34206 - protein, 19 aa, synthetic construct
  source 1..19: note = Seed: LQTVHSIPLTINKEEALQR
LQTVHSIPFTILKPEALQR

SEQ ID NO: 34207 - protein, 19 aa, synthetic construct
  source 1..19: note = Seed: LQTVHSIPLTINKEEALQR
LQTVHSIPFTILKPEAMQR

SEQ ID NO: 34208 - protein, 19 aa, synthetic construct
  source 1..19: note = Seed: LQTVHSIPLTINKEEALQR
LQTVHSIPFTILKPEANQR

SEQ ID NO: 34209 - protein, 19 aa, synthetic construct
  source 1..19: note = Seed: LQTVHSIPLTINKEEALQR
LQTVHSIPFTILKPEASQR

SEQ ID NO: 34210 - protein, 19 aa, synthetic construct
  source 1..19: note = Seed: LQTVHSIPLTINKEEALQR
LQTVHSIPFTILKPEATQR

SEQ ID NO: 34211 - protein, 19 aa, synthetic construct
  source 1..19: note = Seed: LQTVHSIPLTINKEEALQR
LQTVHSIPFTILKPEAVQR

SEQ ID NO: 34212 - protein, 19 aa, synthetic construct
  source 1..19: note = Seed: LQTVHSIPLTINKEEALQR
LQTVHSIPFTILKSEAAQR

SEQ ID NO: 34213 - protein, 19 aa, synthetic construct
  source 1..19: note = Seed: LQTVHSIPLTINKEEALQR
LQTVHSIPFTILKSEACQR

SEQ ID NO: 34214 - protein, 19 aa, synthetic construct
  source 1..19: note = Seed: LQTVHSIPLTINKEEALQR
LQTVHSIPFTILKSEAFQR

SEQ ID NO: 34215 - protein, 19 aa, synthetic construct
  source 1..19: note = Seed: LQTVHSIPLTINKEEALQR
LQTVHSIPFTILKSEAGQR

SEQ ID NO: 34216 - protein, 19 aa, synthetic construct
  source 1..19: note = Seed: LQTVHSIPLTINKEEALQR
LQTVHSIPFTILKSEAHQR

SEQ ID NO: 34217 - protein, 19 aa, synthetic construct
  source 1..19: note = Seed: LQTVHSIPLTINKEEALQR
LQTVHSIPFTILKSEAIQR

SEQ ID NO: 34218 - protein, 19 aa, synthetic construct
  source 1..19: note = Seed: LQTVHSIPLTINKEEALQR
LQTVHSIPFTILKSEALQR

SEQ ID NO: 34219 - protein, 19 aa, synthetic construct
  source 1..19: note = Seed: LQTVHSIPLTINKEEALQR
LQTVHSIPFTILKSEAMQR

SEQ ID NO: 34220 - protein, 19 aa, synthetic construct
  source 1..19: note = Seed: LQTVHSIPLTINKEEALQR
LQTVHSIPFTILKSEANQR

SEQ ID NO: 34221 - protein, 19 aa, synthetic construct
  source 1..19: note = Seed: LQTVHSIPLTINKEEALQR
LQTVHSIPFTILKSEAPQR

SEQ ID NO: 34222 - protein, 19 aa, synthetic construct
  source 1..19: note = Seed: LQTVHSIPLTINKEEALQR
LQTVHSIPFTILKSEAQQR

SEQ ID NO: 34223 - protein, 19 aa, synthetic construct
  source 1..19: note = Seed: LQTVHSIPLTINKEEALQR
LQTVHSIPFTILKSEASQR

SEQ ID NO: 34224 - protein, 19 aa, synthetic construct
  source 1..19: note = Seed: LQTVHSIPLTINKEEALQR
LQTVHSIPFTILKSEATQR

SEQ ID NO: 34225 - protein, 19 aa, synthetic construct
  source 1..19: note = Seed: LQTVHSIPLTINKEEALQR
LQTVHSIPFTILKSEAVQR

SEQ ID NO: 34226 - protein, 19 aa, synthetic construct
  source 1..19: note = Seed: LQTVHSIPLTINKEEALQR
LQTVHSIPFTILKTEAAQR

SEQ ID NO: 34227 - protein, 19 aa, synthetic construct
  source 1..19: note = Seed: LQTVHSIPLTINKEEALQR
LQTVHSIPFTILKTEACQR

SEQ ID NO: 34228 - protein, 19 aa, synthetic construct
  source 1..19: note = Seed: LQTVHSIPLTINKEEALQR
LQTVHSIPFTILKTEAGQR

SEQ ID NO: 34229 - protein, 19 aa, synthetic construct
  source 1..19: note = Seed: LQTVHSIPLTINKEEALQR
LQTVHSIPFTILKTEAIQR

SEQ ID NO: 34230 - protein, 19 aa, synthetic construct
  source 1..19: note = Seed: LQTVHSIPLTINKEEALQR
LQTVHSIPFTILKTEALQR

SEQ ID NO: 34231 - protein, 19 aa, synthetic construct
  source 1..19: note = Seed: LQTVHSIPLTINKEEALQR
LQTVHSIPFTILKTEAMQR

SEQ ID NO: 34232 - protein, 19 aa, synthetic construct
  source 1..19: note = Seed: LQTVHSIPLTINKEEALQR
LQTVHSIPFTILKTEANQR

SEQ ID NO: 34233 - protein, 19 aa, synthetic construct
  source 1..19: note = Seed: LQTVHSIPLTINKEEALQR
LQTVHSIPFTILKTEASQR

SEQ ID NO: 34234 - protein, 19 aa, synthetic construct
  source 1..19: note = Seed: LQTVHSIPLTINKEEALQR
LQTVHSIPFTILKTEATQR

SEQ ID NO: 34235 - protein, 19 aa, synthetic construct
  source 1..19: note = Seed: LQTVHSIPLTINKEEALQR
LQTVHSIPFTILKTEAVQR

SEQ ID NO: 34236 - protein, 19 aa, synthetic construct
  source 1..19: note = Seed: LQTVHSIPLTINKEEALQR
LQTVHSIPFTILKVEAAQR

SEQ ID NO: 34237 - protein, 19 aa, synthetic construct
  source 1..19: note = Seed: LQTVHSIPLTINKEEALQR
LQTVHSIPFTILKVEAIQR

SEQ ID NO: 34238 - protein, 19 aa, synthetic construct
  source 1..19: note = Seed: LQTVHSIPLTINKEEALQR
LQTVHSIPFTILKVEALQR

SEQ ID NO: 34239 - protein, 19 aa, synthetic construct
  source 1..19: note = Seed: LQTVHSIPLTINKEEALQR
LQTVHSIPFTILKVEAMQR

SEQ ID NO: 34240 - protein, 19 aa, synthetic construct
  source 1..19: note = Seed: LQTVHSIPLTINKEEALQR
LQTVHSIPFTILKVEASQR

SEQ ID NO: 34241 - protein, 19 aa, synthetic construct
  source 1..19: note = Seed: LQTVHSIPLTINKEEALQR
LQTVHSIPFTILKVEATQR

SEQ ID NO: 34242 - protein, 19 aa, synthetic construct
  source 1..19: note = Seed: LQTVHSIPLTINKEEALQR
LQTVHSIPFTILKVEAVQR

SEQ ID NO: 34243 - protein, 19 aa, synthetic construct
  source 1..19: note = Seed: LQTVHSIPLTINKEEALQR
LQTVHSIPFTILKWEADQR

SEQ ID NO: 34244 - protein, 19 aa, synthetic construct
  source 1..19: note = Seed: LQTVHSIPLTINKEEALQR
LQTVHSIPFTILKWEAIQR

SEQ ID NO: 34245 - protein, 19 aa, synthetic construct
  source 1..19: note = Seed: LQTVHSIPLTINKEEALQR
LQTVHSIPFTILKWEAVQR

SEQ ID NO: 34246 - protein, 19 aa, synthetic construct
  source 1..19: note = Seed: LQTVHSIPLTINKEEALQR
LQTVHSIPFTILKYEAAQR

SEQ ID NO: 34247 - protein, 19 aa, synthetic construct
  source 1..19: note = Seed: LQTVHSIPLTINKEEALQR
LQTVHSIPFTILKYEADQR

SEQ ID NO: 34248 - protein, 19 aa, synthetic construct
  source 1..19: note = Seed: LQTVHSIPLTINKEEALQR
LQTVHSIPFTILKYEAEQR

SEQ ID NO: 34249 - protein, 19 aa, synthetic construct
  source 1..19: note = Seed: LQTVHSIPLTINKEEALQR
LQTVHSIPFTILKYEAFQR

SEQ ID NO: 34250 - protein, 19 aa, synthetic construct
  source 1..19: note = Seed: LQTVHSIPLTINKEEALQR
LQTVHSIPFTILKYEAIQR

SEQ ID NO: 34251 - protein, 19 aa, synthetic construct
  source 1..19: note = Seed: LQTVHSIPLTINKEEALQR
LQTVHSIPFTILKYEALQR

SEQ ID NO: 34252 - protein, 19 aa, synthetic construct
  source 1..19: note = Seed: LQTVHSIPLTINKEEALQR
LQTVHSIPFTILKYEAMQR

SEQ ID NO: 34253 - protein, 19 aa, synthetic construct
  source 1..19: note = Seed: LQTVHSIPLTINKEEALQR
LQTVHSIPFTILKYEANQR

SEQ ID NO: 34254 - protein, 19 aa, synthetic construct
  source 1..19: note = Seed: LQTVHSIPLTINKEEALQR
LQTVHSIPFTILKYEATQR

SEQ ID NO: 34255 - protein, 19 aa, synthetic construct
  source 1..19: note = Seed: LQTVHSIPLTINKEEALQR
LQTVHSIPFTILKYEAVQR

SEQ ID NO: 34256 - protein, 19 aa, synthetic construct
  source 1..19: note = Seed: LQTVHSIPLTINKEEALQR
LQTVHSIPFTIMKAEAAQR

SEQ ID NO: 34257 - protein, 19 aa, synthetic construct
  source 1..19: note = Seed: LQTVHSIPLTINKEEALQR
LQTVHSIPFTIMKAEACQR

SEQ ID NO: 34258 - protein, 19 aa, synthetic construct
  source 1..19: note = Seed: LQTVHSIPLTINKEEALQR
LQTVHSIPFTIMKAEAFQR

SEQ ID NO: 34259 - protein, 19 aa, synthetic construct
  source 1..19: note = Seed: LQTVHSIPLTINKEEALQR
LQTVHSIPFTIMKAEAGQR

SEQ ID NO: 34260 - protein, 19 aa, synthetic construct
  source 1..19: note = Seed: LQTVHSIPLTINKEEALQR
LQTVHSIPFTIMKAEAHQR

SEQ ID NO: 34261 - protein, 19 aa, synthetic construct
  source 1..19: note = Seed: LQTVHSIPLTINKEEALQR
LQTVHSIPFTIMKAEAIQR

SEQ ID NO: 34262 - protein, 19 aa, synthetic construct
  source 1..19: note = Seed: LQTVHSIPLTINKEEALQR
LQTVHSIPFTIMKAEAKQR

SEQ ID NO: 34263 - protein, 19 aa, synthetic construct
  source 1..19: note = Seed: LQTVHSIPLTINKEEALQR
LQTVHSIPFTIMKAEALQR

SEQ ID NO: 34264 - protein, 19 aa, synthetic construct
  source 1..19: note = Seed: LQTVHSIPLTINKEEALQR
LQTVHSIPFTIMKAEAMQR

SEQ ID NO: 34265 - protein, 19 aa, synthetic construct
  source 1..19: note = Seed: LQTVHSIPLTINKEEALQR
LQTVHSIPFTIMKAEANQR

SEQ ID NO: 34266 - protein, 19 aa, synthetic construct
  source 1..19: note = Seed: LQTVHSIPLTINKEEALQR
LQTVHSIPFTIMKAEAPQR

SEQ ID NO: 34267 - protein, 19 aa, synthetic construct
  source 1..19: note = Seed: LQTVHSIPLTINKEEALQR
LQTVHSIPFTIMKAEAQQR

SEQ ID NO: 34268 - protein, 19 aa, synthetic construct
  source 1..19: note = Seed: LQTVHSIPLTINKEEALQR
LQTVHSIPFTIMKAEARQR

SEQ ID NO: 34269 - protein, 19 aa, synthetic construct
  source 1..19: note = Seed: LQTVHSIPLTINKEEALQR
LQTVHSIPFTIMKAEASQR

SEQ ID NO: 34270 - protein, 19 aa, synthetic construct
  source 1..19: note = Seed: LQTVHSIPLTINKEEALQR
LQTVHSIPFTIMKAEATQR

SEQ ID NO: 34271 - protein, 19 aa, synthetic construct
  source 1..19: note = Seed: LQTVHSIPLTINKEEALQR
LQTVHSIPFTIMKAEAVQR

SEQ ID NO: 34272 - protein, 19 aa, synthetic construct
  source 1..19: note = Seed: LQTVHSIPLTINKEEALQR
LQTVHSIPFTIMKAEAWQR

SEQ ID NO: 34273 - protein, 19 aa, synthetic construct
  source 1..19: note = Seed: LQTVHSIPLTINKEEALQR
LQTVHSIPFTIMKAEAYQR

SEQ ID NO: 34274 - protein, 19 aa, synthetic construct
  source 1..19: note = Seed: LQTVHSIPLTINKEEALQR
LQTVHSIPFTIMKFEAAQR

SEQ ID NO: 34275 - protein, 19 aa, synthetic construct
  source 1..19: note = Seed: LQTVHSIPLTINKEEALQR
LQTVHSIPFTIMKFEACQR

SEQ ID NO: 34276 - protein, 19 aa, synthetic construct
  source 1..19: note = Seed: LQTVHSIPLTINKEEALQR
LQTVHSIPFTIMKFEADQR

SEQ ID NO: 34277 - protein, 19 aa, synthetic construct
  source 1..19: note = Seed: LQTVHSIPLTINKEEALQR
LQTVHSIPFTIMKFEAEQR

SEQ ID NO: 34278 - protein, 19 aa, synthetic construct
  source 1..19: note = Seed: LQTVHSIPLTINKEEALQR
LQTVHSIPFTIMKFEAFQR

SEQ ID NO: 34279 - protein, 19 aa, synthetic construct
  source 1..19: note = Seed: LQTVHSIPLTINKEEALQR
LQTVHSIPFTIMKFEAGQR

SEQ ID NO: 34280 - protein, 19 aa, synthetic construct
  source 1..19: note = Seed: LQTVHSIPLTINKEEALQR
LQTVHSIPFTIMKFEAHQR

SEQ ID NO: 34281 - protein, 19 aa, synthetic construct
  source 1..19: note = Seed: LQTVHSIPLTINKEEALQR
LQTVHSIPFTIMKFEAIQR

SEQ ID NO: 34282 - protein, 19 aa, synthetic construct
  source 1..19: note = Seed: LQTVHSIPLTINKEEALQR
LQTVHSIPFTIMKFEALQR

SEQ ID NO: 34283 - protein, 19 aa, synthetic construct
  source 1..19: note = Seed: LQTVHSIPLTINKEEALQR
LQTVHSIPFTIMKFEAMQR

SEQ ID NO: 34284 - protein, 19 aa, synthetic construct
  source 1..19: note = Seed: LQTVHSIPLTINKEEALQR
LQTVHSIPFTIMKFEANQR

SEQ ID NO: 34285 - protein, 19 aa, synthetic construct
  source 1..19: note = Seed: LQTVHSIPLTINKEEALQR
LQTVHSIPFTIMKFEAQQR

SEQ ID NO: 34286 - protein, 19 aa, synthetic construct
  source 1..19: note = Seed: LQTVHSIPLTINKEEALQR
LQTVHSIPFTIMKFEARQR

SEQ ID NO: 34287 - protein, 19 aa, synthetic construct
  source 1..19: note = Seed: LQTVHSIPLTINKEEALQR
LQTVHSIPFTIMKFEASQR

SEQ ID NO: 34288 - protein, 19 aa, synthetic construct
  source 1..19: note = Seed: LQTVHSIPLTINKEEALQR
LQTVHSIPFTIMKFEATQR

SEQ ID NO: 34289 - protein, 19 aa, synthetic construct
  source 1..19: note = Seed: LQTVHSIPLTINKEEALQR
LQTVHSIPFTIMKFEAVQR

SEQ ID NO: 34290 - protein, 19 aa, synthetic construct
  source 1..19: note = Seed: LQTVHSIPLTINKEEALQR
LQTVHSIPFTIMKFEAYQR

SEQ ID NO: 34291 - protein, 19 aa, synthetic construct
  source 1..19: note = Seed: LQTVHSIPLTINKEEALQR
LQTVHSIPFTIMKGEAAQR

SEQ ID NO: 34292 - protein, 19 aa, synthetic construct
  source 1..19: note = Seed: LQTVHSIPLTINKEEALQR
LQTVHSIPFTIMKGEACQR

SEQ ID NO: 34293 - protein, 19 aa, synthetic construct
  source 1..19: note = Seed: LQTVHSIPLTINKEEALQR
LQTVHSIPFTIMKGEAFQR

SEQ ID NO: 34294 - protein, 19 aa, synthetic construct
  source 1..19: note = Seed: LQTVHSIPLTINKEEALQR
LQTVHSIPFTIMKGEAGQR

SEQ ID NO: 34295 - protein, 19 aa, synthetic construct
  source 1..19: note = Seed: LQTVHSIPLTINKEEALQR
LQTVHSIPFTIMKGEAHQR

SEQ ID NO: 34296 - protein, 19 aa, synthetic construct
  source 1..19: note = Seed: LQTVHSIPLTINKEEALQR
LQTVHSIPFTIMKGEAIQR

SEQ ID NO: 34297 - protein, 19 aa, synthetic construct
  source 1..19: note = Seed: LQTVHSIPLTINKEEALQR
LQTVHSIPFTIMKGEALQR

SEQ ID NO: 34298 - protein, 19 aa, synthetic construct
  source 1..19: note = Seed: LQTVHSIPLTINKEEALQR
LQTVHSIPFTIMKGEAMQR

SEQ ID NO: 34299 - protein, 19 aa, synthetic construct
  source 1..19: note = Seed: LQTVHSIPLTINKEEALQR
LQTVHSIPFTIMKGEANQR

SEQ ID NO: 34300 - protein, 19 aa, synthetic construct
  source 1..19: note = Seed: LQTVHSIPLTINKEEALQR
LQTVHSIPFTIMKGEAPQR

SEQ ID NO: 34301 - protein, 19 aa, synthetic construct
  source 1..19: note = Seed: LQTVHSIPLTINKEEALQR
LQTVHSIPFTIMKGEAQQR

SEQ ID NO: 34302 - protein, 19 aa, synthetic construct
  source 1..19: note = Seed: LQTVHSIPLTINKEEALQR
LQTVHSIPFTIMKGEASQR

SEQ ID NO: 34303 - protein, 19 aa, synthetic construct
  source 1..19: note = Seed: LQTVHSIPLTINKEEALQR
LQTVHSIPFTIMKGEATQR

SEQ ID NO: 34304 - protein, 19 aa, synthetic construct
  source 1..19: note = Seed: LQTVHSIPLTINKEEALQR
LQTVHSIPFTIMKGEAVQR

SEQ ID NO: 34305 - protein, 19 aa, synthetic construct
  source 1..19: note = Seed: LQTVHSIPLTINKEEALQR
LQTVHSIPFTIMKGEAYQR

SEQ ID NO: 34306 - protein, 19 aa, synthetic construct
  source 1..19: note = Seed: LQTVHSIPLTINKEEALQR
LQTVHSIPFTIMKHEAIQR

SEQ ID NO: 34307 - protein, 19 aa, synthetic construct
  source 1..19: note = Seed: LQTVHSIPLTINKEEALQR
LQTVHSIPFTIMKHEALQR

SEQ ID NO: 34308 - protein, 19 aa, synthetic construct
  source 1..19: note = Seed: LQTVHSIPLTINKEEALQR
LQTVHSIPFTIMKHEAVQR

SEQ ID NO: 34309 - protein, 19 aa, synthetic construct
  source 1..19: note = Seed: LQTVHSIPLTINKEEALQR
LQTVHSIPFTIMKIEAAQR

SEQ ID NO: 34310 - protein, 19 aa, synthetic construct
  source 1..19: note = Seed: LQTVHSIPLTINKEEALQR
LQTVHSIPFTIMKIEADQR

SEQ ID NO: 34311 - protein, 19 aa, synthetic construct
  source 1..19: note = Seed: LQTVHSIPLTINKEEALQR
LQTVHSIPFTIMKIEAIQR

SEQ ID NO: 34312 - protein, 19 aa, synthetic construct
  source 1..19: note = Seed: LQTVHSIPLTINKEEALQR
LQTVHSIPFTIMKIEALQR

SEQ ID NO: 34313 - protein, 19 aa, synthetic construct
  source 1..19: note = Seed: LQTVHSIPLTINKEEALQR
LQTVHSIPFTIMKIEAMQR

SEQ ID NO: 34314 - protein, 19 aa, synthetic construct
  source 1..19: note = Seed: LQTVHSIPLTINKEEALQR
LQTVHSIPFTIMKIEASQR

SEQ ID NO: 34315 - protein, 19 aa, synthetic construct
  source 1..19: note = Seed: LQTVHSIPLTINKEEALQR
LQTVHSIPFTIMKIEATQR

SEQ ID NO: 34316 - protein, 19 aa, synthetic construct
  source 1..19: note = Seed: LQTVHSIPLTINKEEALQR
LQTVHSIPFTIMKIEAVQR

SEQ ID NO: 34317 - protein, 19 aa, synthetic construct
  source 1..19: note = Seed: LQTVHSIPLTINKEEALQR
LQTVHSIPFTIMKLEADQR

SEQ ID NO: 34318 - protein, 19 aa, synthetic construct
  source 1..19: note = Seed: LQTVHSIPLTINKEEALQR
LQTVHSIPFTIMKLEAEQR

SEQ ID NO: 34319 - protein, 19 aa, synthetic construct
  source 1..19: note = Seed: LQTVHSIPLTINKEEALQR
LQTVHSIPFTIMKLEAIQR

SEQ ID NO: 34320 - protein, 19 aa, synthetic construct
  source 1..19: note = Seed: LQTVHSIPLTINKEEALQR
LQTVHSIPFTIMKLEALQR

SEQ ID NO: 34321 - protein, 19 aa, synthetic construct
  source 1..19: note = Seed: LQTVHSIPLTINKEEALQR
LQTVHSIPFTIMKLEAMQR

SEQ ID NO: 34322 - protein, 19 aa, synthetic construct
  source 1..19: note = Seed: LQTVHSIPLTINKEEALQR
LQTVHSIPFTIMKLEAVQR

SEQ ID NO: 34323 - protein, 19 aa, synthetic construct
  source 1..19: note = Seed: LQTVHSIPLTINKEEALQR
LQTVHSIPFTIMKMEAIQR

SEQ ID NO: 34324 - protein, 19 aa, synthetic construct
  source 1..19: note = Seed: LQTVHSIPLTINKEEALQR
LQTVHSIPFTIMKMEAVQR

SEQ ID NO: 34325 - protein, 19 aa, synthetic construct
  source 1..19: note = Seed: LQTVHSIPLTINKEEALQR
LQTVHSIPFTIMKNEAAQR

SEQ ID NO: 34326 - protein, 19 aa, synthetic construct
  source 1..19: note = Seed: LQTVHSIPLTINKEEALQR
LQTVHSIPFTIMKNEACQR

SEQ ID NO: 34327 - protein, 19 aa, synthetic construct
  source 1..19: note = Seed: LQTVHSIPLTINKEEALQR
LQTVHSIPFTIMKNEAFQR

SEQ ID NO: 34328 - protein, 19 aa, synthetic construct
  source 1..19: note = Seed: LQTVHSIPLTINKEEALQR
LQTVHSIPFTIMKNEAGQR

SEQ ID NO: 34329 - protein, 19 aa, synthetic construct
  source 1..19: note = Seed: LQTVHSIPLTINKEEALQR
LQTVHSIPFTIMKNEAIQR

SEQ ID NO: 34330 - protein, 19 aa, synthetic construct
  source 1..19: note = Seed: LQTVHSIPLTINKEEALQR
LQTVHSIPFTIMKNEALQR

SEQ ID NO: 34331 - protein, 19 aa, synthetic construct
  source 1..19: note = Seed: LQTVHSIPLTINKEEALQR
LQTVHSIPFTIMKNEAMQR

SEQ ID NO: 34332 - protein, 19 aa, synthetic construct
  source 1..19: note = Seed: LQTVHSIPLTINKEEALQR
LQTVHSIPFTIMKNEANQR

SEQ ID NO: 34333 - protein, 19 aa, synthetic construct
  source 1..19: note = Seed: LQTVHSIPLTINKEEALQR
LQTVHSIPFTIMKNEASQR

SEQ ID NO: 34334 - protein, 19 aa, synthetic construct
  source 1..19: note = Seed: LQTVHSIPLTINKEEALQR
LQTVHSIPFTIMKNEATQR

SEQ ID NO: 34335 - protein, 19 aa, synthetic construct
  source 1..19: note = Seed: LQTVHSIPLTINKEEALQR
LQTVHSIPFTIMKNEAVQR

SEQ ID NO: 34336 - protein, 19 aa, synthetic construct
  source 1..19: note = Seed: LQTVHSIPLTINKEEALQR
LQTVHSIPFTIMKPEAAQR

SEQ ID NO: 34337 - protein, 19 aa, synthetic construct
  source 1..19: note = Seed: LQTVHSIPLTINKEEALQR
LQTVHSIPFTIMKPEACQR

SEQ ID NO: 34338 - protein, 19 aa, synthetic construct
  source 1..19: note = Seed: LQTVHSIPLTINKEEALQR
LQTVHSIPFTIMKPEAFQR

SEQ ID NO: 34339 - protein, 19 aa, synthetic construct
  source 1..19: note = Seed: LQTVHSIPLTINKEEALQR
LQTVHSIPFTIMKPEAGQR

SEQ ID NO: 34340 - protein, 19 aa, synthetic construct
  source 1..19: note = Seed: LQTVHSIPLTINKEEALQR
LQTVHSIPFTIMKPEAIQR

SEQ ID NO: 34341 - protein, 19 aa, synthetic construct
  source 1..19: note = Seed: LQTVHSIPLTINKEEALQR
LQTVHSIPFTIMKPEALQR

SEQ ID NO: 34342 - protein, 19 aa, synthetic construct
  source 1..19: note = Seed: LQTVHSIPLTINKEEALQR
LQTVHSIPFTIMKPEAMQR

SEQ ID NO: 34343 - protein, 19 aa, synthetic construct
  source 1..19: note = Seed: LQTVHSIPLTINKEEALQR
LQTVHSIPFTIMKPEANQR

SEQ ID NO: 34344 - protein, 19 aa, synthetic construct
  source 1..19: note = Seed: LQTVHSIPLTINKEEALQR
LQTVHSIPFTIMKPEASQR

SEQ ID NO: 34345 - protein, 19 aa, synthetic construct
  source 1..19: note = Seed: LQTVHSIPLTINKEEALQR
LQTVHSIPFTIMKPEATQR

SEQ ID NO: 34346 - protein, 19 aa, synthetic construct
  source 1..19: note = Seed: LQTVHSIPLTINKEEALQR
LQTVHSIPFTIMKPEAVQR

SEQ ID NO: 34347 - protein, 19 aa, synthetic construct
  source 1..19: note = Seed: LQTVHSIPLTINKEEALQR
LQTVHSIPFTIMKSEAAQR

SEQ ID NO: 34348 - protein, 19 aa, synthetic construct
  source 1..19: note = Seed: LQTVHSIPLTINKEEALQR
LQTVHSIPFTIMKSEACQR

SEQ ID NO: 34349 - protein, 19 aa, synthetic construct
  source 1..19: note = Seed: LQTVHSIPLTINKEEALQR
LQTVHSIPFTIMKSEAFQR

SEQ ID NO: 34350 - protein, 19 aa, synthetic construct
  source 1..19: note = Seed: LQTVHSIPLTINKEEALQR
LQTVHSIPFTIMKSEAGQR

SEQ ID NO: 34351 - protein, 19 aa, synthetic construct
  source 1..19: note = Seed: LQTVHSIPLTINKEEALQR
LQTVHSIPFTIMKSEAHQR

SEQ ID NO: 34352 - protein, 19 aa, synthetic construct
  source 1..19: note = Seed: LQTVHSIPLTINKEEALQR
LQTVHSIPFTIMKSEAIQR

SEQ ID NO: 34353 - protein, 19 aa, synthetic construct
  source 1..19: note = Seed: LQTVHSIPLTINKEEALQR
LQTVHSIPFTIMKSEALQR

SEQ ID NO: 34354 - protein, 19 aa, synthetic construct
  source 1..19: note = Seed: LQTVHSIPLTINKEEALQR
LQTVHSIPFTIMKSEAMQR

SEQ ID NO: 34355 - protein, 19 aa, synthetic construct
  source 1..19: note = Seed: LQTVHSIPLTINKEEALQR
LQTVHSIPFTIMKSEANQR

SEQ ID NO: 34356 - protein, 19 aa, synthetic construct
  source 1..19: note = Seed: LQTVHSIPLTINKEEALQR
LQTVHSIPFTIMKSEAPQR

SEQ ID NO: 34357 - protein, 19 aa, synthetic construct
  source 1..19: note = Seed: LQTVHSIPLTINKEEALQR
LQTVHSIPFTIMKSEAQQR

SEQ ID NO: 34358 - protein, 19 aa, synthetic construct
  source 1..19: note = Seed: LQTVHSIPLTINKEEALQR
LQTVHSIPFTIMKSEASQR

SEQ ID NO: 34359 - protein, 19 aa, synthetic construct
  source 1..19: note = Seed: LQTVHSIPLTINKEEALQR
LQTVHSIPFTIMKSEATQR

SEQ ID NO: 34360 - protein, 19 aa, synthetic construct
  source 1..19: note = Seed: LQTVHSIPLTINKEEALQR
LQTVHSIPFTIMKSEAVQR

SEQ ID NO: 34361 - protein, 19 aa, synthetic construct
  source 1..19: note = Seed: LQTVHSIPLTINKEEALQR
LQTVHSIPFTIMKSEAYQR

SEQ ID NO: 34362 - protein, 19 aa, synthetic construct
  source 1..19: note = Seed: LQTVHSIPLTINKEEALQR
LQTVHSIPFTIMKTEAAQR

SEQ ID NO: 34363 - protein, 19 aa, synthetic construct
  source 1..19: note = Seed: LQTVHSIPLTINKEEALQR
LQTVHSIPFTIMKTEACQR

SEQ ID NO: 34364 - protein, 19 aa, synthetic construct
  source 1..19: note = Seed: LQTVHSIPLTINKEEALQR
LQTVHSIPFTIMKTEAFQR

SEQ ID NO: 34365 - protein, 19 aa, synthetic construct
  source 1..19: note = Seed: LQTVHSIPLTINKEEALQR
LQTVHSIPFTIMKTEAGQR

SEQ ID NO: 34366 - protein, 19 aa, synthetic construct
  source 1..19: note = Seed: LQTVHSIPLTINKEEALQR
LQTVHSIPFTIMKTEAHQR

SEQ ID NO: 34367 - protein, 19 aa, synthetic construct
  source 1..19: note = Seed: LQTVHSIPLTINKEEALQR
LQTVHSIPFTIMKTEAIQR

SEQ ID NO: 34368 - protein, 19 aa, synthetic construct
  source 1..19: note = Seed: LQTVHSIPLTINKEEALQR
LQTVHSIPFTIMKTEALQR

SEQ ID NO: 34369 - protein, 19 aa, synthetic construct
  source 1..19: note = Seed: LQTVHSIPLTINKEEALQR
LQTVHSIPFTIMKTEAMQR

SEQ ID NO: 34370 - protein, 19 aa, synthetic construct
  source 1..19: note = Seed: LQTVHSIPLTINKEEALQR
LQTVHSIPFTIMKTEANQR

SEQ ID NO: 34371 - protein, 19 aa, synthetic construct
  source 1..19: note = Seed: LQTVHSIPLTINKEEALQR
LQTVHSIPFTIMKTEASQR

SEQ ID NO: 34372 - protein, 19 aa, synthetic construct
  source 1..19: note = Seed: LQTVHSIPLTINKEEALQR
LQTVHSIPFTIMKTEATQR

SEQ ID NO: 34373 - protein, 19 aa, synthetic construct
  source 1..19: note = Seed: LQTVHSIPLTINKEEALQR
LQTVHSIPFTIMKTEAVQR

SEQ ID NO: 34374 - protein, 19 aa, synthetic construct
  source 1..19: note = Seed: LQTVHSIPLTINKEEALQR
LQTVHSIPFTIMKVEAAQR

SEQ ID NO: 34375 - protein, 19 aa, synthetic construct
  source 1..19: note = Seed: LQTVHSIPLTINKEEALQR
LQTVHSIPFTIMKVEAGQR

SEQ ID NO: 34376 - protein, 19 aa, synthetic construct
  source 1..19: note = Seed: LQTVHSIPLTINKEEALQR
LQTVHSIPFTIMKVEAIQR

SEQ ID NO: 34377 - protein, 19 aa, synthetic construct
  source 1..19: note = Seed: LQTVHSIPLTINKEEALQR
LQTVHSIPFTIMKVEALQR

SEQ ID NO: 34378 - protein, 19 aa, synthetic construct
  source 1..19: note = Seed: LQTVHSIPLTINKEEALQR
LQTVHSIPFTIMKVEAMQR

SEQ ID NO: 34379 - protein, 19 aa, synthetic construct
  source 1..19: note = Seed: LQTVHSIPLTINKEEALQR
LQTVHSIPFTIMKVEASQR

SEQ ID NO: 34380 - protein, 19 aa, synthetic construct
  source 1..19: note = Seed: LQTVHSIPLTINKEEALQR
LQTVHSIPFTIMKVEATQR

SEQ ID NO: 34381 - protein, 19 aa, synthetic construct
  source 1..19: note = Seed: LQTVHSIPLTINKEEALQR
LQTVHSIPFTIMKVEAVQR

SEQ ID NO: 34382 - protein, 19 aa, synthetic construct
  source 1..19: note = Seed: LQTVHSIPLTINKEEALQR
LQTVHSIPFTIMKWEAAQR

SEQ ID NO: 34383 - protein, 19 aa, synthetic construct
  source 1..19: note = Seed: LQTVHSIPLTINKEEALQR
LQTVHSIPFTIMKWEADQR

SEQ ID NO: 34384 - protein, 19 aa, synthetic construct
  source 1..19: note = Seed: LQTVHSIPLTINKEEALQR
LQTVHSIPFTIMKWEAIQR

SEQ ID NO: 34385 - protein, 19 aa, synthetic construct
  source 1..19: note = Seed: LQTVHSIPLTINKEEALQR
LQTVHSIPFTIMKWEALQR

SEQ ID NO: 34386 - protein, 19 aa, synthetic construct
  source 1..19: note = Seed: LQTVHSIPLTINKEEALQR
LQTVHSIPFTIMKWEAMQR

SEQ ID NO: 34387 - protein, 19 aa, synthetic construct
  source 1..19: note = Seed: LQTVHSIPLTINKEEALQR
LQTVHSIPFTIMKWEANQR

SEQ ID NO: 34388 - protein, 19 aa, synthetic construct
  source 1..19: note = Seed: LQTVHSIPLTINKEEALQR
LQTVHSIPFTIMKWEATQR

SEQ ID NO: 34389 - protein, 19 aa, synthetic construct
  source 1..19: note = Seed: LQTVHSIPLTINKEEALQR
LQTVHSIPFTIMKWEAVQR

SEQ ID NO: 34390 - protein, 19 aa, synthetic construct
  source 1..19: note = Seed: LQTVHSIPLTINKEEALQR
LQTVHSIPFTIMKYEAAQR

SEQ ID NO: 34391 - protein, 19 aa, synthetic construct
  source 1..19: note = Seed: LQTVHSIPLTINKEEALQR
LQTVHSIPFTIMKYEADQR

SEQ ID NO: 34392 - protein, 19 aa, synthetic construct
  source 1..19: note = Seed: LQTVHSIPLTINKEEALQR
LQTVHSIPFTIMKYEAEQR

SEQ ID NO: 34393 - protein, 19 aa, synthetic construct
  source 1..19: note = Seed: LQTVHSIPLTINKEEALQR
LQTVHSIPFTIMKYEAFQR

SEQ ID NO: 34394 - protein, 19 aa, synthetic construct
  source 1..19: note = Seed: LQTVHSIPLTINKEEALQR
LQTVHSIPFTIMKYEAIQR

SEQ ID NO: 34395 - protein, 19 aa, synthetic construct
  source 1..19: note = Seed: LQTVHSIPLTINKEEALQR
LQTVHSIPFTIMKYEALQR

SEQ ID NO: 34396 - protein, 19 aa, synthetic construct
  source 1..19: note = Seed: LQTVHSIPLTINKEEALQR
LQTVHSIPFTIMKYEAMQR

SEQ ID NO: 34397 - protein, 19 aa, synthetic construct
  source 1..19: note = Seed: LQTVHSIPLTINKEEALQR
LQTVHSIPFTIMKYEANQR

SEQ ID NO: 34398 - protein, 19 aa, synthetic construct
  source 1..19: note = Seed: LQTVHSIPLTINKEEALQR
LQTVHSIPFTIMKYEASQR

SEQ ID NO: 34399 - protein, 19 aa, synthetic construct
  source 1..19: note = Seed: LQTVHSIPLTINKEEALQR
LQTVHSIPFTIMKYEATQR

SEQ ID NO: 34400 - protein, 19 aa, synthetic construct
  source 1..19: note = Seed: LQTVHSIPLTINKEEALQR
LQTVHSIPFTIMKYEAVQR

SEQ ID NO: 34401 - protein, 19 aa, synthetic construct
  source 1..19: note = Seed: LQTVHSIPLTINKEEALQR
LQTVHSIPFTIMKYEAYQR

SEQ ID NO: 34402 - protein, 19 aa, synthetic construct
  source 1..19: note = Seed: LQTVHSIPLTINKEEALQR
LQTVHSIPFTINKAEAAQR

SEQ ID NO: 34403 - protein, 19 aa, synthetic construct
  source 1..19: note = Seed: LQTVHSIPLTINKEEALQR
LQTVHSIPFTINKAEAFQR

SEQ ID NO: 34404 - protein, 19 aa, synthetic construct
  source 1..19: note = Seed: LQTVHSIPLTINKEEALQR
LQTVHSIPFTINKAEAIQR

SEQ ID NO: 34405 - protein, 19 aa, synthetic construct
  source 1..19: note = Seed: LQTVHSIPLTINKEEALQR
LQTVHSIPFTINKAEALQR

SEQ ID NO: 34406 - protein, 19 aa, synthetic construct
  source 1..19: note = Seed: LQTVHSIPLTINKEEALQR
LQTVHSIPFTINKAEAMQR

SEQ ID NO: 34407 - protein, 19 aa, synthetic construct
  source 1..19: note = Seed: LQTVHSIPLTINKEEALQR
LQTVHSIPFTINKAEAVQR

SEQ ID NO: 34408 - protein, 19 aa, synthetic construct
  source 1..19: note = Seed: LQTVHSIPLTINKEEALQR
LQTVHSIPFTINKAEAYQR

SEQ ID NO: 34409 - protein, 19 aa, synthetic construct
  source 1..19: note = Seed: LQTVHSIPLTINKEEALQR
LQTVHSIPFTINKFEAAQR

SEQ ID NO: 34410 - protein, 19 aa, synthetic construct
  source 1..19: note = Seed: LQTVHSIPLTINKEEALQR
LQTVHSIPFTINKFEACQR

SEQ ID NO: 34411 - protein, 19 aa, synthetic construct
  source 1..19: note = Seed: LQTVHSIPLTINKEEALQR
LQTVHSIPFTINKFEADQR

SEQ ID NO: 34412 - protein, 19 aa, synthetic construct
  source 1..19: note = Seed: LQTVHSIPLTINKEEALQR
LQTVHSIPFTINKFEAEQR

SEQ ID NO: 34413 - protein, 19 aa, synthetic construct
  source 1..19: note = Seed: LQTVHSIPLTINKEEALQR
LQTVHSIPFTINKFEAFQR

SEQ ID NO: 34414 - protein, 19 aa, synthetic construct
  source 1..19: note = Seed: LQTVHSIPLTINKEEALQR
LQTVHSIPFTINKFEAIQR

SEQ ID NO: 34415 - protein, 19 aa, synthetic construct
  source 1..19: note = Seed: LQTVHSIPLTINKEEALQR
LQTVHSIPFTINKFEALQR

SEQ ID NO: 34416 - protein, 19 aa, synthetic construct
  source 1..19: note = Seed: LQTVHSIPLTINKEEALQR
LQTVHSIPFTINKFEAMQR

SEQ ID NO: 34417 - protein, 19 aa, synthetic construct
  source 1..19: note = Seed: LQTVHSIPLTINKEEALQR
LQTVHSIPFTINKFEANQR

SEQ ID NO: 34418 - protein, 19 aa, synthetic construct
  source 1..19: note = Seed: LQTVHSIPLTINKEEALQR
LQTVHSIPFTINKFEAQQR

SEQ ID NO: 34419 - protein, 19 aa, synthetic construct
  source 1..19: note = Seed: LQTVHSIPLTINKEEALQR
LQTVHSIPFTINKFEASQR

SEQ ID NO: 34420 - protein, 19 aa, synthetic construct
  source 1..19: note = Seed: LQTVHSIPLTINKEEALQR
LQTVHSIPFTINKFEATQR

SEQ ID NO: 34421 - protein, 19 aa, synthetic construct
  source 1..19: note = Seed: LQTVHSIPLTINKEEALQR
LQTVHSIPFTINKFEAVQR

SEQ ID NO: 34422 - protein, 19 aa, synthetic construct
  source 1..19: note = Seed: LQTVHSIPLTINKEEALQR
LQTVHSIPFTINKFEAWQR

SEQ ID NO: 34423 - protein, 19 aa, synthetic construct
  source 1..19: note = Seed: LQTVHSIPLTINKEEALQR
LQTVHSIPFTINKFEAYQR

SEQ ID NO: 34424 - protein, 19 aa, synthetic construct
  source 1..19: note = Seed: LQTVHSIPLTINKEEALQR
LQTVHSIPFTINKGEAFQR

SEQ ID NO: 34425 - protein, 19 aa, synthetic construct
  source 1..19: note = Seed: LQTVHSIPLTINKEEALQR
LQTVHSIPFTINKGEAIQR

SEQ ID NO: 34426 - protein, 19 aa, synthetic construct
  source 1..19: note = Seed: LQTVHSIPLTINKEEALQR
LQTVHSIPFTINKGEALQR

SEQ ID NO: 34427 - protein, 19 aa, synthetic construct
  source 1..19: note = Seed: LQTVHSIPLTINKEEALQR
LQTVHSIPFTINKGEAMQR

SEQ ID NO: 34428 - protein, 19 aa, synthetic construct
  source 1..19: note = Seed: LQTVHSIPLTINKEEALQR
LQTVHSIPFTINKGEAVQR

SEQ ID NO: 34429 - protein, 19 aa, synthetic construct
  source 1..19: note = Seed: LQTVHSIPLTINKEEALQR
LQTVHSIPFTINKIEAFQR

SEQ ID NO: 34430 - protein, 19 aa, synthetic construct
  source 1..19: note = Seed: LQTVHSIPLTINKEEALQR
LQTVHSIPFTINKIEAIQR

SEQ ID NO: 34431 - protein, 19 aa, synthetic construct
  source 1..19: note = Seed: LQTVHSIPLTINKEEALQR
LQTVHSIPFTINKIEALQR

SEQ ID NO: 34432 - protein, 19 aa, synthetic construct
  source 1..19: note = Seed: LQTVHSIPLTINKEEALQR
LQTVHSIPFTINKIEAVQR

SEQ ID NO: 34433 - protein, 19 aa, synthetic construct
  source 1..19: note = Seed: LQTVHSIPLTINKEEALQR
LQTVHSIPFTINKIEAYQR

SEQ ID NO: 34434 - protein, 19 aa, synthetic construct
  source 1..19: note = Seed: LQTVHSIPLTINKEEALQR
LQTVHSIPFTINKLEAFQR

SEQ ID NO: 34435 - protein, 19 aa, synthetic construct
  source 1..19: note = Seed: LQTVHSIPLTINKEEALQR
LQTVHSIPFTINKLEAIQR

SEQ ID NO: 34436 - protein, 19 aa, synthetic construct
  source 1..19: note = Seed: LQTVHSIPLTINKEEALQR
LQTVHSIPFTINKLEALQR

SEQ ID NO: 34437 - protein, 19 aa, synthetic construct
  source 1..19: note = Seed: LQTVHSIPLTINKEEALQR
LQTVHSIPFTINKLEAMQR

SEQ ID NO: 34438 - protein, 19 aa, synthetic construct
  source 1..19: note = Seed: LQTVHSIPLTINKEEALQR
LQTVHSIPFTINKLEAVQR

SEQ ID NO: 34439 - protein, 19 aa, synthetic construct
  source 1..19: note = Seed: LQTVHSIPLTINKEEALQR
LQTVHSIPFTINKMEAIQR

SEQ ID NO: 34440 - protein, 19 aa, synthetic construct
  source 1..19: note = Seed: LQTVHSIPLTINKEEALQR
LQTVHSIPFTINKMEALQR

SEQ ID NO: 34441 - protein, 19 aa, synthetic construct
  source 1..19: note = Seed: LQTVHSIPLTINKEEALQR
LQTVHSIPFTINKMEAVQR

SEQ ID NO: 34442 - protein, 19 aa, synthetic construct
  source 1..19: note = Seed: LQTVHSIPLTINKEEALQR
LQTVHSIPFTINKNEAAQR

SEQ ID NO: 34443 - protein, 19 aa, synthetic construct
  source 1..19: note = Seed: LQTVHSIPLTINKEEALQR
LQTVHSIPFTINKNEAFQR

SEQ ID NO: 34444 - protein, 19 aa, synthetic construct
  source 1..19: note = Seed: LQTVHSIPLTINKEEALQR
LQTVHSIPFTINKNEAIQR

SEQ ID NO: 34445 - protein, 19 aa, synthetic construct
  source 1..19: note = Seed: LQTVHSIPLTINKEEALQR
LQTVHSIPFTINKNEALQR

SEQ ID NO: 34446 - protein, 19 aa, synthetic construct
  source 1..19: note = Seed: LQTVHSIPLTINKEEALQR
LQTVHSIPFTINKNEAMQR

SEQ ID NO: 34447 - protein, 19 aa, synthetic construct
  source 1..19: note = Seed: LQTVHSIPLTINKEEALQR
LQTVHSIPFTINKNEAVQR

SEQ ID NO: 34448 - protein, 19 aa, synthetic construct
  source 1..19: note = Seed: LQTVHSIPLTINKEEALQR
LQTVHSIPFTINKNEAYQR

SEQ ID NO: 34449 - protein, 19 aa, synthetic construct
  source 1..19: note = Seed: LQTVHSIPLTINKEEALQR
LQTVHSIPFTINKPEAFQR

SEQ ID NO: 34450 - protein, 19 aa, synthetic construct
  source 1..19: note = Seed: LQTVHSIPLTINKEEALQR
LQTVHSIPFTINKPEAIQR

SEQ ID NO: 34451 - protein, 19 aa, synthetic construct
  source 1..19: note = Seed: LQTVHSIPLTINKEEALQR
LQTVHSIPFTINKPEALQR

SEQ ID NO: 34452 - protein, 19 aa, synthetic construct
  source 1..19: note = Seed: LQTVHSIPLTINKEEALQR
LQTVHSIPFTINKPEAVQR

SEQ ID NO: 34453 - protein, 19 aa, synthetic construct
  source 1..19: note = Seed: LQTVHSIPLTINKEEALQR
LQTVHSIPFTINKSEAFQR

SEQ ID NO: 34454 - protein, 19 aa, synthetic construct
  source 1..19: note = Seed: LQTVHSIPLTINKEEALQR
LQTVHSIPFTINKSEAIQR

SEQ ID NO: 34455 - protein, 19 aa, synthetic construct
  source 1..19: note = Seed: LQTVHSIPLTINKEEALQR
LQTVHSIPFTINKSEALQR

SEQ ID NO: 34456 - protein, 19 aa, synthetic construct
  source 1..19: note = Seed: LQTVHSIPLTINKEEALQR
LQTVHSIPFTINKSEAMQR

SEQ ID NO: 34457 - protein, 19 aa, synthetic construct
  source 1..19: note = Seed: LQTVHSIPLTINKEEALQR
LQTVHSIPFTINKSEAVQR

SEQ ID NO: 34458 - protein, 19 aa, synthetic construct
  source 1..19: note = Seed: LQTVHSIPLTINKEEALQR
LQTVHSIPFTINKSEAYQR

SEQ ID NO: 34459 - protein, 19 aa, synthetic construct
  source 1..19: note = Seed: LQTVHSIPLTINKEEALQR
LQTVHSIPFTINKTEAFQR

SEQ ID NO: 34460 - protein, 19 aa, synthetic construct
  source 1..19: note = Seed: LQTVHSIPLTINKEEALQR
LQTVHSIPFTINKTEAIQR

SEQ ID NO: 34461 - protein, 19 aa, synthetic construct
  source 1..19: note = Seed: LQTVHSIPLTINKEEALQR
LQTVHSIPFTINKTEALQR

SEQ ID NO: 34462 - protein, 19 aa, synthetic construct
  source 1..19: note = Seed: LQTVHSIPLTINKEEALQR
LQTVHSIPFTINKTEAVQR

SEQ ID NO: 34463 - protein, 19 aa, synthetic construct
  source 1..19: note = Seed: LQTVHSIPLTINKEEALQR
LQTVHSIPFTINKTEAYQR

SEQ ID NO: 34464 - protein, 19 aa, synthetic construct
  source 1..19: note = Seed: LQTVHSIPLTINKEEALQR
LQTVHSIPFTINKVEAFQR

SEQ ID NO: 34465 - protein, 19 aa, synthetic construct
  source 1..19: note = Seed: LQTVHSIPLTINKEEALQR
LQTVHSIPFTINKVEAIQR

SEQ ID NO: 34466 - protein, 19 aa, synthetic construct
  source 1..19: note = Seed: LQTVHSIPLTINKEEALQR
LQTVHSIPFTINKVEALQR

SEQ ID NO: 34467 - protein, 19 aa, synthetic construct
  source 1..19: note = Seed: LQTVHSIPLTINKEEALQR
LQTVHSIPFTINKVEAVQR

SEQ ID NO: 34468 - protein, 19 aa, synthetic construct
  source 1..19: note = Seed: LQTVHSIPLTINKEEALQR
LQTVHSIPFTINKVEAYQR

SEQ ID NO: 34469 - protein, 19 aa, synthetic construct
  source 1..19: note = Seed: LQTVHSIPLTINKEEALQR
LQTVHSIPFTINKWEAIQR

SEQ ID NO: 34470 - protein, 19 aa, synthetic construct
  source 1..19: note = Seed: LQTVHSIPLTINKEEALQR
LQTVHSIPFTINKWEALQR

SEQ ID NO: 34471 - protein, 19 aa, synthetic construct
  source 1..19: note = Seed: LQTVHSIPLTINKEEALQR
LQTVHSIPFTINKWEAVQR

SEQ ID NO: 34472 - protein, 19 aa, synthetic construct
  source 1..19: note = Seed: LQTVHSIPLTINKEEALQR
LQTVHSIPFTINKYEAFQR

SEQ ID NO: 34473 - protein, 19 aa, synthetic construct
  source 1..19: note = Seed: LQTVHSIPLTINKEEALQR
LQTVHSIPFTINKYEAIQR

SEQ ID NO: 34474 - protein, 19 aa, synthetic construct
  source 1..19: note = Seed: LQTVHSIPLTINKEEALQR
LQTVHSIPFTINKYEALQR

SEQ ID NO: 34475 - protein, 19 aa, synthetic construct
  source 1..19: note = Seed: LQTVHSIPLTINKEEALQR
LQTVHSIPFTINKYEAMQR

SEQ ID NO: 34476 - protein, 19 aa, synthetic construct
  source 1..19: note = Seed: LQTVHSIPLTINKEEALQR
LQTVHSIPFTINKYEAVQR

SEQ ID NO: 34477 - protein, 19 aa, synthetic construct
  source 1..19: note = Seed: LQTVHSIPLTINKEEALQR
LQTVHSIPFTIPKFEAFQR

SEQ ID NO: 34478 - protein, 19 aa, synthetic construct
  source 1..19: note = Seed: LQTVHSIPLTINKEEALQR
LQTVHSIPFTIPKFEAIQR

SEQ ID NO: 34479 - protein, 19 aa, synthetic construct
  source 1..19: note = Seed: LQTVHSIPLTINKEEALQR
LQTVHSIPFTIPKFEALQR

SEQ ID NO: 34480 - protein, 19 aa, synthetic construct
  source 1..19: note = Seed: LQTVHSIPLTINKEEALQR
LQTVHSIPFTIPKFEAVQR

SEQ ID NO: 34481 - protein, 19 aa, synthetic construct
  source 1..19: note = Seed: LQTVHSIPLTINKEEALQR
LQTVHSIPFTIQKAEAAQR

SEQ ID NO: 34482 - protein, 19 aa, synthetic construct
  source 1..19: note = Seed: LQTVHSIPLTINKEEALQR
LQTVHSIPFTIQKAEAGQR

SEQ ID NO: 34483 - protein, 19 aa, synthetic construct
  source 1..19: note = Seed: LQTVHSIPLTINKEEALQR
LQTVHSIPFTIQKAEAIQR

SEQ ID NO: 34484 - protein, 19 aa, synthetic construct
  source 1..19: note = Seed: LQTVHSIPLTINKEEALQR
LQTVHSIPFTIQKAEALQR

SEQ ID NO: 34485 - protein, 19 aa, synthetic construct
  source 1..19: note = Seed: LQTVHSIPLTINKEEALQR
LQTVHSIPFTIQKAEAMQR

SEQ ID NO: 34486 - protein, 19 aa, synthetic construct
  source 1..19: note = Seed: LQTVHSIPLTINKEEALQR
LQTVHSIPFTIQKAEASQR

SEQ ID NO: 34487 - protein, 19 aa, synthetic construct
  source 1..19: note = Seed: LQTVHSIPLTINKEEALQR
LQTVHSIPFTIQKAEATQR

SEQ ID NO: 34488 - protein, 19 aa, synthetic construct
  source 1..19: note = Seed: LQTVHSIPLTINKEEALQR
LQTVHSIPFTIQKAEAVQR

SEQ ID NO: 34489 - protein, 19 aa, synthetic construct
  source 1..19: note = Seed: LQTVHSIPLTINKEEALQR
LQTVHSIPFTIQKFEAAQR

SEQ ID NO: 34490 - protein, 19 aa, synthetic construct
  source 1..19: note = Seed: LQTVHSIPLTINKEEALQR
LQTVHSIPFTIQKFEACQR

SEQ ID NO: 34491 - protein, 19 aa, synthetic construct
  source 1..19: note = Seed: LQTVHSIPLTINKEEALQR
LQTVHSIPFTIQKFEADQR

SEQ ID NO: 34492 - protein, 19 aa, synthetic construct
  source 1..19: note = Seed: LQTVHSIPLTINKEEALQR
LQTVHSIPFTIQKFEAEQR

SEQ ID NO: 34493 - protein, 19 aa, synthetic construct
  source 1..19: note = Seed: LQTVHSIPLTINKEEALQR
LQTVHSIPFTIQKFEAFQR

SEQ ID NO: 34494 - protein, 19 aa, synthetic construct
  source 1..19: note = Seed: LQTVHSIPLTINKEEALQR
LQTVHSIPFTIQKFEAHQR

SEQ ID NO: 34495 - protein, 19 aa, synthetic construct
  source 1..19: note = Seed: LQTVHSIPLTINKEEALQR
LQTVHSIPFTIQKFEAIQR

SEQ ID NO: 34496 - protein, 19 aa, synthetic construct
  source 1..19: note = Seed: LQTVHSIPLTINKEEALQR
LQTVHSIPFTIQKFEALQR

SEQ ID NO: 34497 - protein, 19 aa, synthetic construct
  source 1..19: note = Seed: LQTVHSIPLTINKEEALQR
LQTVHSIPFTIQKFEAMQR

SEQ ID NO: 34498 - protein, 19 aa, synthetic construct
  source 1..19: note = Seed: LQTVHSIPLTINKEEALQR
LQTVHSIPFTIQKFEANQR

SEQ ID NO: 34499 - protein, 19 aa, synthetic construct
  source 1..19: note = Seed: LQTVHSIPLTINKEEALQR
LQTVHSIPFTIQKFEAPQR

SEQ ID NO: 34500 - protein, 19 aa, synthetic construct
  source 1..19: note = Seed: LQTVHSIPLTINKEEALQR
LQTVHSIPFTIQKFEAQQR

SEQ ID NO: 34501 - protein, 19 aa, synthetic construct
  source 1..19: note = Seed: LQTVHSIPLTINKEEALQR
LQTVHSIPFTIQKFEARQR

SEQ ID NO: 34502 - protein, 19 aa, synthetic construct
  source 1..19: note = Seed: LQTVHSIPLTINKEEALQR
LQTVHSIPFTIQKFEASQR

SEQ ID NO: 34503 - protein, 19 aa, synthetic construct
  source 1..19: note = Seed: LQTVHSIPLTINKEEALQR
LQTVHSIPFTIQKFEATQR

SEQ ID NO: 34504 - protein, 19 aa, synthetic construct
  source 1..19: note = Seed: LQTVHSIPLTINKEEALQR
LQTVHSIPFTIQKFEAVQR

SEQ ID NO: 34505 - protein, 19 aa, synthetic construct
  source 1..19: note = Seed: LQTVHSIPLTINKEEALQR
LQTVHSIPFTIQKFEAWQR

SEQ ID NO: 34506 - protein, 19 aa, synthetic construct
  source 1..19: note = Seed: LQTVHSIPLTINKEEALQR
LQTVHSIPFTIQKFEAYQR

SEQ ID NO: 34507 - protein, 19 aa, synthetic construct
  source 1..19: note = Seed: LQTVHSIPLTINKEEALQR
LQTVHSIPFTIQKGEAAQR

SEQ ID NO: 34508 - protein, 19 aa, synthetic construct
  source 1..19: note = Seed: LQTVHSIPLTINKEEALQR
LQTVHSIPFTIQKGEAIQR

SEQ ID NO: 34509 - protein, 19 aa, synthetic construct
  source 1..19: note = Seed: LQTVHSIPLTINKEEALQR
LQTVHSIPFTIQKGEALQR

SEQ ID NO: 34510 - protein, 19 aa, synthetic construct
  source 1..19: note = Seed: LQTVHSIPLTINKEEALQR
LQTVHSIPFTIQKGEAMQR

SEQ ID NO: 34511 - protein, 19 aa, synthetic construct
  source 1..19: note = Seed: LQTVHSIPLTINKEEALQR
LQTVHSIPFTIQKGEASQR

SEQ ID NO: 34512 - protein, 19 aa, synthetic construct
  source 1..19: note = Seed: LQTVHSIPLTINKEEALQR
LQTVHSIPFTIQKGEATQR

SEQ ID NO: 34513 - protein, 19 aa, synthetic construct
  source 1..19: note = Seed: LQTVHSIPLTINKEEALQR
LQTVHSIPFTIQKGEAVQR

SEQ ID NO: 34514 - protein, 19 aa, synthetic construct
  source 1..19: note = Seed: LQTVHSIPLTINKEEALQR
LQTVHSIPFTIQKIEAFQR

SEQ ID NO: 34515 - protein, 19 aa, synthetic construct
  source 1..19: note = Seed: LQTVHSIPLTINKEEALQR
LQTVHSIPFTIQKIEAIQR

SEQ ID NO: 34516 - protein, 19 aa, synthetic construct
  source 1..19: note = Seed: LQTVHSIPLTINKEEALQR
LQTVHSIPFTIQKIEALQR

SEQ ID NO: 34517 - protein, 19 aa, synthetic construct
  source 1..19: note = Seed: LQTVHSIPLTINKEEALQR
LQTVHSIPFTIQKIEAVQR

SEQ ID NO: 34518 - protein, 19 aa, synthetic construct
  source 1..19: note = Seed: LQTVHSIPLTINKEEALQR
LQTVHSIPFTIQKLEAFQR

SEQ ID NO: 34519 - protein, 19 aa, synthetic construct
  source 1..19: note = Seed: LQTVHSIPLTINKEEALQR
LQTVHSIPFTIQKLEAIQR

SEQ ID NO: 34520 - protein, 19 aa, synthetic construct
  source 1..19: note = Seed: LQTVHSIPLTINKEEALQR
LQTVHSIPFTIQKLEALQR

SEQ ID NO: 34521 - protein, 19 aa, synthetic construct
  source 1..19: note = Seed: LQTVHSIPLTINKEEALQR
LQTVHSIPFTIQKLEAMQR

SEQ ID NO: 34522 - protein, 19 aa, synthetic construct
  source 1..19: note = Seed: LQTVHSIPLTINKEEALQR
LQTVHSIPFTIQKLEAVQR

SEQ ID NO: 34523 - protein, 19 aa, synthetic construct
  source 1..19: note = Seed: LQTVHSIPLTINKEEALQR
LQTVHSIPFTIQKMEAIQR

SEQ ID NO: 34524 - protein, 19 aa, synthetic construct
  source 1..19: note = Seed: LQTVHSIPLTINKEEALQR
LQTVHSIPFTIQKMEALQR

SEQ ID NO: 34525 - protein, 19 aa, synthetic construct
  source 1..19: note = Seed: LQTVHSIPLTINKEEALQR
LQTVHSIPFTIQKNEAAQR

SEQ ID NO: 34526 - protein, 19 aa, synthetic construct
  source 1..19: note = Seed: LQTVHSIPLTINKEEALQR
LQTVHSIPFTIQKNEAIQR

SEQ ID NO: 34527 - protein, 19 aa, synthetic construct
  source 1..19: note = Seed: LQTVHSIPLTINKEEALQR
LQTVHSIPFTIQKNEALQR

SEQ ID NO: 34528 - protein, 19 aa, synthetic construct
  source 1..19: note = Seed: LQTVHSIPLTINKEEALQR
LQTVHSIPFTIQKNEAVQR

SEQ ID NO: 34529 - protein, 19 aa, synthetic construct
  source 1..19: note = Seed: LQTVHSIPLTINKEEALQR
LQTVHSIPFTIQKPEAAQR

SEQ ID NO: 34530 - protein, 19 aa, synthetic construct
  source 1..19: note = Seed: LQTVHSIPLTINKEEALQR
LQTVHSIPFTIQKPEAIQR

SEQ ID NO: 34531 - protein, 19 aa, synthetic construct
  source 1..19: note = Seed: LQTVHSIPLTINKEEALQR
LQTVHSIPFTIQKPEALQR

SEQ ID NO: 34532 - protein, 19 aa, synthetic construct
  source 1..19: note = Seed: LQTVHSIPLTINKEEALQR
LQTVHSIPFTIQKPEAVQR

SEQ ID NO: 34533 - protein, 19 aa, synthetic construct
  source 1..19: note = Seed: LQTVHSIPLTINKEEALQR
LQTVHSIPFTIQKSEAAQR

SEQ ID NO: 34534 - protein, 19 aa, synthetic construct
  source 1..19: note = Seed: LQTVHSIPLTINKEEALQR
LQTVHSIPFTIQKSEAIQR

SEQ ID NO: 34535 - protein, 19 aa, synthetic construct
  source 1..19: note = Seed: LQTVHSIPLTINKEEALQR
LQTVHSIPFTIQKSEALQR

SEQ ID NO: 34536 - protein, 19 aa, synthetic construct
  source 1..19: note = Seed: LQTVHSIPLTINKEEALQR
LQTVHSIPFTIQKSEAMQR

SEQ ID NO: 34537 - protein, 19 aa, synthetic construct
  source 1..19: note = Seed: LQTVHSIPLTINKEEALQR
LQTVHSIPFTIQKSEASQR

SEQ ID NO: 34538 - protein, 19 aa, synthetic construct
  source 1..19: note = Seed: LQTVHSIPLTINKEEALQR
LQTVHSIPFTIQKSEATQR

SEQ ID NO: 34539 - protein, 19 aa, synthetic construct
  source 1..19: note = Seed: LQTVHSIPLTINKEEALQR
LQTVHSIPFTIQKSEAVQR

SEQ ID NO: 34540 - protein, 19 aa, synthetic construct
  source 1..19: note = Seed: LQTVHSIPLTINKEEALQR
LQTVHSIPFTIQKTEAAQR

SEQ ID NO: 34541 - protein, 19 aa, synthetic construct
  source 1..19: note = Seed: LQTVHSIPLTINKEEALQR
LQTVHSIPFTIQKTEAIQR

SEQ ID NO: 34542 - protein, 19 aa, synthetic construct
  source 1..19: note = Seed: LQTVHSIPLTINKEEALQR
LQTVHSIPFTIQKTEALQR

SEQ ID NO: 34543 - protein, 19 aa, synthetic construct
  source 1..19: note = Seed: LQTVHSIPLTINKEEALQR
LQTVHSIPFTIQKTEAVQR

SEQ ID NO: 34544 - protein, 19 aa, synthetic construct
  source 1..19: note = Seed: LQTVHSIPLTINKEEALQR
LQTVHSIPFTIQKVEALQR

SEQ ID NO: 34545 - protein, 19 aa, synthetic construct
  source 1..19: note = Seed: LQTVHSIPLTINKEEALQR
LQTVHSIPFTIQKWEAFQR

SEQ ID NO: 34546 - protein, 19 aa, synthetic construct
  source 1..19: note = Seed: LQTVHSIPLTINKEEALQR
LQTVHSIPFTIQKWEAIQR

SEQ ID NO: 34547 - protein, 19 aa, synthetic construct
  source 1..19: note = Seed: LQTVHSIPLTINKEEALQR
LQTVHSIPFTIQKWEALQR

SEQ ID NO: 34548 - protein, 19 aa, synthetic construct
  source 1..19: note = Seed: LQTVHSIPLTINKEEALQR
LQTVHSIPFTIQKWEAMQR

SEQ ID NO: 34549 - protein, 19 aa, synthetic construct
  source 1..19: note = Seed: LQTVHSIPLTINKEEALQR
LQTVHSIPFTIQKWEAVQR

SEQ ID NO: 34550 - protein, 19 aa, synthetic construct
  source 1..19: note = Seed: LQTVHSIPLTINKEEALQR
LQTVHSIPFTIQKYEAFQR

SEQ ID NO: 34551 - protein, 19 aa, synthetic construct
  source 1..19: note = Seed: LQTVHSIPLTINKEEALQR
LQTVHSIPFTIQKYEAIQR

SEQ ID NO: 34552 - protein, 19 aa, synthetic construct
  source 1..19: note = Seed: LQTVHSIPLTINKEEALQR
LQTVHSIPFTIQKYEALQR

SEQ ID NO: 34553 - protein, 19 aa, synthetic construct
  source 1..19: note = Seed: LQTVHSIPLTINKEEALQR
LQTVHSIPFTIQKYEAMQR

SEQ ID NO: 34554 - protein, 19 aa, synthetic construct
  source 1..19: note = Seed: LQTVHSIPLTINKEEALQR
LQTVHSIPFTIQKYEAVQR

SEQ ID NO: 34555 - protein, 19 aa, synthetic construct
  source 1..19: note = Seed: LQTVHSIPLTINKEEALQR
LQTVHSIPFTIQKYEAYQR

SEQ ID NO: 34556 - protein, 19 aa, synthetic construct
  source 1..19: note = Seed: LQTVHSIPLTINKEEALQR
LQTVHSIPFTIRKFEAFQR

SEQ ID NO: 34557 - protein, 19 aa, synthetic construct
  source 1..19: note = Seed: LQTVHSIPLTINKEEALQR
LQTVHSIPFTIRKFEAIQR

SEQ ID NO: 34558 - protein, 19 aa, synthetic construct
  source 1..19: note = Seed: LQTVHSIPLTINKEEALQR
LQTVHSIPFTIRKFEALQR

SEQ ID NO: 34559 - protein, 19 aa, synthetic construct
  source 1..19: note = Seed: LQTVHSIPLTINKEEALQR
LQTVHSIPFTIRKFEAMQR

SEQ ID NO: 34560 - protein, 19 aa, synthetic construct
  source 1..19: note = Seed: LQTVHSIPLTINKEEALQR
LQTVHSIPFTIRKFEAVQR

SEQ ID NO: 34561 - protein, 19 aa, synthetic construct
  source 1..19: note = Seed: LQTVHSIPLTINKEEALQR
LQTVHSIPFTISKAEAAQR

SEQ ID NO: 34562 - protein, 19 aa, synthetic construct
  source 1..19: note = Seed: LQTVHSIPLTINKEEALQR
LQTVHSIPFTISKAEAFQR

SEQ ID NO: 34563 - protein, 19 aa, synthetic construct
  source 1..19: note = Seed: LQTVHSIPLTINKEEALQR
LQTVHSIPFTISKAEAIQR

SEQ ID NO: 34564 - protein, 19 aa, synthetic construct
  source 1..19: note = Seed: LQTVHSIPLTINKEEALQR
LQTVHSIPFTISKAEALQR

SEQ ID NO: 34565 - protein, 19 aa, synthetic construct
  source 1..19: note = Seed: LQTVHSIPLTINKEEALQR
LQTVHSIPFTISKAEAMQR

SEQ ID NO: 34566 - protein, 19 aa, synthetic construct
  source 1..19: note = Seed: LQTVHSIPLTINKEEALQR
LQTVHSIPFTISKAEATQR

SEQ ID NO: 34567 - protein, 19 aa, synthetic construct
  source 1..19: note = Seed: LQTVHSIPLTINKEEALQR
LQTVHSIPFTISKAEAVQR

SEQ ID NO: 34568 - protein, 19 aa, synthetic construct
  source 1..19: note = Seed: LQTVHSIPLTINKEEALQR
LQTVHSIPFTISKFEAAQR

SEQ ID NO: 34569 - protein, 19 aa, synthetic construct
  source 1..19: note = Seed: LQTVHSIPLTINKEEALQR
LQTVHSIPFTISKFEACQR

SEQ ID NO: 34570 - protein, 19 aa, synthetic construct
  source 1..19: note = Seed: LQTVHSIPLTINKEEALQR
LQTVHSIPFTISKFEADQR

SEQ ID NO: 34571 - protein, 19 aa, synthetic construct
  source 1..19: note = Seed: LQTVHSIPLTINKEEALQR
LQTVHSIPFTISKFEAEQR

SEQ ID NO: 34572 - protein, 19 aa, synthetic construct
  source 1..19: note = Seed: LQTVHSIPLTINKEEALQR
LQTVHSIPFTISKFEAFQR

SEQ ID NO: 34573 - protein, 19 aa, synthetic construct
  source 1..19: note = Seed: LQTVHSIPLTINKEEALQR
LQTVHSIPFTISKFEAGQR

SEQ ID NO: 34574 - protein, 19 aa, synthetic construct
  source 1..19: note = Seed: LQTVHSIPLTINKEEALQR
LQTVHSIPFTISKFEAHQR

SEQ ID NO: 34575 - protein, 19 aa, synthetic construct
  source 1..19: note = Seed: LQTVHSIPLTINKEEALQR
LQTVHSIPFTISKFEAIQR

SEQ ID NO: 34576 - protein, 19 aa, synthetic construct
  source 1..19: note = Seed: LQTVHSIPLTINKEEALQR
LQTVHSIPFTISKFEALQR

SEQ ID NO: 34577 - protein, 19 aa, synthetic construct
  source 1..19: note = Seed: LQTVHSIPLTINKEEALQR
LQTVHSIPFTISKFEAMQR

SEQ ID NO: 34578 - protein, 19 aa, synthetic construct
  source 1..19: note = Seed: LQTVHSIPLTINKEEALQR
LQTVHSIPFTISKFEANQR

SEQ ID NO: 34579 - protein, 19 aa, synthetic construct
  source 1..19: note = Seed: LQTVHSIPLTINKEEALQR
LQTVHSIPFTISKFEAPQR

SEQ ID NO: 34580 - protein, 19 aa, synthetic construct
  source 1..19: note = Seed: LQTVHSIPLTINKEEALQR
LQTVHSIPFTISKFEAQQR

SEQ ID NO: 34581 - protein, 19 aa, synthetic construct
  source 1..19: note = Seed: LQTVHSIPLTINKEEALQR
LQTVHSIPFTISKFEARQR

SEQ ID NO: 34582 - protein, 19 aa, synthetic construct
  source 1..19: note = Seed: LQTVHSIPLTINKEEALQR
LQTVHSIPFTISKFEASQR

SEQ ID NO: 34583 - protein, 19 aa, synthetic construct
  source 1..19: note = Seed: LQTVHSIPLTINKEEALQR
LQTVHSIPFTISKFEATQR

SEQ ID NO: 34584 - protein, 19 aa, synthetic construct
  source 1..19: note = Seed: LQTVHSIPLTINKEEALQR
LQTVHSIPFTISKFEAVQR

SEQ ID NO: 34585 - protein, 19 aa, synthetic construct
  source 1..19: note = Seed: LQTVHSIPLTINKEEALQR
LQTVHSIPFTISKFEAWQR

SEQ ID NO: 34586 - protein, 19 aa, synthetic construct
  source 1..19: note = Seed: LQTVHSIPLTINKEEALQR
LQTVHSIPFTISKFEAYQR

SEQ ID NO: 34587 - protein, 19 aa, synthetic construct
  source 1..19: note = Seed: LQTVHSIPLTINKEEALQR
LQTVHSIPFTISKGEAAQR

SEQ ID NO: 34588 - protein, 19 aa, synthetic construct
  source 1..19: note = Seed: LQTVHSIPLTINKEEALQR
LQTVHSIPFTISKGEAFQR

SEQ ID NO: 34589 - protein, 19 aa, synthetic construct
  source 1..19: note = Seed: LQTVHSIPLTINKEEALQR
LQTVHSIPFTISKGEAIQR

SEQ ID NO: 34590 - protein, 19 aa, synthetic construct
  source 1..19: note = Seed: LQTVHSIPLTINKEEALQR
LQTVHSIPFTISKGEALQR

SEQ ID NO: 34591 - protein, 19 aa, synthetic construct
  source 1..19: note = Seed: LQTVHSIPLTINKEEALQR
LQTVHSIPFTISKGEAMQR

SEQ ID NO: 34592 - protein, 19 aa, synthetic construct
  source 1..19: note = Seed: LQTVHSIPLTINKEEALQR
LQTVHSIPFTISKGEAVQR

SEQ ID NO: 34593 - protein, 19 aa, synthetic construct
  source 1..19: note = Seed: LQTVHSIPLTINKEEALQR
LQTVHSIPFTISKIEAFQR

SEQ ID NO: 34594 - protein, 19 aa, synthetic construct
  source 1..19: note = Seed: LQTVHSIPLTINKEEALQR
LQTVHSIPFTISKIEAIQR

SEQ ID NO: 34595 - protein, 19 aa, synthetic construct
  source 1..19: note = Seed: LQTVHSIPLTINKEEALQR
LQTVHSIPFTISKIEALQR

SEQ ID NO: 34596 - protein, 19 aa, synthetic construct
  source 1..19: note = Seed: LQTVHSIPLTINKEEALQR
LQTVHSIPFTISKIEAMQR

SEQ ID NO: 34597 - protein, 19 aa, synthetic construct
  source 1..19: note = Seed: LQTVHSIPLTINKEEALQR
LQTVHSIPFTISKIEAVQR

SEQ ID NO: 34598 - protein, 19 aa, synthetic construct
  source 1..19: note = Seed: LQTVHSIPLTINKEEALQR
LQTVHSIPFTISKLEAFQR

SEQ ID NO: 34599 - protein, 19 aa, synthetic construct
  source 1..19: note = Seed: LQTVHSIPLTINKEEALQR
LQTVHSIPFTISKLEAIQR

SEQ ID NO: 34600 - protein, 19 aa, synthetic construct
  source 1..19: note = Seed: LQTVHSIPLTINKEEALQR
LQTVHSIPFTISKLEALQR

SEQ ID NO: 34601 - protein, 19 aa, synthetic construct
  source 1..19: note = Seed: LQTVHSIPLTINKEEALQR
LQTVHSIPFTISKLEAMQR

SEQ ID NO: 34602 - protein, 19 aa, synthetic construct
  source 1..19: note = Seed: LQTVHSIPLTINKEEALQR
LQTVHSIPFTISKLEAVQR

SEQ ID NO: 34603 - protein, 19 aa, synthetic construct
  source 1..19: note = Seed: LQTVHSIPLTINKEEALQR
LQTVHSIPFTISKLEAYQR

SEQ ID NO: 34604 - protein, 19 aa, synthetic construct
  source 1..19: note = Seed: LQTVHSIPLTINKEEALQR
LQTVHSIPFTISKMEAFQR

SEQ ID NO: 34605 - protein, 19 aa, synthetic construct
  source 1..19: note = Seed: LQTVHSIPLTINKEEALQR
LQTVHSIPFTISKMEAIQR

SEQ ID NO: 34606 - protein, 19 aa, synthetic construct
  source 1..19: note = Seed: LQTVHSIPLTINKEEALQR
LQTVHSIPFTISKMEALQR

SEQ ID NO: 34607 - protein, 19 aa, synthetic construct
  source 1..19: note = Seed: LQTVHSIPLTINKEEALQR
LQTVHSIPFTISKMEAVQR

SEQ ID NO: 34608 - protein, 19 aa, synthetic construct
  source 1..19: note = Seed: LQTVHSIPLTINKEEALQR
LQTVHSIPFTISKNEAIQR

SEQ ID NO: 34609 - protein, 19 aa, synthetic construct
  source 1..19: note = Seed: LQTVHSIPLTINKEEALQR
LQTVHSIPFTISKNEALQR

SEQ ID NO: 34610 - protein, 19 aa, synthetic construct
  source 1..19: note = Seed: LQTVHSIPLTINKEEALQR
LQTVHSIPFTISKNEAVQR

SEQ ID NO: 34611 - protein, 19 aa, synthetic construct
  source 1..19: note = Seed: LQTVHSIPLTINKEEALQR
LQTVHSIPFTISKPEAIQR

SEQ ID NO: 34612 - protein, 19 aa, synthetic construct
  source 1..19: note = Seed: LQTVHSIPLTINKEEALQR
LQTVHSIPFTISKPEALQR

SEQ ID NO: 34613 - protein, 19 aa, synthetic construct
  source 1..19: note = Seed: LQTVHSIPLTINKEEALQR
LQTVHSIPFTISKPEAVQR

SEQ ID NO: 34614 - protein, 19 aa, synthetic construct
  source 1..19: note = Seed: LQTVHSIPLTINKEEALQR
LQTVHSIPFTISKSEAAQR

SEQ ID NO: 34615 - protein, 19 aa, synthetic construct
  source 1..19: note = Seed: LQTVHSIPLTINKEEALQR
LQTVHSIPFTISKSEAFQR

SEQ ID NO: 34616 - protein, 19 aa, synthetic construct
  source 1..19: note = Seed: LQTVHSIPLTINKEEALQR
LQTVHSIPFTISKSEAIQR

SEQ ID NO: 34617 - protein, 19 aa, synthetic construct
  source 1..19: note = Seed: LQTVHSIPLTINKEEALQR
LQTVHSIPFTISKSEALQR

SEQ ID NO: 34618 - protein, 19 aa, synthetic construct
  source 1..19: note = Seed: LQTVHSIPLTINKEEALQR
LQTVHSIPFTISKSEAMQR

SEQ ID NO: 34619 - protein, 19 aa, synthetic construct
  source 1..19: note = Seed: LQTVHSIPLTINKEEALQR
LQTVHSIPFTISKSEAVQR

SEQ ID NO: 34620 - protein, 19 aa, synthetic construct
  source 1..19: note = Seed: LQTVHSIPLTINKEEALQR
LQTVHSIPFTISKTEAIQR

SEQ ID NO: 34621 - protein, 19 aa, synthetic construct
  source 1..19: note = Seed: LQTVHSIPLTINKEEALQR
LQTVHSIPFTISKTEALQR

SEQ ID NO: 34622 - protein, 19 aa, synthetic construct
  source 1..19: note = Seed: LQTVHSIPLTINKEEALQR
LQTVHSIPFTISKTEAVQR

SEQ ID NO: 34623 - protein, 19 aa, synthetic construct
  source 1..19: note = Seed: LQTVHSIPLTINKEEALQR
LQTVHSIPFTISKVEAIQR

SEQ ID NO: 34624 - protein, 19 aa, synthetic construct
  source 1..19: note = Seed: LQTVHSIPLTINKEEALQR
LQTVHSIPFTISKVEALQR

SEQ ID NO: 34625 - protein, 19 aa, synthetic construct
  source 1..19: note = Seed: LQTVHSIPLTINKEEALQR
LQTVHSIPFTISKVEAVQR

SEQ ID NO: 34626 - protein, 19 aa, synthetic construct
  source 1..19: note = Seed: LQTVHSIPLTINKEEALQR
LQTVHSIPFTISKWEAFQR

SEQ ID NO: 34627 - protein, 19 aa, synthetic construct
  source 1..19: note = Seed: LQTVHSIPLTINKEEALQR
LQTVHSIPFTISKWEAIQR

SEQ ID NO: 34628 - protein, 19 aa, synthetic construct
  source 1..19: note = Seed: LQTVHSIPLTINKEEALQR
LQTVHSIPFTISKWEALQR

SEQ ID NO: 34629 - protein, 19 aa, synthetic construct
  source 1..19: note = Seed: LQTVHSIPLTINKEEALQR
LQTVHSIPFTISKWEAMQR

SEQ ID NO: 34630 - protein, 19 aa, synthetic construct
  source 1..19: note = Seed: LQTVHSIPLTINKEEALQR
LQTVHSIPFTISKWEAVQR

SEQ ID NO: 34631 - protein, 19 aa, synthetic construct
  source 1..19: note = Seed: LQTVHSIPLTINKEEALQR
LQTVHSIPFTISKYEAAQR

SEQ ID NO: 34632 - protein, 19 aa, synthetic construct
  source 1..19: note = Seed: LQTVHSIPLTINKEEALQR
LQTVHSIPFTISKYEAFQR

SEQ ID NO: 34633 - protein, 19 aa, synthetic construct
  source 1..19: note = Seed: LQTVHSIPLTINKEEALQR
LQTVHSIPFTISKYEAIQR

SEQ ID NO: 34634 - protein, 19 aa, synthetic construct
  source 1..19: note = Seed: LQTVHSIPLTINKEEALQR
LQTVHSIPFTISKYEALQR

SEQ ID NO: 34635 - protein, 19 aa, synthetic construct
  source 1..19: note = Seed: LQTVHSIPLTINKEEALQR
LQTVHSIPFTISKYEAMQR

SEQ ID NO: 34636 - protein, 19 aa, synthetic construct
  source 1..19: note = Seed: LQTVHSIPLTINKEEALQR
LQTVHSIPFTISKYEANQR

SEQ ID NO: 34637 - protein, 19 aa, synthetic construct
  source 1..19: note = Seed: LQTVHSIPLTINKEEALQR
LQTVHSIPFTISKYEASQR

SEQ ID NO: 34638 - protein, 19 aa, synthetic construct
  source 1..19: note = Seed: LQTVHSIPLTINKEEALQR
LQTVHSIPFTISKYEATQR

SEQ ID NO: 34639 - protein, 19 aa, synthetic construct
  source 1..19: note = Seed: LQTVHSIPLTINKEEALQR
LQTVHSIPFTISKYEAVQR

SEQ ID NO: 34640 - protein, 19 aa, synthetic construct
  source 1..19: note = Seed: LQTVHSIPLTINKEEALQR
LQTVHSIPFTISKYEAYQR

SEQ ID NO: 34641 - protein, 19 aa, synthetic construct
  source 1..19: note = Seed: LQTVHSIPLTINKEEALQR
LQTVHSIPFTITKAEAAQR

SEQ ID NO: 34642 - protein, 19 aa, synthetic construct
  source 1..19: note = Seed: LQTVHSIPLTINKEEALQR
LQTVHSIPFTITKAEAFQR

SEQ ID NO: 34643 - protein, 19 aa, synthetic construct
  source 1..19: note = Seed: LQTVHSIPLTINKEEALQR
LQTVHSIPFTITKAEALQR

SEQ ID NO: 34644 - protein, 19 aa, synthetic construct
  source 1..19: note = Seed: LQTVHSIPLTINKEEALQR
LQTVHSIPFTITKAEAMQR

SEQ ID NO: 34645 - protein, 19 aa, synthetic construct
  source 1..19: note = Seed: LQTVHSIPLTINKEEALQR
LQTVHSIPFTITKAEAVQR

SEQ ID NO: 34646 - protein, 19 aa, synthetic construct
  source 1..19: note = Seed: LQTVHSIPLTINKEEALQR
LQTVHSIPFTITKFEAAQR

SEQ ID NO: 34647 - protein, 19 aa, synthetic construct
  source 1..19: note = Seed: LQTVHSIPLTINKEEALQR
LQTVHSIPFTITKFEACQR

SEQ ID NO: 34648 - protein, 19 aa, synthetic construct
  source 1..19: note = Seed: LQTVHSIPLTINKEEALQR
LQTVHSIPFTITKFEADQR

SEQ ID NO: 34649 - protein, 19 aa, synthetic construct
  source 1..19: note = Seed: LQTVHSIPLTINKEEALQR
LQTVHSIPFTITKFEAEQR

SEQ ID NO: 34650 - protein, 19 aa, synthetic construct
  source 1..19: note = Seed: LQTVHSIPLTINKEEALQR
LQTVHSIPFTITKFEAFQR

SEQ ID NO: 34651 - protein, 19 aa, synthetic construct
  source 1..19: note = Seed: LQTVHSIPLTINKEEALQR
LQTVHSIPFTITKFEAGQR

SEQ ID NO: 34652 - protein, 19 aa, synthetic construct
  source 1..19: note = Seed: LQTVHSIPLTINKEEALQR
LQTVHSIPFTITKFEAHQR

SEQ ID NO: 34653 - protein, 19 aa, synthetic construct
  source 1..19: note = Seed: LQTVHSIPLTINKEEALQR
LQTVHSIPFTITKFEAIQR

SEQ ID NO: 34654 - protein, 19 aa, synthetic construct
  source 1..19: note = Seed: LQTVHSIPLTINKEEALQR
LQTVHSIPFTITKFEAKQR

SEQ ID NO: 34655 - protein, 19 aa, synthetic construct
  source 1..19: note = Seed: LQTVHSIPLTINKEEALQR
LQTVHSIPFTITKFEALQR

SEQ ID NO: 34656 - protein, 19 aa, synthetic construct
  source 1..19: note = Seed: LQTVHSIPLTINKEEALQR
LQTVHSIPFTITKFEAMQR

SEQ ID NO: 34657 - protein, 19 aa, synthetic construct
  source 1..19: note = Seed: LQTVHSIPLTINKEEALQR
LQTVHSIPFTITKFEANQR

SEQ ID NO: 34658 - protein, 19 aa, synthetic construct
  source 1..19: note = Seed: LQTVHSIPLTINKEEALQR
LQTVHSIPFTITKFEAPQR

SEQ ID NO: 34659 - protein, 19 aa, synthetic construct
  source 1..19: note = Seed: LQTVHSIPLTINKEEALQR
LQTVHSIPFTITKFEAQQR

SEQ ID NO: 34660 - protein, 19 aa, synthetic construct
  source 1..19: note = Seed: LQTVHSIPLTINKEEALQR
LQTVHSIPFTITKFEARQR

SEQ ID NO: 34661 - protein, 19 aa, synthetic construct
  source 1..19: note = Seed: LQTVHSIPLTINKEEALQR
LQTVHSIPFTITKFEASQR

SEQ ID NO: 34662 - protein, 19 aa, synthetic construct
  source 1..19: note = Seed: LQTVHSIPLTINKEEALQR
LQTVHSIPFTITKFEATQR

SEQ ID NO: 34663 - protein, 19 aa, synthetic construct
  source 1..19: note = Seed: LQTVHSIPLTINKEEALQR
LQTVHSIPFTITKFEAVQR

SEQ ID NO: 34664 - protein, 19 aa, synthetic construct
  source 1..19: note = Seed: LQTVHSIPLTINKEEALQR
LQTVHSIPFTITKFEAWQR

SEQ ID NO: 34665 - protein, 19 aa, synthetic construct
  source 1..19: note = Seed: LQTVHSIPLTINKEEALQR
LQTVHSIPFTITKFEAYQR

SEQ ID NO: 34666 - protein, 19 aa, synthetic construct
  source 1..19: note = Seed: LQTVHSIPLTINKEEALQR
LQTVHSIPFTITKGEAAQR

SEQ ID NO: 34667 - protein, 19 aa, synthetic construct
  source 1..19: note = Seed: LQTVHSIPLTINKEEALQR
LQTVHSIPFTITKGEAFQR

SEQ ID NO: 34668 - protein, 19 aa, synthetic construct
  source 1..19: note = Seed: LQTVHSIPLTINKEEALQR
LQTVHSIPFTITKGEAIQR

SEQ ID NO: 34669 - protein, 19 aa, synthetic construct
  source 1..19: note = Seed: LQTVHSIPLTINKEEALQR
LQTVHSIPFTITKGEALQR

SEQ ID NO: 34670 - protein, 19 aa, synthetic construct
  source 1..19: note = Seed: LQTVHSIPLTINKEEALQR
LQTVHSIPFTITKGEAMQR

SEQ ID NO: 34671 - protein, 19 aa, synthetic construct
  source 1..19: note = Seed: LQTVHSIPLTINKEEALQR
LQTVHSIPFTITKGEAVQR

SEQ ID NO: 34672 - protein, 19 aa, synthetic construct
  source 1..19: note = Seed: LQTVHSIPLTINKEEALQR
LQTVHSIPFTITKIEAFQR

SEQ ID NO: 34673 - protein, 19 aa, synthetic construct
  source 1..19: note = Seed: LQTVHSIPLTINKEEALQR
LQTVHSIPFTITKIEAIQR

SEQ ID NO: 34674 - protein, 19 aa, synthetic construct
  source 1..19: note = Seed: LQTVHSIPLTINKEEALQR
LQTVHSIPFTITKIEALQR

SEQ ID NO: 34675 - protein, 19 aa, synthetic construct
  source 1..19: note = Seed: LQTVHSIPLTINKEEALQR
LQTVHSIPFTITKIEAMQR

SEQ ID NO: 34676 - protein, 19 aa, synthetic construct
  source 1..19: note = Seed: LQTVHSIPLTINKEEALQR
LQTVHSIPFTITKIEATQR

SEQ ID NO: 34677 - protein, 19 aa, synthetic construct
  source 1..19: note = Seed: LQTVHSIPLTINKEEALQR
LQTVHSIPFTITKIEAVQR

SEQ ID NO: 34678 - protein, 19 aa, synthetic construct
  source 1..19: note = Seed: LQTVHSIPLTINKEEALQR
LQTVHSIPFTITKIEAYQR

SEQ ID NO: 34679 - protein, 19 aa, synthetic construct
  source 1..19: note = Seed: LQTVHSIPLTINKEEALQR
LQTVHSIPFTITKLEAAQR

SEQ ID NO: 34680 - protein, 19 aa, synthetic construct
  source 1..19: note = Seed: LQTVHSIPLTINKEEALQR
LQTVHSIPFTITKLEADQR

SEQ ID NO: 34681 - protein, 19 aa, synthetic construct
  source 1..19: note = Seed: LQTVHSIPLTINKEEALQR
LQTVHSIPFTITKLEAEQR

SEQ ID NO: 34682 - protein, 19 aa, synthetic construct
  source 1..19: note = Seed: LQTVHSIPLTINKEEALQR
LQTVHSIPFTITKLEAFQR

SEQ ID NO: 34683 - protein, 19 aa, synthetic construct
  source 1..19: note = Seed: LQTVHSIPLTINKEEALQR
LQTVHSIPFTITKLEAIQR

SEQ ID NO: 34684 - protein, 19 aa, synthetic construct
  source 1..19: note = Seed: LQTVHSIPLTINKEEALQR
LQTVHSIPFTITKLEALQR

SEQ ID NO: 34685 - protein, 19 aa, synthetic construct
  source 1..19: note = Seed: LQTVHSIPLTINKEEALQR
LQTVHSIPFTITKLEAMQR

SEQ ID NO: 34686 - protein, 19 aa, synthetic construct
  source 1..19: note = Seed: LQTVHSIPLTINKEEALQR
LQTVHSIPFTITKLEANQR

SEQ ID NO: 34687 - protein, 19 aa, synthetic construct
  source 1..19: note = Seed: LQTVHSIPLTINKEEALQR
LQTVHSIPFTITKLEASQR

SEQ ID NO: 34688 - protein, 19 aa, synthetic construct
  source 1..19: note = Seed: LQTVHSIPLTINKEEALQR
LQTVHSIPFTITKLEATQR

SEQ ID NO: 34689 - protein, 19 aa, synthetic construct
  source 1..19: note = Seed: LQTVHSIPLTINKEEALQR
LQTVHSIPFTITKLEAVQR

SEQ ID NO: 34690 - protein, 19 aa, synthetic construct
  source 1..19: note = Seed: LQTVHSIPLTINKEEALQR
LQTVHSIPFTITKLEAWQR

SEQ ID NO: 34691 - protein, 19 aa, synthetic construct
  source 1..19: note = Seed: LQTVHSIPLTINKEEALQR
LQTVHSIPFTITKLEAYQR

SEQ ID NO: 34692 - protein, 19 aa, synthetic construct
  source 1..19: note = Seed: LQTVHSIPLTINKEEALQR
LQTVHSIPFTITKMEAFQR

SEQ ID NO: 34693 - protein, 19 aa, synthetic construct
  source 1..19: note = Seed: LQTVHSIPLTINKEEALQR
LQTVHSIPFTITKMEAIQR

SEQ ID NO: 34694 - protein, 19 aa, synthetic construct
  source 1..19: note = Seed: LQTVHSIPLTINKEEALQR
LQTVHSIPFTITKMEALQR

SEQ ID NO: 34695 - protein, 19 aa, synthetic construct
  source 1..19: note = Seed: LQTVHSIPLTINKEEALQR
LQTVHSIPFTITKMEAMQR

SEQ ID NO: 34696 - protein, 19 aa, synthetic construct
  source 1..19: note = Seed: LQTVHSIPLTINKEEALQR
LQTVHSIPFTITKMEAVQR

SEQ ID NO: 34697 - protein, 19 aa, synthetic construct
  source 1..19: note = Seed: LQTVHSIPLTINKEEALQR
LQTVHSIPFTITKMEAYQR

SEQ ID NO: 34698 - protein, 19 aa, synthetic construct
  source 1..19: note = Seed: LQTVHSIPLTINKEEALQR
LQTVHSIPFTITKNEAIQR

SEQ ID NO: 34699 - protein, 19 aa, synthetic construct
  source 1..19: note = Seed: LQTVHSIPLTINKEEALQR
LQTVHSIPFTITKNEALQR

SEQ ID NO: 34700 - protein, 19 aa, synthetic construct
  source 1..19: note = Seed: LQTVHSIPLTINKEEALQR
LQTVHSIPFTITKNEAVQR

SEQ ID NO: 34701 - protein, 19 aa, synthetic construct
  source 1..19: note = Seed: LQTVHSIPLTINKEEALQR
LQTVHSIPFTITKPEAIQR

SEQ ID NO: 34702 - protein, 19 aa, synthetic construct
  source 1..19: note = Seed: LQTVHSIPLTINKEEALQR
LQTVHSIPFTITKPEALQR

SEQ ID NO: 34703 - protein, 19 aa, synthetic construct
  source 1..19: note = Seed: LQTVHSIPLTINKEEALQR
LQTVHSIPFTITKPEAVQR

SEQ ID NO: 34704 - protein, 19 aa, synthetic construct
  source 1..19: note = Seed: LQTVHSIPLTINKEEALQR
LQTVHSIPFTITKSEAAQR

SEQ ID NO: 34705 - protein, 19 aa, synthetic construct
  source 1..19: note = Seed: LQTVHSIPLTINKEEALQR
LQTVHSIPFTITKSEAFQR

SEQ ID NO: 34706 - protein, 19 aa, synthetic construct
  source 1..19: note = Seed: LQTVHSIPLTINKEEALQR
LQTVHSIPFTITKSEALQR

SEQ ID NO: 34707 - protein, 19 aa, synthetic construct
  source 1..19: note = Seed: LQTVHSIPLTINKEEALQR
LQTVHSIPFTITKSEAMQR

SEQ ID NO: 34708 - protein, 19 aa, synthetic construct
  source 1..19: note = Seed: LQTVHSIPLTINKEEALQR
LQTVHSIPFTITKSEATQR

SEQ ID NO: 34709 - protein, 19 aa, synthetic construct
  source 1..19: note = Seed: LQTVHSIPLTINKEEALQR
LQTVHSIPFTITKSEAVQR

SEQ ID NO: 34710 - protein, 19 aa, synthetic construct
  source 1..19: note = Seed: LQTVHSIPLTINKEEALQR
LQTVHSIPFTITKTEAFQR

SEQ ID NO: 34711 - protein, 19 aa, synthetic construct
  source 1..19: note = Seed: LQTVHSIPLTINKEEALQR
LQTVHSIPFTITKTEAIQR

SEQ ID NO: 34712 - protein, 19 aa, synthetic construct
  source 1..19: note = Seed: LQTVHSIPLTINKEEALQR
LQTVHSIPFTITKTEALQR

SEQ ID NO: 34713 - protein, 19 aa, synthetic construct
  source 1..19: note = Seed: LQTVHSIPLTINKEEALQR
LQTVHSIPFTITKTEAMQR

SEQ ID NO: 34714 - protein, 19 aa, synthetic construct
  source 1..19: note = Seed: LQTVHSIPLTINKEEALQR
LQTVHSIPFTITKTEAVQR

SEQ ID NO: 34715 - protein, 19 aa, synthetic construct
  source 1..19: note = Seed: LQTVHSIPLTINKEEALQR
LQTVHSIPFTITKVEAFQR

SEQ ID NO: 34716 - protein, 19 aa, synthetic construct
  source 1..19: note = Seed: LQTVHSIPLTINKEEALQR
LQTVHSIPFTITKVEAIQR

SEQ ID NO: 34717 - protein, 19 aa, synthetic construct
  source 1..19: note = Seed: LQTVHSIPLTINKEEALQR
LQTVHSIPFTITKVEALQR

SEQ ID NO: 34718 - protein, 19 aa, synthetic construct
  source 1..19: note = Seed: LQTVHSIPLTINKEEALQR
LQTVHSIPFTITKVEAMQR

SEQ ID NO: 34719 - protein, 19 aa, synthetic construct
  source 1..19: note = Seed: LQTVHSIPLTINKEEALQR
LQTVHSIPFTITKVEAVQR

SEQ ID NO: 34720 - protein, 19 aa, synthetic construct
  source 1..19: note = Seed: LQTVHSIPLTINKEEALQR
LQTVHSIPFTITKWEAAQR

SEQ ID NO: 34721 - protein, 19 aa, synthetic construct
  source 1..19: note = Seed: LQTVHSIPLTINKEEALQR
LQTVHSIPFTITKWEADQR

SEQ ID NO: 34722 - protein, 19 aa, synthetic construct
  source 1..19: note = Seed: LQTVHSIPLTINKEEALQR
LQTVHSIPFTITKWEAEQR

SEQ ID NO: 34723 - protein, 19 aa, synthetic construct
  source 1..19: note = Seed: LQTVHSIPLTINKEEALQR
LQTVHSIPFTITKWEAFQR

SEQ ID NO: 34724 - protein, 19 aa, synthetic construct
  source 1..19: note = Seed: LQTVHSIPLTINKEEALQR
LQTVHSIPFTITKWEAIQR

SEQ ID NO: 34725 - protein, 19 aa, synthetic construct
  source 1..19: note = Seed: LQTVHSIPLTINKEEALQR
LQTVHSIPFTITKWEALQR

SEQ ID NO: 34726 - protein, 19 aa, synthetic construct
  source 1..19: note = Seed: LQTVHSIPLTINKEEALQR
LQTVHSIPFTITKWEAMQR

SEQ ID NO: 34727 - protein, 19 aa, synthetic construct
  source 1..19: note = Seed: LQTVHSIPLTINKEEALQR
LQTVHSIPFTITKWEANQR

SEQ ID NO: 34728 - protein, 19 aa, synthetic construct
  source 1..19: note = Seed: LQTVHSIPLTINKEEALQR
LQTVHSIPFTITKWEASQR

SEQ ID NO: 34729 - protein, 19 aa, synthetic construct
  source 1..19: note = Seed: LQTVHSIPLTINKEEALQR
LQTVHSIPFTITKWEATQR

SEQ ID NO: 34730 - protein, 19 aa, synthetic construct
  source 1..19: note = Seed: LQTVHSIPLTINKEEALQR
LQTVHSIPFTITKWEAVQR

SEQ ID NO: 34731 - protein, 19 aa, synthetic construct
  source 1..19: note = Seed: LQTVHSIPLTINKEEALQR
LQTVHSIPFTITKWEAYQR

SEQ ID NO: 34732 - protein, 19 aa, synthetic construct
  source 1..19: note = Seed: LQTVHSIPLTINKEEALQR
LQTVHSIPFTITKYEAAQR

SEQ ID NO: 34733 - protein, 19 aa, synthetic construct
  source 1..19: note = Seed: LQTVHSIPLTINKEEALQR
LQTVHSIPFTITKYEACQR

SEQ ID NO: 34734 - protein, 19 aa, synthetic construct
  source 1..19: note = Seed: LQTVHSIPLTINKEEALQR
LQTVHSIPFTITKYEADQR

SEQ ID NO: 34735 - protein, 19 aa, synthetic construct
  source 1..19: note = Seed: LQTVHSIPLTINKEEALQR
LQTVHSIPFTITKYEAEQR

SEQ ID NO: 34736 - protein, 19 aa, synthetic construct
  source 1..19: note = Seed: LQTVHSIPLTINKEEALQR
LQTVHSIPFTITKYEAFQR

SEQ ID NO: 34737 - protein, 19 aa, synthetic construct
  source 1..19: note = Seed: LQTVHSIPLTINKEEALQR
LQTVHSIPFTITKYEAGQR

SEQ ID NO: 34738 - protein, 19 aa, synthetic construct
  source 1..19: note = Seed: LQTVHSIPLTINKEEALQR
LQTVHSIPFTITKYEAIQR

SEQ ID NO: 34739 - protein, 19 aa, synthetic construct
  source 1..19: note = Seed: LQTVHSIPLTINKEEALQR
LQTVHSIPFTITKYEALQR

SEQ ID NO: 34740 - protein, 19 aa, synthetic construct
  source 1..19: note = Seed: LQTVHSIPLTINKEEALQR
LQTVHSIPFTITKYEAMQR

SEQ ID NO: 34741 - protein, 19 aa, synthetic construct
  source 1..19: note = Seed: LQTVHSIPLTINKEEALQR
LQTVHSIPFTITKYEANQR

SEQ ID NO: 34742 - protein, 19 aa, synthetic construct
  source 1..19: note = Seed: LQTVHSIPLTINKEEALQR
LQTVHSIPFTITKYEASQR

SEQ ID NO: 34743 - protein, 19 aa, synthetic construct
  source 1..19: note = Seed: LQTVHSIPLTINKEEALQR
LQTVHSIPFTITKYEATQR

SEQ ID NO: 34744 - protein, 19 aa, synthetic construct
  source 1..19: note = Seed: LQTVHSIPLTINKEEALQR
LQTVHSIPFTITKYEAVQR

SEQ ID NO: 34745 - protein, 19 aa, synthetic construct
  source 1..19: note = Seed: LQTVHSIPLTINKEEALQR
LQTVHSIPFTITKYEAWQR

SEQ ID NO: 34746 - protein, 19 aa, synthetic construct
  source 1..19: note = Seed: LQTVHSIPLTINKEEALQR
LQTVHSIPFTITKYEAYQR

SEQ ID NO: 34747 - protein, 19 aa, synthetic construct
  source 1..19: note = Seed: LQTVHSIPLTINKEEALQR
LQTVHSIPFTIVKAEAAQR

SEQ ID NO: 34748 - protein, 19 aa, synthetic construct
  source 1..19: note = Seed: LQTVHSIPLTINKEEALQR
LQTVHSIPFTIVKAEAFQR

SEQ ID NO: 34749 - protein, 19 aa, synthetic construct
  source 1..19: note = Seed: LQTVHSIPLTINKEEALQR
LQTVHSIPFTIVKAEAGQR

SEQ ID NO: 34750 - protein, 19 aa, synthetic construct
  source 1..19: note = Seed: LQTVHSIPLTINKEEALQR
LQTVHSIPFTIVKAEAIQR

SEQ ID NO: 34751 - protein, 19 aa, synthetic construct
  source 1..19: note = Seed: LQTVHSIPLTINKEEALQR
LQTVHSIPFTIVKAEALQR

SEQ ID NO: 34752 - protein, 19 aa, synthetic construct
  source 1..19: note = Seed: LQTVHSIPLTINKEEALQR
LQTVHSIPFTIVKAEAMQR

SEQ ID NO: 34753 - protein, 19 aa, synthetic construct
  source 1..19: note = Seed: LQTVHSIPLTINKEEALQR
LQTVHSIPFTIVKAEASQR

SEQ ID NO: 34754 - protein, 19 aa, synthetic construct
  source 1..19: note = Seed: LQTVHSIPLTINKEEALQR
LQTVHSIPFTIVKAEATQR

SEQ ID NO: 34755 - protein, 19 aa, synthetic construct
  source 1..19: note = Seed: LQTVHSIPLTINKEEALQR
LQTVHSIPFTIVKAEAVQR

SEQ ID NO: 34756 - protein, 19 aa, synthetic construct
  source 1..19: note = Seed: LQTVHSIPLTINKEEALQR
LQTVHSIPFTIVKFEAAQR

SEQ ID NO: 34757 - protein, 19 aa, synthetic construct
  source 1..19: note = Seed: LQTVHSIPLTINKEEALQR
LQTVHSIPFTIVKFEACQR

SEQ ID NO: 34758 - protein, 19 aa, synthetic construct
  source 1..19: note = Seed: LQTVHSIPLTINKEEALQR
LQTVHSIPFTIVKFEADQR

SEQ ID NO: 34759 - protein, 19 aa, synthetic construct
  source 1..19: note = Seed: LQTVHSIPLTINKEEALQR
LQTVHSIPFTIVKFEAEQR

SEQ ID NO: 34760 - protein, 19 aa, synthetic construct
  source 1..19: note = Seed: LQTVHSIPLTINKEEALQR
LQTVHSIPFTIVKFEAFQR

SEQ ID NO: 34761 - protein, 19 aa, synthetic construct
  source 1..19: note = Seed: LQTVHSIPLTINKEEALQR
LQTVHSIPFTIVKFEAGQR

SEQ ID NO: 34762 - protein, 19 aa, synthetic construct
  source 1..19: note = Seed: LQTVHSIPLTINKEEALQR
LQTVHSIPFTIVKFEAHQR

SEQ ID NO: 34763 - protein, 19 aa, synthetic construct
  source 1..19: note = Seed: LQTVHSIPLTINKEEALQR
LQTVHSIPFTIVKFEAIQR

SEQ ID NO: 34764 - protein, 19 aa, synthetic construct
  source 1..19: note = Seed: LQTVHSIPLTINKEEALQR
LQTVHSIPFTIVKFEAKQR

SEQ ID NO: 34765 - protein, 19 aa, synthetic construct
  source 1..19: note = Seed: LQTVHSIPLTINKEEALQR
LQTVHSIPFTIVKFEALQR

SEQ ID NO: 34766 - protein, 19 aa, synthetic construct
  source 1..19: note = Seed: LQTVHSIPLTINKEEALQR
LQTVHSIPFTIVKFEAMQR

SEQ ID NO: 34767 - protein, 19 aa, synthetic construct
  source 1..19: note = Seed: LQTVHSIPLTINKEEALQR
LQTVHSIPFTIVKFEANQR

SEQ ID NO: 34768 - protein, 19 aa, synthetic construct
  source 1..19: note = Seed: LQTVHSIPLTINKEEALQR
LQTVHSIPFTIVKFEAPQR

SEQ ID NO: 34769 - protein, 19 aa, synthetic construct
  source 1..19: note = Seed: LQTVHSIPLTINKEEALQR
LQTVHSIPFTIVKFEAQQR

SEQ ID NO: 34770 - protein, 19 aa, synthetic construct
  source 1..19: note = Seed: LQTVHSIPLTINKEEALQR
LQTVHSIPFTIVKFEARQR

SEQ ID NO: 34771 - protein, 19 aa, synthetic construct
  source 1..19: note = Seed: LQTVHSIPLTINKEEALQR
LQTVHSIPFTIVKFEASQR

SEQ ID NO: 34772 - protein, 19 aa, synthetic construct
  source 1..19: note = Seed: LQTVHSIPLTINKEEALQR
LQTVHSIPFTIVKFEATQR

SEQ ID NO: 34773 - protein, 19 aa, synthetic construct
  source 1..19: note = Seed: LQTVHSIPLTINKEEALQR
LQTVHSIPFTIVKFEAVQR

SEQ ID NO: 34774 - protein, 19 aa, synthetic construct
  source 1..19: note = Seed: LQTVHSIPLTINKEEALQR
LQTVHSIPFTIVKFEAYQR

SEQ ID NO: 34775 - protein, 19 aa, synthetic construct
  source 1..19: note = Seed: LQTVHSIPLTINKEEALQR
LQTVHSIPFTIVKGEAAQR

SEQ ID NO: 34776 - protein, 19 aa, synthetic construct
  source 1..19: note = Seed: LQTVHSIPLTINKEEALQR
LQTVHSIPFTIVKGEAFQR

SEQ ID NO: 34777 - protein, 19 aa, synthetic construct
  source 1..19: note = Seed: LQTVHSIPLTINKEEALQR
LQTVHSIPFTIVKGEAGQR

SEQ ID NO: 34778 - protein, 19 aa, synthetic construct
  source 1..19: note = Seed: LQTVHSIPLTINKEEALQR
LQTVHSIPFTIVKGEAIQR

SEQ ID NO: 34779 - protein, 19 aa, synthetic construct
  source 1..19: note = Seed: LQTVHSIPLTINKEEALQR
LQTVHSIPFTIVKGEALQR

SEQ ID NO: 34780 - protein, 19 aa, synthetic construct
  source 1..19: note = Seed: LQTVHSIPLTINKEEALQR
LQTVHSIPFTIVKGEAMQR

SEQ ID NO: 34781 - protein, 19 aa, synthetic construct
  source 1..19: note = Seed: LQTVHSIPLTINKEEALQR
LQTVHSIPFTIVKGEASQR

SEQ ID NO: 34782 - protein, 19 aa, synthetic construct
  source 1..19: note = Seed: LQTVHSIPLTINKEEALQR
LQTVHSIPFTIVKGEATQR

SEQ ID NO: 34783 - protein, 19 aa, synthetic construct
  source 1..19: note = Seed: LQTVHSIPLTINKEEALQR
LQTVHSIPFTIVKGEAVQR

SEQ ID NO: 34784 - protein, 19 aa, synthetic construct
  source 1..19: note = Seed: LQTVHSIPLTINKEEALQR
LQTVHSIPFTIVKIEADQR

SEQ ID NO: 34785 - protein, 19 aa, synthetic construct
  source 1..19: note = Seed: LQTVHSIPLTINKEEALQR
LQTVHSIPFTIVKIEAIQR

SEQ ID NO: 34786 - protein, 19 aa, synthetic construct
  source 1..19: note = Seed: LQTVHSIPLTINKEEALQR
LQTVHSIPFTIVKIEALQR

SEQ ID NO: 34787 - protein, 19 aa, synthetic construct
  source 1..19: note = Seed: LQTVHSIPLTINKEEALQR
LQTVHSIPFTIVKIEAMQR

SEQ ID NO: 34788 - protein, 19 aa, synthetic construct
  source 1..19: note = Seed: LQTVHSIPLTINKEEALQR
LQTVHSIPFTIVKIEAVQR

SEQ ID NO: 34789 - protein, 19 aa, synthetic construct
  source 1..19: note = Seed: LQTVHSIPLTINKEEALQR
LQTVHSIPFTIVKLEADQR

SEQ ID NO: 34790 - protein, 19 aa, synthetic construct
  source 1..19: note = Seed: LQTVHSIPLTINKEEALQR
LQTVHSIPFTIVKLEAEQR

SEQ ID NO: 34791 - protein, 19 aa, synthetic construct
  source 1..19: note = Seed: LQTVHSIPLTINKEEALQR
LQTVHSIPFTIVKLEAIQR

SEQ ID NO: 34792 - protein, 19 aa, synthetic construct
  source 1..19: note = Seed: LQTVHSIPLTINKEEALQR
LQTVHSIPFTIVKLEALQR

SEQ ID NO: 34793 - protein, 19 aa, synthetic construct
  source 1..19: note = Seed: LQTVHSIPLTINKEEALQR
LQTVHSIPFTIVKLEAMQR

SEQ ID NO: 34794 - protein, 19 aa, synthetic construct
  source 1..19: note = Seed: LQTVHSIPLTINKEEALQR
LQTVHSIPFTIVKLEANQR

SEQ ID NO: 34795 - protein, 19 aa, synthetic construct
  source 1..19: note = Seed: LQTVHSIPLTINKEEALQR
LQTVHSIPFTIVKLEATQR

SEQ ID NO: 34796 - protein, 19 aa, synthetic construct
  source 1..19: note = Seed: LQTVHSIPLTINKEEALQR
LQTVHSIPFTIVKLEAVQR

SEQ ID NO: 34797 - protein, 19 aa, synthetic construct
  source 1..19: note = Seed: LQTVHSIPLTINKEEALQR
LQTVHSIPFTIVKMEADQR

SEQ ID NO: 34798 - protein, 19 aa, synthetic construct
  source 1..19: note = Seed: LQTVHSIPLTINKEEALQR
LQTVHSIPFTIVKMEAIQR

SEQ ID NO: 34799 - protein, 19 aa, synthetic construct
  source 1..19: note = Seed: LQTVHSIPLTINKEEALQR
LQTVHSIPFTIVKMEAVQR

SEQ ID NO: 34800 - protein, 19 aa, synthetic construct
  source 1..19: note = Seed: LQTVHSIPLTINKEEALQR
LQTVHSIPFTIVKNEAAQR

SEQ ID NO: 34801 - protein, 19 aa, synthetic construct
  source 1..19: note = Seed: LQTVHSIPLTINKEEALQR
LQTVHSIPFTIVKNEAIQR

SEQ ID NO: 34802 - protein, 19 aa, synthetic construct
  source 1..19: note = Seed: LQTVHSIPLTINKEEALQR
LQTVHSIPFTIVKNEALQR

SEQ ID NO: 34803 - protein, 19 aa, synthetic construct
  source 1..19: note = Seed: LQTVHSIPLTINKEEALQR
LQTVHSIPFTIVKNEAMQR

SEQ ID NO: 34804 - protein, 19 aa, synthetic construct
  source 1..19: note = Seed: LQTVHSIPLTINKEEALQR
LQTVHSIPFTIVKNEATQR

SEQ ID NO: 34805 - protein, 19 aa, synthetic construct
  source 1..19: note = Seed: LQTVHSIPLTINKEEALQR
LQTVHSIPFTIVKNEAVQR

SEQ ID NO: 34806 - protein, 19 aa, synthetic construct
  source 1..19: note = Seed: LQTVHSIPLTINKEEALQR
LQTVHSIPFTIVKPEAAQR

SEQ ID NO: 34807 - protein, 19 aa, synthetic construct
  source 1..19: note = Seed: LQTVHSIPLTINKEEALQR
LQTVHSIPFTIVKPEAIQR

SEQ ID NO: 34808 - protein, 19 aa, synthetic construct
  source 1..19: note = Seed: LQTVHSIPLTINKEEALQR
LQTVHSIPFTIVKPEALQR

SEQ ID NO: 34809 - protein, 19 aa, synthetic construct
  source 1..19: note = Seed: LQTVHSIPLTINKEEALQR
LQTVHSIPFTIVKPEAMQR

SEQ ID NO: 34810 - protein, 19 aa, synthetic construct
  source 1..19: note = Seed: LQTVHSIPLTINKEEALQR
LQTVHSIPFTIVKPEATQR

SEQ ID NO: 34811 - protein, 19 aa, synthetic construct
  source 1..19: note = Seed: LQTVHSIPLTINKEEALQR
LQTVHSIPFTIVKPEAVQR

SEQ ID NO: 34812 - protein, 19 aa, synthetic construct
  source 1..19: note = Seed: LQTVHSIPLTINKEEALQR
LQTVHSIPFTIVKSEAAQR

SEQ ID NO: 34813 - protein, 19 aa, synthetic construct
  source 1..19: note = Seed: LQTVHSIPLTINKEEALQR
LQTVHSIPFTIVKSEAFQR

SEQ ID NO: 34814 - protein, 19 aa, synthetic construct
  source 1..19: note = Seed: LQTVHSIPLTINKEEALQR
LQTVHSIPFTIVKSEAIQR

SEQ ID NO: 34815 - protein, 19 aa, synthetic construct
  source 1..19: note = Seed: LQTVHSIPLTINKEEALQR
LQTVHSIPFTIVKSEALQR

SEQ ID NO: 34816 - protein, 19 aa, synthetic construct
  source 1..19: note = Seed: LQTVHSIPLTINKEEALQR
LQTVHSIPFTIVKSEAMQR

SEQ ID NO: 34817 - protein, 19 aa, synthetic construct
  source 1..19: note = Seed: LQTVHSIPLTINKEEALQR
LQTVHSIPFTIVKSEASQR

SEQ ID NO: 34818 - protein, 19 aa, synthetic construct
  source 1..19: note = Seed: LQTVHSIPLTINKEEALQR
LQTVHSIPFTIVKSEATQR

SEQ ID NO: 34819 - protein, 19 aa, synthetic construct
  source 1..19: note = Seed: LQTVHSIPLTINKEEALQR
LQTVHSIPFTIVKSEAVQR

SEQ ID NO: 34820 - protein, 19 aa, synthetic construct
  source 1..19: note = Seed: LQTVHSIPLTINKEEALQR
LQTVHSIPFTIVKTEAAQR

SEQ ID NO: 34821 - protein, 19 aa, synthetic construct
  source 1..19: note = Seed: LQTVHSIPLTINKEEALQR
LQTVHSIPFTIVKTEAFQR

SEQ ID NO: 34822 - protein, 19 aa, synthetic construct
  source 1..19: note = Seed: LQTVHSIPLTINKEEALQR
LQTVHSIPFTIVKTEAIQR

SEQ ID NO: 34823 - protein, 19 aa, synthetic construct
  source 1..19: note = Seed: LQTVHSIPLTINKEEALQR
LQTVHSIPFTIVKTEALQR

SEQ ID NO: 34824 - protein, 19 aa, synthetic construct
  source 1..19: note = Seed: LQTVHSIPLTINKEEALQR
LQTVHSIPFTIVKTEAMQR

SEQ ID NO: 34825 - protein, 19 aa, synthetic construct
  source 1..19: note = Seed: LQTVHSIPLTINKEEALQR
LQTVHSIPFTIVKTEAVQR

SEQ ID NO: 34826 - protein, 19 aa, synthetic construct
  source 1..19: note = Seed: LQTVHSIPLTINKEEALQR
LQTVHSIPFTIVKVEAIQR

SEQ ID NO: 34827 - protein, 19 aa, synthetic construct
  source 1..19: note = Seed: LQTVHSIPLTINKEEALQR
LQTVHSIPFTIVKVEALQR

SEQ ID NO: 34828 - protein, 19 aa, synthetic construct
  source 1..19: note = Seed: LQTVHSIPLTINKEEALQR
LQTVHSIPFTIVKVEAVQR

SEQ ID NO: 34829 - protein, 19 aa, synthetic construct
  source 1..19: note = Seed: LQTVHSIPLTINKEEALQR
LQTVHSIPFTIVKWEAAQR

SEQ ID NO: 34830 - protein, 19 aa, synthetic construct
  source 1..19: note = Seed: LQTVHSIPLTINKEEALQR
LQTVHSIPFTIVKWEADQR

SEQ ID NO: 34831 - protein, 19 aa, synthetic construct
  source 1..19: note = Seed: LQTVHSIPLTINKEEALQR
LQTVHSIPFTIVKWEAIQR

SEQ ID NO: 34832 - protein, 19 aa, synthetic construct
  source 1..19: note = Seed: LQTVHSIPLTINKEEALQR
LQTVHSIPFTIVKWEALQR

SEQ ID NO: 34833 - protein, 19 aa, synthetic construct
  source 1..19: note = Seed: LQTVHSIPLTINKEEALQR
LQTVHSIPFTIVKWEAMQR

SEQ ID NO: 34834 - protein, 19 aa, synthetic construct
  source 1..19: note = Seed: LQTVHSIPLTINKEEALQR
LQTVHSIPFTIVKWEANQR

SEQ ID NO: 34835 - protein, 19 aa, synthetic construct
  source 1..19: note = Seed: LQTVHSIPLTINKEEALQR
LQTVHSIPFTIVKWEAVQR

SEQ ID NO: 34836 - protein, 19 aa, synthetic construct
  source 1..19: note = Seed: LQTVHSIPLTINKEEALQR
LQTVHSIPFTIVKYEAAQR

SEQ ID NO: 34837 - protein, 19 aa, synthetic construct
  source 1..19: note = Seed: LQTVHSIPLTINKEEALQR
LQTVHSIPFTIVKYEADQR

SEQ ID NO: 34838 - protein, 19 aa, synthetic construct
  source 1..19: note = Seed: LQTVHSIPLTINKEEALQR
LQTVHSIPFTIVKYEAEQR

SEQ ID NO: 34839 - protein, 19 aa, synthetic construct
  source 1..19: note = Seed: LQTVHSIPLTINKEEALQR
LQTVHSIPFTIVKYEAFQR

SEQ ID NO: 34840 - protein, 19 aa, synthetic construct
  source 1..19: note = Seed: LQTVHSIPLTINKEEALQR
LQTVHSIPFTIVKYEAIQR

SEQ ID NO: 34841 - protein, 19 aa, synthetic construct
  source 1..19: note = Seed: LQTVHSIPLTINKEEALQR
LQTVHSIPFTIVKYEALQR

SEQ ID NO: 34842 - protein, 19 aa, synthetic construct
  source 1..19: note = Seed: LQTVHSIPLTINKEEALQR
LQTVHSIPFTIVKYEAMQR

SEQ ID NO: 34843 - protein, 19 aa, synthetic construct
  source 1..19: note = Seed: LQTVHSIPLTINKEEALQR
LQTVHSIPFTIVKYEANQR

SEQ ID NO: 34844 - protein, 19 aa, synthetic construct
  source 1..19: note = Seed: LQTVHSIPLTINKEEALQR
LQTVHSIPFTIVKYEASQR

SEQ ID NO: 34845 - protein, 19 aa, synthetic construct
  source 1..19: note = Seed: LQTVHSIPLTINKEEALQR
LQTVHSIPFTIVKYEATQR

SEQ ID NO: 34846 - protein, 19 aa, synthetic construct
  source 1..19: note = Seed: LQTVHSIPLTINKEEALQR
LQTVHSIPFTIVKYEAVQR

SEQ ID NO: 34847 - protein, 19 aa, synthetic construct
  source 1..19: note = Seed: LQTVHSIPLTINKEEALQR
LQTVHSIPFTIVKYEAYQR

SEQ ID NO: 34848 - protein, 19 aa, synthetic construct
  source 1..19: note = Seed: LQTVHSIPLTINKEEALQR
LQTVHSIPFTIWKAEAIQR

SEQ ID NO: 34849 - protein, 19 aa, synthetic construct
  source 1..19: note = Seed: LQTVHSIPLTINKEEALQR
LQTVHSIPFTIWKAEALQR

SEQ ID NO: 34850 - protein, 19 aa, synthetic construct
  source 1..19: note = Seed: LQTVHSIPLTINKEEALQR
LQTVHSIPFTIWKAEAVQR

SEQ ID NO: 34851 - protein, 19 aa, synthetic construct
  source 1..19: note = Seed: LQTVHSIPLTINKEEALQR
LQTVHSIPFTIWKDEAIQR

SEQ ID NO: 34852 - protein, 19 aa, synthetic construct
  source 1..19: note = Seed: LQTVHSIPLTINKEEALQR
LQTVHSIPFTIWKDEALQR

SEQ ID NO: 34853 - protein, 19 aa, synthetic construct
  source 1..19: note = Seed: LQTVHSIPLTINKEEALQR
LQTVHSIPFTIWKDEAVQR

SEQ ID NO: 34854 - protein, 19 aa, synthetic construct
  source 1..19: note = Seed: LQTVHSIPLTINKEEALQR
LQTVHSIPFTIWKFEAAQR

SEQ ID NO: 34855 - protein, 19 aa, synthetic construct
  source 1..19: note = Seed: LQTVHSIPLTINKEEALQR
LQTVHSIPFTIWKFEADQR

SEQ ID NO: 34856 - protein, 19 aa, synthetic construct
  source 1..19: note = Seed: LQTVHSIPLTINKEEALQR
LQTVHSIPFTIWKFEAEQR

SEQ ID NO: 34857 - protein, 19 aa, synthetic construct
  source 1..19: note = Seed: LQTVHSIPLTINKEEALQR
LQTVHSIPFTIWKFEAFQR

SEQ ID NO: 34858 - protein, 19 aa, synthetic construct
  source 1..19: note = Seed: LQTVHSIPLTINKEEALQR
LQTVHSIPFTIWKFEAHQR

SEQ ID NO: 34859 - protein, 19 aa, synthetic construct
  source 1..19: note = Seed: LQTVHSIPLTINKEEALQR
LQTVHSIPFTIWKFEAIQR

SEQ ID NO: 34860 - protein, 19 aa, synthetic construct
  source 1..19: note = Seed: LQTVHSIPLTINKEEALQR
LQTVHSIPFTIWKFEALQR

SEQ ID NO: 34861 - protein, 19 aa, synthetic construct
  source 1..19: note = Seed: LQTVHSIPLTINKEEALQR
LQTVHSIPFTIWKFEAMQR

SEQ ID NO: 34862 - protein, 19 aa, synthetic construct
  source 1..19: note = Seed: LQTVHSIPLTINKEEALQR
LQTVHSIPFTIWKFEANQR

SEQ ID NO: 34863 - protein, 19 aa, synthetic construct
  source 1..19: note = Seed: LQTVHSIPLTINKEEALQR
LQTVHSIPFTIWKFEARQR

SEQ ID NO: 34864 - protein, 19 aa, synthetic construct
  source 1..19: note = Seed: LQTVHSIPLTINKEEALQR
LQTVHSIPFTIWKFEASQR

SEQ ID NO: 34865 - protein, 19 aa, synthetic construct
  source 1..19: note = Seed: LQTVHSIPLTINKEEALQR
LQTVHSIPFTIWKFEATQR

SEQ ID NO: 34866 - protein, 19 aa, synthetic construct
  source 1..19: note = Seed: LQTVHSIPLTINKEEALQR
LQTVHSIPFTIWKFEAVQR

SEQ ID NO: 34867 - protein, 19 aa, synthetic construct
  source 1..19: note = Seed: LQTVHSIPLTINKEEALQR
LQTVHSIPFTIWKFEAWQR

SEQ ID NO: 34868 - protein, 19 aa, synthetic construct
  source 1..19: note = Seed: LQTVHSIPLTINKEEALQR
LQTVHSIPFTIWKFEAYQR

SEQ ID NO: 34869 - protein, 19 aa, synthetic construct
  source 1..19: note = Seed: LQTVHSIPLTINKEEALQR
LQTVHSIPFTIWKIEAFQR

SEQ ID NO: 34870 - protein, 19 aa, synthetic construct
  source 1..19: note = Seed: LQTVHSIPLTINKEEALQR
LQTVHSIPFTIWKIEAIQR

SEQ ID NO: 34871 - protein, 19 aa, synthetic construct
  source 1..19: note = Seed: LQTVHSIPLTINKEEALQR
LQTVHSIPFTIWKIEALQR

SEQ ID NO: 34872 - protein, 19 aa, synthetic construct
  source 1..19: note = Seed: LQTVHSIPLTINKEEALQR
LQTVHSIPFTIWKIEAMQR

SEQ ID NO: 34873 - protein, 19 aa, synthetic construct
  source 1..19: note = Seed: LQTVHSIPLTINKEEALQR
LQTVHSIPFTIWKIEAVQR

SEQ ID NO: 34874 - protein, 19 aa, synthetic construct
  source 1..19: note = Seed: LQTVHSIPLTINKEEALQR
LQTVHSIPFTIWKIEAYQR

SEQ ID NO: 34875 - protein, 19 aa, synthetic construct
  source 1..19: note = Seed: LQTVHSIPLTINKEEALQR
LQTVHSIPFTIWKLEAFQR

SEQ ID NO: 34876 - protein, 19 aa, synthetic construct
  source 1..19: note = Seed: LQTVHSIPLTINKEEALQR
LQTVHSIPFTIWKLEAIQR

SEQ ID NO: 34877 - protein, 19 aa, synthetic construct
  source 1..19: note = Seed: LQTVHSIPLTINKEEALQR
LQTVHSIPFTIWKLEALQR

SEQ ID NO: 34878 - protein, 19 aa, synthetic construct
  source 1..19: note = Seed: LQTVHSIPLTINKEEALQR
LQTVHSIPFTIWKLEAMQR

SEQ ID NO: 34879 - protein, 19 aa, synthetic construct
  source 1..19: note = Seed: LQTVHSIPLTINKEEALQR
LQTVHSIPFTIWKLEAVQR

SEQ ID NO: 34880 - protein, 19 aa, synthetic construct
  source 1..19: note = Seed: LQTVHSIPLTINKEEALQR
LQTVHSIPFTIWKLEAYQR

SEQ ID NO: 34881 - protein, 19 aa, synthetic construct
  source 1..19: note = Seed: LQTVHSIPLTINKEEALQR
LQTVHSIPFTIWKMEAFQR

SEQ ID NO: 34882 - protein, 19 aa, synthetic construct
  source 1..19: note = Seed: LQTVHSIPLTINKEEALQR
LQTVHSIPFTIWKMEAIQR

SEQ ID NO: 34883 - protein, 19 aa, synthetic construct
  source 1..19: note = Seed: LQTVHSIPLTINKEEALQR
LQTVHSIPFTIWKMEALQR

SEQ ID NO: 34884 - protein, 19 aa, synthetic construct
  source 1..19: note = Seed: LQTVHSIPLTINKEEALQR
LQTVHSIPFTIWKMEAVQR

SEQ ID NO: 34885 - protein, 19 aa, synthetic construct
  source 1..19: note = Seed: LQTVHSIPLTINKEEALQR
LQTVHSIPFTIWKVEAFQR

SEQ ID NO: 34886 - protein, 19 aa, synthetic construct
  source 1..19: note = Seed: LQTVHSIPLTINKEEALQR
LQTVHSIPFTIWKVEAIQR

SEQ ID NO: 34887 - protein, 19 aa, synthetic construct
  source 1..19: note = Seed: LQTVHSIPLTINKEEALQR
LQTVHSIPFTIWKVEALQR

SEQ ID NO: 34888 - protein, 19 aa, synthetic construct
  source 1..19: note = Seed: LQTVHSIPLTINKEEALQR
LQTVHSIPFTIWKVEAVQR

SEQ ID NO: 34889 - protein, 19 aa, synthetic construct
  source 1..19: note = Seed: LQTVHSIPLTINKEEALQR
LQTVHSIPFTIWKWEAFQR

SEQ ID NO: 34890 - protein, 19 aa, synthetic construct
  source 1..19: note = Seed: LQTVHSIPLTINKEEALQR
LQTVHSIPFTIWKWEAIQR

SEQ ID NO: 34891 - protein, 19 aa, synthetic construct
  source 1..19: note = Seed: LQTVHSIPLTINKEEALQR
LQTVHSIPFTIWKWEALQR

SEQ ID NO: 34892 - protein, 19 aa, synthetic construct
  source 1..19: note = Seed: LQTVHSIPLTINKEEALQR
LQTVHSIPFTIWKWEAMQR

SEQ ID NO: 34893 - protein, 19 aa, synthetic construct
  source 1..19: note = Seed: LQTVHSIPLTINKEEALQR
LQTVHSIPFTIWKWEAVQR

SEQ ID NO: 34894 - protein, 19 aa, synthetic construct
  source 1..19: note = Seed: LQTVHSIPLTINKEEALQR
LQTVHSIPFTIWKYEAFQR

SEQ ID NO: 34895 - protein, 19 aa, synthetic construct
  source 1..19: note = Seed: LQTVHSIPLTINKEEALQR
LQTVHSIPFTIWKYEAIQR

SEQ ID NO: 34896 - protein, 19 aa, synthetic construct
  source 1..19: note = Seed: LQTVHSIPLTINKEEALQR
LQTVHSIPFTIWKYEALQR

SEQ ID NO: 34897 - protein, 19 aa, synthetic construct
  source 1..19: note = Seed: LQTVHSIPLTINKEEALQR
LQTVHSIPFTIWKYEAMQR

SEQ ID NO: 34898 - protein, 19 aa, synthetic construct
  source 1..19: note = Seed: LQTVHSIPLTINKEEALQR
LQTVHSIPFTIWKYEAVQR

SEQ ID NO: 34899 - protein, 19 aa, synthetic construct
  source 1..19: note = Seed: LQTVHSIPLTINKEEALQR
LQTVHSIPFTIWKYEAYQR

SEQ ID NO: 34900 - protein, 19 aa, synthetic construct
  source 1..19: note = Seed: LQTVHSIPLTINKEEALQR
LQTVHSIPFTIYKAEAAQR

SEQ ID NO: 34901 - protein, 19 aa, synthetic construct
  source 1..19: note = Seed: LQTVHSIPLTINKEEALQR
LQTVHSIPFTIYKAEAFQR

SEQ ID NO: 34902 - protein, 19 aa, synthetic construct
  source 1..19: note = Seed: LQTVHSIPLTINKEEALQR
LQTVHSIPFTIYKAEAIQR

SEQ ID NO: 34903 - protein, 19 aa, synthetic construct
  source 1..19: note = Seed: LQTVHSIPLTINKEEALQR
LQTVHSIPFTIYKAEALQR

SEQ ID NO: 34904 - protein, 19 aa, synthetic construct
  source 1..19: note = Seed: LQTVHSIPLTINKEEALQR
LQTVHSIPFTIYKAEAMQR

SEQ ID NO: 34905 - protein, 19 aa, synthetic construct
  source 1..19: note = Seed: LQTVHSIPLTINKEEALQR
LQTVHSIPFTIYKAEAVQR

SEQ ID NO: 34906 - protein, 19 aa, synthetic construct
  source 1..19: note = Seed: LQTVHSIPLTINKEEALQR
LQTVHSIPFTIYKDEAAQR

SEQ ID NO: 34907 - protein, 19 aa, synthetic construct
  source 1..19: note = Seed: LQTVHSIPLTINKEEALQR
LQTVHSIPFTIYKDEAFQR

SEQ ID NO: 34908 - protein, 19 aa, synthetic construct
  source 1..19: note = Seed: LQTVHSIPLTINKEEALQR
LQTVHSIPFTIYKDEAIQR

SEQ ID NO: 34909 - protein, 19 aa, synthetic construct
  source 1..19: note = Seed: LQTVHSIPLTINKEEALQR
LQTVHSIPFTIYKDEALQR

SEQ ID NO: 34910 - protein, 19 aa, synthetic construct
  source 1..19: note = Seed: LQTVHSIPLTINKEEALQR
LQTVHSIPFTIYKDEAVQR

SEQ ID NO: 34911 - protein, 19 aa, synthetic construct
  source 1..19: note = Seed: LQTVHSIPLTINKEEALQR
LQTVHSIPFTIYKFEAAQR

SEQ ID NO: 34912 - protein, 19 aa, synthetic construct
  source 1..19: note = Seed: LQTVHSIPLTINKEEALQR
LQTVHSIPFTIYKFEACQR

SEQ ID NO: 34913 - protein, 19 aa, synthetic construct
  source 1..19: note = Seed: LQTVHSIPLTINKEEALQR
LQTVHSIPFTIYKFEADQR

SEQ ID NO: 34914 - protein, 19 aa, synthetic construct
  source 1..19: note = Seed: LQTVHSIPLTINKEEALQR
LQTVHSIPFTIYKFEAEQR

SEQ ID NO: 34915 - protein, 19 aa, synthetic construct
  source 1..19: note = Seed: LQTVHSIPLTINKEEALQR
LQTVHSIPFTIYKFEAFQR

SEQ ID NO: 34916 - protein, 19 aa, synthetic construct
  source 1..19: note = Seed: LQTVHSIPLTINKEEALQR
LQTVHSIPFTIYKFEAGQR

SEQ ID NO: 34917 - protein, 19 aa, synthetic construct
  source 1..19: note = Seed: LQTVHSIPLTINKEEALQR
LQTVHSIPFTIYKFEAHQR

SEQ ID NO: 34918 - protein, 19 aa, synthetic construct
  source 1..19: note = Seed: LQTVHSIPLTINKEEALQR
LQTVHSIPFTIYKFEAIQR

SEQ ID NO: 34919 - protein, 19 aa, synthetic construct
  source 1..19: note = Seed: LQTVHSIPLTINKEEALQR
LQTVHSIPFTIYKFEAKQR

SEQ ID NO: 34920 - protein, 19 aa, synthetic construct
  source 1..19: note = Seed: LQTVHSIPLTINKEEALQR
LQTVHSIPFTIYKFEALQR

SEQ ID NO: 34921 - protein, 19 aa, synthetic construct
  source 1..19: note = Seed: LQTVHSIPLTINKEEALQR
LQTVHSIPFTIYKFEAMQR

SEQ ID NO: 34922 - protein, 19 aa, synthetic construct
  source 1..19: note = Seed: LQTVHSIPLTINKEEALQR
LQTVHSIPFTIYKFEANQR

SEQ ID NO: 34923 - protein, 19 aa, synthetic construct
  source 1..19: note = Seed: LQTVHSIPLTINKEEALQR
LQTVHSIPFTIYKFEAPQR

SEQ ID NO: 34924 - protein, 19 aa, synthetic construct
  source 1..19: note = Seed: LQTVHSIPLTINKEEALQR
LQTVHSIPFTIYKFEAQQR

SEQ ID NO: 34925 - protein, 19 aa, synthetic construct
  source 1..19: note = Seed: LQTVHSIPLTINKEEALQR
LQTVHSIPFTIYKFEARQR

SEQ ID NO: 34926 - protein, 19 aa, synthetic construct
  source 1..19: note = Seed: LQTVHSIPLTINKEEALQR
LQTVHSIPFTIYKFEASQR

SEQ ID NO: 34927 - protein, 19 aa, synthetic construct
  source 1..19: note = Seed: LQTVHSIPLTINKEEALQR
LQTVHSIPFTIYKFEATQR

SEQ ID NO: 34928 - protein, 19 aa, synthetic construct
  source 1..19: note = Seed: LQTVHSIPLTINKEEALQR
LQTVHSIPFTIYKFEAVQR

SEQ ID NO: 34929 - protein, 19 aa, synthetic construct
  source 1..19: note = Seed: LQTVHSIPLTINKEEALQR
LQTVHSIPFTIYKFEAYQR

SEQ ID NO: 34930 - protein, 19 aa, synthetic construct
  source 1..19: note = Seed: LQTVHSIPLTINKEEALQR
LQTVHSIPFTIYKIEAAQR

SEQ ID NO: 34931 - protein, 19 aa, synthetic construct
  source 1..19: note = Seed: LQTVHSIPLTINKEEALQR
LQTVHSIPFTIYKIEADQR

SEQ ID NO: 34932 - protein, 19 aa, synthetic construct
  source 1..19: note = Seed: LQTVHSIPLTINKEEALQR
LQTVHSIPFTIYKIEAEQR

SEQ ID NO: 34933 - protein, 19 aa, synthetic construct
  source 1..19: note = Seed: LQTVHSIPLTINKEEALQR
LQTVHSIPFTIYKIEAFQR

SEQ ID NO: 34934 - protein, 19 aa, synthetic construct
  source 1..19: note = Seed: LQTVHSIPLTINKEEALQR
LQTVHSIPFTIYKIEAHQR

SEQ ID NO: 34935 - protein, 19 aa, synthetic construct
  source 1..19: note = Seed: LQTVHSIPLTINKEEALQR
LQTVHSIPFTIYKIEAIQR

SEQ ID NO: 34936 - protein, 19 aa, synthetic construct
  source 1..19: note = Seed: LQTVHSIPLTINKEEALQR
LQTVHSIPFTIYKIEALQR

SEQ ID NO: 34937 - protein, 19 aa, synthetic construct
  source 1..19: note = Seed: LQTVHSIPLTINKEEALQR
LQTVHSIPFTIYKIEAMQR

SEQ ID NO: 34938 - protein, 19 aa, synthetic construct
  source 1..19: note = Seed: LQTVHSIPLTINKEEALQR
LQTVHSIPFTIYKIEANQR

SEQ ID NO: 34939 - protein, 19 aa, synthetic construct
  source 1..19: note = Seed: LQTVHSIPLTINKEEALQR
LQTVHSIPFTIYKIEARQR

SEQ ID NO: 34940 - protein, 19 aa, synthetic construct
  source 1..19: note = Seed: LQTVHSIPLTINKEEALQR
LQTVHSIPFTIYKIEASQR

SEQ ID NO: 34941 - protein, 19 aa, synthetic construct
  source 1..19: note = Seed: LQTVHSIPLTINKEEALQR
LQTVHSIPFTIYKIEATQR

SEQ ID NO: 34942 - protein, 19 aa, synthetic construct
  source 1..19: note = Seed: LQTVHSIPLTINKEEALQR
LQTVHSIPFTIYKIEAVQR

SEQ ID NO: 34943 - protein, 19 aa, synthetic construct
  source 1..19: note = Seed: LQTVHSIPLTINKEEALQR
LQTVHSIPFTIYKIEAYQR

SEQ ID NO: 34944 - protein, 19 aa, synthetic construct
  source 1..19: note = Seed: LQTVHSIPLTINKEEALQR
LQTVHSIPFTIYKLEAAQR

SEQ ID NO: 34945 - protein, 19 aa, synthetic construct
  source 1..19: note = Seed: LQTVHSIPLTINKEEALQR
LQTVHSIPFTIYKLEACQR

SEQ ID NO: 34946 - protein, 19 aa, synthetic construct
  source 1..19: note = Seed: LQTVHSIPLTINKEEALQR
LQTVHSIPFTIYKLEADQR

SEQ ID NO: 34947 - protein, 19 aa, synthetic construct
  source 1..19: note = Seed: LQTVHSIPLTINKEEALQR
LQTVHSIPFTIYKLEAEQR

SEQ ID NO: 34948 - protein, 19 aa, synthetic construct
  source 1..19: note = Seed: LQTVHSIPLTINKEEALQR
LQTVHSIPFTIYKLEAFQR

SEQ ID NO: 34949 - protein, 19 aa, synthetic construct
  source 1..19: note = Seed: LQTVHSIPLTINKEEALQR
LQTVHSIPFTIYKLEAHQR

SEQ ID NO: 34950 - protein, 19 aa, synthetic construct
  source 1..19: note = Seed: LQTVHSIPLTINKEEALQR
LQTVHSIPFTIYKLEAIQR

SEQ ID NO: 34951 - protein, 19 aa, synthetic construct
  source 1..19: note = Seed: LQTVHSIPLTINKEEALQR
LQTVHSIPFTIYKLEAKQR

SEQ ID NO: 34952 - protein, 19 aa, synthetic construct
  source 1..19: note = Seed: LQTVHSIPLTINKEEALQR
LQTVHSIPFTIYKLEALQR

SEQ ID NO: 34953 - protein, 19 aa, synthetic construct
  source 1..19: note = Seed: LQTVHSIPLTINKEEALQR
LQTVHSIPFTIYKLEAMQR

SEQ ID NO: 34954 - protein, 19 aa, synthetic construct
  source 1..19: note = Seed: LQTVHSIPLTINKEEALQR
LQTVHSIPFTIYKLEANQR

SEQ ID NO: 34955 - protein, 19 aa, synthetic construct
  source 1..19: note = Seed: LQTVHSIPLTINKEEALQR
LQTVHSIPFTIYKLEAQQR

SEQ ID NO: 34956 - protein, 19 aa, synthetic construct
  source 1..19: note = Seed: LQTVHSIPLTINKEEALQR
LQTVHSIPFTIYKLEARQR

SEQ ID NO: 34957 - protein, 19 aa, synthetic construct
  source 1..19: note = Seed: LQTVHSIPLTINKEEALQR
LQTVHSIPFTIYKLEASQR

SEQ ID NO: 34958 - protein, 19 aa, synthetic construct
  source 1..19: note = Seed: LQTVHSIPLTINKEEALQR
LQTVHSIPFTIYKLEATQR

SEQ ID NO: 34959 - protein, 19 aa, synthetic construct
  source 1..19: note = Seed: LQTVHSIPLTINKEEALQR
LQTVHSIPFTIYKLEAVQR

SEQ ID NO: 34960 - protein, 19 aa, synthetic construct
  source 1..19: note = Seed: LQTVHSIPLTINKEEALQR
LQTVHSIPFTIYKLEAYQR

SEQ ID NO: 34961 - protein, 19 aa, synthetic construct
  source 1..19: note = Seed: LQTVHSIPLTINKEEALQR
LQTVHSIPFTIYKMEAAQR

SEQ ID NO: 34962 - protein, 19 aa, synthetic construct
  source 1..19: note = Seed: LQTVHSIPLTINKEEALQR
LQTVHSIPFTIYKMEAFQR

SEQ ID NO: 34963 - protein, 19 aa, synthetic construct
  source 1..19: note = Seed: LQTVHSIPLTINKEEALQR
LQTVHSIPFTIYKMEAIQR

SEQ ID NO: 34964 - protein, 19 aa, synthetic construct
  source 1..19: note = Seed: LQTVHSIPLTINKEEALQR
LQTVHSIPFTIYKMEALQR

SEQ ID NO: 34965 - protein, 19 aa, synthetic construct
  source 1..19: note = Seed: LQTVHSIPLTINKEEALQR
LQTVHSIPFTIYKMEAMQR

SEQ ID NO: 34966 - protein, 19 aa, synthetic construct
  source 1..19: note = Seed: LQTVHSIPLTINKEEALQR
LQTVHSIPFTIYKMEATQR

SEQ ID NO: 34967 - protein, 19 aa, synthetic construct
  source 1..19: note = Seed: LQTVHSIPLTINKEEALQR
LQTVHSIPFTIYKMEAVQR

SEQ ID NO: 34968 - protein, 19 aa, synthetic construct
  source 1..19: note = Seed: LQTVHSIPLTINKEEALQR
LQTVHSIPFTIYKMEAYQR

SEQ ID NO: 34969 - protein, 19 aa, synthetic construct
  source 1..19: note = Seed: LQTVHSIPLTINKEEALQR
LQTVHSIPFTIYKSEALQR

SEQ ID NO: 34970 - protein, 19 aa, synthetic construct
  source 1..19: note = Seed: LQTVHSIPLTINKEEALQR
LQTVHSIPFTIYKTEALQR

SEQ ID NO: 34971 - protein, 19 aa, synthetic construct
  source 1..19: note = Seed: LQTVHSIPLTINKEEALQR
LQTVHSIPFTIYKVEAAQR

SEQ ID NO: 34972 - protein, 19 aa, synthetic construct
  source 1..19: note = Seed: LQTVHSIPLTINKEEALQR
LQTVHSIPFTIYKVEADQR

SEQ ID NO: 34973 - protein, 19 aa, synthetic construct
  source 1..19: note = Seed: LQTVHSIPLTINKEEALQR
LQTVHSIPFTIYKVEAFQR

SEQ ID NO: 34974 - protein, 19 aa, synthetic construct
  source 1..19: note = Seed: LQTVHSIPLTINKEEALQR
LQTVHSIPFTIYKVEAIQR

SEQ ID NO: 34975 - protein, 19 aa, synthetic construct
  source 1..19: note = Seed: LQTVHSIPLTINKEEALQR
LQTVHSIPFTIYKVEALQR

SEQ ID NO: 34976 - protein, 19 aa, synthetic construct
  source 1..19: note = Seed: LQTVHSIPLTINKEEALQR
LQTVHSIPFTIYKVEAMQR

SEQ ID NO: 34977 - protein, 19 aa, synthetic construct
  source 1..19: note = Seed: LQTVHSIPLTINKEEALQR
LQTVHSIPFTIYKVEAVQR

SEQ ID NO: 34978 - protein, 19 aa, synthetic construct
  source 1..19: note = Seed: LQTVHSIPLTINKEEALQR
LQTVHSIPFTIYKVEAYQR

SEQ ID NO: 34979 - protein, 19 aa, synthetic construct
  source 1..19: note = Seed: LQTVHSIPLTINKEEALQR
LQTVHSIPFTIYKWEAAQR

SEQ ID NO: 34980 - protein, 19 aa, synthetic construct
  source 1..19: note = Seed: LQTVHSIPLTINKEEALQR
LQTVHSIPFTIYKWEAIQR

SEQ ID NO: 34981 - protein, 19 aa, synthetic construct
  source 1..19: note = Seed: LQTVHSIPLTINKEEALQR
LQTVHSIPFTIYKWEALQR

SEQ ID NO: 34982 - protein, 19 aa, synthetic construct
  source 1..19: note = Seed: LQTVHSIPLTINKEEALQR
LQTVHSIPFTIYKWEAMQR

SEQ ID NO: 34983 - protein, 19 aa, synthetic construct
  source 1..19: note = Seed: LQTVHSIPLTINKEEALQR
LQTVHSIPFTIYKWEAVQR

SEQ ID NO: 34984 - protein, 19 aa, synthetic construct
  source 1..19: note = Seed: LQTVHSIPLTINKEEALQR
LQTVHSIPFTIYKWEAYQR

SEQ ID NO: 34985 - protein, 19 aa, synthetic construct
  source 1..19: note = Seed: LQTVHSIPLTINKEEALQR
LQTVHSIPFTIYKYEAAQR

SEQ ID NO: 34986 - protein, 19 aa, synthetic construct
  source 1..19: note = Seed: LQTVHSIPLTINKEEALQR
LQTVHSIPFTIYKYEADQR

SEQ ID NO: 34987 - protein, 19 aa, synthetic construct
  source 1..19: note = Seed: LQTVHSIPLTINKEEALQR
LQTVHSIPFTIYKYEAEQR

SEQ ID NO: 34988 - protein, 19 aa, synthetic construct
  source 1..19: note = Seed: LQTVHSIPLTINKEEALQR
LQTVHSIPFTIYKYEAFQR

SEQ ID NO: 34989 - protein, 19 aa, synthetic construct
  source 1..19: note = Seed: LQTVHSIPLTINKEEALQR
LQTVHSIPFTIYKYEAIQR

SEQ ID NO: 34990 - protein, 19 aa, synthetic construct
  source 1..19: note = Seed: LQTVHSIPLTINKEEALQR
LQTVHSIPFTIYKYEALQR

SEQ ID NO: 34991 - protein, 19 aa, synthetic construct
  source 1..19: note = Seed: LQTVHSIPLTINKEEALQR
LQTVHSIPFTIYKYEAMQR

SEQ ID NO: 34992 - protein, 19 aa, synthetic construct
  source 1..19: note = Seed: LQTVHSIPLTINKEEALQR
LQTVHSIPFTIYKYEANQR

SEQ ID NO: 34993 - protein, 19 aa, synthetic construct
  source 1..19: note = Seed: LQTVHSIPLTINKEEALQR
LQTVHSIPFTIYKYEAQQR

SEQ ID NO: 34994 - protein, 19 aa, synthetic construct
  source 1..19: note = Seed: LQTVHSIPLTINKEEALQR
LQTVHSIPFTIYKYEASQR

SEQ ID NO: 34995 - protein, 19 aa, synthetic construct
  source 1..19: note = Seed: LQTVHSIPLTINKEEALQR
LQTVHSIPFTIYKYEATQR

SEQ ID NO: 34996 - protein, 19 aa, synthetic construct
  source 1..19: note = Seed: LQTVHSIPLTINKEEALQR
LQTVHSIPFTIYKYEAVQR

SEQ ID NO: 34997 - protein, 19 aa, synthetic construct
  source 1..19: note = Seed: LQTVHSIPLTINKEEALQR
LQTVHSIPFTIYKYEAYQR

SEQ ID NO: 34998 - protein, 19 aa, synthetic construct
  source 1..19: note = Seed: LQTVHSIPLTINKEEALQR
LQTVHSIPITIAKAEAAQR

SEQ ID NO: 34999 - protein, 19 aa, synthetic construct
  source 1..19: note = Seed: LQTVHSIPLTINKEEALQR
LQTVHSIPITIAKAEAIQR

SEQ ID NO: 35000 - protein, 19 aa, synthetic construct
  source 1..19: note = Seed: LQTVHSIPLTINKEEALQR
LQTVHSIPITIAKAEALQR

SEQ ID NO: 35001 - protein, 19 aa, synthetic construct
  source 1..19: note = Seed: LQTVHSIPLTINKEEALQR
LQTVHSIPITIAKAEAMQR

SEQ ID NO: 35002 - protein, 19 aa, synthetic construct
  source 1..19: note = Seed: LQTVHSIPLTINKEEALQR
LQTVHSIPITIAKAEAVQR

SEQ ID NO: 35003 - protein, 19 aa, synthetic construct
  source 1..19: note = Seed: LQTVHSIPLTINKEEALQR
LQTVHSIPITIAKFEAAQR

SEQ ID NO: 35004 - protein, 19 aa, synthetic construct
  source 1..19: note = Seed: LQTVHSIPLTINKEEALQR
LQTVHSIPITIAKFEAFQR

SEQ ID NO: 35005 - protein, 19 aa, synthetic construct
  source 1..19: note = Seed: LQTVHSIPLTINKEEALQR
LQTVHSIPITIAKFEAIQR

SEQ ID NO: 35006 - protein, 19 aa, synthetic construct
  source 1..19: note = Seed: LQTVHSIPLTINKEEALQR
LQTVHSIPITIAKFEALQR

SEQ ID NO: 35007 - protein, 19 aa, synthetic construct
  source 1..19: note = Seed: LQTVHSIPLTINKEEALQR
LQTVHSIPITIAKFEAMQR

SEQ ID NO: 35008 - protein, 19 aa, synthetic construct
  source 1..19: note = Seed: LQTVHSIPLTINKEEALQR
LQTVHSIPITIAKFEATQR

SEQ ID NO: 35009 - protein, 19 aa, synthetic construct
  source 1..19: note = Seed: LQTVHSIPLTINKEEALQR
LQTVHSIPITIAKFEAVQR

SEQ ID NO: 35010 - protein, 19 aa, synthetic construct
  source 1..19: note = Seed: LQTVHSIPLTINKEEALQR
LQTVHSIPITIAKFEAYQR

SEQ ID NO: 35011 - protein, 19 aa, synthetic construct
  source 1..19: note = Seed: LQTVHSIPLTINKEEALQR
LQTVHSIPITIAKGEAAQR

SEQ ID NO: 35012 - protein, 19 aa, synthetic construct
  source 1..19: note = Seed: LQTVHSIPLTINKEEALQR
LQTVHSIPITIAKGEAIQR

SEQ ID NO: 35013 - protein, 19 aa, synthetic construct
  source 1..19: note = Seed: LQTVHSIPLTINKEEALQR
LQTVHSIPITIAKGEALQR

SEQ ID NO: 35014 - protein, 19 aa, synthetic construct
  source 1..19: note = Seed: LQTVHSIPLTINKEEALQR
LQTVHSIPITIAKGEAVQR

SEQ ID NO: 35015 - protein, 19 aa, synthetic construct
  source 1..19: note = Seed: LQTVHSIPLTINKEEALQR
LQTVHSIPITIAKIEAAQR

SEQ ID NO: 35016 - protein, 19 aa, synthetic construct
  source 1..19: note = Seed: LQTVHSIPLTINKEEALQR
LQTVHSIPITIAKIEAFQR

SEQ ID NO: 35017 - protein, 19 aa, synthetic construct
  source 1..19: note = Seed: LQTVHSIPLTINKEEALQR
LQTVHSIPITIAKIEAIQR

SEQ ID NO: 35018 - protein, 19 aa, synthetic construct
  source 1..19: note = Seed: LQTVHSIPLTINKEEALQR
LQTVHSIPITIAKIEALQR

SEQ ID NO: 35019 - protein, 19 aa, synthetic construct
  source 1..19: note = Seed: LQTVHSIPLTINKEEALQR
LQTVHSIPITIAKIEAVQR

SEQ ID NO: 35020 - protein, 19 aa, synthetic construct
  source 1..19: note = Seed: LQTVHSIPLTINKEEALQR
LQTVHSIPITIAKNEAIQR

SEQ ID NO: 35021 - protein, 19 aa, synthetic construct
  source 1..19: note = Seed: LQTVHSIPLTINKEEALQR
LQTVHSIPITIAKSEAAQR

SEQ ID NO: 35022 - protein, 19 aa, synthetic construct
  source 1..19: note = Seed: LQTVHSIPLTINKEEALQR
LQTVHSIPITIAKSEAIQR

SEQ ID NO: 35023 - protein, 19 aa, synthetic construct
  source 1..19: note = Seed: LQTVHSIPLTINKEEALQR
LQTVHSIPITIAKSEALQR

SEQ ID NO: 35024 - protein, 19 aa, synthetic construct
  source 1..19: note = Seed: LQTVHSIPLTINKEEALQR
LQTVHSIPITIAKSEAVQR

SEQ ID NO: 35025 - protein, 19 aa, synthetic construct
  source 1..19: note = Seed: LQTVHSIPLTINKEEALQR
LQTVHSIPITIAKVEAAQR

SEQ ID NO: 35026 - protein, 19 aa, synthetic construct
  source 1..19: note = Seed: LQTVHSIPLTINKEEALQR
LQTVHSIPITIAKVEAIQR

SEQ ID NO: 35027 - protein, 19 aa, synthetic construct
  source 1..19: note = Seed: LQTVHSIPLTINKEEALQR
LQTVHSIPITIAKVEAVQR

SEQ ID NO: 35028 - protein, 19 aa, synthetic construct
  source 1..19: note = Seed: LQTVHSIPLTINKEEALQR
LQTVHSIPITICKFEAIQR

SEQ ID NO: 35029 - protein, 19 aa, synthetic construct
  source 1..19: note = Seed: LQTVHSIPLTINKEEALQR
LQTVHSIPITICKFEALQR

SEQ ID NO: 35030 - protein, 19 aa, synthetic construct
  source 1..19: note = Seed: LQTVHSIPLTINKEEALQR
LQTVHSIPITICKFEAVQR

SEQ ID NO: 35031 - protein, 19 aa, synthetic construct
  source 1..19: note = Seed: LQTVHSIPLTINKEEALQR
LQTVHSIPITIDKFEAIQR

SEQ ID NO: 35032 - protein, 19 aa, synthetic construct
  source 1..19: note = Seed: LQTVHSIPLTINKEEALQR
LQTVHSIPITIDKFEALQR

SEQ ID NO: 35033 - protein, 19 aa, synthetic construct
  source 1..19: note = Seed: LQTVHSIPLTINKEEALQR
LQTVHSIPITIDKFEAVQR

SEQ ID NO: 35034 - protein, 19 aa, synthetic construct
  source 1..19: note = Seed: LQTVHSIPLTINKEEALQR
LQTVHSIPITIEKFEAFQR

SEQ ID NO: 35035 - protein, 19 aa, synthetic construct
  source 1..19: note = Seed: LQTVHSIPLTINKEEALQR
LQTVHSIPITIEKFEAIQR

SEQ ID NO: 35036 - protein, 19 aa, synthetic construct
  source 1..19: note = Seed: LQTVHSIPLTINKEEALQR
LQTVHSIPITIEKFEALQR

SEQ ID NO: 35037 - protein, 19 aa, synthetic construct
  source 1..19: note = Seed: LQTVHSIPLTINKEEALQR
LQTVHSIPITIEKFEAMQR

SEQ ID NO: 35038 - protein, 19 aa, synthetic construct
  source 1..19: note = Seed: LQTVHSIPLTINKEEALQR
LQTVHSIPITIEKFEATQR

SEQ ID NO: 35039 - protein, 19 aa, synthetic construct
  source 1..19: note = Seed: LQTVHSIPLTINKEEALQR
LQTVHSIPITIEKFEAVQR

SEQ ID NO: 35040 - protein, 19 aa, synthetic construct
  source 1..19: note = Seed: LQTVHSIPLTINKEEALQR
LQTVHSIPITIEKFEAYQR

SEQ ID NO: 35041 - protein, 19 aa, synthetic construct
  source 1..19: note = Seed: LQTVHSIPLTINKEEALQR
LQTVHSIPITIFKAEAAQR

SEQ ID NO: 35042 - protein, 19 aa, synthetic construct
  source 1..19: note = Seed: LQTVHSIPLTINKEEALQR
LQTVHSIPITIFKAEAFQR

SEQ ID NO: 35043 - protein, 19 aa, synthetic construct
  source 1..19: note = Seed: LQTVHSIPLTINKEEALQR
LQTVHSIPITIFKAEAIQR

SEQ ID NO: 35044 - protein, 19 aa, synthetic construct
  source 1..19: note = Seed: LQTVHSIPLTINKEEALQR
LQTVHSIPITIFKAEALQR

SEQ ID NO: 35045 - protein, 19 aa, synthetic construct
  source 1..19: note = Seed: LQTVHSIPLTINKEEALQR
LQTVHSIPITIFKAEAMQR

SEQ ID NO: 35046 - protein, 19 aa, synthetic construct
  source 1..19: note = Seed: LQTVHSIPLTINKEEALQR
LQTVHSIPITIFKAEASQR

SEQ ID NO: 35047 - protein, 19 aa, synthetic construct
  source 1..19: note = Seed: LQTVHSIPLTINKEEALQR
LQTVHSIPITIFKAEATQR

SEQ ID NO: 35048 - protein, 19 aa, synthetic construct
  source 1..19: note = Seed: LQTVHSIPLTINKEEALQR
LQTVHSIPITIFKAEAVQR

SEQ ID NO: 35049 - protein, 19 aa, synthetic construct
  source 1..19: note = Seed: LQTVHSIPLTINKEEALQR
LQTVHSIPITIFKAEAYQR

SEQ ID NO: 35050 - protein, 19 aa, synthetic construct
  source 1..19: note = Seed: LQTVHSIPLTINKEEALQR
LQTVHSIPITIFKDEAAQR

SEQ ID NO: 35051 - protein, 19 aa, synthetic construct
  source 1..19: note = Seed: LQTVHSIPLTINKEEALQR
LQTVHSIPITIFKDEAFQR

SEQ ID NO: 35052 - protein, 19 aa, synthetic construct
  source 1..19: note = Seed: LQTVHSIPLTINKEEALQR
LQTVHSIPITIFKDEAGQR

SEQ ID NO: 35053 - protein, 19 aa, synthetic construct
  source 1..19: note = Seed: LQTVHSIPLTINKEEALQR
LQTVHSIPITIFKDEAIQR

SEQ ID NO: 35054 - protein, 19 aa, synthetic construct
  source 1..19: note = Seed: LQTVHSIPLTINKEEALQR
LQTVHSIPITIFKDEALQR

SEQ ID NO: 35055 - protein, 19 aa, synthetic construct
  source 1..19: note = Seed: LQTVHSIPLTINKEEALQR
LQTVHSIPITIFKDEAMQR

SEQ ID NO: 35056 - protein, 19 aa, synthetic construct
  source 1..19: note = Seed: LQTVHSIPLTINKEEALQR
LQTVHSIPITIFKDEASQR

SEQ ID NO: 35057 - protein, 19 aa, synthetic construct
  source 1..19: note = Seed: LQTVHSIPLTINKEEALQR
LQTVHSIPITIFKDEATQR

SEQ ID NO: 35058 - protein, 19 aa, synthetic construct
  source 1..19: note = Seed: LQTVHSIPLTINKEEALQR
LQTVHSIPITIFKDEAVQR

SEQ ID NO: 35059 - protein, 19 aa, synthetic construct
  source 1..19: note = Seed: LQTVHSIPLTINKEEALQR
LQTVHSIPITIFKDEAYQR

SEQ ID NO: 35060 - protein, 19 aa, synthetic construct
  source 1..19: note = Seed: LQTVHSIPLTINKEEALQR
LQTVHSIPITIFKFEAAQR

SEQ ID NO: 35061 - protein, 19 aa, synthetic construct
  source 1..19: note = Seed: LQTVHSIPLTINKEEALQR
LQTVHSIPITIFKFEADQR

SEQ ID NO: 35062 - protein, 19 aa, synthetic construct
  source 1..19: note = Seed: LQTVHSIPLTINKEEALQR
LQTVHSIPITIFKFEAEQR

SEQ ID NO: 35063 - protein, 19 aa, synthetic construct
  source 1..19: note = Seed: LQTVHSIPLTINKEEALQR
LQTVHSIPITIFKFEAFQR

SEQ ID NO: 35064 - protein, 19 aa, synthetic construct
  source 1..19: note = Seed: LQTVHSIPLTINKEEALQR
LQTVHSIPITIFKFEAHQR

SEQ ID NO: 35065 - protein, 19 aa, synthetic construct
  source 1..19: note = Seed: LQTVHSIPLTINKEEALQR
LQTVHSIPITIFKFEAIQR

SEQ ID NO: 35066 - protein, 19 aa, synthetic construct
  source 1..19: note = Seed: LQTVHSIPLTINKEEALQR
LQTVHSIPITIFKFEALQR

SEQ ID NO: 35067 - protein, 19 aa, synthetic construct
  source 1..19: note = Seed: LQTVHSIPLTINKEEALQR
LQTVHSIPITIFKFEAMQR

SEQ ID NO: 35068 - protein, 19 aa, synthetic construct
  source 1..19: note = Seed: LQTVHSIPLTINKEEALQR
LQTVHSIPITIFKFEANQR

SEQ ID NO: 35069 - protein, 19 aa, synthetic construct
  source 1..19: note = Seed: LQTVHSIPLTINKEEALQR
LQTVHSIPITIFKFEARQR

SEQ ID NO: 35070 - protein, 19 aa, synthetic construct
  source 1..19: note = Seed: LQTVHSIPLTINKEEALQR
LQTVHSIPITIFKFEASQR

SEQ ID NO: 35071 - protein, 19 aa, synthetic construct
  source 1..19: note = Seed: LQTVHSIPLTINKEEALQR
LQTVHSIPITIFKFEATQR

SEQ ID NO: 35072 - protein, 19 aa, synthetic construct
  source 1..19: note = Seed: LQTVHSIPLTINKEEALQR
LQTVHSIPITIFKFEAVQR

SEQ ID NO: 35073 - protein, 19 aa, synthetic construct
  source 1..19: note = Seed: LQTVHSIPLTINKEEALQR
LQTVHSIPITIFKFEAYQR

SEQ ID NO: 35074 - protein, 19 aa, synthetic construct
  source 1..19: note = Seed: LQTVHSIPLTINKEEALQR
LQTVHSIPITIFKGEAVQR

SEQ ID NO: 35075 - protein, 19 aa, synthetic construct
  source 1..19: note = Seed: LQTVHSIPLTINKEEALQR
LQTVHSIPITIFKIEAAQR

SEQ ID NO: 35076 - protein, 19 aa, synthetic construct
  source 1..19: note = Seed: LQTVHSIPLTINKEEALQR
LQTVHSIPITIFKIEAFQR

SEQ ID NO: 35077 - protein, 19 aa, synthetic construct
  source 1..19: note = Seed: LQTVHSIPLTINKEEALQR
LQTVHSIPITIFKIEAGQR

SEQ ID NO: 35078 - protein, 19 aa, synthetic construct
  source 1..19: note = Seed: LQTVHSIPLTINKEEALQR
LQTVHSIPITIFKIEAIQR

SEQ ID NO: 35079 - protein, 19 aa, synthetic construct
  source 1..19: note = Seed: LQTVHSIPLTINKEEALQR
LQTVHSIPITIFKIEALQR

SEQ ID NO: 35080 - protein, 19 aa, synthetic construct
  source 1..19: note = Seed: LQTVHSIPLTINKEEALQR
LQTVHSIPITIFKIEAMQR

SEQ ID NO: 35081 - protein, 19 aa, synthetic construct
  source 1..19: note = Seed: LQTVHSIPLTINKEEALQR
LQTVHSIPITIFKIEAQQR

SEQ ID NO: 35082 - protein, 19 aa, synthetic construct
  source 1..19: note = Seed: LQTVHSIPLTINKEEALQR
LQTVHSIPITIFKIEASQR

SEQ ID NO: 35083 - protein, 19 aa, synthetic construct
  source 1..19: note = Seed: LQTVHSIPLTINKEEALQR
LQTVHSIPITIFKIEATQR

SEQ ID NO: 35084 - protein, 19 aa, synthetic construct
  source 1..19: note = Seed: LQTVHSIPLTINKEEALQR
LQTVHSIPITIFKIEAVQR

SEQ ID NO: 35085 - protein, 19 aa, synthetic construct
  source 1..19: note = Seed: LQTVHSIPLTINKEEALQR
LQTVHSIPITIFKIEAYQR

SEQ ID NO: 35086 - protein, 19 aa, synthetic construct
  source 1..19: note = Seed: LQTVHSIPLTINKEEALQR
LQTVHSIPITIFKLEAAQR

SEQ ID NO: 35087 - protein, 19 aa, synthetic construct
  source 1..19: note = Seed: LQTVHSIPLTINKEEALQR
LQTVHSIPITIFKLEAFQR

SEQ ID NO: 35088 - protein, 19 aa, synthetic construct
  source 1..19: note = Seed: LQTVHSIPLTINKEEALQR
LQTVHSIPITIFKLEAIQR

SEQ ID NO: 35089 - protein, 19 aa, synthetic construct
  source 1..19: note = Seed: LQTVHSIPLTINKEEALQR
LQTVHSIPITIFKLEALQR

SEQ ID NO: 35090 - protein, 19 aa, synthetic construct
  source 1..19: note = Seed: LQTVHSIPLTINKEEALQR
LQTVHSIPITIFKLEAMQR

SEQ ID NO: 35091 - protein, 19 aa, synthetic construct
  source 1..19: note = Seed: LQTVHSIPLTINKEEALQR
LQTVHSIPITIFKLEARQR

SEQ ID NO: 35092 - protein, 19 aa, synthetic construct
  source 1..19: note = Seed: LQTVHSIPLTINKEEALQR
LQTVHSIPITIFKLEASQR

SEQ ID NO: 35093 - protein, 19 aa, synthetic construct
  source 1..19: note = Seed: LQTVHSIPLTINKEEALQR
LQTVHSIPITIFKLEAVQR

SEQ ID NO: 35094 - protein, 19 aa, synthetic construct
  source 1..19: note = Seed: LQTVHSIPLTINKEEALQR
LQTVHSIPITIFKLEAYQR

SEQ ID NO: 35095 - protein, 19 aa, synthetic construct
  source 1..19: note = Seed: LQTVHSIPLTINKEEALQR
LQTVHSIPITIFKMEAAQR

SEQ ID NO: 35096 - protein, 19 aa, synthetic construct
  source 1..19: note = Seed: LQTVHSIPLTINKEEALQR
LQTVHSIPITIFKMEAFQR

SEQ ID NO: 35097 - protein, 19 aa, synthetic construct
  source 1..19: note = Seed: LQTVHSIPLTINKEEALQR
LQTVHSIPITIFKMEAIQR

SEQ ID NO: 35098 - protein, 19 aa, synthetic construct
  source 1..19: note = Seed: LQTVHSIPLTINKEEALQR
LQTVHSIPITIFKMEALQR

SEQ ID NO: 35099 - protein, 19 aa, synthetic construct
  source 1..19: note = Seed: LQTVHSIPLTINKEEALQR
LQTVHSIPITIFKMEAMQR

SEQ ID NO: 35100 - protein, 19 aa, synthetic construct
  source 1..19: note = Seed: LQTVHSIPLTINKEEALQR
LQTVHSIPITIFKMEASQR

SEQ ID NO: 35101 - protein, 19 aa, synthetic construct
  source 1..19: note = Seed: LQTVHSIPLTINKEEALQR
LQTVHSIPITIFKMEAVQR

SEQ ID NO: 35102 - protein, 19 aa, synthetic construct
  source 1..19: note = Seed: LQTVHSIPLTINKEEALQR
LQTVHSIPITIFKNEAAQR

SEQ ID NO: 35103 - protein, 19 aa, synthetic construct
  source 1..19: note = Seed: LQTVHSIPLTINKEEALQR
LQTVHSIPITIFKNEAFQR

SEQ ID NO: 35104 - protein, 19 aa, synthetic construct
  source 1..19: note = Seed: LQTVHSIPLTINKEEALQR
LQTVHSIPITIFKNEAIQR

SEQ ID NO: 35105 - protein, 19 aa, synthetic construct
  source 1..19: note = Seed: LQTVHSIPLTINKEEALQR
LQTVHSIPITIFKNEALQR

SEQ ID NO: 35106 - protein, 19 aa, synthetic construct
  source 1..19: note = Seed: LQTVHSIPLTINKEEALQR
LQTVHSIPITIFKNEAMQR

SEQ ID NO: 35107 - protein, 19 aa, synthetic construct
  source 1..19: note = Seed: LQTVHSIPLTINKEEALQR
LQTVHSIPITIFKNEASQR

SEQ ID NO: 35108 - protein, 19 aa, synthetic construct
  source 1..19: note = Seed: LQTVHSIPLTINKEEALQR
LQTVHSIPITIFKNEAVQR

SEQ ID NO: 35109 - protein, 19 aa, synthetic construct
  source 1..19: note = Seed: LQTVHSIPLTINKEEALQR
LQTVHSIPITIFKPEAAQR

SEQ ID NO: 35110 - protein, 19 aa, synthetic construct
  source 1..19: note = Seed: LQTVHSIPLTINKEEALQR
LQTVHSIPITIFKPEAIQR

SEQ ID NO: 35111 - protein, 19 aa, synthetic construct
  source 1..19: note = Seed: LQTVHSIPLTINKEEALQR
LQTVHSIPITIFKPEAVQR

SEQ ID NO: 35112 - protein, 19 aa, synthetic construct
  source 1..19: note = Seed: LQTVHSIPLTINKEEALQR
LQTVHSIPITIFKSEAAQR

SEQ ID NO: 35113 - protein, 19 aa, synthetic construct
  source 1..19: note = Seed: LQTVHSIPLTINKEEALQR
LQTVHSIPITIFKSEAIQR

SEQ ID NO: 35114 - protein, 19 aa, synthetic construct
  source 1..19: note = Seed: LQTVHSIPLTINKEEALQR
LQTVHSIPITIFKSEALQR

SEQ ID NO: 35115 - protein, 19 aa, synthetic construct
  source 1..19: note = Seed: LQTVHSIPLTINKEEALQR
LQTVHSIPITIFKSEAMQR

SEQ ID NO: 35116 - protein, 19 aa, synthetic construct
  source 1..19: note = Seed: LQTVHSIPLTINKEEALQR
LQTVHSIPITIFKSEAVQR

SEQ ID NO: 35117 - protein, 19 aa, synthetic construct
  source 1..19: note = Seed: LQTVHSIPLTINKEEALQR
LQTVHSIPITIFKTEAAQR

SEQ ID NO: 35118 - protein, 19 aa, synthetic construct
  source 1..19: note = Seed: LQTVHSIPLTINKEEALQR
LQTVHSIPITIFKTEAIQR

SEQ ID NO: 35119 - protein, 19 aa, synthetic construct
  source 1..19: note = Seed: LQTVHSIPLTINKEEALQR
LQTVHSIPITIFKTEALQR

SEQ ID NO: 35120 - protein, 19 aa, synthetic construct
  source 1..19: note = Seed: LQTVHSIPLTINKEEALQR
LQTVHSIPITIFKTEAMQR

SEQ ID NO: 35121 - protein, 19 aa, synthetic construct
  source 1..19: note = Seed: LQTVHSIPLTINKEEALQR
LQTVHSIPITIFKTEAVQR

SEQ ID NO: 35122 - protein, 19 aa, synthetic construct
  source 1..19: note = Seed: LQTVHSIPLTINKEEALQR
LQTVHSIPITIFKVEAAQR

SEQ ID NO: 35123 - protein, 19 aa, synthetic construct
  source 1..19: note = Seed: LQTVHSIPLTINKEEALQR
LQTVHSIPITIFKVEAFQR

SEQ ID NO: 35124 - protein, 19 aa, synthetic construct
  source 1..19: note = Seed: LQTVHSIPLTINKEEALQR
LQTVHSIPITIFKVEAGQR

SEQ ID NO: 35125 - protein, 19 aa, synthetic construct
  source 1..19: note = Seed: LQTVHSIPLTINKEEALQR
LQTVHSIPITIFKVEAIQR

SEQ ID NO: 35126 - protein, 19 aa, synthetic construct
  source 1..19: note = Seed: LQTVHSIPLTINKEEALQR
LQTVHSIPITIFKVEALQR

SEQ ID NO: 35127 - protein, 19 aa, synthetic construct
  source 1..19: note = Seed: LQTVHSIPLTINKEEALQR
LQTVHSIPITIFKVEAMQR

SEQ ID NO: 35128 - protein, 19 aa, synthetic construct
  source 1..19: note = Seed: LQTVHSIPLTINKEEALQR
LQTVHSIPITIFKVEASQR

SEQ ID NO: 35129 - protein, 19 aa, synthetic construct
  source 1..19: note = Seed: LQTVHSIPLTINKEEALQR
LQTVHSIPITIFKVEATQR

SEQ ID NO: 35130 - protein, 19 aa, synthetic construct
  source 1..19: note = Seed: LQTVHSIPLTINKEEALQR
LQTVHSIPITIFKVEAVQR

SEQ ID NO: 35131 - protein, 19 aa, synthetic construct
  source 1..19: note = Seed: LQTVHSIPLTINKEEALQR
LQTVHSIPITIFKVEAYQR

SEQ ID NO: 35132 - protein, 19 aa, synthetic construct
  source 1..19: note = Seed: LQTVHSIPLTINKEEALQR
LQTVHSIPITIFKWEALQR

SEQ ID NO: 35133 - protein, 19 aa, synthetic construct
  source 1..19: note = Seed: LQTVHSIPLTINKEEALQR
LQTVHSIPITIFKYEAFQR

SEQ ID NO: 35134 - protein, 19 aa, synthetic construct
  source 1..19: note = Seed: LQTVHSIPLTINKEEALQR
LQTVHSIPITIFKYEAIQR

SEQ ID NO: 35135 - protein, 19 aa, synthetic construct
  source 1..19: note = Seed: LQTVHSIPLTINKEEALQR
LQTVHSIPITIFKYEALQR

SEQ ID NO: 35136 - protein, 19 aa, synthetic construct
  source 1..19: note = Seed: LQTVHSIPLTINKEEALQR
LQTVHSIPITIFKYEAMQR

SEQ ID NO: 35137 - protein, 19 aa, synthetic construct
  source 1..19: note = Seed: LQTVHSIPLTINKEEALQR
LQTVHSIPITIFKYEAVQR

SEQ ID NO: 35138 - protein, 19 aa, synthetic construct
  source 1..19: note = Seed: LQTVHSIPLTINKEEALQR
LQTVHSIPITIHKFEAFQR

SEQ ID NO: 35139 - protein, 19 aa, synthetic construct
  source 1..19: note = Seed: LQTVHSIPLTINKEEALQR
LQTVHSIPITIHKFEAIQR

SEQ ID NO: 35140 - protein, 19 aa, synthetic construct
  source 1..19: note = Seed: LQTVHSIPLTINKEEALQR
LQTVHSIPITIHKFEALQR

SEQ ID NO: 35141 - protein, 19 aa, synthetic construct
  source 1..19: note = Seed: LQTVHSIPLTINKEEALQR
LQTVHSIPITIHKFEAMQR

SEQ ID NO: 35142 - protein, 19 aa, synthetic construct
  source 1..19: note = Seed: LQTVHSIPLTINKEEALQR
LQTVHSIPITIHKFEAVQR

SEQ ID NO: 35143 - protein, 19 aa, synthetic construct
  source 1..19: note = Seed: LQTVHSIPLTINKEEALQR
LQTVHSIPITIIKAEAAQR

SEQ ID NO: 35144 - protein, 19 aa, synthetic construct
  source 1..19: note = Seed: LQTVHSIPLTINKEEALQR
LQTVHSIPITIIKAEAIQR

SEQ ID NO: 35145 - protein, 19 aa, synthetic construct
  source 1..19: note = Seed: LQTVHSIPLTINKEEALQR
LQTVHSIPITIIKAEALQR

SEQ ID NO: 35146 - protein, 19 aa, synthetic construct
  source 1..19: note = Seed: LQTVHSIPLTINKEEALQR
LQTVHSIPITIIKAEAMQR

SEQ ID NO: 35147 - protein, 19 aa, synthetic construct
  source 1..19: note = Seed: LQTVHSIPLTINKEEALQR
LQTVHSIPITIIKAEATQR

SEQ ID NO: 35148 - protein, 19 aa, synthetic construct
  source 1..19: note = Seed: LQTVHSIPLTINKEEALQR
LQTVHSIPITIIKAEAVQR

SEQ ID NO: 35149 - protein, 19 aa, synthetic construct
  source 1..19: note = Seed: LQTVHSIPLTINKEEALQR
LQTVHSIPITIIKDEAAQR

SEQ ID NO: 35150 - protein, 19 aa, synthetic construct
  source 1..19: note = Seed: LQTVHSIPLTINKEEALQR
LQTVHSIPITIIKDEAIQR

SEQ ID NO: 35151 - protein, 19 aa, synthetic construct
  source 1..19: note = Seed: LQTVHSIPLTINKEEALQR
LQTVHSIPITIIKDEALQR

SEQ ID NO: 35152 - protein, 19 aa, synthetic construct
  source 1..19: note = Seed: LQTVHSIPLTINKEEALQR
LQTVHSIPITIIKDEAVQR

SEQ ID NO: 35153 - protein, 19 aa, synthetic construct
  source 1..19: note = Seed: LQTVHSIPLTINKEEALQR
LQTVHSIPITIIKFEAAQR

SEQ ID NO: 35154 - protein, 19 aa, synthetic construct
  source 1..19: note = Seed: LQTVHSIPLTINKEEALQR
LQTVHSIPITIIKFEADQR

SEQ ID NO: 35155 - protein, 19 aa, synthetic construct
  source 1..19: note = Seed: LQTVHSIPLTINKEEALQR
LQTVHSIPITIIKFEAEQR

SEQ ID NO: 35156 - protein, 19 aa, synthetic construct
  source 1..19: note = Seed: LQTVHSIPLTINKEEALQR
LQTVHSIPITIIKFEAFQR

SEQ ID NO: 35157 - protein, 19 aa, synthetic construct
  source 1..19: note = Seed: LQTVHSIPLTINKEEALQR
LQTVHSIPITIIKFEAHQR

SEQ ID NO: 35158 - protein, 19 aa, synthetic construct
  source 1..19: note = Seed: LQTVHSIPLTINKEEALQR
LQTVHSIPITIIKFEAIQR

SEQ ID NO: 35159 - protein, 19 aa, synthetic construct
  source 1..19: note = Seed: LQTVHSIPLTINKEEALQR
LQTVHSIPITIIKFEALQR

SEQ ID NO: 35160 - protein, 19 aa, synthetic construct
  source 1..19: note = Seed: LQTVHSIPLTINKEEALQR
LQTVHSIPITIIKFEAMQR

SEQ ID NO: 35161 - protein, 19 aa, synthetic construct
  source 1..19: note = Seed: LQTVHSIPLTINKEEALQR
LQTVHSIPITIIKFEANQR

SEQ ID NO: 35162 - protein, 19 aa, synthetic construct
  source 1..19: note = Seed: LQTVHSIPLTINKEEALQR
LQTVHSIPITIIKFEASQR

SEQ ID NO: 35163 - protein, 19 aa, synthetic construct
  source 1..19: note = Seed: LQTVHSIPLTINKEEALQR
LQTVHSIPITIIKFEATQR

SEQ ID NO: 35164 - protein, 19 aa, synthetic construct
  source 1..19: note = Seed: LQTVHSIPLTINKEEALQR
LQTVHSIPITIIKFEAVQR

SEQ ID NO: 35165 - protein, 19 aa, synthetic construct
  source 1..19: note = Seed: LQTVHSIPLTINKEEALQR
LQTVHSIPITIIKFEAYQR

SEQ ID NO: 35166 - protein, 19 aa, synthetic construct
  source 1..19: note = Seed: LQTVHSIPLTINKEEALQR
LQTVHSIPITIIKGEAAQR

SEQ ID NO: 35167 - protein, 19 aa, synthetic construct
  source 1..19: note = Seed: LQTVHSIPLTINKEEALQR
LQTVHSIPITIIKGEAIQR

SEQ ID NO: 35168 - protein, 19 aa, synthetic construct
  source 1..19: note = Seed: LQTVHSIPLTINKEEALQR
LQTVHSIPITIIKGEALQR

SEQ ID NO: 35169 - protein, 19 aa, synthetic construct
  source 1..19: note = Seed: LQTVHSIPLTINKEEALQR
LQTVHSIPITIIKGEAVQR

SEQ ID NO: 35170 - protein, 19 aa, synthetic construct
  source 1..19: note = Seed: LQTVHSIPLTINKEEALQR
LQTVHSIPITIIKIEAAQR

SEQ ID NO: 35171 - protein, 19 aa, synthetic construct
  source 1..19: note = Seed: LQTVHSIPLTINKEEALQR
LQTVHSIPITIIKIEAFQR

SEQ ID NO: 35172 - protein, 19 aa, synthetic construct
  source 1..19: note = Seed: LQTVHSIPLTINKEEALQR
LQTVHSIPITIIKIEAIQR

SEQ ID NO: 35173 - protein, 19 aa, synthetic construct
  source 1..19: note = Seed: LQTVHSIPLTINKEEALQR
LQTVHSIPITIIKIEALQR

SEQ ID NO: 35174 - protein, 19 aa, synthetic construct
  source 1..19: note = Seed: LQTVHSIPLTINKEEALQR
LQTVHSIPITIIKIEAMQR

SEQ ID NO: 35175 - protein, 19 aa, synthetic construct
  source 1..19: note = Seed: LQTVHSIPLTINKEEALQR
LQTVHSIPITIIKIEASQR

SEQ ID NO: 35176 - protein, 19 aa, synthetic construct
  source 1..19: note = Seed: LQTVHSIPLTINKEEALQR
LQTVHSIPITIIKIEAVQR

SEQ ID NO: 35177 - protein, 19 aa, synthetic construct
  source 1..19: note = Seed: LQTVHSIPLTINKEEALQR
LQTVHSIPITIIKIEAYQR

SEQ ID NO: 35178 - protein, 19 aa, synthetic construct
  source 1..19: note = Seed: LQTVHSIPLTINKEEALQR
LQTVHSIPITIIKLEAAQR

SEQ ID NO: 35179 - protein, 19 aa, synthetic construct
  source 1..19: note = Seed: LQTVHSIPLTINKEEALQR
LQTVHSIPITIIKLEAIQR

SEQ ID NO: 35180 - protein, 19 aa, synthetic construct
  source 1..19: note = Seed: LQTVHSIPLTINKEEALQR
LQTVHSIPITIIKLEALQR

SEQ ID NO: 35181 - protein, 19 aa, synthetic construct
  source 1..19: note = Seed: LQTVHSIPLTINKEEALQR
LQTVHSIPITIIKLEAVQR

SEQ ID NO: 35182 - protein, 19 aa, synthetic construct
  source 1..19: note = Seed: LQTVHSIPLTINKEEALQR
LQTVHSIPITIIKMEAAQR

SEQ ID NO: 35183 - protein, 19 aa, synthetic construct
  source 1..19: note = Seed: LQTVHSIPLTINKEEALQR
LQTVHSIPITIIKNEAAQR

SEQ ID NO: 35184 - protein, 19 aa, synthetic construct
  source 1..19: note = Seed: LQTVHSIPLTINKEEALQR
LQTVHSIPITIIKNEAIQR

SEQ ID NO: 35185 - protein, 19 aa, synthetic construct
  source 1..19: note = Seed: LQTVHSIPLTINKEEALQR
LQTVHSIPITIIKNEALQR

SEQ ID NO: 35186 - protein, 19 aa, synthetic construct
  source 1..19: note = Seed: LQTVHSIPLTINKEEALQR
LQTVHSIPITIIKNEAVQR

SEQ ID NO: 35187 - protein, 19 aa, synthetic construct
  source 1..19: note = Seed: LQTVHSIPLTINKEEALQR
LQTVHSIPITIIKSEAAQR

SEQ ID NO: 35188 - protein, 19 aa, synthetic construct
  source 1..19: note = Seed: LQTVHSIPLTINKEEALQR
LQTVHSIPITIIKSEAIQR

SEQ ID NO: 35189 - protein, 19 aa, synthetic construct
  source 1..19: note = Seed: LQTVHSIPLTINKEEALQR
LQTVHSIPITIIKSEALQR

SEQ ID NO: 35190 - protein, 19 aa, synthetic construct
  source 1..19: note = Seed: LQTVHSIPLTINKEEALQR
LQTVHSIPITIIKSEAVQR

SEQ ID NO: 35191 - protein, 19 aa, synthetic construct
  source 1..19: note = Seed: LQTVHSIPLTINKEEALQR
LQTVHSIPITIIKVEAAQR

SEQ ID NO: 35192 - protein, 19 aa, synthetic construct
  source 1..19: note = Seed: LQTVHSIPLTINKEEALQR
LQTVHSIPITIIKVEAIQR

SEQ ID NO: 35193 - protein, 19 aa, synthetic construct
  source 1..19: note = Seed: LQTVHSIPLTINKEEALQR
LQTVHSIPITIIKVEALQR

SEQ ID NO: 35194 - protein, 19 aa, synthetic construct
  source 1..19: note = Seed: LQTVHSIPLTINKEEALQR
LQTVHSIPITIIKVEAMQR

SEQ ID NO: 35195 - protein, 19 aa, synthetic construct
  source 1..19: note = Seed: LQTVHSIPLTINKEEALQR
LQTVHSIPITIIKVEASQR

SEQ ID NO: 35196 - protein, 19 aa, synthetic construct
  source 1..19: note = Seed: LQTVHSIPLTINKEEALQR
LQTVHSIPITIIKVEAVQR

SEQ ID NO: 35197 - protein, 19 aa, synthetic construct
  source 1..19: note = Seed: LQTVHSIPLTINKEEALQR
LQTVHSIPITIIKWEAIQR

SEQ ID NO: 35198 - protein, 19 aa, synthetic construct
  source 1..19: note = Seed: LQTVHSIPLTINKEEALQR
LQTVHSIPITIIKWEALQR

SEQ ID NO: 35199 - protein, 19 aa, synthetic construct
  source 1..19: note = Seed: LQTVHSIPLTINKEEALQR
LQTVHSIPITIIKWEAVQR

SEQ ID NO: 35200 - protein, 19 aa, synthetic construct
  source 1..19: note = Seed: LQTVHSIPLTINKEEALQR
LQTVHSIPITIIKYEAFQR

SEQ ID NO: 35201 - protein, 19 aa, synthetic construct
  source 1..19: note = Seed: LQTVHSIPLTINKEEALQR
LQTVHSIPITIIKYEAIQR

SEQ ID NO: 35202 - protein, 19 aa, synthetic construct
  source 1..19: note = Seed: LQTVHSIPLTINKEEALQR
LQTVHSIPITIIKYEALQR

SEQ ID NO: 35203 - protein, 19 aa, synthetic construct
  source 1..19: note = Seed: LQTVHSIPLTINKEEALQR
LQTVHSIPITIIKYEAVQR

SEQ ID NO: 35204 - protein, 19 aa, synthetic construct
  source 1..19: note = Seed: LQTVHSIPLTINKEEALQR
LQTVHSIPITIKKFEALQR

SEQ ID NO: 35205 - protein, 19 aa, synthetic construct
  source 1..19: note = Seed: LQTVHSIPLTINKEEALQR
LQTVHSIPITILKAEAAQR

SEQ ID NO: 35206 - protein, 19 aa, synthetic construct
  source 1..19: note = Seed: LQTVHSIPLTINKEEALQR
LQTVHSIPITILKAEAIQR

SEQ ID NO: 35207 - protein, 19 aa, synthetic construct
  source 1..19: note = Seed: LQTVHSIPLTINKEEALQR
LQTVHSIPITILKAEALQR

SEQ ID NO: 35208 - protein, 19 aa, synthetic construct
  source 1..19: note = Seed: LQTVHSIPLTINKEEALQR
LQTVHSIPITILKAEAMQR

SEQ ID NO: 35209 - protein, 19 aa, synthetic construct
  source 1..19: note = Seed: LQTVHSIPLTINKEEALQR
LQTVHSIPITILKAEASQR

SEQ ID NO: 35210 - protein, 19 aa, synthetic construct
  source 1..19: note = Seed: LQTVHSIPLTINKEEALQR
LQTVHSIPITILKAEATQR

SEQ ID NO: 35211 - protein, 19 aa, synthetic construct
  source 1..19: note = Seed: LQTVHSIPLTINKEEALQR
LQTVHSIPITILKAEAVQR

SEQ ID NO: 35212 - protein, 19 aa, synthetic construct
  source 1..19: note = Seed: LQTVHSIPLTINKEEALQR
LQTVHSIPITILKDEAIQR

SEQ ID NO: 35213 - protein, 19 aa, synthetic construct
  source 1..19: note = Seed: LQTVHSIPLTINKEEALQR
LQTVHSIPITILKDEALQR

SEQ ID NO: 35214 - protein, 19 aa, synthetic construct
  source 1..19: note = Seed: LQTVHSIPLTINKEEALQR
LQTVHSIPITILKDEAVQR

SEQ ID NO: 35215 - protein, 19 aa, synthetic construct
  source 1..19: note = Seed: LQTVHSIPLTINKEEALQR
LQTVHSIPITILKFEAAQR

SEQ ID NO: 35216 - protein, 19 aa, synthetic construct
  source 1..19: note = Seed: LQTVHSIPLTINKEEALQR
LQTVHSIPITILKFEADQR

SEQ ID NO: 35217 - protein, 19 aa, synthetic construct
  source 1..19: note = Seed: LQTVHSIPLTINKEEALQR
LQTVHSIPITILKFEAEQR

SEQ ID NO: 35218 - protein, 19 aa, synthetic construct
  source 1..19: note = Seed: LQTVHSIPLTINKEEALQR
LQTVHSIPITILKFEAFQR

SEQ ID NO: 35219 - protein, 19 aa, synthetic construct
  source 1..19: note = Seed: LQTVHSIPLTINKEEALQR
LQTVHSIPITILKFEAHQR

SEQ ID NO: 35220 - protein, 19 aa, synthetic construct
  source 1..19: note = Seed: LQTVHSIPLTINKEEALQR
LQTVHSIPITILKFEAIQR

SEQ ID NO: 35221 - protein, 19 aa, synthetic construct
  source 1..19: note = Seed: LQTVHSIPLTINKEEALQR
LQTVHSIPITILKFEALQR

SEQ ID NO: 35222 - protein, 19 aa, synthetic construct
  source 1..19: note = Seed: LQTVHSIPLTINKEEALQR
LQTVHSIPITILKFEAMQR

SEQ ID NO: 35223 - protein, 19 aa, synthetic construct
  source 1..19: note = Seed: LQTVHSIPLTINKEEALQR
LQTVHSIPITILKFEANQR

SEQ ID NO: 35224 - protein, 19 aa, synthetic construct
  source 1..19: note = Seed: LQTVHSIPLTINKEEALQR
LQTVHSIPITILKFEAQQR

SEQ ID NO: 35225 - protein, 19 aa, synthetic construct
  source 1..19: note = Seed: LQTVHSIPLTINKEEALQR
LQTVHSIPITILKFEARQR

SEQ ID NO: 35226 - protein, 19 aa, synthetic construct
  source 1..19: note = Seed: LQTVHSIPLTINKEEALQR
LQTVHSIPITILKFEASQR

SEQ ID NO: 35227 - protein, 19 aa, synthetic construct
  source 1..19: note = Seed: LQTVHSIPLTINKEEALQR
LQTVHSIPITILKFEATQR

SEQ ID NO: 35228 - protein, 19 aa, synthetic construct
  source 1..19: note = Seed: LQTVHSIPLTINKEEALQR
LQTVHSIPITILKFEAVQR

SEQ ID NO: 35229 - protein, 19 aa, synthetic construct
  source 1..19: note = Seed: LQTVHSIPLTINKEEALQR
LQTVHSIPITILKFEAYQR

SEQ ID NO: 35230 - protein, 19 aa, synthetic construct
  source 1..19: note = Seed: LQTVHSIPLTINKEEALQR
LQTVHSIPITILKGEAAQR

SEQ ID NO: 35231 - protein, 19 aa, synthetic construct
  source 1..19: note = Seed: LQTVHSIPLTINKEEALQR
LQTVHSIPITILKGEAIQR

SEQ ID NO: 35232 - protein, 19 aa, synthetic construct
  source 1..19: note = Seed: LQTVHSIPLTINKEEALQR
LQTVHSIPITILKGEALQR

SEQ ID NO: 35233 - protein, 19 aa, synthetic construct
  source 1..19: note = Seed: LQTVHSIPLTINKEEALQR
LQTVHSIPITILKGEAMQR

SEQ ID NO: 35234 - protein, 19 aa, synthetic construct
  source 1..19: note = Seed: LQTVHSIPLTINKEEALQR
LQTVHSIPITILKGEASQR

SEQ ID NO: 35235 - protein, 19 aa, synthetic construct
  source 1..19: note = Seed: LQTVHSIPLTINKEEALQR
LQTVHSIPITILKGEATQR

SEQ ID NO: 35236 - protein, 19 aa, synthetic construct
  source 1..19: note = Seed: LQTVHSIPLTINKEEALQR
LQTVHSIPITILKGEAVQR

SEQ ID NO: 35237 - protein, 19 aa, synthetic construct
  source 1..19: note = Seed: LQTVHSIPLTINKEEALQR
LQTVHSIPITILKIEAAQR

SEQ ID NO: 35238 - protein, 19 aa, synthetic construct
  source 1..19: note = Seed: LQTVHSIPLTINKEEALQR
LQTVHSIPITILKIEAIQR

SEQ ID NO: 35239 - protein, 19 aa, synthetic construct
  source 1..19: note = Seed: LQTVHSIPLTINKEEALQR
LQTVHSIPITILKIEALQR

SEQ ID NO: 35240 - protein, 19 aa, synthetic construct
  source 1..19: note = Seed: LQTVHSIPLTINKEEALQR
LQTVHSIPITILKIEAMQR

SEQ ID NO: 35241 - protein, 19 aa, synthetic construct
  source 1..19: note = Seed: LQTVHSIPLTINKEEALQR
LQTVHSIPITILKIEASQR

SEQ ID NO: 35242 - protein, 19 aa, synthetic construct
  source 1..19: note = Seed: LQTVHSIPLTINKEEALQR
LQTVHSIPITILKIEAVQR

SEQ ID NO: 35243 - protein, 19 aa, synthetic construct
  source 1..19: note = Seed: LQTVHSIPLTINKEEALQR
LQTVHSIPITILKLEAFQR

SEQ ID NO: 35244 - protein, 19 aa, synthetic construct
  source 1..19: note = Seed: LQTVHSIPLTINKEEALQR
LQTVHSIPITILKLEAIQR

SEQ ID NO: 35245 - protein, 19 aa, synthetic construct
  source 1..19: note = Seed: LQTVHSIPLTINKEEALQR
LQTVHSIPITILKLEALQR

SEQ ID NO: 35246 - protein, 19 aa, synthetic construct
  source 1..19: note = Seed: LQTVHSIPLTINKEEALQR
LQTVHSIPITILKLEAMQR

SEQ ID NO: 35247 - protein, 19 aa, synthetic construct
  source 1..19: note = Seed: LQTVHSIPLTINKEEALQR
LQTVHSIPITILKLEAVQR

SEQ ID NO: 35248 - protein, 19 aa, synthetic construct
  source 1..19: note = Seed: LQTVHSIPLTINKEEALQR
LQTVHSIPITILKNEAAQR

SEQ ID NO: 35249 - protein, 19 aa, synthetic construct
  source 1..19: note = Seed: LQTVHSIPLTINKEEALQR
LQTVHSIPITILKNEAIQR

SEQ ID NO: 35250 - protein, 19 aa, synthetic construct
  source 1..19: note = Seed: LQTVHSIPLTINKEEALQR
LQTVHSIPITILKNEALQR

SEQ ID NO: 35251 - protein, 19 aa, synthetic construct
  source 1..19: note = Seed: LQTVHSIPLTINKEEALQR
LQTVHSIPITILKNEAVQR

SEQ ID NO: 35252 - protein, 19 aa, synthetic construct
  source 1..19: note = Seed: LQTVHSIPLTINKEEALQR
LQTVHSIPITILKPEAAQR

SEQ ID NO: 35253 - protein, 19 aa, synthetic construct
  source 1..19: note = Seed: LQTVHSIPLTINKEEALQR
LQTVHSIPITILKPEAIQR

SEQ ID NO: 35254 - protein, 19 aa, synthetic construct
  source 1..19: note = Seed: LQTVHSIPLTINKEEALQR
LQTVHSIPITILKPEALQR

SEQ ID NO: 35255 - protein, 19 aa, synthetic construct
  source 1..19: note = Seed: LQTVHSIPLTINKEEALQR
LQTVHSIPITILKPEATQR

SEQ ID NO: 35256 - protein, 19 aa, synthetic construct
  source 1..19: note = Seed: LQTVHSIPLTINKEEALQR
LQTVHSIPITILKPEAVQR

SEQ ID NO: 35257 - protein, 19 aa, synthetic construct
  source 1..19: note = Seed: LQTVHSIPLTINKEEALQR
LQTVHSIPITILKSEAAQR

SEQ ID NO: 35258 - protein, 19 aa, synthetic construct
  source 1..19: note = Seed: LQTVHSIPLTINKEEALQR
LQTVHSIPITILKSEAIQR

SEQ ID NO: 35259 - protein, 19 aa, synthetic construct
  source 1..19: note = Seed: LQTVHSIPLTINKEEALQR
LQTVHSIPITILKSEALQR

SEQ ID NO: 35260 - protein, 19 aa, synthetic construct
  source 1..19: note = Seed: LQTVHSIPLTINKEEALQR
LQTVHSIPITILKSEAMQR

SEQ ID NO: 35261 - protein, 19 aa, synthetic construct
  source 1..19: note = Seed: LQTVHSIPLTINKEEALQR
LQTVHSIPITILKSEASQR

SEQ ID NO: 35262 - protein, 19 aa, synthetic construct
  source 1..19: note = Seed: LQTVHSIPLTINKEEALQR
LQTVHSIPITILKSEATQR

SEQ ID NO: 35263 - protein, 19 aa, synthetic construct
  source 1..19: note = Seed: LQTVHSIPLTINKEEALQR
LQTVHSIPITILKSEAVQR

SEQ ID NO: 35264 - protein, 19 aa, synthetic construct
  source 1..19: note = Seed: LQTVHSIPLTINKEEALQR
LQTVHSIPITILKTEAAQR

SEQ ID NO: 35265 - protein, 19 aa, synthetic construct
  source 1..19: note = Seed: LQTVHSIPLTINKEEALQR
LQTVHSIPITILKTEAIQR

SEQ ID NO: 35266 - protein, 19 aa, synthetic construct
  source 1..19: note = Seed: LQTVHSIPLTINKEEALQR
LQTVHSIPITILKTEALQR

SEQ ID NO: 35267 - protein, 19 aa, synthetic construct
  source 1..19: note = Seed: LQTVHSIPLTINKEEALQR
LQTVHSIPITILKTEATQR

SEQ ID NO: 35268 - protein, 19 aa, synthetic construct
  source 1..19: note = Seed: LQTVHSIPLTINKEEALQR
LQTVHSIPITILKTEAVQR

SEQ ID NO: 35269 - protein, 19 aa, synthetic construct
  source 1..19: note = Seed: LQTVHSIPLTINKEEALQR
LQTVHSIPITILKVEAAQR

SEQ ID NO: 35270 - protein, 19 aa, synthetic construct
  source 1..19: note = Seed: LQTVHSIPLTINKEEALQR
LQTVHSIPITILKVEAIQR

SEQ ID NO: 35271 - protein, 19 aa, synthetic construct
  source 1..19: note = Seed: LQTVHSIPLTINKEEALQR
LQTVHSIPITILKVEAVQR

SEQ ID NO: 35272 - protein, 19 aa, synthetic construct
  source 1..19: note = Seed: LQTVHSIPLTINKEEALQR
LQTVHSIPITILKWEAIQR

SEQ ID NO: 35273 - protein, 19 aa, synthetic construct
  source 1..19: note = Seed: LQTVHSIPLTINKEEALQR
LQTVHSIPITILKWEALQR

SEQ ID NO: 35274 - protein, 19 aa, synthetic construct
  source 1..19: note = Seed: LQTVHSIPLTINKEEALQR
LQTVHSIPITILKWEAVQR

SEQ ID NO: 35275 - protein, 19 aa, synthetic construct
  source 1..19: note = Seed: LQTVHSIPLTINKEEALQR
LQTVHSIPITILKYEAFQR

SEQ ID NO: 35276 - protein, 19 aa, synthetic construct
  source 1..19: note = Seed: LQTVHSIPLTINKEEALQR
LQTVHSIPITILKYEAIQR

SEQ ID NO: 35277 - protein, 19 aa, synthetic construct
  source 1..19: note = Seed: LQTVHSIPLTINKEEALQR
LQTVHSIPITILKYEALQR

SEQ ID NO: 35278 - protein, 19 aa, synthetic construct
  source 1..19: note = Seed: LQTVHSIPLTINKEEALQR
LQTVHSIPITILKYEAVQR

SEQ ID NO: 35279 - protein, 19 aa, synthetic construct
  source 1..19: note = Seed: LQTVHSIPLTINKEEALQR
LQTVHSIPITIMKAEAAQR

SEQ ID NO: 35280 - protein, 19 aa, synthetic construct
  source 1..19: note = Seed: LQTVHSIPLTINKEEALQR
LQTVHSIPITIMKAEAFQR

SEQ ID NO: 35281 - protein, 19 aa, synthetic construct
  source 1..19: note = Seed: LQTVHSIPLTINKEEALQR
LQTVHSIPITIMKAEAIQR

SEQ ID NO: 35282 - protein, 19 aa, synthetic construct
  source 1..19: note = Seed: LQTVHSIPLTINKEEALQR
LQTVHSIPITIMKAEALQR

SEQ ID NO: 35283 - protein, 19 aa, synthetic construct
  source 1..19: note = Seed: LQTVHSIPLTINKEEALQR
LQTVHSIPITIMKAEAMQR

SEQ ID NO: 35284 - protein, 19 aa, synthetic construct
  source 1..19: note = Seed: LQTVHSIPLTINKEEALQR
LQTVHSIPITIMKAEASQR

SEQ ID NO: 35285 - protein, 19 aa, synthetic construct
  source 1..19: note = Seed: LQTVHSIPLTINKEEALQR
LQTVHSIPITIMKAEATQR

SEQ ID NO: 35286 - protein, 19 aa, synthetic construct
  source 1..19: note = Seed: LQTVHSIPLTINKEEALQR
LQTVHSIPITIMKAEAVQR

SEQ ID NO: 35287 - protein, 19 aa, synthetic construct
  source 1..19: note = Seed: LQTVHSIPLTINKEEALQR
LQTVHSIPITIMKAEAYQR

SEQ ID NO: 35288 - protein, 19 aa, synthetic construct
  source 1..19: note = Seed: LQTVHSIPLTINKEEALQR
LQTVHSIPITIMKDEAAQR

SEQ ID NO: 35289 - protein, 19 aa, synthetic construct
  source 1..19: note = Seed: LQTVHSIPLTINKEEALQR
LQTVHSIPITIMKDEAIQR

SEQ ID NO: 35290 - protein, 19 aa, synthetic construct
  source 1..19: note = Seed: LQTVHSIPLTINKEEALQR
LQTVHSIPITIMKDEALQR

SEQ ID NO: 35291 - protein, 19 aa, synthetic construct
  source 1..19: note = Seed: LQTVHSIPLTINKEEALQR
LQTVHSIPITIMKDEAMQR

SEQ ID NO: 35292 - protein, 19 aa, synthetic construct
  source 1..19: note = Seed: LQTVHSIPLTINKEEALQR
LQTVHSIPITIMKDEAVQR

SEQ ID NO: 35293 - protein, 19 aa, synthetic construct
  source 1..19: note = Seed: LQTVHSIPLTINKEEALQR
LQTVHSIPITIMKFEAEQR

SEQ ID NO: 35294 - protein, 19 aa, synthetic construct
  source 1..19: note = Seed: LQTVHSIPLTINKEEALQR
LQTVHSIPITIMKFEAFQR

SEQ ID NO: 35295 - protein, 19 aa, synthetic construct
  source 1..19: note = Seed: LQTVHSIPLTINKEEALQR
LQTVHSIPITIMKFEAIQR

SEQ ID NO: 35296 - protein, 19 aa, synthetic construct
  source 1..19: note = Seed: LQTVHSIPLTINKEEALQR
LQTVHSIPITIMKFEALQR

SEQ ID NO: 35297 - protein, 19 aa, synthetic construct
  source 1..19: note = Seed: LQTVHSIPLTINKEEALQR
LQTVHSIPITIMKFEAMQR

SEQ ID NO: 35298 - protein, 19 aa, synthetic construct
  source 1..19: note = Seed: LQTVHSIPLTINKEEALQR
LQTVHSIPITIMKFEATQR

SEQ ID NO: 35299 - protein, 19 aa, synthetic construct
  source 1..19: note = Seed: LQTVHSIPLTINKEEALQR
LQTVHSIPITIMKFEAVQR

SEQ ID NO: 35300 - protein, 19 aa, synthetic construct
  source 1..19: note = Seed: LQTVHSIPLTINKEEALQR
LQTVHSIPITIMKFEAYQR

SEQ ID NO: 35301 - protein, 19 aa, synthetic construct
  source 1..19: note = Seed: LQTVHSIPLTINKEEALQR
LQTVHSIPITIMKGEAAQR

SEQ ID NO: 35302 - protein, 19 aa, synthetic construct
  source 1..19: note = Seed: LQTVHSIPLTINKEEALQR
LQTVHSIPITIMKGEAIQR

SEQ ID NO: 35303 - protein, 19 aa, synthetic construct
  source 1..19: note = Seed: LQTVHSIPLTINKEEALQR
LQTVHSIPITIMKGEALQR

SEQ ID NO: 35304 - protein, 19 aa, synthetic construct
  source 1..19: note = Seed: LQTVHSIPLTINKEEALQR
LQTVHSIPITIMKGEAMQR

SEQ ID NO: 35305 - protein, 19 aa, synthetic construct
  source 1..19: note = Seed: LQTVHSIPLTINKEEALQR
LQTVHSIPITIMKGEASQR

SEQ ID NO: 35306 - protein, 19 aa, synthetic construct
  source 1..19: note = Seed: LQTVHSIPLTINKEEALQR
LQTVHSIPITIMKGEATQR

SEQ ID NO: 35307 - protein, 19 aa, synthetic construct
  source 1..19: note = Seed: LQTVHSIPLTINKEEALQR
LQTVHSIPITIMKGEAVQR

SEQ ID NO: 35308 - protein, 19 aa, synthetic construct
  source 1..19: note = Seed: LQTVHSIPLTINKEEALQR
LQTVHSIPITIMKIEAAQR

SEQ ID NO: 35309 - protein, 19 aa, synthetic construct
  source 1..19: note = Seed: LQTVHSIPLTINKEEALQR
LQTVHSIPITIMKIEAFQR

SEQ ID NO: 35310 - protein, 19 aa, synthetic construct
  source 1..19: note = Seed: LQTVHSIPLTINKEEALQR
LQTVHSIPITIMKIEAIQR

SEQ ID NO: 35311 - protein, 19 aa, synthetic construct
  source 1..19: note = Seed: LQTVHSIPLTINKEEALQR
LQTVHSIPITIMKIEALQR

SEQ ID NO: 35312 - protein, 19 aa, synthetic construct
  source 1..19: note = Seed: LQTVHSIPLTINKEEALQR
LQTVHSIPITIMKIEAMQR

SEQ ID NO: 35313 - protein, 19 aa, synthetic construct
  source 1..19: note = Seed: LQTVHSIPLTINKEEALQR
LQTVHSIPITIMKIEASQR

SEQ ID NO: 35314 - protein, 19 aa, synthetic construct
  source 1..19: note = Seed: LQTVHSIPLTINKEEALQR
LQTVHSIPITIMKIEATQR

SEQ ID NO: 35315 - protein, 19 aa, synthetic construct
  source 1..19: note = Seed: LQTVHSIPLTINKEEALQR
LQTVHSIPITIMKIEAVQR

SEQ ID NO: 35316 - protein, 19 aa, synthetic construct
  source 1..19: note = Seed: LQTVHSIPLTINKEEALQR
LQTVHSIPITIMKIEAYQR

SEQ ID NO: 35317 - protein, 19 aa, synthetic construct
  source 1..19: note = Seed: LQTVHSIPLTINKEEALQR
LQTVHSIPITIMKLEAAQR

SEQ ID NO: 35318 - protein, 19 aa, synthetic construct
  source 1..19: note = Seed: LQTVHSIPLTINKEEALQR
LQTVHSIPITIMKLEAIQR

SEQ ID NO: 35319 - protein, 19 aa, synthetic construct
  source 1..19: note = Seed: LQTVHSIPLTINKEEALQR
LQTVHSIPITIMKLEALQR

SEQ ID NO: 35320 - protein, 19 aa, synthetic construct
  source 1..19: note = Seed: LQTVHSIPLTINKEEALQR
LQTVHSIPITIMKLEAMQR

SEQ ID NO: 35321 - protein, 19 aa, synthetic construct
  source 1..19: note = Seed: LQTVHSIPLTINKEEALQR
LQTVHSIPITIMKLEAVQR

SEQ ID NO: 35322 - protein, 19 aa, synthetic construct
  source 1..19: note = Seed: LQTVHSIPLTINKEEALQR
LQTVHSIPITIMKMEAAQR

SEQ ID NO: 35323 - protein, 19 aa, synthetic construct
  source 1..19: note = Seed: LQTVHSIPLTINKEEALQR
LQTVHSIPITIMKMEAIQR

SEQ ID NO: 35324 - protein, 19 aa, synthetic construct
  source 1..19: note = Seed: LQTVHSIPLTINKEEALQR
LQTVHSIPITIMKMEALQR

SEQ ID NO: 35325 - protein, 19 aa, synthetic construct
  source 1..19: note = Seed: LQTVHSIPLTINKEEALQR
LQTVHSIPITIMKMEAMQR

SEQ ID NO: 35326 - protein, 19 aa, synthetic construct
  source 1..19: note = Seed: LQTVHSIPLTINKEEALQR
LQTVHSIPITIMKMEAVQR

SEQ ID NO: 35327 - protein, 19 aa, synthetic construct
  source 1..19: note = Seed: LQTVHSIPLTINKEEALQR
LQTVHSIPITIMKNEAAQR

SEQ ID NO: 35328 - protein, 19 aa, synthetic construct
  source 1..19: note = Seed: LQTVHSIPLTINKEEALQR
LQTVHSIPITIMKNEAIQR

SEQ ID NO: 35329 - protein, 19 aa, synthetic construct
  source 1..19: note = Seed: LQTVHSIPLTINKEEALQR
LQTVHSIPITIMKNEALQR

SEQ ID NO: 35330 - protein, 19 aa, synthetic construct
  source 1..19: note = Seed: LQTVHSIPLTINKEEALQR
LQTVHSIPITIMKNEAVQR

SEQ ID NO: 35331 - protein, 19 aa, synthetic construct
  source 1..19: note = Seed: LQTVHSIPLTINKEEALQR
LQTVHSIPITIMKPEAAQR

SEQ ID NO: 35332 - protein, 19 aa, synthetic construct
  source 1..19: note = Seed: LQTVHSIPLTINKEEALQR
LQTVHSIPITIMKPEAIQR

SEQ ID NO: 35333 - protein, 19 aa, synthetic construct
  source 1..19: note = Seed: LQTVHSIPLTINKEEALQR
LQTVHSIPITIMKPEALQR

SEQ ID NO: 35334 - protein, 19 aa, synthetic construct
  source 1..19: note = Seed: LQTVHSIPLTINKEEALQR
LQTVHSIPITIMKPEAMQR

SEQ ID NO: 35335 - protein, 19 aa, synthetic construct
  source 1..19: note = Seed: LQTVHSIPLTINKEEALQR
LQTVHSIPITIMKPEATQR

SEQ ID NO: 35336 - protein, 19 aa, synthetic construct
  source 1..19: note = Seed: LQTVHSIPLTINKEEALQR
LQTVHSIPITIMKPEAVQR

SEQ ID NO: 35337 - protein, 19 aa, synthetic construct
  source 1..19: note = Seed: LQTVHSIPLTINKEEALQR
LQTVHSIPITIMKSEAAQR

SEQ ID NO: 35338 - protein, 19 aa, synthetic construct
  source 1..19: note = Seed: LQTVHSIPLTINKEEALQR
LQTVHSIPITIMKSEAIQR

SEQ ID NO: 35339 - protein, 19 aa, synthetic construct
  source 1..19: note = Seed: LQTVHSIPLTINKEEALQR
LQTVHSIPITIMKSEALQR

SEQ ID NO: 35340 - protein, 19 aa, synthetic construct
  source 1..19: note = Seed: LQTVHSIPLTINKEEALQR
LQTVHSIPITIMKSEAMQR

SEQ ID NO: 35341 - protein, 19 aa, synthetic construct
  source 1..19: note = Seed: LQTVHSIPLTINKEEALQR
LQTVHSIPITIMKSEASQR

SEQ ID NO: 35342 - protein, 19 aa, synthetic construct
  source 1..19: note = Seed: LQTVHSIPLTINKEEALQR
LQTVHSIPITIMKSEATQR

SEQ ID NO: 35343 - protein, 19 aa, synthetic construct
  source 1..19: note = Seed: LQTVHSIPLTINKEEALQR
LQTVHSIPITIMKSEAVQR

SEQ ID NO: 35344 - protein, 19 aa, synthetic construct
  source 1..19: note = Seed: LQTVHSIPLTINKEEALQR
LQTVHSIPITIMKTEAAQR

SEQ ID NO: 35345 - protein, 19 aa, synthetic construct
  source 1..19: note = Seed: LQTVHSIPLTINKEEALQR
LQTVHSIPITIMKTEAIQR

SEQ ID NO: 35346 - protein, 19 aa, synthetic construct
  source 1..19: note = Seed: LQTVHSIPLTINKEEALQR
LQTVHSIPITIMKTEALQR

SEQ ID NO: 35347 - protein, 19 aa, synthetic construct
  source 1..19: note = Seed: LQTVHSIPLTINKEEALQR
LQTVHSIPITIMKTEAVQR

SEQ ID NO: 35348 - protein, 19 aa, synthetic construct
  source 1..19: note = Seed: LQTVHSIPLTINKEEALQR
LQTVHSIPITIMKVEAAQR

SEQ ID NO: 35349 - protein, 19 aa, synthetic construct
  source 1..19: note = Seed: LQTVHSIPLTINKEEALQR
LQTVHSIPITIMKVEAFQR

SEQ ID NO: 35350 - protein, 19 aa, synthetic construct
  source 1..19: note = Seed: LQTVHSIPLTINKEEALQR
LQTVHSIPITIMKVEAIQR

SEQ ID NO: 35351 - protein, 19 aa, synthetic construct
  source 1..19: note = Seed: LQTVHSIPLTINKEEALQR
LQTVHSIPITIMKVEALQR

SEQ ID NO: 35352 - protein, 19 aa, synthetic construct
  source 1..19: note = Seed: LQTVHSIPLTINKEEALQR
LQTVHSIPITIMKVEAMQR

SEQ ID NO: 35353 - protein, 19 aa, synthetic construct
  source 1..19: note = Seed: LQTVHSIPLTINKEEALQR
LQTVHSIPITIMKVEASQR

SEQ ID NO: 35354 - protein, 19 aa, synthetic construct
  source 1..19: note = Seed: LQTVHSIPLTINKEEALQR
LQTVHSIPITIMKVEATQR

SEQ ID NO: 35355 - protein, 19 aa, synthetic construct
  source 1..19: note = Seed: LQTVHSIPLTINKEEALQR
LQTVHSIPITIMKVEAVQR

SEQ ID NO: 35356 - protein, 19 aa, synthetic construct
  source 1..19: note = Seed: LQTVHSIPLTINKEEALQR
LQTVHSIPITIMKVEAYQR

SEQ ID NO: 35357 - protein, 19 aa, synthetic construct
  source 1..19: note = Seed: LQTVHSIPLTINKEEALQR
LQTVHSIPITIMKYEALQR

SEQ ID NO: 35358 - protein, 19 aa, synthetic construct
  source 1..19: note = Seed: LQTVHSIPLTINKEEALQR
LQTVHSIPITINKAEAAQR

SEQ ID NO: 35359 - protein, 19 aa, synthetic construct
  source 1..19: note = Seed: LQTVHSIPLTINKEEALQR
LQTVHSIPITINKAEAFQR

SEQ ID NO: 35360 - protein, 19 aa, synthetic construct
  source 1..19: note = Seed: LQTVHSIPLTINKEEALQR
LQTVHSIPITINKAEAIQR

SEQ ID NO: 35361 - protein, 19 aa, synthetic construct
  source 1..19: note = Seed: LQTVHSIPLTINKEEALQR
LQTVHSIPITINKAEALQR

SEQ ID NO: 35362 - protein, 19 aa, synthetic construct
  source 1..19: note = Seed: LQTVHSIPLTINKEEALQR
LQTVHSIPITINKAEAMQR

SEQ ID NO: 35363 - protein, 19 aa, synthetic construct
  source 1..19: note = Seed: LQTVHSIPLTINKEEALQR
LQTVHSIPITINKAEATQR

SEQ ID NO: 35364 - protein, 19 aa, synthetic construct
  source 1..19: note = Seed: LQTVHSIPLTINKEEALQR
LQTVHSIPITINKAEAVQR

SEQ ID NO: 35365 - protein, 19 aa, synthetic construct
  source 1..19: note = Seed: LQTVHSIPLTINKEEALQR
LQTVHSIPITINKAEAWQR

SEQ ID NO: 35366 - protein, 19 aa, synthetic construct
  source 1..19: note = Seed: LQTVHSIPLTINKEEALQR
LQTVHSIPITINKAEAYQR

SEQ ID NO: 35367 - protein, 19 aa, synthetic construct
  source 1..19: note = Seed: LQTVHSIPLTINKEEALQR
LQTVHSIPITINKFEAFQR

SEQ ID NO: 35368 - protein, 19 aa, synthetic construct
  source 1..19: note = Seed: LQTVHSIPLTINKEEALQR
LQTVHSIPITINKFEAIQR

SEQ ID NO: 35369 - protein, 19 aa, synthetic construct
  source 1..19: note = Seed: LQTVHSIPLTINKEEALQR
LQTVHSIPITINKFEALQR

SEQ ID NO: 35370 - protein, 19 aa, synthetic construct
  source 1..19: note = Seed: LQTVHSIPLTINKEEALQR
LQTVHSIPITINKFEAMQR

SEQ ID NO: 35371 - protein, 19 aa, synthetic construct
  source 1..19: note = Seed: LQTVHSIPLTINKEEALQR
LQTVHSIPITINKFEAVQR

SEQ ID NO: 35372 - protein, 19 aa, synthetic construct
  source 1..19: note = Seed: LQTVHSIPLTINKEEALQR
LQTVHSIPITINKGEAAQR

SEQ ID NO: 35373 - protein, 19 aa, synthetic construct
  source 1..19: note = Seed: LQTVHSIPLTINKEEALQR
LQTVHSIPITINKGEAFQR

SEQ ID NO: 35374 - protein, 19 aa, synthetic construct
  source 1..19: note = Seed: LQTVHSIPLTINKEEALQR
LQTVHSIPITINKGEAIQR

SEQ ID NO: 35375 - protein, 19 aa, synthetic construct
  source 1..19: note = Seed: LQTVHSIPLTINKEEALQR
LQTVHSIPITINKGEALQR

SEQ ID NO: 35376 - protein, 19 aa, synthetic construct
  source 1..19: note = Seed: LQTVHSIPLTINKEEALQR
LQTVHSIPITINKGEAMQR

SEQ ID NO: 35377 - protein, 19 aa, synthetic construct
  source 1..19: note = Seed: LQTVHSIPLTINKEEALQR
LQTVHSIPITINKGEAVQR

SEQ ID NO: 35378 - protein, 19 aa, synthetic construct
  source 1..19: note = Seed: LQTVHSIPLTINKEEALQR
LQTVHSIPITINKGEAYQR

SEQ ID NO: 35379 - protein, 19 aa, synthetic construct
  source 1..19: note = Seed: LQTVHSIPLTINKEEALQR
LQTVHSIPITINKHEAIQR

SEQ ID NO: 35380 - protein, 19 aa, synthetic construct
  source 1..19: note = Seed: LQTVHSIPLTINKEEALQR
LQTVHSIPITINKHEAVQR

SEQ ID NO: 35381 - protein, 19 aa, synthetic construct
  source 1..19: note = Seed: LQTVHSIPLTINKEEALQR
LQTVHSIPITINKIEAAQR

SEQ ID NO: 35382 - protein, 19 aa, synthetic construct
  source 1..19: note = Seed: LQTVHSIPLTINKEEALQR
LQTVHSIPITINKIEAFQR

SEQ ID NO: 35383 - protein, 19 aa, synthetic construct
  source 1..19: note = Seed: LQTVHSIPLTINKEEALQR
LQTVHSIPITINKIEAIQR

SEQ ID NO: 35384 - protein, 19 aa, synthetic construct
  source 1..19: note = Seed: LQTVHSIPLTINKEEALQR
LQTVHSIPITINKIEALQR

SEQ ID NO: 35385 - protein, 19 aa, synthetic construct
  source 1..19: note = Seed: LQTVHSIPLTINKEEALQR
LQTVHSIPITINKIEAMQR

SEQ ID NO: 35386 - protein, 19 aa, synthetic construct
  source 1..19: note = Seed: LQTVHSIPLTINKEEALQR
LQTVHSIPITINKIEAVQR

SEQ ID NO: 35387 - protein, 19 aa, synthetic construct
  source 1..19: note = Seed: LQTVHSIPLTINKEEALQR
LQTVHSIPITINKIEAYQR

SEQ ID NO: 35388 - protein, 19 aa, synthetic construct
  source 1..19: note = Seed: LQTVHSIPLTINKEEALQR
LQTVHSIPITINKLEAFQR

SEQ ID NO: 35389 - protein, 19 aa, synthetic construct
  source 1..19: note = Seed: LQTVHSIPLTINKEEALQR
LQTVHSIPITINKLEAIQR

SEQ ID NO: 35390 - protein, 19 aa, synthetic construct
  source 1..19: note = Seed: LQTVHSIPLTINKEEALQR
LQTVHSIPITINKLEALQR

SEQ ID NO: 35391 - protein, 19 aa, synthetic construct
  source 1..19: note = Seed: LQTVHSIPLTINKEEALQR
LQTVHSIPITINKLEAVQR

SEQ ID NO: 35392 - protein, 19 aa, synthetic construct
  source 1..19: note = Seed: LQTVHSIPLTINKEEALQR
LQTVHSIPITINKMEAIQR

SEQ ID NO: 35393 - protein, 19 aa, synthetic construct
  source 1..19: note = Seed: LQTVHSIPLTINKEEALQR
LQTVHSIPITINKMEALQR

SEQ ID NO: 35394 - protein, 19 aa, synthetic construct
  source 1..19: note = Seed: LQTVHSIPLTINKEEALQR
LQTVHSIPITINKMEAVQR

SEQ ID NO: 35395 - protein, 19 aa, synthetic construct
  source 1..19: note = Seed: LQTVHSIPLTINKEEALQR
LQTVHSIPITINKNEAAQR

SEQ ID NO: 35396 - protein, 19 aa, synthetic construct
  source 1..19: note = Seed: LQTVHSIPLTINKEEALQR
LQTVHSIPITINKNEAFQR

SEQ ID NO: 35397 - protein, 19 aa, synthetic construct
  source 1..19: note = Seed: LQTVHSIPLTINKEEALQR
LQTVHSIPITINKNEAIQR

SEQ ID NO: 35398 - protein, 19 aa, synthetic construct
  source 1..19: note = Seed: LQTVHSIPLTINKEEALQR
LQTVHSIPITINKNEALQR

SEQ ID NO: 35399 - protein, 19 aa, synthetic construct
  source 1..19: note = Seed: LQTVHSIPLTINKEEALQR
LQTVHSIPITINKNEAMQR

SEQ ID NO: 35400 - protein, 19 aa, synthetic construct
  source 1..19: note = Seed: LQTVHSIPLTINKEEALQR
LQTVHSIPITINKNEATQR

SEQ ID NO: 35401 - protein, 19 aa, synthetic construct
  source 1..19: note = Seed: LQTVHSIPLTINKEEALQR
LQTVHSIPITINKNEAVQR

SEQ ID NO: 35402 - protein, 19 aa, synthetic construct
  source 1..19: note = Seed: LQTVHSIPLTINKEEALQR
LQTVHSIPITINKNEAWQR

SEQ ID NO: 35403 - protein, 19 aa, synthetic construct
  source 1..19: note = Seed: LQTVHSIPLTINKEEALQR
LQTVHSIPITINKNEAYQR

SEQ ID NO: 35404 - protein, 19 aa, synthetic construct
  source 1..19: note = Seed: LQTVHSIPLTINKEEALQR
LQTVHSIPITINKPEAFQR

SEQ ID NO: 35405 - protein, 19 aa, synthetic construct
  source 1..19: note = Seed: LQTVHSIPLTINKEEALQR
LQTVHSIPITINKPEAIQR

SEQ ID NO: 35406 - protein, 19 aa, synthetic construct
  source 1..19: note = Seed: LQTVHSIPLTINKEEALQR
LQTVHSIPITINKPEALQR

SEQ ID NO: 35407 - protein, 19 aa, synthetic construct
  source 1..19: note = Seed: LQTVHSIPLTINKEEALQR
LQTVHSIPITINKPEAMQR

SEQ ID NO: 35408 - protein, 19 aa, synthetic construct
  source 1..19: note = Seed: LQTVHSIPLTINKEEALQR
LQTVHSIPITINKPEAVQR

SEQ ID NO: 35409 - protein, 19 aa, synthetic construct
  source 1..19: note = Seed: LQTVHSIPLTINKEEALQR
LQTVHSIPITINKPEAYQR

SEQ ID NO: 35410 - protein, 19 aa, synthetic construct
  source 1..19: note = Seed: LQTVHSIPLTINKEEALQR
LQTVHSIPITINKSEAAQR

SEQ ID NO: 35411 - protein, 19 aa, synthetic construct
  source 1..19: note = Seed: LQTVHSIPLTINKEEALQR
LQTVHSIPITINKSEAFQR

SEQ ID NO: 35412 - protein, 19 aa, synthetic construct
  source 1..19: note = Seed: LQTVHSIPLTINKEEALQR
LQTVHSIPITINKSEAIQR

SEQ ID NO: 35413 - protein, 19 aa, synthetic construct
  source 1..19: note = Seed: LQTVHSIPLTINKEEALQR
LQTVHSIPITINKSEALQR

SEQ ID NO: 35414 - protein, 19 aa, synthetic construct
  source 1..19: note = Seed: LQTVHSIPLTINKEEALQR
LQTVHSIPITINKSEAMQR

SEQ ID NO: 35415 - protein, 19 aa, synthetic construct
  source 1..19: note = Seed: LQTVHSIPLTINKEEALQR
LQTVHSIPITINKSEAVQR

SEQ ID NO: 35416 - protein, 19 aa, synthetic construct
  source 1..19: note = Seed: LQTVHSIPLTINKEEALQR
LQTVHSIPITINKSEAYQR

SEQ ID NO: 35417 - protein, 19 aa, synthetic construct
  source 1..19: note = Seed: LQTVHSIPLTINKEEALQR
LQTVHSIPITINKTEAFQR

SEQ ID NO: 35418 - protein, 19 aa, synthetic construct
  source 1..19: note = Seed: LQTVHSIPLTINKEEALQR
LQTVHSIPITINKTEAIQR

SEQ ID NO: 35419 - protein, 19 aa, synthetic construct
  source 1..19: note = Seed: LQTVHSIPLTINKEEALQR
LQTVHSIPITINKTEALQR

SEQ ID NO: 35420 - protein, 19 aa, synthetic construct
  source 1..19: note = Seed: LQTVHSIPLTINKEEALQR
LQTVHSIPITINKTEAMQR

SEQ ID NO: 35421 - protein, 19 aa, synthetic construct
  source 1..19: note = Seed: LQTVHSIPLTINKEEALQR
LQTVHSIPITINKTEAVQR

SEQ ID NO: 35422 - protein, 19 aa, synthetic construct
  source 1..19: note = Seed: LQTVHSIPLTINKEEALQR
LQTVHSIPITINKTEAYQR

SEQ ID NO: 35423 - protein, 19 aa, synthetic construct
  source 1..19: note = Seed: LQTVHSIPLTINKEEALQR
LQTVHSIPITINKVEAAQR

SEQ ID NO: 35424 - protein, 19 aa, synthetic construct
  source 1..19: note = Seed: LQTVHSIPLTINKEEALQR
LQTVHSIPITINKVEAFQR

SEQ ID NO: 35425 - protein, 19 aa, synthetic construct
  source 1..19: note = Seed: LQTVHSIPLTINKEEALQR
LQTVHSIPITINKVEAIQR

SEQ ID NO: 35426 - protein, 19 aa, synthetic construct
  source 1..19: note = Seed: LQTVHSIPLTINKEEALQR
LQTVHSIPITINKVEALQR

SEQ ID NO: 35427 - protein, 19 aa, synthetic construct
  source 1..19: note = Seed: LQTVHSIPLTINKEEALQR
LQTVHSIPITINKVEAMQR

SEQ ID NO: 35428 - protein, 19 aa, synthetic construct
  source 1..19: note = Seed: LQTVHSIPLTINKEEALQR
LQTVHSIPITINKVEAVQR

SEQ ID NO: 35429 - protein, 19 aa, synthetic construct
  source 1..19: note = Seed: LQTVHSIPLTINKEEALQR
LQTVHSIPITINKVEAYQR

SEQ ID NO: 35430 - protein, 19 aa, synthetic construct
  source 1..19: note = Seed: LQTVHSIPLTINKEEALQR
LQTVHSIPITIQKAEAAQR

SEQ ID NO: 35431 - protein, 19 aa, synthetic construct
  source 1..19: note = Seed: LQTVHSIPLTINKEEALQR
LQTVHSIPITIQKAEAIQR

SEQ ID NO: 35432 - protein, 19 aa, synthetic construct
  source 1..19: note = Seed: LQTVHSIPLTINKEEALQR
LQTVHSIPITIQKAEALQR

SEQ ID NO: 35433 - protein, 19 aa, synthetic construct
  source 1..19: note = Seed: LQTVHSIPLTINKEEALQR
LQTVHSIPITIQKAEAVQR

SEQ ID NO: 35434 - protein, 19 aa, synthetic construct
  source 1..19: note = Seed: LQTVHSIPLTINKEEALQR
LQTVHSIPITIQKFEAFQR

SEQ ID NO: 35435 - protein, 19 aa, synthetic construct
  source 1..19: note = Seed: LQTVHSIPLTINKEEALQR
LQTVHSIPITIQKFEAIQR

SEQ ID NO: 35436 - protein, 19 aa, synthetic construct
  source 1..19: note = Seed: LQTVHSIPLTINKEEALQR
LQTVHSIPITIQKFEALQR

SEQ ID NO: 35437 - protein, 19 aa, synthetic construct
  source 1..19: note = Seed: LQTVHSIPLTINKEEALQR
LQTVHSIPITIQKFEAMQR

SEQ ID NO: 35438 - protein, 19 aa, synthetic construct
  source 1..19: note = Seed: LQTVHSIPLTINKEEALQR
LQTVHSIPITIQKFEAVQR

SEQ ID NO: 35439 - protein, 19 aa, synthetic construct
  source 1..19: note = Seed: LQTVHSIPLTINKEEALQR
LQTVHSIPITIQKGEALQR

SEQ ID NO: 35440 - protein, 19 aa, synthetic construct
  source 1..19: note = Seed: LQTVHSIPLTINKEEALQR
LQTVHSIPITIQKGEAVQR

SEQ ID NO: 35441 - protein, 19 aa, synthetic construct
  source 1..19: note = Seed: LQTVHSIPLTINKEEALQR
LQTVHSIPITISKAEAIQR

SEQ ID NO: 35442 - protein, 19 aa, synthetic construct
  source 1..19: note = Seed: LQTVHSIPLTINKEEALQR
LQTVHSIPITISKAEALQR

SEQ ID NO: 35443 - protein, 19 aa, synthetic construct
  source 1..19: note = Seed: LQTVHSIPLTINKEEALQR
LQTVHSIPITISKAEAVQR

SEQ ID NO: 35444 - protein, 19 aa, synthetic construct
  source 1..19: note = Seed: LQTVHSIPLTINKEEALQR
LQTVHSIPITISKFEAAQR

SEQ ID NO: 35445 - protein, 19 aa, synthetic construct
  source 1..19: note = Seed: LQTVHSIPLTINKEEALQR
LQTVHSIPITISKFEAFQR

SEQ ID NO: 35446 - protein, 19 aa, synthetic construct
  source 1..19: note = Seed: LQTVHSIPLTINKEEALQR
LQTVHSIPITISKFEAIQR

SEQ ID NO: 35447 - protein, 19 aa, synthetic construct
  source 1..19: note = Seed: LQTVHSIPLTINKEEALQR
LQTVHSIPITISKFEALQR

SEQ ID NO: 35448 - protein, 19 aa, synthetic construct
  source 1..19: note = Seed: LQTVHSIPLTINKEEALQR
LQTVHSIPITISKFEAMQR

SEQ ID NO: 35449 - protein, 19 aa, synthetic construct
  source 1..19: note = Seed: LQTVHSIPLTINKEEALQR
LQTVHSIPITISKFEATQR

SEQ ID NO: 35450 - protein, 19 aa, synthetic construct
  source 1..19: note = Seed: LQTVHSIPLTINKEEALQR
LQTVHSIPITISKFEAVQR

SEQ ID NO: 35451 - protein, 19 aa, synthetic construct
  source 1..19: note = Seed: LQTVHSIPLTINKEEALQR
LQTVHSIPITISKFEAYQR

SEQ ID NO: 35452 - protein, 19 aa, synthetic construct
  source 1..19: note = Seed: LQTVHSIPLTINKEEALQR
LQTVHSIPITISKGEAIQR

SEQ ID NO: 35453 - protein, 19 aa, synthetic construct
  source 1..19: note = Seed: LQTVHSIPLTINKEEALQR
LQTVHSIPITISKIEAAQR

SEQ ID NO: 35454 - protein, 19 aa, synthetic construct
  source 1..19: note = Seed: LQTVHSIPLTINKEEALQR
LQTVHSIPITISKIEAIQR

SEQ ID NO: 35455 - protein, 19 aa, synthetic construct
  source 1..19: note = Seed: LQTVHSIPLTINKEEALQR
LQTVHSIPITISKIEALQR

SEQ ID NO: 35456 - protein, 19 aa, synthetic construct
  source 1..19: note = Seed: LQTVHSIPLTINKEEALQR
LQTVHSIPITISKNEAIQR

SEQ ID NO: 35457 - protein, 19 aa, synthetic construct
  source 1..19: note = Seed: LQTVHSIPLTINKEEALQR
LQTVHSIPITISKNEALQR

SEQ ID NO: 35458 - protein, 19 aa, synthetic construct
  source 1..19: note = Seed: LQTVHSIPLTINKEEALQR
LQTVHSIPITISKNEAVQR

SEQ ID NO: 35459 - protein, 19 aa, synthetic construct
  source 1..19: note = Seed: LQTVHSIPLTINKEEALQR
LQTVHSIPITISKSEAIQR

SEQ ID NO: 35460 - protein, 19 aa, synthetic construct
  source 1..19: note = Seed: LQTVHSIPLTINKEEALQR
LQTVHSIPITISKSEALQR

SEQ ID NO: 35461 - protein, 19 aa, synthetic construct
  source 1..19: note = Seed: LQTVHSIPLTINKEEALQR
LQTVHSIPITISKSEAVQR

SEQ ID NO: 35462 - protein, 19 aa, synthetic construct
  source 1..19: note = Seed: LQTVHSIPLTINKEEALQR
LQTVHSIPITITKAEAIQR

SEQ ID NO: 35463 - protein, 19 aa, synthetic construct
  source 1..19: note = Seed: LQTVHSIPLTINKEEALQR
LQTVHSIPITITKAEALQR

SEQ ID NO: 35464 - protein, 19 aa, synthetic construct
  source 1..19: note = Seed: LQTVHSIPLTINKEEALQR
LQTVHSIPITITKAEAVQR

SEQ ID NO: 35465 - protein, 19 aa, synthetic construct
  source 1..19: note = Seed: LQTVHSIPLTINKEEALQR
LQTVHSIPITITKFEAAQR

SEQ ID NO: 35466 - protein, 19 aa, synthetic construct
  source 1..19: note = Seed: LQTVHSIPLTINKEEALQR
LQTVHSIPITITKFEAFQR

SEQ ID NO: 35467 - protein, 19 aa, synthetic construct
  source 1..19: note = Seed: LQTVHSIPLTINKEEALQR
LQTVHSIPITITKFEAIQR

SEQ ID NO: 35468 - protein, 19 aa, synthetic construct
  source 1..19: note = Seed: LQTVHSIPLTINKEEALQR
LQTVHSIPITITKFEALQR

SEQ ID NO: 35469 - protein, 19 aa, synthetic construct
  source 1..19: note = Seed: LQTVHSIPLTINKEEALQR
LQTVHSIPITITKFEAMQR

SEQ ID NO: 35470 - protein, 19 aa, synthetic construct
  source 1..19: note = Seed: LQTVHSIPLTINKEEALQR
LQTVHSIPITITKFEANQR

SEQ ID NO: 35471 - protein, 19 aa, synthetic construct
  source 1..19: note = Seed: LQTVHSIPLTINKEEALQR
LQTVHSIPITITKFEASQR

SEQ ID NO: 35472 - protein, 19 aa, synthetic construct
  source 1..19: note = Seed: LQTVHSIPLTINKEEALQR
LQTVHSIPITITKFEATQR

SEQ ID NO: 35473 - protein, 19 aa, synthetic construct
  source 1..19: note = Seed: LQTVHSIPLTINKEEALQR
LQTVHSIPITITKFEAVQR

SEQ ID NO: 35474 - protein, 19 aa, synthetic construct
  source 1..19: note = Seed: LQTVHSIPLTINKEEALQR
LQTVHSIPITITKFEAYQR

SEQ ID NO: 35475 - protein, 19 aa, synthetic construct
  source 1..19: note = Seed: LQTVHSIPLTINKEEALQR
LQTVHSIPITITKGEAIQR

SEQ ID NO: 35476 - protein, 19 aa, synthetic construct
  source 1..19: note = Seed: LQTVHSIPLTINKEEALQR
LQTVHSIPITITKSEAIQR

SEQ ID NO: 35477 - protein, 19 aa, synthetic construct
  source 1..19: note = Seed: LQTVHSIPLTINKEEALQR
LQTVHSIPITITKSEALQR

SEQ ID NO: 35478 - protein, 19 aa, synthetic construct
  source 1..19: note = Seed: LQTVHSIPLTINKEEALQR
LQTVHSIPITITKSEAVQR

SEQ ID NO: 35479 - protein, 19 aa, synthetic construct
  source 1..19: note = Seed: LQTVHSIPLTINKEEALQR
LQTVHSIPITITKWEALQR

SEQ ID NO: 35480 - protein, 19 aa, synthetic construct
  source 1..19: note = Seed: LQTVHSIPLTINKEEALQR
LQTVHSIPITITKYEAIQR

SEQ ID NO: 35481 - protein, 19 aa, synthetic construct
  source 1..19: note = Seed: LQTVHSIPLTINKEEALQR
LQTVHSIPITITKYEALQR

SEQ ID NO: 35482 - protein, 19 aa, synthetic construct
  source 1..19: note = Seed: LQTVHSIPLTINKEEALQR
LQTVHSIPITIVKAEAAQR

SEQ ID NO: 35483 - protein, 19 aa, synthetic construct
  source 1..19: note = Seed: LQTVHSIPLTINKEEALQR
LQTVHSIPITIVKAEAIQR

SEQ ID NO: 35484 - protein, 19 aa, synthetic construct
  source 1..19: note = Seed: LQTVHSIPLTINKEEALQR
LQTVHSIPITIVKAEALQR

SEQ ID NO: 35485 - protein, 19 aa, synthetic construct
  source 1..19: note = Seed: LQTVHSIPLTINKEEALQR
LQTVHSIPITIVKAEAVQR

SEQ ID NO: 35486 - protein, 19 aa, synthetic construct
  source 1..19: note = Seed: LQTVHSIPLTINKEEALQR
LQTVHSIPITIVKDEAAQR

SEQ ID NO: 35487 - protein, 19 aa, synthetic construct
  source 1..19: note = Seed: LQTVHSIPLTINKEEALQR
LQTVHSIPITIVKDEAIQR

SEQ ID NO: 35488 - protein, 19 aa, synthetic construct
  source 1..19: note = Seed: LQTVHSIPLTINKEEALQR
LQTVHSIPITIVKDEALQR

SEQ ID NO: 35489 - protein, 19 aa, synthetic construct
  source 1..19: note = Seed: LQTVHSIPLTINKEEALQR
LQTVHSIPITIVKDEAVQR

SEQ ID NO: 35490 - protein, 19 aa, synthetic construct
  source 1..19: note = Seed: LQTVHSIPLTINKEEALQR
LQTVHSIPITIVKFEAAQR

SEQ ID NO: 35491 - protein, 19 aa, synthetic construct
  source 1..19: note = Seed: LQTVHSIPLTINKEEALQR
LQTVHSIPITIVKFEAEQR

SEQ ID NO: 35492 - protein, 19 aa, synthetic construct
  source 1..19: note = Seed: LQTVHSIPLTINKEEALQR
LQTVHSIPITIVKFEAFQR

SEQ ID NO: 35493 - protein, 19 aa, synthetic construct
  source 1..19: note = Seed: LQTVHSIPLTINKEEALQR
LQTVHSIPITIVKFEAIQR

SEQ ID NO: 35494 - protein, 19 aa, synthetic construct
  source 1..19: note = Seed: LQTVHSIPLTINKEEALQR
LQTVHSIPITIVKFEALQR

SEQ ID NO: 35495 - protein, 19 aa, synthetic construct
  source 1..19: note = Seed: LQTVHSIPLTINKEEALQR
LQTVHSIPITIVKFEAMQR

SEQ ID NO: 35496 - protein, 19 aa, synthetic construct
  source 1..19: note = Seed: LQTVHSIPLTINKEEALQR
LQTVHSIPITIVKFEANQR

SEQ ID NO: 35497 - protein, 19 aa, synthetic construct
  source 1..19: note = Seed: LQTVHSIPLTINKEEALQR
LQTVHSIPITIVKFEASQR

SEQ ID NO: 35498 - protein, 19 aa, synthetic construct
  source 1..19: note = Seed: LQTVHSIPLTINKEEALQR
LQTVHSIPITIVKFEATQR

SEQ ID NO: 35499 - protein, 19 aa, synthetic construct
  source 1..19: note = Seed: LQTVHSIPLTINKEEALQR
LQTVHSIPITIVKFEAVQR

SEQ ID NO: 35500 - protein, 19 aa, synthetic construct
  source 1..19: note = Seed: LQTVHSIPLTINKEEALQR
LQTVHSIPITIVKFEAYQR

SEQ ID NO: 35501 - protein, 19 aa, synthetic construct
  source 1..19: note = Seed: LQTVHSIPLTINKEEALQR
LQTVHSIPITIVKGEALQR

SEQ ID NO: 35502 - protein, 19 aa, synthetic construct
  source 1..19: note = Seed: LQTVHSIPLTINKEEALQR
LQTVHSIPITIVKGEAVQR

SEQ ID NO: 35503 - protein, 19 aa, synthetic construct
  source 1..19: note = Seed: LQTVHSIPLTINKEEALQR
LQTVHSIPITIVKIEAAQR

SEQ ID NO: 35504 - protein, 19 aa, synthetic construct
  source 1..19: note = Seed: LQTVHSIPLTINKEEALQR
LQTVHSIPITIVKIEAIQR

SEQ ID NO: 35505 - protein, 19 aa, synthetic construct
  source 1..19: note = Seed: LQTVHSIPLTINKEEALQR
LQTVHSIPITIVKIEALQR

SEQ ID NO: 35506 - protein, 19 aa, synthetic construct
  source 1..19: note = Seed: LQTVHSIPLTINKEEALQR
LQTVHSIPITIVKIEAMQR

SEQ ID NO: 35507 - protein, 19 aa, synthetic construct
  source 1..19: note = Seed: LQTVHSIPLTINKEEALQR
LQTVHSIPITIVKIEASQR

SEQ ID NO: 35508 - protein, 19 aa, synthetic construct
  source 1..19: note = Seed: LQTVHSIPLTINKEEALQR
LQTVHSIPITIVKIEAVQR

SEQ ID NO: 35509 - protein, 19 aa, synthetic construct
  source 1..19: note = Seed: LQTVHSIPLTINKEEALQR
LQTVHSIPITIVKLEAAQR

SEQ ID NO: 35510 - protein, 19 aa, synthetic construct
  source 1..19: note = Seed: LQTVHSIPLTINKEEALQR
LQTVHSIPITIVKLEAIQR

SEQ ID NO: 35511 - protein, 19 aa, synthetic construct
  source 1..19: note = Seed: LQTVHSIPLTINKEEALQR
LQTVHSIPITIVKLEALQR

SEQ ID NO: 35512 - protein, 19 aa, synthetic construct
  source 1..19: note = Seed: LQTVHSIPLTINKEEALQR
LQTVHSIPITIVKNEAAQR

SEQ ID NO: 35513 - protein, 19 aa, synthetic construct
  source 1..19: note = Seed: LQTVHSIPLTINKEEALQR
LQTVHSIPITIVKNEAIQR

SEQ ID NO: 35514 - protein, 19 aa, synthetic construct
  source 1..19: note = Seed: LQTVHSIPLTINKEEALQR
LQTVHSIPITIVKNEAVQR

SEQ ID NO: 35515 - protein, 19 aa, synthetic construct
  source 1..19: note = Seed: LQTVHSIPLTINKEEALQR
LQTVHSIPITIVKSEAIQR

SEQ ID NO: 35516 - protein, 19 aa, synthetic construct
  source 1..19: note = Seed: LQTVHSIPLTINKEEALQR
LQTVHSIPITIVKSEALQR

SEQ ID NO: 35517 - protein, 19 aa, synthetic construct
  source 1..19: note = Seed: LQTVHSIPLTINKEEALQR
LQTVHSIPITIVKSEAVQR

SEQ ID NO: 35518 - protein, 19 aa, synthetic construct
  source 1..19: note = Seed: LQTVHSIPLTINKEEALQR
LQTVHSIPITIVKVEAAQR

SEQ ID NO: 35519 - protein, 19 aa, synthetic construct
  source 1..19: note = Seed: LQTVHSIPLTINKEEALQR
LQTVHSIPITIVKVEAIQR

SEQ ID NO: 35520 - protein, 19 aa, synthetic construct
  source 1..19: note = Seed: LQTVHSIPLTINKEEALQR
LQTVHSIPITIVKVEAVQR

SEQ ID NO: 35521 - protein, 19 aa, synthetic construct
  source 1..19: note = Seed: LQTVHSIPLTINKEEALQR
LQTVHSIPITIVKWEALQR

SEQ ID NO: 35522 - protein, 19 aa, synthetic construct
  source 1..19: note = Seed: LQTVHSIPLTINKEEALQR
LQTVHSIPITIVKYEAFQR

SEQ ID NO: 35523 - protein, 19 aa, synthetic construct
  source 1..19: note = Seed: LQTVHSIPLTINKEEALQR
LQTVHSIPITIVKYEAIQR

SEQ ID NO: 35524 - protein, 19 aa, synthetic construct
  source 1..19: note = Seed: LQTVHSIPLTINKEEALQR
LQTVHSIPITIVKYEALQR

SEQ ID NO: 35525 - protein, 19 aa, synthetic construct
  source 1..19: note = Seed: LQTVHSIPLTINKEEALQR
LQTVHSIPITIVKYEAVQR

SEQ ID NO: 35526 - protein, 19 aa, synthetic construct
  source 1..19: note = Seed: LQTVHSIPLTINKEEALQR
LQTVHSIPITIWKAEAAQR

SEQ ID NO: 35527 - protein, 19 aa, synthetic construct
  source 1..19: note = Seed: LQTVHSIPLTINKEEALQR
LQTVHSIPITIWKAEAFQR

SEQ ID NO: 35528 - protein, 19 aa, synthetic construct
  source 1..19: note = Seed: LQTVHSIPLTINKEEALQR
LQTVHSIPITIWKAEAIQR

SEQ ID NO: 35529 - protein, 19 aa, synthetic construct
  source 1..19: note = Seed: LQTVHSIPLTINKEEALQR
LQTVHSIPITIWKAEALQR

SEQ ID NO: 35530 - protein, 19 aa, synthetic construct
  source 1..19: note = Seed: LQTVHSIPLTINKEEALQR
LQTVHSIPITIWKAEAMQR

SEQ ID NO: 35531 - protein, 19 aa, synthetic construct
  source 1..19: note = Seed: LQTVHSIPLTINKEEALQR
LQTVHSIPITIWKAEAVQR

SEQ ID NO: 35532 - protein, 19 aa, synthetic construct
  source 1..19: note = Seed: LQTVHSIPLTINKEEALQR
LQTVHSIPITIWKDEAAQR

SEQ ID NO: 35533 - protein, 19 aa, synthetic construct
  source 1..19: note = Seed: LQTVHSIPLTINKEEALQR
LQTVHSIPITIWKDEAFQR

SEQ ID NO: 35534 - protein, 19 aa, synthetic construct
  source 1..19: note = Seed: LQTVHSIPLTINKEEALQR
LQTVHSIPITIWKDEAIQR

SEQ ID NO: 35535 - protein, 19 aa, synthetic construct
  source 1..19: note = Seed: LQTVHSIPLTINKEEALQR
LQTVHSIPITIWKDEALQR

SEQ ID NO: 35536 - protein, 19 aa, synthetic construct
  source 1..19: note = Seed: LQTVHSIPLTINKEEALQR
LQTVHSIPITIWKDEAMQR

SEQ ID NO: 35537 - protein, 19 aa, synthetic construct
  source 1..19: note = Seed: LQTVHSIPLTINKEEALQR
LQTVHSIPITIWKDEAVQR

SEQ ID NO: 35538 - protein, 19 aa, synthetic construct
  source 1..19: note = Seed: LQTVHSIPLTINKEEALQR
LQTVHSIPITIWKFEAFQR

SEQ ID NO: 35539 - protein, 19 aa, synthetic construct
  source 1..19: note = Seed: LQTVHSIPLTINKEEALQR
LQTVHSIPITIWKFEAIQR

SEQ ID NO: 35540 - protein, 19 aa, synthetic construct
  source 1..19: note = Seed: LQTVHSIPLTINKEEALQR
LQTVHSIPITIWKFEALQR

SEQ ID NO: 35541 - protein, 19 aa, synthetic construct
  source 1..19: note = Seed: LQTVHSIPLTINKEEALQR
LQTVHSIPITIWKFEAVQR

SEQ ID NO: 35542 - protein, 19 aa, synthetic construct
  source 1..19: note = Seed: LQTVHSIPLTINKEEALQR
LQTVHSIPITIWKIEAAQR

SEQ ID NO: 35543 - protein, 19 aa, synthetic construct
  source 1..19: note = Seed: LQTVHSIPLTINKEEALQR
LQTVHSIPITIWKIEAFQR

SEQ ID NO: 35544 - protein, 19 aa, synthetic construct
  source 1..19: note = Seed: LQTVHSIPLTINKEEALQR
LQTVHSIPITIWKIEAIQR

SEQ ID NO: 35545 - protein, 19 aa, synthetic construct
  source 1..19: note = Seed: LQTVHSIPLTINKEEALQR
LQTVHSIPITIWKIEALQR

SEQ ID NO: 35546 - protein, 19 aa, synthetic construct
  source 1..19: note = Seed: LQTVHSIPLTINKEEALQR
LQTVHSIPITIWKIEAMQR

SEQ ID NO: 35547 - protein, 19 aa, synthetic construct
  source 1..19: note = Seed: LQTVHSIPLTINKEEALQR
LQTVHSIPITIWKIEAVQR

SEQ ID NO: 35548 - protein, 19 aa, synthetic construct
  source 1..19: note = Seed: LQTVHSIPLTINKEEALQR
LQTVHSIPITIWKIEAYQR

SEQ ID NO: 35549 - protein, 19 aa, synthetic construct
  source 1..19: note = Seed: LQTVHSIPLTINKEEALQR
LQTVHSIPITIWKLEAAQR

SEQ ID NO: 35550 - protein, 19 aa, synthetic construct
  source 1..19: note = Seed: LQTVHSIPLTINKEEALQR
LQTVHSIPITIWKLEAIQR

SEQ ID NO: 35551 - protein, 19 aa, synthetic construct
  source 1..19: note = Seed: LQTVHSIPLTINKEEALQR
LQTVHSIPITIWKLEAVQR

SEQ ID NO: 35552 - protein, 19 aa, synthetic construct
  source 1..19: note = Seed: LQTVHSIPLTINKEEALQR
LQTVHSIPITIWKNEAIQR

SEQ ID NO: 35553 - protein, 19 aa, synthetic construct
  source 1..19: note = Seed: LQTVHSIPLTINKEEALQR
LQTVHSIPITIWKNEALQR

SEQ ID NO: 35554 - protein, 19 aa, synthetic construct
  source 1..19: note = Seed: LQTVHSIPLTINKEEALQR
LQTVHSIPITIWKNEAVQR

SEQ ID NO: 35555 - protein, 19 aa, synthetic construct
  source 1..19: note = Seed: LQTVHSIPLTINKEEALQR
LQTVHSIPITIWKSEAIQR

SEQ ID NO: 35556 - protein, 19 aa, synthetic construct
  source 1..19: note = Seed: LQTVHSIPLTINKEEALQR
LQTVHSIPITIWKSEAVQR

SEQ ID NO: 35557 - protein, 19 aa, synthetic construct
  source 1..19: note = Seed: LQTVHSIPLTINKEEALQR
LQTVHSIPITIWKVEAAQR

SEQ ID NO: 35558 - protein, 19 aa, synthetic construct
  source 1..19: note = Seed: LQTVHSIPLTINKEEALQR
LQTVHSIPITIWKVEAFQR

SEQ ID NO: 35559 - protein, 19 aa, synthetic construct
  source 1..19: note = Seed: LQTVHSIPLTINKEEALQR
LQTVHSIPITIWKVEAIQR

SEQ ID NO: 35560 - protein, 19 aa, synthetic construct
  source 1..19: note = Seed: LQTVHSIPLTINKEEALQR
LQTVHSIPITIWKVEALQR

SEQ ID NO: 35561 - protein, 19 aa, synthetic construct
  source 1..19: note = Seed: LQTVHSIPLTINKEEALQR
LQTVHSIPITIWKVEAMQR

SEQ ID NO: 35562 - protein, 19 aa, synthetic construct
  source 1..19: note = Seed: LQTVHSIPLTINKEEALQR
LQTVHSIPITIWKVEAVQR

SEQ ID NO: 35563 - protein, 19 aa, synthetic construct
  source 1..19: note = Seed: LQTVHSIPLTINKEEALQR
LQTVHSIPITIYKAEAAQR

SEQ ID NO: 35564 - protein, 19 aa, synthetic construct
  source 1..19: note = Seed: LQTVHSIPLTINKEEALQR
LQTVHSIPITIYKAEAFQR

SEQ ID NO: 35565 - protein, 19 aa, synthetic construct
  source 1..19: note = Seed: LQTVHSIPLTINKEEALQR
LQTVHSIPITIYKAEAIQR

SEQ ID NO: 35566 - protein, 19 aa, synthetic construct
  source 1..19: note = Seed: LQTVHSIPLTINKEEALQR
LQTVHSIPITIYKAEALQR

SEQ ID NO: 35567 - protein, 19 aa, synthetic construct
  source 1..19: note = Seed: LQTVHSIPLTINKEEALQR
LQTVHSIPITIYKAEAMQR

SEQ ID NO: 35568 - protein, 19 aa, synthetic construct
  source 1..19: note = Seed: LQTVHSIPLTINKEEALQR
LQTVHSIPITIYKAEASQR

SEQ ID NO: 35569 - protein, 19 aa, synthetic construct
  source 1..19: note = Seed: LQTVHSIPLTINKEEALQR
LQTVHSIPITIYKAEATQR

SEQ ID NO: 35570 - protein, 19 aa, synthetic construct
  source 1..19: note = Seed: LQTVHSIPLTINKEEALQR
LQTVHSIPITIYKAEAVQR

SEQ ID NO: 35571 - protein, 19 aa, synthetic construct
  source 1..19: note = Seed: LQTVHSIPLTINKEEALQR
LQTVHSIPITIYKAEAYQR

SEQ ID NO: 35572 - protein, 19 aa, synthetic construct
  source 1..19: note = Seed: LQTVHSIPLTINKEEALQR
LQTVHSIPITIYKDEAAQR

SEQ ID NO: 35573 - protein, 19 aa, synthetic construct
  source 1..19: note = Seed: LQTVHSIPLTINKEEALQR
LQTVHSIPITIYKDEAFQR

SEQ ID NO: 35574 - protein, 19 aa, synthetic construct
  source 1..19: note = Seed: LQTVHSIPLTINKEEALQR
LQTVHSIPITIYKDEAIQR

SEQ ID NO: 35575 - protein, 19 aa, synthetic construct
  source 1..19: note = Seed: LQTVHSIPLTINKEEALQR
LQTVHSIPITIYKDEALQR

SEQ ID NO: 35576 - protein, 19 aa, synthetic construct
  source 1..19: note = Seed: LQTVHSIPLTINKEEALQR
LQTVHSIPITIYKDEAMQR

SEQ ID NO: 35577 - protein, 19 aa, synthetic construct
  source 1..19: note = Seed: LQTVHSIPLTINKEEALQR
LQTVHSIPITIYKDEASQR

SEQ ID NO: 35578 - protein, 19 aa, synthetic construct
  source 1..19: note = Seed: LQTVHSIPLTINKEEALQR
LQTVHSIPITIYKDEAVQR

SEQ ID NO: 35579 - protein, 19 aa, synthetic construct
  source 1..19: note = Seed: LQTVHSIPLTINKEEALQR
LQTVHSIPITIYKDEAYQR

SEQ ID NO: 35580 - protein, 19 aa, synthetic construct
  source 1..19: note = Seed: LQTVHSIPLTINKEEALQR
LQTVHSIPITIYKFEAFQR

SEQ ID NO: 35581 - protein, 19 aa, synthetic construct
  source 1..19: note = Seed: LQTVHSIPLTINKEEALQR
LQTVHSIPITIYKFEAIQR

SEQ ID NO: 35582 - protein, 19 aa, synthetic construct
  source 1..19: note = Seed: LQTVHSIPLTINKEEALQR
LQTVHSIPITIYKFEALQR

SEQ ID NO: 35583 - protein, 19 aa, synthetic construct
  source 1..19: note = Seed: LQTVHSIPLTINKEEALQR
LQTVHSIPITIYKFEAMQR

SEQ ID NO: 35584 - protein, 19 aa, synthetic construct
  source 1..19: note = Seed: LQTVHSIPLTINKEEALQR
LQTVHSIPITIYKFEAVQR

SEQ ID NO: 35585 - protein, 19 aa, synthetic construct
  source 1..19: note = Seed: LQTVHSIPLTINKEEALQR
LQTVHSIPITIYKIEAAQR

SEQ ID NO: 35586 - protein, 19 aa, synthetic construct
  source 1..19: note = Seed: LQTVHSIPLTINKEEALQR
LQTVHSIPITIYKIEAFQR

SEQ ID NO: 35587 - protein, 19 aa, synthetic construct
  source 1..19: note = Seed: LQTVHSIPLTINKEEALQR
LQTVHSIPITIYKIEAGQR

SEQ ID NO: 35588 - protein, 19 aa, synthetic construct
  source 1..19: note = Seed: LQTVHSIPLTINKEEALQR
LQTVHSIPITIYKIEAIQR

SEQ ID NO: 35589 - protein, 19 aa, synthetic construct
  source 1..19: note = Seed: LQTVHSIPLTINKEEALQR
LQTVHSIPITIYKIEALQR

SEQ ID NO: 35590 - protein, 19 aa, synthetic construct
  source 1..19: note = Seed: LQTVHSIPLTINKEEALQR
LQTVHSIPITIYKIEAMQR

SEQ ID NO: 35591 - protein, 19 aa, synthetic construct
  source 1..19: note = Seed: LQTVHSIPLTINKEEALQR
LQTVHSIPITIYKIEANQR

SEQ ID NO: 35592 - protein, 19 aa, synthetic construct
  source 1..19: note = Seed: LQTVHSIPLTINKEEALQR
LQTVHSIPITIYKIEAQQR

SEQ ID NO: 35593 - protein, 19 aa, synthetic construct
  source 1..19: note = Seed: LQTVHSIPLTINKEEALQR
LQTVHSIPITIYKIEASQR

SEQ ID NO: 35594 - protein, 19 aa, synthetic construct
  source 1..19: note = Seed: LQTVHSIPLTINKEEALQR
LQTVHSIPITIYKIEATQR

SEQ ID NO: 35595 - protein, 19 aa, synthetic construct
  source 1..19: note = Seed: LQTVHSIPLTINKEEALQR
LQTVHSIPITIYKIEAVQR

SEQ ID NO: 35596 - protein, 19 aa, synthetic construct
  source 1..19: note = Seed: LQTVHSIPLTINKEEALQR
LQTVHSIPITIYKIEAYQR

SEQ ID NO: 35597 - protein, 19 aa, synthetic construct
  source 1..19: note = Seed: LQTVHSIPLTINKEEALQR
LQTVHSIPITIYKLEAAQR

SEQ ID NO: 35598 - protein, 19 aa, synthetic construct
  source 1..19: note = Seed: LQTVHSIPLTINKEEALQR
LQTVHSIPITIYKLEAIQR

SEQ ID NO: 35599 - protein, 19 aa, synthetic construct
  source 1..19: note = Seed: LQTVHSIPLTINKEEALQR
LQTVHSIPITIYKLEALQR

SEQ ID NO: 35600 - protein, 19 aa, synthetic construct
  source 1..19: note = Seed: LQTVHSIPLTINKEEALQR
LQTVHSIPITIYKLEAMQR

SEQ ID NO: 35601 - protein, 19 aa, synthetic construct
  source 1..19: note = Seed: LQTVHSIPLTINKEEALQR
LQTVHSIPITIYKLEASQR

SEQ ID NO: 35602 - protein, 19 aa, synthetic construct
  source 1..19: note = Seed: LQTVHSIPLTINKEEALQR
LQTVHSIPITIYKLEAVQR

SEQ ID NO: 35603 - protein, 19 aa, synthetic construct
  source 1..19: note = Seed: LQTVHSIPLTINKEEALQR
LQTVHSIPITIYKMEAAQR

SEQ ID NO: 35604 - protein, 19 aa, synthetic construct
  source 1..19: note = Seed: LQTVHSIPLTINKEEALQR
LQTVHSIPITIYKMEAIQR

SEQ ID NO: 35605 - protein, 19 aa, synthetic construct
  source 1..19: note = Seed: LQTVHSIPLTINKEEALQR
LQTVHSIPITIYKMEALQR

SEQ ID NO: 35606 - protein, 19 aa, synthetic construct
  source 1..19: note = Seed: LQTVHSIPLTINKEEALQR
LQTVHSIPITIYKMEAMQR

SEQ ID NO: 35607 - protein, 19 aa, synthetic construct
  source 1..19: note = Seed: LQTVHSIPLTINKEEALQR
LQTVHSIPITIYKMEAVQR

SEQ ID NO: 35608 - protein, 19 aa, synthetic construct
  source 1..19: note = Seed: LQTVHSIPLTINKEEALQR
LQTVHSIPITIYKNEAAQR

SEQ ID NO: 35609 - protein, 19 aa, synthetic construct
  source 1..19: note = Seed: LQTVHSIPLTINKEEALQR
LQTVHSIPITIYKNEAFQR

SEQ ID NO: 35610 - protein, 19 aa, synthetic construct
  source 1..19: note = Seed: LQTVHSIPLTINKEEALQR
LQTVHSIPITIYKNEAIQR

SEQ ID NO: 35611 - protein, 19 aa, synthetic construct
  source 1..19: note = Seed: LQTVHSIPLTINKEEALQR
LQTVHSIPITIYKNEALQR

SEQ ID NO: 35612 - protein, 19 aa, synthetic construct
  source 1..19: note = Seed: LQTVHSIPLTINKEEALQR
LQTVHSIPITIYKNEAMQR

SEQ ID NO: 35613 - protein, 19 aa, synthetic construct
  source 1..19: note = Seed: LQTVHSIPLTINKEEALQR
LQTVHSIPITIYKNEAVQR

SEQ ID NO: 35614 - protein, 19 aa, synthetic construct
  source 1..19: note = Seed: LQTVHSIPLTINKEEALQR
LQTVHSIPITIYKSEAAQR

SEQ ID NO: 35615 - protein, 19 aa, synthetic construct
  source 1..19: note = Seed: LQTVHSIPLTINKEEALQR
LQTVHSIPITIYKSEAIQR

SEQ ID NO: 35616 - protein, 19 aa, synthetic construct
  source 1..19: note = Seed: LQTVHSIPLTINKEEALQR
LQTVHSIPITIYKSEALQR

SEQ ID NO: 35617 - protein, 19 aa, synthetic construct
  source 1..19: note = Seed: LQTVHSIPLTINKEEALQR
LQTVHSIPITIYKSEAVQR

SEQ ID NO: 35618 - protein, 19 aa, synthetic construct
  source 1..19: note = Seed: LQTVHSIPLTINKEEALQR
LQTVHSIPITIYKTEAAQR

SEQ ID NO: 35619 - protein, 19 aa, synthetic construct
  source 1..19: note = Seed: LQTVHSIPLTINKEEALQR
LQTVHSIPITIYKTEAIQR

SEQ ID NO: 35620 - protein, 19 aa, synthetic construct
  source 1..19: note = Seed: LQTVHSIPLTINKEEALQR
LQTVHSIPITIYKTEALQR

SEQ ID NO: 35621 - protein, 19 aa, synthetic construct
  source 1..19: note = Seed: LQTVHSIPLTINKEEALQR
LQTVHSIPITIYKTEAVQR

SEQ ID NO: 35622 - protein, 19 aa, synthetic construct
  source 1..19: note = Seed: LQTVHSIPLTINKEEALQR
LQTVHSIPITIYKVEAAQR

SEQ ID NO: 35623 - protein, 19 aa, synthetic construct
  source 1..19: note = Seed: LQTVHSIPLTINKEEALQR
LQTVHSIPITIYKVEAFQR

SEQ ID NO: 35624 - protein, 19 aa, synthetic construct
  source 1..19: note = Seed: LQTVHSIPLTINKEEALQR
LQTVHSIPITIYKVEAIQR

SEQ ID NO: 35625 - protein, 19 aa, synthetic construct
  source 1..19: note = Seed: LQTVHSIPLTINKEEALQR
LQTVHSIPITIYKVEALQR

SEQ ID NO: 35626 - protein, 19 aa, synthetic construct
  source 1..19: note = Seed: LQTVHSIPLTINKEEALQR
LQTVHSIPITIYKVEAMQR

SEQ ID NO: 35627 - protein, 19 aa, synthetic construct
  source 1..19: note = Seed: LQTVHSIPLTINKEEALQR
LQTVHSIPITIYKVEASQR

SEQ ID NO: 35628 - protein, 19 aa, synthetic construct
  source 1..19: note = Seed: LQTVHSIPLTINKEEALQR
LQTVHSIPITIYKVEATQR

SEQ ID NO: 35629 - protein, 19 aa, synthetic construct
  source 1..19: note = Seed: LQTVHSIPLTINKEEALQR
LQTVHSIPITIYKVEAVQR

SEQ ID NO: 35630 - protein, 19 aa, synthetic construct
  source 1..19: note = Seed: LQTVHSIPLTINKEEALQR
LQTVHSIPITIYKVEAYQR

SEQ ID NO: 35631 - protein, 19 aa, synthetic construct
  source 1..19: note = Seed: LQTVHSIPLTINKEEALQR
LQTVHSIPLTIAKAEAAQR

SEQ ID NO: 35632 - protein, 19 aa, synthetic construct
  source 1..19: note = Seed: LQTVHSIPLTINKEEALQR
LQTVHSIPLTIAKAEAIQR

SEQ ID NO: 35633 - protein, 19 aa, synthetic construct
  source 1..19: note = Seed: LQTVHSIPLTINKEEALQR
LQTVHSIPLTIAKAEALQR

SEQ ID NO: 35634 - protein, 19 aa, synthetic construct
  source 1..19: note = Seed: LQTVHSIPLTINKEEALQR
LQTVHSIPLTIAKAEAVQR

SEQ ID NO: 35635 - protein, 19 aa, synthetic construct
  source 1..19: note = Seed: LQTVHSIPLTINKEEALQR
LQTVHSIPLTIAKFEAAQR

SEQ ID NO: 35636 - protein, 19 aa, synthetic construct
  source 1..19: note = Seed: LQTVHSIPLTINKEEALQR
LQTVHSIPLTIAKFEAFQR

SEQ ID NO: 35637 - protein, 19 aa, synthetic construct
  source 1..19: note = Seed: LQTVHSIPLTINKEEALQR
LQTVHSIPLTIAKFEAIQR

SEQ ID NO: 35638 - protein, 19 aa, synthetic construct
  source 1..19: note = Seed: LQTVHSIPLTINKEEALQR
LQTVHSIPLTIAKFEALQR

SEQ ID NO: 35639 - protein, 19 aa, synthetic construct
  source 1..19: note = Seed: LQTVHSIPLTINKEEALQR
LQTVHSIPLTIAKFEAMQR

SEQ ID NO: 35640 - protein, 19 aa, synthetic construct
  source 1..19: note = Seed: LQTVHSIPLTINKEEALQR
LQTVHSIPLTIAKFEASQR

SEQ ID NO: 35641 - protein, 19 aa, synthetic construct
  source 1..19: note = Seed: LQTVHSIPLTINKEEALQR
LQTVHSIPLTIAKFEATQR

SEQ ID NO: 35642 - protein, 19 aa, synthetic construct
  source 1..19: note = Seed: LQTVHSIPLTINKEEALQR
LQTVHSIPLTIAKFEAVQR

SEQ ID NO: 35643 - protein, 19 aa, synthetic construct
  source 1..19: note = Seed: LQTVHSIPLTINKEEALQR
LQTVHSIPLTIAKFEAYQR

SEQ ID NO: 35644 - protein, 19 aa, synthetic construct
  source 1..19: note = Seed: LQTVHSIPLTINKEEALQR
LQTVHSIPLTIAKGEAAQR

SEQ ID NO: 35645 - protein, 19 aa, synthetic construct
  source 1..19: note = Seed: LQTVHSIPLTINKEEALQR
LQTVHSIPLTIAKGEAIQR

SEQ ID NO: 35646 - protein, 19 aa, synthetic construct
  source 1..19: note = Seed: LQTVHSIPLTINKEEALQR
LQTVHSIPLTIAKGEALQR

SEQ ID NO: 35647 - protein, 19 aa, synthetic construct
  source 1..19: note = Seed: LQTVHSIPLTINKEEALQR
LQTVHSIPLTIAKGEAVQR

SEQ ID NO: 35648 - protein, 19 aa, synthetic construct
  source 1..19: note = Seed: LQTVHSIPLTINKEEALQR
LQTVHSIPLTIAKIEAAQR

SEQ ID NO: 35649 - protein, 19 aa, synthetic construct
  source 1..19: note = Seed: LQTVHSIPLTINKEEALQR
LQTVHSIPLTIAKIEAIQR

SEQ ID NO: 35650 - protein, 19 aa, synthetic construct
  source 1..19: note = Seed: LQTVHSIPLTINKEEALQR
LQTVHSIPLTIAKIEAVQR

SEQ ID NO: 35651 - protein, 19 aa, synthetic construct
  source 1..19: note = Seed: LQTVHSIPLTINKEEALQR
LQTVHSIPLTIAKSEAIQR

SEQ ID NO: 35652 - protein, 19 aa, synthetic construct
  source 1..19: note = Seed: LQTVHSIPLTINKEEALQR
LQTVHSIPLTIAKSEALQR

SEQ ID NO: 35653 - protein, 19 aa, synthetic construct
  source 1..19: note = Seed: LQTVHSIPLTINKEEALQR
LQTVHSIPLTIAKSEAVQR

SEQ ID NO: 35654 - protein, 19 aa, synthetic construct
  source 1..19: note = Seed: LQTVHSIPLTINKEEALQR
LQTVHSIPLTIAKYEALQR

SEQ ID NO: 35655 - protein, 19 aa, synthetic construct
  source 1..19: note = Seed: LQTVHSIPLTINKEEALQR
LQTVHSIPLTICKFEAFQR

SEQ ID NO: 35656 - protein, 19 aa, synthetic construct
  source 1..19: note = Seed: LQTVHSIPLTINKEEALQR
LQTVHSIPLTICKFEAIQR

SEQ ID NO: 35657 - protein, 19 aa, synthetic construct
  source 1..19: note = Seed: LQTVHSIPLTINKEEALQR
LQTVHSIPLTICKFEALQR

SEQ ID NO: 35658 - protein, 19 aa, synthetic construct
  source 1..19: note = Seed: LQTVHSIPLTINKEEALQR
LQTVHSIPLTICKFEAVQR

SEQ ID NO: 35659 - protein, 19 aa, synthetic construct
  source 1..19: note = Seed: LQTVHSIPLTINKEEALQR
LQTVHSIPLTIDKFEAFQR

SEQ ID NO: 35660 - protein, 19 aa, synthetic construct
  source 1..19: note = Seed: LQTVHSIPLTINKEEALQR
LQTVHSIPLTIDKFEAIQR

SEQ ID NO: 35661 - protein, 19 aa, synthetic construct
  source 1..19: note = Seed: LQTVHSIPLTINKEEALQR
LQTVHSIPLTIDKFEALQR

SEQ ID NO: 35662 - protein, 19 aa, synthetic construct
  source 1..19: note = Seed: LQTVHSIPLTINKEEALQR
LQTVHSIPLTIDKFEAVQR

SEQ ID NO: 35663 - protein, 19 aa, synthetic construct
  source 1..19: note = Seed: LQTVHSIPLTINKEEALQR
LQTVHSIPLTIEKFEAAQR

SEQ ID NO: 35664 - protein, 19 aa, synthetic construct
  source 1..19: note = Seed: LQTVHSIPLTINKEEALQR
LQTVHSIPLTIEKFEAFQR

SEQ ID NO: 35665 - protein, 19 aa, synthetic construct
  source 1..19: note = Seed: LQTVHSIPLTINKEEALQR
LQTVHSIPLTIEKFEAIQR

SEQ ID NO: 35666 - protein, 19 aa, synthetic construct
  source 1..19: note = Seed: LQTVHSIPLTINKEEALQR
LQTVHSIPLTIEKFEALQR

SEQ ID NO: 35667 - protein, 19 aa, synthetic construct
  source 1..19: note = Seed: LQTVHSIPLTINKEEALQR
LQTVHSIPLTIEKFEAMQR

SEQ ID NO: 35668 - protein, 19 aa, synthetic construct
  source 1..19: note = Seed: LQTVHSIPLTINKEEALQR
LQTVHSIPLTIEKFEATQR

SEQ ID NO: 35669 - protein, 19 aa, synthetic construct
  source 1..19: note = Seed: LQTVHSIPLTINKEEALQR
LQTVHSIPLTIEKFEAVQR

SEQ ID NO: 35670 - protein, 19 aa, synthetic construct
  source 1..19: note = Seed: LQTVHSIPLTINKEEALQR
LQTVHSIPLTIEKFEAYQR

SEQ ID NO: 35671 - protein, 19 aa, synthetic construct
  source 1..19: note = Seed: LQTVHSIPLTINKEEALQR
LQTVHSIPLTIFKAEAAQR

SEQ ID NO: 35672 - protein, 19 aa, synthetic construct
  source 1..19: note = Seed: LQTVHSIPLTINKEEALQR
LQTVHSIPLTIFKAEAFQR

SEQ ID NO: 35673 - protein, 19 aa, synthetic construct
  source 1..19: note = Seed: LQTVHSIPLTINKEEALQR
LQTVHSIPLTIFKAEAIQR

SEQ ID NO: 35674 - protein, 19 aa, synthetic construct
  source 1..19: note = Seed: LQTVHSIPLTINKEEALQR
LQTVHSIPLTIFKAEALQR

SEQ ID NO: 35675 - protein, 19 aa, synthetic construct
  source 1..19: note = Seed: LQTVHSIPLTINKEEALQR
LQTVHSIPLTIFKAEAMQR

SEQ ID NO: 35676 - protein, 19 aa, synthetic construct
  source 1..19: note = Seed: LQTVHSIPLTINKEEALQR
LQTVHSIPLTIFKAEAVQR

SEQ ID NO: 35677 - protein, 19 aa, synthetic construct
  source 1..19: note = Seed: LQTVHSIPLTINKEEALQR
LQTVHSIPLTIFKDEAAQR

SEQ ID NO: 35678 - protein, 19 aa, synthetic construct
  source 1..19: note = Seed: LQTVHSIPLTINKEEALQR
LQTVHSIPLTIFKDEAFQR

SEQ ID NO: 35679 - protein, 19 aa, synthetic construct
  source 1..19: note = Seed: LQTVHSIPLTINKEEALQR
LQTVHSIPLTIFKDEAIQR

SEQ ID NO: 35680 - protein, 19 aa, synthetic construct
  source 1..19: note = Seed: LQTVHSIPLTINKEEALQR
LQTVHSIPLTIFKDEALQR

SEQ ID NO: 35681 - protein, 19 aa, synthetic construct
  source 1..19: note = Seed: LQTVHSIPLTINKEEALQR
LQTVHSIPLTIFKDEAMQR

SEQ ID NO: 35682 - protein, 19 aa, synthetic construct
  source 1..19: note = Seed: LQTVHSIPLTINKEEALQR
LQTVHSIPLTIFKDEASQR

SEQ ID NO: 35683 - protein, 19 aa, synthetic construct
  source 1..19: note = Seed: LQTVHSIPLTINKEEALQR
LQTVHSIPLTIFKDEAVQR

SEQ ID NO: 35684 - protein, 19 aa, synthetic construct
  source 1..19: note = Seed: LQTVHSIPLTINKEEALQR
LQTVHSIPLTIFKFEAAQR

SEQ ID NO: 35685 - protein, 19 aa, synthetic construct
  source 1..19: note = Seed: LQTVHSIPLTINKEEALQR
LQTVHSIPLTIFKFEADQR

SEQ ID NO: 35686 - protein, 19 aa, synthetic construct
  source 1..19: note = Seed: LQTVHSIPLTINKEEALQR
LQTVHSIPLTIFKFEAEQR

SEQ ID NO: 35687 - protein, 19 aa, synthetic construct
  source 1..19: note = Seed: LQTVHSIPLTINKEEALQR
LQTVHSIPLTIFKFEAFQR

SEQ ID NO: 35688 - protein, 19 aa, synthetic construct
  source 1..19: note = Seed: LQTVHSIPLTINKEEALQR
LQTVHSIPLTIFKFEAHQR

SEQ ID NO: 35689 - protein, 19 aa, synthetic construct
  source 1..19: note = Seed: LQTVHSIPLTINKEEALQR
LQTVHSIPLTIFKFEAIQR

SEQ ID NO: 35690 - protein, 19 aa, synthetic construct
  source 1..19: note = Seed: LQTVHSIPLTINKEEALQR
LQTVHSIPLTIFKFEAKQR

SEQ ID NO: 35691 - protein, 19 aa, synthetic construct
  source 1..19: note = Seed: LQTVHSIPLTINKEEALQR
LQTVHSIPLTIFKFEALQR

SEQ ID NO: 35692 - protein, 19 aa, synthetic construct
  source 1..19: note = Seed: LQTVHSIPLTINKEEALQR
LQTVHSIPLTIFKFEAMQR

SEQ ID NO: 35693 - protein, 19 aa, synthetic construct
  source 1..19: note = Seed: LQTVHSIPLTINKEEALQR
LQTVHSIPLTIFKFEANQR

SEQ ID NO: 35694 - protein, 19 aa, synthetic construct
  source 1..19: note = Seed: LQTVHSIPLTINKEEALQR
LQTVHSIPLTIFKFEAPQR

SEQ ID NO: 35695 - protein, 19 aa, synthetic construct
  source 1..19: note = Seed: LQTVHSIPLTINKEEALQR
LQTVHSIPLTIFKFEAQQR

SEQ ID NO: 35696 - protein, 19 aa, synthetic construct
  source 1..19: note = Seed: LQTVHSIPLTINKEEALQR
LQTVHSIPLTIFKFEARQR

SEQ ID NO: 35697 - protein, 19 aa, synthetic construct
  source 1..19: note = Seed: LQTVHSIPLTINKEEALQR
LQTVHSIPLTIFKFEASQR

SEQ ID NO: 35698 - protein, 19 aa, synthetic construct
  source 1..19: note = Seed: LQTVHSIPLTINKEEALQR
LQTVHSIPLTIFKFEATQR

SEQ ID NO: 35699 - protein, 19 aa, synthetic construct
  source 1..19: note = Seed: LQTVHSIPLTINKEEALQR
LQTVHSIPLTIFKFEAVQR

SEQ ID NO: 35700 - protein, 19 aa, synthetic construct
  source 1..19: note = Seed: LQTVHSIPLTINKEEALQR
LQTVHSIPLTIFKFEAYQR

SEQ ID NO: 35701 - protein, 19 aa, synthetic construct
  source 1..19: note = Seed: LQTVHSIPLTINKEEALQR
LQTVHSIPLTIFKIEAAQR

SEQ ID NO: 35702 - protein, 19 aa, synthetic construct
  source 1..19: note = Seed: LQTVHSIPLTINKEEALQR
LQTVHSIPLTIFKIEAEQR

SEQ ID NO: 35703 - protein, 19 aa, synthetic construct
  source 1..19: note = Seed: LQTVHSIPLTINKEEALQR
LQTVHSIPLTIFKIEAFQR

SEQ ID NO: 35704 - protein, 19 aa, synthetic construct
  source 1..19: note = Seed: LQTVHSIPLTINKEEALQR
LQTVHSIPLTIFKIEAGQR

SEQ ID NO: 35705 - protein, 19 aa, synthetic construct
  source 1..19: note = Seed: LQTVHSIPLTINKEEALQR
LQTVHSIPLTIFKIEAIQR

SEQ ID NO: 35706 - protein, 19 aa, synthetic construct
  source 1..19: note = Seed: LQTVHSIPLTINKEEALQR
LQTVHSIPLTIFKIEALQR

SEQ ID NO: 35707 - protein, 19 aa, synthetic construct
  source 1..19: note = Seed: LQTVHSIPLTINKEEALQR
LQTVHSIPLTIFKIEAMQR

SEQ ID NO: 35708 - protein, 19 aa, synthetic construct
  source 1..19: note = Seed: LQTVHSIPLTINKEEALQR
LQTVHSIPLTIFKIEARQR

SEQ ID NO: 35709 - protein, 19 aa, synthetic construct
  source 1..19: note = Seed: LQTVHSIPLTINKEEALQR
LQTVHSIPLTIFKIEASQR

SEQ ID NO: 35710 - protein, 19 aa, synthetic construct
  source 1..19: note = Seed: LQTVHSIPLTINKEEALQR
LQTVHSIPLTIFKIEATQR

SEQ ID NO: 35711 - protein, 19 aa, synthetic construct
  source 1..19: note = Seed: LQTVHSIPLTINKEEALQR
LQTVHSIPLTIFKIEAVQR

SEQ ID NO: 35712 - protein, 19 aa, synthetic construct
  source 1..19: note = Seed: LQTVHSIPLTINKEEALQR
LQTVHSIPLTIFKIEAYQR

SEQ ID NO: 35713 - protein, 19 aa, synthetic construct
  source 1..19: note = Seed: LQTVHSIPLTINKEEALQR
LQTVHSIPLTIFKLEAAQR

SEQ ID NO: 35714 - protein, 19 aa, synthetic construct
  source 1..19: note = Seed: LQTVHSIPLTINKEEALQR
LQTVHSIPLTIFKLEADQR

SEQ ID NO: 35715 - protein, 19 aa, synthetic construct
  source 1..19: note = Seed: LQTVHSIPLTINKEEALQR
LQTVHSIPLTIFKLEAEQR

SEQ ID NO: 35716 - protein, 19 aa, synthetic construct
  source 1..19: note = Seed: LQTVHSIPLTINKEEALQR
LQTVHSIPLTIFKLEAFQR

SEQ ID NO: 35717 - protein, 19 aa, synthetic construct
  source 1..19: note = Seed: LQTVHSIPLTINKEEALQR
LQTVHSIPLTIFKLEAIQR

SEQ ID NO: 35718 - protein, 19 aa, synthetic construct
  source 1..19: note = Seed: LQTVHSIPLTINKEEALQR
LQTVHSIPLTIFKLEALQR

SEQ ID NO: 35719 - protein, 19 aa, synthetic construct
  source 1..19: note = Seed: LQTVHSIPLTINKEEALQR
LQTVHSIPLTIFKLEAMQR

SEQ ID NO: 35720 - protein, 19 aa, synthetic construct
  source 1..19: note = Seed: LQTVHSIPLTINKEEALQR
LQTVHSIPLTIFKLEANQR

SEQ ID NO: 35721 - protein, 19 aa, synthetic construct
  source 1..19: note = Seed: LQTVHSIPLTINKEEALQR
LQTVHSIPLTIFKLEAQQR

SEQ ID NO: 35722 - protein, 19 aa, synthetic construct
  source 1..19: note = Seed: LQTVHSIPLTINKEEALQR
LQTVHSIPLTIFKLEARQR

SEQ ID NO: 35723 - protein, 19 aa, synthetic construct
  source 1..19: note = Seed: LQTVHSIPLTINKEEALQR
LQTVHSIPLTIFKLEASQR

SEQ ID NO: 35724 - protein, 19 aa, synthetic construct
  source 1..19: note = Seed: LQTVHSIPLTINKEEALQR
LQTVHSIPLTIFKLEATQR

SEQ ID NO: 35725 - protein, 19 aa, synthetic construct
  source 1..19: note = Seed: LQTVHSIPLTINKEEALQR
LQTVHSIPLTIFKLEAVQR

SEQ ID NO: 35726 - protein, 19 aa, synthetic construct
  source 1..19: note = Seed: LQTVHSIPLTINKEEALQR
LQTVHSIPLTIFKLEAYQR

SEQ ID NO: 35727 - protein, 19 aa, synthetic construct
  source 1..19: note = Seed: LQTVHSIPLTINKEEALQR
LQTVHSIPLTIFKMEAAQR

SEQ ID NO: 35728 - protein, 19 aa, synthetic construct
  source 1..19: note = Seed: LQTVHSIPLTINKEEALQR
LQTVHSIPLTIFKMEAFQR

SEQ ID NO: 35729 - protein, 19 aa, synthetic construct
  source 1..19: note = Seed: LQTVHSIPLTINKEEALQR
LQTVHSIPLTIFKMEAIQR

SEQ ID NO: 35730 - protein, 19 aa, synthetic construct
  source 1..19: note = Seed: LQTVHSIPLTINKEEALQR
LQTVHSIPLTIFKMEALQR

SEQ ID NO: 35731 - protein, 19 aa, synthetic construct
  source 1..19: note = Seed: LQTVHSIPLTINKEEALQR
LQTVHSIPLTIFKMEAMQR

SEQ ID NO: 35732 - protein, 19 aa, synthetic construct
  source 1..19: note = Seed: LQTVHSIPLTINKEEALQR
LQTVHSIPLTIFKMEAVQR

SEQ ID NO: 35733 - protein, 19 aa, synthetic construct
  source 1..19: note = Seed: LQTVHSIPLTINKEEALQR
LQTVHSIPLTIFKMEAYQR

SEQ ID NO: 35734 - protein, 19 aa, synthetic construct
  source 1..19: note = Seed: LQTVHSIPLTINKEEALQR
LQTVHSIPLTIFKNEAAQR

SEQ ID NO: 35735 - protein, 19 aa, synthetic construct
  source 1..19: note = Seed: LQTVHSIPLTINKEEALQR
LQTVHSIPLTIFKNEAIQR

SEQ ID NO: 35736 - protein, 19 aa, synthetic construct
  source 1..19: note = Seed: LQTVHSIPLTINKEEALQR
LQTVHSIPLTIFKNEALQR

SEQ ID NO: 35737 - protein, 19 aa, synthetic construct
  source 1..19: note = Seed: LQTVHSIPLTINKEEALQR
LQTVHSIPLTIFKNEAMQR

SEQ ID NO: 35738 - protein, 19 aa, synthetic construct
  source 1..19: note = Seed: LQTVHSIPLTINKEEALQR
LQTVHSIPLTIFKNEAVQR

SEQ ID NO: 35739 - protein, 19 aa, synthetic construct
  source 1..19: note = Seed: LQTVHSIPLTINKEEALQR
LQTVHSIPLTIFKSEAAQR

SEQ ID NO: 35740 - protein, 19 aa, synthetic construct
  source 1..19: note = Seed: LQTVHSIPLTINKEEALQR
LQTVHSIPLTIFKSEAIQR

SEQ ID NO: 35741 - protein, 19 aa, synthetic construct
  source 1..19: note = Seed: LQTVHSIPLTINKEEALQR
LQTVHSIPLTIFKSEALQR

SEQ ID NO: 35742 - protein, 19 aa, synthetic construct
  source 1..19: note = Seed: LQTVHSIPLTINKEEALQR
LQTVHSIPLTIFKSEAVQR

SEQ ID NO: 35743 - protein, 19 aa, synthetic construct
  source 1..19: note = Seed: LQTVHSIPLTINKEEALQR
LQTVHSIPLTIFKTEAAQR

SEQ ID NO: 35744 - protein, 19 aa, synthetic construct
  source 1..19: note = Seed: LQTVHSIPLTINKEEALQR
LQTVHSIPLTIFKTEAIQR

SEQ ID NO: 35745 - protein, 19 aa, synthetic construct
  source 1..19: note = Seed: LQTVHSIPLTINKEEALQR
LQTVHSIPLTIFKTEAVQR

SEQ ID NO: 35746 - protein, 19 aa, synthetic construct
  source 1..19: note = Seed: LQTVHSIPLTINKEEALQR
LQTVHSIPLTIFKVEAAQR

SEQ ID NO: 35747 - protein, 19 aa, synthetic construct
  source 1..19: note = Seed: LQTVHSIPLTINKEEALQR
LQTVHSIPLTIFKVEAFQR

SEQ ID NO: 35748 - protein, 19 aa, synthetic construct
  source 1..19: note = Seed: LQTVHSIPLTINKEEALQR
LQTVHSIPLTIFKVEAIQR

SEQ ID NO: 35749 - protein, 19 aa, synthetic construct
  source 1..19: note = Seed: LQTVHSIPLTINKEEALQR
LQTVHSIPLTIFKVEALQR

SEQ ID NO: 35750 - protein, 19 aa, synthetic construct
  source 1..19: note = Seed: LQTVHSIPLTINKEEALQR
LQTVHSIPLTIFKVEAMQR

SEQ ID NO: 35751 - protein, 19 aa, synthetic construct
  source 1..19: note = Seed: LQTVHSIPLTINKEEALQR
LQTVHSIPLTIFKVEASQR

SEQ ID NO: 35752 - protein, 19 aa, synthetic construct
  source 1..19: note = Seed: LQTVHSIPLTINKEEALQR
LQTVHSIPLTIFKVEAVQR

SEQ ID NO: 35753 - protein, 19 aa, synthetic construct
  source 1..19: note = Seed: LQTVHSIPLTINKEEALQR
LQTVHSIPLTIFKVEAYQR

SEQ ID NO: 35754 - protein, 19 aa, synthetic construct
  source 1..19: note = Seed: LQTVHSIPLTINKEEALQR
LQTVHSIPLTIFKWEAFQR

SEQ ID NO: 35755 - protein, 19 aa, synthetic construct
  source 1..19: note = Seed: LQTVHSIPLTINKEEALQR
LQTVHSIPLTIFKWEAIQR

SEQ ID NO: 35756 - protein, 19 aa, synthetic construct
  source 1..19: note = Seed: LQTVHSIPLTINKEEALQR
LQTVHSIPLTIFKWEALQR

SEQ ID NO: 35757 - protein, 19 aa, synthetic construct
  source 1..19: note = Seed: LQTVHSIPLTINKEEALQR
LQTVHSIPLTIFKWEAMQR

SEQ ID NO: 35758 - protein, 19 aa, synthetic construct
  source 1..19: note = Seed: LQTVHSIPLTINKEEALQR
LQTVHSIPLTIFKWEAVQR

SEQ ID NO: 35759 - protein, 19 aa, synthetic construct
  source 1..19: note = Seed: LQTVHSIPLTINKEEALQR
LQTVHSIPLTIFKYEAAQR

SEQ ID NO: 35760 - protein, 19 aa, synthetic construct
  source 1..19: note = Seed: LQTVHSIPLTINKEEALQR
LQTVHSIPLTIFKYEAFQR

SEQ ID NO: 35761 - protein, 19 aa, synthetic construct
  source 1..19: note = Seed: LQTVHSIPLTINKEEALQR
LQTVHSIPLTIFKYEAIQR

SEQ ID NO: 35762 - protein, 19 aa, synthetic construct
  source 1..19: note = Seed: LQTVHSIPLTINKEEALQR
LQTVHSIPLTIFKYEALQR

SEQ ID NO: 35763 - protein, 19 aa, synthetic construct
  source 1..19: note = Seed: LQTVHSIPLTINKEEALQR
LQTVHSIPLTIFKYEAMQR

SEQ ID NO: 35764 - protein, 19 aa, synthetic construct
  source 1..19: note = Seed: LQTVHSIPLTINKEEALQR
LQTVHSIPLTIFKYEAVQR

SEQ ID NO: 35765 - protein, 19 aa, synthetic construct
  source 1..19: note = Seed: LQTVHSIPLTINKEEALQR
LQTVHSIPLTIFKYEAYQR

SEQ ID NO: 35766 - protein, 19 aa, synthetic construct
  source 1..19: note = Seed: LQTVHSIPLTINKEEALQR
LQTVHSIPLTIHKFEAAQR

SEQ ID NO: 35767 - protein, 19 aa, synthetic construct
  source 1..19: note = Seed: LQTVHSIPLTINKEEALQR
LQTVHSIPLTIHKFEAFQR

SEQ ID NO: 35768 - protein, 19 aa, synthetic construct
  source 1..19: note = Seed: LQTVHSIPLTINKEEALQR
LQTVHSIPLTIHKFEAIQR

SEQ ID NO: 35769 - protein, 19 aa, synthetic construct
  source 1..19: note = Seed: LQTVHSIPLTINKEEALQR
LQTVHSIPLTIHKFEALQR

SEQ ID NO: 35770 - protein, 19 aa, synthetic construct
  source 1..19: note = Seed: LQTVHSIPLTINKEEALQR
LQTVHSIPLTIHKFEAMQR

SEQ ID NO: 35771 - protein, 19 aa, synthetic construct
  source 1..19: note = Seed: LQTVHSIPLTINKEEALQR
LQTVHSIPLTIHKFEATQR

SEQ ID NO: 35772 - protein, 19 aa, synthetic construct
  source 1..19: note = Seed: LQTVHSIPLTINKEEALQR
LQTVHSIPLTIHKFEAVQR

SEQ ID NO: 35773 - protein, 19 aa, synthetic construct
  source 1..19: note = Seed: LQTVHSIPLTINKEEALQR
LQTVHSIPLTIHKFEAYQR

SEQ ID NO: 35774 - protein, 19 aa, synthetic construct
  source 1..19: note = Seed: LQTVHSIPLTINKEEALQR
LQTVHSIPLTIHKLEAIQR

SEQ ID NO: 35775 - protein, 19 aa, synthetic construct
  source 1..19: note = Seed: LQTVHSIPLTINKEEALQR
LQTVHSIPLTIHKLEALQR

SEQ ID NO: 35776 - protein, 19 aa, synthetic construct
  source 1..19: note = Seed: LQTVHSIPLTINKEEALQR
LQTVHSIPLTIIKAEAAQR

SEQ ID NO: 35777 - protein, 19 aa, synthetic construct
  source 1..19: note = Seed: LQTVHSIPLTINKEEALQR
LQTVHSIPLTIIKAEAIQR

SEQ ID NO: 35778 - protein, 19 aa, synthetic construct
  source 1..19: note = Seed: LQTVHSIPLTINKEEALQR
LQTVHSIPLTIIKAEALQR

SEQ ID NO: 35779 - protein, 19 aa, synthetic construct
  source 1..19: note = Seed: LQTVHSIPLTINKEEALQR
LQTVHSIPLTIIKAEAVQR

SEQ ID NO: 35780 - protein, 19 aa, synthetic construct
  source 1..19: note = Seed: LQTVHSIPLTINKEEALQR
LQTVHSIPLTIIKDEAAQR

SEQ ID NO: 35781 - protein, 19 aa, synthetic construct
  source 1..19: note = Seed: LQTVHSIPLTINKEEALQR
LQTVHSIPLTIIKDEAIQR

SEQ ID NO: 35782 - protein, 19 aa, synthetic construct
  source 1..19: note = Seed: LQTVHSIPLTINKEEALQR
LQTVHSIPLTIIKDEALQR

SEQ ID NO: 35783 - protein, 19 aa, synthetic construct
  source 1..19: note = Seed: LQTVHSIPLTINKEEALQR
LQTVHSIPLTIIKDEAVQR

SEQ ID NO: 35784 - protein, 19 aa, synthetic construct
  source 1..19: note = Seed: LQTVHSIPLTINKEEALQR
LQTVHSIPLTIIKFEAAQR

SEQ ID NO: 35785 - protein, 19 aa, synthetic construct
  source 1..19: note = Seed: LQTVHSIPLTINKEEALQR
LQTVHSIPLTIIKFEACQR

SEQ ID NO: 35786 - protein, 19 aa, synthetic construct
  source 1..19: note = Seed: LQTVHSIPLTINKEEALQR
LQTVHSIPLTIIKFEADQR

SEQ ID NO: 35787 - protein, 19 aa, synthetic construct
  source 1..19: note = Seed: LQTVHSIPLTINKEEALQR
LQTVHSIPLTIIKFEAEQR

SEQ ID NO: 35788 - protein, 19 aa, synthetic construct
  source 1..19: note = Seed: LQTVHSIPLTINKEEALQR
LQTVHSIPLTIIKFEAFQR

SEQ ID NO: 35789 - protein, 19 aa, synthetic construct
  source 1..19: note = Seed: LQTVHSIPLTINKEEALQR
LQTVHSIPLTIIKFEAHQR

SEQ ID NO: 35790 - protein, 19 aa, synthetic construct
  source 1..19: note = Seed: LQTVHSIPLTINKEEALQR
LQTVHSIPLTIIKFEAIQR

SEQ ID NO: 35791 - protein, 19 aa, synthetic construct
  source 1..19: note = Seed: LQTVHSIPLTINKEEALQR
LQTVHSIPLTIIKFEAKQR

SEQ ID NO: 35792 - protein, 19 aa, synthetic construct
  source 1..19: note = Seed: LQTVHSIPLTINKEEALQR
LQTVHSIPLTIIKFEALQR

SEQ ID NO: 35793 - protein, 19 aa, synthetic construct
  source 1..19: note = Seed: LQTVHSIPLTINKEEALQR
LQTVHSIPLTIIKFEAMQR

SEQ ID NO: 35794 - protein, 19 aa, synthetic construct
  source 1..19: note = Seed: LQTVHSIPLTINKEEALQR
LQTVHSIPLTIIKFEANQR

SEQ ID NO: 35795 - protein, 19 aa, synthetic construct
  source 1..19: note = Seed: LQTVHSIPLTINKEEALQR
LQTVHSIPLTIIKFEAPQR

SEQ ID NO: 35796 - protein, 19 aa, synthetic construct
  source 1..19: note = Seed: LQTVHSIPLTINKEEALQR
LQTVHSIPLTIIKFEAQQR

SEQ ID NO: 35797 - protein, 19 aa, synthetic construct
  source 1..19: note = Seed: LQTVHSIPLTINKEEALQR
LQTVHSIPLTIIKFEARQR

SEQ ID NO: 35798 - protein, 19 aa, synthetic construct
  source 1..19: note = Seed: LQTVHSIPLTINKEEALQR
LQTVHSIPLTIIKFEASQR

SEQ ID NO: 35799 - protein, 19 aa, synthetic construct
  source 1..19: note = Seed: LQTVHSIPLTINKEEALQR
LQTVHSIPLTIIKFEATQR

SEQ ID NO: 35800 - protein, 19 aa, synthetic construct
  source 1..19: note = Seed: LQTVHSIPLTINKEEALQR
LQTVHSIPLTIIKFEAVQR

SEQ ID NO: 35801 - protein, 19 aa, synthetic construct
  source 1..19: note = Seed: LQTVHSIPLTINKEEALQR
LQTVHSIPLTIIKFEAWQR

SEQ ID NO: 35802 - protein, 19 aa, synthetic construct
  source 1..19: note = Seed: LQTVHSIPLTINKEEALQR
LQTVHSIPLTIIKFEAYQR

SEQ ID NO: 35803 - protein, 19 aa, synthetic construct
  source 1..19: note = Seed: LQTVHSIPLTINKEEALQR
LQTVHSIPLTIIKGEAAQR

SEQ ID NO: 35804 - protein, 19 aa, synthetic construct
  source 1..19: note = Seed: LQTVHSIPLTINKEEALQR
LQTVHSIPLTIIKGEAIQR

SEQ ID NO: 35805 - protein, 19 aa, synthetic construct
  source 1..19: note = Seed: LQTVHSIPLTINKEEALQR
LQTVHSIPLTIIKGEALQR

SEQ ID NO: 35806 - protein, 19 aa, synthetic construct
  source 1..19: note = Seed: LQTVHSIPLTINKEEALQR
LQTVHSIPLTIIKGEAVQR

SEQ ID NO: 35807 - protein, 19 aa, synthetic construct
  source 1..19: note = Seed: LQTVHSIPLTINKEEALQR
LQTVHSIPLTIIKIEAAQR

SEQ ID NO: 35808 - protein, 19 aa, synthetic construct
  source 1..19: note = Seed: LQTVHSIPLTINKEEALQR
LQTVHSIPLTIIKIEAFQR

SEQ ID NO: 35809 - protein, 19 aa, synthetic construct
  source 1..19: note = Seed: LQTVHSIPLTINKEEALQR
LQTVHSIPLTIIKIEAIQR

SEQ ID NO: 35810 - protein, 19 aa, synthetic construct
  source 1..19: note = Seed: LQTVHSIPLTINKEEALQR
LQTVHSIPLTIIKIEALQR

SEQ ID NO: 35811 - protein, 19 aa, synthetic construct
  source 1..19: note = Seed: LQTVHSIPLTINKEEALQR
LQTVHSIPLTIIKIEAMQR

SEQ ID NO: 35812 - protein, 19 aa, synthetic construct
  source 1..19: note = Seed: LQTVHSIPLTINKEEALQR
LQTVHSIPLTIIKIEAVQR

SEQ ID NO: 35813 - protein, 19 aa, synthetic construct
  source 1..19: note = Seed: LQTVHSIPLTINKEEALQR
LQTVHSIPLTIIKIEAYQR

SEQ ID NO: 35814 - protein, 19 aa, synthetic construct
  source 1..19: note = Seed: LQTVHSIPLTINKEEALQR
LQTVHSIPLTIIKLEAFQR

SEQ ID NO: 35815 - protein, 19 aa, synthetic construct
  source 1..19: note = Seed: LQTVHSIPLTINKEEALQR
LQTVHSIPLTIIKLEAIQR

SEQ ID NO: 35816 - protein, 19 aa, synthetic construct
  source 1..19: note = Seed: LQTVHSIPLTINKEEALQR
LQTVHSIPLTIIKLEALQR

SEQ ID NO: 35817 - protein, 19 aa, synthetic construct
  source 1..19: note = Seed: LQTVHSIPLTINKEEALQR
LQTVHSIPLTIIKLEAMQR

SEQ ID NO: 35818 - protein, 19 aa, synthetic construct
  source 1..19: note = Seed: LQTVHSIPLTINKEEALQR
LQTVHSIPLTIIKLEAVQR

SEQ ID NO: 35819 - protein, 19 aa, synthetic construct
  source 1..19: note = Seed: LQTVHSIPLTINKEEALQR
LQTVHSIPLTIIKLEAYQR

SEQ ID NO: 35820 - protein, 19 aa, synthetic construct
  source 1..19: note = Seed: LQTVHSIPLTINKEEALQR
LQTVHSIPLTIIKMEAFQR

SEQ ID NO: 35821 - protein, 19 aa, synthetic construct
  source 1..19: note = Seed: LQTVHSIPLTINKEEALQR
LQTVHSIPLTIIKMEAIQR

SEQ ID NO: 35822 - protein, 19 aa, synthetic construct
  source 1..19: note = Seed: LQTVHSIPLTINKEEALQR
LQTVHSIPLTIIKMEALQR

SEQ ID NO: 35823 - protein, 19 aa, synthetic construct
  source 1..19: note = Seed: LQTVHSIPLTINKEEALQR
LQTVHSIPLTIIKMEAVQR

SEQ ID NO: 35824 - protein, 19 aa, synthetic construct
  source 1..19: note = Seed: LQTVHSIPLTINKEEALQR
LQTVHSIPLTIIKNEAIQR

SEQ ID NO: 35825 - protein, 19 aa, synthetic construct
  source 1..19: note = Seed: LQTVHSIPLTINKEEALQR
LQTVHSIPLTIIKNEAVQR

SEQ ID NO: 35826 - protein, 19 aa, synthetic construct
  source 1..19: note = Seed: LQTVHSIPLTINKEEALQR
LQTVHSIPLTIIKSEAAQR

SEQ ID NO: 35827 - protein, 19 aa, synthetic construct
  source 1..19: note = Seed: LQTVHSIPLTINKEEALQR
LQTVHSIPLTIIKSEAIQR

SEQ ID NO: 35828 - protein, 19 aa, synthetic construct
  source 1..19: note = Seed: LQTVHSIPLTINKEEALQR
LQTVHSIPLTIIKSEALQR

SEQ ID NO: 35829 - protein, 19 aa, synthetic construct
  source 1..19: note = Seed: LQTVHSIPLTINKEEALQR
LQTVHSIPLTIIKSEAVQR

SEQ ID NO: 35830 - protein, 19 aa, synthetic construct
  source 1..19: note = Seed: LQTVHSIPLTINKEEALQR
LQTVHSIPLTIIKVEAAQR

SEQ ID NO: 35831 - protein, 19 aa, synthetic construct
  source 1..19: note = Seed: LQTVHSIPLTINKEEALQR
LQTVHSIPLTIIKVEAIQR

SEQ ID NO: 35832 - protein, 19 aa, synthetic construct
  source 1..19: note = Seed: LQTVHSIPLTINKEEALQR
LQTVHSIPLTIIKVEALQR

SEQ ID NO: 35833 - protein, 19 aa, synthetic construct
  source 1..19: note = Seed: LQTVHSIPLTINKEEALQR
LQTVHSIPLTIIKVEAVQR

SEQ ID NO: 35834 - protein, 19 aa, synthetic construct
  source 1..19: note = Seed: LQTVHSIPLTINKEEALQR
LQTVHSIPLTIIKWEAFQR

SEQ ID NO: 35835 - protein, 19 aa, synthetic construct
  source 1..19: note = Seed: LQTVHSIPLTINKEEALQR
LQTVHSIPLTIIKWEAIQR

SEQ ID NO: 35836 - protein, 19 aa, synthetic construct
  source 1..19: note = Seed: LQTVHSIPLTINKEEALQR
LQTVHSIPLTIIKWEALQR

SEQ ID NO: 35837 - protein, 19 aa, synthetic construct
  source 1..19: note = Seed: LQTVHSIPLTINKEEALQR
LQTVHSIPLTIIKWEAMQR

SEQ ID NO: 35838 - protein, 19 aa, synthetic construct
  source 1..19: note = Seed: LQTVHSIPLTINKEEALQR
LQTVHSIPLTIIKWEAVQR

SEQ ID NO: 35839 - protein, 19 aa, synthetic construct
  source 1..19: note = Seed: LQTVHSIPLTINKEEALQR
LQTVHSIPLTIIKYEAFQR

SEQ ID NO: 35840 - protein, 19 aa, synthetic construct
  source 1..19: note = Seed: LQTVHSIPLTINKEEALQR
LQTVHSIPLTIIKYEAIQR

SEQ ID NO: 35841 - protein, 19 aa, synthetic construct
  source 1..19: note = Seed: LQTVHSIPLTINKEEALQR
LQTVHSIPLTIIKYEALQR

SEQ ID NO: 35842 - protein, 19 aa, synthetic construct
  source 1..19: note = Seed: LQTVHSIPLTINKEEALQR
LQTVHSIPLTIIKYEAMQR

SEQ ID NO: 35843 - protein, 19 aa, synthetic construct
  source 1..19: note = Seed: LQTVHSIPLTINKEEALQR
LQTVHSIPLTIIKYEAVQR

SEQ ID NO: 35844 - protein, 19 aa, synthetic construct
  source 1..19: note = Seed: LQTVHSIPLTINKEEALQR
LQTVHSIPLTIIKYEAYQR

SEQ ID NO: 35845 - protein, 19 aa, synthetic construct
  source 1..19: note = Seed: LQTVHSIPLTINKEEALQR
LQTVHSIPLTIKKFEAIQR

SEQ ID NO: 35846 - protein, 19 aa, synthetic construct
  source 1..19: note = Seed: LQTVHSIPLTINKEEALQR
LQTVHSIPLTIKKFEALQR

SEQ ID NO: 35847 - protein, 19 aa, synthetic construct
  source 1..19: note = Seed: LQTVHSIPLTINKEEALQR
LQTVHSIPLTILKAEAAQR

SEQ ID NO: 35848 - protein, 19 aa, synthetic construct
  source 1..19: note = Seed: LQTVHSIPLTINKEEALQR
LQTVHSIPLTILKAEAIQR

SEQ ID NO: 35849 - protein, 19 aa, synthetic construct
  source 1..19: note = Seed: LQTVHSIPLTINKEEALQR
LQTVHSIPLTILKAEALQR

SEQ ID NO: 35850 - protein, 19 aa, synthetic construct
  source 1..19: note = Seed: LQTVHSIPLTINKEEALQR
LQTVHSIPLTILKAEAMQR

SEQ ID NO: 35851 - protein, 19 aa, synthetic construct
  source 1..19: note = Seed: LQTVHSIPLTINKEEALQR
LQTVHSIPLTILKAEASQR

SEQ ID NO: 35852 - protein, 19 aa, synthetic construct
  source 1..19: note = Seed: LQTVHSIPLTINKEEALQR
LQTVHSIPLTILKAEATQR

SEQ ID NO: 35853 - protein, 19 aa, synthetic construct
  source 1..19: note = Seed: LQTVHSIPLTINKEEALQR
LQTVHSIPLTILKAEAVQR

SEQ ID NO: 35854 - protein, 19 aa, synthetic construct
  source 1..19: note = Seed: LQTVHSIPLTINKEEALQR
LQTVHSIPLTILKFEAAQR

SEQ ID NO: 35855 - protein, 19 aa, synthetic construct
  source 1..19: note = Seed: LQTVHSIPLTINKEEALQR
LQTVHSIPLTILKFEADQR

SEQ ID NO: 35856 - protein, 19 aa, synthetic construct
  source 1..19: note = Seed: LQTVHSIPLTINKEEALQR
LQTVHSIPLTILKFEAEQR

SEQ ID NO: 35857 - protein, 19 aa, synthetic construct
  source 1..19: note = Seed: LQTVHSIPLTINKEEALQR
LQTVHSIPLTILKFEAFQR

SEQ ID NO: 35858 - protein, 19 aa, synthetic construct
  source 1..19: note = Seed: LQTVHSIPLTINKEEALQR
LQTVHSIPLTILKFEAHQR

SEQ ID NO: 35859 - protein, 19 aa, synthetic construct
  source 1..19: note = Seed: LQTVHSIPLTINKEEALQR
LQTVHSIPLTILKFEAIQR

SEQ ID NO: 35860 - protein, 19 aa, synthetic construct
  source 1..19: note = Seed: LQTVHSIPLTINKEEALQR
LQTVHSIPLTILKFEALQR

SEQ ID NO: 35861 - protein, 19 aa, synthetic construct
  source 1..19: note = Seed: LQTVHSIPLTINKEEALQR
LQTVHSIPLTILKFEAMQR

SEQ ID NO: 35862 - protein, 19 aa, synthetic construct
  source 1..19: note = Seed: LQTVHSIPLTINKEEALQR
LQTVHSIPLTILKFEANQR

SEQ ID NO: 35863 - protein, 19 aa, synthetic construct
  source 1..19: note = Seed: LQTVHSIPLTINKEEALQR
LQTVHSIPLTILKFEAPQR

SEQ ID NO: 35864 - protein, 19 aa, synthetic construct
  source 1..19: note = Seed: LQTVHSIPLTINKEEALQR
LQTVHSIPLTILKFEAQQR

SEQ ID NO: 35865 - protein, 19 aa, synthetic construct
  source 1..19: note = Seed: LQTVHSIPLTINKEEALQR
LQTVHSIPLTILKFEARQR

SEQ ID NO: 35866 - protein, 19 aa, synthetic construct
  source 1..19: note = Seed: LQTVHSIPLTINKEEALQR
LQTVHSIPLTILKFEASQR

SEQ ID NO: 35867 - protein, 19 aa, synthetic construct
  source 1..19: note = Seed: LQTVHSIPLTINKEEALQR
LQTVHSIPLTILKFEATQR

SEQ ID NO: 35868 - protein, 19 aa, synthetic construct
  source 1..19: note = Seed: LQTVHSIPLTINKEEALQR
LQTVHSIPLTILKFEAVQR

SEQ ID NO: 35869 - protein, 19 aa, synthetic construct
  source 1..19: note = Seed: LQTVHSIPLTINKEEALQR
LQTVHSIPLTILKFEAWQR

SEQ ID NO: 35870 - protein, 19 aa, synthetic construct
  source 1..19: note = Seed: LQTVHSIPLTINKEEALQR
LQTVHSIPLTILKFEAYQR

SEQ ID NO: 35871 - protein, 19 aa, synthetic construct
  source 1..19: note = Seed: LQTVHSIPLTINKEEALQR
LQTVHSIPLTILKGEAAQR

SEQ ID NO: 35872 - protein, 19 aa, synthetic construct
  source 1..19: note = Seed: LQTVHSIPLTINKEEALQR
LQTVHSIPLTILKGEAIQR

SEQ ID NO: 35873 - protein, 19 aa, synthetic construct
  source 1..19: note = Seed: LQTVHSIPLTINKEEALQR
LQTVHSIPLTILKGEALQR

SEQ ID NO: 35874 - protein, 19 aa, synthetic construct
  source 1..19: note = Seed: LQTVHSIPLTINKEEALQR
LQTVHSIPLTILKGEAMQR

SEQ ID NO: 35875 - protein, 19 aa, synthetic construct
  source 1..19: note = Seed: LQTVHSIPLTINKEEALQR
LQTVHSIPLTILKGEASQR

SEQ ID NO: 35876 - protein, 19 aa, synthetic construct
  source 1..19: note = Seed: LQTVHSIPLTINKEEALQR
LQTVHSIPLTILKGEATQR

SEQ ID NO: 35877 - protein, 19 aa, synthetic construct
  source 1..19: note = Seed: LQTVHSIPLTINKEEALQR
LQTVHSIPLTILKGEAVQR

SEQ ID NO: 35878 - protein, 19 aa, synthetic construct
  source 1..19: note = Seed: LQTVHSIPLTINKEEALQR
LQTVHSIPLTILKIEAAQR

SEQ ID NO: 35879 - protein, 19 aa, synthetic construct
  source 1..19: note = Seed: LQTVHSIPLTINKEEALQR
LQTVHSIPLTILKIEAFQR

SEQ ID NO: 35880 - protein, 19 aa, synthetic construct
  source 1..19: note = Seed: LQTVHSIPLTINKEEALQR
LQTVHSIPLTILKIEAIQR

SEQ ID NO: 35881 - protein, 19 aa, synthetic construct
  source 1..19: note = Seed: LQTVHSIPLTINKEEALQR
LQTVHSIPLTILKIEALQR

SEQ ID NO: 35882 - protein, 19 aa, synthetic construct
  source 1..19: note = Seed: LQTVHSIPLTINKEEALQR
LQTVHSIPLTILKIEAMQR

SEQ ID NO: 35883 - protein, 19 aa, synthetic construct
  source 1..19: note = Seed: LQTVHSIPLTINKEEALQR
LQTVHSIPLTILKIEAVQR

SEQ ID NO: 35884 - protein, 19 aa, synthetic construct
  source 1..19: note = Seed: LQTVHSIPLTINKEEALQR
LQTVHSIPLTILKIEAYQR

SEQ ID NO: 35885 - protein, 19 aa, synthetic construct
  source 1..19: note = Seed: LQTVHSIPLTINKEEALQR
LQTVHSIPLTILKLEAAQR

SEQ ID NO: 35886 - protein, 19 aa, synthetic construct
  source 1..19: note = Seed: LQTVHSIPLTINKEEALQR
LQTVHSIPLTILKLEAFQR

SEQ ID NO: 35887 - protein, 19 aa, synthetic construct
  source 1..19: note = Seed: LQTVHSIPLTINKEEALQR
LQTVHSIPLTILKLEAIQR

SEQ ID NO: 35888 - protein, 19 aa, synthetic construct
  source 1..19: note = Seed: LQTVHSIPLTINKEEALQR
LQTVHSIPLTILKLEALQR

SEQ ID NO: 35889 - protein, 19 aa, synthetic construct
  source 1..19: note = Seed: LQTVHSIPLTINKEEALQR
LQTVHSIPLTILKLEAMQR

SEQ ID NO: 35890 - protein, 19 aa, synthetic construct
  source 1..19: note = Seed: LQTVHSIPLTINKEEALQR
LQTVHSIPLTILKLEATQR

SEQ ID NO: 35891 - protein, 19 aa, synthetic construct
  source 1..19: note = Seed: LQTVHSIPLTINKEEALQR
LQTVHSIPLTILKLEAVQR

SEQ ID NO: 35892 - protein, 19 aa, synthetic construct
  source 1..19: note = Seed: LQTVHSIPLTINKEEALQR
LQTVHSIPLTILKLEAYQR

SEQ ID NO: 35893 - protein, 19 aa, synthetic construct
  source 1..19: note = Seed: LQTVHSIPLTINKEEALQR
LQTVHSIPLTILKMEAIQR

SEQ ID NO: 35894 - protein, 19 aa, synthetic construct
  source 1..19: note = Seed: LQTVHSIPLTINKEEALQR
LQTVHSIPLTILKMEALQR

SEQ ID NO: 35895 - protein, 19 aa, synthetic construct
  source 1..19: note = Seed: LQTVHSIPLTINKEEALQR
LQTVHSIPLTILKMEAMQR

SEQ ID NO: 35896 - protein, 19 aa, synthetic construct
  source 1..19: note = Seed: LQTVHSIPLTINKEEALQR
LQTVHSIPLTILKMEAVQR

SEQ ID NO: 35897 - protein, 19 aa, synthetic construct
  source 1..19: note = Seed: LQTVHSIPLTINKEEALQR
LQTVHSIPLTILKNEAAQR

SEQ ID NO: 35898 - protein, 19 aa, synthetic construct
  source 1..19: note = Seed: LQTVHSIPLTINKEEALQR
LQTVHSIPLTILKNEAIQR

SEQ ID NO: 35899 - protein, 19 aa, synthetic construct
  source 1..19: note = Seed: LQTVHSIPLTINKEEALQR
LQTVHSIPLTILKNEALQR

SEQ ID NO: 35900 - protein, 19 aa, synthetic construct
  source 1..19: note = Seed: LQTVHSIPLTINKEEALQR
LQTVHSIPLTILKNEAVQR

SEQ ID NO: 35901 - protein, 19 aa, synthetic construct
  source 1..19: note = Seed: LQTVHSIPLTINKEEALQR
LQTVHSIPLTILKPEAAQR

SEQ ID NO: 35902 - protein, 19 aa, synthetic construct
  source 1..19: note = Seed: LQTVHSIPLTINKEEALQR
LQTVHSIPLTILKPEAIQR

SEQ ID NO: 35903 - protein, 19 aa, synthetic construct
  source 1..19: note = Seed: LQTVHSIPLTINKEEALQR
LQTVHSIPLTILKPEALQR

SEQ ID NO: 35904 - protein, 19 aa, synthetic construct
  source 1..19: note = Seed: LQTVHSIPLTINKEEALQR
LQTVHSIPLTILKPEAVQR

SEQ ID NO: 35905 - protein, 19 aa, synthetic construct
  source 1..19: note = Seed: LQTVHSIPLTINKEEALQR
LQTVHSIPLTILKSEAAQR

SEQ ID NO: 35906 - protein, 19 aa, synthetic construct
  source 1..19: note = Seed: LQTVHSIPLTINKEEALQR
LQTVHSIPLTILKSEAIQR

SEQ ID NO: 35907 - protein, 19 aa, synthetic construct
  source 1..19: note = Seed: LQTVHSIPLTINKEEALQR
LQTVHSIPLTILKSEALQR

SEQ ID NO: 35908 - protein, 19 aa, synthetic construct
  source 1..19: note = Seed: LQTVHSIPLTINKEEALQR
LQTVHSIPLTILKSEAMQR

SEQ ID NO: 35909 - protein, 19 aa, synthetic construct
  source 1..19: note = Seed: LQTVHSIPLTINKEEALQR
LQTVHSIPLTILKSEASQR

SEQ ID NO: 35910 - protein, 19 aa, synthetic construct
  source 1..19: note = Seed: LQTVHSIPLTINKEEALQR
LQTVHSIPLTILKSEATQR

SEQ ID NO: 35911 - protein, 19 aa, synthetic construct
  source 1..19: note = Seed: LQTVHSIPLTINKEEALQR
LQTVHSIPLTILKSEAVQR

SEQ ID NO: 35912 - protein, 19 aa, synthetic construct
  source 1..19: note = Seed: LQTVHSIPLTINKEEALQR
LQTVHSIPLTILKTEAAQR

SEQ ID NO: 35913 - protein, 19 aa, synthetic construct
  source 1..19: note = Seed: LQTVHSIPLTINKEEALQR
LQTVHSIPLTILKTEAIQR

SEQ ID NO: 35914 - protein, 19 aa, synthetic construct
  source 1..19: note = Seed: LQTVHSIPLTINKEEALQR
LQTVHSIPLTILKTEALQR

SEQ ID NO: 35915 - protein, 19 aa, synthetic construct
  source 1..19: note = Seed: LQTVHSIPLTINKEEALQR
LQTVHSIPLTILKTEAVQR

SEQ ID NO: 35916 - protein, 19 aa, synthetic construct
  source 1..19: note = Seed: LQTVHSIPLTINKEEALQR
LQTVHSIPLTILKVEAAQR

SEQ ID NO: 35917 - protein, 19 aa, synthetic construct
  source 1..19: note = Seed: LQTVHSIPLTINKEEALQR
LQTVHSIPLTILKVEAFQR

SEQ ID NO: 35918 - protein, 19 aa, synthetic construct
  source 1..19: note = Seed: LQTVHSIPLTINKEEALQR
LQTVHSIPLTILKVEAIQR

SEQ ID NO: 35919 - protein, 19 aa, synthetic construct
  source 1..19: note = Seed: LQTVHSIPLTINKEEALQR
LQTVHSIPLTILKVEALQR

SEQ ID NO: 35920 - protein, 19 aa, synthetic construct
  source 1..19: note = Seed: LQTVHSIPLTINKEEALQR
LQTVHSIPLTILKVEAVQR

SEQ ID NO: 35921 - protein, 19 aa, synthetic construct
  source 1..19: note = Seed: LQTVHSIPLTINKEEALQR
LQTVHSIPLTILKWEAFQR

SEQ ID NO: 35922 - protein, 19 aa, synthetic construct
  source 1..19: note = Seed: LQTVHSIPLTINKEEALQR
LQTVHSIPLTILKWEAIQR

SEQ ID NO: 35923 - protein, 19 aa, synthetic construct
  source 1..19: note = Seed: LQTVHSIPLTINKEEALQR
LQTVHSIPLTILKWEALQR

SEQ ID NO: 35924 - protein, 19 aa, synthetic construct
  source 1..19: note = Seed: LQTVHSIPLTINKEEALQR
LQTVHSIPLTILKWEAMQR

SEQ ID NO: 35925 - protein, 19 aa, synthetic construct
  source 1..19: note = Seed: LQTVHSIPLTINKEEALQR
LQTVHSIPLTILKWEAVQR

SEQ ID NO: 35926 - protein, 19 aa, synthetic construct
  source 1..19: note = Seed: LQTVHSIPLTINKEEALQR
LQTVHSIPLTILKWEAYQR

SEQ ID NO: 35927 - protein, 19 aa, synthetic construct
  source 1..19: note = Seed: LQTVHSIPLTINKEEALQR
LQTVHSIPLTILKYEAAQR

SEQ ID NO: 35928 - protein, 19 aa, synthetic construct
  source 1..19: note = Seed: LQTVHSIPLTINKEEALQR
LQTVHSIPLTILKYEAFQR

SEQ ID NO: 35929 - protein, 19 aa, synthetic construct
  source 1..19: note = Seed: LQTVHSIPLTINKEEALQR
LQTVHSIPLTILKYEAIQR

SEQ ID NO: 35930 - protein, 19 aa, synthetic construct
  source 1..19: note = Seed: LQTVHSIPLTINKEEALQR
LQTVHSIPLTILKYEALQR

SEQ ID NO: 35931 - protein, 19 aa, synthetic construct
  source 1..19: note = Seed: LQTVHSIPLTINKEEALQR
LQTVHSIPLTILKYEAMQR

SEQ ID NO: 35932 - protein, 19 aa, synthetic construct
  source 1..19: note = Seed: LQTVHSIPLTINKEEALQR
LQTVHSIPLTILKYEAVQR

SEQ ID NO: 35933 - protein, 19 aa, synthetic construct
  source 1..19: note = Seed: LQTVHSIPLTINKEEALQR
LQTVHSIPLTILKYEAYQR

SEQ ID NO: 35934 - protein, 19 aa, synthetic construct
  source 1..19: note = Seed: LQTVHSIPLTINKEEALQR
LQTVHSIPLTIMKAEAAQR

SEQ ID NO: 35935 - protein, 19 aa, synthetic construct
  source 1..19: note = Seed: LQTVHSIPLTINKEEALQR
LQTVHSIPLTIMKAEAFQR

SEQ ID NO: 35936 - protein, 19 aa, synthetic construct
  source 1..19: note = Seed: LQTVHSIPLTINKEEALQR
LQTVHSIPLTIMKAEAIQR

SEQ ID NO: 35937 - protein, 19 aa, synthetic construct
  source 1..19: note = Seed: LQTVHSIPLTINKEEALQR
LQTVHSIPLTIMKAEALQR

SEQ ID NO: 35938 - protein, 19 aa, synthetic construct
  source 1..19: note = Seed: LQTVHSIPLTINKEEALQR
LQTVHSIPLTIMKAEAMQR

SEQ ID NO: 35939 - protein, 19 aa, synthetic construct
  source 1..19: note = Seed: LQTVHSIPLTINKEEALQR
LQTVHSIPLTIMKAEASQR

SEQ ID NO: 35940 - protein, 19 aa, synthetic construct
  source 1..19: note = Seed: LQTVHSIPLTINKEEALQR
LQTVHSIPLTIMKAEATQR

SEQ ID NO: 35941 - protein, 19 aa, synthetic construct
  source 1..19: note = Seed: LQTVHSIPLTINKEEALQR
LQTVHSIPLTIMKAEAVQR

SEQ ID NO: 35942 - protein, 19 aa, synthetic construct
  source 1..19: note = Seed: LQTVHSIPLTINKEEALQR
LQTVHSIPLTIMKDEAIQR

SEQ ID NO: 35943 - protein, 19 aa, synthetic construct
  source 1..19: note = Seed: LQTVHSIPLTINKEEALQR
LQTVHSIPLTIMKDEALQR

SEQ ID NO: 35944 - protein, 19 aa, synthetic construct
  source 1..19: note = Seed: LQTVHSIPLTINKEEALQR
LQTVHSIPLTIMKDEAVQR

SEQ ID NO: 35945 - protein, 19 aa, synthetic construct
  source 1..19: note = Seed: LQTVHSIPLTINKEEALQR
LQTVHSIPLTIMKFEAAQR

SEQ ID NO: 35946 - protein, 19 aa, synthetic construct
  source 1..19: note = Seed: LQTVHSIPLTINKEEALQR
LQTVHSIPLTIMKFEADQR

SEQ ID NO: 35947 - protein, 19 aa, synthetic construct
  source 1..19: note = Seed: LQTVHSIPLTINKEEALQR
LQTVHSIPLTIMKFEAEQR

SEQ ID NO: 35948 - protein, 19 aa, synthetic construct
  source 1..19: note = Seed: LQTVHSIPLTINKEEALQR
LQTVHSIPLTIMKFEAFQR

SEQ ID NO: 35949 - protein, 19 aa, synthetic construct
  source 1..19: note = Seed: LQTVHSIPLTINKEEALQR
LQTVHSIPLTIMKFEAHQR

SEQ ID NO: 35950 - protein, 19 aa, synthetic construct
  source 1..19: note = Seed: LQTVHSIPLTINKEEALQR
LQTVHSIPLTIMKFEAIQR

SEQ ID NO: 35951 - protein, 19 aa, synthetic construct
  source 1..19: note = Seed: LQTVHSIPLTINKEEALQR
LQTVHSIPLTIMKFEALQR

SEQ ID NO: 35952 - protein, 19 aa, synthetic construct
  source 1..19: note = Seed: LQTVHSIPLTINKEEALQR
LQTVHSIPLTIMKFEAMQR

SEQ ID NO: 35953 - protein, 19 aa, synthetic construct
  source 1..19: note = Seed: LQTVHSIPLTINKEEALQR
LQTVHSIPLTIMKFEANQR

SEQ ID NO: 35954 - protein, 19 aa, synthetic construct
  source 1..19: note = Seed: LQTVHSIPLTINKEEALQR
LQTVHSIPLTIMKFEASQR

SEQ ID NO: 35955 - protein, 19 aa, synthetic construct
  source 1..19: note = Seed: LQTVHSIPLTINKEEALQR
LQTVHSIPLTIMKFEATQR

SEQ ID NO: 35956 - protein, 19 aa, synthetic construct
  source 1..19: note = Seed: LQTVHSIPLTINKEEALQR
LQTVHSIPLTIMKFEAVQR

SEQ ID NO: 35957 - protein, 19 aa, synthetic construct
  source 1..19: note = Seed: LQTVHSIPLTINKEEALQR
LQTVHSIPLTIMKFEAYQR

SEQ ID NO: 35958 - protein, 19 aa, synthetic construct
  source 1..19: note = Seed: LQTVHSIPLTINKEEALQR
LQTVHSIPLTIMKGEAAQR

SEQ ID NO: 35959 - protein, 19 aa, synthetic construct
  source 1..19: note = Seed: LQTVHSIPLTINKEEALQR
LQTVHSIPLTIMKGEAIQR

SEQ ID NO: 35960 - protein, 19 aa, synthetic construct
  source 1..19: note = Seed: LQTVHSIPLTINKEEALQR
LQTVHSIPLTIMKGEALQR

SEQ ID NO: 35961 - protein, 19 aa, synthetic construct
  source 1..19: note = Seed: LQTVHSIPLTINKEEALQR
LQTVHSIPLTIMKGEAMQR

SEQ ID NO: 35962 - protein, 19 aa, synthetic construct
  source 1..19: note = Seed: LQTVHSIPLTINKEEALQR
LQTVHSIPLTIMKGEASQR

SEQ ID NO: 35963 - protein, 19 aa, synthetic construct
  source 1..19: note = Seed: LQTVHSIPLTINKEEALQR
LQTVHSIPLTIMKGEATQR

SEQ ID NO: 35964 - protein, 19 aa, synthetic construct
  source 1..19: note = Seed: LQTVHSIPLTINKEEALQR
LQTVHSIPLTIMKGEAVQR

SEQ ID NO: 35965 - protein, 19 aa, synthetic construct
  source 1..19: note = Seed: LQTVHSIPLTINKEEALQR
LQTVHSIPLTIMKIEAAQR

SEQ ID NO: 35966 - protein, 19 aa, synthetic construct
  source 1..19: note = Seed: LQTVHSIPLTINKEEALQR
LQTVHSIPLTIMKIEAFQR

SEQ ID NO: 35967 - protein, 19 aa, synthetic construct
  source 1..19: note = Seed: LQTVHSIPLTINKEEALQR
LQTVHSIPLTIMKIEAIQR

SEQ ID NO: 35968 - protein, 19 aa, synthetic construct
  source 1..19: note = Seed: LQTVHSIPLTINKEEALQR
LQTVHSIPLTIMKIEALQR

SEQ ID NO: 35969 - protein, 19 aa, synthetic construct
  source 1..19: note = Seed: LQTVHSIPLTINKEEALQR
LQTVHSIPLTIMKIEAMQR

SEQ ID NO: 35970 - protein, 19 aa, synthetic construct
  source 1..19: note = Seed: LQTVHSIPLTINKEEALQR
LQTVHSIPLTIMKIEASQR

SEQ ID NO: 35971 - protein, 19 aa, synthetic construct
  source 1..19: note = Seed: LQTVHSIPLTINKEEALQR
LQTVHSIPLTIMKIEATQR

SEQ ID NO: 35972 - protein, 19 aa, synthetic construct
  source 1..19: note = Seed: LQTVHSIPLTINKEEALQR
LQTVHSIPLTIMKIEAVQR

SEQ ID NO: 35973 - protein, 19 aa, synthetic construct
  source 1..19: note = Seed: LQTVHSIPLTINKEEALQR
LQTVHSIPLTIMKLEAAQR

SEQ ID NO: 35974 - protein, 19 aa, synthetic construct
  source 1..19: note = Seed: LQTVHSIPLTINKEEALQR
LQTVHSIPLTIMKLEAFQR

SEQ ID NO: 35975 - protein, 19 aa, synthetic construct
  source 1..19: note = Seed: LQTVHSIPLTINKEEALQR
LQTVHSIPLTIMKLEAIQR

SEQ ID NO: 35976 - protein, 19 aa, synthetic construct
  source 1..19: note = Seed: LQTVHSIPLTINKEEALQR
LQTVHSIPLTIMKLEALQR

SEQ ID NO: 35977 - protein, 19 aa, synthetic construct
  source 1..19: note = Seed: LQTVHSIPLTINKEEALQR
LQTVHSIPLTIMKLEAVQR

SEQ ID NO: 35978 - protein, 19 aa, synthetic construct
  source 1..19: note = Seed: LQTVHSIPLTINKEEALQR
LQTVHSIPLTIMKMEAAQR

SEQ ID NO: 35979 - protein, 19 aa, synthetic construct
  source 1..19: note = Seed: LQTVHSIPLTINKEEALQR
LQTVHSIPLTIMKMEAIQR

SEQ ID NO: 35980 - protein, 19 aa, synthetic construct
  source 1..19: note = Seed: LQTVHSIPLTINKEEALQR
LQTVHSIPLTIMKMEALQR

SEQ ID NO: 35981 - protein, 19 aa, synthetic construct
  source 1..19: note = Seed: LQTVHSIPLTINKEEALQR
LQTVHSIPLTIMKMEAVQR

SEQ ID NO: 35982 - protein, 19 aa, synthetic construct
  source 1..19: note = Seed: LQTVHSIPLTINKEEALQR
LQTVHSIPLTIMKNEAAQR

SEQ ID NO: 35983 - protein, 19 aa, synthetic construct
  source 1..19: note = Seed: LQTVHSIPLTINKEEALQR
LQTVHSIPLTIMKNEAIQR

SEQ ID NO: 35984 - protein, 19 aa, synthetic construct
  source 1..19: note = Seed: LQTVHSIPLTINKEEALQR
LQTVHSIPLTIMKNEALQR

SEQ ID NO: 35985 - protein, 19 aa, synthetic construct
  source 1..19: note = Seed: LQTVHSIPLTINKEEALQR
LQTVHSIPLTIMKNEAVQR

SEQ ID NO: 35986 - protein, 19 aa, synthetic construct
  source 1..19: note = Seed: LQTVHSIPLTINKEEALQR
LQTVHSIPLTIMKPEAAQR

SEQ ID NO: 35987 - protein, 19 aa, synthetic construct
  source 1..19: note = Seed: LQTVHSIPLTINKEEALQR
LQTVHSIPLTIMKPEAIQR

SEQ ID NO: 35988 - protein, 19 aa, synthetic construct
  source 1..19: note = Seed: LQTVHSIPLTINKEEALQR
LQTVHSIPLTIMKPEALQR

SEQ ID NO: 35989 - protein, 19 aa, synthetic construct
  source 1..19: note = Seed: LQTVHSIPLTINKEEALQR
LQTVHSIPLTIMKPEAVQR

SEQ ID NO: 35990 - protein, 19 aa, synthetic construct
  source 1..19: note = Seed: LQTVHSIPLTINKEEALQR
LQTVHSIPLTIMKSEAAQR

SEQ ID NO: 35991 - protein, 19 aa, synthetic construct
  source 1..19: note = Seed: LQTVHSIPLTINKEEALQR
LQTVHSIPLTIMKSEAIQR

SEQ ID NO: 35992 - protein, 19 aa, synthetic construct
  source 1..19: note = Seed: LQTVHSIPLTINKEEALQR
LQTVHSIPLTIMKSEALQR

SEQ ID NO: 35993 - protein, 19 aa, synthetic construct
  source 1..19: note = Seed: LQTVHSIPLTINKEEALQR
LQTVHSIPLTIMKSEAMQR

SEQ ID NO: 35994 - protein, 19 aa, synthetic construct
  source 1..19: note = Seed: LQTVHSIPLTINKEEALQR
LQTVHSIPLTIMKSEASQR

SEQ ID NO: 35995 - protein, 19 aa, synthetic construct
  source 1..19: note = Seed: LQTVHSIPLTINKEEALQR
LQTVHSIPLTIMKSEATQR

SEQ ID NO: 35996 - protein, 19 aa, synthetic construct
  source 1..19: note = Seed: LQTVHSIPLTINKEEALQR
LQTVHSIPLTIMKSEAVQR

SEQ ID NO: 35997 - protein, 19 aa, synthetic construct
  source 1..19: note = Seed: LQTVHSIPLTINKEEALQR
LQTVHSIPLTIMKTEAAQR

SEQ ID NO: 35998 - protein, 19 aa, synthetic construct
  source 1..19: note = Seed: LQTVHSIPLTINKEEALQR
LQTVHSIPLTIMKTEAIQR

SEQ ID NO: 35999 - protein, 19 aa, synthetic construct
  source 1..19: note = Seed: LQTVHSIPLTINKEEALQR
LQTVHSIPLTIMKTEALQR

SEQ ID NO: 36000 - protein, 19 aa, synthetic construct
  source 1..19: note = Seed: LQTVHSIPLTINKEEALQR
LQTVHSIPLTIMKTEAVQR

SEQ ID NO: 36001 - protein, 19 aa, synthetic construct
  source 1..19: note = Seed: LQTVHSIPLTINKEEALQR
LQTVHSIPLTIMKVEAAQR

SEQ ID NO: 36002 - protein, 19 aa, synthetic construct
  source 1..19: note = Seed: LQTVHSIPLTINKEEALQR
LQTVHSIPLTIMKVEAFQR

SEQ ID NO: 36003 - protein, 19 aa, synthetic construct
  source 1..19: note = Seed: LQTVHSIPLTINKEEALQR
LQTVHSIPLTIMKVEAIQR

SEQ ID NO: 36004 - protein, 19 aa, synthetic construct
  source 1..19: note = Seed: LQTVHSIPLTINKEEALQR
LQTVHSIPLTIMKVEALQR

SEQ ID NO: 36005 - protein, 19 aa, synthetic construct
  source 1..19: note = Seed: LQTVHSIPLTINKEEALQR
LQTVHSIPLTIMKVEAMQR

SEQ ID NO: 36006 - protein, 19 aa, synthetic construct
  source 1..19: note = Seed: LQTVHSIPLTINKEEALQR
LQTVHSIPLTIMKVEAVQR

SEQ ID NO: 36007 - protein, 19 aa, synthetic construct
  source 1..19: note = Seed: LQTVHSIPLTINKEEALQR
LQTVHSIPLTIMKWEALQR

SEQ ID NO: 36008 - protein, 19 aa, synthetic construct
  source 1..19: note = Seed: LQTVHSIPLTINKEEALQR
LQTVHSIPLTIMKYEAFQR

SEQ ID NO: 36009 - protein, 19 aa, synthetic construct
  source 1..19: note = Seed: LQTVHSIPLTINKEEALQR
LQTVHSIPLTIMKYEAIQR

SEQ ID NO: 36010 - protein, 19 aa, synthetic construct
  source 1..19: note = Seed: LQTVHSIPLTINKEEALQR
LQTVHSIPLTIMKYEALQR

SEQ ID NO: 36011 - protein, 19 aa, synthetic construct
  source 1..19: note = Seed: LQTVHSIPLTINKEEALQR
LQTVHSIPLTIMKYEAVQR

SEQ ID NO: 36012 - protein, 19 aa, synthetic construct
  source 1..19: note = Seed: LQTVHSIPLTINKEEALQR
LQTVHSIPLTINKAEAAQR

SEQ ID NO: 36013 - protein, 19 aa, synthetic construct
  source 1..19: note = Seed: LQTVHSIPLTINKEEALQR
LQTVHSIPLTINKAEAFQR

SEQ ID NO: 36014 - protein, 19 aa, synthetic construct
  source 1..19: note = Seed: LQTVHSIPLTINKEEALQR
LQTVHSIPLTINKAEAIQR

SEQ ID NO: 36015 - protein, 19 aa, synthetic construct
  source 1..19: note = Seed: LQTVHSIPLTINKEEALQR
LQTVHSIPLTINKAEALQR

SEQ ID NO: 36016 - protein, 19 aa, synthetic construct
  source 1..19: note = Seed: LQTVHSIPLTINKEEALQR
LQTVHSIPLTINKAEAMQR

SEQ ID NO: 36017 - protein, 19 aa, synthetic construct
  source 1..19: note = Seed: LQTVHSIPLTINKEEALQR
LQTVHSIPLTINKAEAVQR

SEQ ID NO: 36018 - protein, 19 aa, synthetic construct
  source 1..19: note = Seed: LQTVHSIPLTINKEEALQR
LQTVHSIPLTINKAEAYQR

SEQ ID NO: 36019 - protein, 19 aa, synthetic construct
  source 1..19: note = Seed: LQTVHSIPLTINKEEALQR
LQTVHSIPLTINKFEAFQR

SEQ ID NO: 36020 - protein, 19 aa, synthetic construct
  source 1..19: note = Seed: LQTVHSIPLTINKEEALQR
LQTVHSIPLTINKFEAIQR

SEQ ID NO: 36021 - protein, 19 aa, synthetic construct
  source 1..19: note = Seed: LQTVHSIPLTINKEEALQR
LQTVHSIPLTINKFEALQR

SEQ ID NO: 36022 - protein, 19 aa, synthetic construct
  source 1..19: note = Seed: LQTVHSIPLTINKEEALQR
LQTVHSIPLTINKFEAMQR

SEQ ID NO: 36023 - protein, 19 aa, synthetic construct
  source 1..19: note = Seed: LQTVHSIPLTINKEEALQR
LQTVHSIPLTINKFEAVQR

SEQ ID NO: 36024 - protein, 19 aa, synthetic construct
  source 1..19: note = Seed: LQTVHSIPLTINKEEALQR
LQTVHSIPLTINKGEAFQR

SEQ ID NO: 36025 - protein, 19 aa, synthetic construct
  source 1..19: note = Seed: LQTVHSIPLTINKEEALQR
LQTVHSIPLTINKGEAIQR

SEQ ID NO: 36026 - protein, 19 aa, synthetic construct
  source 1..19: note = Seed: LQTVHSIPLTINKEEALQR
LQTVHSIPLTINKGEALQR

SEQ ID NO: 36027 - protein, 19 aa, synthetic construct
  source 1..19: note = Seed: LQTVHSIPLTINKEEALQR
LQTVHSIPLTINKGEAMQR

SEQ ID NO: 36028 - protein, 19 aa, synthetic construct
  source 1..19: note = Seed: LQTVHSIPLTINKEEALQR
LQTVHSIPLTINKGEAVQR

SEQ ID NO: 36029 - protein, 19 aa, synthetic construct
  source 1..19: note = Seed: LQTVHSIPLTINKEEALQR
LQTVHSIPLTINKIEAFQR

SEQ ID NO: 36030 - protein, 19 aa, synthetic construct
  source 1..19: note = Seed: LQTVHSIPLTINKEEALQR
LQTVHSIPLTINKIEAIQR

SEQ ID NO: 36031 - protein, 19 aa, synthetic construct
  source 1..19: note = Seed: LQTVHSIPLTINKEEALQR
LQTVHSIPLTINKIEALQR

SEQ ID NO: 36032 - protein, 19 aa, synthetic construct
  source 1..19: note = Seed: LQTVHSIPLTINKEEALQR
LQTVHSIPLTINKIEAMQR

SEQ ID NO: 36033 - protein, 19 aa, synthetic construct
  source 1..19: note = Seed: LQTVHSIPLTINKEEALQR
LQTVHSIPLTINKIEAVQR

SEQ ID NO: 36034 - protein, 19 aa, synthetic construct
  source 1..19: note = Seed: LQTVHSIPLTINKEEALQR
LQTVHSIPLTINKIEAYQR

SEQ ID NO: 36035 - protein, 19 aa, synthetic construct
  source 1..19: note = Seed: LQTVHSIPLTINKEEALQR
LQTVHSIPLTINKLEAIQR

SEQ ID NO: 36036 - protein, 19 aa, synthetic construct
  source 1..19: note = Seed: LQTVHSIPLTINKEEALQR
LQTVHSIPLTINKLEAVQR

SEQ ID NO: 36037 - protein, 19 aa, synthetic construct
  source 1..19: note = Seed: LQTVHSIPLTINKEEALQR
LQTVHSIPLTINKMEAIQR

SEQ ID NO: 36038 - protein, 19 aa, synthetic construct
  source 1..19: note = Seed: LQTVHSIPLTINKEEALQR
LQTVHSIPLTINKMEAVQR

SEQ ID NO: 36039 - protein, 19 aa, synthetic construct
  source 1..19: note = Seed: LQTVHSIPLTINKEEALQR
LQTVHSIPLTINKNEAAQR

SEQ ID NO: 36040 - protein, 19 aa, synthetic construct
  source 1..19: note = Seed: LQTVHSIPLTINKEEALQR
LQTVHSIPLTINKNEAFQR

SEQ ID NO: 36041 - protein, 19 aa, synthetic construct
  source 1..19: note = Seed: LQTVHSIPLTINKEEALQR
LQTVHSIPLTINKNEAIQR

SEQ ID NO: 36042 - protein, 19 aa, synthetic construct
  source 1..19: note = Seed: LQTVHSIPLTINKEEALQR
LQTVHSIPLTINKNEALQR

SEQ ID NO: 36043 - protein, 19 aa, synthetic construct
  source 1..19: note = Seed: LQTVHSIPLTINKEEALQR
LQTVHSIPLTINKNEAMQR

SEQ ID NO: 36044 - protein, 19 aa, synthetic construct
  source 1..19: note = Seed: LQTVHSIPLTINKEEALQR
LQTVHSIPLTINKNEAVQR

SEQ ID NO: 36045 - protein, 19 aa, synthetic construct
  source 1..19: note = Seed: LQTVHSIPLTINKEEALQR
LQTVHSIPLTINKNEAYQR

SEQ ID NO: 36046 - protein, 19 aa, synthetic construct
  source 1..19: note = Seed: LQTVHSIPLTINKEEALQR
LQTVHSIPLTINKPEAIQR

SEQ ID NO: 36047 - protein, 19 aa, synthetic construct
  source 1..19: note = Seed: LQTVHSIPLTINKEEALQR
LQTVHSIPLTINKPEALQR

SEQ ID NO: 36048 - protein, 19 aa, synthetic construct
  source 1..19: note = Seed: LQTVHSIPLTINKEEALQR
LQTVHSIPLTINKPEAVQR

SEQ ID NO: 36049 - protein, 19 aa, synthetic construct
  source 1..19: note = Seed: LQTVHSIPLTINKEEALQR
LQTVHSIPLTINKSEAFQR

SEQ ID NO: 36050 - protein, 19 aa, synthetic construct
  source 1..19: note = Seed: LQTVHSIPLTINKEEALQR
LQTVHSIPLTINKSEAIQR

SEQ ID NO: 36051 - protein, 19 aa, synthetic construct
  source 1..19: note = Seed: LQTVHSIPLTINKEEALQR
LQTVHSIPLTINKSEALQR

SEQ ID NO: 36052 - protein, 19 aa, synthetic construct
  source 1..19: note = Seed: LQTVHSIPLTINKEEALQR
LQTVHSIPLTINKSEAMQR

SEQ ID NO: 36053 - protein, 19 aa, synthetic construct
  source 1..19: note = Seed: LQTVHSIPLTINKEEALQR
LQTVHSIPLTINKSEAVQR

SEQ ID NO: 36054 - protein, 19 aa, synthetic construct
  source 1..19: note = Seed: LQTVHSIPLTINKEEALQR
LQTVHSIPLTINKSEAYQR

SEQ ID NO: 36055 - protein, 19 aa, synthetic construct
  source 1..19: note = Seed: LQTVHSIPLTINKEEALQR
LQTVHSIPLTINKTEAFQR

SEQ ID NO: 36056 - protein, 19 aa, synthetic construct
  source 1..19: note = Seed: LQTVHSIPLTINKEEALQR
LQTVHSIPLTINKTEAIQR

SEQ ID NO: 36057 - protein, 19 aa, synthetic construct
  source 1..19: note = Seed: LQTVHSIPLTINKEEALQR
LQTVHSIPLTINKTEALQR

SEQ ID NO: 36058 - protein, 19 aa, synthetic construct
  source 1..19: note = Seed: LQTVHSIPLTINKEEALQR
LQTVHSIPLTINKTEAVQR

SEQ ID NO: 36059 - protein, 19 aa, synthetic construct
  source 1..19: note = Seed: LQTVHSIPLTINKEEALQR
LQTVHSIPLTINKTEAYQR

SEQ ID NO: 36060 - protein, 19 aa, synthetic construct
  source 1..19: note = Seed: LQTVHSIPLTINKEEALQR
LQTVHSIPLTINKVEAFQR

SEQ ID NO: 36061 - protein, 19 aa, synthetic construct
  source 1..19: note = Seed: LQTVHSIPLTINKEEALQR
LQTVHSIPLTINKVEAIQR

SEQ ID NO: 36062 - protein, 19 aa, synthetic construct
  source 1..19: note = Seed: LQTVHSIPLTINKEEALQR
LQTVHSIPLTINKVEALQR

SEQ ID NO: 36063 - protein, 19 aa, synthetic construct
  source 1..19: note = Seed: LQTVHSIPLTINKEEALQR
LQTVHSIPLTINKVEAMQR

SEQ ID NO: 36064 - protein, 19 aa, synthetic construct
  source 1..19: note = Seed: LQTVHSIPLTINKEEALQR
LQTVHSIPLTINKVEAVQR

SEQ ID NO: 36065 - protein, 19 aa, synthetic construct
  source 1..19: note = Seed: LQTVHSIPLTINKEEALQR
LQTVHSIPLTINKVEAYQR

SEQ ID NO: 36066 - protein, 19 aa, synthetic construct
  source 1..19: note = Seed: LQTVHSIPLTINKEEALQR
LQTVHSIPLTIQKAEALQR

SEQ ID NO: 36067 - protein, 19 aa, synthetic construct
  source 1..19: note = Seed: LQTVHSIPLTINKEEALQR
LQTVHSIPLTIQKAEAVQR

SEQ ID NO: 36068 - protein, 19 aa, synthetic construct
  source 1..19: note = Seed: LQTVHSIPLTINKEEALQR
LQTVHSIPLTIQKFEAFQR

SEQ ID NO: 36069 - protein, 19 aa, synthetic construct
  source 1..19: note = Seed: LQTVHSIPLTINKEEALQR
LQTVHSIPLTIQKFEAIQR

SEQ ID NO: 36070 - protein, 19 aa, synthetic construct
  source 1..19: note = Seed: LQTVHSIPLTINKEEALQR
LQTVHSIPLTIQKFEALQR

SEQ ID NO: 36071 - protein, 19 aa, synthetic construct
  source 1..19: note = Seed: LQTVHSIPLTINKEEALQR
LQTVHSIPLTIQKFEAMQR

SEQ ID NO: 36072 - protein, 19 aa, synthetic construct
  source 1..19: note = Seed: LQTVHSIPLTINKEEALQR
LQTVHSIPLTIQKFEAVQR

SEQ ID NO: 36073 - protein, 19 aa, synthetic construct
  source 1..19: note = Seed: LQTVHSIPLTINKEEALQR
LQTVHSIPLTIQKFEAYQR

SEQ ID NO: 36074 - protein, 19 aa, synthetic construct
  source 1..19: note = Seed: LQTVHSIPLTINKEEALQR
LQTVHSIPLTISKAEAIQR

SEQ ID NO: 36075 - protein, 19 aa, synthetic construct
  source 1..19: note = Seed: LQTVHSIPLTINKEEALQR
LQTVHSIPLTISKAEALQR

SEQ ID NO: 36076 - protein, 19 aa, synthetic construct
  source 1..19: note = Seed: LQTVHSIPLTINKEEALQR
LQTVHSIPLTISKFEAAQR

SEQ ID NO: 36077 - protein, 19 aa, synthetic construct
  source 1..19: note = Seed: LQTVHSIPLTINKEEALQR
LQTVHSIPLTISKFEAFQR

SEQ ID NO: 36078 - protein, 19 aa, synthetic construct
  source 1..19: note = Seed: LQTVHSIPLTINKEEALQR
LQTVHSIPLTISKFEAIQR

SEQ ID NO: 36079 - protein, 19 aa, synthetic construct
  source 1..19: note = Seed: LQTVHSIPLTINKEEALQR
LQTVHSIPLTISKFEALQR

SEQ ID NO: 36080 - protein, 19 aa, synthetic construct
  source 1..19: note = Seed: LQTVHSIPLTINKEEALQR
LQTVHSIPLTISKFEAMQR

SEQ ID NO: 36081 - protein, 19 aa, synthetic construct
  source 1..19: note = Seed: LQTVHSIPLTINKEEALQR
LQTVHSIPLTISKFEATQR

SEQ ID NO: 36082 - protein, 19 aa, synthetic construct
  source 1..19: note = Seed: LQTVHSIPLTINKEEALQR
LQTVHSIPLTISKFEAVQR

SEQ ID NO: 36083 - protein, 19 aa, synthetic construct
  source 1..19: note = Seed: LQTVHSIPLTINKEEALQR
LQTVHSIPLTISKFEAYQR

SEQ ID NO: 36084 - protein, 19 aa, synthetic construct
  source 1..19: note = Seed: LQTVHSIPLTINKEEALQR
LQTVHSIPLTISKNEAIQR

SEQ ID NO: 36085 - protein, 19 aa, synthetic construct
  source 1..19: note = Seed: LQTVHSIPLTINKEEALQR
LQTVHSIPLTISKSEAIQR

SEQ ID NO: 36086 - protein, 19 aa, synthetic construct
  source 1..19: note = Seed: LQTVHSIPLTINKEEALQR
LQTVHSIPLTISKSEALQR

SEQ ID NO: 36087 - protein, 19 aa, synthetic construct
  source 1..19: note = Seed: LQTVHSIPLTINKEEALQR
LQTVHSIPLTISKSEAVQR

SEQ ID NO: 36088 - protein, 19 aa, synthetic construct
  source 1..19: note = Seed: LQTVHSIPLTINKEEALQR
LQTVHSIPLTISKYEAIQR

SEQ ID NO: 36089 - protein, 19 aa, synthetic construct
  source 1..19: note = Seed: LQTVHSIPLTINKEEALQR
LQTVHSIPLTISKYEALQR

SEQ ID NO: 36090 - protein, 19 aa, synthetic construct
  source 1..19: note = Seed: LQTVHSIPLTINKEEALQR
LQTVHSIPLTITKAEAIQR

SEQ ID NO: 36091 - protein, 19 aa, synthetic construct
  source 1..19: note = Seed: LQTVHSIPLTINKEEALQR
LQTVHSIPLTITKAEALQR

SEQ ID NO: 36092 - protein, 19 aa, synthetic construct
  source 1..19: note = Seed: LQTVHSIPLTINKEEALQR
LQTVHSIPLTITKAEAVQR

SEQ ID NO: 36093 - protein, 19 aa, synthetic construct
  source 1..19: note = Seed: LQTVHSIPLTINKEEALQR
LQTVHSIPLTITKFEAAQR

SEQ ID NO: 36094 - protein, 19 aa, synthetic construct
  source 1..19: note = Seed: LQTVHSIPLTINKEEALQR
LQTVHSIPLTITKFEAEQR

SEQ ID NO: 36095 - protein, 19 aa, synthetic construct
  source 1..19: note = Seed: LQTVHSIPLTINKEEALQR
LQTVHSIPLTITKFEAFQR

SEQ ID NO: 36096 - protein, 19 aa, synthetic construct
  source 1..19: note = Seed: LQTVHSIPLTINKEEALQR
LQTVHSIPLTITKFEAIQR

SEQ ID NO: 36097 - protein, 19 aa, synthetic construct
  source 1..19: note = Seed: LQTVHSIPLTINKEEALQR
LQTVHSIPLTITKFEALQR

SEQ ID NO: 36098 - protein, 19 aa, synthetic construct
  source 1..19: note = Seed: LQTVHSIPLTINKEEALQR
LQTVHSIPLTITKFEAMQR

SEQ ID NO: 36099 - protein, 19 aa, synthetic construct
  source 1..19: note = Seed: LQTVHSIPLTINKEEALQR
LQTVHSIPLTITKFEANQR

SEQ ID NO: 36100 - protein, 19 aa, synthetic construct
  source 1..19: note = Seed: LQTVHSIPLTINKEEALQR
LQTVHSIPLTITKFEASQR

SEQ ID NO: 36101 - protein, 19 aa, synthetic construct
  source 1..19: note = Seed: LQTVHSIPLTINKEEALQR
LQTVHSIPLTITKFEATQR

SEQ ID NO: 36102 - protein, 19 aa, synthetic construct
  source 1..19: note = Seed: LQTVHSIPLTINKEEALQR
LQTVHSIPLTITKFEAVQR

SEQ ID NO: 36103 - protein, 19 aa, synthetic construct
  source 1..19: note = Seed: LQTVHSIPLTINKEEALQR
LQTVHSIPLTITKFEAYQR

SEQ ID NO: 36104 - protein, 19 aa, synthetic construct
  source 1..19: note = Seed: LQTVHSIPLTINKEEALQR
LQTVHSIPLTITKGEAIQR

SEQ ID NO: 36105 - protein, 19 aa, synthetic construct
  source 1..19: note = Seed: LQTVHSIPLTINKEEALQR
LQTVHSIPLTITKLEAFQR

SEQ ID NO: 36106 - protein, 19 aa, synthetic construct
  source 1..19: note = Seed: LQTVHSIPLTINKEEALQR
LQTVHSIPLTITKLEAIQR

SEQ ID NO: 36107 - protein, 19 aa, synthetic construct
  source 1..19: note = Seed: LQTVHSIPLTINKEEALQR
LQTVHSIPLTITKLEALQR

SEQ ID NO: 36108 - protein, 19 aa, synthetic construct
  source 1..19: note = Seed: LQTVHSIPLTINKEEALQR
LQTVHSIPLTITKLEAVQR

SEQ ID NO: 36109 - protein, 19 aa, synthetic construct
  source 1..19: note = Seed: LQTVHSIPLTINKEEALQR
LQTVHSIPLTITKSEAIQR

SEQ ID NO: 36110 - protein, 19 aa, synthetic construct
  source 1..19: note = Seed: LQTVHSIPLTINKEEALQR
LQTVHSIPLTITKSEALQR

SEQ ID NO: 36111 - protein, 19 aa, synthetic construct
  source 1..19: note = Seed: LQTVHSIPLTINKEEALQR
LQTVHSIPLTITKSEAVQR

SEQ ID NO: 36112 - protein, 19 aa, synthetic construct
  source 1..19: note = Seed: LQTVHSIPLTINKEEALQR
LQTVHSIPLTITKWEAIQR

SEQ ID NO: 36113 - protein, 19 aa, synthetic construct
  source 1..19: note = Seed: LQTVHSIPLTINKEEALQR
LQTVHSIPLTITKWEALQR

SEQ ID NO: 36114 - protein, 19 aa, synthetic construct
  source 1..19: note = Seed: LQTVHSIPLTINKEEALQR
LQTVHSIPLTITKWEAVQR

SEQ ID NO: 36115 - protein, 19 aa, synthetic construct
  source 1..19: note = Seed: LQTVHSIPLTINKEEALQR
LQTVHSIPLTITKYEAFQR

SEQ ID NO: 36116 - protein, 19 aa, synthetic construct
  source 1..19: note = Seed: LQTVHSIPLTINKEEALQR
LQTVHSIPLTITKYEAIQR

SEQ ID NO: 36117 - protein, 19 aa, synthetic construct
  source 1..19: note = Seed: LQTVHSIPLTINKEEALQR
LQTVHSIPLTITKYEALQR

SEQ ID NO: 36118 - protein, 19 aa, synthetic construct
  source 1..19: note = Seed: LQTVHSIPLTINKEEALQR
LQTVHSIPLTITKYEAVQR

SEQ ID NO: 36119 - protein, 19 aa, synthetic construct
  source 1..19: note = Seed: LQTVHSIPLTINKEEALQR
LQTVHSIPLTIVKAEAIQR

SEQ ID NO: 36120 - protein, 19 aa, synthetic construct
  source 1..19: note = Seed: LQTVHSIPLTINKEEALQR
LQTVHSIPLTIVKAEALQR

SEQ ID NO: 36121 - protein, 19 aa, synthetic construct
  source 1..19: note = Seed: LQTVHSIPLTINKEEALQR
LQTVHSIPLTIVKAEAVQR

SEQ ID NO: 36122 - protein, 19 aa, synthetic construct
  source 1..19: note = Seed: LQTVHSIPLTINKEEALQR
LQTVHSIPLTIVKFEAAQR

SEQ ID NO: 36123 - protein, 19 aa, synthetic construct
  source 1..19: note = Seed: LQTVHSIPLTINKEEALQR
LQTVHSIPLTIVKFEADQR

SEQ ID NO: 36124 - protein, 19 aa, synthetic construct
  source 1..19: note = Seed: LQTVHSIPLTINKEEALQR
LQTVHSIPLTIVKFEAEQR

SEQ ID NO: 36125 - protein, 19 aa, synthetic construct
  source 1..19: note = Seed: LQTVHSIPLTINKEEALQR
LQTVHSIPLTIVKFEAFQR

SEQ ID NO: 36126 - protein, 19 aa, synthetic construct
  source 1..19: note = Seed: LQTVHSIPLTINKEEALQR
LQTVHSIPLTIVKFEAHQR

SEQ ID NO: 36127 - protein, 19 aa, synthetic construct
  source 1..19: note = Seed: LQTVHSIPLTINKEEALQR
LQTVHSIPLTIVKFEAIQR

SEQ ID NO: 36128 - protein, 19 aa, synthetic construct
  source 1..19: note = Seed: LQTVHSIPLTINKEEALQR
LQTVHSIPLTIVKFEALQR

SEQ ID NO: 36129 - protein, 19 aa, synthetic construct
  source 1..19: note = Seed: LQTVHSIPLTINKEEALQR
LQTVHSIPLTIVKFEAMQR

SEQ ID NO: 36130 - protein, 19 aa, synthetic construct
  source 1..19: note = Seed: LQTVHSIPLTINKEEALQR
LQTVHSIPLTIVKFEANQR

SEQ ID NO: 36131 - protein, 19 aa, synthetic construct
  source 1..19: note = Seed: LQTVHSIPLTINKEEALQR
LQTVHSIPLTIVKFEAPQR

SEQ ID NO: 36132 - protein, 19 aa, synthetic construct
  source 1..19: note = Seed: LQTVHSIPLTINKEEALQR
LQTVHSIPLTIVKFEAQQR

SEQ ID NO: 36133 - protein, 19 aa, synthetic construct
  source 1..19: note = Seed: LQTVHSIPLTINKEEALQR
LQTVHSIPLTIVKFEARQR

SEQ ID NO: 36134 - protein, 19 aa, synthetic construct
  source 1..19: note = Seed: LQTVHSIPLTINKEEALQR
LQTVHSIPLTIVKFEASQR

SEQ ID NO: 36135 - protein, 19 aa, synthetic construct
  source 1..19: note = Seed: LQTVHSIPLTINKEEALQR
LQTVHSIPLTIVKFEATQR

SEQ ID NO: 36136 - protein, 19 aa, synthetic construct
  source 1..19: note = Seed: LQTVHSIPLTINKEEALQR
LQTVHSIPLTIVKFEAVQR

SEQ ID NO: 36137 - protein, 19 aa, synthetic construct
  source 1..19: note = Seed: LQTVHSIPLTINKEEALQR
LQTVHSIPLTIVKFEAYQR

SEQ ID NO: 36138 - protein, 19 aa, synthetic construct
  source 1..19: note = Seed: LQTVHSIPLTINKEEALQR
LQTVHSIPLTIVKIEAAQR

SEQ ID NO: 36139 - protein, 19 aa, synthetic construct
  source 1..19: note = Seed: LQTVHSIPLTINKEEALQR
LQTVHSIPLTIVKIEAIQR

SEQ ID NO: 36140 - protein, 19 aa, synthetic construct
  source 1..19: note = Seed: LQTVHSIPLTINKEEALQR
LQTVHSIPLTIVKIEALQR

SEQ ID NO: 36141 - protein, 19 aa, synthetic construct
  source 1..19: note = Seed: LQTVHSIPLTINKEEALQR
LQTVHSIPLTIVKIEAVQR

SEQ ID NO: 36142 - protein, 19 aa, synthetic construct
  source 1..19: note = Seed: LQTVHSIPLTINKEEALQR
LQTVHSIPLTIVKLEAFQR

SEQ ID NO: 36143 - protein, 19 aa, synthetic construct
  source 1..19: note = Seed: LQTVHSIPLTINKEEALQR
LQTVHSIPLTIVKLEAIQR

SEQ ID NO: 36144 - protein, 19 aa, synthetic construct
  source 1..19: note = Seed: LQTVHSIPLTINKEEALQR
LQTVHSIPLTIVKLEALQR

SEQ ID NO: 36145 - protein, 19 aa, synthetic construct
  source 1..19: note = Seed: LQTVHSIPLTINKEEALQR
LQTVHSIPLTIVKLEAMQR

SEQ ID NO: 36146 - protein, 19 aa, synthetic construct
  source 1..19: note = Seed: LQTVHSIPLTINKEEALQR
LQTVHSIPLTIVKLEAVQR

SEQ ID NO: 36147 - protein, 19 aa, synthetic construct
  source 1..19: note = Seed: LQTVHSIPLTINKEEALQR
LQTVHSIPLTIVKLEAYQR

SEQ ID NO: 36148 - protein, 19 aa, synthetic construct
  source 1..19: note = Seed: LQTVHSIPLTINKEEALQR
LQTVHSIPLTIVKMEALQR

SEQ ID NO: 36149 - protein, 19 aa, synthetic construct
  source 1..19: note = Seed: LQTVHSIPLTINKEEALQR
LQTVHSIPLTIVKSEAIQR

SEQ ID NO: 36150 - protein, 19 aa, synthetic construct
  source 1..19: note = Seed: LQTVHSIPLTINKEEALQR
LQTVHSIPLTIVKSEALQR

SEQ ID NO: 36151 - protein, 19 aa, synthetic construct
  source 1..19: note = Seed: LQTVHSIPLTINKEEALQR
LQTVHSIPLTIVKSEAVQR

SEQ ID NO: 36152 - protein, 19 aa, synthetic construct
  source 1..19: note = Seed: LQTVHSIPLTINKEEALQR
LQTVHSIPLTIVKVEAAQR

SEQ ID NO: 36153 - protein, 19 aa, synthetic construct
  source 1..19: note = Seed: LQTVHSIPLTINKEEALQR
LQTVHSIPLTIVKWEAFQR

SEQ ID NO: 36154 - protein, 19 aa, synthetic construct
  source 1..19: note = Seed: LQTVHSIPLTINKEEALQR
LQTVHSIPLTIVKWEAIQR

SEQ ID NO: 36155 - protein, 19 aa, synthetic construct
  source 1..19: note = Seed: LQTVHSIPLTINKEEALQR
LQTVHSIPLTIVKWEALQR

SEQ ID NO: 36156 - protein, 19 aa, synthetic construct
  source 1..19: note = Seed: LQTVHSIPLTINKEEALQR
LQTVHSIPLTIVKWEAVQR

SEQ ID NO: 36157 - protein, 19 aa, synthetic construct
  source 1..19: note = Seed: LQTVHSIPLTINKEEALQR
LQTVHSIPLTIVKYEAFQR

SEQ ID NO: 36158 - protein, 19 aa, synthetic construct
  source 1..19: note = Seed: LQTVHSIPLTINKEEALQR
LQTVHSIPLTIVKYEAIQR

SEQ ID NO: 36159 - protein, 19 aa, synthetic construct
  source 1..19: note = Seed: LQTVHSIPLTINKEEALQR
LQTVHSIPLTIVKYEALQR

SEQ ID NO: 36160 - protein, 19 aa, synthetic construct
  source 1..19: note = Seed: LQTVHSIPLTINKEEALQR
LQTVHSIPLTIVKYEAMQR

SEQ ID NO: 36161 - protein, 19 aa, synthetic construct
  source 1..19: note = Seed: LQTVHSIPLTINKEEALQR
LQTVHSIPLTIVKYEAVQR

SEQ ID NO: 36162 - protein, 19 aa, synthetic construct
  source 1..19: note = Seed: LQTVHSIPLTINKEEALQR
LQTVHSIPLTIWKAEAIQR

SEQ ID NO: 36163 - protein, 19 aa, synthetic construct
  source 1..19: note = Seed: LQTVHSIPLTINKEEALQR
LQTVHSIPLTIWKAEALQR

SEQ ID NO: 36164 - protein, 19 aa, synthetic construct
  source 1..19: note = Seed: LQTVHSIPLTINKEEALQR
LQTVHSIPLTIWKAEAVQR

SEQ ID NO: 36165 - protein, 19 aa, synthetic construct
  source 1..19: note = Seed: LQTVHSIPLTINKEEALQR
LQTVHSIPLTIWKDEAAQR

SEQ ID NO: 36166 - protein, 19 aa, synthetic construct
  source 1..19: note = Seed: LQTVHSIPLTINKEEALQR
LQTVHSIPLTIWKDEAIQR

SEQ ID NO: 36167 - protein, 19 aa, synthetic construct
  source 1..19: note = Seed: LQTVHSIPLTINKEEALQR
LQTVHSIPLTIWKDEALQR

SEQ ID NO: 36168 - protein, 19 aa, synthetic construct
  source 1..19: note = Seed: LQTVHSIPLTINKEEALQR
LQTVHSIPLTIWKDEAVQR

SEQ ID NO: 36169 - protein, 19 aa, synthetic construct
  source 1..19: note = Seed: LQTVHSIPLTINKEEALQR
LQTVHSIPLTIWKFEAFQR

SEQ ID NO: 36170 - protein, 19 aa, synthetic construct
  source 1..19: note = Seed: LQTVHSIPLTINKEEALQR
LQTVHSIPLTIWKFEAIQR

SEQ ID NO: 36171 - protein, 19 aa, synthetic construct
  source 1..19: note = Seed: LQTVHSIPLTINKEEALQR
LQTVHSIPLTIWKFEALQR

SEQ ID NO: 36172 - protein, 19 aa, synthetic construct
  source 1..19: note = Seed: LQTVHSIPLTINKEEALQR
LQTVHSIPLTIWKFEAMQR

SEQ ID NO: 36173 - protein, 19 aa, synthetic construct
  source 1..19: note = Seed: LQTVHSIPLTINKEEALQR
LQTVHSIPLTIWKFEAVQR

SEQ ID NO: 36174 - protein, 19 aa, synthetic construct
  source 1..19: note = Seed: LQTVHSIPLTINKEEALQR
LQTVHSIPLTIWKFEAYQR

SEQ ID NO: 36175 - protein, 19 aa, synthetic construct
  source 1..19: note = Seed: LQTVHSIPLTINKEEALQR
LQTVHSIPLTIWKIEAAQR

SEQ ID NO: 36176 - protein, 19 aa, synthetic construct
  source 1..19: note = Seed: LQTVHSIPLTINKEEALQR
LQTVHSIPLTIWKIEAIQR

SEQ ID NO: 36177 - protein, 19 aa, synthetic construct
  source 1..19: note = Seed: LQTVHSIPLTINKEEALQR
LQTVHSIPLTIWKIEALQR

SEQ ID NO: 36178 - protein, 19 aa, synthetic construct
  source 1..19: note = Seed: LQTVHSIPLTINKEEALQR
LQTVHSIPLTIWKIEAMQR

SEQ ID NO: 36179 - protein, 19 aa, synthetic construct
  source 1..19: note = Seed: LQTVHSIPLTINKEEALQR
LQTVHSIPLTIWKIEAVQR

SEQ ID NO: 36180 - protein, 19 aa, synthetic construct
  source 1..19: note = Seed: LQTVHSIPLTINKEEALQR
LQTVHSIPLTIWKLEALQR

SEQ ID NO: 36181 - protein, 19 aa, synthetic construct
  source 1..19: note = Seed: LQTVHSIPLTINKEEALQR
LQTVHSIPLTIWKNEAIQR

SEQ ID NO: 36182 - protein, 19 aa, synthetic construct
  source 1..19: note = Seed: LQTVHSIPLTINKEEALQR
LQTVHSIPLTIWKNEALQR

SEQ ID NO: 36183 - protein, 19 aa, synthetic construct
  source 1..19: note = Seed: LQTVHSIPLTINKEEALQR
LQTVHSIPLTIWKNEAVQR

SEQ ID NO: 36184 - protein, 19 aa, synthetic construct
  source 1..19: note = Seed: LQTVHSIPLTINKEEALQR
LQTVHSIPLTIWKVEAAQR

SEQ ID NO: 36185 - protein, 19 aa, synthetic construct
  source 1..19: note = Seed: LQTVHSIPLTINKEEALQR
LQTVHSIPLTIWKVEAIQR

SEQ ID NO: 36186 - protein, 19 aa, synthetic construct
  source 1..19: note = Seed: LQTVHSIPLTINKEEALQR
LQTVHSIPLTIWKVEALQR

SEQ ID NO: 36187 - protein, 19 aa, synthetic construct
  source 1..19: note = Seed: LQTVHSIPLTINKEEALQR
LQTVHSIPLTIWKVEAVQR

SEQ ID NO: 36188 - protein, 19 aa, synthetic construct
  source 1..19: note = Seed: LQTVHSIPLTINKEEALQR
LQTVHSIPLTIYKAEAAQR

SEQ ID NO: 36189 - protein, 19 aa, synthetic construct
  source 1..19: note = Seed: LQTVHSIPLTINKEEALQR
LQTVHSIPLTIYKAEAFQR

SEQ ID NO: 36190 - protein, 19 aa, synthetic construct
  source 1..19: note = Seed: LQTVHSIPLTINKEEALQR
LQTVHSIPLTIYKAEAIQR

SEQ ID NO: 36191 - protein, 19 aa, synthetic construct
  source 1..19: note = Seed: LQTVHSIPLTINKEEALQR
LQTVHSIPLTIYKAEALQR

SEQ ID NO: 36192 - protein, 19 aa, synthetic construct
  source 1..19: note = Seed: LQTVHSIPLTINKEEALQR
LQTVHSIPLTIYKAEAMQR

SEQ ID NO: 36193 - protein, 19 aa, synthetic construct
  source 1..19: note = Seed: LQTVHSIPLTINKEEALQR
LQTVHSIPLTIYKAEAVQR

SEQ ID NO: 36194 - protein, 19 aa, synthetic construct
  source 1..19: note = Seed: LQTVHSIPLTINKEEALQR
LQTVHSIPLTIYKDEAAQR

SEQ ID NO: 36195 - protein, 19 aa, synthetic construct
  source 1..19: note = Seed: LQTVHSIPLTINKEEALQR
LQTVHSIPLTIYKDEAFQR

SEQ ID NO: 36196 - protein, 19 aa, synthetic construct
  source 1..19: note = Seed: LQTVHSIPLTINKEEALQR
LQTVHSIPLTIYKDEAIQR

SEQ ID NO: 36197 - protein, 19 aa, synthetic construct
  source 1..19: note = Seed: LQTVHSIPLTINKEEALQR
LQTVHSIPLTIYKDEALQR

SEQ ID NO: 36198 - protein, 19 aa, synthetic construct
  source 1..19: note = Seed: LQTVHSIPLTINKEEALQR
LQTVHSIPLTIYKDEAMQR

SEQ ID NO: 36199 - protein, 19 aa, synthetic construct
  source 1..19: note = Seed: LQTVHSIPLTINKEEALQR
LQTVHSIPLTIYKDEASQR

SEQ ID NO: 36200 - protein, 19 aa, synthetic construct
  source 1..19: note = Seed: LQTVHSIPLTINKEEALQR
LQTVHSIPLTIYKDEAVQR

SEQ ID NO: 36201 - protein, 19 aa, synthetic construct
  source 1..19: note = Seed: LQTVHSIPLTINKEEALQR
LQTVHSIPLTIYKFEAAQR

SEQ ID NO: 36202 - protein, 19 aa, synthetic construct
  source 1..19: note = Seed: LQTVHSIPLTINKEEALQR
LQTVHSIPLTIYKFEAEQR

SEQ ID NO: 36203 - protein, 19 aa, synthetic construct
  source 1..19: note = Seed: LQTVHSIPLTINKEEALQR
LQTVHSIPLTIYKFEAFQR

SEQ ID NO: 36204 - protein, 19 aa, synthetic construct
  source 1..19: note = Seed: LQTVHSIPLTINKEEALQR
LQTVHSIPLTIYKFEAIQR

SEQ ID NO: 36205 - protein, 19 aa, synthetic construct
  source 1..19: note = Seed: LQTVHSIPLTINKEEALQR
LQTVHSIPLTIYKFEALQR

SEQ ID NO: 36206 - protein, 19 aa, synthetic construct
  source 1..19: note = Seed: LQTVHSIPLTINKEEALQR
LQTVHSIPLTIYKFEAMQR

SEQ ID NO: 36207 - protein, 19 aa, synthetic construct
  source 1..19: note = Seed: LQTVHSIPLTINKEEALQR
LQTVHSIPLTIYKFEAVQR

SEQ ID NO: 36208 - protein, 19 aa, synthetic construct
  source 1..19: note = Seed: LQTVHSIPLTINKEEALQR
LQTVHSIPLTIYKFEAYQR

SEQ ID NO: 36209 - protein, 19 aa, synthetic construct
  source 1..19: note = Seed: LQTVHSIPLTINKEEALQR
LQTVHSIPLTIYKIEAAQR

SEQ ID NO: 36210 - protein, 19 aa, synthetic construct
  source 1..19: note = Seed: LQTVHSIPLTINKEEALQR
LQTVHSIPLTIYKIEAFQR

SEQ ID NO: 36211 - protein, 19 aa, synthetic construct
  source 1..19: note = Seed: LQTVHSIPLTINKEEALQR
LQTVHSIPLTIYKIEAIQR

SEQ ID NO: 36212 - protein, 19 aa, synthetic construct
  source 1..19: note = Seed: LQTVHSIPLTINKEEALQR
LQTVHSIPLTIYKIEALQR

SEQ ID NO: 36213 - protein, 19 aa, synthetic construct
  source 1..19: note = Seed: LQTVHSIPLTINKEEALQR
LQTVHSIPLTIYKIEAMQR

SEQ ID NO: 36214 - protein, 19 aa, synthetic construct
  source 1..19: note = Seed: LQTVHSIPLTINKEEALQR
LQTVHSIPLTIYKIEASQR

SEQ ID NO: 36215 - protein, 19 aa, synthetic construct
  source 1..19: note = Seed: LQTVHSIPLTINKEEALQR
LQTVHSIPLTIYKIEAVQR

SEQ ID NO: 36216 - protein, 19 aa, synthetic construct
  source 1..19: note = Seed: LQTVHSIPLTINKEEALQR
LQTVHSIPLTIYKIEAYQR

SEQ ID NO: 36217 - protein, 19 aa, synthetic construct
  source 1..19: note = Seed: LQTVHSIPLTINKEEALQR
LQTVHSIPLTIYKLEAAQR

SEQ ID NO: 36218 - protein, 19 aa, synthetic construct
  source 1..19: note = Seed: LQTVHSIPLTINKEEALQR
LQTVHSIPLTIYKLEAFQR

SEQ ID NO: 36219 - protein, 19 aa, synthetic construct
  source 1..19: note = Seed: LQTVHSIPLTINKEEALQR
LQTVHSIPLTIYKLEAIQR

SEQ ID NO: 36220 - protein, 19 aa, synthetic construct
  source 1..19: note = Seed: LQTVHSIPLTINKEEALQR
LQTVHSIPLTIYKLEALQR

SEQ ID NO: 36221 - protein, 19 aa, synthetic construct
  source 1..19: note = Seed: LQTVHSIPLTINKEEALQR
LQTVHSIPLTIYKLEAVQR

SEQ ID NO: 36222 - protein, 19 aa, synthetic construct
  source 1..19: note = Seed: LQTVHSIPLTINKEEALQR
LQTVHSIPLTIYKMEAAQR

SEQ ID NO: 36223 - protein, 19 aa, synthetic construct
  source 1..19: note = Seed: LQTVHSIPLTINKEEALQR
LQTVHSIPLTIYKNEAAQR

SEQ ID NO: 36224 - protein, 19 aa, synthetic construct
  source 1..19: note = Seed: LQTVHSIPLTINKEEALQR
LQTVHSIPLTIYKNEAIQR

SEQ ID NO: 36225 - protein, 19 aa, synthetic construct
  source 1..19: note = Seed: LQTVHSIPLTINKEEALQR
LQTVHSIPLTIYKNEALQR

SEQ ID NO: 36226 - protein, 19 aa, synthetic construct
  source 1..19: note = Seed: LQTVHSIPLTINKEEALQR
LQTVHSIPLTIYKNEAVQR

SEQ ID NO: 36227 - protein, 19 aa, synthetic construct
  source 1..19: note = Seed: LQTVHSIPLTINKEEALQR
LQTVHSIPLTIYKVEAAQR

SEQ ID NO: 36228 - protein, 19 aa, synthetic construct
  source 1..19: note = Seed: LQTVHSIPLTINKEEALQR
LQTVHSIPLTIYKVEAFQR

SEQ ID NO: 36229 - protein, 19 aa, synthetic construct
  source 1..19: note = Seed: LQTVHSIPLTINKEEALQR
LQTVHSIPLTIYKVEAIQR

SEQ ID NO: 36230 - protein, 19 aa, synthetic construct
  source 1..19: note = Seed: LQTVHSIPLTINKEEALQR
LQTVHSIPLTIYKVEALQR

SEQ ID NO: 36231 - protein, 19 aa, synthetic construct
  source 1..19: note = Seed: LQTVHSIPLTINKEEALQR
LQTVHSIPLTIYKVEAMQR

SEQ ID NO: 36232 - protein, 19 aa, synthetic construct
  source 1..19: note = Seed: LQTVHSIPLTINKEEALQR
LQTVHSIPLTIYKVEASQR

SEQ ID NO: 36233 - protein, 19 aa, synthetic construct
  source 1..19: note = Seed: LQTVHSIPLTINKEEALQR
LQTVHSIPLTIYKVEAVQR

SEQ ID NO: 36234 - protein, 19 aa, synthetic construct
  source 1..19: note = Seed: LQTVHSIPLTINKEEALQR
LQTVHSIPLTIYKYEAIQR

SEQ ID NO: 36235 - protein, 19 aa, synthetic construct
  source 1..19: note = Seed: LQTVHSIPLTINKEEALQR
LQTVHSIPLTIYKYEALQR

SEQ ID NO: 36236 - protein, 19 aa, synthetic construct
  source 1..19: note = Seed: LQTVHSIPLTINKEEALQR
LQTVHSIPMTIAKFEAFQR

SEQ ID NO: 36237 - protein, 19 aa, synthetic construct
  source 1..19: note = Seed: LQTVHSIPLTINKEEALQR
LQTVHSIPMTIAKFEAIQR

SEQ ID NO: 36238 - protein, 19 aa, synthetic construct
  source 1..19: note = Seed: LQTVHSIPLTINKEEALQR
LQTVHSIPMTIAKFEALQR

SEQ ID NO: 36239 - protein, 19 aa, synthetic construct
  source 1..19: note = Seed: LQTVHSIPLTINKEEALQR
LQTVHSIPMTIAKFEAVQR

SEQ ID NO: 36240 - protein, 19 aa, synthetic construct
  source 1..19: note = Seed: LQTVHSIPLTINKEEALQR
LQTVHSIPMTIAKIEAAQR

SEQ ID NO: 36241 - protein, 19 aa, synthetic construct
  source 1..19: note = Seed: LQTVHSIPLTINKEEALQR
LQTVHSIPMTIAKIEAIQR

SEQ ID NO: 36242 - protein, 19 aa, synthetic construct
  source 1..19: note = Seed: LQTVHSIPLTINKEEALQR
LQTVHSIPMTIAKIEAVQR

SEQ ID NO: 36243 - protein, 19 aa, synthetic construct
  source 1..19: note = Seed: LQTVHSIPLTINKEEALQR
LQTVHSIPMTIEKFEAFQR

SEQ ID NO: 36244 - protein, 19 aa, synthetic construct
  source 1..19: note = Seed: LQTVHSIPLTINKEEALQR
LQTVHSIPMTIEKFEAIQR

SEQ ID NO: 36245 - protein, 19 aa, synthetic construct
  source 1..19: note = Seed: LQTVHSIPLTINKEEALQR
LQTVHSIPMTIEKFEALQR

SEQ ID NO: 36246 - protein, 19 aa, synthetic construct
  source 1..19: note = Seed: LQTVHSIPLTINKEEALQR
LQTVHSIPMTIEKFEAVQR

SEQ ID NO: 36247 - protein, 19 aa, synthetic construct
  source 1..19: note = Seed: LQTVHSIPLTINKEEALQR
LQTVHSIPMTIFKAEAAQR

SEQ ID NO: 36248 - protein, 19 aa, synthetic construct
  source 1..19: note = Seed: LQTVHSIPLTINKEEALQR
LQTVHSIPMTIFKAEAFQR

SEQ ID NO: 36249 - protein, 19 aa, synthetic construct
  source 1..19: note = Seed: LQTVHSIPLTINKEEALQR
LQTVHSIPMTIFKAEAIQR

SEQ ID NO: 36250 - protein, 19 aa, synthetic construct
  source 1..19: note = Seed: LQTVHSIPLTINKEEALQR
LQTVHSIPMTIFKAEALQR

SEQ ID NO: 36251 - protein, 19 aa, synthetic construct
  source 1..19: note = Seed: LQTVHSIPLTINKEEALQR
LQTVHSIPMTIFKAEAMQR

SEQ ID NO: 36252 - protein, 19 aa, synthetic construct
  source 1..19: note = Seed: LQTVHSIPLTINKEEALQR
LQTVHSIPMTIFKAEAVQR

SEQ ID NO: 36253 - protein, 19 aa, synthetic construct
  source 1..19: note = Seed: LQTVHSIPLTINKEEALQR
LQTVHSIPMTIFKDEAAQR

SEQ ID NO: 36254 - protein, 19 aa, synthetic construct
  source 1..19: note = Seed: LQTVHSIPLTINKEEALQR
LQTVHSIPMTIFKDEAFQR

SEQ ID NO: 36255 - protein, 19 aa, synthetic construct
  source 1..19: note = Seed: LQTVHSIPLTINKEEALQR
LQTVHSIPMTIFKDEAIQR

SEQ ID NO: 36256 - protein, 19 aa, synthetic construct
  source 1..19: note = Seed: LQTVHSIPLTINKEEALQR
LQTVHSIPMTIFKDEALQR

SEQ ID NO: 36257 - protein, 19 aa, synthetic construct
  source 1..19: note = Seed: LQTVHSIPLTINKEEALQR
LQTVHSIPMTIFKDEAMQR

SEQ ID NO: 36258 - protein, 19 aa, synthetic construct
  source 1..19: note = Seed: LQTVHSIPLTINKEEALQR
LQTVHSIPMTIFKDEAVQR

SEQ ID NO: 36259 - protein, 19 aa, synthetic construct
  source 1..19: note = Seed: LQTVHSIPLTINKEEALQR
LQTVHSIPMTIFKFEAAQR

SEQ ID NO: 36260 - protein, 19 aa, synthetic construct
  source 1..19: note = Seed: LQTVHSIPLTINKEEALQR
LQTVHSIPMTIFKFEAEQR

SEQ ID NO: 36261 - protein, 19 aa, synthetic construct
  source 1..19: note = Seed: LQTVHSIPLTINKEEALQR
LQTVHSIPMTIFKFEAFQR

SEQ ID NO: 36262 - protein, 19 aa, synthetic construct
  source 1..19: note = Seed: LQTVHSIPLTINKEEALQR
LQTVHSIPMTIFKFEAIQR

SEQ ID NO: 36263 - protein, 19 aa, synthetic construct
  source 1..19: note = Seed: LQTVHSIPLTINKEEALQR
LQTVHSIPMTIFKFEALQR

SEQ ID NO: 36264 - protein, 19 aa, synthetic construct
  source 1..19: note = Seed: LQTVHSIPLTINKEEALQR
LQTVHSIPMTIFKFEAMQR

SEQ ID NO: 36265 - protein, 19 aa, synthetic construct
  source 1..19: note = Seed: LQTVHSIPLTINKEEALQR
LQTVHSIPMTIFKFEARQR

SEQ ID NO: 36266 - protein, 19 aa, synthetic construct
  source 1..19: note = Seed: LQTVHSIPLTINKEEALQR
LQTVHSIPMTIFKFEASQR

SEQ ID NO: 36267 - protein, 19 aa, synthetic construct
  source 1..19: note = Seed: LQTVHSIPLTINKEEALQR
LQTVHSIPMTIFKFEATQR

SEQ ID NO: 36268 - protein, 19 aa, synthetic construct
  source 1..19: note = Seed: LQTVHSIPLTINKEEALQR
LQTVHSIPMTIFKFEAVQR

SEQ ID NO: 36269 - protein, 19 aa, synthetic construct
  source 1..19: note = Seed: LQTVHSIPLTINKEEALQR
LQTVHSIPMTIFKFEAYQR

SEQ ID NO: 36270 - protein, 19 aa, synthetic construct
  source 1..19: note = Seed: LQTVHSIPLTINKEEALQR
LQTVHSIPMTIFKIEAAQR

SEQ ID NO: 36271 - protein, 19 aa, synthetic construct
  source 1..19: note = Seed: LQTVHSIPLTINKEEALQR
LQTVHSIPMTIFKIEAFQR

SEQ ID NO: 36272 - protein, 19 aa, synthetic construct
  source 1..19: note = Seed: LQTVHSIPLTINKEEALQR
LQTVHSIPMTIFKIEAGQR

SEQ ID NO: 36273 - protein, 19 aa, synthetic construct
  source 1..19: note = Seed: LQTVHSIPLTINKEEALQR
LQTVHSIPMTIFKIEAIQR

SEQ ID NO: 36274 - protein, 19 aa, synthetic construct
  source 1..19: note = Seed: LQTVHSIPLTINKEEALQR
LQTVHSIPMTIFKIEALQR

SEQ ID NO: 36275 - protein, 19 aa, synthetic construct
  source 1..19: note = Seed: LQTVHSIPLTINKEEALQR
LQTVHSIPMTIFKIEAMQR

SEQ ID NO: 36276 - protein, 19 aa, synthetic construct
  source 1..19: note = Seed: LQTVHSIPLTINKEEALQR
LQTVHSIPMTIFKIEASQR

SEQ ID NO: 36277 - protein, 19 aa, synthetic construct
  source 1..19: note = Seed: LQTVHSIPLTINKEEALQR
LQTVHSIPMTIFKIEATQR

SEQ ID NO: 36278 - protein, 19 aa, synthetic construct
  source 1..19: note = Seed: LQTVHSIPLTINKEEALQR
LQTVHSIPMTIFKIEAVQR

SEQ ID NO: 36279 - protein, 19 aa, synthetic construct
  source 1..19: note = Seed: LQTVHSIPLTINKEEALQR
LQTVHSIPMTIFKIEAYQR

SEQ ID NO: 36280 - protein, 19 aa, synthetic construct
  source 1..19: note = Seed: LQTVHSIPLTINKEEALQR
LQTVHSIPMTIFKLEAAQR

SEQ ID NO: 36281 - protein, 19 aa, synthetic construct
  source 1..19: note = Seed: LQTVHSIPLTINKEEALQR
LQTVHSIPMTIFKLEAFQR

SEQ ID NO: 36282 - protein, 19 aa, synthetic construct
  source 1..19: note = Seed: LQTVHSIPLTINKEEALQR
LQTVHSIPMTIFKLEAIQR

SEQ ID NO: 36283 - protein, 19 aa, synthetic construct
  source 1..19: note = Seed: LQTVHSIPLTINKEEALQR
LQTVHSIPMTIFKLEALQR

SEQ ID NO: 36284 - protein, 19 aa, synthetic construct
  source 1..19: note = Seed: LQTVHSIPLTINKEEALQR
LQTVHSIPMTIFKLEAMQR

SEQ ID NO: 36285 - protein, 19 aa, synthetic construct
  source 1..19: note = Seed: LQTVHSIPLTINKEEALQR
LQTVHSIPMTIFKLEAVQR

SEQ ID NO: 36286 - protein, 19 aa, synthetic construct
  source 1..19: note = Seed: LQTVHSIPLTINKEEALQR
LQTVHSIPMTIFKLEAYQR

SEQ ID NO: 36287 - protein, 19 aa, synthetic construct
  source 1..19: note = Seed: LQTVHSIPLTINKEEALQR
LQTVHSIPMTIFKMEAAQR

SEQ ID NO: 36288 - protein, 19 aa, synthetic construct
  source 1..19: note = Seed: LQTVHSIPLTINKEEALQR
LQTVHSIPMTIFKMEAIQR

SEQ ID NO: 36289 - protein, 19 aa, synthetic construct
  source 1..19: note = Seed: LQTVHSIPLTINKEEALQR
LQTVHSIPMTIFKMEAVQR

SEQ ID NO: 36290 - protein, 19 aa, synthetic construct
  source 1..19: note = Seed: LQTVHSIPLTINKEEALQR
LQTVHSIPMTIFKNEAAQR

SEQ ID NO: 36291 - protein, 19 aa, synthetic construct
  source 1..19: note = Seed: LQTVHSIPLTINKEEALQR
LQTVHSIPMTIFKNEAIQR

SEQ ID NO: 36292 - protein, 19 aa, synthetic construct
  source 1..19: note = Seed: LQTVHSIPLTINKEEALQR
LQTVHSIPMTIFKNEALQR

SEQ ID NO: 36293 - protein, 19 aa, synthetic construct
  source 1..19: note = Seed: LQTVHSIPLTINKEEALQR
LQTVHSIPMTIFKNEAVQR

SEQ ID NO: 36294 - protein, 19 aa, synthetic construct
  source 1..19: note = Seed: LQTVHSIPLTINKEEALQR
LQTVHSIPMTIFKSEAIQR

SEQ ID NO: 36295 - protein, 19 aa, synthetic construct
  source 1..19: note = Seed: LQTVHSIPLTINKEEALQR
LQTVHSIPMTIFKSEAVQR

SEQ ID NO: 36296 - protein, 19 aa, synthetic construct
  source 1..19: note = Seed: LQTVHSIPLTINKEEALQR
LQTVHSIPMTIFKVEAAQR

SEQ ID NO: 36297 - protein, 19 aa, synthetic construct
  source 1..19: note = Seed: LQTVHSIPLTINKEEALQR
LQTVHSIPMTIFKVEAFQR

SEQ ID NO: 36298 - protein, 19 aa, synthetic construct
  source 1..19: note = Seed: LQTVHSIPLTINKEEALQR
LQTVHSIPMTIFKVEAIQR

SEQ ID NO: 36299 - protein, 19 aa, synthetic construct
  source 1..19: note = Seed: LQTVHSIPLTINKEEALQR
LQTVHSIPMTIFKVEALQR

SEQ ID NO: 36300 - protein, 19 aa, synthetic construct
  source 1..19: note = Seed: LQTVHSIPLTINKEEALQR
LQTVHSIPMTIFKVEAMQR

SEQ ID NO: 36301 - protein, 19 aa, synthetic construct
  source 1..19: note = Seed: LQTVHSIPLTINKEEALQR
LQTVHSIPMTIFKVEASQR

SEQ ID NO: 36302 - protein, 19 aa, synthetic construct
  source 1..19: note = Seed: LQTVHSIPLTINKEEALQR
LQTVHSIPMTIFKVEATQR

SEQ ID NO: 36303 - protein, 19 aa, synthetic construct
  source 1..19: note = Seed: LQTVHSIPLTINKEEALQR
LQTVHSIPMTIFKVEAVQR

SEQ ID NO: 36304 - protein, 19 aa, synthetic construct
  source 1..19: note = Seed: LQTVHSIPLTINKEEALQR
LQTVHSIPMTIFKVEAYQR

SEQ ID NO: 36305 - protein, 19 aa, synthetic construct
  source 1..19: note = Seed: LQTVHSIPLTINKEEALQR
LQTVHSIPMTIFKYEAFQR

SEQ ID NO: 36306 - protein, 19 aa, synthetic construct
  source 1..19: note = Seed: LQTVHSIPLTINKEEALQR
LQTVHSIPMTIFKYEAIQR

SEQ ID NO: 36307 - protein, 19 aa, synthetic construct
  source 1..19: note = Seed: LQTVHSIPLTINKEEALQR
LQTVHSIPMTIFKYEALQR

SEQ ID NO: 36308 - protein, 19 aa, synthetic construct
  source 1..19: note = Seed: LQTVHSIPLTINKEEALQR
LQTVHSIPMTIFKYEAVQR

SEQ ID NO: 36309 - protein, 19 aa, synthetic construct
  source 1..19: note = Seed: LQTVHSIPLTINKEEALQR
LQTVHSIPMTIHKFEAFQR

SEQ ID NO: 36310 - protein, 19 aa, synthetic construct
  source 1..19: note = Seed: LQTVHSIPLTINKEEALQR
LQTVHSIPMTIHKFEAIQR

SEQ ID NO: 36311 - protein, 19 aa, synthetic construct
  source 1..19: note = Seed: LQTVHSIPLTINKEEALQR
LQTVHSIPMTIHKFEALQR

SEQ ID NO: 36312 - protein, 19 aa, synthetic construct
  source 1..19: note = Seed: LQTVHSIPLTINKEEALQR
LQTVHSIPMTIHKFEAVQR

SEQ ID NO: 36313 - protein, 19 aa, synthetic construct
  source 1..19: note = Seed: LQTVHSIPLTINKEEALQR
LQTVHSIPMTIIKAEAIQR

SEQ ID NO: 36314 - protein, 19 aa, synthetic construct
  source 1..19: note = Seed: LQTVHSIPLTINKEEALQR
LQTVHSIPMTIIKAEALQR

SEQ ID NO: 36315 - protein, 19 aa, synthetic construct
  source 1..19: note = Seed: LQTVHSIPLTINKEEALQR
LQTVHSIPMTIIKAEAVQR

SEQ ID NO: 36316 - protein, 19 aa, synthetic construct
  source 1..19: note = Seed: LQTVHSIPLTINKEEALQR
LQTVHSIPMTIIKFEAAQR

SEQ ID NO: 36317 - protein, 19 aa, synthetic construct
  source 1..19: note = Seed: LQTVHSIPLTINKEEALQR
LQTVHSIPMTIIKFEAEQR

SEQ ID NO: 36318 - protein, 19 aa, synthetic construct
  source 1..19: note = Seed: LQTVHSIPLTINKEEALQR
LQTVHSIPMTIIKFEAFQR

SEQ ID NO: 36319 - protein, 19 aa, synthetic construct
  source 1..19: note = Seed: LQTVHSIPLTINKEEALQR
LQTVHSIPMTIIKFEAIQR

SEQ ID NO: 36320 - protein, 19 aa, synthetic construct
  source 1..19: note = Seed: LQTVHSIPLTINKEEALQR
LQTVHSIPMTIIKFEALQR

SEQ ID NO: 36321 - protein, 19 aa, synthetic construct
  source 1..19: note = Seed: LQTVHSIPLTINKEEALQR
LQTVHSIPMTIIKFEAMQR

SEQ ID NO: 36322 - protein, 19 aa, synthetic construct
  source 1..19: note = Seed: LQTVHSIPLTINKEEALQR
LQTVHSIPMTIIKFEATQR

SEQ ID NO: 36323 - protein, 19 aa, synthetic construct
  source 1..19: note = Seed: LQTVHSIPLTINKEEALQR
LQTVHSIPMTIIKFEAVQR

SEQ ID NO: 36324 - protein, 19 aa, synthetic construct
  source 1..19: note = Seed: LQTVHSIPLTINKEEALQR
LQTVHSIPMTIIKFEAYQR

SEQ ID NO: 36325 - protein, 19 aa, synthetic construct
  source 1..19: note = Seed: LQTVHSIPLTINKEEALQR
LQTVHSIPMTIIKIEAAQR

SEQ ID NO: 36326 - protein, 19 aa, synthetic construct
  source 1..19: note = Seed: LQTVHSIPLTINKEEALQR
LQTVHSIPMTIIKIEAIQR

SEQ ID NO: 36327 - protein, 19 aa, synthetic construct
  source 1..19: note = Seed: LQTVHSIPLTINKEEALQR
LQTVHSIPMTIIKIEALQR

SEQ ID NO: 36328 - protein, 19 aa, synthetic construct
  source 1..19: note = Seed: LQTVHSIPLTINKEEALQR
LQTVHSIPMTIIKIEAMQR

SEQ ID NO: 36329 - protein, 19 aa, synthetic construct
  source 1..19: note = Seed: LQTVHSIPLTINKEEALQR
LQTVHSIPMTIIKIEAVQR

SEQ ID NO: 36330 - protein, 19 aa, synthetic construct
  source 1..19: note = Seed: LQTVHSIPLTINKEEALQR
LQTVHSIPMTIIKLEAAQR

SEQ ID NO: 36331 - protein, 19 aa, synthetic construct
  source 1..19: note = Seed: LQTVHSIPLTINKEEALQR
LQTVHSIPMTIIKLEAIQR

SEQ ID NO: 36332 - protein, 19 aa, synthetic construct
  source 1..19: note = Seed: LQTVHSIPLTINKEEALQR
LQTVHSIPMTIIKLEALQR

SEQ ID NO: 36333 - protein, 19 aa, synthetic construct
  source 1..19: note = Seed: LQTVHSIPLTINKEEALQR
LQTVHSIPMTIIKVEAAQR

SEQ ID NO: 36334 - protein, 19 aa, synthetic construct
  source 1..19: note = Seed: LQTVHSIPLTINKEEALQR
LQTVHSIPMTIIKVEAIQR

SEQ ID NO: 36335 - protein, 19 aa, synthetic construct
  source 1..19: note = Seed: LQTVHSIPLTINKEEALQR
LQTVHSIPMTIIKVEALQR

SEQ ID NO: 36336 - protein, 19 aa, synthetic construct
  source 1..19: note = Seed: LQTVHSIPLTINKEEALQR
LQTVHSIPMTIIKVEAVQR

SEQ ID NO: 36337 - protein, 19 aa, synthetic construct
  source 1..19: note = Seed: LQTVHSIPLTINKEEALQR
LQTVHSIPMTIIKYEAIQR

SEQ ID NO: 36338 - protein, 19 aa, synthetic construct
  source 1..19: note = Seed: LQTVHSIPLTINKEEALQR
LQTVHSIPMTIIKYEALQR

SEQ ID NO: 36339 - protein, 19 aa, synthetic construct
  source 1..19: note = Seed: LQTVHSIPLTINKEEALQR
LQTVHSIPMTILKAEAAQR

SEQ ID NO: 36340 - protein, 19 aa, synthetic construct
  source 1..19: note = Seed: LQTVHSIPLTINKEEALQR
LQTVHSIPMTILKAEAIQR

SEQ ID NO: 36341 - protein, 19 aa, synthetic construct
  source 1..19: note = Seed: LQTVHSIPLTINKEEALQR
LQTVHSIPMTILKAEALQR

SEQ ID NO: 36342 - protein, 19 aa, synthetic construct
  source 1..19: note = Seed: LQTVHSIPLTINKEEALQR
LQTVHSIPMTILKAEATQR

SEQ ID NO: 36343 - protein, 19 aa, synthetic construct
  source 1..19: note = Seed: LQTVHSIPLTINKEEALQR
LQTVHSIPMTILKAEAVQR

SEQ ID NO: 36344 - protein, 19 aa, synthetic construct
  source 1..19: note = Seed: LQTVHSIPLTINKEEALQR
LQTVHSIPMTILKFEAAQR

SEQ ID NO: 36345 - protein, 19 aa, synthetic construct
  source 1..19: note = Seed: LQTVHSIPLTINKEEALQR
LQTVHSIPMTILKFEAEQR

SEQ ID NO: 36346 - protein, 19 aa, synthetic construct
  source 1..19: note = Seed: LQTVHSIPLTINKEEALQR
LQTVHSIPMTILKFEAFQR

SEQ ID NO: 36347 - protein, 19 aa, synthetic construct
  source 1..19: note = Seed: LQTVHSIPLTINKEEALQR
LQTVHSIPMTILKFEAIQR

SEQ ID NO: 36348 - protein, 19 aa, synthetic construct
  source 1..19: note = Seed: LQTVHSIPLTINKEEALQR
LQTVHSIPMTILKFEALQR

SEQ ID NO: 36349 - protein, 19 aa, synthetic construct
  source 1..19: note = Seed: LQTVHSIPLTINKEEALQR
LQTVHSIPMTILKFEAMQR

SEQ ID NO: 36350 - protein, 19 aa, synthetic construct
  source 1..19: note = Seed: LQTVHSIPLTINKEEALQR
LQTVHSIPMTILKFEASQR

SEQ ID NO: 36351 - protein, 19 aa, synthetic construct
  source 1..19: note = Seed: LQTVHSIPLTINKEEALQR
LQTVHSIPMTILKFEATQR

SEQ ID NO: 36352 - protein, 19 aa, synthetic construct
  source 1..19: note = Seed: LQTVHSIPLTINKEEALQR
LQTVHSIPMTILKFEAVQR

SEQ ID NO: 36353 - protein, 19 aa, synthetic construct
  source 1..19: note = Seed: LQTVHSIPLTINKEEALQR
LQTVHSIPMTILKFEAYQR

SEQ ID NO: 36354 - protein, 19 aa, synthetic construct
  source 1..19: note = Seed: LQTVHSIPLTINKEEALQR
LQTVHSIPMTILKGEAAQR

SEQ ID NO: 36355 - protein, 19 aa, synthetic construct
  source 1..19: note = Seed: LQTVHSIPLTINKEEALQR
LQTVHSIPMTILKGEAIQR

SEQ ID NO: 36356 - protein, 19 aa, synthetic construct
  source 1..19: note = Seed: LQTVHSIPLTINKEEALQR
LQTVHSIPMTILKGEALQR

SEQ ID NO: 36357 - protein, 19 aa, synthetic construct
  source 1..19: note = Seed: LQTVHSIPLTINKEEALQR
LQTVHSIPMTILKGEATQR

SEQ ID NO: 36358 - protein, 19 aa, synthetic construct
  source 1..19: note = Seed: LQTVHSIPLTINKEEALQR
LQTVHSIPMTILKGEAVQR

SEQ ID NO: 36359 - protein, 19 aa, synthetic construct
  source 1..19: note = Seed: LQTVHSIPLTINKEEALQR
LQTVHSIPMTILKIEAAQR

SEQ ID NO: 36360 - protein, 19 aa, synthetic construct
  source 1..19: note = Seed: LQTVHSIPLTINKEEALQR
LQTVHSIPMTILKIEAIQR

SEQ ID NO: 36361 - protein, 19 aa, synthetic construct
  source 1..19: note = Seed: LQTVHSIPLTINKEEALQR
LQTVHSIPMTILKIEALQR

SEQ ID NO: 36362 - protein, 19 aa, synthetic construct
  source 1..19: note = Seed: LQTVHSIPLTINKEEALQR
LQTVHSIPMTILKIEAVQR

SEQ ID NO: 36363 - protein, 19 aa, synthetic construct
  source 1..19: note = Seed: LQTVHSIPLTINKEEALQR
LQTVHSIPMTILKLEAFQR

SEQ ID NO: 36364 - protein, 19 aa, synthetic construct
  source 1..19: note = Seed: LQTVHSIPLTINKEEALQR
LQTVHSIPMTILKLEAIQR

SEQ ID NO: 36365 - protein, 19 aa, synthetic construct
  source 1..19: note = Seed: LQTVHSIPLTINKEEALQR
LQTVHSIPMTILKLEALQR

SEQ ID NO: 36366 - protein, 19 aa, synthetic construct
  source 1..19: note = Seed: LQTVHSIPLTINKEEALQR
LQTVHSIPMTILKPEAVQR

SEQ ID NO: 36367 - protein, 19 aa, synthetic construct
  source 1..19: note = Seed: LQTVHSIPLTINKEEALQR
LQTVHSIPMTILKSEAAQR

SEQ ID NO: 36368 - protein, 19 aa, synthetic construct
  source 1..19: note = Seed: LQTVHSIPLTINKEEALQR
LQTVHSIPMTILKSEAIQR

SEQ ID NO: 36369 - protein, 19 aa, synthetic construct
  source 1..19: note = Seed: LQTVHSIPLTINKEEALQR
LQTVHSIPMTILKSEALQR

SEQ ID NO: 36370 - protein, 19 aa, synthetic construct
  source 1..19: note = Seed: LQTVHSIPLTINKEEALQR
LQTVHSIPMTILKSEATQR

SEQ ID NO: 36371 - protein, 19 aa, synthetic construct
  source 1..19: note = Seed: LQTVHSIPLTINKEEALQR
LQTVHSIPMTILKSEAVQR

SEQ ID NO: 36372 - protein, 19 aa, synthetic construct
  source 1..19: note = Seed: LQTVHSIPLTINKEEALQR
LQTVHSIPMTILKVEAAQR

SEQ ID NO: 36373 - protein, 19 aa, synthetic construct
  source 1..19: note = Seed: LQTVHSIPLTINKEEALQR
LQTVHSIPMTILKVEAIQR

SEQ ID NO: 36374 - protein, 19 aa, synthetic construct
  source 1..19: note = Seed: LQTVHSIPLTINKEEALQR
LQTVHSIPMTILKVEAVQR

SEQ ID NO: 36375 - protein, 19 aa, synthetic construct
  source 1..19: note = Seed: LQTVHSIPLTINKEEALQR
LQTVHSIPMTILKYEAFQR

SEQ ID NO: 36376 - protein, 19 aa, synthetic construct
  source 1..19: note = Seed: LQTVHSIPLTINKEEALQR
LQTVHSIPMTILKYEAIQR

SEQ ID NO: 36377 - protein, 19 aa, synthetic construct
  source 1..19: note = Seed: LQTVHSIPLTINKEEALQR
LQTVHSIPMTILKYEALQR

SEQ ID NO: 36378 - protein, 19 aa, synthetic construct
  source 1..19: note = Seed: LQTVHSIPLTINKEEALQR
LQTVHSIPMTIMKAEAAQR

SEQ ID NO: 36379 - protein, 19 aa, synthetic construct
  source 1..19: note = Seed: LQTVHSIPLTINKEEALQR
LQTVHSIPMTIMKAEAIQR

SEQ ID NO: 36380 - protein, 19 aa, synthetic construct
  source 1..19: note = Seed: LQTVHSIPLTINKEEALQR
LQTVHSIPMTIMKAEALQR

SEQ ID NO: 36381 - protein, 19 aa, synthetic construct
  source 1..19: note = Seed: LQTVHSIPLTINKEEALQR
LQTVHSIPMTIMKAEAMQR

SEQ ID NO: 36382 - protein, 19 aa, synthetic construct
  source 1..19: note = Seed: LQTVHSIPLTINKEEALQR
LQTVHSIPMTIMKAEASQR

SEQ ID NO: 36383 - protein, 19 aa, synthetic construct
  source 1..19: note = Seed: LQTVHSIPLTINKEEALQR
LQTVHSIPMTIMKAEATQR

SEQ ID NO: 36384 - protein, 19 aa, synthetic construct
  source 1..19: note = Seed: LQTVHSIPLTINKEEALQR
LQTVHSIPMTIMKAEAVQR

SEQ ID NO: 36385 - protein, 19 aa, synthetic construct
  source 1..19: note = Seed: LQTVHSIPLTINKEEALQR
LQTVHSIPMTIMKDEAIQR

SEQ ID NO: 36386 - protein, 19 aa, synthetic construct
  source 1..19: note = Seed: LQTVHSIPLTINKEEALQR
LQTVHSIPMTIMKDEAVQR

SEQ ID NO: 36387 - protein, 19 aa, synthetic construct
  source 1..19: note = Seed: LQTVHSIPLTINKEEALQR
LQTVHSIPMTIMKFEAFQR

SEQ ID NO: 36388 - protein, 19 aa, synthetic construct
  source 1..19: note = Seed: LQTVHSIPLTINKEEALQR
LQTVHSIPMTIMKFEAIQR

SEQ ID NO: 36389 - protein, 19 aa, synthetic construct
  source 1..19: note = Seed: LQTVHSIPLTINKEEALQR
LQTVHSIPMTIMKFEALQR

SEQ ID NO: 36390 - protein, 19 aa, synthetic construct
  source 1..19: note = Seed: LQTVHSIPLTINKEEALQR
LQTVHSIPMTIMKFEAMQR

SEQ ID NO: 36391 - protein, 19 aa, synthetic construct
  source 1..19: note = Seed: LQTVHSIPLTINKEEALQR
LQTVHSIPMTIMKFEAVQR

SEQ ID NO: 36392 - protein, 19 aa, synthetic construct
  source 1..19: note = Seed: LQTVHSIPLTINKEEALQR
LQTVHSIPMTIMKFEAYQR

SEQ ID NO: 36393 - protein, 19 aa, synthetic construct
  source 1..19: note = Seed: LQTVHSIPLTINKEEALQR
LQTVHSIPMTIMKGEAAQR

SEQ ID NO: 36394 - protein, 19 aa, synthetic construct
  source 1..19: note = Seed: LQTVHSIPLTINKEEALQR
LQTVHSIPMTIMKGEAIQR

SEQ ID NO: 36395 - protein, 19 aa, synthetic construct
  source 1..19: note = Seed: LQTVHSIPLTINKEEALQR
LQTVHSIPMTIMKGEALQR

SEQ ID NO: 36396 - protein, 19 aa, synthetic construct
  source 1..19: note = Seed: LQTVHSIPLTINKEEALQR
LQTVHSIPMTIMKGEAMQR

SEQ ID NO: 36397 - protein, 19 aa, synthetic construct
  source 1..19: note = Seed: LQTVHSIPLTINKEEALQR
LQTVHSIPMTIMKGEATQR

SEQ ID NO: 36398 - protein, 19 aa, synthetic construct
  source 1..19: note = Seed: LQTVHSIPLTINKEEALQR
LQTVHSIPMTIMKGEAVQR

SEQ ID NO: 36399 - protein, 19 aa, synthetic construct
  source 1..19: note = Seed: LQTVHSIPLTINKEEALQR
LQTVHSIPMTIMKIEAAQR

SEQ ID NO: 36400 - protein, 19 aa, synthetic construct
  source 1..19: note = Seed: LQTVHSIPLTINKEEALQR
LQTVHSIPMTIMKIEAFQR

SEQ ID NO: 36401 - protein, 19 aa, synthetic construct
  source 1..19: note = Seed: LQTVHSIPLTINKEEALQR
LQTVHSIPMTIMKIEAIQR

SEQ ID NO: 36402 - protein, 19 aa, synthetic construct
  source 1..19: note = Seed: LQTVHSIPLTINKEEALQR
LQTVHSIPMTIMKIEALQR

SEQ ID NO: 36403 - protein, 19 aa, synthetic construct
  source 1..19: note = Seed: LQTVHSIPLTINKEEALQR
LQTVHSIPMTIMKIEAMQR

SEQ ID NO: 36404 - protein, 19 aa, synthetic construct
  source 1..19: note = Seed: LQTVHSIPLTINKEEALQR
LQTVHSIPMTIMKIEASQR

SEQ ID NO: 36405 - protein, 19 aa, synthetic construct
  source 1..19: note = Seed: LQTVHSIPLTINKEEALQR
LQTVHSIPMTIMKIEAVQR

SEQ ID NO: 36406 - protein, 19 aa, synthetic construct
  source 1..19: note = Seed: LQTVHSIPLTINKEEALQR
LQTVHSIPMTIMKLEAAQR

SEQ ID NO: 36407 - protein, 19 aa, synthetic construct
  source 1..19: note = Seed: LQTVHSIPLTINKEEALQR
LQTVHSIPMTIMKLEAIQR

SEQ ID NO: 36408 - protein, 19 aa, synthetic construct
  source 1..19: note = Seed: LQTVHSIPLTINKEEALQR
LQTVHSIPMTIMKLEALQR

SEQ ID NO: 36409 - protein, 19 aa, synthetic construct
  source 1..19: note = Seed: LQTVHSIPLTINKEEALQR
LQTVHSIPMTIMKLEAVQR

SEQ ID NO: 36410 - protein, 19 aa, synthetic construct
  source 1..19: note = Seed: LQTVHSIPLTINKEEALQR
LQTVHSIPMTIMKMEAAQR

SEQ ID NO: 36411 - protein, 19 aa, synthetic construct
  source 1..19: note = Seed: LQTVHSIPLTINKEEALQR
LQTVHSIPMTIMKMEAIQR

SEQ ID NO: 36412 - protein, 19 aa, synthetic construct
  source 1..19: note = Seed: LQTVHSIPLTINKEEALQR
LQTVHSIPMTIMKMEALQR

SEQ ID NO: 36413 - protein, 19 aa, synthetic construct
  source 1..19: note = Seed: LQTVHSIPLTINKEEALQR
LQTVHSIPMTIMKMEAVQR

SEQ ID NO: 36414 - protein, 19 aa, synthetic construct
  source 1..19: note = Seed: LQTVHSIPLTINKEEALQR
LQTVHSIPMTIMKPEALQR

SEQ ID NO: 36415 - protein, 19 aa, synthetic construct
  source 1..19: note = Seed: LQTVHSIPLTINKEEALQR
LQTVHSIPMTIMKPEAVQR

SEQ ID NO: 36416 - protein, 19 aa, synthetic construct
  source 1..19: note = Seed: LQTVHSIPLTINKEEALQR
LQTVHSIPMTIMKSEAAQR

SEQ ID NO: 36417 - protein, 19 aa, synthetic construct
  source 1..19: note = Seed: LQTVHSIPLTINKEEALQR
LQTVHSIPMTIMKSEAIQR

SEQ ID NO: 36418 - protein, 19 aa, synthetic construct
  source 1..19: note = Seed: LQTVHSIPLTINKEEALQR
LQTVHSIPMTIMKSEALQR

SEQ ID NO: 36419 - protein, 19 aa, synthetic construct
  source 1..19: note = Seed: LQTVHSIPLTINKEEALQR
LQTVHSIPMTIMKSEATQR

SEQ ID NO: 36420 - protein, 19 aa, synthetic construct
  source 1..19: note = Seed: LQTVHSIPLTINKEEALQR
LQTVHSIPMTIMKSEAVQR

SEQ ID NO: 36421 - protein, 19 aa, synthetic construct
  source 1..19: note = Seed: LQTVHSIPLTINKEEALQR
LQTVHSIPMTIMKVEAAQR

SEQ ID NO: 36422 - protein, 19 aa, synthetic construct
  source 1..19: note = Seed: LQTVHSIPLTINKEEALQR
LQTVHSIPMTIMKVEAIQR

SEQ ID NO: 36423 - protein, 19 aa, synthetic construct
  source 1..19: note = Seed: LQTVHSIPLTINKEEALQR
LQTVHSIPMTIMKVEALQR

SEQ ID NO: 36424 - protein, 19 aa, synthetic construct
  source 1..19: note = Seed: LQTVHSIPLTINKEEALQR
LQTVHSIPMTIMKVEAMQR

SEQ ID NO: 36425 - protein, 19 aa, synthetic construct
  source 1..19: note = Seed: LQTVHSIPLTINKEEALQR
LQTVHSIPMTIMKVEAVQR

SEQ ID NO: 36426 - protein, 19 aa, synthetic construct
  source 1..19: note = Seed: LQTVHSIPLTINKEEALQR
LQTVHSIPMTINKAEAIQR

SEQ ID NO: 36427 - protein, 19 aa, synthetic construct
  source 1..19: note = Seed: LQTVHSIPLTINKEEALQR
LQTVHSIPMTINKAEALQR

SEQ ID NO: 36428 - protein, 19 aa, synthetic construct
  source 1..19: note = Seed: LQTVHSIPLTINKEEALQR
LQTVHSIPMTINKAEAVQR

SEQ ID NO: 36429 - protein, 19 aa, synthetic construct
  source 1..19: note = Seed: LQTVHSIPLTINKEEALQR
LQTVHSIPMTINKFEAIQR

SEQ ID NO: 36430 - protein, 19 aa, synthetic construct
  source 1..19: note = Seed: LQTVHSIPLTINKEEALQR
LQTVHSIPMTINKFEALQR

SEQ ID NO: 36431 - protein, 19 aa, synthetic construct
  source 1..19: note = Seed: LQTVHSIPLTINKEEALQR
LQTVHSIPMTINKIEAIQR

SEQ ID NO: 36432 - protein, 19 aa, synthetic construct
  source 1..19: note = Seed: LQTVHSIPLTINKEEALQR
LQTVHSIPMTINKNEAIQR

SEQ ID NO: 36433 - protein, 19 aa, synthetic construct
  source 1..19: note = Seed: LQTVHSIPLTINKEEALQR
LQTVHSIPMTINKNEALQR

SEQ ID NO: 36434 - protein, 19 aa, synthetic construct
  source 1..19: note = Seed: LQTVHSIPLTINKEEALQR
LQTVHSIPMTINKNEAVQR

SEQ ID NO: 36435 - protein, 19 aa, synthetic construct
  source 1..19: note = Seed: LQTVHSIPLTINKEEALQR
LQTVHSIPMTINKSEAIQR

SEQ ID NO: 36436 - protein, 19 aa, synthetic construct
  source 1..19: note = Seed: LQTVHSIPLTINKEEALQR
LQTVHSIPMTINKSEALQR

SEQ ID NO: 36437 - protein, 19 aa, synthetic construct
  source 1..19: note = Seed: LQTVHSIPLTINKEEALQR
LQTVHSIPMTINKSEAVQR

SEQ ID NO: 36438 - protein, 19 aa, synthetic construct
  source 1..19: note = Seed: LQTVHSIPLTINKEEALQR
LQTVHSIPMTINKVEAIQR

SEQ ID NO: 36439 - protein, 19 aa, synthetic construct
  source 1..19: note = Seed: LQTVHSIPLTINKEEALQR
LQTVHSIPMTIQKFEAFQR

SEQ ID NO: 36440 - protein, 19 aa, synthetic construct
  source 1..19: note = Seed: LQTVHSIPLTINKEEALQR
LQTVHSIPMTIQKFEAIQR

SEQ ID NO: 36441 - protein, 19 aa, synthetic construct
  source 1..19: note = Seed: LQTVHSIPLTINKEEALQR
LQTVHSIPMTIQKFEALQR

SEQ ID NO: 36442 - protein, 19 aa, synthetic construct
  source 1..19: note = Seed: LQTVHSIPLTINKEEALQR
LQTVHSIPMTIQKFEAVQR

SEQ ID NO: 36443 - protein, 19 aa, synthetic construct
  source 1..19: note = Seed: LQTVHSIPLTINKEEALQR
LQTVHSIPMTISKFEAFQR

SEQ ID NO: 36444 - protein, 19 aa, synthetic construct
  source 1..19: note = Seed: LQTVHSIPLTINKEEALQR
LQTVHSIPMTISKFEAIQR

SEQ ID NO: 36445 - protein, 19 aa, synthetic construct
  source 1..19: note = Seed: LQTVHSIPLTINKEEALQR
LQTVHSIPMTISKFEALQR

SEQ ID NO: 36446 - protein, 19 aa, synthetic construct
  source 1..19: note = Seed: LQTVHSIPLTINKEEALQR
LQTVHSIPMTISKFEAVQR

SEQ ID NO: 36447 - protein, 19 aa, synthetic construct
  source 1..19: note = Seed: LQTVHSIPLTINKEEALQR
LQTVHSIPMTISKSEAIQR

SEQ ID NO: 36448 - protein, 19 aa, synthetic construct
  source 1..19: note = Seed: LQTVHSIPLTINKEEALQR
LQTVHSIPMTITKAEAIQR

SEQ ID NO: 36449 - protein, 19 aa, synthetic construct
  source 1..19: note = Seed: LQTVHSIPLTINKEEALQR
LQTVHSIPMTITKFEAFQR

SEQ ID NO: 36450 - protein, 19 aa, synthetic construct
  source 1..19: note = Seed: LQTVHSIPLTINKEEALQR
LQTVHSIPMTITKFEAIQR

SEQ ID NO: 36451 - protein, 19 aa, synthetic construct
  source 1..19: note = Seed: LQTVHSIPLTINKEEALQR
LQTVHSIPMTITKFEALQR

SEQ ID NO: 36452 - protein, 19 aa, synthetic construct
  source 1..19: note = Seed: LQTVHSIPLTINKEEALQR
LQTVHSIPMTITKFEAMQR

SEQ ID NO: 36453 - protein, 19 aa, synthetic construct
  source 1..19: note = Seed: LQTVHSIPLTINKEEALQR
LQTVHSIPMTITKFEAVQR

SEQ ID NO: 36454 - protein, 19 aa, synthetic construct
  source 1..19: note = Seed: LQTVHSIPLTINKEEALQR
LQTVHSIPMTITKSEAIQR

SEQ ID NO: 36455 - protein, 19 aa, synthetic construct
  source 1..19: note = Seed: LQTVHSIPLTINKEEALQR
LQTVHSIPMTITKSEALQR

SEQ ID NO: 36456 - protein, 19 aa, synthetic construct
  source 1..19: note = Seed: LQTVHSIPLTINKEEALQR
LQTVHSIPMTIVKAEAIQR

SEQ ID NO: 36457 - protein, 19 aa, synthetic construct
  source 1..19: note = Seed: LQTVHSIPLTINKEEALQR
LQTVHSIPMTIVKAEAVQR

SEQ ID NO: 36458 - protein, 19 aa, synthetic construct
  source 1..19: note = Seed: LQTVHSIPLTINKEEALQR
LQTVHSIPMTIVKFEAAQR

SEQ ID NO: 36459 - protein, 19 aa, synthetic construct
  source 1..19: note = Seed: LQTVHSIPLTINKEEALQR
LQTVHSIPMTIVKFEAFQR

SEQ ID NO: 36460 - protein, 19 aa, synthetic construct
  source 1..19: note = Seed: LQTVHSIPLTINKEEALQR
LQTVHSIPMTIVKFEAIQR

SEQ ID NO: 36461 - protein, 19 aa, synthetic construct
  source 1..19: note = Seed: LQTVHSIPLTINKEEALQR
LQTVHSIPMTIVKFEALQR

SEQ ID NO: 36462 - protein, 19 aa, synthetic construct
  source 1..19: note = Seed: LQTVHSIPLTINKEEALQR
LQTVHSIPMTIVKFEAMQR

SEQ ID NO: 36463 - protein, 19 aa, synthetic construct
  source 1..19: note = Seed: LQTVHSIPLTINKEEALQR
LQTVHSIPMTIVKFEATQR

SEQ ID NO: 36464 - protein, 19 aa, synthetic construct
  source 1..19: note = Seed: LQTVHSIPLTINKEEALQR
LQTVHSIPMTIVKFEAVQR

SEQ ID NO: 36465 - protein, 19 aa, synthetic construct
  source 1..19: note = Seed: LQTVHSIPLTINKEEALQR
LQTVHSIPMTIVKFEAYQR

SEQ ID NO: 36466 - protein, 19 aa, synthetic construct
  source 1..19: note = Seed: LQTVHSIPLTINKEEALQR
LQTVHSIPMTIVKIEAAQR

SEQ ID NO: 36467 - protein, 19 aa, synthetic construct
  source 1..19: note = Seed: LQTVHSIPLTINKEEALQR
LQTVHSIPMTIVKIEAIQR

SEQ ID NO: 36468 - protein, 19 aa, synthetic construct
  source 1..19: note = Seed: LQTVHSIPLTINKEEALQR
LQTVHSIPMTIVKIEAVQR

SEQ ID NO: 36469 - protein, 19 aa, synthetic construct
  source 1..19: note = Seed: LQTVHSIPLTINKEEALQR
LQTVHSIPMTIVKSEAIQR

SEQ ID NO: 36470 - protein, 19 aa, synthetic construct
  source 1..19: note = Seed: LQTVHSIPLTINKEEALQR
LQTVHSIPMTIVKVEAIQR

SEQ ID NO: 36471 - protein, 19 aa, synthetic construct
  source 1..19: note = Seed: LQTVHSIPLTINKEEALQR
LQTVHSIPMTIVKVEAVQR

SEQ ID NO: 36472 - protein, 19 aa, synthetic construct
  source 1..19: note = Seed: LQTVHSIPLTINKEEALQR
LQTVHSIPMTIWKAEAIQR

SEQ ID NO: 36473 - protein, 19 aa, synthetic construct
  source 1..19: note = Seed: LQTVHSIPLTINKEEALQR
LQTVHSIPMTIWKAEALQR

SEQ ID NO: 36474 - protein, 19 aa, synthetic construct
  source 1..19: note = Seed: LQTVHSIPLTINKEEALQR
LQTVHSIPMTIWKAEAVQR

SEQ ID NO: 36475 - protein, 19 aa, synthetic construct
  source 1..19: note = Seed: LQTVHSIPLTINKEEALQR
LQTVHSIPMTIWKDEAIQR

SEQ ID NO: 36476 - protein, 19 aa, synthetic construct
  source 1..19: note = Seed: LQTVHSIPLTINKEEALQR
LQTVHSIPMTIWKDEALQR

SEQ ID NO: 36477 - protein, 19 aa, synthetic construct
  source 1..19: note = Seed: LQTVHSIPLTINKEEALQR
LQTVHSIPMTIWKDEAVQR

SEQ ID NO: 36478 - protein, 19 aa, synthetic construct
  source 1..19: note = Seed: LQTVHSIPLTINKEEALQR
LQTVHSIPMTIWKFEALQR

SEQ ID NO: 36479 - protein, 19 aa, synthetic construct
  source 1..19: note = Seed: LQTVHSIPLTINKEEALQR
LQTVHSIPMTIWKIEAAQR

SEQ ID NO: 36480 - protein, 19 aa, synthetic construct
  source 1..19: note = Seed: LQTVHSIPLTINKEEALQR
LQTVHSIPMTIWKIEAFQR

SEQ ID NO: 36481 - protein, 19 aa, synthetic construct
  source 1..19: note = Seed: LQTVHSIPLTINKEEALQR
LQTVHSIPMTIWKIEAIQR

SEQ ID NO: 36482 - protein, 19 aa, synthetic construct
  source 1..19: note = Seed: LQTVHSIPLTINKEEALQR
LQTVHSIPMTIWKIEALQR

SEQ ID NO: 36483 - protein, 19 aa, synthetic construct
  source 1..19: note = Seed: LQTVHSIPLTINKEEALQR
LQTVHSIPMTIWKIEAMQR

SEQ ID NO: 36484 - protein, 19 aa, synthetic construct
  source 1..19: note = Seed: LQTVHSIPLTINKEEALQR
LQTVHSIPMTIWKIEAVQR

SEQ ID NO: 36485 - protein, 19 aa, synthetic construct
  source 1..19: note = Seed: LQTVHSIPLTINKEEALQR
LQTVHSIPMTIWKVEAAQR

SEQ ID NO: 36486 - protein, 19 aa, synthetic construct
  source 1..19: note = Seed: LQTVHSIPLTINKEEALQR
LQTVHSIPMTIWKVEAIQR

SEQ ID NO: 36487 - protein, 19 aa, synthetic construct
  source 1..19: note = Seed: LQTVHSIPLTINKEEALQR
LQTVHSIPMTIWKVEALQR

SEQ ID NO: 36488 - protein, 19 aa, synthetic construct
  source 1..19: note = Seed: LQTVHSIPLTINKEEALQR
LQTVHSIPMTIWKVEAVQR

SEQ ID NO: 36489 - protein, 19 aa, synthetic construct
  source 1..19: note = Seed: LQTVHSIPLTINKEEALQR
LQTVHSIPMTIYKAEAAQR

SEQ ID NO: 36490 - protein, 19 aa, synthetic construct
  source 1..19: note = Seed: LQTVHSIPLTINKEEALQR
LQTVHSIPMTIYKAEAFQR

SEQ ID NO: 36491 - protein, 19 aa, synthetic construct
  source 1..19: note = Seed: LQTVHSIPLTINKEEALQR
LQTVHSIPMTIYKAEAIQR

SEQ ID NO: 36492 - protein, 19 aa, synthetic construct
  source 1..19: note = Seed: LQTVHSIPLTINKEEALQR
LQTVHSIPMTIYKAEALQR

SEQ ID NO: 36493 - protein, 19 aa, synthetic construct
  source 1..19: note = Seed: LQTVHSIPLTINKEEALQR
LQTVHSIPMTIYKAEAVQR

SEQ ID NO: 36494 - protein, 19 aa, synthetic construct
  source 1..19: note = Seed: LQTVHSIPLTINKEEALQR
LQTVHSIPMTIYKDEAAQR

SEQ ID NO: 36495 - protein, 19 aa, synthetic construct
  source 1..19: note = Seed: LQTVHSIPLTINKEEALQR
LQTVHSIPMTIYKDEAFQR

SEQ ID NO: 36496 - protein, 19 aa, synthetic construct
  source 1..19: note = Seed: LQTVHSIPLTINKEEALQR
LQTVHSIPMTIYKDEAIQR

SEQ ID NO: 36497 - protein, 19 aa, synthetic construct
  source 1..19: note = Seed: LQTVHSIPLTINKEEALQR
LQTVHSIPMTIYKDEALQR

SEQ ID NO: 36498 - protein, 19 aa, synthetic construct
  source 1..19: note = Seed: LQTVHSIPLTINKEEALQR
LQTVHSIPMTIYKDEAMQR

SEQ ID NO: 36499 - protein, 19 aa, synthetic construct
  source 1..19: note = Seed: LQTVHSIPLTINKEEALQR
LQTVHSIPMTIYKDEAVQR

SEQ ID NO: 36500 - protein, 19 aa, synthetic construct
  source 1..19: note = Seed: LQTVHSIPLTINKEEALQR
LQTVHSIPMTIYKFEAFQR

SEQ ID NO: 36501 - protein, 19 aa, synthetic construct
  source 1..19: note = Seed: LQTVHSIPLTINKEEALQR
LQTVHSIPMTIYKFEAIQR

SEQ ID NO: 36502 - protein, 19 aa, synthetic construct
  source 1..19: note = Seed: LQTVHSIPLTINKEEALQR
LQTVHSIPMTIYKFEALQR

SEQ ID NO: 36503 - protein, 19 aa, synthetic construct
  source 1..19: note = Seed: LQTVHSIPLTINKEEALQR
LQTVHSIPMTIYKFEAVQR

SEQ ID NO: 36504 - protein, 19 aa, synthetic construct
  source 1..19: note = Seed: LQTVHSIPLTINKEEALQR
LQTVHSIPMTIYKIEAAQR

SEQ ID NO: 36505 - protein, 19 aa, synthetic construct
  source 1..19: note = Seed: LQTVHSIPLTINKEEALQR
LQTVHSIPMTIYKIEAFQR

SEQ ID NO: 36506 - protein, 19 aa, synthetic construct
  source 1..19: note = Seed: LQTVHSIPLTINKEEALQR
LQTVHSIPMTIYKIEAIQR

SEQ ID NO: 36507 - protein, 19 aa, synthetic construct
  source 1..19: note = Seed: LQTVHSIPLTINKEEALQR
LQTVHSIPMTIYKIEALQR

SEQ ID NO: 36508 - protein, 19 aa, synthetic construct
  source 1..19: note = Seed: LQTVHSIPLTINKEEALQR
LQTVHSIPMTIYKIEAMQR

SEQ ID NO: 36509 - protein, 19 aa, synthetic construct
  source 1..19: note = Seed: LQTVHSIPLTINKEEALQR
LQTVHSIPMTIYKIEASQR

SEQ ID NO: 36510 - protein, 19 aa, synthetic construct
  source 1..19: note = Seed: LQTVHSIPLTINKEEALQR
LQTVHSIPMTIYKIEAVQR

SEQ ID NO: 36511 - protein, 19 aa, synthetic construct
  source 1..19: note = Seed: LQTVHSIPLTINKEEALQR
LQTVHSIPMTIYKIEAYQR

SEQ ID NO: 36512 - protein, 19 aa, synthetic construct
  source 1..19: note = Seed: LQTVHSIPLTINKEEALQR
LQTVHSIPMTIYKLEAAQR

SEQ ID NO: 36513 - protein, 19 aa, synthetic construct
  source 1..19: note = Seed: LQTVHSIPLTINKEEALQR
LQTVHSIPMTIYKLEAIQR

SEQ ID NO: 36514 - protein, 19 aa, synthetic construct
  source 1..19: note = Seed: LQTVHSIPLTINKEEALQR
LQTVHSIPMTIYKLEAVQR

SEQ ID NO: 36515 - protein, 19 aa, synthetic construct
  source 1..19: note = Seed: LQTVHSIPLTINKEEALQR
LQTVHSIPMTIYKMEAAQR

SEQ ID NO: 36516 - protein, 19 aa, synthetic construct
  source 1..19: note = Seed: LQTVHSIPLTINKEEALQR
LQTVHSIPMTIYKNEAIQR

SEQ ID NO: 36517 - protein, 19 aa, synthetic construct
  source 1..19: note = Seed: LQTVHSIPLTINKEEALQR
LQTVHSIPMTIYKNEALQR

SEQ ID NO: 36518 - protein, 19 aa, synthetic construct
  source 1..19: note = Seed: LQTVHSIPLTINKEEALQR
LQTVHSIPMTIYKNEAVQR

SEQ ID NO: 36519 - protein, 19 aa, synthetic construct
  source 1..19: note = Seed: LQTVHSIPLTINKEEALQR
LQTVHSIPMTIYKVEAAQR

SEQ ID NO: 36520 - protein, 19 aa, synthetic construct
  source 1..19: note = Seed: LQTVHSIPLTINKEEALQR
LQTVHSIPMTIYKVEAFQR

SEQ ID NO: 36521 - protein, 19 aa, synthetic construct
  source 1..19: note = Seed: LQTVHSIPLTINKEEALQR
LQTVHSIPMTIYKVEAIQR

SEQ ID NO: 36522 - protein, 19 aa, synthetic construct
  source 1..19: note = Seed: LQTVHSIPLTINKEEALQR
LQTVHSIPMTIYKVEALQR

SEQ ID NO: 36523 - protein, 19 aa, synthetic construct
  source 1..19: note = Seed: LQTVHSIPLTINKEEALQR
LQTVHSIPMTIYKVEAMQR

SEQ ID NO: 36524 - protein, 19 aa, synthetic construct
  source 1..19: note = Seed: LQTVHSIPLTINKEEALQR
LQTVHSIPMTIYKVEASQR

SEQ ID NO: 36525 - protein, 19 aa, synthetic construct
  source 1..19: note = Seed: LQTVHSIPLTINKEEALQR
LQTVHSIPMTIYKVEAVQR

SEQ ID NO: 36526 - protein, 19 aa, synthetic construct
  source 1..19: note = Seed: LQTVHSIPLTINKEEALQR
LQTVHSIPMTIYKVEAYQR

SEQ ID NO: 36527 - protein, 19 aa, synthetic construct
  source 1..19: note = Seed: LQTVHSIPLTINKEEALQR
LQTVHSIPVTIAKFEAFQR

SEQ ID NO: 36528 - protein, 19 aa, synthetic construct
  source 1..19: note = Seed: LQTVHSIPLTINKEEALQR
LQTVHSIPVTIAKFEAIQR

SEQ ID NO: 36529 - protein, 19 aa, synthetic construct
  source 1..19: note = Seed: LQTVHSIPLTINKEEALQR
LQTVHSIPVTIAKFEALQR

SEQ ID NO: 36530 - protein, 19 aa, synthetic construct
  source 1..19: note = Seed: LQTVHSIPLTINKEEALQR
LQTVHSIPVTIAKFEAMQR

SEQ ID NO: 36531 - protein, 19 aa, synthetic construct
  source 1..19: note = Seed: LQTVHSIPLTINKEEALQR
LQTVHSIPVTIAKFEAVQR

SEQ ID NO: 36532 - protein, 19 aa, synthetic construct
  source 1..19: note = Seed: LQTVHSIPLTINKEEALQR
LQTVHSIPVTIEKFEAFQR

SEQ ID NO: 36533 - protein, 19 aa, synthetic construct
  source 1..19: note = Seed: LQTVHSIPLTINKEEALQR
LQTVHSIPVTIEKFEAIQR

SEQ ID NO: 36534 - protein, 19 aa, synthetic construct
  source 1..19: note = Seed: LQTVHSIPLTINKEEALQR
LQTVHSIPVTIEKFEALQR

SEQ ID NO: 36535 - protein, 19 aa, synthetic construct
  source 1..19: note = Seed: LQTVHSIPLTINKEEALQR
LQTVHSIPVTIEKFEAVQR

SEQ ID NO: 36536 - protein, 19 aa, synthetic construct
  source 1..19: note = Seed: LQTVHSIPLTINKEEALQR
LQTVHSIPVTIFKAEAAQR

SEQ ID NO: 36537 - protein, 19 aa, synthetic construct
  source 1..19: note = Seed: LQTVHSIPLTINKEEALQR
LQTVHSIPVTIFKAEAIQR

SEQ ID NO: 36538 - protein, 19 aa, synthetic construct
  source 1..19: note = Seed: LQTVHSIPLTINKEEALQR
LQTVHSIPVTIFKAEALQR

SEQ ID NO: 36539 - protein, 19 aa, synthetic construct
  source 1..19: note = Seed: LQTVHSIPLTINKEEALQR
LQTVHSIPVTIFKAEAVQR

SEQ ID NO: 36540 - protein, 19 aa, synthetic construct
  source 1..19: note = Seed: LQTVHSIPLTINKEEALQR
LQTVHSIPVTIFKDEAAQR

SEQ ID NO: 36541 - protein, 19 aa, synthetic construct
  source 1..19: note = Seed: LQTVHSIPLTINKEEALQR
LQTVHSIPVTIFKDEAFQR

SEQ ID NO: 36542 - protein, 19 aa, synthetic construct
  source 1..19: note = Seed: LQTVHSIPLTINKEEALQR
LQTVHSIPVTIFKDEAIQR

SEQ ID NO: 36543 - protein, 19 aa, synthetic construct
  source 1..19: note = Seed: LQTVHSIPLTINKEEALQR
LQTVHSIPVTIFKDEALQR

SEQ ID NO: 36544 - protein, 19 aa, synthetic construct
  source 1..19: note = Seed: LQTVHSIPLTINKEEALQR
LQTVHSIPVTIFKDEAMQR

SEQ ID NO: 36545 - protein, 19 aa, synthetic construct
  source 1..19: note = Seed: LQTVHSIPLTINKEEALQR
LQTVHSIPVTIFKDEAVQR

SEQ ID NO: 36546 - protein, 19 aa, synthetic construct
  source 1..19: note = Seed: LQTVHSIPLTINKEEALQR
LQTVHSIPVTIFKFEAFQR

SEQ ID NO: 36547 - protein, 19 aa, synthetic construct
  source 1..19: note = Seed: LQTVHSIPLTINKEEALQR
LQTVHSIPVTIFKFEAIQR

SEQ ID NO: 36548 - protein, 19 aa, synthetic construct
  source 1..19: note = Seed: LQTVHSIPLTINKEEALQR
LQTVHSIPVTIFKFEALQR

SEQ ID NO: 36549 - protein, 19 aa, synthetic construct
  source 1..19: note = Seed: LQTVHSIPLTINKEEALQR
LQTVHSIPVTIFKFEAMQR

SEQ ID NO: 36550 - protein, 19 aa, synthetic construct
  source 1..19: note = Seed: LQTVHSIPLTINKEEALQR
LQTVHSIPVTIFKFEAVQR

SEQ ID NO: 36551 - protein, 19 aa, synthetic construct
  source 1..19: note = Seed: LQTVHSIPLTINKEEALQR
LQTVHSIPVTIFKFEAYQR

SEQ ID NO: 36552 - protein, 19 aa, synthetic construct
  source 1..19: note = Seed: LQTVHSIPLTINKEEALQR
LQTVHSIPVTIFKIEAAQR

SEQ ID NO: 36553 - protein, 19 aa, synthetic construct
  source 1..19: note = Seed: LQTVHSIPLTINKEEALQR
LQTVHSIPVTIFKIEAIQR

SEQ ID NO: 36554 - protein, 19 aa, synthetic construct
  source 1..19: note = Seed: LQTVHSIPLTINKEEALQR
LQTVHSIPVTIFKIEALQR

SEQ ID NO: 36555 - protein, 19 aa, synthetic construct
  source 1..19: note = Seed: LQTVHSIPLTINKEEALQR
LQTVHSIPVTIFKIEAMQR

SEQ ID NO: 36556 - protein, 19 aa, synthetic construct
  source 1..19: note = Seed: LQTVHSIPLTINKEEALQR
LQTVHSIPVTIFKIEASQR

SEQ ID NO: 36557 - protein, 19 aa, synthetic construct
  source 1..19: note = Seed: LQTVHSIPLTINKEEALQR
LQTVHSIPVTIFKIEAVQR

SEQ ID NO: 36558 - protein, 19 aa, synthetic construct
  source 1..19: note = Seed: LQTVHSIPLTINKEEALQR
LQTVHSIPVTIFKLEAFQR

SEQ ID NO: 36559 - protein, 19 aa, synthetic construct
  source 1..19: note = Seed: LQTVHSIPLTINKEEALQR
LQTVHSIPVTIFKLEALQR

SEQ ID NO: 36560 - protein, 19 aa, synthetic construct
  source 1..19: note = Seed: LQTVHSIPLTINKEEALQR
LQTVHSIPVTIFKNEAIQR

SEQ ID NO: 36561 - protein, 19 aa, synthetic construct
  source 1..19: note = Seed: LQTVHSIPLTINKEEALQR
LQTVHSIPVTIFKNEAVQR

SEQ ID NO: 36562 - protein, 19 aa, synthetic construct
  source 1..19: note = Seed: LQTVHSIPLTINKEEALQR
LQTVHSIPVTIFKVEAAQR

SEQ ID NO: 36563 - protein, 19 aa, synthetic construct
  source 1..19: note = Seed: LQTVHSIPLTINKEEALQR
LQTVHSIPVTIFKVEAIQR

SEQ ID NO: 36564 - protein, 19 aa, synthetic construct
  source 1..19: note = Seed: LQTVHSIPLTINKEEALQR
LQTVHSIPVTIFKVEALQR

SEQ ID NO: 36565 - protein, 19 aa, synthetic construct
  source 1..19: note = Seed: LQTVHSIPLTINKEEALQR
LQTVHSIPVTIFKVEAVQR

SEQ ID NO: 36566 - protein, 19 aa, synthetic construct
  source 1..19: note = Seed: LQTVHSIPLTINKEEALQR
LQTVHSIPVTIHKFEAFQR

SEQ ID NO: 36567 - protein, 19 aa, synthetic construct
  source 1..19: note = Seed: LQTVHSIPLTINKEEALQR
LQTVHSIPVTIHKFEAIQR

SEQ ID NO: 36568 - protein, 19 aa, synthetic construct
  source 1..19: note = Seed: LQTVHSIPLTINKEEALQR
LQTVHSIPVTIHKFEALQR

SEQ ID NO: 36569 - protein, 19 aa, synthetic construct
  source 1..19: note = Seed: LQTVHSIPLTINKEEALQR
LQTVHSIPVTIHKFEAVQR

SEQ ID NO: 36570 - protein, 19 aa, synthetic construct
  source 1..19: note = Seed: LQTVHSIPLTINKEEALQR
LQTVHSIPVTIIKFEAFQR

SEQ ID NO: 36571 - protein, 19 aa, synthetic construct
  source 1..19: note = Seed: LQTVHSIPLTINKEEALQR
LQTVHSIPVTIIKFEAIQR

SEQ ID NO: 36572 - protein, 19 aa, synthetic construct
  source 1..19: note = Seed: LQTVHSIPLTINKEEALQR
LQTVHSIPVTIIKFEALQR

SEQ ID NO: 36573 - protein, 19 aa, synthetic construct
  source 1..19: note = Seed: LQTVHSIPLTINKEEALQR
LQTVHSIPVTIIKFEAMQR

SEQ ID NO: 36574 - protein, 19 aa, synthetic construct
  source 1..19: note = Seed: LQTVHSIPLTINKEEALQR
LQTVHSIPVTIIKFEATQR

SEQ ID NO: 36575 - protein, 19 aa, synthetic construct
  source 1..19: note = Seed: LQTVHSIPLTINKEEALQR
LQTVHSIPVTIIKFEAVQR

SEQ ID NO: 36576 - protein, 19 aa, synthetic construct
  source 1..19: note = Seed: LQTVHSIPLTINKEEALQR
LQTVHSIPVTIIKFEAYQR

SEQ ID NO: 36577 - protein, 19 aa, synthetic construct
  source 1..19: note = Seed: LQTVHSIPLTINKEEALQR
LQTVHSIPVTIIKIEAAQR

SEQ ID NO: 36578 - protein, 19 aa, synthetic construct
  source 1..19: note = Seed: LQTVHSIPLTINKEEALQR
LQTVHSIPVTILKAEAAQR

SEQ ID NO: 36579 - protein, 19 aa, synthetic construct
  source 1..19: note = Seed: LQTVHSIPLTINKEEALQR
LQTVHSIPVTILKAEAIQR

SEQ ID NO: 36580 - protein, 19 aa, synthetic construct
  source 1..19: note = Seed: LQTVHSIPLTINKEEALQR
LQTVHSIPVTILKAEALQR

SEQ ID NO: 36581 - protein, 19 aa, synthetic construct
  source 1..19: note = Seed: LQTVHSIPLTINKEEALQR
LQTVHSIPVTILKAEAVQR

SEQ ID NO: 36582 - protein, 19 aa, synthetic construct
  source 1..19: note = Seed: LQTVHSIPLTINKEEALQR
LQTVHSIPVTILKFEAFQR

SEQ ID NO: 36583 - protein, 19 aa, synthetic construct
  source 1..19: note = Seed: LQTVHSIPLTINKEEALQR
LQTVHSIPVTILKFEAIQR

SEQ ID NO: 36584 - protein, 19 aa, synthetic construct
  source 1..19: note = Seed: LQTVHSIPLTINKEEALQR
LQTVHSIPVTILKFEALQR

SEQ ID NO: 36585 - protein, 19 aa, synthetic construct
  source 1..19: note = Seed: LQTVHSIPLTINKEEALQR
LQTVHSIPVTILKFEAMQR

SEQ ID NO: 36586 - protein, 19 aa, synthetic construct
  source 1..19: note = Seed: LQTVHSIPLTINKEEALQR
LQTVHSIPVTILKFEATQR

SEQ ID NO: 36587 - protein, 19 aa, synthetic construct
  source 1..19: note = Seed: LQTVHSIPLTINKEEALQR
LQTVHSIPVTILKFEAVQR

SEQ ID NO: 36588 - protein, 19 aa, synthetic construct
  source 1..19: note = Seed: LQTVHSIPLTINKEEALQR
LQTVHSIPVTILKFEAYQR

SEQ ID NO: 36589 - protein, 19 aa, synthetic construct
  source 1..19: note = Seed: LQTVHSIPLTINKEEALQR
LQTVHSIPVTILKGEAAQR

SEQ ID NO: 36590 - protein, 19 aa, synthetic construct
  source 1..19: note = Seed: LQTVHSIPLTINKEEALQR
LQTVHSIPVTILKGEAIQR

SEQ ID NO: 36591 - protein, 19 aa, synthetic construct
  source 1..19: note = Seed: LQTVHSIPLTINKEEALQR
LQTVHSIPVTILKGEALQR

SEQ ID NO: 36592 - protein, 19 aa, synthetic construct
  source 1..19: note = Seed: LQTVHSIPLTINKEEALQR
LQTVHSIPVTILKGEAVQR

SEQ ID NO: 36593 - protein, 19 aa, synthetic construct
  source 1..19: note = Seed: LQTVHSIPLTINKEEALQR
LQTVHSIPVTILKSEAAQR

SEQ ID NO: 36594 - protein, 19 aa, synthetic construct
  source 1..19: note = Seed: LQTVHSIPLTINKEEALQR
LQTVHSIPVTILKSEAIQR

SEQ ID NO: 36595 - protein, 19 aa, synthetic construct
  source 1..19: note = Seed: LQTVHSIPLTINKEEALQR
LQTVHSIPVTILKSEALQR

SEQ ID NO: 36596 - protein, 19 aa, synthetic construct
  source 1..19: note = Seed: LQTVHSIPLTINKEEALQR
LQTVHSIPVTILKSEAVQR

SEQ ID NO: 36597 - protein, 19 aa, synthetic construct
  source 1..19: note = Seed: LQTVHSIPLTINKEEALQR
LQTVHSIPVTIMKAEAAQR

SEQ ID NO: 36598 - protein, 19 aa, synthetic construct
  source 1..19: note = Seed: LQTVHSIPLTINKEEALQR
LQTVHSIPVTIMKAEAIQR

SEQ ID NO: 36599 - protein, 19 aa, synthetic construct
  source 1..19: note = Seed: LQTVHSIPLTINKEEALQR
LQTVHSIPVTIMKAEALQR

SEQ ID NO: 36600 - protein, 19 aa, synthetic construct
  source 1..19: note = Seed: LQTVHSIPLTINKEEALQR
LQTVHSIPVTIMKAEAMQR

SEQ ID NO: 36601 - protein, 19 aa, synthetic construct
  source 1..19: note = Seed: LQTVHSIPLTINKEEALQR
LQTVHSIPVTIMKAEAVQR

SEQ ID NO: 36602 - protein, 19 aa, synthetic construct
  source 1..19: note = Seed: LQTVHSIPLTINKEEALQR
LQTVHSIPVTIMKFEAFQR

SEQ ID NO: 36603 - protein, 19 aa, synthetic construct
  source 1..19: note = Seed: LQTVHSIPLTINKEEALQR
LQTVHSIPVTIMKFEAIQR

SEQ ID NO: 36604 - protein, 19 aa, synthetic construct
  source 1..19: note = Seed: LQTVHSIPLTINKEEALQR
LQTVHSIPVTIMKFEALQR

SEQ ID NO: 36605 - protein, 19 aa, synthetic construct
  source 1..19: note = Seed: LQTVHSIPLTINKEEALQR
LQTVHSIPVTIMKFEAMQR

SEQ ID NO: 36606 - protein, 19 aa, synthetic construct
  source 1..19: note = Seed: LQTVHSIPLTINKEEALQR
LQTVHSIPVTIMKFEAVQR

SEQ ID NO: 36607 - protein, 19 aa, synthetic construct
  source 1..19: note = Seed: LQTVHSIPLTINKEEALQR
LQTVHSIPVTIMKGEAAQR

SEQ ID NO: 36608 - protein, 19 aa, synthetic construct
  source 1..19: note = Seed: LQTVHSIPLTINKEEALQR
LQTVHSIPVTIMKGEAIQR

SEQ ID NO: 36609 - protein, 19 aa, synthetic construct
  source 1..19: note = Seed: LQTVHSIPLTINKEEALQR
LQTVHSIPVTIMKGEALQR

SEQ ID NO: 36610 - protein, 19 aa, synthetic construct
  source 1..19: note = Seed: LQTVHSIPLTINKEEALQR
LQTVHSIPVTIMKGEAVQR

SEQ ID NO: 36611 - protein, 19 aa, synthetic construct
  source 1..19: note = Seed: LQTVHSIPLTINKEEALQR
LQTVHSIPVTIMKIEAAQR

SEQ ID NO: 36612 - protein, 19 aa, synthetic construct
  source 1..19: note = Seed: LQTVHSIPLTINKEEALQR
LQTVHSIPVTIMKIEAIQR

SEQ ID NO: 36613 - protein, 19 aa, synthetic construct
  source 1..19: note = Seed: LQTVHSIPLTINKEEALQR
LQTVHSIPVTIMKIEALQR

SEQ ID NO: 36614 - protein, 19 aa, synthetic construct
  source 1..19: note = Seed: LQTVHSIPLTINKEEALQR
LQTVHSIPVTIMKIEAVQR

SEQ ID NO: 36615 - protein, 19 aa, synthetic construct
  source 1..19: note = Seed: LQTVHSIPLTINKEEALQR
LQTVHSIPVTIMKSEAAQR

SEQ ID NO: 36616 - protein, 19 aa, synthetic construct
  source 1..19: note = Seed: LQTVHSIPLTINKEEALQR
LQTVHSIPVTIMKSEAIQR

SEQ ID NO: 36617 - protein, 19 aa, synthetic construct
  source 1..19: note = Seed: LQTVHSIPLTINKEEALQR
LQTVHSIPVTIMKSEALQR

SEQ ID NO: 36618 - protein, 19 aa, synthetic construct
  source 1..19: note = Seed: LQTVHSIPLTINKEEALQR
LQTVHSIPVTIMKSEAVQR

SEQ ID NO: 36619 - protein, 19 aa, synthetic construct
  source 1..19: note = Seed: LQTVHSIPLTINKEEALQR
LQTVHSIPVTIMKVEAIQR

SEQ ID NO: 36620 - protein, 19 aa, synthetic construct
  source 1..19: note = Seed: LQTVHSIPLTINKEEALQR
LQTVHSIPVTIMKVEAVQR

SEQ ID NO: 36621 - protein, 19 aa, synthetic construct
  source 1..19: note = Seed: LQTVHSIPLTINKEEALQR
LQTVHSIPVTINKAEAFQR

SEQ ID NO: 36622 - protein, 19 aa, synthetic construct
  source 1..19: note = Seed: LQTVHSIPLTINKEEALQR
LQTVHSIPVTINKAEAIQR

SEQ ID NO: 36623 - protein, 19 aa, synthetic construct
  source 1..19: note = Seed: LQTVHSIPLTINKEEALQR
LQTVHSIPVTINKAEALQR

SEQ ID NO: 36624 - protein, 19 aa, synthetic construct
  source 1..19: note = Seed: LQTVHSIPLTINKEEALQR
LQTVHSIPVTINKAEAVQR

SEQ ID NO: 36625 - protein, 19 aa, synthetic construct
  source 1..19: note = Seed: LQTVHSIPLTINKEEALQR
LQTVHSIPVTINKFEAIQR

SEQ ID NO: 36626 - protein, 19 aa, synthetic construct
  source 1..19: note = Seed: LQTVHSIPLTINKEEALQR
LQTVHSIPVTINKFEALQR

SEQ ID NO: 36627 - protein, 19 aa, synthetic construct
  source 1..19: note = Seed: LQTVHSIPLTINKEEALQR
LQTVHSIPVTINKGEAIQR

SEQ ID NO: 36628 - protein, 19 aa, synthetic construct
  source 1..19: note = Seed: LQTVHSIPLTINKEEALQR
LQTVHSIPVTINKIEAIQR

SEQ ID NO: 36629 - protein, 19 aa, synthetic construct
  source 1..19: note = Seed: LQTVHSIPLTINKEEALQR
LQTVHSIPVTINKIEALQR

SEQ ID NO: 36630 - protein, 19 aa, synthetic construct
  source 1..19: note = Seed: LQTVHSIPLTINKEEALQR
LQTVHSIPVTINKIEAVQR

SEQ ID NO: 36631 - protein, 19 aa, synthetic construct
  source 1..19: note = Seed: LQTVHSIPLTINKEEALQR
LQTVHSIPVTINKNEAFQR

SEQ ID NO: 36632 - protein, 19 aa, synthetic construct
  source 1..19: note = Seed: LQTVHSIPLTINKEEALQR
LQTVHSIPVTINKNEAIQR

SEQ ID NO: 36633 - protein, 19 aa, synthetic construct
  source 1..19: note = Seed: LQTVHSIPLTINKEEALQR
LQTVHSIPVTINKNEALQR

SEQ ID NO: 36634 - protein, 19 aa, synthetic construct
  source 1..19: note = Seed: LQTVHSIPLTINKEEALQR
LQTVHSIPVTINKNEAVQR

SEQ ID NO: 36635 - protein, 19 aa, synthetic construct
  source 1..19: note = Seed: LQTVHSIPLTINKEEALQR
LQTVHSIPVTINKSEAIQR

SEQ ID NO: 36636 - protein, 19 aa, synthetic construct
  source 1..19: note = Seed: LQTVHSIPLTINKEEALQR
LQTVHSIPVTINKSEALQR

SEQ ID NO: 36637 - protein, 19 aa, synthetic construct
  source 1..19: note = Seed: LQTVHSIPLTINKEEALQR
LQTVHSIPVTINKSEAVQR

SEQ ID NO: 36638 - protein, 19 aa, synthetic construct
  source 1..19: note = Seed: LQTVHSIPLTINKEEALQR
LQTVHSIPVTINKTEAIQR

SEQ ID NO: 36639 - protein, 19 aa, synthetic construct
  source 1..19: note = Seed: LQTVHSIPLTINKEEALQR
LQTVHSIPVTINKVEAIQR

SEQ ID NO: 36640 - protein, 19 aa, synthetic construct
  source 1..19: note = Seed: LQTVHSIPLTINKEEALQR
LQTVHSIPVTINKVEAVQR

SEQ ID NO: 36641 - protein, 19 aa, synthetic construct
  source 1..19: note = Seed: LQTVHSIPLTINKEEALQR
LQTVHSIPVTIQKFEAFQR

SEQ ID NO: 36642 - protein, 19 aa, synthetic construct
  source 1..19: note = Seed: LQTVHSIPLTINKEEALQR
LQTVHSIPVTIQKFEAIQR

SEQ ID NO: 36643 - protein, 19 aa, synthetic construct
  source 1..19: note = Seed: LQTVHSIPLTINKEEALQR
LQTVHSIPVTIQKFEALQR

SEQ ID NO: 36644 - protein, 19 aa, synthetic construct
  source 1..19: note = Seed: LQTVHSIPLTINKEEALQR
LQTVHSIPVTIQKFEAVQR

SEQ ID NO: 36645 - protein, 19 aa, synthetic construct
  source 1..19: note = Seed: LQTVHSIPLTINKEEALQR
LQTVHSIPVTISKFEAFQR

SEQ ID NO: 36646 - protein, 19 aa, synthetic construct
  source 1..19: note = Seed: LQTVHSIPLTINKEEALQR
LQTVHSIPVTISKFEAIQR

SEQ ID NO: 36647 - protein, 19 aa, synthetic construct
  source 1..19: note = Seed: LQTVHSIPLTINKEEALQR
LQTVHSIPVTISKFEALQR

SEQ ID NO: 36648 - protein, 19 aa, synthetic construct
  source 1..19: note = Seed: LQTVHSIPLTINKEEALQR
LQTVHSIPVTISKFEAVQR

SEQ ID NO: 36649 - protein, 19 aa, synthetic construct
  source 1..19: note = Seed: LQTVHSIPLTINKEEALQR
LQTVHSIPVTITKFEAFQR

SEQ ID NO: 36650 - protein, 19 aa, synthetic construct
  source 1..19: note = Seed: LQTVHSIPLTINKEEALQR
LQTVHSIPVTITKFEAIQR

SEQ ID NO: 36651 - protein, 19 aa, synthetic construct
  source 1..19: note = Seed: LQTVHSIPLTINKEEALQR
LQTVHSIPVTITKFEALQR

SEQ ID NO: 36652 - protein, 19 aa, synthetic construct
  source 1..19: note = Seed: LQTVHSIPLTINKEEALQR
LQTVHSIPVTITKFEAMQR

SEQ ID NO: 36653 - protein, 19 aa, synthetic construct
  source 1..19: note = Seed: LQTVHSIPLTINKEEALQR
LQTVHSIPVTITKFEAVQR

SEQ ID NO: 36654 - protein, 19 aa, synthetic construct
  source 1..19: note = Seed: LQTVHSIPLTINKEEALQR
LQTVHSIPVTITKSEAIQR

SEQ ID NO: 36655 - protein, 19 aa, synthetic construct
  source 1..19: note = Seed: LQTVHSIPLTINKEEALQR
LQTVHSIPVTIVKFEAFQR

SEQ ID NO: 36656 - protein, 19 aa, synthetic construct
  source 1..19: note = Seed: LQTVHSIPLTINKEEALQR
LQTVHSIPVTIVKFEAIQR

SEQ ID NO: 36657 - protein, 19 aa, synthetic construct
  source 1..19: note = Seed: LQTVHSIPLTINKEEALQR
LQTVHSIPVTIVKFEALQR

SEQ ID NO: 36658 - protein, 19 aa, synthetic construct
  source 1..19: note = Seed: LQTVHSIPLTINKEEALQR
LQTVHSIPVTIVKFEAMQR

SEQ ID NO: 36659 - protein, 19 aa, synthetic construct
  source 1..19: note = Seed: LQTVHSIPLTINKEEALQR
LQTVHSIPVTIVKFEAVQR

SEQ ID NO: 36660 - protein, 19 aa, synthetic construct
  source 1..19: note = Seed: LQTVHSIPLTINKEEALQR
LQTVHSIPVTIVKFEAYQR

SEQ ID NO: 36661 - protein, 19 aa, synthetic construct
  source 1..19: note = Seed: LQTVHSIPLTINKEEALQR
LQTVHSIPVTIVKSEAIQR

SEQ ID NO: 36662 - protein, 19 aa, synthetic construct
  source 1..19: note = Seed: LQTVHSIPLTINKEEALQR
LQTVHSIPVTIWKAEAIQR

SEQ ID NO: 36663 - protein, 19 aa, synthetic construct
  source 1..19: note = Seed: LQTVHSIPLTINKEEALQR
LQTVHSIPVTIWKDEAIQR

SEQ ID NO: 36664 - protein, 19 aa, synthetic construct
  source 1..19: note = Seed: LQTVHSIPLTINKEEALQR
LQTVHSIPVTIWKDEALQR

SEQ ID NO: 36665 - protein, 19 aa, synthetic construct
  source 1..19: note = Seed: LQTVHSIPLTINKEEALQR
LQTVHSIPVTIWKDEAVQR

SEQ ID NO: 36666 - protein, 19 aa, synthetic construct
  source 1..19: note = Seed: LQTVHSIPLTINKEEALQR
LQTVHSIPVTIWKIEAIQR

SEQ ID NO: 36667 - protein, 19 aa, synthetic construct
  source 1..19: note = Seed: LQTVHSIPLTINKEEALQR
LQTVHSIPVTIWKIEAVQR

SEQ ID NO: 36668 - protein, 19 aa, synthetic construct
  source 1..19: note = Seed: LQTVHSIPLTINKEEALQR
LQTVHSIPVTIYKAEAAQR

SEQ ID NO: 36669 - protein, 19 aa, synthetic construct
  source 1..19: note = Seed: LQTVHSIPLTINKEEALQR
LQTVHSIPVTIYKAEAIQR

SEQ ID NO: 36670 - protein, 19 aa, synthetic construct
  source 1..19: note = Seed: LQTVHSIPLTINKEEALQR
LQTVHSIPVTIYKAEALQR

SEQ ID NO: 36671 - protein, 19 aa, synthetic construct
  source 1..19: note = Seed: LQTVHSIPLTINKEEALQR
LQTVHSIPVTIYKAEAVQR

SEQ ID NO: 36672 - protein, 19 aa, synthetic construct
  source 1..19: note = Seed: LQTVHSIPLTINKEEALQR
LQTVHSIPVTIYKDEAAQR

SEQ ID NO: 36673 - protein, 19 aa, synthetic construct
  source 1..19: note = Seed: LQTVHSIPLTINKEEALQR
LQTVHSIPVTIYKDEAFQR

SEQ ID NO: 36674 - protein, 19 aa, synthetic construct
  source 1..19: note = Seed: LQTVHSIPLTINKEEALQR
LQTVHSIPVTIYKDEAIQR

SEQ ID NO: 36675 - protein, 19 aa, synthetic construct
  source 1..19: note = Seed: LQTVHSIPLTINKEEALQR
LQTVHSIPVTIYKDEALQR

SEQ ID NO: 36676 - protein, 19 aa, synthetic construct
  source 1..19: note = Seed: LQTVHSIPLTINKEEALQR
LQTVHSIPVTIYKDEAMQR

SEQ ID NO: 36677 - protein, 19 aa, synthetic construct
  source 1..19: note = Seed: LQTVHSIPLTINKEEALQR
LQTVHSIPVTIYKDEAVQR

SEQ ID NO: 36678 - protein, 19 aa, synthetic construct
  source 1..19: note = Seed: LQTVHSIPLTINKEEALQR
LQTVHSIPVTIYKFEALQR

SEQ ID NO: 36679 - protein, 19 aa, synthetic construct
  source 1..19: note = Seed: LQTVHSIPLTINKEEALQR
LQTVHSIPVTIYKIEAAQR

SEQ ID NO: 36680 - protein, 19 aa, synthetic construct
  source 1..19: note = Seed: LQTVHSIPLTINKEEALQR
LQTVHSIPVTIYKIEAIQR

SEQ ID NO: 36681 - protein, 19 aa, synthetic construct
  source 1..19: note = Seed: LQTVHSIPLTINKEEALQR
LQTVHSIPVTIYKIEALQR

SEQ ID NO: 36682 - protein, 19 aa, synthetic construct
  source 1..19: note = Seed: LQTVHSIPLTINKEEALQR
LQTVHSIPVTIYKIEAMQR

SEQ ID NO: 36683 - protein, 19 aa, synthetic construct
  source 1..19: note = Seed: LQTVHSIPLTINKEEALQR
LQTVHSIPVTIYKIEAVQR

SEQ ID NO: 36684 - protein, 19 aa, synthetic construct
  source 1..19: note = Seed: LQTVHSIPLTINKEEALQR
LQTVHSIPVTIYKVEAAQR

SEQ ID NO: 36685 - protein, 19 aa, synthetic construct
  source 1..19: note = Seed: LQTVHSIPLTINKEEALQR
LQTVHSIPVTIYKVEAIQR

SEQ ID NO: 36686 - protein, 19 aa, synthetic construct
  source 1..19: note = Seed: LQTVHSIPLTINKEEALQR
LQTVHSIPVTIYKVEAVQR

SEQ ID NO: 36687 - protein, 19 aa, synthetic construct
  source 1..19: note = Seed: LQTVHSIPLTINKEEALQR
LQTVHSIPWTIAKAEAAQR

SEQ ID NO: 36688 - protein, 19 aa, synthetic construct
  source 1..19: note = Seed: LQTVHSIPLTINKEEALQR
LQTVHSIPWTIAKAEAIQR

SEQ ID NO: 36689 - protein, 19 aa, synthetic construct
  source 1..19: note = Seed: LQTVHSIPLTINKEEALQR
LQTVHSIPWTIAKAEALQR

SEQ ID NO: 36690 - protein, 19 aa, synthetic construct
  source 1..19: note = Seed: LQTVHSIPLTINKEEALQR
LQTVHSIPWTIAKAEAMQR

SEQ ID NO: 36691 - protein, 19 aa, synthetic construct
  source 1..19: note = Seed: LQTVHSIPLTINKEEALQR
LQTVHSIPWTIAKAEASQR

SEQ ID NO: 36692 - protein, 19 aa, synthetic construct
  source 1..19: note = Seed: LQTVHSIPLTINKEEALQR
LQTVHSIPWTIAKAEATQR

SEQ ID NO: 36693 - protein, 19 aa, synthetic construct
  source 1..19: note = Seed: LQTVHSIPLTINKEEALQR
LQTVHSIPWTIAKAEAVQR

SEQ ID NO: 36694 - protein, 19 aa, synthetic construct
  source 1..19: note = Seed: LQTVHSIPLTINKEEALQR
LQTVHSIPWTIAKFEAAQR

SEQ ID NO: 36695 - protein, 19 aa, synthetic construct
  source 1..19: note = Seed: LQTVHSIPLTINKEEALQR
LQTVHSIPWTIAKFEAFQR

SEQ ID NO: 36696 - protein, 19 aa, synthetic construct
  source 1..19: note = Seed: LQTVHSIPLTINKEEALQR
LQTVHSIPWTIAKFEAIQR

SEQ ID NO: 36697 - protein, 19 aa, synthetic construct
  source 1..19: note = Seed: LQTVHSIPLTINKEEALQR
LQTVHSIPWTIAKFEALQR

SEQ ID NO: 36698 - protein, 19 aa, synthetic construct
  source 1..19: note = Seed: LQTVHSIPLTINKEEALQR
LQTVHSIPWTIAKFEAMQR

SEQ ID NO: 36699 - protein, 19 aa, synthetic construct
  source 1..19: note = Seed: LQTVHSIPLTINKEEALQR
LQTVHSIPWTIAKFEATQR

SEQ ID NO: 36700 - protein, 19 aa, synthetic construct
  source 1..19: note = Seed: LQTVHSIPLTINKEEALQR
LQTVHSIPWTIAKFEAVQR

SEQ ID NO: 36701 - protein, 19 aa, synthetic construct
  source 1..19: note = Seed: LQTVHSIPLTINKEEALQR
LQTVHSIPWTIAKFEAYQR

SEQ ID NO: 36702 - protein, 19 aa, synthetic construct
  source 1..19: note = Seed: LQTVHSIPLTINKEEALQR
LQTVHSIPWTIAKGEAAQR

SEQ ID NO: 36703 - protein, 19 aa, synthetic construct
  source 1..19: note = Seed: LQTVHSIPLTINKEEALQR
LQTVHSIPWTIAKGEAIQR

SEQ ID NO: 36704 - protein, 19 aa, synthetic construct
  source 1..19: note = Seed: LQTVHSIPLTINKEEALQR
LQTVHSIPWTIAKGEALQR

SEQ ID NO: 36705 - protein, 19 aa, synthetic construct
  source 1..19: note = Seed: LQTVHSIPLTINKEEALQR
LQTVHSIPWTIAKGEAVQR

SEQ ID NO: 36706 - protein, 19 aa, synthetic construct
  source 1..19: note = Seed: LQTVHSIPLTINKEEALQR
LQTVHSIPWTIAKNEALQR

SEQ ID NO: 36707 - protein, 19 aa, synthetic construct
  source 1..19: note = Seed: LQTVHSIPLTINKEEALQR
LQTVHSIPWTIAKNEAVQR

SEQ ID NO: 36708 - protein, 19 aa, synthetic construct
  source 1..19: note = Seed: LQTVHSIPLTINKEEALQR
LQTVHSIPWTIAKPEALQR

SEQ ID NO: 36709 - protein, 19 aa, synthetic construct
  source 1..19: note = Seed: LQTVHSIPLTINKEEALQR
LQTVHSIPWTIAKPEAVQR

SEQ ID NO: 36710 - protein, 19 aa, synthetic construct
  source 1..19: note = Seed: LQTVHSIPLTINKEEALQR
LQTVHSIPWTIAKSEAAQR

SEQ ID NO: 36711 - protein, 19 aa, synthetic construct
  source 1..19: note = Seed: LQTVHSIPLTINKEEALQR
LQTVHSIPWTIAKSEAIQR

SEQ ID NO: 36712 - protein, 19 aa, synthetic construct
  source 1..19: note = Seed: LQTVHSIPLTINKEEALQR
LQTVHSIPWTIAKSEALQR

SEQ ID NO: 36713 - protein, 19 aa, synthetic construct
  source 1..19: note = Seed: LQTVHSIPLTINKEEALQR
LQTVHSIPWTIAKSEAMQR

SEQ ID NO: 36714 - protein, 19 aa, synthetic construct
  source 1..19: note = Seed: LQTVHSIPLTINKEEALQR
LQTVHSIPWTIAKSEAVQR

SEQ ID NO: 36715 - protein, 19 aa, synthetic construct
  source 1..19: note = Seed: LQTVHSIPLTINKEEALQR
LQTVHSIPWTIAKTEALQR

SEQ ID NO: 36716 - protein, 19 aa, synthetic construct
  source 1..19: note = Seed: LQTVHSIPLTINKEEALQR
LQTVHSIPWTIAKTEAVQR

SEQ ID NO: 36717 - protein, 19 aa, synthetic construct
  source 1..19: note = Seed: LQTVHSIPLTINKEEALQR
LQTVHSIPWTIDKFEAIQR

SEQ ID NO: 36718 - protein, 19 aa, synthetic construct
  source 1..19: note = Seed: LQTVHSIPLTINKEEALQR
LQTVHSIPWTIDKFEALQR

SEQ ID NO: 36719 - protein, 19 aa, synthetic construct
  source 1..19: note = Seed: LQTVHSIPLTINKEEALQR
LQTVHSIPWTIDKFEAVQR

SEQ ID NO: 36720 - protein, 19 aa, synthetic construct
  source 1..19: note = Seed: LQTVHSIPLTINKEEALQR
LQTVHSIPWTIEKFEAFQR

SEQ ID NO: 36721 - protein, 19 aa, synthetic construct
  source 1..19: note = Seed: LQTVHSIPLTINKEEALQR
LQTVHSIPWTIEKFEAIQR

SEQ ID NO: 36722 - protein, 19 aa, synthetic construct
  source 1..19: note = Seed: LQTVHSIPLTINKEEALQR
LQTVHSIPWTIEKFEALQR

SEQ ID NO: 36723 - protein, 19 aa, synthetic construct
  source 1..19: note = Seed: LQTVHSIPLTINKEEALQR
LQTVHSIPWTIEKFEAMQR

SEQ ID NO: 36724 - protein, 19 aa, synthetic construct
  source 1..19: note = Seed: LQTVHSIPLTINKEEALQR
LQTVHSIPWTIEKFEAVQR

SEQ ID NO: 36725 - protein, 19 aa, synthetic construct
  source 1..19: note = Seed: LQTVHSIPLTINKEEALQR
LQTVHSIPWTIFKAEAFQR

SEQ ID NO: 36726 - protein, 19 aa, synthetic construct
  source 1..19: note = Seed: LQTVHSIPLTINKEEALQR
LQTVHSIPWTIFKFEAAQR

SEQ ID NO: 36727 - protein, 19 aa, synthetic construct
  source 1..19: note = Seed: LQTVHSIPLTINKEEALQR
LQTVHSIPWTIFKFEADQR

SEQ ID NO: 36728 - protein, 19 aa, synthetic construct
  source 1..19: note = Seed: LQTVHSIPLTINKEEALQR
LQTVHSIPWTIFKFEAEQR

SEQ ID NO: 36729 - protein, 19 aa, synthetic construct
  source 1..19: note = Seed: LQTVHSIPLTINKEEALQR
LQTVHSIPWTIFKFEAFQR

SEQ ID NO: 36730 - protein, 19 aa, synthetic construct
  source 1..19: note = Seed: LQTVHSIPLTINKEEALQR
LQTVHSIPWTIFKFEAHQR

SEQ ID NO: 36731 - protein, 19 aa, synthetic construct
  source 1..19: note = Seed: LQTVHSIPLTINKEEALQR
LQTVHSIPWTIFKFEAIQR

SEQ ID NO: 36732 - protein, 19 aa, synthetic construct
  source 1..19: note = Seed: LQTVHSIPLTINKEEALQR
LQTVHSIPWTIFKFEAKQR

SEQ ID NO: 36733 - protein, 19 aa, synthetic construct
  source 1..19: note = Seed: LQTVHSIPLTINKEEALQR
LQTVHSIPWTIFKFEALQR

SEQ ID NO: 36734 - protein, 19 aa, synthetic construct
  source 1..19: note = Seed: LQTVHSIPLTINKEEALQR
LQTVHSIPWTIFKFEAMQR

SEQ ID NO: 36735 - protein, 19 aa, synthetic construct
  source 1..19: note = Seed: LQTVHSIPLTINKEEALQR
LQTVHSIPWTIFKFEANQR

SEQ ID NO: 36736 - protein, 19 aa, synthetic construct
  source 1..19: note = Seed: LQTVHSIPLTINKEEALQR
LQTVHSIPWTIFKFEAQQR

SEQ ID NO: 36737 - protein, 19 aa, synthetic construct
  source 1..19: note = Seed: LQTVHSIPLTINKEEALQR
LQTVHSIPWTIFKFEARQR

SEQ ID NO: 36738 - protein, 19 aa, synthetic construct
  source 1..19: note = Seed: LQTVHSIPLTINKEEALQR
LQTVHSIPWTIFKFEASQR

SEQ ID NO: 36739 - protein, 19 aa, synthetic construct
  source 1..19: note = Seed: LQTVHSIPLTINKEEALQR
LQTVHSIPWTIFKFEATQR

SEQ ID NO: 36740 - protein, 19 aa, synthetic construct
  source 1..19: note = Seed: LQTVHSIPLTINKEEALQR
LQTVHSIPWTIFKFEAVQR

SEQ ID NO: 36741 - protein, 19 aa, synthetic construct
  source 1..19: note = Seed: LQTVHSIPLTINKEEALQR
LQTVHSIPWTIFKFEAYQR

SEQ ID NO: 36742 - protein, 19 aa, synthetic construct
  source 1..19: note = Seed: LQTVHSIPLTINKEEALQR
LQTVHSIPWTIFKIEAFQR

SEQ ID NO: 36743 - protein, 19 aa, synthetic construct
  source 1..19: note = Seed: LQTVHSIPLTINKEEALQR
LQTVHSIPWTIFKIEAIQR

SEQ ID NO: 36744 - protein, 19 aa, synthetic construct
  source 1..19: note = Seed: LQTVHSIPLTINKEEALQR
LQTVHSIPWTIFKIEALQR

SEQ ID NO: 36745 - protein, 19 aa, synthetic construct
  source 1..19: note = Seed: LQTVHSIPLTINKEEALQR
LQTVHSIPWTIFKIEAMQR

SEQ ID NO: 36746 - protein, 19 aa, synthetic construct
  source 1..19: note = Seed: LQTVHSIPLTINKEEALQR
LQTVHSIPWTIFKIEAVQR

SEQ ID NO: 36747 - protein, 19 aa, synthetic construct
  source 1..19: note = Seed: LQTVHSIPLTINKEEALQR
LQTVHSIPWTIFKIEAYQR

SEQ ID NO: 36748 - protein, 19 aa, synthetic construct
  source 1..19: note = Seed: LQTVHSIPLTINKEEALQR
LQTVHSIPWTIFKLEAFQR

SEQ ID NO: 36749 - protein, 19 aa, synthetic construct
  source 1..19: note = Seed: LQTVHSIPLTINKEEALQR
LQTVHSIPWTIFKLEAIQR

SEQ ID NO: 36750 - protein, 19 aa, synthetic construct
  source 1..19: note = Seed: LQTVHSIPLTINKEEALQR
LQTVHSIPWTIFKLEALQR

SEQ ID NO: 36751 - protein, 19 aa, synthetic construct
  source 1..19: note = Seed: LQTVHSIPLTINKEEALQR
LQTVHSIPWTIFKLEAMQR

SEQ ID NO: 36752 - protein, 19 aa, synthetic construct
  source 1..19: note = Seed: LQTVHSIPLTINKEEALQR
LQTVHSIPWTIFKLEARQR

SEQ ID NO: 36753 - protein, 19 aa, synthetic construct
  source 1..19: note = Seed: LQTVHSIPLTINKEEALQR
LQTVHSIPWTIFKLEAVQR

SEQ ID NO: 36754 - protein, 19 aa, synthetic construct
  source 1..19: note = Seed: LQTVHSIPLTINKEEALQR
LQTVHSIPWTIFKLEAYQR

SEQ ID NO: 36755 - protein, 19 aa, synthetic construct
  source 1..19: note = Seed: LQTVHSIPLTINKEEALQR
LQTVHSIPWTIFKMEAFQR

SEQ ID NO: 36756 - protein, 19 aa, synthetic construct
  source 1..19: note = Seed: LQTVHSIPLTINKEEALQR
LQTVHSIPWTIFKMEAIQR

SEQ ID NO: 36757 - protein, 19 aa, synthetic construct
  source 1..19: note = Seed: LQTVHSIPLTINKEEALQR
LQTVHSIPWTIFKMEALQR

SEQ ID NO: 36758 - protein, 19 aa, synthetic construct
  source 1..19: note = Seed: LQTVHSIPLTINKEEALQR
LQTVHSIPWTIFKMEAVQR

SEQ ID NO: 36759 - protein, 19 aa, synthetic construct
  source 1..19: note = Seed: LQTVHSIPLTINKEEALQR
LQTVHSIPWTIFKVEAFQR

SEQ ID NO: 36760 - protein, 19 aa, synthetic construct
  source 1..19: note = Seed: LQTVHSIPLTINKEEALQR
LQTVHSIPWTIFKVEAIQR

SEQ ID NO: 36761 - protein, 19 aa, synthetic construct
  source 1..19: note = Seed: LQTVHSIPLTINKEEALQR
LQTVHSIPWTIFKVEALQR

SEQ ID NO: 36762 - protein, 19 aa, synthetic construct
  source 1..19: note = Seed: LQTVHSIPLTINKEEALQR
LQTVHSIPWTIFKWEAFQR

SEQ ID NO: 36763 - protein, 19 aa, synthetic construct
  source 1..19: note = Seed: LQTVHSIPLTINKEEALQR
LQTVHSIPWTIFKWEAIQR

SEQ ID NO: 36764 - protein, 19 aa, synthetic construct
  source 1..19: note = Seed: LQTVHSIPLTINKEEALQR
LQTVHSIPWTIFKWEALQR

SEQ ID NO: 36765 - protein, 19 aa, synthetic construct
  source 1..19: note = Seed: LQTVHSIPLTINKEEALQR
LQTVHSIPWTIFKWEAMQR

SEQ ID NO: 36766 - protein, 19 aa, synthetic construct
  source 1..19: note = Seed: LQTVHSIPLTINKEEALQR
LQTVHSIPWTIFKWEAVQR

SEQ ID NO: 36767 - protein, 19 aa, synthetic construct
  source 1..19: note = Seed: LQTVHSIPLTINKEEALQR
LQTVHSIPWTIFKYEAAQR

SEQ ID NO: 36768 - protein, 19 aa, synthetic construct
  source 1..19: note = Seed: LQTVHSIPLTINKEEALQR
LQTVHSIPWTIFKYEAFQR

SEQ ID NO: 36769 - protein, 19 aa, synthetic construct
  source 1..19: note = Seed: LQTVHSIPLTINKEEALQR
LQTVHSIPWTIFKYEAIQR

SEQ ID NO: 36770 - protein, 19 aa, synthetic construct
  source 1..19: note = Seed: LQTVHSIPLTINKEEALQR
LQTVHSIPWTIFKYEALQR

SEQ ID NO: 36771 - protein, 19 aa, synthetic construct
  source 1..19: note = Seed: LQTVHSIPLTINKEEALQR
LQTVHSIPWTIFKYEAMQR

SEQ ID NO: 36772 - protein, 19 aa, synthetic construct
  source 1..19: note = Seed: LQTVHSIPLTINKEEALQR
LQTVHSIPWTIFKYEAVQR

SEQ ID NO: 36773 - protein, 19 aa, synthetic construct
  source 1..19: note = Seed: LQTVHSIPLTINKEEALQR
LQTVHSIPWTIFKYEAYQR

SEQ ID NO: 36774 - protein, 19 aa, synthetic construct
  source 1..19: note = Seed: LQTVHSIPLTINKEEALQR
LQTVHSIPWTIHKFEAFQR

SEQ ID NO: 36775 - protein, 19 aa, synthetic construct
  source 1..19: note = Seed: LQTVHSIPLTINKEEALQR
LQTVHSIPWTIHKFEAIQR

SEQ ID NO: 36776 - protein, 19 aa, synthetic construct
  source 1..19: note = Seed: LQTVHSIPLTINKEEALQR
LQTVHSIPWTIHKFEALQR

SEQ ID NO: 36777 - protein, 19 aa, synthetic construct
  source 1..19: note = Seed: LQTVHSIPLTINKEEALQR
LQTVHSIPWTIHKFEAMQR

SEQ ID NO: 36778 - protein, 19 aa, synthetic construct
  source 1..19: note = Seed: LQTVHSIPLTINKEEALQR
LQTVHSIPWTIHKFEAVQR

SEQ ID NO: 36779 - protein, 19 aa, synthetic construct
  source 1..19: note = Seed: LQTVHSIPLTINKEEALQR
LQTVHSIPWTIIKAEAAQR

SEQ ID NO: 36780 - protein, 19 aa, synthetic construct
  source 1..19: note = Seed: LQTVHSIPLTINKEEALQR
LQTVHSIPWTIIKAEAIQR

SEQ ID NO: 36781 - protein, 19 aa, synthetic construct
  source 1..19: note = Seed: LQTVHSIPLTINKEEALQR
LQTVHSIPWTIIKAEALQR

SEQ ID NO: 36782 - protein, 19 aa, synthetic construct
  source 1..19: note = Seed: LQTVHSIPLTINKEEALQR
LQTVHSIPWTIIKAEAMQR

SEQ ID NO: 36783 - protein, 19 aa, synthetic construct
  source 1..19: note = Seed: LQTVHSIPLTINKEEALQR
LQTVHSIPWTIIKAEASQR

SEQ ID NO: 36784 - protein, 19 aa, synthetic construct
  source 1..19: note = Seed: LQTVHSIPLTINKEEALQR
LQTVHSIPWTIIKAEATQR

SEQ ID NO: 36785 - protein, 19 aa, synthetic construct
  source 1..19: note = Seed: LQTVHSIPLTINKEEALQR
LQTVHSIPWTIIKAEAVQR

SEQ ID NO: 36786 - protein, 19 aa, synthetic construct
  source 1..19: note = Seed: LQTVHSIPLTINKEEALQR
LQTVHSIPWTIIKFEAAQR

SEQ ID NO: 36787 - protein, 19 aa, synthetic construct
  source 1..19: note = Seed: LQTVHSIPLTINKEEALQR
LQTVHSIPWTIIKFEADQR

SEQ ID NO: 36788 - protein, 19 aa, synthetic construct
  source 1..19: note = Seed: LQTVHSIPLTINKEEALQR
LQTVHSIPWTIIKFEAEQR

SEQ ID NO: 36789 - protein, 19 aa, synthetic construct
  source 1..19: note = Seed: LQTVHSIPLTINKEEALQR
LQTVHSIPWTIIKFEAFQR

SEQ ID NO: 36790 - protein, 19 aa, synthetic construct
  source 1..19: note = Seed: LQTVHSIPLTINKEEALQR
LQTVHSIPWTIIKFEAHQR

SEQ ID NO: 36791 - protein, 19 aa, synthetic construct
  source 1..19: note = Seed: LQTVHSIPLTINKEEALQR
LQTVHSIPWTIIKFEAIQR

SEQ ID NO: 36792 - protein, 19 aa, synthetic construct
  source 1..19: note = Seed: LQTVHSIPLTINKEEALQR
LQTVHSIPWTIIKFEALQR

SEQ ID NO: 36793 - protein, 19 aa, synthetic construct
  source 1..19: note = Seed: LQTVHSIPLTINKEEALQR
LQTVHSIPWTIIKFEAMQR

SEQ ID NO: 36794 - protein, 19 aa, synthetic construct
  source 1..19: note = Seed: LQTVHSIPLTINKEEALQR
LQTVHSIPWTIIKFEANQR

SEQ ID NO: 36795 - protein, 19 aa, synthetic construct
  source 1..19: note = Seed: LQTVHSIPLTINKEEALQR
LQTVHSIPWTIIKFEAPQR

SEQ ID NO: 36796 - protein, 19 aa, synthetic construct
  source 1..19: note = Seed: LQTVHSIPLTINKEEALQR
LQTVHSIPWTIIKFEAQQR

SEQ ID NO: 36797 - protein, 19 aa, synthetic construct
  source 1..19: note = Seed: LQTVHSIPLTINKEEALQR
LQTVHSIPWTIIKFEARQR

SEQ ID NO: 36798 - protein, 19 aa, synthetic construct
  source 1..19: note = Seed: LQTVHSIPLTINKEEALQR
LQTVHSIPWTIIKFEASQR

SEQ ID NO: 36799 - protein, 19 aa, synthetic construct
  source 1..19: note = Seed: LQTVHSIPLTINKEEALQR
LQTVHSIPWTIIKFEATQR

SEQ ID NO: 36800 - protein, 19 aa, synthetic construct
  source 1..19: note = Seed: LQTVHSIPLTINKEEALQR
LQTVHSIPWTIIKFEAVQR

SEQ ID NO: 36801 - protein, 19 aa, synthetic construct
  source 1..19: note = Seed: LQTVHSIPLTINKEEALQR
LQTVHSIPWTIIKFEAWQR

SEQ ID NO: 36802 - protein, 19 aa, synthetic construct
  source 1..19: note = Seed: LQTVHSIPLTINKEEALQR
LQTVHSIPWTIIKFEAYQR

SEQ ID NO: 36803 - protein, 19 aa, synthetic construct
  source 1..19: note = Seed: LQTVHSIPLTINKEEALQR
LQTVHSIPWTIIKGEAAQR

SEQ ID NO: 36804 - protein, 19 aa, synthetic construct
  source 1..19: note = Seed: LQTVHSIPLTINKEEALQR
LQTVHSIPWTIIKGEAIQR

SEQ ID NO: 36805 - protein, 19 aa, synthetic construct
  source 1..19: note = Seed: LQTVHSIPLTINKEEALQR
LQTVHSIPWTIIKGEALQR

SEQ ID NO: 36806 - protein, 19 aa, synthetic construct
  source 1..19: note = Seed: LQTVHSIPLTINKEEALQR
LQTVHSIPWTIIKGEAMQR

SEQ ID NO: 36807 - protein, 19 aa, synthetic construct
  source 1..19: note = Seed: LQTVHSIPLTINKEEALQR
LQTVHSIPWTIIKGEASQR

SEQ ID NO: 36808 - protein, 19 aa, synthetic construct
  source 1..19: note = Seed: LQTVHSIPLTINKEEALQR
LQTVHSIPWTIIKGEATQR

SEQ ID NO: 36809 - protein, 19 aa, synthetic construct
  source 1..19: note = Seed: LQTVHSIPLTINKEEALQR
LQTVHSIPWTIIKGEAVQR

SEQ ID NO: 36810 - protein, 19 aa, synthetic construct
  source 1..19: note = Seed: LQTVHSIPLTINKEEALQR
LQTVHSIPWTIIKIEAIQR

SEQ ID NO: 36811 - protein, 19 aa, synthetic construct
  source 1..19: note = Seed: LQTVHSIPLTINKEEALQR
LQTVHSIPWTIIKIEALQR

SEQ ID NO: 36812 - protein, 19 aa, synthetic construct
  source 1..19: note = Seed: LQTVHSIPLTINKEEALQR
LQTVHSIPWTIIKIEAVQR

SEQ ID NO: 36813 - protein, 19 aa, synthetic construct
  source 1..19: note = Seed: LQTVHSIPLTINKEEALQR
LQTVHSIPWTIIKLEAFQR

SEQ ID NO: 36814 - protein, 19 aa, synthetic construct
  source 1..19: note = Seed: LQTVHSIPLTINKEEALQR
LQTVHSIPWTIIKLEAIQR

SEQ ID NO: 36815 - protein, 19 aa, synthetic construct
  source 1..19: note = Seed: LQTVHSIPLTINKEEALQR
LQTVHSIPWTIIKLEALQR

SEQ ID NO: 36816 - protein, 19 aa, synthetic construct
  source 1..19: note = Seed: LQTVHSIPLTINKEEALQR
LQTVHSIPWTIIKLEAMQR

SEQ ID NO: 36817 - protein, 19 aa, synthetic construct
  source 1..19: note = Seed: LQTVHSIPLTINKEEALQR
LQTVHSIPWTIIKLEAVQR

SEQ ID NO: 36818 - protein, 19 aa, synthetic construct
  source 1..19: note = Seed: LQTVHSIPLTINKEEALQR
LQTVHSIPWTIIKLEAYQR

SEQ ID NO: 36819 - protein, 19 aa, synthetic construct
  source 1..19: note = Seed: LQTVHSIPLTINKEEALQR
LQTVHSIPWTIIKNEAAQR

SEQ ID NO: 36820 - protein, 19 aa, synthetic construct
  source 1..19: note = Seed: LQTVHSIPLTINKEEALQR
LQTVHSIPWTIIKNEAIQR

SEQ ID NO: 36821 - protein, 19 aa, synthetic construct
  source 1..19: note = Seed: LQTVHSIPLTINKEEALQR
LQTVHSIPWTIIKNEALQR

SEQ ID NO: 36822 - protein, 19 aa, synthetic construct
  source 1..19: note = Seed: LQTVHSIPLTINKEEALQR
LQTVHSIPWTIIKNEAVQR

SEQ ID NO: 36823 - protein, 19 aa, synthetic construct
  source 1..19: note = Seed: LQTVHSIPLTINKEEALQR
LQTVHSIPWTIIKPEAAQR

SEQ ID NO: 36824 - protein, 19 aa, synthetic construct
  source 1..19: note = Seed: LQTVHSIPLTINKEEALQR
LQTVHSIPWTIIKPEAIQR

SEQ ID NO: 36825 - protein, 19 aa, synthetic construct
  source 1..19: note = Seed: LQTVHSIPLTINKEEALQR
LQTVHSIPWTIIKPEALQR

SEQ ID NO: 36826 - protein, 19 aa, synthetic construct
  source 1..19: note = Seed: LQTVHSIPLTINKEEALQR
LQTVHSIPWTIIKPEAVQR

SEQ ID NO: 36827 - protein, 19 aa, synthetic construct
  source 1..19: note = Seed: LQTVHSIPLTINKEEALQR
LQTVHSIPWTIIKSEAAQR

SEQ ID NO: 36828 - protein, 19 aa, synthetic construct
  source 1..19: note = Seed: LQTVHSIPLTINKEEALQR
LQTVHSIPWTIIKSEAIQR

SEQ ID NO: 36829 - protein, 19 aa, synthetic construct
  source 1..19: note = Seed: LQTVHSIPLTINKEEALQR
LQTVHSIPWTIIKSEALQR

SEQ ID NO: 36830 - protein, 19 aa, synthetic construct
  source 1..19: note = Seed: LQTVHSIPLTINKEEALQR
LQTVHSIPWTIIKSEAMQR

SEQ ID NO: 36831 - protein, 19 aa, synthetic construct
  source 1..19: note = Seed: LQTVHSIPLTINKEEALQR
LQTVHSIPWTIIKSEASQR

SEQ ID NO: 36832 - protein, 19 aa, synthetic construct
  source 1..19: note = Seed: LQTVHSIPLTINKEEALQR
LQTVHSIPWTIIKSEATQR

SEQ ID NO: 36833 - protein, 19 aa, synthetic construct
  source 1..19: note = Seed: LQTVHSIPLTINKEEALQR
LQTVHSIPWTIIKSEAVQR

SEQ ID NO: 36834 - protein, 19 aa, synthetic construct
  source 1..19: note = Seed: LQTVHSIPLTINKEEALQR
LQTVHSIPWTIIKTEAAQR

SEQ ID NO: 36835 - protein, 19 aa, synthetic construct
  source 1..19: note = Seed: LQTVHSIPLTINKEEALQR
LQTVHSIPWTIIKTEAIQR

SEQ ID NO: 36836 - protein, 19 aa, synthetic construct
  source 1..19: note = Seed: LQTVHSIPLTINKEEALQR
LQTVHSIPWTIIKTEALQR

SEQ ID NO: 36837 - protein, 19 aa, synthetic construct
  source 1..19: note = Seed: LQTVHSIPLTINKEEALQR
LQTVHSIPWTIIKTEAVQR

SEQ ID NO: 36838 - protein, 19 aa, synthetic construct
  source 1..19: note = Seed: LQTVHSIPLTINKEEALQR
LQTVHSIPWTIIKWEAFQR

SEQ ID NO: 36839 - protein, 19 aa, synthetic construct
  source 1..19: note = Seed: LQTVHSIPLTINKEEALQR
LQTVHSIPWTIIKWEAIQR

SEQ ID NO: 36840 - protein, 19 aa, synthetic construct
  source 1..19: note = Seed: LQTVHSIPLTINKEEALQR
LQTVHSIPWTIIKWEALQR

SEQ ID NO: 36841 - protein, 19 aa, synthetic construct
  source 1..19: note = Seed: LQTVHSIPLTINKEEALQR
LQTVHSIPWTIIKWEAVQR

SEQ ID NO: 36842 - protein, 19 aa, synthetic construct
  source 1..19: note = Seed: LQTVHSIPLTINKEEALQR
LQTVHSIPWTIIKYEAFQR

SEQ ID NO: 36843 - protein, 19 aa, synthetic construct
  source 1..19: note = Seed: LQTVHSIPLTINKEEALQR
LQTVHSIPWTIIKYEAIQR

SEQ ID NO: 36844 - protein, 19 aa, synthetic construct
  source 1..19: note = Seed: LQTVHSIPLTINKEEALQR
LQTVHSIPWTIIKYEALQR

SEQ ID NO: 36845 - protein, 19 aa, synthetic construct
  source 1..19: note = Seed: LQTVHSIPLTINKEEALQR
LQTVHSIPWTIIKYEAMQR

SEQ ID NO: 36846 - protein, 19 aa, synthetic construct
  source 1..19: note = Seed: LQTVHSIPLTINKEEALQR
LQTVHSIPWTIIKYEAVQR

SEQ ID NO: 36847 - protein, 19 aa, synthetic construct
  source 1..19: note = Seed: LQTVHSIPLTINKEEALQR
LQTVHSIPWTIIKYEAYQR

SEQ ID NO: 36848 - protein, 19 aa, synthetic construct
  source 1..19: note = Seed: LQTVHSIPLTINKEEALQR
LQTVHSIPWTILKAEAAQR

SEQ ID NO: 36849 - protein, 19 aa, synthetic construct
  source 1..19: note = Seed: LQTVHSIPLTINKEEALQR
LQTVHSIPWTILKAEAGQR

SEQ ID NO: 36850 - protein, 19 aa, synthetic construct
  source 1..19: note = Seed: LQTVHSIPLTINKEEALQR
LQTVHSIPWTILKAEAIQR

SEQ ID NO: 36851 - protein, 19 aa, synthetic construct
  source 1..19: note = Seed: LQTVHSIPLTINKEEALQR
LQTVHSIPWTILKAEALQR

SEQ ID NO: 36852 - protein, 19 aa, synthetic construct
  source 1..19: note = Seed: LQTVHSIPLTINKEEALQR
LQTVHSIPWTILKAEAMQR

SEQ ID NO: 36853 - protein, 19 aa, synthetic construct
  source 1..19: note = Seed: LQTVHSIPLTINKEEALQR
LQTVHSIPWTILKAEASQR

SEQ ID NO: 36854 - protein, 19 aa, synthetic construct
  source 1..19: note = Seed: LQTVHSIPLTINKEEALQR
LQTVHSIPWTILKAEATQR

SEQ ID NO: 36855 - protein, 19 aa, synthetic construct
  source 1..19: note = Seed: LQTVHSIPLTINKEEALQR
LQTVHSIPWTILKAEAVQR

SEQ ID NO: 36856 - protein, 19 aa, synthetic construct
  source 1..19: note = Seed: LQTVHSIPLTINKEEALQR
LQTVHSIPWTILKFEAAQR

SEQ ID NO: 36857 - protein, 19 aa, synthetic construct
  source 1..19: note = Seed: LQTVHSIPLTINKEEALQR
LQTVHSIPWTILKFEADQR

SEQ ID NO: 36858 - protein, 19 aa, synthetic construct
  source 1..19: note = Seed: LQTVHSIPLTINKEEALQR
LQTVHSIPWTILKFEAEQR

SEQ ID NO: 36859 - protein, 19 aa, synthetic construct
  source 1..19: note = Seed: LQTVHSIPLTINKEEALQR
LQTVHSIPWTILKFEAFQR

SEQ ID NO: 36860 - protein, 19 aa, synthetic construct
  source 1..19: note = Seed: LQTVHSIPLTINKEEALQR
LQTVHSIPWTILKFEAHQR

SEQ ID NO: 36861 - protein, 19 aa, synthetic construct
  source 1..19: note = Seed: LQTVHSIPLTINKEEALQR
LQTVHSIPWTILKFEAIQR

SEQ ID NO: 36862 - protein, 19 aa, synthetic construct
  source 1..19: note = Seed: LQTVHSIPLTINKEEALQR
LQTVHSIPWTILKFEALQR

SEQ ID NO: 36863 - protein, 19 aa, synthetic construct
  source 1..19: note = Seed: LQTVHSIPLTINKEEALQR
LQTVHSIPWTILKFEAMQR

SEQ ID NO: 36864 - protein, 19 aa, synthetic construct
  source 1..19: note = Seed: LQTVHSIPLTINKEEALQR
LQTVHSIPWTILKFEANQR

SEQ ID NO: 36865 - protein, 19 aa, synthetic construct
  source 1..19: note = Seed: LQTVHSIPLTINKEEALQR
LQTVHSIPWTILKFEAPQR

SEQ ID NO: 36866 - protein, 19 aa, synthetic construct
  source 1..19: note = Seed: LQTVHSIPLTINKEEALQR
LQTVHSIPWTILKFEAQQR

SEQ ID NO: 36867 - protein, 19 aa, synthetic construct
  source 1..19: note = Seed: LQTVHSIPLTINKEEALQR
LQTVHSIPWTILKFEARQR

SEQ ID NO: 36868 - protein, 19 aa, synthetic construct
  source 1..19: note = Seed: LQTVHSIPLTINKEEALQR
LQTVHSIPWTILKFEASQR

SEQ ID NO: 36869 - protein, 19 aa, synthetic construct
  source 1..19: note = Seed: LQTVHSIPLTINKEEALQR
LQTVHSIPWTILKFEATQR

SEQ ID NO: 36870 - protein, 19 aa, synthetic construct
  source 1..19: note = Seed: LQTVHSIPLTINKEEALQR
LQTVHSIPWTILKFEAVQR

SEQ ID NO: 36871 - protein, 19 aa, synthetic construct
  source 1..19: note = Seed: LQTVHSIPLTINKEEALQR
LQTVHSIPWTILKFEAYQR

SEQ ID NO: 36872 - protein, 19 aa, synthetic construct
  source 1..19: note = Seed: LQTVHSIPLTINKEEALQR
LQTVHSIPWTILKGEAAQR

SEQ ID NO: 36873 - protein, 19 aa, synthetic construct
  source 1..19: note = Seed: LQTVHSIPLTINKEEALQR
LQTVHSIPWTILKGEAGQR

SEQ ID NO: 36874 - protein, 19 aa, synthetic construct
  source 1..19: note = Seed: LQTVHSIPLTINKEEALQR
LQTVHSIPWTILKGEAIQR

SEQ ID NO: 36875 - protein, 19 aa, synthetic construct
  source 1..19: note = Seed: LQTVHSIPLTINKEEALQR
LQTVHSIPWTILKGEALQR

SEQ ID NO: 36876 - protein, 19 aa, synthetic construct
  source 1..19: note = Seed: LQTVHSIPLTINKEEALQR
LQTVHSIPWTILKGEAMQR

SEQ ID NO: 36877 - protein, 19 aa, synthetic construct
  source 1..19: note = Seed: LQTVHSIPLTINKEEALQR
LQTVHSIPWTILKGEASQR

SEQ ID NO: 36878 - protein, 19 aa, synthetic construct
  source 1..19: note = Seed: LQTVHSIPLTINKEEALQR
LQTVHSIPWTILKGEATQR

SEQ ID NO: 36879 - protein, 19 aa, synthetic construct
  source 1..19: note = Seed: LQTVHSIPLTINKEEALQR
LQTVHSIPWTILKGEAVQR

SEQ ID NO: 36880 - protein, 19 aa, synthetic construct
  source 1..19: note = Seed: LQTVHSIPLTINKEEALQR
LQTVHSIPWTILKIEAFQR

SEQ ID NO: 36881 - protein, 19 aa, synthetic construct
  source 1..19: note = Seed: LQTVHSIPLTINKEEALQR
LQTVHSIPWTILKIEAIQR

SEQ ID NO: 36882 - protein, 19 aa, synthetic construct
  source 1..19: note = Seed: LQTVHSIPLTINKEEALQR
LQTVHSIPWTILKIEALQR

SEQ ID NO: 36883 - protein, 19 aa, synthetic construct
  source 1..19: note = Seed: LQTVHSIPLTINKEEALQR
LQTVHSIPWTILKIEAVQR

SEQ ID NO: 36884 - protein, 19 aa, synthetic construct
  source 1..19: note = Seed: LQTVHSIPLTINKEEALQR
LQTVHSIPWTILKLEAFQR

SEQ ID NO: 36885 - protein, 19 aa, synthetic construct
  source 1..19: note = Seed: LQTVHSIPLTINKEEALQR
LQTVHSIPWTILKLEAIQR

SEQ ID NO: 36886 - protein, 19 aa, synthetic construct
  source 1..19: note = Seed: LQTVHSIPLTINKEEALQR
LQTVHSIPWTILKLEALQR

SEQ ID NO: 36887 - protein, 19 aa, synthetic construct
  source 1..19: note = Seed: LQTVHSIPLTINKEEALQR
LQTVHSIPWTILKLEAMQR

SEQ ID NO: 36888 - protein, 19 aa, synthetic construct
  source 1..19: note = Seed: LQTVHSIPLTINKEEALQR
LQTVHSIPWTILKLEAVQR

SEQ ID NO: 36889 - protein, 19 aa, synthetic construct
  source 1..19: note = Seed: LQTVHSIPLTINKEEALQR
LQTVHSIPWTILKLEAYQR

SEQ ID NO: 36890 - protein, 19 aa, synthetic construct
  source 1..19: note = Seed: LQTVHSIPLTINKEEALQR
LQTVHSIPWTILKMEALQR

SEQ ID NO: 36891 - protein, 19 aa, synthetic construct
  source 1..19: note = Seed: LQTVHSIPLTINKEEALQR
LQTVHSIPWTILKNEAAQR

SEQ ID NO: 36892 - protein, 19 aa, synthetic construct
  source 1..19: note = Seed: LQTVHSIPLTINKEEALQR
LQTVHSIPWTILKNEAIQR

SEQ ID NO: 36893 - protein, 19 aa, synthetic construct
  source 1..19: note = Seed: LQTVHSIPLTINKEEALQR
LQTVHSIPWTILKNEALQR

SEQ ID NO: 36894 - protein, 19 aa, synthetic construct
  source 1..19: note = Seed: LQTVHSIPLTINKEEALQR
LQTVHSIPWTILKNEAMQR

SEQ ID NO: 36895 - protein, 19 aa, synthetic construct
  source 1..19: note = Seed: LQTVHSIPLTINKEEALQR
LQTVHSIPWTILKNEASQR

SEQ ID NO: 36896 - protein, 19 aa, synthetic construct
  source 1..19: note = Seed: LQTVHSIPLTINKEEALQR
LQTVHSIPWTILKNEATQR

SEQ ID NO: 36897 - protein, 19 aa, synthetic construct
  source 1..19: note = Seed: LQTVHSIPLTINKEEALQR
LQTVHSIPWTILKNEAVQR

SEQ ID NO: 36898 - protein, 19 aa, synthetic construct
  source 1..19: note = Seed: LQTVHSIPLTINKEEALQR
LQTVHSIPWTILKPEAAQR

SEQ ID NO: 36899 - protein, 19 aa, synthetic construct
  source 1..19: note = Seed: LQTVHSIPLTINKEEALQR
LQTVHSIPWTILKPEAIQR

SEQ ID NO: 36900 - protein, 19 aa, synthetic construct
  source 1..19: note = Seed: LQTVHSIPLTINKEEALQR
LQTVHSIPWTILKPEALQR

SEQ ID NO: 36901 - protein, 19 aa, synthetic construct
  source 1..19: note = Seed: LQTVHSIPLTINKEEALQR
LQTVHSIPWTILKPEAMQR

SEQ ID NO: 36902 - protein, 19 aa, synthetic construct
  source 1..19: note = Seed: LQTVHSIPLTINKEEALQR
LQTVHSIPWTILKPEASQR

SEQ ID NO: 36903 - protein, 19 aa, synthetic construct
  source 1..19: note = Seed: LQTVHSIPLTINKEEALQR
LQTVHSIPWTILKPEATQR

SEQ ID NO: 36904 - protein, 19 aa, synthetic construct
  source 1..19: note = Seed: LQTVHSIPLTINKEEALQR
LQTVHSIPWTILKPEAVQR

SEQ ID NO: 36905 - protein, 19 aa, synthetic construct
  source 1..19: note = Seed: LQTVHSIPLTINKEEALQR
LQTVHSIPWTILKSEAAQR

SEQ ID NO: 36906 - protein, 19 aa, synthetic construct
  source 1..19: note = Seed: LQTVHSIPLTINKEEALQR
LQTVHSIPWTILKSEAGQR

SEQ ID NO: 36907 - protein, 19 aa, synthetic construct
  source 1..19: note = Seed: LQTVHSIPLTINKEEALQR
LQTVHSIPWTILKSEAIQR

SEQ ID NO: 36908 - protein, 19 aa, synthetic construct
  source 1..19: note = Seed: LQTVHSIPLTINKEEALQR
LQTVHSIPWTILKSEALQR

SEQ ID NO: 36909 - protein, 19 aa, synthetic construct
  source 1..19: note = Seed: LQTVHSIPLTINKEEALQR
LQTVHSIPWTILKSEAMQR

SEQ ID NO: 36910 - protein, 19 aa, synthetic construct
  source 1..19: note = Seed: LQTVHSIPLTINKEEALQR
LQTVHSIPWTILKSEASQR

SEQ ID NO: 36911 - protein, 19 aa, synthetic construct
  source 1..19: note = Seed: LQTVHSIPLTINKEEALQR
LQTVHSIPWTILKSEATQR

SEQ ID NO: 36912 - protein, 19 aa, synthetic construct
  source 1..19: note = Seed: LQTVHSIPLTINKEEALQR
LQTVHSIPWTILKSEAVQR

SEQ ID NO: 36913 - protein, 19 aa, synthetic construct
  source 1..19: note = Seed: LQTVHSIPLTINKEEALQR
LQTVHSIPWTILKTEAAQR

SEQ ID NO: 36914 - protein, 19 aa, synthetic construct
  source 1..19: note = Seed: LQTVHSIPLTINKEEALQR
LQTVHSIPWTILKTEAIQR

SEQ ID NO: 36915 - protein, 19 aa, synthetic construct
  source 1..19: note = Seed: LQTVHSIPLTINKEEALQR
LQTVHSIPWTILKTEALQR

SEQ ID NO: 36916 - protein, 19 aa, synthetic construct
  source 1..19: note = Seed: LQTVHSIPLTINKEEALQR
LQTVHSIPWTILKTEAMQR

SEQ ID NO: 36917 - protein, 19 aa, synthetic construct
  source 1..19: note = Seed: LQTVHSIPLTINKEEALQR
LQTVHSIPWTILKTEASQR

SEQ ID NO: 36918 - protein, 19 aa, synthetic construct
  source 1..19: note = Seed: LQTVHSIPLTINKEEALQR
LQTVHSIPWTILKTEATQR

SEQ ID NO: 36919 - protein, 19 aa, synthetic construct
  source 1..19: note = Seed: LQTVHSIPLTINKEEALQR
LQTVHSIPWTILKTEAVQR

SEQ ID NO: 36920 - protein, 19 aa, synthetic construct
  source 1..19: note = Seed: LQTVHSIPLTINKEEALQR
LQTVHSIPWTILKWEAIQR

SEQ ID NO: 36921 - protein, 19 aa, synthetic construct
  source 1..19: note = Seed: LQTVHSIPLTINKEEALQR
LQTVHSIPWTILKWEALQR

SEQ ID NO: 36922 - protein, 19 aa, synthetic construct
  source 1..19: note = Seed: LQTVHSIPLTINKEEALQR
LQTVHSIPWTILKWEAVQR

SEQ ID NO: 36923 - protein, 19 aa, synthetic construct
  source 1..19: note = Seed: LQTVHSIPLTINKEEALQR
LQTVHSIPWTILKYEAAQR

SEQ ID NO: 36924 - protein, 19 aa, synthetic construct
  source 1..19: note = Seed: LQTVHSIPLTINKEEALQR
LQTVHSIPWTILKYEAFQR

SEQ ID NO: 36925 - protein, 19 aa, synthetic construct
  source 1..19: note = Seed: LQTVHSIPLTINKEEALQR
LQTVHSIPWTILKYEAIQR

SEQ ID NO: 36926 - protein, 19 aa, synthetic construct
  source 1..19: note = Seed: LQTVHSIPLTINKEEALQR
LQTVHSIPWTILKYEALQR

SEQ ID NO: 36927 - protein, 19 aa, synthetic construct
  source 1..19: note = Seed: LQTVHSIPLTINKEEALQR
LQTVHSIPWTILKYEAMQR

SEQ ID NO: 36928 - protein, 19 aa, synthetic construct
  source 1..19: note = Seed: LQTVHSIPLTINKEEALQR
LQTVHSIPWTILKYEAVQR

SEQ ID NO: 36929 - protein, 19 aa, synthetic construct
  source 1..19: note = Seed: LQTVHSIPLTINKEEALQR
LQTVHSIPWTILKYEAYQR

SEQ ID NO: 36930 - protein, 19 aa, synthetic construct
  source 1..19: note = Seed: LQTVHSIPLTINKEEALQR
LQTVHSIPWTIMKAEAAQR

SEQ ID NO: 36931 - protein, 19 aa, synthetic construct
  source 1..19: note = Seed: LQTVHSIPLTINKEEALQR
LQTVHSIPWTIMKAEAGQR

SEQ ID NO: 36932 - protein, 19 aa, synthetic construct
  source 1..19: note = Seed: LQTVHSIPLTINKEEALQR
LQTVHSIPWTIMKAEAIQR

SEQ ID NO: 36933 - protein, 19 aa, synthetic construct
  source 1..19: note = Seed: LQTVHSIPLTINKEEALQR
LQTVHSIPWTIMKAEALQR

SEQ ID NO: 36934 - protein, 19 aa, synthetic construct
  source 1..19: note = Seed: LQTVHSIPLTINKEEALQR
LQTVHSIPWTIMKAEAMQR

SEQ ID NO: 36935 - protein, 19 aa, synthetic construct
  source 1..19: note = Seed: LQTVHSIPLTINKEEALQR
LQTVHSIPWTIMKAEASQR

SEQ ID NO: 36936 - protein, 19 aa, synthetic construct
  source 1..19: note = Seed: LQTVHSIPLTINKEEALQR
LQTVHSIPWTIMKAEATQR

SEQ ID NO: 36937 - protein, 19 aa, synthetic construct
  source 1..19: note = Seed: LQTVHSIPLTINKEEALQR
LQTVHSIPWTIMKAEAVQR

SEQ ID NO: 36938 - protein, 19 aa, synthetic construct
  source 1..19: note = Seed: LQTVHSIPLTINKEEALQR
LQTVHSIPWTIMKFEAAQR

SEQ ID NO: 36939 - protein, 19 aa, synthetic construct
  source 1..19: note = Seed: LQTVHSIPLTINKEEALQR
LQTVHSIPWTIMKFEAEQR

SEQ ID NO: 36940 - protein, 19 aa, synthetic construct
  source 1..19: note = Seed: LQTVHSIPLTINKEEALQR
LQTVHSIPWTIMKFEAFQR

SEQ ID NO: 36941 - protein, 19 aa, synthetic construct
  source 1..19: note = Seed: LQTVHSIPLTINKEEALQR
LQTVHSIPWTIMKFEAIQR

SEQ ID NO: 36942 - protein, 19 aa, synthetic construct
  source 1..19: note = Seed: LQTVHSIPLTINKEEALQR
LQTVHSIPWTIMKFEALQR

SEQ ID NO: 36943 - protein, 19 aa, synthetic construct
  source 1..19: note = Seed: LQTVHSIPLTINKEEALQR
LQTVHSIPWTIMKFEAMQR

SEQ ID NO: 36944 - protein, 19 aa, synthetic construct
  source 1..19: note = Seed: LQTVHSIPLTINKEEALQR
LQTVHSIPWTIMKFEANQR

SEQ ID NO: 36945 - protein, 19 aa, synthetic construct
  source 1..19: note = Seed: LQTVHSIPLTINKEEALQR
LQTVHSIPWTIMKFEASQR

SEQ ID NO: 36946 - protein, 19 aa, synthetic construct
  source 1..19: note = Seed: LQTVHSIPLTINKEEALQR
LQTVHSIPWTIMKFEATQR

SEQ ID NO: 36947 - protein, 19 aa, synthetic construct
  source 1..19: note = Seed: LQTVHSIPLTINKEEALQR
LQTVHSIPWTIMKFEAVQR

SEQ ID NO: 36948 - protein, 19 aa, synthetic construct
  source 1..19: note = Seed: LQTVHSIPLTINKEEALQR
LQTVHSIPWTIMKFEAYQR

SEQ ID NO: 36949 - protein, 19 aa, synthetic construct
  source 1..19: note = Seed: LQTVHSIPLTINKEEALQR
LQTVHSIPWTIMKGEAAQR

SEQ ID NO: 36950 - protein, 19 aa, synthetic construct
  source 1..19: note = Seed: LQTVHSIPLTINKEEALQR
LQTVHSIPWTIMKGEAGQR

SEQ ID NO: 36951 - protein, 19 aa, synthetic construct
  source 1..19: note = Seed: LQTVHSIPLTINKEEALQR
LQTVHSIPWTIMKGEAIQR

SEQ ID NO: 36952 - protein, 19 aa, synthetic construct
  source 1..19: note = Seed: LQTVHSIPLTINKEEALQR
LQTVHSIPWTIMKGEALQR

SEQ ID NO: 36953 - protein, 19 aa, synthetic construct
  source 1..19: note = Seed: LQTVHSIPLTINKEEALQR
LQTVHSIPWTIMKGEAMQR

SEQ ID NO: 36954 - protein, 19 aa, synthetic construct
  source 1..19: note = Seed: LQTVHSIPLTINKEEALQR
LQTVHSIPWTIMKGEASQR

SEQ ID NO: 36955 - protein, 19 aa, synthetic construct
  source 1..19: note = Seed: LQTVHSIPLTINKEEALQR
LQTVHSIPWTIMKGEATQR

SEQ ID NO: 36956 - protein, 19 aa, synthetic construct
  source 1..19: note = Seed: LQTVHSIPLTINKEEALQR
LQTVHSIPWTIMKGEAVQR

SEQ ID NO: 36957 - protein, 19 aa, synthetic construct
  source 1..19: note = Seed: LQTVHSIPLTINKEEALQR
LQTVHSIPWTIMKNEAAQR

SEQ ID NO: 36958 - protein, 19 aa, synthetic construct
  source 1..19: note = Seed: LQTVHSIPLTINKEEALQR
LQTVHSIPWTIMKNEAIQR

SEQ ID NO: 36959 - protein, 19 aa, synthetic construct
  source 1..19: note = Seed: LQTVHSIPLTINKEEALQR
LQTVHSIPWTIMKNEALQR

SEQ ID NO: 36960 - protein, 19 aa, synthetic construct
  source 1..19: note = Seed: LQTVHSIPLTINKEEALQR
LQTVHSIPWTIMKNEAMQR

SEQ ID NO: 36961 - protein, 19 aa, synthetic construct
  source 1..19: note = Seed: LQTVHSIPLTINKEEALQR
LQTVHSIPWTIMKNEASQR

SEQ ID NO: 36962 - protein, 19 aa, synthetic construct
  source 1..19: note = Seed: LQTVHSIPLTINKEEALQR
LQTVHSIPWTIMKNEATQR

SEQ ID NO: 36963 - protein, 19 aa, synthetic construct
  source 1..19: note = Seed: LQTVHSIPLTINKEEALQR
LQTVHSIPWTIMKNEAVQR

SEQ ID NO: 36964 - protein, 19 aa, synthetic construct
  source 1..19: note = Seed: LQTVHSIPLTINKEEALQR
LQTVHSIPWTIMKPEAAQR

SEQ ID NO: 36965 - protein, 19 aa, synthetic construct
  source 1..19: note = Seed: LQTVHSIPLTINKEEALQR
LQTVHSIPWTIMKPEAIQR

SEQ ID NO: 36966 - protein, 19 aa, synthetic construct
  source 1..19: note = Seed: LQTVHSIPLTINKEEALQR
LQTVHSIPWTIMKPEALQR

SEQ ID NO: 36967 - protein, 19 aa, synthetic construct
  source 1..19: note = Seed: LQTVHSIPLTINKEEALQR
LQTVHSIPWTIMKPEAMQR

SEQ ID NO: 36968 - protein, 19 aa, synthetic construct
  source 1..19: note = Seed: LQTVHSIPLTINKEEALQR
LQTVHSIPWTIMKPEATQR

SEQ ID NO: 36969 - protein, 19 aa, synthetic construct
  source 1..19: note = Seed: LQTVHSIPLTINKEEALQR
LQTVHSIPWTIMKPEAVQR

SEQ ID NO: 36970 - protein, 19 aa, synthetic construct
  source 1..19: note = Seed: LQTVHSIPLTINKEEALQR
LQTVHSIPWTIMKSEAAQR

SEQ ID NO: 36971 - protein, 19 aa, synthetic construct
  source 1..19: note = Seed: LQTVHSIPLTINKEEALQR
LQTVHSIPWTIMKSEAGQR

SEQ ID NO: 36972 - protein, 19 aa, synthetic construct
  source 1..19: note = Seed: LQTVHSIPLTINKEEALQR
LQTVHSIPWTIMKSEAIQR

SEQ ID NO: 36973 - protein, 19 aa, synthetic construct
  source 1..19: note = Seed: LQTVHSIPLTINKEEALQR
LQTVHSIPWTIMKSEALQR

SEQ ID NO: 36974 - protein, 19 aa, synthetic construct
  source 1..19: note = Seed: LQTVHSIPLTINKEEALQR
LQTVHSIPWTIMKSEAMQR

SEQ ID NO: 36975 - protein, 19 aa, synthetic construct
  source 1..19: note = Seed: LQTVHSIPLTINKEEALQR
LQTVHSIPWTIMKSEASQR

SEQ ID NO: 36976 - protein, 19 aa, synthetic construct
  source 1..19: note = Seed: LQTVHSIPLTINKEEALQR
LQTVHSIPWTIMKSEATQR

SEQ ID NO: 36977 - protein, 19 aa, synthetic construct
  source 1..19: note = Seed: LQTVHSIPLTINKEEALQR
LQTVHSIPWTIMKSEAVQR

SEQ ID NO: 36978 - protein, 19 aa, synthetic construct
  source 1..19: note = Seed: LQTVHSIPLTINKEEALQR
LQTVHSIPWTIMKTEAAQR

SEQ ID NO: 36979 - protein, 19 aa, synthetic construct
  source 1..19: note = Seed: LQTVHSIPLTINKEEALQR
LQTVHSIPWTIMKTEAIQR

SEQ ID NO: 36980 - protein, 19 aa, synthetic construct
  source 1..19: note = Seed: LQTVHSIPLTINKEEALQR
LQTVHSIPWTIMKTEALQR

SEQ ID NO: 36981 - protein, 19 aa, synthetic construct
  source 1..19: note = Seed: LQTVHSIPLTINKEEALQR
LQTVHSIPWTIMKTEAMQR

SEQ ID NO: 36982 - protein, 19 aa, synthetic construct
  source 1..19: note = Seed: LQTVHSIPLTINKEEALQR
LQTVHSIPWTIMKTEASQR

SEQ ID NO: 36983 - protein, 19 aa, synthetic construct
  source 1..19: note = Seed: LQTVHSIPLTINKEEALQR
LQTVHSIPWTIMKTEATQR

SEQ ID NO: 36984 - protein, 19 aa, synthetic construct
  source 1..19: note = Seed: LQTVHSIPLTINKEEALQR
LQTVHSIPWTIMKTEAVQR

SEQ ID NO: 36985 - protein, 19 aa, synthetic construct
  source 1..19: note = Seed: LQTVHSIPLTINKEEALQR
LQTVHSIPWTIMKVEAAQR

SEQ ID NO: 36986 - protein, 19 aa, synthetic construct
  source 1..19: note = Seed: LQTVHSIPLTINKEEALQR
LQTVHSIPWTIMKVEAVQR

SEQ ID NO: 36987 - protein, 19 aa, synthetic construct
  source 1..19: note = Seed: LQTVHSIPLTINKEEALQR
LQTVHSIPWTIMKYEAFQR

SEQ ID NO: 36988 - protein, 19 aa, synthetic construct
  source 1..19: note = Seed: LQTVHSIPLTINKEEALQR
LQTVHSIPWTIMKYEAIQR

SEQ ID NO: 36989 - protein, 19 aa, synthetic construct
  source 1..19: note = Seed: LQTVHSIPLTINKEEALQR
LQTVHSIPWTIMKYEALQR

SEQ ID NO: 36990 - protein, 19 aa, synthetic construct
  source 1..19: note = Seed: LQTVHSIPLTINKEEALQR
LQTVHSIPWTIMKYEAVQR

SEQ ID NO: 36991 - protein, 19 aa, synthetic construct
  source 1..19: note = Seed: LQTVHSIPLTINKEEALQR
LQTVHSIPWTINKAEAIQR

SEQ ID NO: 36992 - protein, 19 aa, synthetic construct
  source 1..19: note = Seed: LQTVHSIPLTINKEEALQR
LQTVHSIPWTINKAEAVQR

SEQ ID NO: 36993 - protein, 19 aa, synthetic construct
  source 1..19: note = Seed: LQTVHSIPLTINKEEALQR
LQTVHSIPWTINKFEAFQR

SEQ ID NO: 36994 - protein, 19 aa, synthetic construct
  source 1..19: note = Seed: LQTVHSIPLTINKEEALQR
LQTVHSIPWTINKFEAIQR

SEQ ID NO: 36995 - protein, 19 aa, synthetic construct
  source 1..19: note = Seed: LQTVHSIPLTINKEEALQR
LQTVHSIPWTINKFEALQR

SEQ ID NO: 36996 - protein, 19 aa, synthetic construct
  source 1..19: note = Seed: LQTVHSIPLTINKEEALQR
LQTVHSIPWTINKFEAVQR

SEQ ID NO: 36997 - protein, 19 aa, synthetic construct
  source 1..19: note = Seed: LQTVHSIPLTINKEEALQR
LQTVHSIPWTINKNEAIQR

SEQ ID NO: 36998 - protein, 19 aa, synthetic construct
  source 1..19: note = Seed: LQTVHSIPLTINKEEALQR
LQTVHSIPWTINKNEAVQR

SEQ ID NO: 36999 - protein, 19 aa, synthetic construct
  source 1..19: note = Seed: LQTVHSIPLTINKEEALQR
LQTVHSIPWTINKSEAIQR

SEQ ID NO: 37000 - protein, 19 aa, synthetic construct
  source 1..19: note = Seed: LQTVHSIPLTINKEEALQR
LQTVHSIPWTINKSEAVQR

SEQ ID NO: 37001 - protein, 19 aa, synthetic construct
  source 1..19: note = Seed: LQTVHSIPLTINKEEALQR
LQTVHSIPWTIQKAEAAQR

SEQ ID NO: 37002 - protein, 19 aa, synthetic construct
  source 1..19: note = Seed: LQTVHSIPLTINKEEALQR
LQTVHSIPWTIQKAEAIQR

SEQ ID NO: 37003 - protein, 19 aa, synthetic construct
  source 1..19: note = Seed: LQTVHSIPLTINKEEALQR
LQTVHSIPWTIQKAEALQR

SEQ ID NO: 37004 - protein, 19 aa, synthetic construct
  source 1..19: note = Seed: LQTVHSIPLTINKEEALQR
LQTVHSIPWTIQKAEAVQR

SEQ ID NO: 37005 - protein, 19 aa, synthetic construct
  source 1..19: note = Seed: LQTVHSIPLTINKEEALQR
LQTVHSIPWTIQKFEAFQR

SEQ ID NO: 37006 - protein, 19 aa, synthetic construct
  source 1..19: note = Seed: LQTVHSIPLTINKEEALQR
LQTVHSIPWTIQKFEAIQR

SEQ ID NO: 37007 - protein, 19 aa, synthetic construct
  source 1..19: note = Seed: LQTVHSIPLTINKEEALQR
LQTVHSIPWTIQKFEALQR

SEQ ID NO: 37008 - protein, 19 aa, synthetic construct
  source 1..19: note = Seed: LQTVHSIPLTINKEEALQR
LQTVHSIPWTIQKFEAMQR

SEQ ID NO: 37009 - protein, 19 aa, synthetic construct
  source 1..19: note = Seed: LQTVHSIPLTINKEEALQR
LQTVHSIPWTIQKFEAVQR

SEQ ID NO: 37010 - protein, 19 aa, synthetic construct
  source 1..19: note = Seed: LQTVHSIPLTINKEEALQR
LQTVHSIPWTIQKGEAAQR

SEQ ID NO: 37011 - protein, 19 aa, synthetic construct
  source 1..19: note = Seed: LQTVHSIPLTINKEEALQR
LQTVHSIPWTIQKGEAIQR

SEQ ID NO: 37012 - protein, 19 aa, synthetic construct
  source 1..19: note = Seed: LQTVHSIPLTINKEEALQR
LQTVHSIPWTIQKGEALQR

SEQ ID NO: 37013 - protein, 19 aa, synthetic construct
  source 1..19: note = Seed: LQTVHSIPLTINKEEALQR
LQTVHSIPWTIQKGEAVQR

SEQ ID NO: 37014 - protein, 19 aa, synthetic construct
  source 1..19: note = Seed: LQTVHSIPLTINKEEALQR
LQTVHSIPWTIQKSEAAQR

SEQ ID NO: 37015 - protein, 19 aa, synthetic construct
  source 1..19: note = Seed: LQTVHSIPLTINKEEALQR
LQTVHSIPWTIQKSEAIQR

SEQ ID NO: 37016 - protein, 19 aa, synthetic construct
  source 1..19: note = Seed: LQTVHSIPLTINKEEALQR
LQTVHSIPWTIQKSEALQR

SEQ ID NO: 37017 - protein, 19 aa, synthetic construct
  source 1..19: note = Seed: LQTVHSIPLTINKEEALQR
LQTVHSIPWTIQKSEAVQR

SEQ ID NO: 37018 - protein, 19 aa, synthetic construct
  source 1..19: note = Seed: LQTVHSIPLTINKEEALQR
LQTVHSIPWTISKAEAIQR

SEQ ID NO: 37019 - protein, 19 aa, synthetic construct
  source 1..19: note = Seed: LQTVHSIPLTINKEEALQR
LQTVHSIPWTISKAEALQR

SEQ ID NO: 37020 - protein, 19 aa, synthetic construct
  source 1..19: note = Seed: LQTVHSIPLTINKEEALQR
LQTVHSIPWTISKAEAVQR

SEQ ID NO: 37021 - protein, 19 aa, synthetic construct
  source 1..19: note = Seed: LQTVHSIPLTINKEEALQR
LQTVHSIPWTISKFEAFQR

SEQ ID NO: 37022 - protein, 19 aa, synthetic construct
  source 1..19: note = Seed: LQTVHSIPLTINKEEALQR
LQTVHSIPWTISKFEAIQR

SEQ ID NO: 37023 - protein, 19 aa, synthetic construct
  source 1..19: note = Seed: LQTVHSIPLTINKEEALQR
LQTVHSIPWTISKFEALQR

SEQ ID NO: 37024 - protein, 19 aa, synthetic construct
  source 1..19: note = Seed: LQTVHSIPLTINKEEALQR
LQTVHSIPWTISKFEAMQR

SEQ ID NO: 37025 - protein, 19 aa, synthetic construct
  source 1..19: note = Seed: LQTVHSIPLTINKEEALQR
LQTVHSIPWTISKFEAVQR

SEQ ID NO: 37026 - protein, 19 aa, synthetic construct
  source 1..19: note = Seed: LQTVHSIPLTINKEEALQR
LQTVHSIPWTISKFEAYQR

SEQ ID NO: 37027 - protein, 19 aa, synthetic construct
  source 1..19: note = Seed: LQTVHSIPLTINKEEALQR
LQTVHSIPWTISKGEAIQR

SEQ ID NO: 37028 - protein, 19 aa, synthetic construct
  source 1..19: note = Seed: LQTVHSIPLTINKEEALQR
LQTVHSIPWTISKSEAIQR

SEQ ID NO: 37029 - protein, 19 aa, synthetic construct
  source 1..19: note = Seed: LQTVHSIPLTINKEEALQR
LQTVHSIPWTISKSEALQR

SEQ ID NO: 37030 - protein, 19 aa, synthetic construct
  source 1..19: note = Seed: LQTVHSIPLTINKEEALQR
LQTVHSIPWTISKSEAMQR

SEQ ID NO: 37031 - protein, 19 aa, synthetic construct
  source 1..19: note = Seed: LQTVHSIPLTINKEEALQR
LQTVHSIPWTISKSEAVQR

SEQ ID NO: 37032 - protein, 19 aa, synthetic construct
  source 1..19: note = Seed: LQTVHSIPLTINKEEALQR
LQTVHSIPWTISKTEAIQR

SEQ ID NO: 37033 - protein, 19 aa, synthetic construct
  source 1..19: note = Seed: LQTVHSIPLTINKEEALQR
LQTVHSIPWTITKAEAIQR

SEQ ID NO: 37034 - protein, 19 aa, synthetic construct
  source 1..19: note = Seed: LQTVHSIPLTINKEEALQR
LQTVHSIPWTITKAEALQR

SEQ ID NO: 37035 - protein, 19 aa, synthetic construct
  source 1..19: note = Seed: LQTVHSIPLTINKEEALQR
LQTVHSIPWTITKAEAVQR

SEQ ID NO: 37036 - protein, 19 aa, synthetic construct
  source 1..19: note = Seed: LQTVHSIPLTINKEEALQR
LQTVHSIPWTITKFEAAQR

SEQ ID NO: 37037 - protein, 19 aa, synthetic construct
  source 1..19: note = Seed: LQTVHSIPLTINKEEALQR
LQTVHSIPWTITKFEAEQR

SEQ ID NO: 37038 - protein, 19 aa, synthetic construct
  source 1..19: note = Seed: LQTVHSIPLTINKEEALQR
LQTVHSIPWTITKFEAFQR

SEQ ID NO: 37039 - protein, 19 aa, synthetic construct
  source 1..19: note = Seed: LQTVHSIPLTINKEEALQR
LQTVHSIPWTITKFEAIQR

SEQ ID NO: 37040 - protein, 19 aa, synthetic construct
  source 1..19: note = Seed: LQTVHSIPLTINKEEALQR
LQTVHSIPWTITKFEALQR

SEQ ID NO: 37041 - protein, 19 aa, synthetic construct
  source 1..19: note = Seed: LQTVHSIPLTINKEEALQR
LQTVHSIPWTITKFEAMQR

SEQ ID NO: 37042 - protein, 19 aa, synthetic construct
  source 1..19: note = Seed: LQTVHSIPLTINKEEALQR
LQTVHSIPWTITKFEANQR

SEQ ID NO: 37043 - protein, 19 aa, synthetic construct
  source 1..19: note = Seed: LQTVHSIPLTINKEEALQR
LQTVHSIPWTITKFEASQR

SEQ ID NO: 37044 - protein, 19 aa, synthetic construct
  source 1..19: note = Seed: LQTVHSIPLTINKEEALQR
LQTVHSIPWTITKFEATQR

SEQ ID NO: 37045 - protein, 19 aa, synthetic construct
  source 1..19: note = Seed: LQTVHSIPLTINKEEALQR
LQTVHSIPWTITKFEAVQR

SEQ ID NO: 37046 - protein, 19 aa, synthetic construct
  source 1..19: note = Seed: LQTVHSIPLTINKEEALQR
LQTVHSIPWTITKFEAYQR

SEQ ID NO: 37047 - protein, 19 aa, synthetic construct
  source 1..19: note = Seed: LQTVHSIPLTINKEEALQR
LQTVHSIPWTITKGEAIQR

SEQ ID NO: 37048 - protein, 19 aa, synthetic construct
  source 1..19: note = Seed: LQTVHSIPLTINKEEALQR
LQTVHSIPWTITKGEALQR

SEQ ID NO: 37049 - protein, 19 aa, synthetic construct
  source 1..19: note = Seed: LQTVHSIPLTINKEEALQR
LQTVHSIPWTITKLEALQR

SEQ ID NO: 37050 - protein, 19 aa, synthetic construct
  source 1..19: note = Seed: LQTVHSIPLTINKEEALQR
LQTVHSIPWTITKSEAIQR

SEQ ID NO: 37051 - protein, 19 aa, synthetic construct
  source 1..19: note = Seed: LQTVHSIPLTINKEEALQR
LQTVHSIPWTITKSEALQR

SEQ ID NO: 37052 - protein, 19 aa, synthetic construct
  source 1..19: note = Seed: LQTVHSIPLTINKEEALQR
LQTVHSIPWTITKSEAMQR

SEQ ID NO: 37053 - protein, 19 aa, synthetic construct
  source 1..19: note = Seed: LQTVHSIPLTINKEEALQR
LQTVHSIPWTITKSEAVQR

SEQ ID NO: 37054 - protein, 19 aa, synthetic construct
  source 1..19: note = Seed: LQTVHSIPLTINKEEALQR
LQTVHSIPWTITKTEAIQR

SEQ ID NO: 37055 - protein, 19 aa, synthetic construct
  source 1..19: note = Seed: LQTVHSIPLTINKEEALQR
LQTVHSIPWTITKYEAIQR

SEQ ID NO: 37056 - protein, 19 aa, synthetic construct
  source 1..19: note = Seed: LQTVHSIPLTINKEEALQR
LQTVHSIPWTITKYEALQR

SEQ ID NO: 37057 - protein, 19 aa, synthetic construct
  source 1..19: note = Seed: LQTVHSIPLTINKEEALQR
LQTVHSIPWTIVKAEAAQR

SEQ ID NO: 37058 - protein, 19 aa, synthetic construct
  source 1..19: note = Seed: LQTVHSIPLTINKEEALQR
LQTVHSIPWTIVKAEAIQR

SEQ ID NO: 37059 - protein, 19 aa, synthetic construct
  source 1..19: note = Seed: LQTVHSIPLTINKEEALQR
LQTVHSIPWTIVKAEALQR

SEQ ID NO: 37060 - protein, 19 aa, synthetic construct
  source 1..19: note = Seed: LQTVHSIPLTINKEEALQR
LQTVHSIPWTIVKAEAVQR

SEQ ID NO: 37061 - protein, 19 aa, synthetic construct
  source 1..19: note = Seed: LQTVHSIPLTINKEEALQR
LQTVHSIPWTIVKFEAAQR

SEQ ID NO: 37062 - protein, 19 aa, synthetic construct
  source 1..19: note = Seed: LQTVHSIPLTINKEEALQR
LQTVHSIPWTIVKFEADQR

SEQ ID NO: 37063 - protein, 19 aa, synthetic construct
  source 1..19: note = Seed: LQTVHSIPLTINKEEALQR
LQTVHSIPWTIVKFEAEQR

SEQ ID NO: 37064 - protein, 19 aa, synthetic construct
  source 1..19: note = Seed: LQTVHSIPLTINKEEALQR
LQTVHSIPWTIVKFEAFQR

SEQ ID NO: 37065 - protein, 19 aa, synthetic construct
  source 1..19: note = Seed: LQTVHSIPLTINKEEALQR
LQTVHSIPWTIVKFEAHQR

SEQ ID NO: 37066 - protein, 19 aa, synthetic construct
  source 1..19: note = Seed: LQTVHSIPLTINKEEALQR
LQTVHSIPWTIVKFEAIQR

SEQ ID NO: 37067 - protein, 19 aa, synthetic construct
  source 1..19: note = Seed: LQTVHSIPLTINKEEALQR
LQTVHSIPWTIVKFEALQR

SEQ ID NO: 37068 - protein, 19 aa, synthetic construct
  source 1..19: note = Seed: LQTVHSIPLTINKEEALQR
LQTVHSIPWTIVKFEAMQR

SEQ ID NO: 37069 - protein, 19 aa, synthetic construct
  source 1..19: note = Seed: LQTVHSIPLTINKEEALQR
LQTVHSIPWTIVKFEANQR

SEQ ID NO: 37070 - protein, 19 aa, synthetic construct
  source 1..19: note = Seed: LQTVHSIPLTINKEEALQR
LQTVHSIPWTIVKFEAPQR

SEQ ID NO: 37071 - protein, 19 aa, synthetic construct
  source 1..19: note = Seed: LQTVHSIPLTINKEEALQR
LQTVHSIPWTIVKFEAQQR

SEQ ID NO: 37072 - protein, 19 aa, synthetic construct
  source 1..19: note = Seed: LQTVHSIPLTINKEEALQR
LQTVHSIPWTIVKFEARQR

SEQ ID NO: 37073 - protein, 19 aa, synthetic construct
  source 1..19: note = Seed: LQTVHSIPLTINKEEALQR
LQTVHSIPWTIVKFEASQR

SEQ ID NO: 37074 - protein, 19 aa, synthetic construct
  source 1..19: note = Seed: LQTVHSIPLTINKEEALQR
LQTVHSIPWTIVKFEATQR

SEQ ID NO: 37075 - protein, 19 aa, synthetic construct
  source 1..19: note = Seed: LQTVHSIPLTINKEEALQR
LQTVHSIPWTIVKFEAVQR

SEQ ID NO: 37076 - protein, 19 aa, synthetic construct
  source 1..19: note = Seed: LQTVHSIPLTINKEEALQR
LQTVHSIPWTIVKFEAYQR

SEQ ID NO: 37077 - protein, 19 aa, synthetic construct
  source 1..19: note = Seed: LQTVHSIPLTINKEEALQR
LQTVHSIPWTIVKGEAAQR

SEQ ID NO: 37078 - protein, 19 aa, synthetic construct
  source 1..19: note = Seed: LQTVHSIPLTINKEEALQR
LQTVHSIPWTIVKGEAIQR

SEQ ID NO: 37079 - protein, 19 aa, synthetic construct
  source 1..19: note = Seed: LQTVHSIPLTINKEEALQR
LQTVHSIPWTIVKGEALQR

SEQ ID NO: 37080 - protein, 19 aa, synthetic construct
  source 1..19: note = Seed: LQTVHSIPLTINKEEALQR
LQTVHSIPWTIVKGEAVQR

SEQ ID NO: 37081 - protein, 19 aa, synthetic construct
  source 1..19: note = Seed: LQTVHSIPLTINKEEALQR
LQTVHSIPWTIVKIEALQR

SEQ ID NO: 37082 - protein, 19 aa, synthetic construct
  source 1..19: note = Seed: LQTVHSIPLTINKEEALQR
LQTVHSIPWTIVKLEAFQR

SEQ ID NO: 37083 - protein, 19 aa, synthetic construct
  source 1..19: note = Seed: LQTVHSIPLTINKEEALQR
LQTVHSIPWTIVKLEAIQR

SEQ ID NO: 37084 - protein, 19 aa, synthetic construct
  source 1..19: note = Seed: LQTVHSIPLTINKEEALQR
LQTVHSIPWTIVKLEALQR

SEQ ID NO: 37085 - protein, 19 aa, synthetic construct
  source 1..19: note = Seed: LQTVHSIPLTINKEEALQR
LQTVHSIPWTIVKLEAVQR

SEQ ID NO: 37086 - protein, 19 aa, synthetic construct
  source 1..19: note = Seed: LQTVHSIPLTINKEEALQR
LQTVHSIPWTIVKSEAAQR

SEQ ID NO: 37087 - protein, 19 aa, synthetic construct
  source 1..19: note = Seed: LQTVHSIPLTINKEEALQR
LQTVHSIPWTIVKSEAIQR

SEQ ID NO: 37088 - protein, 19 aa, synthetic construct
  source 1..19: note = Seed: LQTVHSIPLTINKEEALQR
LQTVHSIPWTIVKSEALQR

SEQ ID NO: 37089 - protein, 19 aa, synthetic construct
  source 1..19: note = Seed: LQTVHSIPLTINKEEALQR
LQTVHSIPWTIVKSEAMQR

SEQ ID NO: 37090 - protein, 19 aa, synthetic construct
  source 1..19: note = Seed: LQTVHSIPLTINKEEALQR
LQTVHSIPWTIVKSEAVQR

SEQ ID NO: 37091 - protein, 19 aa, synthetic construct
  source 1..19: note = Seed: LQTVHSIPLTINKEEALQR
LQTVHSIPWTIVKTEAIQR

SEQ ID NO: 37092 - protein, 19 aa, synthetic construct
  source 1..19: note = Seed: LQTVHSIPLTINKEEALQR
LQTVHSIPWTIVKWEAIQR

SEQ ID NO: 37093 - protein, 19 aa, synthetic construct
  source 1..19: note = Seed: LQTVHSIPLTINKEEALQR
LQTVHSIPWTIVKWEALQR

SEQ ID NO: 37094 - protein, 19 aa, synthetic construct
  source 1..19: note = Seed: LQTVHSIPLTINKEEALQR
LQTVHSIPWTIVKWEAVQR

SEQ ID NO: 37095 - protein, 19 aa, synthetic construct
  source 1..19: note = Seed: LQTVHSIPLTINKEEALQR
LQTVHSIPWTIVKYEAFQR

SEQ ID NO: 37096 - protein, 19 aa, synthetic construct
  source 1..19: note = Seed: LQTVHSIPLTINKEEALQR
LQTVHSIPWTIVKYEAIQR

SEQ ID NO: 37097 - protein, 19 aa, synthetic construct
  source 1..19: note = Seed: LQTVHSIPLTINKEEALQR
LQTVHSIPWTIVKYEALQR

SEQ ID NO: 37098 - protein, 19 aa, synthetic construct
  source 1..19: note = Seed: LQTVHSIPLTINKEEALQR
LQTVHSIPWTIVKYEAMQR

SEQ ID NO: 37099 - protein, 19 aa, synthetic construct
  source 1..19: note = Seed: LQTVHSIPLTINKEEALQR
LQTVHSIPWTIVKYEAVQR

SEQ ID NO: 37100 - protein, 19 aa, synthetic construct
  source 1..19: note = Seed: LQTVHSIPLTINKEEALQR
LQTVHSIPWTIVKYEAYQR

SEQ ID NO: 37101 - protein, 19 aa, synthetic construct
  source 1..19: note = Seed: LQTVHSIPLTINKEEALQR
LQTVHSIPWTIWKFEAFQR

SEQ ID NO: 37102 - protein, 19 aa, synthetic construct
  source 1..19: note = Seed: LQTVHSIPLTINKEEALQR
LQTVHSIPWTIWKFEAIQR

SEQ ID NO: 37103 - protein, 19 aa, synthetic construct
  source 1..19: note = Seed: LQTVHSIPLTINKEEALQR
LQTVHSIPWTIWKFEALQR

SEQ ID NO: 37104 - protein, 19 aa, synthetic construct
  source 1..19: note = Seed: LQTVHSIPLTINKEEALQR
LQTVHSIPWTIWKFEAVQR

SEQ ID NO: 37105 - protein, 19 aa, synthetic construct
  source 1..19: note = Seed: LQTVHSIPLTINKEEALQR
LQTVHSIPWTIYKFEAFQR

SEQ ID NO: 37106 - protein, 19 aa, synthetic construct
  source 1..19: note = Seed: LQTVHSIPLTINKEEALQR
LQTVHSIPWTIYKFEAIQR

SEQ ID NO: 37107 - protein, 19 aa, synthetic construct
  source 1..19: note = Seed: LQTVHSIPLTINKEEALQR
LQTVHSIPWTIYKFEALQR

SEQ ID NO: 37108 - protein, 19 aa, synthetic construct
  source 1..19: note = Seed: LQTVHSIPLTINKEEALQR
LQTVHSIPWTIYKFEAMQR

SEQ ID NO: 37109 - protein, 19 aa, synthetic construct
  source 1..19: note = Seed: LQTVHSIPLTINKEEALQR
LQTVHSIPWTIYKFEAVQR

SEQ ID NO: 37110 - protein, 19 aa, synthetic construct
  source 1..19: note = Seed: LQTVHSIPLTINKEEALQR
LQTVHSIPYTIAKAEAAQR

SEQ ID NO: 37111 - protein, 19 aa, synthetic construct
  source 1..19: note = Seed: LQTVHSIPLTINKEEALQR
LQTVHSIPYTIAKAEAGQR

SEQ ID NO: 37112 - protein, 19 aa, synthetic construct
  source 1..19: note = Seed: LQTVHSIPLTINKEEALQR
LQTVHSIPYTIAKAEAIQR

SEQ ID NO: 37113 - protein, 19 aa, synthetic construct
  source 1..19: note = Seed: LQTVHSIPLTINKEEALQR
LQTVHSIPYTIAKAEALQR

SEQ ID NO: 37114 - protein, 19 aa, synthetic construct
  source 1..19: note = Seed: LQTVHSIPLTINKEEALQR
LQTVHSIPYTIAKAEAMQR

SEQ ID NO: 37115 - protein, 19 aa, synthetic construct
  source 1..19: note = Seed: LQTVHSIPLTINKEEALQR
LQTVHSIPYTIAKAEASQR

SEQ ID NO: 37116 - protein, 19 aa, synthetic construct
  source 1..19: note = Seed: LQTVHSIPLTINKEEALQR
LQTVHSIPYTIAKAEATQR

SEQ ID NO: 37117 - protein, 19 aa, synthetic construct
  source 1..19: note = Seed: LQTVHSIPLTINKEEALQR
LQTVHSIPYTIAKAEAVQR

SEQ ID NO: 37118 - protein, 19 aa, synthetic construct
  source 1..19: note = Seed: LQTVHSIPLTINKEEALQR
LQTVHSIPYTIAKFEAAQR

SEQ ID NO: 37119 - protein, 19 aa, synthetic construct
  source 1..19: note = Seed: LQTVHSIPLTINKEEALQR
LQTVHSIPYTIAKFEAFQR

SEQ ID NO: 37120 - protein, 19 aa, synthetic construct
  source 1..19: note = Seed: LQTVHSIPLTINKEEALQR
LQTVHSIPYTIAKFEAIQR

SEQ ID NO: 37121 - protein, 19 aa, synthetic construct
  source 1..19: note = Seed: LQTVHSIPLTINKEEALQR
LQTVHSIPYTIAKFEALQR

SEQ ID NO: 37122 - protein, 19 aa, synthetic construct
  source 1..19: note = Seed: LQTVHSIPLTINKEEALQR
LQTVHSIPYTIAKFEAMQR

SEQ ID NO: 37123 - protein, 19 aa, synthetic construct
  source 1..19: note = Seed: LQTVHSIPLTINKEEALQR
LQTVHSIPYTIAKFEATQR

SEQ ID NO: 37124 - protein, 19 aa, synthetic construct
  source 1..19: note = Seed: LQTVHSIPLTINKEEALQR
LQTVHSIPYTIAKFEAVQR

SEQ ID NO: 37125 - protein, 19 aa, synthetic construct
  source 1..19: note = Seed: LQTVHSIPLTINKEEALQR
LQTVHSIPYTIAKFEAYQR

SEQ ID NO: 37126 - protein, 19 aa, synthetic construct
  source 1..19: note = Seed: LQTVHSIPLTINKEEALQR
LQTVHSIPYTIAKGEAAQR

SEQ ID NO: 37127 - protein, 19 aa, synthetic construct
  source 1..19: note = Seed: LQTVHSIPLTINKEEALQR
LQTVHSIPYTIAKGEAIQR

SEQ ID NO: 37128 - protein, 19 aa, synthetic construct
  source 1..19: note = Seed: LQTVHSIPLTINKEEALQR
LQTVHSIPYTIAKGEALQR

SEQ ID NO: 37129 - protein, 19 aa, synthetic construct
  source 1..19: note = Seed: LQTVHSIPLTINKEEALQR
LQTVHSIPYTIAKGEAMQR

SEQ ID NO: 37130 - protein, 19 aa, synthetic construct
  source 1..19: note = Seed: LQTVHSIPLTINKEEALQR
LQTVHSIPYTIAKGEASQR

SEQ ID NO: 37131 - protein, 19 aa, synthetic construct
  source 1..19: note = Seed: LQTVHSIPLTINKEEALQR
LQTVHSIPYTIAKGEATQR

SEQ ID NO: 37132 - protein, 19 aa, synthetic construct
  source 1..19: note = Seed: LQTVHSIPLTINKEEALQR
LQTVHSIPYTIAKGEAVQR

SEQ ID NO: 37133 - protein, 19 aa, synthetic construct
  source 1..19: note = Seed: LQTVHSIPLTINKEEALQR
LQTVHSIPYTIAKNEAAQR

SEQ ID NO: 37134 - protein, 19 aa, synthetic construct
  source 1..19: note = Seed: LQTVHSIPLTINKEEALQR
LQTVHSIPYTIAKNEAIQR

SEQ ID NO: 37135 - protein, 19 aa, synthetic construct
  source 1..19: note = Seed: LQTVHSIPLTINKEEALQR
LQTVHSIPYTIAKNEALQR

SEQ ID NO: 37136 - protein, 19 aa, synthetic construct
  source 1..19: note = Seed: LQTVHSIPLTINKEEALQR
LQTVHSIPYTIAKNEAVQR

SEQ ID NO: 37137 - protein, 19 aa, synthetic construct
  source 1..19: note = Seed: LQTVHSIPLTINKEEALQR
LQTVHSIPYTIAKPEAAQR

SEQ ID NO: 37138 - protein, 19 aa, synthetic construct
  source 1..19: note = Seed: LQTVHSIPLTINKEEALQR
LQTVHSIPYTIAKPEAIQR

SEQ ID NO: 37139 - protein, 19 aa, synthetic construct
  source 1..19: note = Seed: LQTVHSIPLTINKEEALQR
LQTVHSIPYTIAKPEALQR

SEQ ID NO: 37140 - protein, 19 aa, synthetic construct
  source 1..19: note = Seed: LQTVHSIPLTINKEEALQR
LQTVHSIPYTIAKPEAMQR

SEQ ID NO: 37141 - protein, 19 aa, synthetic construct
  source 1..19: note = Seed: LQTVHSIPLTINKEEALQR
LQTVHSIPYTIAKPEAVQR

SEQ ID NO: 37142 - protein, 19 aa, synthetic construct
  source 1..19: note = Seed: LQTVHSIPLTINKEEALQR
LQTVHSIPYTIAKSEAAQR

SEQ ID NO: 37143 - protein, 19 aa, synthetic construct
  source 1..19: note = Seed: LQTVHSIPLTINKEEALQR
LQTVHSIPYTIAKSEAFQR

SEQ ID NO: 37144 - protein, 19 aa, synthetic construct
  source 1..19: note = Seed: LQTVHSIPLTINKEEALQR
LQTVHSIPYTIAKSEAIQR

SEQ ID NO: 37145 - protein, 19 aa, synthetic construct
  source 1..19: note = Seed: LQTVHSIPLTINKEEALQR
LQTVHSIPYTIAKSEALQR

SEQ ID NO: 37146 - protein, 19 aa, synthetic construct
  source 1..19: note = Seed: LQTVHSIPLTINKEEALQR
LQTVHSIPYTIAKSEAMQR

SEQ ID NO: 37147 - protein, 19 aa, synthetic construct
  source 1..19: note = Seed: LQTVHSIPLTINKEEALQR
LQTVHSIPYTIAKSEASQR

SEQ ID NO: 37148 - protein, 19 aa, synthetic construct
  source 1..19: note = Seed: LQTVHSIPLTINKEEALQR
LQTVHSIPYTIAKSEATQR

SEQ ID NO: 37149 - protein, 19 aa, synthetic construct
  source 1..19: note = Seed: LQTVHSIPLTINKEEALQR
LQTVHSIPYTIAKSEAVQR

SEQ ID NO: 37150 - protein, 19 aa, synthetic construct
  source 1..19: note = Seed: LQTVHSIPLTINKEEALQR
LQTVHSIPYTIAKTEAAQR

SEQ ID NO: 37151 - protein, 19 aa, synthetic construct
  source 1..19: note = Seed: LQTVHSIPLTINKEEALQR
LQTVHSIPYTIAKTEAIQR

SEQ ID NO: 37152 - protein, 19 aa, synthetic construct
  source 1..19: note = Seed: LQTVHSIPLTINKEEALQR
LQTVHSIPYTIAKTEALQR

SEQ ID NO: 37153 - protein, 19 aa, synthetic construct
  source 1..19: note = Seed: LQTVHSIPLTINKEEALQR
LQTVHSIPYTIAKTEAVQR

SEQ ID NO: 37154 - protein, 19 aa, synthetic construct
  source 1..19: note = Seed: LQTVHSIPLTINKEEALQR
LQTVHSIPYTIAKVEAAQR

SEQ ID NO: 37155 - protein, 19 aa, synthetic construct
  source 1..19: note = Seed: LQTVHSIPLTINKEEALQR
LQTVHSIPYTIAKVEAIQR

SEQ ID NO: 37156 - protein, 19 aa, synthetic construct
  source 1..19: note = Seed: LQTVHSIPLTINKEEALQR
LQTVHSIPYTIAKVEALQR

SEQ ID NO: 37157 - protein, 19 aa, synthetic construct
  source 1..19: note = Seed: LQTVHSIPLTINKEEALQR
LQTVHSIPYTIAKVEAVQR

SEQ ID NO: 37158 - protein, 19 aa, synthetic construct
  source 1..19: note = Seed: LQTVHSIPLTINKEEALQR
LQTVHSIPYTIAKYEALQR

SEQ ID NO: 37159 - protein, 19 aa, synthetic construct
  source 1..19: note = Seed: LQTVHSIPLTINKEEALQR
LQTVHSIPYTICKFEALQR

SEQ ID NO: 37160 - protein, 19 aa, synthetic construct
  source 1..19: note = Seed: LQTVHSIPLTINKEEALQR
LQTVHSIPYTIDKFEAFQR

SEQ ID NO: 37161 - protein, 19 aa, synthetic construct
  source 1..19: note = Seed: LQTVHSIPLTINKEEALQR
LQTVHSIPYTIDKFEAIQR

SEQ ID NO: 37162 - protein, 19 aa, synthetic construct
  source 1..19: note = Seed: LQTVHSIPLTINKEEALQR
LQTVHSIPYTIDKFEALQR

SEQ ID NO: 37163 - protein, 19 aa, synthetic construct
  source 1..19: note = Seed: LQTVHSIPLTINKEEALQR
LQTVHSIPYTIDKFEAVQR

SEQ ID NO: 37164 - protein, 19 aa, synthetic construct
  source 1..19: note = Seed: LQTVHSIPLTINKEEALQR
LQTVHSIPYTIEKAEAAQR

SEQ ID NO: 37165 - protein, 19 aa, synthetic construct
  source 1..19: note = Seed: LQTVHSIPLTINKEEALQR
LQTVHSIPYTIEKAEAIQR

SEQ ID NO: 37166 - protein, 19 aa, synthetic construct
  source 1..19: note = Seed: LQTVHSIPLTINKEEALQR
LQTVHSIPYTIEKAEALQR

SEQ ID NO: 37167 - protein, 19 aa, synthetic construct
  source 1..19: note = Seed: LQTVHSIPLTINKEEALQR
LQTVHSIPYTIEKAEAVQR

SEQ ID NO: 37168 - protein, 19 aa, synthetic construct
  source 1..19: note = Seed: LQTVHSIPLTINKEEALQR
LQTVHSIPYTIEKFEAFQR

SEQ ID NO: 37169 - protein, 19 aa, synthetic construct
  source 1..19: note = Seed: LQTVHSIPLTINKEEALQR
LQTVHSIPYTIEKFEAIQR

SEQ ID NO: 37170 - protein, 19 aa, synthetic construct
  source 1..19: note = Seed: LQTVHSIPLTINKEEALQR
LQTVHSIPYTIEKFEALQR

SEQ ID NO: 37171 - protein, 19 aa, synthetic construct
  source 1..19: note = Seed: LQTVHSIPLTINKEEALQR
LQTVHSIPYTIEKFEAMQR

SEQ ID NO: 37172 - protein, 19 aa, synthetic construct
  source 1..19: note = Seed: LQTVHSIPLTINKEEALQR
LQTVHSIPYTIEKFEAVQR

SEQ ID NO: 37173 - protein, 19 aa, synthetic construct
  source 1..19: note = Seed: LQTVHSIPLTINKEEALQR
LQTVHSIPYTIFKAEAAQR

SEQ ID NO: 37174 - protein, 19 aa, synthetic construct
  source 1..19: note = Seed: LQTVHSIPLTINKEEALQR
LQTVHSIPYTIFKAEAIQR

SEQ ID NO: 37175 - protein, 19 aa, synthetic construct
  source 1..19: note = Seed: LQTVHSIPLTINKEEALQR
LQTVHSIPYTIFKAEALQR

SEQ ID NO: 37176 - protein, 19 aa, synthetic construct
  source 1..19: note = Seed: LQTVHSIPLTINKEEALQR
LQTVHSIPYTIFKAEAVQR

SEQ ID NO: 37177 - protein, 19 aa, synthetic construct
  source 1..19: note = Seed: LQTVHSIPLTINKEEALQR
LQTVHSIPYTIFKFEAAQR

SEQ ID NO: 37178 - protein, 19 aa, synthetic construct
  source 1..19: note = Seed: LQTVHSIPLTINKEEALQR
LQTVHSIPYTIFKFEADQR

SEQ ID NO: 37179 - protein, 19 aa, synthetic construct
  source 1..19: note = Seed: LQTVHSIPLTINKEEALQR
LQTVHSIPYTIFKFEAEQR

SEQ ID NO: 37180 - protein, 19 aa, synthetic construct
  source 1..19: note = Seed: LQTVHSIPLTINKEEALQR
LQTVHSIPYTIFKFEAFQR

SEQ ID NO: 37181 - protein, 19 aa, synthetic construct
  source 1..19: note = Seed: LQTVHSIPLTINKEEALQR
LQTVHSIPYTIFKFEAHQR

SEQ ID NO: 37182 - protein, 19 aa, synthetic construct
  source 1..19: note = Seed: LQTVHSIPLTINKEEALQR
LQTVHSIPYTIFKFEAIQR

SEQ ID NO: 37183 - protein, 19 aa, synthetic construct
  source 1..19: note = Seed: LQTVHSIPLTINKEEALQR
LQTVHSIPYTIFKFEAKQR

SEQ ID NO: 37184 - protein, 19 aa, synthetic construct
  source 1..19: note = Seed: LQTVHSIPLTINKEEALQR
LQTVHSIPYTIFKFEALQR

SEQ ID NO: 37185 - protein, 19 aa, synthetic construct
  source 1..19: note = Seed: LQTVHSIPLTINKEEALQR
LQTVHSIPYTIFKFEAMQR

SEQ ID NO: 37186 - protein, 19 aa, synthetic construct
  source 1..19: note = Seed: LQTVHSIPLTINKEEALQR
LQTVHSIPYTIFKFEANQR

SEQ ID NO: 37187 - protein, 19 aa, synthetic construct
  source 1..19: note = Seed: LQTVHSIPLTINKEEALQR
LQTVHSIPYTIFKFEAPQR

SEQ ID NO: 37188 - protein, 19 aa, synthetic construct
  source 1..19: note = Seed: LQTVHSIPLTINKEEALQR
LQTVHSIPYTIFKFEAQQR

SEQ ID NO: 37189 - protein, 19 aa, synthetic construct
  source 1..19: note = Seed: LQTVHSIPLTINKEEALQR
LQTVHSIPYTIFKFEARQR

SEQ ID NO: 37190 - protein, 19 aa, synthetic construct
  source 1..19: note = Seed: LQTVHSIPLTINKEEALQR
LQTVHSIPYTIFKFEASQR

SEQ ID NO: 37191 - protein, 19 aa, synthetic construct
  source 1..19: note = Seed: LQTVHSIPLTINKEEALQR
LQTVHSIPYTIFKFEATQR

SEQ ID NO: 37192 - protein, 19 aa, synthetic construct
  source 1..19: note = Seed: LQTVHSIPLTINKEEALQR
LQTVHSIPYTIFKFEAVQR

SEQ ID NO: 37193 - protein, 19 aa, synthetic construct
  source 1..19: note = Seed: LQTVHSIPLTINKEEALQR
LQTVHSIPYTIFKFEAWQR

SEQ ID NO: 37194 - protein, 19 aa, synthetic construct
  source 1..19: note = Seed: LQTVHSIPLTINKEEALQR
LQTVHSIPYTIFKFEAYQR

SEQ ID NO: 37195 - protein, 19 aa, synthetic construct
  source 1..19: note = Seed: LQTVHSIPLTINKEEALQR
LQTVHSIPYTIFKGEAAQR

SEQ ID NO: 37196 - protein, 19 aa, synthetic construct
  source 1..19: note = Seed: LQTVHSIPLTINKEEALQR
LQTVHSIPYTIFKGEALQR

SEQ ID NO: 37197 - protein, 19 aa, synthetic construct
  source 1..19: note = Seed: LQTVHSIPLTINKEEALQR
LQTVHSIPYTIFKGEAVQR

SEQ ID NO: 37198 - protein, 19 aa, synthetic construct
  source 1..19: note = Seed: LQTVHSIPLTINKEEALQR
LQTVHSIPYTIFKIEAFQR

SEQ ID NO: 37199 - protein, 19 aa, synthetic construct
  source 1..19: note = Seed: LQTVHSIPLTINKEEALQR
LQTVHSIPYTIFKIEAIQR

SEQ ID NO: 37200 - protein, 19 aa, synthetic construct
  source 1..19: note = Seed: LQTVHSIPLTINKEEALQR
LQTVHSIPYTIFKIEALQR

SEQ ID NO: 37201 - protein, 19 aa, synthetic construct
  source 1..19: note = Seed: LQTVHSIPLTINKEEALQR
LQTVHSIPYTIFKIEAMQR

SEQ ID NO: 37202 - protein, 19 aa, synthetic construct
  source 1..19: note = Seed: LQTVHSIPLTINKEEALQR
LQTVHSIPYTIFKIEAVQR

SEQ ID NO: 37203 - protein, 19 aa, synthetic construct
  source 1..19: note = Seed: LQTVHSIPLTINKEEALQR
LQTVHSIPYTIFKIEAYQR

SEQ ID NO: 37204 - protein, 19 aa, synthetic construct
  source 1..19: note = Seed: LQTVHSIPLTINKEEALQR
LQTVHSIPYTIFKLEAAQR

SEQ ID NO: 37205 - protein, 19 aa, synthetic construct
  source 1..19: note = Seed: LQTVHSIPLTINKEEALQR
LQTVHSIPYTIFKLEAFQR

SEQ ID NO: 37206 - protein, 19 aa, synthetic construct
  source 1..19: note = Seed: LQTVHSIPLTINKEEALQR
LQTVHSIPYTIFKLEAIQR

SEQ ID NO: 37207 - protein, 19 aa, synthetic construct
  source 1..19: note = Seed: LQTVHSIPLTINKEEALQR
LQTVHSIPYTIFKLEALQR

SEQ ID NO: 37208 - protein, 19 aa, synthetic construct
  source 1..19: note = Seed: LQTVHSIPLTINKEEALQR
LQTVHSIPYTIFKLEAMQR

SEQ ID NO: 37209 - protein, 19 aa, synthetic construct
  source 1..19: note = Seed: LQTVHSIPLTINKEEALQR
LQTVHSIPYTIFKLEANQR

SEQ ID NO: 37210 - protein, 19 aa, synthetic construct
  source 1..19: note = Seed: LQTVHSIPLTINKEEALQR
LQTVHSIPYTIFKLEARQR

SEQ ID NO: 37211 - protein, 19 aa, synthetic construct
  source 1..19: note = Seed: LQTVHSIPLTINKEEALQR
LQTVHSIPYTIFKLEATQR

SEQ ID NO: 37212 - protein, 19 aa, synthetic construct
  source 1..19: note = Seed: LQTVHSIPLTINKEEALQR
LQTVHSIPYTIFKLEAVQR

SEQ ID NO: 37213 - protein, 19 aa, synthetic construct
  source 1..19: note = Seed: LQTVHSIPLTINKEEALQR
LQTVHSIPYTIFKLEAYQR

SEQ ID NO: 37214 - protein, 19 aa, synthetic construct
  source 1..19: note = Seed: LQTVHSIPLTINKEEALQR
LQTVHSIPYTIFKMEAFQR

SEQ ID NO: 37215 - protein, 19 aa, synthetic construct
  source 1..19: note = Seed: LQTVHSIPLTINKEEALQR
LQTVHSIPYTIFKMEAIQR

SEQ ID NO: 37216 - protein, 19 aa, synthetic construct
  source 1..19: note = Seed: LQTVHSIPLTINKEEALQR
LQTVHSIPYTIFKMEALQR

SEQ ID NO: 37217 - protein, 19 aa, synthetic construct
  source 1..19: note = Seed: LQTVHSIPLTINKEEALQR
LQTVHSIPYTIFKMEAMQR

SEQ ID NO: 37218 - protein, 19 aa, synthetic construct
  source 1..19: note = Seed: LQTVHSIPLTINKEEALQR
LQTVHSIPYTIFKMEAVQR

SEQ ID NO: 37219 - protein, 19 aa, synthetic construct
  source 1..19: note = Seed: LQTVHSIPLTINKEEALQR
LQTVHSIPYTIFKSEAIQR

SEQ ID NO: 37220 - protein, 19 aa, synthetic construct
  source 1..19: note = Seed: LQTVHSIPLTINKEEALQR
LQTVHSIPYTIFKSEAVQR

SEQ ID NO: 37221 - protein, 19 aa, synthetic construct
  source 1..19: note = Seed: LQTVHSIPLTINKEEALQR
LQTVHSIPYTIFKVEAFQR

SEQ ID NO: 37222 - protein, 19 aa, synthetic construct
  source 1..19: note = Seed: LQTVHSIPLTINKEEALQR
LQTVHSIPYTIFKVEAIQR

SEQ ID NO: 37223 - protein, 19 aa, synthetic construct
  source 1..19: note = Seed: LQTVHSIPLTINKEEALQR
LQTVHSIPYTIFKVEALQR

SEQ ID NO: 37224 - protein, 19 aa, synthetic construct
  source 1..19: note = Seed: LQTVHSIPLTINKEEALQR
LQTVHSIPYTIFKVEAMQR

SEQ ID NO: 37225 - protein, 19 aa, synthetic construct
  source 1..19: note = Seed: LQTVHSIPLTINKEEALQR
LQTVHSIPYTIFKVEAVQR

SEQ ID NO: 37226 - protein, 19 aa, synthetic construct
  source 1..19: note = Seed: LQTVHSIPLTINKEEALQR
LQTVHSIPYTIFKWEAFQR

SEQ ID NO: 37227 - protein, 19 aa, synthetic construct
  source 1..19: note = Seed: LQTVHSIPLTINKEEALQR
LQTVHSIPYTIFKWEAIQR

SEQ ID NO: 37228 - protein, 19 aa, synthetic construct
  source 1..19: note = Seed: LQTVHSIPLTINKEEALQR
LQTVHSIPYTIFKWEALQR

SEQ ID NO: 37229 - protein, 19 aa, synthetic construct
  source 1..19: note = Seed: LQTVHSIPLTINKEEALQR
LQTVHSIPYTIFKWEAMQR

SEQ ID NO: 37230 - protein, 19 aa, synthetic construct
  source 1..19: note = Seed: LQTVHSIPLTINKEEALQR
LQTVHSIPYTIFKWEAVQR

SEQ ID NO: 37231 - protein, 19 aa, synthetic construct
  source 1..19: note = Seed: LQTVHSIPLTINKEEALQR
LQTVHSIPYTIFKYEAAQR

SEQ ID NO: 37232 - protein, 19 aa, synthetic construct
  source 1..19: note = Seed: LQTVHSIPLTINKEEALQR
LQTVHSIPYTIFKYEAFQR

SEQ ID NO: 37233 - protein, 19 aa, synthetic construct
  source 1..19: note = Seed: LQTVHSIPLTINKEEALQR
LQTVHSIPYTIFKYEAIQR

SEQ ID NO: 37234 - protein, 19 aa, synthetic construct
  source 1..19: note = Seed: LQTVHSIPLTINKEEALQR
LQTVHSIPYTIFKYEALQR

SEQ ID NO: 37235 - protein, 19 aa, synthetic construct
  source 1..19: note = Seed: LQTVHSIPLTINKEEALQR
LQTVHSIPYTIFKYEAMQR

SEQ ID NO: 37236 - protein, 19 aa, synthetic construct
  source 1..19: note = Seed: LQTVHSIPLTINKEEALQR
LQTVHSIPYTIFKYEAVQR

SEQ ID NO: 37237 - protein, 19 aa, synthetic construct
  source 1..19: note = Seed: LQTVHSIPLTINKEEALQR
LQTVHSIPYTIFKYEAYQR

SEQ ID NO: 37238 - protein, 19 aa, synthetic construct
  source 1..19: note = Seed: LQTVHSIPLTINKEEALQR
LQTVHSIPYTIGKAEAIQR

SEQ ID NO: 37239 - protein, 19 aa, synthetic construct
  source 1..19: note = Seed: LQTVHSIPLTINKEEALQR
LQTVHSIPYTIGKAEALQR

SEQ ID NO: 37240 - protein, 19 aa, synthetic construct
  source 1..19: note = Seed: LQTVHSIPLTINKEEALQR
LQTVHSIPYTIGKAEAVQR

SEQ ID NO: 37241 - protein, 19 aa, synthetic construct
  source 1..19: note = Seed: LQTVHSIPLTINKEEALQR
LQTVHSIPYTIGKSEALQR

SEQ ID NO: 37242 - protein, 19 aa, synthetic construct
  source 1..19: note = Seed: LQTVHSIPLTINKEEALQR
LQTVHSIPYTIHKAEAIQR

SEQ ID NO: 37243 - protein, 19 aa, synthetic construct
  source 1..19: note = Seed: LQTVHSIPLTINKEEALQR
LQTVHSIPYTIHKFEAFQR

SEQ ID NO: 37244 - protein, 19 aa, synthetic construct
  source 1..19: note = Seed: LQTVHSIPLTINKEEALQR
LQTVHSIPYTIHKFEAIQR

SEQ ID NO: 37245 - protein, 19 aa, synthetic construct
  source 1..19: note = Seed: LQTVHSIPLTINKEEALQR
LQTVHSIPYTIHKFEALQR

SEQ ID NO: 37246 - protein, 19 aa, synthetic construct
  source 1..19: note = Seed: LQTVHSIPLTINKEEALQR
LQTVHSIPYTIHKFEAMQR

SEQ ID NO: 37247 - protein, 19 aa, synthetic construct
  source 1..19: note = Seed: LQTVHSIPLTINKEEALQR
LQTVHSIPYTIHKFEAVQR

SEQ ID NO: 37248 - protein, 19 aa, synthetic construct
  source 1..19: note = Seed: LQTVHSIPLTINKEEALQR
LQTVHSIPYTIHKSEAIQR

SEQ ID NO: 37249 - protein, 19 aa, synthetic construct
  source 1..19: note = Seed: LQTVHSIPLTINKEEALQR
LQTVHSIPYTIIKAEAAQR

SEQ ID NO: 37250 - protein, 19 aa, synthetic construct
  source 1..19: note = Seed: LQTVHSIPLTINKEEALQR
LQTVHSIPYTIIKAEAGQR

SEQ ID NO: 37251 - protein, 19 aa, synthetic construct
  source 1..19: note = Seed: LQTVHSIPLTINKEEALQR
LQTVHSIPYTIIKAEAIQR

SEQ ID NO: 37252 - protein, 19 aa, synthetic construct
  source 1..19: note = Seed: LQTVHSIPLTINKEEALQR
LQTVHSIPYTIIKAEALQR

SEQ ID NO: 37253 - protein, 19 aa, synthetic construct
  source 1..19: note = Seed: LQTVHSIPLTINKEEALQR
LQTVHSIPYTIIKAEAMQR

SEQ ID NO: 37254 - protein, 19 aa, synthetic construct
  source 1..19: note = Seed: LQTVHSIPLTINKEEALQR
LQTVHSIPYTIIKAEASQR

SEQ ID NO: 37255 - protein, 19 aa, synthetic construct
  source 1..19: note = Seed: LQTVHSIPLTINKEEALQR
LQTVHSIPYTIIKAEATQR

SEQ ID NO: 37256 - protein, 19 aa, synthetic construct
  source 1..19: note = Seed: LQTVHSIPLTINKEEALQR
LQTVHSIPYTIIKAEAVQR

SEQ ID NO: 37257 - protein, 19 aa, synthetic construct
  source 1..19: note = Seed: LQTVHSIPLTINKEEALQR
LQTVHSIPYTIIKFEAAQR

SEQ ID NO: 37258 - protein, 19 aa, synthetic construct
  source 1..19: note = Seed: LQTVHSIPLTINKEEALQR
LQTVHSIPYTIIKFEACQR

SEQ ID NO: 37259 - protein, 19 aa, synthetic construct
  source 1..19: note = Seed: LQTVHSIPLTINKEEALQR
LQTVHSIPYTIIKFEADQR

SEQ ID NO: 37260 - protein, 19 aa, synthetic construct
  source 1..19: note = Seed: LQTVHSIPLTINKEEALQR
LQTVHSIPYTIIKFEAEQR

SEQ ID NO: 37261 - protein, 19 aa, synthetic construct
  source 1..19: note = Seed: LQTVHSIPLTINKEEALQR
LQTVHSIPYTIIKFEAFQR

SEQ ID NO: 37262 - protein, 19 aa, synthetic construct
  source 1..19: note = Seed: LQTVHSIPLTINKEEALQR
LQTVHSIPYTIIKFEAHQR

SEQ ID NO: 37263 - protein, 19 aa, synthetic construct
  source 1..19: note = Seed: LQTVHSIPLTINKEEALQR
LQTVHSIPYTIIKFEAIQR

SEQ ID NO: 37264 - protein, 19 aa, synthetic construct
  source 1..19: note = Seed: LQTVHSIPLTINKEEALQR
LQTVHSIPYTIIKFEAKQR

SEQ ID NO: 37265 - protein, 19 aa, synthetic construct
  source 1..19: note = Seed: LQTVHSIPLTINKEEALQR
LQTVHSIPYTIIKFEALQR

SEQ ID NO: 37266 - protein, 19 aa, synthetic construct
  source 1..19: note = Seed: LQTVHSIPLTINKEEALQR
LQTVHSIPYTIIKFEAMQR

SEQ ID NO: 37267 - protein, 19 aa, synthetic construct
  source 1..19: note = Seed: LQTVHSIPLTINKEEALQR
LQTVHSIPYTIIKFEANQR

SEQ ID NO: 37268 - protein, 19 aa, synthetic construct
  source 1..19: note = Seed: LQTVHSIPLTINKEEALQR
LQTVHSIPYTIIKFEAPQR

SEQ ID NO: 37269 - protein, 19 aa, synthetic construct
  source 1..19: note = Seed: LQTVHSIPLTINKEEALQR
LQTVHSIPYTIIKFEAQQR

SEQ ID NO: 37270 - protein, 19 aa, synthetic construct
  source 1..19: note = Seed: LQTVHSIPLTINKEEALQR
LQTVHSIPYTIIKFEARQR

SEQ ID NO: 37271 - protein, 19 aa, synthetic construct
  source 1..19: note = Seed: LQTVHSIPLTINKEEALQR
LQTVHSIPYTIIKFEASQR

SEQ ID NO: 37272 - protein, 19 aa, synthetic construct
  source 1..19: note = Seed: LQTVHSIPLTINKEEALQR
LQTVHSIPYTIIKFEATQR

SEQ ID NO: 37273 - protein, 19 aa, synthetic construct
  source 1..19: note = Seed: LQTVHSIPLTINKEEALQR
LQTVHSIPYTIIKFEAVQR

SEQ ID NO: 37274 - protein, 19 aa, synthetic construct
  source 1..19: note = Seed: LQTVHSIPLTINKEEALQR
LQTVHSIPYTIIKFEAWQR

SEQ ID NO: 37275 - protein, 19 aa, synthetic construct
  source 1..19: note = Seed: LQTVHSIPLTINKEEALQR
LQTVHSIPYTIIKFEAYQR

SEQ ID NO: 37276 - protein, 19 aa, synthetic construct
  source 1..19: note = Seed: LQTVHSIPLTINKEEALQR
LQTVHSIPYTIIKGEAAQR

SEQ ID NO: 37277 - protein, 19 aa, synthetic construct
  source 1..19: note = Seed: LQTVHSIPLTINKEEALQR
LQTVHSIPYTIIKGEAGQR

SEQ ID NO: 37278 - protein, 19 aa, synthetic construct
  source 1..19: note = Seed: LQTVHSIPLTINKEEALQR
LQTVHSIPYTIIKGEAIQR

SEQ ID NO: 37279 - protein, 19 aa, synthetic construct
  source 1..19: note = Seed: LQTVHSIPLTINKEEALQR
LQTVHSIPYTIIKGEALQR

SEQ ID NO: 37280 - protein, 19 aa, synthetic construct
  source 1..19: note = Seed: LQTVHSIPLTINKEEALQR
LQTVHSIPYTIIKGEAMQR

SEQ ID NO: 37281 - protein, 19 aa, synthetic construct
  source 1..19: note = Seed: LQTVHSIPLTINKEEALQR
LQTVHSIPYTIIKGEASQR

SEQ ID NO: 37282 - protein, 19 aa, synthetic construct
  source 1..19: note = Seed: LQTVHSIPLTINKEEALQR
LQTVHSIPYTIIKGEATQR

SEQ ID NO: 37283 - protein, 19 aa, synthetic construct
  source 1..19: note = Seed: LQTVHSIPLTINKEEALQR
LQTVHSIPYTIIKGEAVQR

SEQ ID NO: 37284 - protein, 19 aa, synthetic construct
  source 1..19: note = Seed: LQTVHSIPLTINKEEALQR
LQTVHSIPYTIIKIEAFQR

SEQ ID NO: 37285 - protein, 19 aa, synthetic construct
  source 1..19: note = Seed: LQTVHSIPLTINKEEALQR
LQTVHSIPYTIIKIEAIQR

SEQ ID NO: 37286 - protein, 19 aa, synthetic construct
  source 1..19: note = Seed: LQTVHSIPLTINKEEALQR
LQTVHSIPYTIIKIEALQR

SEQ ID NO: 37287 - protein, 19 aa, synthetic construct
  source 1..19: note = Seed: LQTVHSIPLTINKEEALQR
LQTVHSIPYTIIKIEAMQR

SEQ ID NO: 37288 - protein, 19 aa, synthetic construct
  source 1..19: note = Seed: LQTVHSIPLTINKEEALQR
LQTVHSIPYTIIKIEAVQR

SEQ ID NO: 37289 - protein, 19 aa, synthetic construct
  source 1..19: note = Seed: LQTVHSIPLTINKEEALQR
LQTVHSIPYTIIKLEAFQR

SEQ ID NO: 37290 - protein, 19 aa, synthetic construct
  source 1..19: note = Seed: LQTVHSIPLTINKEEALQR
LQTVHSIPYTIIKLEAIQR

SEQ ID NO: 37291 - protein, 19 aa, synthetic construct
  source 1..19: note = Seed: LQTVHSIPLTINKEEALQR
LQTVHSIPYTIIKLEALQR

SEQ ID NO: 37292 - protein, 19 aa, synthetic construct
  source 1..19: note = Seed: LQTVHSIPLTINKEEALQR
LQTVHSIPYTIIKLEAMQR

SEQ ID NO: 37293 - protein, 19 aa, synthetic construct
  source 1..19: note = Seed: LQTVHSIPLTINKEEALQR
LQTVHSIPYTIIKLEAVQR

SEQ ID NO: 37294 - protein, 19 aa, synthetic construct
  source 1..19: note = Seed: LQTVHSIPLTINKEEALQR
LQTVHSIPYTIIKLEAYQR

SEQ ID NO: 37295 - protein, 19 aa, synthetic construct
  source 1..19: note = Seed: LQTVHSIPLTINKEEALQR
LQTVHSIPYTIIKMEAFQR

SEQ ID NO: 37296 - protein, 19 aa, synthetic construct
  source 1..19: note = Seed: LQTVHSIPLTINKEEALQR
LQTVHSIPYTIIKMEAIQR

SEQ ID NO: 37297 - protein, 19 aa, synthetic construct
  source 1..19: note = Seed: LQTVHSIPLTINKEEALQR
LQTVHSIPYTIIKMEALQR

SEQ ID NO: 37298 - protein, 19 aa, synthetic construct
  source 1..19: note = Seed: LQTVHSIPLTINKEEALQR
LQTVHSIPYTIIKMEAVQR

SEQ ID NO: 37299 - protein, 19 aa, synthetic construct
  source 1..19: note = Seed: LQTVHSIPLTINKEEALQR
LQTVHSIPYTIIKNEAAQR

SEQ ID NO: 37300 - protein, 19 aa, synthetic construct
  source 1..19: note = Seed: LQTVHSIPLTINKEEALQR
LQTVHSIPYTIIKNEAIQR

SEQ ID NO: 37301 - protein, 19 aa, synthetic construct
  source 1..19: note = Seed: LQTVHSIPLTINKEEALQR
LQTVHSIPYTIIKNEALQR

SEQ ID NO: 37302 - protein, 19 aa, synthetic construct
  source 1..19: note = Seed: LQTVHSIPLTINKEEALQR
LQTVHSIPYTIIKNEAMQR

SEQ ID NO: 37303 - protein, 19 aa, synthetic construct
  source 1..19: note = Seed: LQTVHSIPLTINKEEALQR
LQTVHSIPYTIIKNEASQR

SEQ ID NO: 37304 - protein, 19 aa, synthetic construct
  source 1..19: note = Seed: LQTVHSIPLTINKEEALQR
LQTVHSIPYTIIKNEATQR

SEQ ID NO: 37305 - protein, 19 aa, synthetic construct
  source 1..19: note = Seed: LQTVHSIPLTINKEEALQR
LQTVHSIPYTIIKNEAVQR

SEQ ID NO: 37306 - protein, 19 aa, synthetic construct
  source 1..19: note = Seed: LQTVHSIPLTINKEEALQR
LQTVHSIPYTIIKPEAAQR

SEQ ID NO: 37307 - protein, 19 aa, synthetic construct
  source 1..19: note = Seed: LQTVHSIPLTINKEEALQR
LQTVHSIPYTIIKPEAIQR

SEQ ID NO: 37308 - protein, 19 aa, synthetic construct
  source 1..19: note = Seed: LQTVHSIPLTINKEEALQR
LQTVHSIPYTIIKPEALQR

SEQ ID NO: 37309 - protein, 19 aa, synthetic construct
  source 1..19: note = Seed: LQTVHSIPLTINKEEALQR
LQTVHSIPYTIIKPEAMQR

SEQ ID NO: 37310 - protein, 19 aa, synthetic construct
  source 1..19: note = Seed: LQTVHSIPLTINKEEALQR
LQTVHSIPYTIIKPEASQR

SEQ ID NO: 37311 - protein, 19 aa, synthetic construct
  source 1..19: note = Seed: LQTVHSIPLTINKEEALQR
LQTVHSIPYTIIKPEATQR

SEQ ID NO: 37312 - protein, 19 aa, synthetic construct
  source 1..19: note = Seed: LQTVHSIPLTINKEEALQR
LQTVHSIPYTIIKPEAVQR

SEQ ID NO: 37313 - protein, 19 aa, synthetic construct
  source 1..19: note = Seed: LQTVHSIPLTINKEEALQR
LQTVHSIPYTIIKSEAAQR

SEQ ID NO: 37314 - protein, 19 aa, synthetic construct
  source 1..19: note = Seed: LQTVHSIPLTINKEEALQR
LQTVHSIPYTIIKSEAFQR

SEQ ID NO: 37315 - protein, 19 aa, synthetic construct
  source 1..19: note = Seed: LQTVHSIPLTINKEEALQR
LQTVHSIPYTIIKSEAGQR

SEQ ID NO: 37316 - protein, 19 aa, synthetic construct
  source 1..19: note = Seed: LQTVHSIPLTINKEEALQR
LQTVHSIPYTIIKSEAIQR

SEQ ID NO: 37317 - protein, 19 aa, synthetic construct
  source 1..19: note = Seed: LQTVHSIPLTINKEEALQR
LQTVHSIPYTIIKSEALQR

SEQ ID NO: 37318 - protein, 19 aa, synthetic construct
  source 1..19: note = Seed: LQTVHSIPLTINKEEALQR
LQTVHSIPYTIIKSEAMQR

SEQ ID NO: 37319 - protein, 19 aa, synthetic construct
  source 1..19: note = Seed: LQTVHSIPLTINKEEALQR
LQTVHSIPYTIIKSEASQR

SEQ ID NO: 37320 - protein, 19 aa, synthetic construct
  source 1..19: note = Seed: LQTVHSIPLTINKEEALQR
LQTVHSIPYTIIKSEATQR

SEQ ID NO: 37321 - protein, 19 aa, synthetic construct
  source 1..19: note = Seed: LQTVHSIPLTINKEEALQR
LQTVHSIPYTIIKSEAVQR

SEQ ID NO: 37322 - protein, 19 aa, synthetic construct
  source 1..19: note = Seed: LQTVHSIPLTINKEEALQR
LQTVHSIPYTIIKTEAAQR

SEQ ID NO: 37323 - protein, 19 aa, synthetic construct
  source 1..19: note = Seed: LQTVHSIPLTINKEEALQR
LQTVHSIPYTIIKTEAIQR

SEQ ID NO: 37324 - protein, 19 aa, synthetic construct
  source 1..19: note = Seed: LQTVHSIPLTINKEEALQR
LQTVHSIPYTIIKTEALQR

SEQ ID NO: 37325 - protein, 19 aa, synthetic construct
  source 1..19: note = Seed: LQTVHSIPLTINKEEALQR
LQTVHSIPYTIIKTEAMQR

SEQ ID NO: 37326 - protein, 19 aa, synthetic construct
  source 1..19: note = Seed: LQTVHSIPLTINKEEALQR
LQTVHSIPYTIIKTEATQR

SEQ ID NO: 37327 - protein, 19 aa, synthetic construct
  source 1..19: note = Seed: LQTVHSIPLTINKEEALQR
LQTVHSIPYTIIKTEAVQR

SEQ ID NO: 37328 - protein, 19 aa, synthetic construct
  source 1..19: note = Seed: LQTVHSIPLTINKEEALQR
LQTVHSIPYTIIKVEAAQR

SEQ ID NO: 37329 - protein, 19 aa, synthetic construct
  source 1..19: note = Seed: LQTVHSIPLTINKEEALQR
LQTVHSIPYTIIKVEAFQR

SEQ ID NO: 37330 - protein, 19 aa, synthetic construct
  source 1..19: note = Seed: LQTVHSIPLTINKEEALQR
LQTVHSIPYTIIKVEAIQR

SEQ ID NO: 37331 - protein, 19 aa, synthetic construct
  source 1..19: note = Seed: LQTVHSIPLTINKEEALQR
LQTVHSIPYTIIKVEALQR

SEQ ID NO: 37332 - protein, 19 aa, synthetic construct
  source 1..19: note = Seed: LQTVHSIPLTINKEEALQR
LQTVHSIPYTIIKVEAVQR

SEQ ID NO: 37333 - protein, 19 aa, synthetic construct
  source 1..19: note = Seed: LQTVHSIPLTINKEEALQR
LQTVHSIPYTIIKWEAFQR

SEQ ID NO: 37334 - protein, 19 aa, synthetic construct
  source 1..19: note = Seed: LQTVHSIPLTINKEEALQR
LQTVHSIPYTIIKWEAIQR

SEQ ID NO: 37335 - protein, 19 aa, synthetic construct
  source 1..19: note = Seed: LQTVHSIPLTINKEEALQR
LQTVHSIPYTIIKWEALQR

SEQ ID NO: 37336 - protein, 19 aa, synthetic construct
  source 1..19: note = Seed: LQTVHSIPLTINKEEALQR
LQTVHSIPYTIIKWEAMQR

SEQ ID NO: 37337 - protein, 19 aa, synthetic construct
  source 1..19: note = Seed: LQTVHSIPLTINKEEALQR
LQTVHSIPYTIIKWEAVQR

SEQ ID NO: 37338 - protein, 19 aa, synthetic construct
  source 1..19: note = Seed: LQTVHSIPLTINKEEALQR
LQTVHSIPYTIIKYEAFQR

SEQ ID NO: 37339 - protein, 19 aa, synthetic construct
  source 1..19: note = Seed: LQTVHSIPLTINKEEALQR
LQTVHSIPYTIIKYEAIQR

SEQ ID NO: 37340 - protein, 19 aa, synthetic construct
  source 1..19: note = Seed: LQTVHSIPLTINKEEALQR
LQTVHSIPYTIIKYEALQR

SEQ ID NO: 37341 - protein, 19 aa, synthetic construct
  source 1..19: note = Seed: LQTVHSIPLTINKEEALQR
LQTVHSIPYTIIKYEAMQR

SEQ ID NO: 37342 - protein, 19 aa, synthetic construct
  source 1..19: note = Seed: LQTVHSIPLTINKEEALQR
LQTVHSIPYTIIKYEAVQR

SEQ ID NO: 37343 - protein, 19 aa, synthetic construct
  source 1..19: note = Seed: LQTVHSIPLTINKEEALQR
LQTVHSIPYTIIKYEAYQR

SEQ ID NO: 37344 - protein, 19 aa, synthetic construct
  source 1..19: note = Seed: LQTVHSIPLTINKEEALQR
LQTVHSIPYTIKKFEALQR

SEQ ID NO: 37345 - protein, 19 aa, synthetic construct
  source 1..19: note = Seed: LQTVHSIPLTINKEEALQR
LQTVHSIPYTILKAEAAQR

SEQ ID NO: 37346 - protein, 19 aa, synthetic construct
  source 1..19: note = Seed: LQTVHSIPLTINKEEALQR
LQTVHSIPYTILKAEACQR

SEQ ID NO: 37347 - protein, 19 aa, synthetic construct
  source 1..19: note = Seed: LQTVHSIPLTINKEEALQR
LQTVHSIPYTILKAEAFQR

SEQ ID NO: 37348 - protein, 19 aa, synthetic construct
  source 1..19: note = Seed: LQTVHSIPLTINKEEALQR
LQTVHSIPYTILKAEAGQR

SEQ ID NO: 37349 - protein, 19 aa, synthetic construct
  source 1..19: note = Seed: LQTVHSIPLTINKEEALQR
LQTVHSIPYTILKAEAIQR

SEQ ID NO: 37350 - protein, 19 aa, synthetic construct
  source 1..19: note = Seed: LQTVHSIPLTINKEEALQR
LQTVHSIPYTILKAEALQR

SEQ ID NO: 37351 - protein, 19 aa, synthetic construct
  source 1..19: note = Seed: LQTVHSIPLTINKEEALQR
LQTVHSIPYTILKAEAMQR

SEQ ID NO: 37352 - protein, 19 aa, synthetic construct
  source 1..19: note = Seed: LQTVHSIPLTINKEEALQR
LQTVHSIPYTILKAEANQR

SEQ ID NO: 37353 - protein, 19 aa, synthetic construct
  source 1..19: note = Seed: LQTVHSIPLTINKEEALQR
LQTVHSIPYTILKAEAPQR

SEQ ID NO: 37354 - protein, 19 aa, synthetic construct
  source 1..19: note = Seed: LQTVHSIPLTINKEEALQR
LQTVHSIPYTILKAEASQR

SEQ ID NO: 37355 - protein, 19 aa, synthetic construct
  source 1..19: note = Seed: LQTVHSIPLTINKEEALQR
LQTVHSIPYTILKAEATQR

SEQ ID NO: 37356 - protein, 19 aa, synthetic construct
  source 1..19: note = Seed: LQTVHSIPLTINKEEALQR
LQTVHSIPYTILKAEAVQR

SEQ ID NO: 37357 - protein, 19 aa, synthetic construct
  source 1..19: note = Seed: LQTVHSIPLTINKEEALQR
LQTVHSIPYTILKFEAAQR

SEQ ID NO: 37358 - protein, 19 aa, synthetic construct
  source 1..19: note = Seed: LQTVHSIPLTINKEEALQR
LQTVHSIPYTILKFEACQR

SEQ ID NO: 37359 - protein, 19 aa, synthetic construct
  source 1..19: note = Seed: LQTVHSIPLTINKEEALQR
LQTVHSIPYTILKFEADQR

SEQ ID NO: 37360 - protein, 19 aa, synthetic construct
  source 1..19: note = Seed: LQTVHSIPLTINKEEALQR
LQTVHSIPYTILKFEAEQR

SEQ ID NO: 37361 - protein, 19 aa, synthetic construct
  source 1..19: note = Seed: LQTVHSIPLTINKEEALQR
LQTVHSIPYTILKFEAFQR

SEQ ID NO: 37362 - protein, 19 aa, synthetic construct
  source 1..19: note = Seed: LQTVHSIPLTINKEEALQR
LQTVHSIPYTILKFEAHQR

SEQ ID NO: 37363 - protein, 19 aa, synthetic construct
  source 1..19: note = Seed: LQTVHSIPLTINKEEALQR
LQTVHSIPYTILKFEAIQR

SEQ ID NO: 37364 - protein, 19 aa, synthetic construct
  source 1..19: note = Seed: LQTVHSIPLTINKEEALQR
LQTVHSIPYTILKFEALQR

SEQ ID NO: 37365 - protein, 19 aa, synthetic construct
  source 1..19: note = Seed: LQTVHSIPLTINKEEALQR
LQTVHSIPYTILKFEAMQR

SEQ ID NO: 37366 - protein, 19 aa, synthetic construct
  source 1..19: note = Seed: LQTVHSIPLTINKEEALQR
LQTVHSIPYTILKFEANQR

SEQ ID NO: 37367 - protein, 19 aa, synthetic construct
  source 1..19: note = Seed: LQTVHSIPLTINKEEALQR
LQTVHSIPYTILKFEAPQR

SEQ ID NO: 37368 - protein, 19 aa, synthetic construct
  source 1..19: note = Seed: LQTVHSIPLTINKEEALQR
LQTVHSIPYTILKFEAQQR

SEQ ID NO: 37369 - protein, 19 aa, synthetic construct
  source 1..19: note = Seed: LQTVHSIPLTINKEEALQR
LQTVHSIPYTILKFEARQR

SEQ ID NO: 37370 - protein, 19 aa, synthetic construct
  source 1..19: note = Seed: LQTVHSIPLTINKEEALQR
LQTVHSIPYTILKFEASQR

SEQ ID NO: 37371 - protein, 19 aa, synthetic construct
  source 1..19: note = Seed: LQTVHSIPLTINKEEALQR
LQTVHSIPYTILKFEATQR

SEQ ID NO: 37372 - protein, 19 aa, synthetic construct
  source 1..19: note = Seed: LQTVHSIPLTINKEEALQR
LQTVHSIPYTILKFEAVQR

SEQ ID NO: 37373 - protein, 19 aa, synthetic construct
  source 1..19: note = Seed: LQTVHSIPLTINKEEALQR
LQTVHSIPYTILKFEAYQR

SEQ ID NO: 37374 - protein, 19 aa, synthetic construct
  source 1..19: note = Seed: LQTVHSIPLTINKEEALQR
LQTVHSIPYTILKGEAAQR

SEQ ID NO: 37375 - protein, 19 aa, synthetic construct
  source 1..19: note = Seed: LQTVHSIPLTINKEEALQR
LQTVHSIPYTILKGEACQR

SEQ ID NO: 37376 - protein, 19 aa, synthetic construct
  source 1..19: note = Seed: LQTVHSIPLTINKEEALQR
LQTVHSIPYTILKGEAFQR

SEQ ID NO: 37377 - protein, 19 aa, synthetic construct
  source 1..19: note = Seed: LQTVHSIPLTINKEEALQR
LQTVHSIPYTILKGEAGQR

SEQ ID NO: 37378 - protein, 19 aa, synthetic construct
  source 1..19: note = Seed: LQTVHSIPLTINKEEALQR
LQTVHSIPYTILKGEAIQR

SEQ ID NO: 37379 - protein, 19 aa, synthetic construct
  source 1..19: note = Seed: LQTVHSIPLTINKEEALQR
LQTVHSIPYTILKGEALQR

SEQ ID NO: 37380 - protein, 19 aa, synthetic construct
  source 1..19: note = Seed: LQTVHSIPLTINKEEALQR
LQTVHSIPYTILKGEAMQR

SEQ ID NO: 37381 - protein, 19 aa, synthetic construct
  source 1..19: note = Seed: LQTVHSIPLTINKEEALQR
LQTVHSIPYTILKGEANQR

SEQ ID NO: 37382 - protein, 19 aa, synthetic construct
  source 1..19: note = Seed: LQTVHSIPLTINKEEALQR
LQTVHSIPYTILKGEAPQR

SEQ ID NO: 37383 - protein, 19 aa, synthetic construct
  source 1..19: note = Seed: LQTVHSIPLTINKEEALQR
LQTVHSIPYTILKGEASQR

SEQ ID NO: 37384 - protein, 19 aa, synthetic construct
  source 1..19: note = Seed: LQTVHSIPLTINKEEALQR
LQTVHSIPYTILKGEATQR

SEQ ID NO: 37385 - protein, 19 aa, synthetic construct
  source 1..19: note = Seed: LQTVHSIPLTINKEEALQR
LQTVHSIPYTILKGEAVQR

SEQ ID NO: 37386 - protein, 19 aa, synthetic construct
  source 1..19: note = Seed: LQTVHSIPLTINKEEALQR
LQTVHSIPYTILKIEAAQR

SEQ ID NO: 37387 - protein, 19 aa, synthetic construct
  source 1..19: note = Seed: LQTVHSIPLTINKEEALQR
LQTVHSIPYTILKIEAFQR

SEQ ID NO: 37388 - protein, 19 aa, synthetic construct
  source 1..19: note = Seed: LQTVHSIPLTINKEEALQR
LQTVHSIPYTILKIEAIQR

SEQ ID NO: 37389 - protein, 19 aa, synthetic construct
  source 1..19: note = Seed: LQTVHSIPLTINKEEALQR
LQTVHSIPYTILKIEALQR

SEQ ID NO: 37390 - protein, 19 aa, synthetic construct
  source 1..19: note = Seed: LQTVHSIPLTINKEEALQR
LQTVHSIPYTILKIEAMQR

SEQ ID NO: 37391 - protein, 19 aa, synthetic construct
  source 1..19: note = Seed: LQTVHSIPLTINKEEALQR
LQTVHSIPYTILKIEAVQR

SEQ ID NO: 37392 - protein, 19 aa, synthetic construct
  source 1..19: note = Seed: LQTVHSIPLTINKEEALQR
LQTVHSIPYTILKLEAFQR

SEQ ID NO: 37393 - protein, 19 aa, synthetic construct
  source 1..19: note = Seed: LQTVHSIPLTINKEEALQR
LQTVHSIPYTILKLEAIQR

SEQ ID NO: 37394 - protein, 19 aa, synthetic construct
  source 1..19: note = Seed: LQTVHSIPLTINKEEALQR
LQTVHSIPYTILKLEALQR

SEQ ID NO: 37395 - protein, 19 aa, synthetic construct
  source 1..19: note = Seed: LQTVHSIPLTINKEEALQR
LQTVHSIPYTILKLEAMQR

SEQ ID NO: 37396 - protein, 19 aa, synthetic construct
  source 1..19: note = Seed: LQTVHSIPLTINKEEALQR
LQTVHSIPYTILKLEAVQR

SEQ ID NO: 37397 - protein, 19 aa, synthetic construct
  source 1..19: note = Seed: LQTVHSIPLTINKEEALQR
LQTVHSIPYTILKLEAYQR

SEQ ID NO: 37398 - protein, 19 aa, synthetic construct
  source 1..19: note = Seed: LQTVHSIPLTINKEEALQR
LQTVHSIPYTILKMEAIQR

SEQ ID NO: 37399 - protein, 19 aa, synthetic construct
  source 1..19: note = Seed: LQTVHSIPLTINKEEALQR
LQTVHSIPYTILKMEALQR

SEQ ID NO: 37400 - protein, 19 aa, synthetic construct
  source 1..19: note = Seed: LQTVHSIPLTINKEEALQR
LQTVHSIPYTILKMEAVQR

SEQ ID NO: 37401 - protein, 19 aa, synthetic construct
  source 1..19: note = Seed: LQTVHSIPLTINKEEALQR
LQTVHSIPYTILKNEAAQR

SEQ ID NO: 37402 - protein, 19 aa, synthetic construct
  source 1..19: note = Seed: LQTVHSIPLTINKEEALQR
LQTVHSIPYTILKNEAGQR

SEQ ID NO: 37403 - protein, 19 aa, synthetic construct
  source 1..19: note = Seed: LQTVHSIPLTINKEEALQR
LQTVHSIPYTILKNEAIQR

SEQ ID NO: 37404 - protein, 19 aa, synthetic construct
  source 1..19: note = Seed: LQTVHSIPLTINKEEALQR
LQTVHSIPYTILKNEALQR

SEQ ID NO: 37405 - protein, 19 aa, synthetic construct
  source 1..19: note = Seed: LQTVHSIPLTINKEEALQR
LQTVHSIPYTILKNEAMQR

SEQ ID NO: 37406 - protein, 19 aa, synthetic construct
  source 1..19: note = Seed: LQTVHSIPLTINKEEALQR
LQTVHSIPYTILKNEASQR

SEQ ID NO: 37407 - protein, 19 aa, synthetic construct
  source 1..19: note = Seed: LQTVHSIPLTINKEEALQR
LQTVHSIPYTILKNEATQR

SEQ ID NO: 37408 - protein, 19 aa, synthetic construct
  source 1..19: note = Seed: LQTVHSIPLTINKEEALQR
LQTVHSIPYTILKNEAVQR

SEQ ID NO: 37409 - protein, 19 aa, synthetic construct
  source 1..19: note = Seed: LQTVHSIPLTINKEEALQR
LQTVHSIPYTILKPEAAQR

SEQ ID NO: 37410 - protein, 19 aa, synthetic construct
  source 1..19: note = Seed: LQTVHSIPLTINKEEALQR
LQTVHSIPYTILKPEAGQR

SEQ ID NO: 37411 - protein, 19 aa, synthetic construct
  source 1..19: note = Seed: LQTVHSIPLTINKEEALQR
LQTVHSIPYTILKPEAIQR

SEQ ID NO: 37412 - protein, 19 aa, synthetic construct
  source 1..19: note = Seed: LQTVHSIPLTINKEEALQR
LQTVHSIPYTILKPEALQR

SEQ ID NO: 37413 - protein, 19 aa, synthetic construct
  source 1..19: note = Seed: LQTVHSIPLTINKEEALQR
LQTVHSIPYTILKPEAMQR

SEQ ID NO: 37414 - protein, 19 aa, synthetic construct
  source 1..19: note = Seed: LQTVHSIPLTINKEEALQR
LQTVHSIPYTILKPEASQR

SEQ ID NO: 37415 - protein, 19 aa, synthetic construct
  source 1..19: note = Seed: LQTVHSIPLTINKEEALQR
LQTVHSIPYTILKPEATQR

SEQ ID NO: 37416 - protein, 19 aa, synthetic construct
  source 1..19: note = Seed: LQTVHSIPLTINKEEALQR
LQTVHSIPYTILKPEAVQR

SEQ ID NO: 37417 - protein, 19 aa, synthetic construct
  source 1..19: note = Seed: LQTVHSIPLTINKEEALQR
LQTVHSIPYTILKSEAAQR

SEQ ID NO: 37418 - protein, 19 aa, synthetic construct
  source 1..19: note = Seed: LQTVHSIPLTINKEEALQR
LQTVHSIPYTILKSEACQR

SEQ ID NO: 37419 - protein, 19 aa, synthetic construct
  source 1..19: note = Seed: LQTVHSIPLTINKEEALQR
LQTVHSIPYTILKSEAFQR

SEQ ID NO: 37420 - protein, 19 aa, synthetic construct
  source 1..19: note = Seed: LQTVHSIPLTINKEEALQR
LQTVHSIPYTILKSEAGQR

SEQ ID NO: 37421 - protein, 19 aa, synthetic construct
  source 1..19: note = Seed: LQTVHSIPLTINKEEALQR
LQTVHSIPYTILKSEAIQR

SEQ ID NO: 37422 - protein, 19 aa, synthetic construct
  source 1..19: note = Seed: LQTVHSIPLTINKEEALQR
LQTVHSIPYTILKSEALQR

SEQ ID NO: 37423 - protein, 19 aa, synthetic construct
  source 1..19: note = Seed: LQTVHSIPLTINKEEALQR
LQTVHSIPYTILKSEAMQR

SEQ ID NO: 37424 - protein, 19 aa, synthetic construct
  source 1..19: note = Seed: LQTVHSIPLTINKEEALQR
LQTVHSIPYTILKSEANQR

SEQ ID NO: 37425 - protein, 19 aa, synthetic construct
  source 1..19: note = Seed: LQTVHSIPLTINKEEALQR
LQTVHSIPYTILKSEASQR

SEQ ID NO: 37426 - protein, 19 aa, synthetic construct
  source 1..19: note = Seed: LQTVHSIPLTINKEEALQR
LQTVHSIPYTILKSEATQR

SEQ ID NO: 37427 - protein, 19 aa, synthetic construct
  source 1..19: note = Seed: LQTVHSIPLTINKEEALQR
LQTVHSIPYTILKSEAVQR

SEQ ID NO: 37428 - protein, 19 aa, synthetic construct
  source 1..19: note = Seed: LQTVHSIPLTINKEEALQR
LQTVHSIPYTILKTEAAQR

SEQ ID NO: 37429 - protein, 19 aa, synthetic construct
  source 1..19: note = Seed: LQTVHSIPLTINKEEALQR
LQTVHSIPYTILKTEAIQR

SEQ ID NO: 37430 - protein, 19 aa, synthetic construct
  source 1..19: note = Seed: LQTVHSIPLTINKEEALQR
LQTVHSIPYTILKTEALQR

SEQ ID NO: 37431 - protein, 19 aa, synthetic construct
  source 1..19: note = Seed: LQTVHSIPLTINKEEALQR
LQTVHSIPYTILKTEAMQR

SEQ ID NO: 37432 - protein, 19 aa, synthetic construct
  source 1..19: note = Seed: LQTVHSIPLTINKEEALQR
LQTVHSIPYTILKTEASQR

SEQ ID NO: 37433 - protein, 19 aa, synthetic construct
  source 1..19: note = Seed: LQTVHSIPLTINKEEALQR
LQTVHSIPYTILKTEATQR

SEQ ID NO: 37434 - protein, 19 aa, synthetic construct
  source 1..19: note = Seed: LQTVHSIPLTINKEEALQR
LQTVHSIPYTILKTEAVQR

SEQ ID NO: 37435 - protein, 19 aa, synthetic construct
  source 1..19: note = Seed: LQTVHSIPLTINKEEALQR
LQTVHSIPYTILKVEAAQR

SEQ ID NO: 37436 - protein, 19 aa, synthetic construct
  source 1..19: note = Seed: LQTVHSIPLTINKEEALQR
LQTVHSIPYTILKVEAIQR

SEQ ID NO: 37437 - protein, 19 aa, synthetic construct
  source 1..19: note = Seed: LQTVHSIPLTINKEEALQR
LQTVHSIPYTILKVEALQR

SEQ ID NO: 37438 - protein, 19 aa, synthetic construct
  source 1..19: note = Seed: LQTVHSIPLTINKEEALQR
LQTVHSIPYTILKVEAMQR

SEQ ID NO: 37439 - protein, 19 aa, synthetic construct
  source 1..19: note = Seed: LQTVHSIPLTINKEEALQR
LQTVHSIPYTILKVEASQR

SEQ ID NO: 37440 - protein, 19 aa, synthetic construct
  source 1..19: note = Seed: LQTVHSIPLTINKEEALQR
LQTVHSIPYTILKVEATQR

SEQ ID NO: 37441 - protein, 19 aa, synthetic construct
  source 1..19: note = Seed: LQTVHSIPLTINKEEALQR
LQTVHSIPYTILKVEAVQR

SEQ ID NO: 37442 - protein, 19 aa, synthetic construct
  source 1..19: note = Seed: LQTVHSIPLTINKEEALQR
LQTVHSIPYTILKWEAIQR

SEQ ID NO: 37443 - protein, 19 aa, synthetic construct
  source 1..19: note = Seed: LQTVHSIPLTINKEEALQR
LQTVHSIPYTILKWEALQR

SEQ ID NO: 37444 - protein, 19 aa, synthetic construct
  source 1..19: note = Seed: LQTVHSIPLTINKEEALQR
LQTVHSIPYTILKWEAMQR

SEQ ID NO: 37445 - protein, 19 aa, synthetic construct
  source 1..19: note = Seed: LQTVHSIPLTINKEEALQR
LQTVHSIPYTILKWEAVQR

SEQ ID NO: 37446 - protein, 19 aa, synthetic construct
  source 1..19: note = Seed: LQTVHSIPLTINKEEALQR
LQTVHSIPYTILKYEAFQR

SEQ ID NO: 37447 - protein, 19 aa, synthetic construct
  source 1..19: note = Seed: LQTVHSIPLTINKEEALQR
LQTVHSIPYTILKYEAIQR

SEQ ID NO: 37448 - protein, 19 aa, synthetic construct
  source 1..19: note = Seed: LQTVHSIPLTINKEEALQR
LQTVHSIPYTILKYEALQR

SEQ ID NO: 37449 - protein, 19 aa, synthetic construct
  source 1..19: note = Seed: LQTVHSIPLTINKEEALQR
LQTVHSIPYTILKYEAMQR

SEQ ID NO: 37450 - protein, 19 aa, synthetic construct
  source 1..19: note = Seed: LQTVHSIPLTINKEEALQR
LQTVHSIPYTILKYEAVQR

SEQ ID NO: 37451 - protein, 19 aa, synthetic construct
  source 1..19: note = Seed: LQTVHSIPLTINKEEALQR
LQTVHSIPYTILKYEAYQR

SEQ ID NO: 37452 - protein, 19 aa, synthetic construct
  source 1..19: note = Seed: LQTVHSIPLTINKEEALQR
LQTVHSIPYTIMKAEAAQR

SEQ ID NO: 37453 - protein, 19 aa, synthetic construct
  source 1..19: note = Seed: LQTVHSIPLTINKEEALQR
LQTVHSIPYTIMKAEACQR

SEQ ID NO: 37454 - protein, 19 aa, synthetic construct
  source 1..19: note = Seed: LQTVHSIPLTINKEEALQR
LQTVHSIPYTIMKAEAFQR

SEQ ID NO: 37455 - protein, 19 aa, synthetic construct
  source 1..19: note = Seed: LQTVHSIPLTINKEEALQR
LQTVHSIPYTIMKAEAGQR

SEQ ID NO: 37456 - protein, 19 aa, synthetic construct
  source 1..19: note = Seed: LQTVHSIPLTINKEEALQR
LQTVHSIPYTIMKAEAHQR

SEQ ID NO: 37457 - protein, 19 aa, synthetic construct
  source 1..19: note = Seed: LQTVHSIPLTINKEEALQR
LQTVHSIPYTIMKAEAIQR

SEQ ID NO: 37458 - protein, 19 aa, synthetic construct
  source 1..19: note = Seed: LQTVHSIPLTINKEEALQR
LQTVHSIPYTIMKAEALQR

SEQ ID NO: 37459 - protein, 19 aa, synthetic construct
  source 1..19: note = Seed: LQTVHSIPLTINKEEALQR
LQTVHSIPYTIMKAEAMQR

SEQ ID NO: 37460 - protein, 19 aa, synthetic construct
  source 1..19: note = Seed: LQTVHSIPLTINKEEALQR
LQTVHSIPYTIMKAEANQR

SEQ ID NO: 37461 - protein, 19 aa, synthetic construct
  source 1..19: note = Seed: LQTVHSIPLTINKEEALQR
LQTVHSIPYTIMKAEAPQR

SEQ ID NO: 37462 - protein, 19 aa, synthetic construct
  source 1..19: note = Seed: LQTVHSIPLTINKEEALQR
LQTVHSIPYTIMKAEASQR

SEQ ID NO: 37463 - protein, 19 aa, synthetic construct
  source 1..19: note = Seed: LQTVHSIPLTINKEEALQR
LQTVHSIPYTIMKAEATQR

SEQ ID NO: 37464 - protein, 19 aa, synthetic construct
  source 1..19: note = Seed: LQTVHSIPLTINKEEALQR
LQTVHSIPYTIMKAEAVQR

SEQ ID NO: 37465 - protein, 19 aa, synthetic construct
  source 1..19: note = Seed: LQTVHSIPLTINKEEALQR
LQTVHSIPYTIMKFEAAQR

SEQ ID NO: 37466 - protein, 19 aa, synthetic construct
  source 1..19: note = Seed: LQTVHSIPLTINKEEALQR
LQTVHSIPYTIMKFEAEQR

SEQ ID NO: 37467 - protein, 19 aa, synthetic construct
  source 1..19: note = Seed: LQTVHSIPLTINKEEALQR
LQTVHSIPYTIMKFEAFQR

SEQ ID NO: 37468 - protein, 19 aa, synthetic construct
  source 1..19: note = Seed: LQTVHSIPLTINKEEALQR
LQTVHSIPYTIMKFEAIQR

SEQ ID NO: 37469 - protein, 19 aa, synthetic construct
  source 1..19: note = Seed: LQTVHSIPLTINKEEALQR
LQTVHSIPYTIMKFEALQR

SEQ ID NO: 37470 - protein, 19 aa, synthetic construct
  source 1..19: note = Seed: LQTVHSIPLTINKEEALQR
LQTVHSIPYTIMKFEAMQR

SEQ ID NO: 37471 - protein, 19 aa, synthetic construct
  source 1..19: note = Seed: LQTVHSIPLTINKEEALQR
LQTVHSIPYTIMKFEANQR

SEQ ID NO: 37472 - protein, 19 aa, synthetic construct
  source 1..19: note = Seed: LQTVHSIPLTINKEEALQR
LQTVHSIPYTIMKFEASQR

SEQ ID NO: 37473 - protein, 19 aa, synthetic construct
  source 1..19: note = Seed: LQTVHSIPLTINKEEALQR
LQTVHSIPYTIMKFEATQR

SEQ ID NO: 37474 - protein, 19 aa, synthetic construct
  source 1..19: note = Seed: LQTVHSIPLTINKEEALQR
LQTVHSIPYTIMKFEAVQR

SEQ ID NO: 37475 - protein, 19 aa, synthetic construct
  source 1..19: note = Seed: LQTVHSIPLTINKEEALQR
LQTVHSIPYTIMKFEAYQR

SEQ ID NO: 37476 - protein, 19 aa, synthetic construct
  source 1..19: note = Seed: LQTVHSIPLTINKEEALQR
LQTVHSIPYTIMKGEAAQR

SEQ ID NO: 37477 - protein, 19 aa, synthetic construct
  source 1..19: note = Seed: LQTVHSIPLTINKEEALQR
LQTVHSIPYTIMKGEACQR

SEQ ID NO: 37478 - protein, 19 aa, synthetic construct
  source 1..19: note = Seed: LQTVHSIPLTINKEEALQR
LQTVHSIPYTIMKGEAFQR

SEQ ID NO: 37479 - protein, 19 aa, synthetic construct
  source 1..19: note = Seed: LQTVHSIPLTINKEEALQR
LQTVHSIPYTIMKGEAGQR

SEQ ID NO: 37480 - protein, 19 aa, synthetic construct
  source 1..19: note = Seed: LQTVHSIPLTINKEEALQR
LQTVHSIPYTIMKGEAIQR

SEQ ID NO: 37481 - protein, 19 aa, synthetic construct
  source 1..19: note = Seed: LQTVHSIPLTINKEEALQR
LQTVHSIPYTIMKGEALQR

SEQ ID NO: 37482 - protein, 19 aa, synthetic construct
  source 1..19: note = Seed: LQTVHSIPLTINKEEALQR
LQTVHSIPYTIMKGEAMQR

SEQ ID NO: 37483 - protein, 19 aa, synthetic construct
  source 1..19: note = Seed: LQTVHSIPLTINKEEALQR
LQTVHSIPYTIMKGEANQR

SEQ ID NO: 37484 - protein, 19 aa, synthetic construct
  source 1..19: note = Seed: LQTVHSIPLTINKEEALQR
LQTVHSIPYTIMKGEAPQR

SEQ ID NO: 37485 - protein, 19 aa, synthetic construct
  source 1..19: note = Seed: LQTVHSIPLTINKEEALQR
LQTVHSIPYTIMKGEASQR

SEQ ID NO: 37486 - protein, 19 aa, synthetic construct
  source 1..19: note = Seed: LQTVHSIPLTINKEEALQR
LQTVHSIPYTIMKGEATQR

SEQ ID NO: 37487 - protein, 19 aa, synthetic construct
  source 1..19: note = Seed: LQTVHSIPLTINKEEALQR
LQTVHSIPYTIMKGEAVQR

SEQ ID NO: 37488 - protein, 19 aa, synthetic construct
  source 1..19: note = Seed: LQTVHSIPLTINKEEALQR
LQTVHSIPYTIMKIEAAQR

SEQ ID NO: 37489 - protein, 19 aa, synthetic construct
  source 1..19: note = Seed: LQTVHSIPLTINKEEALQR
LQTVHSIPYTIMKIEAIQR

SEQ ID NO: 37490 - protein, 19 aa, synthetic construct
  source 1..19: note = Seed: LQTVHSIPLTINKEEALQR
LQTVHSIPYTIMKIEALQR

SEQ ID NO: 37491 - protein, 19 aa, synthetic construct
  source 1..19: note = Seed: LQTVHSIPLTINKEEALQR
LQTVHSIPYTIMKIEAVQR

SEQ ID NO: 37492 - protein, 19 aa, synthetic construct
  source 1..19: note = Seed: LQTVHSIPLTINKEEALQR
LQTVHSIPYTIMKLEAFQR

SEQ ID NO: 37493 - protein, 19 aa, synthetic construct
  source 1..19: note = Seed: LQTVHSIPLTINKEEALQR
LQTVHSIPYTIMKLEAIQR

SEQ ID NO: 37494 - protein, 19 aa, synthetic construct
  source 1..19: note = Seed: LQTVHSIPLTINKEEALQR
LQTVHSIPYTIMKLEALQR

SEQ ID NO: 37495 - protein, 19 aa, synthetic construct
  source 1..19: note = Seed: LQTVHSIPLTINKEEALQR
LQTVHSIPYTIMKLEAVQR

SEQ ID NO: 37496 - protein, 19 aa, synthetic construct
  source 1..19: note = Seed: LQTVHSIPLTINKEEALQR
LQTVHSIPYTIMKNEAAQR

SEQ ID NO: 37497 - protein, 19 aa, synthetic construct
  source 1..19: note = Seed: LQTVHSIPLTINKEEALQR
LQTVHSIPYTIMKNEAGQR

SEQ ID NO: 37498 - protein, 19 aa, synthetic construct
  source 1..19: note = Seed: LQTVHSIPLTINKEEALQR
LQTVHSIPYTIMKNEAIQR

SEQ ID NO: 37499 - protein, 19 aa, synthetic construct
  source 1..19: note = Seed: LQTVHSIPLTINKEEALQR
LQTVHSIPYTIMKNEALQR

SEQ ID NO: 37500 - protein, 19 aa, synthetic construct
  source 1..19: note = Seed: LQTVHSIPLTINKEEALQR
LQTVHSIPYTIMKNEAMQR

SEQ ID NO: 37501 - protein, 19 aa, synthetic construct
  source 1..19: note = Seed: LQTVHSIPLTINKEEALQR
LQTVHSIPYTIMKNEASQR

SEQ ID NO: 37502 - protein, 19 aa, synthetic construct
  source 1..19: note = Seed: LQTVHSIPLTINKEEALQR
LQTVHSIPYTIMKNEATQR

SEQ ID NO: 37503 - protein, 19 aa, synthetic construct
  source 1..19: note = Seed: LQTVHSIPLTINKEEALQR
LQTVHSIPYTIMKNEAVQR

SEQ ID NO: 37504 - protein, 19 aa, synthetic construct
  source 1..19: note = Seed: LQTVHSIPLTINKEEALQR
LQTVHSIPYTIMKPEAAQR

SEQ ID NO: 37505 - protein, 19 aa, synthetic construct
  source 1..19: note = Seed: LQTVHSIPLTINKEEALQR
LQTVHSIPYTIMKPEAIQR

SEQ ID NO: 37506 - protein, 19 aa, synthetic construct
  source 1..19: note = Seed: LQTVHSIPLTINKEEALQR
LQTVHSIPYTIMKPEALQR

SEQ ID NO: 37507 - protein, 19 aa, synthetic construct
  source 1..19: note = Seed: LQTVHSIPLTINKEEALQR
LQTVHSIPYTIMKPEAMQR

SEQ ID NO: 37508 - protein, 19 aa, synthetic construct
  source 1..19: note = Seed: LQTVHSIPLTINKEEALQR
LQTVHSIPYTIMKPEASQR

SEQ ID NO: 37509 - protein, 19 aa, synthetic construct
  source 1..19: note = Seed: LQTVHSIPLTINKEEALQR
LQTVHSIPYTIMKPEATQR

SEQ ID NO: 37510 - protein, 19 aa, synthetic construct
  source 1..19: note = Seed: LQTVHSIPLTINKEEALQR
LQTVHSIPYTIMKPEAVQR

SEQ ID NO: 37511 - protein, 19 aa, synthetic construct
  source 1..19: note = Seed: LQTVHSIPLTINKEEALQR
LQTVHSIPYTIMKSEAAQR

SEQ ID NO: 37512 - protein, 19 aa, synthetic construct
  source 1..19: note = Seed: LQTVHSIPLTINKEEALQR
LQTVHSIPYTIMKSEACQR

SEQ ID NO: 37513 - protein, 19 aa, synthetic construct
  source 1..19: note = Seed: LQTVHSIPLTINKEEALQR
LQTVHSIPYTIMKSEAFQR

SEQ ID NO: 37514 - protein, 19 aa, synthetic construct
  source 1..19: note = Seed: LQTVHSIPLTINKEEALQR
LQTVHSIPYTIMKSEAGQR

SEQ ID NO: 37515 - protein, 19 aa, synthetic construct
  source 1..19: note = Seed: LQTVHSIPLTINKEEALQR
LQTVHSIPYTIMKSEAIQR

SEQ ID NO: 37516 - protein, 19 aa, synthetic construct
  source 1..19: note = Seed: LQTVHSIPLTINKEEALQR
LQTVHSIPYTIMKSEALQR

SEQ ID NO: 37517 - protein, 19 aa, synthetic construct
  source 1..19: note = Seed: LQTVHSIPLTINKEEALQR
LQTVHSIPYTIMKSEAMQR

SEQ ID NO: 37518 - protein, 19 aa, synthetic construct
  source 1..19: note = Seed: LQTVHSIPLTINKEEALQR
LQTVHSIPYTIMKSEANQR

SEQ ID NO: 37519 - protein, 19 aa, synthetic construct
  source 1..19: note = Seed: LQTVHSIPLTINKEEALQR
LQTVHSIPYTIMKSEASQR

SEQ ID NO: 37520 - protein, 19 aa, synthetic construct
  source 1..19: note = Seed: LQTVHSIPLTINKEEALQR
LQTVHSIPYTIMKSEATQR

SEQ ID NO: 37521 - protein, 19 aa, synthetic construct
  source 1..19: note = Seed: LQTVHSIPLTINKEEALQR
LQTVHSIPYTIMKSEAVQR

SEQ ID NO: 37522 - protein, 19 aa, synthetic construct
  source 1..19: note = Seed: LQTVHSIPLTINKEEALQR
LQTVHSIPYTIMKTEAAQR

SEQ ID NO: 37523 - protein, 19 aa, synthetic construct
  source 1..19: note = Seed: LQTVHSIPLTINKEEALQR
LQTVHSIPYTIMKTEAIQR

SEQ ID NO: 37524 - protein, 19 aa, synthetic construct
  source 1..19: note = Seed: LQTVHSIPLTINKEEALQR
LQTVHSIPYTIMKTEALQR

SEQ ID NO: 37525 - protein, 19 aa, synthetic construct
  source 1..19: note = Seed: LQTVHSIPLTINKEEALQR
LQTVHSIPYTIMKTEAMQR

SEQ ID NO: 37526 - protein, 19 aa, synthetic construct
  source 1..19: note = Seed: LQTVHSIPLTINKEEALQR
LQTVHSIPYTIMKTEASQR

SEQ ID NO: 37527 - protein, 19 aa, synthetic construct
  source 1..19: note = Seed: LQTVHSIPLTINKEEALQR
LQTVHSIPYTIMKTEATQR

SEQ ID NO: 37528 - protein, 19 aa, synthetic construct
  source 1..19: note = Seed: LQTVHSIPLTINKEEALQR
LQTVHSIPYTIMKTEAVQR

SEQ ID NO: 37529 - protein, 19 aa, synthetic construct
  source 1..19: note = Seed: LQTVHSIPLTINKEEALQR
LQTVHSIPYTIMKVEAAQR

SEQ ID NO: 37530 - protein, 19 aa, synthetic construct
  source 1..19: note = Seed: LQTVHSIPLTINKEEALQR
LQTVHSIPYTIMKVEAIQR

SEQ ID NO: 37531 - protein, 19 aa, synthetic construct
  source 1..19: note = Seed: LQTVHSIPLTINKEEALQR
LQTVHSIPYTIMKVEALQR

SEQ ID NO: 37532 - protein, 19 aa, synthetic construct
  source 1..19: note = Seed: LQTVHSIPLTINKEEALQR
LQTVHSIPYTIMKVEAMQR

SEQ ID NO: 37533 - protein, 19 aa, synthetic construct
  source 1..19: note = Seed: LQTVHSIPLTINKEEALQR
LQTVHSIPYTIMKVEASQR

SEQ ID NO: 37534 - protein, 19 aa, synthetic construct
  source 1..19: note = Seed: LQTVHSIPLTINKEEALQR
LQTVHSIPYTIMKVEATQR

SEQ ID NO: 37535 - protein, 19 aa, synthetic construct
  source 1..19: note = Seed: LQTVHSIPLTINKEEALQR
LQTVHSIPYTIMKVEAVQR

SEQ ID NO: 37536 - protein, 19 aa, synthetic construct
  source 1..19: note = Seed: LQTVHSIPLTINKEEALQR
LQTVHSIPYTIMKWEALQR

SEQ ID NO: 37537 - protein, 19 aa, synthetic construct
  source 1..19: note = Seed: LQTVHSIPLTINKEEALQR
LQTVHSIPYTIMKYEAIQR

SEQ ID NO: 37538 - protein, 19 aa, synthetic construct
  source 1..19: note = Seed: LQTVHSIPLTINKEEALQR
LQTVHSIPYTIMKYEALQR

SEQ ID NO: 37539 - protein, 19 aa, synthetic construct
  source 1..19: note = Seed: LQTVHSIPLTINKEEALQR
LQTVHSIPYTINKAEAIQR

SEQ ID NO: 37540 - protein, 19 aa, synthetic construct
  source 1..19: note = Seed: LQTVHSIPLTINKEEALQR
LQTVHSIPYTINKAEALQR

SEQ ID NO: 37541 - protein, 19 aa, synthetic construct
  source 1..19: note = Seed: LQTVHSIPLTINKEEALQR
LQTVHSIPYTINKAEAVQR

SEQ ID NO: 37542 - protein, 19 aa, synthetic construct
  source 1..19: note = Seed: LQTVHSIPLTINKEEALQR
LQTVHSIPYTINKFEAFQR

SEQ ID NO: 37543 - protein, 19 aa, synthetic construct
  source 1..19: note = Seed: LQTVHSIPLTINKEEALQR
LQTVHSIPYTINKFEAIQR

SEQ ID NO: 37544 - protein, 19 aa, synthetic construct
  source 1..19: note = Seed: LQTVHSIPLTINKEEALQR
LQTVHSIPYTINKFEALQR

SEQ ID NO: 37545 - protein, 19 aa, synthetic construct
  source 1..19: note = Seed: LQTVHSIPLTINKEEALQR
LQTVHSIPYTINKFEAMQR

SEQ ID NO: 37546 - protein, 19 aa, synthetic construct
  source 1..19: note = Seed: LQTVHSIPLTINKEEALQR
LQTVHSIPYTINKFEAVQR

SEQ ID NO: 37547 - protein, 19 aa, synthetic construct
  source 1..19: note = Seed: LQTVHSIPLTINKEEALQR
LQTVHSIPYTINKNEAIQR

SEQ ID NO: 37548 - protein, 19 aa, synthetic construct
  source 1..19: note = Seed: LQTVHSIPLTINKEEALQR
LQTVHSIPYTINKNEALQR

SEQ ID NO: 37549 - protein, 19 aa, synthetic construct
  source 1..19: note = Seed: LQTVHSIPLTINKEEALQR
LQTVHSIPYTINKNEAVQR

SEQ ID NO: 37550 - protein, 19 aa, synthetic construct
  source 1..19: note = Seed: LQTVHSIPLTINKEEALQR
LQTVHSIPYTINKSEAIQR

SEQ ID NO: 37551 - protein, 19 aa, synthetic construct
  source 1..19: note = Seed: LQTVHSIPLTINKEEALQR
LQTVHSIPYTINKSEAVQR

SEQ ID NO: 37552 - protein, 19 aa, synthetic construct
  source 1..19: note = Seed: LQTVHSIPLTINKEEALQR
LQTVHSIPYTIQKAEAAQR

SEQ ID NO: 37553 - protein, 19 aa, synthetic construct
  source 1..19: note = Seed: LQTVHSIPLTINKEEALQR
LQTVHSIPYTIQKAEAIQR

SEQ ID NO: 37554 - protein, 19 aa, synthetic construct
  source 1..19: note = Seed: LQTVHSIPLTINKEEALQR
LQTVHSIPYTIQKAEALQR

SEQ ID NO: 37555 - protein, 19 aa, synthetic construct
  source 1..19: note = Seed: LQTVHSIPLTINKEEALQR
LQTVHSIPYTIQKAEAMQR

SEQ ID NO: 37556 - protein, 19 aa, synthetic construct
  source 1..19: note = Seed: LQTVHSIPLTINKEEALQR
LQTVHSIPYTIQKAEASQR

SEQ ID NO: 37557 - protein, 19 aa, synthetic construct
  source 1..19: note = Seed: LQTVHSIPLTINKEEALQR
LQTVHSIPYTIQKAEATQR

SEQ ID NO: 37558 - protein, 19 aa, synthetic construct
  source 1..19: note = Seed: LQTVHSIPLTINKEEALQR
LQTVHSIPYTIQKAEAVQR

SEQ ID NO: 37559 - protein, 19 aa, synthetic construct
  source 1..19: note = Seed: LQTVHSIPLTINKEEALQR
LQTVHSIPYTIQKFEAFQR

SEQ ID NO: 37560 - protein, 19 aa, synthetic construct
  source 1..19: note = Seed: LQTVHSIPLTINKEEALQR
LQTVHSIPYTIQKFEAIQR

SEQ ID NO: 37561 - protein, 19 aa, synthetic construct
  source 1..19: note = Seed: LQTVHSIPLTINKEEALQR
LQTVHSIPYTIQKFEALQR

SEQ ID NO: 37562 - protein, 19 aa, synthetic construct
  source 1..19: note = Seed: LQTVHSIPLTINKEEALQR
LQTVHSIPYTIQKFEAMQR

SEQ ID NO: 37563 - protein, 19 aa, synthetic construct
  source 1..19: note = Seed: LQTVHSIPLTINKEEALQR
LQTVHSIPYTIQKFEAVQR

SEQ ID NO: 37564 - protein, 19 aa, synthetic construct
  source 1..19: note = Seed: LQTVHSIPLTINKEEALQR
LQTVHSIPYTIQKGEAAQR

SEQ ID NO: 37565 - protein, 19 aa, synthetic construct
  source 1..19: note = Seed: LQTVHSIPLTINKEEALQR
LQTVHSIPYTIQKGEAIQR

SEQ ID NO: 37566 - protein, 19 aa, synthetic construct
  source 1..19: note = Seed: LQTVHSIPLTINKEEALQR
LQTVHSIPYTIQKGEALQR

SEQ ID NO: 37567 - protein, 19 aa, synthetic construct
  source 1..19: note = Seed: LQTVHSIPLTINKEEALQR
LQTVHSIPYTIQKGEAMQR

SEQ ID NO: 37568 - protein, 19 aa, synthetic construct
  source 1..19: note = Seed: LQTVHSIPLTINKEEALQR
LQTVHSIPYTIQKGEATQR

SEQ ID NO: 37569 - protein, 19 aa, synthetic construct
  source 1..19: note = Seed: LQTVHSIPLTINKEEALQR
LQTVHSIPYTIQKGEAVQR

SEQ ID NO: 37570 - protein, 19 aa, synthetic construct
  source 1..19: note = Seed: LQTVHSIPLTINKEEALQR
LQTVHSIPYTIQKNEAAQR

SEQ ID NO: 37571 - protein, 19 aa, synthetic construct
  source 1..19: note = Seed: LQTVHSIPLTINKEEALQR
LQTVHSIPYTIQKNEAIQR

SEQ ID NO: 37572 - protein, 19 aa, synthetic construct
  source 1..19: note = Seed: LQTVHSIPLTINKEEALQR
LQTVHSIPYTIQKNEALQR

SEQ ID NO: 37573 - protein, 19 aa, synthetic construct
  source 1..19: note = Seed: LQTVHSIPLTINKEEALQR
LQTVHSIPYTIQKNEAVQR

SEQ ID NO: 37574 - protein, 19 aa, synthetic construct
  source 1..19: note = Seed: LQTVHSIPLTINKEEALQR
LQTVHSIPYTIQKPEAIQR

SEQ ID NO: 37575 - protein, 19 aa, synthetic construct
  source 1..19: note = Seed: LQTVHSIPLTINKEEALQR
LQTVHSIPYTIQKPEALQR

SEQ ID NO: 37576 - protein, 19 aa, synthetic construct
  source 1..19: note = Seed: LQTVHSIPLTINKEEALQR
LQTVHSIPYTIQKPEAVQR

SEQ ID NO: 37577 - protein, 19 aa, synthetic construct
  source 1..19: note = Seed: LQTVHSIPLTINKEEALQR
LQTVHSIPYTIQKSEAAQR

SEQ ID NO: 37578 - protein, 19 aa, synthetic construct
  source 1..19: note = Seed: LQTVHSIPLTINKEEALQR
LQTVHSIPYTIQKSEAIQR

SEQ ID NO: 37579 - protein, 19 aa, synthetic construct
  source 1..19: note = Seed: LQTVHSIPLTINKEEALQR
LQTVHSIPYTIQKSEALQR

SEQ ID NO: 37580 - protein, 19 aa, synthetic construct
  source 1..19: note = Seed: LQTVHSIPLTINKEEALQR
LQTVHSIPYTIQKSEAMQR

SEQ ID NO: 37581 - protein, 19 aa, synthetic construct
  source 1..19: note = Seed: LQTVHSIPLTINKEEALQR
LQTVHSIPYTIQKSEATQR

SEQ ID NO: 37582 - protein, 19 aa, synthetic construct
  source 1..19: note = Seed: LQTVHSIPLTINKEEALQR
LQTVHSIPYTIQKSEAVQR

SEQ ID NO: 37583 - protein, 19 aa, synthetic construct
  source 1..19: note = Seed: LQTVHSIPLTINKEEALQR
LQTVHSIPYTIQKTEAIQR

SEQ ID NO: 37584 - protein, 19 aa, synthetic construct
  source 1..19: note = Seed: LQTVHSIPLTINKEEALQR
LQTVHSIPYTIQKTEALQR

SEQ ID NO: 37585 - protein, 19 aa, synthetic construct
  source 1..19: note = Seed: LQTVHSIPLTINKEEALQR
LQTVHSIPYTIQKTEAVQR

SEQ ID NO: 37586 - protein, 19 aa, synthetic construct
  source 1..19: note = Seed: LQTVHSIPLTINKEEALQR
LQTVHSIPYTISKAEAAQR

SEQ ID NO: 37587 - protein, 19 aa, synthetic construct
  source 1..19: note = Seed: LQTVHSIPLTINKEEALQR
LQTVHSIPYTISKAEAFQR

SEQ ID NO: 37588 - protein, 19 aa, synthetic construct
  source 1..19: note = Seed: LQTVHSIPLTINKEEALQR
LQTVHSIPYTISKAEAIQR

SEQ ID NO: 37589 - protein, 19 aa, synthetic construct
  source 1..19: note = Seed: LQTVHSIPLTINKEEALQR
LQTVHSIPYTISKAEALQR

SEQ ID NO: 37590 - protein, 19 aa, synthetic construct
  source 1..19: note = Seed: LQTVHSIPLTINKEEALQR
LQTVHSIPYTISKAEAMQR

SEQ ID NO: 37591 - protein, 19 aa, synthetic construct
  source 1..19: note = Seed: LQTVHSIPLTINKEEALQR
LQTVHSIPYTISKAEAVQR

SEQ ID NO: 37592 - protein, 19 aa, synthetic construct
  source 1..19: note = Seed: LQTVHSIPLTINKEEALQR
LQTVHSIPYTISKFEAFQR

SEQ ID NO: 37593 - protein, 19 aa, synthetic construct
  source 1..19: note = Seed: LQTVHSIPLTINKEEALQR
LQTVHSIPYTISKFEAIQR

SEQ ID NO: 37594 - protein, 19 aa, synthetic construct
  source 1..19: note = Seed: LQTVHSIPLTINKEEALQR
LQTVHSIPYTISKFEALQR

SEQ ID NO: 37595 - protein, 19 aa, synthetic construct
  source 1..19: note = Seed: LQTVHSIPLTINKEEALQR
LQTVHSIPYTISKFEAMQR

SEQ ID NO: 37596 - protein, 19 aa, synthetic construct
  source 1..19: note = Seed: LQTVHSIPLTINKEEALQR
LQTVHSIPYTISKFEATQR

SEQ ID NO: 37597 - protein, 19 aa, synthetic construct
  source 1..19: note = Seed: LQTVHSIPLTINKEEALQR
LQTVHSIPYTISKFEAVQR

SEQ ID NO: 37598 - protein, 19 aa, synthetic construct
  source 1..19: note = Seed: LQTVHSIPLTINKEEALQR
LQTVHSIPYTISKFEAYQR

SEQ ID NO: 37599 - protein, 19 aa, synthetic construct
  source 1..19: note = Seed: LQTVHSIPLTINKEEALQR
LQTVHSIPYTISKGEAAQR

SEQ ID NO: 37600 - protein, 19 aa, synthetic construct
  source 1..19: note = Seed: LQTVHSIPLTINKEEALQR
LQTVHSIPYTISKGEAIQR

SEQ ID NO: 37601 - protein, 19 aa, synthetic construct
  source 1..19: note = Seed: LQTVHSIPLTINKEEALQR
LQTVHSIPYTISKGEALQR

SEQ ID NO: 37602 - protein, 19 aa, synthetic construct
  source 1..19: note = Seed: LQTVHSIPLTINKEEALQR
LQTVHSIPYTISKGEAVQR

SEQ ID NO: 37603 - protein, 19 aa, synthetic construct
  source 1..19: note = Seed: LQTVHSIPLTINKEEALQR
LQTVHSIPYTISKNEAIQR

SEQ ID NO: 37604 - protein, 19 aa, synthetic construct
  source 1..19: note = Seed: LQTVHSIPLTINKEEALQR
LQTVHSIPYTISKSEAFQR

SEQ ID NO: 37605 - protein, 19 aa, synthetic construct
  source 1..19: note = Seed: LQTVHSIPLTINKEEALQR
LQTVHSIPYTISKSEAIQR

SEQ ID NO: 37606 - protein, 19 aa, synthetic construct
  source 1..19: note = Seed: LQTVHSIPLTINKEEALQR
LQTVHSIPYTISKSEALQR

SEQ ID NO: 37607 - protein, 19 aa, synthetic construct
  source 1..19: note = Seed: LQTVHSIPLTINKEEALQR
LQTVHSIPYTISKSEAMQR

SEQ ID NO: 37608 - protein, 19 aa, synthetic construct
  source 1..19: note = Seed: LQTVHSIPLTINKEEALQR
LQTVHSIPYTISKSEAVQR

SEQ ID NO: 37609 - protein, 19 aa, synthetic construct
  source 1..19: note = Seed: LQTVHSIPLTINKEEALQR
LQTVHSIPYTISKTEAIQR

SEQ ID NO: 37610 - protein, 19 aa, synthetic construct
  source 1..19: note = Seed: LQTVHSIPLTINKEEALQR
LQTVHSIPYTISKTEALQR

SEQ ID NO: 37611 - protein, 19 aa, synthetic construct
  source 1..19: note = Seed: LQTVHSIPLTINKEEALQR
LQTVHSIPYTITKAEAFQR

SEQ ID NO: 37612 - protein, 19 aa, synthetic construct
  source 1..19: note = Seed: LQTVHSIPLTINKEEALQR
LQTVHSIPYTITKAEAIQR

SEQ ID NO: 37613 - protein, 19 aa, synthetic construct
  source 1..19: note = Seed: LQTVHSIPLTINKEEALQR
LQTVHSIPYTITKAEALQR

SEQ ID NO: 37614 - protein, 19 aa, synthetic construct
  source 1..19: note = Seed: LQTVHSIPLTINKEEALQR
LQTVHSIPYTITKAEAMQR

SEQ ID NO: 37615 - protein, 19 aa, synthetic construct
  source 1..19: note = Seed: LQTVHSIPLTINKEEALQR
LQTVHSIPYTITKAEAVQR

SEQ ID NO: 37616 - protein, 19 aa, synthetic construct
  source 1..19: note = Seed: LQTVHSIPLTINKEEALQR
LQTVHSIPYTITKFEAAQR

SEQ ID NO: 37617 - protein, 19 aa, synthetic construct
  source 1..19: note = Seed: LQTVHSIPLTINKEEALQR
LQTVHSIPYTITKFEAEQR

SEQ ID NO: 37618 - protein, 19 aa, synthetic construct
  source 1..19: note = Seed: LQTVHSIPLTINKEEALQR
LQTVHSIPYTITKFEAFQR

SEQ ID NO: 37619 - protein, 19 aa, synthetic construct
  source 1..19: note = Seed: LQTVHSIPLTINKEEALQR
LQTVHSIPYTITKFEAIQR

SEQ ID NO: 37620 - protein, 19 aa, synthetic construct
  source 1..19: note = Seed: LQTVHSIPLTINKEEALQR
LQTVHSIPYTITKFEALQR

SEQ ID NO: 37621 - protein, 19 aa, synthetic construct
  source 1..19: note = Seed: LQTVHSIPLTINKEEALQR
LQTVHSIPYTITKFEAMQR

SEQ ID NO: 37622 - protein, 19 aa, synthetic construct
  source 1..19: note = Seed: LQTVHSIPLTINKEEALQR
LQTVHSIPYTITKFEANQR

SEQ ID NO: 37623 - protein, 19 aa, synthetic construct
  source 1..19: note = Seed: LQTVHSIPLTINKEEALQR
LQTVHSIPYTITKFEATQR

SEQ ID NO: 37624 - protein, 19 aa, synthetic construct
  source 1..19: note = Seed: LQTVHSIPLTINKEEALQR
LQTVHSIPYTITKFEAVQR

SEQ ID NO: 37625 - protein, 19 aa, synthetic construct
  source 1..19: note = Seed: LQTVHSIPLTINKEEALQR
LQTVHSIPYTITKFEAYQR

SEQ ID NO: 37626 - protein, 19 aa, synthetic construct
  source 1..19: note = Seed: LQTVHSIPLTINKEEALQR
LQTVHSIPYTITKGEAIQR

SEQ ID NO: 37627 - protein, 19 aa, synthetic construct
  source 1..19: note = Seed: LQTVHSIPLTINKEEALQR
LQTVHSIPYTITKGEALQR

SEQ ID NO: 37628 - protein, 19 aa, synthetic construct
  source 1..19: note = Seed: LQTVHSIPLTINKEEALQR
LQTVHSIPYTITKGEAVQR

SEQ ID NO: 37629 - protein, 19 aa, synthetic construct
  source 1..19: note = Seed: LQTVHSIPLTINKEEALQR
LQTVHSIPYTITKLEAIQR

SEQ ID NO: 37630 - protein, 19 aa, synthetic construct
  source 1..19: note = Seed: LQTVHSIPLTINKEEALQR
LQTVHSIPYTITKLEALQR

SEQ ID NO: 37631 - protein, 19 aa, synthetic construct
  source 1..19: note = Seed: LQTVHSIPLTINKEEALQR
LQTVHSIPYTITKNEAIQR

SEQ ID NO: 37632 - protein, 19 aa, synthetic construct
  source 1..19: note = Seed: LQTVHSIPLTINKEEALQR
LQTVHSIPYTITKPEAIQR

SEQ ID NO: 37633 - protein, 19 aa, synthetic construct
  source 1..19: note = Seed: LQTVHSIPLTINKEEALQR
LQTVHSIPYTITKSEAFQR

SEQ ID NO: 37634 - protein, 19 aa, synthetic construct
  source 1..19: note = Seed: LQTVHSIPLTINKEEALQR
LQTVHSIPYTITKSEAIQR

SEQ ID NO: 37635 - protein, 19 aa, synthetic construct
  source 1..19: note = Seed: LQTVHSIPLTINKEEALQR
LQTVHSIPYTITKSEALQR

SEQ ID NO: 37636 - protein, 19 aa, synthetic construct
  source 1..19: note = Seed: LQTVHSIPLTINKEEALQR
LQTVHSIPYTITKSEAMQR

SEQ ID NO: 37637 - protein, 19 aa, synthetic construct
  source 1..19: note = Seed: LQTVHSIPLTINKEEALQR
LQTVHSIPYTITKSEAVQR

SEQ ID NO: 37638 - protein, 19 aa, synthetic construct
  source 1..19: note = Seed: LQTVHSIPLTINKEEALQR
LQTVHSIPYTITKTEAIQR

SEQ ID NO: 37639 - protein, 19 aa, synthetic construct
  source 1..19: note = Seed: LQTVHSIPLTINKEEALQR
LQTVHSIPYTITKTEALQR

SEQ ID NO: 37640 - protein, 19 aa, synthetic construct
  source 1..19: note = Seed: LQTVHSIPLTINKEEALQR
LQTVHSIPYTITKTEAVQR

SEQ ID NO: 37641 - protein, 19 aa, synthetic construct
  source 1..19: note = Seed: LQTVHSIPLTINKEEALQR
LQTVHSIPYTITKVEAIQR

SEQ ID NO: 37642 - protein, 19 aa, synthetic construct
  source 1..19: note = Seed: LQTVHSIPLTINKEEALQR
LQTVHSIPYTITKWEALQR

SEQ ID NO: 37643 - protein, 19 aa, synthetic construct
  source 1..19: note = Seed: LQTVHSIPLTINKEEALQR
LQTVHSIPYTITKYEAIQR

SEQ ID NO: 37644 - protein, 19 aa, synthetic construct
  source 1..19: note = Seed: LQTVHSIPLTINKEEALQR
LQTVHSIPYTITKYEALQR

SEQ ID NO: 37645 - protein, 19 aa, synthetic construct
  source 1..19: note = Seed: LQTVHSIPLTINKEEALQR
LQTVHSIPYTIVKAEAAQR

SEQ ID NO: 37646 - protein, 19 aa, synthetic construct
  source 1..19: note = Seed: LQTVHSIPLTINKEEALQR
LQTVHSIPYTIVKAEAFQR

SEQ ID NO: 37647 - protein, 19 aa, synthetic construct
  source 1..19: note = Seed: LQTVHSIPLTINKEEALQR
LQTVHSIPYTIVKAEAIQR

SEQ ID NO: 37648 - protein, 19 aa, synthetic construct
  source 1..19: note = Seed: LQTVHSIPLTINKEEALQR
LQTVHSIPYTIVKAEALQR

SEQ ID NO: 37649 - protein, 19 aa, synthetic construct
  source 1..19: note = Seed: LQTVHSIPLTINKEEALQR
LQTVHSIPYTIVKAEAMQR

SEQ ID NO: 37650 - protein, 19 aa, synthetic construct
  source 1..19: note = Seed: LQTVHSIPLTINKEEALQR
LQTVHSIPYTIVKAEASQR

SEQ ID NO: 37651 - protein, 19 aa, synthetic construct
  source 1..19: note = Seed: LQTVHSIPLTINKEEALQR
LQTVHSIPYTIVKAEATQR

SEQ ID NO: 37652 - protein, 19 aa, synthetic construct
  source 1..19: note = Seed: LQTVHSIPLTINKEEALQR
LQTVHSIPYTIVKAEAVQR

SEQ ID NO: 37653 - protein, 19 aa, synthetic construct
  source 1..19: note = Seed: LQTVHSIPLTINKEEALQR
LQTVHSIPYTIVKFEAAQR

SEQ ID NO: 37654 - protein, 19 aa, synthetic construct
  source 1..19: note = Seed: LQTVHSIPLTINKEEALQR
LQTVHSIPYTIVKFEADQR

SEQ ID NO: 37655 - protein, 19 aa, synthetic construct
  source 1..19: note = Seed: LQTVHSIPLTINKEEALQR
LQTVHSIPYTIVKFEAEQR

SEQ ID NO: 37656 - protein, 19 aa, synthetic construct
  source 1..19: note = Seed: LQTVHSIPLTINKEEALQR
LQTVHSIPYTIVKFEAFQR

SEQ ID NO: 37657 - protein, 19 aa, synthetic construct
  source 1..19: note = Seed: LQTVHSIPLTINKEEALQR
LQTVHSIPYTIVKFEAHQR

SEQ ID NO: 37658 - protein, 19 aa, synthetic construct
  source 1..19: note = Seed: LQTVHSIPLTINKEEALQR
LQTVHSIPYTIVKFEAIQR

SEQ ID NO: 37659 - protein, 19 aa, synthetic construct
  source 1..19: note = Seed: LQTVHSIPLTINKEEALQR
LQTVHSIPYTIVKFEALQR

SEQ ID NO: 37660 - protein, 19 aa, synthetic construct
  source 1..19: note = Seed: LQTVHSIPLTINKEEALQR
LQTVHSIPYTIVKFEAMQR

SEQ ID NO: 37661 - protein, 19 aa, synthetic construct
  source 1..19: note = Seed: LQTVHSIPLTINKEEALQR
LQTVHSIPYTIVKFEANQR

SEQ ID NO: 37662 - protein, 19 aa, synthetic construct
  source 1..19: note = Seed: LQTVHSIPLTINKEEALQR
LQTVHSIPYTIVKFEAPQR

SEQ ID NO: 37663 - protein, 19 aa, synthetic construct
  source 1..19: note = Seed: LQTVHSIPLTINKEEALQR
LQTVHSIPYTIVKFEAQQR

SEQ ID NO: 37664 - protein, 19 aa, synthetic construct
  source 1..19: note = Seed: LQTVHSIPLTINKEEALQR
LQTVHSIPYTIVKFEARQR

SEQ ID NO: 37665 - protein, 19 aa, synthetic construct
  source 1..19: note = Seed: LQTVHSIPLTINKEEALQR
LQTVHSIPYTIVKFEASQR

SEQ ID NO: 37666 - protein, 19 aa, synthetic construct
  source 1..19: note = Seed: LQTVHSIPLTINKEEALQR
LQTVHSIPYTIVKFEATQR

SEQ ID NO: 37667 - protein, 19 aa, synthetic construct
  source 1..19: note = Seed: LQTVHSIPLTINKEEALQR
LQTVHSIPYTIVKFEAVQR

SEQ ID NO: 37668 - protein, 19 aa, synthetic construct
  source 1..19: note = Seed: LQTVHSIPLTINKEEALQR
LQTVHSIPYTIVKFEAWQR

SEQ ID NO: 37669 - protein, 19 aa, synthetic construct
  source 1..19: note = Seed: LQTVHSIPLTINKEEALQR
LQTVHSIPYTIVKFEAYQR

SEQ ID NO: 37670 - protein, 19 aa, synthetic construct
  source 1..19: note = Seed: LQTVHSIPLTINKEEALQR
LQTVHSIPYTIVKGEAAQR

SEQ ID NO: 37671 - protein, 19 aa, synthetic construct
  source 1..19: note = Seed: LQTVHSIPLTINKEEALQR
LQTVHSIPYTIVKGEAIQR

SEQ ID NO: 37672 - protein, 19 aa, synthetic construct
  source 1..19: note = Seed: LQTVHSIPLTINKEEALQR
LQTVHSIPYTIVKGEALQR

SEQ ID NO: 37673 - protein, 19 aa, synthetic construct
  source 1..19: note = Seed: LQTVHSIPLTINKEEALQR
LQTVHSIPYTIVKGEAMQR

SEQ ID NO: 37674 - protein, 19 aa, synthetic construct
  source 1..19: note = Seed: LQTVHSIPLTINKEEALQR
LQTVHSIPYTIVKGEASQR

SEQ ID NO: 37675 - protein, 19 aa, synthetic construct
  source 1..19: note = Seed: LQTVHSIPLTINKEEALQR
LQTVHSIPYTIVKGEATQR

SEQ ID NO: 37676 - protein, 19 aa, synthetic construct
  source 1..19: note = Seed: LQTVHSIPLTINKEEALQR
LQTVHSIPYTIVKGEAVQR

SEQ ID NO: 37677 - protein, 19 aa, synthetic construct
  source 1..19: note = Seed: LQTVHSIPLTINKEEALQR
LQTVHSIPYTIVKIEAFQR

SEQ ID NO: 37678 - protein, 19 aa, synthetic construct
  source 1..19: note = Seed: LQTVHSIPLTINKEEALQR
LQTVHSIPYTIVKIEAIQR

SEQ ID NO: 37679 - protein, 19 aa, synthetic construct
  source 1..19: note = Seed: LQTVHSIPLTINKEEALQR
LQTVHSIPYTIVKIEALQR

SEQ ID NO: 37680 - protein, 19 aa, synthetic construct
  source 1..19: note = Seed: LQTVHSIPLTINKEEALQR
LQTVHSIPYTIVKIEAVQR

SEQ ID NO: 37681 - protein, 19 aa, synthetic construct
  source 1..19: note = Seed: LQTVHSIPLTINKEEALQR
LQTVHSIPYTIVKLEAFQR

SEQ ID NO: 37682 - protein, 19 aa, synthetic construct
  source 1..19: note = Seed: LQTVHSIPLTINKEEALQR
LQTVHSIPYTIVKLEAIQR

SEQ ID NO: 37683 - protein, 19 aa, synthetic construct
  source 1..19: note = Seed: LQTVHSIPLTINKEEALQR
LQTVHSIPYTIVKLEALQR

SEQ ID NO: 37684 - protein, 19 aa, synthetic construct
  source 1..19: note = Seed: LQTVHSIPLTINKEEALQR
LQTVHSIPYTIVKLEAMQR

SEQ ID NO: 37685 - protein, 19 aa, synthetic construct
  source 1..19: note = Seed: LQTVHSIPLTINKEEALQR
LQTVHSIPYTIVKLEAVQR

SEQ ID NO: 37686 - protein, 19 aa, synthetic construct
  source 1..19: note = Seed: LQTVHSIPLTINKEEALQR
LQTVHSIPYTIVKMEAIQR

SEQ ID NO: 37687 - protein, 19 aa, synthetic construct
  source 1..19: note = Seed: LQTVHSIPLTINKEEALQR
LQTVHSIPYTIVKMEALQR

SEQ ID NO: 37688 - protein, 19 aa, synthetic construct
  source 1..19: note = Seed: LQTVHSIPLTINKEEALQR
LQTVHSIPYTIVKMEAVQR

SEQ ID NO: 37689 - protein, 19 aa, synthetic construct
  source 1..19: note = Seed: LQTVHSIPLTINKEEALQR
LQTVHSIPYTIVKNEAAQR

SEQ ID NO: 37690 - protein, 19 aa, synthetic construct
  source 1..19: note = Seed: LQTVHSIPLTINKEEALQR
LQTVHSIPYTIVKNEAIQR

SEQ ID NO: 37691 - protein, 19 aa, synthetic construct
  source 1..19: note = Seed: LQTVHSIPLTINKEEALQR
LQTVHSIPYTIVKNEALQR

SEQ ID NO: 37692 - protein, 19 aa, synthetic construct
  source 1..19: note = Seed: LQTVHSIPLTINKEEALQR
LQTVHSIPYTIVKNEAVQR

SEQ ID NO: 37693 - protein, 19 aa, synthetic construct
  source 1..19: note = Seed: LQTVHSIPLTINKEEALQR
LQTVHSIPYTIVKPEAAQR

SEQ ID NO: 37694 - protein, 19 aa, synthetic construct
  source 1..19: note = Seed: LQTVHSIPLTINKEEALQR
LQTVHSIPYTIVKPEAIQR

SEQ ID NO: 37695 - protein, 19 aa, synthetic construct
  source 1..19: note = Seed: LQTVHSIPLTINKEEALQR
LQTVHSIPYTIVKPEALQR

SEQ ID NO: 37696 - protein, 19 aa, synthetic construct
  source 1..19: note = Seed: LQTVHSIPLTINKEEALQR
LQTVHSIPYTIVKPEAVQR

SEQ ID NO: 37697 - protein, 19 aa, synthetic construct
  source 1..19: note = Seed: LQTVHSIPLTINKEEALQR
LQTVHSIPYTIVKSEAAQR

SEQ ID NO: 37698 - protein, 19 aa, synthetic construct
  source 1..19: note = Seed: LQTVHSIPLTINKEEALQR
LQTVHSIPYTIVKSEAFQR

SEQ ID NO: 37699 - protein, 19 aa, synthetic construct
  source 1..19: note = Seed: LQTVHSIPLTINKEEALQR
LQTVHSIPYTIVKSEAIQR

SEQ ID NO: 37700 - protein, 19 aa, synthetic construct
  source 1..19: note = Seed: LQTVHSIPLTINKEEALQR
LQTVHSIPYTIVKSEALQR

SEQ ID NO: 37701 - protein, 19 aa, synthetic construct
  source 1..19: note = Seed: LQTVHSIPLTINKEEALQR
LQTVHSIPYTIVKSEAMQR

SEQ ID NO: 37702 - protein, 19 aa, synthetic construct
  source 1..19: note = Seed: LQTVHSIPLTINKEEALQR
LQTVHSIPYTIVKSEATQR

SEQ ID NO: 37703 - protein, 19 aa, synthetic construct
  source 1..19: note = Seed: LQTVHSIPLTINKEEALQR
LQTVHSIPYTIVKSEAVQR

SEQ ID NO: 37704 - protein, 19 aa, synthetic construct
  source 1..19: note = Seed: LQTVHSIPLTINKEEALQR
LQTVHSIPYTIVKTEAAQR

SEQ ID NO: 37705 - protein, 19 aa, synthetic construct
  source 1..19: note = Seed: LQTVHSIPLTINKEEALQR
LQTVHSIPYTIVKTEAIQR

SEQ ID NO: 37706 - protein, 19 aa, synthetic construct
  source 1..19: note = Seed: LQTVHSIPLTINKEEALQR
LQTVHSIPYTIVKTEALQR

SEQ ID NO: 37707 - protein, 19 aa, synthetic construct
  source 1..19: note = Seed: LQTVHSIPLTINKEEALQR
LQTVHSIPYTIVKTEAVQR

SEQ ID NO: 37708 - protein, 19 aa, synthetic construct
  source 1..19: note = Seed: LQTVHSIPLTINKEEALQR
LQTVHSIPYTIVKWEAIQR

SEQ ID NO: 37709 - protein, 19 aa, synthetic construct
  source 1..19: note = Seed: LQTVHSIPLTINKEEALQR
LQTVHSIPYTIVKWEALQR

SEQ ID NO: 37710 - protein, 19 aa, synthetic construct
  source 1..19: note = Seed: LQTVHSIPLTINKEEALQR
LQTVHSIPYTIVKWEAMQR

SEQ ID NO: 37711 - protein, 19 aa, synthetic construct
  source 1..19: note = Seed: LQTVHSIPLTINKEEALQR
LQTVHSIPYTIVKWEAVQR

SEQ ID NO: 37712 - protein, 19 aa, synthetic construct
  source 1..19: note = Seed: LQTVHSIPLTINKEEALQR
LQTVHSIPYTIVKYEAFQR

SEQ ID NO: 37713 - protein, 19 aa, synthetic construct
  source 1..19: note = Seed: LQTVHSIPLTINKEEALQR
LQTVHSIPYTIVKYEAIQR

SEQ ID NO: 37714 - protein, 19 aa, synthetic construct
  source 1..19: note = Seed: LQTVHSIPLTINKEEALQR
LQTVHSIPYTIVKYEALQR

SEQ ID NO: 37715 - protein, 19 aa, synthetic construct
  source 1..19: note = Seed: LQTVHSIPLTINKEEALQR
LQTVHSIPYTIVKYEAMQR

SEQ ID NO: 37716 - protein, 19 aa, synthetic construct
  source 1..19: note = Seed: LQTVHSIPLTINKEEALQR
LQTVHSIPYTIVKYEAVQR

SEQ ID NO: 37717 - protein, 19 aa, synthetic construct
  source 1..19: note = Seed: LQTVHSIPLTINKEEALQR
LQTVHSIPYTIWKFEAFQR

SEQ ID NO: 37718 - protein, 19 aa, synthetic construct
  source 1..19: note = Seed: LQTVHSIPLTINKEEALQR
LQTVHSIPYTIWKFEAIQR

SEQ ID NO: 37719 - protein, 19 aa, synthetic construct
  source 1..19: note = Seed: LQTVHSIPLTINKEEALQR
LQTVHSIPYTIWKFEALQR

SEQ ID NO: 37720 - protein, 19 aa, synthetic construct
  source 1..19: note = Seed: LQTVHSIPLTINKEEALQR
LQTVHSIPYTIWKFEAMQR

SEQ ID NO: 37721 - protein, 19 aa, synthetic construct
  source 1..19: note = Seed: LQTVHSIPLTINKEEALQR
LQTVHSIPYTIWKFEAVQR

SEQ ID NO: 37722 - protein, 19 aa, synthetic construct
  source 1..19: note = Seed: LQTVHSIPLTINKEEALQR
LQTVHSIPYTIYKFEAFQR

SEQ ID NO: 37723 - protein, 19 aa, synthetic construct
  source 1..19: note = Seed: LQTVHSIPLTINKEEALQR
LQTVHSIPYTIYKFEAIQR

SEQ ID NO: 37724 - protein, 19 aa, synthetic construct
  source 1..19: note = Seed: LQTVHSIPLTINKEEALQR
LQTVHSIPYTIYKFEALQR

SEQ ID NO: 37725 - protein, 19 aa, synthetic construct
  source 1..19: note = Seed: LQTVHSIPLTINKEEALQR
LQTVHSIPYTIYKFEAMQR

SEQ ID NO: 37726 - protein, 19 aa, synthetic construct
  source 1..19: note = Seed: LQTVHSIPLTINKEEALQR
LQTVHSIPYTIYKFEAVQR

SEQ ID NO: 37727 - protein, 19 aa, synthetic construct
  source 1..19: note = Seed: LQTVHSIPLTINKEEALQR
LQTVHSIPYTIYKIEALQR

SEQ ID NO: 37728 - protein, 19 aa, synthetic construct
  source 1..19: note = Seed: LQTVHSIPLTINKEEALQR
LQTVHSIPYTIYKLEAIQR

SEQ ID NO: 37729 - protein, 19 aa, synthetic construct
  source 1..19: note = Seed: LQTVHSIPLTINKEEALQR
LQTVHSIPYTIYKLEALQR

SEQ ID NO: 37730 - protein, 19 aa, synthetic construct
  source 1..19: note = Seed: LQTVHSIPLTINKEEALQR
LQTVHSIPYTIYKLEAVQR

SEQ ID NO: 37731 - protein, 25 aa, synthetic construct
  source 1..25: note = Seed: NSCVKLQTVHSIPLTINKEEALQRP
NSCVKLQTVHSIPLTINKAEALQRP

SEQ ID NO: 37732 - protein, 25 aa, synthetic construct
  source 1..25: note = Seed: NSCVKLQTVHSIPLTINKEEALQRP
NSCVKLQTVHSIPLTINKDEALQRP

SEQ ID NO: 37733 - protein, 25 aa, synthetic construct
  source 1..25: note = Seed: NSCVKLQTVHSIPLTINKEEALQRP
NSCVKLQTVHSIPLTINKDEKLQYP

SEQ ID NO: 37734 - protein, 25 aa, synthetic construct
  source 1..25: note = Seed: NSCVKLQTVHSIPLTINKEEALQRP
NSCVKLQTVHSIPLTINKDERLQYP

SEQ ID NO: 37735 - protein, 25 aa, synthetic construct
  source 1..25: note = Seed: NSCVKLQTVHSIPLTINKEEALQRP
NSCVKLQTVHSIPLTINKFEALQRP

SEQ ID NO: 37736 - protein, 25 aa, synthetic construct
  source 1..25: note = Seed: NSCVKLQTVHSIPLTINKEEALQRP
NSCVKLQTVHSIPLTINKGEALQRP

SEQ ID NO: 37737 - protein, 25 aa, synthetic construct
  source 1..25: note = Seed: NSCVKLQTVHSIPLTINKEEALQRP
NSCVKLQTVHSIPLTINKHEALQRP

SEQ ID NO: 37738 - protein, 25 aa, synthetic construct
  source 1..25: note = Seed: NSCVKLQTVHSIPLTINKEEALQRP
NSCVKLQTVHSIPLTINKIEALQRP

SEQ ID NO: 37739 - protein, 25 aa, synthetic construct
  source 1..25: note = Seed: NSCVKLQTVHSIPLTINKEEALQRP
NSCVKLQTVHSIPLTINKLEALQRP

SEQ ID NO: 37740 - protein, 25 aa, synthetic construct
  source 1..25: note = Seed: NSCVKLQTVHSIPLTINKEEALQRP
NSCVKLQTVHSIPLTINKMEALQRP

SEQ ID NO: 37741 - protein, 25 aa, synthetic construct
  source 1..25: note = Seed: NSCVKLQTVHSIPLTINKEEALQRP
NSCVKLQTVHSIPLTINKNEALQRP

SEQ ID NO: 37742 - protein, 25 aa, synthetic construct
  source 1..25: note = Seed: NSCVKLQTVHSIPLTINKEEALQRP
NSCVKLQTVHSIPLTINKPEALQRP

SEQ ID NO: 37743 - protein, 25 aa, synthetic construct
  source 1..25: note = Seed: NSCVKLQTVHSIPLTINKEEALQRP
NSCVKLQTVHSIPLTINKSEALQRP

SEQ ID NO: 37744 - protein, 25 aa, synthetic construct
  source 1..25: note = Seed: NSCVKLQTVHSIPLTINKEEALQRP
NSCVKLQTVHSIPLTINKTEALQRP

SEQ ID NO: 37745 - protein, 25 aa, synthetic construct
  source 1..25: note = Seed: NSCVKLQTVHSIPLTINKEEALQRP
NSCVKLQTVHSIPLTINKVEALQRP

SEQ ID NO: 37746 - protein, 25 aa, synthetic construct
  source 1..25: note = Seed: NSCVKLQTVHSIPLTINKEEALQRP
NSCVKLQTVHSIPATIFKAEAIQRP

SEQ ID NO: 37747 - protein, 25 aa, synthetic construct
  source 1..25: note = Seed: NSCVKLQTVHSIPLTINKEEALQRP
NSCVKLQTVHSIPATIFKAEALQRP

SEQ ID NO: 37748 - protein, 25 aa, synthetic construct
  source 1..25: note = Seed: NSCVKLQTVHSIPLTINKEEALQRP
NSCVKLQTVHSIPATIFKAEAVQRP

SEQ ID NO: 37749 - protein, 25 aa, synthetic construct
  source 1..25: note = Seed: NSCVKLQTVHSIPLTINKEEALQRP
NSCVKLQTVHSIPATIFKDEAAQRP

SEQ ID NO: 37750 - protein, 25 aa, synthetic construct
  source 1..25: note = Seed: NSCVKLQTVHSIPLTINKEEALQRP
NSCVKLQTVHSIPATIFKDEAIQRP

SEQ ID NO: 37751 - protein, 25 aa, synthetic construct
  source 1..25: note = Seed: NSCVKLQTVHSIPLTINKEEALQRP
NSCVKLQTVHSIPATIFKDEALQRP

SEQ ID NO: 37752 - protein, 25 aa, synthetic construct
  source 1..25: note = Seed: NSCVKLQTVHSIPLTINKEEALQRP
NSCVKLQTVHSIPATIFKDEAVQRP

SEQ ID NO: 37753 - protein, 25 aa, synthetic construct
  source 1..25: note = Seed: NSCVKLQTVHSIPLTINKEEALQRP
NSCVKLQTVHSIPATIFKFEAFQRP

SEQ ID NO: 37754 - protein, 25 aa, synthetic construct
  source 1..25: note = Seed: NSCVKLQTVHSIPLTINKEEALQRP
NSCVKLQTVHSIPATIFKFEALQRP

SEQ ID NO: 37755 - protein, 25 aa, synthetic construct
  source 1..25: note = Seed: NSCVKLQTVHSIPLTINKEEALQRP
NSCVKLQTVHSIPATIFKIEAAQRP

SEQ ID NO: 37756 - protein, 25 aa, synthetic construct
  source 1..25: note = Seed: NSCVKLQTVHSIPLTINKEEALQRP
NSCVKLQTVHSIPATIFKIEAIQRP

SEQ ID NO: 37757 - protein, 25 aa, synthetic construct
  source 1..25: note = Seed: NSCVKLQTVHSIPLTINKEEALQRP
NSCVKLQTVHSIPATIFKIEAMQRP

SEQ ID NO: 37758 - protein, 25 aa, synthetic construct
  source 1..25: note = Seed: NSCVKLQTVHSIPLTINKEEALQRP
NSCVKLQTVHSIPATIFKIEASQRP

SEQ ID NO: 37759 - protein, 25 aa, synthetic construct
  source 1..25: note = Seed: NSCVKLQTVHSIPLTINKEEALQRP
NSCVKLQTVHSIPATIFKIEATQRP

SEQ ID NO: 37760 - protein, 25 aa, synthetic construct
  source 1..25: note = Seed: NSCVKLQTVHSIPLTINKEEALQRP
NSCVKLQTVHSIPATIFKIEAVQRP

SEQ ID NO: 37761 - protein, 25 aa, synthetic construct
  source 1..25: note = Seed: NSCVKLQTVHSIPLTINKEEALQRP
NSCVKLQTVHSIPATIFKIEAYQRP

SEQ ID NO: 37762 - protein, 25 aa, synthetic construct
  source 1..25: note = Seed: NSCVKLQTVHSIPLTINKEEALQRP
NSCVKLQTVHSIPATIFKLEAAQRP

SEQ ID NO: 37763 - protein, 25 aa, synthetic construct
  source 1..25: note = Seed: NSCVKLQTVHSIPLTINKEEALQRP
NSCVKLQTVHSIPATIFKLEASQRP

SEQ ID NO: 37764 - protein, 25 aa, synthetic construct
  source 1..25: note = Seed: NSCVKLQTVHSIPLTINKEEALQRP
NSCVKLQTVHSIPATIFKLEAVQRP

SEQ ID NO: 37765 - protein, 25 aa, synthetic construct
  source 1..25: note = Seed: NSCVKLQTVHSIPLTINKEEALQRP
NSCVKLQTVHSIPATIFKMEAAQRP

SEQ ID NO: 37766 - protein, 25 aa, synthetic construct
  source 1..25: note = Seed: NSCVKLQTVHSIPLTINKEEALQRP
NSCVKLQTVHSIPATIFKVEAAQRP

SEQ ID NO: 37767 - protein, 25 aa, synthetic construct
  source 1..25: note = Seed: NSCVKLQTVHSIPLTINKEEALQRP
NSCVKLQTVHSIPATIFKVEAIQRP

SEQ ID NO: 37768 - protein, 25 aa, synthetic construct
  source 1..25: note = Seed: NSCVKLQTVHSIPLTINKEEALQRP
NSCVKLQTVHSIPATIFKVEALQRP

SEQ ID NO: 37769 - protein, 25 aa, synthetic construct
  source 1..25: note = Seed: NSCVKLQTVHSIPLTINKEEALQRP
NSCVKLQTVHSIPATIFKVEAMQRP

SEQ ID NO: 37770 - protein, 25 aa, synthetic construct
  source 1..25: note = Seed: NSCVKLQTVHSIPLTINKEEALQRP
NSCVKLQTVHSIPATIFKVEAVQRP

SEQ ID NO: 37771 - protein, 25 aa, synthetic construct
  source 1..25: note = Seed: NSCVKLQTVHSIPLTINKEEALQRP
NSCVKLQTVHSIPATILKFEAFQRP

SEQ ID NO: 37772 - protein, 25 aa, synthetic construct
  source 1..25: note = Seed: NSCVKLQTVHSIPLTINKEEALQRP
NSCVKLQTVHSIPATIYKDEAIQRP

SEQ ID NO: 37773 - protein, 25 aa, synthetic construct
  source 1..25: note = Seed: NSCVKLQTVHSIPLTINKEEALQRP
NSCVKLQTVHSIPATIYKDEALQRP

SEQ ID NO: 37774 - protein, 25 aa, synthetic construct
  source 1..25: note = Seed: NSCVKLQTVHSIPLTINKEEALQRP
NSCVKLQTVHSIPATIYKIEAAQRP

SEQ ID NO: 37775 - protein, 25 aa, synthetic construct
  source 1..25: note = Seed: NSCVKLQTVHSIPLTINKEEALQRP
NSCVKLQTVHSIPATIYKIEAIQRP

SEQ ID NO: 37776 - protein, 25 aa, synthetic construct
  source 1..25: note = Seed: NSCVKLQTVHSIPLTINKEEALQRP
NSCVKLQTVHSIPATIYKIEALQRP

SEQ ID NO: 37777 - protein, 25 aa, synthetic construct
  source 1..25: note = Seed: NSCVKLQTVHSIPLTINKEEALQRP
NSCVKLQTVHSIPATIYKIEAVQRP

SEQ ID NO: 37778 - protein, 25 aa, synthetic construct
  source 1..25: note = Seed: NSCVKLQTVHSIPLTINKEEALQRP
NSCVKLQTVHSIPATIYKLEAAQRP

SEQ ID NO: 37779 - protein, 25 aa, synthetic construct
  source 1..25: note = Seed: NSCVKLQTVHSIPLTINKEEALQRP
NSCVKLQTVHSIPCTIFKFEAFQRP

SEQ ID NO: 37780 - protein, 25 aa, synthetic construct
  source 1..25: note = Seed: NSCVKLQTVHSIPLTINKEEALQRP
NSCVKLQTVHSIPCTIFKFEAIQRP

SEQ ID NO: 37781 - protein, 25 aa, synthetic construct
  source 1..25: note = Seed: NSCVKLQTVHSIPLTINKEEALQRP
NSCVKLQTVHSIPCTIFKFEALQRP

SEQ ID NO: 37782 - protein, 25 aa, synthetic construct
  source 1..25: note = Seed: NSCVKLQTVHSIPLTINKEEALQRP
NSCVKLQTVHSIPCTIFKFEAVQRP

SEQ ID NO: 37783 - protein, 25 aa, synthetic construct
  source 1..25: note = Seed: NSCVKLQTVHSIPLTINKEEALQRP
NSCVKLQTVHSIPCTIIKFEAFQRP

SEQ ID NO: 37784 - protein, 25 aa, synthetic construct
  source 1..25: note = Seed: NSCVKLQTVHSIPLTINKEEALQRP
NSCVKLQTVHSIPCTIIKFEAIQRP

SEQ ID NO: 37785 - protein, 25 aa, synthetic construct
  source 1..25: note = Seed: NSCVKLQTVHSIPLTINKEEALQRP
NSCVKLQTVHSIPCTIIKFEALQRP

SEQ ID NO: 37786 - protein, 25 aa, synthetic construct
  source 1..25: note = Seed: NSCVKLQTVHSIPLTINKEEALQRP
NSCVKLQTVHSIPCTIIKFEAVQRP

SEQ ID NO: 37787 - protein, 25 aa, synthetic construct
  source 1..25: note = Seed: NSCVKLQTVHSIPLTINKEEALQRP
NSCVKLQTVHSIPCTILKFEAFQRP

SEQ ID NO: 37788 - protein, 25 aa, synthetic construct
  source 1..25: note = Seed: NSCVKLQTVHSIPLTINKEEALQRP
NSCVKLQTVHSIPCTILKFEAIQRP

SEQ ID NO: 37789 - protein, 25 aa, synthetic construct
  source 1..25: note = Seed: NSCVKLQTVHSIPLTINKEEALQRP
NSCVKLQTVHSIPCTILKFEALQRP

SEQ ID NO: 37790 - protein, 25 aa, synthetic construct
  source 1..25: note = Seed: NSCVKLQTVHSIPLTINKEEALQRP
NSCVKLQTVHSIPCTILKFEAVQRP

SEQ ID NO: 37791 - protein, 25 aa, synthetic construct
  source 1..25: note = Seed: NSCVKLQTVHSIPLTINKEEALQRP
NSCVKLQTVHSIPCTIMKFEALQRP

SEQ ID NO: 37792 - protein, 25 aa, synthetic construct
  source 1..25: note = Seed: NSCVKLQTVHSIPLTINKEEALQRP
NSCVKLQTVHSIPCTITKFEAIQRP

SEQ ID NO: 37793 - protein, 25 aa, synthetic construct
  source 1..25: note = Seed: NSCVKLQTVHSIPLTINKEEALQRP
NSCVKLQTVHSIPCTITKFEALQRP

SEQ ID NO: 37794 - protein, 25 aa, synthetic construct
  source 1..25: note = Seed: NSCVKLQTVHSIPLTINKEEALQRP
NSCVKLQTVHSIPCTIVKFEAIQRP

SEQ ID NO: 37795 - protein, 25 aa, synthetic construct
  source 1..25: note = Seed: NSCVKLQTVHSIPLTINKEEALQRP
NSCVKLQTVHSIPCTIVKFEALQRP

SEQ ID NO: 37796 - protein, 25 aa, synthetic construct
  source 1..25: note = Seed: NSCVKLQTVHSIPLTINKEEALQRP
NSCVKLQTVHSIPCTIVKFEAVQRP

SEQ ID NO: 37797 - protein, 25 aa, synthetic construct
  source 1..25: note = Seed: NSCVKLQTVHSIPLTINKEEALQRP
NSCVKLQTVHSIPETIFKFEAFQRP

SEQ ID NO: 37798 - protein, 25 aa, synthetic construct
  source 1..25: note = Seed: NSCVKLQTVHSIPLTINKEEALQRP
NSCVKLQTVHSIPFTIAKAEAFQRP

SEQ ID NO: 37799 - protein, 25 aa, synthetic construct
  source 1..25: note = Seed: NSCVKLQTVHSIPLTINKEEALQRP
NSCVKLQTVHSIPFTIAKAEAIQRP

SEQ ID NO: 37800 - protein, 25 aa, synthetic construct
  source 1..25: note = Seed: NSCVKLQTVHSIPLTINKEEALQRP
NSCVKLQTVHSIPFTIAKAEALQRP

SEQ ID NO: 37801 - protein, 25 aa, synthetic construct
  source 1..25: note = Seed: NSCVKLQTVHSIPLTINKEEALQRP
NSCVKLQTVHSIPFTIAKAEAVQRP

SEQ ID NO: 37802 - protein, 25 aa, synthetic construct
  source 1..25: note = Seed: NSCVKLQTVHSIPLTINKEEALQRP
NSCVKLQTVHSIPFTIAKFEAAQRP

SEQ ID NO: 37803 - protein, 25 aa, synthetic construct
  source 1..25: note = Seed: NSCVKLQTVHSIPLTINKEEALQRP
NSCVKLQTVHSIPFTIAKFEACQRP

SEQ ID NO: 37804 - protein, 25 aa, synthetic construct
  source 1..25: note = Seed: NSCVKLQTVHSIPLTINKEEALQRP
NSCVKLQTVHSIPFTIAKFEADQRP

SEQ ID NO: 37805 - protein, 25 aa, synthetic construct
  source 1..25: note = Seed: NSCVKLQTVHSIPLTINKEEALQRP
NSCVKLQTVHSIPFTIAKFEAEQRP

SEQ ID NO: 37806 - protein, 25 aa, synthetic construct
  source 1..25: note = Seed: NSCVKLQTVHSIPLTINKEEALQRP
NSCVKLQTVHSIPFTIAKFEAFQRP

SEQ ID NO: 37807 - protein, 25 aa, synthetic construct
  source 1..25: note = Seed: NSCVKLQTVHSIPLTINKEEALQRP
NSCVKLQTVHSIPFTIAKFEAGQRP

SEQ ID NO: 37808 - protein, 25 aa, synthetic construct
  source 1..25: note = Seed: NSCVKLQTVHSIPLTINKEEALQRP
NSCVKLQTVHSIPFTIAKFEAHQRP

SEQ ID NO: 37809 - protein, 25 aa, synthetic construct
  source 1..25: note = Seed: NSCVKLQTVHSIPLTINKEEALQRP
NSCVKLQTVHSIPFTIAKFEAIQRP

SEQ ID NO: 37810 - protein, 25 aa, synthetic construct
  source 1..25: note = Seed: NSCVKLQTVHSIPLTINKEEALQRP
NSCVKLQTVHSIPFTIAKFEAKQRP

SEQ ID NO: 37811 - protein, 25 aa, synthetic construct
  source 1..25: note = Seed: NSCVKLQTVHSIPLTINKEEALQRP
NSCVKLQTVHSIPFTIAKFEALQRP

SEQ ID NO: 37812 - protein, 25 aa, synthetic construct
  source 1..25: note = Seed: NSCVKLQTVHSIPLTINKEEALQRP
NSCVKLQTVHSIPFTIAKFEAMQRP

SEQ ID NO: 37813 - protein, 25 aa, synthetic construct
  source 1..25: note = Seed: NSCVKLQTVHSIPLTINKEEALQRP
NSCVKLQTVHSIPFTIAKFEANQRP

SEQ ID NO: 37814 - protein, 25 aa, synthetic construct
  source 1..25: note = Seed: NSCVKLQTVHSIPLTINKEEALQRP
NSCVKLQTVHSIPFTIAKFEAPQRP

SEQ ID NO: 37815 - protein, 25 aa, synthetic construct
  source 1..25: note = Seed: NSCVKLQTVHSIPLTINKEEALQRP
NSCVKLQTVHSIPFTIAKFEAQQRP

SEQ ID NO: 37816 - protein, 25 aa, synthetic construct
  source 1..25: note = Seed: NSCVKLQTVHSIPLTINKEEALQRP
NSCVKLQTVHSIPFTIAKFEARQRP

SEQ ID NO: 37817 - protein, 25 aa, synthetic construct
  source 1..25: note = Seed: NSCVKLQTVHSIPLTINKEEALQRP
NSCVKLQTVHSIPFTIAKFEASQRP

SEQ ID NO: 37818 - protein, 25 aa, synthetic construct
  source 1..25: note = Seed: NSCVKLQTVHSIPLTINKEEALQRP
NSCVKLQTVHSIPFTIAKFEATQRP

SEQ ID NO: 37819 - protein, 25 aa, synthetic construct
  source 1..25: note = Seed: NSCVKLQTVHSIPLTINKEEALQRP
NSCVKLQTVHSIPFTIAKFEAVQRP

SEQ ID NO: 37820 - protein, 25 aa, synthetic construct
  source 1..25: note = Seed: NSCVKLQTVHSIPLTINKEEALQRP
NSCVKLQTVHSIPFTIAKFEAWQRP

SEQ ID NO: 37821 - protein, 25 aa, synthetic construct
  source 1..25: note = Seed: NSCVKLQTVHSIPLTINKEEALQRP
NSCVKLQTVHSIPFTIAKFEAYQRP

SEQ ID NO: 37822 - protein, 25 aa, synthetic construct
  source 1..25: note = Seed: NSCVKLQTVHSIPLTINKEEALQRP
NSCVKLQTVHSIPFTIAKIEAAQRP

SEQ ID NO: 37823 - protein, 25 aa, synthetic construct
  source 1..25: note = Seed: NSCVKLQTVHSIPLTINKEEALQRP
NSCVKLQTVHSIPFTIAKIEAFQRP

SEQ ID NO: 37824 - protein, 25 aa, synthetic construct
  source 1..25: note = Seed: NSCVKLQTVHSIPLTINKEEALQRP
NSCVKLQTVHSIPFTIAKIEAIQRP

SEQ ID NO: 37825 - protein, 25 aa, synthetic construct
  source 1..25: note = Seed: NSCVKLQTVHSIPLTINKEEALQRP
NSCVKLQTVHSIPFTIAKIEALQRP

SEQ ID NO: 37826 - protein, 25 aa, synthetic construct
  source 1..25: note = Seed: NSCVKLQTVHSIPLTINKEEALQRP
NSCVKLQTVHSIPFTIAKIEAMQRP

SEQ ID NO: 37827 - protein, 25 aa, synthetic construct
  source 1..25: note = Seed: NSCVKLQTVHSIPLTINKEEALQRP
NSCVKLQTVHSIPFTIAKIEAVQRP

SEQ ID NO: 37828 - protein, 25 aa, synthetic construct
  source 1..25: note = Seed: NSCVKLQTVHSIPLTINKEEALQRP
NSCVKLQTVHSIPFTIAKLEAAQRP

SEQ ID NO: 37829 - protein, 25 aa, synthetic construct
  source 1..25: note = Seed: NSCVKLQTVHSIPLTINKEEALQRP
NSCVKLQTVHSIPFTIAKLEADQRP

SEQ ID NO: 37830 - protein, 25 aa, synthetic construct
  source 1..25: note = Seed: NSCVKLQTVHSIPLTINKEEALQRP
NSCVKLQTVHSIPFTIAKLEAFQRP

SEQ ID NO: 37831 - protein, 25 aa, synthetic construct
  source 1..25: note = Seed: NSCVKLQTVHSIPLTINKEEALQRP
NSCVKLQTVHSIPFTIAKLEAIQRP

SEQ ID NO: 37832 - protein, 25 aa, synthetic construct
  source 1..25: note = Seed: NSCVKLQTVHSIPLTINKEEALQRP
NSCVKLQTVHSIPFTIAKLEALQRP

SEQ ID NO: 37833 - protein, 25 aa, synthetic construct
  source 1..25: note = Seed: NSCVKLQTVHSIPLTINKEEALQRP
NSCVKLQTVHSIPFTIAKLEAMQRP

SEQ ID NO: 37834 - protein, 25 aa, synthetic construct
  source 1..25: note = Seed: NSCVKLQTVHSIPLTINKEEALQRP
NSCVKLQTVHSIPFTIAKLEANQRP

SEQ ID NO: 37835 - protein, 25 aa, synthetic construct
  source 1..25: note = Seed: NSCVKLQTVHSIPLTINKEEALQRP
NSCVKLQTVHSIPFTIAKLEASQRP

SEQ ID NO: 37836 - protein, 25 aa, synthetic construct
  source 1..25: note = Seed: NSCVKLQTVHSIPLTINKEEALQRP
NSCVKLQTVHSIPFTIAKLEATQRP

SEQ ID NO: 37837 - protein, 25 aa, synthetic construct
  source 1..25: note = Seed: NSCVKLQTVHSIPLTINKEEALQRP
NSCVKLQTVHSIPFTIAKLEAVQRP

SEQ ID NO: 37838 - protein, 25 aa, synthetic construct
  source 1..25: note = Seed: NSCVKLQTVHSIPLTINKEEALQRP
NSCVKLQTVHSIPFTIAKLEAYQRP

SEQ ID NO: 37839 - protein, 25 aa, synthetic construct
  source 1..25: note = Seed: NSCVKLQTVHSIPLTINKEEALQRP
NSCVKLQTVHSIPFTIAKMEAFQRP

SEQ ID NO: 37840 - protein, 25 aa, synthetic construct
  source 1..25: note = Seed: NSCVKLQTVHSIPLTINKEEALQRP
NSCVKLQTVHSIPFTIAKMEAIQRP

SEQ ID NO: 37841 - protein, 25 aa, synthetic construct
  source 1..25: note = Seed: NSCVKLQTVHSIPLTINKEEALQRP
NSCVKLQTVHSIPFTIAKMEALQRP

SEQ ID NO: 37842 - protein, 25 aa, synthetic construct
  source 1..25: note = Seed: NSCVKLQTVHSIPLTINKEEALQRP
NSCVKLQTVHSIPFTIAKMEAMQRP

SEQ ID NO: 37843 - protein, 25 aa, synthetic construct
  source 1..25: note = Seed: NSCVKLQTVHSIPLTINKEEALQRP
NSCVKLQTVHSIPFTIAKMEAVQRP

SEQ ID NO: 37844 - protein, 25 aa, synthetic construct
  source 1..25: note = Seed: NSCVKLQTVHSIPLTINKEEALQRP
NSCVKLQTVHSIPFTIAKNEAAQRP

SEQ ID NO: 37845 - protein, 25 aa, synthetic construct
  source 1..25: note = Seed: NSCVKLQTVHSIPLTINKEEALQRP
NSCVKLQTVHSIPFTIAKNEADQRP

SEQ ID NO: 37846 - protein, 25 aa, synthetic construct
  source 1..25: note = Seed: NSCVKLQTVHSIPLTINKEEALQRP
NSCVKLQTVHSIPFTIAKNEAEQRP

SEQ ID NO: 37847 - protein, 25 aa, synthetic construct
  source 1..25: note = Seed: NSCVKLQTVHSIPLTINKEEALQRP
NSCVKLQTVHSIPFTIAKNEAGQRP

SEQ ID NO: 37848 - protein, 25 aa, synthetic construct
  source 1..25: note = Seed: NSCVKLQTVHSIPLTINKEEALQRP
NSCVKLQTVHSIPFTIAKNEAIQRP

SEQ ID NO: 37849 - protein, 25 aa, synthetic construct
  source 1..25: note = Seed: NSCVKLQTVHSIPLTINKEEALQRP
NSCVKLQTVHSIPFTIAKNEAMQRP

SEQ ID NO: 37850 - protein, 25 aa, synthetic construct
  source 1..25: note = Seed: NSCVKLQTVHSIPLTINKEEALQRP
NSCVKLQTVHSIPFTIAKNEANQRP

SEQ ID NO: 37851 - protein, 25 aa, synthetic construct
  source 1..25: note = Seed: NSCVKLQTVHSIPLTINKEEALQRP
NSCVKLQTVHSIPFTIAKNEAQQRP

SEQ ID NO: 37852 - protein, 25 aa, synthetic construct
  source 1..25: note = Seed: NSCVKLQTVHSIPLTINKEEALQRP
NSCVKLQTVHSIPFTIAKNEASQRP

SEQ ID NO: 37853 - protein, 25 aa, synthetic construct
  source 1..25: note = Seed: NSCVKLQTVHSIPLTINKEEALQRP
NSCVKLQTVHSIPFTIAKNEATQRP

SEQ ID NO: 37854 - protein, 25 aa, synthetic construct
  source 1..25: note = Seed: NSCVKLQTVHSIPLTINKEEALQRP
NSCVKLQTVHSIPFTIAKNEAVQRP

SEQ ID NO: 37855 - protein, 25 aa, synthetic construct
  source 1..25: note = Seed: NSCVKLQTVHSIPLTINKEEALQRP
NSCVKLQTVHSIPFTIAKSEAAQRP

SEQ ID NO: 37856 - protein, 25 aa, synthetic construct
  source 1..25: note = Seed: NSCVKLQTVHSIPLTINKEEALQRP
NSCVKLQTVHSIPFTIAKSEADQRP

SEQ ID NO: 37857 - protein, 25 aa, synthetic construct
  source 1..25: note = Seed: NSCVKLQTVHSIPLTINKEEALQRP
NSCVKLQTVHSIPFTIAKSEAGQRP

SEQ ID NO: 37858 - protein, 25 aa, synthetic construct
  source 1..25: note = Seed: NSCVKLQTVHSIPLTINKEEALQRP
NSCVKLQTVHSIPFTIAKSEASQRP

SEQ ID NO: 37859 - protein, 25 aa, synthetic construct
  source 1..25: note = Seed: NSCVKLQTVHSIPLTINKEEALQRP
NSCVKLQTVHSIPFTIAKSEATQRP

SEQ ID NO: 37860 - protein, 25 aa, synthetic construct
  source 1..25: note = Seed: NSCVKLQTVHSIPLTINKEEALQRP
NSCVKLQTVHSIPFTIAKTEAAQRP

SEQ ID NO: 37861 - protein, 25 aa, synthetic construct
  source 1..25: note = Seed: NSCVKLQTVHSIPLTINKEEALQRP
NSCVKLQTVHSIPFTIAKTEAGQRP

SEQ ID NO: 37862 - protein, 25 aa, synthetic construct
  source 1..25: note = Seed: NSCVKLQTVHSIPLTINKEEALQRP
NSCVKLQTVHSIPFTIAKTEAHQRP

SEQ ID NO: 37863 - protein, 25 aa, synthetic construct
  source 1..25: note = Seed: NSCVKLQTVHSIPLTINKEEALQRP
NSCVKLQTVHSIPFTIAKTEAMQRP

SEQ ID NO: 37864 - protein, 25 aa, synthetic construct
  source 1..25: note = Seed: NSCVKLQTVHSIPLTINKEEALQRP
NSCVKLQTVHSIPFTIAKTEAQQRP

SEQ ID NO: 37865 - protein, 25 aa, synthetic construct
  source 1..25: note = Seed: NSCVKLQTVHSIPLTINKEEALQRP
NSCVKLQTVHSIPFTIAKTEASQRP

SEQ ID NO: 37866 - protein, 25 aa, synthetic construct
  source 1..25: note = Seed: NSCVKLQTVHSIPLTINKEEALQRP
NSCVKLQTVHSIPFTIAKTEATQRP

SEQ ID NO: 37867 - protein, 25 aa, synthetic construct
  source 1..25: note = Seed: NSCVKLQTVHSIPLTINKEEALQRP
NSCVKLQTVHSIPFTIAKTEAVQRP

SEQ ID NO: 37868 - protein, 25 aa, synthetic construct
  source 1..25: note = Seed: NSCVKLQTVHSIPLTINKEEALQRP
NSCVKLQTVHSIPFTIAKVEAAQRP

SEQ ID NO: 37869 - protein, 25 aa, synthetic construct
  source 1..25: note = Seed: NSCVKLQTVHSIPLTINKEEALQRP
NSCVKLQTVHSIPFTIAKVEAIQRP

SEQ ID NO: 37870 - protein, 25 aa, synthetic construct
  source 1..25: note = Seed: NSCVKLQTVHSIPLTINKEEALQRP
NSCVKLQTVHSIPFTIAKVEALQRP

SEQ ID NO: 37871 - protein, 25 aa, synthetic construct
  source 1..25: note = Seed: NSCVKLQTVHSIPLTINKEEALQRP
NSCVKLQTVHSIPFTIAKVEASQRP

SEQ ID NO: 37872 - protein, 25 aa, synthetic construct
  source 1..25: note = Seed: NSCVKLQTVHSIPLTINKEEALQRP
NSCVKLQTVHSIPFTIAKVEAVQRP

SEQ ID NO: 37873 - protein, 25 aa, synthetic construct
  source 1..25: note = Seed: NSCVKLQTVHSIPLTINKEEALQRP
NSCVKLQTVHSIPFTIAKWEAAQRP

SEQ ID NO: 37874 - protein, 25 aa, synthetic construct
  source 1..25: note = Seed: NSCVKLQTVHSIPLTINKEEALQRP
NSCVKLQTVHSIPFTIAKWEADQRP

SEQ ID NO: 37875 - protein, 25 aa, synthetic construct
  source 1..25: note = Seed: NSCVKLQTVHSIPLTINKEEALQRP
NSCVKLQTVHSIPFTIAKWEAEQRP

SEQ ID NO: 37876 - protein, 25 aa, synthetic construct
  source 1..25: note = Seed: NSCVKLQTVHSIPLTINKEEALQRP
NSCVKLQTVHSIPFTIAKWEAFQRP

SEQ ID NO: 37877 - protein, 25 aa, synthetic construct
  source 1..25: note = Seed: NSCVKLQTVHSIPLTINKEEALQRP
NSCVKLQTVHSIPFTIAKWEAIQRP

SEQ ID NO: 37878 - protein, 25 aa, synthetic construct
  source 1..25: note = Seed: NSCVKLQTVHSIPLTINKEEALQRP
NSCVKLQTVHSIPFTIAKWEALQRP

SEQ ID NO: 37879 - protein, 25 aa, synthetic construct
  source 1..25: note = Seed: NSCVKLQTVHSIPLTINKEEALQRP
NSCVKLQTVHSIPFTIAKWEAMQRP

SEQ ID NO: 37880 - protein, 25 aa, synthetic construct
  source 1..25: note = Seed: NSCVKLQTVHSIPLTINKEEALQRP
NSCVKLQTVHSIPFTIAKWEANQRP

SEQ ID NO: 37881 - protein, 25 aa, synthetic construct
  source 1..25: note = Seed: NSCVKLQTVHSIPLTINKEEALQRP
NSCVKLQTVHSIPFTIAKWEASQRP

SEQ ID NO: 37882 - protein, 25 aa, synthetic construct
  source 1..25: note = Seed: NSCVKLQTVHSIPLTINKEEALQRP
NSCVKLQTVHSIPFTIAKWEATQRP

SEQ ID NO: 37883 - protein, 25 aa, synthetic construct
  source 1..25: note = Seed: NSCVKLQTVHSIPLTINKEEALQRP
NSCVKLQTVHSIPFTIAKWEAVQRP

SEQ ID NO: 37884 - protein, 25 aa, synthetic construct
  source 1..25: note = Seed: NSCVKLQTVHSIPLTINKEEALQRP
NSCVKLQTVHSIPFTIAKWEAYQRP

SEQ ID NO: 37885 - protein, 25 aa, synthetic construct
  source 1..25: note = Seed: NSCVKLQTVHSIPLTINKEEALQRP
NSCVKLQTVHSIPFTIAKYEAAQRP

SEQ ID NO: 37886 - protein, 25 aa, synthetic construct
  source 1..25: note = Seed: NSCVKLQTVHSIPLTINKEEALQRP
NSCVKLQTVHSIPFTIAKYEACQRP

SEQ ID NO: 37887 - protein, 25 aa, synthetic construct
  source 1..25: note = Seed: NSCVKLQTVHSIPLTINKEEALQRP
NSCVKLQTVHSIPFTIAKYEADQRP

SEQ ID NO: 37888 - protein, 25 aa, synthetic construct
  source 1..25: note = Seed: NSCVKLQTVHSIPLTINKEEALQRP
NSCVKLQTVHSIPFTIAKYEAEQRP

SEQ ID NO: 37889 - protein, 25 aa, synthetic construct
  source 1..25: note = Seed: NSCVKLQTVHSIPLTINKEEALQRP
NSCVKLQTVHSIPFTIAKYEAFQRP

SEQ ID NO: 37890 - protein, 25 aa, synthetic construct
  source 1..25: note = Seed: NSCVKLQTVHSIPLTINKEEALQRP
NSCVKLQTVHSIPFTIAKYEAGQRP

SEQ ID NO: 37891 - protein, 25 aa, synthetic construct
  source 1..25: note = Seed: NSCVKLQTVHSIPLTINKEEALQRP
NSCVKLQTVHSIPFTIAKYEAIQRP

SEQ ID NO: 37892 - protein, 25 aa, synthetic construct
  source 1..25: note = Seed: NSCVKLQTVHSIPLTINKEEALQRP
NSCVKLQTVHSIPFTIAKYEALQRP

SEQ ID NO: 37893 - protein, 25 aa, synthetic construct
  source 1..25: note = Seed: NSCVKLQTVHSIPLTINKEEALQRP
NSCVKLQTVHSIPFTIAKYEAMQRP

SEQ ID NO: 37894 - protein, 25 aa, synthetic construct
  source 1..25: note = Seed: NSCVKLQTVHSIPLTINKEEALQRP
NSCVKLQTVHSIPFTIAKYEANQRP

SEQ ID NO: 37895 - protein, 25 aa, synthetic construct
  source 1..25: note = Seed: NSCVKLQTVHSIPLTINKEEALQRP
NSCVKLQTVHSIPFTIAKYEASQRP

SEQ ID NO: 37896 - protein, 25 aa, synthetic construct
  source 1..25: note = Seed: NSCVKLQTVHSIPLTINKEEALQRP
NSCVKLQTVHSIPFTIAKYEATQRP

SEQ ID NO: 37897 - protein, 25 aa, synthetic construct
  source 1..25: note = Seed: NSCVKLQTVHSIPLTINKEEALQRP
NSCVKLQTVHSIPFTIAKYEAVQRP

SEQ ID NO: 37898 - protein, 25 aa, synthetic construct
  source 1..25: note = Seed: NSCVKLQTVHSIPLTINKEEALQRP
NSCVKLQTVHSIPFTIAKYEAYQRP

SEQ ID NO: 37899 - protein, 25 aa, synthetic construct
  source 1..25: note = Seed: NSCVKLQTVHSIPLTINKEEALQRP
NSCVKLQTVHSIPFTICKFEAAQRP

SEQ ID NO: 37900 - protein, 25 aa, synthetic construct
  source 1..25: note = Seed: NSCVKLQTVHSIPLTINKEEALQRP
NSCVKLQTVHSIPFTICKFEADQRP

SEQ ID NO: 37901 - protein, 25 aa, synthetic construct
  source 1..25: note = Seed: NSCVKLQTVHSIPLTINKEEALQRP
NSCVKLQTVHSIPFTICKFEAEQRP

SEQ ID NO: 37902 - protein, 25 aa, synthetic construct
  source 1..25: note = Seed: NSCVKLQTVHSIPLTINKEEALQRP
NSCVKLQTVHSIPFTICKFEAFQRP

SEQ ID NO: 37903 - protein, 25 aa, synthetic construct
  source 1..25: note = Seed: NSCVKLQTVHSIPLTINKEEALQRP
NSCVKLQTVHSIPFTICKFEAIQRP

SEQ ID NO: 37904 - protein, 25 aa, synthetic construct
  source 1..25: note = Seed: NSCVKLQTVHSIPLTINKEEALQRP
NSCVKLQTVHSIPFTICKFEALQRP

SEQ ID NO: 37905 - protein, 25 aa, synthetic construct
  source 1..25: note = Seed: NSCVKLQTVHSIPLTINKEEALQRP
NSCVKLQTVHSIPFTICKFEAMQRP

SEQ ID NO: 37906 - protein, 25 aa, synthetic construct
  source 1..25: note = Seed: NSCVKLQTVHSIPLTINKEEALQRP
NSCVKLQTVHSIPFTICKFEANQRP

SEQ ID NO: 37907 - protein, 25 aa, synthetic construct
  source 1..25: note = Seed: NSCVKLQTVHSIPLTINKEEALQRP
NSCVKLQTVHSIPFTICKFEASQRP

SEQ ID NO: 37908 - protein, 25 aa, synthetic construct
  source 1..25: note = Seed: NSCVKLQTVHSIPLTINKEEALQRP
NSCVKLQTVHSIPFTICKFEATQRP

SEQ ID NO: 37909 - protein, 25 aa, synthetic construct
  source 1..25: note = Seed: NSCVKLQTVHSIPLTINKEEALQRP
NSCVKLQTVHSIPFTICKFEAVQRP

SEQ ID NO: 37910 - protein, 25 aa, synthetic construct
  source 1..25: note = Seed: NSCVKLQTVHSIPLTINKEEALQRP
NSCVKLQTVHSIPFTICKFEAYQRP

SEQ ID NO: 37911 - protein, 25 aa, synthetic construct
  source 1..25: note = Seed: NSCVKLQTVHSIPLTINKEEALQRP
NSCVKLQTVHSIPFTICKYEAFQRP

SEQ ID NO: 37912 - protein, 25 aa, synthetic construct
  source 1..25: note = Seed: NSCVKLQTVHSIPLTINKEEALQRP
NSCVKLQTVHSIPFTICKYEAIQRP

SEQ ID NO: 37913 - protein, 25 aa, synthetic construct
  source 1..25: note = Seed: NSCVKLQTVHSIPLTINKEEALQRP
NSCVKLQTVHSIPFTICKYEALQRP

SEQ ID NO: 37914 - protein, 25 aa, synthetic construct
  source 1..25: note = Seed: NSCVKLQTVHSIPLTINKEEALQRP
NSCVKLQTVHSIPFTICKYEAVQRP

SEQ ID NO: 37915 - protein, 25 aa, synthetic construct
  source 1..25: note = Seed: NSCVKLQTVHSIPLTINKEEALQRP
NSCVKLQTVHSIPFTIDKAEAAQRP

SEQ ID NO: 37916 - protein, 25 aa, synthetic construct
  source 1..25: note = Seed: NSCVKLQTVHSIPLTINKEEALQRP
NSCVKLQTVHSIPFTIDKFEAAQRP

SEQ ID NO: 37917 - protein, 25 aa, synthetic construct
  source 1..25: note = Seed: NSCVKLQTVHSIPLTINKEEALQRP
NSCVKLQTVHSIPFTIDKFEACQRP

SEQ ID NO: 37918 - protein, 25 aa, synthetic construct
  source 1..25: note = Seed: NSCVKLQTVHSIPLTINKEEALQRP
NSCVKLQTVHSIPFTIDKFEADQRP

SEQ ID NO: 37919 - protein, 25 aa, synthetic construct
  source 1..25: note = Seed: NSCVKLQTVHSIPLTINKEEALQRP
NSCVKLQTVHSIPFTIDKFEAEQRP

SEQ ID NO: 37920 - protein, 25 aa, synthetic construct
  source 1..25: note = Seed: NSCVKLQTVHSIPLTINKEEALQRP
NSCVKLQTVHSIPFTIDKFEAFQRP

SEQ ID NO: 37921 - protein, 25 aa, synthetic construct
  source 1..25: note = Seed: NSCVKLQTVHSIPLTINKEEALQRP
NSCVKLQTVHSIPFTIDKFEAIQRP

SEQ ID NO: 37922 - protein, 25 aa, synthetic construct
  source 1..25: note = Seed: NSCVKLQTVHSIPLTINKEEALQRP
NSCVKLQTVHSIPFTIDKFEALQRP

SEQ ID NO: 37923 - protein, 25 aa, synthetic construct
  source 1..25: note = Seed: NSCVKLQTVHSIPLTINKEEALQRP
NSCVKLQTVHSIPFTIDKFEAMQRP

SEQ ID NO: 37924 - protein, 25 aa, synthetic construct
  source 1..25: note = Seed: NSCVKLQTVHSIPLTINKEEALQRP
NSCVKLQTVHSIPFTIDKFEANQRP

SEQ ID NO: 37925 - protein, 25 aa, synthetic construct
  source 1..25: note = Seed: NSCVKLQTVHSIPLTINKEEALQRP
NSCVKLQTVHSIPFTIDKFEAPQRP

SEQ ID NO: 37926 - protein, 25 aa, synthetic construct
  source 1..25: note = Seed: NSCVKLQTVHSIPLTINKEEALQRP
NSCVKLQTVHSIPFTIDKFEAQQRP

SEQ ID NO: 37927 - protein, 25 aa, synthetic construct
  source 1..25: note = Seed: NSCVKLQTVHSIPLTINKEEALQRP
NSCVKLQTVHSIPFTIDKFEASQRP

SEQ ID NO: 37928 - protein, 25 aa, synthetic construct
  source 1..25: note = Seed: NSCVKLQTVHSIPLTINKEEALQRP
NSCVKLQTVHSIPFTIDKFEATQRP

SEQ ID NO: 37929 - protein, 25 aa, synthetic construct
  source 1..25: note = Seed: NSCVKLQTVHSIPLTINKEEALQRP
NSCVKLQTVHSIPFTIDKFEAVQRP

SEQ ID NO: 37930 - protein, 25 aa, synthetic construct
  source 1..25: note = Seed: NSCVKLQTVHSIPLTINKEEALQRP
NSCVKLQTVHSIPFTIDKFEAWQRP

SEQ ID NO: 37931 - protein, 25 aa, synthetic construct
  source 1..25: note = Seed: NSCVKLQTVHSIPLTINKEEALQRP
NSCVKLQTVHSIPFTIDKFEAYQRP

SEQ ID NO: 37932 - protein, 25 aa, synthetic construct
  source 1..25: note = Seed: NSCVKLQTVHSIPLTINKEEALQRP
NSCVKLQTVHSIPFTIDKIEAFQRP

SEQ ID NO: 37933 - protein, 25 aa, synthetic construct
  source 1..25: note = Seed: NSCVKLQTVHSIPLTINKEEALQRP
NSCVKLQTVHSIPFTIDKIEAIQRP

SEQ ID NO: 37934 - protein, 25 aa, synthetic construct
  source 1..25: note = Seed: NSCVKLQTVHSIPLTINKEEALQRP
NSCVKLQTVHSIPFTIDKIEALQRP

SEQ ID NO: 37935 - protein, 25 aa, synthetic construct
  source 1..25: note = Seed: NSCVKLQTVHSIPLTINKEEALQRP
NSCVKLQTVHSIPFTIDKIEAVQRP

SEQ ID NO: 37936 - protein, 25 aa, synthetic construct
  source 1..25: note = Seed: NSCVKLQTVHSIPLTINKEEALQRP
NSCVKLQTVHSIPFTIDKLEAFQRP

SEQ ID NO: 37937 - protein, 25 aa, synthetic construct
  source 1..25: note = Seed: NSCVKLQTVHSIPLTINKEEALQRP
NSCVKLQTVHSIPFTIDKLEAIQRP

SEQ ID NO: 37938 - protein, 25 aa, synthetic construct
  source 1..25: note = Seed: NSCVKLQTVHSIPLTINKEEALQRP
NSCVKLQTVHSIPFTIDKLEALQRP

SEQ ID NO: 37939 - protein, 25 aa, synthetic construct
  source 1..25: note = Seed: NSCVKLQTVHSIPLTINKEEALQRP
NSCVKLQTVHSIPFTIDKLEAMQRP

SEQ ID NO: 37940 - protein, 25 aa, synthetic construct
  source 1..25: note = Seed: NSCVKLQTVHSIPLTINKEEALQRP
NSCVKLQTVHSIPFTIDKLEAVQRP

SEQ ID NO: 37941 - protein, 25 aa, synthetic construct
  source 1..25: note = Seed: NSCVKLQTVHSIPLTINKEEALQRP
NSCVKLQTVHSIPFTIDKMEAIQRP

SEQ ID NO: 37942 - protein, 25 aa, synthetic construct
  source 1..25: note = Seed: NSCVKLQTVHSIPLTINKEEALQRP
NSCVKLQTVHSIPFTIDKMEALQRP

SEQ ID NO: 37943 - protein, 25 aa, synthetic construct
  source 1..25: note = Seed: NSCVKLQTVHSIPLTINKEEALQRP
NSCVKLQTVHSIPFTIDKNEAAQRP

SEQ ID NO: 37944 - protein, 25 aa, synthetic construct
  source 1..25: note = Seed: NSCVKLQTVHSIPLTINKEEALQRP
NSCVKLQTVHSIPFTIDKNEASQRP

SEQ ID NO: 37945 - protein, 25 aa, synthetic construct
  source 1..25: note = Seed: NSCVKLQTVHSIPLTINKEEALQRP
NSCVKLQTVHSIPFTIDKSEAAQRP

SEQ ID NO: 37946 - protein, 25 aa, synthetic construct
  source 1..25: note = Seed: NSCVKLQTVHSIPLTINKEEALQRP
NSCVKLQTVHSIPFTIDKSEASQRP

SEQ ID NO: 37947 - protein, 25 aa, synthetic construct
  source 1..25: note = Seed: NSCVKLQTVHSIPLTINKEEALQRP
NSCVKLQTVHSIPFTIDKTEAAQRP

SEQ ID NO: 37948 - protein, 25 aa, synthetic construct
  source 1..25: note = Seed: NSCVKLQTVHSIPLTINKEEALQRP
NSCVKLQTVHSIPFTIDKTEASQRP

SEQ ID NO: 37949 - protein, 25 aa, synthetic construct
  source 1..25: note = Seed: NSCVKLQTVHSIPLTINKEEALQRP
NSCVKLQTVHSIPFTIDKVEAAQRP

SEQ ID NO: 37950 - protein, 25 aa, synthetic construct
  source 1..25: note = Seed: NSCVKLQTVHSIPLTINKEEALQRP
NSCVKLQTVHSIPFTIDKWEAFQRP

SEQ ID NO: 37951 - protein, 25 aa, synthetic construct
  source 1..25: note = Seed: NSCVKLQTVHSIPLTINKEEALQRP
NSCVKLQTVHSIPFTIDKWEAIQRP

SEQ ID NO: 37952 - protein, 25 aa, synthetic construct
  source 1..25: note = Seed: NSCVKLQTVHSIPLTINKEEALQRP
NSCVKLQTVHSIPFTIDKWEALQRP

SEQ ID NO: 37953 - protein, 25 aa, synthetic construct
  source 1..25: note = Seed: NSCVKLQTVHSIPLTINKEEALQRP
NSCVKLQTVHSIPFTIDKWEAVQRP

SEQ ID NO: 37954 - protein, 25 aa, synthetic construct
  source 1..25: note = Seed: NSCVKLQTVHSIPLTINKEEALQRP
NSCVKLQTVHSIPFTIDKYEAFQRP

SEQ ID NO: 37955 - protein, 25 aa, synthetic construct
  source 1..25: note = Seed: NSCVKLQTVHSIPLTINKEEALQRP
NSCVKLQTVHSIPFTIDKYEAIQRP

SEQ ID NO: 37956 - protein, 25 aa, synthetic construct
  source 1..25: note = Seed: NSCVKLQTVHSIPLTINKEEALQRP
NSCVKLQTVHSIPFTIDKYEALQRP

SEQ ID NO: 37957 - protein, 25 aa, synthetic construct
  source 1..25: note = Seed: NSCVKLQTVHSIPLTINKEEALQRP
NSCVKLQTVHSIPFTIDKYEAMQRP

SEQ ID NO: 37958 - protein, 25 aa, synthetic construct
  source 1..25: note = Seed: NSCVKLQTVHSIPLTINKEEALQRP
NSCVKLQTVHSIPFTIDKYEAVQRP

SEQ ID NO: 37959 - protein, 25 aa, synthetic construct
  source 1..25: note = Seed: NSCVKLQTVHSIPLTINKEEALQRP
NSCVKLQTVHSIPFTIEKAEAIQRP

SEQ ID NO: 37960 - protein, 25 aa, synthetic construct
  source 1..25: note = Seed: NSCVKLQTVHSIPLTINKEEALQRP
NSCVKLQTVHSIPFTIEKAEALQRP

SEQ ID NO: 37961 - protein, 25 aa, synthetic construct
  source 1..25: note = Seed: NSCVKLQTVHSIPLTINKEEALQRP
NSCVKLQTVHSIPFTIEKFEAAQRP

SEQ ID NO: 37962 - protein, 25 aa, synthetic construct
  source 1..25: note = Seed: NSCVKLQTVHSIPLTINKEEALQRP
NSCVKLQTVHSIPFTIEKFEACQRP

SEQ ID NO: 37963 - protein, 25 aa, synthetic construct
  source 1..25: note = Seed: NSCVKLQTVHSIPLTINKEEALQRP
NSCVKLQTVHSIPFTIEKFEADQRP

SEQ ID NO: 37964 - protein, 25 aa, synthetic construct
  source 1..25: note = Seed: NSCVKLQTVHSIPLTINKEEALQRP
NSCVKLQTVHSIPFTIEKFEAEQRP

SEQ ID NO: 37965 - protein, 25 aa, synthetic construct
  source 1..25: note = Seed: NSCVKLQTVHSIPLTINKEEALQRP
NSCVKLQTVHSIPFTIEKFEAFQRP

SEQ ID NO: 37966 - protein, 25 aa, synthetic construct
  source 1..25: note = Seed: NSCVKLQTVHSIPLTINKEEALQRP
NSCVKLQTVHSIPFTIEKFEAGQRP

SEQ ID NO: 37967 - protein, 25 aa, synthetic construct
  source 1..25: note = Seed: NSCVKLQTVHSIPLTINKEEALQRP
NSCVKLQTVHSIPFTIEKFEAHQRP

SEQ ID NO: 37968 - protein, 25 aa, synthetic construct
  source 1..25: note = Seed: NSCVKLQTVHSIPLTINKEEALQRP
NSCVKLQTVHSIPFTIEKFEAIQRP

SEQ ID NO: 37969 - protein, 25 aa, synthetic construct
  source 1..25: note = Seed: NSCVKLQTVHSIPLTINKEEALQRP
NSCVKLQTVHSIPFTIEKFEAKQRP

SEQ ID NO: 37970 - protein, 25 aa, synthetic construct
  source 1..25: note = Seed: NSCVKLQTVHSIPLTINKEEALQRP
NSCVKLQTVHSIPFTIEKFEALQRP

SEQ ID NO: 37971 - protein, 25 aa, synthetic construct
  source 1..25: note = Seed: NSCVKLQTVHSIPLTINKEEALQRP
NSCVKLQTVHSIPFTIEKFEAMQRP

SEQ ID NO: 37972 - protein, 25 aa, synthetic construct
  source 1..25: note = Seed: NSCVKLQTVHSIPLTINKEEALQRP
NSCVKLQTVHSIPFTIEKFEANQRP

SEQ ID NO: 37973 - protein, 25 aa, synthetic construct
  source 1..25: note = Seed: NSCVKLQTVHSIPLTINKEEALQRP
NSCVKLQTVHSIPFTIEKFEAPQRP

SEQ ID NO: 37974 - protein, 25 aa, synthetic construct
  source 1..25: note = Seed: NSCVKLQTVHSIPLTINKEEALQRP
NSCVKLQTVHSIPFTIEKFEAQQRP

SEQ ID NO: 37975 - protein, 25 aa, synthetic construct
  source 1..25: note = Seed: NSCVKLQTVHSIPLTINKEEALQRP
NSCVKLQTVHSIPFTIEKFEARQRP

SEQ ID NO: 37976 - protein, 25 aa, synthetic construct
  source 1..25: note = Seed: NSCVKLQTVHSIPLTINKEEALQRP
NSCVKLQTVHSIPFTIEKFEASQRP

SEQ ID NO: 37977 - protein, 25 aa, synthetic construct
  source 1..25: note = Seed: NSCVKLQTVHSIPLTINKEEALQRP
NSCVKLQTVHSIPFTIEKFEATQRP

SEQ ID NO: 37978 - protein, 25 aa, synthetic construct
  source 1..25: note = Seed: NSCVKLQTVHSIPLTINKEEALQRP
NSCVKLQTVHSIPFTIEKFEAVQRP

SEQ ID NO: 37979 - protein, 25 aa, synthetic construct
  source 1..25: note = Seed: NSCVKLQTVHSIPLTINKEEALQRP
NSCVKLQTVHSIPFTIEKFEAWQRP

SEQ ID NO: 37980 - protein, 25 aa, synthetic construct
  source 1..25: note = Seed: NSCVKLQTVHSIPLTINKEEALQRP
NSCVKLQTVHSIPFTIEKFEAYQRP

SEQ ID NO: 37981 - protein, 25 aa, synthetic construct
  source 1..25: note = Seed: NSCVKLQTVHSIPLTINKEEALQRP
NSCVKLQTVHSIPFTIEKIEAAQRP

SEQ ID NO: 37982 - protein, 25 aa, synthetic construct
  source 1..25: note = Seed: NSCVKLQTVHSIPLTINKEEALQRP
NSCVKLQTVHSIPFTIEKIEAFQRP

SEQ ID NO: 37983 - protein, 25 aa, synthetic construct
  source 1..25: note = Seed: NSCVKLQTVHSIPLTINKEEALQRP
NSCVKLQTVHSIPFTIEKIEAIQRP

SEQ ID NO: 37984 - protein, 25 aa, synthetic construct
  source 1..25: note = Seed: NSCVKLQTVHSIPLTINKEEALQRP
NSCVKLQTVHSIPFTIEKIEALQRP

SEQ ID NO: 37985 - protein, 25 aa, synthetic construct
  source 1..25: note = Seed: NSCVKLQTVHSIPLTINKEEALQRP
NSCVKLQTVHSIPFTIEKIEAMQRP

SEQ ID NO: 37986 - protein, 25 aa, synthetic construct
  source 1..25: note = Seed: NSCVKLQTVHSIPLTINKEEALQRP
NSCVKLQTVHSIPFTIEKIEATQRP

SEQ ID NO: 37987 - protein, 25 aa, synthetic construct
  source 1..25: note = Seed: NSCVKLQTVHSIPLTINKEEALQRP
NSCVKLQTVHSIPFTIEKIEAVQRP

SEQ ID NO: 37988 - protein, 25 aa, synthetic construct
  source 1..25: note = Seed: NSCVKLQTVHSIPLTINKEEALQRP
NSCVKLQTVHSIPFTIEKIEAWQRP

SEQ ID NO: 37989 - protein, 25 aa, synthetic construct
  source 1..25: note = Seed: NSCVKLQTVHSIPLTINKEEALQRP
NSCVKLQTVHSIPFTIEKIEAYQRP

SEQ ID NO: 37990 - protein, 25 aa, synthetic construct
  source 1..25: note = Seed: NSCVKLQTVHSIPLTINKEEALQRP
NSCVKLQTVHSIPFTIEKLEAAQRP

SEQ ID NO: 37991 - protein, 25 aa, synthetic construct
  source 1..25: note = Seed: NSCVKLQTVHSIPLTINKEEALQRP
NSCVKLQTVHSIPFTIEKLEADQRP

SEQ ID NO: 37992 - protein, 25 aa, synthetic construct
  source 1..25: note = Seed: NSCVKLQTVHSIPLTINKEEALQRP
NSCVKLQTVHSIPFTIEKLEAEQRP

SEQ ID NO: 37993 - protein, 25 aa, synthetic construct
  source 1..25: note = Seed: NSCVKLQTVHSIPLTINKEEALQRP
NSCVKLQTVHSIPFTIEKLEAFQRP

SEQ ID NO: 37994 - protein, 25 aa, synthetic construct
  source 1..25: note = Seed: NSCVKLQTVHSIPLTINKEEALQRP
NSCVKLQTVHSIPFTIEKLEAIQRP

SEQ ID NO: 37995 - protein, 25 aa, synthetic construct
  source 1..25: note = Seed: NSCVKLQTVHSIPLTINKEEALQRP
NSCVKLQTVHSIPFTIEKLEALQRP

SEQ ID NO: 37996 - protein, 25 aa, synthetic construct
  source 1..25: note = Seed: NSCVKLQTVHSIPLTINKEEALQRP
NSCVKLQTVHSIPFTIEKLEAMQRP

SEQ ID NO: 37997 - protein, 25 aa, synthetic construct
  source 1..25: note = Seed: NSCVKLQTVHSIPLTINKEEALQRP
NSCVKLQTVHSIPFTIEKLEANQRP

SEQ ID NO: 37998 - protein, 25 aa, synthetic construct
  source 1..25: note = Seed: NSCVKLQTVHSIPLTINKEEALQRP
NSCVKLQTVHSIPFTIEKLEASQRP

SEQ ID NO: 37999 - protein, 25 aa, synthetic construct
  source 1..25: note = Seed: NSCVKLQTVHSIPLTINKEEALQRP
NSCVKLQTVHSIPFTIEKLEATQRP

SEQ ID NO: 38000 - protein, 25 aa, synthetic construct
  source 1..25: note = Seed: NSCVKLQTVHSIPLTINKEEALQRP
NSCVKLQTVHSIPFTIEKLEAVQRP

SEQ ID NO: 38001 - protein, 25 aa, synthetic construct
  source 1..25: note = Seed: NSCVKLQTVHSIPLTINKEEALQRP
NSCVKLQTVHSIPFTIEKLEAWQRP

SEQ ID NO: 38002 - protein, 25 aa, synthetic construct
  source 1..25: note = Seed: NSCVKLQTVHSIPLTINKEEALQRP
NSCVKLQTVHSIPFTIEKLEAYQRP

SEQ ID NO: 38003 - protein, 25 aa, synthetic construct
  source 1..25: note = Seed: NSCVKLQTVHSIPLTINKEEALQRP
NSCVKLQTVHSIPFTIEKMEAFQRP

SEQ ID NO: 38004 - protein, 25 aa, synthetic construct
  source 1..25: note = Seed: NSCVKLQTVHSIPLTINKEEALQRP
NSCVKLQTVHSIPFTIEKMEAIQRP

SEQ ID NO: 38005 - protein, 25 aa, synthetic construct
  source 1..25: note = Seed: NSCVKLQTVHSIPLTINKEEALQRP
NSCVKLQTVHSIPFTIEKMEALQRP

SEQ ID NO: 38006 - protein, 25 aa, synthetic construct
  source 1..25: note = Seed: NSCVKLQTVHSIPLTINKEEALQRP
NSCVKLQTVHSIPFTIEKMEAMQRP

SEQ ID NO: 38007 - protein, 25 aa, synthetic construct
  source 1..25: note = Seed: NSCVKLQTVHSIPLTINKEEALQRP
NSCVKLQTVHSIPFTIEKMEAVQRP

SEQ ID NO: 38008 - protein, 25 aa, synthetic construct
  source 1..25: note = Seed: NSCVKLQTVHSIPLTINKEEALQRP
NSCVKLQTVHSIPFTIEKMEAYQRP

SEQ ID NO: 38009 - protein, 25 aa, synthetic construct
  source 1..25: note = Seed: NSCVKLQTVHSIPLTINKEEALQRP
NSCVKLQTVHSIPFTIEKNEAAQRP

SEQ ID NO: 38010 - protein, 25 aa, synthetic construct
  source 1..25: note = Seed: NSCVKLQTVHSIPLTINKEEALQRP
NSCVKLQTVHSIPFTIEKNEASQRP

SEQ ID NO: 38011 - protein, 25 aa, synthetic construct
  source 1..25: note = Seed: NSCVKLQTVHSIPLTINKEEALQRP
NSCVKLQTVHSIPFTIEKSEAAQRP

SEQ ID NO: 38012 - protein, 25 aa, synthetic construct
  source 1..25: note = Seed: NSCVKLQTVHSIPLTINKEEALQRP
NSCVKLQTVHSIPFTIEKTEAAQRP

SEQ ID NO: 38013 - protein, 25 aa, synthetic construct
  source 1..25: note = Seed: NSCVKLQTVHSIPLTINKEEALQRP
NSCVKLQTVHSIPFTIEKVEAFQRP

SEQ ID NO: 38014 - protein, 25 aa, synthetic construct
  source 1..25: note = Seed: NSCVKLQTVHSIPLTINKEEALQRP
NSCVKLQTVHSIPFTIEKVEAIQRP

SEQ ID NO: 38015 - protein, 25 aa, synthetic construct
  source 1..25: note = Seed: NSCVKLQTVHSIPLTINKEEALQRP
NSCVKLQTVHSIPFTIEKVEALQRP

SEQ ID NO: 38016 - protein, 25 aa, synthetic construct
  source 1..25: note = Seed: NSCVKLQTVHSIPLTINKEEALQRP
NSCVKLQTVHSIPFTIEKVEAMQRP

SEQ ID NO: 38017 - protein, 25 aa, synthetic construct
  source 1..25: note = Seed: NSCVKLQTVHSIPLTINKEEALQRP
NSCVKLQTVHSIPFTIEKVEAVQRP

SEQ ID NO: 38018 - protein, 25 aa, synthetic construct
  source 1..25: note = Seed: NSCVKLQTVHSIPLTINKEEALQRP
NSCVKLQTVHSIPFTIEKWEAAQRP

SEQ ID NO: 38019 - protein, 25 aa, synthetic construct
  source 1..25: note = Seed: NSCVKLQTVHSIPLTINKEEALQRP
NSCVKLQTVHSIPFTIEKWEAFQRP

SEQ ID NO: 38020 - protein, 25 aa, synthetic construct
  source 1..25: note = Seed: NSCVKLQTVHSIPLTINKEEALQRP
NSCVKLQTVHSIPFTIEKWEAIQRP

SEQ ID NO: 38021 - protein, 25 aa, synthetic construct
  source 1..25: note = Seed: NSCVKLQTVHSIPLTINKEEALQRP
NSCVKLQTVHSIPFTIEKWEALQRP

SEQ ID NO: 38022 - protein, 25 aa, synthetic construct
  source 1..25: note = Seed: NSCVKLQTVHSIPLTINKEEALQRP
NSCVKLQTVHSIPFTIEKWEAMQRP

SEQ ID NO: 38023 - protein, 25 aa, synthetic construct
  source 1..25: note = Seed: NSCVKLQTVHSIPLTINKEEALQRP
NSCVKLQTVHSIPFTIEKWEATQRP

SEQ ID NO: 38024 - protein, 25 aa, synthetic construct
  source 1..25: note = Seed: NSCVKLQTVHSIPLTINKEEALQRP
NSCVKLQTVHSIPFTIEKWEAVQRP

SEQ ID NO: 38025 - protein, 25 aa, synthetic construct
  source 1..25: note = Seed: NSCVKLQTVHSIPLTINKEEALQRP
NSCVKLQTVHSIPFTIEKWEAYQRP

SEQ ID NO: 38026 - protein, 25 aa, synthetic construct
  source 1..25: note = Seed: NSCVKLQTVHSIPLTINKEEALQRP
NSCVKLQTVHSIPFTIEKYEAAQRP

SEQ ID NO: 38027 - protein, 25 aa, synthetic construct
  source 1..25: note = Seed: NSCVKLQTVHSIPLTINKEEALQRP
NSCVKLQTVHSIPFTIEKYEACQRP

SEQ ID NO: 38028 - protein, 25 aa, synthetic construct
  source 1..25: note = Seed: NSCVKLQTVHSIPLTINKEEALQRP
NSCVKLQTVHSIPFTIEKYEAFQRP

SEQ ID NO: 38029 - protein, 25 aa, synthetic construct
  source 1..25: note = Seed: NSCVKLQTVHSIPLTINKEEALQRP
NSCVKLQTVHSIPFTIEKYEAIQRP

SEQ ID NO: 38030 - protein, 25 aa, synthetic construct
  source 1..25: note = Seed: NSCVKLQTVHSIPLTINKEEALQRP
NSCVKLQTVHSIPFTIEKYEALQRP

SEQ ID NO: 38031 - protein, 25 aa, synthetic construct
  source 1..25: note = Seed: NSCVKLQTVHSIPLTINKEEALQRP
NSCVKLQTVHSIPFTIEKYEAMQRP

SEQ ID NO: 38032 - protein, 25 aa, synthetic construct
  source 1..25: note = Seed: NSCVKLQTVHSIPLTINKEEALQRP
NSCVKLQTVHSIPFTIEKYEANQRP

SEQ ID NO: 38033 - protein, 25 aa, synthetic construct
  source 1..25: note = Seed: NSCVKLQTVHSIPLTINKEEALQRP
NSCVKLQTVHSIPFTIEKYEASQRP

SEQ ID NO: 38034 - protein, 25 aa, synthetic construct
  source 1..25: note = Seed: NSCVKLQTVHSIPLTINKEEALQRP
NSCVKLQTVHSIPFTIEKYEATQRP

SEQ ID NO: 38035 - protein, 25 aa, synthetic construct
  source 1..25: note = Seed: NSCVKLQTVHSIPLTINKEEALQRP
NSCVKLQTVHSIPFTIEKYEAVQRP

SEQ ID NO: 38036 - protein, 25 aa, synthetic construct
  source 1..25: note = Seed: NSCVKLQTVHSIPLTINKEEALQRP
NSCVKLQTVHSIPFTIEKYEAWQRP

SEQ ID NO: 38037 - protein, 25 aa, synthetic construct
  source 1..25: note = Seed: NSCVKLQTVHSIPLTINKEEALQRP
NSCVKLQTVHSIPFTIEKYEAYQRP

SEQ ID NO: 38038 - protein, 25 aa, synthetic construct
  source 1..25: note = Seed: NSCVKLQTVHSIPLTINKEEALQRP
NSCVKLQTVHSIPFTIFKAEAAQRP

SEQ ID NO: 38039 - protein, 25 aa, synthetic construct
  source 1..25: note = Seed: NSCVKLQTVHSIPLTINKEEALQRP
NSCVKLQTVHSIPFTIFKAEADQRP

SEQ ID NO: 38040 - protein, 25 aa, synthetic construct
  source 1..25: note = Seed: NSCVKLQTVHSIPLTINKEEALQRP
NSCVKLQTVHSIPFTIFKAEAEQRP

SEQ ID NO: 38041 - protein, 25 aa, synthetic construct
  source 1..25: note = Seed: NSCVKLQTVHSIPLTINKEEALQRP
NSCVKLQTVHSIPFTIFKAEAFQRP

SEQ ID NO: 38042 - protein, 25 aa, synthetic construct
  source 1..25: note = Seed: NSCVKLQTVHSIPLTINKEEALQRP
NSCVKLQTVHSIPFTIFKAEAIQRP

SEQ ID NO: 38043 - protein, 25 aa, synthetic construct
  source 1..25: note = Seed: NSCVKLQTVHSIPLTINKEEALQRP
NSCVKLQTVHSIPFTIFKAEALQRP

SEQ ID NO: 38044 - protein, 25 aa, synthetic construct
  source 1..25: note = Seed: NSCVKLQTVHSIPLTINKEEALQRP
NSCVKLQTVHSIPFTIFKAEAMQRP

SEQ ID NO: 38045 - protein, 25 aa, synthetic construct
  source 1..25: note = Seed: NSCVKLQTVHSIPLTINKEEALQRP
NSCVKLQTVHSIPFTIFKAEANQRP

SEQ ID NO: 38046 - protein, 25 aa, synthetic construct
  source 1..25: note = Seed: NSCVKLQTVHSIPLTINKEEALQRP
NSCVKLQTVHSIPFTIFKAEARQRP

SEQ ID NO: 38047 - protein, 25 aa, synthetic construct
  source 1..25: note = Seed: NSCVKLQTVHSIPLTINKEEALQRP
NSCVKLQTVHSIPFTIFKAEASQRP

SEQ ID NO: 38048 - protein, 25 aa, synthetic construct
  source 1..25: note = Seed: NSCVKLQTVHSIPLTINKEEALQRP
NSCVKLQTVHSIPFTIFKAEATQRP

SEQ ID NO: 38049 - protein, 25 aa, synthetic construct
  source 1..25: note = Seed: NSCVKLQTVHSIPLTINKEEALQRP
NSCVKLQTVHSIPFTIFKAEAVQRP

SEQ ID NO: 38050 - protein, 25 aa, synthetic construct
  source 1..25: note = Seed: NSCVKLQTVHSIPLTINKEEALQRP
NSCVKLQTVHSIPFTIFKAEAYQRP

SEQ ID NO: 38051 - protein, 25 aa, synthetic construct
  source 1..25: note = Seed: NSCVKLQTVHSIPLTINKEEALQRP
NSCVKLQTVHSIPFTIFKCEALQRP

SEQ ID NO: 38052 - protein, 25 aa, synthetic construct
  source 1..25: note = Seed: NSCVKLQTVHSIPLTINKEEALQRP
NSCVKLQTVHSIPFTIFKDEAAQRP

SEQ ID NO: 38053 - protein, 25 aa, synthetic construct
  source 1..25: note = Seed: NSCVKLQTVHSIPLTINKEEALQRP
NSCVKLQTVHSIPFTIFKDEAFQRP

SEQ ID NO: 38054 - protein, 25 aa, synthetic construct
  source 1..25: note = Seed: NSCVKLQTVHSIPLTINKEEALQRP
NSCVKLQTVHSIPFTIFKDEAIQRP

SEQ ID NO: 38055 - protein, 25 aa, synthetic construct
  source 1..25: note = Seed: NSCVKLQTVHSIPLTINKEEALQRP
NSCVKLQTVHSIPFTIFKDEALQRP

SEQ ID NO: 38056 - protein, 25 aa, synthetic construct
  source 1..25: note = Seed: NSCVKLQTVHSIPLTINKEEALQRP
NSCVKLQTVHSIPFTIFKDEAMQRP

SEQ ID NO: 38057 - protein, 25 aa, synthetic construct
  source 1..25: note = Seed: NSCVKLQTVHSIPLTINKEEALQRP
NSCVKLQTVHSIPFTIFKDEASQRP

SEQ ID NO: 38058 - protein, 25 aa, synthetic construct
  source 1..25: note = Seed: NSCVKLQTVHSIPLTINKEEALQRP
NSCVKLQTVHSIPFTIFKDEATQRP

SEQ ID NO: 38059 - protein, 25 aa, synthetic construct
  source 1..25: note = Seed: NSCVKLQTVHSIPLTINKEEALQRP
NSCVKLQTVHSIPFTIFKDEAVQRP

SEQ ID NO: 38060 - protein, 25 aa, synthetic construct
  source 1..25: note = Seed: NSCVKLQTVHSIPLTINKEEALQRP
NSCVKLQTVHSIPFTIFKDEAYQRP

SEQ ID NO: 38061 - protein, 25 aa, synthetic construct
  source 1..25: note = Seed: NSCVKLQTVHSIPLTINKEEALQRP
NSCVKLQTVHSIPFTIFKEEAIQRP

SEQ ID NO: 38062 - protein, 25 aa, synthetic construct
  source 1..25: note = Seed: NSCVKLQTVHSIPLTINKEEALQRP
NSCVKLQTVHSIPFTIFKEEALQRP

SEQ ID NO: 38063 - protein, 25 aa, synthetic construct
  source 1..25: note = Seed: NSCVKLQTVHSIPLTINKEEALQRP
NSCVKLQTVHSIPFTIFKEEAVQRP

SEQ ID NO: 38064 - protein, 25 aa, synthetic construct
  source 1..25: note = Seed: NSCVKLQTVHSIPLTINKEEALQRP
NSCVKLQTVHSIPFTIFKFEAAQRP

SEQ ID NO: 38065 - protein, 25 aa, synthetic construct
  source 1..25: note = Seed: NSCVKLQTVHSIPLTINKEEALQRP
NSCVKLQTVHSIPFTIFKFEACQRP

SEQ ID NO: 38066 - protein, 25 aa, synthetic construct
  source 1..25: note = Seed: NSCVKLQTVHSIPLTINKEEALQRP
NSCVKLQTVHSIPFTIFKFEADQRP

SEQ ID NO: 38067 - protein, 25 aa, synthetic construct
  source 1..25: note = Seed: NSCVKLQTVHSIPLTINKEEALQRP
NSCVKLQTVHSIPFTIFKFEAEQRP

SEQ ID NO: 38068 - protein, 25 aa, synthetic construct
  source 1..25: note = Seed: NSCVKLQTVHSIPLTINKEEALQRP
NSCVKLQTVHSIPFTIFKFEAFQRP

SEQ ID NO: 38069 - protein, 25 aa, synthetic construct
  source 1..25: note = Seed: NSCVKLQTVHSIPLTINKEEALQRP
NSCVKLQTVHSIPFTIFKFEAGQRP

SEQ ID NO: 38070 - protein, 25 aa, synthetic construct
  source 1..25: note = Seed: NSCVKLQTVHSIPLTINKEEALQRP
NSCVKLQTVHSIPFTIFKFEAHQRP

SEQ ID NO: 38071 - protein, 25 aa, synthetic construct
  source 1..25: note = Seed: NSCVKLQTVHSIPLTINKEEALQRP
NSCVKLQTVHSIPFTIFKFEAIQRP

SEQ ID NO: 38072 - protein, 25 aa, synthetic construct
  source 1..25: note = Seed: NSCVKLQTVHSIPLTINKEEALQRP
NSCVKLQTVHSIPFTIFKFEAKQRP

SEQ ID NO: 38073 - protein, 25 aa, synthetic construct
  source 1..25: note = Seed: NSCVKLQTVHSIPLTINKEEALQRP
NSCVKLQTVHSIPFTIFKFEALQRP

SEQ ID NO: 38074 - protein, 25 aa, synthetic construct
  source 1..25: note = Seed: NSCVKLQTVHSIPLTINKEEALQRP
NSCVKLQTVHSIPFTIFKFEAMQRP

SEQ ID NO: 38075 - protein, 25 aa, synthetic construct
  source 1..25: note = Seed: NSCVKLQTVHSIPLTINKEEALQRP
NSCVKLQTVHSIPFTIFKFEANQRP

SEQ ID NO: 38076 - protein, 25 aa, synthetic construct
  source 1..25: note = Seed: NSCVKLQTVHSIPLTINKEEALQRP
NSCVKLQTVHSIPFTIFKFEAPQRP

SEQ ID NO: 38077 - protein, 25 aa, synthetic construct
  source 1..25: note = Seed: NSCVKLQTVHSIPLTINKEEALQRP
NSCVKLQTVHSIPFTIFKFEAQQRP

SEQ ID NO: 38078 - protein, 25 aa, synthetic construct
  source 1..25: note = Seed: NSCVKLQTVHSIPLTINKEEALQRP
NSCVKLQTVHSIPFTIFKFEARQRP

SEQ ID NO: 38079 - protein, 25 aa, synthetic construct
  source 1..25: note = Seed: NSCVKLQTVHSIPLTINKEEALQRP
NSCVKLQTVHSIPFTIFKFEASQRP

SEQ ID NO: 38080 - protein, 25 aa, synthetic construct
  source 1..25: note = Seed: NSCVKLQTVHSIPLTINKEEALQRP
NSCVKLQTVHSIPFTIFKFEATQRP

SEQ ID NO: 38081 - protein, 25 aa, synthetic construct
  source 1..25: note = Seed: NSCVKLQTVHSIPLTINKEEALQRP
NSCVKLQTVHSIPFTIFKFEAVQRP

SEQ ID NO: 38082 - protein, 25 aa, synthetic construct
  source 1..25: note = Seed: NSCVKLQTVHSIPLTINKEEALQRP
NSCVKLQTVHSIPFTIFKFEAWQRP

SEQ ID NO: 38083 - protein, 25 aa, synthetic construct
  source 1..25: note = Seed: NSCVKLQTVHSIPLTINKEEALQRP
NSCVKLQTVHSIPFTIFKFEAYQRP

SEQ ID NO: 38084 - protein, 25 aa, synthetic construct
  source 1..25: note = Seed: NSCVKLQTVHSIPLTINKEEALQRP
NSCVKLQTVHSIPFTIFKGEAIQRP

SEQ ID NO: 38085 - protein, 25 aa, synthetic construct
  source 1..25: note = Seed: NSCVKLQTVHSIPLTINKEEALQRP
NSCVKLQTVHSIPFTIFKGEALQRP

SEQ ID NO: 38086 - protein, 25 aa, synthetic construct
  source 1..25: note = Seed: NSCVKLQTVHSIPLTINKEEALQRP
NSCVKLQTVHSIPFTIFKGEAVQRP

SEQ ID NO: 38087 - protein, 25 aa, synthetic construct
  source 1..25: note = Seed: NSCVKLQTVHSIPLTINKEEALQRP
NSCVKLQTVHSIPFTIFKHEADQRP

SEQ ID NO: 38088 - protein, 25 aa, synthetic construct
  source 1..25: note = Seed: NSCVKLQTVHSIPLTINKEEALQRP
NSCVKLQTVHSIPFTIFKHEAIQRP

SEQ ID NO: 38089 - protein, 25 aa, synthetic construct
  source 1..25: note = Seed: NSCVKLQTVHSIPLTINKEEALQRP
NSCVKLQTVHSIPFTIFKHEALQRP

SEQ ID NO: 38090 - protein, 25 aa, synthetic construct
  source 1..25: note = Seed: NSCVKLQTVHSIPLTINKEEALQRP
NSCVKLQTVHSIPFTIFKHEAMQRP

SEQ ID NO: 38091 - protein, 25 aa, synthetic construct
  source 1..25: note = Seed: NSCVKLQTVHSIPLTINKEEALQRP
NSCVKLQTVHSIPFTIFKHEAVQRP

SEQ ID NO: 38092 - protein, 25 aa, synthetic construct
  source 1..25: note = Seed: NSCVKLQTVHSIPLTINKEEALQRP
NSCVKLQTVHSIPFTIFKIEAAQRP

SEQ ID NO: 38093 - protein, 25 aa, synthetic construct
  source 1..25: note = Seed: NSCVKLQTVHSIPLTINKEEALQRP
NSCVKLQTVHSIPFTIFKIEADQRP

SEQ ID NO: 38094 - protein, 25 aa, synthetic construct
  source 1..25: note = Seed: NSCVKLQTVHSIPLTINKEEALQRP
NSCVKLQTVHSIPFTIFKIEAEQRP

SEQ ID NO: 38095 - protein, 25 aa, synthetic construct
  source 1..25: note = Seed: NSCVKLQTVHSIPLTINKEEALQRP
NSCVKLQTVHSIPFTIFKIEAFQRP

SEQ ID NO: 38096 - protein, 25 aa, synthetic construct
  source 1..25: note = Seed: NSCVKLQTVHSIPLTINKEEALQRP
NSCVKLQTVHSIPFTIFKIEAGQRP

SEQ ID NO: 38097 - protein, 25 aa, synthetic construct
  source 1..25: note = Seed: NSCVKLQTVHSIPLTINKEEALQRP
NSCVKLQTVHSIPFTIFKIEAHQRP

SEQ ID NO: 38098 - protein, 25 aa, synthetic construct
  source 1..25: note = Seed: NSCVKLQTVHSIPLTINKEEALQRP
NSCVKLQTVHSIPFTIFKIEAIQRP

SEQ ID NO: 38099 - protein, 25 aa, synthetic construct
  source 1..25: note = Seed: NSCVKLQTVHSIPLTINKEEALQRP
NSCVKLQTVHSIPFTIFKIEALQRP

SEQ ID NO: 38100 - protein, 25 aa, synthetic construct
  source 1..25: note = Seed: NSCVKLQTVHSIPLTINKEEALQRP
NSCVKLQTVHSIPFTIFKIEAMQRP

SEQ ID NO: 38101 - protein, 25 aa, synthetic construct
  source 1..25: note = Seed: NSCVKLQTVHSIPLTINKEEALQRP
NSCVKLQTVHSIPFTIFKIEANQRP

SEQ ID NO: 38102 - protein, 25 aa, synthetic construct
  source 1..25: note = Seed: NSCVKLQTVHSIPLTINKEEALQRP
NSCVKLQTVHSIPFTIFKIEAQQRP

SEQ ID NO: 38103 - protein, 25 aa, synthetic construct
  source 1..25: note = Seed: NSCVKLQTVHSIPLTINKEEALQRP
NSCVKLQTVHSIPFTIFKIEARQRP

SEQ ID NO: 38104 - protein, 25 aa, synthetic construct
  source 1..25: note = Seed: NSCVKLQTVHSIPLTINKEEALQRP
NSCVKLQTVHSIPFTIFKIEASQRP

SEQ ID NO: 38105 - protein, 25 aa, synthetic construct
  source 1..25: note = Seed: NSCVKLQTVHSIPLTINKEEALQRP
NSCVKLQTVHSIPFTIFKIEATQRP

SEQ ID NO: 38106 - protein, 25 aa, synthetic construct
  source 1..25: note = Seed: NSCVKLQTVHSIPLTINKEEALQRP
NSCVKLQTVHSIPFTIFKIEAVQRP

SEQ ID NO: 38107 - protein, 25 aa, synthetic construct
  source 1..25: note = Seed: NSCVKLQTVHSIPLTINKEEALQRP
NSCVKLQTVHSIPFTIFKIEAYQRP

SEQ ID NO: 38108 - protein, 25 aa, synthetic construct
  source 1..25: note = Seed: NSCVKLQTVHSIPLTINKEEALQRP
NSCVKLQTVHSIPFTIFKKEALQRP

SEQ ID NO: 38109 - protein, 25 aa, synthetic construct
  source 1..25: note = Seed: NSCVKLQTVHSIPLTINKEEALQRP
NSCVKLQTVHSIPFTIFKLEAAQRP

SEQ ID NO: 38110 - protein, 25 aa, synthetic construct
  source 1..25: note = Seed: NSCVKLQTVHSIPLTINKEEALQRP
NSCVKLQTVHSIPFTIFKLEACQRP

SEQ ID NO: 38111 - protein, 25 aa, synthetic construct
  source 1..25: note = Seed: NSCVKLQTVHSIPLTINKEEALQRP
NSCVKLQTVHSIPFTIFKLEADQRP

SEQ ID NO: 38112 - protein, 25 aa, synthetic construct
  source 1..25: note = Seed: NSCVKLQTVHSIPLTINKEEALQRP
NSCVKLQTVHSIPFTIFKLEAEQRP

SEQ ID NO: 38113 - protein, 25 aa, synthetic construct
  source 1..25: note = Seed: NSCVKLQTVHSIPLTINKEEALQRP
NSCVKLQTVHSIPFTIFKLEAFQRP

SEQ ID NO: 38114 - protein, 25 aa, synthetic construct
  source 1..25: note = Seed: NSCVKLQTVHSIPLTINKEEALQRP
NSCVKLQTVHSIPFTIFKLEAGQRP

SEQ ID NO: 38115 - protein, 25 aa, synthetic construct
  source 1..25: note = Seed: NSCVKLQTVHSIPLTINKEEALQRP
NSCVKLQTVHSIPFTIFKLEAHQRP

SEQ ID NO: 38116 - protein, 25 aa, synthetic construct
  source 1..25: note = Seed: NSCVKLQTVHSIPLTINKEEALQRP
NSCVKLQTVHSIPFTIFKLEAIQRP

SEQ ID NO: 38117 - protein, 25 aa, synthetic construct
  source 1..25: note = Seed: NSCVKLQTVHSIPLTINKEEALQRP
NSCVKLQTVHSIPFTIFKLEAKQRP

SEQ ID NO: 38118 - protein, 25 aa, synthetic construct
  source 1..25: note = Seed: NSCVKLQTVHSIPLTINKEEALQRP
NSCVKLQTVHSIPFTIFKLEALQRP

SEQ ID NO: 38119 - protein, 25 aa, synthetic construct
  source 1..25: note = Seed: NSCVKLQTVHSIPLTINKEEALQRP
NSCVKLQTVHSIPFTIFKLEAMQRP

SEQ ID NO: 38120 - protein, 25 aa, synthetic construct
  source 1..25: note = Seed: NSCVKLQTVHSIPLTINKEEALQRP
NSCVKLQTVHSIPFTIFKLEANQRP

SEQ ID NO: 38121 - protein, 25 aa, synthetic construct
  source 1..25: note = Seed: NSCVKLQTVHSIPLTINKEEALQRP
NSCVKLQTVHSIPFTIFKLEAQQRP

SEQ ID NO: 38122 - protein, 25 aa, synthetic construct
  source 1..25: note = Seed: NSCVKLQTVHSIPLTINKEEALQRP
NSCVKLQTVHSIPFTIFKLEARQRP

SEQ ID NO: 38123 - protein, 25 aa, synthetic construct
  source 1..25: note = Seed: NSCVKLQTVHSIPLTINKEEALQRP
NSCVKLQTVHSIPFTIFKLEASQRP

SEQ ID NO: 38124 - protein, 25 aa, synthetic construct
  source 1..25: note = Seed: NSCVKLQTVHSIPLTINKEEALQRP
NSCVKLQTVHSIPFTIFKLEATQRP

SEQ ID NO: 38125 - protein, 25 aa, synthetic construct
  source 1..25: note = Seed: NSCVKLQTVHSIPLTINKEEALQRP
NSCVKLQTVHSIPFTIFKLEAVQRP

SEQ ID NO: 38126 - protein, 25 aa, synthetic construct
  source 1..25: note = Seed: NSCVKLQTVHSIPLTINKEEALQRP
NSCVKLQTVHSIPFTIFKLEAYQRP

SEQ ID NO: 38127 - protein, 25 aa, synthetic construct
  source 1..25: note = Seed: NSCVKLQTVHSIPLTINKEEALQRP
NSCVKLQTVHSIPFTIFKMEAAQRP

SEQ ID NO: 38128 - protein, 25 aa, synthetic construct
  source 1..25: note = Seed: NSCVKLQTVHSIPLTINKEEALQRP
NSCVKLQTVHSIPFTIFKMEADQRP

SEQ ID NO: 38129 - protein, 25 aa, synthetic construct
  source 1..25: note = Seed: NSCVKLQTVHSIPLTINKEEALQRP
NSCVKLQTVHSIPFTIFKMEAEQRP

SEQ ID NO: 38130 - protein, 25 aa, synthetic construct
  source 1..25: note = Seed: NSCVKLQTVHSIPLTINKEEALQRP
NSCVKLQTVHSIPFTIFKMEAFQRP

SEQ ID NO: 38131 - protein, 25 aa, synthetic construct
  source 1..25: note = Seed: NSCVKLQTVHSIPLTINKEEALQRP
NSCVKLQTVHSIPFTIFKMEAIQRP

SEQ ID NO: 38132 - protein, 25 aa, synthetic construct
  source 1..25: note = Seed: NSCVKLQTVHSIPLTINKEEALQRP
NSCVKLQTVHSIPFTIFKMEALQRP

SEQ ID NO: 38133 - protein, 25 aa, synthetic construct
  source 1..25: note = Seed: NSCVKLQTVHSIPLTINKEEALQRP
NSCVKLQTVHSIPFTIFKMEAMQRP

SEQ ID NO: 38134 - protein, 25 aa, synthetic construct
  source 1..25: note = Seed: NSCVKLQTVHSIPLTINKEEALQRP
NSCVKLQTVHSIPFTIFKMEANQRP

SEQ ID NO: 38135 - protein, 25 aa, synthetic construct
  source 1..25: note = Seed: NSCVKLQTVHSIPLTINKEEALQRP
NSCVKLQTVHSIPFTIFKMEARQRP

SEQ ID NO: 38136 - protein, 25 aa, synthetic construct
  source 1..25: note = Seed: NSCVKLQTVHSIPLTINKEEALQRP
NSCVKLQTVHSIPFTIFKMEASQRP

SEQ ID NO: 38137 - protein, 25 aa, synthetic construct
  source 1..25: note = Seed: NSCVKLQTVHSIPLTINKEEALQRP
NSCVKLQTVHSIPFTIFKMEATQRP

SEQ ID NO: 38138 - protein, 25 aa, synthetic construct
  source 1..25: note = Seed: NSCVKLQTVHSIPLTINKEEALQRP
NSCVKLQTVHSIPFTIFKMEAVQRP

SEQ ID NO: 38139 - protein, 25 aa, synthetic construct
  source 1..25: note = Seed: NSCVKLQTVHSIPLTINKEEALQRP
NSCVKLQTVHSIPFTIFKMEAYQRP

SEQ ID NO: 38140 - protein, 25 aa, synthetic construct
  source 1..25: note = Seed: NSCVKLQTVHSIPLTINKEEALQRP
NSCVKLQTVHSIPFTIFKNEAAQRP

SEQ ID NO: 38141 - protein, 25 aa, synthetic construct
  source 1..25: note = Seed: NSCVKLQTVHSIPLTINKEEALQRP
NSCVKLQTVHSIPFTIFKNEADQRP

SEQ ID NO: 38142 - protein, 25 aa, synthetic construct
  source 1..25: note = Seed: NSCVKLQTVHSIPLTINKEEALQRP
NSCVKLQTVHSIPFTIFKNEAEQRP

SEQ ID NO: 38143 - protein, 25 aa, synthetic construct
  source 1..25: note = Seed: NSCVKLQTVHSIPLTINKEEALQRP
NSCVKLQTVHSIPFTIFKNEAFQRP

SEQ ID NO: 38144 - protein, 25 aa, synthetic construct
  source 1..25: note = Seed: NSCVKLQTVHSIPLTINKEEALQRP
NSCVKLQTVHSIPFTIFKNEAIQRP

SEQ ID NO: 38145 - protein, 25 aa, synthetic construct
  source 1..25: note = Seed: NSCVKLQTVHSIPLTINKEEALQRP
NSCVKLQTVHSIPFTIFKNEALQRP

SEQ ID NO: 38146 - protein, 25 aa, synthetic construct
  source 1..25: note = Seed: NSCVKLQTVHSIPLTINKEEALQRP
NSCVKLQTVHSIPFTIFKNEAMQRP

SEQ ID NO: 38147 - protein, 25 aa, synthetic construct
  source 1..25: note = Seed: NSCVKLQTVHSIPLTINKEEALQRP
NSCVKLQTVHSIPFTIFKNEASQRP

SEQ ID NO: 38148 - protein, 25 aa, synthetic construct
  source 1..25: note = Seed: NSCVKLQTVHSIPLTINKEEALQRP
NSCVKLQTVHSIPFTIFKNEAVQRP

SEQ ID NO: 38149 - protein, 25 aa, synthetic construct
  source 1..25: note = Seed: NSCVKLQTVHSIPLTINKEEALQRP
NSCVKLQTVHSIPFTIFKPEAFQRP

SEQ ID NO: 38150 - protein, 25 aa, synthetic construct
  source 1..25: note = Seed: NSCVKLQTVHSIPLTINKEEALQRP
NSCVKLQTVHSIPFTIFKPEAIQRP

SEQ ID NO: 38151 - protein, 25 aa, synthetic construct
  source 1..25: note = Seed: NSCVKLQTVHSIPLTINKEEALQRP
NSCVKLQTVHSIPFTIFKPEALQRP

SEQ ID NO: 38152 - protein, 25 aa, synthetic construct
  source 1..25: note = Seed: NSCVKLQTVHSIPLTINKEEALQRP
NSCVKLQTVHSIPFTIFKPEAMQRP

SEQ ID NO: 38153 - protein, 25 aa, synthetic construct
  source 1..25: note = Seed: NSCVKLQTVHSIPLTINKEEALQRP
NSCVKLQTVHSIPFTIFKPEAVQRP

SEQ ID NO: 38154 - protein, 25 aa, synthetic construct
  source 1..25: note = Seed: NSCVKLQTVHSIPLTINKEEALQRP
NSCVKLQTVHSIPFTIFKQEAIQRP

SEQ ID NO: 38155 - protein, 25 aa, synthetic construct
  source 1..25: note = Seed: NSCVKLQTVHSIPLTINKEEALQRP
NSCVKLQTVHSIPFTIFKQEALQRP

SEQ ID NO: 38156 - protein, 25 aa, synthetic construct
  source 1..25: note = Seed: NSCVKLQTVHSIPLTINKEEALQRP
NSCVKLQTVHSIPFTIFKQEAVQRP

SEQ ID NO: 38157 - protein, 25 aa, synthetic construct
  source 1..25: note = Seed: NSCVKLQTVHSIPLTINKEEALQRP
NSCVKLQTVHSIPFTIFKREAFQRP

SEQ ID NO: 38158 - protein, 25 aa, synthetic construct
  source 1..25: note = Seed: NSCVKLQTVHSIPLTINKEEALQRP
NSCVKLQTVHSIPFTIFKREALQRP

SEQ ID NO: 38159 - protein, 25 aa, synthetic construct
  source 1..25: note = Seed: NSCVKLQTVHSIPLTINKEEALQRP
NSCVKLQTVHSIPFTIFKREAMQRP

SEQ ID NO: 38160 - protein, 25 aa, synthetic construct
  source 1..25: note = Seed: NSCVKLQTVHSIPLTINKEEALQRP
NSCVKLQTVHSIPFTIFKREARQRP

SEQ ID NO: 38161 - protein, 25 aa, synthetic construct
  source 1..25: note = Seed: NSCVKLQTVHSIPLTINKEEALQRP
NSCVKLQTVHSIPFTIFKREAYQRP

SEQ ID NO: 38162 - protein, 25 aa, synthetic construct
  source 1..25: note = Seed: NSCVKLQTVHSIPLTINKEEALQRP
NSCVKLQTVHSIPFTIFKSEAAQRP

SEQ ID NO: 38163 - protein, 25 aa, synthetic construct
  source 1..25: note = Seed: NSCVKLQTVHSIPLTINKEEALQRP
NSCVKLQTVHSIPFTIFKSEADQRP

SEQ ID NO: 38164 - protein, 25 aa, synthetic construct
  source 1..25: note = Seed: NSCVKLQTVHSIPLTINKEEALQRP
NSCVKLQTVHSIPFTIFKSEAEQRP

SEQ ID NO: 38165 - protein, 25 aa, synthetic construct
  source 1..25: note = Seed: NSCVKLQTVHSIPLTINKEEALQRP
NSCVKLQTVHSIPFTIFKSEAFQRP

SEQ ID NO: 38166 - protein, 25 aa, synthetic construct
  source 1..25: note = Seed: NSCVKLQTVHSIPLTINKEEALQRP
NSCVKLQTVHSIPFTIFKSEAIQRP

SEQ ID NO: 38167 - protein, 25 aa, synthetic construct
  source 1..25: note = Seed: NSCVKLQTVHSIPLTINKEEALQRP
NSCVKLQTVHSIPFTIFKSEALQRP

SEQ ID NO: 38168 - protein, 25 aa, synthetic construct
  source 1..25: note = Seed: NSCVKLQTVHSIPLTINKEEALQRP
NSCVKLQTVHSIPFTIFKSEAMQRP

SEQ ID NO: 38169 - protein, 25 aa, synthetic construct
  source 1..25: note = Seed: NSCVKLQTVHSIPLTINKEEALQRP
NSCVKLQTVHSIPFTIFKSEASQRP

SEQ ID NO: 38170 - protein, 25 aa, synthetic construct
  source 1..25: note = Seed: NSCVKLQTVHSIPLTINKEEALQRP
NSCVKLQTVHSIPFTIFKSEAVQRP

SEQ ID NO: 38171 - protein, 25 aa, synthetic construct
  source 1..25: note = Seed: NSCVKLQTVHSIPLTINKEEALQRP
NSCVKLQTVHSIPFTIFKTEAAQRP

SEQ ID NO: 38172 - protein, 25 aa, synthetic construct
  source 1..25: note = Seed: NSCVKLQTVHSIPLTINKEEALQRP
NSCVKLQTVHSIPFTIFKTEADQRP

SEQ ID NO: 38173 - protein, 25 aa, synthetic construct
  source 1..25: note = Seed: NSCVKLQTVHSIPLTINKEEALQRP
NSCVKLQTVHSIPFTIFKTEAEQRP

SEQ ID NO: 38174 - protein, 25 aa, synthetic construct
  source 1..25: note = Seed: NSCVKLQTVHSIPLTINKEEALQRP
NSCVKLQTVHSIPFTIFKTEAFQRP

SEQ ID NO: 38175 - protein, 25 aa, synthetic construct
  source 1..25: note = Seed: NSCVKLQTVHSIPLTINKEEALQRP
NSCVKLQTVHSIPFTIFKTEAHQRP

SEQ ID NO: 38176 - protein, 25 aa, synthetic construct
  source 1..25: note = Seed: NSCVKLQTVHSIPLTINKEEALQRP
NSCVKLQTVHSIPFTIFKTEAIQRP

SEQ ID NO: 38177 - protein, 25 aa, synthetic construct
  source 1..25: note = Seed: NSCVKLQTVHSIPLTINKEEALQRP
NSCVKLQTVHSIPFTIFKTEALQRP

SEQ ID NO: 38178 - protein, 25 aa, synthetic construct
  source 1..25: note = Seed: NSCVKLQTVHSIPLTINKEEALQRP
NSCVKLQTVHSIPFTIFKTEAMQRP

SEQ ID NO: 38179 - protein, 25 aa, synthetic construct
  source 1..25: note = Seed: NSCVKLQTVHSIPLTINKEEALQRP
NSCVKLQTVHSIPFTIFKTEASQRP

SEQ ID NO: 38180 - protein, 25 aa, synthetic construct
  source 1..25: note = Seed: NSCVKLQTVHSIPLTINKEEALQRP
NSCVKLQTVHSIPFTIFKTEAVQRP

SEQ ID NO: 38181 - protein, 25 aa, synthetic construct
  source 1..25: note = Seed: NSCVKLQTVHSIPLTINKEEALQRP
NSCVKLQTVHSIPFTIFKTEAYQRP

SEQ ID NO: 38182 - protein, 25 aa, synthetic construct
  source 1..25: note = Seed: NSCVKLQTVHSIPLTINKEEALQRP
NSCVKLQTVHSIPFTIFKVEAAQRP

SEQ ID NO: 38183 - protein, 25 aa, synthetic construct
  source 1..25: note = Seed: NSCVKLQTVHSIPLTINKEEALQRP
NSCVKLQTVHSIPFTIFKVEADQRP

SEQ ID NO: 38184 - protein, 25 aa, synthetic construct
  source 1..25: note = Seed: NSCVKLQTVHSIPLTINKEEALQRP
NSCVKLQTVHSIPFTIFKVEAEQRP

SEQ ID NO: 38185 - protein, 25 aa, synthetic construct
  source 1..25: note = Seed: NSCVKLQTVHSIPLTINKEEALQRP
NSCVKLQTVHSIPFTIFKVEAFQRP

SEQ ID NO: 38186 - protein, 25 aa, synthetic construct
  source 1..25: note = Seed: NSCVKLQTVHSIPLTINKEEALQRP
NSCVKLQTVHSIPFTIFKVEAIQRP

SEQ ID NO: 38187 - protein, 25 aa, synthetic construct
  source 1..25: note = Seed: NSCVKLQTVHSIPLTINKEEALQRP
NSCVKLQTVHSIPFTIFKVEALQRP

SEQ ID NO: 38188 - protein, 25 aa, synthetic construct
  source 1..25: note = Seed: NSCVKLQTVHSIPLTINKEEALQRP
NSCVKLQTVHSIPFTIFKVEAMQRP

SEQ ID NO: 38189 - protein, 25 aa, synthetic construct
  source 1..25: note = Seed: NSCVKLQTVHSIPLTINKEEALQRP
NSCVKLQTVHSIPFTIFKVEANQRP

SEQ ID NO: 38190 - protein, 25 aa, synthetic construct
  source 1..25: note = Seed: NSCVKLQTVHSIPLTINKEEALQRP
NSCVKLQTVHSIPFTIFKVEARQRP

SEQ ID NO: 38191 - protein, 25 aa, synthetic construct
  source 1..25: note = Seed: NSCVKLQTVHSIPLTINKEEALQRP
NSCVKLQTVHSIPFTIFKVEASQRP

SEQ ID NO: 38192 - protein, 25 aa, synthetic construct
  source 1..25: note = Seed: NSCVKLQTVHSIPLTINKEEALQRP
NSCVKLQTVHSIPFTIFKVEATQRP

SEQ ID NO: 38193 - protein, 25 aa, synthetic construct
  source 1..25: note = Seed: NSCVKLQTVHSIPLTINKEEALQRP
NSCVKLQTVHSIPFTIFKVEAVQRP

SEQ ID NO: 38194 - protein, 25 aa, synthetic construct
  source 1..25: note = Seed: NSCVKLQTVHSIPLTINKEEALQRP
NSCVKLQTVHSIPFTIFKVEAYQRP

SEQ ID NO: 38195 - protein, 25 aa, synthetic construct
  source 1..25: note = Seed: NSCVKLQTVHSIPLTINKEEALQRP
NSCVKLQTVHSIPFTIFKWEAAQRP

SEQ ID NO: 38196 - protein, 25 aa, synthetic construct
  source 1..25: note = Seed: NSCVKLQTVHSIPLTINKEEALQRP
NSCVKLQTVHSIPFTIFKWEACQRP

SEQ ID NO: 38197 - protein, 25 aa, synthetic construct
  source 1..25: note = Seed: NSCVKLQTVHSIPLTINKEEALQRP
NSCVKLQTVHSIPFTIFKWEADQRP

SEQ ID NO: 38198 - protein, 25 aa, synthetic construct
  source 1..25: note = Seed: NSCVKLQTVHSIPLTINKEEALQRP
NSCVKLQTVHSIPFTIFKWEAEQRP

SEQ ID NO: 38199 - protein, 25 aa, synthetic construct
  source 1..25: note = Seed: NSCVKLQTVHSIPLTINKEEALQRP
NSCVKLQTVHSIPFTIFKWEAFQRP

SEQ ID NO: 38200 - protein, 25 aa, synthetic construct
  source 1..25: note = Seed: NSCVKLQTVHSIPLTINKEEALQRP
NSCVKLQTVHSIPFTIFKWEAGQRP

SEQ ID NO: 38201 - protein, 25 aa, synthetic construct
  source 1..25: note = Seed: NSCVKLQTVHSIPLTINKEEALQRP
NSCVKLQTVHSIPFTIFKWEAHQRP

SEQ ID NO: 38202 - protein, 25 aa, synthetic construct
  source 1..25: note = Seed: NSCVKLQTVHSIPLTINKEEALQRP
NSCVKLQTVHSIPFTIFKWEAIQRP

SEQ ID NO: 38203 - protein, 25 aa, synthetic construct
  source 1..25: note = Seed: NSCVKLQTVHSIPLTINKEEALQRP
NSCVKLQTVHSIPFTIFKWEALQRP

SEQ ID NO: 38204 - protein, 25 aa, synthetic construct
  source 1..25: note = Seed: NSCVKLQTVHSIPLTINKEEALQRP
NSCVKLQTVHSIPFTIFKWEAMQRP

SEQ ID NO: 38205 - protein, 25 aa, synthetic construct
  source 1..25: note = Seed: NSCVKLQTVHSIPLTINKEEALQRP
NSCVKLQTVHSIPFTIFKWEANQRP

SEQ ID NO: 38206 - protein, 25 aa, synthetic construct
  source 1..25: note = Seed: NSCVKLQTVHSIPLTINKEEALQRP
NSCVKLQTVHSIPFTIFKWEAPQRP

SEQ ID NO: 38207 - protein, 25 aa, synthetic construct
  source 1..25: note = Seed: NSCVKLQTVHSIPLTINKEEALQRP
NSCVKLQTVHSIPFTIFKWEAQQRP

SEQ ID NO: 38208 - protein, 25 aa, synthetic construct
  source 1..25: note = Seed: NSCVKLQTVHSIPLTINKEEALQRP
NSCVKLQTVHSIPFTIFKWEARQRP

SEQ ID NO: 38209 - protein, 25 aa, synthetic construct
  source 1..25: note = Seed: NSCVKLQTVHSIPLTINKEEALQRP
NSCVKLQTVHSIPFTIFKWEASQRP

SEQ ID NO: 38210 - protein, 25 aa, synthetic construct
  source 1..25: note = Seed: NSCVKLQTVHSIPLTINKEEALQRP
NSCVKLQTVHSIPFTIFKWEATQRP

SEQ ID NO: 38211 - protein, 25 aa, synthetic construct
  source 1..25: note = Seed: NSCVKLQTVHSIPLTINKEEALQRP
NSCVKLQTVHSIPFTIFKWEAVQRP

SEQ ID NO: 38212 - protein, 25 aa, synthetic construct
  source 1..25: note = Seed: NSCVKLQTVHSIPLTINKEEALQRP
NSCVKLQTVHSIPFTIFKWEAYQRP

SEQ ID NO: 38213 - protein, 25 aa, synthetic construct
  source 1..25: note = Seed: NSCVKLQTVHSIPLTINKEEALQRP
NSCVKLQTVHSIPFTIFKYEAAQRP

SEQ ID NO: 38214 - protein, 25 aa, synthetic construct
  source 1..25: note = Seed: NSCVKLQTVHSIPLTINKEEALQRP
NSCVKLQTVHSIPFTIFKYEACQRP

SEQ ID NO: 38215 - protein, 25 aa, synthetic construct
  source 1..25: note = Seed: NSCVKLQTVHSIPLTINKEEALQRP
NSCVKLQTVHSIPFTIFKYEADQRP

SEQ ID NO: 38216 - protein, 25 aa, synthetic construct
  source 1..25: note = Seed: NSCVKLQTVHSIPLTINKEEALQRP
NSCVKLQTVHSIPFTIFKYEAEQRP

SEQ ID NO: 38217 - protein, 25 aa, synthetic construct
  source 1..25: note = Seed: NSCVKLQTVHSIPLTINKEEALQRP
NSCVKLQTVHSIPFTIFKYEAFQRP

SEQ ID NO: 38218 - protein, 25 aa, synthetic construct
  source 1..25: note = Seed: NSCVKLQTVHSIPLTINKEEALQRP
NSCVKLQTVHSIPFTIFKYEAGQRP

SEQ ID NO: 38219 - protein, 25 aa, synthetic construct
  source 1..25: note = Seed: NSCVKLQTVHSIPLTINKEEALQRP
NSCVKLQTVHSIPFTIFKYEAHQRP

SEQ ID NO: 38220 - protein, 25 aa, synthetic construct
  source 1..25: note = Seed: NSCVKLQTVHSIPLTINKEEALQRP
NSCVKLQTVHSIPFTIFKYEAIQRP

SEQ ID NO: 38221 - protein, 25 aa, synthetic construct
  source 1..25: note = Seed: NSCVKLQTVHSIPLTINKEEALQRP
NSCVKLQTVHSIPFTIFKYEAKQRP

SEQ ID NO: 38222 - protein, 25 aa, synthetic construct
  source 1..25: note = Seed: NSCVKLQTVHSIPLTINKEEALQRP
NSCVKLQTVHSIPFTIFKYEALQRP

SEQ ID NO: 38223 - protein, 25 aa, synthetic construct
  source 1..25: note = Seed: NSCVKLQTVHSIPLTINKEEALQRP
NSCVKLQTVHSIPFTIFKYEAMQRP

SEQ ID NO: 38224 - protein, 25 aa, synthetic construct
  source 1..25: note = Seed: NSCVKLQTVHSIPLTINKEEALQRP
NSCVKLQTVHSIPFTIFKYEANQRP

SEQ ID NO: 38225 - protein, 25 aa, synthetic construct
  source 1..25: note = Seed: NSCVKLQTVHSIPLTINKEEALQRP
NSCVKLQTVHSIPFTIFKYEAPQRP

SEQ ID NO: 38226 - protein, 25 aa, synthetic construct
  source 1..25: note = Seed: NSCVKLQTVHSIPLTINKEEALQRP
NSCVKLQTVHSIPFTIFKYEAQQRP

SEQ ID NO: 38227 - protein, 25 aa, synthetic construct
  source 1..25: note = Seed: NSCVKLQTVHSIPLTINKEEALQRP
NSCVKLQTVHSIPFTIFKYEARQRP

SEQ ID NO: 38228 - protein, 25 aa, synthetic construct
  source 1..25: note = Seed: NSCVKLQTVHSIPLTINKEEALQRP
NSCVKLQTVHSIPFTIFKYEASQRP

SEQ ID NO: 38229 - protein, 25 aa, synthetic construct
  source 1..25: note = Seed: NSCVKLQTVHSIPLTINKEEALQRP
NSCVKLQTVHSIPFTIFKYEATQRP

SEQ ID NO: 38230 - protein, 25 aa, synthetic construct
  source 1..25: note = Seed: NSCVKLQTVHSIPLTINKEEALQRP
NSCVKLQTVHSIPFTIFKYEAVQRP

SEQ ID NO: 38231 - protein, 25 aa, synthetic construct
  source 1..25: note = Seed: NSCVKLQTVHSIPLTINKEEALQRP
NSCVKLQTVHSIPFTIFKYEAWQRP

SEQ ID NO: 38232 - protein, 25 aa, synthetic construct
  source 1..25: note = Seed: NSCVKLQTVHSIPLTINKEEALQRP
NSCVKLQTVHSIPFTIFKYEAYQRP

SEQ ID NO: 38233 - protein, 25 aa, synthetic construct
  source 1..25: note = Seed: NSCVKLQTVHSIPLTINKEEALQRP
NSCVKLQTVHSIPFTIGKFEAAQRP

SEQ ID NO: 38234 - protein, 25 aa, synthetic construct
  source 1..25: note = Seed: NSCVKLQTVHSIPLTINKEEALQRP
NSCVKLQTVHSIPFTIGKFEAFQRP

SEQ ID NO: 38235 - protein, 25 aa, synthetic construct
  source 1..25: note = Seed: NSCVKLQTVHSIPLTINKEEALQRP
NSCVKLQTVHSIPFTIGKFEAIQRP

SEQ ID NO: 38236 - protein, 25 aa, synthetic construct
  source 1..25: note = Seed: NSCVKLQTVHSIPLTINKEEALQRP
NSCVKLQTVHSIPFTIGKFEALQRP

SEQ ID NO: 38237 - protein, 25 aa, synthetic construct
  source 1..25: note = Seed: NSCVKLQTVHSIPLTINKEEALQRP
NSCVKLQTVHSIPFTIGKFEAMQRP

SEQ ID NO: 38238 - protein, 25 aa, synthetic construct
  source 1..25: note = Seed: NSCVKLQTVHSIPLTINKEEALQRP
NSCVKLQTVHSIPFTIGKFEATQRP

SEQ ID NO: 38239 - protein, 25 aa, synthetic construct
  source 1..25: note = Seed: NSCVKLQTVHSIPLTINKEEALQRP
NSCVKLQTVHSIPFTIGKFEAVQRP

SEQ ID NO: 38240 - protein, 25 aa, synthetic construct
  source 1..25: note = Seed: NSCVKLQTVHSIPLTINKEEALQRP
NSCVKLQTVHSIPFTIGKFEAYQRP

SEQ ID NO: 38241 - protein, 25 aa, synthetic construct
  source 1..25: note = Seed: NSCVKLQTVHSIPLTINKEEALQRP
NSCVKLQTVHSIPFTIHKFEAAQRP

SEQ ID NO: 38242 - protein, 25 aa, synthetic construct
  source 1..25: note = Seed: NSCVKLQTVHSIPLTINKEEALQRP
NSCVKLQTVHSIPFTIHKFEACQRP

SEQ ID NO: 38243 - protein, 25 aa, synthetic construct
  source 1..25: note = Seed: NSCVKLQTVHSIPLTINKEEALQRP
NSCVKLQTVHSIPFTIHKFEADQRP

SEQ ID NO: 38244 - protein, 25 aa, synthetic construct
  source 1..25: note = Seed: NSCVKLQTVHSIPLTINKEEALQRP
NSCVKLQTVHSIPFTIHKFEAEQRP

SEQ ID NO: 38245 - protein, 25 aa, synthetic construct
  source 1..25: note = Seed: NSCVKLQTVHSIPLTINKEEALQRP
NSCVKLQTVHSIPFTIHKFEAFQRP

SEQ ID NO: 38246 - protein, 25 aa, synthetic construct
  source 1..25: note = Seed: NSCVKLQTVHSIPLTINKEEALQRP
NSCVKLQTVHSIPFTIHKFEAGQRP

SEQ ID NO: 38247 - protein, 25 aa, synthetic construct
  source 1..25: note = Seed: NSCVKLQTVHSIPLTINKEEALQRP
NSCVKLQTVHSIPFTIHKFEAHQRP

SEQ ID NO: 38248 - protein, 25 aa, synthetic construct
  source 1..25: note = Seed: NSCVKLQTVHSIPLTINKEEALQRP
NSCVKLQTVHSIPFTIHKFEAIQRP

SEQ ID NO: 38249 - protein, 25 aa, synthetic construct
  source 1..25: note = Seed: NSCVKLQTVHSIPLTINKEEALQRP
NSCVKLQTVHSIPFTIHKFEALQRP

SEQ ID NO: 38250 - protein, 25 aa, synthetic construct
  source 1..25: note = Seed: NSCVKLQTVHSIPLTINKEEALQRP
NSCVKLQTVHSIPFTIHKFEAMQRP

SEQ ID NO: 38251 - protein, 25 aa, synthetic construct
  source 1..25: note = Seed: NSCVKLQTVHSIPLTINKEEALQRP
NSCVKLQTVHSIPFTIHKFEANQRP

SEQ ID NO: 38252 - protein, 25 aa, synthetic construct
  source 1..25: note = Seed: NSCVKLQTVHSIPLTINKEEALQRP
NSCVKLQTVHSIPFTIHKFEAPQRP

SEQ ID NO: 38253 - protein, 25 aa, synthetic construct
  source 1..25: note = Seed: NSCVKLQTVHSIPLTINKEEALQRP
NSCVKLQTVHSIPFTIHKFEAQQRP

SEQ ID NO: 38254 - protein, 25 aa, synthetic construct
  source 1..25: note = Seed: NSCVKLQTVHSIPLTINKEEALQRP
NSCVKLQTVHSIPFTIHKFEARQRP

SEQ ID NO: 38255 - protein, 25 aa, synthetic construct
  source 1..25: note = Seed: NSCVKLQTVHSIPLTINKEEALQRP
NSCVKLQTVHSIPFTIHKFEASQRP

SEQ ID NO: 38256 - protein, 25 aa, synthetic construct
  source 1..25: note = Seed: NSCVKLQTVHSIPLTINKEEALQRP
NSCVKLQTVHSIPFTIHKFEATQRP

SEQ ID NO: 38257 - protein, 25 aa, synthetic construct
  source 1..25: note = Seed: NSCVKLQTVHSIPLTINKEEALQRP
NSCVKLQTVHSIPFTIHKFEAVQRP

SEQ ID NO: 38258 - protein, 25 aa, synthetic construct
  source 1..25: note = Seed: NSCVKLQTVHSIPLTINKEEALQRP
NSCVKLQTVHSIPFTIHKFEAWQRP

SEQ ID NO: 38259 - protein, 25 aa, synthetic construct
  source 1..25: note = Seed: NSCVKLQTVHSIPLTINKEEALQRP
NSCVKLQTVHSIPFTIHKFEAYQRP

SEQ ID NO: 38260 - protein, 25 aa, synthetic construct
  source 1..25: note = Seed: NSCVKLQTVHSIPLTINKEEALQRP
NSCVKLQTVHSIPFTIHKIEAFQRP

SEQ ID NO: 38261 - protein, 25 aa, synthetic construct
  source 1..25: note = Seed: NSCVKLQTVHSIPLTINKEEALQRP
NSCVKLQTVHSIPFTIHKIEAIQRP

SEQ ID NO: 38262 - protein, 25 aa, synthetic construct
  source 1..25: note = Seed: NSCVKLQTVHSIPLTINKEEALQRP
NSCVKLQTVHSIPFTIHKIEALQRP

SEQ ID NO: 38263 - protein, 25 aa, synthetic construct
  source 1..25: note = Seed: NSCVKLQTVHSIPLTINKEEALQRP
NSCVKLQTVHSIPFTIHKIEAMQRP

SEQ ID NO: 38264 - protein, 25 aa, synthetic construct
  source 1..25: note = Seed: NSCVKLQTVHSIPLTINKEEALQRP
NSCVKLQTVHSIPFTIHKIEAVQRP

SEQ ID NO: 38265 - protein, 25 aa, synthetic construct
  source 1..25: note = Seed: NSCVKLQTVHSIPLTINKEEALQRP
NSCVKLQTVHSIPFTIHKLEAFQRP

SEQ ID NO: 38266 - protein, 25 aa, synthetic construct
  source 1..25: note = Seed: NSCVKLQTVHSIPLTINKEEALQRP
NSCVKLQTVHSIPFTIHKLEAIQRP

SEQ ID NO: 38267 - protein, 25 aa, synthetic construct
  source 1..25: note = Seed: NSCVKLQTVHSIPLTINKEEALQRP
NSCVKLQTVHSIPFTIHKLEALQRP

SEQ ID NO: 38268 - protein, 25 aa, synthetic construct
  source 1..25: note = Seed: NSCVKLQTVHSIPLTINKEEALQRP
NSCVKLQTVHSIPFTIHKLEAMQRP

SEQ ID NO: 38269 - protein, 25 aa, synthetic construct
  source 1..25: note = Seed: NSCVKLQTVHSIPLTINKEEALQRP
NSCVKLQTVHSIPFTIHKLEAVQRP

SEQ ID NO: 38270 - protein, 25 aa, synthetic construct
  source 1..25: note = Seed: NSCVKLQTVHSIPLTINKEEALQRP
NSCVKLQTVHSIPFTIHKLEAYQRP

SEQ ID NO: 38271 - protein, 25 aa, synthetic construct
  source 1..25: note = Seed: NSCVKLQTVHSIPLTINKEEALQRP
NSCVKLQTVHSIPFTIHKMEAFQRP

SEQ ID NO: 38272 - protein, 25 aa, synthetic construct
  source 1..25: note = Seed: NSCVKLQTVHSIPLTINKEEALQRP
NSCVKLQTVHSIPFTIHKMEAIQRP

SEQ ID NO: 38273 - protein, 25 aa, synthetic construct
  source 1..25: note = Seed: NSCVKLQTVHSIPLTINKEEALQRP
NSCVKLQTVHSIPFTIHKMEALQRP

SEQ ID NO: 38274 - protein, 25 aa, synthetic construct
  source 1..25: note = Seed: NSCVKLQTVHSIPLTINKEEALQRP
NSCVKLQTVHSIPFTIHKMEAMQRP

SEQ ID NO: 38275 - protein, 25 aa, synthetic construct
  source 1..25: note = Seed: NSCVKLQTVHSIPLTINKEEALQRP
NSCVKLQTVHSIPFTIHKMEAVQRP

SEQ ID NO: 38276 - protein, 25 aa, synthetic construct
  source 1..25: note = Seed: NSCVKLQTVHSIPLTINKEEALQRP
NSCVKLQTVHSIPFTIHKNEAIQRP

SEQ ID NO: 38277 - protein, 25 aa, synthetic construct
  source 1..25: note = Seed: NSCVKLQTVHSIPLTINKEEALQRP
NSCVKLQTVHSIPFTIHKNEAVQRP

SEQ ID NO: 38278 - protein, 25 aa, synthetic construct
  source 1..25: note = Seed: NSCVKLQTVHSIPLTINKEEALQRP
NSCVKLQTVHSIPFTIHKREAFQRP

SEQ ID NO: 38279 - protein, 25 aa, synthetic construct
  source 1..25: note = Seed: NSCVKLQTVHSIPLTINKEEALQRP
NSCVKLQTVHSIPFTIHKREALQRP

SEQ ID NO: 38280 - protein, 25 aa, synthetic construct
  source 1..25: note = Seed: NSCVKLQTVHSIPLTINKEEALQRP
NSCVKLQTVHSIPFTIHKREAYQRP

SEQ ID NO: 38281 - protein, 25 aa, synthetic construct
  source 1..25: note = Seed: NSCVKLQTVHSIPLTINKEEALQRP
NSCVKLQTVHSIPFTIHKVEAFQRP

SEQ ID NO: 38282 - protein, 25 aa, synthetic construct
  source 1..25: note = Seed: NSCVKLQTVHSIPLTINKEEALQRP
NSCVKLQTVHSIPFTIHKVEAIQRP

SEQ ID NO: 38283 - protein, 25 aa, synthetic construct
  source 1..25: note = Seed: NSCVKLQTVHSIPLTINKEEALQRP
NSCVKLQTVHSIPFTIHKVEALQRP

SEQ ID NO: 38284 - protein, 25 aa, synthetic construct
  source 1..25: note = Seed: NSCVKLQTVHSIPLTINKEEALQRP
NSCVKLQTVHSIPFTIHKVEAVQRP

SEQ ID NO: 38285 - protein, 25 aa, synthetic construct
  source 1..25: note = Seed: NSCVKLQTVHSIPLTINKEEALQRP
NSCVKLQTVHSIPFTIHKWEAAQRP

SEQ ID NO: 38286 - protein, 25 aa, synthetic construct
  source 1..25: note = Seed: NSCVKLQTVHSIPLTINKEEALQRP
NSCVKLQTVHSIPFTIHKWEAFQRP

SEQ ID NO: 38287 - protein, 25 aa, synthetic construct
  source 1..25: note = Seed: NSCVKLQTVHSIPLTINKEEALQRP
NSCVKLQTVHSIPFTIHKWEAIQRP

SEQ ID NO: 38288 - protein, 25 aa, synthetic construct
  source 1..25: note = Seed: NSCVKLQTVHSIPLTINKEEALQRP
NSCVKLQTVHSIPFTIHKWEALQRP

SEQ ID NO: 38289 - protein, 25 aa, synthetic construct
  source 1..25: note = Seed: NSCVKLQTVHSIPLTINKEEALQRP
NSCVKLQTVHSIPFTIHKWEAMQRP

SEQ ID NO: 38290 - protein, 25 aa, synthetic construct
  source 1..25: note = Seed: NSCVKLQTVHSIPLTINKEEALQRP
NSCVKLQTVHSIPFTIHKWEASQRP

SEQ ID NO: 38291 - protein, 25 aa, synthetic construct
  source 1..25: note = Seed: NSCVKLQTVHSIPLTINKEEALQRP
NSCVKLQTVHSIPFTIHKWEATQRP

SEQ ID NO: 38292 - protein, 25 aa, synthetic construct
  source 1..25: note = Seed: NSCVKLQTVHSIPLTINKEEALQRP
NSCVKLQTVHSIPFTIHKWEAVQRP

SEQ ID NO: 38293 - protein, 25 aa, synthetic construct
  source 1..25: note = Seed: NSCVKLQTVHSIPLTINKEEALQRP
NSCVKLQTVHSIPFTIHKYEAFQRP

SEQ ID NO: 38294 - protein, 25 aa, synthetic construct
  source 1..25: note = Seed: NSCVKLQTVHSIPLTINKEEALQRP
NSCVKLQTVHSIPFTIHKYEAIQRP

SEQ ID NO: 38295 - protein, 25 aa, synthetic construct
  source 1..25: note = Seed: NSCVKLQTVHSIPLTINKEEALQRP
NSCVKLQTVHSIPFTIHKYEALQRP

SEQ ID NO: 38296 - protein, 25 aa, synthetic construct
  source 1..25: note = Seed: NSCVKLQTVHSIPLTINKEEALQRP
NSCVKLQTVHSIPFTIHKYEAMQRP

SEQ ID NO: 38297 - protein, 25 aa, synthetic construct
  source 1..25: note = Seed: NSCVKLQTVHSIPLTINKEEALQRP
NSCVKLQTVHSIPFTIHKYEATQRP

SEQ ID NO: 38298 - protein, 25 aa, synthetic construct
  source 1..25: note = Seed: NSCVKLQTVHSIPLTINKEEALQRP
NSCVKLQTVHSIPFTIHKYEAVQRP

SEQ ID NO: 38299 - protein, 25 aa, synthetic construct
  source 1..25: note = Seed: NSCVKLQTVHSIPLTINKEEALQRP
NSCVKLQTVHSIPFTIIKAEAAQRP

SEQ ID NO: 38300 - protein, 25 aa, synthetic construct
  source 1..25: note = Seed: NSCVKLQTVHSIPLTINKEEALQRP
NSCVKLQTVHSIPFTIIKAEADQRP

SEQ ID NO: 38301 - protein, 25 aa, synthetic construct
  source 1..25: note = Seed: NSCVKLQTVHSIPLTINKEEALQRP
NSCVKLQTVHSIPFTIIKAEAEQRP

SEQ ID NO: 38302 - protein, 25 aa, synthetic construct
  source 1..25: note = Seed: NSCVKLQTVHSIPLTINKEEALQRP
NSCVKLQTVHSIPFTIIKAEAFQRP

SEQ ID NO: 38303 - protein, 25 aa, synthetic construct
  source 1..25: note = Seed: NSCVKLQTVHSIPLTINKEEALQRP
NSCVKLQTVHSIPFTIIKAEAIQRP

SEQ ID NO: 38304 - protein, 25 aa, synthetic construct
  source 1..25: note = Seed: NSCVKLQTVHSIPLTINKEEALQRP
NSCVKLQTVHSIPFTIIKAEALQRP

SEQ ID NO: 38305 - protein, 25 aa, synthetic construct
  source 1..25: note = Seed: NSCVKLQTVHSIPLTINKEEALQRP
NSCVKLQTVHSIPFTIIKAEAMQRP

SEQ ID NO: 38306 - protein, 25 aa, synthetic construct
  source 1..25: note = Seed: NSCVKLQTVHSIPLTINKEEALQRP
NSCVKLQTVHSIPFTIIKAEAVQRP

SEQ ID NO: 38307 - protein, 25 aa, synthetic construct
  source 1..25: note = Seed: NSCVKLQTVHSIPLTINKEEALQRP
NSCVKLQTVHSIPFTIIKAEAYQRP

SEQ ID NO: 38308 - protein, 25 aa, synthetic construct
  source 1..25: note = Seed: NSCVKLQTVHSIPLTINKEEALQRP
NSCVKLQTVHSIPFTIIKDEAIQRP

SEQ ID NO: 38309 - protein, 25 aa, synthetic construct
  source 1..25: note = Seed: NSCVKLQTVHSIPLTINKEEALQRP
NSCVKLQTVHSIPFTIIKDEALQRP

SEQ ID NO: 38310 - protein, 25 aa, synthetic construct
  source 1..25: note = Seed: NSCVKLQTVHSIPLTINKEEALQRP
NSCVKLQTVHSIPFTIIKDEAVQRP

SEQ ID NO: 38311 - protein, 25 aa, synthetic construct
  source 1..25: note = Seed: NSCVKLQTVHSIPLTINKEEALQRP
NSCVKLQTVHSIPFTIIKFEAAQRP

SEQ ID NO: 38312 - protein, 25 aa, synthetic construct
  source 1..25: note = Seed: NSCVKLQTVHSIPLTINKEEALQRP
NSCVKLQTVHSIPFTIIKFEACQRP

SEQ ID NO: 38313 - protein, 25 aa, synthetic construct
  source 1..25: note = Seed: NSCVKLQTVHSIPLTINKEEALQRP
NSCVKLQTVHSIPFTIIKFEADQRP

SEQ ID NO: 38314 - protein, 25 aa, synthetic construct
  source 1..25: note = Seed: NSCVKLQTVHSIPLTINKEEALQRP
NSCVKLQTVHSIPFTIIKFEAEQRP

SEQ ID NO: 38315 - protein, 25 aa, synthetic construct
  source 1..25: note = Seed: NSCVKLQTVHSIPLTINKEEALQRP
NSCVKLQTVHSIPFTIIKFEAFQRP

SEQ ID NO: 38316 - protein, 25 aa, synthetic construct
  source 1..25: note = Seed: NSCVKLQTVHSIPLTINKEEALQRP
NSCVKLQTVHSIPFTIIKFEAGQRP

SEQ ID NO: 38317 - protein, 25 aa, synthetic construct
  source 1..25: note = Seed: NSCVKLQTVHSIPLTINKEEALQRP
NSCVKLQTVHSIPFTIIKFEAHQRP

SEQ ID NO: 38318 - protein, 25 aa, synthetic construct
  source 1..25: note = Seed: NSCVKLQTVHSIPLTINKEEALQRP
NSCVKLQTVHSIPFTIIKFEAIQRP

SEQ ID NO: 38319 - protein, 25 aa, synthetic construct
  source 1..25: note = Seed: NSCVKLQTVHSIPLTINKEEALQRP
NSCVKLQTVHSIPFTIIKFEAKQRP

SEQ ID NO: 38320 - protein, 25 aa, synthetic construct
  source 1..25: note = Seed: NSCVKLQTVHSIPLTINKEEALQRP
NSCVKLQTVHSIPFTIIKFEALQRP

SEQ ID NO: 38321 - protein, 25 aa, synthetic construct
  source 1..25: note = Seed: NSCVKLQTVHSIPLTINKEEALQRP
NSCVKLQTVHSIPFTIIKFEAMQRP

SEQ ID NO: 38322 - protein, 25 aa, synthetic construct
  source 1..25: note = Seed: NSCVKLQTVHSIPLTINKEEALQRP
NSCVKLQTVHSIPFTIIKFEANQRP

SEQ ID NO: 38323 - protein, 25 aa, synthetic construct
  source 1..25: note = Seed: NSCVKLQTVHSIPLTINKEEALQRP
NSCVKLQTVHSIPFTIIKFEAPQRP

SEQ ID NO: 38324 - protein, 25 aa, synthetic construct
  source 1..25: note = Seed: NSCVKLQTVHSIPLTINKEEALQRP
NSCVKLQTVHSIPFTIIKFEAQQRP

SEQ ID NO: 38325 - protein, 25 aa, synthetic construct
  source 1..25: note = Seed: NSCVKLQTVHSIPLTINKEEALQRP
NSCVKLQTVHSIPFTIIKFEARQRP

SEQ ID NO: 38326 - protein, 25 aa, synthetic construct
  source 1..25: note = Seed: NSCVKLQTVHSIPLTINKEEALQRP
NSCVKLQTVHSIPFTIIKFEASQRP

SEQ ID NO: 38327 - protein, 25 aa, synthetic construct
  source 1..25: note = Seed: NSCVKLQTVHSIPLTINKEEALQRP
NSCVKLQTVHSIPFTIIKFEATQRP

SEQ ID NO: 38328 - protein, 25 aa, synthetic construct
  source 1..25: note = Seed: NSCVKLQTVHSIPLTINKEEALQRP
NSCVKLQTVHSIPFTIIKFEAVQRP

SEQ ID NO: 38329 - protein, 25 aa, synthetic construct
  source 1..25: note = Seed: NSCVKLQTVHSIPLTINKEEALQRP
NSCVKLQTVHSIPFTIIKFEAYQRP

SEQ ID NO: 38330 - protein, 25 aa, synthetic construct
  source 1..25: note = Seed: NSCVKLQTVHSIPLTINKEEALQRP
NSCVKLQTVHSIPFTIIKIEAAQRP

SEQ ID NO: 38331 - protein, 25 aa, synthetic construct
  source 1..25: note = Seed: NSCVKLQTVHSIPLTINKEEALQRP
NSCVKLQTVHSIPFTIIKIEADQRP

SEQ ID NO: 38332 - protein, 25 aa, synthetic construct
  source 1..25: note = Seed: NSCVKLQTVHSIPLTINKEEALQRP
NSCVKLQTVHSIPFTIIKIEAEQRP

SEQ ID NO: 38333 - protein, 25 aa, synthetic construct
  source 1..25: note = Seed: NSCVKLQTVHSIPLTINKEEALQRP
NSCVKLQTVHSIPFTIIKIEAFQRP

SEQ ID NO: 38334 - protein, 25 aa, synthetic construct
  source 1..25: note = Seed: NSCVKLQTVHSIPLTINKEEALQRP
NSCVKLQTVHSIPFTIIKIEAIQRP

SEQ ID NO: 38335 - protein, 25 aa, synthetic construct
  source 1..25: note = Seed: NSCVKLQTVHSIPLTINKEEALQRP
NSCVKLQTVHSIPFTIIKIEALQRP

SEQ ID NO: 38336 - protein, 25 aa, synthetic construct
  source 1..25: note = Seed: NSCVKLQTVHSIPLTINKEEALQRP
NSCVKLQTVHSIPFTIIKIEAMQRP

SEQ ID NO: 38337 - protein, 25 aa, synthetic construct
  source 1..25: note = Seed: NSCVKLQTVHSIPLTINKEEALQRP
NSCVKLQTVHSIPFTIIKIEANQRP

SEQ ID NO: 38338 - protein, 25 aa, synthetic construct
  source 1..25: note = Seed: NSCVKLQTVHSIPLTINKEEALQRP
NSCVKLQTVHSIPFTIIKIEARQRP

SEQ ID NO: 38339 - protein, 25 aa, synthetic construct
  source 1..25: note = Seed: NSCVKLQTVHSIPLTINKEEALQRP
NSCVKLQTVHSIPFTIIKIEASQRP

SEQ ID NO: 38340 - protein, 25 aa, synthetic construct
  source 1..25: note = Seed: NSCVKLQTVHSIPLTINKEEALQRP
NSCVKLQTVHSIPFTIIKIEATQRP

SEQ ID NO: 38341 - protein, 25 aa, synthetic construct
  source 1..25: note = Seed: NSCVKLQTVHSIPLTINKEEALQRP
NSCVKLQTVHSIPFTIIKIEAVQRP

SEQ ID NO: 38342 - protein, 25 aa, synthetic construct
  source 1..25: note = Seed: NSCVKLQTVHSIPLTINKEEALQRP
NSCVKLQTVHSIPFTIIKIEAYQRP

SEQ ID NO: 38343 - protein, 25 aa, synthetic construct
  source 1..25: note = Seed: NSCVKLQTVHSIPLTINKEEALQRP
NSCVKLQTVHSIPFTIIKKEAFQRP

SEQ ID NO: 38344 - protein, 25 aa, synthetic construct
  source 1..25: note = Seed: NSCVKLQTVHSIPLTINKEEALQRP
NSCVKLQTVHSIPFTIIKKEAIQRP

SEQ ID NO: 38345 - protein, 25 aa, synthetic construct
  source 1..25: note = Seed: NSCVKLQTVHSIPLTINKEEALQRP
NSCVKLQTVHSIPFTIIKKEALQRP

SEQ ID NO: 38346 - protein, 25 aa, synthetic construct
  source 1..25: note = Seed: NSCVKLQTVHSIPLTINKEEALQRP
NSCVKLQTVHSIPFTIIKKEAYQRP

SEQ ID NO: 38347 - protein, 25 aa, synthetic construct
  source 1..25: note = Seed: NSCVKLQTVHSIPLTINKEEALQRP
NSCVKLQTVHSIPFTIIKLEAAQRP

SEQ ID NO: 38348 - protein, 25 aa, synthetic construct
  source 1..25: note = Seed: NSCVKLQTVHSIPLTINKEEALQRP
NSCVKLQTVHSIPFTIIKLEADQRP

SEQ ID NO: 38349 - protein, 25 aa, synthetic construct
  source 1..25: note = Seed: NSCVKLQTVHSIPLTINKEEALQRP
NSCVKLQTVHSIPFTIIKLEAEQRP

SEQ ID NO: 38350 - protein, 25 aa, synthetic construct
  source 1..25: note = Seed: NSCVKLQTVHSIPLTINKEEALQRP
NSCVKLQTVHSIPFTIIKLEAFQRP

SEQ ID NO: 38351 - protein, 25 aa, synthetic construct
  source 1..25: note = Seed: NSCVKLQTVHSIPLTINKEEALQRP
NSCVKLQTVHSIPFTIIKLEAIQRP

SEQ ID NO: 38352 - protein, 25 aa, synthetic construct
  source 1..25: note = Seed: NSCVKLQTVHSIPLTINKEEALQRP
NSCVKLQTVHSIPFTIIKLEALQRP

SEQ ID NO: 38353 - protein, 25 aa, synthetic construct
  source 1..25: note = Seed: NSCVKLQTVHSIPLTINKEEALQRP
NSCVKLQTVHSIPFTIIKLEAMQRP

SEQ ID NO: 38354 - protein, 25 aa, synthetic construct
  source 1..25: note = Seed: NSCVKLQTVHSIPLTINKEEALQRP
NSCVKLQTVHSIPFTIIKLEANQRP

SEQ ID NO: 38355 - protein, 25 aa, synthetic construct
  source 1..25: note = Seed: NSCVKLQTVHSIPLTINKEEALQRP
NSCVKLQTVHSIPFTIIKLEASQRP

SEQ ID NO: 38356 - protein, 25 aa, synthetic construct
  source 1..25: note = Seed: NSCVKLQTVHSIPLTINKEEALQRP
NSCVKLQTVHSIPFTIIKLEATQRP

SEQ ID NO: 38357 - protein, 25 aa, synthetic construct
  source 1..25: note = Seed: NSCVKLQTVHSIPLTINKEEALQRP
NSCVKLQTVHSIPFTIIKLEAVQRP

SEQ ID NO: 38358 - protein, 25 aa, synthetic construct
  source 1..25: note = Seed: NSCVKLQTVHSIPLTINKEEALQRP
NSCVKLQTVHSIPFTIIKLEAYQRP

SEQ ID NO: 38359 - protein, 25 aa, synthetic construct
  source 1..25: note = Seed: NSCVKLQTVHSIPLTINKEEALQRP
NSCVKLQTVHSIPFTIIKMEADQRP

SEQ ID NO: 38360 - protein, 25 aa, synthetic construct
  source 1..25: note = Seed: NSCVKLQTVHSIPLTINKEEALQRP
NSCVKLQTVHSIPFTIIKMEAIQRP

SEQ ID NO: 38361 - protein, 25 aa, synthetic construct
  source 1..25: note = Seed: NSCVKLQTVHSIPLTINKEEALQRP
NSCVKLQTVHSIPFTIIKMEALQRP

SEQ ID NO: 38362 - protein, 25 aa, synthetic construct
  source 1..25: note = Seed: NSCVKLQTVHSIPLTINKEEALQRP
NSCVKLQTVHSIPFTIIKMEAMQRP

SEQ ID NO: 38363 - protein, 25 aa, synthetic construct
  source 1..25: note = Seed: NSCVKLQTVHSIPLTINKEEALQRP
NSCVKLQTVHSIPFTIIKMEASQRP

SEQ ID NO: 38364 - protein, 25 aa, synthetic construct
  source 1..25: note = Seed: NSCVKLQTVHSIPLTINKEEALQRP
NSCVKLQTVHSIPFTIIKMEATQRP

SEQ ID NO: 38365 - protein, 25 aa, synthetic construct
  source 1..25: note = Seed: NSCVKLQTVHSIPLTINKEEALQRP
NSCVKLQTVHSIPFTIIKMEAVQRP

SEQ ID NO: 38366 - protein, 25 aa, synthetic construct
  source 1..25: note = Seed: NSCVKLQTVHSIPLTINKEEALQRP
NSCVKLQTVHSIPFTIIKMEAYQRP

SEQ ID NO: 38367 - protein, 25 aa, synthetic construct
  source 1..25: note = Seed: NSCVKLQTVHSIPLTINKEEALQRP
NSCVKLQTVHSIPFTIIKNEAAQRP

SEQ ID NO: 38368 - protein, 25 aa, synthetic construct
  source 1..25: note = Seed: NSCVKLQTVHSIPLTINKEEALQRP
NSCVKLQTVHSIPFTIIKNEADQRP

SEQ ID NO: 38369 - protein, 25 aa, synthetic construct
  source 1..25: note = Seed: NSCVKLQTVHSIPLTINKEEALQRP
NSCVKLQTVHSIPFTIIKNEAEQRP

SEQ ID NO: 38370 - protein, 25 aa, synthetic construct
  source 1..25: note = Seed: NSCVKLQTVHSIPLTINKEEALQRP
NSCVKLQTVHSIPFTIIKNEAGQRP

SEQ ID NO: 38371 - protein, 25 aa, synthetic construct
  source 1..25: note = Seed: NSCVKLQTVHSIPLTINKEEALQRP
NSCVKLQTVHSIPFTIIKNEAHQRP

SEQ ID NO: 38372 - protein, 25 aa, synthetic construct
  source 1..25: note = Seed: NSCVKLQTVHSIPLTINKEEALQRP
NSCVKLQTVHSIPFTIIKNEAIQRP

SEQ ID NO: 38373 - protein, 25 aa, synthetic construct
  source 1..25: note = Seed: NSCVKLQTVHSIPLTINKEEALQRP
NSCVKLQTVHSIPFTIIKNEALQRP

SEQ ID NO: 38374 - protein, 25 aa, synthetic construct
  source 1..25: note = Seed: NSCVKLQTVHSIPLTINKEEALQRP
NSCVKLQTVHSIPFTIIKNEAMQRP

SEQ ID NO: 38375 - protein, 25 aa, synthetic construct
  source 1..25: note = Seed: NSCVKLQTVHSIPLTINKEEALQRP
NSCVKLQTVHSIPFTIIKNEANQRP

SEQ ID NO: 38376 - protein, 25 aa, synthetic construct
  source 1..25: note = Seed: NSCVKLQTVHSIPLTINKEEALQRP
NSCVKLQTVHSIPFTIIKNEAQQRP

SEQ ID NO: 38377 - protein, 25 aa, synthetic construct
  source 1..25: note = Seed: NSCVKLQTVHSIPLTINKEEALQRP
NSCVKLQTVHSIPFTIIKNEASQRP

SEQ ID NO: 38378 - protein, 25 aa, synthetic construct
  source 1..25: note = Seed: NSCVKLQTVHSIPLTINKEEALQRP
NSCVKLQTVHSIPFTIIKNEATQRP

SEQ ID NO: 38379 - protein, 25 aa, synthetic construct
  source 1..25: note = Seed: NSCVKLQTVHSIPLTINKEEALQRP
NSCVKLQTVHSIPFTIIKPEALQRP

SEQ ID NO: 38380 - protein, 25 aa, synthetic construct
  source 1..25: note = Seed: NSCVKLQTVHSIPLTINKEEALQRP
NSCVKLQTVHSIPFTIIKREAFQRP

SEQ ID NO: 38381 - protein, 25 aa, synthetic construct
  source 1..25: note = Seed: NSCVKLQTVHSIPLTINKEEALQRP
NSCVKLQTVHSIPFTIIKREAIQRP

SEQ ID NO: 38382 - protein, 25 aa, synthetic construct
  source 1..25: note = Seed: NSCVKLQTVHSIPLTINKEEALQRP
NSCVKLQTVHSIPFTIIKREALQRP

SEQ ID NO: 38383 - protein, 25 aa, synthetic construct
  source 1..25: note = Seed: NSCVKLQTVHSIPLTINKEEALQRP
NSCVKLQTVHSIPFTIIKREAMQRP

SEQ ID NO: 38384 - protein, 25 aa, synthetic construct
  source 1..25: note = Seed: NSCVKLQTVHSIPLTINKEEALQRP
NSCVKLQTVHSIPFTIIKREARQRP

SEQ ID NO: 38385 - protein, 25 aa, synthetic construct
  source 1..25: note = Seed: NSCVKLQTVHSIPLTINKEEALQRP
NSCVKLQTVHSIPFTIIKREAVQRP

SEQ ID NO: 38386 - protein, 25 aa, synthetic construct
  source 1..25: note = Seed: NSCVKLQTVHSIPLTINKEEALQRP
NSCVKLQTVHSIPFTIIKREAYQRP

SEQ ID NO: 38387 - protein, 25 aa, synthetic construct
  source 1..25: note = Seed: NSCVKLQTVHSIPLTINKEEALQRP
NSCVKLQTVHSIPFTIIKSEAAQRP

SEQ ID NO: 38388 - protein, 25 aa, synthetic construct
  source 1..25: note = Seed: NSCVKLQTVHSIPLTINKEEALQRP
NSCVKLQTVHSIPFTIIKSEADQRP

SEQ ID NO: 38389 - protein, 25 aa, synthetic construct
  source 1..25: note = Seed: NSCVKLQTVHSIPLTINKEEALQRP
NSCVKLQTVHSIPFTIIKSEAEQRP

SEQ ID NO: 38390 - protein, 25 aa, synthetic construct
  source 1..25: note = Seed: NSCVKLQTVHSIPLTINKEEALQRP
NSCVKLQTVHSIPFTIIKSEAFQRP

SEQ ID NO: 38391 - protein, 25 aa, synthetic construct
  source 1..25: note = Seed: NSCVKLQTVHSIPLTINKEEALQRP
NSCVKLQTVHSIPFTIIKSEAGQRP

SEQ ID NO: 38392 - protein, 25 aa, synthetic construct
  source 1..25: note = Seed: NSCVKLQTVHSIPLTINKEEALQRP
NSCVKLQTVHSIPFTIIKSEAHQRP

SEQ ID NO: 38393 - protein, 25 aa, synthetic construct
  source 1..25: note = Seed: NSCVKLQTVHSIPLTINKEEALQRP
NSCVKLQTVHSIPFTIIKSEALQRP

SEQ ID NO: 38394 - protein, 25 aa, synthetic construct
  source 1..25: note = Seed: NSCVKLQTVHSIPLTINKEEALQRP
NSCVKLQTVHSIPFTIIKSEANQRP

SEQ ID NO: 38395 - protein, 25 aa, synthetic construct
  source 1..25: note = Seed: NSCVKLQTVHSIPLTINKEEALQRP
NSCVKLQTVHSIPFTIIKSEAQQRP

SEQ ID NO: 38396 - protein, 25 aa, synthetic construct
  source 1..25: note = Seed: NSCVKLQTVHSIPLTINKEEALQRP
NSCVKLQTVHSIPFTIIKSEASQRP

SEQ ID NO: 38397 - protein, 25 aa, synthetic construct
  source 1..25: note = Seed: NSCVKLQTVHSIPLTINKEEALQRP
NSCVKLQTVHSIPFTIIKSEATQRP

SEQ ID NO: 38398 - protein, 25 aa, synthetic construct
  source 1..25: note = Seed: NSCVKLQTVHSIPLTINKEEALQRP
NSCVKLQTVHSIPFTIIKSEAVQRP

SEQ ID NO: 38399 - protein, 25 aa, synthetic construct
  source 1..25: note = Seed: NSCVKLQTVHSIPLTINKEEALQRP
NSCVKLQTVHSIPFTIIKTEAAQRP

SEQ ID NO: 38400 - protein, 25 aa, synthetic construct
  source 1..25: note = Seed: NSCVKLQTVHSIPLTINKEEALQRP
NSCVKLQTVHSIPFTIIKTEADQRP

SEQ ID NO: 38401 - protein, 25 aa, synthetic construct
  source 1..25: note = Seed: NSCVKLQTVHSIPLTINKEEALQRP
NSCVKLQTVHSIPFTIIKTEAEQRP

SEQ ID NO: 38402 - protein, 25 aa, synthetic construct
  source 1..25: note = Seed: NSCVKLQTVHSIPLTINKEEALQRP
NSCVKLQTVHSIPFTIIKTEAFQRP

SEQ ID NO: 38403 - protein, 25 aa, synthetic construct
  source 1..25: note = Seed: NSCVKLQTVHSIPLTINKEEALQRP
NSCVKLQTVHSIPFTIIKTEAGQRP

SEQ ID NO: 38404 - protein, 25 aa, synthetic construct
  source 1..25: note = Seed: NSCVKLQTVHSIPLTINKEEALQRP
NSCVKLQTVHSIPFTIIKTEAHQRP

SEQ ID NO: 38405 - protein, 25 aa, synthetic construct
  source 1..25: note = Seed: NSCVKLQTVHSIPLTINKEEALQRP
NSCVKLQTVHSIPFTIIKTEAIQRP

SEQ ID NO: 38406 - protein, 25 aa, synthetic construct
  source 1..25: note = Seed: NSCVKLQTVHSIPLTINKEEALQRP
NSCVKLQTVHSIPFTIIKTEALQRP

SEQ ID NO: 38407 - protein, 25 aa, synthetic construct
  source 1..25: note = Seed: NSCVKLQTVHSIPLTINKEEALQRP
NSCVKLQTVHSIPFTIIKTEAMQRP

SEQ ID NO: 38408 - protein, 25 aa, synthetic construct
  source 1..25: note = Seed: NSCVKLQTVHSIPLTINKEEALQRP
NSCVKLQTVHSIPFTIIKTEANQRP

SEQ ID NO: 38409 - protein, 25 aa, synthetic construct
  source 1..25: note = Seed: NSCVKLQTVHSIPLTINKEEALQRP
NSCVKLQTVHSIPFTIIKTEAQQRP

SEQ ID NO: 38410 - protein, 25 aa, synthetic construct
  source 1..25: note = Seed: NSCVKLQTVHSIPLTINKEEALQRP
NSCVKLQTVHSIPFTIIKTEASQRP

SEQ ID NO: 38411 - protein, 25 aa, synthetic construct
  source 1..25: note = Seed: NSCVKLQTVHSIPLTINKEEALQRP
NSCVKLQTVHSIPFTIIKTEATQRP

SEQ ID NO: 38412 - protein, 25 aa, synthetic construct
  source 1..25: note = Seed: NSCVKLQTVHSIPLTINKEEALQRP
NSCVKLQTVHSIPFTIIKTEAVQRP

SEQ ID NO: 38413 - protein, 25 aa, synthetic construct
  source 1..25: note = Seed: NSCVKLQTVHSIPLTINKEEALQRP
NSCVKLQTVHSIPFTIIKVEAAQRP

SEQ ID NO: 38414 - protein, 25 aa, synthetic construct
  source 1..25: note = Seed: NSCVKLQTVHSIPLTINKEEALQRP
NSCVKLQTVHSIPFTIIKVEADQRP

SEQ ID NO: 38415 - protein, 25 aa, synthetic construct
  source 1..25: note = Seed: NSCVKLQTVHSIPLTINKEEALQRP
NSCVKLQTVHSIPFTIIKVEAEQRP

SEQ ID NO: 38416 - protein, 25 aa, synthetic construct
  source 1..25: note = Seed: NSCVKLQTVHSIPLTINKEEALQRP
NSCVKLQTVHSIPFTIIKVEAFQRP

SEQ ID NO: 38417 - protein, 25 aa, synthetic construct
  source 1..25: note = Seed: NSCVKLQTVHSIPLTINKEEALQRP
NSCVKLQTVHSIPFTIIKVEAIQRP

SEQ ID NO: 38418 - protein, 25 aa, synthetic construct
  source 1..25: note = Seed: NSCVKLQTVHSIPLTINKEEALQRP
NSCVKLQTVHSIPFTIIKVEALQRP

SEQ ID NO: 38419 - protein, 25 aa, synthetic construct
  source 1..25: note = Seed: NSCVKLQTVHSIPLTINKEEALQRP
NSCVKLQTVHSIPFTIIKVEAMQRP

SEQ ID NO: 38420 - protein, 25 aa, synthetic construct
  source 1..25: note = Seed: NSCVKLQTVHSIPLTINKEEALQRP
NSCVKLQTVHSIPFTIIKVEANQRP

SEQ ID NO: 38421 - protein, 25 aa, synthetic construct
  source 1..25: note = Seed: NSCVKLQTVHSIPLTINKEEALQRP
NSCVKLQTVHSIPFTIIKVEAVQRP

SEQ ID NO: 38422 - protein, 25 aa, synthetic construct
  source 1..25: note = Seed: NSCVKLQTVHSIPLTINKEEALQRP
NSCVKLQTVHSIPFTIIKWEAAQRP

SEQ ID NO: 38423 - protein, 25 aa, synthetic construct
  source 1..25: note = Seed: NSCVKLQTVHSIPLTINKEEALQRP
NSCVKLQTVHSIPFTIIKWEACQRP

SEQ ID NO: 38424 - protein, 25 aa, synthetic construct
  source 1..25: note = Seed: NSCVKLQTVHSIPLTINKEEALQRP
NSCVKLQTVHSIPFTIIKWEADQRP

SEQ ID NO: 38425 - protein, 25 aa, synthetic construct
  source 1..25: note = Seed: NSCVKLQTVHSIPLTINKEEALQRP
NSCVKLQTVHSIPFTIIKWEAEQRP

SEQ ID NO: 38426 - protein, 25 aa, synthetic construct
  source 1..25: note = Seed: NSCVKLQTVHSIPLTINKEEALQRP
NSCVKLQTVHSIPFTIIKWEAFQRP

SEQ ID NO: 38427 - protein, 25 aa, synthetic construct
  source 1..25: note = Seed: NSCVKLQTVHSIPLTINKEEALQRP
NSCVKLQTVHSIPFTIIKWEAGQRP

SEQ ID NO: 38428 - protein, 25 aa, synthetic construct
  source 1..25: note = Seed: NSCVKLQTVHSIPLTINKEEALQRP
NSCVKLQTVHSIPFTIIKWEAHQRP

SEQ ID NO: 38429 - protein, 25 aa, synthetic construct
  source 1..25: note = Seed: NSCVKLQTVHSIPLTINKEEALQRP
NSCVKLQTVHSIPFTIIKWEAIQRP

SEQ ID NO: 38430 - protein, 25 aa, synthetic construct
  source 1..25: note = Seed: NSCVKLQTVHSIPLTINKEEALQRP
NSCVKLQTVHSIPFTIIKWEALQRP

SEQ ID NO: 38431 - protein, 25 aa, synthetic construct
  source 1..25: note = Seed: NSCVKLQTVHSIPLTINKEEALQRP
NSCVKLQTVHSIPFTIIKWEAMQRP

SEQ ID NO: 38432 - protein, 25 aa, synthetic construct
  source 1..25: note = Seed: NSCVKLQTVHSIPLTINKEEALQRP
NSCVKLQTVHSIPFTIIKWEANQRP

SEQ ID NO: 38433 - protein, 25 aa, synthetic construct
  source 1..25: note = Seed: NSCVKLQTVHSIPLTINKEEALQRP
NSCVKLQTVHSIPFTIIKWEAQQRP

SEQ ID NO: 38434 - protein, 25 aa, synthetic construct
  source 1..25: note = Seed: NSCVKLQTVHSIPLTINKEEALQRP
NSCVKLQTVHSIPFTIIKWEASQRP

SEQ ID NO: 38435 - protein, 25 aa, synthetic construct
  source 1..25: note = Seed: NSCVKLQTVHSIPLTINKEEALQRP
NSCVKLQTVHSIPFTIIKWEATQRP

SEQ ID NO: 38436 - protein, 25 aa, synthetic construct
  source 1..25: note = Seed: NSCVKLQTVHSIPLTINKEEALQRP
NSCVKLQTVHSIPFTIIKWEAVQRP

SEQ ID NO: 38437 - protein, 25 aa, synthetic construct
  source 1..25: note = Seed: NSCVKLQTVHSIPLTINKEEALQRP
NSCVKLQTVHSIPFTIIKWEAYQRP

SEQ ID NO: 38438 - protein, 25 aa, synthetic construct
  source 1..25: note = Seed: NSCVKLQTVHSIPLTINKEEALQRP
NSCVKLQTVHSIPFTIIKYEAAQRP

SEQ ID NO: 38439 - protein, 25 aa, synthetic construct
  source 1..25: note = Seed: NSCVKLQTVHSIPLTINKEEALQRP
NSCVKLQTVHSIPFTIIKYEACQRP

SEQ ID NO: 38440 - protein, 25 aa, synthetic construct
  source 1..25: note = Seed: NSCVKLQTVHSIPLTINKEEALQRP
NSCVKLQTVHSIPFTIIKYEADQRP

SEQ ID NO: 38441 - protein, 25 aa, synthetic construct
  source 1..25: note = Seed: NSCVKLQTVHSIPLTINKEEALQRP
NSCVKLQTVHSIPFTIIKYEAEQRP

SEQ ID NO: 38442 - protein, 25 aa, synthetic construct
  source 1..25: note = Seed: NSCVKLQTVHSIPLTINKEEALQRP
NSCVKLQTVHSIPFTIIKYEAFQRP

SEQ ID NO: 38443 - protein, 25 aa, synthetic construct
  source 1..25: note = Seed: NSCVKLQTVHSIPLTINKEEALQRP
NSCVKLQTVHSIPFTIIKYEAGQRP

SEQ ID NO: 38444 - protein, 25 aa, synthetic construct
  source 1..25: note = Seed: NSCVKLQTVHSIPLTINKEEALQRP
NSCVKLQTVHSIPFTIIKYEAHQRP

SEQ ID NO: 38445 - protein, 25 aa, synthetic construct
  source 1..25: note = Seed: NSCVKLQTVHSIPLTINKEEALQRP
NSCVKLQTVHSIPFTIIKYEAIQRP

SEQ ID NO: 38446 - protein, 25 aa, synthetic construct
  source 1..25: note = Seed: NSCVKLQTVHSIPLTINKEEALQRP
NSCVKLQTVHSIPFTIIKYEALQRP

SEQ ID NO: 38447 - protein, 25 aa, synthetic construct
  source 1..25: note = Seed: NSCVKLQTVHSIPLTINKEEALQRP
NSCVKLQTVHSIPFTIIKYEAMQRP

SEQ ID NO: 38448 - protein, 25 aa, synthetic construct
  source 1..25: note = Seed: NSCVKLQTVHSIPLTINKEEALQRP
NSCVKLQTVHSIPFTIIKYEANQRP

SEQ ID NO: 38449 - protein, 25 aa, synthetic construct
  source 1..25: note = Seed: NSCVKLQTVHSIPLTINKEEALQRP
NSCVKLQTVHSIPFTIIKYEAPQRP

SEQ ID NO: 38450 - protein, 25 aa, synthetic construct
  source 1..25: note = Seed: NSCVKLQTVHSIPLTINKEEALQRP
NSCVKLQTVHSIPFTIIKYEAQQRP

SEQ ID NO: 38451 - protein, 25 aa, synthetic construct
  source 1..25: note = Seed: NSCVKLQTVHSIPLTINKEEALQRP
NSCVKLQTVHSIPFTIIKYEASQRP

SEQ ID NO: 38452 - protein, 25 aa, synthetic construct
  source 1..25: note = Seed: NSCVKLQTVHSIPLTINKEEALQRP
NSCVKLQTVHSIPFTIIKYEATQRP

SEQ ID NO: 38453 - protein, 25 aa, synthetic construct
  source 1..25: note = Seed: NSCVKLQTVHSIPLTINKEEALQRP
NSCVKLQTVHSIPFTIIKYEAVQRP

SEQ ID NO: 38454 - protein, 25 aa, synthetic construct
  source 1..25: note = Seed: NSCVKLQTVHSIPLTINKEEALQRP
NSCVKLQTVHSIPFTIIKYEAYQRP

SEQ ID NO: 38455 - protein, 25 aa, synthetic construct
  source 1..25: note = Seed: NSCVKLQTVHSIPLTINKEEALQRP
NSCVKLQTVHSIPFTIKKFEAAQRP

SEQ ID NO: 38456 - protein, 25 aa, synthetic construct
  source 1..25: note = Seed: NSCVKLQTVHSIPLTINKEEALQRP
NSCVKLQTVHSIPFTIKKFEACQRP

SEQ ID NO: 38457 - protein, 25 aa, synthetic construct
  source 1..25: note = Seed: NSCVKLQTVHSIPLTINKEEALQRP
NSCVKLQTVHSIPFTIKKFEAEQRP

SEQ ID NO: 38458 - protein, 25 aa, synthetic construct
  source 1..25: note = Seed: NSCVKLQTVHSIPLTINKEEALQRP
NSCVKLQTVHSIPFTIKKFEAFQRP

SEQ ID NO: 38459 - protein, 25 aa, synthetic construct
  source 1..25: note = Seed: NSCVKLQTVHSIPLTINKEEALQRP
NSCVKLQTVHSIPFTIKKFEAIQRP

SEQ ID NO: 38460 - protein, 25 aa, synthetic construct
  source 1..25: note = Seed: NSCVKLQTVHSIPLTINKEEALQRP
NSCVKLQTVHSIPFTIKKFEALQRP

SEQ ID NO: 38461 - protein, 25 aa, synthetic construct
  source 1..25: note = Seed: NSCVKLQTVHSIPLTINKEEALQRP
NSCVKLQTVHSIPFTIKKFEAMQRP

SEQ ID NO: 38462 - protein, 25 aa, synthetic construct
  source 1..25: note = Seed: NSCVKLQTVHSIPLTINKEEALQRP
NSCVKLQTVHSIPFTIKKFEANQRP

SEQ ID NO: 38463 - protein, 25 aa, synthetic construct
  source 1..25: note = Seed: NSCVKLQTVHSIPLTINKEEALQRP
NSCVKLQTVHSIPFTIKKFEASQRP

SEQ ID NO: 38464 - protein, 25 aa, synthetic construct
  source 1..25: note = Seed: NSCVKLQTVHSIPLTINKEEALQRP
NSCVKLQTVHSIPFTIKKFEATQRP

SEQ ID NO: 38465 - protein, 25 aa, synthetic construct
  source 1..25: note = Seed: NSCVKLQTVHSIPLTINKEEALQRP
NSCVKLQTVHSIPFTIKKFEAVQRP

SEQ ID NO: 38466 - protein, 25 aa, synthetic construct
  source 1..25: note = Seed: NSCVKLQTVHSIPLTINKEEALQRP
NSCVKLQTVHSIPFTIKKFEAYQRP

SEQ ID NO: 38467 - protein, 25 aa, synthetic construct
  source 1..25: note = Seed: NSCVKLQTVHSIPLTINKEEALQRP
NSCVKLQTVHSIPFTIKKIEAFQRP

SEQ ID NO: 38468 - protein, 25 aa, synthetic construct
  source 1..25: note = Seed: NSCVKLQTVHSIPLTINKEEALQRP
NSCVKLQTVHSIPFTIKKLEAIQRP

SEQ ID NO: 38469 - protein, 25 aa, synthetic construct
  source 1..25: note = Seed: NSCVKLQTVHSIPLTINKEEALQRP
NSCVKLQTVHSIPFTIKKLEALQRP

SEQ ID NO: 38470 - protein, 25 aa, synthetic construct
  source 1..25: note = Seed: NSCVKLQTVHSIPLTINKEEALQRP
NSCVKLQTVHSIPFTIKKLEAVQRP

SEQ ID NO: 38471 - protein, 25 aa, synthetic construct
  source 1..25: note = Seed: NSCVKLQTVHSIPLTINKEEALQRP
NSCVKLQTVHSIPFTIKKREAFQRP

SEQ ID NO: 38472 - protein, 25 aa, synthetic construct
  source 1..25: note = Seed: NSCVKLQTVHSIPLTINKEEALQRP
NSCVKLQTVHSIPFTIKKREAIQRP

SEQ ID NO: 38473 - protein, 25 aa, synthetic construct
  source 1..25: note = Seed: NSCVKLQTVHSIPLTINKEEALQRP
NSCVKLQTVHSIPFTIKKREALQRP

SEQ ID NO: 38474 - protein, 25 aa, synthetic construct
  source 1..25: note = Seed: NSCVKLQTVHSIPLTINKEEALQRP
NSCVKLQTVHSIPFTIKKWEAIQRP

SEQ ID NO: 38475 - protein, 25 aa, synthetic construct
  source 1..25: note = Seed: NSCVKLQTVHSIPLTINKEEALQRP
NSCVKLQTVHSIPFTIKKWEALQRP

SEQ ID NO: 38476 - protein, 25 aa, synthetic construct
  source 1..25: note = Seed: NSCVKLQTVHSIPLTINKEEALQRP
NSCVKLQTVHSIPFTIKKWEAVQRP

SEQ ID NO: 38477 - protein, 25 aa, synthetic construct
  source 1..25: note = Seed: NSCVKLQTVHSIPLTINKEEALQRP
NSCVKLQTVHSIPFTIKKYEAIQRP

SEQ ID NO: 38478 - protein, 25 aa, synthetic construct
  source 1..25: note = Seed: NSCVKLQTVHSIPLTINKEEALQRP
NSCVKLQTVHSIPFTIKKYEALQRP

SEQ ID NO: 38479 - protein, 25 aa, synthetic construct
  source 1..25: note = Seed: NSCVKLQTVHSIPLTINKEEALQRP
NSCVKLQTVHSIPFTIKKYEAVQRP

SEQ ID NO: 38480 - protein, 25 aa, synthetic construct
  source 1..25: note = Seed: NSCVKLQTVHSIPLTINKEEALQRP
NSCVKLQTVHSIPFTILKAEAAQRP

SEQ ID NO: 38481 - protein, 25 aa, synthetic construct
  source 1..25: note = Seed: NSCVKLQTVHSIPLTINKEEALQRP
NSCVKLQTVHSIPFTILKAEADQRP

SEQ ID NO: 38482 - protein, 25 aa, synthetic construct
  source 1..25: note = Seed: NSCVKLQTVHSIPLTINKEEALQRP
NSCVKLQTVHSIPFTILKAEAFQRP

SEQ ID NO: 38483 - protein, 25 aa, synthetic construct
  source 1..25: note = Seed: NSCVKLQTVHSIPLTINKEEALQRP
NSCVKLQTVHSIPFTILKAEAIQRP

SEQ ID NO: 38484 - protein, 25 aa, synthetic construct
  source 1..25: note = Seed: NSCVKLQTVHSIPLTINKEEALQRP
NSCVKLQTVHSIPFTILKAEALQRP

SEQ ID NO: 38485 - protein, 25 aa, synthetic construct
  source 1..25: note = Seed: NSCVKLQTVHSIPLTINKEEALQRP
NSCVKLQTVHSIPFTILKAEAMQRP

SEQ ID NO: 38486 - protein, 25 aa, synthetic construct
  source 1..25: note = Seed: NSCVKLQTVHSIPLTINKEEALQRP
NSCVKLQTVHSIPFTILKAEAVQRP

SEQ ID NO: 38487 - protein, 25 aa, synthetic construct
  source 1..25: note = Seed: NSCVKLQTVHSIPLTINKEEALQRP
NSCVKLQTVHSIPFTILKAEAYQRP

SEQ ID NO: 38488 - protein, 25 aa, synthetic construct
  source 1..25: note = Seed: NSCVKLQTVHSIPLTINKEEALQRP
NSCVKLQTVHSIPFTILKDEAIQRP

SEQ ID NO: 38489 - protein, 25 aa, synthetic construct
  source 1..25: note = Seed: NSCVKLQTVHSIPLTINKEEALQRP
NSCVKLQTVHSIPFTILKDEAVQRP

SEQ ID NO: 38490 - protein, 25 aa, synthetic construct
  source 1..25: note = Seed: NSCVKLQTVHSIPLTINKEEALQRP
NSCVKLQTVHSIPFTILKFEAAQRP

SEQ ID NO: 38491 - protein, 25 aa, synthetic construct
  source 1..25: note = Seed: NSCVKLQTVHSIPLTINKEEALQRP
NSCVKLQTVHSIPFTILKFEACQRP

SEQ ID NO: 38492 - protein, 25 aa, synthetic construct
  source 1..25: note = Seed: NSCVKLQTVHSIPLTINKEEALQRP
NSCVKLQTVHSIPFTILKFEADQRP

SEQ ID NO: 38493 - protein, 25 aa, synthetic construct
  source 1..25: note = Seed: NSCVKLQTVHSIPLTINKEEALQRP
NSCVKLQTVHSIPFTILKFEAEQRP

SEQ ID NO: 38494 - protein, 25 aa, synthetic construct
  source 1..25: note = Seed: NSCVKLQTVHSIPLTINKEEALQRP
NSCVKLQTVHSIPFTILKFEAFQRP

SEQ ID NO: 38495 - protein, 25 aa, synthetic construct
  source 1..25: note = Seed: NSCVKLQTVHSIPLTINKEEALQRP
NSCVKLQTVHSIPFTILKFEAGQRP

SEQ ID NO: 38496 - protein, 25 aa, synthetic construct
  source 1..25: note = Seed: NSCVKLQTVHSIPLTINKEEALQRP
NSCVKLQTVHSIPFTILKFEAHQRP

SEQ ID NO: 38497 - protein, 25 aa, synthetic construct
  source 1..25: note = Seed: NSCVKLQTVHSIPLTINKEEALQRP
NSCVKLQTVHSIPFTILKFEAIQRP

SEQ ID NO: 38498 - protein, 25 aa, synthetic construct
  source 1..25: note = Seed: NSCVKLQTVHSIPLTINKEEALQRP
NSCVKLQTVHSIPFTILKFEAKQRP

SEQ ID NO: 38499 - protein, 25 aa, synthetic construct
  source 1..25: note = Seed: NSCVKLQTVHSIPLTINKEEALQRP
NSCVKLQTVHSIPFTILKFEALQRP

SEQ ID NO: 38500 - protein, 25 aa, synthetic construct
  source 1..25: note = Seed: NSCVKLQTVHSIPLTINKEEALQRP
NSCVKLQTVHSIPFTILKFEAMQRP

SEQ ID NO: 38501 - protein, 25 aa, synthetic construct
  source 1..25: note = Seed: NSCVKLQTVHSIPLTINKEEALQRP
NSCVKLQTVHSIPFTILKFEANQRP

SEQ ID NO: 38502 - protein, 25 aa, synthetic construct
  source 1..25: note = Seed: NSCVKLQTVHSIPLTINKEEALQRP
NSCVKLQTVHSIPFTILKFEAPQRP

SEQ ID NO: 38503 - protein, 25 aa, synthetic construct
  source 1..25: note = Seed: NSCVKLQTVHSIPLTINKEEALQRP
NSCVKLQTVHSIPFTILKFEAQQRP

SEQ ID NO: 38504 - protein, 25 aa, synthetic construct
  source 1..25: note = Seed: NSCVKLQTVHSIPLTINKEEALQRP
NSCVKLQTVHSIPFTILKFEARQRP

SEQ ID NO: 38505 - protein, 25 aa, synthetic construct
  source 1..25: note = Seed: NSCVKLQTVHSIPLTINKEEALQRP
NSCVKLQTVHSIPFTILKFEASQRP

SEQ ID NO: 38506 - protein, 25 aa, synthetic construct
  source 1..25: note = Seed: NSCVKLQTVHSIPLTINKEEALQRP
NSCVKLQTVHSIPFTILKFEATQRP

SEQ ID NO: 38507 - protein, 25 aa, synthetic construct
  source 1..25: note = Seed: NSCVKLQTVHSIPLTINKEEALQRP
NSCVKLQTVHSIPFTILKFEAVQRP

SEQ ID NO: 38508 - protein, 25 aa, synthetic construct
  source 1..25: note = Seed: NSCVKLQTVHSIPLTINKEEALQRP
NSCVKLQTVHSIPFTILKFEAYQRP

SEQ ID NO: 38509 - protein, 25 aa, synthetic construct
  source 1..25: note = Seed: NSCVKLQTVHSIPLTINKEEALQRP
NSCVKLQTVHSIPFTILKGEAVQRP

SEQ ID NO: 38510 - protein, 25 aa, synthetic construct
  source 1..25: note = Seed: NSCVKLQTVHSIPLTINKEEALQRP
NSCVKLQTVHSIPFTILKIEAAQRP

SEQ ID NO: 38511 - protein, 25 aa, synthetic construct
  source 1..25: note = Seed: NSCVKLQTVHSIPLTINKEEALQRP
NSCVKLQTVHSIPFTILKIEADQRP

SEQ ID NO: 38512 - protein, 25 aa, synthetic construct
  source 1..25: note = Seed: NSCVKLQTVHSIPLTINKEEALQRP
NSCVKLQTVHSIPFTILKIEAEQRP

SEQ ID NO: 38513 - protein, 25 aa, synthetic construct
  source 1..25: note = Seed: NSCVKLQTVHSIPLTINKEEALQRP
NSCVKLQTVHSIPFTILKIEAFQRP

SEQ ID NO: 38514 - protein, 25 aa, synthetic construct
  source 1..25: note = Seed: NSCVKLQTVHSIPLTINKEEALQRP
NSCVKLQTVHSIPFTILKIEAIQRP

SEQ ID NO: 38515 - protein, 25 aa, synthetic construct
  source 1..25: note = Seed: NSCVKLQTVHSIPLTINKEEALQRP
NSCVKLQTVHSIPFTILKIEALQRP

SEQ ID NO: 38516 - protein, 25 aa, synthetic construct
  source 1..25: note = Seed: NSCVKLQTVHSIPLTINKEEALQRP
NSCVKLQTVHSIPFTILKIEAMQRP

SEQ ID NO: 38517 - protein, 25 aa, synthetic construct
  source 1..25: note = Seed: NSCVKLQTVHSIPLTINKEEALQRP
NSCVKLQTVHSIPFTILKIEANQRP

SEQ ID NO: 38518 - protein, 25 aa, synthetic construct
  source 1..25: note = Seed: NSCVKLQTVHSIPLTINKEEALQRP
NSCVKLQTVHSIPFTILKIEATQRP

SEQ ID NO: 38519 - protein, 25 aa, synthetic construct
  source 1..25: note = Seed: NSCVKLQTVHSIPLTINKEEALQRP
NSCVKLQTVHSIPFTILKIEAVQRP

SEQ ID NO: 38520 - protein, 25 aa, synthetic construct
  source 1..25: note = Seed: NSCVKLQTVHSIPLTINKEEALQRP
NSCVKLQTVHSIPFTILKIEAYQRP

SEQ ID NO: 38521 - protein, 25 aa, synthetic construct
  source 1..25: note = Seed: NSCVKLQTVHSIPLTINKEEALQRP
NSCVKLQTVHSIPFTILKLEAAQRP

SEQ ID NO: 38522 - protein, 25 aa, synthetic construct
  source 1..25: note = Seed: NSCVKLQTVHSIPLTINKEEALQRP
NSCVKLQTVHSIPFTILKLEADQRP

SEQ ID NO: 38523 - protein, 25 aa, synthetic construct
  source 1..25: note = Seed: NSCVKLQTVHSIPLTINKEEALQRP
NSCVKLQTVHSIPFTILKLEAEQRP

SEQ ID NO: 38524 - protein, 25 aa, synthetic construct
  source 1..25: note = Seed: NSCVKLQTVHSIPLTINKEEALQRP
NSCVKLQTVHSIPFTILKLEAFQRP

SEQ ID NO: 38525 - protein, 25 aa, synthetic construct
  source 1..25: note = Seed: NSCVKLQTVHSIPLTINKEEALQRP
NSCVKLQTVHSIPFTILKLEAIQRP

SEQ ID NO: 38526 - protein, 25 aa, synthetic construct
  source 1..25: note = Seed: NSCVKLQTVHSIPLTINKEEALQRP
NSCVKLQTVHSIPFTILKLEALQRP

SEQ ID NO: 38527 - protein, 25 aa, synthetic construct
  source 1..25: note = Seed: NSCVKLQTVHSIPLTINKEEALQRP
NSCVKLQTVHSIPFTILKLEAMQRP

SEQ ID NO: 38528 - protein, 25 aa, synthetic construct
  source 1..25: note = Seed: NSCVKLQTVHSIPLTINKEEALQRP
NSCVKLQTVHSIPFTILKLEANQRP

SEQ ID NO: 38529 - protein, 25 aa, synthetic construct
  source 1..25: note = Seed: NSCVKLQTVHSIPLTINKEEALQRP
NSCVKLQTVHSIPFTILKLEASQRP

SEQ ID NO: 38530 - protein, 25 aa, synthetic construct
  source 1..25: note = Seed: NSCVKLQTVHSIPLTINKEEALQRP
NSCVKLQTVHSIPFTILKLEATQRP

SEQ ID NO: 38531 - protein, 25 aa, synthetic construct
  source 1..25: note = Seed: NSCVKLQTVHSIPLTINKEEALQRP
NSCVKLQTVHSIPFTILKLEAVQRP

SEQ ID NO: 38532 - protein, 25 aa, synthetic construct
  source 1..25: note = Seed: NSCVKLQTVHSIPLTINKEEALQRP
NSCVKLQTVHSIPFTILKLEAYQRP

SEQ ID NO: 38533 - protein, 25 aa, synthetic construct
  source 1..25: note = Seed: NSCVKLQTVHSIPLTINKEEALQRP
NSCVKLQTVHSIPFTILKMEAIQRP

SEQ ID NO: 38534 - protein, 25 aa, synthetic construct
  source 1..25: note = Seed: NSCVKLQTVHSIPLTINKEEALQRP
NSCVKLQTVHSIPFTILKMEALQRP

SEQ ID NO: 38535 - protein, 25 aa, synthetic construct
  source 1..25: note = Seed: NSCVKLQTVHSIPLTINKEEALQRP
NSCVKLQTVHSIPFTILKMEAMQRP

SEQ ID NO: 38536 - protein, 25 aa, synthetic construct
  source 1..25: note = Seed: NSCVKLQTVHSIPLTINKEEALQRP
NSCVKLQTVHSIPFTILKMEAVQRP

SEQ ID NO: 38537 - protein, 25 aa, synthetic construct
  source 1..25: note = Seed: NSCVKLQTVHSIPLTINKEEALQRP
NSCVKLQTVHSIPFTILKNEAAQRP

SEQ ID NO: 38538 - protein, 25 aa, synthetic construct
  source 1..25: note = Seed: NSCVKLQTVHSIPLTINKEEALQRP
NSCVKLQTVHSIPFTILKNEADQRP

SEQ ID NO: 38539 - protein, 25 aa, synthetic construct
  source 1..25: note = Seed: NSCVKLQTVHSIPLTINKEEALQRP
NSCVKLQTVHSIPFTILKNEAEQRP

SEQ ID NO: 38540 - protein, 25 aa, synthetic construct
  source 1..25: note = Seed: NSCVKLQTVHSIPLTINKEEALQRP
NSCVKLQTVHSIPFTILKNEAGQRP

SEQ ID NO: 38541 - protein, 25 aa, synthetic construct
  source 1..25: note = Seed: NSCVKLQTVHSIPLTINKEEALQRP
NSCVKLQTVHSIPFTILKNEAHQRP

SEQ ID NO: 38542 - protein, 25 aa, synthetic construct
  source 1..25: note = Seed: NSCVKLQTVHSIPLTINKEEALQRP
NSCVKLQTVHSIPFTILKNEAIQRP

SEQ ID NO: 38543 - protein, 25 aa, synthetic construct
  source 1..25: note = Seed: NSCVKLQTVHSIPLTINKEEALQRP
NSCVKLQTVHSIPFTILKNEALQRP

SEQ ID NO: 38544 - protein, 25 aa, synthetic construct
  source 1..25: note = Seed: NSCVKLQTVHSIPLTINKEEALQRP
NSCVKLQTVHSIPFTILKNEAMQRP

SEQ ID NO: 38545 - protein, 25 aa, synthetic construct
  source 1..25: note = Seed: NSCVKLQTVHSIPLTINKEEALQRP
NSCVKLQTVHSIPFTILKNEANQRP

SEQ ID NO: 38546 - protein, 25 aa, synthetic construct
  source 1..25: note = Seed: NSCVKLQTVHSIPLTINKEEALQRP
NSCVKLQTVHSIPFTILKNEASQRP

SEQ ID NO: 38547 - protein, 25 aa, synthetic construct
  source 1..25: note = Seed: NSCVKLQTVHSIPLTINKEEALQRP
NSCVKLQTVHSIPFTILKNEATQRP

SEQ ID NO: 38548 - protein, 25 aa, synthetic construct
  source 1..25: note = Seed: NSCVKLQTVHSIPLTINKEEALQRP
NSCVKLQTVHSIPFTILKNEAVQRP

SEQ ID NO: 38549 - protein, 25 aa, synthetic construct
  source 1..25: note = Seed: NSCVKLQTVHSIPLTINKEEALQRP
NSCVKLQTVHSIPFTILKPEALQRP

SEQ ID NO: 38550 - protein, 25 aa, synthetic construct
  source 1..25: note = Seed: NSCVKLQTVHSIPLTINKEEALQRP
NSCVKLQTVHSIPFTILKREALQRP

SEQ ID NO: 38551 - protein, 25 aa, synthetic construct
  source 1..25: note = Seed: NSCVKLQTVHSIPLTINKEEALQRP
NSCVKLQTVHSIPFTILKREAYQRP

SEQ ID NO: 38552 - protein, 25 aa, synthetic construct
  source 1..25: note = Seed: NSCVKLQTVHSIPLTINKEEALQRP
NSCVKLQTVHSIPFTILKSEAAQRP

SEQ ID NO: 38553 - protein, 25 aa, synthetic construct
  source 1..25: note = Seed: NSCVKLQTVHSIPLTINKEEALQRP
NSCVKLQTVHSIPFTILKSEADQRP

SEQ ID NO: 38554 - protein, 25 aa, synthetic construct
  source 1..25: note = Seed: NSCVKLQTVHSIPLTINKEEALQRP
NSCVKLQTVHSIPFTILKSEAEQRP

SEQ ID NO: 38555 - protein, 25 aa, synthetic construct
  source 1..25: note = Seed: NSCVKLQTVHSIPLTINKEEALQRP
NSCVKLQTVHSIPFTILKSEAFQRP

SEQ ID NO: 38556 - protein, 25 aa, synthetic construct
  source 1..25: note = Seed: NSCVKLQTVHSIPLTINKEEALQRP
NSCVKLQTVHSIPFTILKSEAIQRP

SEQ ID NO: 38557 - protein, 25 aa, synthetic construct
  source 1..25: note = Seed: NSCVKLQTVHSIPLTINKEEALQRP
NSCVKLQTVHSIPFTILKSEALQRP

SEQ ID NO: 38558 - protein, 25 aa, synthetic construct
  source 1..25: note = Seed: NSCVKLQTVHSIPLTINKEEALQRP
NSCVKLQTVHSIPFTILKSEASQRP

SEQ ID NO: 38559 - protein, 25 aa, synthetic construct
  source 1..25: note = Seed: NSCVKLQTVHSIPLTINKEEALQRP
NSCVKLQTVHSIPFTILKSEAVQRP

SEQ ID NO: 38560 - protein, 25 aa, synthetic construct
  source 1..25: note = Seed: NSCVKLQTVHSIPLTINKEEALQRP
NSCVKLQTVHSIPFTILKTEAAQRP

SEQ ID NO: 38561 - protein, 25 aa, synthetic construct
  source 1..25: note = Seed: NSCVKLQTVHSIPLTINKEEALQRP
NSCVKLQTVHSIPFTILKTEADQRP

SEQ ID NO: 38562 - protein, 25 aa, synthetic construct
  source 1..25: note = Seed: NSCVKLQTVHSIPLTINKEEALQRP
NSCVKLQTVHSIPFTILKTEAEQRP

SEQ ID NO: 38563 - protein, 25 aa, synthetic construct
  source 1..25: note = Seed: NSCVKLQTVHSIPLTINKEEALQRP
NSCVKLQTVHSIPFTILKTEAFQRP

SEQ ID NO: 38564 - protein, 25 aa, synthetic construct
  source 1..25: note = Seed: NSCVKLQTVHSIPLTINKEEALQRP
NSCVKLQTVHSIPFTILKTEAHQRP

SEQ ID NO: 38565 - protein, 25 aa, synthetic construct
  source 1..25: note = Seed: NSCVKLQTVHSIPLTINKEEALQRP
NSCVKLQTVHSIPFTILKTEAIQRP

SEQ ID NO: 38566 - protein, 25 aa, synthetic construct
  source 1..25: note = Seed: NSCVKLQTVHSIPLTINKEEALQRP
NSCVKLQTVHSIPFTILKTEALQRP

SEQ ID NO: 38567 - protein, 25 aa, synthetic construct
  source 1..25: note = Seed: NSCVKLQTVHSIPLTINKEEALQRP
NSCVKLQTVHSIPFTILKTEAMQRP

SEQ ID NO: 38568 - protein, 25 aa, synthetic construct
  source 1..25: note = Seed: NSCVKLQTVHSIPLTINKEEALQRP
NSCVKLQTVHSIPFTILKTEASQRP

SEQ ID NO: 38569 - protein, 25 aa, synthetic construct
  source 1..25: note = Seed: NSCVKLQTVHSIPLTINKEEALQRP
NSCVKLQTVHSIPFTILKTEATQRP

SEQ ID NO: 38570 - protein, 25 aa, synthetic construct
  source 1..25: note = Seed: NSCVKLQTVHSIPLTINKEEALQRP
NSCVKLQTVHSIPFTILKTEAVQRP

SEQ ID NO: 38571 - protein, 25 aa, synthetic construct
  source 1..25: note = Seed: NSCVKLQTVHSIPLTINKEEALQRP
NSCVKLQTVHSIPFTILKVEAAQRP

SEQ ID NO: 38572 - protein, 25 aa, synthetic construct
  source 1..25: note = Seed: NSCVKLQTVHSIPLTINKEEALQRP
NSCVKLQTVHSIPFTILKVEADQRP

SEQ ID NO: 38573 - protein, 25 aa, synthetic construct
  source 1..25: note = Seed: NSCVKLQTVHSIPLTINKEEALQRP
NSCVKLQTVHSIPFTILKVEAEQRP

SEQ ID NO: 38574 - protein, 25 aa, synthetic construct
  source 1..25: note = Seed: NSCVKLQTVHSIPLTINKEEALQRP
NSCVKLQTVHSIPFTILKVEAIQRP

SEQ ID NO: 38575 - protein, 25 aa, synthetic construct
  source 1..25: note = Seed: NSCVKLQTVHSIPLTINKEEALQRP
NSCVKLQTVHSIPFTILKVEALQRP

SEQ ID NO: 38576 - protein, 25 aa, synthetic construct
  source 1..25: note = Seed: NSCVKLQTVHSIPLTINKEEALQRP
NSCVKLQTVHSIPFTILKVEAMQRP

SEQ ID NO: 38577 - protein, 25 aa, synthetic construct
  source 1..25: note = Seed: NSCVKLQTVHSIPLTINKEEALQRP
NSCVKLQTVHSIPFTILKVEANQRP

SEQ ID NO: 38578 - protein, 25 aa, synthetic construct
  source 1..25: note = Seed: NSCVKLQTVHSIPLTINKEEALQRP
NSCVKLQTVHSIPFTILKVEAVQRP

SEQ ID NO: 38579 - protein, 25 aa, synthetic construct
  source 1..25: note = Seed: NSCVKLQTVHSIPLTINKEEALQRP
NSCVKLQTVHSIPFTILKWEAAQRP

SEQ ID NO: 38580 - protein, 25 aa, synthetic construct
  source 1..25: note = Seed: NSCVKLQTVHSIPLTINKEEALQRP
NSCVKLQTVHSIPFTILKWEADQRP

SEQ ID NO: 38581 - protein, 25 aa, synthetic construct
  source 1..25: note = Seed: NSCVKLQTVHSIPLTINKEEALQRP
NSCVKLQTVHSIPFTILKWEAEQRP

SEQ ID NO: 38582 - protein, 25 aa, synthetic construct
  source 1..25: note = Seed: NSCVKLQTVHSIPLTINKEEALQRP
NSCVKLQTVHSIPFTILKWEAFQRP

SEQ ID NO: 38583 - protein, 25 aa, synthetic construct
  source 1..25: note = Seed: NSCVKLQTVHSIPLTINKEEALQRP
NSCVKLQTVHSIPFTILKWEAGQRP

SEQ ID NO: 38584 - protein, 25 aa, synthetic construct
  source 1..25: note = Seed: NSCVKLQTVHSIPLTINKEEALQRP
NSCVKLQTVHSIPFTILKWEAHQRP

SEQ ID NO: 38585 - protein, 25 aa, synthetic construct
  source 1..25: note = Seed: NSCVKLQTVHSIPLTINKEEALQRP
NSCVKLQTVHSIPFTILKWEAIQRP

SEQ ID NO: 38586 - protein, 25 aa, synthetic construct
  source 1..25: note = Seed: NSCVKLQTVHSIPLTINKEEALQRP
NSCVKLQTVHSIPFTILKWEALQRP

SEQ ID NO: 38587 - protein, 25 aa, synthetic construct
  source 1..25: note = Seed: NSCVKLQTVHSIPLTINKEEALQRP
NSCVKLQTVHSIPFTILKWEAMQRP

SEQ ID NO: 38588 - protein, 25 aa, synthetic construct
  source 1..25: note = Seed: NSCVKLQTVHSIPLTINKEEALQRP
NSCVKLQTVHSIPFTILKWEANQRP

SEQ ID NO: 38589 - protein, 25 aa, synthetic construct
  source 1..25: note = Seed: NSCVKLQTVHSIPLTINKEEALQRP
NSCVKLQTVHSIPFTILKWEAQQRP

SEQ ID NO: 38590 - protein, 25 aa, synthetic construct
  source 1..25: note = Seed: NSCVKLQTVHSIPLTINKEEALQRP
NSCVKLQTVHSIPFTILKWEASQRP

SEQ ID NO: 38591 - protein, 25 aa, synthetic construct
  source 1..25: note = Seed: NSCVKLQTVHSIPLTINKEEALQRP
NSCVKLQTVHSIPFTILKWEATQRP

SEQ ID NO: 38592 - protein, 25 aa, synthetic construct
  source 1..25: note = Seed: NSCVKLQTVHSIPLTINKEEALQRP
NSCVKLQTVHSIPFTILKWEAVQRP

SEQ ID NO: 38593 - protein, 25 aa, synthetic construct
  source 1..25: note = Seed: NSCVKLQTVHSIPLTINKEEALQRP
NSCVKLQTVHSIPFTILKYEAAQRP

SEQ ID NO: 38594 - protein, 25 aa, synthetic construct
  source 1..25: note = Seed: NSCVKLQTVHSIPLTINKEEALQRP
NSCVKLQTVHSIPFTILKYEACQRP

SEQ ID NO: 38595 - protein, 25 aa, synthetic construct
  source 1..25: note = Seed: NSCVKLQTVHSIPLTINKEEALQRP
NSCVKLQTVHSIPFTILKYEADQRP

SEQ ID NO: 38596 - protein, 25 aa, synthetic construct
  source 1..25: note = Seed: NSCVKLQTVHSIPLTINKEEALQRP
NSCVKLQTVHSIPFTILKYEAEQRP

SEQ ID NO: 38597 - protein, 25 aa, synthetic construct
  source 1..25: note = Seed: NSCVKLQTVHSIPLTINKEEALQRP
NSCVKLQTVHSIPFTILKYEAFQRP

SEQ ID NO: 38598 - protein, 25 aa, synthetic construct
  source 1..25: note = Seed: NSCVKLQTVHSIPLTINKEEALQRP
NSCVKLQTVHSIPFTILKYEAGQRP

SEQ ID NO: 38599 - protein, 25 aa, synthetic construct
  source 1..25: note = Seed: NSCVKLQTVHSIPLTINKEEALQRP
NSCVKLQTVHSIPFTILKYEAHQRP

SEQ ID NO: 38600 - protein, 25 aa, synthetic construct
  source 1..25: note = Seed: NSCVKLQTVHSIPLTINKEEALQRP
NSCVKLQTVHSIPFTILKYEAIQRP

SEQ ID NO: 38601 - protein, 25 aa, synthetic construct
  source 1..25: note = Seed: NSCVKLQTVHSIPLTINKEEALQRP
NSCVKLQTVHSIPFTILKYEALQRP

SEQ ID NO: 38602 - protein, 25 aa, synthetic construct
  source 1..25: note = Seed: NSCVKLQTVHSIPLTINKEEALQRP
NSCVKLQTVHSIPFTILKYEAMQRP

SEQ ID NO: 38603 - protein, 25 aa, synthetic construct
  source 1..25: note = Seed: NSCVKLQTVHSIPLTINKEEALQRP
NSCVKLQTVHSIPFTILKYEANQRP

SEQ ID NO: 38604 - protein, 25 aa, synthetic construct
  source 1..25: note = Seed: NSCVKLQTVHSIPLTINKEEALQRP
NSCVKLQTVHSIPFTILKYEAQQRP

SEQ ID NO: 38605 - protein, 25 aa, synthetic construct
  source 1..25: note = Seed: NSCVKLQTVHSIPLTINKEEALQRP
NSCVKLQTVHSIPFTILKYEASQRP

SEQ ID NO: 38606 - protein, 25 aa, synthetic construct
  source 1..25: note = Seed: NSCVKLQTVHSIPLTINKEEALQRP
NSCVKLQTVHSIPFTILKYEATQRP

SEQ ID NO: 38607 - protein, 25 aa, synthetic construct
  source 1..25: note = Seed: NSCVKLQTVHSIPLTINKEEALQRP
NSCVKLQTVHSIPFTILKYEAVQRP

SEQ ID NO: 38608 - protein, 25 aa, synthetic construct
  source 1..25: note = Seed: NSCVKLQTVHSIPLTINKEEALQRP
NSCVKLQTVHSIPFTILKYEAYQRP

SEQ ID NO: 38609 - protein, 25 aa, synthetic construct
  source 1..25: note = Seed: NSCVKLQTVHSIPLTINKEEALQRP
NSCVKLQTVHSIPFTIMKAEAAQRP

SEQ ID NO: 38610 - protein, 25 aa, synthetic construct
  source 1..25: note = Seed: NSCVKLQTVHSIPLTINKEEALQRP
NSCVKLQTVHSIPFTIMKAEADQRP

SEQ ID NO: 38611 - protein, 25 aa, synthetic construct
  source 1..25: note = Seed: NSCVKLQTVHSIPLTINKEEALQRP
NSCVKLQTVHSIPFTIMKAEAEQRP

SEQ ID NO: 38612 - protein, 25 aa, synthetic construct
  source 1..25: note = Seed: NSCVKLQTVHSIPLTINKEEALQRP
NSCVKLQTVHSIPFTIMKAEAFQRP

SEQ ID NO: 38613 - protein, 25 aa, synthetic construct
  source 1..25: note = Seed: NSCVKLQTVHSIPLTINKEEALQRP
NSCVKLQTVHSIPFTIMKAEAIQRP

SEQ ID NO: 38614 - protein, 25 aa, synthetic construct
  source 1..25: note = Seed: NSCVKLQTVHSIPLTINKEEALQRP
NSCVKLQTVHSIPFTIMKAEALQRP

SEQ ID NO: 38615 - protein, 25 aa, synthetic construct
  source 1..25: note = Seed: NSCVKLQTVHSIPLTINKEEALQRP
NSCVKLQTVHSIPFTIMKAEAMQRP

SEQ ID NO: 38616 - protein, 25 aa, synthetic construct
  source 1..25: note = Seed: NSCVKLQTVHSIPLTINKEEALQRP
NSCVKLQTVHSIPFTIMKAEASQRP

SEQ ID NO: 38617 - protein, 25 aa, synthetic construct
  source 1..25: note = Seed: NSCVKLQTVHSIPLTINKEEALQRP
NSCVKLQTVHSIPFTIMKAEAVQRP

SEQ ID NO: 38618 - protein, 25 aa, synthetic construct
  source 1..25: note = Seed: NSCVKLQTVHSIPLTINKEEALQRP
NSCVKLQTVHSIPFTIMKAEAYQRP

SEQ ID NO: 38619 - protein, 25 aa, synthetic construct
  source 1..25: note = Seed: NSCVKLQTVHSIPLTINKEEALQRP
NSCVKLQTVHSIPFTIMKDEAAQRP

SEQ ID NO: 38620 - protein, 25 aa, synthetic construct
  source 1..25: note = Seed: NSCVKLQTVHSIPLTINKEEALQRP
NSCVKLQTVHSIPFTIMKDEAIQRP

SEQ ID NO: 38621 - protein, 25 aa, synthetic construct
  source 1..25: note = Seed: NSCVKLQTVHSIPLTINKEEALQRP
NSCVKLQTVHSIPFTIMKDEALQRP

SEQ ID NO: 38622 - protein, 25 aa, synthetic construct
  source 1..25: note = Seed: NSCVKLQTVHSIPLTINKEEALQRP
NSCVKLQTVHSIPFTIMKDEAVQRP

SEQ ID NO: 38623 - protein, 25 aa, synthetic construct
  source 1..25: note = Seed: NSCVKLQTVHSIPLTINKEEALQRP
NSCVKLQTVHSIPFTIMKFEAAQRP

SEQ ID NO: 38624 - protein, 25 aa, synthetic construct
  source 1..25: note = Seed: NSCVKLQTVHSIPLTINKEEALQRP
NSCVKLQTVHSIPFTIMKFEACQRP

SEQ ID NO: 38625 - protein, 25 aa, synthetic construct
  source 1..25: note = Seed: NSCVKLQTVHSIPLTINKEEALQRP
NSCVKLQTVHSIPFTIMKFEADQRP

SEQ ID NO: 38626 - protein, 25 aa, synthetic construct
  source 1..25: note = Seed: NSCVKLQTVHSIPLTINKEEALQRP
NSCVKLQTVHSIPFTIMKFEAEQRP

SEQ ID NO: 38627 - protein, 25 aa, synthetic construct
  source 1..25: note = Seed: NSCVKLQTVHSIPLTINKEEALQRP
NSCVKLQTVHSIPFTIMKFEAFQRP

SEQ ID NO: 38628 - protein, 25 aa, synthetic construct
  source 1..25: note = Seed: NSCVKLQTVHSIPLTINKEEALQRP
NSCVKLQTVHSIPFTIMKFEAGQRP

SEQ ID NO: 38629 - protein, 25 aa, synthetic construct
  source 1..25: note = Seed: NSCVKLQTVHSIPLTINKEEALQRP
NSCVKLQTVHSIPFTIMKFEAHQRP

SEQ ID NO: 38630 - protein, 25 aa, synthetic construct
  source 1..25: note = Seed: NSCVKLQTVHSIPLTINKEEALQRP
NSCVKLQTVHSIPFTIMKFEAIQRP

SEQ ID NO: 38631 - protein, 25 aa, synthetic construct
  source 1..25: note = Seed: NSCVKLQTVHSIPLTINKEEALQRP
NSCVKLQTVHSIPFTIMKFEAKQRP

SEQ ID NO: 38632 - protein, 25 aa, synthetic construct
  source 1..25: note = Seed: NSCVKLQTVHSIPLTINKEEALQRP
NSCVKLQTVHSIPFTIMKFEALQRP

SEQ ID NO: 38633 - protein, 25 aa, synthetic construct
  source 1..25: note = Seed: NSCVKLQTVHSIPLTINKEEALQRP
NSCVKLQTVHSIPFTIMKFEAMQRP

SEQ ID NO: 38634 - protein, 25 aa, synthetic construct
  source 1..25: note = Seed: NSCVKLQTVHSIPLTINKEEALQRP
NSCVKLQTVHSIPFTIMKFEANQRP

SEQ ID NO: 38635 - protein, 25 aa, synthetic construct
  source 1..25: note = Seed: NSCVKLQTVHSIPLTINKEEALQRP
NSCVKLQTVHSIPFTIMKFEAPQRP

SEQ ID NO: 38636 - protein, 25 aa, synthetic construct
  source 1..25: note = Seed: NSCVKLQTVHSIPLTINKEEALQRP
NSCVKLQTVHSIPFTIMKFEAQQRP

SEQ ID NO: 38637 - protein, 25 aa, synthetic construct
  source 1..25: note = Seed: NSCVKLQTVHSIPLTINKEEALQRP
NSCVKLQTVHSIPFTIMKFEARQRP

SEQ ID NO: 38638 - protein, 25 aa, synthetic construct
  source 1..25: note = Seed: NSCVKLQTVHSIPLTINKEEALQRP
NSCVKLQTVHSIPFTIMKFEASQRP

SEQ ID NO: 38639 - protein, 25 aa, synthetic construct
  source 1..25: note = Seed: NSCVKLQTVHSIPLTINKEEALQRP
NSCVKLQTVHSIPFTIMKFEATQRP

SEQ ID NO: 38640 - protein, 25 aa, synthetic construct
  source 1..25: note = Seed: NSCVKLQTVHSIPLTINKEEALQRP
NSCVKLQTVHSIPFTIMKFEAVQRP

SEQ ID NO: 38641 - protein, 25 aa, synthetic construct
  source 1..25: note = Seed: NSCVKLQTVHSIPLTINKEEALQRP
NSCVKLQTVHSIPFTIMKFEAYQRP

SEQ ID NO: 38642 - protein, 25 aa, synthetic construct
  source 1..25: note = Seed: NSCVKLQTVHSIPLTINKEEALQRP
NSCVKLQTVHSIPFTIMKGEAAQRP

SEQ ID NO: 38643 - protein, 25 aa, synthetic construct
  source 1..25: note = Seed: NSCVKLQTVHSIPLTINKEEALQRP
NSCVKLQTVHSIPFTIMKGEAIQRP

SEQ ID NO: 38644 - protein, 25 aa, synthetic construct
  source 1..25: note = Seed: NSCVKLQTVHSIPLTINKEEALQRP
NSCVKLQTVHSIPFTIMKGEALQRP

SEQ ID NO: 38645 - protein, 25 aa, synthetic construct
  source 1..25: note = Seed: NSCVKLQTVHSIPLTINKEEALQRP
NSCVKLQTVHSIPFTIMKGEAVQRP

SEQ ID NO: 38646 - protein, 25 aa, synthetic construct
  source 1..25: note = Seed: NSCVKLQTVHSIPLTINKEEALQRP
NSCVKLQTVHSIPFTIMKIEAAQRP

SEQ ID NO: 38647 - protein, 25 aa, synthetic construct
  source 1..25: note = Seed: NSCVKLQTVHSIPLTINKEEALQRP
NSCVKLQTVHSIPFTIMKIEADQRP

SEQ ID NO: 38648 - protein, 25 aa, synthetic construct
  source 1..25: note = Seed: NSCVKLQTVHSIPLTINKEEALQRP
NSCVKLQTVHSIPFTIMKIEAEQRP

SEQ ID NO: 38649 - protein, 25 aa, synthetic construct
  source 1..25: note = Seed: NSCVKLQTVHSIPLTINKEEALQRP
NSCVKLQTVHSIPFTIMKIEAFQRP

SEQ ID NO: 38650 - protein, 25 aa, synthetic construct
  source 1..25: note = Seed: NSCVKLQTVHSIPLTINKEEALQRP
NSCVKLQTVHSIPFTIMKIEAIQRP

SEQ ID NO: 38651 - protein, 25 aa, synthetic construct
  source 1..25: note = Seed: NSCVKLQTVHSIPLTINKEEALQRP
NSCVKLQTVHSIPFTIMKIEALQRP

SEQ ID NO: 38652 - protein, 25 aa, synthetic construct
  source 1..25: note = Seed: NSCVKLQTVHSIPLTINKEEALQRP
NSCVKLQTVHSIPFTIMKIEAMQRP

SEQ ID NO: 38653 - protein, 25 aa, synthetic construct
  source 1..25: note = Seed: NSCVKLQTVHSIPLTINKEEALQRP
NSCVKLQTVHSIPFTIMKIEASQRP

SEQ ID NO: 38654 - protein, 25 aa, synthetic construct
  source 1..25: note = Seed: NSCVKLQTVHSIPLTINKEEALQRP
NSCVKLQTVHSIPFTIMKIEATQRP

SEQ ID NO: 38655 - protein, 25 aa, synthetic construct
  source 1..25: note = Seed: NSCVKLQTVHSIPLTINKEEALQRP
NSCVKLQTVHSIPFTIMKIEAVQRP

SEQ ID NO: 38656 - protein, 25 aa, synthetic construct
  source 1..25: note = Seed: NSCVKLQTVHSIPLTINKEEALQRP
NSCVKLQTVHSIPFTIMKIEAYQRP

SEQ ID NO: 38657 - protein, 25 aa, synthetic construct
  source 1..25: note = Seed: NSCVKLQTVHSIPLTINKEEALQRP
NSCVKLQTVHSIPFTIMKKEALQRP

SEQ ID NO: 38658 - protein, 25 aa, synthetic construct
  source 1..25: note = Seed: NSCVKLQTVHSIPLTINKEEALQRP
NSCVKLQTVHSIPFTIMKLEADQRP

SEQ ID NO: 38659 - protein, 25 aa, synthetic construct
  source 1..25: note = Seed: NSCVKLQTVHSIPLTINKEEALQRP
NSCVKLQTVHSIPFTIMKLEAEQRP

SEQ ID NO: 38660 - protein, 25 aa, synthetic construct
  source 1..25: note = Seed: NSCVKLQTVHSIPLTINKEEALQRP
NSCVKLQTVHSIPFTIMKLEAFQRP

SEQ ID NO: 38661 - protein, 25 aa, synthetic construct
  source 1..25: note = Seed: NSCVKLQTVHSIPLTINKEEALQRP
NSCVKLQTVHSIPFTIMKLEAIQRP

SEQ ID NO: 38662 - protein, 25 aa, synthetic construct
  source 1..25: note = Seed: NSCVKLQTVHSIPLTINKEEALQRP
NSCVKLQTVHSIPFTIMKLEALQRP

SEQ ID NO: 38663 - protein, 25 aa, synthetic construct
  source 1..25: note = Seed: NSCVKLQTVHSIPLTINKEEALQRP
NSCVKLQTVHSIPFTIMKLEAMQRP

SEQ ID NO: 38664 - protein, 25 aa, synthetic construct
  source 1..25: note = Seed: NSCVKLQTVHSIPLTINKEEALQRP
NSCVKLQTVHSIPFTIMKLEAVQRP

SEQ ID NO: 38665 - protein, 25 aa, synthetic construct
  source 1..25: note = Seed: NSCVKLQTVHSIPLTINKEEALQRP
NSCVKLQTVHSIPFTIMKLEAYQRP

SEQ ID NO: 38666 - protein, 25 aa, synthetic construct
  source 1..25: note = Seed: NSCVKLQTVHSIPLTINKEEALQRP
NSCVKLQTVHSIPFTIMKMEAAQRP

SEQ ID NO: 38667 - protein, 25 aa, synthetic construct
  source 1..25: note = Seed: NSCVKLQTVHSIPLTINKEEALQRP
NSCVKLQTVHSIPFTIMKMEADQRP

SEQ ID NO: 38668 - protein, 25 aa, synthetic construct
  source 1..25: note = Seed: NSCVKLQTVHSIPLTINKEEALQRP
NSCVKLQTVHSIPFTIMKMEAFQRP

SEQ ID NO: 38669 - protein, 25 aa, synthetic construct
  source 1..25: note = Seed: NSCVKLQTVHSIPLTINKEEALQRP
NSCVKLQTVHSIPFTIMKMEAIQRP

SEQ ID NO: 38670 - protein, 25 aa, synthetic construct
  source 1..25: note = Seed: NSCVKLQTVHSIPLTINKEEALQRP
NSCVKLQTVHSIPFTIMKMEALQRP

SEQ ID NO: 38671 - protein, 25 aa, synthetic construct
  source 1..25: note = Seed: NSCVKLQTVHSIPLTINKEEALQRP
NSCVKLQTVHSIPFTIMKMEAVQRP

SEQ ID NO: 38672 - protein, 25 aa, synthetic construct
  source 1..25: note = Seed: NSCVKLQTVHSIPLTINKEEALQRP
NSCVKLQTVHSIPFTIMKNEAAQRP

SEQ ID NO: 38673 - protein, 25 aa, synthetic construct
  source 1..25: note = Seed: NSCVKLQTVHSIPLTINKEEALQRP
NSCVKLQTVHSIPFTIMKNEADQRP

SEQ ID NO: 38674 - protein, 25 aa, synthetic construct
  source 1..25: note = Seed: NSCVKLQTVHSIPLTINKEEALQRP
NSCVKLQTVHSIPFTIMKNEAEQRP

SEQ ID NO: 38675 - protein, 25 aa, synthetic construct
  source 1..25: note = Seed: NSCVKLQTVHSIPLTINKEEALQRP
NSCVKLQTVHSIPFTIMKNEAGQRP

SEQ ID NO: 38676 - protein, 25 aa, synthetic construct
  source 1..25: note = Seed: NSCVKLQTVHSIPLTINKEEALQRP
NSCVKLQTVHSIPFTIMKNEAHQRP

SEQ ID NO: 38677 - protein, 25 aa, synthetic construct
  source 1..25: note = Seed: NSCVKLQTVHSIPLTINKEEALQRP
NSCVKLQTVHSIPFTIMKNEAIQRP

SEQ ID NO: 38678 - protein, 25 aa, synthetic construct
  source 1..25: note = Seed: NSCVKLQTVHSIPLTINKEEALQRP
NSCVKLQTVHSIPFTIMKNEALQRP

SEQ ID NO: 38679 - protein, 25 aa, synthetic construct
  source 1..25: note = Seed: NSCVKLQTVHSIPLTINKEEALQRP
NSCVKLQTVHSIPFTIMKNEAMQRP

SEQ ID NO: 38680 - protein, 25 aa, synthetic construct
  source 1..25: note = Seed: NSCVKLQTVHSIPLTINKEEALQRP
NSCVKLQTVHSIPFTIMKNEANQRP

SEQ ID NO: 38681 - protein, 25 aa, synthetic construct
  source 1..25: note = Seed: NSCVKLQTVHSIPLTINKEEALQRP
NSCVKLQTVHSIPFTIMKNEAQQRP

SEQ ID NO: 38682 - protein, 25 aa, synthetic construct
  source 1..25: note = Seed: NSCVKLQTVHSIPLTINKEEALQRP
NSCVKLQTVHSIPFTIMKNEASQRP

SEQ ID NO: 38683 - protein, 25 aa, synthetic construct
  source 1..25: note = Seed: NSCVKLQTVHSIPLTINKEEALQRP
NSCVKLQTVHSIPFTIMKNEATQRP

SEQ ID NO: 38684 - protein, 25 aa, synthetic construct
  source 1..25: note = Seed: NSCVKLQTVHSIPLTINKEEALQRP
NSCVKLQTVHSIPFTIMKNEAVQRP

SEQ ID NO: 38685 - protein, 25 aa, synthetic construct
  source 1..25: note = Seed: NSCVKLQTVHSIPLTINKEEALQRP
NSCVKLQTVHSIPFTIMKPEAAQRP

SEQ ID NO: 38686 - protein, 25 aa, synthetic construct
  source 1..25: note = Seed: NSCVKLQTVHSIPLTINKEEALQRP
NSCVKLQTVHSIPFTIMKREAFQRP

SEQ ID NO: 38687 - protein, 25 aa, synthetic construct
  source 1..25: note = Seed: NSCVKLQTVHSIPLTINKEEALQRP
NSCVKLQTVHSIPFTIMKREAIQRP

SEQ ID NO: 38688 - protein, 25 aa, synthetic construct
  source 1..25: note = Seed: NSCVKLQTVHSIPLTINKEEALQRP
NSCVKLQTVHSIPFTIMKREALQRP

SEQ ID NO: 38689 - protein, 25 aa, synthetic construct
  source 1..25: note = Seed: NSCVKLQTVHSIPLTINKEEALQRP
NSCVKLQTVHSIPFTIMKREARQRP

SEQ ID NO: 38690 - protein, 25 aa, synthetic construct
  source 1..25: note = Seed: NSCVKLQTVHSIPLTINKEEALQRP
NSCVKLQTVHSIPFTIMKREAVQRP

SEQ ID NO: 38691 - protein, 25 aa, synthetic construct
  source 1..25: note = Seed: NSCVKLQTVHSIPLTINKEEALQRP
NSCVKLQTVHSIPFTIMKREAYQRP

SEQ ID NO: 38692 - protein, 25 aa, synthetic construct
  source 1..25: note = Seed: NSCVKLQTVHSIPLTINKEEALQRP
NSCVKLQTVHSIPFTIMKSEADQRP

SEQ ID NO: 38693 - protein, 25 aa, synthetic construct
  source 1..25: note = Seed: NSCVKLQTVHSIPLTINKEEALQRP
NSCVKLQTVHSIPFTIMKSEAEQRP

SEQ ID NO: 38694 - protein, 25 aa, synthetic construct
  source 1..25: note = Seed: NSCVKLQTVHSIPLTINKEEALQRP
NSCVKLQTVHSIPFTIMKSEAGQRP

SEQ ID NO: 38695 - protein, 25 aa, synthetic construct
  source 1..25: note = Seed: NSCVKLQTVHSIPLTINKEEALQRP
NSCVKLQTVHSIPFTIMKSEAHQRP

SEQ ID NO: 38696 - protein, 25 aa, synthetic construct
  source 1..25: note = Seed: NSCVKLQTVHSIPLTINKEEALQRP
NSCVKLQTVHSIPFTIMKSEAIQRP

SEQ ID NO: 38697 - protein, 25 aa, synthetic construct
  source 1..25: note = Seed: NSCVKLQTVHSIPLTINKEEALQRP
NSCVKLQTVHSIPFTIMKSEALQRP

SEQ ID NO: 38698 - protein, 25 aa, synthetic construct
  source 1..25: note = Seed: NSCVKLQTVHSIPLTINKEEALQRP
NSCVKLQTVHSIPFTIMKSEAMQRP

SEQ ID NO: 38699 - protein, 25 aa, synthetic construct
  source 1..25: note = Seed: NSCVKLQTVHSIPLTINKEEALQRP
NSCVKLQTVHSIPFTIMKSEANQRP

SEQ ID NO: 38700 - protein, 25 aa, synthetic construct
  source 1..25: note = Seed: NSCVKLQTVHSIPLTINKEEALQRP
NSCVKLQTVHSIPFTIMKSEAQQRP

SEQ ID NO: 38701 - protein, 25 aa, synthetic construct
  source 1..25: note = Seed: NSCVKLQTVHSIPLTINKEEALQRP
NSCVKLQTVHSIPFTIMKSEASQRP

SEQ ID NO: 38702 - protein, 25 aa, synthetic construct
  source 1..25: note = Seed: NSCVKLQTVHSIPLTINKEEALQRP
NSCVKLQTVHSIPFTIMKSEATQRP

SEQ ID NO: 38703 - protein, 25 aa, synthetic construct
  source 1..25: note = Seed: NSCVKLQTVHSIPLTINKEEALQRP
NSCVKLQTVHSIPFTIMKTEAAQRP

SEQ ID NO: 38704 - protein, 25 aa, synthetic construct
  source 1..25: note = Seed: NSCVKLQTVHSIPLTINKEEALQRP
NSCVKLQTVHSIPFTIMKTEADQRP

SEQ ID NO: 38705 - protein, 25 aa, synthetic construct
  source 1..25: note = Seed: NSCVKLQTVHSIPLTINKEEALQRP
NSCVKLQTVHSIPFTIMKTEAEQRP

SEQ ID NO: 38706 - protein, 25 aa, synthetic construct
  source 1..25: note = Seed: NSCVKLQTVHSIPLTINKEEALQRP
NSCVKLQTVHSIPFTIMKTEAGQRP

SEQ ID NO: 38707 - protein, 25 aa, synthetic construct
  source 1..25: note = Seed: NSCVKLQTVHSIPLTINKEEALQRP
NSCVKLQTVHSIPFTIMKTEAHQRP

SEQ ID NO: 38708 - protein, 25 aa, synthetic construct
  source 1..25: note = Seed: NSCVKLQTVHSIPLTINKEEALQRP
NSCVKLQTVHSIPFTIMKTEAIQRP

SEQ ID NO: 38709 - protein, 25 aa, synthetic construct
  source 1..25: note = Seed: NSCVKLQTVHSIPLTINKEEALQRP
NSCVKLQTVHSIPFTIMKTEALQRP

SEQ ID NO: 38710 - protein, 25 aa, synthetic construct
  source 1..25: note = Seed: NSCVKLQTVHSIPLTINKEEALQRP
NSCVKLQTVHSIPFTIMKTEAMQRP

SEQ ID NO: 38711 - protein, 25 aa, synthetic construct
  source 1..25: note = Seed: NSCVKLQTVHSIPLTINKEEALQRP
NSCVKLQTVHSIPFTIMKTEANQRP

SEQ ID NO: 38712 - protein, 25 aa, synthetic construct
  source 1..25: note = Seed: NSCVKLQTVHSIPLTINKEEALQRP
NSCVKLQTVHSIPFTIMKTEAQQRP

SEQ ID NO: 38713 - protein, 25 aa, synthetic construct
  source 1..25: note = Seed: NSCVKLQTVHSIPLTINKEEALQRP
NSCVKLQTVHSIPFTIMKTEASQRP

SEQ ID NO: 38714 - protein, 25 aa, synthetic construct
  source 1..25: note = Seed: NSCVKLQTVHSIPLTINKEEALQRP
NSCVKLQTVHSIPFTIMKTEATQRP

SEQ ID NO: 38715 - protein, 25 aa, synthetic construct
  source 1..25: note = Seed: NSCVKLQTVHSIPLTINKEEALQRP
NSCVKLQTVHSIPFTIMKTEAVQRP

SEQ ID NO: 38716 - protein, 25 aa, synthetic construct
  source 1..25: note = Seed: NSCVKLQTVHSIPLTINKEEALQRP
NSCVKLQTVHSIPFTIMKVEAAQRP

SEQ ID NO: 38717 - protein, 25 aa, synthetic construct
  source 1..25: note = Seed: NSCVKLQTVHSIPLTINKEEALQRP
NSCVKLQTVHSIPFTIMKVEADQRP

SEQ ID NO: 38718 - protein, 25 aa, synthetic construct
  source 1..25: note = Seed: NSCVKLQTVHSIPLTINKEEALQRP
NSCVKLQTVHSIPFTIMKVEAEQRP

SEQ ID NO: 38719 - protein, 25 aa, synthetic construct
  source 1..25: note = Seed: NSCVKLQTVHSIPLTINKEEALQRP
NSCVKLQTVHSIPFTIMKVEAFQRP

SEQ ID NO: 38720 - protein, 25 aa, synthetic construct
  source 1..25: note = Seed: NSCVKLQTVHSIPLTINKEEALQRP
NSCVKLQTVHSIPFTIMKVEAIQRP

SEQ ID NO: 38721 - protein, 25 aa, synthetic construct
  source 1..25: note = Seed: NSCVKLQTVHSIPLTINKEEALQRP
NSCVKLQTVHSIPFTIMKVEALQRP

SEQ ID NO: 38722 - protein, 25 aa, synthetic construct
  source 1..25: note = Seed: NSCVKLQTVHSIPLTINKEEALQRP
NSCVKLQTVHSIPFTIMKVEAMQRP

SEQ ID NO: 38723 - protein, 25 aa, synthetic construct
  source 1..25: note = Seed: NSCVKLQTVHSIPLTINKEEALQRP
NSCVKLQTVHSIPFTIMKVEASQRP

SEQ ID NO: 38724 - protein, 25 aa, synthetic construct
  source 1..25: note = Seed: NSCVKLQTVHSIPLTINKEEALQRP
NSCVKLQTVHSIPFTIMKVEAVQRP

SEQ ID NO: 38725 - protein, 25 aa, synthetic construct
  source 1..25: note = Seed: NSCVKLQTVHSIPLTINKEEALQRP
NSCVKLQTVHSIPFTIMKVEAYQRP

SEQ ID NO: 38726 - protein, 25 aa, synthetic construct
  source 1..25: note = Seed: NSCVKLQTVHSIPLTINKEEALQRP
NSCVKLQTVHSIPFTIMKWEAAQRP

SEQ ID NO: 38727 - protein, 25 aa, synthetic construct
  source 1..25: note = Seed: NSCVKLQTVHSIPLTINKEEALQRP
NSCVKLQTVHSIPFTIMKWEADQRP

SEQ ID NO: 38728 - protein, 25 aa, synthetic construct
  source 1..25: note = Seed: NSCVKLQTVHSIPLTINKEEALQRP
NSCVKLQTVHSIPFTIMKWEAIQRP

SEQ ID NO: 38729 - protein, 25 aa, synthetic construct
  source 1..25: note = Seed: NSCVKLQTVHSIPLTINKEEALQRP
NSCVKLQTVHSIPFTIMKWEALQRP

SEQ ID NO: 38730 - protein, 25 aa, synthetic construct
  source 1..25: note = Seed: NSCVKLQTVHSIPLTINKEEALQRP
NSCVKLQTVHSIPFTIMKWEAMQRP

SEQ ID NO: 38731 - protein, 25 aa, synthetic construct
  source 1..25: note = Seed: NSCVKLQTVHSIPLTINKEEALQRP
NSCVKLQTVHSIPFTIMKWEANQRP

SEQ ID NO: 38732 - protein, 25 aa, synthetic construct
  source 1..25: note = Seed: NSCVKLQTVHSIPLTINKEEALQRP
NSCVKLQTVHSIPFTIMKWEASQRP

SEQ ID NO: 38733 - protein, 25 aa, synthetic construct
  source 1..25: note = Seed: NSCVKLQTVHSIPLTINKEEALQRP
NSCVKLQTVHSIPFTIMKWEATQRP

SEQ ID NO: 38734 - protein, 25 aa, synthetic construct
  source 1..25: note = Seed: NSCVKLQTVHSIPLTINKEEALQRP
NSCVKLQTVHSIPFTIMKWEAVQRP

SEQ ID NO: 38735 - protein, 25 aa, synthetic construct
  source 1..25: note = Seed: NSCVKLQTVHSIPLTINKEEALQRP
NSCVKLQTVHSIPFTIMKYEAAQRP

SEQ ID NO: 38736 - protein, 25 aa, synthetic construct
  source 1..25: note = Seed: NSCVKLQTVHSIPLTINKEEALQRP
NSCVKLQTVHSIPFTIMKYEACQRP

SEQ ID NO: 38737 - protein, 25 aa, synthetic construct
  source 1..25: note = Seed: NSCVKLQTVHSIPLTINKEEALQRP
NSCVKLQTVHSIPFTIMKYEADQRP

SEQ ID NO: 38738 - protein, 25 aa, synthetic construct
  source 1..25: note = Seed: NSCVKLQTVHSIPLTINKEEALQRP
NSCVKLQTVHSIPFTIMKYEAEQRP

SEQ ID NO: 38739 - protein, 25 aa, synthetic construct
  source 1..25: note = Seed: NSCVKLQTVHSIPLTINKEEALQRP
NSCVKLQTVHSIPFTIMKYEAFQRP

SEQ ID NO: 38740 - protein, 25 aa, synthetic construct
  source 1..25: note = Seed: NSCVKLQTVHSIPLTINKEEALQRP
NSCVKLQTVHSIPFTIMKYEAIQRP

SEQ ID NO: 38741 - protein, 25 aa, synthetic construct
  source 1..25: note = Seed: NSCVKLQTVHSIPLTINKEEALQRP
NSCVKLQTVHSIPFTIMKYEALQRP

SEQ ID NO: 38742 - protein, 25 aa, synthetic construct
  source 1..25: note = Seed: NSCVKLQTVHSIPLTINKEEALQRP
NSCVKLQTVHSIPFTIMKYEAMQRP

SEQ ID NO: 38743 - protein, 25 aa, synthetic construct
  source 1..25: note = Seed: NSCVKLQTVHSIPLTINKEEALQRP
NSCVKLQTVHSIPFTIMKYEANQRP

SEQ ID NO: 38744 - protein, 25 aa, synthetic construct
  source 1..25: note = Seed: NSCVKLQTVHSIPLTINKEEALQRP
NSCVKLQTVHSIPFTIMKYEASQRP

SEQ ID NO: 38745 - protein, 25 aa, synthetic construct
  source 1..25: note = Seed: NSCVKLQTVHSIPLTINKEEALQRP
NSCVKLQTVHSIPFTIMKYEATQRP

SEQ ID NO: 38746 - protein, 25 aa, synthetic construct
  source 1..25: note = Seed: NSCVKLQTVHSIPLTINKEEALQRP
NSCVKLQTVHSIPFTIMKYEAVQRP

SEQ ID NO: 38747 - protein, 25 aa, synthetic construct
  source 1..25: note = Seed: NSCVKLQTVHSIPLTINKEEALQRP
NSCVKLQTVHSIPFTIMKYEAYQRP

SEQ ID NO: 38748 - protein, 25 aa, synthetic construct
  source 1..25: note = Seed: NSCVKLQTVHSIPLTINKEEALQRP
NSCVKLQTVHSIPFTINKAEAAQRP

SEQ ID NO: 38749 - protein, 25 aa, synthetic construct
  source 1..25: note = Seed: NSCVKLQTVHSIPLTINKEEALQRP
NSCVKLQTVHSIPFTINKAEAFQRP

SEQ ID NO: 38750 - protein, 25 aa, synthetic construct
  source 1..25: note = Seed: NSCVKLQTVHSIPLTINKEEALQRP
NSCVKLQTVHSIPFTINKAEAIQRP

SEQ ID NO: 38751 - protein, 25 aa, synthetic construct
  source 1..25: note = Seed: NSCVKLQTVHSIPLTINKEEALQRP
NSCVKLQTVHSIPFTINKAEALQRP

SEQ ID NO: 38752 - protein, 25 aa, synthetic construct
  source 1..25: note = Seed: NSCVKLQTVHSIPLTINKEEALQRP
NSCVKLQTVHSIPFTINKAEAMQRP

SEQ ID NO: 38753 - protein, 25 aa, synthetic construct
  source 1..25: note = Seed: NSCVKLQTVHSIPLTINKEEALQRP
NSCVKLQTVHSIPFTINKAEASQRP

SEQ ID NO: 38754 - protein, 25 aa, synthetic construct
  source 1..25: note = Seed: NSCVKLQTVHSIPLTINKEEALQRP
NSCVKLQTVHSIPFTINKAEATQRP

SEQ ID NO: 38755 - protein, 25 aa, synthetic construct
  source 1..25: note = Seed: NSCVKLQTVHSIPLTINKEEALQRP
NSCVKLQTVHSIPFTINKAEAVQRP

SEQ ID NO: 38756 - protein, 25 aa, synthetic construct
  source 1..25: note = Seed: NSCVKLQTVHSIPLTINKEEALQRP
NSCVKLQTVHSIPFTINKAEAWQRP

SEQ ID NO: 38757 - protein, 25 aa, synthetic construct
  source 1..25: note = Seed: NSCVKLQTVHSIPLTINKEEALQRP
NSCVKLQTVHSIPFTINKAEAYQRP

SEQ ID NO: 38758 - protein, 25 aa, synthetic construct
  source 1..25: note = Seed: NSCVKLQTVHSIPLTINKEEALQRP
NSCVKLQTVHSIPFTINKCEAIQRP

SEQ ID NO: 38759 - protein, 25 aa, synthetic construct
  source 1..25: note = Seed: NSCVKLQTVHSIPLTINKEEALQRP
NSCVKLQTVHSIPFTINKFEAAQRP

SEQ ID NO: 38760 - protein, 25 aa, synthetic construct
  source 1..25: note = Seed: NSCVKLQTVHSIPLTINKEEALQRP
NSCVKLQTVHSIPFTINKFEACQRP

SEQ ID NO: 38761 - protein, 25 aa, synthetic construct
  source 1..25: note = Seed: NSCVKLQTVHSIPLTINKEEALQRP
NSCVKLQTVHSIPFTINKFEADQRP

SEQ ID NO: 38762 - protein, 25 aa, synthetic construct
  source 1..25: note = Seed: NSCVKLQTVHSIPLTINKEEALQRP
NSCVKLQTVHSIPFTINKFEAEQRP

SEQ ID NO: 38763 - protein, 25 aa, synthetic construct
  source 1..25: note = Seed: NSCVKLQTVHSIPLTINKEEALQRP
NSCVKLQTVHSIPFTINKFEAFQRP

SEQ ID NO: 38764 - protein, 25 aa, synthetic construct
  source 1..25: note = Seed: NSCVKLQTVHSIPLTINKEEALQRP
NSCVKLQTVHSIPFTINKFEAGQRP

SEQ ID NO: 38765 - protein, 25 aa, synthetic construct
  source 1..25: note = Seed: NSCVKLQTVHSIPLTINKEEALQRP
NSCVKLQTVHSIPFTINKFEAHQRP

SEQ ID NO: 38766 - protein, 25 aa, synthetic construct
  source 1..25: note = Seed: NSCVKLQTVHSIPLTINKEEALQRP
NSCVKLQTVHSIPFTINKFEAMQRP

SEQ ID NO: 38767 - protein, 25 aa, synthetic construct
  source 1..25: note = Seed: NSCVKLQTVHSIPLTINKEEALQRP
NSCVKLQTVHSIPFTINKFEANQRP

SEQ ID NO: 38768 - protein, 25 aa, synthetic construct
  source 1..25: note = Seed: NSCVKLQTVHSIPLTINKEEALQRP
NSCVKLQTVHSIPFTINKFEAPQRP

SEQ ID NO: 38769 - protein, 25 aa, synthetic construct
  source 1..25: note = Seed: NSCVKLQTVHSIPLTINKEEALQRP
NSCVKLQTVHSIPFTINKFEAQQRP

SEQ ID NO: 38770 - protein, 25 aa, synthetic construct
  source 1..25: note = Seed: NSCVKLQTVHSIPLTINKEEALQRP
NSCVKLQTVHSIPFTINKFEASQRP

SEQ ID NO: 38771 - protein, 25 aa, synthetic construct
  source 1..25: note = Seed: NSCVKLQTVHSIPLTINKEEALQRP
NSCVKLQTVHSIPFTINKFEATQRP

SEQ ID NO: 38772 - protein, 25 aa, synthetic construct
  source 1..25: note = Seed: NSCVKLQTVHSIPLTINKEEALQRP
NSCVKLQTVHSIPFTINKFEAVQRP

SEQ ID NO: 38773 - protein, 25 aa, synthetic construct
  source 1..25: note = Seed: NSCVKLQTVHSIPLTINKEEALQRP
NSCVKLQTVHSIPFTINKFEAWQRP

SEQ ID NO: 38774 - protein, 25 aa, synthetic construct
  source 1..25: note = Seed: NSCVKLQTVHSIPLTINKEEALQRP
NSCVKLQTVHSIPFTINKFEAYQRP

SEQ ID NO: 38775 - protein, 25 aa, synthetic construct
  source 1..25: note = Seed: NSCVKLQTVHSIPLTINKEEALQRP
NSCVKLQTVHSIPFTINKGEAAQRP

SEQ ID NO: 38776 - protein, 25 aa, synthetic construct
  source 1..25: note = Seed: NSCVKLQTVHSIPLTINKEEALQRP
NSCVKLQTVHSIPFTINKGEAFQRP

SEQ ID NO: 38777 - protein, 25 aa, synthetic construct
  source 1..25: note = Seed: NSCVKLQTVHSIPLTINKEEALQRP
NSCVKLQTVHSIPFTINKGEAIQRP

SEQ ID NO: 38778 - protein, 25 aa, synthetic construct
  source 1..25: note = Seed: NSCVKLQTVHSIPLTINKEEALQRP
NSCVKLQTVHSIPFTINKGEALQRP

SEQ ID NO: 38779 - protein, 25 aa, synthetic construct
  source 1..25: note = Seed: NSCVKLQTVHSIPLTINKEEALQRP
NSCVKLQTVHSIPFTINKGEAMQRP

SEQ ID NO: 38780 - protein, 25 aa, synthetic construct
  source 1..25: note = Seed: NSCVKLQTVHSIPLTINKEEALQRP
NSCVKLQTVHSIPFTINKGEAVQRP

SEQ ID NO: 38781 - protein, 25 aa, synthetic construct
  source 1..25: note = Seed: NSCVKLQTVHSIPLTINKEEALQRP
NSCVKLQTVHSIPFTINKGEAYQRP

SEQ ID NO: 38782 - protein, 25 aa, synthetic construct
  source 1..25: note = Seed: NSCVKLQTVHSIPLTINKEEALQRP
NSCVKLQTVHSIPFTINKHEAIQRP

SEQ ID NO: 38783 - protein, 25 aa, synthetic construct
  source 1..25: note = Seed: NSCVKLQTVHSIPLTINKEEALQRP
NSCVKLQTVHSIPFTINKHEALQRP

SEQ ID NO: 38784 - protein, 25 aa, synthetic construct
  source 1..25: note = Seed: NSCVKLQTVHSIPLTINKEEALQRP
NSCVKLQTVHSIPFTINKHEAVQRP

SEQ ID NO: 38785 - protein, 25 aa, synthetic construct
  source 1..25: note = Seed: NSCVKLQTVHSIPLTINKEEALQRP
NSCVKLQTVHSIPFTINKIEAAQRP

SEQ ID NO: 38786 - protein, 25 aa, synthetic construct
  source 1..25: note = Seed: NSCVKLQTVHSIPLTINKEEALQRP
NSCVKLQTVHSIPFTINKIEAFQRP

SEQ ID NO: 38787 - protein, 25 aa, synthetic construct
  source 1..25: note = Seed: NSCVKLQTVHSIPLTINKEEALQRP
NSCVKLQTVHSIPFTINKIEAIQRP

SEQ ID NO: 38788 - protein, 25 aa, synthetic construct
  source 1..25: note = Seed: NSCVKLQTVHSIPLTINKEEALQRP
NSCVKLQTVHSIPFTINKIEALQRP

SEQ ID NO: 38789 - protein, 25 aa, synthetic construct
  source 1..25: note = Seed: NSCVKLQTVHSIPLTINKEEALQRP
NSCVKLQTVHSIPFTINKIEAMQRP

SEQ ID NO: 38790 - protein, 25 aa, synthetic construct
  source 1..25: note = Seed: NSCVKLQTVHSIPLTINKEEALQRP
NSCVKLQTVHSIPFTINKIEAVQRP

SEQ ID NO: 38791 - protein, 25 aa, synthetic construct
  source 1..25: note = Seed: NSCVKLQTVHSIPLTINKEEALQRP
NSCVKLQTVHSIPFTINKIEAYQRP

SEQ ID NO: 38792 - protein, 25 aa, synthetic construct
  source 1..25: note = Seed: NSCVKLQTVHSIPLTINKEEALQRP
NSCVKLQTVHSIPFTINKLEAFQRP

SEQ ID NO: 38793 - protein, 25 aa, synthetic construct
  source 1..25: note = Seed: NSCVKLQTVHSIPLTINKEEALQRP
NSCVKLQTVHSIPFTINKLEAIQRP

SEQ ID NO: 38794 - protein, 25 aa, synthetic construct
  source 1..25: note = Seed: NSCVKLQTVHSIPLTINKEEALQRP
NSCVKLQTVHSIPFTINKLEALQRP

SEQ ID NO: 38795 - protein, 25 aa, synthetic construct
  source 1..25: note = Seed: NSCVKLQTVHSIPLTINKEEALQRP
NSCVKLQTVHSIPFTINKLEAMQRP

SEQ ID NO: 38796 - protein, 25 aa, synthetic construct
  source 1..25: note = Seed: NSCVKLQTVHSIPLTINKEEALQRP
NSCVKLQTVHSIPFTINKLEAVQRP

SEQ ID NO: 38797 - protein, 25 aa, synthetic construct
  source 1..25: note = Seed: NSCVKLQTVHSIPLTINKEEALQRP
NSCVKLQTVHSIPFTINKLEAYQRP

SEQ ID NO: 38798 - protein, 25 aa, synthetic construct
  source 1..25: note = Seed: NSCVKLQTVHSIPLTINKEEALQRP
NSCVKLQTVHSIPFTINKMEAFQRP

SEQ ID NO: 38799 - protein, 25 aa, synthetic construct
  source 1..25: note = Seed: NSCVKLQTVHSIPLTINKEEALQRP
NSCVKLQTVHSIPFTINKMEAIQRP

SEQ ID NO: 38800 - protein, 25 aa, synthetic construct
  source 1..25: note = Seed: NSCVKLQTVHSIPLTINKEEALQRP
NSCVKLQTVHSIPFTINKMEALQRP

SEQ ID NO: 38801 - protein, 25 aa, synthetic construct
  source 1..25: note = Seed: NSCVKLQTVHSIPLTINKEEALQRP
NSCVKLQTVHSIPFTINKMEAMQRP

SEQ ID NO: 38802 - protein, 25 aa, synthetic construct
  source 1..25: note = Seed: NSCVKLQTVHSIPLTINKEEALQRP
NSCVKLQTVHSIPFTINKMEAVQRP

SEQ ID NO: 38803 - protein, 25 aa, synthetic construct
  source 1..25: note = Seed: NSCVKLQTVHSIPLTINKEEALQRP
NSCVKLQTVHSIPFTINKMEAYQRP

SEQ ID NO: 38804 - protein, 25 aa, synthetic construct
  source 1..25: note = Seed: NSCVKLQTVHSIPLTINKEEALQRP
NSCVKLQTVHSIPFTINKNEAAQRP

SEQ ID NO: 38805 - protein, 25 aa, synthetic construct
  source 1..25: note = Seed: NSCVKLQTVHSIPLTINKEEALQRP
NSCVKLQTVHSIPFTINKNEAFQRP

SEQ ID NO: 38806 - protein, 25 aa, synthetic construct
  source 1..25: note = Seed: NSCVKLQTVHSIPLTINKEEALQRP
NSCVKLQTVHSIPFTINKNEAIQRP

SEQ ID NO: 38807 - protein, 25 aa, synthetic construct
  source 1..25: note = Seed: NSCVKLQTVHSIPLTINKEEALQRP
NSCVKLQTVHSIPFTINKNEALQRP

SEQ ID NO: 38808 - protein, 25 aa, synthetic construct
  source 1..25: note = Seed: NSCVKLQTVHSIPLTINKEEALQRP
NSCVKLQTVHSIPFTINKNEAMQRP

SEQ ID NO: 38809 - protein, 25 aa, synthetic construct
  source 1..25: note = Seed: NSCVKLQTVHSIPLTINKEEALQRP
NSCVKLQTVHSIPFTINKNEASQRP

SEQ ID NO: 38810 - protein, 25 aa, synthetic construct
  source 1..25: note = Seed: NSCVKLQTVHSIPLTINKEEALQRP
NSCVKLQTVHSIPFTINKNEATQRP

SEQ ID NO: 38811 - protein, 25 aa, synthetic construct
  source 1..25: note = Seed: NSCVKLQTVHSIPLTINKEEALQRP
NSCVKLQTVHSIPFTINKNEAVQRP

SEQ ID NO: 38812 - protein, 25 aa, synthetic construct
  source 1..25: note = Seed: NSCVKLQTVHSIPLTINKEEALQRP
NSCVKLQTVHSIPFTINKNEAWQRP

SEQ ID NO: 38813 - protein, 25 aa, synthetic construct
  source 1..25: note = Seed: NSCVKLQTVHSIPLTINKEEALQRP
NSCVKLQTVHSIPFTINKNEAYQRP

SEQ ID NO: 38814 - protein, 25 aa, synthetic construct
  source 1..25: note = Seed: NSCVKLQTVHSIPLTINKEEALQRP
NSCVKLQTVHSIPFTINKPEAFQRP

SEQ ID NO: 38815 - protein, 25 aa, synthetic construct
  source 1..25: note = Seed: NSCVKLQTVHSIPLTINKEEALQRP
NSCVKLQTVHSIPFTINKPEAIQRP

SEQ ID NO: 38816 - protein, 25 aa, synthetic construct
  source 1..25: note = Seed: NSCVKLQTVHSIPLTINKEEALQRP
NSCVKLQTVHSIPFTINKPEALQRP

SEQ ID NO: 38817 - protein, 25 aa, synthetic construct
  source 1..25: note = Seed: NSCVKLQTVHSIPLTINKEEALQRP
NSCVKLQTVHSIPFTINKPEAMQRP

SEQ ID NO: 38818 - protein, 25 aa, synthetic construct
  source 1..25: note = Seed: NSCVKLQTVHSIPLTINKEEALQRP
NSCVKLQTVHSIPFTINKPEAVQRP

SEQ ID NO: 38819 - protein, 25 aa, synthetic construct
  source 1..25: note = Seed: NSCVKLQTVHSIPLTINKEEALQRP
NSCVKLQTVHSIPFTINKPEAYQRP

SEQ ID NO: 38820 - protein, 25 aa, synthetic construct
  source 1..25: note = Seed: NSCVKLQTVHSIPLTINKEEALQRP
NSCVKLQTVHSIPFTINKQEAIQRP

SEQ ID NO: 38821 - protein, 25 aa, synthetic construct
  source 1..25: note = Seed: NSCVKLQTVHSIPLTINKEEALQRP
NSCVKLQTVHSIPFTINKQEAVQRP

SEQ ID NO: 38822 - protein, 25 aa, synthetic construct
  source 1..25: note = Seed: NSCVKLQTVHSIPLTINKEEALQRP
NSCVKLQTVHSIPFTINKSEAAQRP

SEQ ID NO: 38823 - protein, 25 aa, synthetic construct
  source 1..25: note = Seed: NSCVKLQTVHSIPLTINKEEALQRP
NSCVKLQTVHSIPFTINKSEAFQRP

SEQ ID NO: 38824 - protein, 25 aa, synthetic construct
  source 1..25: note = Seed: NSCVKLQTVHSIPLTINKEEALQRP
NSCVKLQTVHSIPFTINKSEAIQRP

SEQ ID NO: 38825 - protein, 25 aa, synthetic construct
  source 1..25: note = Seed: NSCVKLQTVHSIPLTINKEEALQRP
NSCVKLQTVHSIPFTINKSEALQRP

SEQ ID NO: 38826 - protein, 25 aa, synthetic construct
  source 1..25: note = Seed: NSCVKLQTVHSIPLTINKEEALQRP
NSCVKLQTVHSIPFTINKSEAMQRP

SEQ ID NO: 38827 - protein, 25 aa, synthetic construct
  source 1..25: note = Seed: NSCVKLQTVHSIPLTINKEEALQRP
NSCVKLQTVHSIPFTINKSEASQRP

SEQ ID NO: 38828 - protein, 25 aa, synthetic construct
  source 1..25: note = Seed: NSCVKLQTVHSIPLTINKEEALQRP
NSCVKLQTVHSIPFTINKSEATQRP

SEQ ID NO: 38829 - protein, 25 aa, synthetic construct
  source 1..25: note = Seed: NSCVKLQTVHSIPLTINKEEALQRP
NSCVKLQTVHSIPFTINKSEAVQRP

SEQ ID NO: 38830 - protein, 25 aa, synthetic construct
  source 1..25: note = Seed: NSCVKLQTVHSIPLTINKEEALQRP
NSCVKLQTVHSIPFTINKSEAWQRP

SEQ ID NO: 38831 - protein, 25 aa, synthetic construct
  source 1..25: note = Seed: NSCVKLQTVHSIPLTINKEEALQRP
NSCVKLQTVHSIPFTINKSEAYQRP

SEQ ID NO: 38832 - protein, 25 aa, synthetic construct
  source 1..25: note = Seed: NSCVKLQTVHSIPLTINKEEALQRP
NSCVKLQTVHSIPFTINKTEAAQRP

SEQ ID NO: 38833 - protein, 25 aa, synthetic construct
  source 1..25: note = Seed: NSCVKLQTVHSIPLTINKEEALQRP
NSCVKLQTVHSIPFTINKTEAFQRP

SEQ ID NO: 38834 - protein, 25 aa, synthetic construct
  source 1..25: note = Seed: NSCVKLQTVHSIPLTINKEEALQRP
NSCVKLQTVHSIPFTINKTEAIQRP

SEQ ID NO: 38835 - protein, 25 aa, synthetic construct
  source 1..25: note = Seed: NSCVKLQTVHSIPLTINKEEALQRP
NSCVKLQTVHSIPFTINKTEALQRP

SEQ ID NO: 38836 - protein, 25 aa, synthetic construct
  source 1..25: note = Seed: NSCVKLQTVHSIPLTINKEEALQRP
NSCVKLQTVHSIPFTINKTEAMQRP

SEQ ID NO: 38837 - protein, 25 aa, synthetic construct
  source 1..25: note = Seed: NSCVKLQTVHSIPLTINKEEALQRP
NSCVKLQTVHSIPFTINKTEAVQRP

SEQ ID NO: 38838 - protein, 25 aa, synthetic construct
  source 1..25: note = Seed: NSCVKLQTVHSIPLTINKEEALQRP
NSCVKLQTVHSIPFTINKTEAYQRP

SEQ ID NO: 38839 - protein, 25 aa, synthetic construct
  source 1..25: note = Seed: NSCVKLQTVHSIPLTINKEEALQRP
NSCVKLQTVHSIPFTINKVEAAQRP

SEQ ID NO: 38840 - protein, 25 aa, synthetic construct
  source 1..25: note = Seed: NSCVKLQTVHSIPLTINKEEALQRP
NSCVKLQTVHSIPFTINKVEAFQRP

SEQ ID NO: 38841 - protein, 25 aa, synthetic construct
  source 1..25: note = Seed: NSCVKLQTVHSIPLTINKEEALQRP
NSCVKLQTVHSIPFTINKVEAIQRP

SEQ ID NO: 38842 - protein, 25 aa, synthetic construct
  source 1..25: note = Seed: NSCVKLQTVHSIPLTINKEEALQRP
NSCVKLQTVHSIPFTINKVEALQRP

SEQ ID NO: 38843 - protein, 25 aa, synthetic construct
  source 1..25: note = Seed: NSCVKLQTVHSIPLTINKEEALQRP
NSCVKLQTVHSIPFTINKVEAMQRP

SEQ ID NO: 38844 - protein, 25 aa, synthetic construct
  source 1..25: note = Seed: NSCVKLQTVHSIPLTINKEEALQRP
NSCVKLQTVHSIPFTINKVEAVQRP

SEQ ID NO: 38845 - protein, 25 aa, synthetic construct
  source 1..25: note = Seed: NSCVKLQTVHSIPLTINKEEALQRP
NSCVKLQTVHSIPFTINKVEAWQRP

SEQ ID NO: 38846 - protein, 25 aa, synthetic construct
  source 1..25: note = Seed: NSCVKLQTVHSIPLTINKEEALQRP
NSCVKLQTVHSIPFTINKVEAYQRP

SEQ ID NO: 38847 - protein, 25 aa, synthetic construct
  source 1..25: note = Seed: NSCVKLQTVHSIPLTINKEEALQRP
NSCVKLQTVHSIPFTINKWEAFQRP

SEQ ID NO: 38848 - protein, 25 aa, synthetic construct
  source 1..25: note = Seed: NSCVKLQTVHSIPLTINKEEALQRP
NSCVKLQTVHSIPFTINKWEAIQRP

SEQ ID NO: 38849 - protein, 25 aa, synthetic construct
  source 1..25: note = Seed: NSCVKLQTVHSIPLTINKEEALQRP
NSCVKLQTVHSIPFTINKWEALQRP

SEQ ID NO: 38850 - protein, 25 aa, synthetic construct
  source 1..25: note = Seed: NSCVKLQTVHSIPLTINKEEALQRP
NSCVKLQTVHSIPFTINKWEAMQRP

SEQ ID NO: 38851 - protein, 25 aa, synthetic construct
  source 1..25: note = Seed: NSCVKLQTVHSIPLTINKEEALQRP
NSCVKLQTVHSIPFTINKWEAVQRP

SEQ ID NO: 38852 - protein, 25 aa, synthetic construct
  source 1..25: note = Seed: NSCVKLQTVHSIPLTINKEEALQRP
NSCVKLQTVHSIPFTINKYEAFQRP

SEQ ID NO: 38853 - protein, 25 aa, synthetic construct
  source 1..25: note = Seed: NSCVKLQTVHSIPLTINKEEALQRP
NSCVKLQTVHSIPFTINKYEAIQRP

SEQ ID NO: 38854 - protein, 25 aa, synthetic construct
  source 1..25: note = Seed: NSCVKLQTVHSIPLTINKEEALQRP
NSCVKLQTVHSIPFTINKYEALQRP

SEQ ID NO: 38855 - protein, 25 aa, synthetic construct
  source 1..25: note = Seed: NSCVKLQTVHSIPLTINKEEALQRP
NSCVKLQTVHSIPFTINKYEAMQRP

SEQ ID NO: 38856 - protein, 25 aa, synthetic construct
  source 1..25: note = Seed: NSCVKLQTVHSIPLTINKEEALQRP
NSCVKLQTVHSIPFTINKYEAVQRP

SEQ ID NO: 38857 - protein, 25 aa, synthetic construct
  source 1..25: note = Seed: NSCVKLQTVHSIPLTINKEEALQRP
NSCVKLQTVHSIPFTIPKFEAFQRP

SEQ ID NO: 38858 - protein, 25 aa, synthetic construct
  source 1..25: note = Seed: NSCVKLQTVHSIPLTINKEEALQRP
NSCVKLQTVHSIPFTIPKFEAIQRP

SEQ ID NO: 38859 - protein, 25 aa, synthetic construct
  source 1..25: note = Seed: NSCVKLQTVHSIPLTINKEEALQRP
NSCVKLQTVHSIPFTIPKFEALQRP

SEQ ID NO: 38860 - protein, 25 aa, synthetic construct
  source 1..25: note = Seed: NSCVKLQTVHSIPLTINKEEALQRP
NSCVKLQTVHSIPFTIPKFEAMQRP

SEQ ID NO: 38861 - protein, 25 aa, synthetic construct
  source 1..25: note = Seed: NSCVKLQTVHSIPLTINKEEALQRP
NSCVKLQTVHSIPFTIPKFEAVQRP

SEQ ID NO: 38862 - protein, 25 aa, synthetic construct
  source 1..25: note = Seed: NSCVKLQTVHSIPLTINKEEALQRP
NSCVKLQTVHSIPFTIQKAEAIQRP

SEQ ID NO: 38863 - protein, 25 aa, synthetic construct
  source 1..25: note = Seed: NSCVKLQTVHSIPLTINKEEALQRP
NSCVKLQTVHSIPFTIQKAEAVQRP

SEQ ID NO: 38864 - protein, 25 aa, synthetic construct
  source 1..25: note = Seed: NSCVKLQTVHSIPLTINKEEALQRP
NSCVKLQTVHSIPFTIQKFEAAQRP

SEQ ID NO: 38865 - protein, 25 aa, synthetic construct
  source 1..25: note = Seed: NSCVKLQTVHSIPLTINKEEALQRP
NSCVKLQTVHSIPFTIQKFEACQRP

SEQ ID NO: 38866 - protein, 25 aa, synthetic construct
  source 1..25: note = Seed: NSCVKLQTVHSIPLTINKEEALQRP
NSCVKLQTVHSIPFTIQKFEADQRP

SEQ ID NO: 38867 - protein, 25 aa, synthetic construct
  source 1..25: note = Seed: NSCVKLQTVHSIPLTINKEEALQRP
NSCVKLQTVHSIPFTIQKFEAEQRP

SEQ ID NO: 38868 - protein, 25 aa, synthetic construct
  source 1..25: note = Seed: NSCVKLQTVHSIPLTINKEEALQRP
NSCVKLQTVHSIPFTIQKFEAFQRP

SEQ ID NO: 38869 - protein, 25 aa, synthetic construct
  source 1..25: note = Seed: NSCVKLQTVHSIPLTINKEEALQRP
NSCVKLQTVHSIPFTIQKFEAGQRP

SEQ ID NO: 38870 - protein, 25 aa, synthetic construct
  source 1..25: note = Seed: NSCVKLQTVHSIPLTINKEEALQRP
NSCVKLQTVHSIPFTIQKFEAHQRP

SEQ ID NO: 38871 - protein, 25 aa, synthetic construct
  source 1..25: note = Seed: NSCVKLQTVHSIPLTINKEEALQRP
NSCVKLQTVHSIPFTIQKFEAIQRP

SEQ ID NO: 38872 - protein, 25 aa, synthetic construct
  source 1..25: note = Seed: NSCVKLQTVHSIPLTINKEEALQRP
NSCVKLQTVHSIPFTIQKFEALQRP

SEQ ID NO: 38873 - protein, 25 aa, synthetic construct
  source 1..25: note = Seed: NSCVKLQTVHSIPLTINKEEALQRP
NSCVKLQTVHSIPFTIQKFEAMQRP

SEQ ID NO: 38874 - protein, 25 aa, synthetic construct
  source 1..25: note = Seed: NSCVKLQTVHSIPLTINKEEALQRP
NSCVKLQTVHSIPFTIQKFEANQRP

SEQ ID NO: 38875 - protein, 25 aa, synthetic construct
  source 1..25: note = Seed: NSCVKLQTVHSIPLTINKEEALQRP
NSCVKLQTVHSIPFTIQKFEAPQRP

SEQ ID NO: 38876 - protein, 25 aa, synthetic construct
  source 1..25: note = Seed: NSCVKLQTVHSIPLTINKEEALQRP
NSCVKLQTVHSIPFTIQKFEAQQRP

SEQ ID NO: 38877 - protein, 25 aa, synthetic construct
  source 1..25: note = Seed: NSCVKLQTVHSIPLTINKEEALQRP
NSCVKLQTVHSIPFTIQKFEARQRP

SEQ ID NO: 38878 - protein, 25 aa, synthetic construct
  source 1..25: note = Seed: NSCVKLQTVHSIPLTINKEEALQRP
NSCVKLQTVHSIPFTIQKFEASQRP

SEQ ID NO: 38879 - protein, 25 aa, synthetic construct
  source 1..25: note = Seed: NSCVKLQTVHSIPLTINKEEALQRP
NSCVKLQTVHSIPFTIQKFEATQRP

SEQ ID NO: 38880 - protein, 25 aa, synthetic construct
  source 1..25: note = Seed: NSCVKLQTVHSIPLTINKEEALQRP
NSCVKLQTVHSIPFTIQKFEAVQRP

SEQ ID NO: 38881 - protein, 25 aa, synthetic construct
  source 1..25: note = Seed: NSCVKLQTVHSIPLTINKEEALQRP
NSCVKLQTVHSIPFTIQKFEAWQRP

SEQ ID NO: 38882 - protein, 25 aa, synthetic construct
  source 1..25: note = Seed: NSCVKLQTVHSIPLTINKEEALQRP
NSCVKLQTVHSIPFTIQKFEAYQRP

SEQ ID NO: 38883 - protein, 25 aa, synthetic construct
  source 1..25: note = Seed: NSCVKLQTVHSIPLTINKEEALQRP
NSCVKLQTVHSIPFTIQKIEAFQRP

SEQ ID NO: 38884 - protein, 25 aa, synthetic construct
  source 1..25: note = Seed: NSCVKLQTVHSIPLTINKEEALQRP
NSCVKLQTVHSIPFTIQKIEAIQRP

SEQ ID NO: 38885 - protein, 25 aa, synthetic construct
  source 1..25: note = Seed: NSCVKLQTVHSIPLTINKEEALQRP
NSCVKLQTVHSIPFTIQKIEALQRP

SEQ ID NO: 38886 - protein, 25 aa, synthetic construct
  source 1..25: note = Seed: NSCVKLQTVHSIPLTINKEEALQRP
NSCVKLQTVHSIPFTIQKIEAMQRP

SEQ ID NO: 38887 - protein, 25 aa, synthetic construct
  source 1..25: note = Seed: NSCVKLQTVHSIPLTINKEEALQRP
NSCVKLQTVHSIPFTIQKIEAVQRP

SEQ ID NO: 38888 - protein, 25 aa, synthetic construct
  source 1..25: note = Seed: NSCVKLQTVHSIPLTINKEEALQRP
NSCVKLQTVHSIPFTIQKLEAFQRP

SEQ ID NO: 38889 - protein, 25 aa, synthetic construct
  source 1..25: note = Seed: NSCVKLQTVHSIPLTINKEEALQRP
NSCVKLQTVHSIPFTIQKLEAIQRP

SEQ ID NO: 38890 - protein, 25 aa, synthetic construct
  source 1..25: note = Seed: NSCVKLQTVHSIPLTINKEEALQRP
NSCVKLQTVHSIPFTIQKLEALQRP

SEQ ID NO: 38891 - protein, 25 aa, synthetic construct
  source 1..25: note = Seed: NSCVKLQTVHSIPLTINKEEALQRP
NSCVKLQTVHSIPFTIQKLEAMQRP

SEQ ID NO: 38892 - protein, 25 aa, synthetic construct
  source 1..25: note = Seed: NSCVKLQTVHSIPLTINKEEALQRP
NSCVKLQTVHSIPFTIQKLEAVQRP

SEQ ID NO: 38893 - protein, 25 aa, synthetic construct
  source 1..25: note = Seed: NSCVKLQTVHSIPLTINKEEALQRP
NSCVKLQTVHSIPFTIQKLEAYQRP

SEQ ID NO: 38894 - protein, 25 aa, synthetic construct
  source 1..25: note = Seed: NSCVKLQTVHSIPLTINKEEALQRP
NSCVKLQTVHSIPFTIQKMEAFQRP

SEQ ID NO: 38895 - protein, 25 aa, synthetic construct
  source 1..25: note = Seed: NSCVKLQTVHSIPLTINKEEALQRP
NSCVKLQTVHSIPFTIQKMEAIQRP

SEQ ID NO: 38896 - protein, 25 aa, synthetic construct
  source 1..25: note = Seed: NSCVKLQTVHSIPLTINKEEALQRP
NSCVKLQTVHSIPFTIQKMEALQRP

SEQ ID NO: 38897 - protein, 25 aa, synthetic construct
  source 1..25: note = Seed: NSCVKLQTVHSIPLTINKEEALQRP
NSCVKLQTVHSIPFTIQKMEAMQRP

SEQ ID NO: 38898 - protein, 25 aa, synthetic construct
  source 1..25: note = Seed: NSCVKLQTVHSIPLTINKEEALQRP
NSCVKLQTVHSIPFTIQKMEAVQRP

SEQ ID NO: 38899 - protein, 25 aa, synthetic construct
  source 1..25: note = Seed: NSCVKLQTVHSIPLTINKEEALQRP
NSCVKLQTVHSIPFTIQKNEAAQRP

SEQ ID NO: 38900 - protein, 25 aa, synthetic construct
  source 1..25: note = Seed: NSCVKLQTVHSIPLTINKEEALQRP
NSCVKLQTVHSIPFTIQKNEAGQRP

SEQ ID NO: 38901 - protein, 25 aa, synthetic construct
  source 1..25: note = Seed: NSCVKLQTVHSIPLTINKEEALQRP
NSCVKLQTVHSIPFTIQKNEASQRP

SEQ ID NO: 38902 - protein, 25 aa, synthetic construct
  source 1..25: note = Seed: NSCVKLQTVHSIPLTINKEEALQRP
NSCVKLQTVHSIPFTIQKNEATQRP

SEQ ID NO: 38903 - protein, 25 aa, synthetic construct
  source 1..25: note = Seed: NSCVKLQTVHSIPLTINKEEALQRP
NSCVKLQTVHSIPFTIQKSEAAQRP

SEQ ID NO: 38904 - protein, 25 aa, synthetic construct
  source 1..25: note = Seed: NSCVKLQTVHSIPLTINKEEALQRP
NSCVKLQTVHSIPFTIQKSEASQRP

SEQ ID NO: 38905 - protein, 25 aa, synthetic construct
  source 1..25: note = Seed: NSCVKLQTVHSIPLTINKEEALQRP
NSCVKLQTVHSIPFTIQKTEAAQRP

SEQ ID NO: 38906 - protein, 25 aa, synthetic construct
  source 1..25: note = Seed: NSCVKLQTVHSIPLTINKEEALQRP
NSCVKLQTVHSIPFTIQKTEASQRP

SEQ ID NO: 38907 - protein, 25 aa, synthetic construct
  source 1..25: note = Seed: NSCVKLQTVHSIPLTINKEEALQRP
NSCVKLQTVHSIPFTIQKTEATQRP

SEQ ID NO: 38908 - protein, 25 aa, synthetic construct
  source 1..25: note = Seed: NSCVKLQTVHSIPLTINKEEALQRP
NSCVKLQTVHSIPFTIQKVEAAQRP

SEQ ID NO: 38909 - protein, 25 aa, synthetic construct
  source 1..25: note = Seed: NSCVKLQTVHSIPLTINKEEALQRP
NSCVKLQTVHSIPFTIQKVEAIQRP

SEQ ID NO: 38910 - protein, 25 aa, synthetic construct
  source 1..25: note = Seed: NSCVKLQTVHSIPLTINKEEALQRP
NSCVKLQTVHSIPFTIQKVEALQRP

SEQ ID NO: 38911 - protein, 25 aa, synthetic construct
  source 1..25: note = Seed: NSCVKLQTVHSIPLTINKEEALQRP
NSCVKLQTVHSIPFTIQKWEAAQRP

SEQ ID NO: 38912 - protein, 25 aa, synthetic construct
  source 1..25: note = Seed: NSCVKLQTVHSIPLTINKEEALQRP
NSCVKLQTVHSIPFTIQKWEAFQRP

SEQ ID NO: 38913 - protein, 25 aa, synthetic construct
  source 1..25: note = Seed: NSCVKLQTVHSIPLTINKEEALQRP
NSCVKLQTVHSIPFTIQKWEAIQRP

SEQ ID NO: 38914 - protein, 25 aa, synthetic construct
  source 1..25: note = Seed: NSCVKLQTVHSIPLTINKEEALQRP
NSCVKLQTVHSIPFTIQKWEALQRP

SEQ ID NO: 38915 - protein, 25 aa, synthetic construct
  source 1..25: note = Seed: NSCVKLQTVHSIPLTINKEEALQRP
NSCVKLQTVHSIPFTIQKWEAMQRP

SEQ ID NO: 38916 - protein, 25 aa, synthetic construct
  source 1..25: note = Seed: NSCVKLQTVHSIPLTINKEEALQRP
NSCVKLQTVHSIPFTIQKWEAVQRP

SEQ ID NO: 38917 - protein, 25 aa, synthetic construct
  source 1..25: note = Seed: NSCVKLQTVHSIPLTINKEEALQRP
NSCVKLQTVHSIPFTIQKWEAYQRP

SEQ ID NO: 38918 - protein, 25 aa, synthetic construct
  source 1..25: note = Seed: NSCVKLQTVHSIPLTINKEEALQRP
NSCVKLQTVHSIPFTIQKYEAAQRP

SEQ ID NO: 38919 - protein, 25 aa, synthetic construct
  source 1..25: note = Seed: NSCVKLQTVHSIPLTINKEEALQRP
NSCVKLQTVHSIPFTIQKYEAFQRP

SEQ ID NO: 38920 - protein, 25 aa, synthetic construct
  source 1..25: note = Seed: NSCVKLQTVHSIPLTINKEEALQRP
NSCVKLQTVHSIPFTIQKYEAIQRP

SEQ ID NO: 38921 - protein, 25 aa, synthetic construct
  source 1..25: note = Seed: NSCVKLQTVHSIPLTINKEEALQRP
NSCVKLQTVHSIPFTIQKYEALQRP

SEQ ID NO: 38922 - protein, 25 aa, synthetic construct
  source 1..25: note = Seed: NSCVKLQTVHSIPLTINKEEALQRP
NSCVKLQTVHSIPFTIQKYEAMQRP

SEQ ID NO: 38923 - protein, 25 aa, synthetic construct
  source 1..25: note = Seed: NSCVKLQTVHSIPLTINKEEALQRP
NSCVKLQTVHSIPFTIQKYEATQRP

SEQ ID NO: 38924 - protein, 25 aa, synthetic construct
  source 1..25: note = Seed: NSCVKLQTVHSIPLTINKEEALQRP
NSCVKLQTVHSIPFTIQKYEAVQRP

SEQ ID NO: 38925 - protein, 25 aa, synthetic construct
  source 1..25: note = Seed: NSCVKLQTVHSIPLTINKEEALQRP
NSCVKLQTVHSIPFTIQKYEAYQRP

SEQ ID NO: 38926 - protein, 25 aa, synthetic construct
  source 1..25: note = Seed: NSCVKLQTVHSIPLTINKEEALQRP
NSCVKLQTVHSIPFTIRKFEAAQRP

SEQ ID NO: 38927 - protein, 25 aa, synthetic construct
  source 1..25: note = Seed: NSCVKLQTVHSIPLTINKEEALQRP
NSCVKLQTVHSIPFTIRKFEAFQRP

SEQ ID NO: 38928 - protein, 25 aa, synthetic construct
  source 1..25: note = Seed: NSCVKLQTVHSIPLTINKEEALQRP
NSCVKLQTVHSIPFTIRKFEAIQRP

SEQ ID NO: 38929 - protein, 25 aa, synthetic construct
  source 1..25: note = Seed: NSCVKLQTVHSIPLTINKEEALQRP
NSCVKLQTVHSIPFTIRKFEALQRP

SEQ ID NO: 38930 - protein, 25 aa, synthetic construct
  source 1..25: note = Seed: NSCVKLQTVHSIPLTINKEEALQRP
NSCVKLQTVHSIPFTIRKFEAMQRP

SEQ ID NO: 38931 - protein, 25 aa, synthetic construct
  source 1..25: note = Seed: NSCVKLQTVHSIPLTINKEEALQRP
NSCVKLQTVHSIPFTIRKFEATQRP

SEQ ID NO: 38932 - protein, 25 aa, synthetic construct
  source 1..25: note = Seed: NSCVKLQTVHSIPLTINKEEALQRP
NSCVKLQTVHSIPFTIRKFEAVQRP

SEQ ID NO: 38933 - protein, 25 aa, synthetic construct
  source 1..25: note = Seed: NSCVKLQTVHSIPLTINKEEALQRP
NSCVKLQTVHSIPFTIRKFEAYQRP

SEQ ID NO: 38934 - protein, 25 aa, synthetic construct
  source 1..25: note = Seed: NSCVKLQTVHSIPLTINKEEALQRP
NSCVKLQTVHSIPFTIRKHEAFQRP

SEQ ID NO: 38935 - protein, 25 aa, synthetic construct
  source 1..25: note = Seed: NSCVKLQTVHSIPLTINKEEALQRP
NSCVKLQTVHSIPFTIRKIEAMQRP

SEQ ID NO: 38936 - protein, 25 aa, synthetic construct
  source 1..25: note = Seed: NSCVKLQTVHSIPLTINKEEALQRP
NSCVKLQTVHSIPFTIRKIEARQRP

SEQ ID NO: 38937 - protein, 25 aa, synthetic construct
  source 1..25: note = Seed: NSCVKLQTVHSIPLTINKEEALQRP
NSCVKLQTVHSIPFTIRKIEAVQRP

SEQ ID NO: 38938 - protein, 25 aa, synthetic construct
  source 1..25: note = Seed: NSCVKLQTVHSIPLTINKEEALQRP
NSCVKLQTVHSIPFTIRKIEAYQRP

SEQ ID NO: 38939 - protein, 25 aa, synthetic construct
  source 1..25: note = Seed: NSCVKLQTVHSIPLTINKEEALQRP
NSCVKLQTVHSIPFTIRKKEAFQRP

SEQ ID NO: 38940 - protein, 25 aa, synthetic construct
  source 1..25: note = Seed: NSCVKLQTVHSIPLTINKEEALQRP
NSCVKLQTVHSIPFTIRKREAFQRP

SEQ ID NO: 38941 - protein, 25 aa, synthetic construct
  source 1..25: note = Seed: NSCVKLQTVHSIPLTINKEEALQRP
NSCVKLQTVHSIPFTIRKREAIQRP

SEQ ID NO: 38942 - protein, 25 aa, synthetic construct
  source 1..25: note = Seed: NSCVKLQTVHSIPLTINKEEALQRP
NSCVKLQTVHSIPFTIRKREALQRP

SEQ ID NO: 38943 - protein, 25 aa, synthetic construct
  source 1..25: note = Seed: NSCVKLQTVHSIPLTINKEEALQRP
NSCVKLQTVHSIPFTIRKREAMQRP

SEQ ID NO: 38944 - protein, 25 aa, synthetic construct
  source 1..25: note = Seed: NSCVKLQTVHSIPLTINKEEALQRP
NSCVKLQTVHSIPFTIRKREAVQRP

SEQ ID NO: 38945 - protein, 25 aa, synthetic construct
  source 1..25: note = Seed: NSCVKLQTVHSIPLTINKEEALQRP
NSCVKLQTVHSIPFTIRKREAYQRP

SEQ ID NO: 38946 - protein, 25 aa, synthetic construct
  source 1..25: note = Seed: NSCVKLQTVHSIPLTINKEEALQRP
NSCVKLQTVHSIPFTIRKVEAFQRP

SEQ ID NO: 38947 - protein, 25 aa, synthetic construct
  source 1..25: note = Seed: NSCVKLQTVHSIPLTINKEEALQRP
NSCVKLQTVHSIPFTIRKVEAIQRP

SEQ ID NO: 38948 - protein, 25 aa, synthetic construct
  source 1..25: note = Seed: NSCVKLQTVHSIPLTINKEEALQRP
NSCVKLQTVHSIPFTIRKVEALQRP

SEQ ID NO: 38949 - protein, 25 aa, synthetic construct
  source 1..25: note = Seed: NSCVKLQTVHSIPLTINKEEALQRP
NSCVKLQTVHSIPFTIRKVEARQRP

SEQ ID NO: 38950 - protein, 25 aa, synthetic construct
  source 1..25: note = Seed: NSCVKLQTVHSIPLTINKEEALQRP
NSCVKLQTVHSIPFTISKAEAIQRP

SEQ ID NO: 38951 - protein, 25 aa, synthetic construct
  source 1..25: note = Seed: NSCVKLQTVHSIPLTINKEEALQRP
NSCVKLQTVHSIPFTISKFEAAQRP

SEQ ID NO: 38952 - protein, 25 aa, synthetic construct
  source 1..25: note = Seed: NSCVKLQTVHSIPLTINKEEALQRP
NSCVKLQTVHSIPFTISKFEACQRP

SEQ ID NO: 38953 - protein, 25 aa, synthetic construct
  source 1..25: note = Seed: NSCVKLQTVHSIPLTINKEEALQRP
NSCVKLQTVHSIPFTISKFEADQRP

SEQ ID NO: 38954 - protein, 25 aa, synthetic construct
  source 1..25: note = Seed: NSCVKLQTVHSIPLTINKEEALQRP
NSCVKLQTVHSIPFTISKFEAEQRP

SEQ ID NO: 38955 - protein, 25 aa, synthetic construct
  source 1..25: note = Seed: NSCVKLQTVHSIPLTINKEEALQRP
NSCVKLQTVHSIPFTISKFEAFQRP

SEQ ID NO: 38956 - protein, 25 aa, synthetic construct
  source 1..25: note = Seed: NSCVKLQTVHSIPLTINKEEALQRP
NSCVKLQTVHSIPFTISKFEAGQRP

SEQ ID NO: 38957 - protein, 25 aa, synthetic construct
  source 1..25: note = Seed: NSCVKLQTVHSIPLTINKEEALQRP
NSCVKLQTVHSIPFTISKFEAHQRP

SEQ ID NO: 38958 - protein, 25 aa, synthetic construct
  source 1..25: note = Seed: NSCVKLQTVHSIPLTINKEEALQRP
NSCVKLQTVHSIPFTISKFEAIQRP

SEQ ID NO: 38959 - protein, 25 aa, synthetic construct
  source 1..25: note = Seed: NSCVKLQTVHSIPLTINKEEALQRP
NSCVKLQTVHSIPFTISKFEAKQRP

SEQ ID NO: 38960 - protein, 25 aa, synthetic construct
  source 1..25: note = Seed: NSCVKLQTVHSIPLTINKEEALQRP
NSCVKLQTVHSIPFTISKFEAMQRP

SEQ ID NO: 38961 - protein, 25 aa, synthetic construct
  source 1..25: note = Seed: NSCVKLQTVHSIPLTINKEEALQRP
NSCVKLQTVHSIPFTISKFEANQRP

SEQ ID NO: 38962 - protein, 25 aa, synthetic construct
  source 1..25: note = Seed: NSCVKLQTVHSIPLTINKEEALQRP
NSCVKLQTVHSIPFTISKFEAPQRP

SEQ ID NO: 38963 - protein, 25 aa, synthetic construct
  source 1..25: note = Seed: NSCVKLQTVHSIPLTINKEEALQRP
NSCVKLQTVHSIPFTISKFEAQQRP

SEQ ID NO: 38964 - protein, 25 aa, synthetic construct
  source 1..25: note = Seed: NSCVKLQTVHSIPLTINKEEALQRP
NSCVKLQTVHSIPFTISKFEARQRP

SEQ ID NO: 38965 - protein, 25 aa, synthetic construct
  source 1..25: note = Seed: NSCVKLQTVHSIPLTINKEEALQRP
NSCVKLQTVHSIPFTISKFEASQRP

SEQ ID NO: 38966 - protein, 25 aa, synthetic construct
  source 1..25: note = Seed: NSCVKLQTVHSIPLTINKEEALQRP
NSCVKLQTVHSIPFTISKFEATQRP

SEQ ID NO: 38967 - protein, 25 aa, synthetic construct
  source 1..25: note = Seed: NSCVKLQTVHSIPLTINKEEALQRP
NSCVKLQTVHSIPFTISKFEAVQRP

SEQ ID NO: 38968 - protein, 25 aa, synthetic construct
  source 1..25: note = Seed: NSCVKLQTVHSIPLTINKEEALQRP
NSCVKLQTVHSIPFTISKFEAWQRP

SEQ ID NO: 38969 - protein, 25 aa, synthetic construct
  source 1..25: note = Seed: NSCVKLQTVHSIPLTINKEEALQRP
NSCVKLQTVHSIPFTISKFEAYQRP

SEQ ID NO: 38970 - protein, 25 aa, synthetic construct
  source 1..25: note = Seed: NSCVKLQTVHSIPLTINKEEALQRP
NSCVKLQTVHSIPFTISKIEAAQRP

SEQ ID NO: 38971 - protein, 25 aa, synthetic construct
  source 1..25: note = Seed: NSCVKLQTVHSIPLTINKEEALQRP
NSCVKLQTVHSIPFTISKIEAFQRP

SEQ ID NO: 38972 - protein, 25 aa, synthetic construct
  source 1..25: note = Seed: NSCVKLQTVHSIPLTINKEEALQRP
NSCVKLQTVHSIPFTISKIEAIQRP

SEQ ID NO: 38973 - protein, 25 aa, synthetic construct
  source 1..25: note = Seed: NSCVKLQTVHSIPLTINKEEALQRP
NSCVKLQTVHSIPFTISKIEALQRP

SEQ ID NO: 38974 - protein, 25 aa, synthetic construct
  source 1..25: note = Seed: NSCVKLQTVHSIPLTINKEEALQRP
NSCVKLQTVHSIPFTISKIEAMQRP

SEQ ID NO: 38975 - protein, 25 aa, synthetic construct
  source 1..25: note = Seed: NSCVKLQTVHSIPLTINKEEALQRP
NSCVKLQTVHSIPFTISKIEAVQRP

SEQ ID NO: 38976 - protein, 25 aa, synthetic construct
  source 1..25: note = Seed: NSCVKLQTVHSIPLTINKEEALQRP
NSCVKLQTVHSIPFTISKIEAYQRP

SEQ ID NO: 38977 - protein, 25 aa, synthetic construct
  source 1..25: note = Seed: NSCVKLQTVHSIPLTINKEEALQRP
NSCVKLQTVHSIPFTISKLEAFQRP

SEQ ID NO: 38978 - protein, 25 aa, synthetic construct
  source 1..25: note = Seed: NSCVKLQTVHSIPLTINKEEALQRP
NSCVKLQTVHSIPFTISKLEAIQRP

SEQ ID NO: 38979 - protein, 25 aa, synthetic construct
  source 1..25: note = Seed: NSCVKLQTVHSIPLTINKEEALQRP
NSCVKLQTVHSIPFTISKLEALQRP

SEQ ID NO: 38980 - protein, 25 aa, synthetic construct
  source 1..25: note = Seed: NSCVKLQTVHSIPLTINKEEALQRP
NSCVKLQTVHSIPFTISKLEAMQRP

SEQ ID NO: 38981 - protein, 25 aa, synthetic construct
  source 1..25: note = Seed: NSCVKLQTVHSIPLTINKEEALQRP
NSCVKLQTVHSIPFTISKLEATQRP

SEQ ID NO: 38982 - protein, 25 aa, synthetic construct
  source 1..25: note = Seed: NSCVKLQTVHSIPLTINKEEALQRP
NSCVKLQTVHSIPFTISKLEAVQRP

SEQ ID NO: 38983 - protein, 25 aa, synthetic construct
  source 1..25: note = Seed: NSCVKLQTVHSIPLTINKEEALQRP
NSCVKLQTVHSIPFTISKLEAYQRP

SEQ ID NO: 38984 - protein, 25 aa, synthetic construct
  source 1..25: note = Seed: NSCVKLQTVHSIPLTINKEEALQRP
NSCVKLQTVHSIPFTISKMEAFQRP

SEQ ID NO: 38985 - protein, 25 aa, synthetic construct
  source 1..25: note = Seed: NSCVKLQTVHSIPLTINKEEALQRP
NSCVKLQTVHSIPFTISKMEAIQRP

SEQ ID NO: 38986 - protein, 25 aa, synthetic construct
  source 1..25: note = Seed: NSCVKLQTVHSIPLTINKEEALQRP
NSCVKLQTVHSIPFTISKMEALQRP

SEQ ID NO: 38987 - protein, 25 aa, synthetic construct
  source 1..25: note = Seed: NSCVKLQTVHSIPLTINKEEALQRP
NSCVKLQTVHSIPFTISKMEAMQRP

SEQ ID NO: 38988 - protein, 25 aa, synthetic construct
  source 1..25: note = Seed: NSCVKLQTVHSIPLTINKEEALQRP
NSCVKLQTVHSIPFTISKMEAVQRP

SEQ ID NO: 38989 - protein, 25 aa, synthetic construct
  source 1..25: note = Seed: NSCVKLQTVHSIPLTINKEEALQRP
NSCVKLQTVHSIPFTISKNEAAQRP

SEQ ID NO: 38990 - protein, 25 aa, synthetic construct
  source 1..25: note = Seed: NSCVKLQTVHSIPLTINKEEALQRP
NSCVKLQTVHSIPFTISKNEAIQRP

SEQ ID NO: 38991 - protein, 25 aa, synthetic construct
  source 1..25: note = Seed: NSCVKLQTVHSIPLTINKEEALQRP
NSCVKLQTVHSIPFTISKNEALQRP

SEQ ID NO: 38992 - protein, 25 aa, synthetic construct
  source 1..25: note = Seed: NSCVKLQTVHSIPLTINKEEALQRP
NSCVKLQTVHSIPFTISKNEASQRP

SEQ ID NO: 38993 - protein, 25 aa, synthetic construct
  source 1..25: note = Seed: NSCVKLQTVHSIPLTINKEEALQRP
NSCVKLQTVHSIPFTISKNEAVQRP

SEQ ID NO: 38994 - protein, 25 aa, synthetic construct
  source 1..25: note = Seed: NSCVKLQTVHSIPLTINKEEALQRP
NSCVKLQTVHSIPFTISKSEAAQRP

SEQ ID NO: 38995 - protein, 25 aa, synthetic construct
  source 1..25: note = Seed: NSCVKLQTVHSIPLTINKEEALQRP
NSCVKLQTVHSIPFTISKSEASQRP

SEQ ID NO: 38996 - protein, 25 aa, synthetic construct
  source 1..25: note = Seed: NSCVKLQTVHSIPLTINKEEALQRP
NSCVKLQTVHSIPFTISKTEAAQRP

SEQ ID NO: 38997 - protein, 25 aa, synthetic construct
  source 1..25: note = Seed: NSCVKLQTVHSIPLTINKEEALQRP
NSCVKLQTVHSIPFTISKTEASQRP

SEQ ID NO: 38998 - protein, 25 aa, synthetic construct
  source 1..25: note = Seed: NSCVKLQTVHSIPLTINKEEALQRP
NSCVKLQTVHSIPFTISKVEAIQRP

SEQ ID NO: 38999 - protein, 25 aa, synthetic construct
  source 1..25: note = Seed: NSCVKLQTVHSIPLTINKEEALQRP
NSCVKLQTVHSIPFTISKVEALQRP

SEQ ID NO: 39000 - protein, 25 aa, synthetic construct
  source 1..25: note = Seed: NSCVKLQTVHSIPLTINKEEALQRP
NSCVKLQTVHSIPFTISKVEAVQRP

SEQ ID NO: 39001 - protein, 25 aa, synthetic construct
  source 1..25: note = Seed: NSCVKLQTVHSIPLTINKEEALQRP
NSCVKLQTVHSIPFTISKWEAAQRP

SEQ ID NO: 39002 - protein, 25 aa, synthetic construct
  source 1..25: note = Seed: NSCVKLQTVHSIPLTINKEEALQRP
NSCVKLQTVHSIPFTISKWEAFQRP

SEQ ID NO: 39003 - protein, 25 aa, synthetic construct
  source 1..25: note = Seed: NSCVKLQTVHSIPLTINKEEALQRP
NSCVKLQTVHSIPFTISKWEAIQRP

SEQ ID NO: 39004 - protein, 25 aa, synthetic construct
  source 1..25: note = Seed: NSCVKLQTVHSIPLTINKEEALQRP
NSCVKLQTVHSIPFTISKWEALQRP

SEQ ID NO: 39005 - protein, 25 aa, synthetic construct
  source 1..25: note = Seed: NSCVKLQTVHSIPLTINKEEALQRP
NSCVKLQTVHSIPFTISKWEAMQRP

SEQ ID NO: 39006 - protein, 25 aa, synthetic construct
  source 1..25: note = Seed: NSCVKLQTVHSIPLTINKEEALQRP
NSCVKLQTVHSIPFTISKWEANQRP

SEQ ID NO: 39007 - protein, 25 aa, synthetic construct
  source 1..25: note = Seed: NSCVKLQTVHSIPLTINKEEALQRP
NSCVKLQTVHSIPFTISKWEASQRP

SEQ ID NO: 39008 - protein, 25 aa, synthetic construct
  source 1..25: note = Seed: NSCVKLQTVHSIPLTINKEEALQRP
NSCVKLQTVHSIPFTISKWEATQRP

SEQ ID NO: 39009 - protein, 25 aa, synthetic construct
  source 1..25: note = Seed: NSCVKLQTVHSIPLTINKEEALQRP
NSCVKLQTVHSIPFTISKWEAVQRP

SEQ ID NO: 39010 - protein, 25 aa, synthetic construct
  source 1..25: note = Seed: NSCVKLQTVHSIPLTINKEEALQRP
NSCVKLQTVHSIPFTISKWEAYQRP

SEQ ID NO: 39011 - protein, 25 aa, synthetic construct
  source 1..25: note = Seed: NSCVKLQTVHSIPLTINKEEALQRP
NSCVKLQTVHSIPFTISKYEAAQRP

SEQ ID NO: 39012 - protein, 25 aa, synthetic construct
  source 1..25: note = Seed: NSCVKLQTVHSIPLTINKEEALQRP
NSCVKLQTVHSIPFTISKYEACQRP

SEQ ID NO: 39013 - protein, 25 aa, synthetic construct
  source 1..25: note = Seed: NSCVKLQTVHSIPLTINKEEALQRP
NSCVKLQTVHSIPFTISKYEADQRP

SEQ ID NO: 39014 - protein, 25 aa, synthetic construct
  source 1..25: note = Seed: NSCVKLQTVHSIPLTINKEEALQRP
NSCVKLQTVHSIPFTISKYEAEQRP

SEQ ID NO: 39015 - protein, 25 aa, synthetic construct
  source 1..25: note = Seed: NSCVKLQTVHSIPLTINKEEALQRP
NSCVKLQTVHSIPFTISKYEAFQRP

SEQ ID NO: 39016 - protein, 25 aa, synthetic construct
  source 1..25: note = Seed: NSCVKLQTVHSIPLTINKEEALQRP
NSCVKLQTVHSIPFTISKYEAIQRP

SEQ ID NO: 39017 - protein, 25 aa, synthetic construct
  source 1..25: note = Seed: NSCVKLQTVHSIPLTINKEEALQRP
NSCVKLQTVHSIPFTISKYEALQRP

SEQ ID NO: 39018 - protein, 25 aa, synthetic construct
  source 1..25: note = Seed: NSCVKLQTVHSIPLTINKEEALQRP
NSCVKLQTVHSIPFTISKYEAMQRP

SEQ ID NO: 39019 - protein, 25 aa, synthetic construct
  source 1..25: note = Seed: NSCVKLQTVHSIPLTINKEEALQRP
NSCVKLQTVHSIPFTISKYEANQRP

SEQ ID NO: 39020 - protein, 25 aa, synthetic construct
  source 1..25: note = Seed: NSCVKLQTVHSIPLTINKEEALQRP
NSCVKLQTVHSIPFTISKYEASQRP

SEQ ID NO: 39021 - protein, 25 aa, synthetic construct
  source 1..25: note = Seed: NSCVKLQTVHSIPLTINKEEALQRP
NSCVKLQTVHSIPFTISKYEATQRP

SEQ ID NO: 39022 - protein, 25 aa, synthetic construct
  source 1..25: note = Seed: NSCVKLQTVHSIPLTINKEEALQRP
NSCVKLQTVHSIPFTISKYEAVQRP

SEQ ID NO: 39023 - protein, 25 aa, synthetic construct
  source 1..25: note = Seed: NSCVKLQTVHSIPLTINKEEALQRP
NSCVKLQTVHSIPFTISKYEAYQRP

SEQ ID NO: 39024 - protein, 25 aa, synthetic construct
  source 1..25: note = Seed: NSCVKLQTVHSIPLTINKEEALQRP
NSCVKLQTVHSIPFTITKAEAFQRP

SEQ ID NO: 39025 - protein, 25 aa, synthetic construct
  source 1..25: note = Seed: NSCVKLQTVHSIPLTINKEEALQRP
NSCVKLQTVHSIPFTITKAEAIQRP

SEQ ID NO: 39026 - protein, 25 aa, synthetic construct
  source 1..25: note = Seed: NSCVKLQTVHSIPLTINKEEALQRP
NSCVKLQTVHSIPFTITKAEALQRP

SEQ ID NO: 39027 - protein, 25 aa, synthetic construct
  source 1..25: note = Seed: NSCVKLQTVHSIPLTINKEEALQRP
NSCVKLQTVHSIPFTITKAEAVQRP

SEQ ID NO: 39028 - protein, 25 aa, synthetic construct
  source 1..25: note = Seed: NSCVKLQTVHSIPLTINKEEALQRP
NSCVKLQTVHSIPFTITKFEAAQRP

SEQ ID NO: 39029 - protein, 25 aa, synthetic construct
  source 1..25: note = Seed: NSCVKLQTVHSIPLTINKEEALQRP
NSCVKLQTVHSIPFTITKFEACQRP

SEQ ID NO: 39030 - protein, 25 aa, synthetic construct
  source 1..25: note = Seed: NSCVKLQTVHSIPLTINKEEALQRP
NSCVKLQTVHSIPFTITKFEADQRP

SEQ ID NO: 39031 - protein, 25 aa, synthetic construct
  source 1..25: note = Seed: NSCVKLQTVHSIPLTINKEEALQRP
NSCVKLQTVHSIPFTITKFEAEQRP

SEQ ID NO: 39032 - protein, 25 aa, synthetic construct
  source 1..25: note = Seed: NSCVKLQTVHSIPLTINKEEALQRP
NSCVKLQTVHSIPFTITKFEAFQRP

SEQ ID NO: 39033 - protein, 25 aa, synthetic construct
  source 1..25: note = Seed: NSCVKLQTVHSIPLTINKEEALQRP
NSCVKLQTVHSIPFTITKFEAGQRP

SEQ ID NO: 39034 - protein, 25 aa, synthetic construct
  source 1..25: note = Seed: NSCVKLQTVHSIPLTINKEEALQRP
NSCVKLQTVHSIPFTITKFEAHQRP

SEQ ID NO: 39035 - protein, 25 aa, synthetic construct
  source 1..25: note = Seed: NSCVKLQTVHSIPLTINKEEALQRP
NSCVKLQTVHSIPFTITKFEAIQRP

SEQ ID NO: 39036 - protein, 25 aa, synthetic construct
  source 1..25: note = Seed: NSCVKLQTVHSIPLTINKEEALQRP
NSCVKLQTVHSIPFTITKFEAKQRP

SEQ ID NO: 39037 - protein, 25 aa, synthetic construct
  source 1..25: note = Seed: NSCVKLQTVHSIPLTINKEEALQRP
NSCVKLQTVHSIPFTITKFEALQRP

SEQ ID NO: 39038 - protein, 25 aa, synthetic construct
  source 1..25: note = Seed: NSCVKLQTVHSIPLTINKEEALQRP
NSCVKLQTVHSIPFTITKFEAMQRP

SEQ ID NO: 39039 - protein, 25 aa, synthetic construct
  source 1..25: note = Seed: NSCVKLQTVHSIPLTINKEEALQRP
NSCVKLQTVHSIPFTITKFEANQRP

SEQ ID NO: 39040 - protein, 25 aa, synthetic construct
  source 1..25: note = Seed: NSCVKLQTVHSIPLTINKEEALQRP
NSCVKLQTVHSIPFTITKFEAPQRP

SEQ ID NO: 39041 - protein, 25 aa, synthetic construct
  source 1..25: note = Seed: NSCVKLQTVHSIPLTINKEEALQRP
NSCVKLQTVHSIPFTITKFEAQQRP

SEQ ID NO: 39042 - protein, 25 aa, synthetic construct
  source 1..25: note = Seed: NSCVKLQTVHSIPLTINKEEALQRP
NSCVKLQTVHSIPFTITKFEARQRP

SEQ ID NO: 39043 - protein, 25 aa, synthetic construct
  source 1..25: note = Seed: NSCVKLQTVHSIPLTINKEEALQRP
NSCVKLQTVHSIPFTITKFEASQRP

SEQ ID NO: 39044 - protein, 25 aa, synthetic construct
  source 1..25: note = Seed: NSCVKLQTVHSIPLTINKEEALQRP
NSCVKLQTVHSIPFTITKFEATQRP

SEQ ID NO: 39045 - protein, 25 aa, synthetic construct
  source 1..25: note = Seed: NSCVKLQTVHSIPLTINKEEALQRP
NSCVKLQTVHSIPFTITKFEAVQRP

SEQ ID NO: 39046 - protein, 25 aa, synthetic construct
  source 1..25: note = Seed: NSCVKLQTVHSIPLTINKEEALQRP
NSCVKLQTVHSIPFTITKFEAWQRP

SEQ ID NO: 39047 - protein, 25 aa, synthetic construct
  source 1..25: note = Seed: NSCVKLQTVHSIPLTINKEEALQRP
NSCVKLQTVHSIPFTITKFEAYQRP

SEQ ID NO: 39048 - protein, 25 aa, synthetic construct
  source 1..25: note = Seed: NSCVKLQTVHSIPLTINKEEALQRP
NSCVKLQTVHSIPFTITKIEAAQRP

SEQ ID NO: 39049 - protein, 25 aa, synthetic construct
  source 1..25: note = Seed: NSCVKLQTVHSIPLTINKEEALQRP
NSCVKLQTVHSIPFTITKIEAEQRP

SEQ ID NO: 39050 - protein, 25 aa, synthetic construct
  source 1..25: note = Seed: NSCVKLQTVHSIPLTINKEEALQRP
NSCVKLQTVHSIPFTITKIEAFQRP

SEQ ID NO: 39051 - protein, 25 aa, synthetic construct
  source 1..25: note = Seed: NSCVKLQTVHSIPLTINKEEALQRP
NSCVKLQTVHSIPFTITKIEAIQRP

SEQ ID NO: 39052 - protein, 25 aa, synthetic construct
  source 1..25: note = Seed: NSCVKLQTVHSIPLTINKEEALQRP
NSCVKLQTVHSIPFTITKIEALQRP

SEQ ID NO: 39053 - protein, 25 aa, synthetic construct
  source 1..25: note = Seed: NSCVKLQTVHSIPLTINKEEALQRP
NSCVKLQTVHSIPFTITKIEAMQRP

SEQ ID NO: 39054 - protein, 25 aa, synthetic construct
  source 1..25: note = Seed: NSCVKLQTVHSIPLTINKEEALQRP
NSCVKLQTVHSIPFTITKIEANQRP

SEQ ID NO: 39055 - protein, 25 aa, synthetic construct
  source 1..25: note = Seed: NSCVKLQTVHSIPLTINKEEALQRP
NSCVKLQTVHSIPFTITKIEASQRP

SEQ ID NO: 39056 - protein, 25 aa, synthetic construct
  source 1..25: note = Seed: NSCVKLQTVHSIPLTINKEEALQRP
NSCVKLQTVHSIPFTITKIEATQRP

SEQ ID NO: 39057 - protein, 25 aa, synthetic construct
  source 1..25: note = Seed: NSCVKLQTVHSIPLTINKEEALQRP
NSCVKLQTVHSIPFTITKIEAVQRP

SEQ ID NO: 39058 - protein, 25 aa, synthetic construct
  source 1..25: note = Seed: NSCVKLQTVHSIPLTINKEEALQRP
NSCVKLQTVHSIPFTITKIEAYQRP

SEQ ID NO: 39059 - protein, 25 aa, synthetic construct
  source 1..25: note = Seed: NSCVKLQTVHSIPLTINKEEALQRP
NSCVKLQTVHSIPFTITKLEAAQRP

SEQ ID NO: 39060 - protein, 25 aa, synthetic construct
  source 1..25: note = Seed: NSCVKLQTVHSIPLTINKEEALQRP
NSCVKLQTVHSIPFTITKLEACQRP

SEQ ID NO: 39061 - protein, 25 aa, synthetic construct
  source 1..25: note = Seed: NSCVKLQTVHSIPLTINKEEALQRP
NSCVKLQTVHSIPFTITKLEADQRP

SEQ ID NO: 39062 - protein, 25 aa, synthetic construct
  source 1..25: note = Seed: NSCVKLQTVHSIPLTINKEEALQRP
NSCVKLQTVHSIPFTITKLEAEQRP

SEQ ID NO: 39063 - protein, 25 aa, synthetic construct
  source 1..25: note = Seed: NSCVKLQTVHSIPLTINKEEALQRP
NSCVKLQTVHSIPFTITKLEAFQRP

SEQ ID NO: 39064 - protein, 25 aa, synthetic construct
  source 1..25: note = Seed: NSCVKLQTVHSIPLTINKEEALQRP
NSCVKLQTVHSIPFTITKLEAIQRP

SEQ ID NO: 39065 - protein, 25 aa, synthetic construct
  source 1..25: note = Seed: NSCVKLQTVHSIPLTINKEEALQRP
NSCVKLQTVHSIPFTITKLEALQRP

SEQ ID NO: 39066 - protein, 25 aa, synthetic construct
  source 1..25: note = Seed: NSCVKLQTVHSIPLTINKEEALQRP
NSCVKLQTVHSIPFTITKLEAMQRP

SEQ ID NO: 39067 - protein, 25 aa, synthetic construct
  source 1..25: note = Seed: NSCVKLQTVHSIPLTINKEEALQRP
NSCVKLQTVHSIPFTITKLEANQRP

SEQ ID NO: 39068 - protein, 25 aa, synthetic construct
  source 1..25: note = Seed: NSCVKLQTVHSIPLTINKEEALQRP
NSCVKLQTVHSIPFTITKLEASQRP

SEQ ID NO: 39069 - protein, 25 aa, synthetic construct
  source 1..25: note = Seed: NSCVKLQTVHSIPLTINKEEALQRP
NSCVKLQTVHSIPFTITKLEATQRP

SEQ ID NO: 39070 - protein, 25 aa, synthetic construct
  source 1..25: note = Seed: NSCVKLQTVHSIPLTINKEEALQRP
NSCVKLQTVHSIPFTITKLEAVQRP

SEQ ID NO: 39071 - protein, 25 aa, synthetic construct
  source 1..25: note = Seed: NSCVKLQTVHSIPLTINKEEALQRP
NSCVKLQTVHSIPFTITKLEAWQRP

SEQ ID NO: 39072 - protein, 25 aa, synthetic construct
  source 1..25: note = Seed: NSCVKLQTVHSIPLTINKEEALQRP
NSCVKLQTVHSIPFTITKLEAYQRP

SEQ ID NO: 39073 - protein, 25 aa, synthetic construct
  source 1..25: note = Seed: NSCVKLQTVHSIPLTINKEEALQRP
NSCVKLQTVHSIPFTITKMEAAQRP

SEQ ID NO: 39074 - protein, 25 aa, synthetic construct
  source 1..25: note = Seed: NSCVKLQTVHSIPLTINKEEALQRP
NSCVKLQTVHSIPFTITKMEAFQRP

SEQ ID NO: 39075 - protein, 25 aa, synthetic construct
  source 1..25: note = Seed: NSCVKLQTVHSIPLTINKEEALQRP
NSCVKLQTVHSIPFTITKMEAIQRP

SEQ ID NO: 39076 - protein, 25 aa, synthetic construct
  source 1..25: note = Seed: NSCVKLQTVHSIPLTINKEEALQRP
NSCVKLQTVHSIPFTITKMEALQRP

SEQ ID NO: 39077 - protein, 25 aa, synthetic construct
  source 1..25: note = Seed: NSCVKLQTVHSIPLTINKEEALQRP
NSCVKLQTVHSIPFTITKMEAMQRP

SEQ ID NO: 39078 - protein, 25 aa, synthetic construct
  source 1..25: note = Seed: NSCVKLQTVHSIPLTINKEEALQRP
NSCVKLQTVHSIPFTITKMEASQRP

SEQ ID NO: 39079 - protein, 25 aa, synthetic construct
  source 1..25: note = Seed: NSCVKLQTVHSIPLTINKEEALQRP
NSCVKLQTVHSIPFTITKMEATQRP

SEQ ID NO: 39080 - protein, 25 aa, synthetic construct
  source 1..25: note = Seed: NSCVKLQTVHSIPLTINKEEALQRP
NSCVKLQTVHSIPFTITKMEAVQRP

SEQ ID NO: 39081 - protein, 25 aa, synthetic construct
  source 1..25: note = Seed: NSCVKLQTVHSIPLTINKEEALQRP
NSCVKLQTVHSIPFTITKMEAYQRP

SEQ ID NO: 39082 - protein, 25 aa, synthetic construct
  source 1..25: note = Seed: NSCVKLQTVHSIPLTINKEEALQRP
NSCVKLQTVHSIPFTITKNEAAQRP

SEQ ID NO: 39083 - protein, 25 aa, synthetic construct
  source 1..25: note = Seed: NSCVKLQTVHSIPLTINKEEALQRP
NSCVKLQTVHSIPFTITKTEAAQRP

SEQ ID NO: 39084 - protein, 25 aa, synthetic construct
  source 1..25: note = Seed: NSCVKLQTVHSIPLTINKEEALQRP
NSCVKLQTVHSIPFTITKVEAFQRP

SEQ ID NO: 39085 - protein, 25 aa, synthetic construct
  source 1..25: note = Seed: NSCVKLQTVHSIPLTINKEEALQRP
NSCVKLQTVHSIPFTITKVEAIQRP

SEQ ID NO: 39086 - protein, 25 aa, synthetic construct
  source 1..25: note = Seed: NSCVKLQTVHSIPLTINKEEALQRP
NSCVKLQTVHSIPFTITKVEALQRP

SEQ ID NO: 39087 - protein, 25 aa, synthetic construct
  source 1..25: note = Seed: NSCVKLQTVHSIPLTINKEEALQRP
NSCVKLQTVHSIPFTITKVEAMQRP

SEQ ID NO: 39088 - protein, 25 aa, synthetic construct
  source 1..25: note = Seed: NSCVKLQTVHSIPLTINKEEALQRP
NSCVKLQTVHSIPFTITKVEAVQRP

SEQ ID NO: 39089 - protein, 25 aa, synthetic construct
  source 1..25: note = Seed: NSCVKLQTVHSIPLTINKEEALQRP
NSCVKLQTVHSIPFTITKWEAAQRP

SEQ ID NO: 39090 - protein, 25 aa, synthetic construct
  source 1..25: note = Seed: NSCVKLQTVHSIPLTINKEEALQRP
NSCVKLQTVHSIPFTITKWEACQRP

SEQ ID NO: 39091 - protein, 25 aa, synthetic construct
  source 1..25: note = Seed: NSCVKLQTVHSIPLTINKEEALQRP
NSCVKLQTVHSIPFTITKWEADQRP

SEQ ID NO: 39092 - protein, 25 aa, synthetic construct
  source 1..25: note = Seed: NSCVKLQTVHSIPLTINKEEALQRP
NSCVKLQTVHSIPFTITKWEAEQRP

SEQ ID NO: 39093 - protein, 25 aa, synthetic construct
  source 1..25: note = Seed: NSCVKLQTVHSIPLTINKEEALQRP
NSCVKLQTVHSIPFTITKWEAFQRP

SEQ ID NO: 39094 - protein, 25 aa, synthetic construct
  source 1..25: note = Seed: NSCVKLQTVHSIPLTINKEEALQRP
NSCVKLQTVHSIPFTITKWEAIQRP

SEQ ID NO: 39095 - protein, 25 aa, synthetic construct
  source 1..25: note = Seed: NSCVKLQTVHSIPLTINKEEALQRP
NSCVKLQTVHSIPFTITKWEALQRP

SEQ ID NO: 39096 - protein, 25 aa, synthetic construct
  source 1..25: note = Seed: NSCVKLQTVHSIPLTINKEEALQRP
NSCVKLQTVHSIPFTITKWEAMQRP

SEQ ID NO: 39097 - protein, 25 aa, synthetic construct
  source 1..25: note = Seed: NSCVKLQTVHSIPLTINKEEALQRP
NSCVKLQTVHSIPFTITKWEANQRP

SEQ ID NO: 39098 - protein, 25 aa, synthetic construct
  source 1..25: note = Seed: NSCVKLQTVHSIPLTINKEEALQRP
NSCVKLQTVHSIPFTITKWEAPQRP

SEQ ID NO: 39099 - protein, 25 aa, synthetic construct
  source 1..25: note = Seed: NSCVKLQTVHSIPLTINKEEALQRP
NSCVKLQTVHSIPFTITKWEASQRP

SEQ ID NO: 39100 - protein, 25 aa, synthetic construct
  source 1..25: note = Seed: NSCVKLQTVHSIPLTINKEEALQRP
NSCVKLQTVHSIPFTITKWEATQRP

SEQ ID NO: 39101 - protein, 25 aa, synthetic construct
  source 1..25: note = Seed: NSCVKLQTVHSIPLTINKEEALQRP
NSCVKLQTVHSIPFTITKWEAVQRP

SEQ ID NO: 39102 - protein, 25 aa, synthetic construct
  source 1..25: note = Seed: NSCVKLQTVHSIPLTINKEEALQRP
NSCVKLQTVHSIPFTITKWEAWQRP

SEQ ID NO: 39103 - protein, 25 aa, synthetic construct
  source 1..25: note = Seed: NSCVKLQTVHSIPLTINKEEALQRP
NSCVKLQTVHSIPFTITKWEAYQRP

SEQ ID NO: 39104 - protein, 25 aa, synthetic construct
  source 1..25: note = Seed: NSCVKLQTVHSIPLTINKEEALQRP
NSCVKLQTVHSIPFTITKYEAAQRP

SEQ ID NO: 39105 - protein, 25 aa, synthetic construct
  source 1..25: note = Seed: NSCVKLQTVHSIPLTINKEEALQRP
NSCVKLQTVHSIPFTITKYEACQRP

SEQ ID NO: 39106 - protein, 25 aa, synthetic construct
  source 1..25: note = Seed: NSCVKLQTVHSIPLTINKEEALQRP
NSCVKLQTVHSIPFTITKYEADQRP

SEQ ID NO: 39107 - protein, 25 aa, synthetic construct
  source 1..25: note = Seed: NSCVKLQTVHSIPLTINKEEALQRP
NSCVKLQTVHSIPFTITKYEAEQRP

SEQ ID NO: 39108 - protein, 25 aa, synthetic construct
  source 1..25: note = Seed: NSCVKLQTVHSIPLTINKEEALQRP
NSCVKLQTVHSIPFTITKYEAFQRP

SEQ ID NO: 39109 - protein, 25 aa, synthetic construct
  source 1..25: note = Seed: NSCVKLQTVHSIPLTINKEEALQRP
NSCVKLQTVHSIPFTITKYEAGQRP

SEQ ID NO: 39110 - protein, 25 aa, synthetic construct
  source 1..25: note = Seed: NSCVKLQTVHSIPLTINKEEALQRP
NSCVKLQTVHSIPFTITKYEAHQRP

SEQ ID NO: 39111 - protein, 25 aa, synthetic construct
  source 1..25: note = Seed: NSCVKLQTVHSIPLTINKEEALQRP
NSCVKLQTVHSIPFTITKYEAIQRP

SEQ ID NO: 39112 - protein, 25 aa, synthetic construct
  source 1..25: note = Seed: NSCVKLQTVHSIPLTINKEEALQRP
NSCVKLQTVHSIPFTITKYEALQRP

SEQ ID NO: 39113 - protein, 25 aa, synthetic construct
  source 1..25: note = Seed: NSCVKLQTVHSIPLTINKEEALQRP
NSCVKLQTVHSIPFTITKYEAMQRP

SEQ ID NO: 39114 - protein, 25 aa, synthetic construct
  source 1..25: note = Seed: NSCVKLQTVHSIPLTINKEEALQRP
NSCVKLQTVHSIPFTITKYEANQRP

SEQ ID NO: 39115 - protein, 25 aa, synthetic construct
  source 1..25: note = Seed: NSCVKLQTVHSIPLTINKEEALQRP
NSCVKLQTVHSIPFTITKYEAPQRP

SEQ ID NO: 39116 - protein, 25 aa, synthetic construct
  source 1..25: note = Seed: NSCVKLQTVHSIPLTINKEEALQRP
NSCVKLQTVHSIPFTITKYEAQQRP

SEQ ID NO: 39117 - protein, 25 aa, synthetic construct
  source 1..25: note = Seed: NSCVKLQTVHSIPLTINKEEALQRP
NSCVKLQTVHSIPFTITKYEASQRP

SEQ ID NO: 39118 - protein, 25 aa, synthetic construct
  source 1..25: note = Seed: NSCVKLQTVHSIPLTINKEEALQRP
NSCVKLQTVHSIPFTITKYEATQRP

SEQ ID NO: 39119 - protein, 25 aa, synthetic construct
  source 1..25: note = Seed: NSCVKLQTVHSIPLTINKEEALQRP
NSCVKLQTVHSIPFTITKYEAVQRP

SEQ ID NO: 39120 - protein, 25 aa, synthetic construct
  source 1..25: note = Seed: NSCVKLQTVHSIPLTINKEEALQRP
NSCVKLQTVHSIPFTITKYEAWQRP

SEQ ID NO: 39121 - protein, 25 aa, synthetic construct
  source 1..25: note = Seed: NSCVKLQTVHSIPLTINKEEALQRP
NSCVKLQTVHSIPFTITKYEAYQRP

SEQ ID NO: 39122 - protein, 25 aa, synthetic construct
  source 1..25: note = Seed: NSCVKLQTVHSIPLTINKEEALQRP
NSCVKLQTVHSIPFTIVKAEAFQRP

SEQ ID NO: 39123 - protein, 25 aa, synthetic construct
  source 1..25: note = Seed: NSCVKLQTVHSIPLTINKEEALQRP
NSCVKLQTVHSIPFTIVKAEAIQRP

SEQ ID NO: 39124 - protein, 25 aa, synthetic construct
  source 1..25: note = Seed: NSCVKLQTVHSIPLTINKEEALQRP
NSCVKLQTVHSIPFTIVKAEALQRP

SEQ ID NO: 39125 - protein, 25 aa, synthetic construct
  source 1..25: note = Seed: NSCVKLQTVHSIPLTINKEEALQRP
NSCVKLQTVHSIPFTIVKAEAVQRP

SEQ ID NO: 39126 - protein, 25 aa, synthetic construct
  source 1..25: note = Seed: NSCVKLQTVHSIPLTINKEEALQRP
NSCVKLQTVHSIPFTIVKFEAAQRP

SEQ ID NO: 39127 - protein, 25 aa, synthetic construct
  source 1..25: note = Seed: NSCVKLQTVHSIPLTINKEEALQRP
NSCVKLQTVHSIPFTIVKFEACQRP

SEQ ID NO: 39128 - protein, 25 aa, synthetic construct
  source 1..25: note = Seed: NSCVKLQTVHSIPLTINKEEALQRP
NSCVKLQTVHSIPFTIVKFEADQRP

SEQ ID NO: 39129 - protein, 25 aa, synthetic construct
  source 1..25: note = Seed: NSCVKLQTVHSIPLTINKEEALQRP
NSCVKLQTVHSIPFTIVKFEAEQRP

SEQ ID NO: 39130 - protein, 25 aa, synthetic construct
  source 1..25: note = Seed: NSCVKLQTVHSIPLTINKEEALQRP
NSCVKLQTVHSIPFTIVKFEAFQRP

SEQ ID NO: 39131 - protein, 25 aa, synthetic construct
  source 1..25: note = Seed: NSCVKLQTVHSIPLTINKEEALQRP
NSCVKLQTVHSIPFTIVKFEAGQRP

SEQ ID NO: 39132 - protein, 25 aa, synthetic construct
  source 1..25: note = Seed: NSCVKLQTVHSIPLTINKEEALQRP
NSCVKLQTVHSIPFTIVKFEAHQRP

SEQ ID NO: 39133 - protein, 25 aa, synthetic construct
  source 1..25: note = Seed: NSCVKLQTVHSIPLTINKEEALQRP
NSCVKLQTVHSIPFTIVKFEAIQRP

SEQ ID NO: 39134 - protein, 25 aa, synthetic construct
  source 1..25: note = Seed: NSCVKLQTVHSIPLTINKEEALQRP
NSCVKLQTVHSIPFTIVKFEAKQRP

SEQ ID NO: 39135 - protein, 25 aa, synthetic construct
  source 1..25: note = Seed: NSCVKLQTVHSIPLTINKEEALQRP
NSCVKLQTVHSIPFTIVKFEALQRP

SEQ ID NO: 39136 - protein, 25 aa, synthetic construct
  source 1..25: note = Seed: NSCVKLQTVHSIPLTINKEEALQRP
NSCVKLQTVHSIPFTIVKFEAMQRP

SEQ ID NO: 39137 - protein, 25 aa, synthetic construct
  source 1..25: note = Seed: NSCVKLQTVHSIPLTINKEEALQRP
NSCVKLQTVHSIPFTIVKFEANQRP

SEQ ID NO: 39138 - protein, 25 aa, synthetic construct
  source 1..25: note = Seed: NSCVKLQTVHSIPLTINKEEALQRP
NSCVKLQTVHSIPFTIVKFEAPQRP

SEQ ID NO: 39139 - protein, 25 aa, synthetic construct
  source 1..25: note = Seed: NSCVKLQTVHSIPLTINKEEALQRP
NSCVKLQTVHSIPFTIVKFEAQQRP

SEQ ID NO: 39140 - protein, 25 aa, synthetic construct
  source 1..25: note = Seed: NSCVKLQTVHSIPLTINKEEALQRP
NSCVKLQTVHSIPFTIVKFEARQRP

SEQ ID NO: 39141 - protein, 25 aa, synthetic construct
  source 1..25: note = Seed: NSCVKLQTVHSIPLTINKEEALQRP
NSCVKLQTVHSIPFTIVKFEASQRP

SEQ ID NO: 39142 - protein, 25 aa, synthetic construct
  source 1..25: note = Seed: NSCVKLQTVHSIPLTINKEEALQRP
NSCVKLQTVHSIPFTIVKFEATQRP

SEQ ID NO: 39143 - protein, 25 aa, synthetic construct
  source 1..25: note = Seed: NSCVKLQTVHSIPLTINKEEALQRP
NSCVKLQTVHSIPFTIVKFEAVQRP

SEQ ID NO: 39144 - protein, 25 aa, synthetic construct
  source 1..25: note = Seed: NSCVKLQTVHSIPLTINKEEALQRP
NSCVKLQTVHSIPFTIVKFEAYQRP

SEQ ID NO: 39145 - protein, 25 aa, synthetic construct
  source 1..25: note = Seed: NSCVKLQTVHSIPLTINKEEALQRP
NSCVKLQTVHSIPFTIVKIEAAQRP

SEQ ID NO: 39146 - protein, 25 aa, synthetic construct
  source 1..25: note = Seed: NSCVKLQTVHSIPLTINKEEALQRP
NSCVKLQTVHSIPFTIVKIEADQRP

SEQ ID NO: 39147 - protein, 25 aa, synthetic construct
  source 1..25: note = Seed: NSCVKLQTVHSIPLTINKEEALQRP
NSCVKLQTVHSIPFTIVKIEAEQRP

SEQ ID NO: 39148 - protein, 25 aa, synthetic construct
  source 1..25: note = Seed: NSCVKLQTVHSIPLTINKEEALQRP
NSCVKLQTVHSIPFTIVKIEAFQRP

SEQ ID NO: 39149 - protein, 25 aa, synthetic construct
  source 1..25: note = Seed: NSCVKLQTVHSIPLTINKEEALQRP
NSCVKLQTVHSIPFTIVKIEAIQRP

SEQ ID NO: 39150 - protein, 25 aa, synthetic construct
  source 1..25: note = Seed: NSCVKLQTVHSIPLTINKEEALQRP
NSCVKLQTVHSIPFTIVKIEALQRP

SEQ ID NO: 39151 - protein, 25 aa, synthetic construct
  source 1..25: note = Seed: NSCVKLQTVHSIPLTINKEEALQRP
NSCVKLQTVHSIPFTIVKIEAMQRP

SEQ ID NO: 39152 - protein, 25 aa, synthetic construct
  source 1..25: note = Seed: NSCVKLQTVHSIPLTINKEEALQRP
NSCVKLQTVHSIPFTIVKIEANQRP

SEQ ID NO: 39153 - protein, 25 aa, synthetic construct
  source 1..25: note = Seed: NSCVKLQTVHSIPLTINKEEALQRP
NSCVKLQTVHSIPFTIVKIEASQRP

SEQ ID NO: 39154 - protein, 25 aa, synthetic construct
  source 1..25: note = Seed: NSCVKLQTVHSIPLTINKEEALQRP
NSCVKLQTVHSIPFTIVKIEATQRP

SEQ ID NO: 39155 - protein, 25 aa, synthetic construct
  source 1..25: note = Seed: NSCVKLQTVHSIPLTINKEEALQRP
NSCVKLQTVHSIPFTIVKIEAVQRP

SEQ ID NO: 39156 - protein, 25 aa, synthetic construct
  source 1..25: note = Seed: NSCVKLQTVHSIPLTINKEEALQRP
NSCVKLQTVHSIPFTIVKIEAYQRP

SEQ ID NO: 39157 - protein, 25 aa, synthetic construct
  source 1..25: note = Seed: NSCVKLQTVHSIPLTINKEEALQRP
NSCVKLQTVHSIPFTIVKLEAAQRP

SEQ ID NO: 39158 - protein, 25 aa, synthetic construct
  source 1..25: note = Seed: NSCVKLQTVHSIPLTINKEEALQRP
NSCVKLQTVHSIPFTIVKLEADQRP

SEQ ID NO: 39159 - protein, 25 aa, synthetic construct
  source 1..25: note = Seed: NSCVKLQTVHSIPLTINKEEALQRP
NSCVKLQTVHSIPFTIVKLEAEQRP

SEQ ID NO: 39160 - protein, 25 aa, synthetic construct
  source 1..25: note = Seed: NSCVKLQTVHSIPLTINKEEALQRP
NSCVKLQTVHSIPFTIVKLEAFQRP

SEQ ID NO: 39161 - protein, 25 aa, synthetic construct
  source 1..25: note = Seed: NSCVKLQTVHSIPLTINKEEALQRP
NSCVKLQTVHSIPFTIVKLEAIQRP

SEQ ID NO: 39162 - protein, 25 aa, synthetic construct
  source 1..25: note = Seed: NSCVKLQTVHSIPLTINKEEALQRP
NSCVKLQTVHSIPFTIVKLEALQRP

SEQ ID NO: 39163 - protein, 25 aa, synthetic construct
  source 1..25: note = Seed: NSCVKLQTVHSIPLTINKEEALQRP
NSCVKLQTVHSIPFTIVKLEAMQRP

SEQ ID NO: 39164 - protein, 25 aa, synthetic construct
  source 1..25: note = Seed: NSCVKLQTVHSIPLTINKEEALQRP
NSCVKLQTVHSIPFTIVKLEANQRP

SEQ ID NO: 39165 - protein, 25 aa, synthetic construct
  source 1..25: note = Seed: NSCVKLQTVHSIPLTINKEEALQRP
NSCVKLQTVHSIPFTIVKLEASQRP

SEQ ID NO: 39166 - protein, 25 aa, synthetic construct
  source 1..25: note = Seed: NSCVKLQTVHSIPLTINKEEALQRP
NSCVKLQTVHSIPFTIVKLEATQRP

SEQ ID NO: 39167 - protein, 25 aa, synthetic construct
  source 1..25: note = Seed: NSCVKLQTVHSIPLTINKEEALQRP
NSCVKLQTVHSIPFTIVKLEAVQRP

SEQ ID NO: 39168 - protein, 25 aa, synthetic construct
  source 1..25: note = Seed: NSCVKLQTVHSIPLTINKEEALQRP
NSCVKLQTVHSIPFTIVKLEAYQRP

SEQ ID NO: 39169 - protein, 25 aa, synthetic construct
  source 1..25: note = Seed: NSCVKLQTVHSIPLTINKEEALQRP
NSCVKLQTVHSIPFTIVKMEADQRP

SEQ ID NO: 39170 - protein, 25 aa, synthetic construct
  source 1..25: note = Seed: NSCVKLQTVHSIPLTINKEEALQRP
NSCVKLQTVHSIPFTIVKMEAIQRP

SEQ ID NO: 39171 - protein, 25 aa, synthetic construct
  source 1..25: note = Seed: NSCVKLQTVHSIPLTINKEEALQRP
NSCVKLQTVHSIPFTIVKMEALQRP

SEQ ID NO: 39172 - protein, 25 aa, synthetic construct
  source 1..25: note = Seed: NSCVKLQTVHSIPLTINKEEALQRP
NSCVKLQTVHSIPFTIVKMEAMQRP

SEQ ID NO: 39173 - protein, 25 aa, synthetic construct
  source 1..25: note = Seed: NSCVKLQTVHSIPLTINKEEALQRP
NSCVKLQTVHSIPFTIVKMEAVQRP

SEQ ID NO: 39174 - protein, 25 aa, synthetic construct
  source 1..25: note = Seed: NSCVKLQTVHSIPLTINKEEALQRP
NSCVKLQTVHSIPFTIVKNEAAQRP

SEQ ID NO: 39175 - protein, 25 aa, synthetic construct
  source 1..25: note = Seed: NSCVKLQTVHSIPLTINKEEALQRP
NSCVKLQTVHSIPFTIVKNEADQRP

SEQ ID NO: 39176 - protein, 25 aa, synthetic construct
  source 1..25: note = Seed: NSCVKLQTVHSIPLTINKEEALQRP
NSCVKLQTVHSIPFTIVKNEAEQRP

SEQ ID NO: 39177 - protein, 25 aa, synthetic construct
  source 1..25: note = Seed: NSCVKLQTVHSIPLTINKEEALQRP
NSCVKLQTVHSIPFTIVKNEAGQRP

SEQ ID NO: 39178 - protein, 25 aa, synthetic construct
  source 1..25: note = Seed: NSCVKLQTVHSIPLTINKEEALQRP
NSCVKLQTVHSIPFTIVKNEAIQRP

SEQ ID NO: 39179 - protein, 25 aa, synthetic construct
  source 1..25: note = Seed: NSCVKLQTVHSIPLTINKEEALQRP
NSCVKLQTVHSIPFTIVKNEALQRP

SEQ ID NO: 39180 - protein, 25 aa, synthetic construct
  source 1..25: note = Seed: NSCVKLQTVHSIPLTINKEEALQRP
NSCVKLQTVHSIPFTIVKNEASQRP

SEQ ID NO: 39181 - protein, 25 aa, synthetic construct
  source 1..25: note = Seed: NSCVKLQTVHSIPLTINKEEALQRP
NSCVKLQTVHSIPFTIVKNEATQRP

SEQ ID NO: 39182 - protein, 25 aa, synthetic construct
  source 1..25: note = Seed: NSCVKLQTVHSIPLTINKEEALQRP
NSCVKLQTVHSIPFTIVKNEAVQRP

SEQ ID NO: 39183 - protein, 25 aa, synthetic construct
  source 1..25: note = Seed: NSCVKLQTVHSIPLTINKEEALQRP
NSCVKLQTVHSIPFTIVKREARQRP

SEQ ID NO: 39184 - protein, 25 aa, synthetic construct
  source 1..25: note = Seed: NSCVKLQTVHSIPLTINKEEALQRP
NSCVKLQTVHSIPFTIVKREAYQRP

SEQ ID NO: 39185 - protein, 25 aa, synthetic construct
  source 1..25: note = Seed: NSCVKLQTVHSIPLTINKEEALQRP
NSCVKLQTVHSIPFTIVKSEAAQRP

SEQ ID NO: 39186 - protein, 25 aa, synthetic construct
  source 1..25: note = Seed: NSCVKLQTVHSIPLTINKEEALQRP
NSCVKLQTVHSIPFTIVKSEADQRP

SEQ ID NO: 39187 - protein, 25 aa, synthetic construct
  source 1..25: note = Seed: NSCVKLQTVHSIPLTINKEEALQRP
NSCVKLQTVHSIPFTIVKSEAEQRP

SEQ ID NO: 39188 - protein, 25 aa, synthetic construct
  source 1..25: note = Seed: NSCVKLQTVHSIPLTINKEEALQRP
NSCVKLQTVHSIPFTIVKSEASQRP

SEQ ID NO: 39189 - protein, 25 aa, synthetic construct
  source 1..25: note = Seed: NSCVKLQTVHSIPLTINKEEALQRP
NSCVKLQTVHSIPFTIVKTEAAQRP

SEQ ID NO: 39190 - protein, 25 aa, synthetic construct
  source 1..25: note = Seed: NSCVKLQTVHSIPLTINKEEALQRP
NSCVKLQTVHSIPFTIVKTEADQRP

SEQ ID NO: 39191 - protein, 25 aa, synthetic construct
  source 1..25: note = Seed: NSCVKLQTVHSIPLTINKEEALQRP
NSCVKLQTVHSIPFTIVKTEAEQRP

SEQ ID NO: 39192 - protein, 25 aa, synthetic construct
  source 1..25: note = Seed: NSCVKLQTVHSIPLTINKEEALQRP
NSCVKLQTVHSIPFTIVKTEASQRP

SEQ ID NO: 39193 - protein, 25 aa, synthetic construct
  source 1..25: note = Seed: NSCVKLQTVHSIPLTINKEEALQRP
NSCVKLQTVHSIPFTIVKTEATQRP

SEQ ID NO: 39194 - protein, 25 aa, synthetic construct
  source 1..25: note = Seed: NSCVKLQTVHSIPLTINKEEALQRP
NSCVKLQTVHSIPFTIVKVEADQRP

SEQ ID NO: 39195 - protein, 25 aa, synthetic construct
  source 1..25: note = Seed: NSCVKLQTVHSIPLTINKEEALQRP
NSCVKLQTVHSIPFTIVKVEAFQRP

SEQ ID NO: 39196 - protein, 25 aa, synthetic construct
  source 1..25: note = Seed: NSCVKLQTVHSIPLTINKEEALQRP
NSCVKLQTVHSIPFTIVKVEAIQRP

SEQ ID NO: 39197 - protein, 25 aa, synthetic construct
  source 1..25: note = Seed: NSCVKLQTVHSIPLTINKEEALQRP
NSCVKLQTVHSIPFTIVKVEALQRP

SEQ ID NO: 39198 - protein, 25 aa, synthetic construct
  source 1..25: note = Seed: NSCVKLQTVHSIPLTINKEEALQRP
NSCVKLQTVHSIPFTIVKVEAMQRP

SEQ ID NO: 39199 - protein, 25 aa, synthetic construct
  source 1..25: note = Seed: NSCVKLQTVHSIPLTINKEEALQRP
NSCVKLQTVHSIPFTIVKVEAVQRP

SEQ ID NO: 39200 - protein, 25 aa, synthetic construct
  source 1..25: note = Seed: NSCVKLQTVHSIPLTINKEEALQRP
NSCVKLQTVHSIPFTIVKWEAAQRP

SEQ ID NO: 39201 - protein, 25 aa, synthetic construct
  source 1..25: note = Seed: NSCVKLQTVHSIPLTINKEEALQRP
NSCVKLQTVHSIPFTIVKWEADQRP

SEQ ID NO: 39202 - protein, 25 aa, synthetic construct
  source 1..25: note = Seed: NSCVKLQTVHSIPLTINKEEALQRP
NSCVKLQTVHSIPFTIVKWEAEQRP

SEQ ID NO: 39203 - protein, 25 aa, synthetic construct
  source 1..25: note = Seed: NSCVKLQTVHSIPLTINKEEALQRP
NSCVKLQTVHSIPFTIVKWEAFQRP

SEQ ID NO: 39204 - protein, 25 aa, synthetic construct
  source 1..25: note = Seed: NSCVKLQTVHSIPLTINKEEALQRP
NSCVKLQTVHSIPFTIVKWEAGQRP

SEQ ID NO: 39205 - protein, 25 aa, synthetic construct
  source 1..25: note = Seed: NSCVKLQTVHSIPLTINKEEALQRP
NSCVKLQTVHSIPFTIVKWEAIQRP

SEQ ID NO: 39206 - protein, 25 aa, synthetic construct
  source 1..25: note = Seed: NSCVKLQTVHSIPLTINKEEALQRP
NSCVKLQTVHSIPFTIVKWEALQRP

SEQ ID NO: 39207 - protein, 25 aa, synthetic construct
  source 1..25: note = Seed: NSCVKLQTVHSIPLTINKEEALQRP
NSCVKLQTVHSIPFTIVKWEAMQRP

SEQ ID NO: 39208 - protein, 25 aa, synthetic construct
  source 1..25: note = Seed: NSCVKLQTVHSIPLTINKEEALQRP
NSCVKLQTVHSIPFTIVKWEANQRP

SEQ ID NO: 39209 - protein, 25 aa, synthetic construct
  source 1..25: note = Seed: NSCVKLQTVHSIPLTINKEEALQRP
NSCVKLQTVHSIPFTIVKWEAQQRP

SEQ ID NO: 39210 - protein, 25 aa, synthetic construct
  source 1..25: note = Seed: NSCVKLQTVHSIPLTINKEEALQRP
NSCVKLQTVHSIPFTIVKWEASQRP

SEQ ID NO: 39211 - protein, 25 aa, synthetic construct
  source 1..25: note = Seed: NSCVKLQTVHSIPLTINKEEALQRP
NSCVKLQTVHSIPFTIVKWEATQRP

SEQ ID NO: 39212 - protein, 25 aa, synthetic construct
  source 1..25: note = Seed: NSCVKLQTVHSIPLTINKEEALQRP
NSCVKLQTVHSIPFTIVKWEAVQRP

SEQ ID NO: 39213 - protein, 25 aa, synthetic construct
  source 1..25: note = Seed: NSCVKLQTVHSIPLTINKEEALQRP
NSCVKLQTVHSIPFTIVKYEAAQRP

SEQ ID NO: 39214 - protein, 25 aa, synthetic construct
  source 1..25: note = Seed: NSCVKLQTVHSIPLTINKEEALQRP
NSCVKLQTVHSIPFTIVKYEACQRP

SEQ ID NO: 39215 - protein, 25 aa, synthetic construct
  source 1..25: note = Seed: NSCVKLQTVHSIPLTINKEEALQRP
NSCVKLQTVHSIPFTIVKYEADQRP

SEQ ID NO: 39216 - protein, 25 aa, synthetic construct
  source 1..25: note = Seed: NSCVKLQTVHSIPLTINKEEALQRP
NSCVKLQTVHSIPFTIVKYEAEQRP

SEQ ID NO: 39217 - protein, 25 aa, synthetic construct
  source 1..25: note = Seed: NSCVKLQTVHSIPLTINKEEALQRP
NSCVKLQTVHSIPFTIVKYEAFQRP

SEQ ID NO: 39218 - protein, 25 aa, synthetic construct
  source 1..25: note = Seed: NSCVKLQTVHSIPLTINKEEALQRP
NSCVKLQTVHSIPFTIVKYEAGQRP

SEQ ID NO: 39219 - protein, 25 aa, synthetic construct
  source 1..25: note = Seed: NSCVKLQTVHSIPLTINKEEALQRP
NSCVKLQTVHSIPFTIVKYEAHQRP

SEQ ID NO: 39220 - protein, 25 aa, synthetic construct
  source 1..25: note = Seed: NSCVKLQTVHSIPLTINKEEALQRP
NSCVKLQTVHSIPFTIVKYEAIQRP

SEQ ID NO: 39221 - protein, 25 aa, synthetic construct
  source 1..25: note = Seed: NSCVKLQTVHSIPLTINKEEALQRP
NSCVKLQTVHSIPFTIVKYEALQRP

SEQ ID NO: 39222 - protein, 25 aa, synthetic construct
  source 1..25: note = Seed: NSCVKLQTVHSIPLTINKEEALQRP
NSCVKLQTVHSIPFTIVKYEAMQRP

SEQ ID NO: 39223 - protein, 25 aa, synthetic construct
  source 1..25: note = Seed: NSCVKLQTVHSIPLTINKEEALQRP
NSCVKLQTVHSIPFTIVKYEANQRP

SEQ ID NO: 39224 - protein, 25 aa, synthetic construct
  source 1..25: note = Seed: NSCVKLQTVHSIPLTINKEEALQRP
NSCVKLQTVHSIPFTIVKYEAQQRP

SEQ ID NO: 39225 - protein, 25 aa, synthetic construct
  source 1..25: note = Seed: NSCVKLQTVHSIPLTINKEEALQRP
NSCVKLQTVHSIPFTIVKYEASQRP

SEQ ID NO: 39226 - protein, 25 aa, synthetic construct
  source 1..25: note = Seed: NSCVKLQTVHSIPLTINKEEALQRP
NSCVKLQTVHSIPFTIVKYEATQRP

SEQ ID NO: 39227 - protein, 25 aa, synthetic construct
  source 1..25: note = Seed: NSCVKLQTVHSIPLTINKEEALQRP
NSCVKLQTVHSIPFTIVKYEAVQRP

SEQ ID NO: 39228 - protein, 25 aa, synthetic construct
  source 1..25: note = Seed: NSCVKLQTVHSIPLTINKEEALQRP
NSCVKLQTVHSIPFTIVKYEAYQRP

SEQ ID NO: 39229 - protein, 25 aa, synthetic construct
  source 1..25: note = Seed: NSCVKLQTVHSIPLTINKEEALQRP
NSCVKLQTVHSIPFTIWKAEAAQRP

SEQ ID NO: 39230 - protein, 25 aa, synthetic construct
  source 1..25: note = Seed: NSCVKLQTVHSIPLTINKEEALQRP
NSCVKLQTVHSIPFTIWKAEAFQRP

SEQ ID NO: 39231 - protein, 25 aa, synthetic construct
  source 1..25: note = Seed: NSCVKLQTVHSIPLTINKEEALQRP
NSCVKLQTVHSIPFTIWKAEAIQRP

SEQ ID NO: 39232 - protein, 25 aa, synthetic construct
  source 1..25: note = Seed: NSCVKLQTVHSIPLTINKEEALQRP
NSCVKLQTVHSIPFTIWKAEALQRP

SEQ ID NO: 39233 - protein, 25 aa, synthetic construct
  source 1..25: note = Seed: NSCVKLQTVHSIPLTINKEEALQRP
NSCVKLQTVHSIPFTIWKAEAMQRP

SEQ ID NO: 39234 - protein, 25 aa, synthetic construct
  source 1..25: note = Seed: NSCVKLQTVHSIPLTINKEEALQRP
NSCVKLQTVHSIPFTIWKAEAVQRP

SEQ ID NO: 39235 - protein, 25 aa, synthetic construct
  source 1..25: note = Seed: NSCVKLQTVHSIPLTINKEEALQRP
NSCVKLQTVHSIPFTIWKDEAAQRP

SEQ ID NO: 39236 - protein, 25 aa, synthetic construct
  source 1..25: note = Seed: NSCVKLQTVHSIPLTINKEEALQRP
NSCVKLQTVHSIPFTIWKDEAFQRP

SEQ ID NO: 39237 - protein, 25 aa, synthetic construct
  source 1..25: note = Seed: NSCVKLQTVHSIPLTINKEEALQRP
NSCVKLQTVHSIPFTIWKDEAIQRP

SEQ ID NO: 39238 - protein, 25 aa, synthetic construct
  source 1..25: note = Seed: NSCVKLQTVHSIPLTINKEEALQRP
NSCVKLQTVHSIPFTIWKDEALQRP

SEQ ID NO: 39239 - protein, 25 aa, synthetic construct
  source 1..25: note = Seed: NSCVKLQTVHSIPLTINKEEALQRP
NSCVKLQTVHSIPFTIWKDEAMQRP

SEQ ID NO: 39240 - protein, 25 aa, synthetic construct
  source 1..25: note = Seed: NSCVKLQTVHSIPLTINKEEALQRP
NSCVKLQTVHSIPFTIWKDEAVQRP

SEQ ID NO: 39241 - protein, 25 aa, synthetic construct
  source 1..25: note = Seed: NSCVKLQTVHSIPLTINKEEALQRP
NSCVKLQTVHSIPFTIWKFEAAQRP

SEQ ID NO: 39242 - protein, 25 aa, synthetic construct
  source 1..25: note = Seed: NSCVKLQTVHSIPLTINKEEALQRP
NSCVKLQTVHSIPFTIWKFEACQRP

SEQ ID NO: 39243 - protein, 25 aa, synthetic construct
  source 1..25: note = Seed: NSCVKLQTVHSIPLTINKEEALQRP
NSCVKLQTVHSIPFTIWKFEADQRP

SEQ ID NO: 39244 - protein, 25 aa, synthetic construct
  source 1..25: note = Seed: NSCVKLQTVHSIPLTINKEEALQRP
NSCVKLQTVHSIPFTIWKFEAEQRP

SEQ ID NO: 39245 - protein, 25 aa, synthetic construct
  source 1..25: note = Seed: NSCVKLQTVHSIPLTINKEEALQRP
NSCVKLQTVHSIPFTIWKFEAFQRP

SEQ ID NO: 39246 - protein, 25 aa, synthetic construct
  source 1..25: note = Seed: NSCVKLQTVHSIPLTINKEEALQRP
NSCVKLQTVHSIPFTIWKFEAHQRP

SEQ ID NO: 39247 - protein, 25 aa, synthetic construct
  source 1..25: note = Seed: NSCVKLQTVHSIPLTINKEEALQRP
NSCVKLQTVHSIPFTIWKFEAIQRP

SEQ ID NO: 39248 - protein, 25 aa, synthetic construct
  source 1..25: note = Seed: NSCVKLQTVHSIPLTINKEEALQRP
NSCVKLQTVHSIPFTIWKFEAKQRP

SEQ ID NO: 39249 - protein, 25 aa, synthetic construct
  source 1..25: note = Seed: NSCVKLQTVHSIPLTINKEEALQRP
NSCVKLQTVHSIPFTIWKFEALQRP

SEQ ID NO: 39250 - protein, 25 aa, synthetic construct
  source 1..25: note = Seed: NSCVKLQTVHSIPLTINKEEALQRP
NSCVKLQTVHSIPFTIWKFEAMQRP

SEQ ID NO: 39251 - protein, 25 aa, synthetic construct
  source 1..25: note = Seed: NSCVKLQTVHSIPLTINKEEALQRP
NSCVKLQTVHSIPFTIWKFEANQRP

SEQ ID NO: 39252 - protein, 25 aa, synthetic construct
  source 1..25: note = Seed: NSCVKLQTVHSIPLTINKEEALQRP
NSCVKLQTVHSIPFTIWKFEAPQRP

SEQ ID NO: 39253 - protein, 25 aa, synthetic construct
  source 1..25: note = Seed: NSCVKLQTVHSIPLTINKEEALQRP
NSCVKLQTVHSIPFTIWKFEAQQRP

SEQ ID NO: 39254 - protein, 25 aa, synthetic construct
  source 1..25: note = Seed: NSCVKLQTVHSIPLTINKEEALQRP
NSCVKLQTVHSIPFTIWKFEARQRP

SEQ ID NO: 39255 - protein, 25 aa, synthetic construct
  source 1..25: note = Seed: NSCVKLQTVHSIPLTINKEEALQRP
NSCVKLQTVHSIPFTIWKFEASQRP

SEQ ID NO: 39256 - protein, 25 aa, synthetic construct
  source 1..25: note = Seed: NSCVKLQTVHSIPLTINKEEALQRP
NSCVKLQTVHSIPFTIWKFEATQRP

SEQ ID NO: 39257 - protein, 25 aa, synthetic construct
  source 1..25: note = Seed: NSCVKLQTVHSIPLTINKEEALQRP
NSCVKLQTVHSIPFTIWKFEAVQRP

SEQ ID NO: 39258 - protein, 25 aa, synthetic construct
  source 1..25: note = Seed: NSCVKLQTVHSIPLTINKEEALQRP
NSCVKLQTVHSIPFTIWKFEAWQRP

SEQ ID NO: 39259 - protein, 25 aa, synthetic construct
  source 1..25: note = Seed: NSCVKLQTVHSIPLTINKEEALQRP
NSCVKLQTVHSIPFTIWKFEAYQRP

SEQ ID NO: 39260 - protein, 25 aa, synthetic construct
  source 1..25: note = Seed: NSCVKLQTVHSIPLTINKEEALQRP
NSCVKLQTVHSIPFTIWKIEAAQRP

SEQ ID NO: 39261 - protein, 25 aa, synthetic construct
  source 1..25: note = Seed: NSCVKLQTVHSIPLTINKEEALQRP
NSCVKLQTVHSIPFTIWKIEAFQRP

SEQ ID NO: 39262 - protein, 25 aa, synthetic construct
  source 1..25: note = Seed: NSCVKLQTVHSIPLTINKEEALQRP
NSCVKLQTVHSIPFTIWKIEAIQRP

SEQ ID NO: 39263 - protein, 25 aa, synthetic construct
  source 1..25: note = Seed: NSCVKLQTVHSIPLTINKEEALQRP
NSCVKLQTVHSIPFTIWKIEALQRP

SEQ ID NO: 39264 - protein, 25 aa, synthetic construct
  source 1..25: note = Seed: NSCVKLQTVHSIPLTINKEEALQRP
NSCVKLQTVHSIPFTIWKIEAMQRP

SEQ ID NO: 39265 - protein, 25 aa, synthetic construct
  source 1..25: note = Seed: NSCVKLQTVHSIPLTINKEEALQRP
NSCVKLQTVHSIPFTIWKIEASQRP

SEQ ID NO: 39266 - protein, 25 aa, synthetic construct
  source 1..25: note = Seed: NSCVKLQTVHSIPLTINKEEALQRP
NSCVKLQTVHSIPFTIWKIEAVQRP

SEQ ID NO: 39267 - protein, 25 aa, synthetic construct
  source 1..25: note = Seed: NSCVKLQTVHSIPLTINKEEALQRP
NSCVKLQTVHSIPFTIWKIEAYQRP

SEQ ID NO: 39268 - protein, 25 aa, synthetic construct
  source 1..25: note = Seed: NSCVKLQTVHSIPLTINKEEALQRP
NSCVKLQTVHSIPFTIWKLEAAQRP

SEQ ID NO: 39269 - protein, 25 aa, synthetic construct
  source 1..25: note = Seed: NSCVKLQTVHSIPLTINKEEALQRP
NSCVKLQTVHSIPFTIWKLEAFQRP

SEQ ID NO: 39270 - protein, 25 aa, synthetic construct
  source 1..25: note = Seed: NSCVKLQTVHSIPLTINKEEALQRP
NSCVKLQTVHSIPFTIWKLEAIQRP

SEQ ID NO: 39271 - protein, 25 aa, synthetic construct
  source 1..25: note = Seed: NSCVKLQTVHSIPLTINKEEALQRP
NSCVKLQTVHSIPFTIWKLEALQRP

SEQ ID NO: 39272 - protein, 25 aa, synthetic construct
  source 1..25: note = Seed: NSCVKLQTVHSIPLTINKEEALQRP
NSCVKLQTVHSIPFTIWKLEAMQRP

SEQ ID NO: 39273 - protein, 25 aa, synthetic construct
  source 1..25: note = Seed: NSCVKLQTVHSIPLTINKEEALQRP
NSCVKLQTVHSIPFTIWKLEARQRP

SEQ ID NO: 39274 - protein, 25 aa, synthetic construct
  source 1..25: note = Seed: NSCVKLQTVHSIPLTINKEEALQRP
NSCVKLQTVHSIPFTIWKLEATQRP

SEQ ID NO: 39275 - protein, 25 aa, synthetic construct
  source 1..25: note = Seed: NSCVKLQTVHSIPLTINKEEALQRP
NSCVKLQTVHSIPFTIWKLEAVQRP

SEQ ID NO: 39276 - protein, 25 aa, synthetic construct
  source 1..25: note = Seed: NSCVKLQTVHSIPLTINKEEALQRP
NSCVKLQTVHSIPFTIWKLEAYQRP

SEQ ID NO: 39277 - protein, 25 aa, synthetic construct
  source 1..25: note = Seed: NSCVKLQTVHSIPLTINKEEALQRP
NSCVKLQTVHSIPFTIWKMEAAQRP

SEQ ID NO: 39278 - protein, 25 aa, synthetic construct
  source 1..25: note = Seed: NSCVKLQTVHSIPLTINKEEALQRP
NSCVKLQTVHSIPFTIWKMEAFQRP

SEQ ID NO: 39279 - protein, 25 aa, synthetic construct
  source 1..25: note = Seed: NSCVKLQTVHSIPLTINKEEALQRP
NSCVKLQTVHSIPFTIWKMEAIQRP

SEQ ID NO: 39280 - protein, 25 aa, synthetic construct
  source 1..25: note = Seed: NSCVKLQTVHSIPLTINKEEALQRP
NSCVKLQTVHSIPFTIWKMEALQRP

SEQ ID NO: 39281 - protein, 25 aa, synthetic construct
  source 1..25: note = Seed: NSCVKLQTVHSIPLTINKEEALQRP
NSCVKLQTVHSIPFTIWKMEAMQRP

SEQ ID NO: 39282 - protein, 25 aa, synthetic construct
  source 1..25: note = Seed: NSCVKLQTVHSIPLTINKEEALQRP
NSCVKLQTVHSIPFTIWKMEAVQRP

SEQ ID NO: 39283 - protein, 25 aa, synthetic construct
  source 1..25: note = Seed: NSCVKLQTVHSIPLTINKEEALQRP
NSCVKLQTVHSIPFTIWKMEAYQRP

SEQ ID NO: 39284 - protein, 25 aa, synthetic construct
  source 1..25: note = Seed: NSCVKLQTVHSIPLTINKEEALQRP
NSCVKLQTVHSIPFTIWKNEAIQRP

SEQ ID NO: 39285 - protein, 25 aa, synthetic construct
  source 1..25: note = Seed: NSCVKLQTVHSIPLTINKEEALQRP
NSCVKLQTVHSIPFTIWKNEALQRP

SEQ ID NO: 39286 - protein, 25 aa, synthetic construct
  source 1..25: note = Seed: NSCVKLQTVHSIPLTINKEEALQRP
NSCVKLQTVHSIPFTIWKNEAVQRP

SEQ ID NO: 39287 - protein, 25 aa, synthetic construct
  source 1..25: note = Seed: NSCVKLQTVHSIPLTINKEEALQRP
NSCVKLQTVHSIPFTIWKREAYQRP

SEQ ID NO: 39288 - protein, 25 aa, synthetic construct
  source 1..25: note = Seed: NSCVKLQTVHSIPLTINKEEALQRP
NSCVKLQTVHSIPFTIWKSEAIQRP

SEQ ID NO: 39289 - protein, 25 aa, synthetic construct
  source 1..25: note = Seed: NSCVKLQTVHSIPLTINKEEALQRP
NSCVKLQTVHSIPFTIWKSEAVQRP

SEQ ID NO: 39290 - protein, 25 aa, synthetic construct
  source 1..25: note = Seed: NSCVKLQTVHSIPLTINKEEALQRP
NSCVKLQTVHSIPFTIWKVEAAQRP

SEQ ID NO: 39291 - protein, 25 aa, synthetic construct
  source 1..25: note = Seed: NSCVKLQTVHSIPLTINKEEALQRP
NSCVKLQTVHSIPFTIWKVEAFQRP

SEQ ID NO: 39292 - protein, 25 aa, synthetic construct
  source 1..25: note = Seed: NSCVKLQTVHSIPLTINKEEALQRP
NSCVKLQTVHSIPFTIWKVEAIQRP

SEQ ID NO: 39293 - protein, 25 aa, synthetic construct
  source 1..25: note = Seed: NSCVKLQTVHSIPLTINKEEALQRP
NSCVKLQTVHSIPFTIWKVEALQRP

SEQ ID NO: 39294 - protein, 25 aa, synthetic construct
  source 1..25: note = Seed: NSCVKLQTVHSIPLTINKEEALQRP
NSCVKLQTVHSIPFTIWKVEAMQRP

SEQ ID NO: 39295 - protein, 25 aa, synthetic construct
  source 1..25: note = Seed: NSCVKLQTVHSIPLTINKEEALQRP
NSCVKLQTVHSIPFTIWKVEAVQRP

SEQ ID NO: 39296 - protein, 25 aa, synthetic construct
  source 1..25: note = Seed: NSCVKLQTVHSIPLTINKEEALQRP
NSCVKLQTVHSIPFTIWKVEAYQRP

SEQ ID NO: 39297 - protein, 25 aa, synthetic construct
  source 1..25: note = Seed: NSCVKLQTVHSIPLTINKEEALQRP
NSCVKLQTVHSIPFTIWKWEAFQRP

SEQ ID NO: 39298 - protein, 25 aa, synthetic construct
  source 1..25: note = Seed: NSCVKLQTVHSIPLTINKEEALQRP
NSCVKLQTVHSIPFTIWKWEAIQRP

SEQ ID NO: 39299 - protein, 25 aa, synthetic construct
  source 1..25: note = Seed: NSCVKLQTVHSIPLTINKEEALQRP
NSCVKLQTVHSIPFTIWKWEALQRP

SEQ ID NO: 39300 - protein, 25 aa, synthetic construct
  source 1..25: note = Seed: NSCVKLQTVHSIPLTINKEEALQRP
NSCVKLQTVHSIPFTIWKWEAMQRP

SEQ ID NO: 39301 - protein, 25 aa, synthetic construct
  source 1..25: note = Seed: NSCVKLQTVHSIPLTINKEEALQRP
NSCVKLQTVHSIPFTIWKWEAVQRP

SEQ ID NO: 39302 - protein, 25 aa, synthetic construct
  source 1..25: note = Seed: NSCVKLQTVHSIPLTINKEEALQRP
NSCVKLQTVHSIPFTIWKWEAYQRP

SEQ ID NO: 39303 - protein, 25 aa, synthetic construct
  source 1..25: note = Seed: NSCVKLQTVHSIPLTINKEEALQRP
NSCVKLQTVHSIPFTIWKYEAAQRP

SEQ ID NO: 39304 - protein, 25 aa, synthetic construct
  source 1..25: note = Seed: NSCVKLQTVHSIPLTINKEEALQRP
NSCVKLQTVHSIPFTIWKYEAFQRP

SEQ ID NO: 39305 - protein, 25 aa, synthetic construct
  source 1..25: note = Seed: NSCVKLQTVHSIPLTINKEEALQRP
NSCVKLQTVHSIPFTIWKYEAIQRP

SEQ ID NO: 39306 - protein, 25 aa, synthetic construct
  source 1..25: note = Seed: NSCVKLQTVHSIPLTINKEEALQRP
NSCVKLQTVHSIPFTIWKYEALQRP

SEQ ID NO: 39307 - protein, 25 aa, synthetic construct
  source 1..25: note = Seed: NSCVKLQTVHSIPLTINKEEALQRP
NSCVKLQTVHSIPFTIWKYEAMQRP

SEQ ID NO: 39308 - protein, 25 aa, synthetic construct
  source 1..25: note = Seed: NSCVKLQTVHSIPLTINKEEALQRP
NSCVKLQTVHSIPFTIWKYEAVQRP

SEQ ID NO: 39309 - protein, 25 aa, synthetic construct
  source 1..25: note = Seed: NSCVKLQTVHSIPLTINKEEALQRP
NSCVKLQTVHSIPFTIWKYEAWQRP

SEQ ID NO: 39310 - protein, 25 aa, synthetic construct
  source 1..25: note = Seed: NSCVKLQTVHSIPLTINKEEALQRP
NSCVKLQTVHSIPFTIWKYEAYQRP

SEQ ID NO: 39311 - protein, 25 aa, synthetic construct
  source 1..25: note = Seed: NSCVKLQTVHSIPLTINKEEALQRP
NSCVKLQTVHSIPFTIYKAEAAQRP

SEQ ID NO: 39312 - protein, 25 aa, synthetic construct
  source 1..25: note = Seed: NSCVKLQTVHSIPLTINKEEALQRP
NSCVKLQTVHSIPFTIYKAEAFQRP

SEQ ID NO: 39313 - protein, 25 aa, synthetic construct
  source 1..25: note = Seed: NSCVKLQTVHSIPLTINKEEALQRP
NSCVKLQTVHSIPFTIYKAEAIQRP

SEQ ID NO: 39314 - protein, 25 aa, synthetic construct
  source 1..25: note = Seed: NSCVKLQTVHSIPLTINKEEALQRP
NSCVKLQTVHSIPFTIYKAEALQRP

SEQ ID NO: 39315 - protein, 25 aa, synthetic construct
  source 1..25: note = Seed: NSCVKLQTVHSIPLTINKEEALQRP
NSCVKLQTVHSIPFTIYKAEAMQRP

SEQ ID NO: 39316 - protein, 25 aa, synthetic construct
  source 1..25: note = Seed: NSCVKLQTVHSIPLTINKEEALQRP
NSCVKLQTVHSIPFTIYKAEAVQRP

SEQ ID NO: 39317 - protein, 25 aa, synthetic construct
  source 1..25: note = Seed: NSCVKLQTVHSIPLTINKEEALQRP
NSCVKLQTVHSIPFTIYKAEAYQRP

SEQ ID NO: 39318 - protein, 25 aa, synthetic construct
  source 1..25: note = Seed: NSCVKLQTVHSIPLTINKEEALQRP
NSCVKLQTVHSIPFTIYKDEAAQRP

SEQ ID NO: 39319 - protein, 25 aa, synthetic construct
  source 1..25: note = Seed: NSCVKLQTVHSIPLTINKEEALQRP
NSCVKLQTVHSIPFTIYKDEAFQRP

SEQ ID NO: 39320 - protein, 25 aa, synthetic construct
  source 1..25: note = Seed: NSCVKLQTVHSIPLTINKEEALQRP
NSCVKLQTVHSIPFTIYKDEAIQRP

SEQ ID NO: 39321 - protein, 25 aa, synthetic construct
  source 1..25: note = Seed: NSCVKLQTVHSIPLTINKEEALQRP
NSCVKLQTVHSIPFTIYKDEALQRP

SEQ ID NO: 39322 - protein, 25 aa, synthetic construct
  source 1..25: note = Seed: NSCVKLQTVHSIPLTINKEEALQRP
NSCVKLQTVHSIPFTIYKDEAMQRP

SEQ ID NO: 39323 - protein, 25 aa, synthetic construct
  source 1..25: note = Seed: NSCVKLQTVHSIPLTINKEEALQRP
NSCVKLQTVHSIPFTIYKDEASQRP

SEQ ID NO: 39324 - protein, 25 aa, synthetic construct
  source 1..25: note = Seed: NSCVKLQTVHSIPLTINKEEALQRP
NSCVKLQTVHSIPFTIYKDEAVQRP

SEQ ID NO: 39325 - protein, 25 aa, synthetic construct
  source 1..25: note = Seed: NSCVKLQTVHSIPLTINKEEALQRP
NSCVKLQTVHSIPFTIYKDEAYQRP

SEQ ID NO: 39326 - protein, 25 aa, synthetic construct
  source 1..25: note = Seed: NSCVKLQTVHSIPLTINKEEALQRP
NSCVKLQTVHSIPFTIYKEEALQRP

SEQ ID NO: 39327 - protein, 25 aa, synthetic construct
  source 1..25: note = Seed: NSCVKLQTVHSIPLTINKEEALQRP
NSCVKLQTVHSIPFTIYKFEAAQRP

SEQ ID NO: 39328 - protein, 25 aa, synthetic construct
  source 1..25: note = Seed: NSCVKLQTVHSIPLTINKEEALQRP
NSCVKLQTVHSIPFTIYKFEACQRP

SEQ ID NO: 39329 - protein, 25 aa, synthetic construct
  source 1..25: note = Seed: NSCVKLQTVHSIPLTINKEEALQRP
NSCVKLQTVHSIPFTIYKFEADQRP

SEQ ID NO: 39330 - protein, 25 aa, synthetic construct
  source 1..25: note = Seed: NSCVKLQTVHSIPLTINKEEALQRP
NSCVKLQTVHSIPFTIYKFEAEQRP

SEQ ID NO: 39331 - protein, 25 aa, synthetic construct
  source 1..25: note = Seed: NSCVKLQTVHSIPLTINKEEALQRP
NSCVKLQTVHSIPFTIYKFEAFQRP

SEQ ID NO: 39332 - protein, 25 aa, synthetic construct
  source 1..25: note = Seed: NSCVKLQTVHSIPLTINKEEALQRP
NSCVKLQTVHSIPFTIYKFEAGQRP

SEQ ID NO: 39333 - protein, 25 aa, synthetic construct
  source 1..25: note = Seed: NSCVKLQTVHSIPLTINKEEALQRP
NSCVKLQTVHSIPFTIYKFEAHQRP

SEQ ID NO: 39334 - protein, 25 aa, synthetic construct
  source 1..25: note = Seed: NSCVKLQTVHSIPLTINKEEALQRP
NSCVKLQTVHSIPFTIYKFEAIQRP

SEQ ID NO: 39335 - protein, 25 aa, synthetic construct
  source 1..25: note = Seed: NSCVKLQTVHSIPLTINKEEALQRP
NSCVKLQTVHSIPFTIYKFEAKQRP

SEQ ID NO: 39336 - protein, 25 aa, synthetic construct
  source 1..25: note = Seed: NSCVKLQTVHSIPLTINKEEALQRP
NSCVKLQTVHSIPFTIYKFEALQRP

SEQ ID NO: 39337 - protein, 25 aa, synthetic construct
  source 1..25: note = Seed: NSCVKLQTVHSIPLTINKEEALQRP
NSCVKLQTVHSIPFTIYKFEAMQRP

SEQ ID NO: 39338 - protein, 25 aa, synthetic construct
  source 1..25: note = Seed: NSCVKLQTVHSIPLTINKEEALQRP
NSCVKLQTVHSIPFTIYKFEANQRP

SEQ ID NO: 39339 - protein, 25 aa, synthetic construct
  source 1..25: note = Seed: NSCVKLQTVHSIPLTINKEEALQRP
NSCVKLQTVHSIPFTIYKFEAPQRP

SEQ ID NO: 39340 - protein, 25 aa, synthetic construct
  source 1..25: note = Seed: NSCVKLQTVHSIPLTINKEEALQRP
NSCVKLQTVHSIPFTIYKFEAQQRP

SEQ ID NO: 39341 - protein, 25 aa, synthetic construct
  source 1..25: note = Seed: NSCVKLQTVHSIPLTINKEEALQRP
NSCVKLQTVHSIPFTIYKFEARQRP

SEQ ID NO: 39342 - protein, 25 aa, synthetic construct
  source 1..25: note = Seed: NSCVKLQTVHSIPLTINKEEALQRP
NSCVKLQTVHSIPFTIYKFEASQRP

SEQ ID NO: 39343 - protein, 25 aa, synthetic construct
  source 1..25: note = Seed: NSCVKLQTVHSIPLTINKEEALQRP
NSCVKLQTVHSIPFTIYKFEATQRP

SEQ ID NO: 39344 - protein, 25 aa, synthetic construct
  source 1..25: note = Seed: NSCVKLQTVHSIPLTINKEEALQRP
NSCVKLQTVHSIPFTIYKFEAVQRP

SEQ ID NO: 39345 - protein, 25 aa, synthetic construct
  source 1..25: note = Seed: NSCVKLQTVHSIPLTINKEEALQRP
NSCVKLQTVHSIPFTIYKFEAYQRP

SEQ ID NO: 39346 - protein, 25 aa, synthetic construct
  source 1..25: note = Seed: NSCVKLQTVHSIPLTINKEEALQRP
NSCVKLQTVHSIPFTIYKHEALQRP

SEQ ID NO: 39347 - protein, 25 aa, synthetic construct
  source 1..25: note = Seed: NSCVKLQTVHSIPLTINKEEALQRP
NSCVKLQTVHSIPFTIYKIEAAQRP

SEQ ID NO: 39348 - protein, 25 aa, synthetic construct
  source 1..25: note = Seed: NSCVKLQTVHSIPLTINKEEALQRP
NSCVKLQTVHSIPFTIYKIEACQRP

SEQ ID NO: 39349 - protein, 25 aa, synthetic construct
  source 1..25: note = Seed: NSCVKLQTVHSIPLTINKEEALQRP
NSCVKLQTVHSIPFTIYKIEADQRP

SEQ ID NO: 39350 - protein, 25 aa, synthetic construct
  source 1..25: note = Seed: NSCVKLQTVHSIPLTINKEEALQRP
NSCVKLQTVHSIPFTIYKIEAEQRP

SEQ ID NO: 39351 - protein, 25 aa, synthetic construct
  source 1..25: note = Seed: NSCVKLQTVHSIPLTINKEEALQRP
NSCVKLQTVHSIPFTIYKIEAFQRP

SEQ ID NO: 39352 - protein, 25 aa, synthetic construct
  source 1..25: note = Seed: NSCVKLQTVHSIPLTINKEEALQRP
NSCVKLQTVHSIPFTIYKIEAGQRP

SEQ ID NO: 39353 - protein, 25 aa, synthetic construct
  source 1..25: note = Seed: NSCVKLQTVHSIPLTINKEEALQRP
NSCVKLQTVHSIPFTIYKIEAHQRP

SEQ ID NO: 39354 - protein, 25 aa, synthetic construct
  source 1..25: note = Seed: NSCVKLQTVHSIPLTINKEEALQRP
NSCVKLQTVHSIPFTIYKIEAIQRP

SEQ ID NO: 39355 - protein, 25 aa, synthetic construct
  source 1..25: note = Seed: NSCVKLQTVHSIPLTINKEEALQRP
NSCVKLQTVHSIPFTIYKIEALQRP

SEQ ID NO: 39356 - protein, 25 aa, synthetic construct
  source 1..25: note = Seed: NSCVKLQTVHSIPLTINKEEALQRP
NSCVKLQTVHSIPFTIYKIEAMQRP

SEQ ID NO: 39357 - protein, 25 aa, synthetic construct
  source 1..25: note = Seed: NSCVKLQTVHSIPLTINKEEALQRP
NSCVKLQTVHSIPFTIYKIEANQRP

SEQ ID NO: 39358 - protein, 25 aa, synthetic construct
  source 1..25: note = Seed: NSCVKLQTVHSIPLTINKEEALQRP
NSCVKLQTVHSIPFTIYKIEAQQRP

SEQ ID NO: 39359 - protein, 25 aa, synthetic construct
  source 1..25: note = Seed: NSCVKLQTVHSIPLTINKEEALQRP
NSCVKLQTVHSIPFTIYKIEARQRP

SEQ ID NO: 39360 - protein, 25 aa, synthetic construct
  source 1..25: note = Seed: NSCVKLQTVHSIPLTINKEEALQRP
NSCVKLQTVHSIPFTIYKIEASQRP

SEQ ID NO: 39361 - protein, 25 aa, synthetic construct
  source 1..25: note = Seed: NSCVKLQTVHSIPLTINKEEALQRP
NSCVKLQTVHSIPFTIYKIEATQRP

SEQ ID NO: 39362 - protein, 25 aa, synthetic construct
  source 1..25: note = Seed: NSCVKLQTVHSIPLTINKEEALQRP
NSCVKLQTVHSIPFTIYKIEAVQRP

SEQ ID NO: 39363 - protein, 25 aa, synthetic construct
  source 1..25: note = Seed: NSCVKLQTVHSIPLTINKEEALQRP
NSCVKLQTVHSIPFTIYKIEAYQRP

SEQ ID NO: 39364 - protein, 25 aa, synthetic construct
  source 1..25: note = Seed: NSCVKLQTVHSIPLTINKEEALQRP
NSCVKLQTVHSIPFTIYKLEAAQRP

SEQ ID NO: 39365 - protein, 25 aa, synthetic construct
  source 1..25: note = Seed: NSCVKLQTVHSIPLTINKEEALQRP
NSCVKLQTVHSIPFTIYKLEACQRP

SEQ ID NO: 39366 - protein, 25 aa, synthetic construct
  source 1..25: note = Seed: NSCVKLQTVHSIPLTINKEEALQRP
NSCVKLQTVHSIPFTIYKLEADQRP

SEQ ID NO: 39367 - protein, 25 aa, synthetic construct
  source 1..25: note = Seed: NSCVKLQTVHSIPLTINKEEALQRP
NSCVKLQTVHSIPFTIYKLEAEQRP

SEQ ID NO: 39368 - protein, 25 aa, synthetic construct
  source 1..25: note = Seed: NSCVKLQTVHSIPLTINKEEALQRP
NSCVKLQTVHSIPFTIYKLEAFQRP

SEQ ID NO: 39369 - protein, 25 aa, synthetic construct
  source 1..25: note = Seed: NSCVKLQTVHSIPLTINKEEALQRP
NSCVKLQTVHSIPFTIYKLEAGQRP

SEQ ID NO: 39370 - protein, 25 aa, synthetic construct
  source 1..25: note = Seed: NSCVKLQTVHSIPLTINKEEALQRP
NSCVKLQTVHSIPFTIYKLEAHQRP

SEQ ID NO: 39371 - protein, 25 aa, synthetic construct
  source 1..25: note = Seed: NSCVKLQTVHSIPLTINKEEALQRP
NSCVKLQTVHSIPFTIYKLEAIQRP

SEQ ID NO: 39372 - protein, 25 aa, synthetic construct
  source 1..25: note = Seed: NSCVKLQTVHSIPLTINKEEALQRP
NSCVKLQTVHSIPFTIYKLEAKQRP

SEQ ID NO: 39373 - protein, 25 aa, synthetic construct
  source 1..25: note = Seed: NSCVKLQTVHSIPLTINKEEALQRP
NSCVKLQTVHSIPFTIYKLEALQRP

SEQ ID NO: 39374 - protein, 25 aa, synthetic construct
  source 1..25: note = Seed: NSCVKLQTVHSIPLTINKEEALQRP
NSCVKLQTVHSIPFTIYKLEAMQRP

SEQ ID NO: 39375 - protein, 25 aa, synthetic construct
  source 1..25: note = Seed: NSCVKLQTVHSIPLTINKEEALQRP
NSCVKLQTVHSIPFTIYKLEANQRP

SEQ ID NO: 39376 - protein, 25 aa, synthetic construct
  source 1..25: note = Seed: NSCVKLQTVHSIPLTINKEEALQRP
NSCVKLQTVHSIPFTIYKLEAQQRP

SEQ ID NO: 39377 - protein, 25 aa, synthetic construct
  source 1..25: note = Seed: NSCVKLQTVHSIPLTINKEEALQRP
NSCVKLQTVHSIPFTIYKLEARQRP

SEQ ID NO: 39378 - protein, 25 aa, synthetic construct
  source 1..25: note = Seed: NSCVKLQTVHSIPLTINKEEALQRP
NSCVKLQTVHSIPFTIYKLEASQRP

SEQ ID NO: 39379 - protein, 25 aa, synthetic construct
  source 1..25: note = Seed: NSCVKLQTVHSIPLTINKEEALQRP
NSCVKLQTVHSIPFTIYKLEATQRP

SEQ ID NO: 39380 - protein, 25 aa, synthetic construct
  source 1..25: note = Seed: NSCVKLQTVHSIPLTINKEEALQRP
NSCVKLQTVHSIPFTIYKLEAVQRP

SEQ ID NO: 39381 - protein, 25 aa, synthetic construct
  source 1..25: note = Seed: NSCVKLQTVHSIPLTINKEEALQRP
NSCVKLQTVHSIPFTIYKLEAYQRP

SEQ ID NO: 39382 - protein, 25 aa, synthetic construct
  source 1..25: note = Seed: NSCVKLQTVHSIPLTINKEEALQRP
NSCVKLQTVHSIPFTIYKMEAAQRP

SEQ ID NO: 39383 - protein, 25 aa, synthetic construct
  source 1..25: note = Seed: NSCVKLQTVHSIPLTINKEEALQRP
NSCVKLQTVHSIPFTIYKMEADQRP

SEQ ID NO: 39384 - protein, 25 aa, synthetic construct
  source 1..25: note = Seed: NSCVKLQTVHSIPLTINKEEALQRP
NSCVKLQTVHSIPFTIYKMEAEQRP

SEQ ID NO: 39385 - protein, 25 aa, synthetic construct
  source 1..25: note = Seed: NSCVKLQTVHSIPLTINKEEALQRP
NSCVKLQTVHSIPFTIYKMEAFQRP

SEQ ID NO: 39386 - protein, 25 aa, synthetic construct
  source 1..25: note = Seed: NSCVKLQTVHSIPLTINKEEALQRP
NSCVKLQTVHSIPFTIYKMEAIQRP

SEQ ID NO: 39387 - protein, 25 aa, synthetic construct
  source 1..25: note = Seed: NSCVKLQTVHSIPLTINKEEALQRP
NSCVKLQTVHSIPFTIYKMEALQRP

SEQ ID NO: 39388 - protein, 25 aa, synthetic construct
  source 1..25: note = Seed: NSCVKLQTVHSIPLTINKEEALQRP
NSCVKLQTVHSIPFTIYKMEAMQRP

SEQ ID NO: 39389 - protein, 25 aa, synthetic construct
  source 1..25: note = Seed: NSCVKLQTVHSIPLTINKEEALQRP
NSCVKLQTVHSIPFTIYKMEANQRP

SEQ ID NO: 39390 - protein, 25 aa, synthetic construct
  source 1..25: note = Seed: NSCVKLQTVHSIPLTINKEEALQRP
NSCVKLQTVHSIPFTIYKMEASQRP

SEQ ID NO: 39391 - protein, 25 aa, synthetic construct
  source 1..25: note = Seed: NSCVKLQTVHSIPLTINKEEALQRP
NSCVKLQTVHSIPFTIYKMEATQRP

SEQ ID NO: 39392 - protein, 25 aa, synthetic construct
  source 1..25: note = Seed: NSCVKLQTVHSIPLTINKEEALQRP
NSCVKLQTVHSIPFTIYKMEAVQRP

SEQ ID NO: 39393 - protein, 25 aa, synthetic construct
  source 1..25: note = Seed: NSCVKLQTVHSIPLTINKEEALQRP
NSCVKLQTVHSIPFTIYKMEAYQRP

SEQ ID NO: 39394 - protein, 25 aa, synthetic construct
  source 1..25: note = Seed: NSCVKLQTVHSIPLTINKEEALQRP
NSCVKLQTVHSIPFTIYKNEAAQRP

SEQ ID NO: 39395 - protein, 25 aa, synthetic construct
  source 1..25: note = Seed: NSCVKLQTVHSIPLTINKEEALQRP
NSCVKLQTVHSIPFTIYKNEAIQRP

SEQ ID NO: 39396 - protein, 25 aa, synthetic construct
  source 1..25: note = Seed: NSCVKLQTVHSIPLTINKEEALQRP
NSCVKLQTVHSIPFTIYKNEALQRP

SEQ ID NO: 39397 - protein, 25 aa, synthetic construct
  source 1..25: note = Seed: NSCVKLQTVHSIPLTINKEEALQRP
NSCVKLQTVHSIPFTIYKNEAVQRP

SEQ ID NO: 39398 - protein, 25 aa, synthetic construct
  source 1..25: note = Seed: NSCVKLQTVHSIPLTINKEEALQRP
NSCVKLQTVHSIPFTIYKPEALQRP

SEQ ID NO: 39399 - protein, 25 aa, synthetic construct
  source 1..25: note = Seed: NSCVKLQTVHSIPLTINKEEALQRP
NSCVKLQTVHSIPFTIYKQEALQRP

SEQ ID NO: 39400 - protein, 25 aa, synthetic construct
  source 1..25: note = Seed: NSCVKLQTVHSIPLTINKEEALQRP
NSCVKLQTVHSIPFTIYKREAFQRP

SEQ ID NO: 39401 - protein, 25 aa, synthetic construct
  source 1..25: note = Seed: NSCVKLQTVHSIPLTINKEEALQRP
NSCVKLQTVHSIPFTIYKREALQRP

SEQ ID NO: 39402 - protein, 25 aa, synthetic construct
  source 1..25: note = Seed: NSCVKLQTVHSIPLTINKEEALQRP
NSCVKLQTVHSIPFTIYKREARQRP

SEQ ID NO: 39403 - protein, 25 aa, synthetic construct
  source 1..25: note = Seed: NSCVKLQTVHSIPLTINKEEALQRP
NSCVKLQTVHSIPFTIYKREAYQRP

SEQ ID NO: 39404 - protein, 25 aa, synthetic construct
  source 1..25: note = Seed: NSCVKLQTVHSIPLTINKEEALQRP
NSCVKLQTVHSIPFTIYKSEAIQRP

SEQ ID NO: 39405 - protein, 25 aa, synthetic construct
  source 1..25: note = Seed: NSCVKLQTVHSIPLTINKEEALQRP
NSCVKLQTVHSIPFTIYKSEALQRP

SEQ ID NO: 39406 - protein, 25 aa, synthetic construct
  source 1..25: note = Seed: NSCVKLQTVHSIPLTINKEEALQRP
NSCVKLQTVHSIPFTIYKSEAVQRP

SEQ ID NO: 39407 - protein, 25 aa, synthetic construct
  source 1..25: note = Seed: NSCVKLQTVHSIPLTINKEEALQRP
NSCVKLQTVHSIPFTIYKTEAFQRP

SEQ ID NO: 39408 - protein, 25 aa, synthetic construct
  source 1..25: note = Seed: NSCVKLQTVHSIPLTINKEEALQRP
NSCVKLQTVHSIPFTIYKTEAIQRP

SEQ ID NO: 39409 - protein, 25 aa, synthetic construct
  source 1..25: note = Seed: NSCVKLQTVHSIPLTINKEEALQRP
NSCVKLQTVHSIPFTIYKTEALQRP

SEQ ID NO: 39410 - protein, 25 aa, synthetic construct
  source 1..25: note = Seed: NSCVKLQTVHSIPLTINKEEALQRP
NSCVKLQTVHSIPFTIYKTEAVQRP

SEQ ID NO: 39411 - protein, 25 aa, synthetic construct
  source 1..25: note = Seed: NSCVKLQTVHSIPLTINKEEALQRP
NSCVKLQTVHSIPFTIYKVEAAQRP

SEQ ID NO: 39412 - protein, 25 aa, synthetic construct
  source 1..25: note = Seed: NSCVKLQTVHSIPLTINKEEALQRP
NSCVKLQTVHSIPFTIYKVEADQRP

SEQ ID NO: 39413 - protein, 25 aa, synthetic construct
  source 1..25: note = Seed: NSCVKLQTVHSIPLTINKEEALQRP
NSCVKLQTVHSIPFTIYKVEAEQRP

SEQ ID NO: 39414 - protein, 25 aa, synthetic construct
  source 1..25: note = Seed: NSCVKLQTVHSIPLTINKEEALQRP
NSCVKLQTVHSIPFTIYKVEAFQRP

SEQ ID NO: 39415 - protein, 25 aa, synthetic construct
  source 1..25: note = Seed: NSCVKLQTVHSIPLTINKEEALQRP
NSCVKLQTVHSIPFTIYKVEAIQRP

SEQ ID NO: 39416 - protein, 25 aa, synthetic construct
  source 1..25: note = Seed: NSCVKLQTVHSIPLTINKEEALQRP
NSCVKLQTVHSIPFTIYKVEALQRP

SEQ ID NO: 39417 - protein, 25 aa, synthetic construct
  source 1..25: note = Seed: NSCVKLQTVHSIPLTINKEEALQRP
NSCVKLQTVHSIPFTIYKVEAMQRP

SEQ ID NO: 39418 - protein, 25 aa, synthetic construct
  source 1..25: note = Seed: NSCVKLQTVHSIPLTINKEEALQRP
NSCVKLQTVHSIPFTIYKVEANQRP

SEQ ID NO: 39419 - protein, 25 aa, synthetic construct
  source 1..25: note = Seed: NSCVKLQTVHSIPLTINKEEALQRP
NSCVKLQTVHSIPFTIYKVEARQRP

SEQ ID NO: 39420 - protein, 25 aa, synthetic construct
  source 1..25: note = Seed: NSCVKLQTVHSIPLTINKEEALQRP
NSCVKLQTVHSIPFTIYKVEASQRP

SEQ ID NO: 39421 - protein, 25 aa, synthetic construct
  source 1..25: note = Seed: NSCVKLQTVHSIPLTINKEEALQRP
NSCVKLQTVHSIPFTIYKVEATQRP

SEQ ID NO: 39422 - protein, 25 aa, synthetic construct
  source 1..25: note = Seed: NSCVKLQTVHSIPLTINKEEALQRP
NSCVKLQTVHSIPFTIYKVEAVQRP

SEQ ID NO: 39423 - protein, 25 aa, synthetic construct
  source 1..25: note = Seed: NSCVKLQTVHSIPLTINKEEALQRP
NSCVKLQTVHSIPFTIYKVEAYQRP

SEQ ID NO: 39424 - protein, 25 aa, synthetic construct
  source 1..25: note = Seed: NSCVKLQTVHSIPLTINKEEALQRP
NSCVKLQTVHSIPFTIYKWEAAQRP

SEQ ID NO: 39425 - protein, 25 aa, synthetic construct
  source 1..25: note = Seed: NSCVKLQTVHSIPLTINKEEALQRP
NSCVKLQTVHSIPFTIYKWEADQRP

SEQ ID NO: 39426 - protein, 25 aa, synthetic construct
  source 1..25: note = Seed: NSCVKLQTVHSIPLTINKEEALQRP
NSCVKLQTVHSIPFTIYKWEAEQRP

SEQ ID NO: 39427 - protein, 25 aa, synthetic construct
  source 1..25: note = Seed: NSCVKLQTVHSIPLTINKEEALQRP
NSCVKLQTVHSIPFTIYKWEAFQRP

SEQ ID NO: 39428 - protein, 25 aa, synthetic construct
  source 1..25: note = Seed: NSCVKLQTVHSIPLTINKEEALQRP
NSCVKLQTVHSIPFTIYKWEAIQRP

SEQ ID NO: 39429 - protein, 25 aa, synthetic construct
  source 1..25: note = Seed: NSCVKLQTVHSIPLTINKEEALQRP
NSCVKLQTVHSIPFTIYKWEALQRP

SEQ ID NO: 39430 - protein, 25 aa, synthetic construct
  source 1..25: note = Seed: NSCVKLQTVHSIPLTINKEEALQRP
NSCVKLQTVHSIPFTIYKWEAMQRP

SEQ ID NO: 39431 - protein, 25 aa, synthetic construct
  source 1..25: note = Seed: NSCVKLQTVHSIPLTINKEEALQRP
NSCVKLQTVHSIPFTIYKWEATQRP

SEQ ID NO: 39432 - protein, 25 aa, synthetic construct
  source 1..25: note = Seed: NSCVKLQTVHSIPLTINKEEALQRP
NSCVKLQTVHSIPFTIYKWEAVQRP

SEQ ID NO: 39433 - protein, 25 aa, synthetic construct
  source 1..25: note = Seed: NSCVKLQTVHSIPLTINKEEALQRP
NSCVKLQTVHSIPFTIYKWEAYQRP

SEQ ID NO: 39434 - protein, 25 aa, synthetic construct
  source 1..25: note = Seed: NSCVKLQTVHSIPLTINKEEALQRP
NSCVKLQTVHSIPFTIYKYEAAQRP

SEQ ID NO: 39435 - protein, 25 aa, synthetic construct
  source 1..25: note = Seed: NSCVKLQTVHSIPLTINKEEALQRP
NSCVKLQTVHSIPFTIYKYEACQRP

SEQ ID NO: 39436 - protein, 25 aa, synthetic construct
  source 1..25: note = Seed: NSCVKLQTVHSIPLTINKEEALQRP
NSCVKLQTVHSIPFTIYKYEADQRP

SEQ ID NO: 39437 - protein, 25 aa, synthetic construct
  source 1..25: note = Seed: NSCVKLQTVHSIPLTINKEEALQRP
NSCVKLQTVHSIPFTIYKYEAEQRP

SEQ ID NO: 39438 - protein, 25 aa, synthetic construct
  source 1..25: note = Seed: NSCVKLQTVHSIPLTINKEEALQRP
NSCVKLQTVHSIPFTIYKYEAFQRP

SEQ ID NO: 39439 - protein, 25 aa, synthetic construct
  source 1..25: note = Seed: NSCVKLQTVHSIPLTINKEEALQRP
NSCVKLQTVHSIPFTIYKYEAHQRP

SEQ ID NO: 39440 - protein, 25 aa, synthetic construct
  source 1..25: note = Seed: NSCVKLQTVHSIPLTINKEEALQRP
NSCVKLQTVHSIPFTIYKYEAIQRP

SEQ ID NO: 39441 - protein, 25 aa, synthetic construct
  source 1..25: note = Seed: NSCVKLQTVHSIPLTINKEEALQRP
NSCVKLQTVHSIPFTIYKYEALQRP

SEQ ID NO: 39442 - protein, 25 aa, synthetic construct
  source 1..25: note = Seed: NSCVKLQTVHSIPLTINKEEALQRP
NSCVKLQTVHSIPFTIYKYEAMQRP

SEQ ID NO: 39443 - protein, 25 aa, synthetic construct
  source 1..25: note = Seed: NSCVKLQTVHSIPLTINKEEALQRP
NSCVKLQTVHSIPFTIYKYEANQRP

SEQ ID NO: 39444 - protein, 25 aa, synthetic construct
  source 1..25: note = Seed: NSCVKLQTVHSIPLTINKEEALQRP
NSCVKLQTVHSIPFTIYKYEAPQRP

SEQ ID NO: 39445 - protein, 25 aa, synthetic construct
  source 1..25: note = Seed: NSCVKLQTVHSIPLTINKEEALQRP
NSCVKLQTVHSIPFTIYKYEAQQRP

SEQ ID NO: 39446 - protein, 25 aa, synthetic construct
  source 1..25: note = Seed: NSCVKLQTVHSIPLTINKEEALQRP
NSCVKLQTVHSIPFTIYKYEASQRP

SEQ ID NO: 39447 - protein, 25 aa, synthetic construct
  source 1..25: note = Seed: NSCVKLQTVHSIPLTINKEEALQRP
NSCVKLQTVHSIPFTIYKYEATQRP

SEQ ID NO: 39448 - protein, 25 aa, synthetic construct
  source 1..25: note = Seed: NSCVKLQTVHSIPLTINKEEALQRP
NSCVKLQTVHSIPFTIYKYEAVQRP

SEQ ID NO: 39449 - protein, 25 aa, synthetic construct
  source 1..25: note = Seed: NSCVKLQTVHSIPLTINKEEALQRP
NSCVKLQTVHSIPFTIYKYEAYQRP

SEQ ID NO: 39450 - protein, 25 aa, synthetic construct
  source 1..25: note = Seed: NSCVKLQTVHSIPLTINKEEALQRP
NSCVKLQTVHSIPHTIFKFEAFQRP

SEQ ID NO: 39451 - protein, 25 aa, synthetic construct
  source 1..25: note = Seed: NSCVKLQTVHSIPLTINKEEALQRP
NSCVKLQTVHSIPHTIFKFEAIQRP

SEQ ID NO: 39452 - protein, 25 aa, synthetic construct
  source 1..25: note = Seed: NSCVKLQTVHSIPLTINKEEALQRP
NSCVKLQTVHSIPHTIFKFEALQRP

SEQ ID NO: 39453 - protein, 25 aa, synthetic construct
  source 1..25: note = Seed: NSCVKLQTVHSIPLTINKEEALQRP
NSCVKLQTVHSIPITIAKAEAAQRP

SEQ ID NO: 39454 - protein, 25 aa, synthetic construct
  source 1..25: note = Seed: NSCVKLQTVHSIPLTINKEEALQRP
NSCVKLQTVHSIPITIAKAEAFQRP

SEQ ID NO: 39455 - protein, 25 aa, synthetic construct
  source 1..25: note = Seed: NSCVKLQTVHSIPLTINKEEALQRP
NSCVKLQTVHSIPITIAKAEAIQRP

SEQ ID NO: 39456 - protein, 25 aa, synthetic construct
  source 1..25: note = Seed: NSCVKLQTVHSIPLTINKEEALQRP
NSCVKLQTVHSIPITIAKAEALQRP

SEQ ID NO: 39457 - protein, 25 aa, synthetic construct
  source 1..25: note = Seed: NSCVKLQTVHSIPLTINKEEALQRP
NSCVKLQTVHSIPITIAKAEAMQRP

SEQ ID NO: 39458 - protein, 25 aa, synthetic construct
  source 1..25: note = Seed: NSCVKLQTVHSIPLTINKEEALQRP
NSCVKLQTVHSIPITIAKAEASQRP

SEQ ID NO: 39459 - protein, 25 aa, synthetic construct
  source 1..25: note = Seed: NSCVKLQTVHSIPLTINKEEALQRP
NSCVKLQTVHSIPITIAKAEAVQRP

SEQ ID NO: 39460 - protein, 25 aa, synthetic construct
  source 1..25: note = Seed: NSCVKLQTVHSIPLTINKEEALQRP
NSCVKLQTVHSIPITIAKAEAYQRP

SEQ ID NO: 39461 - protein, 25 aa, synthetic construct
  source 1..25: note = Seed: NSCVKLQTVHSIPLTINKEEALQRP
NSCVKLQTVHSIPITIAKDEAAQRP

SEQ ID NO: 39462 - protein, 25 aa, synthetic construct
  source 1..25: note = Seed: NSCVKLQTVHSIPLTINKEEALQRP
NSCVKLQTVHSIPITIAKDEAFQRP

SEQ ID NO: 39463 - protein, 25 aa, synthetic construct
  source 1..25: note = Seed: NSCVKLQTVHSIPLTINKEEALQRP
NSCVKLQTVHSIPITIAKDEAIQRP

SEQ ID NO: 39464 - protein, 25 aa, synthetic construct
  source 1..25: note = Seed: NSCVKLQTVHSIPLTINKEEALQRP
NSCVKLQTVHSIPITIAKDEALQRP

SEQ ID NO: 39465 - protein, 25 aa, synthetic construct
  source 1..25: note = Seed: NSCVKLQTVHSIPLTINKEEALQRP
NSCVKLQTVHSIPITIAKDEAMQRP

SEQ ID NO: 39466 - protein, 25 aa, synthetic construct
  source 1..25: note = Seed: NSCVKLQTVHSIPLTINKEEALQRP
NSCVKLQTVHSIPITIAKDEAVQRP

SEQ ID NO: 39467 - protein, 25 aa, synthetic construct
  source 1..25: note = Seed: NSCVKLQTVHSIPLTINKEEALQRP
NSCVKLQTVHSIPITIAKDEAYQRP

SEQ ID NO: 39468 - protein, 25 aa, synthetic construct
  source 1..25: note = Seed: NSCVKLQTVHSIPLTINKEEALQRP
NSCVKLQTVHSIPITIAKFEAAQRP

SEQ ID NO: 39469 - protein, 25 aa, synthetic construct
  source 1..25: note = Seed: NSCVKLQTVHSIPLTINKEEALQRP
NSCVKLQTVHSIPITIAKFEAEQRP

SEQ ID NO: 39470 - protein, 25 aa, synthetic construct
  source 1..25: note = Seed: NSCVKLQTVHSIPLTINKEEALQRP
NSCVKLQTVHSIPITIAKFEAFQRP

SEQ ID NO: 39471 - protein, 25 aa, synthetic construct
  source 1..25: note = Seed: NSCVKLQTVHSIPLTINKEEALQRP
NSCVKLQTVHSIPITIAKFEAIQRP

SEQ ID NO: 39472 - protein, 25 aa, synthetic construct
  source 1..25: note = Seed: NSCVKLQTVHSIPLTINKEEALQRP
NSCVKLQTVHSIPITIAKFEALQRP

SEQ ID NO: 39473 - protein, 25 aa, synthetic construct
  source 1..25: note = Seed: NSCVKLQTVHSIPLTINKEEALQRP
NSCVKLQTVHSIPITIAKFEAMQRP

SEQ ID NO: 39474 - protein, 25 aa, synthetic construct
  source 1..25: note = Seed: NSCVKLQTVHSIPLTINKEEALQRP
NSCVKLQTVHSIPITIAKFEASQRP

SEQ ID NO: 39475 - protein, 25 aa, synthetic construct
  source 1..25: note = Seed: NSCVKLQTVHSIPLTINKEEALQRP
NSCVKLQTVHSIPITIAKFEATQRP

SEQ ID NO: 39476 - protein, 25 aa, synthetic construct
  source 1..25: note = Seed: NSCVKLQTVHSIPLTINKEEALQRP
NSCVKLQTVHSIPITIAKFEAVQRP

SEQ ID NO: 39477 - protein, 25 aa, synthetic construct
  source 1..25: note = Seed: NSCVKLQTVHSIPLTINKEEALQRP
NSCVKLQTVHSIPITIAKFEAYQRP

SEQ ID NO: 39478 - protein, 25 aa, synthetic construct
  source 1..25: note = Seed: NSCVKLQTVHSIPLTINKEEALQRP
NSCVKLQTVHSIPITIAKGEAIQRP

SEQ ID NO: 39479 - protein, 25 aa, synthetic construct
  source 1..25: note = Seed: NSCVKLQTVHSIPLTINKEEALQRP
NSCVKLQTVHSIPITIAKGEAVQRP

SEQ ID NO: 39480 - protein, 25 aa, synthetic construct
  source 1..25: note = Seed: NSCVKLQTVHSIPLTINKEEALQRP
NSCVKLQTVHSIPITIAKIEAAQRP

SEQ ID NO: 39481 - protein, 25 aa, synthetic construct
  source 1..25: note = Seed: NSCVKLQTVHSIPLTINKEEALQRP
NSCVKLQTVHSIPITIAKIEACQRP

SEQ ID NO: 39482 - protein, 25 aa, synthetic construct
  source 1..25: note = Seed: NSCVKLQTVHSIPLTINKEEALQRP
NSCVKLQTVHSIPITIAKIEADQRP

SEQ ID NO: 39483 - protein, 25 aa, synthetic construct
  source 1..25: note = Seed: NSCVKLQTVHSIPLTINKEEALQRP
NSCVKLQTVHSIPITIAKIEAEQRP

SEQ ID NO: 39484 - protein, 25 aa, synthetic construct
  source 1..25: note = Seed: NSCVKLQTVHSIPLTINKEEALQRP
NSCVKLQTVHSIPITIAKIEAFQRP

SEQ ID NO: 39485 - protein, 25 aa, synthetic construct
  source 1..25: note = Seed: NSCVKLQTVHSIPLTINKEEALQRP
NSCVKLQTVHSIPITIAKIEAGQRP

SEQ ID NO: 39486 - protein, 25 aa, synthetic construct
  source 1..25: note = Seed: NSCVKLQTVHSIPLTINKEEALQRP
NSCVKLQTVHSIPITIAKIEAIQRP

SEQ ID NO: 39487 - protein, 25 aa, synthetic construct
  source 1..25: note = Seed: NSCVKLQTVHSIPLTINKEEALQRP
NSCVKLQTVHSIPITIAKIEALQRP

SEQ ID NO: 39488 - protein, 25 aa, synthetic construct
  source 1..25: note = Seed: NSCVKLQTVHSIPLTINKEEALQRP
NSCVKLQTVHSIPITIAKIEAMQRP

SEQ ID NO: 39489 - protein, 25 aa, synthetic construct
  source 1..25: note = Seed: NSCVKLQTVHSIPLTINKEEALQRP
NSCVKLQTVHSIPITIAKIEANQRP

SEQ ID NO: 39490 - protein, 25 aa, synthetic construct
  source 1..25: note = Seed: NSCVKLQTVHSIPLTINKEEALQRP
NSCVKLQTVHSIPITIAKIEAQQRP

SEQ ID NO: 39491 - protein, 25 aa, synthetic construct
  source 1..25: note = Seed: NSCVKLQTVHSIPLTINKEEALQRP
NSCVKLQTVHSIPITIAKIEASQRP

SEQ ID NO: 39492 - protein, 25 aa, synthetic construct
  source 1..25: note = Seed: NSCVKLQTVHSIPLTINKEEALQRP
NSCVKLQTVHSIPITIAKIEATQRP

SEQ ID NO: 39493 - protein, 25 aa, synthetic construct
  source 1..25: note = Seed: NSCVKLQTVHSIPLTINKEEALQRP
NSCVKLQTVHSIPITIAKIEAVQRP

SEQ ID NO: 39494 - protein, 25 aa, synthetic construct
  source 1..25: note = Seed: NSCVKLQTVHSIPLTINKEEALQRP
NSCVKLQTVHSIPITIAKIEAYQRP

SEQ ID NO: 39495 - protein, 25 aa, synthetic construct
  source 1..25: note = Seed: NSCVKLQTVHSIPLTINKEEALQRP
NSCVKLQTVHSIPITIAKKEALQRP

SEQ ID NO: 39496 - protein, 25 aa, synthetic construct
  source 1..25: note = Seed: NSCVKLQTVHSIPLTINKEEALQRP
NSCVKLQTVHSIPITIAKLEAAQRP

SEQ ID NO: 39497 - protein, 25 aa, synthetic construct
  source 1..25: note = Seed: NSCVKLQTVHSIPLTINKEEALQRP
NSCVKLQTVHSIPITIAKLEAFQRP

SEQ ID NO: 39498 - protein, 25 aa, synthetic construct
  source 1..25: note = Seed: NSCVKLQTVHSIPLTINKEEALQRP
NSCVKLQTVHSIPITIAKLEAIQRP

SEQ ID NO: 39499 - protein, 25 aa, synthetic construct
  source 1..25: note = Seed: NSCVKLQTVHSIPLTINKEEALQRP
NSCVKLQTVHSIPITIAKLEALQRP

SEQ ID NO: 39500 - protein, 25 aa, synthetic construct
  source 1..25: note = Seed: NSCVKLQTVHSIPLTINKEEALQRP
NSCVKLQTVHSIPITIAKLEAMQRP

SEQ ID NO: 39501 - protein, 25 aa, synthetic construct
  source 1..25: note = Seed: NSCVKLQTVHSIPLTINKEEALQRP
NSCVKLQTVHSIPITIAKLEANQRP

SEQ ID NO: 39502 - protein, 25 aa, synthetic construct
  source 1..25: note = Seed: NSCVKLQTVHSIPLTINKEEALQRP
NSCVKLQTVHSIPITIAKLEASQRP

SEQ ID NO: 39503 - protein, 25 aa, synthetic construct
  source 1..25: note = Seed: NSCVKLQTVHSIPLTINKEEALQRP
NSCVKLQTVHSIPITIAKLEATQRP

SEQ ID NO: 39504 - protein, 25 aa, synthetic construct
  source 1..25: note = Seed: NSCVKLQTVHSIPLTINKEEALQRP
NSCVKLQTVHSIPITIAKLEAVQRP

SEQ ID NO: 39505 - protein, 25 aa, synthetic construct
  source 1..25: note = Seed: NSCVKLQTVHSIPLTINKEEALQRP
NSCVKLQTVHSIPITIAKLEAYQRP

SEQ ID NO: 39506 - protein, 25 aa, synthetic construct
  source 1..25: note = Seed: NSCVKLQTVHSIPLTINKEEALQRP
NSCVKLQTVHSIPITIAKMEAAQRP

SEQ ID NO: 39507 - protein, 25 aa, synthetic construct
  source 1..25: note = Seed: NSCVKLQTVHSIPLTINKEEALQRP
NSCVKLQTVHSIPITIAKMEAIQRP

SEQ ID NO: 39508 - protein, 25 aa, synthetic construct
  source 1..25: note = Seed: NSCVKLQTVHSIPLTINKEEALQRP
NSCVKLQTVHSIPITIAKMEALQRP

SEQ ID NO: 39509 - protein, 25 aa, synthetic construct
  source 1..25: note = Seed: NSCVKLQTVHSIPLTINKEEALQRP
NSCVKLQTVHSIPITIAKMEAMQRP

SEQ ID NO: 39510 - protein, 25 aa, synthetic construct
  source 1..25: note = Seed: NSCVKLQTVHSIPLTINKEEALQRP
NSCVKLQTVHSIPITIAKMEASQRP

SEQ ID NO: 39511 - protein, 25 aa, synthetic construct
  source 1..25: note = Seed: NSCVKLQTVHSIPLTINKEEALQRP
NSCVKLQTVHSIPITIAKMEAVQRP

SEQ ID NO: 39512 - protein, 25 aa, synthetic construct
  source 1..25: note = Seed: NSCVKLQTVHSIPLTINKEEALQRP
NSCVKLQTVHSIPITIAKMEAYQRP

SEQ ID NO: 39513 - protein, 25 aa, synthetic construct
  source 1..25: note = Seed: NSCVKLQTVHSIPLTINKEEALQRP
NSCVKLQTVHSIPITIAKNEAAQRP

SEQ ID NO: 39514 - protein, 25 aa, synthetic construct
  source 1..25: note = Seed: NSCVKLQTVHSIPLTINKEEALQRP
NSCVKLQTVHSIPITIAKNEAFQRP

SEQ ID NO: 39515 - protein, 25 aa, synthetic construct
  source 1..25: note = Seed: NSCVKLQTVHSIPLTINKEEALQRP
NSCVKLQTVHSIPITIAKNEAIQRP

SEQ ID NO: 39516 - protein, 25 aa, synthetic construct
  source 1..25: note = Seed: NSCVKLQTVHSIPLTINKEEALQRP
NSCVKLQTVHSIPITIAKNEALQRP

SEQ ID NO: 39517 - protein, 25 aa, synthetic construct
  source 1..25: note = Seed: NSCVKLQTVHSIPLTINKEEALQRP
NSCVKLQTVHSIPITIAKNEAMQRP

SEQ ID NO: 39518 - protein, 25 aa, synthetic construct
  source 1..25: note = Seed: NSCVKLQTVHSIPLTINKEEALQRP
NSCVKLQTVHSIPITIAKNEAVQRP

SEQ ID NO: 39519 - protein, 25 aa, synthetic construct
  source 1..25: note = Seed: NSCVKLQTVHSIPLTINKEEALQRP
NSCVKLQTVHSIPITIAKNEAYQRP

SEQ ID NO: 39520 - protein, 25 aa, synthetic construct
  source 1..25: note = Seed: NSCVKLQTVHSIPLTINKEEALQRP
NSCVKLQTVHSIPITIAKPEAIQRP

SEQ ID NO: 39521 - protein, 25 aa, synthetic construct
  source 1..25: note = Seed: NSCVKLQTVHSIPLTINKEEALQRP
NSCVKLQTVHSIPITIAKREAAQRP

SEQ ID NO: 39522 - protein, 25 aa, synthetic construct
  source 1..25: note = Seed: NSCVKLQTVHSIPLTINKEEALQRP
NSCVKLQTVHSIPITIAKREAFQRP

SEQ ID NO: 39523 - protein, 25 aa, synthetic construct
  source 1..25: note = Seed: NSCVKLQTVHSIPLTINKEEALQRP
NSCVKLQTVHSIPITIAKREAIQRP

SEQ ID NO: 39524 - protein, 25 aa, synthetic construct
  source 1..25: note = Seed: NSCVKLQTVHSIPLTINKEEALQRP
NSCVKLQTVHSIPITIAKREALQRP

SEQ ID NO: 39525 - protein, 25 aa, synthetic construct
  source 1..25: note = Seed: NSCVKLQTVHSIPLTINKEEALQRP
NSCVKLQTVHSIPITIAKREAMQRP

SEQ ID NO: 39526 - protein, 25 aa, synthetic construct
  source 1..25: note = Seed: NSCVKLQTVHSIPLTINKEEALQRP
NSCVKLQTVHSIPITIAKREARQRP

SEQ ID NO: 39527 - protein, 25 aa, synthetic construct
  source 1..25: note = Seed: NSCVKLQTVHSIPLTINKEEALQRP
NSCVKLQTVHSIPITIAKREASQRP

SEQ ID NO: 39528 - protein, 25 aa, synthetic construct
  source 1..25: note = Seed: NSCVKLQTVHSIPLTINKEEALQRP
NSCVKLQTVHSIPITIAKREAVQRP

SEQ ID NO: 39529 - protein, 25 aa, synthetic construct
  source 1..25: note = Seed: NSCVKLQTVHSIPLTINKEEALQRP
NSCVKLQTVHSIPITIAKREAYQRP

SEQ ID NO: 39530 - protein, 25 aa, synthetic construct
  source 1..25: note = Seed: NSCVKLQTVHSIPLTINKEEALQRP
NSCVKLQTVHSIPITIAKSEAAQRP

SEQ ID NO: 39531 - protein, 25 aa, synthetic construct
  source 1..25: note = Seed: NSCVKLQTVHSIPLTINKEEALQRP
NSCVKLQTVHSIPITIAKSEAFQRP

SEQ ID NO: 39532 - protein, 25 aa, synthetic construct
  source 1..25: note = Seed: NSCVKLQTVHSIPLTINKEEALQRP
NSCVKLQTVHSIPITIAKSEAIQRP

SEQ ID NO: 39533 - protein, 25 aa, synthetic construct
  source 1..25: note = Seed: NSCVKLQTVHSIPLTINKEEALQRP
NSCVKLQTVHSIPITIAKSEALQRP

SEQ ID NO: 39534 - protein, 25 aa, synthetic construct
  source 1..25: note = Seed: NSCVKLQTVHSIPLTINKEEALQRP
NSCVKLQTVHSIPITIAKSEAMQRP

SEQ ID NO: 39535 - protein, 25 aa, synthetic construct
  source 1..25: note = Seed: NSCVKLQTVHSIPLTINKEEALQRP
NSCVKLQTVHSIPITIAKSEAVQRP

SEQ ID NO: 39536 - protein, 25 aa, synthetic construct
  source 1..25: note = Seed: NSCVKLQTVHSIPLTINKEEALQRP
NSCVKLQTVHSIPITIAKTEAAQRP

SEQ ID NO: 39537 - protein, 25 aa, synthetic construct
  source 1..25: note = Seed: NSCVKLQTVHSIPLTINKEEALQRP
NSCVKLQTVHSIPITIAKTEAIQRP

SEQ ID NO: 39538 - protein, 25 aa, synthetic construct
  source 1..25: note = Seed: NSCVKLQTVHSIPLTINKEEALQRP
NSCVKLQTVHSIPITIAKTEALQRP

SEQ ID NO: 39539 - protein, 25 aa, synthetic construct
  source 1..25: note = Seed: NSCVKLQTVHSIPLTINKEEALQRP
NSCVKLQTVHSIPITIAKTEAVQRP

SEQ ID NO: 39540 - protein, 25 aa, synthetic construct
  source 1..25: note = Seed: NSCVKLQTVHSIPLTINKEEALQRP
NSCVKLQTVHSIPITIAKVEAAQRP

SEQ ID NO: 39541 - protein, 25 aa, synthetic construct
  source 1..25: note = Seed: NSCVKLQTVHSIPLTINKEEALQRP
NSCVKLQTVHSIPITIAKVEACQRP

SEQ ID NO: 39542 - protein, 25 aa, synthetic construct
  source 1..25: note = Seed: NSCVKLQTVHSIPLTINKEEALQRP
NSCVKLQTVHSIPITIAKVEAFQRP

SEQ ID NO: 39543 - protein, 25 aa, synthetic construct
  source 1..25: note = Seed: NSCVKLQTVHSIPLTINKEEALQRP
NSCVKLQTVHSIPITIAKVEAIQRP

SEQ ID NO: 39544 - protein, 25 aa, synthetic construct
  source 1..25: note = Seed: NSCVKLQTVHSIPLTINKEEALQRP
NSCVKLQTVHSIPITIAKVEALQRP

SEQ ID NO: 39545 - protein, 25 aa, synthetic construct
  source 1..25: note = Seed: NSCVKLQTVHSIPLTINKEEALQRP
NSCVKLQTVHSIPITIAKVEAMQRP

SEQ ID NO: 39546 - protein, 25 aa, synthetic construct
  source 1..25: note = Seed: NSCVKLQTVHSIPLTINKEEALQRP
NSCVKLQTVHSIPITIAKVEASQRP

SEQ ID NO: 39547 - protein, 25 aa, synthetic construct
  source 1..25: note = Seed: NSCVKLQTVHSIPLTINKEEALQRP
NSCVKLQTVHSIPITIAKVEATQRP

SEQ ID NO: 39548 - protein, 25 aa, synthetic construct
  source 1..25: note = Seed: NSCVKLQTVHSIPLTINKEEALQRP
NSCVKLQTVHSIPITIAKVEAVQRP

SEQ ID NO: 39549 - protein, 25 aa, synthetic construct
  source 1..25: note = Seed: NSCVKLQTVHSIPLTINKEEALQRP
NSCVKLQTVHSIPITIAKVEAYQRP

SEQ ID NO: 39550 - protein, 25 aa, synthetic construct
  source 1..25: note = Seed: NSCVKLQTVHSIPLTINKEEALQRP
NSCVKLQTVHSIPITICKFEAFQRP

SEQ ID NO: 39551 - protein, 25 aa, synthetic construct
  source 1..25: note = Seed: NSCVKLQTVHSIPLTINKEEALQRP
NSCVKLQTVHSIPITICKFEAIQRP

SEQ ID NO: 39552 - protein, 25 aa, synthetic construct
  source 1..25: note = Seed: NSCVKLQTVHSIPLTINKEEALQRP
NSCVKLQTVHSIPITICKFEALQRP

SEQ ID NO: 39553 - protein, 25 aa, synthetic construct
  source 1..25: note = Seed: NSCVKLQTVHSIPLTINKEEALQRP
NSCVKLQTVHSIPITICKFEAVQRP

SEQ ID NO: 39554 - protein, 25 aa, synthetic construct
  source 1..25: note = Seed: NSCVKLQTVHSIPLTINKEEALQRP
NSCVKLQTVHSIPITIDKAEAIQRP

SEQ ID NO: 39555 - protein, 25 aa, synthetic construct
  source 1..25: note = Seed: NSCVKLQTVHSIPLTINKEEALQRP
NSCVKLQTVHSIPITIDKAEAVQRP

SEQ ID NO: 39556 - protein, 25 aa, synthetic construct
  source 1..25: note = Seed: NSCVKLQTVHSIPLTINKEEALQRP
NSCVKLQTVHSIPITIDKFEAIQRP

SEQ ID NO: 39557 - protein, 25 aa, synthetic construct
  source 1..25: note = Seed: NSCVKLQTVHSIPLTINKEEALQRP
NSCVKLQTVHSIPITIDKFEALQRP

SEQ ID NO: 39558 - protein, 25 aa, synthetic construct
  source 1..25: note = Seed: NSCVKLQTVHSIPLTINKEEALQRP
NSCVKLQTVHSIPITIDKFEAVQRP

SEQ ID NO: 39559 - protein, 25 aa, synthetic construct
  source 1..25: note = Seed: NSCVKLQTVHSIPLTINKEEALQRP
NSCVKLQTVHSIPITIDKNEAIQRP

SEQ ID NO: 39560 - protein, 25 aa, synthetic construct
  source 1..25: note = Seed: NSCVKLQTVHSIPLTINKEEALQRP
NSCVKLQTVHSIPITIDKNEAVQRP

SEQ ID NO: 39561 - protein, 25 aa, synthetic construct
  source 1..25: note = Seed: NSCVKLQTVHSIPLTINKEEALQRP
NSCVKLQTVHSIPITIDKSEAIQRP

SEQ ID NO: 39562 - protein, 25 aa, synthetic construct
  source 1..25: note = Seed: NSCVKLQTVHSIPLTINKEEALQRP
NSCVKLQTVHSIPITIDKSEAVQRP

SEQ ID NO: 39563 - protein, 25 aa, synthetic construct
  source 1..25: note = Seed: NSCVKLQTVHSIPLTINKEEALQRP
NSCVKLQTVHSIPITIEKFEAAQRP

SEQ ID NO: 39564 - protein, 25 aa, synthetic construct
  source 1..25: note = Seed: NSCVKLQTVHSIPLTINKEEALQRP
NSCVKLQTVHSIPITIEKFEAFQRP

SEQ ID NO: 39565 - protein, 25 aa, synthetic construct
  source 1..25: note = Seed: NSCVKLQTVHSIPLTINKEEALQRP
NSCVKLQTVHSIPITIEKFEAIQRP

SEQ ID NO: 39566 - protein, 25 aa, synthetic construct
  source 1..25: note = Seed: NSCVKLQTVHSIPLTINKEEALQRP
NSCVKLQTVHSIPITIEKFEALQRP

SEQ ID NO: 39567 - protein, 25 aa, synthetic construct
  source 1..25: note = Seed: NSCVKLQTVHSIPLTINKEEALQRP
NSCVKLQTVHSIPITIEKFEAMQRP

SEQ ID NO: 39568 - protein, 25 aa, synthetic construct
  source 1..25: note = Seed: NSCVKLQTVHSIPLTINKEEALQRP
NSCVKLQTVHSIPITIEKFEATQRP

SEQ ID NO: 39569 - protein, 25 aa, synthetic construct
  source 1..25: note = Seed: NSCVKLQTVHSIPLTINKEEALQRP
NSCVKLQTVHSIPITIEKFEAVQRP

SEQ ID NO: 39570 - protein, 25 aa, synthetic construct
  source 1..25: note = Seed: NSCVKLQTVHSIPLTINKEEALQRP
NSCVKLQTVHSIPITIEKFEAYQRP

SEQ ID NO: 39571 - protein, 25 aa, synthetic construct
  source 1..25: note = Seed: NSCVKLQTVHSIPLTINKEEALQRP
NSCVKLQTVHSIPITIFKAEAAQRP

SEQ ID NO: 39572 - protein, 25 aa, synthetic construct
  source 1..25: note = Seed: NSCVKLQTVHSIPLTINKEEALQRP
NSCVKLQTVHSIPITIFKAEACQRP

SEQ ID NO: 39573 - protein, 25 aa, synthetic construct
  source 1..25: note = Seed: NSCVKLQTVHSIPLTINKEEALQRP
NSCVKLQTVHSIPITIFKAEADQRP

SEQ ID NO: 39574 - protein, 25 aa, synthetic construct
  source 1..25: note = Seed: NSCVKLQTVHSIPLTINKEEALQRP
NSCVKLQTVHSIPITIFKAEAEQRP

SEQ ID NO: 39575 - protein, 25 aa, synthetic construct
  source 1..25: note = Seed: NSCVKLQTVHSIPLTINKEEALQRP
NSCVKLQTVHSIPITIFKAEAFQRP

SEQ ID NO: 39576 - protein, 25 aa, synthetic construct
  source 1..25: note = Seed: NSCVKLQTVHSIPLTINKEEALQRP
NSCVKLQTVHSIPITIFKAEAGQRP

SEQ ID NO: 39577 - protein, 25 aa, synthetic construct
  source 1..25: note = Seed: NSCVKLQTVHSIPLTINKEEALQRP
NSCVKLQTVHSIPITIFKAEAHQRP

SEQ ID NO: 39578 - protein, 25 aa, synthetic construct
  source 1..25: note = Seed: NSCVKLQTVHSIPLTINKEEALQRP
NSCVKLQTVHSIPITIFKAEAIQRP

SEQ ID NO: 39579 - protein, 25 aa, synthetic construct
  source 1..25: note = Seed: NSCVKLQTVHSIPLTINKEEALQRP
NSCVKLQTVHSIPITIFKAEALQRP

SEQ ID NO: 39580 - protein, 25 aa, synthetic construct
  source 1..25: note = Seed: NSCVKLQTVHSIPLTINKEEALQRP
NSCVKLQTVHSIPITIFKAEAMQRP

SEQ ID NO: 39581 - protein, 25 aa, synthetic construct
  source 1..25: note = Seed: NSCVKLQTVHSIPLTINKEEALQRP
NSCVKLQTVHSIPITIFKAEANQRP

SEQ ID NO: 39582 - protein, 25 aa, synthetic construct
  source 1..25: note = Seed: NSCVKLQTVHSIPLTINKEEALQRP
NSCVKLQTVHSIPITIFKAEAPQRP

SEQ ID NO: 39583 - protein, 25 aa, synthetic construct
  source 1..25: note = Seed: NSCVKLQTVHSIPLTINKEEALQRP
NSCVKLQTVHSIPITIFKAEAQQRP

SEQ ID NO: 39584 - protein, 25 aa, synthetic construct
  source 1..25: note = Seed: NSCVKLQTVHSIPLTINKEEALQRP
NSCVKLQTVHSIPITIFKAEARQRP

SEQ ID NO: 39585 - protein, 25 aa, synthetic construct
  source 1..25: note = Seed: NSCVKLQTVHSIPLTINKEEALQRP
NSCVKLQTVHSIPITIFKAEASQRP

SEQ ID NO: 39586 - protein, 25 aa, synthetic construct
  source 1..25: note = Seed: NSCVKLQTVHSIPLTINKEEALQRP
NSCVKLQTVHSIPITIFKAEATQRP

SEQ ID NO: 39587 - protein, 25 aa, synthetic construct
  source 1..25: note = Seed: NSCVKLQTVHSIPLTINKEEALQRP
NSCVKLQTVHSIPITIFKAEAVQRP

SEQ ID NO: 39588 - protein, 25 aa, synthetic construct
  source 1..25: note = Seed: NSCVKLQTVHSIPLTINKEEALQRP
NSCVKLQTVHSIPITIFKAEAYQRP

SEQ ID NO: 39589 - protein, 25 aa, synthetic construct
  source 1..25: note = Seed: NSCVKLQTVHSIPLTINKEEALQRP
NSCVKLQTVHSIPITIFKDEAAQRP

SEQ ID NO: 39590 - protein, 25 aa, synthetic construct
  source 1..25: note = Seed: NSCVKLQTVHSIPLTINKEEALQRP
NSCVKLQTVHSIPITIFKDEACQRP

SEQ ID NO: 39591 - protein, 25 aa, synthetic construct
  source 1..25: note = Seed: NSCVKLQTVHSIPLTINKEEALQRP
NSCVKLQTVHSIPITIFKDEADQRP

SEQ ID NO: 39592 - protein, 25 aa, synthetic construct
  source 1..25: note = Seed: NSCVKLQTVHSIPLTINKEEALQRP
NSCVKLQTVHSIPITIFKDEAEQRP

SEQ ID NO: 39593 - protein, 25 aa, synthetic construct
  source 1..25: note = Seed: NSCVKLQTVHSIPLTINKEEALQRP
NSCVKLQTVHSIPITIFKDEAFQRP

SEQ ID NO: 39594 - protein, 25 aa, synthetic construct
  source 1..25: note = Seed: NSCVKLQTVHSIPLTINKEEALQRP
NSCVKLQTVHSIPITIFKDEAGQRP

SEQ ID NO: 39595 - protein, 25 aa, synthetic construct
  source 1..25: note = Seed: NSCVKLQTVHSIPLTINKEEALQRP
NSCVKLQTVHSIPITIFKDEAHQRP

SEQ ID NO: 39596 - protein, 25 aa, synthetic construct
  source 1..25: note = Seed: NSCVKLQTVHSIPLTINKEEALQRP
NSCVKLQTVHSIPITIFKDEAIQRP

SEQ ID NO: 39597 - protein, 25 aa, synthetic construct
  source 1..25: note = Seed: NSCVKLQTVHSIPLTINKEEALQRP
NSCVKLQTVHSIPITIFKDEALQRP

SEQ ID NO: 39598 - protein, 25 aa, synthetic construct
  source 1..25: note = Seed: NSCVKLQTVHSIPLTINKEEALQRP
NSCVKLQTVHSIPITIFKDEAMQRP

SEQ ID NO: 39599 - protein, 25 aa, synthetic construct
  source 1..25: note = Seed: NSCVKLQTVHSIPLTINKEEALQRP
NSCVKLQTVHSIPITIFKDEANQRP

SEQ ID NO: 39600 - protein, 25 aa, synthetic construct
  source 1..25: note = Seed: NSCVKLQTVHSIPLTINKEEALQRP
NSCVKLQTVHSIPITIFKDEAPQRP

SEQ ID NO: 39601 - protein, 25 aa, synthetic construct
  source 1..25: note = Seed: NSCVKLQTVHSIPLTINKEEALQRP
NSCVKLQTVHSIPITIFKDEAQQRP

SEQ ID NO: 39602 - protein, 25 aa, synthetic construct
  source 1..25: note = Seed: NSCVKLQTVHSIPLTINKEEALQRP
NSCVKLQTVHSIPITIFKDEASQRP

SEQ ID NO: 39603 - protein, 25 aa, synthetic construct
  source 1..25: note = Seed: NSCVKLQTVHSIPLTINKEEALQRP
NSCVKLQTVHSIPITIFKDEATQRP

SEQ ID NO: 39604 - protein, 25 aa, synthetic construct
  source 1..25: note = Seed: NSCVKLQTVHSIPLTINKEEALQRP
NSCVKLQTVHSIPITIFKDEAVQRP

SEQ ID NO: 39605 - protein, 25 aa, synthetic construct
  source 1..25: note = Seed: NSCVKLQTVHSIPLTINKEEALQRP
NSCVKLQTVHSIPITIFKDEAWQRP

SEQ ID NO: 39606 - protein, 25 aa, synthetic construct
  source 1..25: note = Seed: NSCVKLQTVHSIPLTINKEEALQRP
NSCVKLQTVHSIPITIFKDEAYQRP

SEQ ID NO: 39607 - protein, 25 aa, synthetic construct
  source 1..25: note = Seed: NSCVKLQTVHSIPLTINKEEALQRP
NSCVKLQTVHSIPITIFKEEAAQRP

SEQ ID NO: 39608 - protein, 25 aa, synthetic construct
  source 1..25: note = Seed: NSCVKLQTVHSIPLTINKEEALQRP
NSCVKLQTVHSIPITIFKEEAFQRP

SEQ ID NO: 39609 - protein, 25 aa, synthetic construct
  source 1..25: note = Seed: NSCVKLQTVHSIPLTINKEEALQRP
NSCVKLQTVHSIPITIFKEEAIQRP

SEQ ID NO: 39610 - protein, 25 aa, synthetic construct
  source 1..25: note = Seed: NSCVKLQTVHSIPLTINKEEALQRP
NSCVKLQTVHSIPITIFKEEALQRP

SEQ ID NO: 39611 - protein, 25 aa, synthetic construct
  source 1..25: note = Seed: NSCVKLQTVHSIPLTINKEEALQRP
NSCVKLQTVHSIPITIFKEEAVQRP

SEQ ID NO: 39612 - protein, 25 aa, synthetic construct
  source 1..25: note = Seed: NSCVKLQTVHSIPLTINKEEALQRP
NSCVKLQTVHSIPITIFKFEAAQRP

SEQ ID NO: 39613 - protein, 25 aa, synthetic construct
  source 1..25: note = Seed: NSCVKLQTVHSIPLTINKEEALQRP
NSCVKLQTVHSIPITIFKFEADQRP

SEQ ID NO: 39614 - protein, 25 aa, synthetic construct
  source 1..25: note = Seed: NSCVKLQTVHSIPLTINKEEALQRP
NSCVKLQTVHSIPITIFKFEAEQRP

SEQ ID NO: 39615 - protein, 25 aa, synthetic construct
  source 1..25: note = Seed: NSCVKLQTVHSIPLTINKEEALQRP
NSCVKLQTVHSIPITIFKFEAFQRP

SEQ ID NO: 39616 - protein, 25 aa, synthetic construct
  source 1..25: note = Seed: NSCVKLQTVHSIPLTINKEEALQRP
NSCVKLQTVHSIPITIFKFEAHQRP

SEQ ID NO: 39617 - protein, 25 aa, synthetic construct
  source 1..25: note = Seed: NSCVKLQTVHSIPLTINKEEALQRP
NSCVKLQTVHSIPITIFKFEAIQRP

SEQ ID NO: 39618 - protein, 25 aa, synthetic construct
  source 1..25: note = Seed: NSCVKLQTVHSIPLTINKEEALQRP
NSCVKLQTVHSIPITIFKFEAKQRP

SEQ ID NO: 39619 - protein, 25 aa, synthetic construct
  source 1..25: note = Seed: NSCVKLQTVHSIPLTINKEEALQRP
NSCVKLQTVHSIPITIFKFEALQRP

SEQ ID NO: 39620 - protein, 25 aa, synthetic construct
  source 1..25: note = Seed: NSCVKLQTVHSIPLTINKEEALQRP
NSCVKLQTVHSIPITIFKFEAMQRP

SEQ ID NO: 39621 - protein, 25 aa, synthetic construct
  source 1..25: note = Seed: NSCVKLQTVHSIPLTINKEEALQRP
NSCVKLQTVHSIPITIFKFEANQRP

SEQ ID NO: 39622 - protein, 25 aa, synthetic construct
  source 1..25: note = Seed: NSCVKLQTVHSIPLTINKEEALQRP
NSCVKLQTVHSIPITIFKFEAQQRP

SEQ ID NO: 39623 - protein, 25 aa, synthetic construct
  source 1..25: note = Seed: NSCVKLQTVHSIPLTINKEEALQRP
NSCVKLQTVHSIPITIFKFEARQRP

SEQ ID NO: 39624 - protein, 25 aa, synthetic construct
  source 1..25: note = Seed: NSCVKLQTVHSIPLTINKEEALQRP
NSCVKLQTVHSIPITIFKFEASQRP

SEQ ID NO: 39625 - protein, 25 aa, synthetic construct
  source 1..25: note = Seed: NSCVKLQTVHSIPLTINKEEALQRP
NSCVKLQTVHSIPITIFKFEATQRP

SEQ ID NO: 39626 - protein, 25 aa, synthetic construct
  source 1..25: note = Seed: NSCVKLQTVHSIPLTINKEEALQRP
NSCVKLQTVHSIPITIFKFEAVQRP

SEQ ID NO: 39627 - protein, 25 aa, synthetic construct
  source 1..25: note = Seed: NSCVKLQTVHSIPLTINKEEALQRP
NSCVKLQTVHSIPITIFKFEAWQRP

SEQ ID NO: 39628 - protein, 25 aa, synthetic construct
  source 1..25: note = Seed: NSCVKLQTVHSIPLTINKEEALQRP
NSCVKLQTVHSIPITIFKFEAYQRP

SEQ ID NO: 39629 - protein, 25 aa, synthetic construct
  source 1..25: note = Seed: NSCVKLQTVHSIPLTINKEEALQRP
NSCVKLQTVHSIPITIFKGEAAQRP

SEQ ID NO: 39630 - protein, 25 aa, synthetic construct
  source 1..25: note = Seed: NSCVKLQTVHSIPLTINKEEALQRP
NSCVKLQTVHSIPITIFKGEAFQRP

SEQ ID NO: 39631 - protein, 25 aa, synthetic construct
  source 1..25: note = Seed: NSCVKLQTVHSIPLTINKEEALQRP
NSCVKLQTVHSIPITIFKGEAIQRP

SEQ ID NO: 39632 - protein, 25 aa, synthetic construct
  source 1..25: note = Seed: NSCVKLQTVHSIPLTINKEEALQRP
NSCVKLQTVHSIPITIFKGEALQRP

SEQ ID NO: 39633 - protein, 25 aa, synthetic construct
  source 1..25: note = Seed: NSCVKLQTVHSIPLTINKEEALQRP
NSCVKLQTVHSIPITIFKGEAMQRP

SEQ ID NO: 39634 - protein, 25 aa, synthetic construct
  source 1..25: note = Seed: NSCVKLQTVHSIPLTINKEEALQRP
NSCVKLQTVHSIPITIFKGEASQRP

SEQ ID NO: 39635 - protein, 25 aa, synthetic construct
  source 1..25: note = Seed: NSCVKLQTVHSIPLTINKEEALQRP
NSCVKLQTVHSIPITIFKGEAVQRP

SEQ ID NO: 39636 - protein, 25 aa, synthetic construct
  source 1..25: note = Seed: NSCVKLQTVHSIPLTINKEEALQRP
NSCVKLQTVHSIPITIFKHEAFQRP

SEQ ID NO: 39637 - protein, 25 aa, synthetic construct
  source 1..25: note = Seed: NSCVKLQTVHSIPLTINKEEALQRP
NSCVKLQTVHSIPITIFKHEAIQRP

SEQ ID NO: 39638 - protein, 25 aa, synthetic construct
  source 1..25: note = Seed: NSCVKLQTVHSIPLTINKEEALQRP
NSCVKLQTVHSIPITIFKHEALQRP

SEQ ID NO: 39639 - protein, 25 aa, synthetic construct
  source 1..25: note = Seed: NSCVKLQTVHSIPLTINKEEALQRP
NSCVKLQTVHSIPITIFKHEARQRP

SEQ ID NO: 39640 - protein, 25 aa, synthetic construct
  source 1..25: note = Seed: NSCVKLQTVHSIPLTINKEEALQRP
NSCVKLQTVHSIPITIFKHEAYQRP

SEQ ID NO: 39641 - protein, 25 aa, synthetic construct
  source 1..25: note = Seed: NSCVKLQTVHSIPLTINKEEALQRP
NSCVKLQTVHSIPITIFKIEAAQRP

SEQ ID NO: 39642 - protein, 25 aa, synthetic construct
  source 1..25: note = Seed: NSCVKLQTVHSIPLTINKEEALQRP
NSCVKLQTVHSIPITIFKIEACQRP

SEQ ID NO: 39643 - protein, 25 aa, synthetic construct
  source 1..25: note = Seed: NSCVKLQTVHSIPLTINKEEALQRP
NSCVKLQTVHSIPITIFKIEADQRP

SEQ ID NO: 39644 - protein, 25 aa, synthetic construct
  source 1..25: note = Seed: NSCVKLQTVHSIPLTINKEEALQRP
NSCVKLQTVHSIPITIFKIEAEQRP

SEQ ID NO: 39645 - protein, 25 aa, synthetic construct
  source 1..25: note = Seed: NSCVKLQTVHSIPLTINKEEALQRP
NSCVKLQTVHSIPITIFKIEAFQRP

SEQ ID NO: 39646 - protein, 25 aa, synthetic construct
  source 1..25: note = Seed: NSCVKLQTVHSIPLTINKEEALQRP
NSCVKLQTVHSIPITIFKIEAGQRP

SEQ ID NO: 39647 - protein, 25 aa, synthetic construct
  source 1..25: note = Seed: NSCVKLQTVHSIPLTINKEEALQRP
NSCVKLQTVHSIPITIFKIEAHQRP

SEQ ID NO: 39648 - protein, 25 aa, synthetic construct
  source 1..25: note = Seed: NSCVKLQTVHSIPLTINKEEALQRP
NSCVKLQTVHSIPITIFKIEAIQRP

SEQ ID NO: 39649 - protein, 25 aa, synthetic construct
  source 1..25: note = Seed: NSCVKLQTVHSIPLTINKEEALQRP
NSCVKLQTVHSIPITIFKIEALQRP

SEQ ID NO: 39650 - protein, 25 aa, synthetic construct
  source 1..25: note = Seed: NSCVKLQTVHSIPLTINKEEALQRP
NSCVKLQTVHSIPITIFKIEAMQRP

SEQ ID NO: 39651 - protein, 25 aa, synthetic construct
  source 1..25: note = Seed: NSCVKLQTVHSIPLTINKEEALQRP
NSCVKLQTVHSIPITIFKIEANQRP

SEQ ID NO: 39652 - protein, 25 aa, synthetic construct
  source 1..25: note = Seed: NSCVKLQTVHSIPLTINKEEALQRP
NSCVKLQTVHSIPITIFKIEAPQRP

SEQ ID NO: 39653 - protein, 25 aa, synthetic construct
  source 1..25: note = Seed: NSCVKLQTVHSIPLTINKEEALQRP
NSCVKLQTVHSIPITIFKIEAQQRP

SEQ ID NO: 39654 - protein, 25 aa, synthetic construct
  source 1..25: note = Seed: NSCVKLQTVHSIPLTINKEEALQRP
NSCVKLQTVHSIPITIFKIEARQRP

SEQ ID NO: 39655 - protein, 25 aa, synthetic construct
  source 1..25: note = Seed: NSCVKLQTVHSIPLTINKEEALQRP
NSCVKLQTVHSIPITIFKIEASQRP

SEQ ID NO: 39656 - protein, 25 aa, synthetic construct
  source 1..25: note = Seed: NSCVKLQTVHSIPLTINKEEALQRP
NSCVKLQTVHSIPITIFKIEATQRP

SEQ ID NO: 39657 - protein, 25 aa, synthetic construct
  source 1..25: note = Seed: NSCVKLQTVHSIPLTINKEEALQRP
NSCVKLQTVHSIPITIFKIEAVQRP

SEQ ID NO: 39658 - protein, 25 aa, synthetic construct
  source 1..25: note = Seed: NSCVKLQTVHSIPLTINKEEALQRP
NSCVKLQTVHSIPITIFKIEAYQRP

SEQ ID NO: 39659 - protein, 25 aa, synthetic construct
  source 1..25: note = Seed: NSCVKLQTVHSIPLTINKEEALQRP
NSCVKLQTVHSIPITIFKKEAAQRP

SEQ ID NO: 39660 - protein, 25 aa, synthetic construct
  source 1..25: note = Seed: NSCVKLQTVHSIPLTINKEEALQRP
NSCVKLQTVHSIPITIFKKEAFQRP

SEQ ID NO: 39661 - protein, 25 aa, synthetic construct
  source 1..25: note = Seed: NSCVKLQTVHSIPLTINKEEALQRP
NSCVKLQTVHSIPITIFKKEAHQRP

SEQ ID NO: 39662 - protein, 25 aa, synthetic construct
  source 1..25: note = Seed: NSCVKLQTVHSIPLTINKEEALQRP
NSCVKLQTVHSIPITIFKKEAIQRP

SEQ ID NO: 39663 - protein, 25 aa, synthetic construct
  source 1..25: note = Seed: NSCVKLQTVHSIPLTINKEEALQRP
NSCVKLQTVHSIPITIFKKEALQRP

SEQ ID NO: 39664 - protein, 25 aa, synthetic construct
  source 1..25: note = Seed: NSCVKLQTVHSIPLTINKEEALQRP
NSCVKLQTVHSIPITIFKKEAMQRP

SEQ ID NO: 39665 - protein, 25 aa, synthetic construct
  source 1..25: note = Seed: NSCVKLQTVHSIPLTINKEEALQRP
NSCVKLQTVHSIPITIFKKEARQRP

SEQ ID NO: 39666 - protein, 25 aa, synthetic construct
  source 1..25: note = Seed: NSCVKLQTVHSIPLTINKEEALQRP
NSCVKLQTVHSIPITIFKKEAVQRP

SEQ ID NO: 39667 - protein, 25 aa, synthetic construct
  source 1..25: note = Seed: NSCVKLQTVHSIPLTINKEEALQRP
NSCVKLQTVHSIPITIFKKEAYQRP

SEQ ID NO: 39668 - protein, 25 aa, synthetic construct
  source 1..25: note = Seed: NSCVKLQTVHSIPLTINKEEALQRP
NSCVKLQTVHSIPITIFKLEAAQRP

SEQ ID NO: 39669 - protein, 25 aa, synthetic construct
  source 1..25: note = Seed: NSCVKLQTVHSIPLTINKEEALQRP
NSCVKLQTVHSIPITIFKLEADQRP

SEQ ID NO: 39670 - protein, 25 aa, synthetic construct
  source 1..25: note = Seed: NSCVKLQTVHSIPLTINKEEALQRP
NSCVKLQTVHSIPITIFKLEAEQRP

SEQ ID NO: 39671 - protein, 25 aa, synthetic construct
  source 1..25: note = Seed: NSCVKLQTVHSIPLTINKEEALQRP
NSCVKLQTVHSIPITIFKLEAFQRP

SEQ ID NO: 39672 - protein, 25 aa, synthetic construct
  source 1..25: note = Seed: NSCVKLQTVHSIPLTINKEEALQRP
NSCVKLQTVHSIPITIFKLEAGQRP

SEQ ID NO: 39673 - protein, 25 aa, synthetic construct
  source 1..25: note = Seed: NSCVKLQTVHSIPLTINKEEALQRP
NSCVKLQTVHSIPITIFKLEAHQRP

SEQ ID NO: 39674 - protein, 25 aa, synthetic construct
  source 1..25: note = Seed: NSCVKLQTVHSIPLTINKEEALQRP
NSCVKLQTVHSIPITIFKLEAIQRP

SEQ ID NO: 39675 - protein, 25 aa, synthetic construct
  source 1..25: note = Seed: NSCVKLQTVHSIPLTINKEEALQRP
NSCVKLQTVHSIPITIFKLEAKQRP

SEQ ID NO: 39676 - protein, 25 aa, synthetic construct
  source 1..25: note = Seed: NSCVKLQTVHSIPLTINKEEALQRP
NSCVKLQTVHSIPITIFKLEALQRP

SEQ ID NO: 39677 - protein, 25 aa, synthetic construct
  source 1..25: note = Seed: NSCVKLQTVHSIPLTINKEEALQRP
NSCVKLQTVHSIPITIFKLEAMQRP

SEQ ID NO: 39678 - protein, 25 aa, synthetic construct
  source 1..25: note = Seed: NSCVKLQTVHSIPLTINKEEALQRP
NSCVKLQTVHSIPITIFKLEANQRP

SEQ ID NO: 39679 - protein, 25 aa, synthetic construct
  source 1..25: note = Seed: NSCVKLQTVHSIPLTINKEEALQRP
NSCVKLQTVHSIPITIFKLEAPQRP

SEQ ID NO: 39680 - protein, 25 aa, synthetic construct
  source 1..25: note = Seed: NSCVKLQTVHSIPLTINKEEALQRP
NSCVKLQTVHSIPITIFKLEAQQRP

SEQ ID NO: 39681 - protein, 25 aa, synthetic construct
  source 1..25: note = Seed: NSCVKLQTVHSIPLTINKEEALQRP
NSCVKLQTVHSIPITIFKLEARQRP

SEQ ID NO: 39682 - protein, 25 aa, synthetic construct
  source 1..25: note = Seed: NSCVKLQTVHSIPLTINKEEALQRP
NSCVKLQTVHSIPITIFKLEASQRP

SEQ ID NO: 39683 - protein, 25 aa, synthetic construct
  source 1..25: note = Seed: NSCVKLQTVHSIPLTINKEEALQRP
NSCVKLQTVHSIPITIFKLEATQRP

SEQ ID NO: 39684 - protein, 25 aa, synthetic construct
  source 1..25: note = Seed: NSCVKLQTVHSIPLTINKEEALQRP
NSCVKLQTVHSIPITIFKLEAVQRP

SEQ ID NO: 39685 - protein, 25 aa, synthetic construct
  source 1..25: note = Seed: NSCVKLQTVHSIPLTINKEEALQRP
NSCVKLQTVHSIPITIFKLEAYQRP

SEQ ID NO: 39686 - protein, 25 aa, synthetic construct
  source 1..25: note = Seed: NSCVKLQTVHSIPLTINKEEALQRP
NSCVKLQTVHSIPITIFKMEAAQRP

SEQ ID NO: 39687 - protein, 25 aa, synthetic construct
  source 1..25: note = Seed: NSCVKLQTVHSIPLTINKEEALQRP
NSCVKLQTVHSIPITIFKMEADQRP

SEQ ID NO: 39688 - protein, 25 aa, synthetic construct
  source 1..25: note = Seed: NSCVKLQTVHSIPLTINKEEALQRP
NSCVKLQTVHSIPITIFKMEAEQRP

SEQ ID NO: 39689 - protein, 25 aa, synthetic construct
  source 1..25: note = Seed: NSCVKLQTVHSIPLTINKEEALQRP
NSCVKLQTVHSIPITIFKMEAFQRP

SEQ ID NO: 39690 - protein, 25 aa, synthetic construct
  source 1..25: note = Seed: NSCVKLQTVHSIPLTINKEEALQRP
NSCVKLQTVHSIPITIFKMEAGQRP

SEQ ID NO: 39691 - protein, 25 aa, synthetic construct
  source 1..25: note = Seed: NSCVKLQTVHSIPLTINKEEALQRP
NSCVKLQTVHSIPITIFKMEAIQRP

SEQ ID NO: 39692 - protein, 25 aa, synthetic construct
  source 1..25: note = Seed: NSCVKLQTVHSIPLTINKEEALQRP
NSCVKLQTVHSIPITIFKMEALQRP

SEQ ID NO: 39693 - protein, 25 aa, synthetic construct
  source 1..25: note = Seed: NSCVKLQTVHSIPLTINKEEALQRP
NSCVKLQTVHSIPITIFKMEAMQRP

SEQ ID NO: 39694 - protein, 25 aa, synthetic construct
  source 1..25: note = Seed: NSCVKLQTVHSIPLTINKEEALQRP
NSCVKLQTVHSIPITIFKMEANQRP

SEQ ID NO: 39695 - protein, 25 aa, synthetic construct
  source 1..25: note = Seed: NSCVKLQTVHSIPLTINKEEALQRP
NSCVKLQTVHSIPITIFKMEAPQRP

SEQ ID NO: 39696 - protein, 25 aa, synthetic construct
  source 1..25: note = Seed: NSCVKLQTVHSIPLTINKEEALQRP
NSCVKLQTVHSIPITIFKMEAQQRP

SEQ ID NO: 39697 - protein, 25 aa, synthetic construct
  source 1..25: note = Seed: NSCVKLQTVHSIPLTINKEEALQRP
NSCVKLQTVHSIPITIFKMEASQRP

SEQ ID NO: 39698 - protein, 25 aa, synthetic construct
  source 1..25: note = Seed: NSCVKLQTVHSIPLTINKEEALQRP
NSCVKLQTVHSIPITIFKMEATQRP

SEQ ID NO: 39699 - protein, 25 aa, synthetic construct
  source 1..25: note = Seed: NSCVKLQTVHSIPLTINKEEALQRP
NSCVKLQTVHSIPITIFKMEAVQRP

SEQ ID NO: 39700 - protein, 25 aa, synthetic construct
  source 1..25: note = Seed: NSCVKLQTVHSIPLTINKEEALQRP
NSCVKLQTVHSIPITIFKMEAYQRP

SEQ ID NO: 39701 - protein, 25 aa, synthetic construct
  source 1..25: note = Seed: NSCVKLQTVHSIPLTINKEEALQRP
NSCVKLQTVHSIPITIFKNEAAQRP

SEQ ID NO: 39702 - protein, 25 aa, synthetic construct
  source 1..25: note = Seed: NSCVKLQTVHSIPLTINKEEALQRP
NSCVKLQTVHSIPITIFKNEACQRP

SEQ ID NO: 39703 - protein, 25 aa, synthetic construct
  source 1..25: note = Seed: NSCVKLQTVHSIPLTINKEEALQRP
NSCVKLQTVHSIPITIFKNEADQRP

SEQ ID NO: 39704 - protein, 25 aa, synthetic construct
  source 1..25: note = Seed: NSCVKLQTVHSIPLTINKEEALQRP
NSCVKLQTVHSIPITIFKNEAEQRP

SEQ ID NO: 39705 - protein, 25 aa, synthetic construct
  source 1..25: note = Seed: NSCVKLQTVHSIPLTINKEEALQRP
NSCVKLQTVHSIPITIFKNEAFQRP

SEQ ID NO: 39706 - protein, 25 aa, synthetic construct
  source 1..25: note = Seed: NSCVKLQTVHSIPLTINKEEALQRP
NSCVKLQTVHSIPITIFKNEAGQRP

SEQ ID NO: 39707 - protein, 25 aa, synthetic construct
  source 1..25: note = Seed: NSCVKLQTVHSIPLTINKEEALQRP
NSCVKLQTVHSIPITIFKNEAIQRP

SEQ ID NO: 39708 - protein, 25 aa, synthetic construct
  source 1..25: note = Seed: NSCVKLQTVHSIPLTINKEEALQRP
NSCVKLQTVHSIPITIFKNEAMQRP

SEQ ID NO: 39709 - protein, 25 aa, synthetic construct
  source 1..25: note = Seed: NSCVKLQTVHSIPLTINKEEALQRP
NSCVKLQTVHSIPITIFKNEASQRP

SEQ ID NO: 39710 - protein, 25 aa, synthetic construct
  source 1..25: note = Seed: NSCVKLQTVHSIPLTINKEEALQRP
NSCVKLQTVHSIPITIFKNEATQRP

SEQ ID NO: 39711 - protein, 25 aa, synthetic construct
  source 1..25: note = Seed: NSCVKLQTVHSIPLTINKEEALQRP
NSCVKLQTVHSIPITIFKNEAVQRP

SEQ ID NO: 39712 - protein, 25 aa, synthetic construct
  source 1..25: note = Seed: NSCVKLQTVHSIPLTINKEEALQRP
NSCVKLQTVHSIPITIFKNEAYQRP

SEQ ID NO: 39713 - protein, 25 aa, synthetic construct
  source 1..25: note = Seed: NSCVKLQTVHSIPLTINKEEALQRP
NSCVKLQTVHSIPITIFKPEAAQRP

SEQ ID NO: 39714 - protein, 25 aa, synthetic construct
  source 1..25: note = Seed: NSCVKLQTVHSIPLTINKEEALQRP
NSCVKLQTVHSIPITIFKPEAFQRP

SEQ ID NO: 39715 - protein, 25 aa, synthetic construct
  source 1..25: note = Seed: NSCVKLQTVHSIPLTINKEEALQRP
NSCVKLQTVHSIPITIFKPEAIQRP

SEQ ID NO: 39716 - protein, 25 aa, synthetic construct
  source 1..25: note = Seed: NSCVKLQTVHSIPLTINKEEALQRP
NSCVKLQTVHSIPITIFKPEALQRP

SEQ ID NO: 39717 - protein, 25 aa, synthetic construct
  source 1..25: note = Seed: NSCVKLQTVHSIPLTINKEEALQRP
NSCVKLQTVHSIPITIFKPEAMQRP

SEQ ID NO: 39718 - protein, 25 aa, synthetic construct
  source 1..25: note = Seed: NSCVKLQTVHSIPLTINKEEALQRP
NSCVKLQTVHSIPITIFKPEASQRP

SEQ ID NO: 39719 - protein, 25 aa, synthetic construct
  source 1..25: note = Seed: NSCVKLQTVHSIPLTINKEEALQRP
NSCVKLQTVHSIPITIFKPEAVQRP

SEQ ID NO: 39720 - protein, 25 aa, synthetic construct
  source 1..25: note = Seed: NSCVKLQTVHSIPLTINKEEALQRP
NSCVKLQTVHSIPITIFKQEAAQRP

SEQ ID NO: 39721 - protein, 25 aa, synthetic construct
  source 1..25: note = Seed: NSCVKLQTVHSIPLTINKEEALQRP
NSCVKLQTVHSIPITIFKREAAQRP

SEQ ID NO: 39722 - protein, 25 aa, synthetic construct
  source 1..25: note = Seed: NSCVKLQTVHSIPLTINKEEALQRP
NSCVKLQTVHSIPITIFKREAFQRP

SEQ ID NO: 39723 - protein, 25 aa, synthetic construct
  source 1..25: note = Seed: NSCVKLQTVHSIPLTINKEEALQRP
NSCVKLQTVHSIPITIFKREAHQRP

SEQ ID NO: 39724 - protein, 25 aa, synthetic construct
  source 1..25: note = Seed: NSCVKLQTVHSIPLTINKEEALQRP
NSCVKLQTVHSIPITIFKREAIQRP

SEQ ID NO: 39725 - protein, 25 aa, synthetic construct
  source 1..25: note = Seed: NSCVKLQTVHSIPLTINKEEALQRP
NSCVKLQTVHSIPITIFKREAKQRP

SEQ ID NO: 39726 - protein, 25 aa, synthetic construct
  source 1..25: note = Seed: NSCVKLQTVHSIPLTINKEEALQRP
NSCVKLQTVHSIPITIFKREALQRP

SEQ ID NO: 39727 - protein, 25 aa, synthetic construct
  source 1..25: note = Seed: NSCVKLQTVHSIPLTINKEEALQRP
NSCVKLQTVHSIPITIFKREAMQRP

SEQ ID NO: 39728 - protein, 25 aa, synthetic construct
  source 1..25: note = Seed: NSCVKLQTVHSIPLTINKEEALQRP
NSCVKLQTVHSIPITIFKREARQRP

SEQ ID NO: 39729 - protein, 25 aa, synthetic construct
  source 1..25: note = Seed: NSCVKLQTVHSIPLTINKEEALQRP
NSCVKLQTVHSIPITIFKREASQRP

SEQ ID NO: 39730 - protein, 25 aa, synthetic construct
  source 1..25: note = Seed: NSCVKLQTVHSIPLTINKEEALQRP
NSCVKLQTVHSIPITIFKREAVQRP

SEQ ID NO: 39731 - protein, 25 aa, synthetic construct
  source 1..25: note = Seed: NSCVKLQTVHSIPLTINKEEALQRP
NSCVKLQTVHSIPITIFKREAYQRP

SEQ ID NO: 39732 - protein, 25 aa, synthetic construct
  source 1..25: note = Seed: NSCVKLQTVHSIPLTINKEEALQRP
NSCVKLQTVHSIPITIFKSEAAQRP

SEQ ID NO: 39733 - protein, 25 aa, synthetic construct
  source 1..25: note = Seed: NSCVKLQTVHSIPLTINKEEALQRP
NSCVKLQTVHSIPITIFKSEAFQRP

SEQ ID NO: 39734 - protein, 25 aa, synthetic construct
  source 1..25: note = Seed: NSCVKLQTVHSIPLTINKEEALQRP
NSCVKLQTVHSIPITIFKSEAGQRP

SEQ ID NO: 39735 - protein, 25 aa, synthetic construct
  source 1..25: note = Seed: NSCVKLQTVHSIPLTINKEEALQRP
NSCVKLQTVHSIPITIFKSEAIQRP

SEQ ID NO: 39736 - protein, 25 aa, synthetic construct
  source 1..25: note = Seed: NSCVKLQTVHSIPLTINKEEALQRP
NSCVKLQTVHSIPITIFKSEAMQRP

SEQ ID NO: 39737 - protein, 25 aa, synthetic construct
  source 1..25: note = Seed: NSCVKLQTVHSIPLTINKEEALQRP
NSCVKLQTVHSIPITIFKSEASQRP

SEQ ID NO: 39738 - protein, 25 aa, synthetic construct
  source 1..25: note = Seed: NSCVKLQTVHSIPLTINKEEALQRP
NSCVKLQTVHSIPITIFKSEATQRP

SEQ ID NO: 39739 - protein, 25 aa, synthetic construct
  source 1..25: note = Seed: NSCVKLQTVHSIPLTINKEEALQRP
NSCVKLQTVHSIPITIFKSEAVQRP

SEQ ID NO: 39740 - protein, 25 aa, synthetic construct
  source 1..25: note = Seed: NSCVKLQTVHSIPLTINKEEALQRP
NSCVKLQTVHSIPITIFKSEAYQRP

SEQ ID NO: 39741 - protein, 25 aa, synthetic construct
  source 1..25: note = Seed: NSCVKLQTVHSIPLTINKEEALQRP
NSCVKLQTVHSIPITIFKTEAAQRP

SEQ ID NO: 39742 - protein, 25 aa, synthetic construct
  source 1..25: note = Seed: NSCVKLQTVHSIPLTINKEEALQRP
NSCVKLQTVHSIPITIFKTEAFQRP

SEQ ID NO: 39743 - protein, 25 aa, synthetic construct
  source 1..25: note = Seed: NSCVKLQTVHSIPLTINKEEALQRP
NSCVKLQTVHSIPITIFKTEAGQRP

SEQ ID NO: 39744 - protein, 25 aa, synthetic construct
  source 1..25: note = Seed: NSCVKLQTVHSIPLTINKEEALQRP
NSCVKLQTVHSIPITIFKTEAIQRP

SEQ ID NO: 39745 - protein, 25 aa, synthetic construct
  source 1..25: note = Seed: NSCVKLQTVHSIPLTINKEEALQRP
NSCVKLQTVHSIPITIFKTEALQRP

SEQ ID NO: 39746 - protein, 25 aa, synthetic construct
  source 1..25: note = Seed: NSCVKLQTVHSIPLTINKEEALQRP
NSCVKLQTVHSIPITIFKTEAMQRP

SEQ ID NO: 39747 - protein, 25 aa, synthetic construct
  source 1..25: note = Seed: NSCVKLQTVHSIPLTINKEEALQRP
NSCVKLQTVHSIPITIFKTEASQRP

SEQ ID NO: 39748 - protein, 25 aa, synthetic construct
  source 1..25: note = Seed: NSCVKLQTVHSIPLTINKEEALQRP
NSCVKLQTVHSIPITIFKTEATQRP

SEQ ID NO: 39749 - protein, 25 aa, synthetic construct
  source 1..25: note = Seed: NSCVKLQTVHSIPLTINKEEALQRP
NSCVKLQTVHSIPITIFKTEAVQRP

SEQ ID NO: 39750 - protein, 25 aa, synthetic construct
  source 1..25: note = Seed: NSCVKLQTVHSIPLTINKEEALQRP
NSCVKLQTVHSIPITIFKTEAYQRP

SEQ ID NO: 39751 - protein, 25 aa, synthetic construct
  source 1..25: note = Seed: NSCVKLQTVHSIPLTINKEEALQRP
NSCVKLQTVHSIPITIFKVEAAQRP

SEQ ID NO: 39752 - protein, 25 aa, synthetic construct
  source 1..25: note = Seed: NSCVKLQTVHSIPLTINKEEALQRP
NSCVKLQTVHSIPITIFKVEACQRP

SEQ ID NO: 39753 - protein, 25 aa, synthetic construct
  source 1..25: note = Seed: NSCVKLQTVHSIPLTINKEEALQRP
NSCVKLQTVHSIPITIFKVEADQRP

SEQ ID NO: 39754 - protein, 25 aa, synthetic construct
  source 1..25: note = Seed: NSCVKLQTVHSIPLTINKEEALQRP
NSCVKLQTVHSIPITIFKVEAEQRP

SEQ ID NO: 39755 - protein, 25 aa, synthetic construct
  source 1..25: note = Seed: NSCVKLQTVHSIPLTINKEEALQRP
NSCVKLQTVHSIPITIFKVEAFQRP

SEQ ID NO: 39756 - protein, 25 aa, synthetic construct
  source 1..25: note = Seed: NSCVKLQTVHSIPLTINKEEALQRP
NSCVKLQTVHSIPITIFKVEAGQRP

SEQ ID NO: 39757 - protein, 25 aa, synthetic construct
  source 1..25: note = Seed: NSCVKLQTVHSIPLTINKEEALQRP
NSCVKLQTVHSIPITIFKVEAHQRP

SEQ ID NO: 39758 - protein, 25 aa, synthetic construct
  source 1..25: note = Seed: NSCVKLQTVHSIPLTINKEEALQRP
NSCVKLQTVHSIPITIFKVEAIQRP

SEQ ID NO: 39759 - protein, 25 aa, synthetic construct
  source 1..25: note = Seed: NSCVKLQTVHSIPLTINKEEALQRP
NSCVKLQTVHSIPITIFKVEALQRP

SEQ ID NO: 39760 - protein, 25 aa, synthetic construct
  source 1..25: note = Seed: NSCVKLQTVHSIPLTINKEEALQRP
NSCVKLQTVHSIPITIFKVEAMQRP

SEQ ID NO: 39761 - protein, 25 aa, synthetic construct
  source 1..25: note = Seed: NSCVKLQTVHSIPLTINKEEALQRP
NSCVKLQTVHSIPITIFKVEANQRP

SEQ ID NO: 39762 - protein, 25 aa, synthetic construct
  source 1..25: note = Seed: NSCVKLQTVHSIPLTINKEEALQRP
NSCVKLQTVHSIPITIFKVEAPQRP

SEQ ID NO: 39763 - protein, 25 aa, synthetic construct
  source 1..25: note = Seed: NSCVKLQTVHSIPLTINKEEALQRP
NSCVKLQTVHSIPITIFKVEAQQRP

SEQ ID NO: 39764 - protein, 25 aa, synthetic construct
  source 1..25: note = Seed: NSCVKLQTVHSIPLTINKEEALQRP
NSCVKLQTVHSIPITIFKVEASQRP

SEQ ID NO: 39765 - protein, 25 aa, synthetic construct
  source 1..25: note = Seed: NSCVKLQTVHSIPLTINKEEALQRP
NSCVKLQTVHSIPITIFKVEATQRP

SEQ ID NO: 39766 - protein, 25 aa, synthetic construct
  source 1..25: note = Seed: NSCVKLQTVHSIPLTINKEEALQRP
NSCVKLQTVHSIPITIFKVEAVQRP

SEQ ID NO: 39767 - protein, 25 aa, synthetic construct
  source 1..25: note = Seed: NSCVKLQTVHSIPLTINKEEALQRP
NSCVKLQTVHSIPITIFKVEAYQRP

SEQ ID NO: 39768 - protein, 25 aa, synthetic construct
  source 1..25: note = Seed: NSCVKLQTVHSIPLTINKEEALQRP
NSCVKLQTVHSIPITIFKWEAFQRP

SEQ ID NO: 39769 - protein, 25 aa, synthetic construct
  source 1..25: note = Seed: NSCVKLQTVHSIPLTINKEEALQRP
NSCVKLQTVHSIPITIFKWEAIQRP

SEQ ID NO: 39770 - protein, 25 aa, synthetic construct
  source 1..25: note = Seed: NSCVKLQTVHSIPLTINKEEALQRP
NSCVKLQTVHSIPITIFKWEALQRP

SEQ ID NO: 39771 - protein, 25 aa, synthetic construct
  source 1..25: note = Seed: NSCVKLQTVHSIPLTINKEEALQRP
NSCVKLQTVHSIPITIFKWEAMQRP

SEQ ID NO: 39772 - protein, 25 aa, synthetic construct
  source 1..25: note = Seed: NSCVKLQTVHSIPLTINKEEALQRP
NSCVKLQTVHSIPITIFKWEAVQRP

SEQ ID NO: 39773 - protein, 25 aa, synthetic construct
  source 1..25: note = Seed: NSCVKLQTVHSIPLTINKEEALQRP
NSCVKLQTVHSIPITIFKWEAYQRP

SEQ ID NO: 39774 - protein, 25 aa, synthetic construct
  source 1..25: note = Seed: NSCVKLQTVHSIPLTINKEEALQRP
NSCVKLQTVHSIPITIFKYEAAQRP

SEQ ID NO: 39775 - protein, 25 aa, synthetic construct
  source 1..25: note = Seed: NSCVKLQTVHSIPLTINKEEALQRP
NSCVKLQTVHSIPITIFKYEAFQRP

SEQ ID NO: 39776 - protein, 25 aa, synthetic construct
  source 1..25: note = Seed: NSCVKLQTVHSIPLTINKEEALQRP
NSCVKLQTVHSIPITIFKYEAIQRP

SEQ ID NO: 39777 - protein, 25 aa, synthetic construct
  source 1..25: note = Seed: NSCVKLQTVHSIPLTINKEEALQRP
NSCVKLQTVHSIPITIFKYEALQRP

SEQ ID NO: 39778 - protein, 25 aa, synthetic construct
  source 1..25: note = Seed: NSCVKLQTVHSIPLTINKEEALQRP
NSCVKLQTVHSIPITIFKYEAMQRP

SEQ ID NO: 39779 - protein, 25 aa, synthetic construct
  source 1..25: note = Seed: NSCVKLQTVHSIPLTINKEEALQRP
NSCVKLQTVHSIPITIFKYEAVQRP

SEQ ID NO: 39780 - protein, 25 aa, synthetic construct
  source 1..25: note = Seed: NSCVKLQTVHSIPLTINKEEALQRP
NSCVKLQTVHSIPITIFKYEAWQRP

SEQ ID NO: 39781 - protein, 25 aa, synthetic construct
  source 1..25: note = Seed: NSCVKLQTVHSIPLTINKEEALQRP
NSCVKLQTVHSIPITIFKYEAYQRP

SEQ ID NO: 39782 - protein, 25 aa, synthetic construct
  source 1..25: note = Seed: NSCVKLQTVHSIPLTINKEEALQRP
NSCVKLQTVHSIPITIGKNEAIQRP

SEQ ID NO: 39783 - protein, 25 aa, synthetic construct
  source 1..25: note = Seed: NSCVKLQTVHSIPLTINKEEALQRP
NSCVKLQTVHSIPITIHKAEAFQRP

SEQ ID NO: 39784 - protein, 25 aa, synthetic construct
  source 1..25: note = Seed: NSCVKLQTVHSIPLTINKEEALQRP
NSCVKLQTVHSIPITIHKAEAIQRP

SEQ ID NO: 39785 - protein, 25 aa, synthetic construct
  source 1..25: note = Seed: NSCVKLQTVHSIPLTINKEEALQRP
NSCVKLQTVHSIPITIHKAEALQRP

SEQ ID NO: 39786 - protein, 25 aa, synthetic construct
  source 1..25: note = Seed: NSCVKLQTVHSIPLTINKEEALQRP
NSCVKLQTVHSIPITIHKAEARQRP

SEQ ID NO: 39787 - protein, 25 aa, synthetic construct
  source 1..25: note = Seed: NSCVKLQTVHSIPLTINKEEALQRP
NSCVKLQTVHSIPITIHKAEAVQRP

SEQ ID NO: 39788 - protein, 25 aa, synthetic construct
  source 1..25: note = Seed: NSCVKLQTVHSIPLTINKEEALQRP
NSCVKLQTVHSIPITIHKAEAYQRP

SEQ ID NO: 39789 - protein, 25 aa, synthetic construct
  source 1..25: note = Seed: NSCVKLQTVHSIPLTINKEEALQRP
NSCVKLQTVHSIPITIHKFEAAQRP

SEQ ID NO: 39790 - protein, 25 aa, synthetic construct
  source 1..25: note = Seed: NSCVKLQTVHSIPLTINKEEALQRP
NSCVKLQTVHSIPITIHKFEAEQRP

SEQ ID NO: 39791 - protein, 25 aa, synthetic construct
  source 1..25: note = Seed: NSCVKLQTVHSIPLTINKEEALQRP
NSCVKLQTVHSIPITIHKFEAFQRP

SEQ ID NO: 39792 - protein, 25 aa, synthetic construct
  source 1..25: note = Seed: NSCVKLQTVHSIPLTINKEEALQRP
NSCVKLQTVHSIPITIHKFEAIQRP

SEQ ID NO: 39793 - protein, 25 aa, synthetic construct
  source 1..25: note = Seed: NSCVKLQTVHSIPLTINKEEALQRP
NSCVKLQTVHSIPITIHKFEALQRP

SEQ ID NO: 39794 - protein, 25 aa, synthetic construct
  source 1..25: note = Seed: NSCVKLQTVHSIPLTINKEEALQRP
NSCVKLQTVHSIPITIHKFEAMQRP

SEQ ID NO: 39795 - protein, 25 aa, synthetic construct
  source 1..25: note = Seed: NSCVKLQTVHSIPLTINKEEALQRP
NSCVKLQTVHSIPITIHKFEASQRP

SEQ ID NO: 39796 - protein, 25 aa, synthetic construct
  source 1..25: note = Seed: NSCVKLQTVHSIPLTINKEEALQRP
NSCVKLQTVHSIPITIHKFEATQRP

SEQ ID NO: 39797 - protein, 25 aa, synthetic construct
  source 1..25: note = Seed: NSCVKLQTVHSIPLTINKEEALQRP
NSCVKLQTVHSIPITIHKFEAVQRP

SEQ ID NO: 39798 - protein, 25 aa, synthetic construct
  source 1..25: note = Seed: NSCVKLQTVHSIPLTINKEEALQRP
NSCVKLQTVHSIPITIHKFEAYQRP

SEQ ID NO: 39799 - protein, 25 aa, synthetic construct
  source 1..25: note = Seed: NSCVKLQTVHSIPLTINKEEALQRP
NSCVKLQTVHSIPITIHKGEAIQRP

SEQ ID NO: 39800 - protein, 25 aa, synthetic construct
  source 1..25: note = Seed: NSCVKLQTVHSIPLTINKEEALQRP
NSCVKLQTVHSIPITIHKGEAVQRP

SEQ ID NO: 39801 - protein, 25 aa, synthetic construct
  source 1..25: note = Seed: NSCVKLQTVHSIPLTINKEEALQRP
NSCVKLQTVHSIPITIHKHEAFQRP

SEQ ID NO: 39802 - protein, 25 aa, synthetic construct
  source 1..25: note = Seed: NSCVKLQTVHSIPLTINKEEALQRP
NSCVKLQTVHSIPITIHKHEAIQRP

SEQ ID NO: 39803 - protein, 25 aa, synthetic construct
  source 1..25: note = Seed: NSCVKLQTVHSIPLTINKEEALQRP
NSCVKLQTVHSIPITIHKHEALQRP

SEQ ID NO: 39804 - protein, 25 aa, synthetic construct
  source 1..25: note = Seed: NSCVKLQTVHSIPLTINKEEALQRP
NSCVKLQTVHSIPITIHKHEAMQRP

SEQ ID NO: 39805 - protein, 25 aa, synthetic construct
  source 1..25: note = Seed: NSCVKLQTVHSIPLTINKEEALQRP
NSCVKLQTVHSIPITIHKIEAAQRP

SEQ ID NO: 39806 - protein, 25 aa, synthetic construct
  source 1..25: note = Seed: NSCVKLQTVHSIPLTINKEEALQRP
NSCVKLQTVHSIPITIHKIEAIQRP

SEQ ID NO: 39807 - protein, 25 aa, synthetic construct
  source 1..25: note = Seed: NSCVKLQTVHSIPLTINKEEALQRP
NSCVKLQTVHSIPITIHKIEALQRP

SEQ ID NO: 39808 - protein, 25 aa, synthetic construct
  source 1..25: note = Seed: NSCVKLQTVHSIPLTINKEEALQRP
NSCVKLQTVHSIPITIHKIEARQRP

SEQ ID NO: 39809 - protein, 25 aa, synthetic construct
  source 1..25: note = Seed: NSCVKLQTVHSIPLTINKEEALQRP
NSCVKLQTVHSIPITIHKIEAVQRP

SEQ ID NO: 39810 - protein, 25 aa, synthetic construct
  source 1..25: note = Seed: NSCVKLQTVHSIPLTINKEEALQRP
NSCVKLQTVHSIPITIHKKEAFQRP

SEQ ID NO: 39811 - protein, 25 aa, synthetic construct
  source 1..25: note = Seed: NSCVKLQTVHSIPLTINKEEALQRP
NSCVKLQTVHSIPITIHKKEAIQRP

SEQ ID NO: 39812 - protein, 25 aa, synthetic construct
  source 1..25: note = Seed: NSCVKLQTVHSIPLTINKEEALQRP
NSCVKLQTVHSIPITIHKKEALQRP

SEQ ID NO: 39813 - protein, 25 aa, synthetic construct
  source 1..25: note = Seed: NSCVKLQTVHSIPLTINKEEALQRP
NSCVKLQTVHSIPITIHKKEAMQRP

SEQ ID NO: 39814 - protein, 25 aa, synthetic construct
  source 1..25: note = Seed: NSCVKLQTVHSIPLTINKEEALQRP
NSCVKLQTVHSIPITIHKKEARQRP

SEQ ID NO: 39815 - protein, 25 aa, synthetic construct
  source 1..25: note = Seed: NSCVKLQTVHSIPLTINKEEALQRP
NSCVKLQTVHSIPITIHKKEAVQRP

SEQ ID NO: 39816 - protein, 25 aa, synthetic construct
  source 1..25: note = Seed: NSCVKLQTVHSIPLTINKEEALQRP
NSCVKLQTVHSIPITIHKKEAYQRP

SEQ ID NO: 39817 - protein, 25 aa, synthetic construct
  source 1..25: note = Seed: NSCVKLQTVHSIPLTINKEEALQRP
NSCVKLQTVHSIPITIHKLEALQRP

SEQ ID NO: 39818 - protein, 25 aa, synthetic construct
  source 1..25: note = Seed: NSCVKLQTVHSIPLTINKEEALQRP
NSCVKLQTVHSIPITIHKNEAFQRP

SEQ ID NO: 39819 - protein, 25 aa, synthetic construct
  source 1..25: note = Seed: NSCVKLQTVHSIPLTINKEEALQRP
NSCVKLQTVHSIPITIHKNEAIQRP

SEQ ID NO: 39820 - protein, 25 aa, synthetic construct
  source 1..25: note = Seed: NSCVKLQTVHSIPLTINKEEALQRP
NSCVKLQTVHSIPITIHKNEALQRP

SEQ ID NO: 39821 - protein, 25 aa, synthetic construct
  source 1..25: note = Seed: NSCVKLQTVHSIPLTINKEEALQRP
NSCVKLQTVHSIPITIHKNEAMQRP

SEQ ID NO: 39822 - protein, 25 aa, synthetic construct
  source 1..25: note = Seed: NSCVKLQTVHSIPLTINKEEALQRP
NSCVKLQTVHSIPITIHKNEAVQRP

SEQ ID NO: 39823 - protein, 25 aa, synthetic construct
  source 1..25: note = Seed: NSCVKLQTVHSIPLTINKEEALQRP
NSCVKLQTVHSIPITIHKNEAYQRP

SEQ ID NO: 39824 - protein, 25 aa, synthetic construct
  source 1..25: note = Seed: NSCVKLQTVHSIPLTINKEEALQRP
NSCVKLQTVHSIPITIHKPEAIQRP

SEQ ID NO: 39825 - protein, 25 aa, synthetic construct
  source 1..25: note = Seed: NSCVKLQTVHSIPLTINKEEALQRP
NSCVKLQTVHSIPITIHKPEAVQRP

SEQ ID NO: 39826 - protein, 25 aa, synthetic construct
  source 1..25: note = Seed: NSCVKLQTVHSIPLTINKEEALQRP
NSCVKLQTVHSIPITIHKREAAQRP

SEQ ID NO: 39827 - protein, 25 aa, synthetic construct
  source 1..25: note = Seed: NSCVKLQTVHSIPLTINKEEALQRP
NSCVKLQTVHSIPITIHKREAFQRP

SEQ ID NO: 39828 - protein, 25 aa, synthetic construct
  source 1..25: note = Seed: NSCVKLQTVHSIPLTINKEEALQRP
NSCVKLQTVHSIPITIHKREAIQRP

SEQ ID NO: 39829 - protein, 25 aa, synthetic construct
  source 1..25: note = Seed: NSCVKLQTVHSIPLTINKEEALQRP
NSCVKLQTVHSIPITIHKREALQRP

SEQ ID NO: 39830 - protein, 25 aa, synthetic construct
  source 1..25: note = Seed: NSCVKLQTVHSIPLTINKEEALQRP
NSCVKLQTVHSIPITIHKREAMQRP

SEQ ID NO: 39831 - protein, 25 aa, synthetic construct
  source 1..25: note = Seed: NSCVKLQTVHSIPLTINKEEALQRP
NSCVKLQTVHSIPITIHKREARQRP

SEQ ID NO: 39832 - protein, 25 aa, synthetic construct
  source 1..25: note = Seed: NSCVKLQTVHSIPLTINKEEALQRP
NSCVKLQTVHSIPITIHKREASQRP

SEQ ID NO: 39833 - protein, 25 aa, synthetic construct
  source 1..25: note = Seed: NSCVKLQTVHSIPLTINKEEALQRP
NSCVKLQTVHSIPITIHKREAVQRP

SEQ ID NO: 39834 - protein, 25 aa, synthetic construct
  source 1..25: note = Seed: NSCVKLQTVHSIPLTINKEEALQRP
NSCVKLQTVHSIPITIHKREAWQRP

SEQ ID NO: 39835 - protein, 25 aa, synthetic construct
  source 1..25: note = Seed: NSCVKLQTVHSIPLTINKEEALQRP
NSCVKLQTVHSIPITIHKREAYQRP

SEQ ID NO: 39836 - protein, 25 aa, synthetic construct
  source 1..25: note = Seed: NSCVKLQTVHSIPLTINKEEALQRP
NSCVKLQTVHSIPITIHKSEAFQRP

SEQ ID NO: 39837 - protein, 25 aa, synthetic construct
  source 1..25: note = Seed: NSCVKLQTVHSIPLTINKEEALQRP
NSCVKLQTVHSIPITIHKSEAIQRP

SEQ ID NO: 39838 - protein, 25 aa, synthetic construct
  source 1..25: note = Seed: NSCVKLQTVHSIPLTINKEEALQRP
NSCVKLQTVHSIPITIHKSEALQRP

SEQ ID NO: 39839 - protein, 25 aa, synthetic construct
  source 1..25: note = Seed: NSCVKLQTVHSIPLTINKEEALQRP
NSCVKLQTVHSIPITIHKSEARQRP

SEQ ID NO: 39840 - protein, 25 aa, synthetic construct
  source 1..25: note = Seed: NSCVKLQTVHSIPLTINKEEALQRP
NSCVKLQTVHSIPITIHKSEAVQRP

SEQ ID NO: 39841 - protein, 25 aa, synthetic construct
  source 1..25: note = Seed: NSCVKLQTVHSIPLTINKEEALQRP
NSCVKLQTVHSIPITIHKSEAYQRP

SEQ ID NO: 39842 - protein, 25 aa, synthetic construct
  source 1..25: note = Seed: NSCVKLQTVHSIPLTINKEEALQRP
NSCVKLQTVHSIPITIHKTEAIQRP

SEQ ID NO: 39843 - protein, 25 aa, synthetic construct
  source 1..25: note = Seed: NSCVKLQTVHSIPLTINKEEALQRP
NSCVKLQTVHSIPITIHKTEARQRP

SEQ ID NO: 39844 - protein, 25 aa, synthetic construct
  source 1..25: note = Seed: NSCVKLQTVHSIPLTINKEEALQRP
NSCVKLQTVHSIPITIHKVEAIQRP

SEQ ID NO: 39845 - protein, 25 aa, synthetic construct
  source 1..25: note = Seed: NSCVKLQTVHSIPLTINKEEALQRP
NSCVKLQTVHSIPITIHKVEARQRP

SEQ ID NO: 39846 - protein, 25 aa, synthetic construct
  source 1..25: note = Seed: NSCVKLQTVHSIPLTINKEEALQRP
NSCVKLQTVHSIPITIIKAEAAQRP

SEQ ID NO: 39847 - protein, 25 aa, synthetic construct
  source 1..25: note = Seed: NSCVKLQTVHSIPLTINKEEALQRP
NSCVKLQTVHSIPITIIKAEACQRP

SEQ ID NO: 39848 - protein, 25 aa, synthetic construct
  source 1..25: note = Seed: NSCVKLQTVHSIPLTINKEEALQRP
NSCVKLQTVHSIPITIIKAEADQRP

SEQ ID NO: 39849 - protein, 25 aa, synthetic construct
  source 1..25: note = Seed: NSCVKLQTVHSIPLTINKEEALQRP
NSCVKLQTVHSIPITIIKAEAFQRP

SEQ ID NO: 39850 - protein, 25 aa, synthetic construct
  source 1..25: note = Seed: NSCVKLQTVHSIPLTINKEEALQRP
NSCVKLQTVHSIPITIIKAEAIQRP

SEQ ID NO: 39851 - protein, 25 aa, synthetic construct
  source 1..25: note = Seed: NSCVKLQTVHSIPLTINKEEALQRP
NSCVKLQTVHSIPITIIKAEAMQRP

SEQ ID NO: 39852 - protein, 25 aa, synthetic construct
  source 1..25: note = Seed: NSCVKLQTVHSIPLTINKEEALQRP
NSCVKLQTVHSIPITIIKAEARQRP

SEQ ID NO: 39853 - protein, 25 aa, synthetic construct
  source 1..25: note = Seed: NSCVKLQTVHSIPLTINKEEALQRP
NSCVKLQTVHSIPITIIKAEASQRP

SEQ ID NO: 39854 - protein, 25 aa, synthetic construct
  source 1..25: note = Seed: NSCVKLQTVHSIPLTINKEEALQRP
NSCVKLQTVHSIPITIIKAEATQRP

SEQ ID NO: 39855 - protein, 25 aa, synthetic construct
  source 1..25: note = Seed: NSCVKLQTVHSIPLTINKEEALQRP
NSCVKLQTVHSIPITIIKAEAVQRP

SEQ ID NO: 39856 - protein, 25 aa, synthetic construct
  source 1..25: note = Seed: NSCVKLQTVHSIPLTINKEEALQRP
NSCVKLQTVHSIPITIIKAEAYQRP

SEQ ID NO: 39857 - protein, 25 aa, synthetic construct
  source 1..25: note = Seed: NSCVKLQTVHSIPLTINKEEALQRP
NSCVKLQTVHSIPITIIKDEAAQRP

SEQ ID NO: 39858 - protein, 25 aa, synthetic construct
  source 1..25: note = Seed: NSCVKLQTVHSIPLTINKEEALQRP
NSCVKLQTVHSIPITIIKDEACQRP

SEQ ID NO: 39859 - protein, 25 aa, synthetic construct
  source 1..25: note = Seed: NSCVKLQTVHSIPLTINKEEALQRP
NSCVKLQTVHSIPITIIKDEAFQRP

SEQ ID NO: 39860 - protein, 25 aa, synthetic construct
  source 1..25: note = Seed: NSCVKLQTVHSIPLTINKEEALQRP
NSCVKLQTVHSIPITIIKDEAIQRP

SEQ ID NO: 39861 - protein, 25 aa, synthetic construct
  source 1..25: note = Seed: NSCVKLQTVHSIPLTINKEEALQRP
NSCVKLQTVHSIPITIIKDEALQRP

SEQ ID NO: 39862 - protein, 25 aa, synthetic construct
  source 1..25: note = Seed: NSCVKLQTVHSIPLTINKEEALQRP
NSCVKLQTVHSIPITIIKDEAMQRP

SEQ ID NO: 39863 - protein, 25 aa, synthetic construct
  source 1..25: note = Seed: NSCVKLQTVHSIPLTINKEEALQRP
NSCVKLQTVHSIPITIIKDEASQRP

SEQ ID NO: 39864 - protein, 25 aa, synthetic construct
  source 1..25: note = Seed: NSCVKLQTVHSIPLTINKEEALQRP
NSCVKLQTVHSIPITIIKDEATQRP

SEQ ID NO: 39865 - protein, 25 aa, synthetic construct
  source 1..25: note = Seed: NSCVKLQTVHSIPLTINKEEALQRP
NSCVKLQTVHSIPITIIKDEAVQRP

SEQ ID NO: 39866 - protein, 25 aa, synthetic construct
  source 1..25: note = Seed: NSCVKLQTVHSIPLTINKEEALQRP
NSCVKLQTVHSIPITIIKDEAYQRP

SEQ ID NO: 39867 - protein, 25 aa, synthetic construct
  source 1..25: note = Seed: NSCVKLQTVHSIPLTINKEEALQRP
NSCVKLQTVHSIPITIIKFEAAQRP

SEQ ID NO: 39868 - protein, 25 aa, synthetic construct
  source 1..25: note = Seed: NSCVKLQTVHSIPLTINKEEALQRP
NSCVKLQTVHSIPITIIKFEADQRP

SEQ ID NO: 39869 - protein, 25 aa, synthetic construct
  source 1..25: note = Seed: NSCVKLQTVHSIPLTINKEEALQRP
NSCVKLQTVHSIPITIIKFEAEQRP

SEQ ID NO: 39870 - protein, 25 aa, synthetic construct
  source 1..25: note = Seed: NSCVKLQTVHSIPLTINKEEALQRP
NSCVKLQTVHSIPITIIKFEAFQRP

SEQ ID NO: 39871 - protein, 25 aa, synthetic construct
  source 1..25: note = Seed: NSCVKLQTVHSIPLTINKEEALQRP
NSCVKLQTVHSIPITIIKFEAHQRP

SEQ ID NO: 39872 - protein, 25 aa, synthetic construct
  source 1..25: note = Seed: NSCVKLQTVHSIPLTINKEEALQRP
NSCVKLQTVHSIPITIIKFEAIQRP

SEQ ID NO: 39873 - protein, 25 aa, synthetic construct
  source 1..25: note = Seed: NSCVKLQTVHSIPLTINKEEALQRP
NSCVKLQTVHSIPITIIKFEALQRP

SEQ ID NO: 39874 - protein, 25 aa, synthetic construct
  source 1..25: note = Seed: NSCVKLQTVHSIPLTINKEEALQRP
NSCVKLQTVHSIPITIIKFEAMQRP

SEQ ID NO: 39875 - protein, 25 aa, synthetic construct
  source 1..25: note = Seed: NSCVKLQTVHSIPLTINKEEALQRP
NSCVKLQTVHSIPITIIKFEANQRP

SEQ ID NO: 39876 - protein, 25 aa, synthetic construct
  source 1..25: note = Seed: NSCVKLQTVHSIPLTINKEEALQRP
NSCVKLQTVHSIPITIIKFEAPQRP

SEQ ID NO: 39877 - protein, 25 aa, synthetic construct
  source 1..25: note = Seed: NSCVKLQTVHSIPLTINKEEALQRP
NSCVKLQTVHSIPITIIKFEAQQRP

SEQ ID NO: 39878 - protein, 25 aa, synthetic construct
  source 1..25: note = Seed: NSCVKLQTVHSIPLTINKEEALQRP
NSCVKLQTVHSIPITIIKFEARQRP

SEQ ID NO: 39879 - protein, 25 aa, synthetic construct
  source 1..25: note = Seed: NSCVKLQTVHSIPLTINKEEALQRP
NSCVKLQTVHSIPITIIKFEASQRP

SEQ ID NO: 39880 - protein, 25 aa, synthetic construct
  source 1..25: note = Seed: NSCVKLQTVHSIPLTINKEEALQRP
NSCVKLQTVHSIPITIIKFEATQRP

SEQ ID NO: 39881 - protein, 25 aa, synthetic construct
  source 1..25: note = Seed: NSCVKLQTVHSIPLTINKEEALQRP
NSCVKLQTVHSIPITIIKFEAVQRP

SEQ ID NO: 39882 - protein, 25 aa, synthetic construct
  source 1..25: note = Seed: NSCVKLQTVHSIPLTINKEEALQRP
NSCVKLQTVHSIPITIIKFEAWQRP

SEQ ID NO: 39883 - protein, 25 aa, synthetic construct
  source 1..25: note = Seed: NSCVKLQTVHSIPLTINKEEALQRP
NSCVKLQTVHSIPITIIKFEAYQRP

SEQ ID NO: 39884 - protein, 25 aa, synthetic construct
  source 1..25: note = Seed: NSCVKLQTVHSIPLTINKEEALQRP
NSCVKLQTVHSIPITIIKGEAAQRP

SEQ ID NO: 39885 - protein, 25 aa, synthetic construct
  source 1..25: note = Seed: NSCVKLQTVHSIPLTINKEEALQRP
NSCVKLQTVHSIPITIIKGEAIQRP

SEQ ID NO: 39886 - protein, 25 aa, synthetic construct
  source 1..25: note = Seed: NSCVKLQTVHSIPLTINKEEALQRP
NSCVKLQTVHSIPITIIKGEALQRP

SEQ ID NO: 39887 - protein, 25 aa, synthetic construct
  source 1..25: note = Seed: NSCVKLQTVHSIPLTINKEEALQRP
NSCVKLQTVHSIPITIIKGEAVQRP

SEQ ID NO: 39888 - protein, 25 aa, synthetic construct
  source 1..25: note = Seed: NSCVKLQTVHSIPLTINKEEALQRP
NSCVKLQTVHSIPITIIKHEAAQRP

SEQ ID NO: 39889 - protein, 25 aa, synthetic construct
  source 1..25: note = Seed: NSCVKLQTVHSIPLTINKEEALQRP
NSCVKLQTVHSIPITIIKHEAFQRP

SEQ ID NO: 39890 - protein, 25 aa, synthetic construct
  source 1..25: note = Seed: NSCVKLQTVHSIPLTINKEEALQRP
NSCVKLQTVHSIPITIIKHEAIQRP

SEQ ID NO: 39891 - protein, 25 aa, synthetic construct
  source 1..25: note = Seed: NSCVKLQTVHSIPLTINKEEALQRP
NSCVKLQTVHSIPITIIKHEALQRP

SEQ ID NO: 39892 - protein, 25 aa, synthetic construct
  source 1..25: note = Seed: NSCVKLQTVHSIPLTINKEEALQRP
NSCVKLQTVHSIPITIIKHEAMQRP

SEQ ID NO: 39893 - protein, 25 aa, synthetic construct
  source 1..25: note = Seed: NSCVKLQTVHSIPLTINKEEALQRP
NSCVKLQTVHSIPITIIKHEARQRP

SEQ ID NO: 39894 - protein, 25 aa, synthetic construct
  source 1..25: note = Seed: NSCVKLQTVHSIPLTINKEEALQRP
NSCVKLQTVHSIPITIIKHEAVQRP

SEQ ID NO: 39895 - protein, 25 aa, synthetic construct
  source 1..25: note = Seed: NSCVKLQTVHSIPLTINKEEALQRP
NSCVKLQTVHSIPITIIKHEAYQRP

SEQ ID NO: 39896 - protein, 25 aa, synthetic construct
  source 1..25: note = Seed: NSCVKLQTVHSIPLTINKEEALQRP
NSCVKLQTVHSIPITIIKIEAAQRP

SEQ ID NO: 39897 - protein, 25 aa, synthetic construct
  source 1..25: note = Seed: NSCVKLQTVHSIPLTINKEEALQRP
NSCVKLQTVHSIPITIIKIEACQRP

SEQ ID NO: 39898 - protein, 25 aa, synthetic construct
  source 1..25: note = Seed: NSCVKLQTVHSIPLTINKEEALQRP
NSCVKLQTVHSIPITIIKIEADQRP

SEQ ID NO: 39899 - protein, 25 aa, synthetic construct
  source 1..25: note = Seed: NSCVKLQTVHSIPLTINKEEALQRP
NSCVKLQTVHSIPITIIKIEAEQRP

SEQ ID NO: 39900 - protein, 25 aa, synthetic construct
  source 1..25: note = Seed: NSCVKLQTVHSIPLTINKEEALQRP
NSCVKLQTVHSIPITIIKIEAFQRP

SEQ ID NO: 39901 - protein, 25 aa, synthetic construct
  source 1..25: note = Seed: NSCVKLQTVHSIPLTINKEEALQRP
NSCVKLQTVHSIPITIIKIEAGQRP

SEQ ID NO: 39902 - protein, 25 aa, synthetic construct
  source 1..25: note = Seed: NSCVKLQTVHSIPLTINKEEALQRP
NSCVKLQTVHSIPITIIKIEAIQRP

SEQ ID NO: 39903 - protein, 25 aa, synthetic construct
  source 1..25: note = Seed: NSCVKLQTVHSIPLTINKEEALQRP
NSCVKLQTVHSIPITIIKIEALQRP

SEQ ID NO: 39904 - protein, 25 aa, synthetic construct
  source 1..25: note = Seed: NSCVKLQTVHSIPLTINKEEALQRP
NSCVKLQTVHSIPITIIKIEAMQRP

SEQ ID NO: 39905 - protein, 25 aa, synthetic construct
  source 1..25: note = Seed: NSCVKLQTVHSIPLTINKEEALQRP
NSCVKLQTVHSIPITIIKIEANQRP

SEQ ID NO: 39906 - protein, 25 aa, synthetic construct
  source 1..25: note = Seed: NSCVKLQTVHSIPLTINKEEALQRP
NSCVKLQTVHSIPITIIKIEAQQRP

SEQ ID NO: 39907 - protein, 25 aa, synthetic construct
  source 1..25: note = Seed: NSCVKLQTVHSIPLTINKEEALQRP
NSCVKLQTVHSIPITIIKIEARQRP

SEQ ID NO: 39908 - protein, 25 aa, synthetic construct
  source 1..25: note = Seed: NSCVKLQTVHSIPLTINKEEALQRP
NSCVKLQTVHSIPITIIKIEASQRP

SEQ ID NO: 39909 - protein, 25 aa, synthetic construct
  source 1..25: note = Seed: NSCVKLQTVHSIPLTINKEEALQRP
NSCVKLQTVHSIPITIIKIEATQRP

SEQ ID NO: 39910 - protein, 25 aa, synthetic construct
  source 1..25: note = Seed: NSCVKLQTVHSIPLTINKEEALQRP
NSCVKLQTVHSIPITIIKIEAVQRP

SEQ ID NO: 39911 - protein, 25 aa, synthetic construct
  source 1..25: note = Seed: NSCVKLQTVHSIPLTINKEEALQRP
NSCVKLQTVHSIPITIIKIEAYQRP

SEQ ID NO: 39912 - protein, 25 aa, synthetic construct
  source 1..25: note = Seed: NSCVKLQTVHSIPLTINKEEALQRP
NSCVKLQTVHSIPITIIKKEAAQRP

SEQ ID NO: 39913 - protein, 25 aa, synthetic construct
  source 1..25: note = Seed: NSCVKLQTVHSIPLTINKEEALQRP
NSCVKLQTVHSIPITIIKKEAFQRP

SEQ ID NO: 39914 - protein, 25 aa, synthetic construct
  source 1..25: note = Seed: NSCVKLQTVHSIPLTINKEEALQRP
NSCVKLQTVHSIPITIIKKEAIQRP

SEQ ID NO: 39915 - protein, 25 aa, synthetic construct
  source 1..25: note = Seed: NSCVKLQTVHSIPLTINKEEALQRP
NSCVKLQTVHSIPITIIKKEALQRP

SEQ ID NO: 39916 - protein, 25 aa, synthetic construct
  source 1..25: note = Seed: NSCVKLQTVHSIPLTINKEEALQRP
NSCVKLQTVHSIPITIIKKEAMQRP

SEQ ID NO: 39917 - protein, 25 aa, synthetic construct
  source 1..25: note = Seed: NSCVKLQTVHSIPLTINKEEALQRP
NSCVKLQTVHSIPITIIKKEARQRP

SEQ ID NO: 39918 - protein, 25 aa, synthetic construct
  source 1..25: note = Seed: NSCVKLQTVHSIPLTINKEEALQRP
NSCVKLQTVHSIPITIIKKEASQRP

SEQ ID NO: 39919 - protein, 25 aa, synthetic construct
  source 1..25: note = Seed: NSCVKLQTVHSIPLTINKEEALQRP
NSCVKLQTVHSIPITIIKKEAVQRP

SEQ ID NO: 39920 - protein, 25 aa, synthetic construct
  source 1..25: note = Seed: NSCVKLQTVHSIPLTINKEEALQRP
NSCVKLQTVHSIPITIIKKEAYQRP

SEQ ID NO: 39921 - protein, 25 aa, synthetic construct
  source 1..25: note = Seed: NSCVKLQTVHSIPLTINKEEALQRP
NSCVKLQTVHSIPITIIKLEAAQRP

SEQ ID NO: 39922 - protein, 25 aa, synthetic construct
  source 1..25: note = Seed: NSCVKLQTVHSIPLTINKEEALQRP
NSCVKLQTVHSIPITIIKLEADQRP

SEQ ID NO: 39923 - protein, 25 aa, synthetic construct
  source 1..25: note = Seed: NSCVKLQTVHSIPLTINKEEALQRP
NSCVKLQTVHSIPITIIKLEAFQRP

SEQ ID NO: 39924 - protein, 25 aa, synthetic construct
  source 1..25: note = Seed: NSCVKLQTVHSIPLTINKEEALQRP
NSCVKLQTVHSIPITIIKLEAGQRP

SEQ ID NO: 39925 - protein, 25 aa, synthetic construct
  source 1..25: note = Seed: NSCVKLQTVHSIPLTINKEEALQRP
NSCVKLQTVHSIPITIIKLEAIQRP

SEQ ID NO: 39926 - protein, 25 aa, synthetic construct
  source 1..25: note = Seed: NSCVKLQTVHSIPLTINKEEALQRP
NSCVKLQTVHSIPITIIKLEALQRP

SEQ ID NO: 39927 - protein, 25 aa, synthetic construct
  source 1..25: note = Seed: NSCVKLQTVHSIPLTINKEEALQRP
NSCVKLQTVHSIPITIIKLEAMQRP

SEQ ID NO: 39928 - protein, 25 aa, synthetic construct
  source 1..25: note = Seed: NSCVKLQTVHSIPLTINKEEALQRP
NSCVKLQTVHSIPITIIKLEANQRP

SEQ ID NO: 39929 - protein, 25 aa, synthetic construct
  source 1..25: note = Seed: NSCVKLQTVHSIPLTINKEEALQRP
NSCVKLQTVHSIPITIIKLEAQQRP

SEQ ID NO: 39930 - protein, 25 aa, synthetic construct
  source 1..25: note = Seed: NSCVKLQTVHSIPLTINKEEALQRP
NSCVKLQTVHSIPITIIKLEASQRP

SEQ ID NO: 39931 - protein, 25 aa, synthetic construct
  source 1..25: note = Seed: NSCVKLQTVHSIPLTINKEEALQRP
NSCVKLQTVHSIPITIIKLEATQRP

SEQ ID NO: 39932 - protein, 25 aa, synthetic construct
  source 1..25: note = Seed: NSCVKLQTVHSIPLTINKEEALQRP
NSCVKLQTVHSIPITIIKLEAVQRP

SEQ ID NO: 39933 - protein, 25 aa, synthetic construct
  source 1..25: note = Seed: NSCVKLQTVHSIPLTINKEEALQRP
NSCVKLQTVHSIPITIIKLEAYQRP

SEQ ID NO: 39934 - protein, 25 aa, synthetic construct
  source 1..25: note = Seed: NSCVKLQTVHSIPLTINKEEALQRP
NSCVKLQTVHSIPITIIKMEAAQRP

SEQ ID NO: 39935 - protein, 25 aa, synthetic construct
  source 1..25: note = Seed: NSCVKLQTVHSIPLTINKEEALQRP
NSCVKLQTVHSIPITIIKMEAFQRP

SEQ ID NO: 39936 - protein, 25 aa, synthetic construct
  source 1..25: note = Seed: NSCVKLQTVHSIPLTINKEEALQRP
NSCVKLQTVHSIPITIIKMEAGQRP

SEQ ID NO: 39937 - protein, 25 aa, synthetic construct
  source 1..25: note = Seed: NSCVKLQTVHSIPLTINKEEALQRP
NSCVKLQTVHSIPITIIKMEAIQRP

SEQ ID NO: 39938 - protein, 25 aa, synthetic construct
  source 1..25: note = Seed: NSCVKLQTVHSIPLTINKEEALQRP
NSCVKLQTVHSIPITIIKMEALQRP

SEQ ID NO: 39939 - protein, 25 aa, synthetic construct
  source 1..25: note = Seed: NSCVKLQTVHSIPLTINKEEALQRP
NSCVKLQTVHSIPITIIKMEAMQRP

SEQ ID NO: 39940 - protein, 25 aa, synthetic construct
  source 1..25: note = Seed: NSCVKLQTVHSIPLTINKEEALQRP
NSCVKLQTVHSIPITIIKMEANQRP

SEQ ID NO: 39941 - protein, 25 aa, synthetic construct
  source 1..25: note = Seed: NSCVKLQTVHSIPLTINKEEALQRP
NSCVKLQTVHSIPITIIKMEAQQRP

SEQ ID NO: 39942 - protein, 25 aa, synthetic construct
  source 1..25: note = Seed: NSCVKLQTVHSIPLTINKEEALQRP
NSCVKLQTVHSIPITIIKMEASQRP

SEQ ID NO: 39943 - protein, 25 aa, synthetic construct
  source 1..25: note = Seed: NSCVKLQTVHSIPLTINKEEALQRP
NSCVKLQTVHSIPITIIKMEATQRP

SEQ ID NO: 39944 - protein, 25 aa, synthetic construct
  source 1..25: note = Seed: NSCVKLQTVHSIPLTINKEEALQRP
NSCVKLQTVHSIPITIIKMEAVQRP

SEQ ID NO: 39945 - protein, 25 aa, synthetic construct
  source 1..25: note = Seed: NSCVKLQTVHSIPLTINKEEALQRP
NSCVKLQTVHSIPITIIKMEAYQRP

SEQ ID NO: 39946 - protein, 25 aa, synthetic construct
  source 1..25: note = Seed: NSCVKLQTVHSIPLTINKEEALQRP
NSCVKLQTVHSIPITIIKNEAAQRP

SEQ ID NO: 39947 - protein, 25 aa, synthetic construct
  source 1..25: note = Seed: NSCVKLQTVHSIPLTINKEEALQRP
NSCVKLQTVHSIPITIIKNEAFQRP

SEQ ID NO: 39948 - protein, 25 aa, synthetic construct
  source 1..25: note = Seed: NSCVKLQTVHSIPLTINKEEALQRP
NSCVKLQTVHSIPITIIKNEAIQRP

SEQ ID NO: 39949 - protein, 25 aa, synthetic construct
  source 1..25: note = Seed: NSCVKLQTVHSIPLTINKEEALQRP
NSCVKLQTVHSIPITIIKNEALQRP

SEQ ID NO: 39950 - protein, 25 aa, synthetic construct
  source 1..25: note = Seed: NSCVKLQTVHSIPLTINKEEALQRP
NSCVKLQTVHSIPITIIKNEAMQRP

SEQ ID NO: 39951 - protein, 25 aa, synthetic construct
  source 1..25: note = Seed: NSCVKLQTVHSIPLTINKEEALQRP
NSCVKLQTVHSIPITIIKNEAVQRP

SEQ ID NO: 39952 - protein, 25 aa, synthetic construct
  source 1..25: note = Seed: NSCVKLQTVHSIPLTINKEEALQRP
NSCVKLQTVHSIPITIIKNEAYQRP

SEQ ID NO: 39953 - protein, 25 aa, synthetic construct
  source 1..25: note = Seed: NSCVKLQTVHSIPLTINKEEALQRP
NSCVKLQTVHSIPITIIKPEAAQRP

SEQ ID NO: 39954 - protein, 25 aa, synthetic construct
  source 1..25: note = Seed: NSCVKLQTVHSIPLTINKEEALQRP
NSCVKLQTVHSIPITIIKPEAFQRP

SEQ ID NO: 39955 - protein, 25 aa, synthetic construct
  source 1..25: note = Seed: NSCVKLQTVHSIPLTINKEEALQRP
NSCVKLQTVHSIPITIIKPEAIQRP

SEQ ID NO: 39956 - protein, 25 aa, synthetic construct
  source 1..25: note = Seed: NSCVKLQTVHSIPLTINKEEALQRP
NSCVKLQTVHSIPITIIKPEALQRP

SEQ ID NO: 39957 - protein, 25 aa, synthetic construct
  source 1..25: note = Seed: NSCVKLQTVHSIPLTINKEEALQRP
NSCVKLQTVHSIPITIIKPEAVQRP

SEQ ID NO: 39958 - protein, 25 aa, synthetic construct
  source 1..25: note = Seed: NSCVKLQTVHSIPLTINKEEALQRP
NSCVKLQTVHSIPITIIKREAAQRP

SEQ ID NO: 39959 - protein, 25 aa, synthetic construct
  source 1..25: note = Seed: NSCVKLQTVHSIPLTINKEEALQRP
NSCVKLQTVHSIPITIIKREAFQRP

SEQ ID NO: 39960 - protein, 25 aa, synthetic construct
  source 1..25: note = Seed: NSCVKLQTVHSIPLTINKEEALQRP
NSCVKLQTVHSIPITIIKREAHQRP

SEQ ID NO: 39961 - protein, 25 aa, synthetic construct
  source 1..25: note = Seed: NSCVKLQTVHSIPLTINKEEALQRP
NSCVKLQTVHSIPITIIKREAIQRP

SEQ ID NO: 39962 - protein, 25 aa, synthetic construct
  source 1..25: note = Seed: NSCVKLQTVHSIPLTINKEEALQRP
NSCVKLQTVHSIPITIIKREAKQRP

SEQ ID NO: 39963 - protein, 25 aa, synthetic construct
  source 1..25: note = Seed: NSCVKLQTVHSIPLTINKEEALQRP
NSCVKLQTVHSIPITIIKREALQRP

SEQ ID NO: 39964 - protein, 25 aa, synthetic construct
  source 1..25: note = Seed: NSCVKLQTVHSIPLTINKEEALQRP
NSCVKLQTVHSIPITIIKREAMQRP

SEQ ID NO: 39965 - protein, 25 aa, synthetic construct
  source 1..25: note = Seed: NSCVKLQTVHSIPLTINKEEALQRP
NSCVKLQTVHSIPITIIKREARQRP

SEQ ID NO: 39966 - protein, 25 aa, synthetic construct
  source 1..25: note = Seed: NSCVKLQTVHSIPLTINKEEALQRP
NSCVKLQTVHSIPITIIKREASQRP

SEQ ID NO: 39967 - protein, 25 aa, synthetic construct
  source 1..25: note = Seed: NSCVKLQTVHSIPLTINKEEALQRP
NSCVKLQTVHSIPITIIKREATQRP

SEQ ID NO: 39968 - protein, 25 aa, synthetic construct
  source 1..25: note = Seed: NSCVKLQTVHSIPLTINKEEALQRP
NSCVKLQTVHSIPITIIKREAVQRP

SEQ ID NO: 39969 - protein, 25 aa, synthetic construct
  source 1..25: note = Seed: NSCVKLQTVHSIPLTINKEEALQRP
NSCVKLQTVHSIPITIIKREAYQRP

SEQ ID NO: 39970 - protein, 25 aa, synthetic construct
  source 1..25: note = Seed: NSCVKLQTVHSIPLTINKEEALQRP
NSCVKLQTVHSIPITIIKSEAAQRP

SEQ ID NO: 39971 - protein, 25 aa, synthetic construct
  source 1..25: note = Seed: NSCVKLQTVHSIPLTINKEEALQRP
NSCVKLQTVHSIPITIIKSEAFQRP

SEQ ID NO: 39972 - protein, 25 aa, synthetic construct
  source 1..25: note = Seed: NSCVKLQTVHSIPLTINKEEALQRP
NSCVKLQTVHSIPITIIKSEAIQRP

SEQ ID NO: 39973 - protein, 25 aa, synthetic construct
  source 1..25: note = Seed: NSCVKLQTVHSIPLTINKEEALQRP
NSCVKLQTVHSIPITIIKSEALQRP

SEQ ID NO: 39974 - protein, 25 aa, synthetic construct
  source 1..25: note = Seed: NSCVKLQTVHSIPLTINKEEALQRP
NSCVKLQTVHSIPITIIKSEAMQRP

SEQ ID NO: 39975 - protein, 25 aa, synthetic construct
  source 1..25: note = Seed: NSCVKLQTVHSIPLTINKEEALQRP
NSCVKLQTVHSIPITIIKSEARQRP

SEQ ID NO: 39976 - protein, 25 aa, synthetic construct
  source 1..25: note = Seed: NSCVKLQTVHSIPLTINKEEALQRP
NSCVKLQTVHSIPITIIKSEASQRP

SEQ ID NO: 39977 - protein, 25 aa, synthetic construct
  source 1..25: note = Seed: NSCVKLQTVHSIPLTINKEEALQRP
NSCVKLQTVHSIPITIIKSEAVQRP

SEQ ID NO: 39978 - protein, 25 aa, synthetic construct
  source 1..25: note = Seed: NSCVKLQTVHSIPLTINKEEALQRP
NSCVKLQTVHSIPITIIKSEAYQRP

SEQ ID NO: 39979 - protein, 25 aa, synthetic construct
  source 1..25: note = Seed: NSCVKLQTVHSIPLTINKEEALQRP
NSCVKLQTVHSIPITIIKTEAAQRP

SEQ ID NO: 39980 - protein, 25 aa, synthetic construct
  source 1..25: note = Seed: NSCVKLQTVHSIPLTINKEEALQRP
NSCVKLQTVHSIPITIIKTEAFQRP

SEQ ID NO: 39981 - protein, 25 aa, synthetic construct
  source 1..25: note = Seed: NSCVKLQTVHSIPLTINKEEALQRP
NSCVKLQTVHSIPITIIKTEAIQRP

SEQ ID NO: 39982 - protein, 25 aa, synthetic construct
  source 1..25: note = Seed: NSCVKLQTVHSIPLTINKEEALQRP
NSCVKLQTVHSIPITIIKTEALQRP

SEQ ID NO: 39983 - protein, 25 aa, synthetic construct
  source 1..25: note = Seed: NSCVKLQTVHSIPLTINKEEALQRP
NSCVKLQTVHSIPITIIKTEAMQRP

SEQ ID NO: 39984 - protein, 25 aa, synthetic construct
  source 1..25: note = Seed: NSCVKLQTVHSIPLTINKEEALQRP
NSCVKLQTVHSIPITIIKTEARQRP

SEQ ID NO: 39985 - protein, 25 aa, synthetic construct
  source 1..25: note = Seed: NSCVKLQTVHSIPLTINKEEALQRP
NSCVKLQTVHSIPITIIKTEASQRP

SEQ ID NO: 39986 - protein, 25 aa, synthetic construct
  source 1..25: note = Seed: NSCVKLQTVHSIPLTINKEEALQRP
NSCVKLQTVHSIPITIIKTEAVQRP

SEQ ID NO: 39987 - protein, 25 aa, synthetic construct
  source 1..25: note = Seed: NSCVKLQTVHSIPLTINKEEALQRP
NSCVKLQTVHSIPITIIKTEAYQRP

SEQ ID NO: 39988 - protein, 25 aa, synthetic construct
  source 1..25: note = Seed: NSCVKLQTVHSIPLTINKEEALQRP
NSCVKLQTVHSIPITIIKVEAAQRP

SEQ ID NO: 39989 - protein, 25 aa, synthetic construct
  source 1..25: note = Seed: NSCVKLQTVHSIPLTINKEEALQRP
NSCVKLQTVHSIPITIIKVEACQRP

SEQ ID NO: 39990 - protein, 25 aa, synthetic construct
  source 1..25: note = Seed: NSCVKLQTVHSIPLTINKEEALQRP
NSCVKLQTVHSIPITIIKVEADQRP

SEQ ID NO: 39991 - protein, 25 aa, synthetic construct
  source 1..25: note = Seed: NSCVKLQTVHSIPLTINKEEALQRP
NSCVKLQTVHSIPITIIKVEAFQRP

SEQ ID NO: 39992 - protein, 25 aa, synthetic construct
  source 1..25: note = Seed: NSCVKLQTVHSIPLTINKEEALQRP
NSCVKLQTVHSIPITIIKVEAGQRP

SEQ ID NO: 39993 - protein, 25 aa, synthetic construct
  source 1..25: note = Seed: NSCVKLQTVHSIPLTINKEEALQRP
NSCVKLQTVHSIPITIIKVEAIQRP

SEQ ID NO: 39994 - protein, 25 aa, synthetic construct
  source 1..25: note = Seed: NSCVKLQTVHSIPLTINKEEALQRP
NSCVKLQTVHSIPITIIKVEALQRP

SEQ ID NO: 39995 - protein, 25 aa, synthetic construct
  source 1..25: note = Seed: NSCVKLQTVHSIPLTINKEEALQRP
NSCVKLQTVHSIPITIIKVEAMQRP

SEQ ID NO: 39996 - protein, 25 aa, synthetic construct
  source 1..25: note = Seed: NSCVKLQTVHSIPLTINKEEALQRP
NSCVKLQTVHSIPITIIKVEANQRP

SEQ ID NO: 39997 - protein, 25 aa, synthetic construct
  source 1..25: note = Seed: NSCVKLQTVHSIPLTINKEEALQRP
NSCVKLQTVHSIPITIIKVEAQQRP

SEQ ID NO: 39998 - protein, 25 aa, synthetic construct
  source 1..25: note = Seed: NSCVKLQTVHSIPLTINKEEALQRP
NSCVKLQTVHSIPITIIKVEARQRP

SEQ ID NO: 39999 - protein, 25 aa, synthetic construct
  source 1..25: note = Seed: NSCVKLQTVHSIPLTINKEEALQRP
NSCVKLQTVHSIPITIIKVEASQRP

SEQ ID NO: 40000 - protein, 25 aa, synthetic construct
  source 1..25: note = Seed: NSCVKLQTVHSIPLTINKEEALQRP
NSCVKLQTVHSIPITIIKVEATQRP

SEQ ID NO: 40001 - protein, 25 aa, synthetic construct
  source 1..25: note = Seed: NSCVKLQTVHSIPLTINKEEALQRP
NSCVKLQTVHSIPITIIKVEAVQRP

SEQ ID NO: 40002 - protein, 25 aa, synthetic construct
  source 1..25: note = Seed: NSCVKLQTVHSIPLTINKEEALQRP
NSCVKLQTVHSIPITIIKVEAYQRP

SEQ ID NO: 40003 - protein, 25 aa, synthetic construct
  source 1..25: note = Seed: NSCVKLQTVHSIPLTINKEEALQRP
NSCVKLQTVHSIPITIIKWEAFQRP

SEQ ID NO: 40004 - protein, 25 aa, synthetic construct
  source 1..25: note = Seed: NSCVKLQTVHSIPLTINKEEALQRP
NSCVKLQTVHSIPITIIKWEAIQRP

SEQ ID NO: 40005 - protein, 25 aa, synthetic construct
  source 1..25: note = Seed: NSCVKLQTVHSIPLTINKEEALQRP
NSCVKLQTVHSIPITIIKWEALQRP

SEQ ID NO: 40006 - protein, 25 aa, synthetic construct
  source 1..25: note = Seed: NSCVKLQTVHSIPLTINKEEALQRP
NSCVKLQTVHSIPITIIKWEAMQRP

SEQ ID NO: 40007 - protein, 25 aa, synthetic construct
  source 1..25: note = Seed: NSCVKLQTVHSIPLTINKEEALQRP
NSCVKLQTVHSIPITIIKWEAVQRP

SEQ ID NO: 40008 - protein, 25 aa, synthetic construct
  source 1..25: note = Seed: NSCVKLQTVHSIPLTINKEEALQRP
NSCVKLQTVHSIPITIIKYEAFQRP

SEQ ID NO: 40009 - protein, 25 aa, synthetic construct
  source 1..25: note = Seed: NSCVKLQTVHSIPLTINKEEALQRP
NSCVKLQTVHSIPITIIKYEAIQRP

SEQ ID NO: 40010 - protein, 25 aa, synthetic construct
  source 1..25: note = Seed: NSCVKLQTVHSIPLTINKEEALQRP
NSCVKLQTVHSIPITIIKYEALQRP

SEQ ID NO: 40011 - protein, 25 aa, synthetic construct
  source 1..25: note = Seed: NSCVKLQTVHSIPLTINKEEALQRP
NSCVKLQTVHSIPITIIKYEAMQRP

SEQ ID NO: 40012 - protein, 25 aa, synthetic construct
  source 1..25: note = Seed: NSCVKLQTVHSIPLTINKEEALQRP
NSCVKLQTVHSIPITIIKYEAVQRP

SEQ ID NO: 40013 - protein, 25 aa, synthetic construct
  source 1..25: note = Seed: NSCVKLQTVHSIPLTINKEEALQRP
NSCVKLQTVHSIPITIIKYEAYQRP

SEQ ID NO: 40014 - protein, 25 aa, synthetic construct
  source 1..25: note = Seed: NSCVKLQTVHSIPLTINKEEALQRP
NSCVKLQTVHSIPITIKKFEAFQRP

SEQ ID NO: 40015 - protein, 25 aa, synthetic construct
  source 1..25: note = Seed: NSCVKLQTVHSIPLTINKEEALQRP
NSCVKLQTVHSIPITIKKFEAIQRP

SEQ ID NO: 40016 - protein, 25 aa, synthetic construct
  source 1..25: note = Seed: NSCVKLQTVHSIPLTINKEEALQRP
NSCVKLQTVHSIPITIKKFEALQRP

SEQ ID NO: 40017 - protein, 25 aa, synthetic construct
  source 1..25: note = Seed: NSCVKLQTVHSIPLTINKEEALQRP
NSCVKLQTVHSIPITIKKFEAVQRP

SEQ ID NO: 40018 - protein, 25 aa, synthetic construct
  source 1..25: note = Seed: NSCVKLQTVHSIPLTINKEEALQRP
NSCVKLQTVHSIPITIKKHEAFQRP

SEQ ID NO: 40019 - protein, 25 aa, synthetic construct
  source 1..25: note = Seed: NSCVKLQTVHSIPLTINKEEALQRP
NSCVKLQTVHSIPITIKKHEAIQRP

SEQ ID NO: 40020 - protein, 25 aa, synthetic construct
  source 1..25: note = Seed: NSCVKLQTVHSIPLTINKEEALQRP
NSCVKLQTVHSIPITIKKHEALQRP

SEQ ID NO: 40021 - protein, 25 aa, synthetic construct
  source 1..25: note = Seed: NSCVKLQTVHSIPLTINKEEALQRP
NSCVKLQTVHSIPITIKKKEALQRP

SEQ ID NO: 40022 - protein, 25 aa, synthetic construct
  source 1..25: note = Seed: NSCVKLQTVHSIPLTINKEEALQRP
NSCVKLQTVHSIPITIKKNEAIQRP

SEQ ID NO: 40023 - protein, 25 aa, synthetic construct
  source 1..25: note = Seed: NSCVKLQTVHSIPLTINKEEALQRP
NSCVKLQTVHSIPITIKKNEAVQRP

SEQ ID NO: 40024 - protein, 25 aa, synthetic construct
  source 1..25: note = Seed: NSCVKLQTVHSIPLTINKEEALQRP
NSCVKLQTVHSIPITIKKREAFQRP

SEQ ID NO: 40025 - protein, 25 aa, synthetic construct
  source 1..25: note = Seed: NSCVKLQTVHSIPLTINKEEALQRP
NSCVKLQTVHSIPITIKKREAIQRP

SEQ ID NO: 40026 - protein, 25 aa, synthetic construct
  source 1..25: note = Seed: NSCVKLQTVHSIPLTINKEEALQRP
NSCVKLQTVHSIPITIKKREALQRP

SEQ ID NO: 40027 - protein, 25 aa, synthetic construct
  source 1..25: note = Seed: NSCVKLQTVHSIPLTINKEEALQRP
NSCVKLQTVHSIPITIKKREAMQRP

SEQ ID NO: 40028 - protein, 25 aa, synthetic construct
  source 1..25: note = Seed: NSCVKLQTVHSIPLTINKEEALQRP
NSCVKLQTVHSIPITIKKREAVQRP

SEQ ID NO: 40029 - protein, 25 aa, synthetic construct
  source 1..25: note = Seed: NSCVKLQTVHSIPLTINKEEALQRP
NSCVKLQTVHSIPITIKKREAWQRP

SEQ ID NO: 40030 - protein, 25 aa, synthetic construct
  source 1..25: note = Seed: NSCVKLQTVHSIPLTINKEEALQRP
NSCVKLQTVHSIPITILKAEAAQRP

SEQ ID NO: 40031 - protein, 25 aa, synthetic construct
  source 1..25: note = Seed: NSCVKLQTVHSIPLTINKEEALQRP
NSCVKLQTVHSIPITILKAEACQRP

SEQ ID NO: 40032 - protein, 25 aa, synthetic construct
  source 1..25: note = Seed: NSCVKLQTVHSIPLTINKEEALQRP
NSCVKLQTVHSIPITILKAEAIQRP

SEQ ID NO: 40033 - protein, 25 aa, synthetic construct
  source 1..25: note = Seed: NSCVKLQTVHSIPLTINKEEALQRP
NSCVKLQTVHSIPITILKAEALQRP

SEQ ID NO: 40034 - protein, 25 aa, synthetic construct
  source 1..25: note = Seed: NSCVKLQTVHSIPLTINKEEALQRP
NSCVKLQTVHSIPITILKAEAMQRP

SEQ ID NO: 40035 - protein, 25 aa, synthetic construct
  source 1..25: note = Seed: NSCVKLQTVHSIPLTINKEEALQRP
NSCVKLQTVHSIPITILKAEANQRP

SEQ ID NO: 40036 - protein, 25 aa, synthetic construct
  source 1..25: note = Seed: NSCVKLQTVHSIPLTINKEEALQRP
NSCVKLQTVHSIPITILKAEASQRP

SEQ ID NO: 40037 - protein, 25 aa, synthetic construct
  source 1..25: note = Seed: NSCVKLQTVHSIPLTINKEEALQRP
NSCVKLQTVHSIPITILKAEATQRP

SEQ ID NO: 40038 - protein, 25 aa, synthetic construct
  source 1..25: note = Seed: NSCVKLQTVHSIPLTINKEEALQRP
NSCVKLQTVHSIPITILKAEAVQRP

SEQ ID NO: 40039 - protein, 25 aa, synthetic construct
  source 1..25: note = Seed: NSCVKLQTVHSIPLTINKEEALQRP
NSCVKLQTVHSIPITILKAEAYQRP

SEQ ID NO: 40040 - protein, 25 aa, synthetic construct
  source 1..25: note = Seed: NSCVKLQTVHSIPLTINKEEALQRP
NSCVKLQTVHSIPITILKDEAAQRP

SEQ ID NO: 40041 - protein, 25 aa, synthetic construct
  source 1..25: note = Seed: NSCVKLQTVHSIPLTINKEEALQRP
NSCVKLQTVHSIPITILKDEAFQRP

SEQ ID NO: 40042 - protein, 25 aa, synthetic construct
  source 1..25: note = Seed: NSCVKLQTVHSIPLTINKEEALQRP
NSCVKLQTVHSIPITILKDEAIQRP

SEQ ID NO: 40043 - protein, 25 aa, synthetic construct
  source 1..25: note = Seed: NSCVKLQTVHSIPLTINKEEALQRP
NSCVKLQTVHSIPITILKDEALQRP

SEQ ID NO: 40044 - protein, 25 aa, synthetic construct
  source 1..25: note = Seed: NSCVKLQTVHSIPLTINKEEALQRP
NSCVKLQTVHSIPITILKDEAMQRP

SEQ ID NO: 40045 - protein, 25 aa, synthetic construct
  source 1..25: note = Seed: NSCVKLQTVHSIPLTINKEEALQRP
NSCVKLQTVHSIPITILKDEASQRP

SEQ ID NO: 40046 - protein, 25 aa, synthetic construct
  source 1..25: note = Seed: NSCVKLQTVHSIPLTINKEEALQRP
NSCVKLQTVHSIPITILKDEAVQRP

SEQ ID NO: 40047 - protein, 25 aa, synthetic construct
  source 1..25: note = Seed: NSCVKLQTVHSIPLTINKEEALQRP
NSCVKLQTVHSIPITILKDEAYQRP

SEQ ID NO: 40048 - protein, 25 aa, synthetic construct
  source 1..25: note = Seed: NSCVKLQTVHSIPLTINKEEALQRP
NSCVKLQTVHSIPITILKFEAAQRP

SEQ ID NO: 40049 - protein, 25 aa, synthetic construct
  source 1..25: note = Seed: NSCVKLQTVHSIPLTINKEEALQRP
NSCVKLQTVHSIPITILKFEADQRP

SEQ ID NO: 40050 - protein, 25 aa, synthetic construct
  source 1..25: note = Seed: NSCVKLQTVHSIPLTINKEEALQRP
NSCVKLQTVHSIPITILKFEAEQRP

SEQ ID NO: 40051 - protein, 25 aa, synthetic construct
  source 1..25: note = Seed: NSCVKLQTVHSIPLTINKEEALQRP
NSCVKLQTVHSIPITILKFEAFQRP

SEQ ID NO: 40052 - protein, 25 aa, synthetic construct
  source 1..25: note = Seed: NSCVKLQTVHSIPLTINKEEALQRP
NSCVKLQTVHSIPITILKFEAHQRP

SEQ ID NO: 40053 - protein, 25 aa, synthetic construct
  source 1..25: note = Seed: NSCVKLQTVHSIPLTINKEEALQRP
NSCVKLQTVHSIPITILKFEAIQRP

SEQ ID NO: 40054 - protein, 25 aa, synthetic construct
  source 1..25: note = Seed: NSCVKLQTVHSIPLTINKEEALQRP
NSCVKLQTVHSIPITILKFEAKQRP

SEQ ID NO: 40055 - protein, 25 aa, synthetic construct
  source 1..25: note = Seed: NSCVKLQTVHSIPLTINKEEALQRP
NSCVKLQTVHSIPITILKFEALQRP

SEQ ID NO: 40056 - protein, 25 aa, synthetic construct
  source 1..25: note = Seed: NSCVKLQTVHSIPLTINKEEALQRP
NSCVKLQTVHSIPITILKFEAMQRP

SEQ ID NO: 40057 - protein, 25 aa, synthetic construct
  source 1..25: note = Seed: NSCVKLQTVHSIPLTINKEEALQRP
NSCVKLQTVHSIPITILKFEANQRP

SEQ ID NO: 40058 - protein, 25 aa, synthetic construct
  source 1..25: note = Seed: NSCVKLQTVHSIPLTINKEEALQRP
NSCVKLQTVHSIPITILKFEAPQRP

SEQ ID NO: 40059 - protein, 25 aa, synthetic construct
  source 1..25: note = Seed: NSCVKLQTVHSIPLTINKEEALQRP
NSCVKLQTVHSIPITILKFEAQQRP

SEQ ID NO: 40060 - protein, 25 aa, synthetic construct
  source 1..25: note = Seed: NSCVKLQTVHSIPLTINKEEALQRP
NSCVKLQTVHSIPITILKFEARQRP

SEQ ID NO: 40061 - protein, 25 aa, synthetic construct
  source 1..25: note = Seed: NSCVKLQTVHSIPLTINKEEALQRP
NSCVKLQTVHSIPITILKFEASQRP

SEQ ID NO: 40062 - protein, 25 aa, synthetic construct
  source 1..25: note = Seed: NSCVKLQTVHSIPLTINKEEALQRP
NSCVKLQTVHSIPITILKFEATQRP

SEQ ID NO: 40063 - protein, 25 aa, synthetic construct
  source 1..25: note = Seed: NSCVKLQTVHSIPLTINKEEALQRP
NSCVKLQTVHSIPITILKFEAVQRP

SEQ ID NO: 40064 - protein, 25 aa, synthetic construct
  source 1..25: note = Seed: NSCVKLQTVHSIPLTINKEEALQRP
NSCVKLQTVHSIPITILKFEAWQRP

SEQ ID NO: 40065 - protein, 25 aa, synthetic construct
  source 1..25: note = Seed: NSCVKLQTVHSIPLTINKEEALQRP
NSCVKLQTVHSIPITILKFEAYQRP

SEQ ID NO: 40066 - protein, 25 aa, synthetic construct
  source 1..25: note = Seed: NSCVKLQTVHSIPLTINKEEALQRP
NSCVKLQTVHSIPITILKGEAAQRP

SEQ ID NO: 40067 - protein, 25 aa, synthetic construct
  source 1..25: note = Seed: NSCVKLQTVHSIPLTINKEEALQRP
NSCVKLQTVHSIPITILKGEAIQRP

SEQ ID NO: 40068 - protein, 25 aa, synthetic construct
  source 1..25: note = Seed: NSCVKLQTVHSIPLTINKEEALQRP
NSCVKLQTVHSIPITILKGEALQRP

SEQ ID NO: 40069 - protein, 25 aa, synthetic construct
  source 1..25: note = Seed: NSCVKLQTVHSIPLTINKEEALQRP
NSCVKLQTVHSIPITILKGEAMQRP

SEQ ID NO: 40070 - protein, 25 aa, synthetic construct
  source 1..25: note = Seed: NSCVKLQTVHSIPLTINKEEALQRP
NSCVKLQTVHSIPITILKGEATQRP

SEQ ID NO: 40071 - protein, 25 aa, synthetic construct
  source 1..25: note = Seed: NSCVKLQTVHSIPLTINKEEALQRP
NSCVKLQTVHSIPITILKGEAVQRP

SEQ ID NO: 40072 - protein, 25 aa, synthetic construct
  source 1..25: note = Seed: NSCVKLQTVHSIPLTINKEEALQRP
NSCVKLQTVHSIPITILKIEAAQRP

SEQ ID NO: 40073 - protein, 25 aa, synthetic construct
  source 1..25: note = Seed: NSCVKLQTVHSIPLTINKEEALQRP
NSCVKLQTVHSIPITILKIEADQRP

SEQ ID NO: 40074 - protein, 25 aa, synthetic construct
  source 1..25: note = Seed: NSCVKLQTVHSIPLTINKEEALQRP
NSCVKLQTVHSIPITILKIEAFQRP

SEQ ID NO: 40075 - protein, 25 aa, synthetic construct
  source 1..25: note = Seed: NSCVKLQTVHSIPLTINKEEALQRP
NSCVKLQTVHSIPITILKIEAGQRP

SEQ ID NO: 40076 - protein, 25 aa, synthetic construct
  source 1..25: note = Seed: NSCVKLQTVHSIPLTINKEEALQRP
NSCVKLQTVHSIPITILKIEAIQRP

SEQ ID NO: 40077 - protein, 25 aa, synthetic construct
  source 1..25: note = Seed: NSCVKLQTVHSIPLTINKEEALQRP
NSCVKLQTVHSIPITILKIEALQRP

SEQ ID NO: 40078 - protein, 25 aa, synthetic construct
  source 1..25: note = Seed: NSCVKLQTVHSIPLTINKEEALQRP
NSCVKLQTVHSIPITILKIEAMQRP

SEQ ID NO: 40079 - protein, 25 aa, synthetic construct
  source 1..25: note = Seed: NSCVKLQTVHSIPLTINKEEALQRP
NSCVKLQTVHSIPITILKIEANQRP

SEQ ID NO: 40080 - protein, 25 aa, synthetic construct
  source 1..25: note = Seed: NSCVKLQTVHSIPLTINKEEALQRP
NSCVKLQTVHSIPITILKIEAQQRP

SEQ ID NO: 40081 - protein, 25 aa, synthetic construct
  source 1..25: note = Seed: NSCVKLQTVHSIPLTINKEEALQRP
NSCVKLQTVHSIPITILKIEASQRP

SEQ ID NO: 40082 - protein, 25 aa, synthetic construct
  source 1..25: note = Seed: NSCVKLQTVHSIPLTINKEEALQRP
NSCVKLQTVHSIPITILKIEATQRP

SEQ ID NO: 40083 - protein, 25 aa, synthetic construct
  source 1..25: note = Seed: NSCVKLQTVHSIPLTINKEEALQRP
NSCVKLQTVHSIPITILKIEAVQRP

SEQ ID NO: 40084 - protein, 25 aa, synthetic construct
  source 1..25: note = Seed: NSCVKLQTVHSIPLTINKEEALQRP
NSCVKLQTVHSIPITILKIEAYQRP

SEQ ID NO: 40085 - protein, 25 aa, synthetic construct
  source 1..25: note = Seed: NSCVKLQTVHSIPLTINKEEALQRP
NSCVKLQTVHSIPITILKKEAAQRP

SEQ ID NO: 40086 - protein, 25 aa, synthetic construct
  source 1..25: note = Seed: NSCVKLQTVHSIPLTINKEEALQRP
NSCVKLQTVHSIPITILKKEAFQRP

SEQ ID NO: 40087 - protein, 25 aa, synthetic construct
  source 1..25: note = Seed: NSCVKLQTVHSIPLTINKEEALQRP
NSCVKLQTVHSIPITILKKEAIQRP

SEQ ID NO: 40088 - protein, 25 aa, synthetic construct
  source 1..25: note = Seed: NSCVKLQTVHSIPLTINKEEALQRP
NSCVKLQTVHSIPITILKKEALQRP

SEQ ID NO: 40089 - protein, 25 aa, synthetic construct
  source 1..25: note = Seed: NSCVKLQTVHSIPLTINKEEALQRP
NSCVKLQTVHSIPITILKKEAMQRP

SEQ ID NO: 40090 - protein, 25 aa, synthetic construct
  source 1..25: note = Seed: NSCVKLQTVHSIPLTINKEEALQRP
NSCVKLQTVHSIPITILKKEARQRP

SEQ ID NO: 40091 - protein, 25 aa, synthetic construct
  source 1..25: note = Seed: NSCVKLQTVHSIPLTINKEEALQRP
NSCVKLQTVHSIPITILKKEAVQRP

SEQ ID NO: 40092 - protein, 25 aa, synthetic construct
  source 1..25: note = Seed: NSCVKLQTVHSIPLTINKEEALQRP
NSCVKLQTVHSIPITILKKEAYQRP

SEQ ID NO: 40093 - protein, 25 aa, synthetic construct
  source 1..25: note = Seed: NSCVKLQTVHSIPLTINKEEALQRP
NSCVKLQTVHSIPITILKLEAAQRP

SEQ ID NO: 40094 - protein, 25 aa, synthetic construct
  source 1..25: note = Seed: NSCVKLQTVHSIPLTINKEEALQRP
NSCVKLQTVHSIPITILKLEAFQRP

SEQ ID NO: 40095 - protein, 25 aa, synthetic construct
  source 1..25: note = Seed: NSCVKLQTVHSIPLTINKEEALQRP
NSCVKLQTVHSIPITILKLEAIQRP

SEQ ID NO: 40096 - protein, 25 aa, synthetic construct
  source 1..25: note = Seed: NSCVKLQTVHSIPLTINKEEALQRP
NSCVKLQTVHSIPITILKLEALQRP

SEQ ID NO: 40097 - protein, 25 aa, synthetic construct
  source 1..25: note = Seed: NSCVKLQTVHSIPLTINKEEALQRP
NSCVKLQTVHSIPITILKLEAMQRP

SEQ ID NO: 40098 - protein, 25 aa, synthetic construct
  source 1..25: note = Seed: NSCVKLQTVHSIPLTINKEEALQRP
NSCVKLQTVHSIPITILKLEASQRP

SEQ ID NO: 40099 - protein, 25 aa, synthetic construct
  source 1..25: note = Seed: NSCVKLQTVHSIPLTINKEEALQRP
NSCVKLQTVHSIPITILKLEAVQRP

SEQ ID NO: 40100 - protein, 25 aa, synthetic construct
  source 1..25: note = Seed: NSCVKLQTVHSIPLTINKEEALQRP
NSCVKLQTVHSIPITILKLEAYQRP

SEQ ID NO: 40101 - protein, 25 aa, synthetic construct
  source 1..25: note = Seed: NSCVKLQTVHSIPLTINKEEALQRP
NSCVKLQTVHSIPITILKMEAAQRP

SEQ ID NO: 40102 - protein, 25 aa, synthetic construct
  source 1..25: note = Seed: NSCVKLQTVHSIPLTINKEEALQRP
NSCVKLQTVHSIPITILKMEAFQRP

SEQ ID NO: 40103 - protein, 25 aa, synthetic construct
  source 1..25: note = Seed: NSCVKLQTVHSIPLTINKEEALQRP
NSCVKLQTVHSIPITILKMEAIQRP

SEQ ID NO: 40104 - protein, 25 aa, synthetic construct
  source 1..25: note = Seed: NSCVKLQTVHSIPLTINKEEALQRP
NSCVKLQTVHSIPITILKMEALQRP

SEQ ID NO: 40105 - protein, 25 aa, synthetic construct
  source 1..25: note = Seed: NSCVKLQTVHSIPLTINKEEALQRP
NSCVKLQTVHSIPITILKMEAMQRP

SEQ ID NO: 40106 - protein, 25 aa, synthetic construct
  source 1..25: note = Seed: NSCVKLQTVHSIPLTINKEEALQRP
NSCVKLQTVHSIPITILKMEASQRP

SEQ ID NO: 40107 - protein, 25 aa, synthetic construct
  source 1..25: note = Seed: NSCVKLQTVHSIPLTINKEEALQRP
NSCVKLQTVHSIPITILKMEAVQRP

SEQ ID NO: 40108 - protein, 25 aa, synthetic construct
  source 1..25: note = Seed: NSCVKLQTVHSIPLTINKEEALQRP
NSCVKLQTVHSIPITILKMEAYQRP

SEQ ID NO: 40109 - protein, 25 aa, synthetic construct
  source 1..25: note = Seed: NSCVKLQTVHSIPLTINKEEALQRP
NSCVKLQTVHSIPITILKNEAAQRP

SEQ ID NO: 40110 - protein, 25 aa, synthetic construct
  source 1..25: note = Seed: NSCVKLQTVHSIPLTINKEEALQRP
NSCVKLQTVHSIPITILKNEAFQRP

SEQ ID NO: 40111 - protein, 25 aa, synthetic construct
  source 1..25: note = Seed: NSCVKLQTVHSIPLTINKEEALQRP
NSCVKLQTVHSIPITILKNEAIQRP

SEQ ID NO: 40112 - protein, 25 aa, synthetic construct
  source 1..25: note = Seed: NSCVKLQTVHSIPLTINKEEALQRP
NSCVKLQTVHSIPITILKNEALQRP

SEQ ID NO: 40113 - protein, 25 aa, synthetic construct
  source 1..25: note = Seed: NSCVKLQTVHSIPLTINKEEALQRP
NSCVKLQTVHSIPITILKNEAMQRP

SEQ ID NO: 40114 - protein, 25 aa, synthetic construct
  source 1..25: note = Seed: NSCVKLQTVHSIPLTINKEEALQRP
NSCVKLQTVHSIPITILKNEAVQRP

SEQ ID NO: 40115 - protein, 25 aa, synthetic construct
  source 1..25: note = Seed: NSCVKLQTVHSIPLTINKEEALQRP
NSCVKLQTVHSIPITILKPEAAQRP

SEQ ID NO: 40116 - protein, 25 aa, synthetic construct
  source 1..25: note = Seed: NSCVKLQTVHSIPLTINKEEALQRP
NSCVKLQTVHSIPITILKPEAIQRP

SEQ ID NO: 40117 - protein, 25 aa, synthetic construct
  source 1..25: note = Seed: NSCVKLQTVHSIPLTINKEEALQRP
NSCVKLQTVHSIPITILKPEALQRP

SEQ ID NO: 40118 - protein, 25 aa, synthetic construct
  source 1..25: note = Seed: NSCVKLQTVHSIPLTINKEEALQRP
NSCVKLQTVHSIPITILKPEAVQRP

SEQ ID NO: 40119 - protein, 25 aa, synthetic construct
  source 1..25: note = Seed: NSCVKLQTVHSIPLTINKEEALQRP
NSCVKLQTVHSIPITILKREAAQRP

SEQ ID NO: 40120 - protein, 25 aa, synthetic construct
  source 1..25: note = Seed: NSCVKLQTVHSIPLTINKEEALQRP
NSCVKLQTVHSIPITILKREAFQRP

SEQ ID NO: 40121 - protein, 25 aa, synthetic construct
  source 1..25: note = Seed: NSCVKLQTVHSIPLTINKEEALQRP
NSCVKLQTVHSIPITILKREAHQRP

SEQ ID NO: 40122 - protein, 25 aa, synthetic construct
  source 1..25: note = Seed: NSCVKLQTVHSIPLTINKEEALQRP
NSCVKLQTVHSIPITILKREAIQRP

SEQ ID NO: 40123 - protein, 25 aa, synthetic construct
  source 1..25: note = Seed: NSCVKLQTVHSIPLTINKEEALQRP
NSCVKLQTVHSIPITILKREALQRP

SEQ ID NO: 40124 - protein, 25 aa, synthetic construct
  source 1..25: note = Seed: NSCVKLQTVHSIPLTINKEEALQRP
NSCVKLQTVHSIPITILKREAMQRP

SEQ ID NO: 40125 - protein, 25 aa, synthetic construct
  source 1..25: note = Seed: NSCVKLQTVHSIPLTINKEEALQRP
NSCVKLQTVHSIPITILKREARQRP

SEQ ID NO: 40126 - protein, 25 aa, synthetic construct
  source 1..25: note = Seed: NSCVKLQTVHSIPLTINKEEALQRP
NSCVKLQTVHSIPITILKREASQRP

SEQ ID NO: 40127 - protein, 25 aa, synthetic construct
  source 1..25: note = Seed: NSCVKLQTVHSIPLTINKEEALQRP
NSCVKLQTVHSIPITILKREATQRP

SEQ ID NO: 40128 - protein, 25 aa, synthetic construct
  source 1..25: note = Seed: NSCVKLQTVHSIPLTINKEEALQRP
NSCVKLQTVHSIPITILKREAVQRP

SEQ ID NO: 40129 - protein, 25 aa, synthetic construct
  source 1..25: note = Seed: NSCVKLQTVHSIPLTINKEEALQRP
NSCVKLQTVHSIPITILKREAYQRP

SEQ ID NO: 40130 - protein, 25 aa, synthetic construct
  source 1..25: note = Seed: NSCVKLQTVHSIPLTINKEEALQRP
NSCVKLQTVHSIPITILKSEAAQRP

SEQ ID NO: 40131 - protein, 25 aa, synthetic construct
  source 1..25: note = Seed: NSCVKLQTVHSIPLTINKEEALQRP
NSCVKLQTVHSIPITILKSEAIQRP

SEQ ID NO: 40132 - protein, 25 aa, synthetic construct
  source 1..25: note = Seed: NSCVKLQTVHSIPLTINKEEALQRP
NSCVKLQTVHSIPITILKSEALQRP

SEQ ID NO: 40133 - protein, 25 aa, synthetic construct
  source 1..25: note = Seed: NSCVKLQTVHSIPLTINKEEALQRP
NSCVKLQTVHSIPITILKSEAMQRP

SEQ ID NO: 40134 - protein, 25 aa, synthetic construct
  source 1..25: note = Seed: NSCVKLQTVHSIPLTINKEEALQRP
NSCVKLQTVHSIPITILKSEAVQRP

SEQ ID NO: 40135 - protein, 25 aa, synthetic construct
  source 1..25: note = Seed: NSCVKLQTVHSIPLTINKEEALQRP
NSCVKLQTVHSIPITILKSEAYQRP

SEQ ID NO: 40136 - protein, 25 aa, synthetic construct
  source 1..25: note = Seed: NSCVKLQTVHSIPLTINKEEALQRP
NSCVKLQTVHSIPITILKTEAAQRP

SEQ ID NO: 40137 - protein, 25 aa, synthetic construct
  source 1..25: note = Seed: NSCVKLQTVHSIPLTINKEEALQRP
NSCVKLQTVHSIPITILKTEAIQRP

SEQ ID NO: 40138 - protein, 25 aa, synthetic construct
  source 1..25: note = Seed: NSCVKLQTVHSIPLTINKEEALQRP
NSCVKLQTVHSIPITILKTEALQRP

SEQ ID NO: 40139 - protein, 25 aa, synthetic construct
  source 1..25: note = Seed: NSCVKLQTVHSIPLTINKEEALQRP
NSCVKLQTVHSIPITILKTEAMQRP

SEQ ID NO: 40140 - protein, 25 aa, synthetic construct
  source 1..25: note = Seed: NSCVKLQTVHSIPLTINKEEALQRP
NSCVKLQTVHSIPITILKTEAVQRP

SEQ ID NO: 40141 - protein, 25 aa, synthetic construct
  source 1..25: note = Seed: NSCVKLQTVHSIPLTINKEEALQRP
NSCVKLQTVHSIPITILKVEAAQRP

SEQ ID NO: 40142 - protein, 25 aa, synthetic construct
  source 1..25: note = Seed: NSCVKLQTVHSIPLTINKEEALQRP
NSCVKLQTVHSIPITILKVEAFQRP

SEQ ID NO: 40143 - protein, 25 aa, synthetic construct
  source 1..25: note = Seed: NSCVKLQTVHSIPLTINKEEALQRP
NSCVKLQTVHSIPITILKVEAGQRP

SEQ ID NO: 40144 - protein, 25 aa, synthetic construct
  source 1..25: note = Seed: NSCVKLQTVHSIPLTINKEEALQRP
NSCVKLQTVHSIPITILKVEAIQRP

SEQ ID NO: 40145 - protein, 25 aa, synthetic construct
  source 1..25: note = Seed: NSCVKLQTVHSIPLTINKEEALQRP
NSCVKLQTVHSIPITILKVEALQRP

SEQ ID NO: 40146 - protein, 25 aa, synthetic construct
  source 1..25: note = Seed: NSCVKLQTVHSIPLTINKEEALQRP
NSCVKLQTVHSIPITILKVEAMQRP

SEQ ID NO: 40147 - protein, 25 aa, synthetic construct
  source 1..25: note = Seed: NSCVKLQTVHSIPLTINKEEALQRP
NSCVKLQTVHSIPITILKVEANQRP

SEQ ID NO: 40148 - protein, 25 aa, synthetic construct
  source 1..25: note = Seed: NSCVKLQTVHSIPLTINKEEALQRP
NSCVKLQTVHSIPITILKVEASQRP

SEQ ID NO: 40149 - protein, 25 aa, synthetic construct
  source 1..25: note = Seed: NSCVKLQTVHSIPLTINKEEALQRP
NSCVKLQTVHSIPITILKVEATQRP

SEQ ID NO: 40150 - protein, 25 aa, synthetic construct
  source 1..25: note = Seed: NSCVKLQTVHSIPLTINKEEALQRP
NSCVKLQTVHSIPITILKVEAVQRP

SEQ ID NO: 40151 - protein, 25 aa, synthetic construct
  source 1..25: note = Seed: NSCVKLQTVHSIPLTINKEEALQRP
NSCVKLQTVHSIPITILKVEAYQRP

SEQ ID NO: 40152 - protein, 25 aa, synthetic construct
  source 1..25: note = Seed: NSCVKLQTVHSIPLTINKEEALQRP
NSCVKLQTVHSIPITILKWEAFQRP

SEQ ID NO: 40153 - protein, 25 aa, synthetic construct
  source 1..25: note = Seed: NSCVKLQTVHSIPLTINKEEALQRP
NSCVKLQTVHSIPITILKWEAIQRP

SEQ ID NO: 40154 - protein, 25 aa, synthetic construct
  source 1..25: note = Seed: NSCVKLQTVHSIPLTINKEEALQRP
NSCVKLQTVHSIPITILKWEALQRP

SEQ ID NO: 40155 - protein, 25 aa, synthetic construct
  source 1..25: note = Seed: NSCVKLQTVHSIPLTINKEEALQRP
NSCVKLQTVHSIPITILKWEAMQRP

SEQ ID NO: 40156 - protein, 25 aa, synthetic construct
  source 1..25: note = Seed: NSCVKLQTVHSIPLTINKEEALQRP
NSCVKLQTVHSIPITILKWEAVQRP

SEQ ID NO: 40157 - protein, 25 aa, synthetic construct
  source 1..25: note = Seed: NSCVKLQTVHSIPLTINKEEALQRP
NSCVKLQTVHSIPITILKYEAFQRP

SEQ ID NO: 40158 - protein, 25 aa, synthetic construct
  source 1..25: note = Seed: NSCVKLQTVHSIPLTINKEEALQRP
NSCVKLQTVHSIPITILKYEAIQRP

SEQ ID NO: 40159 - protein, 25 aa, synthetic construct
  source 1..25: note = Seed: NSCVKLQTVHSIPLTINKEEALQRP
NSCVKLQTVHSIPITILKYEALQRP

SEQ ID NO: 40160 - protein, 25 aa, synthetic construct
  source 1..25: note = Seed: NSCVKLQTVHSIPLTINKEEALQRP
NSCVKLQTVHSIPITILKYEAMQRP

SEQ ID NO: 40161 - protein, 25 aa, synthetic construct
  source 1..25: note = Seed: NSCVKLQTVHSIPLTINKEEALQRP
NSCVKLQTVHSIPITILKYEAVQRP

SEQ ID NO: 40162 - protein, 25 aa, synthetic construct
  source 1..25: note = Seed: NSCVKLQTVHSIPLTINKEEALQRP
NSCVKLQTVHSIPITILKYEAYQRP

SEQ ID NO: 40163 - protein, 25 aa, synthetic construct
  source 1..25: note = Seed: NSCVKLQTVHSIPLTINKEEALQRP
NSCVKLQTVHSIPITIMKAEAAQRP

SEQ ID NO: 40164 - protein, 25 aa, synthetic construct
  source 1..25: note = Seed: NSCVKLQTVHSIPLTINKEEALQRP
NSCVKLQTVHSIPITIMKAEACQRP

SEQ ID NO: 40165 - protein, 25 aa, synthetic construct
  source 1..25: note = Seed: NSCVKLQTVHSIPLTINKEEALQRP
NSCVKLQTVHSIPITIMKAEAFQRP

SEQ ID NO: 40166 - protein, 25 aa, synthetic construct
  source 1..25: note = Seed: NSCVKLQTVHSIPLTINKEEALQRP
NSCVKLQTVHSIPITIMKAEAIQRP

SEQ ID NO: 40167 - protein, 25 aa, synthetic construct
  source 1..25: note = Seed: NSCVKLQTVHSIPLTINKEEALQRP
NSCVKLQTVHSIPITIMKAEALQRP

SEQ ID NO: 40168 - protein, 25 aa, synthetic construct
  source 1..25: note = Seed: NSCVKLQTVHSIPLTINKEEALQRP
NSCVKLQTVHSIPITIMKAEAMQRP

SEQ ID NO: 40169 - protein, 25 aa, synthetic construct
  source 1..25: note = Seed: NSCVKLQTVHSIPLTINKEEALQRP
NSCVKLQTVHSIPITIMKAEANQRP

SEQ ID NO: 40170 - protein, 25 aa, synthetic construct
  source 1..25: note = Seed: NSCVKLQTVHSIPLTINKEEALQRP
NSCVKLQTVHSIPITIMKAEAQQRP

SEQ ID NO: 40171 - protein, 25 aa, synthetic construct
  source 1..25: note = Seed: NSCVKLQTVHSIPLTINKEEALQRP
NSCVKLQTVHSIPITIMKAEARQRP

SEQ ID NO: 40172 - protein, 25 aa, synthetic construct
  source 1..25: note = Seed: NSCVKLQTVHSIPLTINKEEALQRP
NSCVKLQTVHSIPITIMKAEASQRP

SEQ ID NO: 40173 - protein, 25 aa, synthetic construct
  source 1..25: note = Seed: NSCVKLQTVHSIPLTINKEEALQRP
NSCVKLQTVHSIPITIMKAEATQRP

SEQ ID NO: 40174 - protein, 25 aa, synthetic construct
  source 1..25: note = Seed: NSCVKLQTVHSIPLTINKEEALQRP
NSCVKLQTVHSIPITIMKAEAVQRP

SEQ ID NO: 40175 - protein, 25 aa, synthetic construct
  source 1..25: note = Seed: NSCVKLQTVHSIPLTINKEEALQRP
NSCVKLQTVHSIPITIMKAEAYQRP

SEQ ID NO: 40176 - protein, 25 aa, synthetic construct
  source 1..25: note = Seed: NSCVKLQTVHSIPLTINKEEALQRP
NSCVKLQTVHSIPITIMKDEAAQRP

SEQ ID NO: 40177 - protein, 25 aa, synthetic construct
  source 1..25: note = Seed: NSCVKLQTVHSIPLTINKEEALQRP
NSCVKLQTVHSIPITIMKDEAFQRP

SEQ ID NO: 40178 - protein, 25 aa, synthetic construct
  source 1..25: note = Seed: NSCVKLQTVHSIPLTINKEEALQRP
NSCVKLQTVHSIPITIMKDEAIQRP

SEQ ID NO: 40179 - protein, 25 aa, synthetic construct
  source 1..25: note = Seed: NSCVKLQTVHSIPLTINKEEALQRP
NSCVKLQTVHSIPITIMKDEALQRP

SEQ ID NO: 40180 - protein, 25 aa, synthetic construct
  source 1..25: note = Seed: NSCVKLQTVHSIPLTINKEEALQRP
NSCVKLQTVHSIPITIMKDEAMQRP

SEQ ID NO: 40181 - protein, 25 aa, synthetic construct
  source 1..25: note = Seed: NSCVKLQTVHSIPLTINKEEALQRP
NSCVKLQTVHSIPITIMKDEASQRP

SEQ ID NO: 40182 - protein, 25 aa, synthetic construct
  source 1..25: note = Seed: NSCVKLQTVHSIPLTINKEEALQRP
NSCVKLQTVHSIPITIMKDEATQRP

SEQ ID NO: 40183 - protein, 25 aa, synthetic construct
  source 1..25: note = Seed: NSCVKLQTVHSIPLTINKEEALQRP
NSCVKLQTVHSIPITIMKDEAVQRP

SEQ ID NO: 40184 - protein, 25 aa, synthetic construct
  source 1..25: note = Seed: NSCVKLQTVHSIPLTINKEEALQRP
NSCVKLQTVHSIPITIMKDEAYQRP

SEQ ID NO: 40185 - protein, 25 aa, synthetic construct
  source 1..25: note = Seed: NSCVKLQTVHSIPLTINKEEALQRP
NSCVKLQTVHSIPITIMKFEAAQRP

SEQ ID NO: 40186 - protein, 25 aa, synthetic construct
  source 1..25: note = Seed: NSCVKLQTVHSIPLTINKEEALQRP
NSCVKLQTVHSIPITIMKFEADQRP

SEQ ID NO: 40187 - protein, 25 aa, synthetic construct
  source 1..25: note = Seed: NSCVKLQTVHSIPLTINKEEALQRP
NSCVKLQTVHSIPITIMKFEAEQRP

SEQ ID NO: 40188 - protein, 25 aa, synthetic construct
  source 1..25: note = Seed: NSCVKLQTVHSIPLTINKEEALQRP
NSCVKLQTVHSIPITIMKFEAFQRP

SEQ ID NO: 40189 - protein, 25 aa, synthetic construct
  source 1..25: note = Seed: NSCVKLQTVHSIPLTINKEEALQRP
NSCVKLQTVHSIPITIMKFEAHQRP

SEQ ID NO: 40190 - protein, 25 aa, synthetic construct
  source 1..25: note = Seed: NSCVKLQTVHSIPLTINKEEALQRP
NSCVKLQTVHSIPITIMKFEAIQRP

SEQ ID NO: 40191 - protein, 25 aa, synthetic construct
  source 1..25: note = Seed: NSCVKLQTVHSIPLTINKEEALQRP
NSCVKLQTVHSIPITIMKFEALQRP

SEQ ID NO: 40192 - protein, 25 aa, synthetic construct
  source 1..25: note = Seed: NSCVKLQTVHSIPLTINKEEALQRP
NSCVKLQTVHSIPITIMKFEAMQRP

SEQ ID NO: 40193 - protein, 25 aa, synthetic construct
  source 1..25: note = Seed: NSCVKLQTVHSIPLTINKEEALQRP
NSCVKLQTVHSIPITIMKFEANQRP

SEQ ID NO: 40194 - protein, 25 aa, synthetic construct
  source 1..25: note = Seed: NSCVKLQTVHSIPLTINKEEALQRP
NSCVKLQTVHSIPITIMKFEASQRP

SEQ ID NO: 40195 - protein, 25 aa, synthetic construct
  source 1..25: note = Seed: NSCVKLQTVHSIPLTINKEEALQRP
NSCVKLQTVHSIPITIMKFEATQRP

SEQ ID NO: 40196 - protein, 25 aa, synthetic construct
  source 1..25: note = Seed: NSCVKLQTVHSIPLTINKEEALQRP
NSCVKLQTVHSIPITIMKFEAVQRP

SEQ ID NO: 40197 - protein, 25 aa, synthetic construct
  source 1..25: note = Seed: NSCVKLQTVHSIPLTINKEEALQRP
NSCVKLQTVHSIPITIMKFEAYQRP

SEQ ID NO: 40198 - protein, 25 aa, synthetic construct
  source 1..25: note = Seed: NSCVKLQTVHSIPLTINKEEALQRP
NSCVKLQTVHSIPITIMKGEAAQRP

SEQ ID NO: 40199 - protein, 25 aa, synthetic construct
  source 1..25: note = Seed: NSCVKLQTVHSIPLTINKEEALQRP
NSCVKLQTVHSIPITIMKGEAIQRP

SEQ ID NO: 40200 - protein, 25 aa, synthetic construct
  source 1..25: note = Seed: NSCVKLQTVHSIPLTINKEEALQRP
NSCVKLQTVHSIPITIMKGEALQRP

SEQ ID NO: 40201 - protein, 25 aa, synthetic construct
  source 1..25: note = Seed: NSCVKLQTVHSIPLTINKEEALQRP
NSCVKLQTVHSIPITIMKGEAMQRP

SEQ ID NO: 40202 - protein, 25 aa, synthetic construct
  source 1..25: note = Seed: NSCVKLQTVHSIPLTINKEEALQRP
NSCVKLQTVHSIPITIMKGEATQRP

SEQ ID NO: 40203 - protein, 25 aa, synthetic construct
  source 1..25: note = Seed: NSCVKLQTVHSIPLTINKEEALQRP
NSCVKLQTVHSIPITIMKGEAVQRP

SEQ ID NO: 40204 - protein, 25 aa, synthetic construct
  source 1..25: note = Seed: NSCVKLQTVHSIPLTINKEEALQRP
NSCVKLQTVHSIPITIMKHEAIQRP

SEQ ID NO: 40205 - protein, 25 aa, synthetic construct
  source 1..25: note = Seed: NSCVKLQTVHSIPLTINKEEALQRP
NSCVKLQTVHSIPITIMKHEALQRP

SEQ ID NO: 40206 - protein, 25 aa, synthetic construct
  source 1..25: note = Seed: NSCVKLQTVHSIPLTINKEEALQRP
NSCVKLQTVHSIPITIMKHEARQRP

SEQ ID NO: 40207 - protein, 25 aa, synthetic construct
  source 1..25: note = Seed: NSCVKLQTVHSIPLTINKEEALQRP
NSCVKLQTVHSIPITIMKIEAAQRP

SEQ ID NO: 40208 - protein, 25 aa, synthetic construct
  source 1..25: note = Seed: NSCVKLQTVHSIPLTINKEEALQRP
NSCVKLQTVHSIPITIMKIEACQRP

SEQ ID NO: 40209 - protein, 25 aa, synthetic construct
  source 1..25: note = Seed: NSCVKLQTVHSIPLTINKEEALQRP
NSCVKLQTVHSIPITIMKIEADQRP

SEQ ID NO: 40210 - protein, 25 aa, synthetic construct
  source 1..25: note = Seed: NSCVKLQTVHSIPLTINKEEALQRP
NSCVKLQTVHSIPITIMKIEAEQRP

SEQ ID NO: 40211 - protein, 25 aa, synthetic construct
  source 1..25: note = Seed: NSCVKLQTVHSIPLTINKEEALQRP
NSCVKLQTVHSIPITIMKIEAFQRP

SEQ ID NO: 40212 - protein, 25 aa, synthetic construct
  source 1..25: note = Seed: NSCVKLQTVHSIPLTINKEEALQRP
NSCVKLQTVHSIPITIMKIEAGQRP

SEQ ID NO: 40213 - protein, 25 aa, synthetic construct
  source 1..25: note = Seed: NSCVKLQTVHSIPLTINKEEALQRP
NSCVKLQTVHSIPITIMKIEAIQRP

SEQ ID NO: 40214 - protein, 25 aa, synthetic construct
  source 1..25: note = Seed: NSCVKLQTVHSIPLTINKEEALQRP
NSCVKLQTVHSIPITIMKIEALQRP

SEQ ID NO: 40215 - protein, 25 aa, synthetic construct
  source 1..25: note = Seed: NSCVKLQTVHSIPLTINKEEALQRP
NSCVKLQTVHSIPITIMKIEAMQRP

SEQ ID NO: 40216 - protein, 25 aa, synthetic construct
  source 1..25: note = Seed: NSCVKLQTVHSIPLTINKEEALQRP
NSCVKLQTVHSIPITIMKIEANQRP

SEQ ID NO: 40217 - protein, 25 aa, synthetic construct
  source 1..25: note = Seed: NSCVKLQTVHSIPLTINKEEALQRP
NSCVKLQTVHSIPITIMKIEAQQRP

SEQ ID NO: 40218 - protein, 25 aa, synthetic construct
  source 1..25: note = Seed: NSCVKLQTVHSIPLTINKEEALQRP
NSCVKLQTVHSIPITIMKIEARQRP

SEQ ID NO: 40219 - protein, 25 aa, synthetic construct
  source 1..25: note = Seed: NSCVKLQTVHSIPLTINKEEALQRP
NSCVKLQTVHSIPITIMKIEASQRP

SEQ ID NO: 40220 - protein, 25 aa, synthetic construct
  source 1..25: note = Seed: NSCVKLQTVHSIPLTINKEEALQRP
NSCVKLQTVHSIPITIMKIEATQRP

SEQ ID NO: 40221 - protein, 25 aa, synthetic construct
  source 1..25: note = Seed: NSCVKLQTVHSIPLTINKEEALQRP
NSCVKLQTVHSIPITIMKIEAVQRP

SEQ ID NO: 40222 - protein, 25 aa, synthetic construct
  source 1..25: note = Seed: NSCVKLQTVHSIPLTINKEEALQRP
NSCVKLQTVHSIPITIMKIEAYQRP

SEQ ID NO: 40223 - protein, 25 aa, synthetic construct
  source 1..25: note = Seed: NSCVKLQTVHSIPLTINKEEALQRP
NSCVKLQTVHSIPITIMKKEAAQRP

SEQ ID NO: 40224 - protein, 25 aa, synthetic construct
  source 1..25: note = Seed: NSCVKLQTVHSIPLTINKEEALQRP
NSCVKLQTVHSIPITIMKKEAFQRP

SEQ ID NO: 40225 - protein, 25 aa, synthetic construct
  source 1..25: note = Seed: NSCVKLQTVHSIPLTINKEEALQRP
NSCVKLQTVHSIPITIMKKEAIQRP

SEQ ID NO: 40226 - protein, 25 aa, synthetic construct
  source 1..25: note = Seed: NSCVKLQTVHSIPLTINKEEALQRP
NSCVKLQTVHSIPITIMKKEALQRP

SEQ ID NO: 40227 - protein, 25 aa, synthetic construct
  source 1..25: note = Seed: NSCVKLQTVHSIPLTINKEEALQRP
NSCVKLQTVHSIPITIMKKEAMQRP

SEQ ID NO: 40228 - protein, 25 aa, synthetic construct
  source 1..25: note = Seed: NSCVKLQTVHSIPLTINKEEALQRP
NSCVKLQTVHSIPITIMKKEARQRP

SEQ ID NO: 40229 - protein, 25 aa, synthetic construct
  source 1..25: note = Seed: NSCVKLQTVHSIPLTINKEEALQRP
NSCVKLQTVHSIPITIMKKEASQRP

SEQ ID NO: 40230 - protein, 25 aa, synthetic construct
  source 1..25: note = Seed: NSCVKLQTVHSIPLTINKEEALQRP
NSCVKLQTVHSIPITIMKKEAVQRP

SEQ ID NO: 40231 - protein, 25 aa, synthetic construct
  source 1..25: note = Seed: NSCVKLQTVHSIPLTINKEEALQRP
NSCVKLQTVHSIPITIMKKEAYQRP

SEQ ID NO: 40232 - protein, 25 aa, synthetic construct
  source 1..25: note = Seed: NSCVKLQTVHSIPLTINKEEALQRP
NSCVKLQTVHSIPITIMKLEAAQRP

SEQ ID NO: 40233 - protein, 25 aa, synthetic construct
  source 1..25: note = Seed: NSCVKLQTVHSIPLTINKEEALQRP
NSCVKLQTVHSIPITIMKLEADQRP

SEQ ID NO: 40234 - protein, 25 aa, synthetic construct
  source 1..25: note = Seed: NSCVKLQTVHSIPLTINKEEALQRP
NSCVKLQTVHSIPITIMKLEAEQRP

SEQ ID NO: 40235 - protein, 25 aa, synthetic construct
  source 1..25: note = Seed: NSCVKLQTVHSIPLTINKEEALQRP
NSCVKLQTVHSIPITIMKLEAFQRP

SEQ ID NO: 40236 - protein, 25 aa, synthetic construct
  source 1..25: note = Seed: NSCVKLQTVHSIPLTINKEEALQRP
NSCVKLQTVHSIPITIMKLEAGQRP

SEQ ID NO: 40237 - protein, 25 aa, synthetic construct
  source 1..25: note = Seed: NSCVKLQTVHSIPLTINKEEALQRP
NSCVKLQTVHSIPITIMKLEAIQRP

SEQ ID NO: 40238 - protein, 25 aa, synthetic construct
  source 1..25: note = Seed: NSCVKLQTVHSIPLTINKEEALQRP
NSCVKLQTVHSIPITIMKLEALQRP

SEQ ID NO: 40239 - protein, 25 aa, synthetic construct
  source 1..25: note = Seed: NSCVKLQTVHSIPLTINKEEALQRP
NSCVKLQTVHSIPITIMKLEAMQRP

SEQ ID NO: 40240 - protein, 25 aa, synthetic construct
  source 1..25: note = Seed: NSCVKLQTVHSIPLTINKEEALQRP
NSCVKLQTVHSIPITIMKLEANQRP

SEQ ID NO: 40241 - protein, 25 aa, synthetic construct
  source 1..25: note = Seed: NSCVKLQTVHSIPLTINKEEALQRP
NSCVKLQTVHSIPITIMKLEAQQRP

SEQ ID NO: 40242 - protein, 25 aa, synthetic construct
  source 1..25: note = Seed: NSCVKLQTVHSIPLTINKEEALQRP
NSCVKLQTVHSIPITIMKLEASQRP

SEQ ID NO: 40243 - protein, 25 aa, synthetic construct
  source 1..25: note = Seed: NSCVKLQTVHSIPLTINKEEALQRP
NSCVKLQTVHSIPITIMKLEATQRP

SEQ ID NO: 40244 - protein, 25 aa, synthetic construct
  source 1..25: note = Seed: NSCVKLQTVHSIPLTINKEEALQRP
NSCVKLQTVHSIPITIMKLEAVQRP

SEQ ID NO: 40245 - protein, 25 aa, synthetic construct
  source 1..25: note = Seed: NSCVKLQTVHSIPLTINKEEALQRP
NSCVKLQTVHSIPITIMKLEAYQRP

SEQ ID NO: 40246 - protein, 25 aa, synthetic construct
  source 1..25: note = Seed: NSCVKLQTVHSIPLTINKEEALQRP
NSCVKLQTVHSIPITIMKMEAAQRP

SEQ ID NO: 40247 - protein, 25 aa, synthetic construct
  source 1..25: note = Seed: NSCVKLQTVHSIPLTINKEEALQRP
NSCVKLQTVHSIPITIMKMEADQRP

SEQ ID NO: 40248 - protein, 25 aa, synthetic construct
  source 1..25: note = Seed: NSCVKLQTVHSIPLTINKEEALQRP
NSCVKLQTVHSIPITIMKMEAFQRP

SEQ ID NO: 40249 - protein, 25 aa, synthetic construct
  source 1..25: note = Seed: NSCVKLQTVHSIPLTINKEEALQRP
NSCVKLQTVHSIPITIMKMEAIQRP

SEQ ID NO: 40250 - protein, 25 aa, synthetic construct
  source 1..25: note = Seed: NSCVKLQTVHSIPLTINKEEALQRP
NSCVKLQTVHSIPITIMKMEALQRP

SEQ ID NO: 40251 - protein, 25 aa, synthetic construct
  source 1..25: note = Seed: NSCVKLQTVHSIPLTINKEEALQRP
NSCVKLQTVHSIPITIMKMEAMQRP

SEQ ID NO: 40252 - protein, 25 aa, synthetic construct
  source 1..25: note = Seed: NSCVKLQTVHSIPLTINKEEALQRP
NSCVKLQTVHSIPITIMKMEANQRP

SEQ ID NO: 40253 - protein, 25 aa, synthetic construct
  source 1..25: note = Seed: NSCVKLQTVHSIPLTINKEEALQRP
NSCVKLQTVHSIPITIMKMEAQQRP

SEQ ID NO: 40254 - protein, 25 aa, synthetic construct
  source 1..25: note = Seed: NSCVKLQTVHSIPLTINKEEALQRP
NSCVKLQTVHSIPITIMKMEASQRP

SEQ ID NO: 40255 - protein, 25 aa, synthetic construct
  source 1..25: note = Seed: NSCVKLQTVHSIPLTINKEEALQRP
NSCVKLQTVHSIPITIMKMEATQRP

SEQ ID NO: 40256 - protein, 25 aa, synthetic construct
  source 1..25: note = Seed: NSCVKLQTVHSIPLTINKEEALQRP
NSCVKLQTVHSIPITIMKMEAVQRP

SEQ ID NO: 40257 - protein, 25 aa, synthetic construct
  source 1..25: note = Seed: NSCVKLQTVHSIPLTINKEEALQRP
NSCVKLQTVHSIPITIMKMEAYQRP

SEQ ID NO: 40258 - protein, 25 aa, synthetic construct
  source 1..25: note = Seed: NSCVKLQTVHSIPLTINKEEALQRP
NSCVKLQTVHSIPITIMKNEAAQRP

SEQ ID NO: 40259 - protein, 25 aa, synthetic construct
  source 1..25: note = Seed: NSCVKLQTVHSIPLTINKEEALQRP
NSCVKLQTVHSIPITIMKNEAFQRP

SEQ ID NO: 40260 - protein, 25 aa, synthetic construct
  source 1..25: note = Seed: NSCVKLQTVHSIPLTINKEEALQRP
NSCVKLQTVHSIPITIMKNEAIQRP

SEQ ID NO: 40261 - protein, 25 aa, synthetic construct
  source 1..25: note = Seed: NSCVKLQTVHSIPLTINKEEALQRP
NSCVKLQTVHSIPITIMKNEALQRP

SEQ ID NO: 40262 - protein, 25 aa, synthetic construct
  source 1..25: note = Seed: NSCVKLQTVHSIPLTINKEEALQRP
NSCVKLQTVHSIPITIMKNEAMQRP

SEQ ID NO: 40263 - protein, 25 aa, synthetic construct
  source 1..25: note = Seed: NSCVKLQTVHSIPLTINKEEALQRP
NSCVKLQTVHSIPITIMKNEASQRP

SEQ ID NO: 40264 - protein, 25 aa, synthetic construct
  source 1..25: note = Seed: NSCVKLQTVHSIPLTINKEEALQRP
NSCVKLQTVHSIPITIMKNEAVQRP

SEQ ID NO: 40265 - protein, 25 aa, synthetic construct
  source 1..25: note = Seed: NSCVKLQTVHSIPLTINKEEALQRP
NSCVKLQTVHSIPITIMKNEAYQRP

SEQ ID NO: 40266 - protein, 25 aa, synthetic construct
  source 1..25: note = Seed: NSCVKLQTVHSIPLTINKEEALQRP
NSCVKLQTVHSIPITIMKPEAAQRP

SEQ ID NO: 40267 - protein, 25 aa, synthetic construct
  source 1..25: note = Seed: NSCVKLQTVHSIPLTINKEEALQRP
NSCVKLQTVHSIPITIMKPEAIQRP

SEQ ID NO: 40268 - protein, 25 aa, synthetic construct
  source 1..25: note = Seed: NSCVKLQTVHSIPLTINKEEALQRP
NSCVKLQTVHSIPITIMKPEALQRP

SEQ ID NO: 40269 - protein, 25 aa, synthetic construct
  source 1..25: note = Seed: NSCVKLQTVHSIPLTINKEEALQRP
NSCVKLQTVHSIPITIMKPEAMQRP

SEQ ID NO: 40270 - protein, 25 aa, synthetic construct
  source 1..25: note = Seed: NSCVKLQTVHSIPLTINKEEALQRP
NSCVKLQTVHSIPITIMKPEAVQRP

SEQ ID NO: 40271 - protein, 25 aa, synthetic construct
  source 1..25: note = Seed: NSCVKLQTVHSIPLTINKEEALQRP
NSCVKLQTVHSIPITIMKREAAQRP

SEQ ID NO: 40272 - protein, 25 aa, synthetic construct
  source 1..25: note = Seed: NSCVKLQTVHSIPLTINKEEALQRP
NSCVKLQTVHSIPITIMKREAFQRP

SEQ ID NO: 40273 - protein, 25 aa, synthetic construct
  source 1..25: note = Seed: NSCVKLQTVHSIPLTINKEEALQRP
NSCVKLQTVHSIPITIMKREAHQRP

SEQ ID NO: 40274 - protein, 25 aa, synthetic construct
  source 1..25: note = Seed: NSCVKLQTVHSIPLTINKEEALQRP
NSCVKLQTVHSIPITIMKREAIQRP

SEQ ID NO: 40275 - protein, 25 aa, synthetic construct
  source 1..25: note = Seed: NSCVKLQTVHSIPLTINKEEALQRP
NSCVKLQTVHSIPITIMKREALQRP

SEQ ID NO: 40276 - protein, 25 aa, synthetic construct
  source 1..25: note = Seed: NSCVKLQTVHSIPLTINKEEALQRP
NSCVKLQTVHSIPITIMKREAMQRP

SEQ ID NO: 40277 - protein, 25 aa, synthetic construct
  source 1..25: note = Seed: NSCVKLQTVHSIPLTINKEEALQRP
NSCVKLQTVHSIPITIMKREARQRP

SEQ ID NO: 40278 - protein, 25 aa, synthetic construct
  source 1..25: note = Seed: NSCVKLQTVHSIPLTINKEEALQRP
NSCVKLQTVHSIPITIMKREASQRP

SEQ ID NO: 40279 - protein, 25 aa, synthetic construct
  source 1..25: note = Seed: NSCVKLQTVHSIPLTINKEEALQRP
NSCVKLQTVHSIPITIMKREATQRP

SEQ ID NO: 40280 - protein, 25 aa, synthetic construct
  source 1..25: note = Seed: NSCVKLQTVHSIPLTINKEEALQRP
NSCVKLQTVHSIPITIMKREAVQRP

SEQ ID NO: 40281 - protein, 25 aa, synthetic construct
  source 1..25: note = Seed: NSCVKLQTVHSIPLTINKEEALQRP
NSCVKLQTVHSIPITIMKREAYQRP

SEQ ID NO: 40282 - protein, 25 aa, synthetic construct
  source 1..25: note = Seed: NSCVKLQTVHSIPLTINKEEALQRP
NSCVKLQTVHSIPITIMKSEAAQRP

SEQ ID NO: 40283 - protein, 25 aa, synthetic construct
  source 1..25: note = Seed: NSCVKLQTVHSIPLTINKEEALQRP
NSCVKLQTVHSIPITIMKSEAFQRP

SEQ ID NO: 40284 - protein, 25 aa, synthetic construct
  source 1..25: note = Seed: NSCVKLQTVHSIPLTINKEEALQRP
NSCVKLQTVHSIPITIMKSEAIQRP

SEQ ID NO: 40285 - protein, 25 aa, synthetic construct
  source 1..25: note = Seed: NSCVKLQTVHSIPLTINKEEALQRP
NSCVKLQTVHSIPITIMKSEALQRP

SEQ ID NO: 40286 - protein, 25 aa, synthetic construct
  source 1..25: note = Seed: NSCVKLQTVHSIPLTINKEEALQRP
NSCVKLQTVHSIPITIMKSEAMQRP

SEQ ID NO: 40287 - protein, 25 aa, synthetic construct
  source 1..25: note = Seed: NSCVKLQTVHSIPLTINKEEALQRP
NSCVKLQTVHSIPITIMKSEASQRP

SEQ ID NO: 40288 - protein, 25 aa, synthetic construct
  source 1..25: note = Seed: NSCVKLQTVHSIPLTINKEEALQRP
NSCVKLQTVHSIPITIMKSEAVQRP

SEQ ID NO: 40289 - protein, 25 aa, synthetic construct
  source 1..25: note = Seed: NSCVKLQTVHSIPLTINKEEALQRP
NSCVKLQTVHSIPITIMKSEAYQRP

SEQ ID NO: 40290 - protein, 25 aa, synthetic construct
  source 1..25: note = Seed: NSCVKLQTVHSIPLTINKEEALQRP
NSCVKLQTVHSIPITIMKTEAAQRP

SEQ ID NO: 40291 - protein, 25 aa, synthetic construct
  source 1..25: note = Seed: NSCVKLQTVHSIPLTINKEEALQRP
NSCVKLQTVHSIPITIMKTEAFQRP

SEQ ID NO: 40292 - protein, 25 aa, synthetic construct
  source 1..25: note = Seed: NSCVKLQTVHSIPLTINKEEALQRP
NSCVKLQTVHSIPITIMKTEAIQRP

SEQ ID NO: 40293 - protein, 25 aa, synthetic construct
  source 1..25: note = Seed: NSCVKLQTVHSIPLTINKEEALQRP
NSCVKLQTVHSIPITIMKTEALQRP

SEQ ID NO: 40294 - protein, 25 aa, synthetic construct
  source 1..25: note = Seed: NSCVKLQTVHSIPLTINKEEALQRP
NSCVKLQTVHSIPITIMKTEAMQRP

SEQ ID NO: 40295 - protein, 25 aa, synthetic construct
  source 1..25: note = Seed: NSCVKLQTVHSIPLTINKEEALQRP
NSCVKLQTVHSIPITIMKTEAVQRP

SEQ ID NO: 40296 - protein, 25 aa, synthetic construct
  source 1..25: note = Seed: NSCVKLQTVHSIPLTINKEEALQRP
NSCVKLQTVHSIPITIMKTEAYQRP

SEQ ID NO: 40297 - protein, 25 aa, synthetic construct
  source 1..25: note = Seed: NSCVKLQTVHSIPLTINKEEALQRP
NSCVKLQTVHSIPITIMKVEAAQRP

SEQ ID NO: 40298 - protein, 25 aa, synthetic construct
  source 1..25: note = Seed: NSCVKLQTVHSIPLTINKEEALQRP
NSCVKLQTVHSIPITIMKVEACQRP

SEQ ID NO: 40299 - protein, 25 aa, synthetic construct
  source 1..25: note = Seed: NSCVKLQTVHSIPLTINKEEALQRP
NSCVKLQTVHSIPITIMKVEADQRP

SEQ ID NO: 40300 - protein, 25 aa, synthetic construct
  source 1..25: note = Seed: NSCVKLQTVHSIPLTINKEEALQRP
NSCVKLQTVHSIPITIMKVEAEQRP

SEQ ID NO: 40301 - protein, 25 aa, synthetic construct
  source 1..25: note = Seed: NSCVKLQTVHSIPLTINKEEALQRP
NSCVKLQTVHSIPITIMKVEAFQRP

SEQ ID NO: 40302 - protein, 25 aa, synthetic construct
  source 1..25: note = Seed: NSCVKLQTVHSIPLTINKEEALQRP
NSCVKLQTVHSIPITIMKVEAGQRP

SEQ ID NO: 40303 - protein, 25 aa, synthetic construct
  source 1..25: note = Seed: NSCVKLQTVHSIPLTINKEEALQRP
NSCVKLQTVHSIPITIMKVEAIQRP

SEQ ID NO: 40304 - protein, 25 aa, synthetic construct
  source 1..25: note = Seed: NSCVKLQTVHSIPLTINKEEALQRP
NSCVKLQTVHSIPITIMKVEALQRP

SEQ ID NO: 40305 - protein, 25 aa, synthetic construct
  source 1..25: note = Seed: NSCVKLQTVHSIPLTINKEEALQRP
NSCVKLQTVHSIPITIMKVEAMQRP

SEQ ID NO: 40306 - protein, 25 aa, synthetic construct
  source 1..25: note = Seed: NSCVKLQTVHSIPLTINKEEALQRP
NSCVKLQTVHSIPITIMKVEANQRP

SEQ ID NO: 40307 - protein, 25 aa, synthetic construct
  source 1..25: note = Seed: NSCVKLQTVHSIPLTINKEEALQRP
NSCVKLQTVHSIPITIMKVEAQQRP

SEQ ID NO: 40308 - protein, 25 aa, synthetic construct
  source 1..25: note = Seed: NSCVKLQTVHSIPLTINKEEALQRP
NSCVKLQTVHSIPITIMKVEARQRP

SEQ ID NO: 40309 - protein, 25 aa, synthetic construct
  source 1..25: note = Seed: NSCVKLQTVHSIPLTINKEEALQRP
NSCVKLQTVHSIPITIMKVEASQRP

SEQ ID NO: 40310 - protein, 25 aa, synthetic construct
  source 1..25: note = Seed: NSCVKLQTVHSIPLTINKEEALQRP
NSCVKLQTVHSIPITIMKVEATQRP

SEQ ID NO: 40311 - protein, 25 aa, synthetic construct
  source 1..25: note = Seed: NSCVKLQTVHSIPLTINKEEALQRP
NSCVKLQTVHSIPITIMKVEAVQRP

SEQ ID NO: 40312 - protein, 25 aa, synthetic construct
  source 1..25: note = Seed: NSCVKLQTVHSIPLTINKEEALQRP
NSCVKLQTVHSIPITIMKVEAYQRP

SEQ ID NO: 40313 - protein, 25 aa, synthetic construct
  source 1..25: note = Seed: NSCVKLQTVHSIPLTINKEEALQRP
NSCVKLQTVHSIPITIMKWEAFQRP

SEQ ID NO: 40314 - protein, 25 aa, synthetic construct
  source 1..25: note = Seed: NSCVKLQTVHSIPLTINKEEALQRP
NSCVKLQTVHSIPITIMKWEALQRP

SEQ ID NO: 40315 - protein, 25 aa, synthetic construct
  source 1..25: note = Seed: NSCVKLQTVHSIPLTINKEEALQRP
NSCVKLQTVHSIPITIMKYEAFQRP

SEQ ID NO: 40316 - protein, 25 aa, synthetic construct
  source 1..25: note = Seed: NSCVKLQTVHSIPLTINKEEALQRP
NSCVKLQTVHSIPITIMKYEAIQRP

SEQ ID NO: 40317 - protein, 25 aa, synthetic construct
  source 1..25: note = Seed: NSCVKLQTVHSIPLTINKEEALQRP
NSCVKLQTVHSIPITIMKYEALQRP

SEQ ID NO: 40318 - protein, 25 aa, synthetic construct
  source 1..25: note = Seed: NSCVKLQTVHSIPLTINKEEALQRP
NSCVKLQTVHSIPITIMKYEAVQRP

SEQ ID NO: 40319 - protein, 25 aa, synthetic construct
  source 1..25: note = Seed: NSCVKLQTVHSIPLTINKEEALQRP
NSCVKLQTVHSIPITINKAEAAQRP

SEQ ID NO: 40320 - protein, 25 aa, synthetic construct
  source 1..25: note = Seed: NSCVKLQTVHSIPLTINKEEALQRP
NSCVKLQTVHSIPITINKAEAFQRP

SEQ ID NO: 40321 - protein, 25 aa, synthetic construct
  source 1..25: note = Seed: NSCVKLQTVHSIPLTINKEEALQRP
NSCVKLQTVHSIPITINKAEAGQRP

SEQ ID NO: 40322 - protein, 25 aa, synthetic construct
  source 1..25: note = Seed: NSCVKLQTVHSIPLTINKEEALQRP
NSCVKLQTVHSIPITINKAEAHQRP

SEQ ID NO: 40323 - protein, 25 aa, synthetic construct
  source 1..25: note = Seed: NSCVKLQTVHSIPLTINKEEALQRP
NSCVKLQTVHSIPITINKAEAIQRP

SEQ ID NO: 40324 - protein, 25 aa, synthetic construct
  source 1..25: note = Seed: NSCVKLQTVHSIPLTINKEEALQRP
NSCVKLQTVHSIPITINKAEALQRP

SEQ ID NO: 40325 - protein, 25 aa, synthetic construct
  source 1..25: note = Seed: NSCVKLQTVHSIPLTINKEEALQRP
NSCVKLQTVHSIPITINKAEAMQRP

SEQ ID NO: 40326 - protein, 25 aa, synthetic construct
  source 1..25: note = Seed: NSCVKLQTVHSIPLTINKEEALQRP
NSCVKLQTVHSIPITINKAEANQRP

SEQ ID NO: 40327 - protein, 25 aa, synthetic construct
  source 1..25: note = Seed: NSCVKLQTVHSIPLTINKEEALQRP
NSCVKLQTVHSIPITINKAEAPQRP

SEQ ID NO: 40328 - protein, 25 aa, synthetic construct
  source 1..25: note = Seed: NSCVKLQTVHSIPLTINKEEALQRP
NSCVKLQTVHSIPITINKAEAQQRP

SEQ ID NO: 40329 - protein, 25 aa, synthetic construct
  source 1..25: note = Seed: NSCVKLQTVHSIPLTINKEEALQRP
NSCVKLQTVHSIPITINKAEARQRP

SEQ ID NO: 40330 - protein, 25 aa, synthetic construct
  source 1..25: note = Seed: NSCVKLQTVHSIPLTINKEEALQRP
NSCVKLQTVHSIPITINKAEASQRP

SEQ ID NO: 40331 - protein, 25 aa, synthetic construct
  source 1..25: note = Seed: NSCVKLQTVHSIPLTINKEEALQRP
NSCVKLQTVHSIPITINKAEATQRP

SEQ ID NO: 40332 - protein, 25 aa, synthetic construct
  source 1..25: note = Seed: NSCVKLQTVHSIPLTINKEEALQRP
NSCVKLQTVHSIPITINKAEAVQRP

SEQ ID NO: 40333 - protein, 25 aa, synthetic construct
  source 1..25: note = Seed: NSCVKLQTVHSIPLTINKEEALQRP
NSCVKLQTVHSIPITINKAEAWQRP

SEQ ID NO: 40334 - protein, 25 aa, synthetic construct
  source 1..25: note = Seed: NSCVKLQTVHSIPLTINKEEALQRP
NSCVKLQTVHSIPITINKAEAYQRP

SEQ ID NO: 40335 - protein, 25 aa, synthetic construct
  source 1..25: note = Seed: NSCVKLQTVHSIPLTINKEEALQRP
NSCVKLQTVHSIPITINKCEAFQRP

SEQ ID NO: 40336 - protein, 25 aa, synthetic construct
  source 1..25: note = Seed: NSCVKLQTVHSIPLTINKEEALQRP
NSCVKLQTVHSIPITINKCEAIQRP

SEQ ID NO: 40337 - protein, 25 aa, synthetic construct
  source 1..25: note = Seed: NSCVKLQTVHSIPLTINKEEALQRP
NSCVKLQTVHSIPITINKCEALQRP

SEQ ID NO: 40338 - protein, 25 aa, synthetic construct
  source 1..25: note = Seed: NSCVKLQTVHSIPLTINKEEALQRP
NSCVKLQTVHSIPITINKCEAVQRP

SEQ ID NO: 40339 - protein, 25 aa, synthetic construct
  source 1..25: note = Seed: NSCVKLQTVHSIPLTINKEEALQRP
NSCVKLQTVHSIPITINKDEAFQRP

SEQ ID NO: 40340 - protein, 25 aa, synthetic construct
  source 1..25: note = Seed: NSCVKLQTVHSIPLTINKEEALQRP
NSCVKLQTVHSIPITINKDEAIQRP

SEQ ID NO: 40341 - protein, 25 aa, synthetic construct
  source 1..25: note = Seed: NSCVKLQTVHSIPLTINKEEALQRP
NSCVKLQTVHSIPITINKDEALQRP

SEQ ID NO: 40342 - protein, 25 aa, synthetic construct
  source 1..25: note = Seed: NSCVKLQTVHSIPLTINKEEALQRP
NSCVKLQTVHSIPITINKDEAVQRP

SEQ ID NO: 40343 - protein, 25 aa, synthetic construct
  source 1..25: note = Seed: NSCVKLQTVHSIPLTINKEEALQRP
NSCVKLQTVHSIPITINKEEAIQRP

SEQ ID NO: 40344 - protein, 25 aa, synthetic construct
  source 1..25: note = Seed: NSCVKLQTVHSIPLTINKEEALQRP
NSCVKLQTVHSIPITINKEEAVQRP

SEQ ID NO: 40345 - protein, 25 aa, synthetic construct
  source 1..25: note = Seed: NSCVKLQTVHSIPLTINKEEALQRP
NSCVKLQTVHSIPITINKFEAAQRP

SEQ ID NO: 40346 - protein, 25 aa, synthetic construct
  source 1..25: note = Seed: NSCVKLQTVHSIPLTINKEEALQRP
NSCVKLQTVHSIPITINKFEAFQRP

SEQ ID NO: 40347 - protein, 25 aa, synthetic construct
  source 1..25: note = Seed: NSCVKLQTVHSIPLTINKEEALQRP
NSCVKLQTVHSIPITINKFEAIQRP

SEQ ID NO: 40348 - protein, 25 aa, synthetic construct
  source 1..25: note = Seed: NSCVKLQTVHSIPLTINKEEALQRP
NSCVKLQTVHSIPITINKFEALQRP

SEQ ID NO: 40349 - protein, 25 aa, synthetic construct
  source 1..25: note = Seed: NSCVKLQTVHSIPLTINKEEALQRP
NSCVKLQTVHSIPITINKFEAMQRP

SEQ ID NO: 40350 - protein, 25 aa, synthetic construct
  source 1..25: note = Seed: NSCVKLQTVHSIPLTINKEEALQRP
NSCVKLQTVHSIPITINKFEAVQRP

SEQ ID NO: 40351 - protein, 25 aa, synthetic construct
  source 1..25: note = Seed: NSCVKLQTVHSIPLTINKEEALQRP
NSCVKLQTVHSIPITINKFEAYQRP

SEQ ID NO: 40352 - protein, 25 aa, synthetic construct
  source 1..25: note = Seed: NSCVKLQTVHSIPLTINKEEALQRP
NSCVKLQTVHSIPITINKGEAAQRP

SEQ ID NO: 40353 - protein, 25 aa, synthetic construct
  source 1..25: note = Seed: NSCVKLQTVHSIPLTINKEEALQRP
NSCVKLQTVHSIPITINKGEAFQRP

SEQ ID NO: 40354 - protein, 25 aa, synthetic construct
  source 1..25: note = Seed: NSCVKLQTVHSIPLTINKEEALQRP
NSCVKLQTVHSIPITINKGEAIQRP

SEQ ID NO: 40355 - protein, 25 aa, synthetic construct
  source 1..25: note = Seed: NSCVKLQTVHSIPLTINKEEALQRP
NSCVKLQTVHSIPITINKGEALQRP

SEQ ID NO: 40356 - protein, 25 aa, synthetic construct
  source 1..25: note = Seed: NSCVKLQTVHSIPLTINKEEALQRP
NSCVKLQTVHSIPITINKGEAMQRP

SEQ ID NO: 40357 - protein, 25 aa, synthetic construct
  source 1..25: note = Seed: NSCVKLQTVHSIPLTINKEEALQRP
NSCVKLQTVHSIPITINKGEASQRP

SEQ ID NO: 40358 - protein, 25 aa, synthetic construct
  source 1..25: note = Seed: NSCVKLQTVHSIPLTINKEEALQRP
NSCVKLQTVHSIPITINKGEATQRP

SEQ ID NO: 40359 - protein, 25 aa, synthetic construct
  source 1..25: note = Seed: NSCVKLQTVHSIPLTINKEEALQRP
NSCVKLQTVHSIPITINKGEAVQRP

SEQ ID NO: 40360 - protein, 25 aa, synthetic construct
  source 1..25: note = Seed: NSCVKLQTVHSIPLTINKEEALQRP
NSCVKLQTVHSIPITINKGEAWQRP

SEQ ID NO: 40361 - protein, 25 aa, synthetic construct
  source 1..25: note = Seed: NSCVKLQTVHSIPLTINKEEALQRP
NSCVKLQTVHSIPITINKGEAYQRP

SEQ ID NO: 40362 - protein, 25 aa, synthetic construct
  source 1..25: note = Seed: NSCVKLQTVHSIPLTINKEEALQRP
NSCVKLQTVHSIPITINKHEAAQRP

SEQ ID NO: 40363 - protein, 25 aa, synthetic construct
  source 1..25: note = Seed: NSCVKLQTVHSIPLTINKEEALQRP
NSCVKLQTVHSIPITINKHEAFQRP

SEQ ID NO: 40364 - protein, 25 aa, synthetic construct
  source 1..25: note = Seed: NSCVKLQTVHSIPLTINKEEALQRP
NSCVKLQTVHSIPITINKHEAIQRP

SEQ ID NO: 40365 - protein, 25 aa, synthetic construct
  source 1..25: note = Seed: NSCVKLQTVHSIPLTINKEEALQRP
NSCVKLQTVHSIPITINKHEALQRP

SEQ ID NO: 40366 - protein, 25 aa, synthetic construct
  source 1..25: note = Seed: NSCVKLQTVHSIPLTINKEEALQRP
NSCVKLQTVHSIPITINKHEAMQRP

SEQ ID NO: 40367 - protein, 25 aa, synthetic construct
  source 1..25: note = Seed: NSCVKLQTVHSIPLTINKEEALQRP
NSCVKLQTVHSIPITINKHEASQRP

SEQ ID NO: 40368 - protein, 25 aa, synthetic construct
  source 1..25: note = Seed: NSCVKLQTVHSIPLTINKEEALQRP
NSCVKLQTVHSIPITINKHEATQRP

SEQ ID NO: 40369 - protein, 25 aa, synthetic construct
  source 1..25: note = Seed: NSCVKLQTVHSIPLTINKEEALQRP
NSCVKLQTVHSIPITINKHEAVQRP

SEQ ID NO: 40370 - protein, 25 aa, synthetic construct
  source 1..25: note = Seed: NSCVKLQTVHSIPLTINKEEALQRP
NSCVKLQTVHSIPITINKHEAYQRP

SEQ ID NO: 40371 - protein, 25 aa, synthetic construct
  source 1..25: note = Seed: NSCVKLQTVHSIPLTINKEEALQRP
NSCVKLQTVHSIPITINKIEAAQRP

SEQ ID NO: 40372 - protein, 25 aa, synthetic construct
  source 1..25: note = Seed: NSCVKLQTVHSIPLTINKEEALQRP
NSCVKLQTVHSIPITINKIEAFQRP

SEQ ID NO: 40373 - protein, 25 aa, synthetic construct
  source 1..25: note = Seed: NSCVKLQTVHSIPLTINKEEALQRP
NSCVKLQTVHSIPITINKIEAIQRP

SEQ ID NO: 40374 - protein, 25 aa, synthetic construct
  source 1..25: note = Seed: NSCVKLQTVHSIPLTINKEEALQRP
NSCVKLQTVHSIPITINKIEALQRP

SEQ ID NO: 40375 - protein, 25 aa, synthetic construct
  source 1..25: note = Seed: NSCVKLQTVHSIPLTINKEEALQRP
NSCVKLQTVHSIPITINKIEAMQRP

SEQ ID NO: 40376 - protein, 25 aa, synthetic construct
  source 1..25: note = Seed: NSCVKLQTVHSIPLTINKEEALQRP
NSCVKLQTVHSIPITINKIEANQRP

SEQ ID NO: 40377 - protein, 25 aa, synthetic construct
  source 1..25: note = Seed: NSCVKLQTVHSIPLTINKEEALQRP
NSCVKLQTVHSIPITINKIEASQRP

SEQ ID NO: 40378 - protein, 25 aa, synthetic construct
  source 1..25: note = Seed: NSCVKLQTVHSIPLTINKEEALQRP
NSCVKLQTVHSIPITINKIEATQRP

SEQ ID NO: 40379 - protein, 25 aa, synthetic construct
  source 1..25: note = Seed: NSCVKLQTVHSIPLTINKEEALQRP
NSCVKLQTVHSIPITINKIEAVQRP

SEQ ID NO: 40380 - protein, 25 aa, synthetic construct
  source 1..25: note = Seed: NSCVKLQTVHSIPLTINKEEALQRP
NSCVKLQTVHSIPITINKIEAWQRP

SEQ ID NO: 40381 - protein, 25 aa, synthetic construct
  source 1..25: note = Seed: NSCVKLQTVHSIPLTINKEEALQRP
NSCVKLQTVHSIPITINKIEAYQRP

SEQ ID NO: 40382 - protein, 25 aa, synthetic construct
  source 1..25: note = Seed: NSCVKLQTVHSIPLTINKEEALQRP
NSCVKLQTVHSIPITINKKEAFQRP

SEQ ID NO: 40383 - protein, 25 aa, synthetic construct
  source 1..25: note = Seed: NSCVKLQTVHSIPLTINKEEALQRP
NSCVKLQTVHSIPITINKKEAIQRP

SEQ ID NO: 40384 - protein, 25 aa, synthetic construct
  source 1..25: note = Seed: NSCVKLQTVHSIPLTINKEEALQRP
NSCVKLQTVHSIPITINKKEALQRP

SEQ ID NO: 40385 - protein, 25 aa, synthetic construct
  source 1..25: note = Seed: NSCVKLQTVHSIPLTINKEEALQRP
NSCVKLQTVHSIPITINKKEAVQRP

SEQ ID NO: 40386 - protein, 25 aa, synthetic construct
  source 1..25: note = Seed: NSCVKLQTVHSIPLTINKEEALQRP
NSCVKLQTVHSIPITINKLEAAQRP

SEQ ID NO: 40387 - protein, 25 aa, synthetic construct
  source 1..25: note = Seed: NSCVKLQTVHSIPLTINKEEALQRP
NSCVKLQTVHSIPITINKLEAFQRP

SEQ ID NO: 40388 - protein, 25 aa, synthetic construct
  source 1..25: note = Seed: NSCVKLQTVHSIPLTINKEEALQRP
NSCVKLQTVHSIPITINKLEAIQRP

SEQ ID NO: 40389 - protein, 25 aa, synthetic construct
  source 1..25: note = Seed: NSCVKLQTVHSIPLTINKEEALQRP
NSCVKLQTVHSIPITINKLEALQRP

SEQ ID NO: 40390 - protein, 25 aa, synthetic construct
  source 1..25: note = Seed: NSCVKLQTVHSIPLTINKEEALQRP
NSCVKLQTVHSIPITINKLEAMQRP

SEQ ID NO: 40391 - protein, 25 aa, synthetic construct
  source 1..25: note = Seed: NSCVKLQTVHSIPLTINKEEALQRP
NSCVKLQTVHSIPITINKLEASQRP

SEQ ID NO: 40392 - protein, 25 aa, synthetic construct
  source 1..25: note = Seed: NSCVKLQTVHSIPLTINKEEALQRP
NSCVKLQTVHSIPITINKLEATQRP

SEQ ID NO: 40393 - protein, 25 aa, synthetic construct
  source 1..25: note = Seed: NSCVKLQTVHSIPLTINKEEALQRP
NSCVKLQTVHSIPITINKLEAVQRP

SEQ ID NO: 40394 - protein, 25 aa, synthetic construct
  source 1..25: note = Seed: NSCVKLQTVHSIPLTINKEEALQRP
NSCVKLQTVHSIPITINKLEAYQRP

SEQ ID NO: 40395 - protein, 25 aa, synthetic construct
  source 1..25: note = Seed: NSCVKLQTVHSIPLTINKEEALQRP
NSCVKLQTVHSIPITINKMEAAQRP

SEQ ID NO: 40396 - protein, 25 aa, synthetic construct
  source 1..25: note = Seed: NSCVKLQTVHSIPLTINKEEALQRP
NSCVKLQTVHSIPITINKMEAFQRP

SEQ ID NO: 40397 - protein, 25 aa, synthetic construct
  source 1..25: note = Seed: NSCVKLQTVHSIPLTINKEEALQRP
NSCVKLQTVHSIPITINKMEAIQRP

SEQ ID NO: 40398 - protein, 25 aa, synthetic construct
  source 1..25: note = Seed: NSCVKLQTVHSIPLTINKEEALQRP
NSCVKLQTVHSIPITINKMEALQRP

SEQ ID NO: 40399 - protein, 25 aa, synthetic construct
  source 1..25: note = Seed: NSCVKLQTVHSIPLTINKEEALQRP
NSCVKLQTVHSIPITINKMEAMQRP

SEQ ID NO: 40400 - protein, 25 aa, synthetic construct
  source 1..25: note = Seed: NSCVKLQTVHSIPLTINKEEALQRP
NSCVKLQTVHSIPITINKMEASQRP

SEQ ID NO: 40401 - protein, 25 aa, synthetic construct
  source 1..25: note = Seed: NSCVKLQTVHSIPLTINKEEALQRP
NSCVKLQTVHSIPITINKMEATQRP

SEQ ID NO: 40402 - protein, 25 aa, synthetic construct
  source 1..25: note = Seed: NSCVKLQTVHSIPLTINKEEALQRP
NSCVKLQTVHSIPITINKMEAVQRP

SEQ ID NO: 40403 - protein, 25 aa, synthetic construct
  source 1..25: note = Seed: NSCVKLQTVHSIPLTINKEEALQRP
NSCVKLQTVHSIPITINKMEAYQRP

SEQ ID NO: 40404 - protein, 25 aa, synthetic construct
  source 1..25: note = Seed: NSCVKLQTVHSIPLTINKEEALQRP
NSCVKLQTVHSIPITINKNEAAQRP

SEQ ID NO: 40405 - protein, 25 aa, synthetic construct
  source 1..25: note = Seed: NSCVKLQTVHSIPLTINKEEALQRP
NSCVKLQTVHSIPITINKNEAFQRP

SEQ ID NO: 40406 - protein, 25 aa, synthetic construct
  source 1..25: note = Seed: NSCVKLQTVHSIPLTINKEEALQRP
NSCVKLQTVHSIPITINKNEAGQRP

SEQ ID NO: 40407 - protein, 25 aa, synthetic construct
  source 1..25: note = Seed: NSCVKLQTVHSIPLTINKEEALQRP
NSCVKLQTVHSIPITINKNEAHQRP

SEQ ID NO: 40408 - protein, 25 aa, synthetic construct
  source 1..25: note = Seed: NSCVKLQTVHSIPLTINKEEALQRP
NSCVKLQTVHSIPITINKNEAIQRP

SEQ ID NO: 40409 - protein, 25 aa, synthetic construct
  source 1..25: note = Seed: NSCVKLQTVHSIPLTINKEEALQRP
NSCVKLQTVHSIPITINKNEALQRP

SEQ ID NO: 40410 - protein, 25 aa, synthetic construct
  source 1..25: note = Seed: NSCVKLQTVHSIPLTINKEEALQRP
NSCVKLQTVHSIPITINKNEAMQRP

SEQ ID NO: 40411 - protein, 25 aa, synthetic construct
  source 1..25: note = Seed: NSCVKLQTVHSIPLTINKEEALQRP
NSCVKLQTVHSIPITINKNEANQRP

SEQ ID NO: 40412 - protein, 25 aa, synthetic construct
  source 1..25: note = Seed: NSCVKLQTVHSIPLTINKEEALQRP
NSCVKLQTVHSIPITINKNEAPQRP

SEQ ID NO: 40413 - protein, 25 aa, synthetic construct
  source 1..25: note = Seed: NSCVKLQTVHSIPLTINKEEALQRP
NSCVKLQTVHSIPITINKNEAQQRP

SEQ ID NO: 40414 - protein, 25 aa, synthetic construct
  source 1..25: note = Seed: NSCVKLQTVHSIPLTINKEEALQRP
NSCVKLQTVHSIPITINKNEASQRP

SEQ ID NO: 40415 - protein, 25 aa, synthetic construct
  source 1..25: note = Seed: NSCVKLQTVHSIPLTINKEEALQRP
NSCVKLQTVHSIPITINKNEATQRP

SEQ ID NO: 40416 - protein, 25 aa, synthetic construct
  source 1..25: note = Seed: NSCVKLQTVHSIPLTINKEEALQRP
NSCVKLQTVHSIPITINKNEAVQRP

SEQ ID NO: 40417 - protein, 25 aa, synthetic construct
  source 1..25: note = Seed: NSCVKLQTVHSIPLTINKEEALQRP
NSCVKLQTVHSIPITINKNEAWQRP

SEQ ID NO: 40418 - protein, 25 aa, synthetic construct
  source 1..25: note = Seed: NSCVKLQTVHSIPLTINKEEALQRP
NSCVKLQTVHSIPITINKNEAYQRP

SEQ ID NO: 40419 - protein, 25 aa, synthetic construct
  source 1..25: note = Seed: NSCVKLQTVHSIPLTINKEEALQRP
NSCVKLQTVHSIPITINKPEAAQRP

SEQ ID NO: 40420 - protein, 25 aa, synthetic construct
  source 1..25: note = Seed: NSCVKLQTVHSIPLTINKEEALQRP
NSCVKLQTVHSIPITINKPEAFQRP

SEQ ID NO: 40421 - protein, 25 aa, synthetic construct
  source 1..25: note = Seed: NSCVKLQTVHSIPLTINKEEALQRP
NSCVKLQTVHSIPITINKPEAIQRP

SEQ ID NO: 40422 - protein, 25 aa, synthetic construct
  source 1..25: note = Seed: NSCVKLQTVHSIPLTINKEEALQRP
NSCVKLQTVHSIPITINKPEALQRP

SEQ ID NO: 40423 - protein, 25 aa, synthetic construct
  source 1..25: note = Seed: NSCVKLQTVHSIPLTINKEEALQRP
NSCVKLQTVHSIPITINKPEAMQRP

SEQ ID NO: 40424 - protein, 25 aa, synthetic construct
  source 1..25: note = Seed: NSCVKLQTVHSIPLTINKEEALQRP
NSCVKLQTVHSIPITINKPEASQRP

SEQ ID NO: 40425 - protein, 25 aa, synthetic construct
  source 1..25: note = Seed: NSCVKLQTVHSIPLTINKEEALQRP
NSCVKLQTVHSIPITINKPEATQRP

SEQ ID NO: 40426 - protein, 25 aa, synthetic construct
  source 1..25: note = Seed: NSCVKLQTVHSIPLTINKEEALQRP
NSCVKLQTVHSIPITINKPEAVQRP

SEQ ID NO: 40427 - protein, 25 aa, synthetic construct
  source 1..25: note = Seed: NSCVKLQTVHSIPLTINKEEALQRP
NSCVKLQTVHSIPITINKPEAWQRP

SEQ ID NO: 40428 - protein, 25 aa, synthetic construct
  source 1..25: note = Seed: NSCVKLQTVHSIPLTINKEEALQRP
NSCVKLQTVHSIPITINKPEAYQRP

SEQ ID NO: 40429 - protein, 25 aa, synthetic construct
  source 1..25: note = Seed: NSCVKLQTVHSIPLTINKEEALQRP
NSCVKLQTVHSIPITINKQEAFQRP

SEQ ID NO: 40430 - protein, 25 aa, synthetic construct
  source 1..25: note = Seed: NSCVKLQTVHSIPLTINKEEALQRP
NSCVKLQTVHSIPITINKQEAIQRP

SEQ ID NO: 40431 - protein, 25 aa, synthetic construct
  source 1..25: note = Seed: NSCVKLQTVHSIPLTINKEEALQRP
NSCVKLQTVHSIPITINKQEALQRP

SEQ ID NO: 40432 - protein, 25 aa, synthetic construct
  source 1..25: note = Seed: NSCVKLQTVHSIPLTINKEEALQRP
NSCVKLQTVHSIPITINKQEAVQRP

SEQ ID NO: 40433 - protein, 25 aa, synthetic construct
  source 1..25: note = Seed: NSCVKLQTVHSIPLTINKEEALQRP
NSCVKLQTVHSIPITINKREAFQRP

SEQ ID NO: 40434 - protein, 25 aa, synthetic construct
  source 1..25: note = Seed: NSCVKLQTVHSIPLTINKEEALQRP
NSCVKLQTVHSIPITINKREAIQRP

SEQ ID NO: 40435 - protein, 25 aa, synthetic construct
  source 1..25: note = Seed: NSCVKLQTVHSIPLTINKEEALQRP
NSCVKLQTVHSIPITINKREALQRP

SEQ ID NO: 40436 - protein, 25 aa, synthetic construct
  source 1..25: note = Seed: NSCVKLQTVHSIPLTINKEEALQRP
NSCVKLQTVHSIPITINKREAVQRP

SEQ ID NO: 40437 - protein, 25 aa, synthetic construct
  source 1..25: note = Seed: NSCVKLQTVHSIPLTINKEEALQRP
NSCVKLQTVHSIPITINKSEAAQRP

SEQ ID NO: 40438 - protein, 25 aa, synthetic construct
  source 1..25: note = Seed: NSCVKLQTVHSIPLTINKEEALQRP
NSCVKLQTVHSIPITINKSEAFQRP

SEQ ID NO: 40439 - protein, 25 aa, synthetic construct
  source 1..25: note = Seed: NSCVKLQTVHSIPLTINKEEALQRP
NSCVKLQTVHSIPITINKSEAHQRP

SEQ ID NO: 40440 - protein, 25 aa, synthetic construct
  source 1..25: note = Seed: NSCVKLQTVHSIPLTINKEEALQRP
NSCVKLQTVHSIPITINKSEAIQRP

SEQ ID NO: 40441 - protein, 25 aa, synthetic construct
  source 1..25: note = Seed: NSCVKLQTVHSIPLTINKEEALQRP
NSCVKLQTVHSIPITINKSEALQRP

SEQ ID NO: 40442 - protein, 25 aa, synthetic construct
  source 1..25: note = Seed: NSCVKLQTVHSIPLTINKEEALQRP
NSCVKLQTVHSIPITINKSEAMQRP

SEQ ID NO: 40443 - protein, 25 aa, synthetic construct
  source 1..25: note = Seed: NSCVKLQTVHSIPLTINKEEALQRP
NSCVKLQTVHSIPITINKSEANQRP

SEQ ID NO: 40444 - protein, 25 aa, synthetic construct
  source 1..25: note = Seed: NSCVKLQTVHSIPLTINKEEALQRP
NSCVKLQTVHSIPITINKSEAQQRP

SEQ ID NO: 40445 - protein, 25 aa, synthetic construct
  source 1..25: note = Seed: NSCVKLQTVHSIPLTINKEEALQRP
NSCVKLQTVHSIPITINKSEASQRP

SEQ ID NO: 40446 - protein, 25 aa, synthetic construct
  source 1..25: note = Seed: NSCVKLQTVHSIPLTINKEEALQRP
NSCVKLQTVHSIPITINKSEATQRP

SEQ ID NO: 40447 - protein, 25 aa, synthetic construct
  source 1..25: note = Seed: NSCVKLQTVHSIPLTINKEEALQRP
NSCVKLQTVHSIPITINKSEAVQRP

SEQ ID NO: 40448 - protein, 25 aa, synthetic construct
  source 1..25: note = Seed: NSCVKLQTVHSIPLTINKEEALQRP
NSCVKLQTVHSIPITINKSEAWQRP

SEQ ID NO: 40449 - protein, 25 aa, synthetic construct
  source 1..25: note = Seed: NSCVKLQTVHSIPLTINKEEALQRP
NSCVKLQTVHSIPITINKSEAYQRP

SEQ ID NO: 40450 - protein, 25 aa, synthetic construct
  source 1..25: note = Seed: NSCVKLQTVHSIPLTINKEEALQRP
NSCVKLQTVHSIPITINKTEAAQRP

SEQ ID NO: 40451 - protein, 25 aa, synthetic construct
  source 1..25: note = Seed: NSCVKLQTVHSIPLTINKEEALQRP
NSCVKLQTVHSIPITINKTEAFQRP

SEQ ID NO: 40452 - protein, 25 aa, synthetic construct
  source 1..25: note = Seed: NSCVKLQTVHSIPLTINKEEALQRP
NSCVKLQTVHSIPITINKTEAIQRP

SEQ ID NO: 40453 - protein, 25 aa, synthetic construct
  source 1..25: note = Seed: NSCVKLQTVHSIPLTINKEEALQRP
NSCVKLQTVHSIPITINKTEALQRP

SEQ ID NO: 40454 - protein, 25 aa, synthetic construct
  source 1..25: note = Seed: NSCVKLQTVHSIPLTINKEEALQRP
NSCVKLQTVHSIPITINKTEAMQRP

SEQ ID NO: 40455 - protein, 25 aa, synthetic construct
  source 1..25: note = Seed: NSCVKLQTVHSIPLTINKEEALQRP
NSCVKLQTVHSIPITINKTEASQRP

SEQ ID NO: 40456 - protein, 25 aa, synthetic construct
  source 1..25: note = Seed: NSCVKLQTVHSIPLTINKEEALQRP
NSCVKLQTVHSIPITINKTEATQRP

SEQ ID NO: 40457 - protein, 25 aa, synthetic construct
  source 1..25: note = Seed: NSCVKLQTVHSIPLTINKEEALQRP
NSCVKLQTVHSIPITINKTEAVQRP

SEQ ID NO: 40458 - protein, 25 aa, synthetic construct
  source 1..25: note = Seed: NSCVKLQTVHSIPLTINKEEALQRP
NSCVKLQTVHSIPITINKTEAWQRP

SEQ ID NO: 40459 - protein, 25 aa, synthetic construct
  source 1..25: note = Seed: NSCVKLQTVHSIPLTINKEEALQRP
NSCVKLQTVHSIPITINKTEAYQRP

SEQ ID NO: 40460 - protein, 25 aa, synthetic construct
  source 1..25: note = Seed: NSCVKLQTVHSIPLTINKEEALQRP
NSCVKLQTVHSIPITINKVEAAQRP

SEQ ID NO: 40461 - protein, 25 aa, synthetic construct
  source 1..25: note = Seed: NSCVKLQTVHSIPLTINKEEALQRP
NSCVKLQTVHSIPITINKVEAFQRP

SEQ ID NO: 40462 - protein, 25 aa, synthetic construct
  source 1..25: note = Seed: NSCVKLQTVHSIPLTINKEEALQRP
NSCVKLQTVHSIPITINKVEAIQRP

SEQ ID NO: 40463 - protein, 25 aa, synthetic construct
  source 1..25: note = Seed: NSCVKLQTVHSIPLTINKEEALQRP
NSCVKLQTVHSIPITINKVEALQRP

SEQ ID NO: 40464 - protein, 25 aa, synthetic construct
  source 1..25: note = Seed: NSCVKLQTVHSIPLTINKEEALQRP
NSCVKLQTVHSIPITINKVEAMQRP

SEQ ID NO: 40465 - protein, 25 aa, synthetic construct
  source 1..25: note = Seed: NSCVKLQTVHSIPLTINKEEALQRP
NSCVKLQTVHSIPITINKVEANQRP

SEQ ID NO: 40466 - protein, 25 aa, synthetic construct
  source 1..25: note = Seed: NSCVKLQTVHSIPLTINKEEALQRP
NSCVKLQTVHSIPITINKVEASQRP

SEQ ID NO: 40467 - protein, 25 aa, synthetic construct
  source 1..25: note = Seed: NSCVKLQTVHSIPLTINKEEALQRP
NSCVKLQTVHSIPITINKVEATQRP

SEQ ID NO: 40468 - protein, 25 aa, synthetic construct
  source 1..25: note = Seed: NSCVKLQTVHSIPLTINKEEALQRP
NSCVKLQTVHSIPITINKVEAVQRP

SEQ ID NO: 40469 - protein, 25 aa, synthetic construct
  source 1..25: note = Seed: NSCVKLQTVHSIPLTINKEEALQRP
NSCVKLQTVHSIPITINKVEAWQRP

SEQ ID NO: 40470 - protein, 25 aa, synthetic construct
  source 1..25: note = Seed: NSCVKLQTVHSIPLTINKEEALQRP
NSCVKLQTVHSIPITINKVEAYQRP

SEQ ID NO: 40471 - protein, 25 aa, synthetic construct
  source 1..25: note = Seed: NSCVKLQTVHSIPLTINKEEALQRP
NSCVKLQTVHSIPITINKWEAIQRP

SEQ ID NO: 40472 - protein, 25 aa, synthetic construct
  source 1..25: note = Seed: NSCVKLQTVHSIPLTINKEEALQRP
NSCVKLQTVHSIPITINKWEALQRP

SEQ ID NO: 40473 - protein, 25 aa, synthetic construct
  source 1..25: note = Seed: NSCVKLQTVHSIPLTINKEEALQRP
NSCVKLQTVHSIPITINKWEAVQRP

SEQ ID NO: 40474 - protein, 25 aa, synthetic construct
  source 1..25: note = Seed: NSCVKLQTVHSIPLTINKEEALQRP
NSCVKLQTVHSIPITINKYEAAQRP

SEQ ID NO: 40475 - protein, 25 aa, synthetic construct
  source 1..25: note = Seed: NSCVKLQTVHSIPLTINKEEALQRP
NSCVKLQTVHSIPITINKYEAFQRP

SEQ ID NO: 40476 - protein, 25 aa, synthetic construct
  source 1..25: note = Seed: NSCVKLQTVHSIPLTINKEEALQRP
NSCVKLQTVHSIPITINKYEAIQRP

SEQ ID NO: 40477 - protein, 25 aa, synthetic construct
  source 1..25: note = Seed: NSCVKLQTVHSIPLTINKEEALQRP
NSCVKLQTVHSIPITINKYEALQRP

SEQ ID NO: 40478 - protein, 25 aa, synthetic construct
  source 1..25: note = Seed: NSCVKLQTVHSIPLTINKEEALQRP
NSCVKLQTVHSIPITINKYEAMQRP

SEQ ID NO: 40479 - protein, 25 aa, synthetic construct
  source 1..25: note = Seed: NSCVKLQTVHSIPLTINKEEALQRP
NSCVKLQTVHSIPITINKYEAVQRP

SEQ ID NO: 40480 - protein, 25 aa, synthetic construct
  source 1..25: note = Seed: NSCVKLQTVHSIPLTINKEEALQRP
NSCVKLQTVHSIPITINKYEAYQRP

SEQ ID NO: 40481 - protein, 25 aa, synthetic construct
  source 1..25: note = Seed: NSCVKLQTVHSIPLTINKEEALQRP
NSCVKLQTVHSIPITIQKAEAIQRP

SEQ ID NO: 40482 - protein, 25 aa, synthetic construct
  source 1..25: note = Seed: NSCVKLQTVHSIPLTINKEEALQRP
NSCVKLQTVHSIPITIQKAEALQRP

SEQ ID NO: 40483 - protein, 25 aa, synthetic construct
  source 1..25: note = Seed: NSCVKLQTVHSIPLTINKEEALQRP
NSCVKLQTVHSIPITIQKAEAVQRP

SEQ ID NO: 40484 - protein, 25 aa, synthetic construct
  source 1..25: note = Seed: NSCVKLQTVHSIPLTINKEEALQRP
NSCVKLQTVHSIPITIQKFEAFQRP

SEQ ID NO: 40485 - protein, 25 aa, synthetic construct
  source 1..25: note = Seed: NSCVKLQTVHSIPLTINKEEALQRP
NSCVKLQTVHSIPITIQKFEAIQRP

SEQ ID NO: 40486 - protein, 25 aa, synthetic construct
  source 1..25: note = Seed: NSCVKLQTVHSIPLTINKEEALQRP
NSCVKLQTVHSIPITIQKFEALQRP

SEQ ID NO: 40487 - protein, 25 aa, synthetic construct
  source 1..25: note = Seed: NSCVKLQTVHSIPLTINKEEALQRP
NSCVKLQTVHSIPITIQKFEAMQRP

SEQ ID NO: 40488 - protein, 25 aa, synthetic construct
  source 1..25: note = Seed: NSCVKLQTVHSIPLTINKEEALQRP
NSCVKLQTVHSIPITIQKFEAVQRP

SEQ ID NO: 40489 - protein, 25 aa, synthetic construct
  source 1..25: note = Seed: NSCVKLQTVHSIPLTINKEEALQRP
NSCVKLQTVHSIPITIQKFEAYQRP

SEQ ID NO: 40490 - protein, 25 aa, synthetic construct
  source 1..25: note = Seed: NSCVKLQTVHSIPLTINKEEALQRP
NSCVKLQTVHSIPITIQKIEAAQRP

SEQ ID NO: 40491 - protein, 25 aa, synthetic construct
  source 1..25: note = Seed: NSCVKLQTVHSIPLTINKEEALQRP
NSCVKLQTVHSIPITIQKIEAIQRP

SEQ ID NO: 40492 - protein, 25 aa, synthetic construct
  source 1..25: note = Seed: NSCVKLQTVHSIPLTINKEEALQRP
NSCVKLQTVHSIPITIQKIEALQRP

SEQ ID NO: 40493 - protein, 25 aa, synthetic construct
  source 1..25: note = Seed: NSCVKLQTVHSIPLTINKEEALQRP
NSCVKLQTVHSIPITIQKIEAVQRP

SEQ ID NO: 40494 - protein, 25 aa, synthetic construct
  source 1..25: note = Seed: NSCVKLQTVHSIPLTINKEEALQRP
NSCVKLQTVHSIPITIQKKEAIQRP

SEQ ID NO: 40495 - protein, 25 aa, synthetic construct
  source 1..25: note = Seed: NSCVKLQTVHSIPLTINKEEALQRP
NSCVKLQTVHSIPITIQKKEALQRP

SEQ ID NO: 40496 - protein, 25 aa, synthetic construct
  source 1..25: note = Seed: NSCVKLQTVHSIPLTINKEEALQRP
NSCVKLQTVHSIPITIQKNEAIQRP

SEQ ID NO: 40497 - protein, 25 aa, synthetic construct
  source 1..25: note = Seed: NSCVKLQTVHSIPLTINKEEALQRP
NSCVKLQTVHSIPITIQKNEALQRP

SEQ ID NO: 40498 - protein, 25 aa, synthetic construct
  source 1..25: note = Seed: NSCVKLQTVHSIPLTINKEEALQRP
NSCVKLQTVHSIPITIQKNEAVQRP

SEQ ID NO: 40499 - protein, 25 aa, synthetic construct
  source 1..25: note = Seed: NSCVKLQTVHSIPLTINKEEALQRP
NSCVKLQTVHSIPITIQKREAFQRP

SEQ ID NO: 40500 - protein, 25 aa, synthetic construct
  source 1..25: note = Seed: NSCVKLQTVHSIPLTINKEEALQRP
NSCVKLQTVHSIPITIQKREAIQRP

SEQ ID NO: 40501 - protein, 25 aa, synthetic construct
  source 1..25: note = Seed: NSCVKLQTVHSIPLTINKEEALQRP
NSCVKLQTVHSIPITIQKREALQRP

SEQ ID NO: 40502 - protein, 25 aa, synthetic construct
  source 1..25: note = Seed: NSCVKLQTVHSIPLTINKEEALQRP
NSCVKLQTVHSIPITIQKREAMQRP

SEQ ID NO: 40503 - protein, 25 aa, synthetic construct
  source 1..25: note = Seed: NSCVKLQTVHSIPLTINKEEALQRP
NSCVKLQTVHSIPITIQKREAVQRP

SEQ ID NO: 40504 - protein, 25 aa, synthetic construct
  source 1..25: note = Seed: NSCVKLQTVHSIPLTINKEEALQRP
NSCVKLQTVHSIPITIQKREAYQRP

SEQ ID NO: 40505 - protein, 25 aa, synthetic construct
  source 1..25: note = Seed: NSCVKLQTVHSIPLTINKEEALQRP
NSCVKLQTVHSIPITIQKSEAIQRP

SEQ ID NO: 40506 - protein, 25 aa, synthetic construct
  source 1..25: note = Seed: NSCVKLQTVHSIPLTINKEEALQRP
NSCVKLQTVHSIPITIQKSEAVQRP

SEQ ID NO: 40507 - protein, 25 aa, synthetic construct
  source 1..25: note = Seed: NSCVKLQTVHSIPLTINKEEALQRP
NSCVKLQTVHSIPITIQKVEAIQRP

SEQ ID NO: 40508 - protein, 25 aa, synthetic construct
  source 1..25: note = Seed: NSCVKLQTVHSIPLTINKEEALQRP
NSCVKLQTVHSIPITIQKVEAVQRP

SEQ ID NO: 40509 - protein, 25 aa, synthetic construct
  source 1..25: note = Seed: NSCVKLQTVHSIPLTINKEEALQRP
NSCVKLQTVHSIPITIRKAEAFQRP

SEQ ID NO: 40510 - protein, 25 aa, synthetic construct
  source 1..25: note = Seed: NSCVKLQTVHSIPLTINKEEALQRP
NSCVKLQTVHSIPITIRKAEAIQRP

SEQ ID NO: 40511 - protein, 25 aa, synthetic construct
  source 1..25: note = Seed: NSCVKLQTVHSIPLTINKEEALQRP
NSCVKLQTVHSIPITIRKAEALQRP

SEQ ID NO: 40512 - protein, 25 aa, synthetic construct
  source 1..25: note = Seed: NSCVKLQTVHSIPLTINKEEALQRP
NSCVKLQTVHSIPITIRKAEAMQRP

SEQ ID NO: 40513 - protein, 25 aa, synthetic construct
  source 1..25: note = Seed: NSCVKLQTVHSIPLTINKEEALQRP
NSCVKLQTVHSIPITIRKAEARQRP

SEQ ID NO: 40514 - protein, 25 aa, synthetic construct
  source 1..25: note = Seed: NSCVKLQTVHSIPLTINKEEALQRP
NSCVKLQTVHSIPITIRKAEAYQRP

SEQ ID NO: 40515 - protein, 25 aa, synthetic construct
  source 1..25: note = Seed: NSCVKLQTVHSIPLTINKEEALQRP
NSCVKLQTVHSIPITIRKHEAAQRP

SEQ ID NO: 40516 - protein, 25 aa, synthetic construct
  source 1..25: note = Seed: NSCVKLQTVHSIPLTINKEEALQRP
NSCVKLQTVHSIPITIRKHEAFQRP

SEQ ID NO: 40517 - protein, 25 aa, synthetic construct
  source 1..25: note = Seed: NSCVKLQTVHSIPLTINKEEALQRP
NSCVKLQTVHSIPITIRKHEALQRP

SEQ ID NO: 40518 - protein, 25 aa, synthetic construct
  source 1..25: note = Seed: NSCVKLQTVHSIPLTINKEEALQRP
NSCVKLQTVHSIPITIRKHEAMQRP

SEQ ID NO: 40519 - protein, 25 aa, synthetic construct
  source 1..25: note = Seed: NSCVKLQTVHSIPLTINKEEALQRP
NSCVKLQTVHSIPITIRKHEARQRP

SEQ ID NO: 40520 - protein, 25 aa, synthetic construct
  source 1..25: note = Seed: NSCVKLQTVHSIPLTINKEEALQRP
NSCVKLQTVHSIPITIRKHEAVQRP

SEQ ID NO: 40521 - protein, 25 aa, synthetic construct
  source 1..25: note = Seed: NSCVKLQTVHSIPLTINKEEALQRP
NSCVKLQTVHSIPITIRKHEAYQRP

SEQ ID NO: 40522 - protein, 25 aa, synthetic construct
  source 1..25: note = Seed: NSCVKLQTVHSIPLTINKEEALQRP
NSCVKLQTVHSIPITIRKIEAFQRP

SEQ ID NO: 40523 - protein, 25 aa, synthetic construct
  source 1..25: note = Seed: NSCVKLQTVHSIPLTINKEEALQRP
NSCVKLQTVHSIPITIRKIEALQRP

SEQ ID NO: 40524 - protein, 25 aa, synthetic construct
  source 1..25: note = Seed: NSCVKLQTVHSIPLTINKEEALQRP
NSCVKLQTVHSIPITIRKIEAMQRP

SEQ ID NO: 40525 - protein, 25 aa, synthetic construct
  source 1..25: note = Seed: NSCVKLQTVHSIPLTINKEEALQRP
NSCVKLQTVHSIPITIRKIEARQRP

SEQ ID NO: 40526 - protein, 25 aa, synthetic construct
  source 1..25: note = Seed: NSCVKLQTVHSIPLTINKEEALQRP
NSCVKLQTVHSIPITIRKKEAFQRP

SEQ ID NO: 40527 - protein, 25 aa, synthetic construct
  source 1..25: note = Seed: NSCVKLQTVHSIPLTINKEEALQRP
NSCVKLQTVHSIPITIRKKEAIQRP

SEQ ID NO: 40528 - protein, 25 aa, synthetic construct
  source 1..25: note = Seed: NSCVKLQTVHSIPLTINKEEALQRP
NSCVKLQTVHSIPITIRKKEALQRP

SEQ ID NO: 40529 - protein, 25 aa, synthetic construct
  source 1..25: note = Seed: NSCVKLQTVHSIPLTINKEEALQRP
NSCVKLQTVHSIPITIRKKEAMQRP

SEQ ID NO: 40530 - protein, 25 aa, synthetic construct
  source 1..25: note = Seed: NSCVKLQTVHSIPLTINKEEALQRP
NSCVKLQTVHSIPITIRKKEAVQRP

SEQ ID NO: 40531 - protein, 25 aa, synthetic construct
  source 1..25: note = Seed: NSCVKLQTVHSIPLTINKEEALQRP
NSCVKLQTVHSIPITIRKKEAWQRP

SEQ ID NO: 40532 - protein, 25 aa, synthetic construct
  source 1..25: note = Seed: NSCVKLQTVHSIPLTINKEEALQRP
NSCVKLQTVHSIPITIRKKEAYQRP

SEQ ID NO: 40533 - protein, 25 aa, synthetic construct
  source 1..25: note = Seed: NSCVKLQTVHSIPLTINKEEALQRP
NSCVKLQTVHSIPITIRKLEALQRP

SEQ ID NO: 40534 - protein, 25 aa, synthetic construct
  source 1..25: note = Seed: NSCVKLQTVHSIPLTINKEEALQRP
NSCVKLQTVHSIPITIRKMEAFQRP

SEQ ID NO: 40535 - protein, 25 aa, synthetic construct
  source 1..25: note = Seed: NSCVKLQTVHSIPLTINKEEALQRP
NSCVKLQTVHSIPITIRKMEARQRP

SEQ ID NO: 40536 - protein, 25 aa, synthetic construct
  source 1..25: note = Seed: NSCVKLQTVHSIPLTINKEEALQRP
NSCVKLQTVHSIPITIRKNEAIQRP

SEQ ID NO: 40537 - protein, 25 aa, synthetic construct
  source 1..25: note = Seed: NSCVKLQTVHSIPLTINKEEALQRP
NSCVKLQTVHSIPITIRKNEALQRP

SEQ ID NO: 40538 - protein, 25 aa, synthetic construct
  source 1..25: note = Seed: NSCVKLQTVHSIPLTINKEEALQRP
NSCVKLQTVHSIPITIRKNEAVQRP

SEQ ID NO: 40539 - protein, 25 aa, synthetic construct
  source 1..25: note = Seed: NSCVKLQTVHSIPLTINKEEALQRP
NSCVKLQTVHSIPITIRKREAAQRP

SEQ ID NO: 40540 - protein, 25 aa, synthetic construct
  source 1..25: note = Seed: NSCVKLQTVHSIPLTINKEEALQRP
NSCVKLQTVHSIPITIRKREAFQRP

SEQ ID NO: 40541 - protein, 25 aa, synthetic construct
  source 1..25: note = Seed: NSCVKLQTVHSIPLTINKEEALQRP
NSCVKLQTVHSIPITIRKREAHQRP

SEQ ID NO: 40542 - protein, 25 aa, synthetic construct
  source 1..25: note = Seed: NSCVKLQTVHSIPLTINKEEALQRP
NSCVKLQTVHSIPITIRKREAIQRP

SEQ ID NO: 40543 - protein, 25 aa, synthetic construct
  source 1..25: note = Seed: NSCVKLQTVHSIPLTINKEEALQRP
NSCVKLQTVHSIPITIRKREALQRP

SEQ ID NO: 40544 - protein, 25 aa, synthetic construct
  source 1..25: note = Seed: NSCVKLQTVHSIPLTINKEEALQRP
NSCVKLQTVHSIPITIRKREAMQRP

SEQ ID NO: 40545 - protein, 25 aa, synthetic construct
  source 1..25: note = Seed: NSCVKLQTVHSIPLTINKEEALQRP
NSCVKLQTVHSIPITIRKREARQRP

SEQ ID NO: 40546 - protein, 25 aa, synthetic construct
  source 1..25: note = Seed: NSCVKLQTVHSIPLTINKEEALQRP
NSCVKLQTVHSIPITIRKREASQRP

SEQ ID NO: 40547 - protein, 25 aa, synthetic construct
  source 1..25: note = Seed: NSCVKLQTVHSIPLTINKEEALQRP
NSCVKLQTVHSIPITIRKREAVQRP

SEQ ID NO: 40548 - protein, 25 aa, synthetic construct
  source 1..25: note = Seed: NSCVKLQTVHSIPLTINKEEALQRP
NSCVKLQTVHSIPITIRKREAWQRP

SEQ ID NO: 40549 - protein, 25 aa, synthetic construct
  source 1..25: note = Seed: NSCVKLQTVHSIPLTINKEEALQRP
NSCVKLQTVHSIPITIRKREAYQRP

SEQ ID NO: 40550 - protein, 25 aa, synthetic construct
  source 1..25: note = Seed: NSCVKLQTVHSIPLTINKEEALQRP
NSCVKLQTVHSIPITIRKSEAFQRP

SEQ ID NO: 40551 - protein, 25 aa, synthetic construct
  source 1..25: note = Seed: NSCVKLQTVHSIPLTINKEEALQRP
NSCVKLQTVHSIPITIRKSEALQRP

SEQ ID NO: 40552 - protein, 25 aa, synthetic construct
  source 1..25: note = Seed: NSCVKLQTVHSIPLTINKEEALQRP
NSCVKLQTVHSIPITIRKSEARQRP

SEQ ID NO: 40553 - protein, 25 aa, synthetic construct
  source 1..25: note = Seed: NSCVKLQTVHSIPLTINKEEALQRP
NSCVKLQTVHSIPITIRKVEAFQRP

SEQ ID NO: 40554 - protein, 25 aa, synthetic construct
  source 1..25: note = Seed: NSCVKLQTVHSIPLTINKEEALQRP
NSCVKLQTVHSIPITIRKVEALQRP

SEQ ID NO: 40555 - protein, 25 aa, synthetic construct
  source 1..25: note = Seed: NSCVKLQTVHSIPLTINKEEALQRP
NSCVKLQTVHSIPITIRKVEARQRP

SEQ ID NO: 40556 - protein, 25 aa, synthetic construct
  source 1..25: note = Seed: NSCVKLQTVHSIPLTINKEEALQRP
NSCVKLQTVHSIPITISKAEAAQRP

SEQ ID NO: 40557 - protein, 25 aa, synthetic construct
  source 1..25: note = Seed: NSCVKLQTVHSIPLTINKEEALQRP
NSCVKLQTVHSIPITISKAEAFQRP

SEQ ID NO: 40558 - protein, 25 aa, synthetic construct
  source 1..25: note = Seed: NSCVKLQTVHSIPLTINKEEALQRP
NSCVKLQTVHSIPITISKAEAIQRP

SEQ ID NO: 40559 - protein, 25 aa, synthetic construct
  source 1..25: note = Seed: NSCVKLQTVHSIPLTINKEEALQRP
NSCVKLQTVHSIPITISKAEALQRP

SEQ ID NO: 40560 - protein, 25 aa, synthetic construct
  source 1..25: note = Seed: NSCVKLQTVHSIPLTINKEEALQRP
NSCVKLQTVHSIPITISKAEAMQRP

SEQ ID NO: 40561 - protein, 25 aa, synthetic construct
  source 1..25: note = Seed: NSCVKLQTVHSIPLTINKEEALQRP
NSCVKLQTVHSIPITISKAEAVQRP

SEQ ID NO: 40562 - protein, 25 aa, synthetic construct
  source 1..25: note = Seed: NSCVKLQTVHSIPLTINKEEALQRP
NSCVKLQTVHSIPITISKAEAYQRP

SEQ ID NO: 40563 - protein, 25 aa, synthetic construct
  source 1..25: note = Seed: NSCVKLQTVHSIPLTINKEEALQRP
NSCVKLQTVHSIPITISKDEAIQRP

SEQ ID NO: 40564 - protein, 25 aa, synthetic construct
  source 1..25: note = Seed: NSCVKLQTVHSIPLTINKEEALQRP
NSCVKLQTVHSIPITISKFEAAQRP

SEQ ID NO: 40565 - protein, 25 aa, synthetic construct
  source 1..25: note = Seed: NSCVKLQTVHSIPLTINKEEALQRP
NSCVKLQTVHSIPITISKFEAFQRP

SEQ ID NO: 40566 - protein, 25 aa, synthetic construct
  source 1..25: note = Seed: NSCVKLQTVHSIPLTINKEEALQRP
NSCVKLQTVHSIPITISKFEAIQRP

SEQ ID NO: 40567 - protein, 25 aa, synthetic construct
  source 1..25: note = Seed: NSCVKLQTVHSIPLTINKEEALQRP
NSCVKLQTVHSIPITISKFEALQRP

SEQ ID NO: 40568 - protein, 25 aa, synthetic construct
  source 1..25: note = Seed: NSCVKLQTVHSIPLTINKEEALQRP
NSCVKLQTVHSIPITISKFEAMQRP

SEQ ID NO: 40569 - protein, 25 aa, synthetic construct
  source 1..25: note = Seed: NSCVKLQTVHSIPLTINKEEALQRP
NSCVKLQTVHSIPITISKFEANQRP

SEQ ID NO: 40570 - protein, 25 aa, synthetic construct
  source 1..25: note = Seed: NSCVKLQTVHSIPLTINKEEALQRP
NSCVKLQTVHSIPITISKFEASQRP

SEQ ID NO: 40571 - protein, 25 aa, synthetic construct
  source 1..25: note = Seed: NSCVKLQTVHSIPLTINKEEALQRP
NSCVKLQTVHSIPITISKFEATQRP

SEQ ID NO: 40572 - protein, 25 aa, synthetic construct
  source 1..25: note = Seed: NSCVKLQTVHSIPLTINKEEALQRP
NSCVKLQTVHSIPITISKFEAVQRP

SEQ ID NO: 40573 - protein, 25 aa, synthetic construct
  source 1..25: note = Seed: NSCVKLQTVHSIPLTINKEEALQRP
NSCVKLQTVHSIPITISKFEAYQRP

SEQ ID NO: 40574 - protein, 25 aa, synthetic construct
  source 1..25: note = Seed: NSCVKLQTVHSIPLTINKEEALQRP
NSCVKLQTVHSIPITISKGEAFQRP

SEQ ID NO: 40575 - protein, 25 aa, synthetic construct
  source 1..25: note = Seed: NSCVKLQTVHSIPLTINKEEALQRP
NSCVKLQTVHSIPITISKGEAIQRP

SEQ ID NO: 40576 - protein, 25 aa, synthetic construct
  source 1..25: note = Seed: NSCVKLQTVHSIPLTINKEEALQRP
NSCVKLQTVHSIPITISKGEALQRP

SEQ ID NO: 40577 - protein, 25 aa, synthetic construct
  source 1..25: note = Seed: NSCVKLQTVHSIPLTINKEEALQRP
NSCVKLQTVHSIPITISKGEAVQRP

SEQ ID NO: 40578 - protein, 25 aa, synthetic construct
  source 1..25: note = Seed: NSCVKLQTVHSIPLTINKEEALQRP
NSCVKLQTVHSIPITISKIEAAQRP

SEQ ID NO: 40579 - protein, 25 aa, synthetic construct
  source 1..25: note = Seed: NSCVKLQTVHSIPLTINKEEALQRP
NSCVKLQTVHSIPITISKIEAFQRP

SEQ ID NO: 40580 - protein, 25 aa, synthetic construct
  source 1..25: note = Seed: NSCVKLQTVHSIPLTINKEEALQRP
NSCVKLQTVHSIPITISKIEAIQRP

SEQ ID NO: 40581 - protein, 25 aa, synthetic construct
  source 1..25: note = Seed: NSCVKLQTVHSIPLTINKEEALQRP
NSCVKLQTVHSIPITISKIEALQRP

SEQ ID NO: 40582 - protein, 25 aa, synthetic construct
  source 1..25: note = Seed: NSCVKLQTVHSIPLTINKEEALQRP
NSCVKLQTVHSIPITISKIEAMQRP

SEQ ID NO: 40583 - protein, 25 aa, synthetic construct
  source 1..25: note = Seed: NSCVKLQTVHSIPLTINKEEALQRP
NSCVKLQTVHSIPITISKIEASQRP

SEQ ID NO: 40584 - protein, 25 aa, synthetic construct
  source 1..25: note = Seed: NSCVKLQTVHSIPLTINKEEALQRP
NSCVKLQTVHSIPITISKIEATQRP

SEQ ID NO: 40585 - protein, 25 aa, synthetic construct
  source 1..25: note = Seed: NSCVKLQTVHSIPLTINKEEALQRP
NSCVKLQTVHSIPITISKIEAVQRP

SEQ ID NO: 40586 - protein, 25 aa, synthetic construct
  source 1..25: note = Seed: NSCVKLQTVHSIPLTINKEEALQRP
NSCVKLQTVHSIPITISKIEAYQRP

SEQ ID NO: 40587 - protein, 25 aa, synthetic construct
  source 1..25: note = Seed: NSCVKLQTVHSIPLTINKEEALQRP
NSCVKLQTVHSIPITISKLEAAQRP

SEQ ID NO: 40588 - protein, 25 aa, synthetic construct
  source 1..25: note = Seed: NSCVKLQTVHSIPLTINKEEALQRP
NSCVKLQTVHSIPITISKLEAFQRP

SEQ ID NO: 40589 - protein, 25 aa, synthetic construct
  source 1..25: note = Seed: NSCVKLQTVHSIPLTINKEEALQRP
NSCVKLQTVHSIPITISKLEAIQRP

SEQ ID NO: 40590 - protein, 25 aa, synthetic construct
  source 1..25: note = Seed: NSCVKLQTVHSIPLTINKEEALQRP
NSCVKLQTVHSIPITISKLEALQRP

SEQ ID NO: 40591 - protein, 25 aa, synthetic construct
  source 1..25: note = Seed: NSCVKLQTVHSIPLTINKEEALQRP
NSCVKLQTVHSIPITISKLEAMQRP

SEQ ID NO: 40592 - protein, 25 aa, synthetic construct
  source 1..25: note = Seed: NSCVKLQTVHSIPLTINKEEALQRP
NSCVKLQTVHSIPITISKLEASQRP

SEQ ID NO: 40593 - protein, 25 aa, synthetic construct
  source 1..25: note = Seed: NSCVKLQTVHSIPLTINKEEALQRP
NSCVKLQTVHSIPITISKLEAVQRP

SEQ ID NO: 40594 - protein, 25 aa, synthetic construct
  source 1..25: note = Seed: NSCVKLQTVHSIPLTINKEEALQRP
NSCVKLQTVHSIPITISKLEAYQRP

SEQ ID NO: 40595 - protein, 25 aa, synthetic construct
  source 1..25: note = Seed: NSCVKLQTVHSIPLTINKEEALQRP
NSCVKLQTVHSIPITISKMEAAQRP

SEQ ID NO: 40596 - protein, 25 aa, synthetic construct
  source 1..25: note = Seed: NSCVKLQTVHSIPLTINKEEALQRP
NSCVKLQTVHSIPITISKMEAFQRP

SEQ ID NO: 40597 - protein, 25 aa, synthetic construct
  source 1..25: note = Seed: NSCVKLQTVHSIPLTINKEEALQRP
NSCVKLQTVHSIPITISKMEAIQRP

SEQ ID NO: 40598 - protein, 25 aa, synthetic construct
  source 1..25: note = Seed: NSCVKLQTVHSIPLTINKEEALQRP
NSCVKLQTVHSIPITISKMEALQRP

SEQ ID NO: 40599 - protein, 25 aa, synthetic construct
  source 1..25: note = Seed: NSCVKLQTVHSIPLTINKEEALQRP
NSCVKLQTVHSIPITISKMEAMQRP

SEQ ID NO: 40600 - protein, 25 aa, synthetic construct
  source 1..25: note = Seed: NSCVKLQTVHSIPLTINKEEALQRP
NSCVKLQTVHSIPITISKMEAVQRP

SEQ ID NO: 40601 - protein, 25 aa, synthetic construct
  source 1..25: note = Seed: NSCVKLQTVHSIPLTINKEEALQRP
NSCVKLQTVHSIPITISKNEAAQRP

SEQ ID NO: 40602 - protein, 25 aa, synthetic construct
  source 1..25: note = Seed: NSCVKLQTVHSIPLTINKEEALQRP
NSCVKLQTVHSIPITISKNEAFQRP

SEQ ID NO: 40603 - protein, 25 aa, synthetic construct
  source 1..25: note = Seed: NSCVKLQTVHSIPLTINKEEALQRP
NSCVKLQTVHSIPITISKNEAIQRP

SEQ ID NO: 40604 - protein, 25 aa, synthetic construct
  source 1..25: note = Seed: NSCVKLQTVHSIPLTINKEEALQRP
NSCVKLQTVHSIPITISKNEALQRP

SEQ ID NO: 40605 - protein, 25 aa, synthetic construct
  source 1..25: note = Seed: NSCVKLQTVHSIPLTINKEEALQRP
NSCVKLQTVHSIPITISKNEAMQRP

SEQ ID NO: 40606 - protein, 25 aa, synthetic construct
  source 1..25: note = Seed: NSCVKLQTVHSIPLTINKEEALQRP
NSCVKLQTVHSIPITISKNEAVQRP

SEQ ID NO: 40607 - protein, 25 aa, synthetic construct
  source 1..25: note = Seed: NSCVKLQTVHSIPLTINKEEALQRP
NSCVKLQTVHSIPITISKNEAYQRP

SEQ ID NO: 40608 - protein, 25 aa, synthetic construct
  source 1..25: note = Seed: NSCVKLQTVHSIPLTINKEEALQRP
NSCVKLQTVHSIPITISKPEAFQRP

SEQ ID NO: 40609 - protein, 25 aa, synthetic construct
  source 1..25: note = Seed: NSCVKLQTVHSIPLTINKEEALQRP
NSCVKLQTVHSIPITISKPEAIQRP

SEQ ID NO: 40610 - protein, 25 aa, synthetic construct
  source 1..25: note = Seed: NSCVKLQTVHSIPLTINKEEALQRP
NSCVKLQTVHSIPITISKPEALQRP

SEQ ID NO: 40611 - protein, 25 aa, synthetic construct
  source 1..25: note = Seed: NSCVKLQTVHSIPLTINKEEALQRP
NSCVKLQTVHSIPITISKPEAVQRP

SEQ ID NO: 40612 - protein, 25 aa, synthetic construct
  source 1..25: note = Seed: NSCVKLQTVHSIPLTINKEEALQRP
NSCVKLQTVHSIPITISKREAFQRP

SEQ ID NO: 40613 - protein, 25 aa, synthetic construct
  source 1..25: note = Seed: NSCVKLQTVHSIPLTINKEEALQRP
NSCVKLQTVHSIPITISKREALQRP

SEQ ID NO: 40614 - protein, 25 aa, synthetic construct
  source 1..25: note = Seed: NSCVKLQTVHSIPLTINKEEALQRP
NSCVKLQTVHSIPITISKREARQRP

SEQ ID NO: 40615 - protein, 25 aa, synthetic construct
  source 1..25: note = Seed: NSCVKLQTVHSIPLTINKEEALQRP
NSCVKLQTVHSIPITISKREAYQRP

SEQ ID NO: 40616 - protein, 25 aa, synthetic construct
  source 1..25: note = Seed: NSCVKLQTVHSIPLTINKEEALQRP
NSCVKLQTVHSIPITISKSEAFQRP

SEQ ID NO: 40617 - protein, 25 aa, synthetic construct
  source 1..25: note = Seed: NSCVKLQTVHSIPLTINKEEALQRP
NSCVKLQTVHSIPITISKSEAIQRP

SEQ ID NO: 40618 - protein, 25 aa, synthetic construct
  source 1..25: note = Seed: NSCVKLQTVHSIPLTINKEEALQRP
NSCVKLQTVHSIPITISKSEALQRP

SEQ ID NO: 40619 - protein, 25 aa, synthetic construct
  source 1..25: note = Seed: NSCVKLQTVHSIPLTINKEEALQRP
NSCVKLQTVHSIPITISKSEAMQRP

SEQ ID NO: 40620 - protein, 25 aa, synthetic construct
  source 1..25: note = Seed: NSCVKLQTVHSIPLTINKEEALQRP
NSCVKLQTVHSIPITISKSEAVQRP

SEQ ID NO: 40621 - protein, 25 aa, synthetic construct
  source 1..25: note = Seed: NSCVKLQTVHSIPLTINKEEALQRP
NSCVKLQTVHSIPITISKSEAYQRP

SEQ ID NO: 40622 - protein, 25 aa, synthetic construct
  source 1..25: note = Seed: NSCVKLQTVHSIPLTINKEEALQRP
NSCVKLQTVHSIPITISKTEAFQRP

SEQ ID NO: 40623 - protein, 25 aa, synthetic construct
  source 1..25: note = Seed: NSCVKLQTVHSIPLTINKEEALQRP
NSCVKLQTVHSIPITISKTEAIQRP

SEQ ID NO: 40624 - protein, 25 aa, synthetic construct
  source 1..25: note = Seed: NSCVKLQTVHSIPLTINKEEALQRP
NSCVKLQTVHSIPITISKTEALQRP

SEQ ID NO: 40625 - protein, 25 aa, synthetic construct
  source 1..25: note = Seed: NSCVKLQTVHSIPLTINKEEALQRP
NSCVKLQTVHSIPITISKTEAVQRP

SEQ ID NO: 40626 - protein, 25 aa, synthetic construct
  source 1..25: note = Seed: NSCVKLQTVHSIPLTINKEEALQRP
NSCVKLQTVHSIPITISKTEAYQRP

SEQ ID NO: 40627 - protein, 25 aa, synthetic construct
  source 1..25: note = Seed: NSCVKLQTVHSIPLTINKEEALQRP
NSCVKLQTVHSIPITISKVEAAQRP

SEQ ID NO: 40628 - protein, 25 aa, synthetic construct
  source 1..25: note = Seed: NSCVKLQTVHSIPLTINKEEALQRP
NSCVKLQTVHSIPITISKVEAFQRP

SEQ ID NO: 40629 - protein, 25 aa, synthetic construct
  source 1..25: note = Seed: NSCVKLQTVHSIPLTINKEEALQRP
NSCVKLQTVHSIPITISKVEAIQRP

SEQ ID NO: 40630 - protein, 25 aa, synthetic construct
  source 1..25: note = Seed: NSCVKLQTVHSIPLTINKEEALQRP
NSCVKLQTVHSIPITISKVEALQRP

SEQ ID NO: 40631 - protein, 25 aa, synthetic construct
  source 1..25: note = Seed: NSCVKLQTVHSIPLTINKEEALQRP
NSCVKLQTVHSIPITISKVEAMQRP

SEQ ID NO: 40632 - protein, 25 aa, synthetic construct
  source 1..25: note = Seed: NSCVKLQTVHSIPLTINKEEALQRP
NSCVKLQTVHSIPITISKVEASQRP

SEQ ID NO: 40633 - protein, 25 aa, synthetic construct
  source 1..25: note = Seed: NSCVKLQTVHSIPLTINKEEALQRP
NSCVKLQTVHSIPITISKVEAVQRP

SEQ ID NO: 40634 - protein, 25 aa, synthetic construct
  source 1..25: note = Seed: NSCVKLQTVHSIPLTINKEEALQRP
NSCVKLQTVHSIPITISKVEAYQRP

SEQ ID NO: 40635 - protein, 25 aa, synthetic construct
  source 1..25: note = Seed: NSCVKLQTVHSIPLTINKEEALQRP
NSCVKLQTVHSIPITISKYEAIQRP

SEQ ID NO: 40636 - protein, 25 aa, synthetic construct
  source 1..25: note = Seed: NSCVKLQTVHSIPLTINKEEALQRP
NSCVKLQTVHSIPITISKYEALQRP

SEQ ID NO: 40637 - protein, 25 aa, synthetic construct
  source 1..25: note = Seed: NSCVKLQTVHSIPLTINKEEALQRP
NSCVKLQTVHSIPITITKAEAIQRP

SEQ ID NO: 40638 - protein, 25 aa, synthetic construct
  source 1..25: note = Seed: NSCVKLQTVHSIPLTINKEEALQRP
NSCVKLQTVHSIPITITKAEAVQRP

SEQ ID NO: 40639 - protein, 25 aa, synthetic construct
  source 1..25: note = Seed: NSCVKLQTVHSIPLTINKEEALQRP
NSCVKLQTVHSIPITITKFEAAQRP

SEQ ID NO: 40640 - protein, 25 aa, synthetic construct
  source 1..25: note = Seed: NSCVKLQTVHSIPLTINKEEALQRP
NSCVKLQTVHSIPITITKFEAEQRP

SEQ ID NO: 40641 - protein, 25 aa, synthetic construct
  source 1..25: note = Seed: NSCVKLQTVHSIPLTINKEEALQRP
NSCVKLQTVHSIPITITKFEAFQRP

SEQ ID NO: 40642 - protein, 25 aa, synthetic construct
  source 1..25: note = Seed: NSCVKLQTVHSIPLTINKEEALQRP
NSCVKLQTVHSIPITITKFEAIQRP

SEQ ID NO: 40643 - protein, 25 aa, synthetic construct
  source 1..25: note = Seed: NSCVKLQTVHSIPLTINKEEALQRP
NSCVKLQTVHSIPITITKFEALQRP

SEQ ID NO: 40644 - protein, 25 aa, synthetic construct
  source 1..25: note = Seed: NSCVKLQTVHSIPLTINKEEALQRP
NSCVKLQTVHSIPITITKFEAMQRP

SEQ ID NO: 40645 - protein, 25 aa, synthetic construct
  source 1..25: note = Seed: NSCVKLQTVHSIPLTINKEEALQRP
NSCVKLQTVHSIPITITKFEANQRP

SEQ ID NO: 40646 - protein, 25 aa, synthetic construct
  source 1..25: note = Seed: NSCVKLQTVHSIPLTINKEEALQRP
NSCVKLQTVHSIPITITKFEASQRP

SEQ ID NO: 40647 - protein, 25 aa, synthetic construct
  source 1..25: note = Seed: NSCVKLQTVHSIPLTINKEEALQRP
NSCVKLQTVHSIPITITKFEATQRP

SEQ ID NO: 40648 - protein, 25 aa, synthetic construct
  source 1..25: note = Seed: NSCVKLQTVHSIPLTINKEEALQRP
NSCVKLQTVHSIPITITKFEAVQRP

SEQ ID NO: 40649 - protein, 25 aa, synthetic construct
  source 1..25: note = Seed: NSCVKLQTVHSIPLTINKEEALQRP
NSCVKLQTVHSIPITITKFEAYQRP

SEQ ID NO: 40650 - protein, 25 aa, synthetic construct
  source 1..25: note = Seed: NSCVKLQTVHSIPLTINKEEALQRP
NSCVKLQTVHSIPITITKIEAAQRP

SEQ ID NO: 40651 - protein, 25 aa, synthetic construct
  source 1..25: note = Seed: NSCVKLQTVHSIPLTINKEEALQRP
NSCVKLQTVHSIPITITKIEAIQRP

SEQ ID NO: 40652 - protein, 25 aa, synthetic construct
  source 1..25: note = Seed: NSCVKLQTVHSIPLTINKEEALQRP
NSCVKLQTVHSIPITITKIEALQRP

SEQ ID NO: 40653 - protein, 25 aa, synthetic construct
  source 1..25: note = Seed: NSCVKLQTVHSIPLTINKEEALQRP
NSCVKLQTVHSIPITITKIEAMQRP

SEQ ID NO: 40654 - protein, 25 aa, synthetic construct
  source 1..25: note = Seed: NSCVKLQTVHSIPLTINKEEALQRP
NSCVKLQTVHSIPITITKIEAVQRP

SEQ ID NO: 40655 - protein, 25 aa, synthetic construct
  source 1..25: note = Seed: NSCVKLQTVHSIPLTINKEEALQRP
NSCVKLQTVHSIPITITKLEAIQRP

SEQ ID NO: 40656 - protein, 25 aa, synthetic construct
  source 1..25: note = Seed: NSCVKLQTVHSIPLTINKEEALQRP
NSCVKLQTVHSIPITITKLEALQRP

SEQ ID NO: 40657 - protein, 25 aa, synthetic construct
  source 1..25: note = Seed: NSCVKLQTVHSIPLTINKEEALQRP
NSCVKLQTVHSIPITITKNEAFQRP

SEQ ID NO: 40658 - protein, 25 aa, synthetic construct
  source 1..25: note = Seed: NSCVKLQTVHSIPLTINKEEALQRP
NSCVKLQTVHSIPITITKNEAIQRP

SEQ ID NO: 40659 - protein, 25 aa, synthetic construct
  source 1..25: note = Seed: NSCVKLQTVHSIPLTINKEEALQRP
NSCVKLQTVHSIPITITKNEALQRP

SEQ ID NO: 40660 - protein, 25 aa, synthetic construct
  source 1..25: note = Seed: NSCVKLQTVHSIPLTINKEEALQRP
NSCVKLQTVHSIPITITKNEAVQRP

SEQ ID NO: 40661 - protein, 25 aa, synthetic construct
  source 1..25: note = Seed: NSCVKLQTVHSIPLTINKEEALQRP
NSCVKLQTVHSIPITITKSEAIQRP

SEQ ID NO: 40662 - protein, 25 aa, synthetic construct
  source 1..25: note = Seed: NSCVKLQTVHSIPLTINKEEALQRP
NSCVKLQTVHSIPITITKSEAVQRP

SEQ ID NO: 40663 - protein, 25 aa, synthetic construct
  source 1..25: note = Seed: NSCVKLQTVHSIPLTINKEEALQRP
NSCVKLQTVHSIPITITKVEAAQRP

SEQ ID NO: 40664 - protein, 25 aa, synthetic construct
  source 1..25: note = Seed: NSCVKLQTVHSIPLTINKEEALQRP
NSCVKLQTVHSIPITITKWEAIQRP

SEQ ID NO: 40665 - protein, 25 aa, synthetic construct
  source 1..25: note = Seed: NSCVKLQTVHSIPLTINKEEALQRP
NSCVKLQTVHSIPITITKWEALQRP

SEQ ID NO: 40666 - protein, 25 aa, synthetic construct
  source 1..25: note = Seed: NSCVKLQTVHSIPLTINKEEALQRP
NSCVKLQTVHSIPITITKWEAVQRP

SEQ ID NO: 40667 - protein, 25 aa, synthetic construct
  source 1..25: note = Seed: NSCVKLQTVHSIPLTINKEEALQRP
NSCVKLQTVHSIPITITKYEAFQRP

SEQ ID NO: 40668 - protein, 25 aa, synthetic construct
  source 1..25: note = Seed: NSCVKLQTVHSIPLTINKEEALQRP
NSCVKLQTVHSIPITITKYEAIQRP

SEQ ID NO: 40669 - protein, 25 aa, synthetic construct
  source 1..25: note = Seed: NSCVKLQTVHSIPLTINKEEALQRP
NSCVKLQTVHSIPITITKYEALQRP

SEQ ID NO: 40670 - protein, 25 aa, synthetic construct
  source 1..25: note = Seed: NSCVKLQTVHSIPLTINKEEALQRP
NSCVKLQTVHSIPITITKYEAVQRP

SEQ ID NO: 40671 - protein, 25 aa, synthetic construct
  source 1..25: note = Seed: NSCVKLQTVHSIPLTINKEEALQRP
NSCVKLQTVHSIPITIVKAEAAQRP

SEQ ID NO: 40672 - protein, 25 aa, synthetic construct
  source 1..25: note = Seed: NSCVKLQTVHSIPLTINKEEALQRP
NSCVKLQTVHSIPITIVKAEACQRP

SEQ ID NO: 40673 - protein, 25 aa, synthetic construct
  source 1..25: note = Seed: NSCVKLQTVHSIPLTINKEEALQRP
NSCVKLQTVHSIPITIVKAEAFQRP

SEQ ID NO: 40674 - protein, 25 aa, synthetic construct
  source 1..25: note = Seed: NSCVKLQTVHSIPLTINKEEALQRP
NSCVKLQTVHSIPITIVKAEAIQRP

SEQ ID NO: 40675 - protein, 25 aa, synthetic construct
  source 1..25: note = Seed: NSCVKLQTVHSIPLTINKEEALQRP
NSCVKLQTVHSIPITIVKAEALQRP

SEQ ID NO: 40676 - protein, 25 aa, synthetic construct
  source 1..25: note = Seed: NSCVKLQTVHSIPLTINKEEALQRP
NSCVKLQTVHSIPITIVKAEAMQRP

SEQ ID NO: 40677 - protein, 25 aa, synthetic construct
  source 1..25: note = Seed: NSCVKLQTVHSIPLTINKEEALQRP
NSCVKLQTVHSIPITIVKAEARQRP

SEQ ID NO: 40678 - protein, 25 aa, synthetic construct
  source 1..25: note = Seed: NSCVKLQTVHSIPLTINKEEALQRP
NSCVKLQTVHSIPITIVKAEASQRP

SEQ ID NO: 40679 - protein, 25 aa, synthetic construct
  source 1..25: note = Seed: NSCVKLQTVHSIPLTINKEEALQRP
NSCVKLQTVHSIPITIVKAEATQRP

SEQ ID NO: 40680 - protein, 25 aa, synthetic construct
  source 1..25: note = Seed: NSCVKLQTVHSIPLTINKEEALQRP
NSCVKLQTVHSIPITIVKAEAVQRP

SEQ ID NO: 40681 - protein, 25 aa, synthetic construct
  source 1..25: note = Seed: NSCVKLQTVHSIPLTINKEEALQRP
NSCVKLQTVHSIPITIVKAEAYQRP

SEQ ID NO: 40682 - protein, 25 aa, synthetic construct
  source 1..25: note = Seed: NSCVKLQTVHSIPLTINKEEALQRP
NSCVKLQTVHSIPITIVKDEAAQRP

SEQ ID NO: 40683 - protein, 25 aa, synthetic construct
  source 1..25: note = Seed: NSCVKLQTVHSIPLTINKEEALQRP
NSCVKLQTVHSIPITIVKDEACQRP

SEQ ID NO: 40684 - protein, 25 aa, synthetic construct
  source 1..25: note = Seed: NSCVKLQTVHSIPLTINKEEALQRP
NSCVKLQTVHSIPITIVKDEAFQRP

SEQ ID NO: 40685 - protein, 25 aa, synthetic construct
  source 1..25: note = Seed: NSCVKLQTVHSIPLTINKEEALQRP
NSCVKLQTVHSIPITIVKDEAIQRP

SEQ ID NO: 40686 - protein, 25 aa, synthetic construct
  source 1..25: note = Seed: NSCVKLQTVHSIPLTINKEEALQRP
NSCVKLQTVHSIPITIVKDEALQRP

SEQ ID NO: 40687 - protein, 25 aa, synthetic construct
  source 1..25: note = Seed: NSCVKLQTVHSIPLTINKEEALQRP
NSCVKLQTVHSIPITIVKDEAMQRP

SEQ ID NO: 40688 - protein, 25 aa, synthetic construct
  source 1..25: note = Seed: NSCVKLQTVHSIPLTINKEEALQRP
NSCVKLQTVHSIPITIVKDEASQRP

SEQ ID NO: 40689 - protein, 25 aa, synthetic construct
  source 1..25: note = Seed: NSCVKLQTVHSIPLTINKEEALQRP
NSCVKLQTVHSIPITIVKDEAVQRP

SEQ ID NO: 40690 - protein, 25 aa, synthetic construct
  source 1..25: note = Seed: NSCVKLQTVHSIPLTINKEEALQRP
NSCVKLQTVHSIPITIVKDEAYQRP

SEQ ID NO: 40691 - protein, 25 aa, synthetic construct
  source 1..25: note = Seed: NSCVKLQTVHSIPLTINKEEALQRP
NSCVKLQTVHSIPITIVKFEAAQRP

SEQ ID NO: 40692 - protein, 25 aa, synthetic construct
  source 1..25: note = Seed: NSCVKLQTVHSIPLTINKEEALQRP
NSCVKLQTVHSIPITIVKFEADQRP

SEQ ID NO: 40693 - protein, 25 aa, synthetic construct
  source 1..25: note = Seed: NSCVKLQTVHSIPLTINKEEALQRP
NSCVKLQTVHSIPITIVKFEAEQRP

SEQ ID NO: 40694 - protein, 25 aa, synthetic construct
  source 1..25: note = Seed: NSCVKLQTVHSIPLTINKEEALQRP
NSCVKLQTVHSIPITIVKFEAFQRP

SEQ ID NO: 40695 - protein, 25 aa, synthetic construct
  source 1..25: note = Seed: NSCVKLQTVHSIPLTINKEEALQRP
NSCVKLQTVHSIPITIVKFEAHQRP

SEQ ID NO: 40696 - protein, 25 aa, synthetic construct
  source 1..25: note = Seed: NSCVKLQTVHSIPLTINKEEALQRP
NSCVKLQTVHSIPITIVKFEAIQRP

SEQ ID NO: 40697 - protein, 25 aa, synthetic construct
  source 1..25: note = Seed: NSCVKLQTVHSIPLTINKEEALQRP
NSCVKLQTVHSIPITIVKFEALQRP

SEQ ID NO: 40698 - protein, 25 aa, synthetic construct
  source 1..25: note = Seed: NSCVKLQTVHSIPLTINKEEALQRP
NSCVKLQTVHSIPITIVKFEAMQRP

SEQ ID NO: 40699 - protein, 25 aa, synthetic construct
  source 1..25: note = Seed: NSCVKLQTVHSIPLTINKEEALQRP
NSCVKLQTVHSIPITIVKFEANQRP

SEQ ID NO: 40700 - protein, 25 aa, synthetic construct
  source 1..25: note = Seed: NSCVKLQTVHSIPLTINKEEALQRP
NSCVKLQTVHSIPITIVKFEAQQRP

SEQ ID NO: 40701 - protein, 25 aa, synthetic construct
  source 1..25: note = Seed: NSCVKLQTVHSIPLTINKEEALQRP
NSCVKLQTVHSIPITIVKFEASQRP

SEQ ID NO: 40702 - protein, 25 aa, synthetic construct
  source 1..25: note = Seed: NSCVKLQTVHSIPLTINKEEALQRP
NSCVKLQTVHSIPITIVKFEATQRP

SEQ ID NO: 40703 - protein, 25 aa, synthetic construct
  source 1..25: note = Seed: NSCVKLQTVHSIPLTINKEEALQRP
NSCVKLQTVHSIPITIVKFEAVQRP

SEQ ID NO: 40704 - protein, 25 aa, synthetic construct
  source 1..25: note = Seed: NSCVKLQTVHSIPLTINKEEALQRP
NSCVKLQTVHSIPITIVKFEAYQRP

SEQ ID NO: 40705 - protein, 25 aa, synthetic construct
  source 1..25: note = Seed: NSCVKLQTVHSIPLTINKEEALQRP
NSCVKLQTVHSIPITIVKGEAAQRP

SEQ ID NO: 40706 - protein, 25 aa, synthetic construct
  source 1..25: note = Seed: NSCVKLQTVHSIPLTINKEEALQRP
NSCVKLQTVHSIPITIVKGEAIQRP

SEQ ID NO: 40707 - protein, 25 aa, synthetic construct
  source 1..25: note = Seed: NSCVKLQTVHSIPLTINKEEALQRP
NSCVKLQTVHSIPITIVKGEAVQRP

SEQ ID NO: 40708 - protein, 25 aa, synthetic construct
  source 1..25: note = Seed: NSCVKLQTVHSIPLTINKEEALQRP
NSCVKLQTVHSIPITIVKHEARQRP

SEQ ID NO: 40709 - protein, 25 aa, synthetic construct
  source 1..25: note = Seed: NSCVKLQTVHSIPLTINKEEALQRP
NSCVKLQTVHSIPITIVKIEAAQRP

SEQ ID NO: 40710 - protein, 25 aa, synthetic construct
  source 1..25: note = Seed: NSCVKLQTVHSIPLTINKEEALQRP
NSCVKLQTVHSIPITIVKIEACQRP

SEQ ID NO: 40711 - protein, 25 aa, synthetic construct
  source 1..25: note = Seed: NSCVKLQTVHSIPLTINKEEALQRP
NSCVKLQTVHSIPITIVKIEADQRP

SEQ ID NO: 40712 - protein, 25 aa, synthetic construct
  source 1..25: note = Seed: NSCVKLQTVHSIPLTINKEEALQRP
NSCVKLQTVHSIPITIVKIEAEQRP

SEQ ID NO: 40713 - protein, 25 aa, synthetic construct
  source 1..25: note = Seed: NSCVKLQTVHSIPLTINKEEALQRP
NSCVKLQTVHSIPITIVKIEAFQRP

SEQ ID NO: 40714 - protein, 25 aa, synthetic construct
  source 1..25: note = Seed: NSCVKLQTVHSIPLTINKEEALQRP
NSCVKLQTVHSIPITIVKIEAGQRP

SEQ ID NO: 40715 - protein, 25 aa, synthetic construct
  source 1..25: note = Seed: NSCVKLQTVHSIPLTINKEEALQRP
NSCVKLQTVHSIPITIVKIEAIQRP

SEQ ID NO: 40716 - protein, 25 aa, synthetic construct
  source 1..25: note = Seed: NSCVKLQTVHSIPLTINKEEALQRP
NSCVKLQTVHSIPITIVKIEALQRP

SEQ ID NO: 40717 - protein, 25 aa, synthetic construct
  source 1..25: note = Seed: NSCVKLQTVHSIPLTINKEEALQRP
NSCVKLQTVHSIPITIVKIEAMQRP

SEQ ID NO: 40718 - protein, 25 aa, synthetic construct
  source 1..25: note = Seed: NSCVKLQTVHSIPLTINKEEALQRP
NSCVKLQTVHSIPITIVKIEANQRP

SEQ ID NO: 40719 - protein, 25 aa, synthetic construct
  source 1..25: note = Seed: NSCVKLQTVHSIPLTINKEEALQRP
NSCVKLQTVHSIPITIVKIEAQQRP

SEQ ID NO: 40720 - protein, 25 aa, synthetic construct
  source 1..25: note = Seed: NSCVKLQTVHSIPLTINKEEALQRP
NSCVKLQTVHSIPITIVKIEASQRP

SEQ ID NO: 40721 - protein, 25 aa, synthetic construct
  source 1..25: note = Seed: NSCVKLQTVHSIPLTINKEEALQRP
NSCVKLQTVHSIPITIVKIEATQRP

SEQ ID NO: 40722 - protein, 25 aa, synthetic construct
  source 1..25: note = Seed: NSCVKLQTVHSIPLTINKEEALQRP
NSCVKLQTVHSIPITIVKIEAVQRP

SEQ ID NO: 40723 - protein, 25 aa, synthetic construct
  source 1..25: note = Seed: NSCVKLQTVHSIPLTINKEEALQRP
NSCVKLQTVHSIPITIVKIEAYQRP

SEQ ID NO: 40724 - protein, 25 aa, synthetic construct
  source 1..25: note = Seed: NSCVKLQTVHSIPLTINKEEALQRP
NSCVKLQTVHSIPITIVKKEAAQRP

SEQ ID NO: 40725 - protein, 25 aa, synthetic construct
  source 1..25: note = Seed: NSCVKLQTVHSIPLTINKEEALQRP
NSCVKLQTVHSIPITIVKKEAFQRP

SEQ ID NO: 40726 - protein, 25 aa, synthetic construct
  source 1..25: note = Seed: NSCVKLQTVHSIPLTINKEEALQRP
NSCVKLQTVHSIPITIVKKEAIQRP

SEQ ID NO: 40727 - protein, 25 aa, synthetic construct
  source 1..25: note = Seed: NSCVKLQTVHSIPLTINKEEALQRP
NSCVKLQTVHSIPITIVKKEALQRP

SEQ ID NO: 40728 - protein, 25 aa, synthetic construct
  source 1..25: note = Seed: NSCVKLQTVHSIPLTINKEEALQRP
NSCVKLQTVHSIPITIVKKEAMQRP

SEQ ID NO: 40729 - protein, 25 aa, synthetic construct
  source 1..25: note = Seed: NSCVKLQTVHSIPLTINKEEALQRP
NSCVKLQTVHSIPITIVKKEARQRP

SEQ ID NO: 40730 - protein, 25 aa, synthetic construct
  source 1..25: note = Seed: NSCVKLQTVHSIPLTINKEEALQRP
NSCVKLQTVHSIPITIVKKEAVQRP

SEQ ID NO: 40731 - protein, 25 aa, synthetic construct
  source 1..25: note = Seed: NSCVKLQTVHSIPLTINKEEALQRP
NSCVKLQTVHSIPITIVKKEAYQRP

SEQ ID NO: 40732 - protein, 25 aa, synthetic construct
  source 1..25: note = Seed: NSCVKLQTVHSIPLTINKEEALQRP
NSCVKLQTVHSIPITIVKLEAAQRP

SEQ ID NO: 40733 - protein, 25 aa, synthetic construct
  source 1..25: note = Seed: NSCVKLQTVHSIPLTINKEEALQRP
NSCVKLQTVHSIPITIVKLEAFQRP

SEQ ID NO: 40734 - protein, 25 aa, synthetic construct
  source 1..25: note = Seed: NSCVKLQTVHSIPLTINKEEALQRP
NSCVKLQTVHSIPITIVKLEAIQRP

SEQ ID NO: 40735 - protein, 25 aa, synthetic construct
  source 1..25: note = Seed: NSCVKLQTVHSIPLTINKEEALQRP
NSCVKLQTVHSIPITIVKLEALQRP

SEQ ID NO: 40736 - protein, 25 aa, synthetic construct
  source 1..25: note = Seed: NSCVKLQTVHSIPLTINKEEALQRP
NSCVKLQTVHSIPITIVKLEAMQRP

SEQ ID NO: 40737 - protein, 25 aa, synthetic construct
  source 1..25: note = Seed: NSCVKLQTVHSIPLTINKEEALQRP
NSCVKLQTVHSIPITIVKLEANQRP

SEQ ID NO: 40738 - protein, 25 aa, synthetic construct
  source 1..25: note = Seed: NSCVKLQTVHSIPLTINKEEALQRP
NSCVKLQTVHSIPITIVKLEAQQRP

SEQ ID NO: 40739 - protein, 25 aa, synthetic construct
  source 1..25: note = Seed: NSCVKLQTVHSIPLTINKEEALQRP
NSCVKLQTVHSIPITIVKLEASQRP

SEQ ID NO: 40740 - protein, 25 aa, synthetic construct
  source 1..25: note = Seed: NSCVKLQTVHSIPLTINKEEALQRP
NSCVKLQTVHSIPITIVKLEAVQRP

SEQ ID NO: 40741 - protein, 25 aa, synthetic construct
  source 1..25: note = Seed: NSCVKLQTVHSIPLTINKEEALQRP
NSCVKLQTVHSIPITIVKLEAYQRP

SEQ ID NO: 40742 - protein, 25 aa, synthetic construct
  source 1..25: note = Seed: NSCVKLQTVHSIPLTINKEEALQRP
NSCVKLQTVHSIPITIVKMEAAQRP

SEQ ID NO: 40743 - protein, 25 aa, synthetic construct
  source 1..25: note = Seed: NSCVKLQTVHSIPLTINKEEALQRP
NSCVKLQTVHSIPITIVKMEAFQRP

SEQ ID NO: 40744 - protein, 25 aa, synthetic construct
  source 1..25: note = Seed: NSCVKLQTVHSIPLTINKEEALQRP
NSCVKLQTVHSIPITIVKMEAIQRP

SEQ ID NO: 40745 - protein, 25 aa, synthetic construct
  source 1..25: note = Seed: NSCVKLQTVHSIPLTINKEEALQRP
NSCVKLQTVHSIPITIVKMEALQRP

SEQ ID NO: 40746 - protein, 25 aa, synthetic construct
  source 1..25: note = Seed: NSCVKLQTVHSIPLTINKEEALQRP
NSCVKLQTVHSIPITIVKMEAMQRP

SEQ ID NO: 40747 - protein, 25 aa, synthetic construct
  source 1..25: note = Seed: NSCVKLQTVHSIPLTINKEEALQRP
NSCVKLQTVHSIPITIVKMEANQRP

SEQ ID NO: 40748 - protein, 25 aa, synthetic construct
  source 1..25: note = Seed: NSCVKLQTVHSIPLTINKEEALQRP
NSCVKLQTVHSIPITIVKMEASQRP

SEQ ID NO: 40749 - protein, 25 aa, synthetic construct
  source 1..25: note = Seed: NSCVKLQTVHSIPLTINKEEALQRP
NSCVKLQTVHSIPITIVKMEAVQRP

SEQ ID NO: 40750 - protein, 25 aa, synthetic construct
  source 1..25: note = Seed: NSCVKLQTVHSIPLTINKEEALQRP
NSCVKLQTVHSIPITIVKMEAYQRP

SEQ ID NO: 40751 - protein, 25 aa, synthetic construct
  source 1..25: note = Seed: NSCVKLQTVHSIPLTINKEEALQRP
NSCVKLQTVHSIPITIVKNEAAQRP

SEQ ID NO: 40752 - protein, 25 aa, synthetic construct
  source 1..25: note = Seed: NSCVKLQTVHSIPLTINKEEALQRP
NSCVKLQTVHSIPITIVKNEAFQRP

SEQ ID NO: 40753 - protein, 25 aa, synthetic construct
  source 1..25: note = Seed: NSCVKLQTVHSIPLTINKEEALQRP
NSCVKLQTVHSIPITIVKNEAIQRP

SEQ ID NO: 40754 - protein, 25 aa, synthetic construct
  source 1..25: note = Seed: NSCVKLQTVHSIPLTINKEEALQRP
NSCVKLQTVHSIPITIVKNEALQRP

SEQ ID NO: 40755 - protein, 25 aa, synthetic construct
  source 1..25: note = Seed: NSCVKLQTVHSIPLTINKEEALQRP
NSCVKLQTVHSIPITIVKNEAMQRP

SEQ ID NO: 40756 - protein, 25 aa, synthetic construct
  source 1..25: note = Seed: NSCVKLQTVHSIPLTINKEEALQRP
NSCVKLQTVHSIPITIVKNEAVQRP

SEQ ID NO: 40757 - protein, 25 aa, synthetic construct
  source 1..25: note = Seed: NSCVKLQTVHSIPLTINKEEALQRP
NSCVKLQTVHSIPITIVKNEAYQRP

SEQ ID NO: 40758 - protein, 25 aa, synthetic construct
  source 1..25: note = Seed: NSCVKLQTVHSIPLTINKEEALQRP
NSCVKLQTVHSIPITIVKPEAAQRP

SEQ ID NO: 40759 - protein, 25 aa, synthetic construct
  source 1..25: note = Seed: NSCVKLQTVHSIPLTINKEEALQRP
NSCVKLQTVHSIPITIVKPEAIQRP

SEQ ID NO: 40760 - protein, 25 aa, synthetic construct
  source 1..25: note = Seed: NSCVKLQTVHSIPLTINKEEALQRP
NSCVKLQTVHSIPITIVKPEAVQRP

SEQ ID NO: 40761 - protein, 25 aa, synthetic construct
  source 1..25: note = Seed: NSCVKLQTVHSIPLTINKEEALQRP
NSCVKLQTVHSIPITIVKREAAQRP

SEQ ID NO: 40762 - protein, 25 aa, synthetic construct
  source 1..25: note = Seed: NSCVKLQTVHSIPLTINKEEALQRP
NSCVKLQTVHSIPITIVKREAFQRP

SEQ ID NO: 40763 - protein, 25 aa, synthetic construct
  source 1..25: note = Seed: NSCVKLQTVHSIPLTINKEEALQRP
NSCVKLQTVHSIPITIVKREAHQRP

SEQ ID NO: 40764 - protein, 25 aa, synthetic construct
  source 1..25: note = Seed: NSCVKLQTVHSIPLTINKEEALQRP
NSCVKLQTVHSIPITIVKREAIQRP

SEQ ID NO: 40765 - protein, 25 aa, synthetic construct
  source 1..25: note = Seed: NSCVKLQTVHSIPLTINKEEALQRP
NSCVKLQTVHSIPITIVKREAKQRP

SEQ ID NO: 40766 - protein, 25 aa, synthetic construct
  source 1..25: note = Seed: NSCVKLQTVHSIPLTINKEEALQRP
NSCVKLQTVHSIPITIVKREALQRP

SEQ ID NO: 40767 - protein, 25 aa, synthetic construct
  source 1..25: note = Seed: NSCVKLQTVHSIPLTINKEEALQRP
NSCVKLQTVHSIPITIVKREAMQRP

SEQ ID NO: 40768 - protein, 25 aa, synthetic construct
  source 1..25: note = Seed: NSCVKLQTVHSIPLTINKEEALQRP
NSCVKLQTVHSIPITIVKREARQRP

SEQ ID NO: 40769 - protein, 25 aa, synthetic construct
  source 1..25: note = Seed: NSCVKLQTVHSIPLTINKEEALQRP
NSCVKLQTVHSIPITIVKREASQRP

SEQ ID NO: 40770 - protein, 25 aa, synthetic construct
  source 1..25: note = Seed: NSCVKLQTVHSIPLTINKEEALQRP
NSCVKLQTVHSIPITIVKREAVQRP

SEQ ID NO: 40771 - protein, 25 aa, synthetic construct
  source 1..25: note = Seed: NSCVKLQTVHSIPLTINKEEALQRP
NSCVKLQTVHSIPITIVKREAYQRP

SEQ ID NO: 40772 - protein, 25 aa, synthetic construct
  source 1..25: note = Seed: NSCVKLQTVHSIPLTINKEEALQRP
NSCVKLQTVHSIPITIVKSEAAQRP

SEQ ID NO: 40773 - protein, 25 aa, synthetic construct
  source 1..25: note = Seed: NSCVKLQTVHSIPLTINKEEALQRP
NSCVKLQTVHSIPITIVKSEAFQRP

SEQ ID NO: 40774 - protein, 25 aa, synthetic construct
  source 1..25: note = Seed: NSCVKLQTVHSIPLTINKEEALQRP
NSCVKLQTVHSIPITIVKSEAIQRP

SEQ ID NO: 40775 - protein, 25 aa, synthetic construct
  source 1..25: note = Seed: NSCVKLQTVHSIPLTINKEEALQRP
NSCVKLQTVHSIPITIVKSEALQRP

SEQ ID NO: 40776 - protein, 25 aa, synthetic construct
  source 1..25: note = Seed: NSCVKLQTVHSIPLTINKEEALQRP
NSCVKLQTVHSIPITIVKSEAMQRP

SEQ ID NO: 40777 - protein, 25 aa, synthetic construct
  source 1..25: note = Seed: NSCVKLQTVHSIPLTINKEEALQRP
NSCVKLQTVHSIPITIVKSEASQRP

SEQ ID NO: 40778 - protein, 25 aa, synthetic construct
  source 1..25: note = Seed: NSCVKLQTVHSIPLTINKEEALQRP
NSCVKLQTVHSIPITIVKSEAVQRP

SEQ ID NO: 40779 - protein, 25 aa, synthetic construct
  source 1..25: note = Seed: NSCVKLQTVHSIPLTINKEEALQRP
NSCVKLQTVHSIPITIVKSEAYQRP

SEQ ID NO: 40780 - protein, 25 aa, synthetic construct
  source 1..25: note = Seed: NSCVKLQTVHSIPLTINKEEALQRP
NSCVKLQTVHSIPITIVKTEAAQRP

SEQ ID NO: 40781 - protein, 25 aa, synthetic construct
  source 1..25: note = Seed: NSCVKLQTVHSIPLTINKEEALQRP
NSCVKLQTVHSIPITIVKTEAFQRP

SEQ ID NO: 40782 - protein, 25 aa, synthetic construct
  source 1..25: note = Seed: NSCVKLQTVHSIPLTINKEEALQRP
NSCVKLQTVHSIPITIVKTEAIQRP

SEQ ID NO: 40783 - protein, 25 aa, synthetic construct
  source 1..25: note = Seed: NSCVKLQTVHSIPLTINKEEALQRP
NSCVKLQTVHSIPITIVKTEALQRP

SEQ ID NO: 40784 - protein, 25 aa, synthetic construct
  source 1..25: note = Seed: NSCVKLQTVHSIPLTINKEEALQRP
NSCVKLQTVHSIPITIVKTEAMQRP

SEQ ID NO: 40785 - protein, 25 aa, synthetic construct
  source 1..25: note = Seed: NSCVKLQTVHSIPLTINKEEALQRP
NSCVKLQTVHSIPITIVKTEAVQRP

SEQ ID NO: 40786 - protein, 25 aa, synthetic construct
  source 1..25: note = Seed: NSCVKLQTVHSIPLTINKEEALQRP
NSCVKLQTVHSIPITIVKVEAAQRP

SEQ ID NO: 40787 - protein, 25 aa, synthetic construct
  source 1..25: note = Seed: NSCVKLQTVHSIPLTINKEEALQRP
NSCVKLQTVHSIPITIVKVEACQRP

SEQ ID NO: 40788 - protein, 25 aa, synthetic construct
  source 1..25: note = Seed: NSCVKLQTVHSIPLTINKEEALQRP
NSCVKLQTVHSIPITIVKVEAFQRP

SEQ ID NO: 40789 - protein, 25 aa, synthetic construct
  source 1..25: note = Seed: NSCVKLQTVHSIPLTINKEEALQRP
NSCVKLQTVHSIPITIVKVEAGQRP

SEQ ID NO: 40790 - protein, 25 aa, synthetic construct
  source 1..25: note = Seed: NSCVKLQTVHSIPLTINKEEALQRP
NSCVKLQTVHSIPITIVKVEAIQRP

SEQ ID NO: 40791 - protein, 25 aa, synthetic construct
  source 1..25: note = Seed: NSCVKLQTVHSIPLTINKEEALQRP
NSCVKLQTVHSIPITIVKVEALQRP

SEQ ID NO: 40792 - protein, 25 aa, synthetic construct
  source 1..25: note = Seed: NSCVKLQTVHSIPLTINKEEALQRP
NSCVKLQTVHSIPITIVKVEAMQRP

SEQ ID NO: 40793 - protein, 25 aa, synthetic construct
  source 1..25: note = Seed: NSCVKLQTVHSIPLTINKEEALQRP
NSCVKLQTVHSIPITIVKVEAQQRP

SEQ ID NO: 40794 - protein, 25 aa, synthetic construct
  source 1..25: note = Seed: NSCVKLQTVHSIPLTINKEEALQRP
NSCVKLQTVHSIPITIVKVEASQRP

SEQ ID NO: 40795 - protein, 25 aa, synthetic construct
  source 1..25: note = Seed: NSCVKLQTVHSIPLTINKEEALQRP
NSCVKLQTVHSIPITIVKVEATQRP

SEQ ID NO: 40796 - protein, 25 aa, synthetic construct
  source 1..25: note = Seed: NSCVKLQTVHSIPLTINKEEALQRP
NSCVKLQTVHSIPITIVKVEAVQRP

SEQ ID NO: 40797 - protein, 25 aa, synthetic construct
  source 1..25: note = Seed: NSCVKLQTVHSIPLTINKEEALQRP
NSCVKLQTVHSIPITIVKVEAYQRP

SEQ ID NO: 40798 - protein, 25 aa, synthetic construct
  source 1..25: note = Seed: NSCVKLQTVHSIPLTINKEEALQRP
NSCVKLQTVHSIPITIVKWEAFQRP

SEQ ID NO: 40799 - protein, 25 aa, synthetic construct
  source 1..25: note = Seed: NSCVKLQTVHSIPLTINKEEALQRP
NSCVKLQTVHSIPITIVKWEAIQRP

SEQ ID NO: 40800 - protein, 25 aa, synthetic construct
  source 1..25: note = Seed: NSCVKLQTVHSIPLTINKEEALQRP
NSCVKLQTVHSIPITIVKWEALQRP

SEQ ID NO: 40801 - protein, 25 aa, synthetic construct
  source 1..25: note = Seed: NSCVKLQTVHSIPLTINKEEALQRP
NSCVKLQTVHSIPITIVKWEAVQRP

SEQ ID NO: 40802 - protein, 25 aa, synthetic construct
  source 1..25: note = Seed: NSCVKLQTVHSIPLTINKEEALQRP
NSCVKLQTVHSIPITIVKYEAFQRP

SEQ ID NO: 40803 - protein, 25 aa, synthetic construct
  source 1..25: note = Seed: NSCVKLQTVHSIPLTINKEEALQRP
NSCVKLQTVHSIPITIVKYEAIQRP

SEQ ID NO: 40804 - protein, 25 aa, synthetic construct
  source 1..25: note = Seed: NSCVKLQTVHSIPLTINKEEALQRP
NSCVKLQTVHSIPITIVKYEALQRP

SEQ ID NO: 40805 - protein, 25 aa, synthetic construct
  source 1..25: note = Seed: NSCVKLQTVHSIPLTINKEEALQRP
NSCVKLQTVHSIPITIVKYEAMQRP

SEQ ID NO: 40806 - protein, 25 aa, synthetic construct
  source 1..25: note = Seed: NSCVKLQTVHSIPLTINKEEALQRP
NSCVKLQTVHSIPITIVKYEAVQRP

SEQ ID NO: 40807 - protein, 25 aa, synthetic construct
  source 1..25: note = Seed: NSCVKLQTVHSIPLTINKEEALQRP
NSCVKLQTVHSIPITIVKYEAYQRP

SEQ ID NO: 40808 - protein, 25 aa, synthetic construct
  source 1..25: note = Seed: NSCVKLQTVHSIPLTINKEEALQRP
NSCVKLQTVHSIPITIWKAEAAQRP

SEQ ID NO: 40809 - protein, 25 aa, synthetic construct
  source 1..25: note = Seed: NSCVKLQTVHSIPLTINKEEALQRP
NSCVKLQTVHSIPITIWKAEACQRP

SEQ ID NO: 40810 - protein, 25 aa, synthetic construct
  source 1..25: note = Seed: NSCVKLQTVHSIPLTINKEEALQRP
NSCVKLQTVHSIPITIWKAEAFQRP

SEQ ID NO: 40811 - protein, 25 aa, synthetic construct
  source 1..25: note = Seed: NSCVKLQTVHSIPLTINKEEALQRP
NSCVKLQTVHSIPITIWKAEAIQRP

SEQ ID NO: 40812 - protein, 25 aa, synthetic construct
  source 1..25: note = Seed: NSCVKLQTVHSIPLTINKEEALQRP
NSCVKLQTVHSIPITIWKAEALQRP

SEQ ID NO: 40813 - protein, 25 aa, synthetic construct
  source 1..25: note = Seed: NSCVKLQTVHSIPLTINKEEALQRP
NSCVKLQTVHSIPITIWKAEAMQRP

SEQ ID NO: 40814 - protein, 25 aa, synthetic construct
  source 1..25: note = Seed: NSCVKLQTVHSIPLTINKEEALQRP
NSCVKLQTVHSIPITIWKAEASQRP

SEQ ID NO: 40815 - protein, 25 aa, synthetic construct
  source 1..25: note = Seed: NSCVKLQTVHSIPLTINKEEALQRP
NSCVKLQTVHSIPITIWKAEATQRP

SEQ ID NO: 40816 - protein, 25 aa, synthetic construct
  source 1..25: note = Seed: NSCVKLQTVHSIPLTINKEEALQRP
NSCVKLQTVHSIPITIWKAEAVQRP

SEQ ID NO: 40817 - protein, 25 aa, synthetic construct
  source 1..25: note = Seed: NSCVKLQTVHSIPLTINKEEALQRP
NSCVKLQTVHSIPITIWKAEAYQRP

SEQ ID NO: 40818 - protein, 25 aa, synthetic construct
  source 1..25: note = Seed: NSCVKLQTVHSIPLTINKEEALQRP
NSCVKLQTVHSIPITIWKDEAAQRP

SEQ ID NO: 40819 - protein, 25 aa, synthetic construct
  source 1..25: note = Seed: NSCVKLQTVHSIPLTINKEEALQRP
NSCVKLQTVHSIPITIWKDEACQRP

SEQ ID NO: 40820 - protein, 25 aa, synthetic construct
  source 1..25: note = Seed: NSCVKLQTVHSIPLTINKEEALQRP
NSCVKLQTVHSIPITIWKDEADQRP

SEQ ID NO: 40821 - protein, 25 aa, synthetic construct
  source 1..25: note = Seed: NSCVKLQTVHSIPLTINKEEALQRP
NSCVKLQTVHSIPITIWKDEAFQRP

SEQ ID NO: 40822 - protein, 25 aa, synthetic construct
  source 1..25: note = Seed: NSCVKLQTVHSIPLTINKEEALQRP
NSCVKLQTVHSIPITIWKDEAGQRP

SEQ ID NO: 40823 - protein, 25 aa, synthetic construct
  source 1..25: note = Seed: NSCVKLQTVHSIPLTINKEEALQRP
NSCVKLQTVHSIPITIWKDEAIQRP

SEQ ID NO: 40824 - protein, 25 aa, synthetic construct
  source 1..25: note = Seed: NSCVKLQTVHSIPLTINKEEALQRP
NSCVKLQTVHSIPITIWKDEALQRP

SEQ ID NO: 40825 - protein, 25 aa, synthetic construct
  source 1..25: note = Seed: NSCVKLQTVHSIPLTINKEEALQRP
NSCVKLQTVHSIPITIWKDEAMQRP

SEQ ID NO: 40826 - protein, 25 aa, synthetic construct
  source 1..25: note = Seed: NSCVKLQTVHSIPLTINKEEALQRP
NSCVKLQTVHSIPITIWKDEAQQRP

SEQ ID NO: 40827 - protein, 25 aa, synthetic construct
  source 1..25: note = Seed: NSCVKLQTVHSIPLTINKEEALQRP
NSCVKLQTVHSIPITIWKDEASQRP

SEQ ID NO: 40828 - protein, 25 aa, synthetic construct
  source 1..25: note = Seed: NSCVKLQTVHSIPLTINKEEALQRP
NSCVKLQTVHSIPITIWKDEATQRP

SEQ ID NO: 40829 - protein, 25 aa, synthetic construct
  source 1..25: note = Seed: NSCVKLQTVHSIPLTINKEEALQRP
NSCVKLQTVHSIPITIWKDEAVQRP

SEQ ID NO: 40830 - protein, 25 aa, synthetic construct
  source 1..25: note = Seed: NSCVKLQTVHSIPLTINKEEALQRP
NSCVKLQTVHSIPITIWKDEAWQRP

SEQ ID NO: 40831 - protein, 25 aa, synthetic construct
  source 1..25: note = Seed: NSCVKLQTVHSIPLTINKEEALQRP
NSCVKLQTVHSIPITIWKDEAYQRP

SEQ ID NO: 40832 - protein, 25 aa, synthetic construct
  source 1..25: note = Seed: NSCVKLQTVHSIPLTINKEEALQRP
NSCVKLQTVHSIPITIWKFEAFQRP

SEQ ID NO: 40833 - protein, 25 aa, synthetic construct
  source 1..25: note = Seed: NSCVKLQTVHSIPLTINKEEALQRP
NSCVKLQTVHSIPITIWKFEAIQRP

SEQ ID NO: 40834 - protein, 25 aa, synthetic construct
  source 1..25: note = Seed: NSCVKLQTVHSIPLTINKEEALQRP
NSCVKLQTVHSIPITIWKFEALQRP

SEQ ID NO: 40835 - protein, 25 aa, synthetic construct
  source 1..25: note = Seed: NSCVKLQTVHSIPLTINKEEALQRP
NSCVKLQTVHSIPITIWKFEAMQRP

SEQ ID NO: 40836 - protein, 25 aa, synthetic construct
  source 1..25: note = Seed: NSCVKLQTVHSIPLTINKEEALQRP
NSCVKLQTVHSIPITIWKFEAVQRP

SEQ ID NO: 40837 - protein, 25 aa, synthetic construct
  source 1..25: note = Seed: NSCVKLQTVHSIPLTINKEEALQRP
NSCVKLQTVHSIPITIWKFEAYQRP

SEQ ID NO: 40838 - protein, 25 aa, synthetic construct
  source 1..25: note = Seed: NSCVKLQTVHSIPLTINKEEALQRP
NSCVKLQTVHSIPITIWKGEAIQRP

SEQ ID NO: 40839 - protein, 25 aa, synthetic construct
  source 1..25: note = Seed: NSCVKLQTVHSIPLTINKEEALQRP
NSCVKLQTVHSIPITIWKGEALQRP

SEQ ID NO: 40840 - protein, 25 aa, synthetic construct
  source 1..25: note = Seed: NSCVKLQTVHSIPLTINKEEALQRP
NSCVKLQTVHSIPITIWKGEAVQRP

SEQ ID NO: 40841 - protein, 25 aa, synthetic construct
  source 1..25: note = Seed: NSCVKLQTVHSIPLTINKEEALQRP
NSCVKLQTVHSIPITIWKHEAFQRP

SEQ ID NO: 40842 - protein, 25 aa, synthetic construct
  source 1..25: note = Seed: NSCVKLQTVHSIPLTINKEEALQRP
NSCVKLQTVHSIPITIWKHEAIQRP

SEQ ID NO: 40843 - protein, 25 aa, synthetic construct
  source 1..25: note = Seed: NSCVKLQTVHSIPLTINKEEALQRP
NSCVKLQTVHSIPITIWKHEALQRP

SEQ ID NO: 40844 - protein, 25 aa, synthetic construct
  source 1..25: note = Seed: NSCVKLQTVHSIPLTINKEEALQRP
NSCVKLQTVHSIPITIWKIEAAQRP

SEQ ID NO: 40845 - protein, 25 aa, synthetic construct
  source 1..25: note = Seed: NSCVKLQTVHSIPLTINKEEALQRP
NSCVKLQTVHSIPITIWKIEACQRP

SEQ ID NO: 40846 - protein, 25 aa, synthetic construct
  source 1..25: note = Seed: NSCVKLQTVHSIPLTINKEEALQRP
NSCVKLQTVHSIPITIWKIEADQRP

SEQ ID NO: 40847 - protein, 25 aa, synthetic construct
  source 1..25: note = Seed: NSCVKLQTVHSIPLTINKEEALQRP
NSCVKLQTVHSIPITIWKIEAEQRP

SEQ ID NO: 40848 - protein, 25 aa, synthetic construct
  source 1..25: note = Seed: NSCVKLQTVHSIPLTINKEEALQRP
NSCVKLQTVHSIPITIWKIEAFQRP

SEQ ID NO: 40849 - protein, 25 aa, synthetic construct
  source 1..25: note = Seed: NSCVKLQTVHSIPLTINKEEALQRP
NSCVKLQTVHSIPITIWKIEAGQRP

SEQ ID NO: 40850 - protein, 25 aa, synthetic construct
  source 1..25: note = Seed: NSCVKLQTVHSIPLTINKEEALQRP
NSCVKLQTVHSIPITIWKIEAIQRP

SEQ ID NO: 40851 - protein, 25 aa, synthetic construct
  source 1..25: note = Seed: NSCVKLQTVHSIPLTINKEEALQRP
NSCVKLQTVHSIPITIWKIEALQRP

SEQ ID NO: 40852 - protein, 25 aa, synthetic construct
  source 1..25: note = Seed: NSCVKLQTVHSIPLTINKEEALQRP
NSCVKLQTVHSIPITIWKIEAMQRP

SEQ ID NO: 40853 - protein, 25 aa, synthetic construct
  source 1..25: note = Seed: NSCVKLQTVHSIPLTINKEEALQRP
NSCVKLQTVHSIPITIWKIEANQRP

SEQ ID NO: 40854 - protein, 25 aa, synthetic construct
  source 1..25: note = Seed: NSCVKLQTVHSIPLTINKEEALQRP
NSCVKLQTVHSIPITIWKIEAQQRP

SEQ ID NO: 40855 - protein, 25 aa, synthetic construct
  source 1..25: note = Seed: NSCVKLQTVHSIPLTINKEEALQRP
NSCVKLQTVHSIPITIWKIEASQRP

SEQ ID NO: 40856 - protein, 25 aa, synthetic construct
  source 1..25: note = Seed: NSCVKLQTVHSIPLTINKEEALQRP
NSCVKLQTVHSIPITIWKIEATQRP

SEQ ID NO: 40857 - protein, 25 aa, synthetic construct
  source 1..25: note = Seed: NSCVKLQTVHSIPLTINKEEALQRP
NSCVKLQTVHSIPITIWKIEAVQRP

SEQ ID NO: 40858 - protein, 25 aa, synthetic construct
  source 1..25: note = Seed: NSCVKLQTVHSIPLTINKEEALQRP
NSCVKLQTVHSIPITIWKIEAYQRP

SEQ ID NO: 40859 - protein, 25 aa, synthetic construct
  source 1..25: note = Seed: NSCVKLQTVHSIPLTINKEEALQRP
NSCVKLQTVHSIPITIWKKEAFQRP

SEQ ID NO: 40860 - protein, 25 aa, synthetic construct
  source 1..25: note = Seed: NSCVKLQTVHSIPLTINKEEALQRP
NSCVKLQTVHSIPITIWKKEAIQRP

SEQ ID NO: 40861 - protein, 25 aa, synthetic construct
  source 1..25: note = Seed: NSCVKLQTVHSIPLTINKEEALQRP
NSCVKLQTVHSIPITIWKKEALQRP

SEQ ID NO: 40862 - protein, 25 aa, synthetic construct
  source 1..25: note = Seed: NSCVKLQTVHSIPLTINKEEALQRP
NSCVKLQTVHSIPITIWKKEAMQRP

SEQ ID NO: 40863 - protein, 25 aa, synthetic construct
  source 1..25: note = Seed: NSCVKLQTVHSIPLTINKEEALQRP
NSCVKLQTVHSIPITIWKKEAVQRP

SEQ ID NO: 40864 - protein, 25 aa, synthetic construct
  source 1..25: note = Seed: NSCVKLQTVHSIPLTINKEEALQRP
NSCVKLQTVHSIPITIWKKEAYQRP

SEQ ID NO: 40865 - protein, 25 aa, synthetic construct
  source 1..25: note = Seed: NSCVKLQTVHSIPLTINKEEALQRP
NSCVKLQTVHSIPITIWKLEAAQRP

SEQ ID NO: 40866 - protein, 25 aa, synthetic construct
  source 1..25: note = Seed: NSCVKLQTVHSIPLTINKEEALQRP
NSCVKLQTVHSIPITIWKLEAFQRP

SEQ ID NO: 40867 - protein, 25 aa, synthetic construct
  source 1..25: note = Seed: NSCVKLQTVHSIPLTINKEEALQRP
NSCVKLQTVHSIPITIWKLEAIQRP

SEQ ID NO: 40868 - protein, 25 aa, synthetic construct
  source 1..25: note = Seed: NSCVKLQTVHSIPLTINKEEALQRP
NSCVKLQTVHSIPITIWKLEALQRP

SEQ ID NO: 40869 - protein, 25 aa, synthetic construct
  source 1..25: note = Seed: NSCVKLQTVHSIPLTINKEEALQRP
NSCVKLQTVHSIPITIWKLEAMQRP

SEQ ID NO: 40870 - protein, 25 aa, synthetic construct
  source 1..25: note = Seed: NSCVKLQTVHSIPLTINKEEALQRP
NSCVKLQTVHSIPITIWKLEASQRP

SEQ ID NO: 40871 - protein, 25 aa, synthetic construct
  source 1..25: note = Seed: NSCVKLQTVHSIPLTINKEEALQRP
NSCVKLQTVHSIPITIWKLEATQRP

SEQ ID NO: 40872 - protein, 25 aa, synthetic construct
  source 1..25: note = Seed: NSCVKLQTVHSIPLTINKEEALQRP
NSCVKLQTVHSIPITIWKLEAVQRP

SEQ ID NO: 40873 - protein, 25 aa, synthetic construct
  source 1..25: note = Seed: NSCVKLQTVHSIPLTINKEEALQRP
NSCVKLQTVHSIPITIWKLEAYQRP

SEQ ID NO: 40874 - protein, 25 aa, synthetic construct
  source 1..25: note = Seed: NSCVKLQTVHSIPLTINKEEALQRP
NSCVKLQTVHSIPITIWKMEAAQRP

SEQ ID NO: 40875 - protein, 25 aa, synthetic construct
  source 1..25: note = Seed: NSCVKLQTVHSIPLTINKEEALQRP
NSCVKLQTVHSIPITIWKMEAFQRP

SEQ ID NO: 40876 - protein, 25 aa, synthetic construct
  source 1..25: note = Seed: NSCVKLQTVHSIPLTINKEEALQRP
NSCVKLQTVHSIPITIWKMEAIQRP

SEQ ID NO: 40877 - protein, 25 aa, synthetic construct
  source 1..25: note = Seed: NSCVKLQTVHSIPLTINKEEALQRP
NSCVKLQTVHSIPITIWKMEALQRP

SEQ ID NO: 40878 - protein, 25 aa, synthetic construct
  source 1..25: note = Seed: NSCVKLQTVHSIPLTINKEEALQRP
NSCVKLQTVHSIPITIWKMEAMQRP

SEQ ID NO: 40879 - protein, 25 aa, synthetic construct
  source 1..25: note = Seed: NSCVKLQTVHSIPLTINKEEALQRP
NSCVKLQTVHSIPITIWKMEASQRP

SEQ ID NO: 40880 - protein, 25 aa, synthetic construct
  source 1..25: note = Seed: NSCVKLQTVHSIPLTINKEEALQRP
NSCVKLQTVHSIPITIWKMEAVQRP

SEQ ID NO: 40881 - protein, 25 aa, synthetic construct
  source 1..25: note = Seed: NSCVKLQTVHSIPLTINKEEALQRP
NSCVKLQTVHSIPITIWKMEAYQRP

SEQ ID NO: 40882 - protein, 25 aa, synthetic construct
  source 1..25: note = Seed: NSCVKLQTVHSIPLTINKEEALQRP
NSCVKLQTVHSIPITIWKNEAAQRP

SEQ ID NO: 40883 - protein, 25 aa, synthetic construct
  source 1..25: note = Seed: NSCVKLQTVHSIPLTINKEEALQRP
NSCVKLQTVHSIPITIWKNEAFQRP

SEQ ID NO: 40884 - protein, 25 aa, synthetic construct
  source 1..25: note = Seed: NSCVKLQTVHSIPLTINKEEALQRP
NSCVKLQTVHSIPITIWKNEAIQRP

SEQ ID NO: 40885 - protein, 25 aa, synthetic construct
  source 1..25: note = Seed: NSCVKLQTVHSIPLTINKEEALQRP
NSCVKLQTVHSIPITIWKNEALQRP

SEQ ID NO: 40886 - protein, 25 aa, synthetic construct
  source 1..25: note = Seed: NSCVKLQTVHSIPLTINKEEALQRP
NSCVKLQTVHSIPITIWKNEAMQRP

SEQ ID NO: 40887 - protein, 25 aa, synthetic construct
  source 1..25: note = Seed: NSCVKLQTVHSIPLTINKEEALQRP
NSCVKLQTVHSIPITIWKNEASQRP

SEQ ID NO: 40888 - protein, 25 aa, synthetic construct
  source 1..25: note = Seed: NSCVKLQTVHSIPLTINKEEALQRP
NSCVKLQTVHSIPITIWKNEAVQRP

SEQ ID NO: 40889 - protein, 25 aa, synthetic construct
  source 1..25: note = Seed: NSCVKLQTVHSIPLTINKEEALQRP
NSCVKLQTVHSIPITIWKNEAYQRP

SEQ ID NO: 40890 - protein, 25 aa, synthetic construct
  source 1..25: note = Seed: NSCVKLQTVHSIPLTINKEEALQRP
NSCVKLQTVHSIPITIWKPEAAQRP

SEQ ID NO: 40891 - protein, 25 aa, synthetic construct
  source 1..25: note = Seed: NSCVKLQTVHSIPLTINKEEALQRP
NSCVKLQTVHSIPITIWKPEAIQRP

SEQ ID NO: 40892 - protein, 25 aa, synthetic construct
  source 1..25: note = Seed: NSCVKLQTVHSIPLTINKEEALQRP
NSCVKLQTVHSIPITIWKPEALQRP

SEQ ID NO: 40893 - protein, 25 aa, synthetic construct
  source 1..25: note = Seed: NSCVKLQTVHSIPLTINKEEALQRP
NSCVKLQTVHSIPITIWKPEAVQRP

SEQ ID NO: 40894 - protein, 25 aa, synthetic construct
  source 1..25: note = Seed: NSCVKLQTVHSIPLTINKEEALQRP
NSCVKLQTVHSIPITIWKREAFQRP

SEQ ID NO: 40895 - protein, 25 aa, synthetic construct
  source 1..25: note = Seed: NSCVKLQTVHSIPLTINKEEALQRP
NSCVKLQTVHSIPITIWKREAHQRP

SEQ ID NO: 40896 - protein, 25 aa, synthetic construct
  source 1..25: note = Seed: NSCVKLQTVHSIPLTINKEEALQRP
NSCVKLQTVHSIPITIWKREAIQRP

SEQ ID NO: 40897 - protein, 25 aa, synthetic construct
  source 1..25: note = Seed: NSCVKLQTVHSIPLTINKEEALQRP
NSCVKLQTVHSIPITIWKREALQRP

SEQ ID NO: 40898 - protein, 25 aa, synthetic construct
  source 1..25: note = Seed: NSCVKLQTVHSIPLTINKEEALQRP
NSCVKLQTVHSIPITIWKREAMQRP

SEQ ID NO: 40899 - protein, 25 aa, synthetic construct
  source 1..25: note = Seed: NSCVKLQTVHSIPLTINKEEALQRP
NSCVKLQTVHSIPITIWKREARQRP

SEQ ID NO: 40900 - protein, 25 aa, synthetic construct
  source 1..25: note = Seed: NSCVKLQTVHSIPLTINKEEALQRP
NSCVKLQTVHSIPITIWKREAVQRP

SEQ ID NO: 40901 - protein, 25 aa, synthetic construct
  source 1..25: note = Seed: NSCVKLQTVHSIPLTINKEEALQRP
NSCVKLQTVHSIPITIWKREAYQRP

SEQ ID NO: 40902 - protein, 25 aa, synthetic construct
  source 1..25: note = Seed: NSCVKLQTVHSIPLTINKEEALQRP
NSCVKLQTVHSIPITIWKSEAAQRP

SEQ ID NO: 40903 - protein, 25 aa, synthetic construct
  source 1..25: note = Seed: NSCVKLQTVHSIPLTINKEEALQRP
NSCVKLQTVHSIPITIWKSEAFQRP

SEQ ID NO: 40904 - protein, 25 aa, synthetic construct
  source 1..25: note = Seed: NSCVKLQTVHSIPLTINKEEALQRP
NSCVKLQTVHSIPITIWKSEAIQRP

SEQ ID NO: 40905 - protein, 25 aa, synthetic construct
  source 1..25: note = Seed: NSCVKLQTVHSIPLTINKEEALQRP
NSCVKLQTVHSIPITIWKSEALQRP

SEQ ID NO: 40906 - protein, 25 aa, synthetic construct
  source 1..25: note = Seed: NSCVKLQTVHSIPLTINKEEALQRP
NSCVKLQTVHSIPITIWKSEAMQRP

SEQ ID NO: 40907 - protein, 25 aa, synthetic construct
  source 1..25: note = Seed: NSCVKLQTVHSIPLTINKEEALQRP
NSCVKLQTVHSIPITIWKSEAVQRP

SEQ ID NO: 40908 - protein, 25 aa, synthetic construct
  source 1..25: note = Seed: NSCVKLQTVHSIPLTINKEEALQRP
NSCVKLQTVHSIPITIWKTEAAQRP

SEQ ID NO: 40909 - protein, 25 aa, synthetic construct
  source 1..25: note = Seed: NSCVKLQTVHSIPLTINKEEALQRP
NSCVKLQTVHSIPITIWKTEAFQRP

SEQ ID NO: 40910 - protein, 25 aa, synthetic construct
  source 1..25: note = Seed: NSCVKLQTVHSIPLTINKEEALQRP
NSCVKLQTVHSIPITIWKTEAIQRP

SEQ ID NO: 40911 - protein, 25 aa, synthetic construct
  source 1..25: note = Seed: NSCVKLQTVHSIPLTINKEEALQRP
NSCVKLQTVHSIPITIWKTEALQRP

SEQ ID NO: 40912 - protein, 25 aa, synthetic construct
  source 1..25: note = Seed: NSCVKLQTVHSIPLTINKEEALQRP
NSCVKLQTVHSIPITIWKTEAMQRP

SEQ ID NO: 40913 - protein, 25 aa, synthetic construct
  source 1..25: note = Seed: NSCVKLQTVHSIPLTINKEEALQRP
NSCVKLQTVHSIPITIWKTEAVQRP

SEQ ID NO: 40914 - protein, 25 aa, synthetic construct
  source 1..25: note = Seed: NSCVKLQTVHSIPLTINKEEALQRP
NSCVKLQTVHSIPITIWKVEAAQRP

SEQ ID NO: 40915 - protein, 25 aa, synthetic construct
  source 1..25: note = Seed: NSCVKLQTVHSIPLTINKEEALQRP
NSCVKLQTVHSIPITIWKVEACQRP

SEQ ID NO: 40916 - protein, 25 aa, synthetic construct
  source 1..25: note = Seed: NSCVKLQTVHSIPLTINKEEALQRP
NSCVKLQTVHSIPITIWKVEAFQRP

SEQ ID NO: 40917 - protein, 25 aa, synthetic construct
  source 1..25: note = Seed: NSCVKLQTVHSIPLTINKEEALQRP
NSCVKLQTVHSIPITIWKVEAIQRP

SEQ ID NO: 40918 - protein, 25 aa, synthetic construct
  source 1..25: note = Seed: NSCVKLQTVHSIPLTINKEEALQRP
NSCVKLQTVHSIPITIWKVEALQRP

SEQ ID NO: 40919 - protein, 25 aa, synthetic construct
  source 1..25: note = Seed: NSCVKLQTVHSIPLTINKEEALQRP
NSCVKLQTVHSIPITIWKVEAMQRP

SEQ ID NO: 40920 - protein, 25 aa, synthetic construct
  source 1..25: note = Seed: NSCVKLQTVHSIPLTINKEEALQRP
NSCVKLQTVHSIPITIWKVEASQRP

SEQ ID NO: 40921 - protein, 25 aa, synthetic construct
  source 1..25: note = Seed: NSCVKLQTVHSIPLTINKEEALQRP
NSCVKLQTVHSIPITIWKVEATQRP

SEQ ID NO: 40922 - protein, 25 aa, synthetic construct
  source 1..25: note = Seed: NSCVKLQTVHSIPLTINKEEALQRP
NSCVKLQTVHSIPITIWKVEAVQRP

SEQ ID NO: 40923 - protein, 25 aa, synthetic construct
  source 1..25: note = Seed: NSCVKLQTVHSIPLTINKEEALQRP
NSCVKLQTVHSIPITIWKVEAYQRP

SEQ ID NO: 40924 - protein, 25 aa, synthetic construct
  source 1..25: note = Seed: NSCVKLQTVHSIPLTINKEEALQRP
NSCVKLQTVHSIPITIWKYEAFQRP

SEQ ID NO: 40925 - protein, 25 aa, synthetic construct
  source 1..25: note = Seed: NSCVKLQTVHSIPLTINKEEALQRP
NSCVKLQTVHSIPITIWKYEALQRP

SEQ ID NO: 40926 - protein, 25 aa, synthetic construct
  source 1..25: note = Seed: NSCVKLQTVHSIPLTINKEEALQRP
NSCVKLQTVHSIPITIYKAEAAQRP

SEQ ID NO: 40927 - protein, 25 aa, synthetic construct
  source 1..25: note = Seed: NSCVKLQTVHSIPLTINKEEALQRP
NSCVKLQTVHSIPITIYKAEACQRP

SEQ ID NO: 40928 - protein, 25 aa, synthetic construct
  source 1..25: note = Seed: NSCVKLQTVHSIPLTINKEEALQRP
NSCVKLQTVHSIPITIYKAEADQRP

SEQ ID NO: 40929 - protein, 25 aa, synthetic construct
  source 1..25: note = Seed: NSCVKLQTVHSIPLTINKEEALQRP
NSCVKLQTVHSIPITIYKAEAEQRP

SEQ ID NO: 40930 - protein, 25 aa, synthetic construct
  source 1..25: note = Seed: NSCVKLQTVHSIPLTINKEEALQRP
NSCVKLQTVHSIPITIYKAEAFQRP

SEQ ID NO: 40931 - protein, 25 aa, synthetic construct
  source 1..25: note = Seed: NSCVKLQTVHSIPLTINKEEALQRP
NSCVKLQTVHSIPITIYKAEAGQRP

SEQ ID NO: 40932 - protein, 25 aa, synthetic construct
  source 1..25: note = Seed: NSCVKLQTVHSIPLTINKEEALQRP
NSCVKLQTVHSIPITIYKAEAHQRP

SEQ ID NO: 40933 - protein, 25 aa, synthetic construct
  source 1..25: note = Seed: NSCVKLQTVHSIPLTINKEEALQRP
NSCVKLQTVHSIPITIYKAEAIQRP

SEQ ID NO: 40934 - protein, 25 aa, synthetic construct
  source 1..25: note = Seed: NSCVKLQTVHSIPLTINKEEALQRP
NSCVKLQTVHSIPITIYKAEAMQRP

SEQ ID NO: 40935 - protein, 25 aa, synthetic construct
  source 1..25: note = Seed: NSCVKLQTVHSIPLTINKEEALQRP
NSCVKLQTVHSIPITIYKAEANQRP

SEQ ID NO: 40936 - protein, 25 aa, synthetic construct
  source 1..25: note = Seed: NSCVKLQTVHSIPLTINKEEALQRP
NSCVKLQTVHSIPITIYKAEAPQRP

SEQ ID NO: 40937 - protein, 25 aa, synthetic construct
  source 1..25: note = Seed: NSCVKLQTVHSIPLTINKEEALQRP
NSCVKLQTVHSIPITIYKAEAQQRP

SEQ ID NO: 40938 - protein, 25 aa, synthetic construct
  source 1..25: note = Seed: NSCVKLQTVHSIPLTINKEEALQRP
NSCVKLQTVHSIPITIYKAEASQRP

SEQ ID NO: 40939 - protein, 25 aa, synthetic construct
  source 1..25: note = Seed: NSCVKLQTVHSIPLTINKEEALQRP
NSCVKLQTVHSIPITIYKAEATQRP

SEQ ID NO: 40940 - protein, 25 aa, synthetic construct
  source 1..25: note = Seed: NSCVKLQTVHSIPLTINKEEALQRP
NSCVKLQTVHSIPITIYKAEAVQRP

SEQ ID NO: 40941 - protein, 25 aa, synthetic construct
  source 1..25: note = Seed: NSCVKLQTVHSIPLTINKEEALQRP
NSCVKLQTVHSIPITIYKAEAYQRP

SEQ ID NO: 40942 - protein, 25 aa, synthetic construct
  source 1..25: note = Seed: NSCVKLQTVHSIPLTINKEEALQRP
NSCVKLQTVHSIPITIYKDEAAQRP

SEQ ID NO: 40943 - protein, 25 aa, synthetic construct
  source 1..25: note = Seed: NSCVKLQTVHSIPLTINKEEALQRP
NSCVKLQTVHSIPITIYKDEACQRP

SEQ ID NO: 40944 - protein, 25 aa, synthetic construct
  source 1..25: note = Seed: NSCVKLQTVHSIPLTINKEEALQRP
NSCVKLQTVHSIPITIYKDEADQRP

SEQ ID NO: 40945 - protein, 25 aa, synthetic construct
  source 1..25: note = Seed: NSCVKLQTVHSIPLTINKEEALQRP
NSCVKLQTVHSIPITIYKDEAEQRP

SEQ ID NO: 40946 - protein, 25 aa, synthetic construct
  source 1..25: note = Seed: NSCVKLQTVHSIPLTINKEEALQRP
NSCVKLQTVHSIPITIYKDEAFQRP

SEQ ID NO: 40947 - protein, 25 aa, synthetic construct
  source 1..25: note = Seed: NSCVKLQTVHSIPLTINKEEALQRP
NSCVKLQTVHSIPITIYKDEAGQRP

SEQ ID NO: 40948 - protein, 25 aa, synthetic construct
  source 1..25: note = Seed: NSCVKLQTVHSIPLTINKEEALQRP
NSCVKLQTVHSIPITIYKDEAIQRP

SEQ ID NO: 40949 - protein, 25 aa, synthetic construct
  source 1..25: note = Seed: NSCVKLQTVHSIPLTINKEEALQRP
NSCVKLQTVHSIPITIYKDEALQRP

SEQ ID NO: 40950 - protein, 25 aa, synthetic construct
  source 1..25: note = Seed: NSCVKLQTVHSIPLTINKEEALQRP
NSCVKLQTVHSIPITIYKDEAMQRP

SEQ ID NO: 40951 - protein, 25 aa, synthetic construct
  source 1..25: note = Seed: NSCVKLQTVHSIPLTINKEEALQRP
NSCVKLQTVHSIPITIYKDEANQRP

SEQ ID NO: 40952 - protein, 25 aa, synthetic construct
  source 1..25: note = Seed: NSCVKLQTVHSIPLTINKEEALQRP
NSCVKLQTVHSIPITIYKDEAPQRP

SEQ ID NO: 40953 - protein, 25 aa, synthetic construct
  source 1..25: note = Seed: NSCVKLQTVHSIPLTINKEEALQRP
NSCVKLQTVHSIPITIYKDEAQQRP

SEQ ID NO: 40954 - protein, 25 aa, synthetic construct
  source 1..25: note = Seed: NSCVKLQTVHSIPLTINKEEALQRP
NSCVKLQTVHSIPITIYKDEASQRP

SEQ ID NO: 40955 - protein, 25 aa, synthetic construct
  source 1..25: note = Seed: NSCVKLQTVHSIPLTINKEEALQRP
NSCVKLQTVHSIPITIYKDEATQRP

SEQ ID NO: 40956 - protein, 25 aa, synthetic construct
  source 1..25: note = Seed: NSCVKLQTVHSIPLTINKEEALQRP
NSCVKLQTVHSIPITIYKDEAVQRP

SEQ ID NO: 40957 - protein, 25 aa, synthetic construct
  source 1..25: note = Seed: NSCVKLQTVHSIPLTINKEEALQRP
NSCVKLQTVHSIPITIYKDEAWQRP

SEQ ID NO: 40958 - protein, 25 aa, synthetic construct
  source 1..25: note = Seed: NSCVKLQTVHSIPLTINKEEALQRP
NSCVKLQTVHSIPITIYKDEAYQRP

SEQ ID NO: 40959 - protein, 25 aa, synthetic construct
  source 1..25: note = Seed: NSCVKLQTVHSIPLTINKEEALQRP
NSCVKLQTVHSIPITIYKEEAAQRP

SEQ ID NO: 40960 - protein, 25 aa, synthetic construct
  source 1..25: note = Seed: NSCVKLQTVHSIPLTINKEEALQRP
NSCVKLQTVHSIPITIYKEEAIQRP

SEQ ID NO: 40961 - protein, 25 aa, synthetic construct
  source 1..25: note = Seed: NSCVKLQTVHSIPLTINKEEALQRP
NSCVKLQTVHSIPITIYKFEAAQRP

SEQ ID NO: 40962 - protein, 25 aa, synthetic construct
  source 1..25: note = Seed: NSCVKLQTVHSIPLTINKEEALQRP
NSCVKLQTVHSIPITIYKFEAFQRP

SEQ ID NO: 40963 - protein, 25 aa, synthetic construct
  source 1..25: note = Seed: NSCVKLQTVHSIPLTINKEEALQRP
NSCVKLQTVHSIPITIYKFEAIQRP

SEQ ID NO: 40964 - protein, 25 aa, synthetic construct
  source 1..25: note = Seed: NSCVKLQTVHSIPLTINKEEALQRP
NSCVKLQTVHSIPITIYKFEALQRP

SEQ ID NO: 40965 - protein, 25 aa, synthetic construct
  source 1..25: note = Seed: NSCVKLQTVHSIPLTINKEEALQRP
NSCVKLQTVHSIPITIYKFEAMQRP

SEQ ID NO: 40966 - protein, 25 aa, synthetic construct
  source 1..25: note = Seed: NSCVKLQTVHSIPLTINKEEALQRP
NSCVKLQTVHSIPITIYKFEAVQRP

SEQ ID NO: 40967 - protein, 25 aa, synthetic construct
  source 1..25: note = Seed: NSCVKLQTVHSIPLTINKEEALQRP
NSCVKLQTVHSIPITIYKFEAYQRP

SEQ ID NO: 40968 - protein, 25 aa, synthetic construct
  source 1..25: note = Seed: NSCVKLQTVHSIPLTINKEEALQRP
NSCVKLQTVHSIPITIYKGEAAQRP

SEQ ID NO: 40969 - protein, 25 aa, synthetic construct
  source 1..25: note = Seed: NSCVKLQTVHSIPLTINKEEALQRP
NSCVKLQTVHSIPITIYKGEAFQRP

SEQ ID NO: 40970 - protein, 25 aa, synthetic construct
  source 1..25: note = Seed: NSCVKLQTVHSIPLTINKEEALQRP
NSCVKLQTVHSIPITIYKGEAIQRP

SEQ ID NO: 40971 - protein, 25 aa, synthetic construct
  source 1..25: note = Seed: NSCVKLQTVHSIPLTINKEEALQRP
NSCVKLQTVHSIPITIYKGEALQRP

SEQ ID NO: 40972 - protein, 25 aa, synthetic construct
  source 1..25: note = Seed: NSCVKLQTVHSIPLTINKEEALQRP
NSCVKLQTVHSIPITIYKGEAMQRP

SEQ ID NO: 40973 - protein, 25 aa, synthetic construct
  source 1..25: note = Seed: NSCVKLQTVHSIPLTINKEEALQRP
NSCVKLQTVHSIPITIYKGEAVQRP

SEQ ID NO: 40974 - protein, 25 aa, synthetic construct
  source 1..25: note = Seed: NSCVKLQTVHSIPLTINKEEALQRP
NSCVKLQTVHSIPITIYKHEALQRP

SEQ ID NO: 40975 - protein, 25 aa, synthetic construct
  source 1..25: note = Seed: NSCVKLQTVHSIPLTINKEEALQRP
NSCVKLQTVHSIPITIYKIEAAQRP

SEQ ID NO: 40976 - protein, 25 aa, synthetic construct
  source 1..25: note = Seed: NSCVKLQTVHSIPLTINKEEALQRP
NSCVKLQTVHSIPITIYKIEACQRP

SEQ ID NO: 40977 - protein, 25 aa, synthetic construct
  source 1..25: note = Seed: NSCVKLQTVHSIPLTINKEEALQRP
NSCVKLQTVHSIPITIYKIEADQRP

SEQ ID NO: 40978 - protein, 25 aa, synthetic construct
  source 1..25: note = Seed: NSCVKLQTVHSIPLTINKEEALQRP
NSCVKLQTVHSIPITIYKIEAEQRP

SEQ ID NO: 40979 - protein, 25 aa, synthetic construct
  source 1..25: note = Seed: NSCVKLQTVHSIPLTINKEEALQRP
NSCVKLQTVHSIPITIYKIEAFQRP

SEQ ID NO: 40980 - protein, 25 aa, synthetic construct
  source 1..25: note = Seed: NSCVKLQTVHSIPLTINKEEALQRP
NSCVKLQTVHSIPITIYKIEAGQRP

SEQ ID NO: 40981 - protein, 25 aa, synthetic construct
  source 1..25: note = Seed: NSCVKLQTVHSIPLTINKEEALQRP
NSCVKLQTVHSIPITIYKIEAHQRP

SEQ ID NO: 40982 - protein, 25 aa, synthetic construct
  source 1..25: note = Seed: NSCVKLQTVHSIPLTINKEEALQRP
NSCVKLQTVHSIPITIYKIEAIQRP

SEQ ID NO: 40983 - protein, 25 aa, synthetic construct
  source 1..25: note = Seed: NSCVKLQTVHSIPLTINKEEALQRP
NSCVKLQTVHSIPITIYKIEALQRP

SEQ ID NO: 40984 - protein, 25 aa, synthetic construct
  source 1..25: note = Seed: NSCVKLQTVHSIPLTINKEEALQRP
NSCVKLQTVHSIPITIYKIEAMQRP

SEQ ID NO: 40985 - protein, 25 aa, synthetic construct
  source 1..25: note = Seed: NSCVKLQTVHSIPLTINKEEALQRP
NSCVKLQTVHSIPITIYKIEANQRP

SEQ ID NO: 40986 - protein, 25 aa, synthetic construct
  source 1..25: note = Seed: NSCVKLQTVHSIPLTINKEEALQRP
NSCVKLQTVHSIPITIYKIEAPQRP

SEQ ID NO: 40987 - protein, 25 aa, synthetic construct
  source 1..25: note = Seed: NSCVKLQTVHSIPLTINKEEALQRP
NSCVKLQTVHSIPITIYKIEAQQRP

SEQ ID NO: 40988 - protein, 25 aa, synthetic construct
  source 1..25: note = Seed: NSCVKLQTVHSIPLTINKEEALQRP
NSCVKLQTVHSIPITIYKIEARQRP

SEQ ID NO: 40989 - protein, 25 aa, synthetic construct
  source 1..25: note = Seed: NSCVKLQTVHSIPLTINKEEALQRP
NSCVKLQTVHSIPITIYKIEASQRP

SEQ ID NO: 40990 - protein, 25 aa, synthetic construct
  source 1..25: note = Seed: NSCVKLQTVHSIPLTINKEEALQRP
NSCVKLQTVHSIPITIYKIEATQRP

SEQ ID NO: 40991 - protein, 25 aa, synthetic construct
  source 1..25: note = Seed: NSCVKLQTVHSIPLTINKEEALQRP
NSCVKLQTVHSIPITIYKIEAVQRP

SEQ ID NO: 40992 - protein, 25 aa, synthetic construct
  source 1..25: note = Seed: NSCVKLQTVHSIPLTINKEEALQRP
NSCVKLQTVHSIPITIYKIEAYQRP

SEQ ID NO: 40993 - protein, 25 aa, synthetic construct
  source 1..25: note = Seed: NSCVKLQTVHSIPLTINKEEALQRP
NSCVKLQTVHSIPITIYKKEAFQRP

SEQ ID NO: 40994 - protein, 25 aa, synthetic construct
  source 1..25: note = Seed: NSCVKLQTVHSIPLTINKEEALQRP
NSCVKLQTVHSIPITIYKKEAIQRP

SEQ ID NO: 40995 - protein, 25 aa, synthetic construct
  source 1..25: note = Seed: NSCVKLQTVHSIPLTINKEEALQRP
NSCVKLQTVHSIPITIYKKEALQRP

SEQ ID NO: 40996 - protein, 25 aa, synthetic construct
  source 1..25: note = Seed: NSCVKLQTVHSIPLTINKEEALQRP
NSCVKLQTVHSIPITIYKKEAMQRP

SEQ ID NO: 40997 - protein, 25 aa, synthetic construct
  source 1..25: note = Seed: NSCVKLQTVHSIPLTINKEEALQRP
NSCVKLQTVHSIPITIYKKEAVQRP

SEQ ID NO: 40998 - protein, 25 aa, synthetic construct
  source 1..25: note = Seed: NSCVKLQTVHSIPLTINKEEALQRP
NSCVKLQTVHSIPITIYKKEAYQRP

SEQ ID NO: 40999 - protein, 25 aa, synthetic construct
  source 1..25: note = Seed: NSCVKLQTVHSIPLTINKEEALQRP
NSCVKLQTVHSIPITIYKLEAAQRP

SEQ ID NO: 41000 - protein, 25 aa, synthetic construct
  source 1..25: note = Seed: NSCVKLQTVHSIPLTINKEEALQRP
NSCVKLQTVHSIPITIYKLEACQRP

SEQ ID NO: 41001 - protein, 25 aa, synthetic construct
  source 1..25: note = Seed: NSCVKLQTVHSIPLTINKEEALQRP
NSCVKLQTVHSIPITIYKLEADQRP

SEQ ID NO: 41002 - protein, 25 aa, synthetic construct
  source 1..25: note = Seed: NSCVKLQTVHSIPLTINKEEALQRP
NSCVKLQTVHSIPITIYKLEAEQRP

SEQ ID NO: 41003 - protein, 25 aa, synthetic construct
  source 1..25: note = Seed: NSCVKLQTVHSIPLTINKEEALQRP
NSCVKLQTVHSIPITIYKLEAFQRP

SEQ ID NO: 41004 - protein, 25 aa, synthetic construct
  source 1..25: note = Seed: NSCVKLQTVHSIPLTINKEEALQRP
NSCVKLQTVHSIPITIYKLEAGQRP

SEQ ID NO: 41005 - protein, 25 aa, synthetic construct
  source 1..25: note = Seed: NSCVKLQTVHSIPLTINKEEALQRP
NSCVKLQTVHSIPITIYKLEAHQRP

SEQ ID NO: 41006 - protein, 25 aa, synthetic construct
  source 1..25: note = Seed: NSCVKLQTVHSIPLTINKEEALQRP
NSCVKLQTVHSIPITIYKLEAIQRP

SEQ ID NO: 41007 - protein, 25 aa, synthetic construct
  source 1..25: note = Seed: NSCVKLQTVHSIPLTINKEEALQRP
NSCVKLQTVHSIPITIYKLEALQRP

SEQ ID NO: 41008 - protein, 25 aa, synthetic construct
  source 1..25: note = Seed: NSCVKLQTVHSIPLTINKEEALQRP
NSCVKLQTVHSIPITIYKLEAMQRP

SEQ ID NO: 41009 - protein, 25 aa, synthetic construct
  source 1..25: note = Seed: NSCVKLQTVHSIPLTINKEEALQRP
NSCVKLQTVHSIPITIYKLEANQRP

SEQ ID NO: 41010 - protein, 25 aa, synthetic construct
  source 1..25: note = Seed: NSCVKLQTVHSIPLTINKEEALQRP
NSCVKLQTVHSIPITIYKLEAQQRP

SEQ ID NO: 41011 - protein, 25 aa, synthetic construct
  source 1..25: note = Seed: NSCVKLQTVHSIPLTINKEEALQRP
NSCVKLQTVHSIPITIYKLEASQRP

SEQ ID NO: 41012 - protein, 25 aa, synthetic construct
  source 1..25: note = Seed: NSCVKLQTVHSIPLTINKEEALQRP
NSCVKLQTVHSIPITIYKLEATQRP

SEQ ID NO: 41013 - protein, 25 aa, synthetic construct
  source 1..25: note = Seed: NSCVKLQTVHSIPLTINKEEALQRP
NSCVKLQTVHSIPITIYKLEAVQRP

SEQ ID NO: 41014 - protein, 25 aa, synthetic construct
  source 1..25: note = Seed: NSCVKLQTVHSIPLTINKEEALQRP
NSCVKLQTVHSIPITIYKLEAYQRP

SEQ ID NO: 41015 - protein, 25 aa, synthetic construct
  source 1..25: note = Seed: NSCVKLQTVHSIPLTINKEEALQRP
NSCVKLQTVHSIPITIYKMEAAQRP

SEQ ID NO: 41016 - protein, 25 aa, synthetic construct
  source 1..25: note = Seed: NSCVKLQTVHSIPLTINKEEALQRP
NSCVKLQTVHSIPITIYKMEAFQRP

SEQ ID NO: 41017 - protein, 25 aa, synthetic construct
  source 1..25: note = Seed: NSCVKLQTVHSIPLTINKEEALQRP
NSCVKLQTVHSIPITIYKMEAGQRP

SEQ ID NO: 41018 - protein, 25 aa, synthetic construct
  source 1..25: note = Seed: NSCVKLQTVHSIPLTINKEEALQRP
NSCVKLQTVHSIPITIYKMEAIQRP

SEQ ID NO: 41019 - protein, 25 aa, synthetic construct
  source 1..25: note = Seed: NSCVKLQTVHSIPLTINKEEALQRP
NSCVKLQTVHSIPITIYKMEALQRP

SEQ ID NO: 41020 - protein, 25 aa, synthetic construct
  source 1..25: note = Seed: NSCVKLQTVHSIPLTINKEEALQRP
NSCVKLQTVHSIPITIYKMEAMQRP

SEQ ID NO: 41021 - protein, 25 aa, synthetic construct
  source 1..25: note = Seed: NSCVKLQTVHSIPLTINKEEALQRP
NSCVKLQTVHSIPITIYKMEANQRP

SEQ ID NO: 41022 - protein, 25 aa, synthetic construct
  source 1..25: note = Seed: NSCVKLQTVHSIPLTINKEEALQRP
NSCVKLQTVHSIPITIYKMEAQQRP

SEQ ID NO: 41023 - protein, 25 aa, synthetic construct
  source 1..25: note = Seed: NSCVKLQTVHSIPLTINKEEALQRP
NSCVKLQTVHSIPITIYKMEASQRP

SEQ ID NO: 41024 - protein, 25 aa, synthetic construct
  source 1..25: note = Seed: NSCVKLQTVHSIPLTINKEEALQRP
NSCVKLQTVHSIPITIYKMEATQRP

SEQ ID NO: 41025 - protein, 25 aa, synthetic construct
  source 1..25: note = Seed: NSCVKLQTVHSIPLTINKEEALQRP
NSCVKLQTVHSIPITIYKMEAVQRP

SEQ ID NO: 41026 - protein, 25 aa, synthetic construct
  source 1..25: note = Seed: NSCVKLQTVHSIPLTINKEEALQRP
NSCVKLQTVHSIPITIYKMEAYQRP

SEQ ID NO: 41027 - protein, 25 aa, synthetic construct
  source 1..25: note = Seed: NSCVKLQTVHSIPLTINKEEALQRP
NSCVKLQTVHSIPITIYKNEAAQRP

SEQ ID NO: 41028 - protein, 25 aa, synthetic construct
  source 1..25: note = Seed: NSCVKLQTVHSIPLTINKEEALQRP
NSCVKLQTVHSIPITIYKNEACQRP

SEQ ID NO: 41029 - protein, 25 aa, synthetic construct
  source 1..25: note = Seed: NSCVKLQTVHSIPLTINKEEALQRP
NSCVKLQTVHSIPITIYKNEAFQRP

SEQ ID NO: 41030 - protein, 25 aa, synthetic construct
  source 1..25: note = Seed: NSCVKLQTVHSIPLTINKEEALQRP
NSCVKLQTVHSIPITIYKNEAIQRP

SEQ ID NO: 41031 - protein, 25 aa, synthetic construct
  source 1..25: note = Seed: NSCVKLQTVHSIPLTINKEEALQRP
NSCVKLQTVHSIPITIYKNEALQRP

SEQ ID NO: 41032 - protein, 25 aa, synthetic construct
  source 1..25: note = Seed: NSCVKLQTVHSIPLTINKEEALQRP
NSCVKLQTVHSIPITIYKNEAMQRP

SEQ ID NO: 41033 - protein, 25 aa, synthetic construct
  source 1..25: note = Seed: NSCVKLQTVHSIPLTINKEEALQRP
NSCVKLQTVHSIPITIYKNEASQRP

SEQ ID NO: 41034 - protein, 25 aa, synthetic construct
  source 1..25: note = Seed: NSCVKLQTVHSIPLTINKEEALQRP
NSCVKLQTVHSIPITIYKNEATQRP

SEQ ID NO: 41035 - protein, 25 aa, synthetic construct
  source 1..25: note = Seed: NSCVKLQTVHSIPLTINKEEALQRP
NSCVKLQTVHSIPITIYKNEAVQRP

SEQ ID NO: 41036 - protein, 25 aa, synthetic construct
  source 1..25: note = Seed: NSCVKLQTVHSIPLTINKEEALQRP
NSCVKLQTVHSIPITIYKNEAYQRP

SEQ ID NO: 41037 - protein, 25 aa, synthetic construct
  source 1..25: note = Seed: NSCVKLQTVHSIPLTINKEEALQRP
NSCVKLQTVHSIPITIYKPEAAQRP

SEQ ID NO: 41038 - protein, 25 aa, synthetic construct
  source 1..25: note = Seed: NSCVKLQTVHSIPLTINKEEALQRP
NSCVKLQTVHSIPITIYKPEAFQRP

SEQ ID NO: 41039 - protein, 25 aa, synthetic construct
  source 1..25: note = Seed: NSCVKLQTVHSIPLTINKEEALQRP
NSCVKLQTVHSIPITIYKPEAIQRP

SEQ ID NO: 41040 - protein, 25 aa, synthetic construct
  source 1..25: note = Seed: NSCVKLQTVHSIPLTINKEEALQRP
NSCVKLQTVHSIPITIYKPEALQRP

SEQ ID NO: 41041 - protein, 25 aa, synthetic construct
  source 1..25: note = Seed: NSCVKLQTVHSIPLTINKEEALQRP
NSCVKLQTVHSIPITIYKPEAMQRP

SEQ ID NO: 41042 - protein, 25 aa, synthetic construct
  source 1..25: note = Seed: NSCVKLQTVHSIPLTINKEEALQRP
NSCVKLQTVHSIPITIYKPEASQRP

SEQ ID NO: 41043 - protein, 25 aa, synthetic construct
  source 1..25: note = Seed: NSCVKLQTVHSIPLTINKEEALQRP
NSCVKLQTVHSIPITIYKPEAVQRP

SEQ ID NO: 41044 - protein, 25 aa, synthetic construct
  source 1..25: note = Seed: NSCVKLQTVHSIPLTINKEEALQRP
NSCVKLQTVHSIPITIYKREAFQRP

SEQ ID NO: 41045 - protein, 25 aa, synthetic construct
  source 1..25: note = Seed: NSCVKLQTVHSIPLTINKEEALQRP
NSCVKLQTVHSIPITIYKREAHQRP

SEQ ID NO: 41046 - protein, 25 aa, synthetic construct
  source 1..25: note = Seed: NSCVKLQTVHSIPLTINKEEALQRP
NSCVKLQTVHSIPITIYKREAIQRP

SEQ ID NO: 41047 - protein, 25 aa, synthetic construct
  source 1..25: note = Seed: NSCVKLQTVHSIPLTINKEEALQRP
NSCVKLQTVHSIPITIYKREALQRP

SEQ ID NO: 41048 - protein, 25 aa, synthetic construct
  source 1..25: note = Seed: NSCVKLQTVHSIPLTINKEEALQRP
NSCVKLQTVHSIPITIYKREAMQRP

SEQ ID NO: 41049 - protein, 25 aa, synthetic construct
  source 1..25: note = Seed: NSCVKLQTVHSIPLTINKEEALQRP
NSCVKLQTVHSIPITIYKREARQRP

SEQ ID NO: 41050 - protein, 25 aa, synthetic construct
  source 1..25: note = Seed: NSCVKLQTVHSIPLTINKEEALQRP
NSCVKLQTVHSIPITIYKREAVQRP

SEQ ID NO: 41051 - protein, 25 aa, synthetic construct
  source 1..25: note = Seed: NSCVKLQTVHSIPLTINKEEALQRP
NSCVKLQTVHSIPITIYKREAYQRP

SEQ ID NO: 41052 - protein, 25 aa, synthetic construct
  source 1..25: note = Seed: NSCVKLQTVHSIPLTINKEEALQRP
NSCVKLQTVHSIPITIYKSEAAQRP

SEQ ID NO: 41053 - protein, 25 aa, synthetic construct
  source 1..25: note = Seed: NSCVKLQTVHSIPLTINKEEALQRP
NSCVKLQTVHSIPITIYKSEAFQRP

SEQ ID NO: 41054 - protein, 25 aa, synthetic construct
  source 1..25: note = Seed: NSCVKLQTVHSIPLTINKEEALQRP
NSCVKLQTVHSIPITIYKSEAIQRP

SEQ ID NO: 41055 - protein, 25 aa, synthetic construct
  source 1..25: note = Seed: NSCVKLQTVHSIPLTINKEEALQRP
NSCVKLQTVHSIPITIYKSEALQRP

SEQ ID NO: 41056 - protein, 25 aa, synthetic construct
  source 1..25: note = Seed: NSCVKLQTVHSIPLTINKEEALQRP
NSCVKLQTVHSIPITIYKSEAMQRP

SEQ ID NO: 41057 - protein, 25 aa, synthetic construct
  source 1..25: note = Seed: NSCVKLQTVHSIPLTINKEEALQRP
NSCVKLQTVHSIPITIYKSEASQRP

SEQ ID NO: 41058 - protein, 25 aa, synthetic construct
  source 1..25: note = Seed: NSCVKLQTVHSIPLTINKEEALQRP
NSCVKLQTVHSIPITIYKSEATQRP

SEQ ID NO: 41059 - protein, 25 aa, synthetic construct
  source 1..25: note = Seed: NSCVKLQTVHSIPLTINKEEALQRP
NSCVKLQTVHSIPITIYKSEAVQRP

SEQ ID NO: 41060 - protein, 25 aa, synthetic construct
  source 1..25: note = Seed: NSCVKLQTVHSIPLTINKEEALQRP
NSCVKLQTVHSIPITIYKSEAYQRP

SEQ ID NO: 41061 - protein, 25 aa, synthetic construct
  source 1..25: note = Seed: NSCVKLQTVHSIPLTINKEEALQRP
NSCVKLQTVHSIPITIYKTEAAQRP

SEQ ID NO: 41062 - protein, 25 aa, synthetic construct
  source 1..25: note = Seed: NSCVKLQTVHSIPLTINKEEALQRP
NSCVKLQTVHSIPITIYKTEAFQRP

SEQ ID NO: 41063 - protein, 25 aa, synthetic construct
  source 1..25: note = Seed: NSCVKLQTVHSIPLTINKEEALQRP
NSCVKLQTVHSIPITIYKTEAIQRP

SEQ ID NO: 41064 - protein, 25 aa, synthetic construct
  source 1..25: note = Seed: NSCVKLQTVHSIPLTINKEEALQRP
NSCVKLQTVHSIPITIYKTEALQRP

SEQ ID NO: 41065 - protein, 25 aa, synthetic construct
  source 1..25: note = Seed: NSCVKLQTVHSIPLTINKEEALQRP
NSCVKLQTVHSIPITIYKTEAMQRP

SEQ ID NO: 41066 - protein, 25 aa, synthetic construct
  source 1..25: note = Seed: NSCVKLQTVHSIPLTINKEEALQRP
NSCVKLQTVHSIPITIYKTEASQRP

SEQ ID NO: 41067 - protein, 25 aa, synthetic construct
  source 1..25: note = Seed: NSCVKLQTVHSIPLTINKEEALQRP
NSCVKLQTVHSIPITIYKTEATQRP

SEQ ID NO: 41068 - protein, 25 aa, synthetic construct
  source 1..25: note = Seed: NSCVKLQTVHSIPLTINKEEALQRP
NSCVKLQTVHSIPITIYKTEAVQRP

SEQ ID NO: 41069 - protein, 25 aa, synthetic construct
  source 1..25: note = Seed: NSCVKLQTVHSIPLTINKEEALQRP
NSCVKLQTVHSIPITIYKTEAYQRP

SEQ ID NO: 41070 - protein, 25 aa, synthetic construct
  source 1..25: note = Seed: NSCVKLQTVHSIPLTINKEEALQRP
NSCVKLQTVHSIPITIYKVEAAQRP

SEQ ID NO: 41071 - protein, 25 aa, synthetic construct
  source 1..25: note = Seed: NSCVKLQTVHSIPLTINKEEALQRP
NSCVKLQTVHSIPITIYKVEACQRP

SEQ ID NO: 41072 - protein, 25 aa, synthetic construct
  source 1..25: note = Seed: NSCVKLQTVHSIPLTINKEEALQRP
NSCVKLQTVHSIPITIYKVEADQRP

SEQ ID NO: 41073 - protein, 25 aa, synthetic construct
  source 1..25: note = Seed: NSCVKLQTVHSIPLTINKEEALQRP
NSCVKLQTVHSIPITIYKVEAEQRP

SEQ ID NO: 41074 - protein, 25 aa, synthetic construct
  source 1..25: note = Seed: NSCVKLQTVHSIPLTINKEEALQRP
NSCVKLQTVHSIPITIYKVEAFQRP

SEQ ID NO: 41075 - protein, 25 aa, synthetic construct
  source 1..25: note = Seed: NSCVKLQTVHSIPLTINKEEALQRP
NSCVKLQTVHSIPITIYKVEAGQRP

SEQ ID NO: 41076 - protein, 25 aa, synthetic construct
  source 1..25: note = Seed: NSCVKLQTVHSIPLTINKEEALQRP
NSCVKLQTVHSIPITIYKVEAHQRP

SEQ ID NO: 41077 - protein, 25 aa, synthetic construct
  source 1..25: note = Seed: NSCVKLQTVHSIPLTINKEEALQRP
NSCVKLQTVHSIPITIYKVEAIQRP

SEQ ID NO: 41078 - protein, 25 aa, synthetic construct
  source 1..25: note = Seed: NSCVKLQTVHSIPLTINKEEALQRP
NSCVKLQTVHSIPITIYKVEALQRP

SEQ ID NO: 41079 - protein, 25 aa, synthetic construct
  source 1..25: note = Seed: NSCVKLQTVHSIPLTINKEEALQRP
NSCVKLQTVHSIPITIYKVEAMQRP

SEQ ID NO: 41080 - protein, 25 aa, synthetic construct
  source 1..25: note = Seed: NSCVKLQTVHSIPLTINKEEALQRP
NSCVKLQTVHSIPITIYKVEANQRP

SEQ ID NO: 41081 - protein, 25 aa, synthetic construct
  source 1..25: note = Seed: NSCVKLQTVHSIPLTINKEEALQRP
NSCVKLQTVHSIPITIYKVEAQQRP

SEQ ID NO: 41082 - protein, 25 aa, synthetic construct
  source 1..25: note = Seed: NSCVKLQTVHSIPLTINKEEALQRP
NSCVKLQTVHSIPITIYKVEASQRP

SEQ ID NO: 41083 - protein, 25 aa, synthetic construct
  source 1..25: note = Seed: NSCVKLQTVHSIPLTINKEEALQRP
NSCVKLQTVHSIPITIYKVEATQRP

SEQ ID NO: 41084 - protein, 25 aa, synthetic construct
  source 1..25: note = Seed: NSCVKLQTVHSIPLTINKEEALQRP
NSCVKLQTVHSIPITIYKVEAVQRP

SEQ ID NO: 41085 - protein, 25 aa, synthetic construct
  source 1..25: note = Seed: NSCVKLQTVHSIPLTINKEEALQRP
NSCVKLQTVHSIPITIYKVEAYQRP

SEQ ID NO: 41086 - protein, 25 aa, synthetic construct
  source 1..25: note = Seed: NSCVKLQTVHSIPLTINKEEALQRP
NSCVKLQTVHSIPITIYKWEAFQRP

SEQ ID NO: 41087 - protein, 25 aa, synthetic construct
  source 1..25: note = Seed: NSCVKLQTVHSIPLTINKEEALQRP
NSCVKLQTVHSIPITIYKYEAFQRP

SEQ ID NO: 41088 - protein, 25 aa, synthetic construct
  source 1..25: note = Seed: NSCVKLQTVHSIPLTINKEEALQRP
NSCVKLQTVHSIPITIYKYEAIQRP

SEQ ID NO: 41089 - protein, 25 aa, synthetic construct
  source 1..25: note = Seed: NSCVKLQTVHSIPLTINKEEALQRP
NSCVKLQTVHSIPITIYKYEALQRP

SEQ ID NO: 41090 - protein, 25 aa, synthetic construct
  source 1..25: note = Seed: NSCVKLQTVHSIPLTINKEEALQRP
NSCVKLQTVHSIPITIYKYEAVQRP

SEQ ID NO: 41091 - protein, 25 aa, synthetic construct
  source 1..25: note = Seed: NSCVKLQTVHSIPLTINKEEALQRP
NSCVKLQTVHSIPKTIFKFEAFQRP

SEQ ID NO: 41092 - protein, 25 aa, synthetic construct
  source 1..25: note = Seed: NSCVKLQTVHSIPLTINKEEALQRP
NSCVKLQTVHSIPKTIIKFEAFQRP

SEQ ID NO: 41093 - protein, 25 aa, synthetic construct
  source 1..25: note = Seed: NSCVKLQTVHSIPLTINKEEALQRP
NSCVKLQTVHSIPKTILKFEAFQRP

SEQ ID NO: 41094 - protein, 25 aa, synthetic construct
  source 1..25: note = Seed: NSCVKLQTVHSIPLTINKEEALQRP
NSCVKLQTVHSIPLTIAKAEAAQRP

SEQ ID NO: 41095 - protein, 25 aa, synthetic construct
  source 1..25: note = Seed: NSCVKLQTVHSIPLTINKEEALQRP
NSCVKLQTVHSIPLTIAKAEAFQRP

SEQ ID NO: 41096 - protein, 25 aa, synthetic construct
  source 1..25: note = Seed: NSCVKLQTVHSIPLTINKEEALQRP
NSCVKLQTVHSIPLTIAKAEAIQRP

SEQ ID NO: 41097 - protein, 25 aa, synthetic construct
  source 1..25: note = Seed: NSCVKLQTVHSIPLTINKEEALQRP
NSCVKLQTVHSIPLTIAKAEALQRP

SEQ ID NO: 41098 - protein, 25 aa, synthetic construct
  source 1..25: note = Seed: NSCVKLQTVHSIPLTINKEEALQRP
NSCVKLQTVHSIPLTIAKAEAMQRP

SEQ ID NO: 41099 - protein, 25 aa, synthetic construct
  source 1..25: note = Seed: NSCVKLQTVHSIPLTINKEEALQRP
NSCVKLQTVHSIPLTIAKAEAVQRP

SEQ ID NO: 41100 - protein, 25 aa, synthetic construct
  source 1..25: note = Seed: NSCVKLQTVHSIPLTINKEEALQRP
NSCVKLQTVHSIPLTIAKDEAAQRP

SEQ ID NO: 41101 - protein, 25 aa, synthetic construct
  source 1..25: note = Seed: NSCVKLQTVHSIPLTINKEEALQRP
NSCVKLQTVHSIPLTIAKDEAIQRP

SEQ ID NO: 41102 - protein, 25 aa, synthetic construct
  source 1..25: note = Seed: NSCVKLQTVHSIPLTINKEEALQRP
NSCVKLQTVHSIPLTIAKDEALQRP

SEQ ID NO: 41103 - protein, 25 aa, synthetic construct
  source 1..25: note = Seed: NSCVKLQTVHSIPLTINKEEALQRP
NSCVKLQTVHSIPLTIAKDEAMQRP

SEQ ID NO: 41104 - protein, 25 aa, synthetic construct
  source 1..25: note = Seed: NSCVKLQTVHSIPLTINKEEALQRP
NSCVKLQTVHSIPLTIAKDEAVQRP

SEQ ID NO: 41105 - protein, 25 aa, synthetic construct
  source 1..25: note = Seed: NSCVKLQTVHSIPLTINKEEALQRP
NSCVKLQTVHSIPLTIAKFEAAQRP

SEQ ID NO: 41106 - protein, 25 aa, synthetic construct
  source 1..25: note = Seed: NSCVKLQTVHSIPLTINKEEALQRP
NSCVKLQTVHSIPLTIAKFEADQRP

SEQ ID NO: 41107 - protein, 25 aa, synthetic construct
  source 1..25: note = Seed: NSCVKLQTVHSIPLTINKEEALQRP
NSCVKLQTVHSIPLTIAKFEAEQRP

SEQ ID NO: 41108 - protein, 25 aa, synthetic construct
  source 1..25: note = Seed: NSCVKLQTVHSIPLTINKEEALQRP
NSCVKLQTVHSIPLTIAKFEAFQRP

SEQ ID NO: 41109 - protein, 25 aa, synthetic construct
  source 1..25: note = Seed: NSCVKLQTVHSIPLTINKEEALQRP
NSCVKLQTVHSIPLTIAKFEAIQRP

SEQ ID NO: 41110 - protein, 25 aa, synthetic construct
  source 1..25: note = Seed: NSCVKLQTVHSIPLTINKEEALQRP
NSCVKLQTVHSIPLTIAKFEALQRP

SEQ ID NO: 41111 - protein, 25 aa, synthetic construct
  source 1..25: note = Seed: NSCVKLQTVHSIPLTINKEEALQRP
NSCVKLQTVHSIPLTIAKFEAMQRP

SEQ ID NO: 41112 - protein, 25 aa, synthetic construct
  source 1..25: note = Seed: NSCVKLQTVHSIPLTINKEEALQRP
NSCVKLQTVHSIPLTIAKFEANQRP

SEQ ID NO: 41113 - protein, 25 aa, synthetic construct
  source 1..25: note = Seed: NSCVKLQTVHSIPLTINKEEALQRP
NSCVKLQTVHSIPLTIAKFEASQRP

SEQ ID NO: 41114 - protein, 25 aa, synthetic construct
  source 1..25: note = Seed: NSCVKLQTVHSIPLTINKEEALQRP
NSCVKLQTVHSIPLTIAKFEATQRP

SEQ ID NO: 41115 - protein, 25 aa, synthetic construct
  source 1..25: note = Seed: NSCVKLQTVHSIPLTINKEEALQRP
NSCVKLQTVHSIPLTIAKFEAVQRP

SEQ ID NO: 41116 - protein, 25 aa, synthetic construct
  source 1..25: note = Seed: NSCVKLQTVHSIPLTINKEEALQRP
NSCVKLQTVHSIPLTIAKFEAYQRP

SEQ ID NO: 41117 - protein, 25 aa, synthetic construct
  source 1..25: note = Seed: NSCVKLQTVHSIPLTINKEEALQRP
NSCVKLQTVHSIPLTIAKIEAAQRP

SEQ ID NO: 41118 - protein, 25 aa, synthetic construct
  source 1..25: note = Seed: NSCVKLQTVHSIPLTINKEEALQRP
NSCVKLQTVHSIPLTIAKIEAFQRP

SEQ ID NO: 41119 - protein, 25 aa, synthetic construct
  source 1..25: note = Seed: NSCVKLQTVHSIPLTINKEEALQRP
NSCVKLQTVHSIPLTIAKIEAIQRP

SEQ ID NO: 41120 - protein, 25 aa, synthetic construct
  source 1..25: note = Seed: NSCVKLQTVHSIPLTINKEEALQRP
NSCVKLQTVHSIPLTIAKIEALQRP

SEQ ID NO: 41121 - protein, 25 aa, synthetic construct
  source 1..25: note = Seed: NSCVKLQTVHSIPLTINKEEALQRP
NSCVKLQTVHSIPLTIAKIEAMQRP

SEQ ID NO: 41122 - protein, 25 aa, synthetic construct
  source 1..25: note = Seed: NSCVKLQTVHSIPLTINKEEALQRP
NSCVKLQTVHSIPLTIAKIEASQRP

SEQ ID NO: 41123 - protein, 25 aa, synthetic construct
  source 1..25: note = Seed: NSCVKLQTVHSIPLTINKEEALQRP
NSCVKLQTVHSIPLTIAKIEATQRP

SEQ ID NO: 41124 - protein, 25 aa, synthetic construct
  source 1..25: note = Seed: NSCVKLQTVHSIPLTINKEEALQRP
NSCVKLQTVHSIPLTIAKIEAVQRP

SEQ ID NO: 41125 - protein, 25 aa, synthetic construct
  source 1..25: note = Seed: NSCVKLQTVHSIPLTINKEEALQRP
NSCVKLQTVHSIPLTIAKIEAYQRP

SEQ ID NO: 41126 - protein, 25 aa, synthetic construct
  source 1..25: note = Seed: NSCVKLQTVHSIPLTINKEEALQRP
NSCVKLQTVHSIPLTIAKLEAAQRP

SEQ ID NO: 41127 - protein, 25 aa, synthetic construct
  source 1..25: note = Seed: NSCVKLQTVHSIPLTINKEEALQRP
NSCVKLQTVHSIPLTIAKLEAFQRP

SEQ ID NO: 41128 - protein, 25 aa, synthetic construct
  source 1..25: note = Seed: NSCVKLQTVHSIPLTINKEEALQRP
NSCVKLQTVHSIPLTIAKLEAIQRP

SEQ ID NO: 41129 - protein, 25 aa, synthetic construct
  source 1..25: note = Seed: NSCVKLQTVHSIPLTINKEEALQRP
NSCVKLQTVHSIPLTIAKLEALQRP

SEQ ID NO: 41130 - protein, 25 aa, synthetic construct
  source 1..25: note = Seed: NSCVKLQTVHSIPLTINKEEALQRP
NSCVKLQTVHSIPLTIAKLEAVQRP

SEQ ID NO: 41131 - protein, 25 aa, synthetic construct
  source 1..25: note = Seed: NSCVKLQTVHSIPLTINKEEALQRP
NSCVKLQTVHSIPLTIAKLEAYQRP

SEQ ID NO: 41132 - protein, 25 aa, synthetic construct
  source 1..25: note = Seed: NSCVKLQTVHSIPLTINKEEALQRP
NSCVKLQTVHSIPLTIAKMEAAQRP

SEQ ID NO: 41133 - protein, 25 aa, synthetic construct
  source 1..25: note = Seed: NSCVKLQTVHSIPLTINKEEALQRP
NSCVKLQTVHSIPLTIAKMEAIQRP

SEQ ID NO: 41134 - protein, 25 aa, synthetic construct
  source 1..25: note = Seed: NSCVKLQTVHSIPLTINKEEALQRP
NSCVKLQTVHSIPLTIAKMEAVQRP

SEQ ID NO: 41135 - protein, 25 aa, synthetic construct
  source 1..25: note = Seed: NSCVKLQTVHSIPLTINKEEALQRP
NSCVKLQTVHSIPLTIAKNEAAQRP

SEQ ID NO: 41136 - protein, 25 aa, synthetic construct
  source 1..25: note = Seed: NSCVKLQTVHSIPLTINKEEALQRP
NSCVKLQTVHSIPLTIAKNEAIQRP

SEQ ID NO: 41137 - protein, 25 aa, synthetic construct
  source 1..25: note = Seed: NSCVKLQTVHSIPLTINKEEALQRP
NSCVKLQTVHSIPLTIAKNEALQRP

SEQ ID NO: 41138 - protein, 25 aa, synthetic construct
  source 1..25: note = Seed: NSCVKLQTVHSIPLTINKEEALQRP
NSCVKLQTVHSIPLTIAKNEAVQRP

SEQ ID NO: 41139 - protein, 25 aa, synthetic construct
  source 1..25: note = Seed: NSCVKLQTVHSIPLTINKEEALQRP
NSCVKLQTVHSIPLTIAKREAFQRP

SEQ ID NO: 41140 - protein, 25 aa, synthetic construct
  source 1..25: note = Seed: NSCVKLQTVHSIPLTINKEEALQRP
NSCVKLQTVHSIPLTIAKREAYQRP

SEQ ID NO: 41141 - protein, 25 aa, synthetic construct
  source 1..25: note = Seed: NSCVKLQTVHSIPLTINKEEALQRP
NSCVKLQTVHSIPLTIAKSEAIQRP

SEQ ID NO: 41142 - protein, 25 aa, synthetic construct
  source 1..25: note = Seed: NSCVKLQTVHSIPLTINKEEALQRP
NSCVKLQTVHSIPLTIAKSEAVQRP

SEQ ID NO: 41143 - protein, 25 aa, synthetic construct
  source 1..25: note = Seed: NSCVKLQTVHSIPLTINKEEALQRP
NSCVKLQTVHSIPLTIAKTEAIQRP

SEQ ID NO: 41144 - protein, 25 aa, synthetic construct
  source 1..25: note = Seed: NSCVKLQTVHSIPLTINKEEALQRP
NSCVKLQTVHSIPLTIAKTEAVQRP

SEQ ID NO: 41145 - protein, 25 aa, synthetic construct
  source 1..25: note = Seed: NSCVKLQTVHSIPLTINKEEALQRP
NSCVKLQTVHSIPLTIAKVEAAQRP

SEQ ID NO: 41146 - protein, 25 aa, synthetic construct
  source 1..25: note = Seed: NSCVKLQTVHSIPLTINKEEALQRP
NSCVKLQTVHSIPLTIAKVEAFQRP

SEQ ID NO: 41147 - protein, 25 aa, synthetic construct
  source 1..25: note = Seed: NSCVKLQTVHSIPLTINKEEALQRP
NSCVKLQTVHSIPLTIAKVEAIQRP

SEQ ID NO: 41148 - protein, 25 aa, synthetic construct
  source 1..25: note = Seed: NSCVKLQTVHSIPLTINKEEALQRP
NSCVKLQTVHSIPLTIAKVEALQRP

SEQ ID NO: 41149 - protein, 25 aa, synthetic construct
  source 1..25: note = Seed: NSCVKLQTVHSIPLTINKEEALQRP
NSCVKLQTVHSIPLTIAKVEAMQRP

SEQ ID NO: 41150 - protein, 25 aa, synthetic construct
  source 1..25: note = Seed: NSCVKLQTVHSIPLTINKEEALQRP
NSCVKLQTVHSIPLTIAKVEASQRP

SEQ ID NO: 41151 - protein, 25 aa, synthetic construct
  source 1..25: note = Seed: NSCVKLQTVHSIPLTINKEEALQRP
NSCVKLQTVHSIPLTIAKVEAVQRP

SEQ ID NO: 41152 - protein, 25 aa, synthetic construct
  source 1..25: note = Seed: NSCVKLQTVHSIPLTINKEEALQRP
NSCVKLQTVHSIPLTIAKVEAYQRP

SEQ ID NO: 41153 - protein, 25 aa, synthetic construct
  source 1..25: note = Seed: NSCVKLQTVHSIPLTINKEEALQRP
NSCVKLQTVHSIPLTIAKWEAIQRP

SEQ ID NO: 41154 - protein, 25 aa, synthetic construct
  source 1..25: note = Seed: NSCVKLQTVHSIPLTINKEEALQRP
NSCVKLQTVHSIPLTIAKWEALQRP

SEQ ID NO: 41155 - protein, 25 aa, synthetic construct
  source 1..25: note = Seed: NSCVKLQTVHSIPLTINKEEALQRP
NSCVKLQTVHSIPLTIAKWEAVQRP

SEQ ID NO: 41156 - protein, 25 aa, synthetic construct
  source 1..25: note = Seed: NSCVKLQTVHSIPLTINKEEALQRP
NSCVKLQTVHSIPLTIAKYEAFQRP

SEQ ID NO: 41157 - protein, 25 aa, synthetic construct
  source 1..25: note = Seed: NSCVKLQTVHSIPLTINKEEALQRP
NSCVKLQTVHSIPLTIAKYEAIQRP

SEQ ID NO: 41158 - protein, 25 aa, synthetic construct
  source 1..25: note = Seed: NSCVKLQTVHSIPLTINKEEALQRP
NSCVKLQTVHSIPLTIAKYEALQRP

SEQ ID NO: 41159 - protein, 25 aa, synthetic construct
  source 1..25: note = Seed: NSCVKLQTVHSIPLTINKEEALQRP
NSCVKLQTVHSIPLTIAKYEAVQRP

SEQ ID NO: 41160 - protein, 25 aa, synthetic construct
  source 1..25: note = Seed: NSCVKLQTVHSIPLTINKEEALQRP
NSCVKLQTVHSIPLTICKFEAFQRP

SEQ ID NO: 41161 - protein, 25 aa, synthetic construct
  source 1..25: note = Seed: NSCVKLQTVHSIPLTINKEEALQRP
NSCVKLQTVHSIPLTICKFEAIQRP

SEQ ID NO: 41162 - protein, 25 aa, synthetic construct
  source 1..25: note = Seed: NSCVKLQTVHSIPLTINKEEALQRP
NSCVKLQTVHSIPLTICKFEALQRP

SEQ ID NO: 41163 - protein, 25 aa, synthetic construct
  source 1..25: note = Seed: NSCVKLQTVHSIPLTINKEEALQRP
NSCVKLQTVHSIPLTICKFEAMQRP

SEQ ID NO: 41164 - protein, 25 aa, synthetic construct
  source 1..25: note = Seed: NSCVKLQTVHSIPLTINKEEALQRP
NSCVKLQTVHSIPLTICKFEAVQRP

SEQ ID NO: 41165 - protein, 25 aa, synthetic construct
  source 1..25: note = Seed: NSCVKLQTVHSIPLTINKEEALQRP
NSCVKLQTVHSIPLTIDKFEAFQRP

SEQ ID NO: 41166 - protein, 25 aa, synthetic construct
  source 1..25: note = Seed: NSCVKLQTVHSIPLTINKEEALQRP
NSCVKLQTVHSIPLTIDKFEAIQRP

SEQ ID NO: 41167 - protein, 25 aa, synthetic construct
  source 1..25: note = Seed: NSCVKLQTVHSIPLTINKEEALQRP
NSCVKLQTVHSIPLTIDKFEALQRP

SEQ ID NO: 41168 - protein, 25 aa, synthetic construct
  source 1..25: note = Seed: NSCVKLQTVHSIPLTINKEEALQRP
NSCVKLQTVHSIPLTIDKFEAMQRP

SEQ ID NO: 41169 - protein, 25 aa, synthetic construct
  source 1..25: note = Seed: NSCVKLQTVHSIPLTINKEEALQRP
NSCVKLQTVHSIPLTIDKFEAVQRP

SEQ ID NO: 41170 - protein, 25 aa, synthetic construct
  source 1..25: note = Seed: NSCVKLQTVHSIPLTINKEEALQRP
NSCVKLQTVHSIPLTIEKFEAAQRP

SEQ ID NO: 41171 - protein, 25 aa, synthetic construct
  source 1..25: note = Seed: NSCVKLQTVHSIPLTINKEEALQRP
NSCVKLQTVHSIPLTIEKFEAFQRP

SEQ ID NO: 41172 - protein, 25 aa, synthetic construct
  source 1..25: note = Seed: NSCVKLQTVHSIPLTINKEEALQRP
NSCVKLQTVHSIPLTIEKFEAIQRP

SEQ ID NO: 41173 - protein, 25 aa, synthetic construct
  source 1..25: note = Seed: NSCVKLQTVHSIPLTINKEEALQRP
NSCVKLQTVHSIPLTIEKFEALQRP

SEQ ID NO: 41174 - protein, 25 aa, synthetic construct
  source 1..25: note = Seed: NSCVKLQTVHSIPLTINKEEALQRP
NSCVKLQTVHSIPLTIEKFEAMQRP

SEQ ID NO: 41175 - protein, 25 aa, synthetic construct
  source 1..25: note = Seed: NSCVKLQTVHSIPLTINKEEALQRP
NSCVKLQTVHSIPLTIEKFEASQRP

SEQ ID NO: 41176 - protein, 25 aa, synthetic construct
  source 1..25: note = Seed: NSCVKLQTVHSIPLTINKEEALQRP
NSCVKLQTVHSIPLTIEKFEATQRP

SEQ ID NO: 41177 - protein, 25 aa, synthetic construct
  source 1..25: note = Seed: NSCVKLQTVHSIPLTINKEEALQRP
NSCVKLQTVHSIPLTIEKFEAVQRP

SEQ ID NO: 41178 - protein, 25 aa, synthetic construct
  source 1..25: note = Seed: NSCVKLQTVHSIPLTINKEEALQRP
NSCVKLQTVHSIPLTIEKFEAYQRP

SEQ ID NO: 41179 - protein, 25 aa, synthetic construct
  source 1..25: note = Seed: NSCVKLQTVHSIPLTINKEEALQRP
NSCVKLQTVHSIPLTIEKLEAFQRP

SEQ ID NO: 41180 - protein, 25 aa, synthetic construct
  source 1..25: note = Seed: NSCVKLQTVHSIPLTINKEEALQRP
NSCVKLQTVHSIPLTIEKLEAIQRP

SEQ ID NO: 41181 - protein, 25 aa, synthetic construct
  source 1..25: note = Seed: NSCVKLQTVHSIPLTINKEEALQRP
NSCVKLQTVHSIPLTIEKLEALQRP

SEQ ID NO: 41182 - protein, 25 aa, synthetic construct
  source 1..25: note = Seed: NSCVKLQTVHSIPLTINKEEALQRP
NSCVKLQTVHSIPLTIEKWEALQRP

SEQ ID NO: 41183 - protein, 25 aa, synthetic construct
  source 1..25: note = Seed: NSCVKLQTVHSIPLTINKEEALQRP
NSCVKLQTVHSIPLTIEKYEALQRP

SEQ ID NO: 41184 - protein, 25 aa, synthetic construct
  source 1..25: note = Seed: NSCVKLQTVHSIPLTINKEEALQRP
NSCVKLQTVHSIPLTIFKAEAAQRP

SEQ ID NO: 41185 - protein, 25 aa, synthetic construct
  source 1..25: note = Seed: NSCVKLQTVHSIPLTINKEEALQRP
NSCVKLQTVHSIPLTIFKAEACQRP

SEQ ID NO: 41186 - protein, 25 aa, synthetic construct
  source 1..25: note = Seed: NSCVKLQTVHSIPLTINKEEALQRP
NSCVKLQTVHSIPLTIFKAEAFQRP

SEQ ID NO: 41187 - protein, 25 aa, synthetic construct
  source 1..25: note = Seed: NSCVKLQTVHSIPLTINKEEALQRP
NSCVKLQTVHSIPLTIFKAEAGQRP

SEQ ID NO: 41188 - protein, 25 aa, synthetic construct
  source 1..25: note = Seed: NSCVKLQTVHSIPLTINKEEALQRP
NSCVKLQTVHSIPLTIFKAEAIQRP

SEQ ID NO: 41189 - protein, 25 aa, synthetic construct
  source 1..25: note = Seed: NSCVKLQTVHSIPLTINKEEALQRP
NSCVKLQTVHSIPLTIFKAEALQRP

SEQ ID NO: 41190 - protein, 25 aa, synthetic construct
  source 1..25: note = Seed: NSCVKLQTVHSIPLTINKEEALQRP
NSCVKLQTVHSIPLTIFKAEAMQRP

SEQ ID NO: 41191 - protein, 25 aa, synthetic construct
  source 1..25: note = Seed: NSCVKLQTVHSIPLTINKEEALQRP
NSCVKLQTVHSIPLTIFKAEAQQRP

SEQ ID NO: 41192 - protein, 25 aa, synthetic construct
  source 1..25: note = Seed: NSCVKLQTVHSIPLTINKEEALQRP
NSCVKLQTVHSIPLTIFKAEASQRP

SEQ ID NO: 41193 - protein, 25 aa, synthetic construct
  source 1..25: note = Seed: NSCVKLQTVHSIPLTINKEEALQRP
NSCVKLQTVHSIPLTIFKAEATQRP

SEQ ID NO: 41194 - protein, 25 aa, synthetic construct
  source 1..25: note = Seed: NSCVKLQTVHSIPLTINKEEALQRP
NSCVKLQTVHSIPLTIFKAEAVQRP

SEQ ID NO: 41195 - protein, 25 aa, synthetic construct
  source 1..25: note = Seed: NSCVKLQTVHSIPLTINKEEALQRP
NSCVKLQTVHSIPLTIFKAEAWQRP

SEQ ID NO: 41196 - protein, 25 aa, synthetic construct
  source 1..25: note = Seed: NSCVKLQTVHSIPLTINKEEALQRP
NSCVKLQTVHSIPLTIFKAEAYQRP

SEQ ID NO: 41197 - protein, 25 aa, synthetic construct
  source 1..25: note = Seed: NSCVKLQTVHSIPLTINKEEALQRP
NSCVKLQTVHSIPLTIFKDEAAQRP

SEQ ID NO: 41198 - protein, 25 aa, synthetic construct
  source 1..25: note = Seed: NSCVKLQTVHSIPLTINKEEALQRP
NSCVKLQTVHSIPLTIFKDEACQRP

SEQ ID NO: 41199 - protein, 25 aa, synthetic construct
  source 1..25: note = Seed: NSCVKLQTVHSIPLTINKEEALQRP
NSCVKLQTVHSIPLTIFKDEADQRP

SEQ ID NO: 41200 - protein, 25 aa, synthetic construct
  source 1..25: note = Seed: NSCVKLQTVHSIPLTINKEEALQRP
NSCVKLQTVHSIPLTIFKDEAEQRP

SEQ ID NO: 41201 - protein, 25 aa, synthetic construct
  source 1..25: note = Seed: NSCVKLQTVHSIPLTINKEEALQRP
NSCVKLQTVHSIPLTIFKDEAFQRP

SEQ ID NO: 41202 - protein, 25 aa, synthetic construct
  source 1..25: note = Seed: NSCVKLQTVHSIPLTINKEEALQRP
NSCVKLQTVHSIPLTIFKDEAGQRP

SEQ ID NO: 41203 - protein, 25 aa, synthetic construct
  source 1..25: note = Seed: NSCVKLQTVHSIPLTINKEEALQRP
NSCVKLQTVHSIPLTIFKDEAIQRP

SEQ ID NO: 41204 - protein, 25 aa, synthetic construct
  source 1..25: note = Seed: NSCVKLQTVHSIPLTINKEEALQRP
NSCVKLQTVHSIPLTIFKDEALQRP

SEQ ID NO: 41205 - protein, 25 aa, synthetic construct
  source 1..25: note = Seed: NSCVKLQTVHSIPLTINKEEALQRP
NSCVKLQTVHSIPLTIFKDEAMQRP

SEQ ID NO: 41206 - protein, 25 aa, synthetic construct
  source 1..25: note = Seed: NSCVKLQTVHSIPLTINKEEALQRP
NSCVKLQTVHSIPLTIFKDEANQRP

SEQ ID NO: 41207 - protein, 25 aa, synthetic construct
  source 1..25: note = Seed: NSCVKLQTVHSIPLTINKEEALQRP
NSCVKLQTVHSIPLTIFKDEAPQRP

SEQ ID NO: 41208 - protein, 25 aa, synthetic construct
  source 1..25: note = Seed: NSCVKLQTVHSIPLTINKEEALQRP
NSCVKLQTVHSIPLTIFKDEAQQRP

SEQ ID NO: 41209 - protein, 25 aa, synthetic construct
  source 1..25: note = Seed: NSCVKLQTVHSIPLTINKEEALQRP
NSCVKLQTVHSIPLTIFKDEASQRP

SEQ ID NO: 41210 - protein, 25 aa, synthetic construct
  source 1..25: note = Seed: NSCVKLQTVHSIPLTINKEEALQRP
NSCVKLQTVHSIPLTIFKDEATQRP

SEQ ID NO: 41211 - protein, 25 aa, synthetic construct
  source 1..25: note = Seed: NSCVKLQTVHSIPLTINKEEALQRP
NSCVKLQTVHSIPLTIFKDEAVQRP

SEQ ID NO: 41212 - protein, 25 aa, synthetic construct
  source 1..25: note = Seed: NSCVKLQTVHSIPLTINKEEALQRP
NSCVKLQTVHSIPLTIFKDEAYQRP

SEQ ID NO: 41213 - protein, 25 aa, synthetic construct
  source 1..25: note = Seed: NSCVKLQTVHSIPLTINKEEALQRP
NSCVKLQTVHSIPLTIFKEEAAQRP

SEQ ID NO: 41214 - protein, 25 aa, synthetic construct
  source 1..25: note = Seed: NSCVKLQTVHSIPLTINKEEALQRP
NSCVKLQTVHSIPLTIFKEEAFQRP

SEQ ID NO: 41215 - protein, 25 aa, synthetic construct
  source 1..25: note = Seed: NSCVKLQTVHSIPLTINKEEALQRP
NSCVKLQTVHSIPLTIFKFEAAQRP

SEQ ID NO: 41216 - protein, 25 aa, synthetic construct
  source 1..25: note = Seed: NSCVKLQTVHSIPLTINKEEALQRP
NSCVKLQTVHSIPLTIFKFEACQRP

SEQ ID NO: 41217 - protein, 25 aa, synthetic construct
  source 1..25: note = Seed: NSCVKLQTVHSIPLTINKEEALQRP
NSCVKLQTVHSIPLTIFKFEADQRP

SEQ ID NO: 41218 - protein, 25 aa, synthetic construct
  source 1..25: note = Seed: NSCVKLQTVHSIPLTINKEEALQRP
NSCVKLQTVHSIPLTIFKFEAEQRP

SEQ ID NO: 41219 - protein, 25 aa, synthetic construct
  source 1..25: note = Seed: NSCVKLQTVHSIPLTINKEEALQRP
NSCVKLQTVHSIPLTIFKFEAFQRP

SEQ ID NO: 41220 - protein, 25 aa, synthetic construct
  source 1..25: note = Seed: NSCVKLQTVHSIPLTINKEEALQRP
NSCVKLQTVHSIPLTIFKFEAGQRP

SEQ ID NO: 41221 - protein, 25 aa, synthetic construct
  source 1..25: note = Seed: NSCVKLQTVHSIPLTINKEEALQRP
NSCVKLQTVHSIPLTIFKFEAHQRP

SEQ ID NO: 41222 - protein, 25 aa, synthetic construct
  source 1..25: note = Seed: NSCVKLQTVHSIPLTINKEEALQRP
NSCVKLQTVHSIPLTIFKFEAIQRP

SEQ ID NO: 41223 - protein, 25 aa, synthetic construct
  source 1..25: note = Seed: NSCVKLQTVHSIPLTINKEEALQRP
NSCVKLQTVHSIPLTIFKFEAKQRP

SEQ ID NO: 41224 - protein, 25 aa, synthetic construct
  source 1..25: note = Seed: NSCVKLQTVHSIPLTINKEEALQRP
NSCVKLQTVHSIPLTIFKFEALQRP

SEQ ID NO: 41225 - protein, 25 aa, synthetic construct
  source 1..25: note = Seed: NSCVKLQTVHSIPLTINKEEALQRP
NSCVKLQTVHSIPLTIFKFEAMQRP

SEQ ID NO: 41226 - protein, 25 aa, synthetic construct
  source 1..25: note = Seed: NSCVKLQTVHSIPLTINKEEALQRP
NSCVKLQTVHSIPLTIFKFEANQRP

SEQ ID NO: 41227 - protein, 25 aa, synthetic construct
  source 1..25: note = Seed: NSCVKLQTVHSIPLTINKEEALQRP
NSCVKLQTVHSIPLTIFKFEAPQRP

SEQ ID NO: 41228 - protein, 25 aa, synthetic construct
  source 1..25: note = Seed: NSCVKLQTVHSIPLTINKEEALQRP
NSCVKLQTVHSIPLTIFKFEAQQRP

SEQ ID NO: 41229 - protein, 25 aa, synthetic construct
  source 1..25: note = Seed: NSCVKLQTVHSIPLTINKEEALQRP
NSCVKLQTVHSIPLTIFKFEARQRP

SEQ ID NO: 41230 - protein, 25 aa, synthetic construct
  source 1..25: note = Seed: NSCVKLQTVHSIPLTINKEEALQRP
NSCVKLQTVHSIPLTIFKFEASQRP

SEQ ID NO: 41231 - protein, 25 aa, synthetic construct
  source 1..25: note = Seed: NSCVKLQTVHSIPLTINKEEALQRP
NSCVKLQTVHSIPLTIFKFEATQRP

SEQ ID NO: 41232 - protein, 25 aa, synthetic construct
  source 1..25: note = Seed: NSCVKLQTVHSIPLTINKEEALQRP
NSCVKLQTVHSIPLTIFKFEAVQRP

SEQ ID NO: 41233 - protein, 25 aa, synthetic construct
  source 1..25: note = Seed: NSCVKLQTVHSIPLTINKEEALQRP
NSCVKLQTVHSIPLTIFKFEAWQRP

SEQ ID NO: 41234 - protein, 25 aa, synthetic construct
  source 1..25: note = Seed: NSCVKLQTVHSIPLTINKEEALQRP
NSCVKLQTVHSIPLTIFKFEAYQRP

SEQ ID NO: 41235 - protein, 25 aa, synthetic construct
  source 1..25: note = Seed: NSCVKLQTVHSIPLTINKEEALQRP
NSCVKLQTVHSIPLTIFKGEAAQRP

SEQ ID NO: 41236 - protein, 25 aa, synthetic construct
  source 1..25: note = Seed: NSCVKLQTVHSIPLTINKEEALQRP
NSCVKLQTVHSIPLTIFKGEAFQRP

SEQ ID NO: 41237 - protein, 25 aa, synthetic construct
  source 1..25: note = Seed: NSCVKLQTVHSIPLTINKEEALQRP
NSCVKLQTVHSIPLTIFKGEAIQRP

SEQ ID NO: 41238 - protein, 25 aa, synthetic construct
  source 1..25: note = Seed: NSCVKLQTVHSIPLTINKEEALQRP
NSCVKLQTVHSIPLTIFKGEALQRP

SEQ ID NO: 41239 - protein, 25 aa, synthetic construct
  source 1..25: note = Seed: NSCVKLQTVHSIPLTINKEEALQRP
NSCVKLQTVHSIPLTIFKGEAMQRP

SEQ ID NO: 41240 - protein, 25 aa, synthetic construct
  source 1..25: note = Seed: NSCVKLQTVHSIPLTINKEEALQRP
NSCVKLQTVHSIPLTIFKGEAVQRP

SEQ ID NO: 41241 - protein, 25 aa, synthetic construct
  source 1..25: note = Seed: NSCVKLQTVHSIPLTINKEEALQRP
NSCVKLQTVHSIPLTIFKHEAFQRP

SEQ ID NO: 41242 - protein, 25 aa, synthetic construct
  source 1..25: note = Seed: NSCVKLQTVHSIPLTINKEEALQRP
NSCVKLQTVHSIPLTIFKHEALQRP

SEQ ID NO: 41243 - protein, 25 aa, synthetic construct
  source 1..25: note = Seed: NSCVKLQTVHSIPLTINKEEALQRP
NSCVKLQTVHSIPLTIFKHEAYQRP

SEQ ID NO: 41244 - protein, 25 aa, synthetic construct
  source 1..25: note = Seed: NSCVKLQTVHSIPLTINKEEALQRP
NSCVKLQTVHSIPLTIFKIEAAQRP

SEQ ID NO: 41245 - protein, 25 aa, synthetic construct
  source 1..25: note = Seed: NSCVKLQTVHSIPLTINKEEALQRP
NSCVKLQTVHSIPLTIFKIEACQRP

SEQ ID NO: 41246 - protein, 25 aa, synthetic construct
  source 1..25: note = Seed: NSCVKLQTVHSIPLTINKEEALQRP
NSCVKLQTVHSIPLTIFKIEADQRP

SEQ ID NO: 41247 - protein, 25 aa, synthetic construct
  source 1..25: note = Seed: NSCVKLQTVHSIPLTINKEEALQRP
NSCVKLQTVHSIPLTIFKIEAEQRP

SEQ ID NO: 41248 - protein, 25 aa, synthetic construct
  source 1..25: note = Seed: NSCVKLQTVHSIPLTINKEEALQRP
NSCVKLQTVHSIPLTIFKIEAFQRP

SEQ ID NO: 41249 - protein, 25 aa, synthetic construct
  source 1..25: note = Seed: NSCVKLQTVHSIPLTINKEEALQRP
NSCVKLQTVHSIPLTIFKIEAGQRP

SEQ ID NO: 41250 - protein, 25 aa, synthetic construct
  source 1..25: note = Seed: NSCVKLQTVHSIPLTINKEEALQRP
NSCVKLQTVHSIPLTIFKIEAHQRP

SEQ ID NO: 41251 - protein, 25 aa, synthetic construct
  source 1..25: note = Seed: NSCVKLQTVHSIPLTINKEEALQRP
NSCVKLQTVHSIPLTIFKIEAIQRP

SEQ ID NO: 41252 - protein, 25 aa, synthetic construct
  source 1..25: note = Seed: NSCVKLQTVHSIPLTINKEEALQRP
NSCVKLQTVHSIPLTIFKIEALQRP

SEQ ID NO: 41253 - protein, 25 aa, synthetic construct
  source 1..25: note = Seed: NSCVKLQTVHSIPLTINKEEALQRP
NSCVKLQTVHSIPLTIFKIEAMQRP

SEQ ID NO: 41254 - protein, 25 aa, synthetic construct
  source 1..25: note = Seed: NSCVKLQTVHSIPLTINKEEALQRP
NSCVKLQTVHSIPLTIFKIEANQRP

SEQ ID NO: 41255 - protein, 25 aa, synthetic construct
  source 1..25: note = Seed: NSCVKLQTVHSIPLTINKEEALQRP
NSCVKLQTVHSIPLTIFKIEAPQRP

SEQ ID NO: 41256 - protein, 25 aa, synthetic construct
  source 1..25: note = Seed: NSCVKLQTVHSIPLTINKEEALQRP
NSCVKLQTVHSIPLTIFKIEAQQRP

SEQ ID NO: 41257 - protein, 25 aa, synthetic construct
  source 1..25: note = Seed: NSCVKLQTVHSIPLTINKEEALQRP
NSCVKLQTVHSIPLTIFKIEARQRP

SEQ ID NO: 41258 - protein, 25 aa, synthetic construct
  source 1..25: note = Seed: NSCVKLQTVHSIPLTINKEEALQRP
NSCVKLQTVHSIPLTIFKIEASQRP

SEQ ID NO: 41259 - protein, 25 aa, synthetic construct
  source 1..25: note = Seed: NSCVKLQTVHSIPLTINKEEALQRP
NSCVKLQTVHSIPLTIFKIEATQRP

SEQ ID NO: 41260 - protein, 25 aa, synthetic construct
  source 1..25: note = Seed: NSCVKLQTVHSIPLTINKEEALQRP
NSCVKLQTVHSIPLTIFKIEAVQRP

SEQ ID NO: 41261 - protein, 25 aa, synthetic construct
  source 1..25: note = Seed: NSCVKLQTVHSIPLTINKEEALQRP
NSCVKLQTVHSIPLTIFKIEAWQRP

SEQ ID NO: 41262 - protein, 25 aa, synthetic construct
  source 1..25: note = Seed: NSCVKLQTVHSIPLTINKEEALQRP
NSCVKLQTVHSIPLTIFKIEAYQRP

SEQ ID NO: 41263 - protein, 25 aa, synthetic construct
  source 1..25: note = Seed: NSCVKLQTVHSIPLTINKEEALQRP
NSCVKLQTVHSIPLTIFKKEAFQRP

SEQ ID NO: 41264 - protein, 25 aa, synthetic construct
  source 1..25: note = Seed: NSCVKLQTVHSIPLTINKEEALQRP
NSCVKLQTVHSIPLTIFKKEAIQRP

SEQ ID NO: 41265 - protein, 25 aa, synthetic construct
  source 1..25: note = Seed: NSCVKLQTVHSIPLTINKEEALQRP
NSCVKLQTVHSIPLTIFKKEALQRP

SEQ ID NO: 41266 - protein, 25 aa, synthetic construct
  source 1..25: note = Seed: NSCVKLQTVHSIPLTINKEEALQRP
NSCVKLQTVHSIPLTIFKKEAMQRP

SEQ ID NO: 41267 - protein, 25 aa, synthetic construct
  source 1..25: note = Seed: NSCVKLQTVHSIPLTINKEEALQRP
NSCVKLQTVHSIPLTIFKKEARQRP

SEQ ID NO: 41268 - protein, 25 aa, synthetic construct
  source 1..25: note = Seed: NSCVKLQTVHSIPLTINKEEALQRP
NSCVKLQTVHSIPLTIFKKEAVQRP

SEQ ID NO: 41269 - protein, 25 aa, synthetic construct
  source 1..25: note = Seed: NSCVKLQTVHSIPLTINKEEALQRP
NSCVKLQTVHSIPLTIFKKEAYQRP

SEQ ID NO: 41270 - protein, 25 aa, synthetic construct
  source 1..25: note = Seed: NSCVKLQTVHSIPLTINKEEALQRP
NSCVKLQTVHSIPLTIFKLEAAQRP

SEQ ID NO: 41271 - protein, 25 aa, synthetic construct
  source 1..25: note = Seed: NSCVKLQTVHSIPLTINKEEALQRP
NSCVKLQTVHSIPLTIFKLEADQRP

SEQ ID NO: 41272 - protein, 25 aa, synthetic construct
  source 1..25: note = Seed: NSCVKLQTVHSIPLTINKEEALQRP
NSCVKLQTVHSIPLTIFKLEAEQRP

SEQ ID NO: 41273 - protein, 25 aa, synthetic construct
  source 1..25: note = Seed: NSCVKLQTVHSIPLTINKEEALQRP
NSCVKLQTVHSIPLTIFKLEAFQRP

SEQ ID NO: 41274 - protein, 25 aa, synthetic construct
  source 1..25: note = Seed: NSCVKLQTVHSIPLTINKEEALQRP
NSCVKLQTVHSIPLTIFKLEAGQRP

SEQ ID NO: 41275 - protein, 25 aa, synthetic construct
  source 1..25: note = Seed: NSCVKLQTVHSIPLTINKEEALQRP
NSCVKLQTVHSIPLTIFKLEAHQRP

SEQ ID NO: 41276 - protein, 25 aa, synthetic construct
  source 1..25: note = Seed: NSCVKLQTVHSIPLTINKEEALQRP
NSCVKLQTVHSIPLTIFKLEAIQRP

SEQ ID NO: 41277 - protein, 25 aa, synthetic construct
  source 1..25: note = Seed: NSCVKLQTVHSIPLTINKEEALQRP
NSCVKLQTVHSIPLTIFKLEAKQRP

SEQ ID NO: 41278 - protein, 25 aa, synthetic construct
  source 1..25: note = Seed: NSCVKLQTVHSIPLTINKEEALQRP
NSCVKLQTVHSIPLTIFKLEALQRP

SEQ ID NO: 41279 - protein, 25 aa, synthetic construct
  source 1..25: note = Seed: NSCVKLQTVHSIPLTINKEEALQRP
NSCVKLQTVHSIPLTIFKLEAMQRP

SEQ ID NO: 41280 - protein, 25 aa, synthetic construct
  source 1..25: note = Seed: NSCVKLQTVHSIPLTINKEEALQRP
NSCVKLQTVHSIPLTIFKLEANQRP

SEQ ID NO: 41281 - protein, 25 aa, synthetic construct
  source 1..25: note = Seed: NSCVKLQTVHSIPLTINKEEALQRP
NSCVKLQTVHSIPLTIFKLEAPQRP

SEQ ID NO: 41282 - protein, 25 aa, synthetic construct
  source 1..25: note = Seed: NSCVKLQTVHSIPLTINKEEALQRP
NSCVKLQTVHSIPLTIFKLEAQQRP

SEQ ID NO: 41283 - protein, 25 aa, synthetic construct
  source 1..25: note = Seed: NSCVKLQTVHSIPLTINKEEALQRP
NSCVKLQTVHSIPLTIFKLEARQRP

SEQ ID NO: 41284 - protein, 25 aa, synthetic construct
  source 1..25: note = Seed: NSCVKLQTVHSIPLTINKEEALQRP
NSCVKLQTVHSIPLTIFKLEASQRP

SEQ ID NO: 41285 - protein, 25 aa, synthetic construct
  source 1..25: note = Seed: NSCVKLQTVHSIPLTINKEEALQRP
NSCVKLQTVHSIPLTIFKLEATQRP

SEQ ID NO: 41286 - protein, 25 aa, synthetic construct
  source 1..25: note = Seed: NSCVKLQTVHSIPLTINKEEALQRP
NSCVKLQTVHSIPLTIFKLEAVQRP

SEQ ID NO: 41287 - protein, 25 aa, synthetic construct
  source 1..25: note = Seed: NSCVKLQTVHSIPLTINKEEALQRP
NSCVKLQTVHSIPLTIFKLEAWQRP

SEQ ID NO: 41288 - protein, 25 aa, synthetic construct
  source 1..25: note = Seed: NSCVKLQTVHSIPLTINKEEALQRP
NSCVKLQTVHSIPLTIFKLEAYQRP

SEQ ID NO: 41289 - protein, 25 aa, synthetic construct
  source 1..25: note = Seed: NSCVKLQTVHSIPLTINKEEALQRP
NSCVKLQTVHSIPLTIFKMEAAQRP

SEQ ID NO: 41290 - protein, 25 aa, synthetic construct
  source 1..25: note = Seed: NSCVKLQTVHSIPLTINKEEALQRP
NSCVKLQTVHSIPLTIFKMEADQRP

SEQ ID NO: 41291 - protein, 25 aa, synthetic construct
  source 1..25: note = Seed: NSCVKLQTVHSIPLTINKEEALQRP
NSCVKLQTVHSIPLTIFKMEAEQRP

SEQ ID NO: 41292 - protein, 25 aa, synthetic construct
  source 1..25: note = Seed: NSCVKLQTVHSIPLTINKEEALQRP
NSCVKLQTVHSIPLTIFKMEAFQRP

SEQ ID NO: 41293 - protein, 25 aa, synthetic construct
  source 1..25: note = Seed: NSCVKLQTVHSIPLTINKEEALQRP
NSCVKLQTVHSIPLTIFKMEAGQRP

SEQ ID NO: 41294 - protein, 25 aa, synthetic construct
  source 1..25: note = Seed: NSCVKLQTVHSIPLTINKEEALQRP
NSCVKLQTVHSIPLTIFKMEAHQRP

SEQ ID NO: 41295 - protein, 25 aa, synthetic construct
  source 1..25: note = Seed: NSCVKLQTVHSIPLTINKEEALQRP
NSCVKLQTVHSIPLTIFKMEAIQRP

SEQ ID NO: 41296 - protein, 25 aa, synthetic construct
  source 1..25: note = Seed: NSCVKLQTVHSIPLTINKEEALQRP
NSCVKLQTVHSIPLTIFKMEALQRP

SEQ ID NO: 41297 - protein, 25 aa, synthetic construct
  source 1..25: note = Seed: NSCVKLQTVHSIPLTINKEEALQRP
NSCVKLQTVHSIPLTIFKMEAMQRP

SEQ ID NO: 41298 - protein, 25 aa, synthetic construct
  source 1..25: note = Seed: NSCVKLQTVHSIPLTINKEEALQRP
NSCVKLQTVHSIPLTIFKMEANQRP

SEQ ID NO: 41299 - protein, 25 aa, synthetic construct
  source 1..25: note = Seed: NSCVKLQTVHSIPLTINKEEALQRP
NSCVKLQTVHSIPLTIFKMEAQQRP

SEQ ID NO: 41300 - protein, 25 aa, synthetic construct
  source 1..25: note = Seed: NSCVKLQTVHSIPLTINKEEALQRP
NSCVKLQTVHSIPLTIFKMEARQRP

SEQ ID NO: 41301 - protein, 25 aa, synthetic construct
  source 1..25: note = Seed: NSCVKLQTVHSIPLTINKEEALQRP
NSCVKLQTVHSIPLTIFKMEASQRP

SEQ ID NO: 41302 - protein, 25 aa, synthetic construct
  source 1..25: note = Seed: NSCVKLQTVHSIPLTINKEEALQRP
NSCVKLQTVHSIPLTIFKMEATQRP

SEQ ID NO: 41303 - protein, 25 aa, synthetic construct
  source 1..25: note = Seed: NSCVKLQTVHSIPLTINKEEALQRP
NSCVKLQTVHSIPLTIFKMEAVQRP

SEQ ID NO: 41304 - protein, 25 aa, synthetic construct
  source 1..25: note = Seed: NSCVKLQTVHSIPLTINKEEALQRP
NSCVKLQTVHSIPLTIFKMEAYQRP

SEQ ID NO: 41305 - protein, 25 aa, synthetic construct
  source 1..25: note = Seed: NSCVKLQTVHSIPLTINKEEALQRP
NSCVKLQTVHSIPLTIFKNEAAQRP

SEQ ID NO: 41306 - protein, 25 aa, synthetic construct
  source 1..25: note = Seed: NSCVKLQTVHSIPLTINKEEALQRP
NSCVKLQTVHSIPLTIFKNEAFQRP

SEQ ID NO: 41307 - protein, 25 aa, synthetic construct
  source 1..25: note = Seed: NSCVKLQTVHSIPLTINKEEALQRP
NSCVKLQTVHSIPLTIFKNEAGQRP

SEQ ID NO: 41308 - protein, 25 aa, synthetic construct
  source 1..25: note = Seed: NSCVKLQTVHSIPLTINKEEALQRP
NSCVKLQTVHSIPLTIFKNEAIQRP

SEQ ID NO: 41309 - protein, 25 aa, synthetic construct
  source 1..25: note = Seed: NSCVKLQTVHSIPLTINKEEALQRP
NSCVKLQTVHSIPLTIFKNEALQRP

SEQ ID NO: 41310 - protein, 25 aa, synthetic construct
  source 1..25: note = Seed: NSCVKLQTVHSIPLTINKEEALQRP
NSCVKLQTVHSIPLTIFKNEAMQRP

SEQ ID NO: 41311 - protein, 25 aa, synthetic construct
  source 1..25: note = Seed: NSCVKLQTVHSIPLTINKEEALQRP
NSCVKLQTVHSIPLTIFKNEASQRP

SEQ ID NO: 41312 - protein, 25 aa, synthetic construct
  source 1..25: note = Seed: NSCVKLQTVHSIPLTINKEEALQRP
NSCVKLQTVHSIPLTIFKNEATQRP

SEQ ID NO: 41313 - protein, 25 aa, synthetic construct
  source 1..25: note = Seed: NSCVKLQTVHSIPLTINKEEALQRP
NSCVKLQTVHSIPLTIFKNEAVQRP

SEQ ID NO: 41314 - protein, 25 aa, synthetic construct
  source 1..25: note = Seed: NSCVKLQTVHSIPLTINKEEALQRP
NSCVKLQTVHSIPLTIFKNEAYQRP

SEQ ID NO: 41315 - protein, 25 aa, synthetic construct
  source 1..25: note = Seed: NSCVKLQTVHSIPLTINKEEALQRP
NSCVKLQTVHSIPLTIFKPEAAQRP

SEQ ID NO: 41316 - protein, 25 aa, synthetic construct
  source 1..25: note = Seed: NSCVKLQTVHSIPLTINKEEALQRP
NSCVKLQTVHSIPLTIFKPEAFQRP

SEQ ID NO: 41317 - protein, 25 aa, synthetic construct
  source 1..25: note = Seed: NSCVKLQTVHSIPLTINKEEALQRP
NSCVKLQTVHSIPLTIFKPEAIQRP

SEQ ID NO: 41318 - protein, 25 aa, synthetic construct
  source 1..25: note = Seed: NSCVKLQTVHSIPLTINKEEALQRP
NSCVKLQTVHSIPLTIFKPEALQRP

SEQ ID NO: 41319 - protein, 25 aa, synthetic construct
  source 1..25: note = Seed: NSCVKLQTVHSIPLTINKEEALQRP
NSCVKLQTVHSIPLTIFKPEAMQRP

SEQ ID NO: 41320 - protein, 25 aa, synthetic construct
  source 1..25: note = Seed: NSCVKLQTVHSIPLTINKEEALQRP
NSCVKLQTVHSIPLTIFKPEASQRP

SEQ ID NO: 41321 - protein, 25 aa, synthetic construct
  source 1..25: note = Seed: NSCVKLQTVHSIPLTINKEEALQRP
NSCVKLQTVHSIPLTIFKPEAVQRP

SEQ ID NO: 41322 - protein, 25 aa, synthetic construct
  source 1..25: note = Seed: NSCVKLQTVHSIPLTINKEEALQRP
NSCVKLQTVHSIPLTIFKQEAAQRP

SEQ ID NO: 41323 - protein, 25 aa, synthetic construct
  source 1..25: note = Seed: NSCVKLQTVHSIPLTINKEEALQRP
NSCVKLQTVHSIPLTIFKQEAFQRP

SEQ ID NO: 41324 - protein, 25 aa, synthetic construct
  source 1..25: note = Seed: NSCVKLQTVHSIPLTINKEEALQRP
NSCVKLQTVHSIPLTIFKQEALQRP

SEQ ID NO: 41325 - protein, 25 aa, synthetic construct
  source 1..25: note = Seed: NSCVKLQTVHSIPLTINKEEALQRP
NSCVKLQTVHSIPLTIFKREAAQRP

SEQ ID NO: 41326 - protein, 25 aa, synthetic construct
  source 1..25: note = Seed: NSCVKLQTVHSIPLTINKEEALQRP
NSCVKLQTVHSIPLTIFKREAFQRP

SEQ ID NO: 41327 - protein, 25 aa, synthetic construct
  source 1..25: note = Seed: NSCVKLQTVHSIPLTINKEEALQRP
NSCVKLQTVHSIPLTIFKREAHQRP

SEQ ID NO: 41328 - protein, 25 aa, synthetic construct
  source 1..25: note = Seed: NSCVKLQTVHSIPLTINKEEALQRP
NSCVKLQTVHSIPLTIFKREAIQRP

SEQ ID NO: 41329 - protein, 25 aa, synthetic construct
  source 1..25: note = Seed: NSCVKLQTVHSIPLTINKEEALQRP
NSCVKLQTVHSIPLTIFKREAKQRP

SEQ ID NO: 41330 - protein, 25 aa, synthetic construct
  source 1..25: note = Seed: NSCVKLQTVHSIPLTINKEEALQRP
NSCVKLQTVHSIPLTIFKREALQRP

SEQ ID NO: 41331 - protein, 25 aa, synthetic construct
  source 1..25: note = Seed: NSCVKLQTVHSIPLTINKEEALQRP
NSCVKLQTVHSIPLTIFKREAMQRP

SEQ ID NO: 41332 - protein, 25 aa, synthetic construct
  source 1..25: note = Seed: NSCVKLQTVHSIPLTINKEEALQRP
NSCVKLQTVHSIPLTIFKREARQRP

SEQ ID NO: 41333 - protein, 25 aa, synthetic construct
  source 1..25: note = Seed: NSCVKLQTVHSIPLTINKEEALQRP
NSCVKLQTVHSIPLTIFKREAVQRP

SEQ ID NO: 41334 - protein, 25 aa, synthetic construct
  source 1..25: note = Seed: NSCVKLQTVHSIPLTINKEEALQRP
NSCVKLQTVHSIPLTIFKREAYQRP

SEQ ID NO: 41335 - protein, 25 aa, synthetic construct
  source 1..25: note = Seed: NSCVKLQTVHSIPLTINKEEALQRP
NSCVKLQTVHSIPLTIFKSEAAQRP

SEQ ID NO: 41336 - protein, 25 aa, synthetic construct
  source 1..25: note = Seed: NSCVKLQTVHSIPLTINKEEALQRP
NSCVKLQTVHSIPLTIFKSEAFQRP

SEQ ID NO: 41337 - protein, 25 aa, synthetic construct
  source 1..25: note = Seed: NSCVKLQTVHSIPLTINKEEALQRP
NSCVKLQTVHSIPLTIFKSEAIQRP

SEQ ID NO: 41338 - protein, 25 aa, synthetic construct
  source 1..25: note = Seed: NSCVKLQTVHSIPLTINKEEALQRP
NSCVKLQTVHSIPLTIFKSEALQRP

SEQ ID NO: 41339 - protein, 25 aa, synthetic construct
  source 1..25: note = Seed: NSCVKLQTVHSIPLTINKEEALQRP
NSCVKLQTVHSIPLTIFKSEAMQRP

SEQ ID NO: 41340 - protein, 25 aa, synthetic construct
  source 1..25: note = Seed: NSCVKLQTVHSIPLTINKEEALQRP
NSCVKLQTVHSIPLTIFKSEASQRP

SEQ ID NO: 41341 - protein, 25 aa, synthetic construct
  source 1..25: note = Seed: NSCVKLQTVHSIPLTINKEEALQRP
NSCVKLQTVHSIPLTIFKSEATQRP

SEQ ID NO: 41342 - protein, 25 aa, synthetic construct
  source 1..25: note = Seed: NSCVKLQTVHSIPLTINKEEALQRP
NSCVKLQTVHSIPLTIFKSEAVQRP

SEQ ID NO: 41343 - protein, 25 aa, synthetic construct
  source 1..25: note = Seed: NSCVKLQTVHSIPLTINKEEALQRP
NSCVKLQTVHSIPLTIFKSEAYQRP

SEQ ID NO: 41344 - protein, 25 aa, synthetic construct
  source 1..25: note = Seed: NSCVKLQTVHSIPLTINKEEALQRP
NSCVKLQTVHSIPLTIFKTEAAQRP

SEQ ID NO: 41345 - protein, 25 aa, synthetic construct
  source 1..25: note = Seed: NSCVKLQTVHSIPLTINKEEALQRP
NSCVKLQTVHSIPLTIFKTEAFQRP

SEQ ID NO: 41346 - protein, 25 aa, synthetic construct
  source 1..25: note = Seed: NSCVKLQTVHSIPLTINKEEALQRP
NSCVKLQTVHSIPLTIFKTEAIQRP

SEQ ID NO: 41347 - protein, 25 aa, synthetic construct
  source 1..25: note = Seed: NSCVKLQTVHSIPLTINKEEALQRP
NSCVKLQTVHSIPLTIFKTEALQRP

SEQ ID NO: 41348 - protein, 25 aa, synthetic construct
  source 1..25: note = Seed: NSCVKLQTVHSIPLTINKEEALQRP
NSCVKLQTVHSIPLTIFKTEAMQRP

SEQ ID NO: 41349 - protein, 25 aa, synthetic construct
  source 1..25: note = Seed: NSCVKLQTVHSIPLTINKEEALQRP
NSCVKLQTVHSIPLTIFKTEASQRP

SEQ ID NO: 41350 - protein, 25 aa, synthetic construct
  source 1..25: note = Seed: NSCVKLQTVHSIPLTINKEEALQRP
NSCVKLQTVHSIPLTIFKTEATQRP

SEQ ID NO: 41351 - protein, 25 aa, synthetic construct
  source 1..25: note = Seed: NSCVKLQTVHSIPLTINKEEALQRP
NSCVKLQTVHSIPLTIFKTEAVQRP

SEQ ID NO: 41352 - protein, 25 aa, synthetic construct
  source 1..25: note = Seed: NSCVKLQTVHSIPLTINKEEALQRP
NSCVKLQTVHSIPLTIFKVEAAQRP

SEQ ID NO: 41353 - protein, 25 aa, synthetic construct
  source 1..25: note = Seed: NSCVKLQTVHSIPLTINKEEALQRP
NSCVKLQTVHSIPLTIFKVEACQRP

SEQ ID NO: 41354 - protein, 25 aa, synthetic construct
  source 1..25: note = Seed: NSCVKLQTVHSIPLTINKEEALQRP
NSCVKLQTVHSIPLTIFKVEADQRP

SEQ ID NO: 41355 - protein, 25 aa, synthetic construct
  source 1..25: note = Seed: NSCVKLQTVHSIPLTINKEEALQRP
NSCVKLQTVHSIPLTIFKVEAEQRP

SEQ ID NO: 41356 - protein, 25 aa, synthetic construct
  source 1..25: note = Seed: NSCVKLQTVHSIPLTINKEEALQRP
NSCVKLQTVHSIPLTIFKVEAFQRP

SEQ ID NO: 41357 - protein, 25 aa, synthetic construct
  source 1..25: note = Seed: NSCVKLQTVHSIPLTINKEEALQRP
NSCVKLQTVHSIPLTIFKVEAGQRP

SEQ ID NO: 41358 - protein, 25 aa, synthetic construct
  source 1..25: note = Seed: NSCVKLQTVHSIPLTINKEEALQRP
NSCVKLQTVHSIPLTIFKVEAHQRP

SEQ ID NO: 41359 - protein, 25 aa, synthetic construct
  source 1..25: note = Seed: NSCVKLQTVHSIPLTINKEEALQRP
NSCVKLQTVHSIPLTIFKVEAIQRP

SEQ ID NO: 41360 - protein, 25 aa, synthetic construct
  source 1..25: note = Seed: NSCVKLQTVHSIPLTINKEEALQRP
NSCVKLQTVHSIPLTIFKVEALQRP

SEQ ID NO: 41361 - protein, 25 aa, synthetic construct
  source 1..25: note = Seed: NSCVKLQTVHSIPLTINKEEALQRP
NSCVKLQTVHSIPLTIFKVEAMQRP

SEQ ID NO: 41362 - protein, 25 aa, synthetic construct
  source 1..25: note = Seed: NSCVKLQTVHSIPLTINKEEALQRP
NSCVKLQTVHSIPLTIFKVEANQRP

SEQ ID NO: 41363 - protein, 25 aa, synthetic construct
  source 1..25: note = Seed: NSCVKLQTVHSIPLTINKEEALQRP
NSCVKLQTVHSIPLTIFKVEAPQRP

SEQ ID NO: 41364 - protein, 25 aa, synthetic construct
  source 1..25: note = Seed: NSCVKLQTVHSIPLTINKEEALQRP
NSCVKLQTVHSIPLTIFKVEAQQRP

SEQ ID NO: 41365 - protein, 25 aa, synthetic construct
  source 1..25: note = Seed: NSCVKLQTVHSIPLTINKEEALQRP
NSCVKLQTVHSIPLTIFKVEARQRP

SEQ ID NO: 41366 - protein, 25 aa, synthetic construct
  source 1..25: note = Seed: NSCVKLQTVHSIPLTINKEEALQRP
NSCVKLQTVHSIPLTIFKVEASQRP

SEQ ID NO: 41367 - protein, 25 aa, synthetic construct
  source 1..25: note = Seed: NSCVKLQTVHSIPLTINKEEALQRP
NSCVKLQTVHSIPLTIFKVEATQRP

SEQ ID NO: 41368 - protein, 25 aa, synthetic construct
  source 1..25: note = Seed: NSCVKLQTVHSIPLTINKEEALQRP
NSCVKLQTVHSIPLTIFKVEAVQRP

SEQ ID NO: 41369 - protein, 25 aa, synthetic construct
  source 1..25: note = Seed: NSCVKLQTVHSIPLTINKEEALQRP
NSCVKLQTVHSIPLTIFKVEAYQRP

SEQ ID NO: 41370 - protein, 25 aa, synthetic construct
  source 1..25: note = Seed: NSCVKLQTVHSIPLTINKEEALQRP
NSCVKLQTVHSIPLTIFKWEAAQRP

SEQ ID NO: 41371 - protein, 25 aa, synthetic construct
  source 1..25: note = Seed: NSCVKLQTVHSIPLTINKEEALQRP
NSCVKLQTVHSIPLTIFKWEAFQRP

SEQ ID NO: 41372 - protein, 25 aa, synthetic construct
  source 1..25: note = Seed: NSCVKLQTVHSIPLTINKEEALQRP
NSCVKLQTVHSIPLTIFKWEAIQRP

SEQ ID NO: 41373 - protein, 25 aa, synthetic construct
  source 1..25: note = Seed: NSCVKLQTVHSIPLTINKEEALQRP
NSCVKLQTVHSIPLTIFKWEALQRP

SEQ ID NO: 41374 - protein, 25 aa, synthetic construct
  source 1..25: note = Seed: NSCVKLQTVHSIPLTINKEEALQRP
NSCVKLQTVHSIPLTIFKWEAMQRP

SEQ ID NO: 41375 - protein, 25 aa, synthetic construct
  source 1..25: note = Seed: NSCVKLQTVHSIPLTINKEEALQRP
NSCVKLQTVHSIPLTIFKWEAVQRP

SEQ ID NO: 41376 - protein, 25 aa, synthetic construct
  source 1..25: note = Seed: NSCVKLQTVHSIPLTINKEEALQRP
NSCVKLQTVHSIPLTIFKWEAYQRP

SEQ ID NO: 41377 - protein, 25 aa, synthetic construct
  source 1..25: note = Seed: NSCVKLQTVHSIPLTINKEEALQRP
NSCVKLQTVHSIPLTIFKYEAAQRP

SEQ ID NO: 41378 - protein, 25 aa, synthetic construct
  source 1..25: note = Seed: NSCVKLQTVHSIPLTINKEEALQRP
NSCVKLQTVHSIPLTIFKYEADQRP

SEQ ID NO: 41379 - protein, 25 aa, synthetic construct
  source 1..25: note = Seed: NSCVKLQTVHSIPLTINKEEALQRP
NSCVKLQTVHSIPLTIFKYEAEQRP

SEQ ID NO: 41380 - protein, 25 aa, synthetic construct
  source 1..25: note = Seed: NSCVKLQTVHSIPLTINKEEALQRP
NSCVKLQTVHSIPLTIFKYEAFQRP

SEQ ID NO: 41381 - protein, 25 aa, synthetic construct
  source 1..25: note = Seed: NSCVKLQTVHSIPLTINKEEALQRP
NSCVKLQTVHSIPLTIFKYEAHQRP

SEQ ID NO: 41382 - protein, 25 aa, synthetic construct
  source 1..25: note = Seed: NSCVKLQTVHSIPLTINKEEALQRP
NSCVKLQTVHSIPLTIFKYEAIQRP

SEQ ID NO: 41383 - protein, 25 aa, synthetic construct
  source 1..25: note = Seed: NSCVKLQTVHSIPLTINKEEALQRP
NSCVKLQTVHSIPLTIFKYEAKQRP

SEQ ID NO: 41384 - protein, 25 aa, synthetic construct
  source 1..25: note = Seed: NSCVKLQTVHSIPLTINKEEALQRP
NSCVKLQTVHSIPLTIFKYEALQRP

SEQ ID NO: 41385 - protein, 25 aa, synthetic construct
  source 1..25: note = Seed: NSCVKLQTVHSIPLTINKEEALQRP
NSCVKLQTVHSIPLTIFKYEAMQRP

SEQ ID NO: 41386 - protein, 25 aa, synthetic construct
  source 1..25: note = Seed: NSCVKLQTVHSIPLTINKEEALQRP
NSCVKLQTVHSIPLTIFKYEANQRP

SEQ ID NO: 41387 - protein, 25 aa, synthetic construct
  source 1..25: note = Seed: NSCVKLQTVHSIPLTINKEEALQRP
NSCVKLQTVHSIPLTIFKYEAPQRP

SEQ ID NO: 41388 - protein, 25 aa, synthetic construct
  source 1..25: note = Seed: NSCVKLQTVHSIPLTINKEEALQRP
NSCVKLQTVHSIPLTIFKYEAQQRP

SEQ ID NO: 41389 - protein, 25 aa, synthetic construct
  source 1..25: note = Seed: NSCVKLQTVHSIPLTINKEEALQRP
NSCVKLQTVHSIPLTIFKYEARQRP

SEQ ID NO: 41390 - protein, 25 aa, synthetic construct
  source 1..25: note = Seed: NSCVKLQTVHSIPLTINKEEALQRP
NSCVKLQTVHSIPLTIFKYEASQRP

SEQ ID NO: 41391 - protein, 25 aa, synthetic construct
  source 1..25: note = Seed: NSCVKLQTVHSIPLTINKEEALQRP
NSCVKLQTVHSIPLTIFKYEATQRP

SEQ ID NO: 41392 - protein, 25 aa, synthetic construct
  source 1..25: note = Seed: NSCVKLQTVHSIPLTINKEEALQRP
NSCVKLQTVHSIPLTIFKYEAVQRP

SEQ ID NO: 41393 - protein, 25 aa, synthetic construct
  source 1..25: note = Seed: NSCVKLQTVHSIPLTINKEEALQRP
NSCVKLQTVHSIPLTIFKYEAWQRP

SEQ ID NO: 41394 - protein, 25 aa, synthetic construct
  source 1..25: note = Seed: NSCVKLQTVHSIPLTINKEEALQRP
NSCVKLQTVHSIPLTIFKYEAYQRP

SEQ ID NO: 41395 - protein, 25 aa, synthetic construct
  source 1..25: note = Seed: NSCVKLQTVHSIPLTINKEEALQRP
NSCVKLQTVHSIPLTIGKFEAIQRP

SEQ ID NO: 41396 - protein, 25 aa, synthetic construct
  source 1..25: note = Seed: NSCVKLQTVHSIPLTINKEEALQRP
NSCVKLQTVHSIPLTIGKFEALQRP

SEQ ID NO: 41397 - protein, 25 aa, synthetic construct
  source 1..25: note = Seed: NSCVKLQTVHSIPLTINKEEALQRP
NSCVKLQTVHSIPLTIGKFEAVQRP

SEQ ID NO: 41398 - protein, 25 aa, synthetic construct
  source 1..25: note = Seed: NSCVKLQTVHSIPLTINKEEALQRP
NSCVKLQTVHSIPLTIHKAEARQRP

SEQ ID NO: 41399 - protein, 25 aa, synthetic construct
  source 1..25: note = Seed: NSCVKLQTVHSIPLTINKEEALQRP
NSCVKLQTVHSIPLTIHKFEAAQRP

SEQ ID NO: 41400 - protein, 25 aa, synthetic construct
  source 1..25: note = Seed: NSCVKLQTVHSIPLTINKEEALQRP
NSCVKLQTVHSIPLTIHKFEADQRP

SEQ ID NO: 41401 - protein, 25 aa, synthetic construct
  source 1..25: note = Seed: NSCVKLQTVHSIPLTINKEEALQRP
NSCVKLQTVHSIPLTIHKFEAEQRP

SEQ ID NO: 41402 - protein, 25 aa, synthetic construct
  source 1..25: note = Seed: NSCVKLQTVHSIPLTINKEEALQRP
NSCVKLQTVHSIPLTIHKFEAFQRP

SEQ ID NO: 41403 - protein, 25 aa, synthetic construct
  source 1..25: note = Seed: NSCVKLQTVHSIPLTINKEEALQRP
NSCVKLQTVHSIPLTIHKFEAIQRP

SEQ ID NO: 41404 - protein, 25 aa, synthetic construct
  source 1..25: note = Seed: NSCVKLQTVHSIPLTINKEEALQRP
NSCVKLQTVHSIPLTIHKFEALQRP

SEQ ID NO: 41405 - protein, 25 aa, synthetic construct
  source 1..25: note = Seed: NSCVKLQTVHSIPLTINKEEALQRP
NSCVKLQTVHSIPLTIHKFEAMQRP

SEQ ID NO: 41406 - protein, 25 aa, synthetic construct
  source 1..25: note = Seed: NSCVKLQTVHSIPLTINKEEALQRP
NSCVKLQTVHSIPLTIHKFEANQRP

SEQ ID NO: 41407 - protein, 25 aa, synthetic construct
  source 1..25: note = Seed: NSCVKLQTVHSIPLTINKEEALQRP
NSCVKLQTVHSIPLTIHKFEASQRP

SEQ ID NO: 41408 - protein, 25 aa, synthetic construct
  source 1..25: note = Seed: NSCVKLQTVHSIPLTINKEEALQRP
NSCVKLQTVHSIPLTIHKFEATQRP

SEQ ID NO: 41409 - protein, 25 aa, synthetic construct
  source 1..25: note = Seed: NSCVKLQTVHSIPLTINKEEALQRP
NSCVKLQTVHSIPLTIHKFEAVQRP

SEQ ID NO: 41410 - protein, 25 aa, synthetic construct
  source 1..25: note = Seed: NSCVKLQTVHSIPLTINKEEALQRP
NSCVKLQTVHSIPLTIHKFEAWQRP

SEQ ID NO: 41411 - protein, 25 aa, synthetic construct
  source 1..25: note = Seed: NSCVKLQTVHSIPLTINKEEALQRP
NSCVKLQTVHSIPLTIHKFEAYQRP

SEQ ID NO: 41412 - protein, 25 aa, synthetic construct
  source 1..25: note = Seed: NSCVKLQTVHSIPLTINKEEALQRP
NSCVKLQTVHSIPLTIHKIEAIQRP

SEQ ID NO: 41413 - protein, 25 aa, synthetic construct
  source 1..25: note = Seed: NSCVKLQTVHSIPLTINKEEALQRP
NSCVKLQTVHSIPLTIHKIEALQRP

SEQ ID NO: 41414 - protein, 25 aa, synthetic construct
  source 1..25: note = Seed: NSCVKLQTVHSIPLTINKEEALQRP
NSCVKLQTVHSIPLTIHKLEAFQRP

SEQ ID NO: 41415 - protein, 25 aa, synthetic construct
  source 1..25: note = Seed: NSCVKLQTVHSIPLTINKEEALQRP
NSCVKLQTVHSIPLTIHKLEAIQRP

SEQ ID NO: 41416 - protein, 25 aa, synthetic construct
  source 1..25: note = Seed: NSCVKLQTVHSIPLTINKEEALQRP
NSCVKLQTVHSIPLTIHKLEALQRP

SEQ ID NO: 41417 - protein, 25 aa, synthetic construct
  source 1..25: note = Seed: NSCVKLQTVHSIPLTINKEEALQRP
NSCVKLQTVHSIPLTIHKLEAVQRP

SEQ ID NO: 41418 - protein, 25 aa, synthetic construct
  source 1..25: note = Seed: NSCVKLQTVHSIPLTINKEEALQRP
NSCVKLQTVHSIPLTIHKNEAIQRP

SEQ ID NO: 41419 - protein, 25 aa, synthetic construct
  source 1..25: note = Seed: NSCVKLQTVHSIPLTINKEEALQRP
NSCVKLQTVHSIPLTIHKREAFQRP

SEQ ID NO: 41420 - protein, 25 aa, synthetic construct
  source 1..25: note = Seed: NSCVKLQTVHSIPLTINKEEALQRP
NSCVKLQTVHSIPLTIHKREALQRP

SEQ ID NO: 41421 - protein, 25 aa, synthetic construct
  source 1..25: note = Seed: NSCVKLQTVHSIPLTINKEEALQRP
NSCVKLQTVHSIPLTIHKREAMQRP

SEQ ID NO: 41422 - protein, 25 aa, synthetic construct
  source 1..25: note = Seed: NSCVKLQTVHSIPLTINKEEALQRP
NSCVKLQTVHSIPLTIHKREARQRP

SEQ ID NO: 41423 - protein, 25 aa, synthetic construct
  source 1..25: note = Seed: NSCVKLQTVHSIPLTINKEEALQRP
NSCVKLQTVHSIPLTIHKREAYQRP

SEQ ID NO: 41424 - protein, 25 aa, synthetic construct
  source 1..25: note = Seed: NSCVKLQTVHSIPLTINKEEALQRP
NSCVKLQTVHSIPLTIHKWEAIQRP

SEQ ID NO: 41425 - protein, 25 aa, synthetic construct
  source 1..25: note = Seed: NSCVKLQTVHSIPLTINKEEALQRP
NSCVKLQTVHSIPLTIHKWEALQRP

SEQ ID NO: 41426 - protein, 25 aa, synthetic construct
  source 1..25: note = Seed: NSCVKLQTVHSIPLTINKEEALQRP
NSCVKLQTVHSIPLTIHKYEAFQRP

SEQ ID NO: 41427 - protein, 25 aa, synthetic construct
  source 1..25: note = Seed: NSCVKLQTVHSIPLTINKEEALQRP
NSCVKLQTVHSIPLTIHKYEAIQRP

SEQ ID NO: 41428 - protein, 25 aa, synthetic construct
  source 1..25: note = Seed: NSCVKLQTVHSIPLTINKEEALQRP
NSCVKLQTVHSIPLTIHKYEALQRP

SEQ ID NO: 41429 - protein, 25 aa, synthetic construct
  source 1..25: note = Seed: NSCVKLQTVHSIPLTINKEEALQRP
NSCVKLQTVHSIPLTIHKYEAVQRP

SEQ ID NO: 41430 - protein, 25 aa, synthetic construct
  source 1..25: note = Seed: NSCVKLQTVHSIPLTINKEEALQRP
NSCVKLQTVHSIPLTIIKAEAAQRP

SEQ ID NO: 41431 - protein, 25 aa, synthetic construct
  source 1..25: note = Seed: NSCVKLQTVHSIPLTINKEEALQRP
NSCVKLQTVHSIPLTIIKAEAFQRP

SEQ ID NO: 41432 - protein, 25 aa, synthetic construct
  source 1..25: note = Seed: NSCVKLQTVHSIPLTINKEEALQRP
NSCVKLQTVHSIPLTIIKAEAIQRP

SEQ ID NO: 41433 - protein, 25 aa, synthetic construct
  source 1..25: note = Seed: NSCVKLQTVHSIPLTINKEEALQRP
NSCVKLQTVHSIPLTIIKAEALQRP

SEQ ID NO: 41434 - protein, 25 aa, synthetic construct
  source 1..25: note = Seed: NSCVKLQTVHSIPLTINKEEALQRP
NSCVKLQTVHSIPLTIIKAEAMQRP

SEQ ID NO: 41435 - protein, 25 aa, synthetic construct
  source 1..25: note = Seed: NSCVKLQTVHSIPLTINKEEALQRP
NSCVKLQTVHSIPLTIIKAEASQRP

SEQ ID NO: 41436 - protein, 25 aa, synthetic construct
  source 1..25: note = Seed: NSCVKLQTVHSIPLTINKEEALQRP
NSCVKLQTVHSIPLTIIKAEAVQRP

SEQ ID NO: 41437 - protein, 25 aa, synthetic construct
  source 1..25: note = Seed: NSCVKLQTVHSIPLTINKEEALQRP
NSCVKLQTVHSIPLTIIKAEAYQRP

SEQ ID NO: 41438 - protein, 25 aa, synthetic construct
  source 1..25: note = Seed: NSCVKLQTVHSIPLTINKEEALQRP
NSCVKLQTVHSIPLTIIKDEAAQRP

SEQ ID NO: 41439 - protein, 25 aa, synthetic construct
  source 1..25: note = Seed: NSCVKLQTVHSIPLTINKEEALQRP
NSCVKLQTVHSIPLTIIKDEAFQRP

SEQ ID NO: 41440 - protein, 25 aa, synthetic construct
  source 1..25: note = Seed: NSCVKLQTVHSIPLTINKEEALQRP
NSCVKLQTVHSIPLTIIKDEAIQRP

SEQ ID NO: 41441 - protein, 25 aa, synthetic construct
  source 1..25: note = Seed: NSCVKLQTVHSIPLTINKEEALQRP
NSCVKLQTVHSIPLTIIKDEALQRP

SEQ ID NO: 41442 - protein, 25 aa, synthetic construct
  source 1..25: note = Seed: NSCVKLQTVHSIPLTINKEEALQRP
NSCVKLQTVHSIPLTIIKDEAMQRP

SEQ ID NO: 41443 - protein, 25 aa, synthetic construct
  source 1..25: note = Seed: NSCVKLQTVHSIPLTINKEEALQRP
NSCVKLQTVHSIPLTIIKDEASQRP

SEQ ID NO: 41444 - protein, 25 aa, synthetic construct
  source 1..25: note = Seed: NSCVKLQTVHSIPLTINKEEALQRP
NSCVKLQTVHSIPLTIIKDEAVQRP

SEQ ID NO: 41445 - protein, 25 aa, synthetic construct
  source 1..25: note = Seed: NSCVKLQTVHSIPLTINKEEALQRP
NSCVKLQTVHSIPLTIIKDEAYQRP

SEQ ID NO: 41446 - protein, 25 aa, synthetic construct
  source 1..25: note = Seed: NSCVKLQTVHSIPLTINKEEALQRP
NSCVKLQTVHSIPLTIIKFEAAQRP

SEQ ID NO: 41447 - protein, 25 aa, synthetic construct
  source 1..25: note = Seed: NSCVKLQTVHSIPLTINKEEALQRP
NSCVKLQTVHSIPLTIIKFEACQRP

SEQ ID NO: 41448 - protein, 25 aa, synthetic construct
  source 1..25: note = Seed: NSCVKLQTVHSIPLTINKEEALQRP
NSCVKLQTVHSIPLTIIKFEADQRP

SEQ ID NO: 41449 - protein, 25 aa, synthetic construct
  source 1..25: note = Seed: NSCVKLQTVHSIPLTINKEEALQRP
NSCVKLQTVHSIPLTIIKFEAEQRP

SEQ ID NO: 41450 - protein, 25 aa, synthetic construct
  source 1..25: note = Seed: NSCVKLQTVHSIPLTINKEEALQRP
NSCVKLQTVHSIPLTIIKFEAFQRP

SEQ ID NO: 41451 - protein, 25 aa, synthetic construct
  source 1..25: note = Seed: NSCVKLQTVHSIPLTINKEEALQRP
NSCVKLQTVHSIPLTIIKFEAGQRP

SEQ ID NO: 41452 - protein, 25 aa, synthetic construct
  source 1..25: note = Seed: NSCVKLQTVHSIPLTINKEEALQRP
NSCVKLQTVHSIPLTIIKFEAHQRP

SEQ ID NO: 41453 - protein, 25 aa, synthetic construct
  source 1..25: note = Seed: NSCVKLQTVHSIPLTINKEEALQRP
NSCVKLQTVHSIPLTIIKFEAIQRP

SEQ ID NO: 41454 - protein, 25 aa, synthetic construct
  source 1..25: note = Seed: NSCVKLQTVHSIPLTINKEEALQRP
NSCVKLQTVHSIPLTIIKFEAKQRP

SEQ ID NO: 41455 - protein, 25 aa, synthetic construct
  source 1..25: note = Seed: NSCVKLQTVHSIPLTINKEEALQRP
NSCVKLQTVHSIPLTIIKFEALQRP

SEQ ID NO: 41456 - protein, 25 aa, synthetic construct
  source 1..25: note = Seed: NSCVKLQTVHSIPLTINKEEALQRP
NSCVKLQTVHSIPLTIIKFEAMQRP

SEQ ID NO: 41457 - protein, 25 aa, synthetic construct
  source 1..25: note = Seed: NSCVKLQTVHSIPLTINKEEALQRP
NSCVKLQTVHSIPLTIIKFEANQRP

SEQ ID NO: 41458 - protein, 25 aa, synthetic construct
  source 1..25: note = Seed: NSCVKLQTVHSIPLTINKEEALQRP
NSCVKLQTVHSIPLTIIKFEAPQRP

SEQ ID NO: 41459 - protein, 25 aa, synthetic construct
  source 1..25: note = Seed: NSCVKLQTVHSIPLTINKEEALQRP
NSCVKLQTVHSIPLTIIKFEAQQRP

SEQ ID NO: 41460 - protein, 25 aa, synthetic construct
  source 1..25: note = Seed: NSCVKLQTVHSIPLTINKEEALQRP
NSCVKLQTVHSIPLTIIKFEARQRP

SEQ ID NO: 41461 - protein, 25 aa, synthetic construct
  source 1..25: note = Seed: NSCVKLQTVHSIPLTINKEEALQRP
NSCVKLQTVHSIPLTIIKFEASQRP

SEQ ID NO: 41462 - protein, 25 aa, synthetic construct
  source 1..25: note = Seed: NSCVKLQTVHSIPLTINKEEALQRP
NSCVKLQTVHSIPLTIIKFEATQRP

SEQ ID NO: 41463 - protein, 25 aa, synthetic construct
  source 1..25: note = Seed: NSCVKLQTVHSIPLTINKEEALQRP
NSCVKLQTVHSIPLTIIKFEAVQRP

SEQ ID NO: 41464 - protein, 25 aa, synthetic construct
  source 1..25: note = Seed: NSCVKLQTVHSIPLTINKEEALQRP
NSCVKLQTVHSIPLTIIKFEAWQRP

SEQ ID NO: 41465 - protein, 25 aa, synthetic construct
  source 1..25: note = Seed: NSCVKLQTVHSIPLTINKEEALQRP
NSCVKLQTVHSIPLTIIKFEAYQRP

SEQ ID NO: 41466 - protein, 25 aa, synthetic construct
  source 1..25: note = Seed: NSCVKLQTVHSIPLTINKEEALQRP
NSCVKLQTVHSIPLTIIKGEAIQRP

SEQ ID NO: 41467 - protein, 25 aa, synthetic construct
  source 1..25: note = Seed: NSCVKLQTVHSIPLTINKEEALQRP
NSCVKLQTVHSIPLTIIKGEAVQRP

SEQ ID NO: 41468 - protein, 25 aa, synthetic construct
  source 1..25: note = Seed: NSCVKLQTVHSIPLTINKEEALQRP
NSCVKLQTVHSIPLTIIKHEALQRP

SEQ ID NO: 41469 - protein, 25 aa, synthetic construct
  source 1..25: note = Seed: NSCVKLQTVHSIPLTINKEEALQRP
NSCVKLQTVHSIPLTIIKHEARQRP

SEQ ID NO: 41470 - protein, 25 aa, synthetic construct
  source 1..25: note = Seed: NSCVKLQTVHSIPLTINKEEALQRP
NSCVKLQTVHSIPLTIIKIEAAQRP

SEQ ID NO: 41471 - protein, 25 aa, synthetic construct
  source 1..25: note = Seed: NSCVKLQTVHSIPLTINKEEALQRP
NSCVKLQTVHSIPLTIIKIEADQRP

SEQ ID NO: 41472 - protein, 25 aa, synthetic construct
  source 1..25: note = Seed: NSCVKLQTVHSIPLTINKEEALQRP
NSCVKLQTVHSIPLTIIKIEAFQRP

SEQ ID NO: 41473 - protein, 25 aa, synthetic construct
  source 1..25: note = Seed: NSCVKLQTVHSIPLTINKEEALQRP
NSCVKLQTVHSIPLTIIKIEAGQRP

SEQ ID NO: 41474 - protein, 25 aa, synthetic construct
  source 1..25: note = Seed: NSCVKLQTVHSIPLTINKEEALQRP
NSCVKLQTVHSIPLTIIKIEAIQRP

SEQ ID NO: 41475 - protein, 25 aa, synthetic construct
  source 1..25: note = Seed: NSCVKLQTVHSIPLTINKEEALQRP
NSCVKLQTVHSIPLTIIKIEALQRP

SEQ ID NO: 41476 - protein, 25 aa, synthetic construct
  source 1..25: note = Seed: NSCVKLQTVHSIPLTINKEEALQRP
NSCVKLQTVHSIPLTIIKIEAMQRP

SEQ ID NO: 41477 - protein, 25 aa, synthetic construct
  source 1..25: note = Seed: NSCVKLQTVHSIPLTINKEEALQRP
NSCVKLQTVHSIPLTIIKIEANQRP

SEQ ID NO: 41478 - protein, 25 aa, synthetic construct
  source 1..25: note = Seed: NSCVKLQTVHSIPLTINKEEALQRP
NSCVKLQTVHSIPLTIIKIEAQQRP

SEQ ID NO: 41479 - protein, 25 aa, synthetic construct
  source 1..25: note = Seed: NSCVKLQTVHSIPLTINKEEALQRP
NSCVKLQTVHSIPLTIIKIEASQRP

SEQ ID NO: 41480 - protein, 25 aa, synthetic construct
  source 1..25: note = Seed: NSCVKLQTVHSIPLTINKEEALQRP
NSCVKLQTVHSIPLTIIKIEATQRP

SEQ ID NO: 41481 - protein, 25 aa, synthetic construct
  source 1..25: note = Seed: NSCVKLQTVHSIPLTINKEEALQRP
NSCVKLQTVHSIPLTIIKIEAVQRP

SEQ ID NO: 41482 - protein, 25 aa, synthetic construct
  source 1..25: note = Seed: NSCVKLQTVHSIPLTINKEEALQRP
NSCVKLQTVHSIPLTIIKIEAYQRP

SEQ ID NO: 41483 - protein, 25 aa, synthetic construct
  source 1..25: note = Seed: NSCVKLQTVHSIPLTINKEEALQRP
NSCVKLQTVHSIPLTIIKKEAFQRP

SEQ ID NO: 41484 - protein, 25 aa, synthetic construct
  source 1..25: note = Seed: NSCVKLQTVHSIPLTINKEEALQRP
NSCVKLQTVHSIPLTIIKKEAIQRP

SEQ ID NO: 41485 - protein, 25 aa, synthetic construct
  source 1..25: note = Seed: NSCVKLQTVHSIPLTINKEEALQRP
NSCVKLQTVHSIPLTIIKKEALQRP

SEQ ID NO: 41486 - protein, 25 aa, synthetic construct
  source 1..25: note = Seed: NSCVKLQTVHSIPLTINKEEALQRP
NSCVKLQTVHSIPLTIIKKEAMQRP

SEQ ID NO: 41487 - protein, 25 aa, synthetic construct
  source 1..25: note = Seed: NSCVKLQTVHSIPLTINKEEALQRP
NSCVKLQTVHSIPLTIIKKEARQRP

SEQ ID NO: 41488 - protein, 25 aa, synthetic construct
  source 1..25: note = Seed: NSCVKLQTVHSIPLTINKEEALQRP
NSCVKLQTVHSIPLTIIKKEAVQRP

SEQ ID NO: 41489 - protein, 25 aa, synthetic construct
  source 1..25: note = Seed: NSCVKLQTVHSIPLTINKEEALQRP
NSCVKLQTVHSIPLTIIKKEAYQRP

SEQ ID NO: 41490 - protein, 25 aa, synthetic construct
  source 1..25: note = Seed: NSCVKLQTVHSIPLTINKEEALQRP
NSCVKLQTVHSIPLTIIKLEAAQRP

SEQ ID NO: 41491 - protein, 25 aa, synthetic construct
  source 1..25: note = Seed: NSCVKLQTVHSIPLTINKEEALQRP
NSCVKLQTVHSIPLTIIKLEADQRP

SEQ ID NO: 41492 - protein, 25 aa, synthetic construct
  source 1..25: note = Seed: NSCVKLQTVHSIPLTINKEEALQRP
NSCVKLQTVHSIPLTIIKLEAEQRP

SEQ ID NO: 41493 - protein, 25 aa, synthetic construct
  source 1..25: note = Seed: NSCVKLQTVHSIPLTINKEEALQRP
NSCVKLQTVHSIPLTIIKLEAFQRP

SEQ ID NO: 41494 - protein, 25 aa, synthetic construct
  source 1..25: note = Seed: NSCVKLQTVHSIPLTINKEEALQRP
NSCVKLQTVHSIPLTIIKLEAIQRP

SEQ ID NO: 41495 - protein, 25 aa, synthetic construct
  source 1..25: note = Seed: NSCVKLQTVHSIPLTINKEEALQRP
NSCVKLQTVHSIPLTIIKLEALQRP

SEQ ID NO: 41496 - protein, 25 aa, synthetic construct
  source 1..25: note = Seed: NSCVKLQTVHSIPLTINKEEALQRP
NSCVKLQTVHSIPLTIIKLEAMQRP

SEQ ID NO: 41497 - protein, 25 aa, synthetic construct
  source 1..25: note = Seed: NSCVKLQTVHSIPLTINKEEALQRP
NSCVKLQTVHSIPLTIIKLEANQRP

SEQ ID NO: 41498 - protein, 25 aa, synthetic construct
  source 1..25: note = Seed: NSCVKLQTVHSIPLTINKEEALQRP
NSCVKLQTVHSIPLTIIKLEAQQRP

SEQ ID NO: 41499 - protein, 25 aa, synthetic construct
  source 1..25: note = Seed: NSCVKLQTVHSIPLTINKEEALQRP
NSCVKLQTVHSIPLTIIKLEARQRP

SEQ ID NO: 41500 - protein, 25 aa, synthetic construct
  source 1..25: note = Seed: NSCVKLQTVHSIPLTINKEEALQRP
NSCVKLQTVHSIPLTIIKLEASQRP

SEQ ID NO: 41501 - protein, 25 aa, synthetic construct
  source 1..25: note = Seed: NSCVKLQTVHSIPLTINKEEALQRP
NSCVKLQTVHSIPLTIIKLEATQRP

SEQ ID NO: 41502 - protein, 25 aa, synthetic construct
  source 1..25: note = Seed: NSCVKLQTVHSIPLTINKEEALQRP
NSCVKLQTVHSIPLTIIKLEAVQRP

SEQ ID NO: 41503 - protein, 25 aa, synthetic construct
  source 1..25: note = Seed: NSCVKLQTVHSIPLTINKEEALQRP
NSCVKLQTVHSIPLTIIKLEAYQRP

SEQ ID NO: 41504 - protein, 25 aa, synthetic construct
  source 1..25: note = Seed: NSCVKLQTVHSIPLTINKEEALQRP
NSCVKLQTVHSIPLTIIKMEAAQRP

SEQ ID NO: 41505 - protein, 25 aa, synthetic construct
  source 1..25: note = Seed: NSCVKLQTVHSIPLTINKEEALQRP
NSCVKLQTVHSIPLTIIKMEAFQRP

SEQ ID NO: 41506 - protein, 25 aa, synthetic construct
  source 1..25: note = Seed: NSCVKLQTVHSIPLTINKEEALQRP
NSCVKLQTVHSIPLTIIKMEAIQRP

SEQ ID NO: 41507 - protein, 25 aa, synthetic construct
  source 1..25: note = Seed: NSCVKLQTVHSIPLTINKEEALQRP
NSCVKLQTVHSIPLTIIKMEALQRP

SEQ ID NO: 41508 - protein, 25 aa, synthetic construct
  source 1..25: note = Seed: NSCVKLQTVHSIPLTINKEEALQRP
NSCVKLQTVHSIPLTIIKMEAMQRP

SEQ ID NO: 41509 - protein, 25 aa, synthetic construct
  source 1..25: note = Seed: NSCVKLQTVHSIPLTINKEEALQRP
NSCVKLQTVHSIPLTIIKMEASQRP

SEQ ID NO: 41510 - protein, 25 aa, synthetic construct
  source 1..25: note = Seed: NSCVKLQTVHSIPLTINKEEALQRP
NSCVKLQTVHSIPLTIIKMEAVQRP

SEQ ID NO: 41511 - protein, 25 aa, synthetic construct
  source 1..25: note = Seed: NSCVKLQTVHSIPLTINKEEALQRP
NSCVKLQTVHSIPLTIIKMEAYQRP

SEQ ID NO: 41512 - protein, 25 aa, synthetic construct
  source 1..25: note = Seed: NSCVKLQTVHSIPLTINKEEALQRP
NSCVKLQTVHSIPLTIIKNEAAQRP

SEQ ID NO: 41513 - protein, 25 aa, synthetic construct
  source 1..25: note = Seed: NSCVKLQTVHSIPLTINKEEALQRP
NSCVKLQTVHSIPLTIIKNEAFQRP

SEQ ID NO: 41514 - protein, 25 aa, synthetic construct
  source 1..25: note = Seed: NSCVKLQTVHSIPLTINKEEALQRP
NSCVKLQTVHSIPLTIIKNEAIQRP

SEQ ID NO: 41515 - protein, 25 aa, synthetic construct
  source 1..25: note = Seed: NSCVKLQTVHSIPLTINKEEALQRP
NSCVKLQTVHSIPLTIIKNEALQRP

SEQ ID NO: 41516 - protein, 25 aa, synthetic construct
  source 1..25: note = Seed: NSCVKLQTVHSIPLTINKEEALQRP
NSCVKLQTVHSIPLTIIKNEAMQRP

SEQ ID NO: 41517 - protein, 25 aa, synthetic construct
  source 1..25: note = Seed: NSCVKLQTVHSIPLTINKEEALQRP
NSCVKLQTVHSIPLTIIKNEAVQRP

SEQ ID NO: 41518 - protein, 25 aa, synthetic construct
  source 1..25: note = Seed: NSCVKLQTVHSIPLTINKEEALQRP
NSCVKLQTVHSIPLTIIKPEAIQRP

SEQ ID NO: 41519 - protein, 25 aa, synthetic construct
  source 1..25: note = Seed: NSCVKLQTVHSIPLTINKEEALQRP
NSCVKLQTVHSIPLTIIKPEAVQRP

SEQ ID NO: 41520 - protein, 25 aa, synthetic construct
  source 1..25: note = Seed: NSCVKLQTVHSIPLTINKEEALQRP
NSCVKLQTVHSIPLTIIKREAAQRP

SEQ ID NO: 41521 - protein, 25 aa, synthetic construct
  source 1..25: note = Seed: NSCVKLQTVHSIPLTINKEEALQRP
NSCVKLQTVHSIPLTIIKREAFQRP

SEQ ID NO: 41522 - protein, 25 aa, synthetic construct
  source 1..25: note = Seed: NSCVKLQTVHSIPLTINKEEALQRP
NSCVKLQTVHSIPLTIIKREAIQRP

SEQ ID NO: 41523 - protein, 25 aa, synthetic construct
  source 1..25: note = Seed: NSCVKLQTVHSIPLTINKEEALQRP
NSCVKLQTVHSIPLTIIKREALQRP

SEQ ID NO: 41524 - protein, 25 aa, synthetic construct
  source 1..25: note = Seed: NSCVKLQTVHSIPLTINKEEALQRP
NSCVKLQTVHSIPLTIIKREAMQRP

SEQ ID NO: 41525 - protein, 25 aa, synthetic construct
  source 1..25: note = Seed: NSCVKLQTVHSIPLTINKEEALQRP
NSCVKLQTVHSIPLTIIKREARQRP

SEQ ID NO: 41526 - protein, 25 aa, synthetic construct
  source 1..25: note = Seed: NSCVKLQTVHSIPLTINKEEALQRP
NSCVKLQTVHSIPLTIIKREASQRP

SEQ ID NO: 41527 - protein, 25 aa, synthetic construct
  source 1..25: note = Seed: NSCVKLQTVHSIPLTINKEEALQRP
NSCVKLQTVHSIPLTIIKREAVQRP

SEQ ID NO: 41528 - protein, 25 aa, synthetic construct
  source 1..25: note = Seed: NSCVKLQTVHSIPLTINKEEALQRP
NSCVKLQTVHSIPLTIIKREAYQRP

SEQ ID NO: 41529 - protein, 25 aa, synthetic construct
  source 1..25: note = Seed: NSCVKLQTVHSIPLTINKEEALQRP
NSCVKLQTVHSIPLTIIKSEAAQRP

SEQ ID NO: 41530 - protein, 25 aa, synthetic construct
  source 1..25: note = Seed: NSCVKLQTVHSIPLTINKEEALQRP
NSCVKLQTVHSIPLTIIKSEAIQRP

SEQ ID NO: 41531 - protein, 25 aa, synthetic construct
  source 1..25: note = Seed: NSCVKLQTVHSIPLTINKEEALQRP
NSCVKLQTVHSIPLTIIKSEALQRP

SEQ ID NO: 41532 - protein, 25 aa, synthetic construct
  source 1..25: note = Seed: NSCVKLQTVHSIPLTINKEEALQRP
NSCVKLQTVHSIPLTIIKSEAVQRP

SEQ ID NO: 41533 - protein, 25 aa, synthetic construct
  source 1..25: note = Seed: NSCVKLQTVHSIPLTINKEEALQRP
NSCVKLQTVHSIPLTIIKTEAAQRP

SEQ ID NO: 41534 - protein, 25 aa, synthetic construct
  source 1..25: note = Seed: NSCVKLQTVHSIPLTINKEEALQRP
NSCVKLQTVHSIPLTIIKTEAIQRP

SEQ ID NO: 41535 - protein, 25 aa, synthetic construct
  source 1..25: note = Seed: NSCVKLQTVHSIPLTINKEEALQRP
NSCVKLQTVHSIPLTIIKTEALQRP

SEQ ID NO: 41536 - protein, 25 aa, synthetic construct
  source 1..25: note = Seed: NSCVKLQTVHSIPLTINKEEALQRP
NSCVKLQTVHSIPLTIIKTEAVQRP

SEQ ID NO: 41537 - protein, 25 aa, synthetic construct
  source 1..25: note = Seed: NSCVKLQTVHSIPLTINKEEALQRP
NSCVKLQTVHSIPLTIIKVEAAQRP

SEQ ID NO: 41538 - protein, 25 aa, synthetic construct
  source 1..25: note = Seed: NSCVKLQTVHSIPLTINKEEALQRP
NSCVKLQTVHSIPLTIIKVEAFQRP

SEQ ID NO: 41539 - protein, 25 aa, synthetic construct
  source 1..25: note = Seed: NSCVKLQTVHSIPLTINKEEALQRP
NSCVKLQTVHSIPLTIIKVEAIQRP

SEQ ID NO: 41540 - protein, 25 aa, synthetic construct
  source 1..25: note = Seed: NSCVKLQTVHSIPLTINKEEALQRP
NSCVKLQTVHSIPLTIIKVEALQRP

SEQ ID NO: 41541 - protein, 25 aa, synthetic construct
  source 1..25: note = Seed: NSCVKLQTVHSIPLTINKEEALQRP
NSCVKLQTVHSIPLTIIKVEAMQRP

SEQ ID NO: 41542 - protein, 25 aa, synthetic construct
  source 1..25: note = Seed: NSCVKLQTVHSIPLTINKEEALQRP
NSCVKLQTVHSIPLTIIKVEASQRP

SEQ ID NO: 41543 - protein, 25 aa, synthetic construct
  source 1..25: note = Seed: NSCVKLQTVHSIPLTINKEEALQRP
NSCVKLQTVHSIPLTIIKVEATQRP

SEQ ID NO: 41544 - protein, 25 aa, synthetic construct
  source 1..25: note = Seed: NSCVKLQTVHSIPLTINKEEALQRP
NSCVKLQTVHSIPLTIIKVEAVQRP

SEQ ID NO: 41545 - protein, 25 aa, synthetic construct
  source 1..25: note = Seed: NSCVKLQTVHSIPLTINKEEALQRP
NSCVKLQTVHSIPLTIIKVEAYQRP

SEQ ID NO: 41546 - protein, 25 aa, synthetic construct
  source 1..25: note = Seed: NSCVKLQTVHSIPLTINKEEALQRP
NSCVKLQTVHSIPLTIIKWEAAQRP

SEQ ID NO: 41547 - protein, 25 aa, synthetic construct
  source 1..25: note = Seed: NSCVKLQTVHSIPLTINKEEALQRP
NSCVKLQTVHSIPLTIIKWEADQRP

SEQ ID NO: 41548 - protein, 25 aa, synthetic construct
  source 1..25: note = Seed: NSCVKLQTVHSIPLTINKEEALQRP
NSCVKLQTVHSIPLTIIKWEAEQRP

SEQ ID NO: 41549 - protein, 25 aa, synthetic construct
  source 1..25: note = Seed: NSCVKLQTVHSIPLTINKEEALQRP
NSCVKLQTVHSIPLTIIKWEAFQRP

SEQ ID NO: 41550 - protein, 25 aa, synthetic construct
  source 1..25: note = Seed: NSCVKLQTVHSIPLTINKEEALQRP
NSCVKLQTVHSIPLTIIKWEAIQRP

SEQ ID NO: 41551 - protein, 25 aa, synthetic construct
  source 1..25: note = Seed: NSCVKLQTVHSIPLTINKEEALQRP
NSCVKLQTVHSIPLTIIKWEALQRP

SEQ ID NO: 41552 - protein, 25 aa, synthetic construct
  source 1..25: note = Seed: NSCVKLQTVHSIPLTINKEEALQRP
NSCVKLQTVHSIPLTIIKWEAMQRP

SEQ ID NO: 41553 - protein, 25 aa, synthetic construct
  source 1..25: note = Seed: NSCVKLQTVHSIPLTINKEEALQRP
NSCVKLQTVHSIPLTIIKWEANQRP

SEQ ID NO: 41554 - protein, 25 aa, synthetic construct
  source 1..25: note = Seed: NSCVKLQTVHSIPLTINKEEALQRP
NSCVKLQTVHSIPLTIIKWEATQRP

SEQ ID NO: 41555 - protein, 25 aa, synthetic construct
  source 1..25: note = Seed: NSCVKLQTVHSIPLTINKEEALQRP
NSCVKLQTVHSIPLTIIKWEAVQRP

SEQ ID NO: 41556 - protein, 25 aa, synthetic construct
  source 1..25: note = Seed: NSCVKLQTVHSIPLTINKEEALQRP
NSCVKLQTVHSIPLTIIKWEAYQRP

SEQ ID NO: 41557 - protein, 25 aa, synthetic construct
  source 1..25: note = Seed: NSCVKLQTVHSIPLTINKEEALQRP
NSCVKLQTVHSIPLTIIKYEAAQRP

SEQ ID NO: 41558 - protein, 25 aa, synthetic construct
  source 1..25: note = Seed: NSCVKLQTVHSIPLTINKEEALQRP
NSCVKLQTVHSIPLTIIKYEACQRP

SEQ ID NO: 41559 - protein, 25 aa, synthetic construct
  source 1..25: note = Seed: NSCVKLQTVHSIPLTINKEEALQRP
NSCVKLQTVHSIPLTIIKYEADQRP

SEQ ID NO: 41560 - protein, 25 aa, synthetic construct
  source 1..25: note = Seed: NSCVKLQTVHSIPLTINKEEALQRP
NSCVKLQTVHSIPLTIIKYEAEQRP

SEQ ID NO: 41561 - protein, 25 aa, synthetic construct
  source 1..25: note = Seed: NSCVKLQTVHSIPLTINKEEALQRP
NSCVKLQTVHSIPLTIIKYEAFQRP

SEQ ID NO: 41562 - protein, 25 aa, synthetic construct
  source 1..25: note = Seed: NSCVKLQTVHSIPLTINKEEALQRP
NSCVKLQTVHSIPLTIIKYEAHQRP

SEQ ID NO: 41563 - protein, 25 aa, synthetic construct
  source 1..25: note = Seed: NSCVKLQTVHSIPLTINKEEALQRP
NSCVKLQTVHSIPLTIIKYEAIQRP

SEQ ID NO: 41564 - protein, 25 aa, synthetic construct
  source 1..25: note = Seed: NSCVKLQTVHSIPLTINKEEALQRP
NSCVKLQTVHSIPLTIIKYEALQRP

SEQ ID NO: 41565 - protein, 25 aa, synthetic construct
  source 1..25: note = Seed: NSCVKLQTVHSIPLTINKEEALQRP
NSCVKLQTVHSIPLTIIKYEAMQRP

SEQ ID NO: 41566 - protein, 25 aa, synthetic construct
  source 1..25: note = Seed: NSCVKLQTVHSIPLTINKEEALQRP
NSCVKLQTVHSIPLTIIKYEANQRP

SEQ ID NO: 41567 - protein, 25 aa, synthetic construct
  source 1..25: note = Seed: NSCVKLQTVHSIPLTINKEEALQRP
NSCVKLQTVHSIPLTIIKYEAPQRP

SEQ ID NO: 41568 - protein, 25 aa, synthetic construct
  source 1..25: note = Seed: NSCVKLQTVHSIPLTINKEEALQRP
NSCVKLQTVHSIPLTIIKYEAQQRP

SEQ ID NO: 41569 - protein, 25 aa, synthetic construct
  source 1..25: note = Seed: NSCVKLQTVHSIPLTINKEEALQRP
NSCVKLQTVHSIPLTIIKYEARQRP

SEQ ID NO: 41570 - protein, 25 aa, synthetic construct
  source 1..25: note = Seed: NSCVKLQTVHSIPLTINKEEALQRP
NSCVKLQTVHSIPLTIIKYEASQRP

SEQ ID NO: 41571 - protein, 25 aa, synthetic construct
  source 1..25: note = Seed: NSCVKLQTVHSIPLTINKEEALQRP
NSCVKLQTVHSIPLTIIKYEATQRP

SEQ ID NO: 41572 - protein, 25 aa, synthetic construct
  source 1..25: note = Seed: NSCVKLQTVHSIPLTINKEEALQRP
NSCVKLQTVHSIPLTIIKYEAVQRP

SEQ ID NO: 41573 - protein, 25 aa, synthetic construct
  source 1..25: note = Seed: NSCVKLQTVHSIPLTINKEEALQRP
NSCVKLQTVHSIPLTIIKYEAWQRP

SEQ ID NO: 41574 - protein, 25 aa, synthetic construct
  source 1..25: note = Seed: NSCVKLQTVHSIPLTINKEEALQRP
NSCVKLQTVHSIPLTIIKYEAYQRP

SEQ ID NO: 41575 - protein, 25 aa, synthetic construct
  source 1..25: note = Seed: NSCVKLQTVHSIPLTINKEEALQRP
NSCVKLQTVHSIPLTIKKFEAFQRP

SEQ ID NO: 41576 - protein, 25 aa, synthetic construct
  source 1..25: note = Seed: NSCVKLQTVHSIPLTINKEEALQRP
NSCVKLQTVHSIPLTIKKFEAIQRP

SEQ ID NO: 41577 - protein, 25 aa, synthetic construct
  source 1..25: note = Seed: NSCVKLQTVHSIPLTINKEEALQRP
NSCVKLQTVHSIPLTIKKFEALQRP

SEQ ID NO: 41578 - protein, 25 aa, synthetic construct
  source 1..25: note = Seed: NSCVKLQTVHSIPLTINKEEALQRP
NSCVKLQTVHSIPLTIKKFEAMQRP

SEQ ID NO: 41579 - protein, 25 aa, synthetic construct
  source 1..25: note = Seed: NSCVKLQTVHSIPLTINKEEALQRP
NSCVKLQTVHSIPLTIKKFEAVQRP

SEQ ID NO: 41580 - protein, 25 aa, synthetic construct
  source 1..25: note = Seed: NSCVKLQTVHSIPLTINKEEALQRP
NSCVKLQTVHSIPLTIKKREAFQRP

SEQ ID NO: 41581 - protein, 25 aa, synthetic construct
  source 1..25: note = Seed: NSCVKLQTVHSIPLTINKEEALQRP
NSCVKLQTVHSIPLTILKAEAAQRP

SEQ ID NO: 41582 - protein, 25 aa, synthetic construct
  source 1..25: note = Seed: NSCVKLQTVHSIPLTINKEEALQRP
NSCVKLQTVHSIPLTILKAEAFQRP

SEQ ID NO: 41583 - protein, 25 aa, synthetic construct
  source 1..25: note = Seed: NSCVKLQTVHSIPLTINKEEALQRP
NSCVKLQTVHSIPLTILKAEAIQRP

SEQ ID NO: 41584 - protein, 25 aa, synthetic construct
  source 1..25: note = Seed: NSCVKLQTVHSIPLTINKEEALQRP
NSCVKLQTVHSIPLTILKAEALQRP

SEQ ID NO: 41585 - protein, 25 aa, synthetic construct
  source 1..25: note = Seed: NSCVKLQTVHSIPLTINKEEALQRP
NSCVKLQTVHSIPLTILKAEAMQRP

SEQ ID NO: 41586 - protein, 25 aa, synthetic construct
  source 1..25: note = Seed: NSCVKLQTVHSIPLTINKEEALQRP
NSCVKLQTVHSIPLTILKAEASQRP

SEQ ID NO: 41587 - protein, 25 aa, synthetic construct
  source 1..25: note = Seed: NSCVKLQTVHSIPLTINKEEALQRP
NSCVKLQTVHSIPLTILKAEAVQRP

SEQ ID NO: 41588 - protein, 25 aa, synthetic construct
  source 1..25: note = Seed: NSCVKLQTVHSIPLTINKEEALQRP
NSCVKLQTVHSIPLTILKAEAYQRP

SEQ ID NO: 41589 - protein, 25 aa, synthetic construct
  source 1..25: note = Seed: NSCVKLQTVHSIPLTINKEEALQRP
NSCVKLQTVHSIPLTILKDEAAQRP

SEQ ID NO: 41590 - protein, 25 aa, synthetic construct
  source 1..25: note = Seed: NSCVKLQTVHSIPLTINKEEALQRP
NSCVKLQTVHSIPLTILKDEAIQRP

SEQ ID NO: 41591 - protein, 25 aa, synthetic construct
  source 1..25: note = Seed: NSCVKLQTVHSIPLTINKEEALQRP
NSCVKLQTVHSIPLTILKDEALQRP

SEQ ID NO: 41592 - protein, 25 aa, synthetic construct
  source 1..25: note = Seed: NSCVKLQTVHSIPLTINKEEALQRP
NSCVKLQTVHSIPLTILKDEAMQRP

SEQ ID NO: 41593 - protein, 25 aa, synthetic construct
  source 1..25: note = Seed: NSCVKLQTVHSIPLTINKEEALQRP
NSCVKLQTVHSIPLTILKDEAVQRP

SEQ ID NO: 41594 - protein, 25 aa, synthetic construct
  source 1..25: note = Seed: NSCVKLQTVHSIPLTINKEEALQRP
NSCVKLQTVHSIPLTILKFEAAQRP

SEQ ID NO: 41595 - protein, 25 aa, synthetic construct
  source 1..25: note = Seed: NSCVKLQTVHSIPLTINKEEALQRP
NSCVKLQTVHSIPLTILKFEACQRP

SEQ ID NO: 41596 - protein, 25 aa, synthetic construct
  source 1..25: note = Seed: NSCVKLQTVHSIPLTINKEEALQRP
NSCVKLQTVHSIPLTILKFEADQRP

SEQ ID NO: 41597 - protein, 25 aa, synthetic construct
  source 1..25: note = Seed: NSCVKLQTVHSIPLTINKEEALQRP
NSCVKLQTVHSIPLTILKFEAEQRP

SEQ ID NO: 41598 - protein, 25 aa, synthetic construct
  source 1..25: note = Seed: NSCVKLQTVHSIPLTINKEEALQRP
NSCVKLQTVHSIPLTILKFEAFQRP

SEQ ID NO: 41599 - protein, 25 aa, synthetic construct
  source 1..25: note = Seed: NSCVKLQTVHSIPLTINKEEALQRP
NSCVKLQTVHSIPLTILKFEAGQRP

SEQ ID NO: 41600 - protein, 25 aa, synthetic construct
  source 1..25: note = Seed: NSCVKLQTVHSIPLTINKEEALQRP
NSCVKLQTVHSIPLTILKFEAHQRP

SEQ ID NO: 41601 - protein, 25 aa, synthetic construct
  source 1..25: note = Seed: NSCVKLQTVHSIPLTINKEEALQRP
NSCVKLQTVHSIPLTILKFEAIQRP

SEQ ID NO: 41602 - protein, 25 aa, synthetic construct
  source 1..25: note = Seed: NSCVKLQTVHSIPLTINKEEALQRP
NSCVKLQTVHSIPLTILKFEAKQRP

SEQ ID NO: 41603 - protein, 25 aa, synthetic construct
  source 1..25: note = Seed: NSCVKLQTVHSIPLTINKEEALQRP
NSCVKLQTVHSIPLTILKFEALQRP

SEQ ID NO: 41604 - protein, 25 aa, synthetic construct
  source 1..25: note = Seed: NSCVKLQTVHSIPLTINKEEALQRP
NSCVKLQTVHSIPLTILKFEAMQRP

SEQ ID NO: 41605 - protein, 25 aa, synthetic construct
  source 1..25: note = Seed: NSCVKLQTVHSIPLTINKEEALQRP
NSCVKLQTVHSIPLTILKFEANQRP

SEQ ID NO: 41606 - protein, 25 aa, synthetic construct
  source 1..25: note = Seed: NSCVKLQTVHSIPLTINKEEALQRP
NSCVKLQTVHSIPLTILKFEAPQRP

SEQ ID NO: 41607 - protein, 25 aa, synthetic construct
  source 1..25: note = Seed: NSCVKLQTVHSIPLTINKEEALQRP
NSCVKLQTVHSIPLTILKFEAQQRP

SEQ ID NO: 41608 - protein, 25 aa, synthetic construct
  source 1..25: note = Seed: NSCVKLQTVHSIPLTINKEEALQRP
NSCVKLQTVHSIPLTILKFEARQRP

SEQ ID NO: 41609 - protein, 25 aa, synthetic construct
  source 1..25: note = Seed: NSCVKLQTVHSIPLTINKEEALQRP
NSCVKLQTVHSIPLTILKFEASQRP

SEQ ID NO: 41610 - protein, 25 aa, synthetic construct
  source 1..25: note = Seed: NSCVKLQTVHSIPLTINKEEALQRP
NSCVKLQTVHSIPLTILKFEATQRP

SEQ ID NO: 41611 - protein, 25 aa, synthetic construct
  source 1..25: note = Seed: NSCVKLQTVHSIPLTINKEEALQRP
NSCVKLQTVHSIPLTILKFEAVQRP

SEQ ID NO: 41612 - protein, 25 aa, synthetic construct
  source 1..25: note = Seed: NSCVKLQTVHSIPLTINKEEALQRP
NSCVKLQTVHSIPLTILKFEAWQRP

SEQ ID NO: 41613 - protein, 25 aa, synthetic construct
  source 1..25: note = Seed: NSCVKLQTVHSIPLTINKEEALQRP
NSCVKLQTVHSIPLTILKFEAYQRP

SEQ ID NO: 41614 - protein, 25 aa, synthetic construct
  source 1..25: note = Seed: NSCVKLQTVHSIPLTINKEEALQRP
NSCVKLQTVHSIPLTILKGEAAQRP

SEQ ID NO: 41615 - protein, 25 aa, synthetic construct
  source 1..25: note = Seed: NSCVKLQTVHSIPLTINKEEALQRP
NSCVKLQTVHSIPLTILKGEAIQRP

SEQ ID NO: 41616 - protein, 25 aa, synthetic construct
  source 1..25: note = Seed: NSCVKLQTVHSIPLTINKEEALQRP
NSCVKLQTVHSIPLTILKGEALQRP

SEQ ID NO: 41617 - protein, 25 aa, synthetic construct
  source 1..25: note = Seed: NSCVKLQTVHSIPLTINKEEALQRP
NSCVKLQTVHSIPLTILKGEAVQRP

SEQ ID NO: 41618 - protein, 25 aa, synthetic construct
  source 1..25: note = Seed: NSCVKLQTVHSIPLTINKEEALQRP
NSCVKLQTVHSIPLTILKHEAFQRP

SEQ ID NO: 41619 - protein, 25 aa, synthetic construct
  source 1..25: note = Seed: NSCVKLQTVHSIPLTINKEEALQRP
NSCVKLQTVHSIPLTILKIEAAQRP

SEQ ID NO: 41620 - protein, 25 aa, synthetic construct
  source 1..25: note = Seed: NSCVKLQTVHSIPLTINKEEALQRP
NSCVKLQTVHSIPLTILKIEAEQRP

SEQ ID NO: 41621 - protein, 25 aa, synthetic construct
  source 1..25: note = Seed: NSCVKLQTVHSIPLTINKEEALQRP
NSCVKLQTVHSIPLTILKIEAFQRP

SEQ ID NO: 41622 - protein, 25 aa, synthetic construct
  source 1..25: note = Seed: NSCVKLQTVHSIPLTINKEEALQRP
NSCVKLQTVHSIPLTILKIEAGQRP

SEQ ID NO: 41623 - protein, 25 aa, synthetic construct
  source 1..25: note = Seed: NSCVKLQTVHSIPLTINKEEALQRP
NSCVKLQTVHSIPLTILKIEAIQRP

SEQ ID NO: 41624 - protein, 25 aa, synthetic construct
  source 1..25: note = Seed: NSCVKLQTVHSIPLTINKEEALQRP
NSCVKLQTVHSIPLTILKIEALQRP

SEQ ID NO: 41625 - protein, 25 aa, synthetic construct
  source 1..25: note = Seed: NSCVKLQTVHSIPLTINKEEALQRP
NSCVKLQTVHSIPLTILKIEAMQRP

SEQ ID NO: 41626 - protein, 25 aa, synthetic construct
  source 1..25: note = Seed: NSCVKLQTVHSIPLTINKEEALQRP
NSCVKLQTVHSIPLTILKIEANQRP

SEQ ID NO: 41627 - protein, 25 aa, synthetic construct
  source 1..25: note = Seed: NSCVKLQTVHSIPLTINKEEALQRP
NSCVKLQTVHSIPLTILKIEASQRP

SEQ ID NO: 41628 - protein, 25 aa, synthetic construct
  source 1..25: note = Seed: NSCVKLQTVHSIPLTINKEEALQRP
NSCVKLQTVHSIPLTILKIEATQRP

SEQ ID NO: 41629 - protein, 25 aa, synthetic construct
  source 1..25: note = Seed: NSCVKLQTVHSIPLTINKEEALQRP
NSCVKLQTVHSIPLTILKIEAVQRP

SEQ ID NO: 41630 - protein, 25 aa, synthetic construct
  source 1..25: note = Seed: NSCVKLQTVHSIPLTINKEEALQRP
NSCVKLQTVHSIPLTILKIEAYQRP

SEQ ID NO: 41631 - protein, 25 aa, synthetic construct
  source 1..25: note = Seed: NSCVKLQTVHSIPLTINKEEALQRP
NSCVKLQTVHSIPLTILKKEAIQRP

SEQ ID NO: 41632 - protein, 25 aa, synthetic construct
  source 1..25: note = Seed: NSCVKLQTVHSIPLTINKEEALQRP
NSCVKLQTVHSIPLTILKKEALQRP

SEQ ID NO: 41633 - protein, 25 aa, synthetic construct
  source 1..25: note = Seed: NSCVKLQTVHSIPLTINKEEALQRP
NSCVKLQTVHSIPLTILKLEAAQRP

SEQ ID NO: 41634 - protein, 25 aa, synthetic construct
  source 1..25: note = Seed: NSCVKLQTVHSIPLTINKEEALQRP
NSCVKLQTVHSIPLTILKLEADQRP

SEQ ID NO: 41635 - protein, 25 aa, synthetic construct
  source 1..25: note = Seed: NSCVKLQTVHSIPLTINKEEALQRP
NSCVKLQTVHSIPLTILKLEAEQRP

SEQ ID NO: 41636 - protein, 25 aa, synthetic construct
  source 1..25: note = Seed: NSCVKLQTVHSIPLTINKEEALQRP
NSCVKLQTVHSIPLTILKLEAFQRP

SEQ ID NO: 41637 - protein, 25 aa, synthetic construct
  source 1..25: note = Seed: NSCVKLQTVHSIPLTINKEEALQRP
NSCVKLQTVHSIPLTILKLEAHQRP

SEQ ID NO: 41638 - protein, 25 aa, synthetic construct
  source 1..25: note = Seed: NSCVKLQTVHSIPLTINKEEALQRP
NSCVKLQTVHSIPLTILKLEAIQRP

SEQ ID NO: 41639 - protein, 25 aa, synthetic construct
  source 1..25: note = Seed: NSCVKLQTVHSIPLTINKEEALQRP
NSCVKLQTVHSIPLTILKLEALQRP

SEQ ID NO: 41640 - protein, 25 aa, synthetic construct
  source 1..25: note = Seed: NSCVKLQTVHSIPLTINKEEALQRP
NSCVKLQTVHSIPLTILKLEAMQRP

SEQ ID NO: 41641 - protein, 25 aa, synthetic construct
  source 1..25: note = Seed: NSCVKLQTVHSIPLTINKEEALQRP
NSCVKLQTVHSIPLTILKLEANQRP

SEQ ID NO: 41642 - protein, 25 aa, synthetic construct
  source 1..25: note = Seed: NSCVKLQTVHSIPLTINKEEALQRP
NSCVKLQTVHSIPLTILKLEAQQRP

SEQ ID NO: 41643 - protein, 25 aa, synthetic construct
  source 1..25: note = Seed: NSCVKLQTVHSIPLTINKEEALQRP
NSCVKLQTVHSIPLTILKLEARQRP

SEQ ID NO: 41644 - protein, 25 aa, synthetic construct
  source 1..25: note = Seed: NSCVKLQTVHSIPLTINKEEALQRP
NSCVKLQTVHSIPLTILKLEASQRP

SEQ ID NO: 41645 - protein, 25 aa, synthetic construct
  source 1..25: note = Seed: NSCVKLQTVHSIPLTINKEEALQRP
NSCVKLQTVHSIPLTILKLEATQRP

SEQ ID NO: 41646 - protein, 25 aa, synthetic construct
  source 1..25: note = Seed: NSCVKLQTVHSIPLTINKEEALQRP
NSCVKLQTVHSIPLTILKLEAVQRP

SEQ ID NO: 41647 - protein, 25 aa, synthetic construct
  source 1..25: note = Seed: NSCVKLQTVHSIPLTINKEEALQRP
NSCVKLQTVHSIPLTILKLEAYQRP

SEQ ID NO: 41648 - protein, 25 aa, synthetic construct
  source 1..25: note = Seed: NSCVKLQTVHSIPLTINKEEALQRP
NSCVKLQTVHSIPLTILKMEAAQRP

SEQ ID NO: 41649 - protein, 25 aa, synthetic construct
  source 1..25: note = Seed: NSCVKLQTVHSIPLTINKEEALQRP
NSCVKLQTVHSIPLTILKMEAFQRP

SEQ ID NO: 41650 - protein, 25 aa, synthetic construct
  source 1..25: note = Seed: NSCVKLQTVHSIPLTINKEEALQRP
NSCVKLQTVHSIPLTILKMEAIQRP

SEQ ID NO: 41651 - protein, 25 aa, synthetic construct
  source 1..25: note = Seed: NSCVKLQTVHSIPLTINKEEALQRP
NSCVKLQTVHSIPLTILKMEALQRP

SEQ ID NO: 41652 - protein, 25 aa, synthetic construct
  source 1..25: note = Seed: NSCVKLQTVHSIPLTINKEEALQRP
NSCVKLQTVHSIPLTILKMEAMQRP

SEQ ID NO: 41653 - protein, 25 aa, synthetic construct
  source 1..25: note = Seed: NSCVKLQTVHSIPLTINKEEALQRP
NSCVKLQTVHSIPLTILKMEAVQRP

SEQ ID NO: 41654 - protein, 25 aa, synthetic construct
  source 1..25: note = Seed: NSCVKLQTVHSIPLTINKEEALQRP
NSCVKLQTVHSIPLTILKMEAYQRP

SEQ ID NO: 41655 - protein, 25 aa, synthetic construct
  source 1..25: note = Seed: NSCVKLQTVHSIPLTINKEEALQRP
NSCVKLQTVHSIPLTILKNEAAQRP

SEQ ID NO: 41656 - protein, 25 aa, synthetic construct
  source 1..25: note = Seed: NSCVKLQTVHSIPLTINKEEALQRP
NSCVKLQTVHSIPLTILKNEAIQRP

SEQ ID NO: 41657 - protein, 25 aa, synthetic construct
  source 1..25: note = Seed: NSCVKLQTVHSIPLTINKEEALQRP
NSCVKLQTVHSIPLTILKNEALQRP

SEQ ID NO: 41658 - protein, 25 aa, synthetic construct
  source 1..25: note = Seed: NSCVKLQTVHSIPLTINKEEALQRP
NSCVKLQTVHSIPLTILKNEAVQRP

SEQ ID NO: 41659 - protein, 25 aa, synthetic construct
  source 1..25: note = Seed: NSCVKLQTVHSIPLTINKEEALQRP
NSCVKLQTVHSIPLTILKPEAIQRP

SEQ ID NO: 41660 - protein, 25 aa, synthetic construct
  source 1..25: note = Seed: NSCVKLQTVHSIPLTINKEEALQRP
NSCVKLQTVHSIPLTILKPEAVQRP

SEQ ID NO: 41661 - protein, 25 aa, synthetic construct
  source 1..25: note = Seed: NSCVKLQTVHSIPLTINKEEALQRP
NSCVKLQTVHSIPLTILKREAFQRP

SEQ ID NO: 41662 - protein, 25 aa, synthetic construct
  source 1..25: note = Seed: NSCVKLQTVHSIPLTINKEEALQRP
NSCVKLQTVHSIPLTILKREAIQRP

SEQ ID NO: 41663 - protein, 25 aa, synthetic construct
  source 1..25: note = Seed: NSCVKLQTVHSIPLTINKEEALQRP
NSCVKLQTVHSIPLTILKREALQRP

SEQ ID NO: 41664 - protein, 25 aa, synthetic construct
  source 1..25: note = Seed: NSCVKLQTVHSIPLTINKEEALQRP
NSCVKLQTVHSIPLTILKREAMQRP

SEQ ID NO: 41665 - protein, 25 aa, synthetic construct
  source 1..25: note = Seed: NSCVKLQTVHSIPLTINKEEALQRP
NSCVKLQTVHSIPLTILKREARQRP

SEQ ID NO: 41666 - protein, 25 aa, synthetic construct
  source 1..25: note = Seed: NSCVKLQTVHSIPLTINKEEALQRP
NSCVKLQTVHSIPLTILKREAVQRP

SEQ ID NO: 41667 - protein, 25 aa, synthetic construct
  source 1..25: note = Seed: NSCVKLQTVHSIPLTINKEEALQRP
NSCVKLQTVHSIPLTILKREAYQRP

SEQ ID NO: 41668 - protein, 25 aa, synthetic construct
  source 1..25: note = Seed: NSCVKLQTVHSIPLTINKEEALQRP
NSCVKLQTVHSIPLTILKSEAAQRP

SEQ ID NO: 41669 - protein, 25 aa, synthetic construct
  source 1..25: note = Seed: NSCVKLQTVHSIPLTINKEEALQRP
NSCVKLQTVHSIPLTILKSEAFQRP

SEQ ID NO: 41670 - protein, 25 aa, synthetic construct
  source 1..25: note = Seed: NSCVKLQTVHSIPLTINKEEALQRP
NSCVKLQTVHSIPLTILKSEAIQRP

SEQ ID NO: 41671 - protein, 25 aa, synthetic construct
  source 1..25: note = Seed: NSCVKLQTVHSIPLTINKEEALQRP
NSCVKLQTVHSIPLTILKSEALQRP

SEQ ID NO: 41672 - protein, 25 aa, synthetic construct
  source 1..25: note = Seed: NSCVKLQTVHSIPLTINKEEALQRP
NSCVKLQTVHSIPLTILKSEAVQRP

SEQ ID NO: 41673 - protein, 25 aa, synthetic construct
  source 1..25: note = Seed: NSCVKLQTVHSIPLTINKEEALQRP
NSCVKLQTVHSIPLTILKSEAYQRP

SEQ ID NO: 41674 - protein, 25 aa, synthetic construct
  source 1..25: note = Seed: NSCVKLQTVHSIPLTINKEEALQRP
NSCVKLQTVHSIPLTILKTEAIQRP

SEQ ID NO: 41675 - protein, 25 aa, synthetic construct
  source 1..25: note = Seed: NSCVKLQTVHSIPLTINKEEALQRP
NSCVKLQTVHSIPLTILKTEAVQRP

SEQ ID NO: 41676 - protein, 25 aa, synthetic construct
  source 1..25: note = Seed: NSCVKLQTVHSIPLTINKEEALQRP
NSCVKLQTVHSIPLTILKVEAAQRP

SEQ ID NO: 41677 - protein, 25 aa, synthetic construct
  source 1..25: note = Seed: NSCVKLQTVHSIPLTINKEEALQRP
NSCVKLQTVHSIPLTILKVEAFQRP

SEQ ID NO: 41678 - protein, 25 aa, synthetic construct
  source 1..25: note = Seed: NSCVKLQTVHSIPLTINKEEALQRP
NSCVKLQTVHSIPLTILKVEAIQRP

SEQ ID NO: 41679 - protein, 25 aa, synthetic construct
  source 1..25: note = Seed: NSCVKLQTVHSIPLTINKEEALQRP
NSCVKLQTVHSIPLTILKVEALQRP

SEQ ID NO: 41680 - protein, 25 aa, synthetic construct
  source 1..25: note = Seed: NSCVKLQTVHSIPLTINKEEALQRP
NSCVKLQTVHSIPLTILKVEAMQRP

SEQ ID NO: 41681 - protein, 25 aa, synthetic construct
  source 1..25: note = Seed: NSCVKLQTVHSIPLTINKEEALQRP
NSCVKLQTVHSIPLTILKVEASQRP

SEQ ID NO: 41682 - protein, 25 aa, synthetic construct
  source 1..25: note = Seed: NSCVKLQTVHSIPLTINKEEALQRP
NSCVKLQTVHSIPLTILKVEATQRP

SEQ ID NO: 41683 - protein, 25 aa, synthetic construct
  source 1..25: note = Seed: NSCVKLQTVHSIPLTINKEEALQRP
NSCVKLQTVHSIPLTILKVEAVQRP

SEQ ID NO: 41684 - protein, 25 aa, synthetic construct
  source 1..25: note = Seed: NSCVKLQTVHSIPLTINKEEALQRP
NSCVKLQTVHSIPLTILKVEAYQRP

SEQ ID NO: 41685 - protein, 25 aa, synthetic construct
  source 1..25: note = Seed: NSCVKLQTVHSIPLTINKEEALQRP
NSCVKLQTVHSIPLTILKWEAAQRP

SEQ ID NO: 41686 - protein, 25 aa, synthetic construct
  source 1..25: note = Seed: NSCVKLQTVHSIPLTINKEEALQRP
NSCVKLQTVHSIPLTILKWEAEQRP

SEQ ID NO: 41687 - protein, 25 aa, synthetic construct
  source 1..25: note = Seed: NSCVKLQTVHSIPLTINKEEALQRP
NSCVKLQTVHSIPLTILKWEAFQRP

SEQ ID NO: 41688 - protein, 25 aa, synthetic construct
  source 1..25: note = Seed: NSCVKLQTVHSIPLTINKEEALQRP
NSCVKLQTVHSIPLTILKWEAIQRP

SEQ ID NO: 41689 - protein, 25 aa, synthetic construct
  source 1..25: note = Seed: NSCVKLQTVHSIPLTINKEEALQRP
NSCVKLQTVHSIPLTILKWEALQRP

SEQ ID NO: 41690 - protein, 25 aa, synthetic construct
  source 1..25: note = Seed: NSCVKLQTVHSIPLTINKEEALQRP
NSCVKLQTVHSIPLTILKWEAMQRP

SEQ ID NO: 41691 - protein, 25 aa, synthetic construct
  source 1..25: note = Seed: NSCVKLQTVHSIPLTINKEEALQRP
NSCVKLQTVHSIPLTILKWEAVQRP

SEQ ID NO: 41692 - protein, 25 aa, synthetic construct
  source 1..25: note = Seed: NSCVKLQTVHSIPLTINKEEALQRP
NSCVKLQTVHSIPLTILKWEAYQRP

SEQ ID NO: 41693 - protein, 25 aa, synthetic construct
  source 1..25: note = Seed: NSCVKLQTVHSIPLTINKEEALQRP
NSCVKLQTVHSIPLTILKYEAAQRP

SEQ ID NO: 41694 - protein, 25 aa, synthetic construct
  source 1..25: note = Seed: NSCVKLQTVHSIPLTINKEEALQRP
NSCVKLQTVHSIPLTILKYEACQRP

SEQ ID NO: 41695 - protein, 25 aa, synthetic construct
  source 1..25: note = Seed: NSCVKLQTVHSIPLTINKEEALQRP
NSCVKLQTVHSIPLTILKYEADQRP

SEQ ID NO: 41696 - protein, 25 aa, synthetic construct
  source 1..25: note = Seed: NSCVKLQTVHSIPLTINKEEALQRP
NSCVKLQTVHSIPLTILKYEAEQRP

SEQ ID NO: 41697 - protein, 25 aa, synthetic construct
  source 1..25: note = Seed: NSCVKLQTVHSIPLTINKEEALQRP
NSCVKLQTVHSIPLTILKYEAFQRP

SEQ ID NO: 41698 - protein, 25 aa, synthetic construct
  source 1..25: note = Seed: NSCVKLQTVHSIPLTINKEEALQRP
NSCVKLQTVHSIPLTILKYEAHQRP

SEQ ID NO: 41699 - protein, 25 aa, synthetic construct
  source 1..25: note = Seed: NSCVKLQTVHSIPLTINKEEALQRP
NSCVKLQTVHSIPLTILKYEAIQRP

SEQ ID NO: 41700 - protein, 25 aa, synthetic construct
  source 1..25: note = Seed: NSCVKLQTVHSIPLTINKEEALQRP
NSCVKLQTVHSIPLTILKYEALQRP

SEQ ID NO: 41701 - protein, 25 aa, synthetic construct
  source 1..25: note = Seed: NSCVKLQTVHSIPLTINKEEALQRP
NSCVKLQTVHSIPLTILKYEAMQRP

SEQ ID NO: 41702 - protein, 25 aa, synthetic construct
  source 1..25: note = Seed: NSCVKLQTVHSIPLTINKEEALQRP
NSCVKLQTVHSIPLTILKYEANQRP

SEQ ID NO: 41703 - protein, 25 aa, synthetic construct
  source 1..25: note = Seed: NSCVKLQTVHSIPLTINKEEALQRP
NSCVKLQTVHSIPLTILKYEAPQRP

SEQ ID NO: 41704 - protein, 25 aa, synthetic construct
  source 1..25: note = Seed: NSCVKLQTVHSIPLTINKEEALQRP
NSCVKLQTVHSIPLTILKYEAQQRP

SEQ ID NO: 41705 - protein, 25 aa, synthetic construct
  source 1..25: note = Seed: NSCVKLQTVHSIPLTINKEEALQRP
NSCVKLQTVHSIPLTILKYEARQRP

SEQ ID NO: 41706 - protein, 25 aa, synthetic construct
  source 1..25: note = Seed: NSCVKLQTVHSIPLTINKEEALQRP
NSCVKLQTVHSIPLTILKYEASQRP

SEQ ID NO: 41707 - protein, 25 aa, synthetic construct
  source 1..25: note = Seed: NSCVKLQTVHSIPLTINKEEALQRP
NSCVKLQTVHSIPLTILKYEATQRP

SEQ ID NO: 41708 - protein, 25 aa, synthetic construct
  source 1..25: note = Seed: NSCVKLQTVHSIPLTINKEEALQRP
NSCVKLQTVHSIPLTILKYEAVQRP

SEQ ID NO: 41709 - protein, 25 aa, synthetic construct
  source 1..25: note = Seed: NSCVKLQTVHSIPLTINKEEALQRP
NSCVKLQTVHSIPLTILKYEAYQRP

SEQ ID NO: 41710 - protein, 25 aa, synthetic construct
  source 1..25: note = Seed: NSCVKLQTVHSIPLTINKEEALQRP
NSCVKLQTVHSIPLTIMKAEAAQRP

SEQ ID NO: 41711 - protein, 25 aa, synthetic construct
  source 1..25: note = Seed: NSCVKLQTVHSIPLTINKEEALQRP
NSCVKLQTVHSIPLTIMKAEAFQRP

SEQ ID NO: 41712 - protein, 25 aa, synthetic construct
  source 1..25: note = Seed: NSCVKLQTVHSIPLTINKEEALQRP
NSCVKLQTVHSIPLTIMKAEAIQRP

SEQ ID NO: 41713 - protein, 25 aa, synthetic construct
  source 1..25: note = Seed: NSCVKLQTVHSIPLTINKEEALQRP
NSCVKLQTVHSIPLTIMKAEALQRP

SEQ ID NO: 41714 - protein, 25 aa, synthetic construct
  source 1..25: note = Seed: NSCVKLQTVHSIPLTINKEEALQRP
NSCVKLQTVHSIPLTIMKAEAMQRP

SEQ ID NO: 41715 - protein, 25 aa, synthetic construct
  source 1..25: note = Seed: NSCVKLQTVHSIPLTINKEEALQRP
NSCVKLQTVHSIPLTIMKAEASQRP

SEQ ID NO: 41716 - protein, 25 aa, synthetic construct
  source 1..25: note = Seed: NSCVKLQTVHSIPLTINKEEALQRP
NSCVKLQTVHSIPLTIMKAEATQRP

SEQ ID NO: 41717 - protein, 25 aa, synthetic construct
  source 1..25: note = Seed: NSCVKLQTVHSIPLTINKEEALQRP
NSCVKLQTVHSIPLTIMKAEAVQRP

SEQ ID NO: 41718 - protein, 25 aa, synthetic construct
  source 1..25: note = Seed: NSCVKLQTVHSIPLTINKEEALQRP
NSCVKLQTVHSIPLTIMKAEAYQRP

SEQ ID NO: 41719 - protein, 25 aa, synthetic construct
  source 1..25: note = Seed: NSCVKLQTVHSIPLTINKEEALQRP
NSCVKLQTVHSIPLTIMKDEAAQRP

SEQ ID NO: 41720 - protein, 25 aa, synthetic construct
  source 1..25: note = Seed: NSCVKLQTVHSIPLTINKEEALQRP
NSCVKLQTVHSIPLTIMKDEAFQRP

SEQ ID NO: 41721 - protein, 25 aa, synthetic construct
  source 1..25: note = Seed: NSCVKLQTVHSIPLTINKEEALQRP
NSCVKLQTVHSIPLTIMKDEAIQRP

SEQ ID NO: 41722 - protein, 25 aa, synthetic construct
  source 1..25: note = Seed: NSCVKLQTVHSIPLTINKEEALQRP
NSCVKLQTVHSIPLTIMKDEALQRP

SEQ ID NO: 41723 - protein, 25 aa, synthetic construct
  source 1..25: note = Seed: NSCVKLQTVHSIPLTINKEEALQRP
NSCVKLQTVHSIPLTIMKDEAMQRP

SEQ ID NO: 41724 - protein, 25 aa, synthetic construct
  source 1..25: note = Seed: NSCVKLQTVHSIPLTINKEEALQRP
NSCVKLQTVHSIPLTIMKDEASQRP

SEQ ID NO: 41725 - protein, 25 aa, synthetic construct
  source 1..25: note = Seed: NSCVKLQTVHSIPLTINKEEALQRP
NSCVKLQTVHSIPLTIMKDEAVQRP

SEQ ID NO: 41726 - protein, 25 aa, synthetic construct
  source 1..25: note = Seed: NSCVKLQTVHSIPLTINKEEALQRP
NSCVKLQTVHSIPLTIMKDEAYQRP

SEQ ID NO: 41727 - protein, 25 aa, synthetic construct
  source 1..25: note = Seed: NSCVKLQTVHSIPLTINKEEALQRP
NSCVKLQTVHSIPLTIMKFEAAQRP

SEQ ID NO: 41728 - protein, 25 aa, synthetic construct
  source 1..25: note = Seed: NSCVKLQTVHSIPLTINKEEALQRP
NSCVKLQTVHSIPLTIMKFEADQRP

SEQ ID NO: 41729 - protein, 25 aa, synthetic construct
  source 1..25: note = Seed: NSCVKLQTVHSIPLTINKEEALQRP
NSCVKLQTVHSIPLTIMKFEAEQRP

SEQ ID NO: 41730 - protein, 25 aa, synthetic construct
  source 1..25: note = Seed: NSCVKLQTVHSIPLTINKEEALQRP
NSCVKLQTVHSIPLTIMKFEAFQRP

SEQ ID NO: 41731 - protein, 25 aa, synthetic construct
  source 1..25: note = Seed: NSCVKLQTVHSIPLTINKEEALQRP
NSCVKLQTVHSIPLTIMKFEAHQRP

SEQ ID NO: 41732 - protein, 25 aa, synthetic construct
  source 1..25: note = Seed: NSCVKLQTVHSIPLTINKEEALQRP
NSCVKLQTVHSIPLTIMKFEAIQRP

SEQ ID NO: 41733 - protein, 25 aa, synthetic construct
  source 1..25: note = Seed: NSCVKLQTVHSIPLTINKEEALQRP
NSCVKLQTVHSIPLTIMKFEALQRP

SEQ ID NO: 41734 - protein, 25 aa, synthetic construct
  source 1..25: note = Seed: NSCVKLQTVHSIPLTINKEEALQRP
NSCVKLQTVHSIPLTIMKFEAMQRP

SEQ ID NO: 41735 - protein, 25 aa, synthetic construct
  source 1..25: note = Seed: NSCVKLQTVHSIPLTINKEEALQRP
NSCVKLQTVHSIPLTIMKFEANQRP

SEQ ID NO: 41736 - protein, 25 aa, synthetic construct
  source 1..25: note = Seed: NSCVKLQTVHSIPLTINKEEALQRP
NSCVKLQTVHSIPLTIMKFEAPQRP

SEQ ID NO: 41737 - protein, 25 aa, synthetic construct
  source 1..25: note = Seed: NSCVKLQTVHSIPLTINKEEALQRP
NSCVKLQTVHSIPLTIMKFEAQQRP

SEQ ID NO: 41738 - protein, 25 aa, synthetic construct
  source 1..25: note = Seed: NSCVKLQTVHSIPLTINKEEALQRP
NSCVKLQTVHSIPLTIMKFEARQRP

SEQ ID NO: 41739 - protein, 25 aa, synthetic construct
  source 1..25: note = Seed: NSCVKLQTVHSIPLTINKEEALQRP
NSCVKLQTVHSIPLTIMKFEASQRP

SEQ ID NO: 41740 - protein, 25 aa, synthetic construct
  source 1..25: note = Seed: NSCVKLQTVHSIPLTINKEEALQRP
NSCVKLQTVHSIPLTIMKFEATQRP

SEQ ID NO: 41741 - protein, 25 aa, synthetic construct
  source 1..25: note = Seed: NSCVKLQTVHSIPLTINKEEALQRP
NSCVKLQTVHSIPLTIMKFEAVQRP

SEQ ID NO: 41742 - protein, 25 aa, synthetic construct
  source 1..25: note = Seed: NSCVKLQTVHSIPLTINKEEALQRP
NSCVKLQTVHSIPLTIMKFEAWQRP

SEQ ID NO: 41743 - protein, 25 aa, synthetic construct
  source 1..25: note = Seed: NSCVKLQTVHSIPLTINKEEALQRP
NSCVKLQTVHSIPLTIMKFEAYQRP

SEQ ID NO: 41744 - protein, 25 aa, synthetic construct
  source 1..25: note = Seed: NSCVKLQTVHSIPLTINKEEALQRP
NSCVKLQTVHSIPLTIMKGEAAQRP

SEQ ID NO: 41745 - protein, 25 aa, synthetic construct
  source 1..25: note = Seed: NSCVKLQTVHSIPLTINKEEALQRP
NSCVKLQTVHSIPLTIMKGEAIQRP

SEQ ID NO: 41746 - protein, 25 aa, synthetic construct
  source 1..25: note = Seed: NSCVKLQTVHSIPLTINKEEALQRP
NSCVKLQTVHSIPLTIMKGEALQRP

SEQ ID NO: 41747 - protein, 25 aa, synthetic construct
  source 1..25: note = Seed: NSCVKLQTVHSIPLTINKEEALQRP
NSCVKLQTVHSIPLTIMKGEAVQRP

SEQ ID NO: 41748 - protein, 25 aa, synthetic construct
  source 1..25: note = Seed: NSCVKLQTVHSIPLTINKEEALQRP
NSCVKLQTVHSIPLTIMKIEAAQRP

SEQ ID NO: 41749 - protein, 25 aa, synthetic construct
  source 1..25: note = Seed: NSCVKLQTVHSIPLTINKEEALQRP
NSCVKLQTVHSIPLTIMKIEACQRP

SEQ ID NO: 41750 - protein, 25 aa, synthetic construct
  source 1..25: note = Seed: NSCVKLQTVHSIPLTINKEEALQRP
NSCVKLQTVHSIPLTIMKIEADQRP

SEQ ID NO: 41751 - protein, 25 aa, synthetic construct
  source 1..25: note = Seed: NSCVKLQTVHSIPLTINKEEALQRP
NSCVKLQTVHSIPLTIMKIEAEQRP

SEQ ID NO: 41752 - protein, 25 aa, synthetic construct
  source 1..25: note = Seed: NSCVKLQTVHSIPLTINKEEALQRP
NSCVKLQTVHSIPLTIMKIEAFQRP

SEQ ID NO: 41753 - protein, 25 aa, synthetic construct
  source 1..25: note = Seed: NSCVKLQTVHSIPLTINKEEALQRP
NSCVKLQTVHSIPLTIMKIEAGQRP

SEQ ID NO: 41754 - protein, 25 aa, synthetic construct
  source 1..25: note = Seed: NSCVKLQTVHSIPLTINKEEALQRP
NSCVKLQTVHSIPLTIMKIEAIQRP

SEQ ID NO: 41755 - protein, 25 aa, synthetic construct
  source 1..25: note = Seed: NSCVKLQTVHSIPLTINKEEALQRP
NSCVKLQTVHSIPLTIMKIEALQRP

SEQ ID NO: 41756 - protein, 25 aa, synthetic construct
  source 1..25: note = Seed: NSCVKLQTVHSIPLTINKEEALQRP
NSCVKLQTVHSIPLTIMKIEAMQRP

SEQ ID NO: 41757 - protein, 25 aa, synthetic construct
  source 1..25: note = Seed: NSCVKLQTVHSIPLTINKEEALQRP
NSCVKLQTVHSIPLTIMKIEANQRP

SEQ ID NO: 41758 - protein, 25 aa, synthetic construct
  source 1..25: note = Seed: NSCVKLQTVHSIPLTINKEEALQRP
NSCVKLQTVHSIPLTIMKIEAQQRP

SEQ ID NO: 41759 - protein, 25 aa, synthetic construct
  source 1..25: note = Seed: NSCVKLQTVHSIPLTINKEEALQRP
NSCVKLQTVHSIPLTIMKIEASQRP

SEQ ID NO: 41760 - protein, 25 aa, synthetic construct
  source 1..25: note = Seed: NSCVKLQTVHSIPLTINKEEALQRP
NSCVKLQTVHSIPLTIMKIEATQRP

SEQ ID NO: 41761 - protein, 25 aa, synthetic construct
  source 1..25: note = Seed: NSCVKLQTVHSIPLTINKEEALQRP
NSCVKLQTVHSIPLTIMKIEAVQRP

SEQ ID NO: 41762 - protein, 25 aa, synthetic construct
  source 1..25: note = Seed: NSCVKLQTVHSIPLTINKEEALQRP
NSCVKLQTVHSIPLTIMKIEAYQRP

SEQ ID NO: 41763 - protein, 25 aa, synthetic construct
  source 1..25: note = Seed: NSCVKLQTVHSIPLTINKEEALQRP
NSCVKLQTVHSIPLTIMKKEAIQRP

SEQ ID NO: 41764 - protein, 25 aa, synthetic construct
  source 1..25: note = Seed: NSCVKLQTVHSIPLTINKEEALQRP
NSCVKLQTVHSIPLTIMKKEALQRP

SEQ ID NO: 41765 - protein, 25 aa, synthetic construct
  source 1..25: note = Seed: NSCVKLQTVHSIPLTINKEEALQRP
NSCVKLQTVHSIPLTIMKKEAVQRP

SEQ ID NO: 41766 - protein, 25 aa, synthetic construct
  source 1..25: note = Seed: NSCVKLQTVHSIPLTINKEEALQRP
NSCVKLQTVHSIPLTIMKKEAYQRP

SEQ ID NO: 41767 - protein, 25 aa, synthetic construct
  source 1..25: note = Seed: NSCVKLQTVHSIPLTINKEEALQRP
NSCVKLQTVHSIPLTIMKLEAAQRP

SEQ ID NO: 41768 - protein, 25 aa, synthetic construct
  source 1..25: note = Seed: NSCVKLQTVHSIPLTINKEEALQRP
NSCVKLQTVHSIPLTIMKLEADQRP

SEQ ID NO: 41769 - protein, 25 aa, synthetic construct
  source 1..25: note = Seed: NSCVKLQTVHSIPLTINKEEALQRP
NSCVKLQTVHSIPLTIMKLEAFQRP

SEQ ID NO: 41770 - protein, 25 aa, synthetic construct
  source 1..25: note = Seed: NSCVKLQTVHSIPLTINKEEALQRP
NSCVKLQTVHSIPLTIMKLEAIQRP

SEQ ID NO: 41771 - protein, 25 aa, synthetic construct
  source 1..25: note = Seed: NSCVKLQTVHSIPLTINKEEALQRP
NSCVKLQTVHSIPLTIMKLEALQRP

SEQ ID NO: 41772 - protein, 25 aa, synthetic construct
  source 1..25: note = Seed: NSCVKLQTVHSIPLTINKEEALQRP
NSCVKLQTVHSIPLTIMKLEAMQRP

SEQ ID NO: 41773 - protein, 25 aa, synthetic construct
  source 1..25: note = Seed: NSCVKLQTVHSIPLTINKEEALQRP
NSCVKLQTVHSIPLTIMKLEANQRP

SEQ ID NO: 41774 - protein, 25 aa, synthetic construct
  source 1..25: note = Seed: NSCVKLQTVHSIPLTINKEEALQRP
NSCVKLQTVHSIPLTIMKLEAQQRP

SEQ ID NO: 41775 - protein, 25 aa, synthetic construct
  source 1..25: note = Seed: NSCVKLQTVHSIPLTINKEEALQRP
NSCVKLQTVHSIPLTIMKLEASQRP

SEQ ID NO: 41776 - protein, 25 aa, synthetic construct
  source 1..25: note = Seed: NSCVKLQTVHSIPLTINKEEALQRP
NSCVKLQTVHSIPLTIMKLEATQRP

SEQ ID NO: 41777 - protein, 25 aa, synthetic construct
  source 1..25: note = Seed: NSCVKLQTVHSIPLTINKEEALQRP
NSCVKLQTVHSIPLTIMKLEAVQRP

SEQ ID NO: 41778 - protein, 25 aa, synthetic construct
  source 1..25: note = Seed: NSCVKLQTVHSIPLTINKEEALQRP
NSCVKLQTVHSIPLTIMKLEAYQRP

SEQ ID NO: 41779 - protein, 25 aa, synthetic construct
  source 1..25: note = Seed: NSCVKLQTVHSIPLTINKEEALQRP
NSCVKLQTVHSIPLTIMKMEAAQRP

SEQ ID NO: 41780 - protein, 25 aa, synthetic construct
  source 1..25: note = Seed: NSCVKLQTVHSIPLTINKEEALQRP
NSCVKLQTVHSIPLTIMKMEAFQRP

SEQ ID NO: 41781 - protein, 25 aa, synthetic construct
  source 1..25: note = Seed: NSCVKLQTVHSIPLTINKEEALQRP
NSCVKLQTVHSIPLTIMKMEAIQRP

SEQ ID NO: 41782 - protein, 25 aa, synthetic construct
  source 1..25: note = Seed: NSCVKLQTVHSIPLTINKEEALQRP
NSCVKLQTVHSIPLTIMKMEALQRP

SEQ ID NO: 41783 - protein, 25 aa, synthetic construct
  source 1..25: note = Seed: NSCVKLQTVHSIPLTINKEEALQRP
NSCVKLQTVHSIPLTIMKMEAMQRP

SEQ ID NO: 41784 - protein, 25 aa, synthetic construct
  source 1..25: note = Seed: NSCVKLQTVHSIPLTINKEEALQRP
NSCVKLQTVHSIPLTIMKMEASQRP

SEQ ID NO: 41785 - protein, 25 aa, synthetic construct
  source 1..25: note = Seed: NSCVKLQTVHSIPLTINKEEALQRP
NSCVKLQTVHSIPLTIMKMEATQRP

SEQ ID NO: 41786 - protein, 25 aa, synthetic construct
  source 1..25: note = Seed: NSCVKLQTVHSIPLTINKEEALQRP
NSCVKLQTVHSIPLTIMKMEAVQRP

SEQ ID NO: 41787 - protein, 25 aa, synthetic construct
  source 1..25: note = Seed: NSCVKLQTVHSIPLTINKEEALQRP
NSCVKLQTVHSIPLTIMKMEAYQRP

SEQ ID NO: 41788 - protein, 25 aa, synthetic construct
  source 1..25: note = Seed: NSCVKLQTVHSIPLTINKEEALQRP
NSCVKLQTVHSIPLTIMKNEAAQRP

SEQ ID NO: 41789 - protein, 25 aa, synthetic construct
  source 1..25: note = Seed: NSCVKLQTVHSIPLTINKEEALQRP
NSCVKLQTVHSIPLTIMKNEAFQRP

SEQ ID NO: 41790 - protein, 25 aa, synthetic construct
  source 1..25: note = Seed: NSCVKLQTVHSIPLTINKEEALQRP
NSCVKLQTVHSIPLTIMKNEAIQRP

SEQ ID NO: 41791 - protein, 25 aa, synthetic construct
  source 1..25: note = Seed: NSCVKLQTVHSIPLTINKEEALQRP
NSCVKLQTVHSIPLTIMKNEALQRP

SEQ ID NO: 41792 - protein, 25 aa, synthetic construct
  source 1..25: note = Seed: NSCVKLQTVHSIPLTINKEEALQRP
NSCVKLQTVHSIPLTIMKNEAMQRP

SEQ ID NO: 41793 - protein, 25 aa, synthetic construct
  source 1..25: note = Seed: NSCVKLQTVHSIPLTINKEEALQRP
NSCVKLQTVHSIPLTIMKNEASQRP

SEQ ID NO: 41794 - protein, 25 aa, synthetic construct
  source 1..25: note = Seed: NSCVKLQTVHSIPLTINKEEALQRP
NSCVKLQTVHSIPLTIMKNEAVQRP

SEQ ID NO: 41795 - protein, 25 aa, synthetic construct
  source 1..25: note = Seed: NSCVKLQTVHSIPLTINKEEALQRP
NSCVKLQTVHSIPLTIMKPEAIQRP

SEQ ID NO: 41796 - protein, 25 aa, synthetic construct
  source 1..25: note = Seed: NSCVKLQTVHSIPLTINKEEALQRP
NSCVKLQTVHSIPLTIMKPEALQRP

SEQ ID NO: 41797 - protein, 25 aa, synthetic construct
  source 1..25: note = Seed: NSCVKLQTVHSIPLTINKEEALQRP
NSCVKLQTVHSIPLTIMKPEAVQRP

SEQ ID NO: 41798 - protein, 25 aa, synthetic construct
  source 1..25: note = Seed: NSCVKLQTVHSIPLTINKEEALQRP
NSCVKLQTVHSIPLTIMKREAAQRP

SEQ ID NO: 41799 - protein, 25 aa, synthetic construct
  source 1..25: note = Seed: NSCVKLQTVHSIPLTINKEEALQRP
NSCVKLQTVHSIPLTIMKREAFQRP

SEQ ID NO: 41800 - protein, 25 aa, synthetic construct
  source 1..25: note = Seed: NSCVKLQTVHSIPLTINKEEALQRP
NSCVKLQTVHSIPLTIMKREAIQRP

SEQ ID NO: 41801 - protein, 25 aa, synthetic construct
  source 1..25: note = Seed: NSCVKLQTVHSIPLTINKEEALQRP
NSCVKLQTVHSIPLTIMKREALQRP

SEQ ID NO: 41802 - protein, 25 aa, synthetic construct
  source 1..25: note = Seed: NSCVKLQTVHSIPLTINKEEALQRP
NSCVKLQTVHSIPLTIMKREAMQRP

SEQ ID NO: 41803 - protein, 25 aa, synthetic construct
  source 1..25: note = Seed: NSCVKLQTVHSIPLTINKEEALQRP
NSCVKLQTVHSIPLTIMKREARQRP

SEQ ID NO: 41804 - protein, 25 aa, synthetic construct
  source 1..25: note = Seed: NSCVKLQTVHSIPLTINKEEALQRP
NSCVKLQTVHSIPLTIMKREAVQRP

SEQ ID NO: 41805 - protein, 25 aa, synthetic construct
  source 1..25: note = Seed: NSCVKLQTVHSIPLTINKEEALQRP
NSCVKLQTVHSIPLTIMKREAYQRP

SEQ ID NO: 41806 - protein, 25 aa, synthetic construct
  source 1..25: note = Seed: NSCVKLQTVHSIPLTINKEEALQRP
NSCVKLQTVHSIPLTIMKSEAAQRP

SEQ ID NO: 41807 - protein, 25 aa, synthetic construct
  source 1..25: note = Seed: NSCVKLQTVHSIPLTINKEEALQRP
NSCVKLQTVHSIPLTIMKSEAFQRP

SEQ ID NO: 41808 - protein, 25 aa, synthetic construct
  source 1..25: note = Seed: NSCVKLQTVHSIPLTINKEEALQRP
NSCVKLQTVHSIPLTIMKSEAIQRP

SEQ ID NO: 41809 - protein, 25 aa, synthetic construct
  source 1..25: note = Seed: NSCVKLQTVHSIPLTINKEEALQRP
NSCVKLQTVHSIPLTIMKSEALQRP

SEQ ID NO: 41810 - protein, 25 aa, synthetic construct
  source 1..25: note = Seed: NSCVKLQTVHSIPLTINKEEALQRP
NSCVKLQTVHSIPLTIMKSEAMQRP

SEQ ID NO: 41811 - protein, 25 aa, synthetic construct
  source 1..25: note = Seed: NSCVKLQTVHSIPLTINKEEALQRP
NSCVKLQTVHSIPLTIMKSEAVQRP

SEQ ID NO: 41812 - protein, 25 aa, synthetic construct
  source 1..25: note = Seed: NSCVKLQTVHSIPLTINKEEALQRP
NSCVKLQTVHSIPLTIMKTEAAQRP

SEQ ID NO: 41813 - protein, 25 aa, synthetic construct
  source 1..25: note = Seed: NSCVKLQTVHSIPLTINKEEALQRP
NSCVKLQTVHSIPLTIMKTEAFQRP

SEQ ID NO: 41814 - protein, 25 aa, synthetic construct
  source 1..25: note = Seed: NSCVKLQTVHSIPLTINKEEALQRP
NSCVKLQTVHSIPLTIMKTEAIQRP

SEQ ID NO: 41815 - protein, 25 aa, synthetic construct
  source 1..25: note = Seed: NSCVKLQTVHSIPLTINKEEALQRP
NSCVKLQTVHSIPLTIMKTEALQRP

SEQ ID NO: 41816 - protein, 25 aa, synthetic construct
  source 1..25: note = Seed: NSCVKLQTVHSIPLTINKEEALQRP
NSCVKLQTVHSIPLTIMKTEAMQRP

SEQ ID NO: 41817 - protein, 25 aa, synthetic construct
  source 1..25: note = Seed: NSCVKLQTVHSIPLTINKEEALQRP
NSCVKLQTVHSIPLTIMKTEAVQRP

SEQ ID NO: 41818 - protein, 25 aa, synthetic construct
  source 1..25: note = Seed: NSCVKLQTVHSIPLTINKEEALQRP
NSCVKLQTVHSIPLTIMKVEAAQRP

SEQ ID NO: 41819 - protein, 25 aa, synthetic construct
  source 1..25: note = Seed: NSCVKLQTVHSIPLTINKEEALQRP
NSCVKLQTVHSIPLTIMKVEADQRP

SEQ ID NO: 41820 - protein, 25 aa, synthetic construct
  source 1..25: note = Seed: NSCVKLQTVHSIPLTINKEEALQRP
NSCVKLQTVHSIPLTIMKVEAEQRP

SEQ ID NO: 41821 - protein, 25 aa, synthetic construct
  source 1..25: note = Seed: NSCVKLQTVHSIPLTINKEEALQRP
NSCVKLQTVHSIPLTIMKVEAFQRP

SEQ ID NO: 41822 - protein, 25 aa, synthetic construct
  source 1..25: note = Seed: NSCVKLQTVHSIPLTINKEEALQRP
NSCVKLQTVHSIPLTIMKVEAGQRP

SEQ ID NO: 41823 - protein, 25 aa, synthetic construct
  source 1..25: note = Seed: NSCVKLQTVHSIPLTINKEEALQRP
NSCVKLQTVHSIPLTIMKVEAIQRP

SEQ ID NO: 41824 - protein, 25 aa, synthetic construct
  source 1..25: note = Seed: NSCVKLQTVHSIPLTINKEEALQRP
NSCVKLQTVHSIPLTIMKVEALQRP

SEQ ID NO: 41825 - protein, 25 aa, synthetic construct
  source 1..25: note = Seed: NSCVKLQTVHSIPLTINKEEALQRP
NSCVKLQTVHSIPLTIMKVEAMQRP

SEQ ID NO: 41826 - protein, 25 aa, synthetic construct
  source 1..25: note = Seed: NSCVKLQTVHSIPLTINKEEALQRP
NSCVKLQTVHSIPLTIMKVEANQRP

SEQ ID NO: 41827 - protein, 25 aa, synthetic construct
  source 1..25: note = Seed: NSCVKLQTVHSIPLTINKEEALQRP
NSCVKLQTVHSIPLTIMKVEAQQRP

SEQ ID NO: 41828 - protein, 25 aa, synthetic construct
  source 1..25: note = Seed: NSCVKLQTVHSIPLTINKEEALQRP
NSCVKLQTVHSIPLTIMKVEASQRP

SEQ ID NO: 41829 - protein, 25 aa, synthetic construct
  source 1..25: note = Seed: NSCVKLQTVHSIPLTINKEEALQRP
NSCVKLQTVHSIPLTIMKVEATQRP

SEQ ID NO: 41830 - protein, 25 aa, synthetic construct
  source 1..25: note = Seed: NSCVKLQTVHSIPLTINKEEALQRP
NSCVKLQTVHSIPLTIMKVEAVQRP

SEQ ID NO: 41831 - protein, 25 aa, synthetic construct
  source 1..25: note = Seed: NSCVKLQTVHSIPLTINKEEALQRP
NSCVKLQTVHSIPLTIMKVEAYQRP

SEQ ID NO: 41832 - protein, 25 aa, synthetic construct
  source 1..25: note = Seed: NSCVKLQTVHSIPLTINKEEALQRP
NSCVKLQTVHSIPLTIMKWEAFQRP

SEQ ID NO: 41833 - protein, 25 aa, synthetic construct
  source 1..25: note = Seed: NSCVKLQTVHSIPLTINKEEALQRP
NSCVKLQTVHSIPLTIMKWEAIQRP

SEQ ID NO: 41834 - protein, 25 aa, synthetic construct
  source 1..25: note = Seed: NSCVKLQTVHSIPLTINKEEALQRP
NSCVKLQTVHSIPLTIMKWEALQRP

SEQ ID NO: 41835 - protein, 25 aa, synthetic construct
  source 1..25: note = Seed: NSCVKLQTVHSIPLTINKEEALQRP
NSCVKLQTVHSIPLTIMKWEAMQRP

SEQ ID NO: 41836 - protein, 25 aa, synthetic construct
  source 1..25: note = Seed: NSCVKLQTVHSIPLTINKEEALQRP
NSCVKLQTVHSIPLTIMKWEAVQRP

SEQ ID NO: 41837 - protein, 25 aa, synthetic construct
  source 1..25: note = Seed: NSCVKLQTVHSIPLTINKEEALQRP
NSCVKLQTVHSIPLTIMKWEAYQRP

SEQ ID NO: 41838 - protein, 25 aa, synthetic construct
  source 1..25: note = Seed: NSCVKLQTVHSIPLTINKEEALQRP
NSCVKLQTVHSIPLTIMKYEAFQRP

SEQ ID NO: 41839 - protein, 25 aa, synthetic construct
  source 1..25: note = Seed: NSCVKLQTVHSIPLTINKEEALQRP
NSCVKLQTVHSIPLTIMKYEAIQRP

SEQ ID NO: 41840 - protein, 25 aa, synthetic construct
  source 1..25: note = Seed: NSCVKLQTVHSIPLTINKEEALQRP
NSCVKLQTVHSIPLTIMKYEALQRP

SEQ ID NO: 41841 - protein, 25 aa, synthetic construct
  source 1..25: note = Seed: NSCVKLQTVHSIPLTINKEEALQRP
NSCVKLQTVHSIPLTIMKYEAMQRP

SEQ ID NO: 41842 - protein, 25 aa, synthetic construct
  source 1..25: note = Seed: NSCVKLQTVHSIPLTINKEEALQRP
NSCVKLQTVHSIPLTIMKYEAVQRP

SEQ ID NO: 41843 - protein, 25 aa, synthetic construct
  source 1..25: note = Seed: NSCVKLQTVHSIPLTINKEEALQRP
NSCVKLQTVHSIPLTIMKYEAYQRP

SEQ ID NO: 41844 - protein, 25 aa, synthetic construct
  source 1..25: note = Seed: NSCVKLQTVHSIPLTINKEEALQRP
NSCVKLQTVHSIPLTINKAEAAQRP

SEQ ID NO: 41845 - protein, 25 aa, synthetic construct
  source 1..25: note = Seed: NSCVKLQTVHSIPLTINKEEALQRP
NSCVKLQTVHSIPLTINKAEAFQRP

SEQ ID NO: 41846 - protein, 25 aa, synthetic construct
  source 1..25: note = Seed: NSCVKLQTVHSIPLTINKEEALQRP
NSCVKLQTVHSIPLTINKAEAIQRP

SEQ ID NO: 41847 - protein, 25 aa, synthetic construct
  source 1..25: note = Seed: NSCVKLQTVHSIPLTINKEEALQRP
NSCVKLQTVHSIPLTINKAEAMQRP

SEQ ID NO: 41848 - protein, 25 aa, synthetic construct
  source 1..25: note = Seed: NSCVKLQTVHSIPLTINKEEALQRP
NSCVKLQTVHSIPLTINKAEASQRP

SEQ ID NO: 41849 - protein, 25 aa, synthetic construct
  source 1..25: note = Seed: NSCVKLQTVHSIPLTINKEEALQRP
NSCVKLQTVHSIPLTINKAEATQRP

SEQ ID NO: 41850 - protein, 25 aa, synthetic construct
  source 1..25: note = Seed: NSCVKLQTVHSIPLTINKEEALQRP
NSCVKLQTVHSIPLTINKAEAVQRP

SEQ ID NO: 41851 - protein, 25 aa, synthetic construct
  source 1..25: note = Seed: NSCVKLQTVHSIPLTINKEEALQRP
NSCVKLQTVHSIPLTINKAEAWQRP

SEQ ID NO: 41852 - protein, 25 aa, synthetic construct
  source 1..25: note = Seed: NSCVKLQTVHSIPLTINKEEALQRP
NSCVKLQTVHSIPLTINKAEAYQRP

SEQ ID NO: 41853 - protein, 25 aa, synthetic construct
  source 1..25: note = Seed: NSCVKLQTVHSIPLTINKEEALQRP
NSCVKLQTVHSIPLTINKFEAAQRP

SEQ ID NO: 41854 - protein, 25 aa, synthetic construct
  source 1..25: note = Seed: NSCVKLQTVHSIPLTINKEEALQRP
NSCVKLQTVHSIPLTINKFEAFQRP

SEQ ID NO: 41855 - protein, 25 aa, synthetic construct
  source 1..25: note = Seed: NSCVKLQTVHSIPLTINKEEALQRP
NSCVKLQTVHSIPLTINKFEAIQRP

SEQ ID NO: 41856 - protein, 25 aa, synthetic construct
  source 1..25: note = Seed: NSCVKLQTVHSIPLTINKEEALQRP
NSCVKLQTVHSIPLTINKFEAMQRP

SEQ ID NO: 41857 - protein, 25 aa, synthetic construct
  source 1..25: note = Seed: NSCVKLQTVHSIPLTINKEEALQRP
NSCVKLQTVHSIPLTINKFEASQRP

SEQ ID NO: 41858 - protein, 25 aa, synthetic construct
  source 1..25: note = Seed: NSCVKLQTVHSIPLTINKEEALQRP
NSCVKLQTVHSIPLTINKFEATQRP

SEQ ID NO: 41859 - protein, 25 aa, synthetic construct
  source 1..25: note = Seed: NSCVKLQTVHSIPLTINKEEALQRP
NSCVKLQTVHSIPLTINKFEAVQRP

SEQ ID NO: 41860 - protein, 25 aa, synthetic construct
  source 1..25: note = Seed: NSCVKLQTVHSIPLTINKEEALQRP
NSCVKLQTVHSIPLTINKFEAYQRP

SEQ ID NO: 41861 - protein, 25 aa, synthetic construct
  source 1..25: note = Seed: NSCVKLQTVHSIPLTINKEEALQRP
NSCVKLQTVHSIPLTINKGEAAQRP

SEQ ID NO: 41862 - protein, 25 aa, synthetic construct
  source 1..25: note = Seed: NSCVKLQTVHSIPLTINKEEALQRP
NSCVKLQTVHSIPLTINKGEAFQRP

SEQ ID NO: 41863 - protein, 25 aa, synthetic construct
  source 1..25: note = Seed: NSCVKLQTVHSIPLTINKEEALQRP
NSCVKLQTVHSIPLTINKGEAIQRP

SEQ ID NO: 41864 - protein, 25 aa, synthetic construct
  source 1..25: note = Seed: NSCVKLQTVHSIPLTINKEEALQRP
NSCVKLQTVHSIPLTINKGEAMQRP

SEQ ID NO: 41865 - protein, 25 aa, synthetic construct
  source 1..25: note = Seed: NSCVKLQTVHSIPLTINKEEALQRP
NSCVKLQTVHSIPLTINKGEAVQRP

SEQ ID NO: 41866 - protein, 25 aa, synthetic construct
  source 1..25: note = Seed: NSCVKLQTVHSIPLTINKEEALQRP
NSCVKLQTVHSIPLTINKGEAYQRP

SEQ ID NO: 41867 - protein, 25 aa, synthetic construct
  source 1..25: note = Seed: NSCVKLQTVHSIPLTINKEEALQRP
NSCVKLQTVHSIPLTINKHEAIQRP

SEQ ID NO: 41868 - protein, 25 aa, synthetic construct
  source 1..25: note = Seed: NSCVKLQTVHSIPLTINKEEALQRP
NSCVKLQTVHSIPLTINKHEAVQRP

SEQ ID NO: 41869 - protein, 25 aa, synthetic construct
  source 1..25: note = Seed: NSCVKLQTVHSIPLTINKEEALQRP
NSCVKLQTVHSIPLTINKIEAAQRP

SEQ ID NO: 41870 - protein, 25 aa, synthetic construct
  source 1..25: note = Seed: NSCVKLQTVHSIPLTINKEEALQRP
NSCVKLQTVHSIPLTINKIEAFQRP

SEQ ID NO: 41871 - protein, 25 aa, synthetic construct
  source 1..25: note = Seed: NSCVKLQTVHSIPLTINKEEALQRP
NSCVKLQTVHSIPLTINKIEAIQRP

SEQ ID NO: 41872 - protein, 25 aa, synthetic construct
  source 1..25: note = Seed: NSCVKLQTVHSIPLTINKEEALQRP
NSCVKLQTVHSIPLTINKIEAMQRP

SEQ ID NO: 41873 - protein, 25 aa, synthetic construct
  source 1..25: note = Seed: NSCVKLQTVHSIPLTINKEEALQRP
NSCVKLQTVHSIPLTINKIEATQRP

SEQ ID NO: 41874 - protein, 25 aa, synthetic construct
  source 1..25: note = Seed: NSCVKLQTVHSIPLTINKEEALQRP
NSCVKLQTVHSIPLTINKIEAVQRP

SEQ ID NO: 41875 - protein, 25 aa, synthetic construct
  source 1..25: note = Seed: NSCVKLQTVHSIPLTINKEEALQRP
NSCVKLQTVHSIPLTINKIEAYQRP

SEQ ID NO: 41876 - protein, 25 aa, synthetic construct
  source 1..25: note = Seed: NSCVKLQTVHSIPLTINKEEALQRP
NSCVKLQTVHSIPLTINKLEAFQRP

SEQ ID NO: 41877 - protein, 25 aa, synthetic construct
  source 1..25: note = Seed: NSCVKLQTVHSIPLTINKEEALQRP
NSCVKLQTVHSIPLTINKLEAIQRP

SEQ ID NO: 41878 - protein, 25 aa, synthetic construct
  source 1..25: note = Seed: NSCVKLQTVHSIPLTINKEEALQRP
NSCVKLQTVHSIPLTINKLEAVQRP

SEQ ID NO: 41879 - protein, 25 aa, synthetic construct
  source 1..25: note = Seed: NSCVKLQTVHSIPLTINKEEALQRP
NSCVKLQTVHSIPLTINKLEAYQRP

SEQ ID NO: 41880 - protein, 25 aa, synthetic construct
  source 1..25: note = Seed: NSCVKLQTVHSIPLTINKEEALQRP
NSCVKLQTVHSIPLTINKMEAFQRP

SEQ ID NO: 41881 - protein, 25 aa, synthetic construct
  source 1..25: note = Seed: NSCVKLQTVHSIPLTINKEEALQRP
NSCVKLQTVHSIPLTINKMEAIQRP

SEQ ID NO: 41882 - protein, 25 aa, synthetic construct
  source 1..25: note = Seed: NSCVKLQTVHSIPLTINKEEALQRP
NSCVKLQTVHSIPLTINKMEAVQRP

SEQ ID NO: 41883 - protein, 25 aa, synthetic construct
  source 1..25: note = Seed: NSCVKLQTVHSIPLTINKEEALQRP
NSCVKLQTVHSIPLTINKMEAYQRP

SEQ ID NO: 41884 - protein, 25 aa, synthetic construct
  source 1..25: note = Seed: NSCVKLQTVHSIPLTINKEEALQRP
NSCVKLQTVHSIPLTINKNEAAQRP

SEQ ID NO: 41885 - protein, 25 aa, synthetic construct
  source 1..25: note = Seed: NSCVKLQTVHSIPLTINKEEALQRP
NSCVKLQTVHSIPLTINKNEAFQRP

SEQ ID NO: 41886 - protein, 25 aa, synthetic construct
  source 1..25: note = Seed: NSCVKLQTVHSIPLTINKEEALQRP
NSCVKLQTVHSIPLTINKNEAIQRP

SEQ ID NO: 41887 - protein, 25 aa, synthetic construct
  source 1..25: note = Seed: NSCVKLQTVHSIPLTINKEEALQRP
NSCVKLQTVHSIPLTINKNEAMQRP

SEQ ID NO: 41888 - protein, 25 aa, synthetic construct
  source 1..25: note = Seed: NSCVKLQTVHSIPLTINKEEALQRP
NSCVKLQTVHSIPLTINKNEASQRP

SEQ ID NO: 41889 - protein, 25 aa, synthetic construct
  source 1..25: note = Seed: NSCVKLQTVHSIPLTINKEEALQRP
NSCVKLQTVHSIPLTINKNEATQRP

SEQ ID NO: 41890 - protein, 25 aa, synthetic construct
  source 1..25: note = Seed: NSCVKLQTVHSIPLTINKEEALQRP
NSCVKLQTVHSIPLTINKNEAVQRP

SEQ ID NO: 41891 - protein, 25 aa, synthetic construct
  source 1..25: note = Seed: NSCVKLQTVHSIPLTINKEEALQRP
NSCVKLQTVHSIPLTINKNEAWQRP

SEQ ID NO: 41892 - protein, 25 aa, synthetic construct
  source 1..25: note = Seed: NSCVKLQTVHSIPLTINKEEALQRP
NSCVKLQTVHSIPLTINKNEAYQRP

SEQ ID NO: 41893 - protein, 25 aa, synthetic construct
  source 1..25: note = Seed: NSCVKLQTVHSIPLTINKEEALQRP
NSCVKLQTVHSIPLTINKPEAAQRP

SEQ ID NO: 41894 - protein, 25 aa, synthetic construct
  source 1..25: note = Seed: NSCVKLQTVHSIPLTINKEEALQRP
NSCVKLQTVHSIPLTINKPEAFQRP

SEQ ID NO: 41895 - protein, 25 aa, synthetic construct
  source 1..25: note = Seed: NSCVKLQTVHSIPLTINKEEALQRP
NSCVKLQTVHSIPLTINKPEAIQRP

SEQ ID NO: 41896 - protein, 25 aa, synthetic construct
  source 1..25: note = Seed: NSCVKLQTVHSIPLTINKEEALQRP
NSCVKLQTVHSIPLTINKPEAMQRP

SEQ ID NO: 41897 - protein, 25 aa, synthetic construct
  source 1..25: note = Seed: NSCVKLQTVHSIPLTINKEEALQRP
NSCVKLQTVHSIPLTINKPEAVQRP

SEQ ID NO: 41898 - protein, 25 aa, synthetic construct
  source 1..25: note = Seed: NSCVKLQTVHSIPLTINKEEALQRP
NSCVKLQTVHSIPLTINKPEAYQRP

SEQ ID NO: 41899 - protein, 25 aa, synthetic construct
  source 1..25: note = Seed: NSCVKLQTVHSIPLTINKEEALQRP
NSCVKLQTVHSIPLTINKSEAAQRP

SEQ ID NO: 41900 - protein, 25 aa, synthetic construct
  source 1..25: note = Seed: NSCVKLQTVHSIPLTINKEEALQRP
NSCVKLQTVHSIPLTINKSEAFQRP

SEQ ID NO: 41901 - protein, 25 aa, synthetic construct
  source 1..25: note = Seed: NSCVKLQTVHSIPLTINKEEALQRP
NSCVKLQTVHSIPLTINKSEAIQRP

SEQ ID NO: 41902 - protein, 25 aa, synthetic construct
  source 1..25: note = Seed: NSCVKLQTVHSIPLTINKEEALQRP
NSCVKLQTVHSIPLTINKSEAMQRP

SEQ ID NO: 41903 - protein, 25 aa, synthetic construct
  source 1..25: note = Seed: NSCVKLQTVHSIPLTINKEEALQRP
NSCVKLQTVHSIPLTINKSEASQRP

SEQ ID NO: 41904 - protein, 25 aa, synthetic construct
  source 1..25: note = Seed: NSCVKLQTVHSIPLTINKEEALQRP
NSCVKLQTVHSIPLTINKSEATQRP

SEQ ID NO: 41905 - protein, 25 aa, synthetic construct
  source 1..25: note = Seed: NSCVKLQTVHSIPLTINKEEALQRP
NSCVKLQTVHSIPLTINKSEAVQRP

SEQ ID NO: 41906 - protein, 25 aa, synthetic construct
  source 1..25: note = Seed: NSCVKLQTVHSIPLTINKEEALQRP
NSCVKLQTVHSIPLTINKSEAWQRP

SEQ ID NO: 41907 - protein, 25 aa, synthetic construct
  source 1..25: note = Seed: NSCVKLQTVHSIPLTINKEEALQRP
NSCVKLQTVHSIPLTINKSEAYQRP

SEQ ID NO: 41908 - protein, 25 aa, synthetic construct
  source 1..25: note = Seed: NSCVKLQTVHSIPLTINKEEALQRP
NSCVKLQTVHSIPLTINKTEAAQRP

SEQ ID NO: 41909 - protein, 25 aa, synthetic construct
  source 1..25: note = Seed: NSCVKLQTVHSIPLTINKEEALQRP
NSCVKLQTVHSIPLTINKTEAFQRP

SEQ ID NO: 41910 - protein, 25 aa, synthetic construct
  source 1..25: note = Seed: NSCVKLQTVHSIPLTINKEEALQRP
NSCVKLQTVHSIPLTINKTEAIQRP

SEQ ID NO: 41911 - protein, 25 aa, synthetic construct
  source 1..25: note = Seed: NSCVKLQTVHSIPLTINKEEALQRP
NSCVKLQTVHSIPLTINKTEAMQRP

SEQ ID NO: 41912 - protein, 25 aa, synthetic construct
  source 1..25: note = Seed: NSCVKLQTVHSIPLTINKEEALQRP
NSCVKLQTVHSIPLTINKTEAVQRP

SEQ ID NO: 41913 - protein, 25 aa, synthetic construct
  source 1..25: note = Seed: NSCVKLQTVHSIPLTINKEEALQRP
NSCVKLQTVHSIPLTINKTEAYQRP

SEQ ID NO: 41914 - protein, 25 aa, synthetic construct
  source 1..25: note = Seed: NSCVKLQTVHSIPLTINKEEALQRP
NSCVKLQTVHSIPLTINKVEAAQRP

SEQ ID NO: 41915 - protein, 25 aa, synthetic construct
  source 1..25: note = Seed: NSCVKLQTVHSIPLTINKEEALQRP
NSCVKLQTVHSIPLTINKVEAFQRP

SEQ ID NO: 41916 - protein, 25 aa, synthetic construct
  source 1..25: note = Seed: NSCVKLQTVHSIPLTINKEEALQRP
NSCVKLQTVHSIPLTINKVEAIQRP

SEQ ID NO: 41917 - protein, 25 aa, synthetic construct
  source 1..25: note = Seed: NSCVKLQTVHSIPLTINKEEALQRP
NSCVKLQTVHSIPLTINKVEAMQRP

SEQ ID NO: 41918 - protein, 25 aa, synthetic construct
  source 1..25: note = Seed: NSCVKLQTVHSIPLTINKEEALQRP
NSCVKLQTVHSIPLTINKVEATQRP

SEQ ID NO: 41919 - protein, 25 aa, synthetic construct
  source 1..25: note = Seed: NSCVKLQTVHSIPLTINKEEALQRP
NSCVKLQTVHSIPLTINKVEAVQRP

SEQ ID NO: 41920 - protein, 25 aa, synthetic construct
  source 1..25: note = Seed: NSCVKLQTVHSIPLTINKEEALQRP
NSCVKLQTVHSIPLTINKVEAYQRP

SEQ ID NO: 41921 - protein, 25 aa, synthetic construct
  source 1..25: note = Seed: NSCVKLQTVHSIPLTINKEEALQRP
NSCVKLQTVHSIPLTIQKFEAAQRP

SEQ ID NO: 41922 - protein, 25 aa, synthetic construct
  source 1..25: note = Seed: NSCVKLQTVHSIPLTINKEEALQRP
NSCVKLQTVHSIPLTIQKFEAFQRP

SEQ ID NO: 41923 - protein, 25 aa, synthetic construct
  source 1..25: note = Seed: NSCVKLQTVHSIPLTINKEEALQRP
NSCVKLQTVHSIPLTIQKFEAIQRP

SEQ ID NO: 41924 - protein, 25 aa, synthetic construct
  source 1..25: note = Seed: NSCVKLQTVHSIPLTINKEEALQRP
NSCVKLQTVHSIPLTIQKFEALQRP

SEQ ID NO: 41925 - protein, 25 aa, synthetic construct
  source 1..25: note = Seed: NSCVKLQTVHSIPLTINKEEALQRP
NSCVKLQTVHSIPLTIQKFEAMQRP

SEQ ID NO: 41926 - protein, 25 aa, synthetic construct
  source 1..25: note = Seed: NSCVKLQTVHSIPLTINKEEALQRP
NSCVKLQTVHSIPLTIQKFEATQRP

SEQ ID NO: 41927 - protein, 25 aa, synthetic construct
  source 1..25: note = Seed: NSCVKLQTVHSIPLTINKEEALQRP
NSCVKLQTVHSIPLTIQKFEAVQRP

SEQ ID NO: 41928 - protein, 25 aa, synthetic construct
  source 1..25: note = Seed: NSCVKLQTVHSIPLTINKEEALQRP
NSCVKLQTVHSIPLTIQKFEAYQRP

SEQ ID NO: 41929 - protein, 25 aa, synthetic construct
  source 1..25: note = Seed: NSCVKLQTVHSIPLTINKEEALQRP
NSCVKLQTVHSIPLTIQKIEAIQRP

SEQ ID NO: 41930 - protein, 25 aa, synthetic construct
  source 1..25: note = Seed: NSCVKLQTVHSIPLTINKEEALQRP
NSCVKLQTVHSIPLTIQKIEAVQRP

SEQ ID NO: 41931 - protein, 25 aa, synthetic construct
  source 1..25: note = Seed: NSCVKLQTVHSIPLTINKEEALQRP
NSCVKLQTVHSIPLTIQKLEALQRP

SEQ ID NO: 41932 - protein, 25 aa, synthetic construct
  source 1..25: note = Seed: NSCVKLQTVHSIPLTINKEEALQRP
NSCVKLQTVHSIPLTIRKFEAFQRP

SEQ ID NO: 41933 - protein, 25 aa, synthetic construct
  source 1..25: note = Seed: NSCVKLQTVHSIPLTINKEEALQRP
NSCVKLQTVHSIPLTIRKFEAIQRP

SEQ ID NO: 41934 - protein, 25 aa, synthetic construct
  source 1..25: note = Seed: NSCVKLQTVHSIPLTINKEEALQRP
NSCVKLQTVHSIPLTIRKFEALQRP

SEQ ID NO: 41935 - protein, 25 aa, synthetic construct
  source 1..25: note = Seed: NSCVKLQTVHSIPLTINKEEALQRP
NSCVKLQTVHSIPLTIRKFEAVQRP

SEQ ID NO: 41936 - protein, 25 aa, synthetic construct
  source 1..25: note = Seed: NSCVKLQTVHSIPLTINKEEALQRP
NSCVKLQTVHSIPLTIRKIEAFQRP

SEQ ID NO: 41937 - protein, 25 aa, synthetic construct
  source 1..25: note = Seed: NSCVKLQTVHSIPLTINKEEALQRP
NSCVKLQTVHSIPLTIRKKEALQRP

SEQ ID NO: 41938 - protein, 25 aa, synthetic construct
  source 1..25: note = Seed: NSCVKLQTVHSIPLTINKEEALQRP
NSCVKLQTVHSIPLTIRKREAFQRP

SEQ ID NO: 41939 - protein, 25 aa, synthetic construct
  source 1..25: note = Seed: NSCVKLQTVHSIPLTINKEEALQRP
NSCVKLQTVHSIPLTIRKREAIQRP

SEQ ID NO: 41940 - protein, 25 aa, synthetic construct
  source 1..25: note = Seed: NSCVKLQTVHSIPLTINKEEALQRP
NSCVKLQTVHSIPLTIRKREALQRP

SEQ ID NO: 41941 - protein, 25 aa, synthetic construct
  source 1..25: note = Seed: NSCVKLQTVHSIPLTINKEEALQRP
NSCVKLQTVHSIPLTISKAEAAQRP

SEQ ID NO: 41942 - protein, 25 aa, synthetic construct
  source 1..25: note = Seed: NSCVKLQTVHSIPLTINKEEALQRP
NSCVKLQTVHSIPLTISKAEAFQRP

SEQ ID NO: 41943 - protein, 25 aa, synthetic construct
  source 1..25: note = Seed: NSCVKLQTVHSIPLTINKEEALQRP
NSCVKLQTVHSIPLTISKAEAIQRP

SEQ ID NO: 41944 - protein, 25 aa, synthetic construct
  source 1..25: note = Seed: NSCVKLQTVHSIPLTINKEEALQRP
NSCVKLQTVHSIPLTISKAEALQRP

SEQ ID NO: 41945 - protein, 25 aa, synthetic construct
  source 1..25: note = Seed: NSCVKLQTVHSIPLTINKEEALQRP
NSCVKLQTVHSIPLTISKAEAVQRP

SEQ ID NO: 41946 - protein, 25 aa, synthetic construct
  source 1..25: note = Seed: NSCVKLQTVHSIPLTINKEEALQRP
NSCVKLQTVHSIPLTISKFEAAQRP

SEQ ID NO: 41947 - protein, 25 aa, synthetic construct
  source 1..25: note = Seed: NSCVKLQTVHSIPLTINKEEALQRP
NSCVKLQTVHSIPLTISKFEAEQRP

SEQ ID NO: 41948 - protein, 25 aa, synthetic construct
  source 1..25: note = Seed: NSCVKLQTVHSIPLTINKEEALQRP
NSCVKLQTVHSIPLTISKFEAFQRP

SEQ ID NO: 41949 - protein, 25 aa, synthetic construct
  source 1..25: note = Seed: NSCVKLQTVHSIPLTINKEEALQRP
NSCVKLQTVHSIPLTISKFEAIQRP

SEQ ID NO: 41950 - protein, 25 aa, synthetic construct
  source 1..25: note = Seed: NSCVKLQTVHSIPLTINKEEALQRP
NSCVKLQTVHSIPLTISKFEALQRP

SEQ ID NO: 41951 - protein, 25 aa, synthetic construct
  source 1..25: note = Seed: NSCVKLQTVHSIPLTINKEEALQRP
NSCVKLQTVHSIPLTISKFEAMQRP

SEQ ID NO: 41952 - protein, 25 aa, synthetic construct
  source 1..25: note = Seed: NSCVKLQTVHSIPLTINKEEALQRP
NSCVKLQTVHSIPLTISKFEANQRP

SEQ ID NO: 41953 - protein, 25 aa, synthetic construct
  source 1..25: note = Seed: NSCVKLQTVHSIPLTINKEEALQRP
NSCVKLQTVHSIPLTISKFEASQRP

SEQ ID NO: 41954 - protein, 25 aa, synthetic construct
  source 1..25: note = Seed: NSCVKLQTVHSIPLTINKEEALQRP
NSCVKLQTVHSIPLTISKFEATQRP

SEQ ID NO: 41955 - protein, 25 aa, synthetic construct
  source 1..25: note = Seed: NSCVKLQTVHSIPLTINKEEALQRP
NSCVKLQTVHSIPLTISKFEAVQRP

SEQ ID NO: 41956 - protein, 25 aa, synthetic construct
  source 1..25: note = Seed: NSCVKLQTVHSIPLTINKEEALQRP
NSCVKLQTVHSIPLTISKFEAYQRP

SEQ ID NO: 41957 - protein, 25 aa, synthetic construct
  source 1..25: note = Seed: NSCVKLQTVHSIPLTINKEEALQRP
NSCVKLQTVHSIPLTISKIEAAQRP

SEQ ID NO: 41958 - protein, 25 aa, synthetic construct
  source 1..25: note = Seed: NSCVKLQTVHSIPLTINKEEALQRP
NSCVKLQTVHSIPLTISKIEAFQRP

SEQ ID NO: 41959 - protein, 25 aa, synthetic construct
  source 1..25: note = Seed: NSCVKLQTVHSIPLTINKEEALQRP
NSCVKLQTVHSIPLTISKIEAIQRP

SEQ ID NO: 41960 - protein, 25 aa, synthetic construct
  source 1..25: note = Seed: NSCVKLQTVHSIPLTINKEEALQRP
NSCVKLQTVHSIPLTISKIEALQRP

SEQ ID NO: 41961 - protein, 25 aa, synthetic construct
  source 1..25: note = Seed: NSCVKLQTVHSIPLTINKEEALQRP
NSCVKLQTVHSIPLTISKIEAMQRP

SEQ ID NO: 41962 - protein, 25 aa, synthetic construct
  source 1..25: note = Seed: NSCVKLQTVHSIPLTINKEEALQRP
NSCVKLQTVHSIPLTISKIEASQRP

SEQ ID NO: 41963 - protein, 25 aa, synthetic construct
  source 1..25: note = Seed: NSCVKLQTVHSIPLTINKEEALQRP
NSCVKLQTVHSIPLTISKIEAVQRP

SEQ ID NO: 41964 - protein, 25 aa, synthetic construct
  source 1..25: note = Seed: NSCVKLQTVHSIPLTINKEEALQRP
NSCVKLQTVHSIPLTISKIEAYQRP

SEQ ID NO: 41965 - protein, 25 aa, synthetic construct
  source 1..25: note = Seed: NSCVKLQTVHSIPLTINKEEALQRP
NSCVKLQTVHSIPLTISKLEAAQRP

SEQ ID NO: 41966 - protein, 25 aa, synthetic construct
  source 1..25: note = Seed: NSCVKLQTVHSIPLTINKEEALQRP
NSCVKLQTVHSIPLTISKLEAIQRP

SEQ ID NO: 41967 - protein, 25 aa, synthetic construct
  source 1..25: note = Seed: NSCVKLQTVHSIPLTINKEEALQRP
NSCVKLQTVHSIPLTISKLEALQRP

SEQ ID NO: 41968 - protein, 25 aa, synthetic construct
  source 1..25: note = Seed: NSCVKLQTVHSIPLTINKEEALQRP
NSCVKLQTVHSIPLTISKLEAVQRP

SEQ ID NO: 41969 - protein, 25 aa, synthetic construct
  source 1..25: note = Seed: NSCVKLQTVHSIPLTINKEEALQRP
NSCVKLQTVHSIPLTISKMEAIQRP

SEQ ID NO: 41970 - protein, 25 aa, synthetic construct
  source 1..25: note = Seed: NSCVKLQTVHSIPLTINKEEALQRP
NSCVKLQTVHSIPLTISKMEAVQRP

SEQ ID NO: 41971 - protein, 25 aa, synthetic construct
  source 1..25: note = Seed: NSCVKLQTVHSIPLTINKEEALQRP
NSCVKLQTVHSIPLTISKNEAFQRP

SEQ ID NO: 41972 - protein, 25 aa, synthetic construct
  source 1..25: note = Seed: NSCVKLQTVHSIPLTINKEEALQRP
NSCVKLQTVHSIPLTISKNEAIQRP

SEQ ID NO: 41973 - protein, 25 aa, synthetic construct
  source 1..25: note = Seed: NSCVKLQTVHSIPLTINKEEALQRP
NSCVKLQTVHSIPLTISKNEALQRP

SEQ ID NO: 41974 - protein, 25 aa, synthetic construct
  source 1..25: note = Seed: NSCVKLQTVHSIPLTINKEEALQRP
NSCVKLQTVHSIPLTISKNEAVQRP

SEQ ID NO: 41975 - protein, 25 aa, synthetic construct
  source 1..25: note = Seed: NSCVKLQTVHSIPLTINKEEALQRP
NSCVKLQTVHSIPLTISKSEAIQRP

SEQ ID NO: 41976 - protein, 25 aa, synthetic construct
  source 1..25: note = Seed: NSCVKLQTVHSIPLTINKEEALQRP
NSCVKLQTVHSIPLTISKSEAVQRP

SEQ ID NO: 41977 - protein, 25 aa, synthetic construct
  source 1..25: note = Seed: NSCVKLQTVHSIPLTINKEEALQRP
NSCVKLQTVHSIPLTISKVEAAQRP

SEQ ID NO: 41978 - protein, 25 aa, synthetic construct
  source 1..25: note = Seed: NSCVKLQTVHSIPLTINKEEALQRP
NSCVKLQTVHSIPLTISKVEAFQRP

SEQ ID NO: 41979 - protein, 25 aa, synthetic construct
  source 1..25: note = Seed: NSCVKLQTVHSIPLTINKEEALQRP
NSCVKLQTVHSIPLTISKVEAIQRP

SEQ ID NO: 41980 - protein, 25 aa, synthetic construct
  source 1..25: note = Seed: NSCVKLQTVHSIPLTINKEEALQRP
NSCVKLQTVHSIPLTISKVEALQRP

SEQ ID NO: 41981 - protein, 25 aa, synthetic construct
  source 1..25: note = Seed: NSCVKLQTVHSIPLTINKEEALQRP
NSCVKLQTVHSIPLTISKVEAMQRP

SEQ ID NO: 41982 - protein, 25 aa, synthetic construct
  source 1..25: note = Seed: NSCVKLQTVHSIPLTINKEEALQRP
NSCVKLQTVHSIPLTISKVEAVQRP

SEQ ID NO: 41983 - protein, 25 aa, synthetic construct
  source 1..25: note = Seed: NSCVKLQTVHSIPLTINKEEALQRP
NSCVKLQTVHSIPLTISKVEAYQRP

SEQ ID NO: 41984 - protein, 25 aa, synthetic construct
  source 1..25: note = Seed: NSCVKLQTVHSIPLTINKEEALQRP
NSCVKLQTVHSIPLTISKWEAIQRP

SEQ ID NO: 41985 - protein, 25 aa, synthetic construct
  source 1..25: note = Seed: NSCVKLQTVHSIPLTINKEEALQRP
NSCVKLQTVHSIPLTISKWEALQRP

SEQ ID NO: 41986 - protein, 25 aa, synthetic construct
  source 1..25: note = Seed: NSCVKLQTVHSIPLTINKEEALQRP
NSCVKLQTVHSIPLTISKWEAVQRP

SEQ ID NO: 41987 - protein, 25 aa, synthetic construct
  source 1..25: note = Seed: NSCVKLQTVHSIPLTINKEEALQRP
NSCVKLQTVHSIPLTISKYEAFQRP

SEQ ID NO: 41988 - protein, 25 aa, synthetic construct
  source 1..25: note = Seed: NSCVKLQTVHSIPLTINKEEALQRP
NSCVKLQTVHSIPLTISKYEAIQRP

SEQ ID NO: 41989 - protein, 25 aa, synthetic construct
  source 1..25: note = Seed: NSCVKLQTVHSIPLTINKEEALQRP
NSCVKLQTVHSIPLTISKYEALQRP

SEQ ID NO: 41990 - protein, 25 aa, synthetic construct
  source 1..25: note = Seed: NSCVKLQTVHSIPLTINKEEALQRP
NSCVKLQTVHSIPLTISKYEAVQRP

SEQ ID NO: 41991 - protein, 25 aa, synthetic construct
  source 1..25: note = Seed: NSCVKLQTVHSIPLTINKEEALQRP
NSCVKLQTVHSIPLTITKFEAAQRP

SEQ ID NO: 41992 - protein, 25 aa, synthetic construct
  source 1..25: note = Seed: NSCVKLQTVHSIPLTINKEEALQRP
NSCVKLQTVHSIPLTITKFEADQRP

SEQ ID NO: 41993 - protein, 25 aa, synthetic construct
  source 1..25: note = Seed: NSCVKLQTVHSIPLTINKEEALQRP
NSCVKLQTVHSIPLTITKFEAEQRP

SEQ ID NO: 41994 - protein, 25 aa, synthetic construct
  source 1..25: note = Seed: NSCVKLQTVHSIPLTINKEEALQRP
NSCVKLQTVHSIPLTITKFEAFQRP

SEQ ID NO: 41995 - protein, 25 aa, synthetic construct
  source 1..25: note = Seed: NSCVKLQTVHSIPLTINKEEALQRP
NSCVKLQTVHSIPLTITKFEAIQRP

SEQ ID NO: 41996 - protein, 25 aa, synthetic construct
  source 1..25: note = Seed: NSCVKLQTVHSIPLTINKEEALQRP
NSCVKLQTVHSIPLTITKFEALQRP

SEQ ID NO: 41997 - protein, 25 aa, synthetic construct
  source 1..25: note = Seed: NSCVKLQTVHSIPLTINKEEALQRP
NSCVKLQTVHSIPLTITKFEAMQRP

SEQ ID NO: 41998 - protein, 25 aa, synthetic construct
  source 1..25: note = Seed: NSCVKLQTVHSIPLTINKEEALQRP
NSCVKLQTVHSIPLTITKFEANQRP

SEQ ID NO: 41999 - protein, 25 aa, synthetic construct
  source 1..25: note = Seed: NSCVKLQTVHSIPLTINKEEALQRP
NSCVKLQTVHSIPLTITKFEASQRP

SEQ ID NO: 42000 - protein, 25 aa, synthetic construct
  source 1..25: note = Seed: NSCVKLQTVHSIPLTINKEEALQRP
NSCVKLQTVHSIPLTITKFEATQRP

SEQ ID NO: 42001 - protein, 25 aa, synthetic construct
  source 1..25: note = Seed: NSCVKLQTVHSIPLTINKEEALQRP
NSCVKLQTVHSIPLTITKFEAVQRP

SEQ ID NO: 42002 - protein, 25 aa, synthetic construct
  source 1..25: note = Seed: NSCVKLQTVHSIPLTINKEEALQRP
NSCVKLQTVHSIPLTITKFEAWQRP

SEQ ID NO: 42003 - protein, 25 aa, synthetic construct
  source 1..25: note = Seed: NSCVKLQTVHSIPLTINKEEALQRP
NSCVKLQTVHSIPLTITKFEAYQRP

SEQ ID NO: 42004 - protein, 25 aa, synthetic construct
  source 1..25: note = Seed: NSCVKLQTVHSIPLTINKEEALQRP
NSCVKLQTVHSIPLTITKIEAAQRP

SEQ ID NO: 42005 - protein, 25 aa, synthetic construct
  source 1..25: note = Seed: NSCVKLQTVHSIPLTINKEEALQRP
NSCVKLQTVHSIPLTITKIEAIQRP

SEQ ID NO: 42006 - protein, 25 aa, synthetic construct
  source 1..25: note = Seed: NSCVKLQTVHSIPLTINKEEALQRP
NSCVKLQTVHSIPLTITKIEALQRP

SEQ ID NO: 42007 - protein, 25 aa, synthetic construct
  source 1..25: note = Seed: NSCVKLQTVHSIPLTINKEEALQRP
NSCVKLQTVHSIPLTITKIEAVQRP

SEQ ID NO: 42008 - protein, 25 aa, synthetic construct
  source 1..25: note = Seed: NSCVKLQTVHSIPLTINKEEALQRP
NSCVKLQTVHSIPLTITKLEAFQRP

SEQ ID NO: 42009 - protein, 25 aa, synthetic construct
  source 1..25: note = Seed: NSCVKLQTVHSIPLTINKEEALQRP
NSCVKLQTVHSIPLTITKLEAIQRP

SEQ ID NO: 42010 - protein, 25 aa, synthetic construct
  source 1..25: note = Seed: NSCVKLQTVHSIPLTINKEEALQRP
NSCVKLQTVHSIPLTITKLEALQRP

SEQ ID NO: 42011 - protein, 25 aa, synthetic construct
  source 1..25: note = Seed: NSCVKLQTVHSIPLTINKEEALQRP
NSCVKLQTVHSIPLTITKLEAVQRP

SEQ ID NO: 42012 - protein, 25 aa, synthetic construct
  source 1..25: note = Seed: NSCVKLQTVHSIPLTINKEEALQRP
NSCVKLQTVHSIPLTITKWEAFQRP

SEQ ID NO: 42013 - protein, 25 aa, synthetic construct
  source 1..25: note = Seed: NSCVKLQTVHSIPLTINKEEALQRP
NSCVKLQTVHSIPLTITKWEAIQRP

SEQ ID NO: 42014 - protein, 25 aa, synthetic construct
  source 1..25: note = Seed: NSCVKLQTVHSIPLTINKEEALQRP
NSCVKLQTVHSIPLTITKWEALQRP

SEQ ID NO: 42015 - protein, 25 aa, synthetic construct
  source 1..25: note = Seed: NSCVKLQTVHSIPLTINKEEALQRP
NSCVKLQTVHSIPLTITKWEAVQRP

SEQ ID NO: 42016 - protein, 25 aa, synthetic construct
  source 1..25: note = Seed: NSCVKLQTVHSIPLTINKEEALQRP
NSCVKLQTVHSIPLTITKYEAFQRP

SEQ ID NO: 42017 - protein, 25 aa, synthetic construct
  source 1..25: note = Seed: NSCVKLQTVHSIPLTINKEEALQRP
NSCVKLQTVHSIPLTITKYEAIQRP

SEQ ID NO: 42018 - protein, 25 aa, synthetic construct
  source 1..25: note = Seed: NSCVKLQTVHSIPLTINKEEALQRP
NSCVKLQTVHSIPLTITKYEALQRP

SEQ ID NO: 42019 - protein, 25 aa, synthetic construct
  source 1..25: note = Seed: NSCVKLQTVHSIPLTINKEEALQRP
NSCVKLQTVHSIPLTITKYEAMQRP

SEQ ID NO: 42020 - protein, 25 aa, synthetic construct
  source 1..25: note = Seed: NSCVKLQTVHSIPLTINKEEALQRP
NSCVKLQTVHSIPLTITKYEAVQRP

SEQ ID NO: 42021 - protein, 25 aa, synthetic construct
  source 1..25: note = Seed: NSCVKLQTVHSIPLTINKEEALQRP
NSCVKLQTVHSIPLTIVKAEAAQRP

SEQ ID NO: 42022 - protein, 25 aa, synthetic construct
  source 1..25: note = Seed: NSCVKLQTVHSIPLTINKEEALQRP
NSCVKLQTVHSIPLTIVKAEAFQRP

SEQ ID NO: 42023 - protein, 25 aa, synthetic construct
  source 1..25: note = Seed: NSCVKLQTVHSIPLTINKEEALQRP
NSCVKLQTVHSIPLTIVKAEAIQRP

SEQ ID NO: 42024 - protein, 25 aa, synthetic construct
  source 1..25: note = Seed: NSCVKLQTVHSIPLTINKEEALQRP
NSCVKLQTVHSIPLTIVKAEALQRP

SEQ ID NO: 42025 - protein, 25 aa, synthetic construct
  source 1..25: note = Seed: NSCVKLQTVHSIPLTINKEEALQRP
NSCVKLQTVHSIPLTIVKAEAMQRP

SEQ ID NO: 42026 - protein, 25 aa, synthetic construct
  source 1..25: note = Seed: NSCVKLQTVHSIPLTINKEEALQRP
NSCVKLQTVHSIPLTIVKAEAVQRP

SEQ ID NO: 42027 - protein, 25 aa, synthetic construct
  source 1..25: note = Seed: NSCVKLQTVHSIPLTINKEEALQRP
NSCVKLQTVHSIPLTIVKAEAYQRP

SEQ ID NO: 42028 - protein, 25 aa, synthetic construct
  source 1..25: note = Seed: NSCVKLQTVHSIPLTINKEEALQRP
NSCVKLQTVHSIPLTIVKDEAAQRP

SEQ ID NO: 42029 - protein, 25 aa, synthetic construct
  source 1..25: note = Seed: NSCVKLQTVHSIPLTINKEEALQRP
NSCVKLQTVHSIPLTIVKDEAFQRP

SEQ ID NO: 42030 - protein, 25 aa, synthetic construct
  source 1..25: note = Seed: NSCVKLQTVHSIPLTINKEEALQRP
NSCVKLQTVHSIPLTIVKDEAIQRP

SEQ ID NO: 42031 - protein, 25 aa, synthetic construct
  source 1..25: note = Seed: NSCVKLQTVHSIPLTINKEEALQRP
NSCVKLQTVHSIPLTIVKDEALQRP

SEQ ID NO: 42032 - protein, 25 aa, synthetic construct
  source 1..25: note = Seed: NSCVKLQTVHSIPLTINKEEALQRP
NSCVKLQTVHSIPLTIVKDEAMQRP

SEQ ID NO: 42033 - protein, 25 aa, synthetic construct
  source 1..25: note = Seed: NSCVKLQTVHSIPLTINKEEALQRP
NSCVKLQTVHSIPLTIVKDEAVQRP

SEQ ID NO: 42034 - protein, 25 aa, synthetic construct
  source 1..25: note = Seed: NSCVKLQTVHSIPLTINKEEALQRP
NSCVKLQTVHSIPLTIVKFEAAQRP

SEQ ID NO: 42035 - protein, 25 aa, synthetic construct
  source 1..25: note = Seed: NSCVKLQTVHSIPLTINKEEALQRP
NSCVKLQTVHSIPLTIVKFEACQRP

SEQ ID NO: 42036 - protein, 25 aa, synthetic construct
  source 1..25: note = Seed: NSCVKLQTVHSIPLTINKEEALQRP
NSCVKLQTVHSIPLTIVKFEADQRP

SEQ ID NO: 42037 - protein, 25 aa, synthetic construct
  source 1..25: note = Seed: NSCVKLQTVHSIPLTINKEEALQRP
NSCVKLQTVHSIPLTIVKFEAEQRP

SEQ ID NO: 42038 - protein, 25 aa, synthetic construct
  source 1..25: note = Seed: NSCVKLQTVHSIPLTINKEEALQRP
NSCVKLQTVHSIPLTIVKFEAFQRP

SEQ ID NO: 42039 - protein, 25 aa, synthetic construct
  source 1..25: note = Seed: NSCVKLQTVHSIPLTINKEEALQRP
NSCVKLQTVHSIPLTIVKFEAGQRP

SEQ ID NO: 42040 - protein, 25 aa, synthetic construct
  source 1..25: note = Seed: NSCVKLQTVHSIPLTINKEEALQRP
NSCVKLQTVHSIPLTIVKFEAHQRP

SEQ ID NO: 42041 - protein, 25 aa, synthetic construct
  source 1..25: note = Seed: NSCVKLQTVHSIPLTINKEEALQRP
NSCVKLQTVHSIPLTIVKFEAIQRP

SEQ ID NO: 42042 - protein, 25 aa, synthetic construct
  source 1..25: note = Seed: NSCVKLQTVHSIPLTINKEEALQRP
NSCVKLQTVHSIPLTIVKFEAKQRP

SEQ ID NO: 42043 - protein, 25 aa, synthetic construct
  source 1..25: note = Seed: NSCVKLQTVHSIPLTINKEEALQRP
NSCVKLQTVHSIPLTIVKFEALQRP

SEQ ID NO: 42044 - protein, 25 aa, synthetic construct
  source 1..25: note = Seed: NSCVKLQTVHSIPLTINKEEALQRP
NSCVKLQTVHSIPLTIVKFEAMQRP

SEQ ID NO: 42045 - protein, 25 aa, synthetic construct
  source 1..25: note = Seed: NSCVKLQTVHSIPLTINKEEALQRP
NSCVKLQTVHSIPLTIVKFEANQRP

SEQ ID NO: 42046 - protein, 25 aa, synthetic construct
  source 1..25: note = Seed: NSCVKLQTVHSIPLTINKEEALQRP
NSCVKLQTVHSIPLTIVKFEAPQRP

SEQ ID NO: 42047 - protein, 25 aa, synthetic construct
  source 1..25: note = Seed: NSCVKLQTVHSIPLTINKEEALQRP
NSCVKLQTVHSIPLTIVKFEAQQRP

SEQ ID NO: 42048 - protein, 25 aa, synthetic construct
  source 1..25: note = Seed: NSCVKLQTVHSIPLTINKEEALQRP
NSCVKLQTVHSIPLTIVKFEARQRP

SEQ ID NO: 42049 - protein, 25 aa, synthetic construct
  source 1..25: note = Seed: NSCVKLQTVHSIPLTINKEEALQRP
NSCVKLQTVHSIPLTIVKFEASQRP

SEQ ID NO: 42050 - protein, 25 aa, synthetic construct
  source 1..25: note = Seed: NSCVKLQTVHSIPLTINKEEALQRP
NSCVKLQTVHSIPLTIVKFEATQRP

SEQ ID NO: 42051 - protein, 25 aa, synthetic construct
  source 1..25: note = Seed: NSCVKLQTVHSIPLTINKEEALQRP
NSCVKLQTVHSIPLTIVKFEAVQRP

SEQ ID NO: 42052 - protein, 25 aa, synthetic construct
  source 1..25: note = Seed: NSCVKLQTVHSIPLTINKEEALQRP
NSCVKLQTVHSIPLTIVKFEAWQRP

SEQ ID NO: 42053 - protein, 25 aa, synthetic construct
  source 1..25: note = Seed: NSCVKLQTVHSIPLTINKEEALQRP
NSCVKLQTVHSIPLTIVKFEAYQRP

SEQ ID NO: 42054 - protein, 25 aa, synthetic construct
  source 1..25: note = Seed: NSCVKLQTVHSIPLTINKEEALQRP
NSCVKLQTVHSIPLTIVKIEAAQRP

SEQ ID NO: 42055 - protein, 25 aa, synthetic construct
  source 1..25: note = Seed: NSCVKLQTVHSIPLTINKEEALQRP
NSCVKLQTVHSIPLTIVKIEAFQRP

SEQ ID NO: 42056 - protein, 25 aa, synthetic construct
  source 1..25: note = Seed: NSCVKLQTVHSIPLTINKEEALQRP
NSCVKLQTVHSIPLTIVKIEAIQRP

SEQ ID NO: 42057 - protein, 25 aa, synthetic construct
  source 1..25: note = Seed: NSCVKLQTVHSIPLTINKEEALQRP
NSCVKLQTVHSIPLTIVKIEALQRP

SEQ ID NO: 42058 - protein, 25 aa, synthetic construct
  source 1..25: note = Seed: NSCVKLQTVHSIPLTINKEEALQRP
NSCVKLQTVHSIPLTIVKIEAMQRP

SEQ ID NO: 42059 - protein, 25 aa, synthetic construct
  source 1..25: note = Seed: NSCVKLQTVHSIPLTINKEEALQRP
NSCVKLQTVHSIPLTIVKIEAQQRP

SEQ ID NO: 42060 - protein, 25 aa, synthetic construct
  source 1..25: note = Seed: NSCVKLQTVHSIPLTINKEEALQRP
NSCVKLQTVHSIPLTIVKIEASQRP

SEQ ID NO: 42061 - protein, 25 aa, synthetic construct
  source 1..25: note = Seed: NSCVKLQTVHSIPLTINKEEALQRP
NSCVKLQTVHSIPLTIVKIEATQRP

SEQ ID NO: 42062 - protein, 25 aa, synthetic construct
  source 1..25: note = Seed: NSCVKLQTVHSIPLTINKEEALQRP
NSCVKLQTVHSIPLTIVKIEAVQRP

SEQ ID NO: 42063 - protein, 25 aa, synthetic construct
  source 1..25: note = Seed: NSCVKLQTVHSIPLTINKEEALQRP
NSCVKLQTVHSIPLTIVKIEAYQRP

SEQ ID NO: 42064 - protein, 25 aa, synthetic construct
  source 1..25: note = Seed: NSCVKLQTVHSIPLTINKEEALQRP
NSCVKLQTVHSIPLTIVKKEALQRP

SEQ ID NO: 42065 - protein, 25 aa, synthetic construct
  source 1..25: note = Seed: NSCVKLQTVHSIPLTINKEEALQRP
NSCVKLQTVHSIPLTIVKLEAAQRP

SEQ ID NO: 42066 - protein, 25 aa, synthetic construct
  source 1..25: note = Seed: NSCVKLQTVHSIPLTINKEEALQRP
NSCVKLQTVHSIPLTIVKLEAEQRP

SEQ ID NO: 42067 - protein, 25 aa, synthetic construct
  source 1..25: note = Seed: NSCVKLQTVHSIPLTINKEEALQRP
NSCVKLQTVHSIPLTIVKLEAFQRP

SEQ ID NO: 42068 - protein, 25 aa, synthetic construct
  source 1..25: note = Seed: NSCVKLQTVHSIPLTINKEEALQRP
NSCVKLQTVHSIPLTIVKLEAIQRP

SEQ ID NO: 42069 - protein, 25 aa, synthetic construct
  source 1..25: note = Seed: NSCVKLQTVHSIPLTINKEEALQRP
NSCVKLQTVHSIPLTIVKLEALQRP

SEQ ID NO: 42070 - protein, 25 aa, synthetic construct
  source 1..25: note = Seed: NSCVKLQTVHSIPLTINKEEALQRP
NSCVKLQTVHSIPLTIVKLEAMQRP

SEQ ID NO: 42071 - protein, 25 aa, synthetic construct
  source 1..25: note = Seed: NSCVKLQTVHSIPLTINKEEALQRP
NSCVKLQTVHSIPLTIVKLEANQRP

SEQ ID NO: 42072 - protein, 25 aa, synthetic construct
  source 1..25: note = Seed: NSCVKLQTVHSIPLTINKEEALQRP
NSCVKLQTVHSIPLTIVKLEASQRP

SEQ ID NO: 42073 - protein, 25 aa, synthetic construct
  source 1..25: note = Seed: NSCVKLQTVHSIPLTINKEEALQRP
NSCVKLQTVHSIPLTIVKLEATQRP

SEQ ID NO: 42074 - protein, 25 aa, synthetic construct
  source 1..25: note = Seed: NSCVKLQTVHSIPLTINKEEALQRP
NSCVKLQTVHSIPLTIVKLEAVQRP

SEQ ID NO: 42075 - protein, 25 aa, synthetic construct
  source 1..25: note = Seed: NSCVKLQTVHSIPLTINKEEALQRP
NSCVKLQTVHSIPLTIVKLEAYQRP

SEQ ID NO: 42076 - protein, 25 aa, synthetic construct
  source 1..25: note = Seed: NSCVKLQTVHSIPLTINKEEALQRP
NSCVKLQTVHSIPLTIVKMEAAQRP

SEQ ID NO: 42077 - protein, 25 aa, synthetic construct
  source 1..25: note = Seed: NSCVKLQTVHSIPLTINKEEALQRP
NSCVKLQTVHSIPLTIVKMEAFQRP

SEQ ID NO: 42078 - protein, 25 aa, synthetic construct
  source 1..25: note = Seed: NSCVKLQTVHSIPLTINKEEALQRP
NSCVKLQTVHSIPLTIVKMEAIQRP

SEQ ID NO: 42079 - protein, 25 aa, synthetic construct
  source 1..25: note = Seed: NSCVKLQTVHSIPLTINKEEALQRP
NSCVKLQTVHSIPLTIVKMEALQRP

SEQ ID NO: 42080 - protein, 25 aa, synthetic construct
  source 1..25: note = Seed: NSCVKLQTVHSIPLTINKEEALQRP
NSCVKLQTVHSIPLTIVKMEAMQRP

SEQ ID NO: 42081 - protein, 25 aa, synthetic construct
  source 1..25: note = Seed: NSCVKLQTVHSIPLTINKEEALQRP
NSCVKLQTVHSIPLTIVKMEAVQRP

SEQ ID NO: 42082 - protein, 25 aa, synthetic construct
  source 1..25: note = Seed: NSCVKLQTVHSIPLTINKEEALQRP
NSCVKLQTVHSIPLTIVKMEAYQRP

SEQ ID NO: 42083 - protein, 25 aa, synthetic construct
  source 1..25: note = Seed: NSCVKLQTVHSIPLTINKEEALQRP
NSCVKLQTVHSIPLTIVKNEAAQRP

SEQ ID NO: 42084 - protein, 25 aa, synthetic construct
  source 1..25: note = Seed: NSCVKLQTVHSIPLTINKEEALQRP
NSCVKLQTVHSIPLTIVKNEAIQRP

SEQ ID NO: 42085 - protein, 25 aa, synthetic construct
  source 1..25: note = Seed: NSCVKLQTVHSIPLTINKEEALQRP
NSCVKLQTVHSIPLTIVKNEALQRP

SEQ ID NO: 42086 - protein, 25 aa, synthetic construct
  source 1..25: note = Seed: NSCVKLQTVHSIPLTINKEEALQRP
NSCVKLQTVHSIPLTIVKNEAVQRP

SEQ ID NO: 42087 - protein, 25 aa, synthetic construct
  source 1..25: note = Seed: NSCVKLQTVHSIPLTINKEEALQRP
NSCVKLQTVHSIPLTIVKREAFQRP

SEQ ID NO: 42088 - protein, 25 aa, synthetic construct
  source 1..25: note = Seed: NSCVKLQTVHSIPLTINKEEALQRP
NSCVKLQTVHSIPLTIVKREAIQRP

SEQ ID NO: 42089 - protein, 25 aa, synthetic construct
  source 1..25: note = Seed: NSCVKLQTVHSIPLTINKEEALQRP
NSCVKLQTVHSIPLTIVKREALQRP

SEQ ID NO: 42090 - protein, 25 aa, synthetic construct
  source 1..25: note = Seed: NSCVKLQTVHSIPLTINKEEALQRP
NSCVKLQTVHSIPLTIVKREAMQRP

SEQ ID NO: 42091 - protein, 25 aa, synthetic construct
  source 1..25: note = Seed: NSCVKLQTVHSIPLTINKEEALQRP
NSCVKLQTVHSIPLTIVKREARQRP

SEQ ID NO: 42092 - protein, 25 aa, synthetic construct
  source 1..25: note = Seed: NSCVKLQTVHSIPLTINKEEALQRP
NSCVKLQTVHSIPLTIVKREAVQRP

SEQ ID NO: 42093 - protein, 25 aa, synthetic construct
  source 1..25: note = Seed: NSCVKLQTVHSIPLTINKEEALQRP
NSCVKLQTVHSIPLTIVKREAYQRP

SEQ ID NO: 42094 - protein, 25 aa, synthetic construct
  source 1..25: note = Seed: NSCVKLQTVHSIPLTINKEEALQRP
NSCVKLQTVHSIPLTIVKSEAAQRP

SEQ ID NO: 42095 - protein, 25 aa, synthetic construct
  source 1..25: note = Seed: NSCVKLQTVHSIPLTINKEEALQRP
NSCVKLQTVHSIPLTIVKSEAIQRP

SEQ ID NO: 42096 - protein, 25 aa, synthetic construct
  source 1..25: note = Seed: NSCVKLQTVHSIPLTINKEEALQRP
NSCVKLQTVHSIPLTIVKSEAVQRP

SEQ ID NO: 42097 - protein, 25 aa, synthetic construct
  source 1..25: note = Seed: NSCVKLQTVHSIPLTINKEEALQRP
NSCVKLQTVHSIPLTIVKTEAIQRP

SEQ ID NO: 42098 - protein, 25 aa, synthetic construct
  source 1..25: note = Seed: NSCVKLQTVHSIPLTINKEEALQRP
NSCVKLQTVHSIPLTIVKTEAVQRP

SEQ ID NO: 42099 - protein, 25 aa, synthetic construct
  source 1..25: note = Seed: NSCVKLQTVHSIPLTINKEEALQRP
NSCVKLQTVHSIPLTIVKVEAAQRP

SEQ ID NO: 42100 - protein, 25 aa, synthetic construct
  source 1..25: note = Seed: NSCVKLQTVHSIPLTINKEEALQRP
NSCVKLQTVHSIPLTIVKVEAFQRP

SEQ ID NO: 42101 - protein, 25 aa, synthetic construct
  source 1..25: note = Seed: NSCVKLQTVHSIPLTINKEEALQRP
NSCVKLQTVHSIPLTIVKVEAIQRP

SEQ ID NO: 42102 - protein, 25 aa, synthetic construct
  source 1..25: note = Seed: NSCVKLQTVHSIPLTINKEEALQRP
NSCVKLQTVHSIPLTIVKVEALQRP

SEQ ID NO: 42103 - protein, 25 aa, synthetic construct
  source 1..25: note = Seed: NSCVKLQTVHSIPLTINKEEALQRP
NSCVKLQTVHSIPLTIVKVEAMQRP

SEQ ID NO: 42104 - protein, 25 aa, synthetic construct
  source 1..25: note = Seed: NSCVKLQTVHSIPLTINKEEALQRP
NSCVKLQTVHSIPLTIVKVEASQRP

SEQ ID NO: 42105 - protein, 25 aa, synthetic construct
  source 1..25: note = Seed: NSCVKLQTVHSIPLTINKEEALQRP
NSCVKLQTVHSIPLTIVKVEAVQRP

SEQ ID NO: 42106 - protein, 25 aa, synthetic construct
  source 1..25: note = Seed: NSCVKLQTVHSIPLTINKEEALQRP
NSCVKLQTVHSIPLTIVKVEAYQRP

SEQ ID NO: 42107 - protein, 25 aa, synthetic construct
  source 1..25: note = Seed: NSCVKLQTVHSIPLTINKEEALQRP
NSCVKLQTVHSIPLTIVKWEAAQRP

SEQ ID NO: 42108 - protein, 25 aa, synthetic construct
  source 1..25: note = Seed: NSCVKLQTVHSIPLTINKEEALQRP
NSCVKLQTVHSIPLTIVKWEAEQRP

SEQ ID NO: 42109 - protein, 25 aa, synthetic construct
  source 1..25: note = Seed: NSCVKLQTVHSIPLTINKEEALQRP
NSCVKLQTVHSIPLTIVKWEAFQRP

SEQ ID NO: 42110 - protein, 25 aa, synthetic construct
  source 1..25: note = Seed: NSCVKLQTVHSIPLTINKEEALQRP
NSCVKLQTVHSIPLTIVKWEAIQRP

SEQ ID NO: 42111 - protein, 25 aa, synthetic construct
  source 1..25: note = Seed: NSCVKLQTVHSIPLTINKEEALQRP
NSCVKLQTVHSIPLTIVKWEALQRP

SEQ ID NO: 42112 - protein, 25 aa, synthetic construct
  source 1..25: note = Seed: NSCVKLQTVHSIPLTINKEEALQRP
NSCVKLQTVHSIPLTIVKWEAMQRP

SEQ ID NO: 42113 - protein, 25 aa, synthetic construct
  source 1..25: note = Seed: NSCVKLQTVHSIPLTINKEEALQRP
NSCVKLQTVHSIPLTIVKWEAVQRP

SEQ ID NO: 42114 - protein, 25 aa, synthetic construct
  source 1..25: note = Seed: NSCVKLQTVHSIPLTINKEEALQRP
NSCVKLQTVHSIPLTIVKWEAYQRP

SEQ ID NO: 42115 - protein, 25 aa, synthetic construct
  source 1..25: note = Seed: NSCVKLQTVHSIPLTINKEEALQRP
NSCVKLQTVHSIPLTIVKYEAAQRP

SEQ ID NO: 42116 - protein, 25 aa, synthetic construct
  source 1..25: note = Seed: NSCVKLQTVHSIPLTINKEEALQRP
NSCVKLQTVHSIPLTIVKYEADQRP

SEQ ID NO: 42117 - protein, 25 aa, synthetic construct
  source 1..25: note = Seed: NSCVKLQTVHSIPLTINKEEALQRP
NSCVKLQTVHSIPLTIVKYEAEQRP

SEQ ID NO: 42118 - protein, 25 aa, synthetic construct
  source 1..25: note = Seed: NSCVKLQTVHSIPLTINKEEALQRP
NSCVKLQTVHSIPLTIVKYEAFQRP

SEQ ID NO: 42119 - protein, 25 aa, synthetic construct
  source 1..25: note = Seed: NSCVKLQTVHSIPLTINKEEALQRP
NSCVKLQTVHSIPLTIVKYEAIQRP

SEQ ID NO: 42120 - protein, 25 aa, synthetic construct
  source 1..25: note = Seed: NSCVKLQTVHSIPLTINKEEALQRP
NSCVKLQTVHSIPLTIVKYEALQRP

SEQ ID NO: 42121 - protein, 25 aa, synthetic construct
  source 1..25: note = Seed: NSCVKLQTVHSIPLTINKEEALQRP
NSCVKLQTVHSIPLTIVKYEAMQRP

SEQ ID NO: 42122 - protein, 25 aa, synthetic construct
  source 1..25: note = Seed: NSCVKLQTVHSIPLTINKEEALQRP
NSCVKLQTVHSIPLTIVKYEANQRP

SEQ ID NO: 42123 - protein, 25 aa, synthetic construct
  source 1..25: note = Seed: NSCVKLQTVHSIPLTINKEEALQRP
NSCVKLQTVHSIPLTIVKYEASQRP

SEQ ID NO: 42124 - protein, 25 aa, synthetic construct
  source 1..25: note = Seed: NSCVKLQTVHSIPLTINKEEALQRP
NSCVKLQTVHSIPLTIVKYEATQRP

SEQ ID NO: 42125 - protein, 25 aa, synthetic construct
  source 1..25: note = Seed: NSCVKLQTVHSIPLTINKEEALQRP
NSCVKLQTVHSIPLTIVKYEAVQRP

SEQ ID NO: 42126 - protein, 25 aa, synthetic construct
  source 1..25: note = Seed: NSCVKLQTVHSIPLTINKEEALQRP
NSCVKLQTVHSIPLTIVKYEAYQRP

SEQ ID NO: 42127 - protein, 25 aa, synthetic construct
  source 1..25: note = Seed: NSCVKLQTVHSIPLTINKEEALQRP
NSCVKLQTVHSIPLTIWKAEAAQRP

SEQ ID NO: 42128 - protein, 25 aa, synthetic construct
  source 1..25: note = Seed: NSCVKLQTVHSIPLTINKEEALQRP
NSCVKLQTVHSIPLTIWKAEAFQRP

SEQ ID NO: 42129 - protein, 25 aa, synthetic construct
  source 1..25: note = Seed: NSCVKLQTVHSIPLTINKEEALQRP
NSCVKLQTVHSIPLTIWKAEAIQRP

SEQ ID NO: 42130 - protein, 25 aa, synthetic construct
  source 1..25: note = Seed: NSCVKLQTVHSIPLTINKEEALQRP
NSCVKLQTVHSIPLTIWKAEALQRP

SEQ ID NO: 42131 - protein, 25 aa, synthetic construct
  source 1..25: note = Seed: NSCVKLQTVHSIPLTINKEEALQRP
NSCVKLQTVHSIPLTIWKAEAMQRP

SEQ ID NO: 42132 - protein, 25 aa, synthetic construct
  source 1..25: note = Seed: NSCVKLQTVHSIPLTINKEEALQRP
NSCVKLQTVHSIPLTIWKAEASQRP

SEQ ID NO: 42133 - protein, 25 aa, synthetic construct
  source 1..25: note = Seed: NSCVKLQTVHSIPLTINKEEALQRP
NSCVKLQTVHSIPLTIWKAEAVQRP

SEQ ID NO: 42134 - protein, 25 aa, synthetic construct
  source 1..25: note = Seed: NSCVKLQTVHSIPLTINKEEALQRP
NSCVKLQTVHSIPLTIWKAEAYQRP

SEQ ID NO: 42135 - protein, 25 aa, synthetic construct
  source 1..25: note = Seed: NSCVKLQTVHSIPLTINKEEALQRP
NSCVKLQTVHSIPLTIWKDEAAQRP

SEQ ID NO: 42136 - protein, 25 aa, synthetic construct
  source 1..25: note = Seed: NSCVKLQTVHSIPLTINKEEALQRP
NSCVKLQTVHSIPLTIWKDEAFQRP

SEQ ID NO: 42137 - protein, 25 aa, synthetic construct
  source 1..25: note = Seed: NSCVKLQTVHSIPLTINKEEALQRP
NSCVKLQTVHSIPLTIWKDEAIQRP

SEQ ID NO: 42138 - protein, 25 aa, synthetic construct
  source 1..25: note = Seed: NSCVKLQTVHSIPLTINKEEALQRP
NSCVKLQTVHSIPLTIWKDEALQRP

SEQ ID NO: 42139 - protein, 25 aa, synthetic construct
  source 1..25: note = Seed: NSCVKLQTVHSIPLTINKEEALQRP
NSCVKLQTVHSIPLTIWKDEAMQRP

SEQ ID NO: 42140 - protein, 25 aa, synthetic construct
  source 1..25: note = Seed: NSCVKLQTVHSIPLTINKEEALQRP
NSCVKLQTVHSIPLTIWKDEASQRP

SEQ ID NO: 42141 - protein, 25 aa, synthetic construct
  source 1..25: note = Seed: NSCVKLQTVHSIPLTINKEEALQRP
NSCVKLQTVHSIPLTIWKDEATQRP

SEQ ID NO: 42142 - protein, 25 aa, synthetic construct
  source 1..25: note = Seed: NSCVKLQTVHSIPLTINKEEALQRP
NSCVKLQTVHSIPLTIWKDEAVQRP

SEQ ID NO: 42143 - protein, 25 aa, synthetic construct
  source 1..25: note = Seed: NSCVKLQTVHSIPLTINKEEALQRP
NSCVKLQTVHSIPLTIWKDEAYQRP

SEQ ID NO: 42144 - protein, 25 aa, synthetic construct
  source 1..25: note = Seed: NSCVKLQTVHSIPLTINKEEALQRP
NSCVKLQTVHSIPLTIWKFEAAQRP

SEQ ID NO: 42145 - protein, 25 aa, synthetic construct
  source 1..25: note = Seed: NSCVKLQTVHSIPLTINKEEALQRP
NSCVKLQTVHSIPLTIWKFEAFQRP

SEQ ID NO: 42146 - protein, 25 aa, synthetic construct
  source 1..25: note = Seed: NSCVKLQTVHSIPLTINKEEALQRP
NSCVKLQTVHSIPLTIWKFEAIQRP

SEQ ID NO: 42147 - protein, 25 aa, synthetic construct
  source 1..25: note = Seed: NSCVKLQTVHSIPLTINKEEALQRP
NSCVKLQTVHSIPLTIWKFEALQRP

SEQ ID NO: 42148 - protein, 25 aa, synthetic construct
  source 1..25: note = Seed: NSCVKLQTVHSIPLTINKEEALQRP
NSCVKLQTVHSIPLTIWKFEAMQRP

SEQ ID NO: 42149 - protein, 25 aa, synthetic construct
  source 1..25: note = Seed: NSCVKLQTVHSIPLTINKEEALQRP
NSCVKLQTVHSIPLTIWKFEAVQRP

SEQ ID NO: 42150 - protein, 25 aa, synthetic construct
  source 1..25: note = Seed: NSCVKLQTVHSIPLTINKEEALQRP
NSCVKLQTVHSIPLTIWKFEAYQRP

SEQ ID NO: 42151 - protein, 25 aa, synthetic construct
  source 1..25: note = Seed: NSCVKLQTVHSIPLTINKEEALQRP
NSCVKLQTVHSIPLTIWKIEAAQRP

SEQ ID NO: 42152 - protein, 25 aa, synthetic construct
  source 1..25: note = Seed: NSCVKLQTVHSIPLTINKEEALQRP
NSCVKLQTVHSIPLTIWKIEACQRP

SEQ ID NO: 42153 - protein, 25 aa, synthetic construct
  source 1..25: note = Seed: NSCVKLQTVHSIPLTINKEEALQRP
NSCVKLQTVHSIPLTIWKIEAFQRP

SEQ ID NO: 42154 - protein, 25 aa, synthetic construct
  source 1..25: note = Seed: NSCVKLQTVHSIPLTINKEEALQRP
NSCVKLQTVHSIPLTIWKIEAIQRP

SEQ ID NO: 42155 - protein, 25 aa, synthetic construct
  source 1..25: note = Seed: NSCVKLQTVHSIPLTINKEEALQRP
NSCVKLQTVHSIPLTIWKIEALQRP

SEQ ID NO: 42156 - protein, 25 aa, synthetic construct
  source 1..25: note = Seed: NSCVKLQTVHSIPLTINKEEALQRP
NSCVKLQTVHSIPLTIWKIEAMQRP

SEQ ID NO: 42157 - protein, 25 aa, synthetic construct
  source 1..25: note = Seed: NSCVKLQTVHSIPLTINKEEALQRP
NSCVKLQTVHSIPLTIWKIEANQRP

SEQ ID NO: 42158 - protein, 25 aa, synthetic construct
  source 1..25: note = Seed: NSCVKLQTVHSIPLTINKEEALQRP
NSCVKLQTVHSIPLTIWKIEASQRP

SEQ ID NO: 42159 - protein, 25 aa, synthetic construct
  source 1..25: note = Seed: NSCVKLQTVHSIPLTINKEEALQRP
NSCVKLQTVHSIPLTIWKIEATQRP

SEQ ID NO: 42160 - protein, 25 aa, synthetic construct
  source 1..25: note = Seed: NSCVKLQTVHSIPLTINKEEALQRP
NSCVKLQTVHSIPLTIWKIEAVQRP

SEQ ID NO: 42161 - protein, 25 aa, synthetic construct
  source 1..25: note = Seed: NSCVKLQTVHSIPLTINKEEALQRP
NSCVKLQTVHSIPLTIWKIEAYQRP

SEQ ID NO: 42162 - protein, 25 aa, synthetic construct
  source 1..25: note = Seed: NSCVKLQTVHSIPLTINKEEALQRP
NSCVKLQTVHSIPLTIWKKEAFQRP

SEQ ID NO: 42163 - protein, 25 aa, synthetic construct
  source 1..25: note = Seed: NSCVKLQTVHSIPLTINKEEALQRP
NSCVKLQTVHSIPLTIWKKEALQRP

SEQ ID NO: 42164 - protein, 25 aa, synthetic construct
  source 1..25: note = Seed: NSCVKLQTVHSIPLTINKEEALQRP
NSCVKLQTVHSIPLTIWKLEAAQRP

SEQ ID NO: 42165 - protein, 25 aa, synthetic construct
  source 1..25: note = Seed: NSCVKLQTVHSIPLTINKEEALQRP
NSCVKLQTVHSIPLTIWKLEAFQRP

SEQ ID NO: 42166 - protein, 25 aa, synthetic construct
  source 1..25: note = Seed: NSCVKLQTVHSIPLTINKEEALQRP
NSCVKLQTVHSIPLTIWKLEAIQRP

SEQ ID NO: 42167 - protein, 25 aa, synthetic construct
  source 1..25: note = Seed: NSCVKLQTVHSIPLTINKEEALQRP
NSCVKLQTVHSIPLTIWKLEALQRP

SEQ ID NO: 42168 - protein, 25 aa, synthetic construct
  source 1..25: note = Seed: NSCVKLQTVHSIPLTINKEEALQRP
NSCVKLQTVHSIPLTIWKLEAMQRP

SEQ ID NO: 42169 - protein, 25 aa, synthetic construct
  source 1..25: note = Seed: NSCVKLQTVHSIPLTINKEEALQRP
NSCVKLQTVHSIPLTIWKLEASQRP

SEQ ID NO: 42170 - protein, 25 aa, synthetic construct
  source 1..25: note = Seed: NSCVKLQTVHSIPLTINKEEALQRP
NSCVKLQTVHSIPLTIWKLEAVQRP

SEQ ID NO: 42171 - protein, 25 aa, synthetic construct
  source 1..25: note = Seed: NSCVKLQTVHSIPLTINKEEALQRP
NSCVKLQTVHSIPLTIWKMEAAQRP

SEQ ID NO: 42172 - protein, 25 aa, synthetic construct
  source 1..25: note = Seed: NSCVKLQTVHSIPLTINKEEALQRP
NSCVKLQTVHSIPLTIWKMEAFQRP

SEQ ID NO: 42173 - protein, 25 aa, synthetic construct
  source 1..25: note = Seed: NSCVKLQTVHSIPLTINKEEALQRP
NSCVKLQTVHSIPLTIWKMEAIQRP

SEQ ID NO: 42174 - protein, 25 aa, synthetic construct
  source 1..25: note = Seed: NSCVKLQTVHSIPLTINKEEALQRP
NSCVKLQTVHSIPLTIWKMEALQRP

SEQ ID NO: 42175 - protein, 25 aa, synthetic construct
  source 1..25: note = Seed: NSCVKLQTVHSIPLTINKEEALQRP
NSCVKLQTVHSIPLTIWKMEAMQRP

SEQ ID NO: 42176 - protein, 25 aa, synthetic construct
  source 1..25: note = Seed: NSCVKLQTVHSIPLTINKEEALQRP
NSCVKLQTVHSIPLTIWKMEASQRP

SEQ ID NO: 42177 - protein, 25 aa, synthetic construct
  source 1..25: note = Seed: NSCVKLQTVHSIPLTINKEEALQRP
NSCVKLQTVHSIPLTIWKMEAVQRP

SEQ ID NO: 42178 - protein, 25 aa, synthetic construct
  source 1..25: note = Seed: NSCVKLQTVHSIPLTINKEEALQRP
NSCVKLQTVHSIPLTIWKNEAAQRP

SEQ ID NO: 42179 - protein, 25 aa, synthetic construct
  source 1..25: note = Seed: NSCVKLQTVHSIPLTINKEEALQRP
NSCVKLQTVHSIPLTIWKNEAFQRP

SEQ ID NO: 42180 - protein, 25 aa, synthetic construct
  source 1..25: note = Seed: NSCVKLQTVHSIPLTINKEEALQRP
NSCVKLQTVHSIPLTIWKNEAIQRP

SEQ ID NO: 42181 - protein, 25 aa, synthetic construct
  source 1..25: note = Seed: NSCVKLQTVHSIPLTINKEEALQRP
NSCVKLQTVHSIPLTIWKNEALQRP

SEQ ID NO: 42182 - protein, 25 aa, synthetic construct
  source 1..25: note = Seed: NSCVKLQTVHSIPLTINKEEALQRP
NSCVKLQTVHSIPLTIWKNEAMQRP

SEQ ID NO: 42183 - protein, 25 aa, synthetic construct
  source 1..25: note = Seed: NSCVKLQTVHSIPLTINKEEALQRP
NSCVKLQTVHSIPLTIWKNEAVQRP

SEQ ID NO: 42184 - protein, 25 aa, synthetic construct
  source 1..25: note = Seed: NSCVKLQTVHSIPLTINKEEALQRP
NSCVKLQTVHSIPLTIWKPEAIQRP

SEQ ID NO: 42185 - protein, 25 aa, synthetic construct
  source 1..25: note = Seed: NSCVKLQTVHSIPLTINKEEALQRP
NSCVKLQTVHSIPLTIWKPEAVQRP

SEQ ID NO: 42186 - protein, 25 aa, synthetic construct
  source 1..25: note = Seed: NSCVKLQTVHSIPLTINKEEALQRP
NSCVKLQTVHSIPLTIWKREAFQRP

SEQ ID NO: 42187 - protein, 25 aa, synthetic construct
  source 1..25: note = Seed: NSCVKLQTVHSIPLTINKEEALQRP
NSCVKLQTVHSIPLTIWKREAIQRP

SEQ ID NO: 42188 - protein, 25 aa, synthetic construct
  source 1..25: note = Seed: NSCVKLQTVHSIPLTINKEEALQRP
NSCVKLQTVHSIPLTIWKREALQRP

SEQ ID NO: 42189 - protein, 25 aa, synthetic construct
  source 1..25: note = Seed: NSCVKLQTVHSIPLTINKEEALQRP
NSCVKLQTVHSIPLTIWKREAMQRP

SEQ ID NO: 42190 - protein, 25 aa, synthetic construct
  source 1..25: note = Seed: NSCVKLQTVHSIPLTINKEEALQRP
NSCVKLQTVHSIPLTIWKREAVQRP

SEQ ID NO: 42191 - protein, 25 aa, synthetic construct
  source 1..25: note = Seed: NSCVKLQTVHSIPLTINKEEALQRP
NSCVKLQTVHSIPLTIWKREAYQRP

SEQ ID NO: 42192 - protein, 25 aa, synthetic construct
  source 1..25: note = Seed: NSCVKLQTVHSIPLTINKEEALQRP
NSCVKLQTVHSIPLTIWKSEAAQRP

SEQ ID NO: 42193 - protein, 25 aa, synthetic construct
  source 1..25: note = Seed: NSCVKLQTVHSIPLTINKEEALQRP
NSCVKLQTVHSIPLTIWKSEAFQRP

SEQ ID NO: 42194 - protein, 25 aa, synthetic construct
  source 1..25: note = Seed: NSCVKLQTVHSIPLTINKEEALQRP
NSCVKLQTVHSIPLTIWKSEAIQRP

SEQ ID NO: 42195 - protein, 25 aa, synthetic construct
  source 1..25: note = Seed: NSCVKLQTVHSIPLTINKEEALQRP
NSCVKLQTVHSIPLTIWKSEALQRP

SEQ ID NO: 42196 - protein, 25 aa, synthetic construct
  source 1..25: note = Seed: NSCVKLQTVHSIPLTINKEEALQRP
NSCVKLQTVHSIPLTIWKSEAMQRP

SEQ ID NO: 42197 - protein, 25 aa, synthetic construct
  source 1..25: note = Seed: NSCVKLQTVHSIPLTINKEEALQRP
NSCVKLQTVHSIPLTIWKSEAVQRP

SEQ ID NO: 42198 - protein, 25 aa, synthetic construct
  source 1..25: note = Seed: NSCVKLQTVHSIPLTINKEEALQRP
NSCVKLQTVHSIPLTIWKTEAAQRP

SEQ ID NO: 42199 - protein, 25 aa, synthetic construct
  source 1..25: note = Seed: NSCVKLQTVHSIPLTINKEEALQRP
NSCVKLQTVHSIPLTIWKTEAFQRP

SEQ ID NO: 42200 - protein, 25 aa, synthetic construct
  source 1..25: note = Seed: NSCVKLQTVHSIPLTINKEEALQRP
NSCVKLQTVHSIPLTIWKTEAIQRP

SEQ ID NO: 42201 - protein, 25 aa, synthetic construct
  source 1..25: note = Seed: NSCVKLQTVHSIPLTINKEEALQRP
NSCVKLQTVHSIPLTIWKTEALQRP

SEQ ID NO: 42202 - protein, 25 aa, synthetic construct
  source 1..25: note = Seed: NSCVKLQTVHSIPLTINKEEALQRP
NSCVKLQTVHSIPLTIWKTEAVQRP

SEQ ID NO: 42203 - protein, 25 aa, synthetic construct
  source 1..25: note = Seed: NSCVKLQTVHSIPLTINKEEALQRP
NSCVKLQTVHSIPLTIWKVEAAQRP

SEQ ID NO: 42204 - protein, 25 aa, synthetic construct
  source 1..25: note = Seed: NSCVKLQTVHSIPLTINKEEALQRP
NSCVKLQTVHSIPLTIWKVEAFQRP

SEQ ID NO: 42205 - protein, 25 aa, synthetic construct
  source 1..25: note = Seed: NSCVKLQTVHSIPLTINKEEALQRP
NSCVKLQTVHSIPLTIWKVEAIQRP

SEQ ID NO: 42206 - protein, 25 aa, synthetic construct
  source 1..25: note = Seed: NSCVKLQTVHSIPLTINKEEALQRP
NSCVKLQTVHSIPLTIWKVEALQRP

SEQ ID NO: 42207 - protein, 25 aa, synthetic construct
  source 1..25: note = Seed: NSCVKLQTVHSIPLTINKEEALQRP
NSCVKLQTVHSIPLTIWKVEAMQRP

SEQ ID NO: 42208 - protein, 25 aa, synthetic construct
  source 1..25: note = Seed: NSCVKLQTVHSIPLTINKEEALQRP
NSCVKLQTVHSIPLTIWKVEASQRP

SEQ ID NO: 42209 - protein, 25 aa, synthetic construct
  source 1..25: note = Seed: NSCVKLQTVHSIPLTINKEEALQRP
NSCVKLQTVHSIPLTIWKVEATQRP

SEQ ID NO: 42210 - protein, 25 aa, synthetic construct
  source 1..25: note = Seed: NSCVKLQTVHSIPLTINKEEALQRP
NSCVKLQTVHSIPLTIWKVEAVQRP

SEQ ID NO: 42211 - protein, 25 aa, synthetic construct
  source 1..25: note = Seed: NSCVKLQTVHSIPLTINKEEALQRP
NSCVKLQTVHSIPLTIWKVEAYQRP

SEQ ID NO: 42212 - protein, 25 aa, synthetic construct
  source 1..25: note = Seed: NSCVKLQTVHSIPLTINKEEALQRP
NSCVKLQTVHSIPLTIWKWEAFQRP

SEQ ID NO: 42213 - protein, 25 aa, synthetic construct
  source 1..25: note = Seed: NSCVKLQTVHSIPLTINKEEALQRP
NSCVKLQTVHSIPLTIWKWEAIQRP

SEQ ID NO: 42214 - protein, 25 aa, synthetic construct
  source 1..25: note = Seed: NSCVKLQTVHSIPLTINKEEALQRP
NSCVKLQTVHSIPLTIWKYEAFQRP

SEQ ID NO: 42215 - protein, 25 aa, synthetic construct
  source 1..25: note = Seed: NSCVKLQTVHSIPLTINKEEALQRP
NSCVKLQTVHSIPLTIWKYEAIQRP

SEQ ID NO: 42216 - protein, 25 aa, synthetic construct
  source 1..25: note = Seed: NSCVKLQTVHSIPLTINKEEALQRP
NSCVKLQTVHSIPLTIWKYEALQRP

SEQ ID NO: 42217 - protein, 25 aa, synthetic construct
  source 1..25: note = Seed: NSCVKLQTVHSIPLTINKEEALQRP
NSCVKLQTVHSIPLTIWKYEAVQRP

SEQ ID NO: 42218 - protein, 25 aa, synthetic construct
  source 1..25: note = Seed: NSCVKLQTVHSIPLTINKEEALQRP
NSCVKLQTVHSIPLTIYKAEAAQRP

SEQ ID NO: 42219 - protein, 25 aa, synthetic construct
  source 1..25: note = Seed: NSCVKLQTVHSIPLTINKEEALQRP
NSCVKLQTVHSIPLTIYKAEACQRP

SEQ ID NO: 42220 - protein, 25 aa, synthetic construct
  source 1..25: note = Seed: NSCVKLQTVHSIPLTINKEEALQRP
NSCVKLQTVHSIPLTIYKAEAFQRP

SEQ ID NO: 42221 - protein, 25 aa, synthetic construct
  source 1..25: note = Seed: NSCVKLQTVHSIPLTINKEEALQRP
NSCVKLQTVHSIPLTIYKAEAGQRP

SEQ ID NO: 42222 - protein, 25 aa, synthetic construct
  source 1..25: note = Seed: NSCVKLQTVHSIPLTINKEEALQRP
NSCVKLQTVHSIPLTIYKAEAIQRP

SEQ ID NO: 42223 - protein, 25 aa, synthetic construct
  source 1..25: note = Seed: NSCVKLQTVHSIPLTINKEEALQRP
NSCVKLQTVHSIPLTIYKAEALQRP

SEQ ID NO: 42224 - protein, 25 aa, synthetic construct
  source 1..25: note = Seed: NSCVKLQTVHSIPLTINKEEALQRP
NSCVKLQTVHSIPLTIYKAEAMQRP

SEQ ID NO: 42225 - protein, 25 aa, synthetic construct
  source 1..25: note = Seed: NSCVKLQTVHSIPLTINKEEALQRP
NSCVKLQTVHSIPLTIYKAEASQRP

SEQ ID NO: 42226 - protein, 25 aa, synthetic construct
  source 1..25: note = Seed: NSCVKLQTVHSIPLTINKEEALQRP
NSCVKLQTVHSIPLTIYKAEATQRP

SEQ ID NO: 42227 - protein, 25 aa, synthetic construct
  source 1..25: note = Seed: NSCVKLQTVHSIPLTINKEEALQRP
NSCVKLQTVHSIPLTIYKAEAVQRP

SEQ ID NO: 42228 - protein, 25 aa, synthetic construct
  source 1..25: note = Seed: NSCVKLQTVHSIPLTINKEEALQRP
NSCVKLQTVHSIPLTIYKAEAYQRP

SEQ ID NO: 42229 - protein, 25 aa, synthetic construct
  source 1..25: note = Seed: NSCVKLQTVHSIPLTINKEEALQRP
NSCVKLQTVHSIPLTIYKDEAAQRP

SEQ ID NO: 42230 - protein, 25 aa, synthetic construct
  source 1..25: note = Seed: NSCVKLQTVHSIPLTINKEEALQRP
NSCVKLQTVHSIPLTIYKDEACQRP

SEQ ID NO: 42231 - protein, 25 aa, synthetic construct
  source 1..25: note = Seed: NSCVKLQTVHSIPLTINKEEALQRP
NSCVKLQTVHSIPLTIYKDEADQRP

SEQ ID NO: 42232 - protein, 25 aa, synthetic construct
  source 1..25: note = Seed: NSCVKLQTVHSIPLTINKEEALQRP
NSCVKLQTVHSIPLTIYKDEAFQRP

SEQ ID NO: 42233 - protein, 25 aa, synthetic construct
  source 1..25: note = Seed: NSCVKLQTVHSIPLTINKEEALQRP
NSCVKLQTVHSIPLTIYKDEAGQRP

SEQ ID NO: 42234 - protein, 25 aa, synthetic construct
  source 1..25: note = Seed: NSCVKLQTVHSIPLTINKEEALQRP
NSCVKLQTVHSIPLTIYKDEAIQRP

SEQ ID NO: 42235 - protein, 25 aa, synthetic construct
  source 1..25: note = Seed: NSCVKLQTVHSIPLTINKEEALQRP
NSCVKLQTVHSIPLTIYKDEALQRP

SEQ ID NO: 42236 - protein, 25 aa, synthetic construct
  source 1..25: note = Seed: NSCVKLQTVHSIPLTINKEEALQRP
NSCVKLQTVHSIPLTIYKDEAMQRP

SEQ ID NO: 42237 - protein, 25 aa, synthetic construct
  source 1..25: note = Seed: NSCVKLQTVHSIPLTINKEEALQRP
NSCVKLQTVHSIPLTIYKDEANQRP

SEQ ID NO: 42238 - protein, 25 aa, synthetic construct
  source 1..25: note = Seed: NSCVKLQTVHSIPLTINKEEALQRP
NSCVKLQTVHSIPLTIYKDEAQQRP

SEQ ID NO: 42239 - protein, 25 aa, synthetic construct
  source 1..25: note = Seed: NSCVKLQTVHSIPLTINKEEALQRP
NSCVKLQTVHSIPLTIYKDEASQRP

SEQ ID NO: 42240 - protein, 25 aa, synthetic construct
  source 1..25: note = Seed: NSCVKLQTVHSIPLTINKEEALQRP
NSCVKLQTVHSIPLTIYKDEATQRP

SEQ ID NO: 42241 - protein, 25 aa, synthetic construct
  source 1..25: note = Seed: NSCVKLQTVHSIPLTINKEEALQRP
NSCVKLQTVHSIPLTIYKDEAVQRP

SEQ ID NO: 42242 - protein, 25 aa, synthetic construct
  source 1..25: note = Seed: NSCVKLQTVHSIPLTINKEEALQRP
NSCVKLQTVHSIPLTIYKDEAYQRP

SEQ ID NO: 42243 - protein, 25 aa, synthetic construct
  source 1..25: note = Seed: NSCVKLQTVHSIPLTINKEEALQRP
NSCVKLQTVHSIPLTIYKFEAAQRP

SEQ ID NO: 42244 - protein, 25 aa, synthetic construct
  source 1..25: note = Seed: NSCVKLQTVHSIPLTINKEEALQRP
NSCVKLQTVHSIPLTIYKFEADQRP

SEQ ID NO: 42245 - protein, 25 aa, synthetic construct
  source 1..25: note = Seed: NSCVKLQTVHSIPLTINKEEALQRP
NSCVKLQTVHSIPLTIYKFEAEQRP

SEQ ID NO: 42246 - protein, 25 aa, synthetic construct
  source 1..25: note = Seed: NSCVKLQTVHSIPLTINKEEALQRP
NSCVKLQTVHSIPLTIYKFEAFQRP

SEQ ID NO: 42247 - protein, 25 aa, synthetic construct
  source 1..25: note = Seed: NSCVKLQTVHSIPLTINKEEALQRP
NSCVKLQTVHSIPLTIYKFEAHQRP

SEQ ID NO: 42248 - protein, 25 aa, synthetic construct
  source 1..25: note = Seed: NSCVKLQTVHSIPLTINKEEALQRP
NSCVKLQTVHSIPLTIYKFEAIQRP

SEQ ID NO: 42249 - protein, 25 aa, synthetic construct
  source 1..25: note = Seed: NSCVKLQTVHSIPLTINKEEALQRP
NSCVKLQTVHSIPLTIYKFEAKQRP

SEQ ID NO: 42250 - protein, 25 aa, synthetic construct
  source 1..25: note = Seed: NSCVKLQTVHSIPLTINKEEALQRP
NSCVKLQTVHSIPLTIYKFEALQRP

SEQ ID NO: 42251 - protein, 25 aa, synthetic construct
  source 1..25: note = Seed: NSCVKLQTVHSIPLTINKEEALQRP
NSCVKLQTVHSIPLTIYKFEAMQRP

SEQ ID NO: 42252 - protein, 25 aa, synthetic construct
  source 1..25: note = Seed: NSCVKLQTVHSIPLTINKEEALQRP
NSCVKLQTVHSIPLTIYKFEANQRP

SEQ ID NO: 42253 - protein, 25 aa, synthetic construct
  source 1..25: note = Seed: NSCVKLQTVHSIPLTINKEEALQRP
NSCVKLQTVHSIPLTIYKFEAPQRP

SEQ ID NO: 42254 - protein, 25 aa, synthetic construct
  source 1..25: note = Seed: NSCVKLQTVHSIPLTINKEEALQRP
NSCVKLQTVHSIPLTIYKFEAQQRP

SEQ ID NO: 42255 - protein, 25 aa, synthetic construct
  source 1..25: note = Seed: NSCVKLQTVHSIPLTINKEEALQRP
NSCVKLQTVHSIPLTIYKFEARQRP

SEQ ID NO: 42256 - protein, 25 aa, synthetic construct
  source 1..25: note = Seed: NSCVKLQTVHSIPLTINKEEALQRP
NSCVKLQTVHSIPLTIYKFEASQRP

SEQ ID NO: 42257 - protein, 25 aa, synthetic construct
  source 1..25: note = Seed: NSCVKLQTVHSIPLTINKEEALQRP
NSCVKLQTVHSIPLTIYKFEATQRP

SEQ ID NO: 42258 - protein, 25 aa, synthetic construct
  source 1..25: note = Seed: NSCVKLQTVHSIPLTINKEEALQRP
NSCVKLQTVHSIPLTIYKFEAVQRP

SEQ ID NO: 42259 - protein, 25 aa, synthetic construct
  source 1..25: note = Seed: NSCVKLQTVHSIPLTINKEEALQRP
NSCVKLQTVHSIPLTIYKFEAWQRP

SEQ ID NO: 42260 - protein, 25 aa, synthetic construct
  source 1..25: note = Seed: NSCVKLQTVHSIPLTINKEEALQRP
NSCVKLQTVHSIPLTIYKFEAYQRP

SEQ ID NO: 42261 - protein, 25 aa, synthetic construct
  source 1..25: note = Seed: NSCVKLQTVHSIPLTINKEEALQRP
NSCVKLQTVHSIPLTIYKGEAAQRP

SEQ ID NO: 42262 - protein, 25 aa, synthetic construct
  source 1..25: note = Seed: NSCVKLQTVHSIPLTINKEEALQRP
NSCVKLQTVHSIPLTIYKGEAIQRP

SEQ ID NO: 42263 - protein, 25 aa, synthetic construct
  source 1..25: note = Seed: NSCVKLQTVHSIPLTINKEEALQRP
NSCVKLQTVHSIPLTIYKGEALQRP

SEQ ID NO: 42264 - protein, 25 aa, synthetic construct
  source 1..25: note = Seed: NSCVKLQTVHSIPLTINKEEALQRP
NSCVKLQTVHSIPLTIYKGEAVQRP

SEQ ID NO: 42265 - protein, 25 aa, synthetic construct
  source 1..25: note = Seed: NSCVKLQTVHSIPLTINKEEALQRP
NSCVKLQTVHSIPLTIYKIEAAQRP

SEQ ID NO: 42266 - protein, 25 aa, synthetic construct
  source 1..25: note = Seed: NSCVKLQTVHSIPLTINKEEALQRP
NSCVKLQTVHSIPLTIYKIEACQRP

SEQ ID NO: 42267 - protein, 25 aa, synthetic construct
  source 1..25: note = Seed: NSCVKLQTVHSIPLTINKEEALQRP
NSCVKLQTVHSIPLTIYKIEADQRP

SEQ ID NO: 42268 - protein, 25 aa, synthetic construct
  source 1..25: note = Seed: NSCVKLQTVHSIPLTINKEEALQRP
NSCVKLQTVHSIPLTIYKIEAEQRP

SEQ ID NO: 42269 - protein, 25 aa, synthetic construct
  source 1..25: note = Seed: NSCVKLQTVHSIPLTINKEEALQRP
NSCVKLQTVHSIPLTIYKIEAFQRP

SEQ ID NO: 42270 - protein, 25 aa, synthetic construct
  source 1..25: note = Seed: NSCVKLQTVHSIPLTINKEEALQRP
NSCVKLQTVHSIPLTIYKIEAGQRP

SEQ ID NO: 42271 - protein, 25 aa, synthetic construct
  source 1..25: note = Seed: NSCVKLQTVHSIPLTINKEEALQRP
NSCVKLQTVHSIPLTIYKIEAHQRP

SEQ ID NO: 42272 - protein, 25 aa, synthetic construct
  source 1..25: note = Seed: NSCVKLQTVHSIPLTINKEEALQRP
NSCVKLQTVHSIPLTIYKIEAIQRP

SEQ ID NO: 42273 - protein, 25 aa, synthetic construct
  source 1..25: note = Seed: NSCVKLQTVHSIPLTINKEEALQRP
NSCVKLQTVHSIPLTIYKIEALQRP

SEQ ID NO: 42274 - protein, 25 aa, synthetic construct
  source 1..25: note = Seed: NSCVKLQTVHSIPLTINKEEALQRP
NSCVKLQTVHSIPLTIYKIEAMQRP

SEQ ID NO: 42275 - protein, 25 aa, synthetic construct
  source 1..25: note = Seed: NSCVKLQTVHSIPLTINKEEALQRP
NSCVKLQTVHSIPLTIYKIEANQRP

SEQ ID NO: 42276 - protein, 25 aa, synthetic construct
  source 1..25: note = Seed: NSCVKLQTVHSIPLTINKEEALQRP
NSCVKLQTVHSIPLTIYKIEAPQRP

SEQ ID NO: 42277 - protein, 25 aa, synthetic construct
  source 1..25: note = Seed: NSCVKLQTVHSIPLTINKEEALQRP
NSCVKLQTVHSIPLTIYKIEAQQRP

SEQ ID NO: 42278 - protein, 25 aa, synthetic construct
  source 1..25: note = Seed: NSCVKLQTVHSIPLTINKEEALQRP
NSCVKLQTVHSIPLTIYKIEASQRP

SEQ ID NO: 42279 - protein, 25 aa, synthetic construct
  source 1..25: note = Seed: NSCVKLQTVHSIPLTINKEEALQRP
NSCVKLQTVHSIPLTIYKIEATQRP

SEQ ID NO: 42280 - protein, 25 aa, synthetic construct
  source 1..25: note = Seed: NSCVKLQTVHSIPLTINKEEALQRP
NSCVKLQTVHSIPLTIYKIEAVQRP

SEQ ID NO: 42281 - protein, 25 aa, synthetic construct
  source 1..25: note = Seed: NSCVKLQTVHSIPLTINKEEALQRP
NSCVKLQTVHSIPLTIYKIEAYQRP

SEQ ID NO: 42282 - protein, 25 aa, synthetic construct
  source 1..25: note = Seed: NSCVKLQTVHSIPLTINKEEALQRP
NSCVKLQTVHSIPLTIYKKEAFQRP

SEQ ID NO: 42283 - protein, 25 aa, synthetic construct
  source 1..25: note = Seed: NSCVKLQTVHSIPLTINKEEALQRP
NSCVKLQTVHSIPLTIYKLEAAQRP

SEQ ID NO: 42284 - protein, 25 aa, synthetic construct
  source 1..25: note = Seed: NSCVKLQTVHSIPLTINKEEALQRP
NSCVKLQTVHSIPLTIYKLEAEQRP

SEQ ID NO: 42285 - protein, 25 aa, synthetic construct
  source 1..25: note = Seed: NSCVKLQTVHSIPLTINKEEALQRP
NSCVKLQTVHSIPLTIYKLEAFQRP

SEQ ID NO: 42286 - protein, 25 aa, synthetic construct
  source 1..25: note = Seed: NSCVKLQTVHSIPLTINKEEALQRP
NSCVKLQTVHSIPLTIYKLEAGQRP

SEQ ID NO: 42287 - protein, 25 aa, synthetic construct
  source 1..25: note = Seed: NSCVKLQTVHSIPLTINKEEALQRP
NSCVKLQTVHSIPLTIYKLEAIQRP

SEQ ID NO: 42288 - protein, 25 aa, synthetic construct
  source 1..25: note = Seed: NSCVKLQTVHSIPLTINKEEALQRP
NSCVKLQTVHSIPLTIYKLEALQRP

SEQ ID NO: 42289 - protein, 25 aa, synthetic construct
  source 1..25: note = Seed: NSCVKLQTVHSIPLTINKEEALQRP
NSCVKLQTVHSIPLTIYKLEAMQRP

SEQ ID NO: 42290 - protein, 25 aa, synthetic construct
  source 1..25: note = Seed: NSCVKLQTVHSIPLTINKEEALQRP
NSCVKLQTVHSIPLTIYKLEANQRP

SEQ ID NO: 42291 - protein, 25 aa, synthetic construct
  source 1..25: note = Seed: NSCVKLQTVHSIPLTINKEEALQRP
NSCVKLQTVHSIPLTIYKLEAQQRP

SEQ ID NO: 42292 - protein, 25 aa, synthetic construct
  source 1..25: note = Seed: NSCVKLQTVHSIPLTINKEEALQRP
NSCVKLQTVHSIPLTIYKLEARQRP

SEQ ID NO: 42293 - protein, 25 aa, synthetic construct
  source 1..25: note = Seed: NSCVKLQTVHSIPLTINKEEALQRP
NSCVKLQTVHSIPLTIYKLEASQRP

SEQ ID NO: 42294 - protein, 25 aa, synthetic construct
  source 1..25: note = Seed: NSCVKLQTVHSIPLTINKEEALQRP
NSCVKLQTVHSIPLTIYKLEATQRP

SEQ ID NO: 42295 - protein, 25 aa, synthetic construct
  source 1..25: note = Seed: NSCVKLQTVHSIPLTINKEEALQRP
NSCVKLQTVHSIPLTIYKLEAVQRP

SEQ ID NO: 42296 - protein, 25 aa, synthetic construct
  source 1..25: note = Seed: NSCVKLQTVHSIPLTINKEEALQRP
NSCVKLQTVHSIPLTIYKLEAYQRP

SEQ ID NO: 42297 - protein, 25 aa, synthetic construct
  source 1..25: note = Seed: NSCVKLQTVHSIPLTINKEEALQRP
NSCVKLQTVHSIPLTIYKMEAAQRP

SEQ ID NO: 42298 - protein, 25 aa, synthetic construct
  source 1..25: note = Seed: NSCVKLQTVHSIPLTINKEEALQRP
NSCVKLQTVHSIPLTIYKMEAFQRP

SEQ ID NO: 42299 - protein, 25 aa, synthetic construct
  source 1..25: note = Seed: NSCVKLQTVHSIPLTINKEEALQRP
NSCVKLQTVHSIPLTIYKMEAIQRP

SEQ ID NO: 42300 - protein, 25 aa, synthetic construct
  source 1..25: note = Seed: NSCVKLQTVHSIPLTINKEEALQRP
NSCVKLQTVHSIPLTIYKMEALQRP

SEQ ID NO: 42301 - protein, 25 aa, synthetic construct
  source 1..25: note = Seed: NSCVKLQTVHSIPLTINKEEALQRP
NSCVKLQTVHSIPLTIYKMEAMQRP

SEQ ID NO: 42302 - protein, 25 aa, synthetic construct
  source 1..25: note = Seed: NSCVKLQTVHSIPLTINKEEALQRP
NSCVKLQTVHSIPLTIYKMEASQRP

SEQ ID NO: 42303 - protein, 25 aa, synthetic construct
  source 1..25: note = Seed: NSCVKLQTVHSIPLTINKEEALQRP
NSCVKLQTVHSIPLTIYKMEAVQRP

SEQ ID NO: 42304 - protein, 25 aa, synthetic construct
  source 1..25: note = Seed: NSCVKLQTVHSIPLTINKEEALQRP
NSCVKLQTVHSIPLTIYKMEAYQRP

SEQ ID NO: 42305 - protein, 25 aa, synthetic construct
  source 1..25: note = Seed: NSCVKLQTVHSIPLTINKEEALQRP
NSCVKLQTVHSIPLTIYKNEAAQRP

SEQ ID NO: 42306 - protein, 25 aa, synthetic construct
  source 1..25: note = Seed: NSCVKLQTVHSIPLTINKEEALQRP
NSCVKLQTVHSIPLTIYKNEACQRP

SEQ ID NO: 42307 - protein, 25 aa, synthetic construct
  source 1..25: note = Seed: NSCVKLQTVHSIPLTINKEEALQRP
NSCVKLQTVHSIPLTIYKNEAFQRP

SEQ ID NO: 42308 - protein, 25 aa, synthetic construct
  source 1..25: note = Seed: NSCVKLQTVHSIPLTINKEEALQRP
NSCVKLQTVHSIPLTIYKNEAIQRP

SEQ ID NO: 42309 - protein, 25 aa, synthetic construct
  source 1..25: note = Seed: NSCVKLQTVHSIPLTINKEEALQRP
NSCVKLQTVHSIPLTIYKNEALQRP

SEQ ID NO: 42310 - protein, 25 aa, synthetic construct
  source 1..25: note = Seed: NSCVKLQTVHSIPLTINKEEALQRP
NSCVKLQTVHSIPLTIYKNEAMQRP

SEQ ID NO: 42311 - protein, 25 aa, synthetic construct
  source 1..25: note = Seed: NSCVKLQTVHSIPLTINKEEALQRP
NSCVKLQTVHSIPLTIYKNEASQRP

SEQ ID NO: 42312 - protein, 25 aa, synthetic construct
  source 1..25: note = Seed: NSCVKLQTVHSIPLTINKEEALQRP
NSCVKLQTVHSIPLTIYKNEATQRP

SEQ ID NO: 42313 - protein, 25 aa, synthetic construct
  source 1..25: note = Seed: NSCVKLQTVHSIPLTINKEEALQRP
NSCVKLQTVHSIPLTIYKNEAVQRP

SEQ ID NO: 42314 - protein, 25 aa, synthetic construct
  source 1..25: note = Seed: NSCVKLQTVHSIPLTINKEEALQRP
NSCVKLQTVHSIPLTIYKNEAYQRP

SEQ ID NO: 42315 - protein, 25 aa, synthetic construct
  source 1..25: note = Seed: NSCVKLQTVHSIPLTINKEEALQRP
NSCVKLQTVHSIPLTIYKPEAAQRP

SEQ ID NO: 42316 - protein, 25 aa, synthetic construct
  source 1..25: note = Seed: NSCVKLQTVHSIPLTINKEEALQRP
NSCVKLQTVHSIPLTIYKPEAFQRP

SEQ ID NO: 42317 - protein, 25 aa, synthetic construct
  source 1..25: note = Seed: NSCVKLQTVHSIPLTINKEEALQRP
NSCVKLQTVHSIPLTIYKPEAIQRP

SEQ ID NO: 42318 - protein, 25 aa, synthetic construct
  source 1..25: note = Seed: NSCVKLQTVHSIPLTINKEEALQRP
NSCVKLQTVHSIPLTIYKPEALQRP

SEQ ID NO: 42319 - protein, 25 aa, synthetic construct
  source 1..25: note = Seed: NSCVKLQTVHSIPLTINKEEALQRP
NSCVKLQTVHSIPLTIYKPEAVQRP

SEQ ID NO: 42320 - protein, 25 aa, synthetic construct
  source 1..25: note = Seed: NSCVKLQTVHSIPLTINKEEALQRP
NSCVKLQTVHSIPLTIYKREAFQRP

SEQ ID NO: 42321 - protein, 25 aa, synthetic construct
  source 1..25: note = Seed: NSCVKLQTVHSIPLTINKEEALQRP
NSCVKLQTVHSIPLTIYKREAIQRP

SEQ ID NO: 42322 - protein, 25 aa, synthetic construct
  source 1..25: note = Seed: NSCVKLQTVHSIPLTINKEEALQRP
NSCVKLQTVHSIPLTIYKREALQRP

SEQ ID NO: 42323 - protein, 25 aa, synthetic construct
  source 1..25: note = Seed: NSCVKLQTVHSIPLTINKEEALQRP
NSCVKLQTVHSIPLTIYKREAMQRP

SEQ ID NO: 42324 - protein, 25 aa, synthetic construct
  source 1..25: note = Seed: NSCVKLQTVHSIPLTINKEEALQRP
NSCVKLQTVHSIPLTIYKREARQRP

SEQ ID NO: 42325 - protein, 25 aa, synthetic construct
  source 1..25: note = Seed: NSCVKLQTVHSIPLTINKEEALQRP
NSCVKLQTVHSIPLTIYKREAYQRP

SEQ ID NO: 42326 - protein, 25 aa, synthetic construct
  source 1..25: note = Seed: NSCVKLQTVHSIPLTINKEEALQRP
NSCVKLQTVHSIPLTIYKSEAAQRP

SEQ ID NO: 42327 - protein, 25 aa, synthetic construct
  source 1..25: note = Seed: NSCVKLQTVHSIPLTINKEEALQRP
NSCVKLQTVHSIPLTIYKSEAFQRP

SEQ ID NO: 42328 - protein, 25 aa, synthetic construct
  source 1..25: note = Seed: NSCVKLQTVHSIPLTINKEEALQRP
NSCVKLQTVHSIPLTIYKSEAIQRP

SEQ ID NO: 42329 - protein, 25 aa, synthetic construct
  source 1..25: note = Seed: NSCVKLQTVHSIPLTINKEEALQRP
NSCVKLQTVHSIPLTIYKSEALQRP

SEQ ID NO: 42330 - protein, 25 aa, synthetic construct
  source 1..25: note = Seed: NSCVKLQTVHSIPLTINKEEALQRP
NSCVKLQTVHSIPLTIYKSEAMQRP

SEQ ID NO: 42331 - protein, 25 aa, synthetic construct
  source 1..25: note = Seed: NSCVKLQTVHSIPLTINKEEALQRP
NSCVKLQTVHSIPLTIYKSEASQRP

SEQ ID NO: 42332 - protein, 25 aa, synthetic construct
  source 1..25: note = Seed: NSCVKLQTVHSIPLTINKEEALQRP
NSCVKLQTVHSIPLTIYKSEAVQRP

SEQ ID NO: 42333 - protein, 25 aa, synthetic construct
  source 1..25: note = Seed: NSCVKLQTVHSIPLTINKEEALQRP
NSCVKLQTVHSIPLTIYKTEAAQRP

SEQ ID NO: 42334 - protein, 25 aa, synthetic construct
  source 1..25: note = Seed: NSCVKLQTVHSIPLTINKEEALQRP
NSCVKLQTVHSIPLTIYKTEAFQRP

SEQ ID NO: 42335 - protein, 25 aa, synthetic construct
  source 1..25: note = Seed: NSCVKLQTVHSIPLTINKEEALQRP
NSCVKLQTVHSIPLTIYKTEAIQRP

SEQ ID NO: 42336 - protein, 25 aa, synthetic construct
  source 1..25: note = Seed: NSCVKLQTVHSIPLTINKEEALQRP
NSCVKLQTVHSIPLTIYKTEALQRP

SEQ ID NO: 42337 - protein, 25 aa, synthetic construct
  source 1..25: note = Seed: NSCVKLQTVHSIPLTINKEEALQRP
NSCVKLQTVHSIPLTIYKTEAMQRP

SEQ ID NO: 42338 - protein, 25 aa, synthetic construct
  source 1..25: note = Seed: NSCVKLQTVHSIPLTINKEEALQRP
NSCVKLQTVHSIPLTIYKTEAVQRP

SEQ ID NO: 42339 - protein, 25 aa, synthetic construct
  source 1..25: note = Seed: NSCVKLQTVHSIPLTINKEEALQRP
NSCVKLQTVHSIPLTIYKVEAAQRP

SEQ ID NO: 42340 - protein, 25 aa, synthetic construct
  source 1..25: note = Seed: NSCVKLQTVHSIPLTINKEEALQRP
NSCVKLQTVHSIPLTIYKVEACQRP

SEQ ID NO: 42341 - protein, 25 aa, synthetic construct
  source 1..25: note = Seed: NSCVKLQTVHSIPLTINKEEALQRP
NSCVKLQTVHSIPLTIYKVEAFQRP

SEQ ID NO: 42342 - protein, 25 aa, synthetic construct
  source 1..25: note = Seed: NSCVKLQTVHSIPLTINKEEALQRP
NSCVKLQTVHSIPLTIYKVEAGQRP

SEQ ID NO: 42343 - protein, 25 aa, synthetic construct
  source 1..25: note = Seed: NSCVKLQTVHSIPLTINKEEALQRP
NSCVKLQTVHSIPLTIYKVEAIQRP

SEQ ID NO: 42344 - protein, 25 aa, synthetic construct
  source 1..25: note = Seed: NSCVKLQTVHSIPLTINKEEALQRP
NSCVKLQTVHSIPLTIYKVEALQRP

SEQ ID NO: 42345 - protein, 25 aa, synthetic construct
  source 1..25: note = Seed: NSCVKLQTVHSIPLTINKEEALQRP
NSCVKLQTVHSIPLTIYKVEAMQRP

SEQ ID NO: 42346 - protein, 25 aa, synthetic construct
  source 1..25: note = Seed: NSCVKLQTVHSIPLTINKEEALQRP
NSCVKLQTVHSIPLTIYKVEANQRP

SEQ ID NO: 42347 - protein, 25 aa, synthetic construct
  source 1..25: note = Seed: NSCVKLQTVHSIPLTINKEEALQRP
NSCVKLQTVHSIPLTIYKVEAQQRP

SEQ ID NO: 42348 - protein, 25 aa, synthetic construct
  source 1..25: note = Seed: NSCVKLQTVHSIPLTINKEEALQRP
NSCVKLQTVHSIPLTIYKVEASQRP

SEQ ID NO: 42349 - protein, 25 aa, synthetic construct
  source 1..25: note = Seed: NSCVKLQTVHSIPLTINKEEALQRP
NSCVKLQTVHSIPLTIYKVEATQRP

SEQ ID NO: 42350 - protein, 25 aa, synthetic construct
  source 1..25: note = Seed: NSCVKLQTVHSIPLTINKEEALQRP
NSCVKLQTVHSIPLTIYKVEAVQRP

SEQ ID NO: 42351 - protein, 25 aa, synthetic construct
  source 1..25: note = Seed: NSCVKLQTVHSIPLTINKEEALQRP
NSCVKLQTVHSIPLTIYKVEAYQRP

SEQ ID NO: 42352 - protein, 25 aa, synthetic construct
  source 1..25: note = Seed: NSCVKLQTVHSIPLTINKEEALQRP
NSCVKLQTVHSIPLTIYKWEAFQRP

SEQ ID NO: 42353 - protein, 25 aa, synthetic construct
  source 1..25: note = Seed: NSCVKLQTVHSIPLTINKEEALQRP
NSCVKLQTVHSIPLTIYKWEAIQRP

SEQ ID NO: 42354 - protein, 25 aa, synthetic construct
  source 1..25: note = Seed: NSCVKLQTVHSIPLTINKEEALQRP
NSCVKLQTVHSIPLTIYKWEALQRP

SEQ ID NO: 42355 - protein, 25 aa, synthetic construct
  source 1..25: note = Seed: NSCVKLQTVHSIPLTINKEEALQRP
NSCVKLQTVHSIPLTIYKWEAMQRP

SEQ ID NO: 42356 - protein, 25 aa, synthetic construct
  source 1..25: note = Seed: NSCVKLQTVHSIPLTINKEEALQRP
NSCVKLQTVHSIPLTIYKWEAVQRP

SEQ ID NO: 42357 - protein, 25 aa, synthetic construct
  source 1..25: note = Seed: NSCVKLQTVHSIPLTINKEEALQRP
NSCVKLQTVHSIPLTIYKYEAFQRP

SEQ ID NO: 42358 - protein, 25 aa, synthetic construct
  source 1..25: note = Seed: NSCVKLQTVHSIPLTINKEEALQRP
NSCVKLQTVHSIPLTIYKYEAIQRP

SEQ ID NO: 42359 - protein, 25 aa, synthetic construct
  source 1..25: note = Seed: NSCVKLQTVHSIPLTINKEEALQRP
NSCVKLQTVHSIPLTIYKYEALQRP

SEQ ID NO: 42360 - protein, 25 aa, synthetic construct
  source 1..25: note = Seed: NSCVKLQTVHSIPLTINKEEALQRP
NSCVKLQTVHSIPLTIYKYEAMQRP

SEQ ID NO: 42361 - protein, 25 aa, synthetic construct
  source 1..25: note = Seed: NSCVKLQTVHSIPLTINKEEALQRP
NSCVKLQTVHSIPLTIYKYEAVQRP

SEQ ID NO: 42362 - protein, 25 aa, synthetic construct
  source 1..25: note = Seed: NSCVKLQTVHSIPLTINKEEALQRP
NSCVKLQTVHSIPLTIYKYEAYQRP

SEQ ID NO: 42363 - protein, 25 aa, synthetic construct
  source 1..25: note = Seed: NSCVKLQTVHSIPLTINKEEALQRP
NSCVKLQTVHSIPMTIAKAEAAQRP

SEQ ID NO: 42364 - protein, 25 aa, synthetic construct
  source 1..25: note = Seed: NSCVKLQTVHSIPLTINKEEALQRP
NSCVKLQTVHSIPMTIAKAEAIQRP

SEQ ID NO: 42365 - protein, 25 aa, synthetic construct
  source 1..25: note = Seed: NSCVKLQTVHSIPLTINKEEALQRP
NSCVKLQTVHSIPMTIAKAEALQRP

SEQ ID NO: 42366 - protein, 25 aa, synthetic construct
  source 1..25: note = Seed: NSCVKLQTVHSIPLTINKEEALQRP
NSCVKLQTVHSIPMTIAKAEAVQRP

SEQ ID NO: 42367 - protein, 25 aa, synthetic construct
  source 1..25: note = Seed: NSCVKLQTVHSIPLTINKEEALQRP
NSCVKLQTVHSIPMTIAKDEAIQRP

SEQ ID NO: 42368 - protein, 25 aa, synthetic construct
  source 1..25: note = Seed: NSCVKLQTVHSIPLTINKEEALQRP
NSCVKLQTVHSIPMTIAKDEALQRP

SEQ ID NO: 42369 - protein, 25 aa, synthetic construct
  source 1..25: note = Seed: NSCVKLQTVHSIPLTINKEEALQRP
NSCVKLQTVHSIPMTIAKDEAVQRP

SEQ ID NO: 42370 - protein, 25 aa, synthetic construct
  source 1..25: note = Seed: NSCVKLQTVHSIPLTINKEEALQRP
NSCVKLQTVHSIPMTIAKFEAFQRP

SEQ ID NO: 42371 - protein, 25 aa, synthetic construct
  source 1..25: note = Seed: NSCVKLQTVHSIPLTINKEEALQRP
NSCVKLQTVHSIPMTIAKFEAIQRP

SEQ ID NO: 42372 - protein, 25 aa, synthetic construct
  source 1..25: note = Seed: NSCVKLQTVHSIPLTINKEEALQRP
NSCVKLQTVHSIPMTIAKFEALQRP

SEQ ID NO: 42373 - protein, 25 aa, synthetic construct
  source 1..25: note = Seed: NSCVKLQTVHSIPLTINKEEALQRP
NSCVKLQTVHSIPMTIAKFEAMQRP

SEQ ID NO: 42374 - protein, 25 aa, synthetic construct
  source 1..25: note = Seed: NSCVKLQTVHSIPLTINKEEALQRP
NSCVKLQTVHSIPMTIAKFEAVQRP

SEQ ID NO: 42375 - protein, 25 aa, synthetic construct
  source 1..25: note = Seed: NSCVKLQTVHSIPLTINKEEALQRP
NSCVKLQTVHSIPMTIAKIEAAQRP

SEQ ID NO: 42376 - protein, 25 aa, synthetic construct
  source 1..25: note = Seed: NSCVKLQTVHSIPLTINKEEALQRP
NSCVKLQTVHSIPMTIAKIEAFQRP

SEQ ID NO: 42377 - protein, 25 aa, synthetic construct
  source 1..25: note = Seed: NSCVKLQTVHSIPLTINKEEALQRP
NSCVKLQTVHSIPMTIAKIEAIQRP

SEQ ID NO: 42378 - protein, 25 aa, synthetic construct
  source 1..25: note = Seed: NSCVKLQTVHSIPLTINKEEALQRP
NSCVKLQTVHSIPMTIAKIEALQRP

SEQ ID NO: 42379 - protein, 25 aa, synthetic construct
  source 1..25: note = Seed: NSCVKLQTVHSIPLTINKEEALQRP
NSCVKLQTVHSIPMTIAKIEAMQRP

SEQ ID NO: 42380 - protein, 25 aa, synthetic construct
  source 1..25: note = Seed: NSCVKLQTVHSIPLTINKEEALQRP
NSCVKLQTVHSIPMTIAKIEASQRP

SEQ ID NO: 42381 - protein, 25 aa, synthetic construct
  source 1..25: note = Seed: NSCVKLQTVHSIPLTINKEEALQRP
NSCVKLQTVHSIPMTIAKIEATQRP

SEQ ID NO: 42382 - protein, 25 aa, synthetic construct
  source 1..25: note = Seed: NSCVKLQTVHSIPLTINKEEALQRP
NSCVKLQTVHSIPMTIAKIEAVQRP

SEQ ID NO: 42383 - protein, 25 aa, synthetic construct
  source 1..25: note = Seed: NSCVKLQTVHSIPLTINKEEALQRP
NSCVKLQTVHSIPMTIAKIEAYQRP

SEQ ID NO: 42384 - protein, 25 aa, synthetic construct
  source 1..25: note = Seed: NSCVKLQTVHSIPLTINKEEALQRP
NSCVKLQTVHSIPMTIAKLEAAQRP

SEQ ID NO: 42385 - protein, 25 aa, synthetic construct
  source 1..25: note = Seed: NSCVKLQTVHSIPLTINKEEALQRP
NSCVKLQTVHSIPMTIAKVEAAQRP

SEQ ID NO: 42386 - protein, 25 aa, synthetic construct
  source 1..25: note = Seed: NSCVKLQTVHSIPLTINKEEALQRP
NSCVKLQTVHSIPMTIAKVEAFQRP

SEQ ID NO: 42387 - protein, 25 aa, synthetic construct
  source 1..25: note = Seed: NSCVKLQTVHSIPLTINKEEALQRP
NSCVKLQTVHSIPMTIAKVEAIQRP

SEQ ID NO: 42388 - protein, 25 aa, synthetic construct
  source 1..25: note = Seed: NSCVKLQTVHSIPLTINKEEALQRP
NSCVKLQTVHSIPMTIAKVEALQRP

SEQ ID NO: 42389 - protein, 25 aa, synthetic construct
  source 1..25: note = Seed: NSCVKLQTVHSIPLTINKEEALQRP
NSCVKLQTVHSIPMTIAKVEAMQRP

SEQ ID NO: 42390 - protein, 25 aa, synthetic construct
  source 1..25: note = Seed: NSCVKLQTVHSIPLTINKEEALQRP
NSCVKLQTVHSIPMTIAKVEASQRP

SEQ ID NO: 42391 - protein, 25 aa, synthetic construct
  source 1..25: note = Seed: NSCVKLQTVHSIPLTINKEEALQRP
NSCVKLQTVHSIPMTIAKVEAVQRP

SEQ ID NO: 42392 - protein, 25 aa, synthetic construct
  source 1..25: note = Seed: NSCVKLQTVHSIPLTINKEEALQRP
NSCVKLQTVHSIPMTIEKFEAFQRP

SEQ ID NO: 42393 - protein, 25 aa, synthetic construct
  source 1..25: note = Seed: NSCVKLQTVHSIPLTINKEEALQRP
NSCVKLQTVHSIPMTIEKFEAIQRP

SEQ ID NO: 42394 - protein, 25 aa, synthetic construct
  source 1..25: note = Seed: NSCVKLQTVHSIPLTINKEEALQRP
NSCVKLQTVHSIPMTIEKFEALQRP

SEQ ID NO: 42395 - protein, 25 aa, synthetic construct
  source 1..25: note = Seed: NSCVKLQTVHSIPLTINKEEALQRP
NSCVKLQTVHSIPMTIEKFEAMQRP

SEQ ID NO: 42396 - protein, 25 aa, synthetic construct
  source 1..25: note = Seed: NSCVKLQTVHSIPLTINKEEALQRP
NSCVKLQTVHSIPMTIEKFEAVQRP

SEQ ID NO: 42397 - protein, 25 aa, synthetic construct
  source 1..25: note = Seed: NSCVKLQTVHSIPLTINKEEALQRP
NSCVKLQTVHSIPMTIFKAEAAQRP

SEQ ID NO: 42398 - protein, 25 aa, synthetic construct
  source 1..25: note = Seed: NSCVKLQTVHSIPLTINKEEALQRP
NSCVKLQTVHSIPMTIFKAEACQRP

SEQ ID NO: 42399 - protein, 25 aa, synthetic construct
  source 1..25: note = Seed: NSCVKLQTVHSIPLTINKEEALQRP
NSCVKLQTVHSIPMTIFKAEADQRP

SEQ ID NO: 42400 - protein, 25 aa, synthetic construct
  source 1..25: note = Seed: NSCVKLQTVHSIPLTINKEEALQRP
NSCVKLQTVHSIPMTIFKAEAEQRP

SEQ ID NO: 42401 - protein, 25 aa, synthetic construct
  source 1..25: note = Seed: NSCVKLQTVHSIPLTINKEEALQRP
NSCVKLQTVHSIPMTIFKAEAFQRP

SEQ ID NO: 42402 - protein, 25 aa, synthetic construct
  source 1..25: note = Seed: NSCVKLQTVHSIPLTINKEEALQRP
NSCVKLQTVHSIPMTIFKAEAGQRP

SEQ ID NO: 42403 - protein, 25 aa, synthetic construct
  source 1..25: note = Seed: NSCVKLQTVHSIPLTINKEEALQRP
NSCVKLQTVHSIPMTIFKAEAIQRP

SEQ ID NO: 42404 - protein, 25 aa, synthetic construct
  source 1..25: note = Seed: NSCVKLQTVHSIPLTINKEEALQRP
NSCVKLQTVHSIPMTIFKAEALQRP

SEQ ID NO: 42405 - protein, 25 aa, synthetic construct
  source 1..25: note = Seed: NSCVKLQTVHSIPLTINKEEALQRP
NSCVKLQTVHSIPMTIFKAEAMQRP

SEQ ID NO: 42406 - protein, 25 aa, synthetic construct
  source 1..25: note = Seed: NSCVKLQTVHSIPLTINKEEALQRP
NSCVKLQTVHSIPMTIFKAEAQQRP

SEQ ID NO: 42407 - protein, 25 aa, synthetic construct
  source 1..25: note = Seed: NSCVKLQTVHSIPLTINKEEALQRP
NSCVKLQTVHSIPMTIFKAEASQRP

SEQ ID NO: 42408 - protein, 25 aa, synthetic construct
  source 1..25: note = Seed: NSCVKLQTVHSIPLTINKEEALQRP
NSCVKLQTVHSIPMTIFKAEATQRP

SEQ ID NO: 42409 - protein, 25 aa, synthetic construct
  source 1..25: note = Seed: NSCVKLQTVHSIPLTINKEEALQRP
NSCVKLQTVHSIPMTIFKAEAVQRP

SEQ ID NO: 42410 - protein, 25 aa, synthetic construct
  source 1..25: note = Seed: NSCVKLQTVHSIPLTINKEEALQRP
NSCVKLQTVHSIPMTIFKAEAYQRP

SEQ ID NO: 42411 - protein, 25 aa, synthetic construct
  source 1..25: note = Seed: NSCVKLQTVHSIPLTINKEEALQRP
NSCVKLQTVHSIPMTIFKDEAAQRP

SEQ ID NO: 42412 - protein, 25 aa, synthetic construct
  source 1..25: note = Seed: NSCVKLQTVHSIPLTINKEEALQRP
NSCVKLQTVHSIPMTIFKDEACQRP

SEQ ID NO: 42413 - protein, 25 aa, synthetic construct
  source 1..25: note = Seed: NSCVKLQTVHSIPLTINKEEALQRP
NSCVKLQTVHSIPMTIFKDEAEQRP

SEQ ID NO: 42414 - protein, 25 aa, synthetic construct
  source 1..25: note = Seed: NSCVKLQTVHSIPLTINKEEALQRP
NSCVKLQTVHSIPMTIFKDEAFQRP

SEQ ID NO: 42415 - protein, 25 aa, synthetic construct
  source 1..25: note = Seed: NSCVKLQTVHSIPLTINKEEALQRP
NSCVKLQTVHSIPMTIFKDEAGQRP

SEQ ID NO: 42416 - protein, 25 aa, synthetic construct
  source 1..25: note = Seed: NSCVKLQTVHSIPLTINKEEALQRP
NSCVKLQTVHSIPMTIFKDEAIQRP

SEQ ID NO: 42417 - protein, 25 aa, synthetic construct
  source 1..25: note = Seed: NSCVKLQTVHSIPLTINKEEALQRP
NSCVKLQTVHSIPMTIFKDEALQRP

SEQ ID NO: 42418 - protein, 25 aa, synthetic construct
  source 1..25: note = Seed: NSCVKLQTVHSIPLTINKEEALQRP
NSCVKLQTVHSIPMTIFKDEAMQRP

SEQ ID NO: 42419 - protein, 25 aa, synthetic construct
  source 1..25: note = Seed: NSCVKLQTVHSIPLTINKEEALQRP
NSCVKLQTVHSIPMTIFKDEANQRP

SEQ ID NO: 42420 - protein, 25 aa, synthetic construct
  source 1..25: note = Seed: NSCVKLQTVHSIPLTINKEEALQRP
NSCVKLQTVHSIPMTIFKDEAQQRP

SEQ ID NO: 42421 - protein, 25 aa, synthetic construct
  source 1..25: note = Seed: NSCVKLQTVHSIPLTINKEEALQRP
NSCVKLQTVHSIPMTIFKDEASQRP

SEQ ID NO: 42422 - protein, 25 aa, synthetic construct
  source 1..25: note = Seed: NSCVKLQTVHSIPLTINKEEALQRP
NSCVKLQTVHSIPMTIFKDEATQRP

SEQ ID NO: 42423 - protein, 25 aa, synthetic construct
  source 1..25: note = Seed: NSCVKLQTVHSIPLTINKEEALQRP
NSCVKLQTVHSIPMTIFKDEAVQRP

SEQ ID NO: 42424 - protein, 25 aa, synthetic construct
  source 1..25: note = Seed: NSCVKLQTVHSIPLTINKEEALQRP
NSCVKLQTVHSIPMTIFKDEAYQRP

SEQ ID NO: 42425 - protein, 25 aa, synthetic construct
  source 1..25: note = Seed: NSCVKLQTVHSIPLTINKEEALQRP
NSCVKLQTVHSIPMTIFKEEAIQRP

SEQ ID NO: 42426 - protein, 25 aa, synthetic construct
  source 1..25: note = Seed: NSCVKLQTVHSIPLTINKEEALQRP
NSCVKLQTVHSIPMTIFKEEAVQRP

SEQ ID NO: 42427 - protein, 25 aa, synthetic construct
  source 1..25: note = Seed: NSCVKLQTVHSIPLTINKEEALQRP
NSCVKLQTVHSIPMTIFKFEAAQRP

SEQ ID NO: 42428 - protein, 25 aa, synthetic construct
  source 1..25: note = Seed: NSCVKLQTVHSIPLTINKEEALQRP
NSCVKLQTVHSIPMTIFKFEADQRP

SEQ ID NO: 42429 - protein, 25 aa, synthetic construct
  source 1..25: note = Seed: NSCVKLQTVHSIPLTINKEEALQRP
NSCVKLQTVHSIPMTIFKFEAEQRP

SEQ ID NO: 42430 - protein, 25 aa, synthetic construct
  source 1..25: note = Seed: NSCVKLQTVHSIPLTINKEEALQRP
NSCVKLQTVHSIPMTIFKFEAFQRP

SEQ ID NO: 42431 - protein, 25 aa, synthetic construct
  source 1..25: note = Seed: NSCVKLQTVHSIPLTINKEEALQRP
NSCVKLQTVHSIPMTIFKFEAHQRP

SEQ ID NO: 42432 - protein, 25 aa, synthetic construct
  source 1..25: note = Seed: NSCVKLQTVHSIPLTINKEEALQRP
NSCVKLQTVHSIPMTIFKFEAIQRP

SEQ ID NO: 42433 - protein, 25 aa, synthetic construct
  source 1..25: note = Seed: NSCVKLQTVHSIPLTINKEEALQRP
NSCVKLQTVHSIPMTIFKFEALQRP

SEQ ID NO: 42434 - protein, 25 aa, synthetic construct
  source 1..25: note = Seed: NSCVKLQTVHSIPLTINKEEALQRP
NSCVKLQTVHSIPMTIFKFEAMQRP

SEQ ID NO: 42435 - protein, 25 aa, synthetic construct
  source 1..25: note = Seed: NSCVKLQTVHSIPLTINKEEALQRP
NSCVKLQTVHSIPMTIFKFEANQRP

SEQ ID NO: 42436 - protein, 25 aa, synthetic construct
  source 1..25: note = Seed: NSCVKLQTVHSIPLTINKEEALQRP
NSCVKLQTVHSIPMTIFKFEAQQRP

SEQ ID NO: 42437 - protein, 25 aa, synthetic construct
  source 1..25: note = Seed: NSCVKLQTVHSIPLTINKEEALQRP
NSCVKLQTVHSIPMTIFKFEARQRP

SEQ ID NO: 42438 - protein, 25 aa, synthetic construct
  source 1..25: note = Seed: NSCVKLQTVHSIPLTINKEEALQRP
NSCVKLQTVHSIPMTIFKFEASQRP

SEQ ID NO: 42439 - protein, 25 aa, synthetic construct
  source 1..25: note = Seed: NSCVKLQTVHSIPLTINKEEALQRP
NSCVKLQTVHSIPMTIFKFEATQRP

SEQ ID NO: 42440 - protein, 25 aa, synthetic construct
  source 1..25: note = Seed: NSCVKLQTVHSIPLTINKEEALQRP
NSCVKLQTVHSIPMTIFKFEAVQRP

SEQ ID NO: 42441 - protein, 25 aa, synthetic construct
  source 1..25: note = Seed: NSCVKLQTVHSIPLTINKEEALQRP
NSCVKLQTVHSIPMTIFKFEAWQRP

SEQ ID NO: 42442 - protein, 25 aa, synthetic construct
  source 1..25: note = Seed: NSCVKLQTVHSIPLTINKEEALQRP
NSCVKLQTVHSIPMTIFKFEAYQRP

SEQ ID NO: 42443 - protein, 25 aa, synthetic construct
  source 1..25: note = Seed: NSCVKLQTVHSIPLTINKEEALQRP
NSCVKLQTVHSIPMTIFKGEAAQRP

SEQ ID NO: 42444 - protein, 25 aa, synthetic construct
  source 1..25: note = Seed: NSCVKLQTVHSIPLTINKEEALQRP
NSCVKLQTVHSIPMTIFKGEAIQRP

SEQ ID NO: 42445 - protein, 25 aa, synthetic construct
  source 1..25: note = Seed: NSCVKLQTVHSIPLTINKEEALQRP
NSCVKLQTVHSIPMTIFKGEALQRP

SEQ ID NO: 42446 - protein, 25 aa, synthetic construct
  source 1..25: note = Seed: NSCVKLQTVHSIPLTINKEEALQRP
NSCVKLQTVHSIPMTIFKGEAVQRP

SEQ ID NO: 42447 - protein, 25 aa, synthetic construct
  source 1..25: note = Seed: NSCVKLQTVHSIPLTINKEEALQRP
NSCVKLQTVHSIPMTIFKIEAAQRP

SEQ ID NO: 42448 - protein, 25 aa, synthetic construct
  source 1..25: note = Seed: NSCVKLQTVHSIPLTINKEEALQRP
NSCVKLQTVHSIPMTIFKIEACQRP

SEQ ID NO: 42449 - protein, 25 aa, synthetic construct
  source 1..25: note = Seed: NSCVKLQTVHSIPLTINKEEALQRP
NSCVKLQTVHSIPMTIFKIEADQRP

SEQ ID NO: 42450 - protein, 25 aa, synthetic construct
  source 1..25: note = Seed: NSCVKLQTVHSIPLTINKEEALQRP
NSCVKLQTVHSIPMTIFKIEAEQRP

SEQ ID NO: 42451 - protein, 25 aa, synthetic construct
  source 1..25: note = Seed: NSCVKLQTVHSIPLTINKEEALQRP
NSCVKLQTVHSIPMTIFKIEAFQRP

SEQ ID NO: 42452 - protein, 25 aa, synthetic construct
  source 1..25: note = Seed: NSCVKLQTVHSIPLTINKEEALQRP
NSCVKLQTVHSIPMTIFKIEAGQRP

SEQ ID NO: 42453 - protein, 25 aa, synthetic construct
  source 1..25: note = Seed: NSCVKLQTVHSIPLTINKEEALQRP
NSCVKLQTVHSIPMTIFKIEAHQRP

SEQ ID NO: 42454 - protein, 25 aa, synthetic construct
  source 1..25: note = Seed: NSCVKLQTVHSIPLTINKEEALQRP
NSCVKLQTVHSIPMTIFKIEAIQRP

SEQ ID NO: 42455 - protein, 25 aa, synthetic construct
  source 1..25: note = Seed: NSCVKLQTVHSIPLTINKEEALQRP
NSCVKLQTVHSIPMTIFKIEALQRP

SEQ ID NO: 42456 - protein, 25 aa, synthetic construct
  source 1..25: note = Seed: NSCVKLQTVHSIPLTINKEEALQRP
NSCVKLQTVHSIPMTIFKIEAMQRP

SEQ ID NO: 42457 - protein, 25 aa, synthetic construct
  source 1..25: note = Seed: NSCVKLQTVHSIPLTINKEEALQRP
NSCVKLQTVHSIPMTIFKIEANQRP

SEQ ID NO: 42458 - protein, 25 aa, synthetic construct
  source 1..25: note = Seed: NSCVKLQTVHSIPLTINKEEALQRP
NSCVKLQTVHSIPMTIFKIEAPQRP

SEQ ID NO: 42459 - protein, 25 aa, synthetic construct
  source 1..25: note = Seed: NSCVKLQTVHSIPLTINKEEALQRP
NSCVKLQTVHSIPMTIFKIEAQQRP

SEQ ID NO: 42460 - protein, 25 aa, synthetic construct
  source 1..25: note = Seed: NSCVKLQTVHSIPLTINKEEALQRP
NSCVKLQTVHSIPMTIFKIEARQRP

SEQ ID NO: 42461 - protein, 25 aa, synthetic construct
  source 1..25: note = Seed: NSCVKLQTVHSIPLTINKEEALQRP
NSCVKLQTVHSIPMTIFKIEASQRP

SEQ ID NO: 42462 - protein, 25 aa, synthetic construct
  source 1..25: note = Seed: NSCVKLQTVHSIPLTINKEEALQRP
NSCVKLQTVHSIPMTIFKIEATQRP

SEQ ID NO: 42463 - protein, 25 aa, synthetic construct
  source 1..25: note = Seed: NSCVKLQTVHSIPLTINKEEALQRP
NSCVKLQTVHSIPMTIFKIEAVQRP

SEQ ID NO: 42464 - protein, 25 aa, synthetic construct
  source 1..25: note = Seed: NSCVKLQTVHSIPLTINKEEALQRP
NSCVKLQTVHSIPMTIFKIEAWQRP

SEQ ID NO: 42465 - protein, 25 aa, synthetic construct
  source 1..25: note = Seed: NSCVKLQTVHSIPLTINKEEALQRP
NSCVKLQTVHSIPMTIFKIEAYQRP

SEQ ID NO: 42466 - protein, 25 aa, synthetic construct
  source 1..25: note = Seed: NSCVKLQTVHSIPLTINKEEALQRP
NSCVKLQTVHSIPMTIFKKEAFQRP

SEQ ID NO: 42467 - protein, 25 aa, synthetic construct
  source 1..25: note = Seed: NSCVKLQTVHSIPLTINKEEALQRP
NSCVKLQTVHSIPMTIFKKEAIQRP

SEQ ID NO: 42468 - protein, 25 aa, synthetic construct
  source 1..25: note = Seed: NSCVKLQTVHSIPLTINKEEALQRP
NSCVKLQTVHSIPMTIFKKEALQRP

SEQ ID NO: 42469 - protein, 25 aa, synthetic construct
  source 1..25: note = Seed: NSCVKLQTVHSIPLTINKEEALQRP
NSCVKLQTVHSIPMTIFKKEAMQRP

SEQ ID NO: 42470 - protein, 25 aa, synthetic construct
  source 1..25: note = Seed: NSCVKLQTVHSIPLTINKEEALQRP
NSCVKLQTVHSIPMTIFKKEAVQRP

SEQ ID NO: 42471 - protein, 25 aa, synthetic construct
  source 1..25: note = Seed: NSCVKLQTVHSIPLTINKEEALQRP
NSCVKLQTVHSIPMTIFKLEAAQRP

SEQ ID NO: 42472 - protein, 25 aa, synthetic construct
  source 1..25: note = Seed: NSCVKLQTVHSIPLTINKEEALQRP
NSCVKLQTVHSIPMTIFKLEACQRP

SEQ ID NO: 42473 - protein, 25 aa, synthetic construct
  source 1..25: note = Seed: NSCVKLQTVHSIPLTINKEEALQRP
NSCVKLQTVHSIPMTIFKLEADQRP

SEQ ID NO: 42474 - protein, 25 aa, synthetic construct
  source 1..25: note = Seed: NSCVKLQTVHSIPLTINKEEALQRP
NSCVKLQTVHSIPMTIFKLEAEQRP

SEQ ID NO: 42475 - protein, 25 aa, synthetic construct
  source 1..25: note = Seed: NSCVKLQTVHSIPLTINKEEALQRP
NSCVKLQTVHSIPMTIFKLEAFQRP

SEQ ID NO: 42476 - protein, 25 aa, synthetic construct
  source 1..25: note = Seed: NSCVKLQTVHSIPLTINKEEALQRP
NSCVKLQTVHSIPMTIFKLEAGQRP

SEQ ID NO: 42477 - protein, 25 aa, synthetic construct
  source 1..25: note = Seed: NSCVKLQTVHSIPLTINKEEALQRP
NSCVKLQTVHSIPMTIFKLEAHQRP

SEQ ID NO: 42478 - protein, 25 aa, synthetic construct
  source 1..25: note = Seed: NSCVKLQTVHSIPLTINKEEALQRP
NSCVKLQTVHSIPMTIFKLEAIQRP

SEQ ID NO: 42479 - protein, 25 aa, synthetic construct
  source 1..25: note = Seed: NSCVKLQTVHSIPLTINKEEALQRP
NSCVKLQTVHSIPMTIFKLEALQRP

SEQ ID NO: 42480 - protein, 25 aa, synthetic construct
  source 1..25: note = Seed: NSCVKLQTVHSIPLTINKEEALQRP
NSCVKLQTVHSIPMTIFKLEAMQRP

SEQ ID NO: 42481 - protein, 25 aa, synthetic construct
  source 1..25: note = Seed: NSCVKLQTVHSIPLTINKEEALQRP
NSCVKLQTVHSIPMTIFKLEANQRP

SEQ ID NO: 42482 - protein, 25 aa, synthetic construct
  source 1..25: note = Seed: NSCVKLQTVHSIPLTINKEEALQRP
NSCVKLQTVHSIPMTIFKLEAPQRP

SEQ ID NO: 42483 - protein, 25 aa, synthetic construct
  source 1..25: note = Seed: NSCVKLQTVHSIPLTINKEEALQRP
NSCVKLQTVHSIPMTIFKLEAQQRP

SEQ ID NO: 42484 - protein, 25 aa, synthetic construct
  source 1..25: note = Seed: NSCVKLQTVHSIPLTINKEEALQRP
NSCVKLQTVHSIPMTIFKLEASQRP

SEQ ID NO: 42485 - protein, 25 aa, synthetic construct
  source 1..25: note = Seed: NSCVKLQTVHSIPLTINKEEALQRP
NSCVKLQTVHSIPMTIFKLEATQRP

SEQ ID NO: 42486 - protein, 25 aa, synthetic construct
  source 1..25: note = Seed: NSCVKLQTVHSIPLTINKEEALQRP
NSCVKLQTVHSIPMTIFKLEAVQRP

SEQ ID NO: 42487 - protein, 25 aa, synthetic construct
  source 1..25: note = Seed: NSCVKLQTVHSIPLTINKEEALQRP
NSCVKLQTVHSIPMTIFKLEAYQRP

SEQ ID NO: 42488 - protein, 25 aa, synthetic construct
  source 1..25: note = Seed: NSCVKLQTVHSIPLTINKEEALQRP
NSCVKLQTVHSIPMTIFKMEAAQRP

SEQ ID NO: 42489 - protein, 25 aa, synthetic construct
  source 1..25: note = Seed: NSCVKLQTVHSIPLTINKEEALQRP
NSCVKLQTVHSIPMTIFKMEADQRP

SEQ ID NO: 42490 - protein, 25 aa, synthetic construct
  source 1..25: note = Seed: NSCVKLQTVHSIPLTINKEEALQRP
NSCVKLQTVHSIPMTIFKMEAEQRP

SEQ ID NO: 42491 - protein, 25 aa, synthetic construct
  source 1..25: note = Seed: NSCVKLQTVHSIPLTINKEEALQRP
NSCVKLQTVHSIPMTIFKMEAFQRP

SEQ ID NO: 42492 - protein, 25 aa, synthetic construct
  source 1..25: note = Seed: NSCVKLQTVHSIPLTINKEEALQRP
NSCVKLQTVHSIPMTIFKMEAGQRP

SEQ ID NO: 42493 - protein, 25 aa, synthetic construct
  source 1..25: note = Seed: NSCVKLQTVHSIPLTINKEEALQRP
NSCVKLQTVHSIPMTIFKMEAIQRP

SEQ ID NO: 42494 - protein, 25 aa, synthetic construct
  source 1..25: note = Seed: NSCVKLQTVHSIPLTINKEEALQRP
NSCVKLQTVHSIPMTIFKMEALQRP

SEQ ID NO: 42495 - protein, 25 aa, synthetic construct
  source 1..25: note = Seed: NSCVKLQTVHSIPLTINKEEALQRP
NSCVKLQTVHSIPMTIFKMEAMQRP

SEQ ID NO: 42496 - protein, 25 aa, synthetic construct
  source 1..25: note = Seed: NSCVKLQTVHSIPLTINKEEALQRP
NSCVKLQTVHSIPMTIFKMEANQRP

SEQ ID NO: 42497 - protein, 25 aa, synthetic construct
  source 1..25: note = Seed: NSCVKLQTVHSIPLTINKEEALQRP
NSCVKLQTVHSIPMTIFKMEAPQRP

SEQ ID NO: 42498 - protein, 25 aa, synthetic construct
  source 1..25: note = Seed: NSCVKLQTVHSIPLTINKEEALQRP
NSCVKLQTVHSIPMTIFKMEAQQRP

SEQ ID NO: 42499 - protein, 25 aa, synthetic construct
  source 1..25: note = Seed: NSCVKLQTVHSIPLTINKEEALQRP
NSCVKLQTVHSIPMTIFKMEASQRP

SEQ ID NO: 42500 - protein, 25 aa, synthetic construct
  source 1..25: note = Seed: NSCVKLQTVHSIPLTINKEEALQRP
NSCVKLQTVHSIPMTIFKMEATQRP

SEQ ID NO: 42501 - protein, 25 aa, synthetic construct
  source 1..25: note = Seed: NSCVKLQTVHSIPLTINKEEALQRP
NSCVKLQTVHSIPMTIFKMEAVQRP

SEQ ID NO: 42502 - protein, 25 aa, synthetic construct
  source 1..25: note = Seed: NSCVKLQTVHSIPLTINKEEALQRP
NSCVKLQTVHSIPMTIFKMEAYQRP

SEQ ID NO: 42503 - protein, 25 aa, synthetic construct
  source 1..25: note = Seed: NSCVKLQTVHSIPLTINKEEALQRP
NSCVKLQTVHSIPMTIFKNEAAQRP

SEQ ID NO: 42504 - protein, 25 aa, synthetic construct
  source 1..25: note = Seed: NSCVKLQTVHSIPLTINKEEALQRP
NSCVKLQTVHSIPMTIFKNEAFQRP

SEQ ID NO: 42505 - protein, 25 aa, synthetic construct
  source 1..25: note = Seed: NSCVKLQTVHSIPLTINKEEALQRP
NSCVKLQTVHSIPMTIFKNEAIQRP

SEQ ID NO: 42506 - protein, 25 aa, synthetic construct
  source 1..25: note = Seed: NSCVKLQTVHSIPLTINKEEALQRP
NSCVKLQTVHSIPMTIFKNEALQRP

SEQ ID NO: 42507 - protein, 25 aa, synthetic construct
  source 1..25: note = Seed: NSCVKLQTVHSIPLTINKEEALQRP
NSCVKLQTVHSIPMTIFKNEAMQRP

SEQ ID NO: 42508 - protein, 25 aa, synthetic construct
  source 1..25: note = Seed: NSCVKLQTVHSIPLTINKEEALQRP
NSCVKLQTVHSIPMTIFKNEASQRP

SEQ ID NO: 42509 - protein, 25 aa, synthetic construct
  source 1..25: note = Seed: NSCVKLQTVHSIPLTINKEEALQRP
NSCVKLQTVHSIPMTIFKNEATQRP

SEQ ID NO: 42510 - protein, 25 aa, synthetic construct
  source 1..25: note = Seed: NSCVKLQTVHSIPLTINKEEALQRP
NSCVKLQTVHSIPMTIFKNEAVQRP

SEQ ID NO: 42511 - protein, 25 aa, synthetic construct
  source 1..25: note = Seed: NSCVKLQTVHSIPLTINKEEALQRP
NSCVKLQTVHSIPMTIFKPEAAQRP

SEQ ID NO: 42512 - protein, 25 aa, synthetic construct
  source 1..25: note = Seed: NSCVKLQTVHSIPLTINKEEALQRP
NSCVKLQTVHSIPMTIFKPEAFQRP

SEQ ID NO: 42513 - protein, 25 aa, synthetic construct
  source 1..25: note = Seed: NSCVKLQTVHSIPLTINKEEALQRP
NSCVKLQTVHSIPMTIFKPEAIQRP

SEQ ID NO: 42514 - protein, 25 aa, synthetic construct
  source 1..25: note = Seed: NSCVKLQTVHSIPLTINKEEALQRP
NSCVKLQTVHSIPMTIFKPEALQRP

SEQ ID NO: 42515 - protein, 25 aa, synthetic construct
  source 1..25: note = Seed: NSCVKLQTVHSIPLTINKEEALQRP
NSCVKLQTVHSIPMTIFKPEAMQRP

SEQ ID NO: 42516 - protein, 25 aa, synthetic construct
  source 1..25: note = Seed: NSCVKLQTVHSIPLTINKEEALQRP
NSCVKLQTVHSIPMTIFKPEAVQRP

SEQ ID NO: 42517 - protein, 25 aa, synthetic construct
  source 1..25: note = Seed: NSCVKLQTVHSIPLTINKEEALQRP
NSCVKLQTVHSIPMTIFKREAFQRP

SEQ ID NO: 42518 - protein, 25 aa, synthetic construct
  source 1..25: note = Seed: NSCVKLQTVHSIPLTINKEEALQRP
NSCVKLQTVHSIPMTIFKREAHQRP

SEQ ID NO: 42519 - protein, 25 aa, synthetic construct
  source 1..25: note = Seed: NSCVKLQTVHSIPLTINKEEALQRP
NSCVKLQTVHSIPMTIFKREAIQRP

SEQ ID NO: 42520 - protein, 25 aa, synthetic construct
  source 1..25: note = Seed: NSCVKLQTVHSIPLTINKEEALQRP
NSCVKLQTVHSIPMTIFKREALQRP

SEQ ID NO: 42521 - protein, 25 aa, synthetic construct
  source 1..25: note = Seed: NSCVKLQTVHSIPLTINKEEALQRP
NSCVKLQTVHSIPMTIFKREAMQRP

SEQ ID NO: 42522 - protein, 25 aa, synthetic construct
  source 1..25: note = Seed: NSCVKLQTVHSIPLTINKEEALQRP
NSCVKLQTVHSIPMTIFKREARQRP

SEQ ID NO: 42523 - protein, 25 aa, synthetic construct
  source 1..25: note = Seed: NSCVKLQTVHSIPLTINKEEALQRP
NSCVKLQTVHSIPMTIFKREAVQRP

SEQ ID NO: 42524 - protein, 25 aa, synthetic construct
  source 1..25: note = Seed: NSCVKLQTVHSIPLTINKEEALQRP
NSCVKLQTVHSIPMTIFKREAYQRP

SEQ ID NO: 42525 - protein, 25 aa, synthetic construct
  source 1..25: note = Seed: NSCVKLQTVHSIPLTINKEEALQRP
NSCVKLQTVHSIPMTIFKSEAAQRP

SEQ ID NO: 42526 - protein, 25 aa, synthetic construct
  source 1..25: note = Seed: NSCVKLQTVHSIPLTINKEEALQRP
NSCVKLQTVHSIPMTIFKSEAFQRP

SEQ ID NO: 42527 - protein, 25 aa, synthetic construct
  source 1..25: note = Seed: NSCVKLQTVHSIPLTINKEEALQRP
NSCVKLQTVHSIPMTIFKSEAIQRP

SEQ ID NO: 42528 - protein, 25 aa, synthetic construct
  source 1..25: note = Seed: NSCVKLQTVHSIPLTINKEEALQRP
NSCVKLQTVHSIPMTIFKSEALQRP

SEQ ID NO: 42529 - protein, 25 aa, synthetic construct
  source 1..25: note = Seed: NSCVKLQTVHSIPLTINKEEALQRP
NSCVKLQTVHSIPMTIFKSEAMQRP

SEQ ID NO: 42530 - protein, 25 aa, synthetic construct
  source 1..25: note = Seed: NSCVKLQTVHSIPLTINKEEALQRP
NSCVKLQTVHSIPMTIFKSEASQRP

SEQ ID NO: 42531 - protein, 25 aa, synthetic construct
  source 1..25: note = Seed: NSCVKLQTVHSIPLTINKEEALQRP
NSCVKLQTVHSIPMTIFKSEAVQRP

SEQ ID NO: 42532 - protein, 25 aa, synthetic construct
  source 1..25: note = Seed: NSCVKLQTVHSIPLTINKEEALQRP
NSCVKLQTVHSIPMTIFKSEAYQRP

SEQ ID NO: 42533 - protein, 25 aa, synthetic construct
  source 1..25: note = Seed: NSCVKLQTVHSIPLTINKEEALQRP
NSCVKLQTVHSIPMTIFKTEAAQRP

SEQ ID NO: 42534 - protein, 25 aa, synthetic construct
  source 1..25: note = Seed: NSCVKLQTVHSIPLTINKEEALQRP
NSCVKLQTVHSIPMTIFKTEAFQRP

SEQ ID NO: 42535 - protein, 25 aa, synthetic construct
  source 1..25: note = Seed: NSCVKLQTVHSIPLTINKEEALQRP
NSCVKLQTVHSIPMTIFKTEAIQRP

SEQ ID NO: 42536 - protein, 25 aa, synthetic construct
  source 1..25: note = Seed: NSCVKLQTVHSIPLTINKEEALQRP
NSCVKLQTVHSIPMTIFKTEALQRP

SEQ ID NO: 42537 - protein, 25 aa, synthetic construct
  source 1..25: note = Seed: NSCVKLQTVHSIPLTINKEEALQRP
NSCVKLQTVHSIPMTIFKTEAMQRP

SEQ ID NO: 42538 - protein, 25 aa, synthetic construct
  source 1..25: note = Seed: NSCVKLQTVHSIPLTINKEEALQRP
NSCVKLQTVHSIPMTIFKTEASQRP

SEQ ID NO: 42539 - protein, 25 aa, synthetic construct
  source 1..25: note = Seed: NSCVKLQTVHSIPLTINKEEALQRP
NSCVKLQTVHSIPMTIFKTEAVQRP

SEQ ID NO: 42540 - protein, 25 aa, synthetic construct
  source 1..25: note = Seed: NSCVKLQTVHSIPLTINKEEALQRP
NSCVKLQTVHSIPMTIFKVEAAQRP

SEQ ID NO: 42541 - protein, 25 aa, synthetic construct
  source 1..25: note = Seed: NSCVKLQTVHSIPLTINKEEALQRP
NSCVKLQTVHSIPMTIFKVEACQRP

SEQ ID NO: 42542 - protein, 25 aa, synthetic construct
  source 1..25: note = Seed: NSCVKLQTVHSIPLTINKEEALQRP
NSCVKLQTVHSIPMTIFKVEADQRP

SEQ ID NO: 42543 - protein, 25 aa, synthetic construct
  source 1..25: note = Seed: NSCVKLQTVHSIPLTINKEEALQRP
NSCVKLQTVHSIPMTIFKVEAEQRP

SEQ ID NO: 42544 - protein, 25 aa, synthetic construct
  source 1..25: note = Seed: NSCVKLQTVHSIPLTINKEEALQRP
NSCVKLQTVHSIPMTIFKVEAFQRP

SEQ ID NO: 42545 - protein, 25 aa, synthetic construct
  source 1..25: note = Seed: NSCVKLQTVHSIPLTINKEEALQRP
NSCVKLQTVHSIPMTIFKVEAGQRP

SEQ ID NO: 42546 - protein, 25 aa, synthetic construct
  source 1..25: note = Seed: NSCVKLQTVHSIPLTINKEEALQRP
NSCVKLQTVHSIPMTIFKVEAHQRP

SEQ ID NO: 42547 - protein, 25 aa, synthetic construct
  source 1..25: note = Seed: NSCVKLQTVHSIPLTINKEEALQRP
NSCVKLQTVHSIPMTIFKVEAIQRP

SEQ ID NO: 42548 - protein, 25 aa, synthetic construct
  source 1..25: note = Seed: NSCVKLQTVHSIPLTINKEEALQRP
NSCVKLQTVHSIPMTIFKVEALQRP

SEQ ID NO: 42549 - protein, 25 aa, synthetic construct
  source 1..25: note = Seed: NSCVKLQTVHSIPLTINKEEALQRP
NSCVKLQTVHSIPMTIFKVEAMQRP

SEQ ID NO: 42550 - protein, 25 aa, synthetic construct
  source 1..25: note = Seed: NSCVKLQTVHSIPLTINKEEALQRP
NSCVKLQTVHSIPMTIFKVEANQRP

SEQ ID NO: 42551 - protein, 25 aa, synthetic construct
  source 1..25: note = Seed: NSCVKLQTVHSIPLTINKEEALQRP
NSCVKLQTVHSIPMTIFKVEAPQRP

SEQ ID NO: 42552 - protein, 25 aa, synthetic construct
  source 1..25: note = Seed: NSCVKLQTVHSIPLTINKEEALQRP
NSCVKLQTVHSIPMTIFKVEAQQRP

SEQ ID NO: 42553 - protein, 25 aa, synthetic construct
  source 1..25: note = Seed: NSCVKLQTVHSIPLTINKEEALQRP
NSCVKLQTVHSIPMTIFKVEASQRP

SEQ ID NO: 42554 - protein, 25 aa, synthetic construct
  source 1..25: note = Seed: NSCVKLQTVHSIPLTINKEEALQRP
NSCVKLQTVHSIPMTIFKVEATQRP

SEQ ID NO: 42555 - protein, 25 aa, synthetic construct
  source 1..25: note = Seed: NSCVKLQTVHSIPLTINKEEALQRP
NSCVKLQTVHSIPMTIFKVEAVQRP

SEQ ID NO: 42556 - protein, 25 aa, synthetic construct
  source 1..25: note = Seed: NSCVKLQTVHSIPLTINKEEALQRP
NSCVKLQTVHSIPMTIFKVEAWQRP

SEQ ID NO: 42557 - protein, 25 aa, synthetic construct
  source 1..25: note = Seed: NSCVKLQTVHSIPLTINKEEALQRP
NSCVKLQTVHSIPMTIFKVEAYQRP

SEQ ID NO: 42558 - protein, 25 aa, synthetic construct
  source 1..25: note = Seed: NSCVKLQTVHSIPLTINKEEALQRP
NSCVKLQTVHSIPMTIFKWEAFQRP

SEQ ID NO: 42559 - protein, 25 aa, synthetic construct
  source 1..25: note = Seed: NSCVKLQTVHSIPLTINKEEALQRP
NSCVKLQTVHSIPMTIFKWEAIQRP

SEQ ID NO: 42560 - protein, 25 aa, synthetic construct
  source 1..25: note = Seed: NSCVKLQTVHSIPLTINKEEALQRP
NSCVKLQTVHSIPMTIFKWEALQRP

SEQ ID NO: 42561 - protein, 25 aa, synthetic construct
  source 1..25: note = Seed: NSCVKLQTVHSIPLTINKEEALQRP
NSCVKLQTVHSIPMTIFKWEAVQRP

SEQ ID NO: 42562 - protein, 25 aa, synthetic construct
  source 1..25: note = Seed: NSCVKLQTVHSIPLTINKEEALQRP
NSCVKLQTVHSIPMTIFKYEAFQRP

SEQ ID NO: 42563 - protein, 25 aa, synthetic construct
  source 1..25: note = Seed: NSCVKLQTVHSIPLTINKEEALQRP
NSCVKLQTVHSIPMTIFKYEAIQRP

SEQ ID NO: 42564 - protein, 25 aa, synthetic construct
  source 1..25: note = Seed: NSCVKLQTVHSIPLTINKEEALQRP
NSCVKLQTVHSIPMTIFKYEALQRP

SEQ ID NO: 42565 - protein, 25 aa, synthetic construct
  source 1..25: note = Seed: NSCVKLQTVHSIPLTINKEEALQRP
NSCVKLQTVHSIPMTIFKYEAMQRP

SEQ ID NO: 42566 - protein, 25 aa, synthetic construct
  source 1..25: note = Seed: NSCVKLQTVHSIPLTINKEEALQRP
NSCVKLQTVHSIPMTIFKYEAVQRP

SEQ ID NO: 42567 - protein, 25 aa, synthetic construct
  source 1..25: note = Seed: NSCVKLQTVHSIPLTINKEEALQRP
NSCVKLQTVHSIPMTIFKYEAYQRP

SEQ ID NO: 42568 - protein, 25 aa, synthetic construct
  source 1..25: note = Seed: NSCVKLQTVHSIPLTINKEEALQRP
NSCVKLQTVHSIPMTIHKFEAFQRP

SEQ ID NO: 42569 - protein, 25 aa, synthetic construct
  source 1..25: note = Seed: NSCVKLQTVHSIPLTINKEEALQRP
NSCVKLQTVHSIPMTIHKFEAIQRP

SEQ ID NO: 42570 - protein, 25 aa, synthetic construct
  source 1..25: note = Seed: NSCVKLQTVHSIPLTINKEEALQRP
NSCVKLQTVHSIPMTIHKFEALQRP

SEQ ID NO: 42571 - protein, 25 aa, synthetic construct
  source 1..25: note = Seed: NSCVKLQTVHSIPLTINKEEALQRP
NSCVKLQTVHSIPMTIHKFEAMQRP

SEQ ID NO: 42572 - protein, 25 aa, synthetic construct
  source 1..25: note = Seed: NSCVKLQTVHSIPLTINKEEALQRP
NSCVKLQTVHSIPMTIHKFEAVQRP

SEQ ID NO: 42573 - protein, 25 aa, synthetic construct
  source 1..25: note = Seed: NSCVKLQTVHSIPLTINKEEALQRP
NSCVKLQTVHSIPMTIIKAEAAQRP

SEQ ID NO: 42574 - protein, 25 aa, synthetic construct
  source 1..25: note = Seed: NSCVKLQTVHSIPLTINKEEALQRP
NSCVKLQTVHSIPMTIIKAEAFQRP

SEQ ID NO: 42575 - protein, 25 aa, synthetic construct
  source 1..25: note = Seed: NSCVKLQTVHSIPLTINKEEALQRP
NSCVKLQTVHSIPMTIIKAEAIQRP

SEQ ID NO: 42576 - protein, 25 aa, synthetic construct
  source 1..25: note = Seed: NSCVKLQTVHSIPLTINKEEALQRP
NSCVKLQTVHSIPMTIIKAEALQRP

SEQ ID NO: 42577 - protein, 25 aa, synthetic construct
  source 1..25: note = Seed: NSCVKLQTVHSIPLTINKEEALQRP
NSCVKLQTVHSIPMTIIKAEAMQRP

SEQ ID NO: 42578 - protein, 25 aa, synthetic construct
  source 1..25: note = Seed: NSCVKLQTVHSIPLTINKEEALQRP
NSCVKLQTVHSIPMTIIKAEAVQRP

SEQ ID NO: 42579 - protein, 25 aa, synthetic construct
  source 1..25: note = Seed: NSCVKLQTVHSIPLTINKEEALQRP
NSCVKLQTVHSIPMTIIKAEAYQRP

SEQ ID NO: 42580 - protein, 25 aa, synthetic construct
  source 1..25: note = Seed: NSCVKLQTVHSIPLTINKEEALQRP
NSCVKLQTVHSIPMTIIKDEAAQRP

SEQ ID NO: 42581 - protein, 25 aa, synthetic construct
  source 1..25: note = Seed: NSCVKLQTVHSIPLTINKEEALQRP
NSCVKLQTVHSIPMTIIKDEAIQRP

SEQ ID NO: 42582 - protein, 25 aa, synthetic construct
  source 1..25: note = Seed: NSCVKLQTVHSIPLTINKEEALQRP
NSCVKLQTVHSIPMTIIKDEALQRP

SEQ ID NO: 42583 - protein, 25 aa, synthetic construct
  source 1..25: note = Seed: NSCVKLQTVHSIPLTINKEEALQRP
NSCVKLQTVHSIPMTIIKDEAMQRP

SEQ ID NO: 42584 - protein, 25 aa, synthetic construct
  source 1..25: note = Seed: NSCVKLQTVHSIPLTINKEEALQRP
NSCVKLQTVHSIPMTIIKDEAVQRP

SEQ ID NO: 42585 - protein, 25 aa, synthetic construct
  source 1..25: note = Seed: NSCVKLQTVHSIPLTINKEEALQRP
NSCVKLQTVHSIPMTIIKFEAAQRP

SEQ ID NO: 42586 - protein, 25 aa, synthetic construct
  source 1..25: note = Seed: NSCVKLQTVHSIPLTINKEEALQRP
NSCVKLQTVHSIPMTIIKFEADQRP

SEQ ID NO: 42587 - protein, 25 aa, synthetic construct
  source 1..25: note = Seed: NSCVKLQTVHSIPLTINKEEALQRP
NSCVKLQTVHSIPMTIIKFEAEQRP

SEQ ID NO: 42588 - protein, 25 aa, synthetic construct
  source 1..25: note = Seed: NSCVKLQTVHSIPLTINKEEALQRP
NSCVKLQTVHSIPMTIIKFEAFQRP

SEQ ID NO: 42589 - protein, 25 aa, synthetic construct
  source 1..25: note = Seed: NSCVKLQTVHSIPLTINKEEALQRP
NSCVKLQTVHSIPMTIIKFEAIQRP

SEQ ID NO: 42590 - protein, 25 aa, synthetic construct
  source 1..25: note = Seed: NSCVKLQTVHSIPLTINKEEALQRP
NSCVKLQTVHSIPMTIIKFEALQRP

SEQ ID NO: 42591 - protein, 25 aa, synthetic construct
  source 1..25: note = Seed: NSCVKLQTVHSIPLTINKEEALQRP
NSCVKLQTVHSIPMTIIKFEAMQRP

SEQ ID NO: 42592 - protein, 25 aa, synthetic construct
  source 1..25: note = Seed: NSCVKLQTVHSIPLTINKEEALQRP
NSCVKLQTVHSIPMTIIKFEANQRP

SEQ ID NO: 42593 - protein, 25 aa, synthetic construct
  source 1..25: note = Seed: NSCVKLQTVHSIPLTINKEEALQRP
NSCVKLQTVHSIPMTIIKFEASQRP

SEQ ID NO: 42594 - protein, 25 aa, synthetic construct
  source 1..25: note = Seed: NSCVKLQTVHSIPLTINKEEALQRP
NSCVKLQTVHSIPMTIIKFEATQRP

SEQ ID NO: 42595 - protein, 25 aa, synthetic construct
  source 1..25: note = Seed: NSCVKLQTVHSIPLTINKEEALQRP
NSCVKLQTVHSIPMTIIKFEAVQRP

SEQ ID NO: 42596 - protein, 25 aa, synthetic construct
  source 1..25: note = Seed: NSCVKLQTVHSIPLTINKEEALQRP
NSCVKLQTVHSIPMTIIKFEAWQRP

SEQ ID NO: 42597 - protein, 25 aa, synthetic construct
  source 1..25: note = Seed: NSCVKLQTVHSIPLTINKEEALQRP
NSCVKLQTVHSIPMTIIKFEAYQRP

SEQ ID NO: 42598 - protein, 25 aa, synthetic construct
  source 1..25: note = Seed: NSCVKLQTVHSIPLTINKEEALQRP
NSCVKLQTVHSIPMTIIKIEAAQRP

SEQ ID NO: 42599 - protein, 25 aa, synthetic construct
  source 1..25: note = Seed: NSCVKLQTVHSIPLTINKEEALQRP
NSCVKLQTVHSIPMTIIKIEADQRP

SEQ ID NO: 42600 - protein, 25 aa, synthetic construct
  source 1..25: note = Seed: NSCVKLQTVHSIPLTINKEEALQRP
NSCVKLQTVHSIPMTIIKIEAFQRP

SEQ ID NO: 42601 - protein, 25 aa, synthetic construct
  source 1..25: note = Seed: NSCVKLQTVHSIPLTINKEEALQRP
NSCVKLQTVHSIPMTIIKIEAIQRP

SEQ ID NO: 42602 - protein, 25 aa, synthetic construct
  source 1..25: note = Seed: NSCVKLQTVHSIPLTINKEEALQRP
NSCVKLQTVHSIPMTIIKIEALQRP

SEQ ID NO: 42603 - protein, 25 aa, synthetic construct
  source 1..25: note = Seed: NSCVKLQTVHSIPLTINKEEALQRP
NSCVKLQTVHSIPMTIIKIEAMQRP

SEQ ID NO: 42604 - protein, 25 aa, synthetic construct
  source 1..25: note = Seed: NSCVKLQTVHSIPLTINKEEALQRP
NSCVKLQTVHSIPMTIIKIEANQRP

SEQ ID NO: 42605 - protein, 25 aa, synthetic construct
  source 1..25: note = Seed: NSCVKLQTVHSIPLTINKEEALQRP
NSCVKLQTVHSIPMTIIKIEAQQRP

SEQ ID NO: 42606 - protein, 25 aa, synthetic construct
  source 1..25: note = Seed: NSCVKLQTVHSIPLTINKEEALQRP
NSCVKLQTVHSIPMTIIKIEASQRP

SEQ ID NO: 42607 - protein, 25 aa, synthetic construct
  source 1..25: note = Seed: NSCVKLQTVHSIPLTINKEEALQRP
NSCVKLQTVHSIPMTIIKIEATQRP

SEQ ID NO: 42608 - protein, 25 aa, synthetic construct
  source 1..25: note = Seed: NSCVKLQTVHSIPLTINKEEALQRP
NSCVKLQTVHSIPMTIIKIEAVQRP

SEQ ID NO: 42609 - protein, 25 aa, synthetic construct
  source 1..25: note = Seed: NSCVKLQTVHSIPLTINKEEALQRP
NSCVKLQTVHSIPMTIIKIEAYQRP

SEQ ID NO: 42610 - protein, 25 aa, synthetic construct
  source 1..25: note = Seed: NSCVKLQTVHSIPLTINKEEALQRP
NSCVKLQTVHSIPMTIIKKEAIQRP

SEQ ID NO: 42611 - protein, 25 aa, synthetic construct
  source 1..25: note = Seed: NSCVKLQTVHSIPLTINKEEALQRP
NSCVKLQTVHSIPMTIIKKEALQRP

SEQ ID NO: 42612 - protein, 25 aa, synthetic construct
  source 1..25: note = Seed: NSCVKLQTVHSIPLTINKEEALQRP
NSCVKLQTVHSIPMTIIKLEAAQRP

SEQ ID NO: 42613 - protein, 25 aa, synthetic construct
  source 1..25: note = Seed: NSCVKLQTVHSIPLTINKEEALQRP
NSCVKLQTVHSIPMTIIKLEAFQRP

SEQ ID NO: 42614 - protein, 25 aa, synthetic construct
  source 1..25: note = Seed: NSCVKLQTVHSIPLTINKEEALQRP
NSCVKLQTVHSIPMTIIKLEAIQRP

SEQ ID NO: 42615 - protein, 25 aa, synthetic construct
  source 1..25: note = Seed: NSCVKLQTVHSIPLTINKEEALQRP
NSCVKLQTVHSIPMTIIKLEALQRP

SEQ ID NO: 42616 - protein, 25 aa, synthetic construct
  source 1..25: note = Seed: NSCVKLQTVHSIPLTINKEEALQRP
NSCVKLQTVHSIPMTIIKLEAMQRP

SEQ ID NO: 42617 - protein, 25 aa, synthetic construct
  source 1..25: note = Seed: NSCVKLQTVHSIPLTINKEEALQRP
NSCVKLQTVHSIPMTIIKLEANQRP

SEQ ID NO: 42618 - protein, 25 aa, synthetic construct
  source 1..25: note = Seed: NSCVKLQTVHSIPLTINKEEALQRP
NSCVKLQTVHSIPMTIIKLEASQRP

SEQ ID NO: 42619 - protein, 25 aa, synthetic construct
  source 1..25: note = Seed: NSCVKLQTVHSIPLTINKEEALQRP
NSCVKLQTVHSIPMTIIKLEAVQRP

SEQ ID NO: 42620 - protein, 25 aa, synthetic construct
  source 1..25: note = Seed: NSCVKLQTVHSIPLTINKEEALQRP
NSCVKLQTVHSIPMTIIKLEAYQRP

SEQ ID NO: 42621 - protein, 25 aa, synthetic construct
  source 1..25: note = Seed: NSCVKLQTVHSIPLTINKEEALQRP
NSCVKLQTVHSIPMTIIKMEAAQRP

SEQ ID NO: 42622 - protein, 25 aa, synthetic construct
  source 1..25: note = Seed: NSCVKLQTVHSIPLTINKEEALQRP
NSCVKLQTVHSIPMTIIKMEAIQRP

SEQ ID NO: 42623 - protein, 25 aa, synthetic construct
  source 1..25: note = Seed: NSCVKLQTVHSIPLTINKEEALQRP
NSCVKLQTVHSIPMTIIKMEALQRP

SEQ ID NO: 42624 - protein, 25 aa, synthetic construct
  source 1..25: note = Seed: NSCVKLQTVHSIPLTINKEEALQRP
NSCVKLQTVHSIPMTIIKMEAMQRP

SEQ ID NO: 42625 - protein, 25 aa, synthetic construct
  source 1..25: note = Seed: NSCVKLQTVHSIPLTINKEEALQRP
NSCVKLQTVHSIPMTIIKMEASQRP

SEQ ID NO: 42626 - protein, 25 aa, synthetic construct
  source 1..25: note = Seed: NSCVKLQTVHSIPLTINKEEALQRP
NSCVKLQTVHSIPMTIIKMEAVQRP

SEQ ID NO: 42627 - protein, 25 aa, synthetic construct
  source 1..25: note = Seed: NSCVKLQTVHSIPLTINKEEALQRP
NSCVKLQTVHSIPMTIIKMEAYQRP

SEQ ID NO: 42628 - protein, 25 aa, synthetic construct
  source 1..25: note = Seed: NSCVKLQTVHSIPLTINKEEALQRP
NSCVKLQTVHSIPMTIIKNEAAQRP

SEQ ID NO: 42629 - protein, 25 aa, synthetic construct
  source 1..25: note = Seed: NSCVKLQTVHSIPLTINKEEALQRP
NSCVKLQTVHSIPMTIIKNEAIQRP

SEQ ID NO: 42630 - protein, 25 aa, synthetic construct
  source 1..25: note = Seed: NSCVKLQTVHSIPLTINKEEALQRP
NSCVKLQTVHSIPMTIIKNEALQRP

SEQ ID NO: 42631 - protein, 25 aa, synthetic construct
  source 1..25: note = Seed: NSCVKLQTVHSIPLTINKEEALQRP
NSCVKLQTVHSIPMTIIKNEAVQRP

SEQ ID NO: 42632 - protein, 25 aa, synthetic construct
  source 1..25: note = Seed: NSCVKLQTVHSIPLTINKEEALQRP
NSCVKLQTVHSIPMTIIKPEAIQRP

SEQ ID NO: 42633 - protein, 25 aa, synthetic construct
  source 1..25: note = Seed: NSCVKLQTVHSIPLTINKEEALQRP
NSCVKLQTVHSIPMTIIKREAFQRP

SEQ ID NO: 42634 - protein, 25 aa, synthetic construct
  source 1..25: note = Seed: NSCVKLQTVHSIPLTINKEEALQRP
NSCVKLQTVHSIPMTIIKREAIQRP

SEQ ID NO: 42635 - protein, 25 aa, synthetic construct
  source 1..25: note = Seed: NSCVKLQTVHSIPLTINKEEALQRP
NSCVKLQTVHSIPMTIIKREALQRP

SEQ ID NO: 42636 - protein, 25 aa, synthetic construct
  source 1..25: note = Seed: NSCVKLQTVHSIPLTINKEEALQRP
NSCVKLQTVHSIPMTIIKREAMQRP

SEQ ID NO: 42637 - protein, 25 aa, synthetic construct
  source 1..25: note = Seed: NSCVKLQTVHSIPLTINKEEALQRP
NSCVKLQTVHSIPMTIIKREARQRP

SEQ ID NO: 42638 - protein, 25 aa, synthetic construct
  source 1..25: note = Seed: NSCVKLQTVHSIPLTINKEEALQRP
NSCVKLQTVHSIPMTIIKREAVQRP

SEQ ID NO: 42639 - protein, 25 aa, synthetic construct
  source 1..25: note = Seed: NSCVKLQTVHSIPLTINKEEALQRP
NSCVKLQTVHSIPMTIIKREAYQRP

SEQ ID NO: 42640 - protein, 25 aa, synthetic construct
  source 1..25: note = Seed: NSCVKLQTVHSIPLTINKEEALQRP
NSCVKLQTVHSIPMTIIKSEAAQRP

SEQ ID NO: 42641 - protein, 25 aa, synthetic construct
  source 1..25: note = Seed: NSCVKLQTVHSIPLTINKEEALQRP
NSCVKLQTVHSIPMTIIKSEAIQRP

SEQ ID NO: 42642 - protein, 25 aa, synthetic construct
  source 1..25: note = Seed: NSCVKLQTVHSIPLTINKEEALQRP
NSCVKLQTVHSIPMTIIKSEAVQRP

SEQ ID NO: 42643 - protein, 25 aa, synthetic construct
  source 1..25: note = Seed: NSCVKLQTVHSIPLTINKEEALQRP
NSCVKLQTVHSIPMTIIKTEAAQRP

SEQ ID NO: 42644 - protein, 25 aa, synthetic construct
  source 1..25: note = Seed: NSCVKLQTVHSIPLTINKEEALQRP
NSCVKLQTVHSIPMTIIKTEAIQRP

SEQ ID NO: 42645 - protein, 25 aa, synthetic construct
  source 1..25: note = Seed: NSCVKLQTVHSIPLTINKEEALQRP
NSCVKLQTVHSIPMTIIKTEAVQRP

SEQ ID NO: 42646 - protein, 25 aa, synthetic construct
  source 1..25: note = Seed: NSCVKLQTVHSIPLTINKEEALQRP
NSCVKLQTVHSIPMTIIKVEAAQRP

SEQ ID NO: 42647 - protein, 25 aa, synthetic construct
  source 1..25: note = Seed: NSCVKLQTVHSIPLTINKEEALQRP
NSCVKLQTVHSIPMTIIKVEAFQRP

SEQ ID NO: 42648 - protein, 25 aa, synthetic construct
  source 1..25: note = Seed: NSCVKLQTVHSIPLTINKEEALQRP
NSCVKLQTVHSIPMTIIKVEAIQRP

SEQ ID NO: 42649 - protein, 25 aa, synthetic construct
  source 1..25: note = Seed: NSCVKLQTVHSIPLTINKEEALQRP
NSCVKLQTVHSIPMTIIKVEALQRP

SEQ ID NO: 42650 - protein, 25 aa, synthetic construct
  source 1..25: note = Seed: NSCVKLQTVHSIPLTINKEEALQRP
NSCVKLQTVHSIPMTIIKVEAMQRP

SEQ ID NO: 42651 - protein, 25 aa, synthetic construct
  source 1..25: note = Seed: NSCVKLQTVHSIPLTINKEEALQRP
NSCVKLQTVHSIPMTIIKVEAQQRP

SEQ ID NO: 42652 - protein, 25 aa, synthetic construct
  source 1..25: note = Seed: NSCVKLQTVHSIPLTINKEEALQRP
NSCVKLQTVHSIPMTIIKVEASQRP

SEQ ID NO: 42653 - protein, 25 aa, synthetic construct
  source 1..25: note = Seed: NSCVKLQTVHSIPLTINKEEALQRP
NSCVKLQTVHSIPMTIIKVEATQRP

SEQ ID NO: 42654 - protein, 25 aa, synthetic construct
  source 1..25: note = Seed: NSCVKLQTVHSIPLTINKEEALQRP
NSCVKLQTVHSIPMTIIKVEAVQRP

SEQ ID NO: 42655 - protein, 25 aa, synthetic construct
  source 1..25: note = Seed: NSCVKLQTVHSIPLTINKEEALQRP
NSCVKLQTVHSIPMTIIKVEAYQRP

SEQ ID NO: 42656 - protein, 25 aa, synthetic construct
  source 1..25: note = Seed: NSCVKLQTVHSIPLTINKEEALQRP
NSCVKLQTVHSIPMTIIKWEAFQRP

SEQ ID NO: 42657 - protein, 25 aa, synthetic construct
  source 1..25: note = Seed: NSCVKLQTVHSIPLTINKEEALQRP
NSCVKLQTVHSIPMTIIKWEAIQRP

SEQ ID NO: 42658 - protein, 25 aa, synthetic construct
  source 1..25: note = Seed: NSCVKLQTVHSIPLTINKEEALQRP
NSCVKLQTVHSIPMTIIKWEALQRP

SEQ ID NO: 42659 - protein, 25 aa, synthetic construct
  source 1..25: note = Seed: NSCVKLQTVHSIPLTINKEEALQRP
NSCVKLQTVHSIPMTIIKYEAFQRP

SEQ ID NO: 42660 - protein, 25 aa, synthetic construct
  source 1..25: note = Seed: NSCVKLQTVHSIPLTINKEEALQRP
NSCVKLQTVHSIPMTIIKYEAIQRP

SEQ ID NO: 42661 - protein, 25 aa, synthetic construct
  source 1..25: note = Seed: NSCVKLQTVHSIPLTINKEEALQRP
NSCVKLQTVHSIPMTIIKYEALQRP

SEQ ID NO: 42662 - protein, 25 aa, synthetic construct
  source 1..25: note = Seed: NSCVKLQTVHSIPLTINKEEALQRP
NSCVKLQTVHSIPMTIIKYEAVQRP

SEQ ID NO: 42663 - protein, 25 aa, synthetic construct
  source 1..25: note = Seed: NSCVKLQTVHSIPLTINKEEALQRP
NSCVKLQTVHSIPMTIKKFEALQRP

SEQ ID NO: 42664 - protein, 25 aa, synthetic construct
  source 1..25: note = Seed: NSCVKLQTVHSIPLTINKEEALQRP
NSCVKLQTVHSIPMTIKKFEAVQRP

SEQ ID NO: 42665 - protein, 25 aa, synthetic construct
  source 1..25: note = Seed: NSCVKLQTVHSIPLTINKEEALQRP
NSCVKLQTVHSIPMTILKAEAAQRP

SEQ ID NO: 42666 - protein, 25 aa, synthetic construct
  source 1..25: note = Seed: NSCVKLQTVHSIPLTINKEEALQRP
NSCVKLQTVHSIPMTILKAEAFQRP

SEQ ID NO: 42667 - protein, 25 aa, synthetic construct
  source 1..25: note = Seed: NSCVKLQTVHSIPLTINKEEALQRP
NSCVKLQTVHSIPMTILKAEAIQRP

SEQ ID NO: 42668 - protein, 25 aa, synthetic construct
  source 1..25: note = Seed: NSCVKLQTVHSIPLTINKEEALQRP
NSCVKLQTVHSIPMTILKAEALQRP

SEQ ID NO: 42669 - protein, 25 aa, synthetic construct
  source 1..25: note = Seed: NSCVKLQTVHSIPLTINKEEALQRP
NSCVKLQTVHSIPMTILKAEAMQRP

SEQ ID NO: 42670 - protein, 25 aa, synthetic construct
  source 1..25: note = Seed: NSCVKLQTVHSIPLTINKEEALQRP
NSCVKLQTVHSIPMTILKAEASQRP

SEQ ID NO: 42671 - protein, 25 aa, synthetic construct
  source 1..25: note = Seed: NSCVKLQTVHSIPLTINKEEALQRP
NSCVKLQTVHSIPMTILKAEAVQRP

SEQ ID NO: 42672 - protein, 25 aa, synthetic construct
  source 1..25: note = Seed: NSCVKLQTVHSIPLTINKEEALQRP
NSCVKLQTVHSIPMTILKAEAYQRP

SEQ ID NO: 42673 - protein, 25 aa, synthetic construct
  source 1..25: note = Seed: NSCVKLQTVHSIPLTINKEEALQRP
NSCVKLQTVHSIPMTILKDEAAQRP

SEQ ID NO: 42674 - protein, 25 aa, synthetic construct
  source 1..25: note = Seed: NSCVKLQTVHSIPLTINKEEALQRP
NSCVKLQTVHSIPMTILKDEAIQRP

SEQ ID NO: 42675 - protein, 25 aa, synthetic construct
  source 1..25: note = Seed: NSCVKLQTVHSIPLTINKEEALQRP
NSCVKLQTVHSIPMTILKDEALQRP

SEQ ID NO: 42676 - protein, 25 aa, synthetic construct
  source 1..25: note = Seed: NSCVKLQTVHSIPLTINKEEALQRP
NSCVKLQTVHSIPMTILKDEAVQRP

SEQ ID NO: 42677 - protein, 25 aa, synthetic construct
  source 1..25: note = Seed: NSCVKLQTVHSIPLTINKEEALQRP
NSCVKLQTVHSIPMTILKFEAAQRP

SEQ ID NO: 42678 - protein, 25 aa, synthetic construct
  source 1..25: note = Seed: NSCVKLQTVHSIPLTINKEEALQRP
NSCVKLQTVHSIPMTILKFEADQRP

SEQ ID NO: 42679 - protein, 25 aa, synthetic construct
  source 1..25: note = Seed: NSCVKLQTVHSIPLTINKEEALQRP
NSCVKLQTVHSIPMTILKFEAEQRP

SEQ ID NO: 42680 - protein, 25 aa, synthetic construct
  source 1..25: note = Seed: NSCVKLQTVHSIPLTINKEEALQRP
NSCVKLQTVHSIPMTILKFEAFQRP

SEQ ID NO: 42681 - protein, 25 aa, synthetic construct
  source 1..25: note = Seed: NSCVKLQTVHSIPLTINKEEALQRP
NSCVKLQTVHSIPMTILKFEAHQRP

SEQ ID NO: 42682 - protein, 25 aa, synthetic construct
  source 1..25: note = Seed: NSCVKLQTVHSIPLTINKEEALQRP
NSCVKLQTVHSIPMTILKFEAIQRP

SEQ ID NO: 42683 - protein, 25 aa, synthetic construct
  source 1..25: note = Seed: NSCVKLQTVHSIPLTINKEEALQRP
NSCVKLQTVHSIPMTILKFEALQRP

SEQ ID NO: 42684 - protein, 25 aa, synthetic construct
  source 1..25: note = Seed: NSCVKLQTVHSIPLTINKEEALQRP
NSCVKLQTVHSIPMTILKFEAMQRP

SEQ ID NO: 42685 - protein, 25 aa, synthetic construct
  source 1..25: note = Seed: NSCVKLQTVHSIPLTINKEEALQRP
NSCVKLQTVHSIPMTILKFEANQRP

SEQ ID NO: 42686 - protein, 25 aa, synthetic construct
  source 1..25: note = Seed: NSCVKLQTVHSIPLTINKEEALQRP
NSCVKLQTVHSIPMTILKFEAQQRP

SEQ ID NO: 42687 - protein, 25 aa, synthetic construct
  source 1..25: note = Seed: NSCVKLQTVHSIPLTINKEEALQRP
NSCVKLQTVHSIPMTILKFEARQRP

SEQ ID NO: 42688 - protein, 25 aa, synthetic construct
  source 1..25: note = Seed: NSCVKLQTVHSIPLTINKEEALQRP
NSCVKLQTVHSIPMTILKFEASQRP

SEQ ID NO: 42689 - protein, 25 aa, synthetic construct
  source 1..25: note = Seed: NSCVKLQTVHSIPLTINKEEALQRP
NSCVKLQTVHSIPMTILKFEATQRP

SEQ ID NO: 42690 - protein, 25 aa, synthetic construct
  source 1..25: note = Seed: NSCVKLQTVHSIPLTINKEEALQRP
NSCVKLQTVHSIPMTILKFEAVQRP

SEQ ID NO: 42691 - protein, 25 aa, synthetic construct
  source 1..25: note = Seed: NSCVKLQTVHSIPLTINKEEALQRP
NSCVKLQTVHSIPMTILKFEAWQRP

SEQ ID NO: 42692 - protein, 25 aa, synthetic construct
  source 1..25: note = Seed: NSCVKLQTVHSIPLTINKEEALQRP
NSCVKLQTVHSIPMTILKFEAYQRP

SEQ ID NO: 42693 - protein, 25 aa, synthetic construct
  source 1..25: note = Seed: NSCVKLQTVHSIPLTINKEEALQRP
NSCVKLQTVHSIPMTILKGEAVQRP

SEQ ID NO: 42694 - protein, 25 aa, synthetic construct
  source 1..25: note = Seed: NSCVKLQTVHSIPLTINKEEALQRP
NSCVKLQTVHSIPMTILKIEAAQRP

SEQ ID NO: 42695 - protein, 25 aa, synthetic construct
  source 1..25: note = Seed: NSCVKLQTVHSIPLTINKEEALQRP
NSCVKLQTVHSIPMTILKIEAFQRP

SEQ ID NO: 42696 - protein, 25 aa, synthetic construct
  source 1..25: note = Seed: NSCVKLQTVHSIPLTINKEEALQRP
NSCVKLQTVHSIPMTILKIEAGQRP

SEQ ID NO: 42697 - protein, 25 aa, synthetic construct
  source 1..25: note = Seed: NSCVKLQTVHSIPLTINKEEALQRP
NSCVKLQTVHSIPMTILKIEAIQRP

SEQ ID NO: 42698 - protein, 25 aa, synthetic construct
  source 1..25: note = Seed: NSCVKLQTVHSIPLTINKEEALQRP
NSCVKLQTVHSIPMTILKIEALQRP

SEQ ID NO: 42699 - protein, 25 aa, synthetic construct
  source 1..25: note = Seed: NSCVKLQTVHSIPLTINKEEALQRP
NSCVKLQTVHSIPMTILKIEAMQRP

SEQ ID NO: 42700 - protein, 25 aa, synthetic construct
  source 1..25: note = Seed: NSCVKLQTVHSIPLTINKEEALQRP
NSCVKLQTVHSIPMTILKIEASQRP

SEQ ID NO: 42701 - protein, 25 aa, synthetic construct
  source 1..25: note = Seed: NSCVKLQTVHSIPLTINKEEALQRP
NSCVKLQTVHSIPMTILKIEATQRP

SEQ ID NO: 42702 - protein, 25 aa, synthetic construct
  source 1..25: note = Seed: NSCVKLQTVHSIPLTINKEEALQRP
NSCVKLQTVHSIPMTILKIEAVQRP

SEQ ID NO: 42703 - protein, 25 aa, synthetic construct
  source 1..25: note = Seed: NSCVKLQTVHSIPLTINKEEALQRP
NSCVKLQTVHSIPMTILKIEAYQRP

SEQ ID NO: 42704 - protein, 25 aa, synthetic construct
  source 1..25: note = Seed: NSCVKLQTVHSIPLTINKEEALQRP
NSCVKLQTVHSIPMTILKLEAAQRP

SEQ ID NO: 42705 - protein, 25 aa, synthetic construct
  source 1..25: note = Seed: NSCVKLQTVHSIPLTINKEEALQRP
NSCVKLQTVHSIPMTILKLEAFQRP

SEQ ID NO: 42706 - protein, 25 aa, synthetic construct
  source 1..25: note = Seed: NSCVKLQTVHSIPLTINKEEALQRP
NSCVKLQTVHSIPMTILKLEAIQRP

SEQ ID NO: 42707 - protein, 25 aa, synthetic construct
  source 1..25: note = Seed: NSCVKLQTVHSIPLTINKEEALQRP
NSCVKLQTVHSIPMTILKLEALQRP

SEQ ID NO: 42708 - protein, 25 aa, synthetic construct
  source 1..25: note = Seed: NSCVKLQTVHSIPLTINKEEALQRP
NSCVKLQTVHSIPMTILKLEAMQRP

SEQ ID NO: 42709 - protein, 25 aa, synthetic construct
  source 1..25: note = Seed: NSCVKLQTVHSIPLTINKEEALQRP
NSCVKLQTVHSIPMTILKLEASQRP

SEQ ID NO: 42710 - protein, 25 aa, synthetic construct
  source 1..25: note = Seed: NSCVKLQTVHSIPLTINKEEALQRP
NSCVKLQTVHSIPMTILKLEAVQRP

SEQ ID NO: 42711 - protein, 25 aa, synthetic construct
  source 1..25: note = Seed: NSCVKLQTVHSIPLTINKEEALQRP
NSCVKLQTVHSIPMTILKLEAYQRP

SEQ ID NO: 42712 - protein, 25 aa, synthetic construct
  source 1..25: note = Seed: NSCVKLQTVHSIPLTINKEEALQRP
NSCVKLQTVHSIPMTILKMEAAQRP

SEQ ID NO: 42713 - protein, 25 aa, synthetic construct
  source 1..25: note = Seed: NSCVKLQTVHSIPLTINKEEALQRP
NSCVKLQTVHSIPMTILKMEAIQRP

SEQ ID NO: 42714 - protein, 25 aa, synthetic construct
  source 1..25: note = Seed: NSCVKLQTVHSIPLTINKEEALQRP
NSCVKLQTVHSIPMTILKMEALQRP

SEQ ID NO: 42715 - protein, 25 aa, synthetic construct
  source 1..25: note = Seed: NSCVKLQTVHSIPLTINKEEALQRP
NSCVKLQTVHSIPMTILKMEAMQRP

SEQ ID NO: 42716 - protein, 25 aa, synthetic construct
  source 1..25: note = Seed: NSCVKLQTVHSIPLTINKEEALQRP
NSCVKLQTVHSIPMTILKMEASQRP

SEQ ID NO: 42717 - protein, 25 aa, synthetic construct
  source 1..25: note = Seed: NSCVKLQTVHSIPLTINKEEALQRP
NSCVKLQTVHSIPMTILKMEAVQRP

SEQ ID NO: 42718 - protein, 25 aa, synthetic construct
  source 1..25: note = Seed: NSCVKLQTVHSIPLTINKEEALQRP
NSCVKLQTVHSIPMTILKMEAYQRP

SEQ ID NO: 42719 - protein, 25 aa, synthetic construct
  source 1..25: note = Seed: NSCVKLQTVHSIPLTINKEEALQRP
NSCVKLQTVHSIPMTILKNEAIQRP

SEQ ID NO: 42720 - protein, 25 aa, synthetic construct
  source 1..25: note = Seed: NSCVKLQTVHSIPLTINKEEALQRP
NSCVKLQTVHSIPMTILKNEALQRP

SEQ ID NO: 42721 - protein, 25 aa, synthetic construct
  source 1..25: note = Seed: NSCVKLQTVHSIPLTINKEEALQRP
NSCVKLQTVHSIPMTILKNEAVQRP

SEQ ID NO: 42722 - protein, 25 aa, synthetic construct
  source 1..25: note = Seed: NSCVKLQTVHSIPLTINKEEALQRP
NSCVKLQTVHSIPMTILKPEAIQRP

SEQ ID NO: 42723 - protein, 25 aa, synthetic construct
  source 1..25: note = Seed: NSCVKLQTVHSIPLTINKEEALQRP
NSCVKLQTVHSIPMTILKPEAVQRP

SEQ ID NO: 42724 - protein, 25 aa, synthetic construct
  source 1..25: note = Seed: NSCVKLQTVHSIPLTINKEEALQRP
NSCVKLQTVHSIPMTILKREAFQRP

SEQ ID NO: 42725 - protein, 25 aa, synthetic construct
  source 1..25: note = Seed: NSCVKLQTVHSIPLTINKEEALQRP
NSCVKLQTVHSIPMTILKREAIQRP

SEQ ID NO: 42726 - protein, 25 aa, synthetic construct
  source 1..25: note = Seed: NSCVKLQTVHSIPLTINKEEALQRP
NSCVKLQTVHSIPMTILKREALQRP

SEQ ID NO: 42727 - protein, 25 aa, synthetic construct
  source 1..25: note = Seed: NSCVKLQTVHSIPLTINKEEALQRP
NSCVKLQTVHSIPMTILKREAMQRP

SEQ ID NO: 42728 - protein, 25 aa, synthetic construct
  source 1..25: note = Seed: NSCVKLQTVHSIPLTINKEEALQRP
NSCVKLQTVHSIPMTILKREAVQRP

SEQ ID NO: 42729 - protein, 25 aa, synthetic construct
  source 1..25: note = Seed: NSCVKLQTVHSIPLTINKEEALQRP
NSCVKLQTVHSIPMTILKREAYQRP

SEQ ID NO: 42730 - protein, 25 aa, synthetic construct
  source 1..25: note = Seed: NSCVKLQTVHSIPLTINKEEALQRP
NSCVKLQTVHSIPMTILKSEAIQRP

SEQ ID NO: 42731 - protein, 25 aa, synthetic construct
  source 1..25: note = Seed: NSCVKLQTVHSIPLTINKEEALQRP
NSCVKLQTVHSIPMTILKSEAVQRP

SEQ ID NO: 42732 - protein, 25 aa, synthetic construct
  source 1..25: note = Seed: NSCVKLQTVHSIPLTINKEEALQRP
NSCVKLQTVHSIPMTILKTEAIQRP

SEQ ID NO: 42733 - protein, 25 aa, synthetic construct
  source 1..25: note = Seed: NSCVKLQTVHSIPLTINKEEALQRP
NSCVKLQTVHSIPMTILKTEAVQRP

SEQ ID NO: 42734 - protein, 25 aa, synthetic construct
  source 1..25: note = Seed: NSCVKLQTVHSIPLTINKEEALQRP
NSCVKLQTVHSIPMTILKVEAAQRP

SEQ ID NO: 42735 - protein, 25 aa, synthetic construct
  source 1..25: note = Seed: NSCVKLQTVHSIPLTINKEEALQRP
NSCVKLQTVHSIPMTILKVEAFQRP

SEQ ID NO: 42736 - protein, 25 aa, synthetic construct
  source 1..25: note = Seed: NSCVKLQTVHSIPLTINKEEALQRP
NSCVKLQTVHSIPMTILKVEAIQRP

SEQ ID NO: 42737 - protein, 25 aa, synthetic construct
  source 1..25: note = Seed: NSCVKLQTVHSIPLTINKEEALQRP
NSCVKLQTVHSIPMTILKVEALQRP

SEQ ID NO: 42738 - protein, 25 aa, synthetic construct
  source 1..25: note = Seed: NSCVKLQTVHSIPLTINKEEALQRP
NSCVKLQTVHSIPMTILKVEAMQRP

SEQ ID NO: 42739 - protein, 25 aa, synthetic construct
  source 1..25: note = Seed: NSCVKLQTVHSIPLTINKEEALQRP
NSCVKLQTVHSIPMTILKVEASQRP

SEQ ID NO: 42740 - protein, 25 aa, synthetic construct
  source 1..25: note = Seed: NSCVKLQTVHSIPLTINKEEALQRP
NSCVKLQTVHSIPMTILKVEATQRP

SEQ ID NO: 42741 - protein, 25 aa, synthetic construct
  source 1..25: note = Seed: NSCVKLQTVHSIPLTINKEEALQRP
NSCVKLQTVHSIPMTILKVEAVQRP

SEQ ID NO: 42742 - protein, 25 aa, synthetic construct
  source 1..25: note = Seed: NSCVKLQTVHSIPLTINKEEALQRP
NSCVKLQTVHSIPMTILKVEAYQRP

SEQ ID NO: 42743 - protein, 25 aa, synthetic construct
  source 1..25: note = Seed: NSCVKLQTVHSIPLTINKEEALQRP
NSCVKLQTVHSIPMTILKWEAFQRP

SEQ ID NO: 42744 - protein, 25 aa, synthetic construct
  source 1..25: note = Seed: NSCVKLQTVHSIPLTINKEEALQRP
NSCVKLQTVHSIPMTILKWEAIQRP

SEQ ID NO: 42745 - protein, 25 aa, synthetic construct
  source 1..25: note = Seed: NSCVKLQTVHSIPLTINKEEALQRP
NSCVKLQTVHSIPMTILKWEALQRP

SEQ ID NO: 42746 - protein, 25 aa, synthetic construct
  source 1..25: note = Seed: NSCVKLQTVHSIPLTINKEEALQRP
NSCVKLQTVHSIPMTILKYEAFQRP

SEQ ID NO: 42747 - protein, 25 aa, synthetic construct
  source 1..25: note = Seed: NSCVKLQTVHSIPLTINKEEALQRP
NSCVKLQTVHSIPMTILKYEAIQRP

SEQ ID NO: 42748 - protein, 25 aa, synthetic construct
  source 1..25: note = Seed: NSCVKLQTVHSIPLTINKEEALQRP
NSCVKLQTVHSIPMTILKYEALQRP

SEQ ID NO: 42749 - protein, 25 aa, synthetic construct
  source 1..25: note = Seed: NSCVKLQTVHSIPLTINKEEALQRP
NSCVKLQTVHSIPMTILKYEAVQRP

SEQ ID NO: 42750 - protein, 25 aa, synthetic construct
  source 1..25: note = Seed: NSCVKLQTVHSIPLTINKEEALQRP
NSCVKLQTVHSIPMTIMKAEAAQRP

SEQ ID NO: 42751 - protein, 25 aa, synthetic construct
  source 1..25: note = Seed: NSCVKLQTVHSIPLTINKEEALQRP
NSCVKLQTVHSIPMTIMKAEAFQRP

SEQ ID NO: 42752 - protein, 25 aa, synthetic construct
  source 1..25: note = Seed: NSCVKLQTVHSIPLTINKEEALQRP
NSCVKLQTVHSIPMTIMKAEAIQRP

SEQ ID NO: 42753 - protein, 25 aa, synthetic construct
  source 1..25: note = Seed: NSCVKLQTVHSIPLTINKEEALQRP
NSCVKLQTVHSIPMTIMKAEALQRP

SEQ ID NO: 42754 - protein, 25 aa, synthetic construct
  source 1..25: note = Seed: NSCVKLQTVHSIPLTINKEEALQRP
NSCVKLQTVHSIPMTIMKAEAMQRP

SEQ ID NO: 42755 - protein, 25 aa, synthetic construct
  source 1..25: note = Seed: NSCVKLQTVHSIPLTINKEEALQRP
NSCVKLQTVHSIPMTIMKAEAVQRP

SEQ ID NO: 42756 - protein, 25 aa, synthetic construct
  source 1..25: note = Seed: NSCVKLQTVHSIPLTINKEEALQRP
NSCVKLQTVHSIPMTIMKAEAYQRP

SEQ ID NO: 42757 - protein, 25 aa, synthetic construct
  source 1..25: note = Seed: NSCVKLQTVHSIPLTINKEEALQRP
NSCVKLQTVHSIPMTIMKDEAAQRP

SEQ ID NO: 42758 - protein, 25 aa, synthetic construct
  source 1..25: note = Seed: NSCVKLQTVHSIPLTINKEEALQRP
NSCVKLQTVHSIPMTIMKDEAIQRP

SEQ ID NO: 42759 - protein, 25 aa, synthetic construct
  source 1..25: note = Seed: NSCVKLQTVHSIPLTINKEEALQRP
NSCVKLQTVHSIPMTIMKDEALQRP

SEQ ID NO: 42760 - protein, 25 aa, synthetic construct
  source 1..25: note = Seed: NSCVKLQTVHSIPLTINKEEALQRP
NSCVKLQTVHSIPMTIMKDEAMQRP

SEQ ID NO: 42761 - protein, 25 aa, synthetic construct
  source 1..25: note = Seed: NSCVKLQTVHSIPLTINKEEALQRP
NSCVKLQTVHSIPMTIMKDEAVQRP

SEQ ID NO: 42762 - protein, 25 aa, synthetic construct
  source 1..25: note = Seed: NSCVKLQTVHSIPLTINKEEALQRP
NSCVKLQTVHSIPMTIMKFEAAQRP

SEQ ID NO: 42763 - protein, 25 aa, synthetic construct
  source 1..25: note = Seed: NSCVKLQTVHSIPLTINKEEALQRP
NSCVKLQTVHSIPMTIMKFEAEQRP

SEQ ID NO: 42764 - protein, 25 aa, synthetic construct
  source 1..25: note = Seed: NSCVKLQTVHSIPLTINKEEALQRP
NSCVKLQTVHSIPMTIMKFEAFQRP

SEQ ID NO: 42765 - protein, 25 aa, synthetic construct
  source 1..25: note = Seed: NSCVKLQTVHSIPLTINKEEALQRP
NSCVKLQTVHSIPMTIMKFEAIQRP

SEQ ID NO: 42766 - protein, 25 aa, synthetic construct
  source 1..25: note = Seed: NSCVKLQTVHSIPLTINKEEALQRP
NSCVKLQTVHSIPMTIMKFEALQRP

SEQ ID NO: 42767 - protein, 25 aa, synthetic construct
  source 1..25: note = Seed: NSCVKLQTVHSIPLTINKEEALQRP
NSCVKLQTVHSIPMTIMKFEAMQRP

SEQ ID NO: 42768 - protein, 25 aa, synthetic construct
  source 1..25: note = Seed: NSCVKLQTVHSIPLTINKEEALQRP
NSCVKLQTVHSIPMTIMKFEATQRP

SEQ ID NO: 42769 - protein, 25 aa, synthetic construct
  source 1..25: note = Seed: NSCVKLQTVHSIPLTINKEEALQRP
NSCVKLQTVHSIPMTIMKFEAVQRP

SEQ ID NO: 42770 - protein, 25 aa, synthetic construct
  source 1..25: note = Seed: NSCVKLQTVHSIPLTINKEEALQRP
NSCVKLQTVHSIPMTIMKFEAYQRP

SEQ ID NO: 42771 - protein, 25 aa, synthetic construct
  source 1..25: note = Seed: NSCVKLQTVHSIPLTINKEEALQRP
NSCVKLQTVHSIPMTIMKGEAVQRP

SEQ ID NO: 42772 - protein, 25 aa, synthetic construct
  source 1..25: note = Seed: NSCVKLQTVHSIPLTINKEEALQRP
NSCVKLQTVHSIPMTIMKIEAAQRP

SEQ ID NO: 42773 - protein, 25 aa, synthetic construct
  source 1..25: note = Seed: NSCVKLQTVHSIPLTINKEEALQRP
NSCVKLQTVHSIPMTIMKIEACQRP

SEQ ID NO: 42774 - protein, 25 aa, synthetic construct
  source 1..25: note = Seed: NSCVKLQTVHSIPLTINKEEALQRP
NSCVKLQTVHSIPMTIMKIEADQRP

SEQ ID NO: 42775 - protein, 25 aa, synthetic construct
  source 1..25: note = Seed: NSCVKLQTVHSIPLTINKEEALQRP
NSCVKLQTVHSIPMTIMKIEAFQRP

SEQ ID NO: 42776 - protein, 25 aa, synthetic construct
  source 1..25: note = Seed: NSCVKLQTVHSIPLTINKEEALQRP
NSCVKLQTVHSIPMTIMKIEAGQRP

SEQ ID NO: 42777 - protein, 25 aa, synthetic construct
  source 1..25: note = Seed: NSCVKLQTVHSIPLTINKEEALQRP
NSCVKLQTVHSIPMTIMKIEAIQRP

SEQ ID NO: 42778 - protein, 25 aa, synthetic construct
  source 1..25: note = Seed: NSCVKLQTVHSIPLTINKEEALQRP
NSCVKLQTVHSIPMTIMKIEALQRP

SEQ ID NO: 42779 - protein, 25 aa, synthetic construct
  source 1..25: note = Seed: NSCVKLQTVHSIPLTINKEEALQRP
NSCVKLQTVHSIPMTIMKIEAMQRP

SEQ ID NO: 42780 - protein, 25 aa, synthetic construct
  source 1..25: note = Seed: NSCVKLQTVHSIPLTINKEEALQRP
NSCVKLQTVHSIPMTIMKIEANQRP

SEQ ID NO: 42781 - protein, 25 aa, synthetic construct
  source 1..25: note = Seed: NSCVKLQTVHSIPLTINKEEALQRP
NSCVKLQTVHSIPMTIMKIEAQQRP

SEQ ID NO: 42782 - protein, 25 aa, synthetic construct
  source 1..25: note = Seed: NSCVKLQTVHSIPLTINKEEALQRP
NSCVKLQTVHSIPMTIMKIEASQRP

SEQ ID NO: 42783 - protein, 25 aa, synthetic construct
  source 1..25: note = Seed: NSCVKLQTVHSIPLTINKEEALQRP
NSCVKLQTVHSIPMTIMKIEATQRP

SEQ ID NO: 42784 - protein, 25 aa, synthetic construct
  source 1..25: note = Seed: NSCVKLQTVHSIPLTINKEEALQRP
NSCVKLQTVHSIPMTIMKIEAVQRP

SEQ ID NO: 42785 - protein, 25 aa, synthetic construct
  source 1..25: note = Seed: NSCVKLQTVHSIPLTINKEEALQRP
NSCVKLQTVHSIPMTIMKIEAYQRP

SEQ ID NO: 42786 - protein, 25 aa, synthetic construct
  source 1..25: note = Seed: NSCVKLQTVHSIPLTINKEEALQRP
NSCVKLQTVHSIPMTIMKLEAAQRP

SEQ ID NO: 42787 - protein, 25 aa, synthetic construct
  source 1..25: note = Seed: NSCVKLQTVHSIPLTINKEEALQRP
NSCVKLQTVHSIPMTIMKLEAFQRP

SEQ ID NO: 42788 - protein, 25 aa, synthetic construct
  source 1..25: note = Seed: NSCVKLQTVHSIPLTINKEEALQRP
NSCVKLQTVHSIPMTIMKLEAIQRP

SEQ ID NO: 42789 - protein, 25 aa, synthetic construct
  source 1..25: note = Seed: NSCVKLQTVHSIPLTINKEEALQRP
NSCVKLQTVHSIPMTIMKLEALQRP

SEQ ID NO: 42790 - protein, 25 aa, synthetic construct
  source 1..25: note = Seed: NSCVKLQTVHSIPLTINKEEALQRP
NSCVKLQTVHSIPMTIMKLEAMQRP

SEQ ID NO: 42791 - protein, 25 aa, synthetic construct
  source 1..25: note = Seed: NSCVKLQTVHSIPLTINKEEALQRP
NSCVKLQTVHSIPMTIMKLEASQRP

SEQ ID NO: 42792 - protein, 25 aa, synthetic construct
  source 1..25: note = Seed: NSCVKLQTVHSIPLTINKEEALQRP
NSCVKLQTVHSIPMTIMKLEATQRP

SEQ ID NO: 42793 - protein, 25 aa, synthetic construct
  source 1..25: note = Seed: NSCVKLQTVHSIPLTINKEEALQRP
NSCVKLQTVHSIPMTIMKLEAVQRP

SEQ ID NO: 42794 - protein, 25 aa, synthetic construct
  source 1..25: note = Seed: NSCVKLQTVHSIPLTINKEEALQRP
NSCVKLQTVHSIPMTIMKLEAYQRP

SEQ ID NO: 42795 - protein, 25 aa, synthetic construct
  source 1..25: note = Seed: NSCVKLQTVHSIPLTINKEEALQRP
NSCVKLQTVHSIPMTIMKMEAAQRP

SEQ ID NO: 42796 - protein, 25 aa, synthetic construct
  source 1..25: note = Seed: NSCVKLQTVHSIPLTINKEEALQRP
NSCVKLQTVHSIPMTIMKMEAIQRP

SEQ ID NO: 42797 - protein, 25 aa, synthetic construct
  source 1..25: note = Seed: NSCVKLQTVHSIPLTINKEEALQRP
NSCVKLQTVHSIPMTIMKMEALQRP

SEQ ID NO: 42798 - protein, 25 aa, synthetic construct
  source 1..25: note = Seed: NSCVKLQTVHSIPLTINKEEALQRP
NSCVKLQTVHSIPMTIMKMEAMQRP

SEQ ID NO: 42799 - protein, 25 aa, synthetic construct
  source 1..25: note = Seed: NSCVKLQTVHSIPLTINKEEALQRP
NSCVKLQTVHSIPMTIMKMEASQRP

SEQ ID NO: 42800 - protein, 25 aa, synthetic construct
  source 1..25: note = Seed: NSCVKLQTVHSIPLTINKEEALQRP
NSCVKLQTVHSIPMTIMKMEAVQRP

SEQ ID NO: 42801 - protein, 25 aa, synthetic construct
  source 1..25: note = Seed: NSCVKLQTVHSIPLTINKEEALQRP
NSCVKLQTVHSIPMTIMKMEAYQRP

SEQ ID NO: 42802 - protein, 25 aa, synthetic construct
  source 1..25: note = Seed: NSCVKLQTVHSIPLTINKEEALQRP
NSCVKLQTVHSIPMTIMKNEAAQRP

SEQ ID NO: 42803 - protein, 25 aa, synthetic construct
  source 1..25: note = Seed: NSCVKLQTVHSIPLTINKEEALQRP
NSCVKLQTVHSIPMTIMKNEAIQRP

SEQ ID NO: 42804 - protein, 25 aa, synthetic construct
  source 1..25: note = Seed: NSCVKLQTVHSIPLTINKEEALQRP
NSCVKLQTVHSIPMTIMKNEALQRP

SEQ ID NO: 42805 - protein, 25 aa, synthetic construct
  source 1..25: note = Seed: NSCVKLQTVHSIPLTINKEEALQRP
NSCVKLQTVHSIPMTIMKNEAVQRP

SEQ ID NO: 42806 - protein, 25 aa, synthetic construct
  source 1..25: note = Seed: NSCVKLQTVHSIPLTINKEEALQRP
NSCVKLQTVHSIPMTIMKPEAIQRP

SEQ ID NO: 42807 - protein, 25 aa, synthetic construct
  source 1..25: note = Seed: NSCVKLQTVHSIPLTINKEEALQRP
NSCVKLQTVHSIPMTIMKPEAVQRP

SEQ ID NO: 42808 - protein, 25 aa, synthetic construct
  source 1..25: note = Seed: NSCVKLQTVHSIPLTINKEEALQRP
NSCVKLQTVHSIPMTIMKREAFQRP

SEQ ID NO: 42809 - protein, 25 aa, synthetic construct
  source 1..25: note = Seed: NSCVKLQTVHSIPLTINKEEALQRP
NSCVKLQTVHSIPMTIMKREAIQRP

SEQ ID NO: 42810 - protein, 25 aa, synthetic construct
  source 1..25: note = Seed: NSCVKLQTVHSIPLTINKEEALQRP
NSCVKLQTVHSIPMTIMKREALQRP

SEQ ID NO: 42811 - protein, 25 aa, synthetic construct
  source 1..25: note = Seed: NSCVKLQTVHSIPLTINKEEALQRP
NSCVKLQTVHSIPMTIMKREAVQRP

SEQ ID NO: 42812 - protein, 25 aa, synthetic construct
  source 1..25: note = Seed: NSCVKLQTVHSIPLTINKEEALQRP
NSCVKLQTVHSIPMTIMKREAYQRP

SEQ ID NO: 42813 - protein, 25 aa, synthetic construct
  source 1..25: note = Seed: NSCVKLQTVHSIPLTINKEEALQRP
NSCVKLQTVHSIPMTIMKSEAIQRP

SEQ ID NO: 42814 - protein, 25 aa, synthetic construct
  source 1..25: note = Seed: NSCVKLQTVHSIPLTINKEEALQRP
NSCVKLQTVHSIPMTIMKSEALQRP

SEQ ID NO: 42815 - protein, 25 aa, synthetic construct
  source 1..25: note = Seed: NSCVKLQTVHSIPLTINKEEALQRP
NSCVKLQTVHSIPMTIMKSEAVQRP

SEQ ID NO: 42816 - protein, 25 aa, synthetic construct
  source 1..25: note = Seed: NSCVKLQTVHSIPLTINKEEALQRP
NSCVKLQTVHSIPMTIMKTEAIQRP

SEQ ID NO: 42817 - protein, 25 aa, synthetic construct
  source 1..25: note = Seed: NSCVKLQTVHSIPLTINKEEALQRP
NSCVKLQTVHSIPMTIMKTEALQRP

SEQ ID NO: 42818 - protein, 25 aa, synthetic construct
  source 1..25: note = Seed: NSCVKLQTVHSIPLTINKEEALQRP
NSCVKLQTVHSIPMTIMKTEAVQRP

SEQ ID NO: 42819 - protein, 25 aa, synthetic construct
  source 1..25: note = Seed: NSCVKLQTVHSIPLTINKEEALQRP
NSCVKLQTVHSIPMTIMKVEAAQRP

SEQ ID NO: 42820 - protein, 25 aa, synthetic construct
  source 1..25: note = Seed: NSCVKLQTVHSIPLTINKEEALQRP
NSCVKLQTVHSIPMTIMKVEAFQRP

SEQ ID NO: 42821 - protein, 25 aa, synthetic construct
  source 1..25: note = Seed: NSCVKLQTVHSIPLTINKEEALQRP
NSCVKLQTVHSIPMTIMKVEAIQRP

SEQ ID NO: 42822 - protein, 25 aa, synthetic construct
  source 1..25: note = Seed: NSCVKLQTVHSIPLTINKEEALQRP
NSCVKLQTVHSIPMTIMKVEALQRP

SEQ ID NO: 42823 - protein, 25 aa, synthetic construct
  source 1..25: note = Seed: NSCVKLQTVHSIPLTINKEEALQRP
NSCVKLQTVHSIPMTIMKVEAMQRP

SEQ ID NO: 42824 - protein, 25 aa, synthetic construct
  source 1..25: note = Seed: NSCVKLQTVHSIPLTINKEEALQRP
NSCVKLQTVHSIPMTIMKVEAQQRP

SEQ ID NO: 42825 - protein, 25 aa, synthetic construct
  source 1..25: note = Seed: NSCVKLQTVHSIPLTINKEEALQRP
NSCVKLQTVHSIPMTIMKVEASQRP

SEQ ID NO: 42826 - protein, 25 aa, synthetic construct
  source 1..25: note = Seed: NSCVKLQTVHSIPLTINKEEALQRP
NSCVKLQTVHSIPMTIMKVEATQRP

SEQ ID NO: 42827 - protein, 25 aa, synthetic construct
  source 1..25: note = Seed: NSCVKLQTVHSIPLTINKEEALQRP
NSCVKLQTVHSIPMTIMKVEAVQRP

SEQ ID NO: 42828 - protein, 25 aa, synthetic construct
  source 1..25: note = Seed: NSCVKLQTVHSIPLTINKEEALQRP
NSCVKLQTVHSIPMTIMKVEAYQRP

SEQ ID NO: 42829 - protein, 25 aa, synthetic construct
  source 1..25: note = Seed: NSCVKLQTVHSIPLTINKEEALQRP
NSCVKLQTVHSIPMTIMKYEAFQRP

SEQ ID NO: 42830 - protein, 25 aa, synthetic construct
  source 1..25: note = Seed: NSCVKLQTVHSIPLTINKEEALQRP
NSCVKLQTVHSIPMTIMKYEALQRP

SEQ ID NO: 42831 - protein, 25 aa, synthetic construct
  source 1..25: note = Seed: NSCVKLQTVHSIPLTINKEEALQRP
NSCVKLQTVHSIPMTINKAEAFQRP

SEQ ID NO: 42832 - protein, 25 aa, synthetic construct
  source 1..25: note = Seed: NSCVKLQTVHSIPLTINKEEALQRP
NSCVKLQTVHSIPMTINKAEAIQRP

SEQ ID NO: 42833 - protein, 25 aa, synthetic construct
  source 1..25: note = Seed: NSCVKLQTVHSIPLTINKEEALQRP
NSCVKLQTVHSIPMTINKAEALQRP

SEQ ID NO: 42834 - protein, 25 aa, synthetic construct
  source 1..25: note = Seed: NSCVKLQTVHSIPLTINKEEALQRP
NSCVKLQTVHSIPMTINKAEAMQRP

SEQ ID NO: 42835 - protein, 25 aa, synthetic construct
  source 1..25: note = Seed: NSCVKLQTVHSIPLTINKEEALQRP
NSCVKLQTVHSIPMTINKAEAVQRP

SEQ ID NO: 42836 - protein, 25 aa, synthetic construct
  source 1..25: note = Seed: NSCVKLQTVHSIPLTINKEEALQRP
NSCVKLQTVHSIPMTINKAEAYQRP

SEQ ID NO: 42837 - protein, 25 aa, synthetic construct
  source 1..25: note = Seed: NSCVKLQTVHSIPLTINKEEALQRP
NSCVKLQTVHSIPMTINKFEAIQRP

SEQ ID NO: 42838 - protein, 25 aa, synthetic construct
  source 1..25: note = Seed: NSCVKLQTVHSIPLTINKEEALQRP
NSCVKLQTVHSIPMTINKFEALQRP

SEQ ID NO: 42839 - protein, 25 aa, synthetic construct
  source 1..25: note = Seed: NSCVKLQTVHSIPLTINKEEALQRP
NSCVKLQTVHSIPMTINKFEAVQRP

SEQ ID NO: 42840 - protein, 25 aa, synthetic construct
  source 1..25: note = Seed: NSCVKLQTVHSIPLTINKEEALQRP
NSCVKLQTVHSIPMTINKGEAIQRP

SEQ ID NO: 42841 - protein, 25 aa, synthetic construct
  source 1..25: note = Seed: NSCVKLQTVHSIPLTINKEEALQRP
NSCVKLQTVHSIPMTINKGEALQRP

SEQ ID NO: 42842 - protein, 25 aa, synthetic construct
  source 1..25: note = Seed: NSCVKLQTVHSIPLTINKEEALQRP
NSCVKLQTVHSIPMTINKGEAVQRP

SEQ ID NO: 42843 - protein, 25 aa, synthetic construct
  source 1..25: note = Seed: NSCVKLQTVHSIPLTINKEEALQRP
NSCVKLQTVHSIPMTINKIEAFQRP

SEQ ID NO: 42844 - protein, 25 aa, synthetic construct
  source 1..25: note = Seed: NSCVKLQTVHSIPLTINKEEALQRP
NSCVKLQTVHSIPMTINKIEAIQRP

SEQ ID NO: 42845 - protein, 25 aa, synthetic construct
  source 1..25: note = Seed: NSCVKLQTVHSIPLTINKEEALQRP
NSCVKLQTVHSIPMTINKIEALQRP

SEQ ID NO: 42846 - protein, 25 aa, synthetic construct
  source 1..25: note = Seed: NSCVKLQTVHSIPLTINKEEALQRP
NSCVKLQTVHSIPMTINKIEAVQRP

SEQ ID NO: 42847 - protein, 25 aa, synthetic construct
  source 1..25: note = Seed: NSCVKLQTVHSIPLTINKEEALQRP
NSCVKLQTVHSIPMTINKLEAIQRP

SEQ ID NO: 42848 - protein, 25 aa, synthetic construct
  source 1..25: note = Seed: NSCVKLQTVHSIPLTINKEEALQRP
NSCVKLQTVHSIPMTINKNEAFQRP

SEQ ID NO: 42849 - protein, 25 aa, synthetic construct
  source 1..25: note = Seed: NSCVKLQTVHSIPLTINKEEALQRP
NSCVKLQTVHSIPMTINKNEAIQRP

SEQ ID NO: 42850 - protein, 25 aa, synthetic construct
  source 1..25: note = Seed: NSCVKLQTVHSIPLTINKEEALQRP
NSCVKLQTVHSIPMTINKNEALQRP

SEQ ID NO: 42851 - protein, 25 aa, synthetic construct
  source 1..25: note = Seed: NSCVKLQTVHSIPLTINKEEALQRP
NSCVKLQTVHSIPMTINKNEAMQRP

SEQ ID NO: 42852 - protein, 25 aa, synthetic construct
  source 1..25: note = Seed: NSCVKLQTVHSIPLTINKEEALQRP
NSCVKLQTVHSIPMTINKNEAVQRP

SEQ ID NO: 42853 - protein, 25 aa, synthetic construct
  source 1..25: note = Seed: NSCVKLQTVHSIPLTINKEEALQRP
NSCVKLQTVHSIPMTINKNEAYQRP

SEQ ID NO: 42854 - protein, 25 aa, synthetic construct
  source 1..25: note = Seed: NSCVKLQTVHSIPLTINKEEALQRP
NSCVKLQTVHSIPMTINKPEAIQRP

SEQ ID NO: 42855 - protein, 25 aa, synthetic construct
  source 1..25: note = Seed: NSCVKLQTVHSIPLTINKEEALQRP
NSCVKLQTVHSIPMTINKPEALQRP

SEQ ID NO: 42856 - protein, 25 aa, synthetic construct
  source 1..25: note = Seed: NSCVKLQTVHSIPLTINKEEALQRP
NSCVKLQTVHSIPMTINKPEAVQRP

SEQ ID NO: 42857 - protein, 25 aa, synthetic construct
  source 1..25: note = Seed: NSCVKLQTVHSIPLTINKEEALQRP
NSCVKLQTVHSIPMTINKSEAFQRP

SEQ ID NO: 42858 - protein, 25 aa, synthetic construct
  source 1..25: note = Seed: NSCVKLQTVHSIPLTINKEEALQRP
NSCVKLQTVHSIPMTINKSEAIQRP

SEQ ID NO: 42859 - protein, 25 aa, synthetic construct
  source 1..25: note = Seed: NSCVKLQTVHSIPLTINKEEALQRP
NSCVKLQTVHSIPMTINKSEALQRP

SEQ ID NO: 42860 - protein, 25 aa, synthetic construct
  source 1..25: note = Seed: NSCVKLQTVHSIPLTINKEEALQRP
NSCVKLQTVHSIPMTINKSEAMQRP

SEQ ID NO: 42861 - protein, 25 aa, synthetic construct
  source 1..25: note = Seed: NSCVKLQTVHSIPLTINKEEALQRP
NSCVKLQTVHSIPMTINKSEAVQRP

SEQ ID NO: 42862 - protein, 25 aa, synthetic construct
  source 1..25: note = Seed: NSCVKLQTVHSIPLTINKEEALQRP
NSCVKLQTVHSIPMTINKSEAYQRP

SEQ ID NO: 42863 - protein, 25 aa, synthetic construct
  source 1..25: note = Seed: NSCVKLQTVHSIPLTINKEEALQRP
NSCVKLQTVHSIPMTINKTEAFQRP

SEQ ID NO: 42864 - protein, 25 aa, synthetic construct
  source 1..25: note = Seed: NSCVKLQTVHSIPLTINKEEALQRP
NSCVKLQTVHSIPMTINKTEAIQRP

SEQ ID NO: 42865 - protein, 25 aa, synthetic construct
  source 1..25: note = Seed: NSCVKLQTVHSIPLTINKEEALQRP
NSCVKLQTVHSIPMTINKTEALQRP

SEQ ID NO: 42866 - protein, 25 aa, synthetic construct
  source 1..25: note = Seed: NSCVKLQTVHSIPLTINKEEALQRP
NSCVKLQTVHSIPMTINKTEAVQRP

SEQ ID NO: 42867 - protein, 25 aa, synthetic construct
  source 1..25: note = Seed: NSCVKLQTVHSIPLTINKEEALQRP
NSCVKLQTVHSIPMTINKVEAFQRP

SEQ ID NO: 42868 - protein, 25 aa, synthetic construct
  source 1..25: note = Seed: NSCVKLQTVHSIPLTINKEEALQRP
NSCVKLQTVHSIPMTINKVEAIQRP

SEQ ID NO: 42869 - protein, 25 aa, synthetic construct
  source 1..25: note = Seed: NSCVKLQTVHSIPLTINKEEALQRP
NSCVKLQTVHSIPMTINKVEALQRP

SEQ ID NO: 42870 - protein, 25 aa, synthetic construct
  source 1..25: note = Seed: NSCVKLQTVHSIPLTINKEEALQRP
NSCVKLQTVHSIPMTINKVEAVQRP

SEQ ID NO: 42871 - protein, 25 aa, synthetic construct
  source 1..25: note = Seed: NSCVKLQTVHSIPLTINKEEALQRP
NSCVKLQTVHSIPMTIQKFEAFQRP

SEQ ID NO: 42872 - protein, 25 aa, synthetic construct
  source 1..25: note = Seed: NSCVKLQTVHSIPLTINKEEALQRP
NSCVKLQTVHSIPMTIQKFEAIQRP

SEQ ID NO: 42873 - protein, 25 aa, synthetic construct
  source 1..25: note = Seed: NSCVKLQTVHSIPLTINKEEALQRP
NSCVKLQTVHSIPMTIQKFEALQRP

SEQ ID NO: 42874 - protein, 25 aa, synthetic construct
  source 1..25: note = Seed: NSCVKLQTVHSIPLTINKEEALQRP
NSCVKLQTVHSIPMTIQKFEAMQRP

SEQ ID NO: 42875 - protein, 25 aa, synthetic construct
  source 1..25: note = Seed: NSCVKLQTVHSIPLTINKEEALQRP
NSCVKLQTVHSIPMTIQKFEAVQRP

SEQ ID NO: 42876 - protein, 25 aa, synthetic construct
  source 1..25: note = Seed: NSCVKLQTVHSIPLTINKEEALQRP
NSCVKLQTVHSIPMTIQKIEAVQRP

SEQ ID NO: 42877 - protein, 25 aa, synthetic construct
  source 1..25: note = Seed: NSCVKLQTVHSIPLTINKEEALQRP
NSCVKLQTVHSIPMTIRKREALQRP

SEQ ID NO: 42878 - protein, 25 aa, synthetic construct
  source 1..25: note = Seed: NSCVKLQTVHSIPLTINKEEALQRP
NSCVKLQTVHSIPMTISKAEAIQRP

SEQ ID NO: 42879 - protein, 25 aa, synthetic construct
  source 1..25: note = Seed: NSCVKLQTVHSIPLTINKEEALQRP
NSCVKLQTVHSIPMTISKFEAFQRP

SEQ ID NO: 42880 - protein, 25 aa, synthetic construct
  source 1..25: note = Seed: NSCVKLQTVHSIPLTINKEEALQRP
NSCVKLQTVHSIPMTISKFEAIQRP

SEQ ID NO: 42881 - protein, 25 aa, synthetic construct
  source 1..25: note = Seed: NSCVKLQTVHSIPLTINKEEALQRP
NSCVKLQTVHSIPMTISKFEALQRP

SEQ ID NO: 42882 - protein, 25 aa, synthetic construct
  source 1..25: note = Seed: NSCVKLQTVHSIPLTINKEEALQRP
NSCVKLQTVHSIPMTISKFEAMQRP

SEQ ID NO: 42883 - protein, 25 aa, synthetic construct
  source 1..25: note = Seed: NSCVKLQTVHSIPLTINKEEALQRP
NSCVKLQTVHSIPMTISKFEAVQRP

SEQ ID NO: 42884 - protein, 25 aa, synthetic construct
  source 1..25: note = Seed: NSCVKLQTVHSIPLTINKEEALQRP
NSCVKLQTVHSIPMTISKIEAAQRP

SEQ ID NO: 42885 - protein, 25 aa, synthetic construct
  source 1..25: note = Seed: NSCVKLQTVHSIPLTINKEEALQRP
NSCVKLQTVHSIPMTISKIEAFQRP

SEQ ID NO: 42886 - protein, 25 aa, synthetic construct
  source 1..25: note = Seed: NSCVKLQTVHSIPLTINKEEALQRP
NSCVKLQTVHSIPMTISKIEAIQRP

SEQ ID NO: 42887 - protein, 25 aa, synthetic construct
  source 1..25: note = Seed: NSCVKLQTVHSIPLTINKEEALQRP
NSCVKLQTVHSIPMTISKIEALQRP

SEQ ID NO: 42888 - protein, 25 aa, synthetic construct
  source 1..25: note = Seed: NSCVKLQTVHSIPLTINKEEALQRP
NSCVKLQTVHSIPMTISKIEAMQRP

SEQ ID NO: 42889 - protein, 25 aa, synthetic construct
  source 1..25: note = Seed: NSCVKLQTVHSIPLTINKEEALQRP
NSCVKLQTVHSIPMTISKIEAVQRP

SEQ ID NO: 42890 - protein, 25 aa, synthetic construct
  source 1..25: note = Seed: NSCVKLQTVHSIPLTINKEEALQRP
NSCVKLQTVHSIPMTISKLEAAQRP

SEQ ID NO: 42891 - protein, 25 aa, synthetic construct
  source 1..25: note = Seed: NSCVKLQTVHSIPLTINKEEALQRP
NSCVKLQTVHSIPMTISKLEAIQRP

SEQ ID NO: 42892 - protein, 25 aa, synthetic construct
  source 1..25: note = Seed: NSCVKLQTVHSIPLTINKEEALQRP
NSCVKLQTVHSIPMTISKLEALQRP

SEQ ID NO: 42893 - protein, 25 aa, synthetic construct
  source 1..25: note = Seed: NSCVKLQTVHSIPLTINKEEALQRP
NSCVKLQTVHSIPMTISKLEAVQRP

SEQ ID NO: 42894 - protein, 25 aa, synthetic construct
  source 1..25: note = Seed: NSCVKLQTVHSIPLTINKEEALQRP
NSCVKLQTVHSIPMTISKVEAAQRP

SEQ ID NO: 42895 - protein, 25 aa, synthetic construct
  source 1..25: note = Seed: NSCVKLQTVHSIPLTINKEEALQRP
NSCVKLQTVHSIPMTISKVEAIQRP

SEQ ID NO: 42896 - protein, 25 aa, synthetic construct
  source 1..25: note = Seed: NSCVKLQTVHSIPLTINKEEALQRP
NSCVKLQTVHSIPMTISKVEALQRP

SEQ ID NO: 42897 - protein, 25 aa, synthetic construct
  source 1..25: note = Seed: NSCVKLQTVHSIPLTINKEEALQRP
NSCVKLQTVHSIPMTISKVEAVQRP

SEQ ID NO: 42898 - protein, 25 aa, synthetic construct
  source 1..25: note = Seed: NSCVKLQTVHSIPLTINKEEALQRP
NSCVKLQTVHSIPMTITKFEAFQRP

SEQ ID NO: 42899 - protein, 25 aa, synthetic construct
  source 1..25: note = Seed: NSCVKLQTVHSIPLTINKEEALQRP
NSCVKLQTVHSIPMTITKFEAIQRP

SEQ ID NO: 42900 - protein, 25 aa, synthetic construct
  source 1..25: note = Seed: NSCVKLQTVHSIPLTINKEEALQRP
NSCVKLQTVHSIPMTITKFEALQRP

SEQ ID NO: 42901 - protein, 25 aa, synthetic construct
  source 1..25: note = Seed: NSCVKLQTVHSIPLTINKEEALQRP
NSCVKLQTVHSIPMTITKFEAMQRP

SEQ ID NO: 42902 - protein, 25 aa, synthetic construct
  source 1..25: note = Seed: NSCVKLQTVHSIPLTINKEEALQRP
NSCVKLQTVHSIPMTITKFEAVQRP

SEQ ID NO: 42903 - protein, 25 aa, synthetic construct
  source 1..25: note = Seed: NSCVKLQTVHSIPLTINKEEALQRP
NSCVKLQTVHSIPMTITKFEAYQRP

SEQ ID NO: 42904 - protein, 25 aa, synthetic construct
  source 1..25: note = Seed: NSCVKLQTVHSIPLTINKEEALQRP
NSCVKLQTVHSIPMTIVKAEAAQRP

SEQ ID NO: 42905 - protein, 25 aa, synthetic construct
  source 1..25: note = Seed: NSCVKLQTVHSIPLTINKEEALQRP
NSCVKLQTVHSIPMTIVKAEAFQRP

SEQ ID NO: 42906 - protein, 25 aa, synthetic construct
  source 1..25: note = Seed: NSCVKLQTVHSIPLTINKEEALQRP
NSCVKLQTVHSIPMTIVKAEAIQRP

SEQ ID NO: 42907 - protein, 25 aa, synthetic construct
  source 1..25: note = Seed: NSCVKLQTVHSIPLTINKEEALQRP
NSCVKLQTVHSIPMTIVKAEALQRP

SEQ ID NO: 42908 - protein, 25 aa, synthetic construct
  source 1..25: note = Seed: NSCVKLQTVHSIPLTINKEEALQRP
NSCVKLQTVHSIPMTIVKAEAMQRP

SEQ ID NO: 42909 - protein, 25 aa, synthetic construct
  source 1..25: note = Seed: NSCVKLQTVHSIPLTINKEEALQRP
NSCVKLQTVHSIPMTIVKAEAVQRP

SEQ ID NO: 42910 - protein, 25 aa, synthetic construct
  source 1..25: note = Seed: NSCVKLQTVHSIPLTINKEEALQRP
NSCVKLQTVHSIPMTIVKAEAYQRP

SEQ ID NO: 42911 - protein, 25 aa, synthetic construct
  source 1..25: note = Seed: NSCVKLQTVHSIPLTINKEEALQRP
NSCVKLQTVHSIPMTIVKDEAAQRP

SEQ ID NO: 42912 - protein, 25 aa, synthetic construct
  source 1..25: note = Seed: NSCVKLQTVHSIPLTINKEEALQRP
NSCVKLQTVHSIPMTIVKDEAIQRP

SEQ ID NO: 42913 - protein, 25 aa, synthetic construct
  source 1..25: note = Seed: NSCVKLQTVHSIPLTINKEEALQRP
NSCVKLQTVHSIPMTIVKDEALQRP

SEQ ID NO: 42914 - protein, 25 aa, synthetic construct
  source 1..25: note = Seed: NSCVKLQTVHSIPLTINKEEALQRP
NSCVKLQTVHSIPMTIVKDEAVQRP

SEQ ID NO: 42915 - protein, 25 aa, synthetic construct
  source 1..25: note = Seed: NSCVKLQTVHSIPLTINKEEALQRP
NSCVKLQTVHSIPMTIVKFEAAQRP

SEQ ID NO: 42916 - protein, 25 aa, synthetic construct
  source 1..25: note = Seed: NSCVKLQTVHSIPLTINKEEALQRP
NSCVKLQTVHSIPMTIVKFEAEQRP

SEQ ID NO: 42917 - protein, 25 aa, synthetic construct
  source 1..25: note = Seed: NSCVKLQTVHSIPLTINKEEALQRP
NSCVKLQTVHSIPMTIVKFEAFQRP

SEQ ID NO: 42918 - protein, 25 aa, synthetic construct
  source 1..25: note = Seed: NSCVKLQTVHSIPLTINKEEALQRP
NSCVKLQTVHSIPMTIVKFEAIQRP

SEQ ID NO: 42919 - protein, 25 aa, synthetic construct
  source 1..25: note = Seed: NSCVKLQTVHSIPLTINKEEALQRP
NSCVKLQTVHSIPMTIVKFEALQRP

SEQ ID NO: 42920 - protein, 25 aa, synthetic construct
  source 1..25: note = Seed: NSCVKLQTVHSIPLTINKEEALQRP
NSCVKLQTVHSIPMTIVKFEAMQRP

SEQ ID NO: 42921 - protein, 25 aa, synthetic construct
  source 1..25: note = Seed: NSCVKLQTVHSIPLTINKEEALQRP
NSCVKLQTVHSIPMTIVKFEANQRP

SEQ ID NO: 42922 - protein, 25 aa, synthetic construct
  source 1..25: note = Seed: NSCVKLQTVHSIPLTINKEEALQRP
NSCVKLQTVHSIPMTIVKFEASQRP

SEQ ID NO: 42923 - protein, 25 aa, synthetic construct
  source 1..25: note = Seed: NSCVKLQTVHSIPLTINKEEALQRP
NSCVKLQTVHSIPMTIVKFEATQRP

SEQ ID NO: 42924 - protein, 25 aa, synthetic construct
  source 1..25: note = Seed: NSCVKLQTVHSIPLTINKEEALQRP
NSCVKLQTVHSIPMTIVKFEAVQRP

SEQ ID NO: 42925 - protein, 25 aa, synthetic construct
  source 1..25: note = Seed: NSCVKLQTVHSIPLTINKEEALQRP
NSCVKLQTVHSIPMTIVKFEAYQRP

SEQ ID NO: 42926 - protein, 25 aa, synthetic construct
  source 1..25: note = Seed: NSCVKLQTVHSIPLTINKEEALQRP
NSCVKLQTVHSIPMTIVKIEAAQRP

SEQ ID NO: 42927 - protein, 25 aa, synthetic construct
  source 1..25: note = Seed: NSCVKLQTVHSIPLTINKEEALQRP
NSCVKLQTVHSIPMTIVKIEADQRP

SEQ ID NO: 42928 - protein, 25 aa, synthetic construct
  source 1..25: note = Seed: NSCVKLQTVHSIPLTINKEEALQRP
NSCVKLQTVHSIPMTIVKIEAFQRP

SEQ ID NO: 42929 - protein, 25 aa, synthetic construct
  source 1..25: note = Seed: NSCVKLQTVHSIPLTINKEEALQRP
NSCVKLQTVHSIPMTIVKIEAIQRP

SEQ ID NO: 42930 - protein, 25 aa, synthetic construct
  source 1..25: note = Seed: NSCVKLQTVHSIPLTINKEEALQRP
NSCVKLQTVHSIPMTIVKIEALQRP

SEQ ID NO: 42931 - protein, 25 aa, synthetic construct
  source 1..25: note = Seed: NSCVKLQTVHSIPLTINKEEALQRP
NSCVKLQTVHSIPMTIVKIEAMQRP

SEQ ID NO: 42932 - protein, 25 aa, synthetic construct
  source 1..25: note = Seed: NSCVKLQTVHSIPLTINKEEALQRP
NSCVKLQTVHSIPMTIVKIEAQQRP

SEQ ID NO: 42933 - protein, 25 aa, synthetic construct
  source 1..25: note = Seed: NSCVKLQTVHSIPLTINKEEALQRP
NSCVKLQTVHSIPMTIVKIEASQRP

SEQ ID NO: 42934 - protein, 25 aa, synthetic construct
  source 1..25: note = Seed: NSCVKLQTVHSIPLTINKEEALQRP
NSCVKLQTVHSIPMTIVKIEATQRP

SEQ ID NO: 42935 - protein, 25 aa, synthetic construct
  source 1..25: note = Seed: NSCVKLQTVHSIPLTINKEEALQRP
NSCVKLQTVHSIPMTIVKIEAVQRP

SEQ ID NO: 42936 - protein, 25 aa, synthetic construct
  source 1..25: note = Seed: NSCVKLQTVHSIPLTINKEEALQRP
NSCVKLQTVHSIPMTIVKIEAYQRP

SEQ ID NO: 42937 - protein, 25 aa, synthetic construct
  source 1..25: note = Seed: NSCVKLQTVHSIPLTINKEEALQRP
NSCVKLQTVHSIPMTIVKLEAAQRP

SEQ ID NO: 42938 - protein, 25 aa, synthetic construct
  source 1..25: note = Seed: NSCVKLQTVHSIPLTINKEEALQRP
NSCVKLQTVHSIPMTIVKLEAIQRP

SEQ ID NO: 42939 - protein, 25 aa, synthetic construct
  source 1..25: note = Seed: NSCVKLQTVHSIPLTINKEEALQRP
NSCVKLQTVHSIPMTIVKLEALQRP

SEQ ID NO: 42940 - protein, 25 aa, synthetic construct
  source 1..25: note = Seed: NSCVKLQTVHSIPLTINKEEALQRP
NSCVKLQTVHSIPMTIVKLEAMQRP

SEQ ID NO: 42941 - protein, 25 aa, synthetic construct
  source 1..25: note = Seed: NSCVKLQTVHSIPLTINKEEALQRP
NSCVKLQTVHSIPMTIVKLEASQRP

SEQ ID NO: 42942 - protein, 25 aa, synthetic construct
  source 1..25: note = Seed: NSCVKLQTVHSIPLTINKEEALQRP
NSCVKLQTVHSIPMTIVKLEAVQRP

SEQ ID NO: 42943 - protein, 25 aa, synthetic construct
  source 1..25: note = Seed: NSCVKLQTVHSIPLTINKEEALQRP
NSCVKLQTVHSIPMTIVKLEAYQRP

SEQ ID NO: 42944 - protein, 25 aa, synthetic construct
  source 1..25: note = Seed: NSCVKLQTVHSIPLTINKEEALQRP
NSCVKLQTVHSIPMTIVKMEAAQRP

SEQ ID NO: 42945 - protein, 25 aa, synthetic construct
  source 1..25: note = Seed: NSCVKLQTVHSIPLTINKEEALQRP
NSCVKLQTVHSIPMTIVKMEAIQRP

SEQ ID NO: 42946 - protein, 25 aa, synthetic construct
  source 1..25: note = Seed: NSCVKLQTVHSIPLTINKEEALQRP
NSCVKLQTVHSIPMTIVKMEALQRP

SEQ ID NO: 42947 - protein, 25 aa, synthetic construct
  source 1..25: note = Seed: NSCVKLQTVHSIPLTINKEEALQRP
NSCVKLQTVHSIPMTIVKMEAMQRP

SEQ ID NO: 42948 - protein, 25 aa, synthetic construct
  source 1..25: note = Seed: NSCVKLQTVHSIPLTINKEEALQRP
NSCVKLQTVHSIPMTIVKMEASQRP

SEQ ID NO: 42949 - protein, 25 aa, synthetic construct
  source 1..25: note = Seed: NSCVKLQTVHSIPLTINKEEALQRP
NSCVKLQTVHSIPMTIVKMEAVQRP

SEQ ID NO: 42950 - protein, 25 aa, synthetic construct
  source 1..25: note = Seed: NSCVKLQTVHSIPLTINKEEALQRP
NSCVKLQTVHSIPMTIVKMEAYQRP

SEQ ID NO: 42951 - protein, 25 aa, synthetic construct
  source 1..25: note = Seed: NSCVKLQTVHSIPLTINKEEALQRP
NSCVKLQTVHSIPMTIVKNEAAQRP

SEQ ID NO: 42952 - protein, 25 aa, synthetic construct
  source 1..25: note = Seed: NSCVKLQTVHSIPLTINKEEALQRP
NSCVKLQTVHSIPMTIVKNEAIQRP

SEQ ID NO: 42953 - protein, 25 aa, synthetic construct
  source 1..25: note = Seed: NSCVKLQTVHSIPLTINKEEALQRP
NSCVKLQTVHSIPMTIVKNEAVQRP

SEQ ID NO: 42954 - protein, 25 aa, synthetic construct
  source 1..25: note = Seed: NSCVKLQTVHSIPLTINKEEALQRP
NSCVKLQTVHSIPMTIVKREAIQRP

SEQ ID NO: 42955 - protein, 25 aa, synthetic construct
  source 1..25: note = Seed: NSCVKLQTVHSIPLTINKEEALQRP
NSCVKLQTVHSIPMTIVKREALQRP

SEQ ID NO: 42956 - protein, 25 aa, synthetic construct
  source 1..25: note = Seed: NSCVKLQTVHSIPLTINKEEALQRP
NSCVKLQTVHSIPMTIVKREAYQRP

SEQ ID NO: 42957 - protein, 25 aa, synthetic construct
  source 1..25: note = Seed: NSCVKLQTVHSIPLTINKEEALQRP
NSCVKLQTVHSIPMTIVKSEAIQRP

SEQ ID NO: 42958 - protein, 25 aa, synthetic construct
  source 1..25: note = Seed: NSCVKLQTVHSIPLTINKEEALQRP
NSCVKLQTVHSIPMTIVKSEAVQRP

SEQ ID NO: 42959 - protein, 25 aa, synthetic construct
  source 1..25: note = Seed: NSCVKLQTVHSIPLTINKEEALQRP
NSCVKLQTVHSIPMTIVKVEAAQRP

SEQ ID NO: 42960 - protein, 25 aa, synthetic construct
  source 1..25: note = Seed: NSCVKLQTVHSIPLTINKEEALQRP
NSCVKLQTVHSIPMTIVKVEAFQRP

SEQ ID NO: 42961 - protein, 25 aa, synthetic construct
  source 1..25: note = Seed: NSCVKLQTVHSIPLTINKEEALQRP
NSCVKLQTVHSIPMTIVKVEAIQRP

SEQ ID NO: 42962 - protein, 25 aa, synthetic construct
  source 1..25: note = Seed: NSCVKLQTVHSIPLTINKEEALQRP
NSCVKLQTVHSIPMTIVKVEALQRP

SEQ ID NO: 42963 - protein, 25 aa, synthetic construct
  source 1..25: note = Seed: NSCVKLQTVHSIPLTINKEEALQRP
NSCVKLQTVHSIPMTIVKVEAMQRP

SEQ ID NO: 42964 - protein, 25 aa, synthetic construct
  source 1..25: note = Seed: NSCVKLQTVHSIPLTINKEEALQRP
NSCVKLQTVHSIPMTIVKVEASQRP

SEQ ID NO: 42965 - protein, 25 aa, synthetic construct
  source 1..25: note = Seed: NSCVKLQTVHSIPLTINKEEALQRP
NSCVKLQTVHSIPMTIVKVEAVQRP

SEQ ID NO: 42966 - protein, 25 aa, synthetic construct
  source 1..25: note = Seed: NSCVKLQTVHSIPLTINKEEALQRP
NSCVKLQTVHSIPMTIVKVEAYQRP

SEQ ID NO: 42967 - protein, 25 aa, synthetic construct
  source 1..25: note = Seed: NSCVKLQTVHSIPLTINKEEALQRP
NSCVKLQTVHSIPMTIVKYEAFQRP

SEQ ID NO: 42968 - protein, 25 aa, synthetic construct
  source 1..25: note = Seed: NSCVKLQTVHSIPLTINKEEALQRP
NSCVKLQTVHSIPMTIVKYEAIQRP

SEQ ID NO: 42969 - protein, 25 aa, synthetic construct
  source 1..25: note = Seed: NSCVKLQTVHSIPLTINKEEALQRP
NSCVKLQTVHSIPMTIVKYEALQRP

SEQ ID NO: 42970 - protein, 25 aa, synthetic construct
  source 1..25: note = Seed: NSCVKLQTVHSIPLTINKEEALQRP
NSCVKLQTVHSIPMTIWKAEAAQRP

SEQ ID NO: 42971 - protein, 25 aa, synthetic construct
  source 1..25: note = Seed: NSCVKLQTVHSIPLTINKEEALQRP
NSCVKLQTVHSIPMTIWKAEAFQRP

SEQ ID NO: 42972 - protein, 25 aa, synthetic construct
  source 1..25: note = Seed: NSCVKLQTVHSIPLTINKEEALQRP
NSCVKLQTVHSIPMTIWKAEAIQRP

SEQ ID NO: 42973 - protein, 25 aa, synthetic construct
  source 1..25: note = Seed: NSCVKLQTVHSIPLTINKEEALQRP
NSCVKLQTVHSIPMTIWKAEALQRP

SEQ ID NO: 42974 - protein, 25 aa, synthetic construct
  source 1..25: note = Seed: NSCVKLQTVHSIPLTINKEEALQRP
NSCVKLQTVHSIPMTIWKAEAMQRP

SEQ ID NO: 42975 - protein, 25 aa, synthetic construct
  source 1..25: note = Seed: NSCVKLQTVHSIPLTINKEEALQRP
NSCVKLQTVHSIPMTIWKAEASQRP

SEQ ID NO: 42976 - protein, 25 aa, synthetic construct
  source 1..25: note = Seed: NSCVKLQTVHSIPLTINKEEALQRP
NSCVKLQTVHSIPMTIWKAEAVQRP

SEQ ID NO: 42977 - protein, 25 aa, synthetic construct
  source 1..25: note = Seed: NSCVKLQTVHSIPLTINKEEALQRP
NSCVKLQTVHSIPMTIWKDEAAQRP

SEQ ID NO: 42978 - protein, 25 aa, synthetic construct
  source 1..25: note = Seed: NSCVKLQTVHSIPLTINKEEALQRP
NSCVKLQTVHSIPMTIWKDEAFQRP

SEQ ID NO: 42979 - protein, 25 aa, synthetic construct
  source 1..25: note = Seed: NSCVKLQTVHSIPLTINKEEALQRP
NSCVKLQTVHSIPMTIWKDEAIQRP

SEQ ID NO: 42980 - protein, 25 aa, synthetic construct
  source 1..25: note = Seed: NSCVKLQTVHSIPLTINKEEALQRP
NSCVKLQTVHSIPMTIWKDEALQRP

SEQ ID NO: 42981 - protein, 25 aa, synthetic construct
  source 1..25: note = Seed: NSCVKLQTVHSIPLTINKEEALQRP
NSCVKLQTVHSIPMTIWKDEAMQRP

SEQ ID NO: 42982 - protein, 25 aa, synthetic construct
  source 1..25: note = Seed: NSCVKLQTVHSIPLTINKEEALQRP
NSCVKLQTVHSIPMTIWKDEASQRP

SEQ ID NO: 42983 - protein, 25 aa, synthetic construct
  source 1..25: note = Seed: NSCVKLQTVHSIPLTINKEEALQRP
NSCVKLQTVHSIPMTIWKDEAVQRP

SEQ ID NO: 42984 - protein, 25 aa, synthetic construct
  source 1..25: note = Seed: NSCVKLQTVHSIPLTINKEEALQRP
NSCVKLQTVHSIPMTIWKDEAYQRP

SEQ ID NO: 42985 - protein, 25 aa, synthetic construct
  source 1..25: note = Seed: NSCVKLQTVHSIPLTINKEEALQRP
NSCVKLQTVHSIPMTIWKFEAAQRP

SEQ ID NO: 42986 - protein, 25 aa, synthetic construct
  source 1..25: note = Seed: NSCVKLQTVHSIPLTINKEEALQRP
NSCVKLQTVHSIPMTIWKFEAFQRP

SEQ ID NO: 42987 - protein, 25 aa, synthetic construct
  source 1..25: note = Seed: NSCVKLQTVHSIPLTINKEEALQRP
NSCVKLQTVHSIPMTIWKFEAIQRP

SEQ ID NO: 42988 - protein, 25 aa, synthetic construct
  source 1..25: note = Seed: NSCVKLQTVHSIPLTINKEEALQRP
NSCVKLQTVHSIPMTIWKFEALQRP

SEQ ID NO: 42989 - protein, 25 aa, synthetic construct
  source 1..25: note = Seed: NSCVKLQTVHSIPLTINKEEALQRP
NSCVKLQTVHSIPMTIWKFEAVQRP

SEQ ID NO: 42990 - protein, 25 aa, synthetic construct
  source 1..25: note = Seed: NSCVKLQTVHSIPLTINKEEALQRP
NSCVKLQTVHSIPMTIWKIEAAQRP

SEQ ID NO: 42991 - protein, 25 aa, synthetic construct
  source 1..25: note = Seed: NSCVKLQTVHSIPLTINKEEALQRP
NSCVKLQTVHSIPMTIWKIEACQRP

SEQ ID NO: 42992 - protein, 25 aa, synthetic construct
  source 1..25: note = Seed: NSCVKLQTVHSIPLTINKEEALQRP
NSCVKLQTVHSIPMTIWKIEADQRP

SEQ ID NO: 42993 - protein, 25 aa, synthetic construct
  source 1..25: note = Seed: NSCVKLQTVHSIPLTINKEEALQRP
NSCVKLQTVHSIPMTIWKIEAEQRP

SEQ ID NO: 42994 - protein, 25 aa, synthetic construct
  source 1..25: note = Seed: NSCVKLQTVHSIPLTINKEEALQRP
NSCVKLQTVHSIPMTIWKIEAFQRP

SEQ ID NO: 42995 - protein, 25 aa, synthetic construct
  source 1..25: note = Seed: NSCVKLQTVHSIPLTINKEEALQRP
NSCVKLQTVHSIPMTIWKIEAGQRP

SEQ ID NO: 42996 - protein, 25 aa, synthetic construct
  source 1..25: note = Seed: NSCVKLQTVHSIPLTINKEEALQRP
NSCVKLQTVHSIPMTIWKIEAIQRP

SEQ ID NO: 42997 - protein, 25 aa, synthetic construct
  source 1..25: note = Seed: NSCVKLQTVHSIPLTINKEEALQRP
NSCVKLQTVHSIPMTIWKIEALQRP

SEQ ID NO: 42998 - protein, 25 aa, synthetic construct
  source 1..25: note = Seed: NSCVKLQTVHSIPLTINKEEALQRP
NSCVKLQTVHSIPMTIWKIEAMQRP

SEQ ID NO: 42999 - protein, 25 aa, synthetic construct
  source 1..25: note = Seed: NSCVKLQTVHSIPLTINKEEALQRP
NSCVKLQTVHSIPMTIWKIEANQRP

SEQ ID NO: 43000 - protein, 25 aa, synthetic construct
  source 1..25: note = Seed: NSCVKLQTVHSIPLTINKEEALQRP
NSCVKLQTVHSIPMTIWKIEAQQRP

SEQ ID NO: 43001 - protein, 25 aa, synthetic construct
  source 1..25: note = Seed: NSCVKLQTVHSIPLTINKEEALQRP
NSCVKLQTVHSIPMTIWKIEASQRP

SEQ ID NO: 43002 - protein, 25 aa, synthetic construct
  source 1..25: note = Seed: NSCVKLQTVHSIPLTINKEEALQRP
NSCVKLQTVHSIPMTIWKIEATQRP

SEQ ID NO: 43003 - protein, 25 aa, synthetic construct
  source 1..25: note = Seed: NSCVKLQTVHSIPLTINKEEALQRP
NSCVKLQTVHSIPMTIWKIEAVQRP

SEQ ID NO: 43004 - protein, 25 aa, synthetic construct
  source 1..25: note = Seed: NSCVKLQTVHSIPLTINKEEALQRP
NSCVKLQTVHSIPMTIWKIEAWQRP

SEQ ID NO: 43005 - protein, 25 aa, synthetic construct
  source 1..25: note = Seed: NSCVKLQTVHSIPLTINKEEALQRP
NSCVKLQTVHSIPMTIWKIEAYQRP

SEQ ID NO: 43006 - protein, 25 aa, synthetic construct
  source 1..25: note = Seed: NSCVKLQTVHSIPLTINKEEALQRP
NSCVKLQTVHSIPMTIWKLEAAQRP

SEQ ID NO: 43007 - protein, 25 aa, synthetic construct
  source 1..25: note = Seed: NSCVKLQTVHSIPLTINKEEALQRP
NSCVKLQTVHSIPMTIWKLEAFQRP

SEQ ID NO: 43008 - protein, 25 aa, synthetic construct
  source 1..25: note = Seed: NSCVKLQTVHSIPLTINKEEALQRP
NSCVKLQTVHSIPMTIWKLEAIQRP

SEQ ID NO: 43009 - protein, 25 aa, synthetic construct
  source 1..25: note = Seed: NSCVKLQTVHSIPLTINKEEALQRP
NSCVKLQTVHSIPMTIWKLEALQRP

SEQ ID NO: 43010 - protein, 25 aa, synthetic construct
  source 1..25: note = Seed: NSCVKLQTVHSIPLTINKEEALQRP
NSCVKLQTVHSIPMTIWKLEAMQRP

SEQ ID NO: 43011 - protein, 25 aa, synthetic construct
  source 1..25: note = Seed: NSCVKLQTVHSIPLTINKEEALQRP
NSCVKLQTVHSIPMTIWKLEASQRP

SEQ ID NO: 43012 - protein, 25 aa, synthetic construct
  source 1..25: note = Seed: NSCVKLQTVHSIPLTINKEEALQRP
NSCVKLQTVHSIPMTIWKLEATQRP

SEQ ID NO: 43013 - protein, 25 aa, synthetic construct
  source 1..25: note = Seed: NSCVKLQTVHSIPLTINKEEALQRP
NSCVKLQTVHSIPMTIWKLEAVQRP

SEQ ID NO: 43014 - protein, 25 aa, synthetic construct
  source 1..25: note = Seed: NSCVKLQTVHSIPLTINKEEALQRP
NSCVKLQTVHSIPMTIWKLEAYQRP

SEQ ID NO: 43015 - protein, 25 aa, synthetic construct
  source 1..25: note = Seed: NSCVKLQTVHSIPLTINKEEALQRP
NSCVKLQTVHSIPMTIWKMEAAQRP

SEQ ID NO: 43016 - protein, 25 aa, synthetic construct
  source 1..25: note = Seed: NSCVKLQTVHSIPLTINKEEALQRP
NSCVKLQTVHSIPMTIWKMEAFQRP

SEQ ID NO: 43017 - protein, 25 aa, synthetic construct
  source 1..25: note = Seed: NSCVKLQTVHSIPLTINKEEALQRP
NSCVKLQTVHSIPMTIWKMEAIQRP

SEQ ID NO: 43018 - protein, 25 aa, synthetic construct
  source 1..25: note = Seed: NSCVKLQTVHSIPLTINKEEALQRP
NSCVKLQTVHSIPMTIWKMEALQRP

SEQ ID NO: 43019 - protein, 25 aa, synthetic construct
  source 1..25: note = Seed: NSCVKLQTVHSIPLTINKEEALQRP
NSCVKLQTVHSIPMTIWKMEAMQRP

SEQ ID NO: 43020 - protein, 25 aa, synthetic construct
  source 1..25: note = Seed: NSCVKLQTVHSIPLTINKEEALQRP
NSCVKLQTVHSIPMTIWKMEASQRP

SEQ ID NO: 43021 - protein, 25 aa, synthetic construct
  source 1..25: note = Seed: NSCVKLQTVHSIPLTINKEEALQRP
NSCVKLQTVHSIPMTIWKMEAVQRP

SEQ ID NO: 43022 - protein, 25 aa, synthetic construct
  source 1..25: note = Seed: NSCVKLQTVHSIPLTINKEEALQRP
NSCVKLQTVHSIPMTIWKNEAAQRP

SEQ ID NO: 43023 - protein, 25 aa, synthetic construct
  source 1..25: note = Seed: NSCVKLQTVHSIPLTINKEEALQRP
NSCVKLQTVHSIPMTIWKNEAFQRP

SEQ ID NO: 43024 - protein, 25 aa, synthetic construct
  source 1..25: note = Seed: NSCVKLQTVHSIPLTINKEEALQRP
NSCVKLQTVHSIPMTIWKNEAIQRP

SEQ ID NO: 43025 - protein, 25 aa, synthetic construct
  source 1..25: note = Seed: NSCVKLQTVHSIPLTINKEEALQRP
NSCVKLQTVHSIPMTIWKNEALQRP

SEQ ID NO: 43026 - protein, 25 aa, synthetic construct
  source 1..25: note = Seed: NSCVKLQTVHSIPLTINKEEALQRP
NSCVKLQTVHSIPMTIWKNEAMQRP

SEQ ID NO: 43027 - protein, 25 aa, synthetic construct
  source 1..25: note = Seed: NSCVKLQTVHSIPLTINKEEALQRP
NSCVKLQTVHSIPMTIWKNEAVQRP

SEQ ID NO: 43028 - protein, 25 aa, synthetic construct
  source 1..25: note = Seed: NSCVKLQTVHSIPLTINKEEALQRP
NSCVKLQTVHSIPMTIWKREAFQRP

SEQ ID NO: 43029 - protein, 25 aa, synthetic construct
  source 1..25: note = Seed: NSCVKLQTVHSIPLTINKEEALQRP
NSCVKLQTVHSIPMTIWKREAYQRP

SEQ ID NO: 43030 - protein, 25 aa, synthetic construct
  source 1..25: note = Seed: NSCVKLQTVHSIPLTINKEEALQRP
NSCVKLQTVHSIPMTIWKSEAAQRP

SEQ ID NO: 43031 - protein, 25 aa, synthetic construct
  source 1..25: note = Seed: NSCVKLQTVHSIPLTINKEEALQRP
NSCVKLQTVHSIPMTIWKSEAIQRP

SEQ ID NO: 43032 - protein, 25 aa, synthetic construct
  source 1..25: note = Seed: NSCVKLQTVHSIPLTINKEEALQRP
NSCVKLQTVHSIPMTIWKSEALQRP

SEQ ID NO: 43033 - protein, 25 aa, synthetic construct
  source 1..25: note = Seed: NSCVKLQTVHSIPLTINKEEALQRP
NSCVKLQTVHSIPMTIWKSEAMQRP

SEQ ID NO: 43034 - protein, 25 aa, synthetic construct
  source 1..25: note = Seed: NSCVKLQTVHSIPLTINKEEALQRP
NSCVKLQTVHSIPMTIWKSEAVQRP

SEQ ID NO: 43035 - protein, 25 aa, synthetic construct
  source 1..25: note = Seed: NSCVKLQTVHSIPLTINKEEALQRP
NSCVKLQTVHSIPMTIWKTEAAQRP

SEQ ID NO: 43036 - protein, 25 aa, synthetic construct
  source 1..25: note = Seed: NSCVKLQTVHSIPLTINKEEALQRP
NSCVKLQTVHSIPMTIWKTEAIQRP

SEQ ID NO: 43037 - protein, 25 aa, synthetic construct
  source 1..25: note = Seed: NSCVKLQTVHSIPLTINKEEALQRP
NSCVKLQTVHSIPMTIWKTEALQRP

SEQ ID NO: 43038 - protein, 25 aa, synthetic construct
  source 1..25: note = Seed: NSCVKLQTVHSIPLTINKEEALQRP
NSCVKLQTVHSIPMTIWKTEAVQRP

SEQ ID NO: 43039 - protein, 25 aa, synthetic construct
  source 1..25: note = Seed: NSCVKLQTVHSIPLTINKEEALQRP
NSCVKLQTVHSIPMTIWKVEAAQRP

SEQ ID NO: 43040 - protein, 25 aa, synthetic construct
  source 1..25: note = Seed: NSCVKLQTVHSIPLTINKEEALQRP
NSCVKLQTVHSIPMTIWKVEAFQRP

SEQ ID NO: 43041 - protein, 25 aa, synthetic construct
  source 1..25: note = Seed: NSCVKLQTVHSIPLTINKEEALQRP
NSCVKLQTVHSIPMTIWKVEAIQRP

SEQ ID NO: 43042 - protein, 25 aa, synthetic construct
  source 1..25: note = Seed: NSCVKLQTVHSIPLTINKEEALQRP
NSCVKLQTVHSIPMTIWKVEALQRP

SEQ ID NO: 43043 - protein, 25 aa, synthetic construct
  source 1..25: note = Seed: NSCVKLQTVHSIPLTINKEEALQRP
NSCVKLQTVHSIPMTIWKVEAMQRP

SEQ ID NO: 43044 - protein, 25 aa, synthetic construct
  source 1..25: note = Seed: NSCVKLQTVHSIPLTINKEEALQRP
NSCVKLQTVHSIPMTIWKVEASQRP

SEQ ID NO: 43045 - protein, 25 aa, synthetic construct
  source 1..25: note = Seed: NSCVKLQTVHSIPLTINKEEALQRP
NSCVKLQTVHSIPMTIWKVEATQRP

SEQ ID NO: 43046 - protein, 25 aa, synthetic construct
  source 1..25: note = Seed: NSCVKLQTVHSIPLTINKEEALQRP
NSCVKLQTVHSIPMTIWKVEAVQRP

SEQ ID NO: 43047 - protein, 25 aa, synthetic construct
  source 1..25: note = Seed: NSCVKLQTVHSIPLTINKEEALQRP
NSCVKLQTVHSIPMTIWKVEAYQRP

SEQ ID NO: 43048 - protein, 25 aa, synthetic construct
  source 1..25: note = Seed: NSCVKLQTVHSIPLTINKEEALQRP
NSCVKLQTVHSIPMTIYKAEAAQRP

SEQ ID NO: 43049 - protein, 25 aa, synthetic construct
  source 1..25: note = Seed: NSCVKLQTVHSIPLTINKEEALQRP
NSCVKLQTVHSIPMTIYKAEACQRP

SEQ ID NO: 43050 - protein, 25 aa, synthetic construct
  source 1..25: note = Seed: NSCVKLQTVHSIPLTINKEEALQRP
NSCVKLQTVHSIPMTIYKAEAFQRP

SEQ ID NO: 43051 - protein, 25 aa, synthetic construct
  source 1..25: note = Seed: NSCVKLQTVHSIPLTINKEEALQRP
NSCVKLQTVHSIPMTIYKAEAIQRP

SEQ ID NO: 43052 - protein, 25 aa, synthetic construct
  source 1..25: note = Seed: NSCVKLQTVHSIPLTINKEEALQRP
NSCVKLQTVHSIPMTIYKAEALQRP

SEQ ID NO: 43053 - protein, 25 aa, synthetic construct
  source 1..25: note = Seed: NSCVKLQTVHSIPLTINKEEALQRP
NSCVKLQTVHSIPMTIYKAEAMQRP

SEQ ID NO: 43054 - protein, 25 aa, synthetic construct
  source 1..25: note = Seed: NSCVKLQTVHSIPLTINKEEALQRP
NSCVKLQTVHSIPMTIYKAEASQRP

SEQ ID NO: 43055 - protein, 25 aa, synthetic construct
  source 1..25: note = Seed: NSCVKLQTVHSIPLTINKEEALQRP
NSCVKLQTVHSIPMTIYKAEATQRP

SEQ ID NO: 43056 - protein, 25 aa, synthetic construct
  source 1..25: note = Seed: NSCVKLQTVHSIPLTINKEEALQRP
NSCVKLQTVHSIPMTIYKAEAVQRP

SEQ ID NO: 43057 - protein, 25 aa, synthetic construct
  source 1..25: note = Seed: NSCVKLQTVHSIPLTINKEEALQRP
NSCVKLQTVHSIPMTIYKAEAYQRP

SEQ ID NO: 43058 - protein, 25 aa, synthetic construct
  source 1..25: note = Seed: NSCVKLQTVHSIPLTINKEEALQRP
NSCVKLQTVHSIPMTIYKDEAAQRP

SEQ ID NO: 43059 - protein, 25 aa, synthetic construct
  source 1..25: note = Seed: NSCVKLQTVHSIPLTINKEEALQRP
NSCVKLQTVHSIPMTIYKDEACQRP

SEQ ID NO: 43060 - protein, 25 aa, synthetic construct
  source 1..25: note = Seed: NSCVKLQTVHSIPLTINKEEALQRP
NSCVKLQTVHSIPMTIYKDEAFQRP

SEQ ID NO: 43061 - protein, 25 aa, synthetic construct
  source 1..25: note = Seed: NSCVKLQTVHSIPLTINKEEALQRP
NSCVKLQTVHSIPMTIYKDEAGQRP

SEQ ID NO: 43062 - protein, 25 aa, synthetic construct
  source 1..25: note = Seed: NSCVKLQTVHSIPLTINKEEALQRP
NSCVKLQTVHSIPMTIYKDEAIQRP

SEQ ID NO: 43063 - protein, 25 aa, synthetic construct
  source 1..25: note = Seed: NSCVKLQTVHSIPLTINKEEALQRP
NSCVKLQTVHSIPMTIYKDEALQRP

SEQ ID NO: 43064 - protein, 25 aa, synthetic construct
  source 1..25: note = Seed: NSCVKLQTVHSIPLTINKEEALQRP
NSCVKLQTVHSIPMTIYKDEAMQRP

SEQ ID NO: 43065 - protein, 25 aa, synthetic construct
  source 1..25: note = Seed: NSCVKLQTVHSIPLTINKEEALQRP
NSCVKLQTVHSIPMTIYKDEANQRP

SEQ ID NO: 43066 - protein, 25 aa, synthetic construct
  source 1..25: note = Seed: NSCVKLQTVHSIPLTINKEEALQRP
NSCVKLQTVHSIPMTIYKDEAQQRP

SEQ ID NO: 43067 - protein, 25 aa, synthetic construct
  source 1..25: note = Seed: NSCVKLQTVHSIPLTINKEEALQRP
NSCVKLQTVHSIPMTIYKDEASQRP

SEQ ID NO: 43068 - protein, 25 aa, synthetic construct
  source 1..25: note = Seed: NSCVKLQTVHSIPLTINKEEALQRP
NSCVKLQTVHSIPMTIYKDEATQRP

SEQ ID NO: 43069 - protein, 25 aa, synthetic construct
  source 1..25: note = Seed: NSCVKLQTVHSIPLTINKEEALQRP
NSCVKLQTVHSIPMTIYKDEAVQRP

SEQ ID NO: 43070 - protein, 25 aa, synthetic construct
  source 1..25: note = Seed: NSCVKLQTVHSIPLTINKEEALQRP
NSCVKLQTVHSIPMTIYKDEAYQRP

SEQ ID NO: 43071 - protein, 25 aa, synthetic construct
  source 1..25: note = Seed: NSCVKLQTVHSIPLTINKEEALQRP
NSCVKLQTVHSIPMTIYKFEAAQRP

SEQ ID NO: 43072 - protein, 25 aa, synthetic construct
  source 1..25: note = Seed: NSCVKLQTVHSIPLTINKEEALQRP
NSCVKLQTVHSIPMTIYKFEAFQRP

SEQ ID NO: 43073 - protein, 25 aa, synthetic construct
  source 1..25: note = Seed: NSCVKLQTVHSIPLTINKEEALQRP
NSCVKLQTVHSIPMTIYKFEAIQRP

SEQ ID NO: 43074 - protein, 25 aa, synthetic construct
  source 1..25: note = Seed: NSCVKLQTVHSIPLTINKEEALQRP
NSCVKLQTVHSIPMTIYKFEALQRP

SEQ ID NO: 43075 - protein, 25 aa, synthetic construct
  source 1..25: note = Seed: NSCVKLQTVHSIPLTINKEEALQRP
NSCVKLQTVHSIPMTIYKFEAMQRP

SEQ ID NO: 43076 - protein, 25 aa, synthetic construct
  source 1..25: note = Seed: NSCVKLQTVHSIPLTINKEEALQRP
NSCVKLQTVHSIPMTIYKFEAVQRP

SEQ ID NO: 43077 - protein, 25 aa, synthetic construct
  source 1..25: note = Seed: NSCVKLQTVHSIPLTINKEEALQRP
NSCVKLQTVHSIPMTIYKFEAYQRP

SEQ ID NO: 43078 - protein, 25 aa, synthetic construct
  source 1..25: note = Seed: NSCVKLQTVHSIPLTINKEEALQRP
NSCVKLQTVHSIPMTIYKGEAIQRP

SEQ ID NO: 43079 - protein, 25 aa, synthetic construct
  source 1..25: note = Seed: NSCVKLQTVHSIPLTINKEEALQRP
NSCVKLQTVHSIPMTIYKGEAVQRP

SEQ ID NO: 43080 - protein, 25 aa, synthetic construct
  source 1..25: note = Seed: NSCVKLQTVHSIPLTINKEEALQRP
NSCVKLQTVHSIPMTIYKIEAAQRP

SEQ ID NO: 43081 - protein, 25 aa, synthetic construct
  source 1..25: note = Seed: NSCVKLQTVHSIPLTINKEEALQRP
NSCVKLQTVHSIPMTIYKIEACQRP

SEQ ID NO: 43082 - protein, 25 aa, synthetic construct
  source 1..25: note = Seed: NSCVKLQTVHSIPLTINKEEALQRP
NSCVKLQTVHSIPMTIYKIEADQRP

SEQ ID NO: 43083 - protein, 25 aa, synthetic construct
  source 1..25: note = Seed: NSCVKLQTVHSIPLTINKEEALQRP
NSCVKLQTVHSIPMTIYKIEAEQRP

SEQ ID NO: 43084 - protein, 25 aa, synthetic construct
  source 1..25: note = Seed: NSCVKLQTVHSIPLTINKEEALQRP
NSCVKLQTVHSIPMTIYKIEAFQRP

SEQ ID NO: 43085 - protein, 25 aa, synthetic construct
  source 1..25: note = Seed: NSCVKLQTVHSIPLTINKEEALQRP
NSCVKLQTVHSIPMTIYKIEAGQRP

SEQ ID NO: 43086 - protein, 25 aa, synthetic construct
  source 1..25: note = Seed: NSCVKLQTVHSIPLTINKEEALQRP
NSCVKLQTVHSIPMTIYKIEAHQRP

SEQ ID NO: 43087 - protein, 25 aa, synthetic construct
  source 1..25: note = Seed: NSCVKLQTVHSIPLTINKEEALQRP
NSCVKLQTVHSIPMTIYKIEAIQRP

SEQ ID NO: 43088 - protein, 25 aa, synthetic construct
  source 1..25: note = Seed: NSCVKLQTVHSIPLTINKEEALQRP
NSCVKLQTVHSIPMTIYKIEALQRP

SEQ ID NO: 43089 - protein, 25 aa, synthetic construct
  source 1..25: note = Seed: NSCVKLQTVHSIPLTINKEEALQRP
NSCVKLQTVHSIPMTIYKIEAMQRP

SEQ ID NO: 43090 - protein, 25 aa, synthetic construct
  source 1..25: note = Seed: NSCVKLQTVHSIPLTINKEEALQRP
NSCVKLQTVHSIPMTIYKIEANQRP

SEQ ID NO: 43091 - protein, 25 aa, synthetic construct
  source 1..25: note = Seed: NSCVKLQTVHSIPLTINKEEALQRP
NSCVKLQTVHSIPMTIYKIEAPQRP

SEQ ID NO: 43092 - protein, 25 aa, synthetic construct
  source 1..25: note = Seed: NSCVKLQTVHSIPLTINKEEALQRP
NSCVKLQTVHSIPMTIYKIEAQQRP

SEQ ID NO: 43093 - protein, 25 aa, synthetic construct
  source 1..25: note = Seed: NSCVKLQTVHSIPLTINKEEALQRP
NSCVKLQTVHSIPMTIYKIEASQRP

SEQ ID NO: 43094 - protein, 25 aa, synthetic construct
  source 1..25: note = Seed: NSCVKLQTVHSIPLTINKEEALQRP
NSCVKLQTVHSIPMTIYKIEATQRP

SEQ ID NO: 43095 - protein, 25 aa, synthetic construct
  source 1..25: note = Seed: NSCVKLQTVHSIPLTINKEEALQRP
NSCVKLQTVHSIPMTIYKIEAVQRP

SEQ ID NO: 43096 - protein, 25 aa, synthetic construct
  source 1..25: note = Seed: NSCVKLQTVHSIPLTINKEEALQRP
NSCVKLQTVHSIPMTIYKIEAWQRP

SEQ ID NO: 43097 - protein, 25 aa, synthetic construct
  source 1..25: note = Seed: NSCVKLQTVHSIPLTINKEEALQRP
NSCVKLQTVHSIPMTIYKIEAYQRP

SEQ ID NO: 43098 - protein, 25 aa, synthetic construct
  source 1..25: note = Seed: NSCVKLQTVHSIPLTINKEEALQRP
NSCVKLQTVHSIPMTIYKLEAAQRP

SEQ ID NO: 43099 - protein, 25 aa, synthetic construct
  source 1..25: note = Seed: NSCVKLQTVHSIPLTINKEEALQRP
NSCVKLQTVHSIPMTIYKLEACQRP

SEQ ID NO: 43100 - protein, 25 aa, synthetic construct
  source 1..25: note = Seed: NSCVKLQTVHSIPLTINKEEALQRP
NSCVKLQTVHSIPMTIYKLEAFQRP

SEQ ID NO: 43101 - protein, 25 aa, synthetic construct
  source 1..25: note = Seed: NSCVKLQTVHSIPLTINKEEALQRP
NSCVKLQTVHSIPMTIYKLEAGQRP

SEQ ID NO: 43102 - protein, 25 aa, synthetic construct
  source 1..25: note = Seed: NSCVKLQTVHSIPLTINKEEALQRP
NSCVKLQTVHSIPMTIYKLEAIQRP

SEQ ID NO: 43103 - protein, 25 aa, synthetic construct
  source 1..25: note = Seed: NSCVKLQTVHSIPLTINKEEALQRP
NSCVKLQTVHSIPMTIYKLEALQRP

SEQ ID NO: 43104 - protein, 25 aa, synthetic construct
  source 1..25: note = Seed: NSCVKLQTVHSIPLTINKEEALQRP
NSCVKLQTVHSIPMTIYKLEAMQRP

SEQ ID NO: 43105 - protein, 25 aa, synthetic construct
  source 1..25: note = Seed: NSCVKLQTVHSIPLTINKEEALQRP
NSCVKLQTVHSIPMTIYKLEANQRP

SEQ ID NO: 43106 - protein, 25 aa, synthetic construct
  source 1..25: note = Seed: NSCVKLQTVHSIPLTINKEEALQRP
NSCVKLQTVHSIPMTIYKLEAQQRP

SEQ ID NO: 43107 - protein, 25 aa, synthetic construct
  source 1..25: note = Seed: NSCVKLQTVHSIPLTINKEEALQRP
NSCVKLQTVHSIPMTIYKLEASQRP

SEQ ID NO: 43108 - protein, 25 aa, synthetic construct
  source 1..25: note = Seed: NSCVKLQTVHSIPLTINKEEALQRP
NSCVKLQTVHSIPMTIYKLEATQRP

SEQ ID NO: 43109 - protein, 25 aa, synthetic construct
  source 1..25: note = Seed: NSCVKLQTVHSIPLTINKEEALQRP
NSCVKLQTVHSIPMTIYKLEAVQRP

SEQ ID NO: 43110 - protein, 25 aa, synthetic construct
  source 1..25: note = Seed: NSCVKLQTVHSIPLTINKEEALQRP
NSCVKLQTVHSIPMTIYKLEAYQRP

SEQ ID NO: 43111 - protein, 25 aa, synthetic construct
  source 1..25: note = Seed: NSCVKLQTVHSIPLTINKEEALQRP
NSCVKLQTVHSIPMTIYKMEAAQRP

SEQ ID NO: 43112 - protein, 25 aa, synthetic construct
  source 1..25: note = Seed: NSCVKLQTVHSIPLTINKEEALQRP
NSCVKLQTVHSIPMTIYKMEAFQRP

SEQ ID NO: 43113 - protein, 25 aa, synthetic construct
  source 1..25: note = Seed: NSCVKLQTVHSIPLTINKEEALQRP
NSCVKLQTVHSIPMTIYKMEAIQRP

SEQ ID NO: 43114 - protein, 25 aa, synthetic construct
  source 1..25: note = Seed: NSCVKLQTVHSIPLTINKEEALQRP
NSCVKLQTVHSIPMTIYKMEALQRP

SEQ ID NO: 43115 - protein, 25 aa, synthetic construct
  source 1..25: note = Seed: NSCVKLQTVHSIPLTINKEEALQRP
NSCVKLQTVHSIPMTIYKMEAMQRP

SEQ ID NO: 43116 - protein, 25 aa, synthetic construct
  source 1..25: note = Seed: NSCVKLQTVHSIPLTINKEEALQRP
NSCVKLQTVHSIPMTIYKMEASQRP

SEQ ID NO: 43117 - protein, 25 aa, synthetic construct
  source 1..25: note = Seed: NSCVKLQTVHSIPLTINKEEALQRP
NSCVKLQTVHSIPMTIYKMEAVQRP

SEQ ID NO: 43118 - protein, 25 aa, synthetic construct
  source 1..25: note = Seed: NSCVKLQTVHSIPLTINKEEALQRP
NSCVKLQTVHSIPMTIYKMEAYQRP

SEQ ID NO: 43119 - protein, 25 aa, synthetic construct
  source 1..25: note = Seed: NSCVKLQTVHSIPLTINKEEALQRP
NSCVKLQTVHSIPMTIYKNEAAQRP

SEQ ID NO: 43120 - protein, 25 aa, synthetic construct
  source 1..25: note = Seed: NSCVKLQTVHSIPLTINKEEALQRP
NSCVKLQTVHSIPMTIYKNEAFQRP

SEQ ID NO: 43121 - protein, 25 aa, synthetic construct
  source 1..25: note = Seed: NSCVKLQTVHSIPLTINKEEALQRP
NSCVKLQTVHSIPMTIYKNEAIQRP

SEQ ID NO: 43122 - protein, 25 aa, synthetic construct
  source 1..25: note = Seed: NSCVKLQTVHSIPLTINKEEALQRP
NSCVKLQTVHSIPMTIYKNEALQRP

SEQ ID NO: 43123 - protein, 25 aa, synthetic construct
  source 1..25: note = Seed: NSCVKLQTVHSIPLTINKEEALQRP
NSCVKLQTVHSIPMTIYKNEAMQRP

SEQ ID NO: 43124 - protein, 25 aa, synthetic construct
  source 1..25: note = Seed: NSCVKLQTVHSIPLTINKEEALQRP
NSCVKLQTVHSIPMTIYKNEASQRP

SEQ ID NO: 43125 - protein, 25 aa, synthetic construct
  source 1..25: note = Seed: NSCVKLQTVHSIPLTINKEEALQRP
NSCVKLQTVHSIPMTIYKNEAVQRP

SEQ ID NO: 43126 - protein, 25 aa, synthetic construct
  source 1..25: note = Seed: NSCVKLQTVHSIPLTINKEEALQRP
NSCVKLQTVHSIPMTIYKNEAYQRP

SEQ ID NO: 43127 - protein, 25 aa, synthetic construct
  source 1..25: note = Seed: NSCVKLQTVHSIPLTINKEEALQRP
NSCVKLQTVHSIPMTIYKPEAAQRP

SEQ ID NO: 43128 - protein, 25 aa, synthetic construct
  source 1..25: note = Seed: NSCVKLQTVHSIPLTINKEEALQRP
NSCVKLQTVHSIPMTIYKPEAIQRP

SEQ ID NO: 43129 - protein, 25 aa, synthetic construct
  source 1..25: note = Seed: NSCVKLQTVHSIPLTINKEEALQRP
NSCVKLQTVHSIPMTIYKPEAVQRP

SEQ ID NO: 43130 - protein, 25 aa, synthetic construct
  source 1..25: note = Seed: NSCVKLQTVHSIPLTINKEEALQRP
NSCVKLQTVHSIPMTIYKREAFQRP

SEQ ID NO: 43131 - protein, 25 aa, synthetic construct
  source 1..25: note = Seed: NSCVKLQTVHSIPLTINKEEALQRP
NSCVKLQTVHSIPMTIYKSEAAQRP

SEQ ID NO: 43132 - protein, 25 aa, synthetic construct
  source 1..25: note = Seed: NSCVKLQTVHSIPLTINKEEALQRP
NSCVKLQTVHSIPMTIYKSEAFQRP

SEQ ID NO: 43133 - protein, 25 aa, synthetic construct
  source 1..25: note = Seed: NSCVKLQTVHSIPLTINKEEALQRP
NSCVKLQTVHSIPMTIYKSEAIQRP

SEQ ID NO: 43134 - protein, 25 aa, synthetic construct
  source 1..25: note = Seed: NSCVKLQTVHSIPLTINKEEALQRP
NSCVKLQTVHSIPMTIYKSEALQRP

SEQ ID NO: 43135 - protein, 25 aa, synthetic construct
  source 1..25: note = Seed: NSCVKLQTVHSIPLTINKEEALQRP
NSCVKLQTVHSIPMTIYKSEAMQRP

SEQ ID NO: 43136 - protein, 25 aa, synthetic construct
  source 1..25: note = Seed: NSCVKLQTVHSIPLTINKEEALQRP
NSCVKLQTVHSIPMTIYKSEAVQRP

SEQ ID NO: 43137 - protein, 25 aa, synthetic construct
  source 1..25: note = Seed: NSCVKLQTVHSIPLTINKEEALQRP
NSCVKLQTVHSIPMTIYKTEAAQRP

SEQ ID NO: 43138 - protein, 25 aa, synthetic construct
  source 1..25: note = Seed: NSCVKLQTVHSIPLTINKEEALQRP
NSCVKLQTVHSIPMTIYKTEAFQRP

SEQ ID NO: 43139 - protein, 25 aa, synthetic construct
  source 1..25: note = Seed: NSCVKLQTVHSIPLTINKEEALQRP
NSCVKLQTVHSIPMTIYKTEAIQRP

SEQ ID NO: 43140 - protein, 25 aa, synthetic construct
  source 1..25: note = Seed: NSCVKLQTVHSIPLTINKEEALQRP
NSCVKLQTVHSIPMTIYKTEALQRP

SEQ ID NO: 43141 - protein, 25 aa, synthetic construct
  source 1..25: note = Seed: NSCVKLQTVHSIPLTINKEEALQRP
NSCVKLQTVHSIPMTIYKTEAMQRP

SEQ ID NO: 43142 - protein, 25 aa, synthetic construct
  source 1..25: note = Seed: NSCVKLQTVHSIPLTINKEEALQRP
NSCVKLQTVHSIPMTIYKTEAVQRP

SEQ ID NO: 43143 - protein, 25 aa, synthetic construct
  source 1..25: note = Seed: NSCVKLQTVHSIPLTINKEEALQRP
NSCVKLQTVHSIPMTIYKVEAAQRP

SEQ ID NO: 43144 - protein, 25 aa, synthetic construct
  source 1..25: note = Seed: NSCVKLQTVHSIPLTINKEEALQRP
NSCVKLQTVHSIPMTIYKVEACQRP

SEQ ID NO: 43145 - protein, 25 aa, synthetic construct
  source 1..25: note = Seed: NSCVKLQTVHSIPLTINKEEALQRP
NSCVKLQTVHSIPMTIYKVEAEQRP

SEQ ID NO: 43146 - protein, 25 aa, synthetic construct
  source 1..25: note = Seed: NSCVKLQTVHSIPLTINKEEALQRP
NSCVKLQTVHSIPMTIYKVEAFQRP

SEQ ID NO: 43147 - protein, 25 aa, synthetic construct
  source 1..25: note = Seed: NSCVKLQTVHSIPLTINKEEALQRP
NSCVKLQTVHSIPMTIYKVEAGQRP

SEQ ID NO: 43148 - protein, 25 aa, synthetic construct
  source 1..25: note = Seed: NSCVKLQTVHSIPLTINKEEALQRP
NSCVKLQTVHSIPMTIYKVEAHQRP

SEQ ID NO: 43149 - protein, 25 aa, synthetic construct
  source 1..25: note = Seed: NSCVKLQTVHSIPLTINKEEALQRP
NSCVKLQTVHSIPMTIYKVEAIQRP

SEQ ID NO: 43150 - protein, 25 aa, synthetic construct
  source 1..25: note = Seed: NSCVKLQTVHSIPLTINKEEALQRP
NSCVKLQTVHSIPMTIYKVEALQRP

SEQ ID NO: 43151 - protein, 25 aa, synthetic construct
  source 1..25: note = Seed: NSCVKLQTVHSIPLTINKEEALQRP
NSCVKLQTVHSIPMTIYKVEAMQRP

SEQ ID NO: 43152 - protein, 25 aa, synthetic construct
  source 1..25: note = Seed: NSCVKLQTVHSIPLTINKEEALQRP
NSCVKLQTVHSIPMTIYKVEANQRP

SEQ ID NO: 43153 - protein, 25 aa, synthetic construct
  source 1..25: note = Seed: NSCVKLQTVHSIPLTINKEEALQRP
NSCVKLQTVHSIPMTIYKVEAQQRP

SEQ ID NO: 43154 - protein, 25 aa, synthetic construct
  source 1..25: note = Seed: NSCVKLQTVHSIPLTINKEEALQRP
NSCVKLQTVHSIPMTIYKVEASQRP

SEQ ID NO: 43155 - protein, 25 aa, synthetic construct
  source 1..25: note = Seed: NSCVKLQTVHSIPLTINKEEALQRP
NSCVKLQTVHSIPMTIYKVEATQRP

SEQ ID NO: 43156 - protein, 25 aa, synthetic construct
  source 1..25: note = Seed: NSCVKLQTVHSIPLTINKEEALQRP
NSCVKLQTVHSIPMTIYKVEAVQRP

SEQ ID NO: 43157 - protein, 25 aa, synthetic construct
  source 1..25: note = Seed: NSCVKLQTVHSIPLTINKEEALQRP
NSCVKLQTVHSIPMTIYKVEAWQRP

SEQ ID NO: 43158 - protein, 25 aa, synthetic construct
  source 1..25: note = Seed: NSCVKLQTVHSIPLTINKEEALQRP
NSCVKLQTVHSIPMTIYKVEAYQRP

SEQ ID NO: 43159 - protein, 25 aa, synthetic construct
  source 1..25: note = Seed: NSCVKLQTVHSIPLTINKEEALQRP
NSCVKLQTVHSIPMTIYKYEAFQRP

SEQ ID NO: 43160 - protein, 25 aa, synthetic construct
  source 1..25: note = Seed: NSCVKLQTVHSIPLTINKEEALQRP
NSCVKLQTVHSIPNTIFKIEAAQRP

SEQ ID NO: 43161 - protein, 25 aa, synthetic construct
  source 1..25: note = Seed: NSCVKLQTVHSIPLTINKEEALQRP
NSCVKLQTVHSIPQTIFKFEAFQRP

SEQ ID NO: 43162 - protein, 25 aa, synthetic construct
  source 1..25: note = Seed: NSCVKLQTVHSIPLTINKEEALQRP
NSCVKLQTVHSIPRTIFKFEAFQRP

SEQ ID NO: 43163 - protein, 25 aa, synthetic construct
  source 1..25: note = Seed: NSCVKLQTVHSIPLTINKEEALQRP
NSCVKLQTVHSIPRTIFKFEAIQRP

SEQ ID NO: 43164 - protein, 25 aa, synthetic construct
  source 1..25: note = Seed: NSCVKLQTVHSIPLTINKEEALQRP
NSCVKLQTVHSIPRTIFKFEALQRP

SEQ ID NO: 43165 - protein, 25 aa, synthetic construct
  source 1..25: note = Seed: NSCVKLQTVHSIPLTINKEEALQRP
NSCVKLQTVHSIPRTIFKYEAFQRP

SEQ ID NO: 43166 - protein, 25 aa, synthetic construct
  source 1..25: note = Seed: NSCVKLQTVHSIPLTINKEEALQRP
NSCVKLQTVHSIPRTIIKFEAFQRP

SEQ ID NO: 43167 - protein, 25 aa, synthetic construct
  source 1..25: note = Seed: NSCVKLQTVHSIPLTINKEEALQRP
NSCVKLQTVHSIPRTIIKFEALQRP

SEQ ID NO: 43168 - protein, 25 aa, synthetic construct
  source 1..25: note = Seed: NSCVKLQTVHSIPLTINKEEALQRP
NSCVKLQTVHSIPRTILKFEAFQRP

SEQ ID NO: 43169 - protein, 25 aa, synthetic construct
  source 1..25: note = Seed: NSCVKLQTVHSIPLTINKEEALQRP
NSCVKLQTVHSIPRTILKFEALQRP

SEQ ID NO: 43170 - protein, 25 aa, synthetic construct
  source 1..25: note = Seed: NSCVKLQTVHSIPLTINKEEALQRP
NSCVKLQTVHSIPRTIVKFEALQRP

SEQ ID NO: 43171 - protein, 25 aa, synthetic construct
  source 1..25: note = Seed: NSCVKLQTVHSIPLTINKEEALQRP
NSCVKLQTVHSIPSTIFKFEAFQRP

SEQ ID NO: 43172 - protein, 25 aa, synthetic construct
  source 1..25: note = Seed: NSCVKLQTVHSIPLTINKEEALQRP
NSCVKLQTVHSIPTTIFKFEAFQRP

SEQ ID NO: 43173 - protein, 25 aa, synthetic construct
  source 1..25: note = Seed: NSCVKLQTVHSIPLTINKEEALQRP
NSCVKLQTVHSIPTTILKFEAFQRP

SEQ ID NO: 43174 - protein, 25 aa, synthetic construct
  source 1..25: note = Seed: NSCVKLQTVHSIPLTINKEEALQRP
NSCVKLQTVHSIPVTIAKAEAIQRP

SEQ ID NO: 43175 - protein, 25 aa, synthetic construct
  source 1..25: note = Seed: NSCVKLQTVHSIPLTINKEEALQRP
NSCVKLQTVHSIPVTIAKAEAVQRP

SEQ ID NO: 43176 - protein, 25 aa, synthetic construct
  source 1..25: note = Seed: NSCVKLQTVHSIPLTINKEEALQRP
NSCVKLQTVHSIPVTIAKFEAFQRP

SEQ ID NO: 43177 - protein, 25 aa, synthetic construct
  source 1..25: note = Seed: NSCVKLQTVHSIPLTINKEEALQRP
NSCVKLQTVHSIPVTIAKFEAIQRP

SEQ ID NO: 43178 - protein, 25 aa, synthetic construct
  source 1..25: note = Seed: NSCVKLQTVHSIPLTINKEEALQRP
NSCVKLQTVHSIPVTIAKFEALQRP

SEQ ID NO: 43179 - protein, 25 aa, synthetic construct
  source 1..25: note = Seed: NSCVKLQTVHSIPLTINKEEALQRP
NSCVKLQTVHSIPVTIAKFEAMQRP

SEQ ID NO: 43180 - protein, 25 aa, synthetic construct
  source 1..25: note = Seed: NSCVKLQTVHSIPLTINKEEALQRP
NSCVKLQTVHSIPVTIAKFEAVQRP

SEQ ID NO: 43181 - protein, 25 aa, synthetic construct
  source 1..25: note = Seed: NSCVKLQTVHSIPLTINKEEALQRP
NSCVKLQTVHSIPVTIAKIEAAQRP

SEQ ID NO: 43182 - protein, 25 aa, synthetic construct
  source 1..25: note = Seed: NSCVKLQTVHSIPLTINKEEALQRP
NSCVKLQTVHSIPVTIAKIEAIQRP

SEQ ID NO: 43183 - protein, 25 aa, synthetic construct
  source 1..25: note = Seed: NSCVKLQTVHSIPLTINKEEALQRP
NSCVKLQTVHSIPVTIAKIEALQRP

SEQ ID NO: 43184 - protein, 25 aa, synthetic construct
  source 1..25: note = Seed: NSCVKLQTVHSIPLTINKEEALQRP
NSCVKLQTVHSIPVTIAKIEAVQRP

SEQ ID NO: 43185 - protein, 25 aa, synthetic construct
  source 1..25: note = Seed: NSCVKLQTVHSIPLTINKEEALQRP
NSCVKLQTVHSIPVTIAKNEAIQRP

SEQ ID NO: 43186 - protein, 25 aa, synthetic construct
  source 1..25: note = Seed: NSCVKLQTVHSIPLTINKEEALQRP
NSCVKLQTVHSIPVTIAKNEAVQRP

SEQ ID NO: 43187 - protein, 25 aa, synthetic construct
  source 1..25: note = Seed: NSCVKLQTVHSIPLTINKEEALQRP
NSCVKLQTVHSIPVTIAKVEAFQRP

SEQ ID NO: 43188 - protein, 25 aa, synthetic construct
  source 1..25: note = Seed: NSCVKLQTVHSIPLTINKEEALQRP
NSCVKLQTVHSIPVTIAKVEAIQRP

SEQ ID NO: 43189 - protein, 25 aa, synthetic construct
  source 1..25: note = Seed: NSCVKLQTVHSIPLTINKEEALQRP
NSCVKLQTVHSIPVTIAKVEAVQRP

SEQ ID NO: 43190 - protein, 25 aa, synthetic construct
  source 1..25: note = Seed: NSCVKLQTVHSIPLTINKEEALQRP
NSCVKLQTVHSIPVTIEKFEAFQRP

SEQ ID NO: 43191 - protein, 25 aa, synthetic construct
  source 1..25: note = Seed: NSCVKLQTVHSIPLTINKEEALQRP
NSCVKLQTVHSIPVTIEKFEAIQRP

SEQ ID NO: 43192 - protein, 25 aa, synthetic construct
  source 1..25: note = Seed: NSCVKLQTVHSIPLTINKEEALQRP
NSCVKLQTVHSIPVTIEKFEALQRP

SEQ ID NO: 43193 - protein, 25 aa, synthetic construct
  source 1..25: note = Seed: NSCVKLQTVHSIPLTINKEEALQRP
NSCVKLQTVHSIPVTIEKFEAMQRP

SEQ ID NO: 43194 - protein, 25 aa, synthetic construct
  source 1..25: note = Seed: NSCVKLQTVHSIPLTINKEEALQRP
NSCVKLQTVHSIPVTIEKFEAVQRP

SEQ ID NO: 43195 - protein, 25 aa, synthetic construct
  source 1..25: note = Seed: NSCVKLQTVHSIPLTINKEEALQRP
NSCVKLQTVHSIPVTIFKAEAAQRP

SEQ ID NO: 43196 - protein, 25 aa, synthetic construct
  source 1..25: note = Seed: NSCVKLQTVHSIPLTINKEEALQRP
NSCVKLQTVHSIPVTIFKAEAFQRP

SEQ ID NO: 43197 - protein, 25 aa, synthetic construct
  source 1..25: note = Seed: NSCVKLQTVHSIPLTINKEEALQRP
NSCVKLQTVHSIPVTIFKAEAGQRP

SEQ ID NO: 43198 - protein, 25 aa, synthetic construct
  source 1..25: note = Seed: NSCVKLQTVHSIPLTINKEEALQRP
NSCVKLQTVHSIPVTIFKAEAIQRP

SEQ ID NO: 43199 - protein, 25 aa, synthetic construct
  source 1..25: note = Seed: NSCVKLQTVHSIPLTINKEEALQRP
NSCVKLQTVHSIPVTIFKAEALQRP

SEQ ID NO: 43200 - protein, 25 aa, synthetic construct
  source 1..25: note = Seed: NSCVKLQTVHSIPLTINKEEALQRP
NSCVKLQTVHSIPVTIFKAEAMQRP

SEQ ID NO: 43201 - protein, 25 aa, synthetic construct
  source 1..25: note = Seed: NSCVKLQTVHSIPLTINKEEALQRP
NSCVKLQTVHSIPVTIFKAEASQRP

SEQ ID NO: 43202 - protein, 25 aa, synthetic construct
  source 1..25: note = Seed: NSCVKLQTVHSIPLTINKEEALQRP
NSCVKLQTVHSIPVTIFKAEATQRP

SEQ ID NO: 43203 - protein, 25 aa, synthetic construct
  source 1..25: note = Seed: NSCVKLQTVHSIPLTINKEEALQRP
NSCVKLQTVHSIPVTIFKAEAVQRP

SEQ ID NO: 43204 - protein, 25 aa, synthetic construct
  source 1..25: note = Seed: NSCVKLQTVHSIPLTINKEEALQRP
NSCVKLQTVHSIPVTIFKAEAYQRP

SEQ ID NO: 43205 - protein, 25 aa, synthetic construct
  source 1..25: note = Seed: NSCVKLQTVHSIPLTINKEEALQRP
NSCVKLQTVHSIPVTIFKDEAAQRP

SEQ ID NO: 43206 - protein, 25 aa, synthetic construct
  source 1..25: note = Seed: NSCVKLQTVHSIPLTINKEEALQRP
NSCVKLQTVHSIPVTIFKDEACQRP

SEQ ID NO: 43207 - protein, 25 aa, synthetic construct
  source 1..25: note = Seed: NSCVKLQTVHSIPLTINKEEALQRP
NSCVKLQTVHSIPVTIFKDEAFQRP

SEQ ID NO: 43208 - protein, 25 aa, synthetic construct
  source 1..25: note = Seed: NSCVKLQTVHSIPLTINKEEALQRP
NSCVKLQTVHSIPVTIFKDEAGQRP

SEQ ID NO: 43209 - protein, 25 aa, synthetic construct
  source 1..25: note = Seed: NSCVKLQTVHSIPLTINKEEALQRP
NSCVKLQTVHSIPVTIFKDEAIQRP

SEQ ID NO: 43210 - protein, 25 aa, synthetic construct
  source 1..25: note = Seed: NSCVKLQTVHSIPLTINKEEALQRP
NSCVKLQTVHSIPVTIFKDEALQRP

SEQ ID NO: 43211 - protein, 25 aa, synthetic construct
  source 1..25: note = Seed: NSCVKLQTVHSIPLTINKEEALQRP
NSCVKLQTVHSIPVTIFKDEAMQRP

SEQ ID NO: 43212 - protein, 25 aa, synthetic construct
  source 1..25: note = Seed: NSCVKLQTVHSIPLTINKEEALQRP
NSCVKLQTVHSIPVTIFKDEAQQRP

SEQ ID NO: 43213 - protein, 25 aa, synthetic construct
  source 1..25: note = Seed: NSCVKLQTVHSIPLTINKEEALQRP
NSCVKLQTVHSIPVTIFKDEASQRP

SEQ ID NO: 43214 - protein, 25 aa, synthetic construct
  source 1..25: note = Seed: NSCVKLQTVHSIPLTINKEEALQRP
NSCVKLQTVHSIPVTIFKDEATQRP

SEQ ID NO: 43215 - protein, 25 aa, synthetic construct
  source 1..25: note = Seed: NSCVKLQTVHSIPLTINKEEALQRP
NSCVKLQTVHSIPVTIFKDEAVQRP

SEQ ID NO: 43216 - protein, 25 aa, synthetic construct
  source 1..25: note = Seed: NSCVKLQTVHSIPLTINKEEALQRP
NSCVKLQTVHSIPVTIFKDEAYQRP

SEQ ID NO: 43217 - protein, 25 aa, synthetic construct
  source 1..25: note = Seed: NSCVKLQTVHSIPLTINKEEALQRP
NSCVKLQTVHSIPVTIFKFEAAQRP

SEQ ID NO: 43218 - protein, 25 aa, synthetic construct
  source 1..25: note = Seed: NSCVKLQTVHSIPLTINKEEALQRP
NSCVKLQTVHSIPVTIFKFEAEQRP

SEQ ID NO: 43219 - protein, 25 aa, synthetic construct
  source 1..25: note = Seed: NSCVKLQTVHSIPLTINKEEALQRP
NSCVKLQTVHSIPVTIFKFEAFQRP

SEQ ID NO: 43220 - protein, 25 aa, synthetic construct
  source 1..25: note = Seed: NSCVKLQTVHSIPLTINKEEALQRP
NSCVKLQTVHSIPVTIFKFEAIQRP

SEQ ID NO: 43221 - protein, 25 aa, synthetic construct
  source 1..25: note = Seed: NSCVKLQTVHSIPLTINKEEALQRP
NSCVKLQTVHSIPVTIFKFEALQRP

SEQ ID NO: 43222 - protein, 25 aa, synthetic construct
  source 1..25: note = Seed: NSCVKLQTVHSIPLTINKEEALQRP
NSCVKLQTVHSIPVTIFKFEAMQRP

SEQ ID NO: 43223 - protein, 25 aa, synthetic construct
  source 1..25: note = Seed: NSCVKLQTVHSIPLTINKEEALQRP
NSCVKLQTVHSIPVTIFKFEATQRP

SEQ ID NO: 43224 - protein, 25 aa, synthetic construct
  source 1..25: note = Seed: NSCVKLQTVHSIPLTINKEEALQRP
NSCVKLQTVHSIPVTIFKFEAVQRP

SEQ ID NO: 43225 - protein, 25 aa, synthetic construct
  source 1..25: note = Seed: NSCVKLQTVHSIPLTINKEEALQRP
NSCVKLQTVHSIPVTIFKFEAYQRP

SEQ ID NO: 43226 - protein, 25 aa, synthetic construct
  source 1..25: note = Seed: NSCVKLQTVHSIPLTINKEEALQRP
NSCVKLQTVHSIPVTIFKIEAAQRP

SEQ ID NO: 43227 - protein, 25 aa, synthetic construct
  source 1..25: note = Seed: NSCVKLQTVHSIPLTINKEEALQRP
NSCVKLQTVHSIPVTIFKIEADQRP

SEQ ID NO: 43228 - protein, 25 aa, synthetic construct
  source 1..25: note = Seed: NSCVKLQTVHSIPLTINKEEALQRP
NSCVKLQTVHSIPVTIFKIEAEQRP

SEQ ID NO: 43229 - protein, 25 aa, synthetic construct
  source 1..25: note = Seed: NSCVKLQTVHSIPLTINKEEALQRP
NSCVKLQTVHSIPVTIFKIEAFQRP

SEQ ID NO: 43230 - protein, 25 aa, synthetic construct
  source 1..25: note = Seed: NSCVKLQTVHSIPLTINKEEALQRP
NSCVKLQTVHSIPVTIFKIEAGQRP

SEQ ID NO: 43231 - protein, 25 aa, synthetic construct
  source 1..25: note = Seed: NSCVKLQTVHSIPLTINKEEALQRP
NSCVKLQTVHSIPVTIFKIEAHQRP

SEQ ID NO: 43232 - protein, 25 aa, synthetic construct
  source 1..25: note = Seed: NSCVKLQTVHSIPLTINKEEALQRP
NSCVKLQTVHSIPVTIFKIEAIQRP

SEQ ID NO: 43233 - protein, 25 aa, synthetic construct
  source 1..25: note = Seed: NSCVKLQTVHSIPLTINKEEALQRP
NSCVKLQTVHSIPVTIFKIEALQRP

SEQ ID NO: 43234 - protein, 25 aa, synthetic construct
  source 1..25: note = Seed: NSCVKLQTVHSIPLTINKEEALQRP
NSCVKLQTVHSIPVTIFKIEAMQRP

SEQ ID NO: 43235 - protein, 25 aa, synthetic construct
  source 1..25: note = Seed: NSCVKLQTVHSIPLTINKEEALQRP
NSCVKLQTVHSIPVTIFKIEANQRP

SEQ ID NO: 43236 - protein, 25 aa, synthetic construct
  source 1..25: note = Seed: NSCVKLQTVHSIPLTINKEEALQRP
NSCVKLQTVHSIPVTIFKIEAPQRP

SEQ ID NO: 43237 - protein, 25 aa, synthetic construct
  source 1..25: note = Seed: NSCVKLQTVHSIPLTINKEEALQRP
NSCVKLQTVHSIPVTIFKIEAQQRP

SEQ ID NO: 43238 - protein, 25 aa, synthetic construct
  source 1..25: note = Seed: NSCVKLQTVHSIPLTINKEEALQRP
NSCVKLQTVHSIPVTIFKIEASQRP

SEQ ID NO: 43239 - protein, 25 aa, synthetic construct
  source 1..25: note = Seed: NSCVKLQTVHSIPLTINKEEALQRP
NSCVKLQTVHSIPVTIFKIEATQRP

SEQ ID NO: 43240 - protein, 25 aa, synthetic construct
  source 1..25: note = Seed: NSCVKLQTVHSIPLTINKEEALQRP
NSCVKLQTVHSIPVTIFKIEAVQRP

SEQ ID NO: 43241 - protein, 25 aa, synthetic construct
  source 1..25: note = Seed: NSCVKLQTVHSIPLTINKEEALQRP
NSCVKLQTVHSIPVTIFKIEAYQRP

SEQ ID NO: 43242 - protein, 25 aa, synthetic construct
  source 1..25: note = Seed: NSCVKLQTVHSIPLTINKEEALQRP
NSCVKLQTVHSIPVTIFKKEALQRP

SEQ ID NO: 43243 - protein, 25 aa, synthetic construct
  source 1..25: note = Seed: NSCVKLQTVHSIPLTINKEEALQRP
NSCVKLQTVHSIPVTIFKLEAAQRP

SEQ ID NO: 43244 - protein, 25 aa, synthetic construct
  source 1..25: note = Seed: NSCVKLQTVHSIPLTINKEEALQRP
NSCVKLQTVHSIPVTIFKLEAFQRP

SEQ ID NO: 43245 - protein, 25 aa, synthetic construct
  source 1..25: note = Seed: NSCVKLQTVHSIPLTINKEEALQRP
NSCVKLQTVHSIPVTIFKLEAGQRP

SEQ ID NO: 43246 - protein, 25 aa, synthetic construct
  source 1..25: note = Seed: NSCVKLQTVHSIPLTINKEEALQRP
NSCVKLQTVHSIPVTIFKLEAIQRP

SEQ ID NO: 43247 - protein, 25 aa, synthetic construct
  source 1..25: note = Seed: NSCVKLQTVHSIPLTINKEEALQRP
NSCVKLQTVHSIPVTIFKLEALQRP

SEQ ID NO: 43248 - protein, 25 aa, synthetic construct
  source 1..25: note = Seed: NSCVKLQTVHSIPLTINKEEALQRP
NSCVKLQTVHSIPVTIFKLEAMQRP

SEQ ID NO: 43249 - protein, 25 aa, synthetic construct
  source 1..25: note = Seed: NSCVKLQTVHSIPLTINKEEALQRP
NSCVKLQTVHSIPVTIFKLEASQRP

SEQ ID NO: 43250 - protein, 25 aa, synthetic construct
  source 1..25: note = Seed: NSCVKLQTVHSIPLTINKEEALQRP
NSCVKLQTVHSIPVTIFKLEATQRP

SEQ ID NO: 43251 - protein, 25 aa, synthetic construct
  source 1..25: note = Seed: NSCVKLQTVHSIPLTINKEEALQRP
NSCVKLQTVHSIPVTIFKLEAVQRP

SEQ ID NO: 43252 - protein, 25 aa, synthetic construct
  source 1..25: note = Seed: NSCVKLQTVHSIPLTINKEEALQRP
NSCVKLQTVHSIPVTIFKLEAYQRP

SEQ ID NO: 43253 - protein, 25 aa, synthetic construct
  source 1..25: note = Seed: NSCVKLQTVHSIPLTINKEEALQRP
NSCVKLQTVHSIPVTIFKMEAAQRP

SEQ ID NO: 43254 - protein, 25 aa, synthetic construct
  source 1..25: note = Seed: NSCVKLQTVHSIPLTINKEEALQRP
NSCVKLQTVHSIPVTIFKMEAFQRP

SEQ ID NO: 43255 - protein, 25 aa, synthetic construct
  source 1..25: note = Seed: NSCVKLQTVHSIPLTINKEEALQRP
NSCVKLQTVHSIPVTIFKMEAIQRP

SEQ ID NO: 43256 - protein, 25 aa, synthetic construct
  source 1..25: note = Seed: NSCVKLQTVHSIPLTINKEEALQRP
NSCVKLQTVHSIPVTIFKMEALQRP

SEQ ID NO: 43257 - protein, 25 aa, synthetic construct
  source 1..25: note = Seed: NSCVKLQTVHSIPLTINKEEALQRP
NSCVKLQTVHSIPVTIFKMEAMQRP

SEQ ID NO: 43258 - protein, 25 aa, synthetic construct
  source 1..25: note = Seed: NSCVKLQTVHSIPLTINKEEALQRP
NSCVKLQTVHSIPVTIFKMEASQRP

SEQ ID NO: 43259 - protein, 25 aa, synthetic construct
  source 1..25: note = Seed: NSCVKLQTVHSIPLTINKEEALQRP
NSCVKLQTVHSIPVTIFKMEAVQRP

SEQ ID NO: 43260 - protein, 25 aa, synthetic construct
  source 1..25: note = Seed: NSCVKLQTVHSIPLTINKEEALQRP
NSCVKLQTVHSIPVTIFKMEAYQRP

SEQ ID NO: 43261 - protein, 25 aa, synthetic construct
  source 1..25: note = Seed: NSCVKLQTVHSIPLTINKEEALQRP
NSCVKLQTVHSIPVTIFKNEAAQRP

SEQ ID NO: 43262 - protein, 25 aa, synthetic construct
  source 1..25: note = Seed: NSCVKLQTVHSIPLTINKEEALQRP
NSCVKLQTVHSIPVTIFKNEAFQRP

SEQ ID NO: 43263 - protein, 25 aa, synthetic construct
  source 1..25: note = Seed: NSCVKLQTVHSIPLTINKEEALQRP
NSCVKLQTVHSIPVTIFKNEAIQRP

SEQ ID NO: 43264 - protein, 25 aa, synthetic construct
  source 1..25: note = Seed: NSCVKLQTVHSIPLTINKEEALQRP
NSCVKLQTVHSIPVTIFKNEALQRP

SEQ ID NO: 43265 - protein, 25 aa, synthetic construct
  source 1..25: note = Seed: NSCVKLQTVHSIPLTINKEEALQRP
NSCVKLQTVHSIPVTIFKNEAMQRP

SEQ ID NO: 43266 - protein, 25 aa, synthetic construct
  source 1..25: note = Seed: NSCVKLQTVHSIPLTINKEEALQRP
NSCVKLQTVHSIPVTIFKNEASQRP

SEQ ID NO: 43267 - protein, 25 aa, synthetic construct
  source 1..25: note = Seed: NSCVKLQTVHSIPLTINKEEALQRP
NSCVKLQTVHSIPVTIFKNEAVQRP

SEQ ID NO: 43268 - protein, 25 aa, synthetic construct
  source 1..25: note = Seed: NSCVKLQTVHSIPLTINKEEALQRP
NSCVKLQTVHSIPVTIFKPEAAQRP

SEQ ID NO: 43269 - protein, 25 aa, synthetic construct
  source 1..25: note = Seed: NSCVKLQTVHSIPLTINKEEALQRP
NSCVKLQTVHSIPVTIFKPEAIQRP

SEQ ID NO: 43270 - protein, 25 aa, synthetic construct
  source 1..25: note = Seed: NSCVKLQTVHSIPLTINKEEALQRP
NSCVKLQTVHSIPVTIFKPEAVQRP

SEQ ID NO: 43271 - protein, 25 aa, synthetic construct
  source 1..25: note = Seed: NSCVKLQTVHSIPLTINKEEALQRP
NSCVKLQTVHSIPVTIFKREAFQRP

SEQ ID NO: 43272 - protein, 25 aa, synthetic construct
  source 1..25: note = Seed: NSCVKLQTVHSIPLTINKEEALQRP
NSCVKLQTVHSIPVTIFKREALQRP

SEQ ID NO: 43273 - protein, 25 aa, synthetic construct
  source 1..25: note = Seed: NSCVKLQTVHSIPLTINKEEALQRP
NSCVKLQTVHSIPVTIFKREARQRP

SEQ ID NO: 43274 - protein, 25 aa, synthetic construct
  source 1..25: note = Seed: NSCVKLQTVHSIPLTINKEEALQRP
NSCVKLQTVHSIPVTIFKREAVQRP

SEQ ID NO: 43275 - protein, 25 aa, synthetic construct
  source 1..25: note = Seed: NSCVKLQTVHSIPLTINKEEALQRP
NSCVKLQTVHSIPVTIFKREAYQRP

SEQ ID NO: 43276 - protein, 25 aa, synthetic construct
  source 1..25: note = Seed: NSCVKLQTVHSIPLTINKEEALQRP
NSCVKLQTVHSIPVTIFKSEAAQRP

SEQ ID NO: 43277 - protein, 25 aa, synthetic construct
  source 1..25: note = Seed: NSCVKLQTVHSIPLTINKEEALQRP
NSCVKLQTVHSIPVTIFKSEAFQRP

SEQ ID NO: 43278 - protein, 25 aa, synthetic construct
  source 1..25: note = Seed: NSCVKLQTVHSIPLTINKEEALQRP
NSCVKLQTVHSIPVTIFKSEAIQRP

SEQ ID NO: 43279 - protein, 25 aa, synthetic construct
  source 1..25: note = Seed: NSCVKLQTVHSIPLTINKEEALQRP
NSCVKLQTVHSIPVTIFKSEALQRP

SEQ ID NO: 43280 - protein, 25 aa, synthetic construct
  source 1..25: note = Seed: NSCVKLQTVHSIPLTINKEEALQRP
NSCVKLQTVHSIPVTIFKSEAMQRP

SEQ ID NO: 43281 - protein, 25 aa, synthetic construct
  source 1..25: note = Seed: NSCVKLQTVHSIPLTINKEEALQRP
NSCVKLQTVHSIPVTIFKSEAVQRP

SEQ ID NO: 43282 - protein, 25 aa, synthetic construct
  source 1..25: note = Seed: NSCVKLQTVHSIPLTINKEEALQRP
NSCVKLQTVHSIPVTIFKTEAAQRP

SEQ ID NO: 43283 - protein, 25 aa, synthetic construct
  source 1..25: note = Seed: NSCVKLQTVHSIPLTINKEEALQRP
NSCVKLQTVHSIPVTIFKTEAIQRP

SEQ ID NO: 43284 - protein, 25 aa, synthetic construct
  source 1..25: note = Seed: NSCVKLQTVHSIPLTINKEEALQRP
NSCVKLQTVHSIPVTIFKTEALQRP

SEQ ID NO: 43285 - protein, 25 aa, synthetic construct
  source 1..25: note = Seed: NSCVKLQTVHSIPLTINKEEALQRP
NSCVKLQTVHSIPVTIFKTEAMQRP

SEQ ID NO: 43286 - protein, 25 aa, synthetic construct
  source 1..25: note = Seed: NSCVKLQTVHSIPLTINKEEALQRP
NSCVKLQTVHSIPVTIFKTEAVQRP

SEQ ID NO: 43287 - protein, 25 aa, synthetic construct
  source 1..25: note = Seed: NSCVKLQTVHSIPLTINKEEALQRP
NSCVKLQTVHSIPVTIFKVEAAQRP

SEQ ID NO: 43288 - protein, 25 aa, synthetic construct
  source 1..25: note = Seed: NSCVKLQTVHSIPLTINKEEALQRP
NSCVKLQTVHSIPVTIFKVEAEQRP

SEQ ID NO: 43289 - protein, 25 aa, synthetic construct
  source 1..25: note = Seed: NSCVKLQTVHSIPLTINKEEALQRP
NSCVKLQTVHSIPVTIFKVEAFQRP

SEQ ID NO: 43290 - protein, 25 aa, synthetic construct
  source 1..25: note = Seed: NSCVKLQTVHSIPLTINKEEALQRP
NSCVKLQTVHSIPVTIFKVEAGQRP

SEQ ID NO: 43291 - protein, 25 aa, synthetic construct
  source 1..25: note = Seed: NSCVKLQTVHSIPLTINKEEALQRP
NSCVKLQTVHSIPVTIFKVEAIQRP

SEQ ID NO: 43292 - protein, 25 aa, synthetic construct
  source 1..25: note = Seed: NSCVKLQTVHSIPLTINKEEALQRP
NSCVKLQTVHSIPVTIFKVEALQRP

SEQ ID NO: 43293 - protein, 25 aa, synthetic construct
  source 1..25: note = Seed: NSCVKLQTVHSIPLTINKEEALQRP
NSCVKLQTVHSIPVTIFKVEAMQRP

SEQ ID NO: 43294 - protein, 25 aa, synthetic construct
  source 1..25: note = Seed: NSCVKLQTVHSIPLTINKEEALQRP
NSCVKLQTVHSIPVTIFKVEAQQRP

SEQ ID NO: 43295 - protein, 25 aa, synthetic construct
  source 1..25: note = Seed: NSCVKLQTVHSIPLTINKEEALQRP
NSCVKLQTVHSIPVTIFKVEASQRP

SEQ ID NO: 43296 - protein, 25 aa, synthetic construct
  source 1..25: note = Seed: NSCVKLQTVHSIPLTINKEEALQRP
NSCVKLQTVHSIPVTIFKVEATQRP

SEQ ID NO: 43297 - protein, 25 aa, synthetic construct
  source 1..25: note = Seed: NSCVKLQTVHSIPLTINKEEALQRP
NSCVKLQTVHSIPVTIFKVEAVQRP

SEQ ID NO: 43298 - protein, 25 aa, synthetic construct
  source 1..25: note = Seed: NSCVKLQTVHSIPLTINKEEALQRP
NSCVKLQTVHSIPVTIFKVEAYQRP

SEQ ID NO: 43299 - protein, 25 aa, synthetic construct
  source 1..25: note = Seed: NSCVKLQTVHSIPLTINKEEALQRP
NSCVKLQTVHSIPVTIFKWEAFQRP

SEQ ID NO: 43300 - protein, 25 aa, synthetic construct
  source 1..25: note = Seed: NSCVKLQTVHSIPLTINKEEALQRP
NSCVKLQTVHSIPVTIFKWEALQRP

SEQ ID NO: 43301 - protein, 25 aa, synthetic construct
  source 1..25: note = Seed: NSCVKLQTVHSIPLTINKEEALQRP
NSCVKLQTVHSIPVTIFKYEAFQRP

SEQ ID NO: 43302 - protein, 25 aa, synthetic construct
  source 1..25: note = Seed: NSCVKLQTVHSIPLTINKEEALQRP
NSCVKLQTVHSIPVTIFKYEAIQRP

SEQ ID NO: 43303 - protein, 25 aa, synthetic construct
  source 1..25: note = Seed: NSCVKLQTVHSIPLTINKEEALQRP
NSCVKLQTVHSIPVTIFKYEALQRP

SEQ ID NO: 43304 - protein, 25 aa, synthetic construct
  source 1..25: note = Seed: NSCVKLQTVHSIPLTINKEEALQRP
NSCVKLQTVHSIPVTIFKYEAVQRP

SEQ ID NO: 43305 - protein, 25 aa, synthetic construct
  source 1..25: note = Seed: NSCVKLQTVHSIPLTINKEEALQRP
NSCVKLQTVHSIPVTIFKYEAYQRP

SEQ ID NO: 43306 - protein, 25 aa, synthetic construct
  source 1..25: note = Seed: NSCVKLQTVHSIPLTINKEEALQRP
NSCVKLQTVHSIPVTIHKFEAFQRP

SEQ ID NO: 43307 - protein, 25 aa, synthetic construct
  source 1..25: note = Seed: NSCVKLQTVHSIPLTINKEEALQRP
NSCVKLQTVHSIPVTIHKFEAIQRP

SEQ ID NO: 43308 - protein, 25 aa, synthetic construct
  source 1..25: note = Seed: NSCVKLQTVHSIPLTINKEEALQRP
NSCVKLQTVHSIPVTIHKFEALQRP

SEQ ID NO: 43309 - protein, 25 aa, synthetic construct
  source 1..25: note = Seed: NSCVKLQTVHSIPLTINKEEALQRP
NSCVKLQTVHSIPVTIHKFEAMQRP

SEQ ID NO: 43310 - protein, 25 aa, synthetic construct
  source 1..25: note = Seed: NSCVKLQTVHSIPLTINKEEALQRP
NSCVKLQTVHSIPVTIHKFEAVQRP

SEQ ID NO: 43311 - protein, 25 aa, synthetic construct
  source 1..25: note = Seed: NSCVKLQTVHSIPLTINKEEALQRP
NSCVKLQTVHSIPVTIIKAEAAQRP

SEQ ID NO: 43312 - protein, 25 aa, synthetic construct
  source 1..25: note = Seed: NSCVKLQTVHSIPLTINKEEALQRP
NSCVKLQTVHSIPVTIIKAEAFQRP

SEQ ID NO: 43313 - protein, 25 aa, synthetic construct
  source 1..25: note = Seed: NSCVKLQTVHSIPLTINKEEALQRP
NSCVKLQTVHSIPVTIIKAEAIQRP

SEQ ID NO: 43314 - protein, 25 aa, synthetic construct
  source 1..25: note = Seed: NSCVKLQTVHSIPLTINKEEALQRP
NSCVKLQTVHSIPVTIIKAEALQRP

SEQ ID NO: 43315 - protein, 25 aa, synthetic construct
  source 1..25: note = Seed: NSCVKLQTVHSIPLTINKEEALQRP
NSCVKLQTVHSIPVTIIKAEAMQRP

SEQ ID NO: 43316 - protein, 25 aa, synthetic construct
  source 1..25: note = Seed: NSCVKLQTVHSIPLTINKEEALQRP
NSCVKLQTVHSIPVTIIKAEAVQRP

SEQ ID NO: 43317 - protein, 25 aa, synthetic construct
  source 1..25: note = Seed: NSCVKLQTVHSIPLTINKEEALQRP
NSCVKLQTVHSIPVTIIKAEAYQRP

SEQ ID NO: 43318 - protein, 25 aa, synthetic construct
  source 1..25: note = Seed: NSCVKLQTVHSIPLTINKEEALQRP
NSCVKLQTVHSIPVTIIKDEAAQRP

SEQ ID NO: 43319 - protein, 25 aa, synthetic construct
  source 1..25: note = Seed: NSCVKLQTVHSIPLTINKEEALQRP
NSCVKLQTVHSIPVTIIKDEAIQRP

SEQ ID NO: 43320 - protein, 25 aa, synthetic construct
  source 1..25: note = Seed: NSCVKLQTVHSIPLTINKEEALQRP
NSCVKLQTVHSIPVTIIKDEALQRP

SEQ ID NO: 43321 - protein, 25 aa, synthetic construct
  source 1..25: note = Seed: NSCVKLQTVHSIPLTINKEEALQRP
NSCVKLQTVHSIPVTIIKDEAMQRP

SEQ ID NO: 43322 - protein, 25 aa, synthetic construct
  source 1..25: note = Seed: NSCVKLQTVHSIPLTINKEEALQRP
NSCVKLQTVHSIPVTIIKDEAVQRP

SEQ ID NO: 43323 - protein, 25 aa, synthetic construct
  source 1..25: note = Seed: NSCVKLQTVHSIPLTINKEEALQRP
NSCVKLQTVHSIPVTIIKFEAAQRP

SEQ ID NO: 43324 - protein, 25 aa, synthetic construct
  source 1..25: note = Seed: NSCVKLQTVHSIPLTINKEEALQRP
NSCVKLQTVHSIPVTIIKFEAEQRP

SEQ ID NO: 43325 - protein, 25 aa, synthetic construct
  source 1..25: note = Seed: NSCVKLQTVHSIPLTINKEEALQRP
NSCVKLQTVHSIPVTIIKFEAFQRP

SEQ ID NO: 43326 - protein, 25 aa, synthetic construct
  source 1..25: note = Seed: NSCVKLQTVHSIPLTINKEEALQRP
NSCVKLQTVHSIPVTIIKFEAIQRP

SEQ ID NO: 43327 - protein, 25 aa, synthetic construct
  source 1..25: note = Seed: NSCVKLQTVHSIPLTINKEEALQRP
NSCVKLQTVHSIPVTIIKFEALQRP

SEQ ID NO: 43328 - protein, 25 aa, synthetic construct
  source 1..25: note = Seed: NSCVKLQTVHSIPLTINKEEALQRP
NSCVKLQTVHSIPVTIIKFEAMQRP

SEQ ID NO: 43329 - protein, 25 aa, synthetic construct
  source 1..25: note = Seed: NSCVKLQTVHSIPLTINKEEALQRP
NSCVKLQTVHSIPVTIIKFEATQRP

SEQ ID NO: 43330 - protein, 25 aa, synthetic construct
  source 1..25: note = Seed: NSCVKLQTVHSIPLTINKEEALQRP
NSCVKLQTVHSIPVTIIKFEAVQRP

SEQ ID NO: 43331 - protein, 25 aa, synthetic construct
  source 1..25: note = Seed: NSCVKLQTVHSIPLTINKEEALQRP
NSCVKLQTVHSIPVTIIKFEAYQRP

SEQ ID NO: 43332 - protein, 25 aa, synthetic construct
  source 1..25: note = Seed: NSCVKLQTVHSIPLTINKEEALQRP
NSCVKLQTVHSIPVTIIKHEARQRP

SEQ ID NO: 43333 - protein, 25 aa, synthetic construct
  source 1..25: note = Seed: NSCVKLQTVHSIPLTINKEEALQRP
NSCVKLQTVHSIPVTIIKIEAAQRP

SEQ ID NO: 43334 - protein, 25 aa, synthetic construct
  source 1..25: note = Seed: NSCVKLQTVHSIPLTINKEEALQRP
NSCVKLQTVHSIPVTIIKIEAFQRP

SEQ ID NO: 43335 - protein, 25 aa, synthetic construct
  source 1..25: note = Seed: NSCVKLQTVHSIPLTINKEEALQRP
NSCVKLQTVHSIPVTIIKIEAIQRP

SEQ ID NO: 43336 - protein, 25 aa, synthetic construct
  source 1..25: note = Seed: NSCVKLQTVHSIPLTINKEEALQRP
NSCVKLQTVHSIPVTIIKIEALQRP

SEQ ID NO: 43337 - protein, 25 aa, synthetic construct
  source 1..25: note = Seed: NSCVKLQTVHSIPLTINKEEALQRP
NSCVKLQTVHSIPVTIIKIEAMQRP

SEQ ID NO: 43338 - protein, 25 aa, synthetic construct
  source 1..25: note = Seed: NSCVKLQTVHSIPLTINKEEALQRP
NSCVKLQTVHSIPVTIIKIEASQRP

SEQ ID NO: 43339 - protein, 25 aa, synthetic construct
  source 1..25: note = Seed: NSCVKLQTVHSIPLTINKEEALQRP
NSCVKLQTVHSIPVTIIKIEAVQRP

SEQ ID NO: 43340 - protein, 25 aa, synthetic construct
  source 1..25: note = Seed: NSCVKLQTVHSIPLTINKEEALQRP
NSCVKLQTVHSIPVTIIKIEAYQRP

SEQ ID NO: 43341 - protein, 25 aa, synthetic construct
  source 1..25: note = Seed: NSCVKLQTVHSIPLTINKEEALQRP
NSCVKLQTVHSIPVTIIKKEALQRP

SEQ ID NO: 43342 - protein, 25 aa, synthetic construct
  source 1..25: note = Seed: NSCVKLQTVHSIPLTINKEEALQRP
NSCVKLQTVHSIPVTIIKLEAAQRP

SEQ ID NO: 43343 - protein, 25 aa, synthetic construct
  source 1..25: note = Seed: NSCVKLQTVHSIPLTINKEEALQRP
NSCVKLQTVHSIPVTIIKLEAVQRP

SEQ ID NO: 43344 - protein, 25 aa, synthetic construct
  source 1..25: note = Seed: NSCVKLQTVHSIPLTINKEEALQRP
NSCVKLQTVHSIPVTIIKMEAAQRP

SEQ ID NO: 43345 - protein, 25 aa, synthetic construct
  source 1..25: note = Seed: NSCVKLQTVHSIPLTINKEEALQRP
NSCVKLQTVHSIPVTIIKMEAIQRP

SEQ ID NO: 43346 - protein, 25 aa, synthetic construct
  source 1..25: note = Seed: NSCVKLQTVHSIPLTINKEEALQRP
NSCVKLQTVHSIPVTIIKMEAVQRP

SEQ ID NO: 43347 - protein, 25 aa, synthetic construct
  source 1..25: note = Seed: NSCVKLQTVHSIPLTINKEEALQRP
NSCVKLQTVHSIPVTIIKNEAFQRP

SEQ ID NO: 43348 - protein, 25 aa, synthetic construct
  source 1..25: note = Seed: NSCVKLQTVHSIPLTINKEEALQRP
NSCVKLQTVHSIPVTIIKNEAIQRP

SEQ ID NO: 43349 - protein, 25 aa, synthetic construct
  source 1..25: note = Seed: NSCVKLQTVHSIPLTINKEEALQRP
NSCVKLQTVHSIPVTIIKNEALQRP

SEQ ID NO: 43350 - protein, 25 aa, synthetic construct
  source 1..25: note = Seed: NSCVKLQTVHSIPLTINKEEALQRP
NSCVKLQTVHSIPVTIIKNEAMQRP

SEQ ID NO: 43351 - protein, 25 aa, synthetic construct
  source 1..25: note = Seed: NSCVKLQTVHSIPLTINKEEALQRP
NSCVKLQTVHSIPVTIIKNEAVQRP

SEQ ID NO: 43352 - protein, 25 aa, synthetic construct
  source 1..25: note = Seed: NSCVKLQTVHSIPLTINKEEALQRP
NSCVKLQTVHSIPVTIIKREAIQRP

SEQ ID NO: 43353 - protein, 25 aa, synthetic construct
  source 1..25: note = Seed: NSCVKLQTVHSIPLTINKEEALQRP
NSCVKLQTVHSIPVTIIKREALQRP

SEQ ID NO: 43354 - protein, 25 aa, synthetic construct
  source 1..25: note = Seed: NSCVKLQTVHSIPLTINKEEALQRP
NSCVKLQTVHSIPVTIIKREARQRP

SEQ ID NO: 43355 - protein, 25 aa, synthetic construct
  source 1..25: note = Seed: NSCVKLQTVHSIPLTINKEEALQRP
NSCVKLQTVHSIPVTIIKVEAAQRP

SEQ ID NO: 43356 - protein, 25 aa, synthetic construct
  source 1..25: note = Seed: NSCVKLQTVHSIPLTINKEEALQRP
NSCVKLQTVHSIPVTIIKVEAFQRP

SEQ ID NO: 43357 - protein, 25 aa, synthetic construct
  source 1..25: note = Seed: NSCVKLQTVHSIPLTINKEEALQRP
NSCVKLQTVHSIPVTIIKVEAIQRP

SEQ ID NO: 43358 - protein, 25 aa, synthetic construct
  source 1..25: note = Seed: NSCVKLQTVHSIPLTINKEEALQRP
NSCVKLQTVHSIPVTIIKVEALQRP

SEQ ID NO: 43359 - protein, 25 aa, synthetic construct
  source 1..25: note = Seed: NSCVKLQTVHSIPLTINKEEALQRP
NSCVKLQTVHSIPVTIIKVEAMQRP

SEQ ID NO: 43360 - protein, 25 aa, synthetic construct
  source 1..25: note = Seed: NSCVKLQTVHSIPLTINKEEALQRP
NSCVKLQTVHSIPVTIIKVEAVQRP

SEQ ID NO: 43361 - protein, 25 aa, synthetic construct
  source 1..25: note = Seed: NSCVKLQTVHSIPLTINKEEALQRP
NSCVKLQTVHSIPVTIIKVEAYQRP

SEQ ID NO: 43362 - protein, 25 aa, synthetic construct
  source 1..25: note = Seed: NSCVKLQTVHSIPLTINKEEALQRP
NSCVKLQTVHSIPVTIIKWEAFQRP

SEQ ID NO: 43363 - protein, 25 aa, synthetic construct
  source 1..25: note = Seed: NSCVKLQTVHSIPLTINKEEALQRP
NSCVKLQTVHSIPVTIIKYEAFQRP

SEQ ID NO: 43364 - protein, 25 aa, synthetic construct
  source 1..25: note = Seed: NSCVKLQTVHSIPLTINKEEALQRP
NSCVKLQTVHSIPVTIIKYEAIQRP

SEQ ID NO: 43365 - protein, 25 aa, synthetic construct
  source 1..25: note = Seed: NSCVKLQTVHSIPLTINKEEALQRP
NSCVKLQTVHSIPVTIIKYEALQRP

SEQ ID NO: 43366 - protein, 25 aa, synthetic construct
  source 1..25: note = Seed: NSCVKLQTVHSIPLTINKEEALQRP
NSCVKLQTVHSIPVTILKAEAAQRP

SEQ ID NO: 43367 - protein, 25 aa, synthetic construct
  source 1..25: note = Seed: NSCVKLQTVHSIPLTINKEEALQRP
NSCVKLQTVHSIPVTILKAEAFQRP

SEQ ID NO: 43368 - protein, 25 aa, synthetic construct
  source 1..25: note = Seed: NSCVKLQTVHSIPLTINKEEALQRP
NSCVKLQTVHSIPVTILKAEAIQRP

SEQ ID NO: 43369 - protein, 25 aa, synthetic construct
  source 1..25: note = Seed: NSCVKLQTVHSIPLTINKEEALQRP
NSCVKLQTVHSIPVTILKAEALQRP

SEQ ID NO: 43370 - protein, 25 aa, synthetic construct
  source 1..25: note = Seed: NSCVKLQTVHSIPLTINKEEALQRP
NSCVKLQTVHSIPVTILKAEAMQRP

SEQ ID NO: 43371 - protein, 25 aa, synthetic construct
  source 1..25: note = Seed: NSCVKLQTVHSIPLTINKEEALQRP
NSCVKLQTVHSIPVTILKAEAVQRP

SEQ ID NO: 43372 - protein, 25 aa, synthetic construct
  source 1..25: note = Seed: NSCVKLQTVHSIPLTINKEEALQRP
NSCVKLQTVHSIPVTILKDEAIQRP

SEQ ID NO: 43373 - protein, 25 aa, synthetic construct
  source 1..25: note = Seed: NSCVKLQTVHSIPLTINKEEALQRP
NSCVKLQTVHSIPVTILKDEAVQRP

SEQ ID NO: 43374 - protein, 25 aa, synthetic construct
  source 1..25: note = Seed: NSCVKLQTVHSIPLTINKEEALQRP
NSCVKLQTVHSIPVTILKFEAAQRP

SEQ ID NO: 43375 - protein, 25 aa, synthetic construct
  source 1..25: note = Seed: NSCVKLQTVHSIPLTINKEEALQRP
NSCVKLQTVHSIPVTILKFEAEQRP

SEQ ID NO: 43376 - protein, 25 aa, synthetic construct
  source 1..25: note = Seed: NSCVKLQTVHSIPLTINKEEALQRP
NSCVKLQTVHSIPVTILKFEAFQRP

SEQ ID NO: 43377 - protein, 25 aa, synthetic construct
  source 1..25: note = Seed: NSCVKLQTVHSIPLTINKEEALQRP
NSCVKLQTVHSIPVTILKFEAIQRP

SEQ ID NO: 43378 - protein, 25 aa, synthetic construct
  source 1..25: note = Seed: NSCVKLQTVHSIPLTINKEEALQRP
NSCVKLQTVHSIPVTILKFEALQRP

SEQ ID NO: 43379 - protein, 25 aa, synthetic construct
  source 1..25: note = Seed: NSCVKLQTVHSIPLTINKEEALQRP
NSCVKLQTVHSIPVTILKFEAMQRP

SEQ ID NO: 43380 - protein, 25 aa, synthetic construct
  source 1..25: note = Seed: NSCVKLQTVHSIPLTINKEEALQRP
NSCVKLQTVHSIPVTILKFEASQRP

SEQ ID NO: 43381 - protein, 25 aa, synthetic construct
  source 1..25: note = Seed: NSCVKLQTVHSIPLTINKEEALQRP
NSCVKLQTVHSIPVTILKFEATQRP

SEQ ID NO: 43382 - protein, 25 aa, synthetic construct
  source 1..25: note = Seed: NSCVKLQTVHSIPLTINKEEALQRP
NSCVKLQTVHSIPVTILKFEAVQRP

SEQ ID NO: 43383 - protein, 25 aa, synthetic construct
  source 1..25: note = Seed: NSCVKLQTVHSIPLTINKEEALQRP
NSCVKLQTVHSIPVTILKFEAYQRP

SEQ ID NO: 43384 - protein, 25 aa, synthetic construct
  source 1..25: note = Seed: NSCVKLQTVHSIPLTINKEEALQRP
NSCVKLQTVHSIPVTILKGEAAQRP

SEQ ID NO: 43385 - protein, 25 aa, synthetic construct
  source 1..25: note = Seed: NSCVKLQTVHSIPLTINKEEALQRP
NSCVKLQTVHSIPVTILKGEALQRP

SEQ ID NO: 43386 - protein, 25 aa, synthetic construct
  source 1..25: note = Seed: NSCVKLQTVHSIPLTINKEEALQRP
NSCVKLQTVHSIPVTILKGEAVQRP

SEQ ID NO: 43387 - protein, 25 aa, synthetic construct
  source 1..25: note = Seed: NSCVKLQTVHSIPLTINKEEALQRP
NSCVKLQTVHSIPVTILKIEAAQRP

SEQ ID NO: 43388 - protein, 25 aa, synthetic construct
  source 1..25: note = Seed: NSCVKLQTVHSIPLTINKEEALQRP
NSCVKLQTVHSIPVTILKIEAIQRP

SEQ ID NO: 43389 - protein, 25 aa, synthetic construct
  source 1..25: note = Seed: NSCVKLQTVHSIPLTINKEEALQRP
NSCVKLQTVHSIPVTILKIEALQRP

SEQ ID NO: 43390 - protein, 25 aa, synthetic construct
  source 1..25: note = Seed: NSCVKLQTVHSIPLTINKEEALQRP
NSCVKLQTVHSIPVTILKIEAMQRP

SEQ ID NO: 43391 - protein, 25 aa, synthetic construct
  source 1..25: note = Seed: NSCVKLQTVHSIPLTINKEEALQRP
NSCVKLQTVHSIPVTILKIEASQRP

SEQ ID NO: 43392 - protein, 25 aa, synthetic construct
  source 1..25: note = Seed: NSCVKLQTVHSIPLTINKEEALQRP
NSCVKLQTVHSIPVTILKIEAVQRP

SEQ ID NO: 43393 - protein, 25 aa, synthetic construct
  source 1..25: note = Seed: NSCVKLQTVHSIPLTINKEEALQRP
NSCVKLQTVHSIPVTILKIEAYQRP

SEQ ID NO: 43394 - protein, 25 aa, synthetic construct
  source 1..25: note = Seed: NSCVKLQTVHSIPLTINKEEALQRP
NSCVKLQTVHSIPVTILKLEAAQRP

SEQ ID NO: 43395 - protein, 25 aa, synthetic construct
  source 1..25: note = Seed: NSCVKLQTVHSIPLTINKEEALQRP
NSCVKLQTVHSIPVTILKLEAFQRP

SEQ ID NO: 43396 - protein, 25 aa, synthetic construct
  source 1..25: note = Seed: NSCVKLQTVHSIPLTINKEEALQRP
NSCVKLQTVHSIPVTILKLEAVQRP

SEQ ID NO: 43397 - protein, 25 aa, synthetic construct
  source 1..25: note = Seed: NSCVKLQTVHSIPLTINKEEALQRP
NSCVKLQTVHSIPVTILKMEAAQRP

SEQ ID NO: 43398 - protein, 25 aa, synthetic construct
  source 1..25: note = Seed: NSCVKLQTVHSIPLTINKEEALQRP
NSCVKLQTVHSIPVTILKMEAIQRP

SEQ ID NO: 43399 - protein, 25 aa, synthetic construct
  source 1..25: note = Seed: NSCVKLQTVHSIPLTINKEEALQRP
NSCVKLQTVHSIPVTILKMEAVQRP

SEQ ID NO: 43400 - protein, 25 aa, synthetic construct
  source 1..25: note = Seed: NSCVKLQTVHSIPLTINKEEALQRP
NSCVKLQTVHSIPVTILKREALQRP

SEQ ID NO: 43401 - protein, 25 aa, synthetic construct
  source 1..25: note = Seed: NSCVKLQTVHSIPLTINKEEALQRP
NSCVKLQTVHSIPVTILKSEAVQRP

SEQ ID NO: 43402 - protein, 25 aa, synthetic construct
  source 1..25: note = Seed: NSCVKLQTVHSIPLTINKEEALQRP
NSCVKLQTVHSIPVTILKVEAAQRP

SEQ ID NO: 43403 - protein, 25 aa, synthetic construct
  source 1..25: note = Seed: NSCVKLQTVHSIPLTINKEEALQRP
NSCVKLQTVHSIPVTILKVEAIQRP

SEQ ID NO: 43404 - protein, 25 aa, synthetic construct
  source 1..25: note = Seed: NSCVKLQTVHSIPLTINKEEALQRP
NSCVKLQTVHSIPVTILKVEALQRP

SEQ ID NO: 43405 - protein, 25 aa, synthetic construct
  source 1..25: note = Seed: NSCVKLQTVHSIPLTINKEEALQRP
NSCVKLQTVHSIPVTILKVEAMQRP

SEQ ID NO: 43406 - protein, 25 aa, synthetic construct
  source 1..25: note = Seed: NSCVKLQTVHSIPLTINKEEALQRP
NSCVKLQTVHSIPVTILKVEAVQRP

SEQ ID NO: 43407 - protein, 25 aa, synthetic construct
  source 1..25: note = Seed: NSCVKLQTVHSIPLTINKEEALQRP
NSCVKLQTVHSIPVTILKVEAYQRP

SEQ ID NO: 43408 - protein, 25 aa, synthetic construct
  source 1..25: note = Seed: NSCVKLQTVHSIPLTINKEEALQRP
NSCVKLQTVHSIPVTILKWEAFQRP

SEQ ID NO: 43409 - protein, 25 aa, synthetic construct
  source 1..25: note = Seed: NSCVKLQTVHSIPLTINKEEALQRP
NSCVKLQTVHSIPVTILKYEAFQRP

SEQ ID NO: 43410 - protein, 25 aa, synthetic construct
  source 1..25: note = Seed: NSCVKLQTVHSIPLTINKEEALQRP
NSCVKLQTVHSIPVTILKYEALQRP

SEQ ID NO: 43411 - protein, 25 aa, synthetic construct
  source 1..25: note = Seed: NSCVKLQTVHSIPLTINKEEALQRP
NSCVKLQTVHSIPVTIMKAEAAQRP

SEQ ID NO: 43412 - protein, 25 aa, synthetic construct
  source 1..25: note = Seed: NSCVKLQTVHSIPLTINKEEALQRP
NSCVKLQTVHSIPVTIMKAEAFQRP

SEQ ID NO: 43413 - protein, 25 aa, synthetic construct
  source 1..25: note = Seed: NSCVKLQTVHSIPLTINKEEALQRP
NSCVKLQTVHSIPVTIMKAEAIQRP

SEQ ID NO: 43414 - protein, 25 aa, synthetic construct
  source 1..25: note = Seed: NSCVKLQTVHSIPLTINKEEALQRP
NSCVKLQTVHSIPVTIMKAEALQRP

SEQ ID NO: 43415 - protein, 25 aa, synthetic construct
  source 1..25: note = Seed: NSCVKLQTVHSIPLTINKEEALQRP
NSCVKLQTVHSIPVTIMKAEAMQRP

SEQ ID NO: 43416 - protein, 25 aa, synthetic construct
  source 1..25: note = Seed: NSCVKLQTVHSIPLTINKEEALQRP
NSCVKLQTVHSIPVTIMKAEAVQRP

SEQ ID NO: 43417 - protein, 25 aa, synthetic construct
  source 1..25: note = Seed: NSCVKLQTVHSIPLTINKEEALQRP
NSCVKLQTVHSIPVTIMKAEAYQRP

SEQ ID NO: 43418 - protein, 25 aa, synthetic construct
  source 1..25: note = Seed: NSCVKLQTVHSIPLTINKEEALQRP
NSCVKLQTVHSIPVTIMKDEAAQRP

SEQ ID NO: 43419 - protein, 25 aa, synthetic construct
  source 1..25: note = Seed: NSCVKLQTVHSIPLTINKEEALQRP
NSCVKLQTVHSIPVTIMKDEAIQRP

SEQ ID NO: 43420 - protein, 25 aa, synthetic construct
  source 1..25: note = Seed: NSCVKLQTVHSIPLTINKEEALQRP
NSCVKLQTVHSIPVTIMKDEALQRP

SEQ ID NO: 43421 - protein, 25 aa, synthetic construct
  source 1..25: note = Seed: NSCVKLQTVHSIPLTINKEEALQRP
NSCVKLQTVHSIPVTIMKDEAVQRP

SEQ ID NO: 43422 - protein, 25 aa, synthetic construct
  source 1..25: note = Seed: NSCVKLQTVHSIPLTINKEEALQRP
NSCVKLQTVHSIPVTIMKFEAFQRP

SEQ ID NO: 43423 - protein, 25 aa, synthetic construct
  source 1..25: note = Seed: NSCVKLQTVHSIPLTINKEEALQRP
NSCVKLQTVHSIPVTIMKFEAIQRP

SEQ ID NO: 43424 - protein, 25 aa, synthetic construct
  source 1..25: note = Seed: NSCVKLQTVHSIPLTINKEEALQRP
NSCVKLQTVHSIPVTIMKFEALQRP

SEQ ID NO: 43425 - protein, 25 aa, synthetic construct
  source 1..25: note = Seed: NSCVKLQTVHSIPLTINKEEALQRP
NSCVKLQTVHSIPVTIMKFEAMQRP

SEQ ID NO: 43426 - protein, 25 aa, synthetic construct
  source 1..25: note = Seed: NSCVKLQTVHSIPLTINKEEALQRP
NSCVKLQTVHSIPVTIMKFEAVQRP

SEQ ID NO: 43427 - protein, 25 aa, synthetic construct
  source 1..25: note = Seed: NSCVKLQTVHSIPLTINKEEALQRP
NSCVKLQTVHSIPVTIMKFEAYQRP

SEQ ID NO: 43428 - protein, 25 aa, synthetic construct
  source 1..25: note = Seed: NSCVKLQTVHSIPLTINKEEALQRP
NSCVKLQTVHSIPVTIMKGEALQRP

SEQ ID NO: 43429 - protein, 25 aa, synthetic construct
  source 1..25: note = Seed: NSCVKLQTVHSIPLTINKEEALQRP
NSCVKLQTVHSIPVTIMKGEAVQRP

SEQ ID NO: 43430 - protein, 25 aa, synthetic construct
  source 1..25: note = Seed: NSCVKLQTVHSIPLTINKEEALQRP
NSCVKLQTVHSIPVTIMKIEAAQRP

SEQ ID NO: 43431 - protein, 25 aa, synthetic construct
  source 1..25: note = Seed: NSCVKLQTVHSIPLTINKEEALQRP
NSCVKLQTVHSIPVTIMKIEAFQRP

SEQ ID NO: 43432 - protein, 25 aa, synthetic construct
  source 1..25: note = Seed: NSCVKLQTVHSIPLTINKEEALQRP
NSCVKLQTVHSIPVTIMKIEAIQRP

SEQ ID NO: 43433 - protein, 25 aa, synthetic construct
  source 1..25: note = Seed: NSCVKLQTVHSIPLTINKEEALQRP
NSCVKLQTVHSIPVTIMKIEALQRP

SEQ ID NO: 43434 - protein, 25 aa, synthetic construct
  source 1..25: note = Seed: NSCVKLQTVHSIPLTINKEEALQRP
NSCVKLQTVHSIPVTIMKIEAMQRP

SEQ ID NO: 43435 - protein, 25 aa, synthetic construct
  source 1..25: note = Seed: NSCVKLQTVHSIPLTINKEEALQRP
NSCVKLQTVHSIPVTIMKIEASQRP

SEQ ID NO: 43436 - protein, 25 aa, synthetic construct
  source 1..25: note = Seed: NSCVKLQTVHSIPLTINKEEALQRP
NSCVKLQTVHSIPVTIMKIEATQRP

SEQ ID NO: 43437 - protein, 25 aa, synthetic construct
  source 1..25: note = Seed: NSCVKLQTVHSIPLTINKEEALQRP
NSCVKLQTVHSIPVTIMKIEAVQRP

SEQ ID NO: 43438 - protein, 25 aa, synthetic construct
  source 1..25: note = Seed: NSCVKLQTVHSIPLTINKEEALQRP
NSCVKLQTVHSIPVTIMKIEAYQRP

SEQ ID NO: 43439 - protein, 25 aa, synthetic construct
  source 1..25: note = Seed: NSCVKLQTVHSIPLTINKEEALQRP
NSCVKLQTVHSIPVTIMKLEAAQRP

SEQ ID NO: 43440 - protein, 25 aa, synthetic construct
  source 1..25: note = Seed: NSCVKLQTVHSIPLTINKEEALQRP
NSCVKLQTVHSIPVTIMKLEAIQRP

SEQ ID NO: 43441 - protein, 25 aa, synthetic construct
  source 1..25: note = Seed: NSCVKLQTVHSIPLTINKEEALQRP
NSCVKLQTVHSIPVTIMKLEALQRP

SEQ ID NO: 43442 - protein, 25 aa, synthetic construct
  source 1..25: note = Seed: NSCVKLQTVHSIPLTINKEEALQRP
NSCVKLQTVHSIPVTIMKLEAVQRP

SEQ ID NO: 43443 - protein, 25 aa, synthetic construct
  source 1..25: note = Seed: NSCVKLQTVHSIPLTINKEEALQRP
NSCVKLQTVHSIPVTIMKMEAAQRP

SEQ ID NO: 43444 - protein, 25 aa, synthetic construct
  source 1..25: note = Seed: NSCVKLQTVHSIPLTINKEEALQRP
NSCVKLQTVHSIPVTIMKMEAIQRP

SEQ ID NO: 43445 - protein, 25 aa, synthetic construct
  source 1..25: note = Seed: NSCVKLQTVHSIPLTINKEEALQRP
NSCVKLQTVHSIPVTIMKMEALQRP

SEQ ID NO: 43446 - protein, 25 aa, synthetic construct
  source 1..25: note = Seed: NSCVKLQTVHSIPLTINKEEALQRP
NSCVKLQTVHSIPVTIMKMEAVQRP

SEQ ID NO: 43447 - protein, 25 aa, synthetic construct
  source 1..25: note = Seed: NSCVKLQTVHSIPLTINKEEALQRP
NSCVKLQTVHSIPVTIMKNEAIQRP

SEQ ID NO: 43448 - protein, 25 aa, synthetic construct
  source 1..25: note = Seed: NSCVKLQTVHSIPLTINKEEALQRP
NSCVKLQTVHSIPVTIMKNEALQRP

SEQ ID NO: 43449 - protein, 25 aa, synthetic construct
  source 1..25: note = Seed: NSCVKLQTVHSIPLTINKEEALQRP
NSCVKLQTVHSIPVTIMKNEAVQRP

SEQ ID NO: 43450 - protein, 25 aa, synthetic construct
  source 1..25: note = Seed: NSCVKLQTVHSIPLTINKEEALQRP
NSCVKLQTVHSIPVTIMKREALQRP

SEQ ID NO: 43451 - protein, 25 aa, synthetic construct
  source 1..25: note = Seed: NSCVKLQTVHSIPLTINKEEALQRP
NSCVKLQTVHSIPVTIMKSEAIQRP

SEQ ID NO: 43452 - protein, 25 aa, synthetic construct
  source 1..25: note = Seed: NSCVKLQTVHSIPLTINKEEALQRP
NSCVKLQTVHSIPVTIMKSEAVQRP

SEQ ID NO: 43453 - protein, 25 aa, synthetic construct
  source 1..25: note = Seed: NSCVKLQTVHSIPLTINKEEALQRP
NSCVKLQTVHSIPVTIMKTEAIQRP

SEQ ID NO: 43454 - protein, 25 aa, synthetic construct
  source 1..25: note = Seed: NSCVKLQTVHSIPLTINKEEALQRP
NSCVKLQTVHSIPVTIMKTEAVQRP

SEQ ID NO: 43455 - protein, 25 aa, synthetic construct
  source 1..25: note = Seed: NSCVKLQTVHSIPLTINKEEALQRP
NSCVKLQTVHSIPVTIMKVEAAQRP

SEQ ID NO: 43456 - protein, 25 aa, synthetic construct
  source 1..25: note = Seed: NSCVKLQTVHSIPLTINKEEALQRP
NSCVKLQTVHSIPVTIMKVEAFQRP

SEQ ID NO: 43457 - protein, 25 aa, synthetic construct
  source 1..25: note = Seed: NSCVKLQTVHSIPLTINKEEALQRP
NSCVKLQTVHSIPVTIMKVEAIQRP

SEQ ID NO: 43458 - protein, 25 aa, synthetic construct
  source 1..25: note = Seed: NSCVKLQTVHSIPLTINKEEALQRP
NSCVKLQTVHSIPVTIMKVEALQRP

SEQ ID NO: 43459 - protein, 25 aa, synthetic construct
  source 1..25: note = Seed: NSCVKLQTVHSIPLTINKEEALQRP
NSCVKLQTVHSIPVTIMKVEAMQRP

SEQ ID NO: 43460 - protein, 25 aa, synthetic construct
  source 1..25: note = Seed: NSCVKLQTVHSIPLTINKEEALQRP
NSCVKLQTVHSIPVTIMKVEAVQRP

SEQ ID NO: 43461 - protein, 25 aa, synthetic construct
  source 1..25: note = Seed: NSCVKLQTVHSIPLTINKEEALQRP
NSCVKLQTVHSIPVTIMKVEAYQRP

SEQ ID NO: 43462 - protein, 25 aa, synthetic construct
  source 1..25: note = Seed: NSCVKLQTVHSIPLTINKEEALQRP
NSCVKLQTVHSIPVTIMKYEAFQRP

SEQ ID NO: 43463 - protein, 25 aa, synthetic construct
  source 1..25: note = Seed: NSCVKLQTVHSIPLTINKEEALQRP
NSCVKLQTVHSIPVTINKAEAAQRP

SEQ ID NO: 43464 - protein, 25 aa, synthetic construct
  source 1..25: note = Seed: NSCVKLQTVHSIPLTINKEEALQRP
NSCVKLQTVHSIPVTINKAEAFQRP

SEQ ID NO: 43465 - protein, 25 aa, synthetic construct
  source 1..25: note = Seed: NSCVKLQTVHSIPLTINKEEALQRP
NSCVKLQTVHSIPVTINKAEAIQRP

SEQ ID NO: 43466 - protein, 25 aa, synthetic construct
  source 1..25: note = Seed: NSCVKLQTVHSIPLTINKEEALQRP
NSCVKLQTVHSIPVTINKAEALQRP

SEQ ID NO: 43467 - protein, 25 aa, synthetic construct
  source 1..25: note = Seed: NSCVKLQTVHSIPLTINKEEALQRP
NSCVKLQTVHSIPVTINKAEAMQRP

SEQ ID NO: 43468 - protein, 25 aa, synthetic construct
  source 1..25: note = Seed: NSCVKLQTVHSIPLTINKEEALQRP
NSCVKLQTVHSIPVTINKAEATQRP

SEQ ID NO: 43469 - protein, 25 aa, synthetic construct
  source 1..25: note = Seed: NSCVKLQTVHSIPLTINKEEALQRP
NSCVKLQTVHSIPVTINKAEAVQRP

SEQ ID NO: 43470 - protein, 25 aa, synthetic construct
  source 1..25: note = Seed: NSCVKLQTVHSIPLTINKEEALQRP
NSCVKLQTVHSIPVTINKAEAWQRP

SEQ ID NO: 43471 - protein, 25 aa, synthetic construct
  source 1..25: note = Seed: NSCVKLQTVHSIPLTINKEEALQRP
NSCVKLQTVHSIPVTINKAEAYQRP

SEQ ID NO: 43472 - protein, 25 aa, synthetic construct
  source 1..25: note = Seed: NSCVKLQTVHSIPLTINKEEALQRP
NSCVKLQTVHSIPVTINKFEAIQRP

SEQ ID NO: 43473 - protein, 25 aa, synthetic construct
  source 1..25: note = Seed: NSCVKLQTVHSIPLTINKEEALQRP
NSCVKLQTVHSIPVTINKFEALQRP

SEQ ID NO: 43474 - protein, 25 aa, synthetic construct
  source 1..25: note = Seed: NSCVKLQTVHSIPLTINKEEALQRP
NSCVKLQTVHSIPVTINKFEAVQRP

SEQ ID NO: 43475 - protein, 25 aa, synthetic construct
  source 1..25: note = Seed: NSCVKLQTVHSIPLTINKEEALQRP
NSCVKLQTVHSIPVTINKGEAFQRP

SEQ ID NO: 43476 - protein, 25 aa, synthetic construct
  source 1..25: note = Seed: NSCVKLQTVHSIPLTINKEEALQRP
NSCVKLQTVHSIPVTINKGEAIQRP

SEQ ID NO: 43477 - protein, 25 aa, synthetic construct
  source 1..25: note = Seed: NSCVKLQTVHSIPLTINKEEALQRP
NSCVKLQTVHSIPVTINKGEALQRP

SEQ ID NO: 43478 - protein, 25 aa, synthetic construct
  source 1..25: note = Seed: NSCVKLQTVHSIPLTINKEEALQRP
NSCVKLQTVHSIPVTINKGEAMQRP

SEQ ID NO: 43479 - protein, 25 aa, synthetic construct
  source 1..25: note = Seed: NSCVKLQTVHSIPLTINKEEALQRP
NSCVKLQTVHSIPVTINKGEAVQRP

SEQ ID NO: 43480 - protein, 25 aa, synthetic construct
  source 1..25: note = Seed: NSCVKLQTVHSIPLTINKEEALQRP
NSCVKLQTVHSIPVTINKGEAYQRP

SEQ ID NO: 43481 - protein, 25 aa, synthetic construct
  source 1..25: note = Seed: NSCVKLQTVHSIPLTINKEEALQRP
NSCVKLQTVHSIPVTINKHEAIQRP

SEQ ID NO: 43482 - protein, 25 aa, synthetic construct
  source 1..25: note = Seed: NSCVKLQTVHSIPLTINKEEALQRP
NSCVKLQTVHSIPVTINKHEAVQRP

SEQ ID NO: 43483 - protein, 25 aa, synthetic construct
  source 1..25: note = Seed: NSCVKLQTVHSIPLTINKEEALQRP
NSCVKLQTVHSIPVTINKIEAAQRP

SEQ ID NO: 43484 - protein, 25 aa, synthetic construct
  source 1..25: note = Seed: NSCVKLQTVHSIPLTINKEEALQRP
NSCVKLQTVHSIPVTINKIEAFQRP

SEQ ID NO: 43485 - protein, 25 aa, synthetic construct
  source 1..25: note = Seed: NSCVKLQTVHSIPLTINKEEALQRP
NSCVKLQTVHSIPVTINKIEAIQRP

SEQ ID NO: 43486 - protein, 25 aa, synthetic construct
  source 1..25: note = Seed: NSCVKLQTVHSIPLTINKEEALQRP
NSCVKLQTVHSIPVTINKIEALQRP

SEQ ID NO: 43487 - protein, 25 aa, synthetic construct
  source 1..25: note = Seed: NSCVKLQTVHSIPLTINKEEALQRP
NSCVKLQTVHSIPVTINKIEAMQRP

SEQ ID NO: 43488 - protein, 25 aa, synthetic construct
  source 1..25: note = Seed: NSCVKLQTVHSIPLTINKEEALQRP
NSCVKLQTVHSIPVTINKIEAVQRP

SEQ ID NO: 43489 - protein, 25 aa, synthetic construct
  source 1..25: note = Seed: NSCVKLQTVHSIPLTINKEEALQRP
NSCVKLQTVHSIPVTINKIEAYQRP

SEQ ID NO: 43490 - protein, 25 aa, synthetic construct
  source 1..25: note = Seed: NSCVKLQTVHSIPLTINKEEALQRP
NSCVKLQTVHSIPVTINKLEAFQRP

SEQ ID NO: 43491 - protein, 25 aa, synthetic construct
  source 1..25: note = Seed: NSCVKLQTVHSIPLTINKEEALQRP
NSCVKLQTVHSIPVTINKLEAIQRP

SEQ ID NO: 43492 - protein, 25 aa, synthetic construct
  source 1..25: note = Seed: NSCVKLQTVHSIPLTINKEEALQRP
NSCVKLQTVHSIPVTINKLEALQRP

SEQ ID NO: 43493 - protein, 25 aa, synthetic construct
  source 1..25: note = Seed: NSCVKLQTVHSIPLTINKEEALQRP
NSCVKLQTVHSIPVTINKLEAVQRP

SEQ ID NO: 43494 - protein, 25 aa, synthetic construct
  source 1..25: note = Seed: NSCVKLQTVHSIPLTINKEEALQRP
NSCVKLQTVHSIPVTINKMEAIQRP

SEQ ID NO: 43495 - protein, 25 aa, synthetic construct
  source 1..25: note = Seed: NSCVKLQTVHSIPLTINKEEALQRP
NSCVKLQTVHSIPVTINKMEALQRP

SEQ ID NO: 43496 - protein, 25 aa, synthetic construct
  source 1..25: note = Seed: NSCVKLQTVHSIPLTINKEEALQRP
NSCVKLQTVHSIPVTINKMEAVQRP

SEQ ID NO: 43497 - protein, 25 aa, synthetic construct
  source 1..25: note = Seed: NSCVKLQTVHSIPLTINKEEALQRP
NSCVKLQTVHSIPVTINKNEAAQRP

SEQ ID NO: 43498 - protein, 25 aa, synthetic construct
  source 1..25: note = Seed: NSCVKLQTVHSIPLTINKEEALQRP
NSCVKLQTVHSIPVTINKNEAFQRP

SEQ ID NO: 43499 - protein, 25 aa, synthetic construct
  source 1..25: note = Seed: NSCVKLQTVHSIPLTINKEEALQRP
NSCVKLQTVHSIPVTINKNEAIQRP

SEQ ID NO: 43500 - protein, 25 aa, synthetic construct
  source 1..25: note = Seed: NSCVKLQTVHSIPLTINKEEALQRP
NSCVKLQTVHSIPVTINKNEALQRP

SEQ ID NO: 43501 - protein, 25 aa, synthetic construct
  source 1..25: note = Seed: NSCVKLQTVHSIPLTINKEEALQRP
NSCVKLQTVHSIPVTINKNEAMQRP

SEQ ID NO: 43502 - protein, 25 aa, synthetic construct
  source 1..25: note = Seed: NSCVKLQTVHSIPLTINKEEALQRP
NSCVKLQTVHSIPVTINKNEASQRP

SEQ ID NO: 43503 - protein, 25 aa, synthetic construct
  source 1..25: note = Seed: NSCVKLQTVHSIPLTINKEEALQRP
NSCVKLQTVHSIPVTINKNEAVQRP

SEQ ID NO: 43504 - protein, 25 aa, synthetic construct
  source 1..25: note = Seed: NSCVKLQTVHSIPLTINKEEALQRP
NSCVKLQTVHSIPVTINKNEAWQRP

SEQ ID NO: 43505 - protein, 25 aa, synthetic construct
  source 1..25: note = Seed: NSCVKLQTVHSIPLTINKEEALQRP
NSCVKLQTVHSIPVTINKNEAYQRP

SEQ ID NO: 43506 - protein, 25 aa, synthetic construct
  source 1..25: note = Seed: NSCVKLQTVHSIPLTINKEEALQRP
NSCVKLQTVHSIPVTINKPEAFQRP

SEQ ID NO: 43507 - protein, 25 aa, synthetic construct
  source 1..25: note = Seed: NSCVKLQTVHSIPLTINKEEALQRP
NSCVKLQTVHSIPVTINKPEAIQRP

SEQ ID NO: 43508 - protein, 25 aa, synthetic construct
  source 1..25: note = Seed: NSCVKLQTVHSIPLTINKEEALQRP
NSCVKLQTVHSIPVTINKPEALQRP

SEQ ID NO: 43509 - protein, 25 aa, synthetic construct
  source 1..25: note = Seed: NSCVKLQTVHSIPLTINKEEALQRP
NSCVKLQTVHSIPVTINKPEAMQRP

SEQ ID NO: 43510 - protein, 25 aa, synthetic construct
  source 1..25: note = Seed: NSCVKLQTVHSIPLTINKEEALQRP
NSCVKLQTVHSIPVTINKPEAVQRP

SEQ ID NO: 43511 - protein, 25 aa, synthetic construct
  source 1..25: note = Seed: NSCVKLQTVHSIPLTINKEEALQRP
NSCVKLQTVHSIPVTINKPEAYQRP

SEQ ID NO: 43512 - protein, 25 aa, synthetic construct
  source 1..25: note = Seed: NSCVKLQTVHSIPLTINKEEALQRP
NSCVKLQTVHSIPVTINKSEAAQRP

SEQ ID NO: 43513 - protein, 25 aa, synthetic construct
  source 1..25: note = Seed: NSCVKLQTVHSIPLTINKEEALQRP
NSCVKLQTVHSIPVTINKSEAFQRP

SEQ ID NO: 43514 - protein, 25 aa, synthetic construct
  source 1..25: note = Seed: NSCVKLQTVHSIPLTINKEEALQRP
NSCVKLQTVHSIPVTINKSEAIQRP

SEQ ID NO: 43515 - protein, 25 aa, synthetic construct
  source 1..25: note = Seed: NSCVKLQTVHSIPLTINKEEALQRP
NSCVKLQTVHSIPVTINKSEALQRP

SEQ ID NO: 43516 - protein, 25 aa, synthetic construct
  source 1..25: note = Seed: NSCVKLQTVHSIPLTINKEEALQRP
NSCVKLQTVHSIPVTINKSEAMQRP

SEQ ID NO: 43517 - protein, 25 aa, synthetic construct
  source 1..25: note = Seed: NSCVKLQTVHSIPLTINKEEALQRP
NSCVKLQTVHSIPVTINKSEAVQRP

SEQ ID NO: 43518 - protein, 25 aa, synthetic construct
  source 1..25: note = Seed: NSCVKLQTVHSIPLTINKEEALQRP
NSCVKLQTVHSIPVTINKSEAYQRP

SEQ ID NO: 43519 - protein, 25 aa, synthetic construct
  source 1..25: note = Seed: NSCVKLQTVHSIPLTINKEEALQRP
NSCVKLQTVHSIPVTINKTEAFQRP

SEQ ID NO: 43520 - protein, 25 aa, synthetic construct
  source 1..25: note = Seed: NSCVKLQTVHSIPLTINKEEALQRP
NSCVKLQTVHSIPVTINKTEAIQRP

SEQ ID NO: 43521 - protein, 25 aa, synthetic construct
  source 1..25: note = Seed: NSCVKLQTVHSIPLTINKEEALQRP
NSCVKLQTVHSIPVTINKTEALQRP

SEQ ID NO: 43522 - protein, 25 aa, synthetic construct
  source 1..25: note = Seed: NSCVKLQTVHSIPLTINKEEALQRP
NSCVKLQTVHSIPVTINKTEAMQRP

SEQ ID NO: 43523 - protein, 25 aa, synthetic construct
  source 1..25: note = Seed: NSCVKLQTVHSIPLTINKEEALQRP
NSCVKLQTVHSIPVTINKTEAVQRP

SEQ ID NO: 43524 - protein, 25 aa, synthetic construct
  source 1..25: note = Seed: NSCVKLQTVHSIPLTINKEEALQRP
NSCVKLQTVHSIPVTINKTEAYQRP

SEQ ID NO: 43525 - protein, 25 aa, synthetic construct
  source 1..25: note = Seed: NSCVKLQTVHSIPLTINKEEALQRP
NSCVKLQTVHSIPVTINKVEAFQRP

SEQ ID NO: 43526 - protein, 25 aa, synthetic construct
  source 1..25: note = Seed: NSCVKLQTVHSIPLTINKEEALQRP
NSCVKLQTVHSIPVTINKVEAIQRP

SEQ ID NO: 43527 - protein, 25 aa, synthetic construct
  source 1..25: note = Seed: NSCVKLQTVHSIPLTINKEEALQRP
NSCVKLQTVHSIPVTINKVEALQRP

SEQ ID NO: 43528 - protein, 25 aa, synthetic construct
  source 1..25: note = Seed: NSCVKLQTVHSIPLTINKEEALQRP
NSCVKLQTVHSIPVTINKVEAMQRP

SEQ ID NO: 43529 - protein, 25 aa, synthetic construct
  source 1..25: note = Seed: NSCVKLQTVHSIPLTINKEEALQRP
NSCVKLQTVHSIPVTINKVEAVQRP

SEQ ID NO: 43530 - protein, 25 aa, synthetic construct
  source 1..25: note = Seed: NSCVKLQTVHSIPLTINKEEALQRP
NSCVKLQTVHSIPVTINKVEAYQRP

SEQ ID NO: 43531 - protein, 25 aa, synthetic construct
  source 1..25: note = Seed: NSCVKLQTVHSIPLTINKEEALQRP
NSCVKLQTVHSIPVTIQKFEAFQRP

SEQ ID NO: 43532 - protein, 25 aa, synthetic construct
  source 1..25: note = Seed: NSCVKLQTVHSIPLTINKEEALQRP
NSCVKLQTVHSIPVTIQKFEAIQRP

SEQ ID NO: 43533 - protein, 25 aa, synthetic construct
  source 1..25: note = Seed: NSCVKLQTVHSIPLTINKEEALQRP
NSCVKLQTVHSIPVTIQKFEALQRP

SEQ ID NO: 43534 - protein, 25 aa, synthetic construct
  source 1..25: note = Seed: NSCVKLQTVHSIPLTINKEEALQRP
NSCVKLQTVHSIPVTIQKFEAMQRP

SEQ ID NO: 43535 - protein, 25 aa, synthetic construct
  source 1..25: note = Seed: NSCVKLQTVHSIPLTINKEEALQRP
NSCVKLQTVHSIPVTIQKFEAVQRP

SEQ ID NO: 43536 - protein, 25 aa, synthetic construct
  source 1..25: note = Seed: NSCVKLQTVHSIPLTINKEEALQRP
NSCVKLQTVHSIPVTIRKHEARQRP

SEQ ID NO: 43537 - protein, 25 aa, synthetic construct
  source 1..25: note = Seed: NSCVKLQTVHSIPLTINKEEALQRP
NSCVKLQTVHSIPVTIRKKEALQRP

SEQ ID NO: 43538 - protein, 25 aa, synthetic construct
  source 1..25: note = Seed: NSCVKLQTVHSIPLTINKEEALQRP
NSCVKLQTVHSIPVTIRKREAFQRP

SEQ ID NO: 43539 - protein, 25 aa, synthetic construct
  source 1..25: note = Seed: NSCVKLQTVHSIPLTINKEEALQRP
NSCVKLQTVHSIPVTIRKREAIQRP

SEQ ID NO: 43540 - protein, 25 aa, synthetic construct
  source 1..25: note = Seed: NSCVKLQTVHSIPLTINKEEALQRP
NSCVKLQTVHSIPVTIRKREALQRP

SEQ ID NO: 43541 - protein, 25 aa, synthetic construct
  source 1..25: note = Seed: NSCVKLQTVHSIPLTINKEEALQRP
NSCVKLQTVHSIPVTISKAEAIQRP

SEQ ID NO: 43542 - protein, 25 aa, synthetic construct
  source 1..25: note = Seed: NSCVKLQTVHSIPLTINKEEALQRP
NSCVKLQTVHSIPVTISKAEAVQRP

SEQ ID NO: 43543 - protein, 25 aa, synthetic construct
  source 1..25: note = Seed: NSCVKLQTVHSIPLTINKEEALQRP
NSCVKLQTVHSIPVTISKFEAFQRP

SEQ ID NO: 43544 - protein, 25 aa, synthetic construct
  source 1..25: note = Seed: NSCVKLQTVHSIPLTINKEEALQRP
NSCVKLQTVHSIPVTISKFEAIQRP

SEQ ID NO: 43545 - protein, 25 aa, synthetic construct
  source 1..25: note = Seed: NSCVKLQTVHSIPLTINKEEALQRP
NSCVKLQTVHSIPVTISKFEALQRP

SEQ ID NO: 43546 - protein, 25 aa, synthetic construct
  source 1..25: note = Seed: NSCVKLQTVHSIPLTINKEEALQRP
NSCVKLQTVHSIPVTISKFEAMQRP

SEQ ID NO: 43547 - protein, 25 aa, synthetic construct
  source 1..25: note = Seed: NSCVKLQTVHSIPLTINKEEALQRP
NSCVKLQTVHSIPVTISKFEAVQRP

SEQ ID NO: 43548 - protein, 25 aa, synthetic construct
  source 1..25: note = Seed: NSCVKLQTVHSIPLTINKEEALQRP
NSCVKLQTVHSIPVTISKIEAAQRP

SEQ ID NO: 43549 - protein, 25 aa, synthetic construct
  source 1..25: note = Seed: NSCVKLQTVHSIPLTINKEEALQRP
NSCVKLQTVHSIPVTISKIEAIQRP

SEQ ID NO: 43550 - protein, 25 aa, synthetic construct
  source 1..25: note = Seed: NSCVKLQTVHSIPLTINKEEALQRP
NSCVKLQTVHSIPVTISKIEALQRP

SEQ ID NO: 43551 - protein, 25 aa, synthetic construct
  source 1..25: note = Seed: NSCVKLQTVHSIPLTINKEEALQRP
NSCVKLQTVHSIPVTISKNEAIQRP

SEQ ID NO: 43552 - protein, 25 aa, synthetic construct
  source 1..25: note = Seed: NSCVKLQTVHSIPLTINKEEALQRP
NSCVKLQTVHSIPVTISKNEAVQRP

SEQ ID NO: 43553 - protein, 25 aa, synthetic construct
  source 1..25: note = Seed: NSCVKLQTVHSIPLTINKEEALQRP
NSCVKLQTVHSIPVTISKSEAIQRP

SEQ ID NO: 43554 - protein, 25 aa, synthetic construct
  source 1..25: note = Seed: NSCVKLQTVHSIPLTINKEEALQRP
NSCVKLQTVHSIPVTITKFEAFQRP

SEQ ID NO: 43555 - protein, 25 aa, synthetic construct
  source 1..25: note = Seed: NSCVKLQTVHSIPLTINKEEALQRP
NSCVKLQTVHSIPVTITKFEAIQRP

SEQ ID NO: 43556 - protein, 25 aa, synthetic construct
  source 1..25: note = Seed: NSCVKLQTVHSIPLTINKEEALQRP
NSCVKLQTVHSIPVTITKFEALQRP

SEQ ID NO: 43557 - protein, 25 aa, synthetic construct
  source 1..25: note = Seed: NSCVKLQTVHSIPLTINKEEALQRP
NSCVKLQTVHSIPVTITKFEAMQRP

SEQ ID NO: 43558 - protein, 25 aa, synthetic construct
  source 1..25: note = Seed: NSCVKLQTVHSIPLTINKEEALQRP
NSCVKLQTVHSIPVTITKFEATQRP

SEQ ID NO: 43559 - protein, 25 aa, synthetic construct
  source 1..25: note = Seed: NSCVKLQTVHSIPLTINKEEALQRP
NSCVKLQTVHSIPVTITKFEAVQRP

SEQ ID NO: 43560 - protein, 25 aa, synthetic construct
  source 1..25: note = Seed: NSCVKLQTVHSIPLTINKEEALQRP
NSCVKLQTVHSIPVTITKFEAYQRP

SEQ ID NO: 43561 - protein, 25 aa, synthetic construct
  source 1..25: note = Seed: NSCVKLQTVHSIPLTINKEEALQRP
NSCVKLQTVHSIPVTIVKAEAAQRP

SEQ ID NO: 43562 - protein, 25 aa, synthetic construct
  source 1..25: note = Seed: NSCVKLQTVHSIPLTINKEEALQRP
NSCVKLQTVHSIPVTIVKAEAFQRP

SEQ ID NO: 43563 - protein, 25 aa, synthetic construct
  source 1..25: note = Seed: NSCVKLQTVHSIPLTINKEEALQRP
NSCVKLQTVHSIPVTIVKAEAIQRP

SEQ ID NO: 43564 - protein, 25 aa, synthetic construct
  source 1..25: note = Seed: NSCVKLQTVHSIPLTINKEEALQRP
NSCVKLQTVHSIPVTIVKAEALQRP

SEQ ID NO: 43565 - protein, 25 aa, synthetic construct
  source 1..25: note = Seed: NSCVKLQTVHSIPLTINKEEALQRP
NSCVKLQTVHSIPVTIVKAEAVQRP

SEQ ID NO: 43566 - protein, 25 aa, synthetic construct
  source 1..25: note = Seed: NSCVKLQTVHSIPLTINKEEALQRP
NSCVKLQTVHSIPVTIVKDEAIQRP

SEQ ID NO: 43567 - protein, 25 aa, synthetic construct
  source 1..25: note = Seed: NSCVKLQTVHSIPLTINKEEALQRP
NSCVKLQTVHSIPVTIVKDEALQRP

SEQ ID NO: 43568 - protein, 25 aa, synthetic construct
  source 1..25: note = Seed: NSCVKLQTVHSIPLTINKEEALQRP
NSCVKLQTVHSIPVTIVKDEAVQRP

SEQ ID NO: 43569 - protein, 25 aa, synthetic construct
  source 1..25: note = Seed: NSCVKLQTVHSIPLTINKEEALQRP
NSCVKLQTVHSIPVTIVKFEAAQRP

SEQ ID NO: 43570 - protein, 25 aa, synthetic construct
  source 1..25: note = Seed: NSCVKLQTVHSIPLTINKEEALQRP
NSCVKLQTVHSIPVTIVKFEAEQRP

SEQ ID NO: 43571 - protein, 25 aa, synthetic construct
  source 1..25: note = Seed: NSCVKLQTVHSIPLTINKEEALQRP
NSCVKLQTVHSIPVTIVKFEAFQRP

SEQ ID NO: 43572 - protein, 25 aa, synthetic construct
  source 1..25: note = Seed: NSCVKLQTVHSIPLTINKEEALQRP
NSCVKLQTVHSIPVTIVKFEAIQRP

SEQ ID NO: 43573 - protein, 25 aa, synthetic construct
  source 1..25: note = Seed: NSCVKLQTVHSIPLTINKEEALQRP
NSCVKLQTVHSIPVTIVKFEALQRP

SEQ ID NO: 43574 - protein, 25 aa, synthetic construct
  source 1..25: note = Seed: NSCVKLQTVHSIPLTINKEEALQRP
NSCVKLQTVHSIPVTIVKFEAMQRP

SEQ ID NO: 43575 - protein, 25 aa, synthetic construct
  source 1..25: note = Seed: NSCVKLQTVHSIPLTINKEEALQRP
NSCVKLQTVHSIPVTIVKFEATQRP

SEQ ID NO: 43576 - protein, 25 aa, synthetic construct
  source 1..25: note = Seed: NSCVKLQTVHSIPLTINKEEALQRP
NSCVKLQTVHSIPVTIVKFEAVQRP

SEQ ID NO: 43577 - protein, 25 aa, synthetic construct
  source 1..25: note = Seed: NSCVKLQTVHSIPLTINKEEALQRP
NSCVKLQTVHSIPVTIVKFEAYQRP

SEQ ID NO: 43578 - protein, 25 aa, synthetic construct
  source 1..25: note = Seed: NSCVKLQTVHSIPLTINKEEALQRP
NSCVKLQTVHSIPVTIVKIEAAQRP

SEQ ID NO: 43579 - protein, 25 aa, synthetic construct
  source 1..25: note = Seed: NSCVKLQTVHSIPLTINKEEALQRP
NSCVKLQTVHSIPVTIVKIEAFQRP

SEQ ID NO: 43580 - protein, 25 aa, synthetic construct
  source 1..25: note = Seed: NSCVKLQTVHSIPLTINKEEALQRP
NSCVKLQTVHSIPVTIVKIEAIQRP

SEQ ID NO: 43581 - protein, 25 aa, synthetic construct
  source 1..25: note = Seed: NSCVKLQTVHSIPLTINKEEALQRP
NSCVKLQTVHSIPVTIVKIEALQRP

SEQ ID NO: 43582 - protein, 25 aa, synthetic construct
  source 1..25: note = Seed: NSCVKLQTVHSIPLTINKEEALQRP
NSCVKLQTVHSIPVTIVKIEAMQRP

SEQ ID NO: 43583 - protein, 25 aa, synthetic construct
  source 1..25: note = Seed: NSCVKLQTVHSIPLTINKEEALQRP
NSCVKLQTVHSIPVTIVKIEAVQRP

SEQ ID NO: 43584 - protein, 25 aa, synthetic construct
  source 1..25: note = Seed: NSCVKLQTVHSIPLTINKEEALQRP
NSCVKLQTVHSIPVTIVKIEAYQRP

SEQ ID NO: 43585 - protein, 25 aa, synthetic construct
  source 1..25: note = Seed: NSCVKLQTVHSIPLTINKEEALQRP
NSCVKLQTVHSIPVTIVKNEAIQRP

SEQ ID NO: 43586 - protein, 25 aa, synthetic construct
  source 1..25: note = Seed: NSCVKLQTVHSIPLTINKEEALQRP
NSCVKLQTVHSIPVTIVKNEAVQRP

SEQ ID NO: 43587 - protein, 25 aa, synthetic construct
  source 1..25: note = Seed: NSCVKLQTVHSIPLTINKEEALQRP
NSCVKLQTVHSIPVTIVKVEAAQRP

SEQ ID NO: 43588 - protein, 25 aa, synthetic construct
  source 1..25: note = Seed: NSCVKLQTVHSIPLTINKEEALQRP
NSCVKLQTVHSIPVTIVKVEAIQRP

SEQ ID NO: 43589 - protein, 25 aa, synthetic construct
  source 1..25: note = Seed: NSCVKLQTVHSIPLTINKEEALQRP
NSCVKLQTVHSIPVTIVKVEALQRP

SEQ ID NO: 43590 - protein, 25 aa, synthetic construct
  source 1..25: note = Seed: NSCVKLQTVHSIPLTINKEEALQRP
NSCVKLQTVHSIPVTIVKVEAVQRP

SEQ ID NO: 43591 - protein, 25 aa, synthetic construct
  source 1..25: note = Seed: NSCVKLQTVHSIPLTINKEEALQRP
NSCVKLQTVHSIPVTIVKYEAFQRP

SEQ ID NO: 43592 - protein, 25 aa, synthetic construct
  source 1..25: note = Seed: NSCVKLQTVHSIPLTINKEEALQRP
NSCVKLQTVHSIPVTIWKAEAAQRP

SEQ ID NO: 43593 - protein, 25 aa, synthetic construct
  source 1..25: note = Seed: NSCVKLQTVHSIPLTINKEEALQRP
NSCVKLQTVHSIPVTIWKAEAFQRP

SEQ ID NO: 43594 - protein, 25 aa, synthetic construct
  source 1..25: note = Seed: NSCVKLQTVHSIPLTINKEEALQRP
NSCVKLQTVHSIPVTIWKAEAIQRP

SEQ ID NO: 43595 - protein, 25 aa, synthetic construct
  source 1..25: note = Seed: NSCVKLQTVHSIPLTINKEEALQRP
NSCVKLQTVHSIPVTIWKAEALQRP

SEQ ID NO: 43596 - protein, 25 aa, synthetic construct
  source 1..25: note = Seed: NSCVKLQTVHSIPLTINKEEALQRP
NSCVKLQTVHSIPVTIWKAEAMQRP

SEQ ID NO: 43597 - protein, 25 aa, synthetic construct
  source 1..25: note = Seed: NSCVKLQTVHSIPLTINKEEALQRP
NSCVKLQTVHSIPVTIWKAEAVQRP

SEQ ID NO: 43598 - protein, 25 aa, synthetic construct
  source 1..25: note = Seed: NSCVKLQTVHSIPLTINKEEALQRP
NSCVKLQTVHSIPVTIWKDEAAQRP

SEQ ID NO: 43599 - protein, 25 aa, synthetic construct
  source 1..25: note = Seed: NSCVKLQTVHSIPLTINKEEALQRP
NSCVKLQTVHSIPVTIWKDEAFQRP

SEQ ID NO: 43600 - protein, 25 aa, synthetic construct
  source 1..25: note = Seed: NSCVKLQTVHSIPLTINKEEALQRP
NSCVKLQTVHSIPVTIWKDEAIQRP

SEQ ID NO: 43601 - protein, 25 aa, synthetic construct
  source 1..25: note = Seed: NSCVKLQTVHSIPLTINKEEALQRP
NSCVKLQTVHSIPVTIWKDEALQRP

SEQ ID NO: 43602 - protein, 25 aa, synthetic construct
  source 1..25: note = Seed: NSCVKLQTVHSIPLTINKEEALQRP
NSCVKLQTVHSIPVTIWKDEAMQRP

SEQ ID NO: 43603 - protein, 25 aa, synthetic construct
  source 1..25: note = Seed: NSCVKLQTVHSIPLTINKEEALQRP
NSCVKLQTVHSIPVTIWKDEASQRP

SEQ ID NO: 43604 - protein, 25 aa, synthetic construct
  source 1..25: note = Seed: NSCVKLQTVHSIPLTINKEEALQRP
NSCVKLQTVHSIPVTIWKDEAVQRP

SEQ ID NO: 43605 - protein, 25 aa, synthetic construct
  source 1..25: note = Seed: NSCVKLQTVHSIPLTINKEEALQRP
NSCVKLQTVHSIPVTIWKDEAYQRP

SEQ ID NO: 43606 - protein, 25 aa, synthetic construct
  source 1..25: note = Seed: NSCVKLQTVHSIPLTINKEEALQRP
NSCVKLQTVHSIPVTIWKFEAFQRP

SEQ ID NO: 43607 - protein, 25 aa, synthetic construct
  source 1..25: note = Seed: NSCVKLQTVHSIPLTINKEEALQRP
NSCVKLQTVHSIPVTIWKFEAIQRP

SEQ ID NO: 43608 - protein, 25 aa, synthetic construct
  source 1..25: note = Seed: NSCVKLQTVHSIPLTINKEEALQRP
NSCVKLQTVHSIPVTIWKFEALQRP

SEQ ID NO: 43609 - protein, 25 aa, synthetic construct
  source 1..25: note = Seed: NSCVKLQTVHSIPLTINKEEALQRP
NSCVKLQTVHSIPVTIWKIEAAQRP

SEQ ID NO: 43610 - protein, 25 aa, synthetic construct
  source 1..25: note = Seed: NSCVKLQTVHSIPLTINKEEALQRP
NSCVKLQTVHSIPVTIWKIEAFQRP

SEQ ID NO: 43611 - protein, 25 aa, synthetic construct
  source 1..25: note = Seed: NSCVKLQTVHSIPLTINKEEALQRP
NSCVKLQTVHSIPVTIWKIEAIQRP

SEQ ID NO: 43612 - protein, 25 aa, synthetic construct
  source 1..25: note = Seed: NSCVKLQTVHSIPLTINKEEALQRP
NSCVKLQTVHSIPVTIWKIEALQRP

SEQ ID NO: 43613 - protein, 25 aa, synthetic construct
  source 1..25: note = Seed: NSCVKLQTVHSIPLTINKEEALQRP
NSCVKLQTVHSIPVTIWKIEAMQRP

SEQ ID NO: 43614 - protein, 25 aa, synthetic construct
  source 1..25: note = Seed: NSCVKLQTVHSIPLTINKEEALQRP
NSCVKLQTVHSIPVTIWKIEASQRP

SEQ ID NO: 43615 - protein, 25 aa, synthetic construct
  source 1..25: note = Seed: NSCVKLQTVHSIPLTINKEEALQRP
NSCVKLQTVHSIPVTIWKIEAVQRP

SEQ ID NO: 43616 - protein, 25 aa, synthetic construct
  source 1..25: note = Seed: NSCVKLQTVHSIPLTINKEEALQRP
NSCVKLQTVHSIPVTIWKIEAYQRP

SEQ ID NO: 43617 - protein, 25 aa, synthetic construct
  source 1..25: note = Seed: NSCVKLQTVHSIPLTINKEEALQRP
NSCVKLQTVHSIPVTIWKLEAAQRP

SEQ ID NO: 43618 - protein, 25 aa, synthetic construct
  source 1..25: note = Seed: NSCVKLQTVHSIPLTINKEEALQRP
NSCVKLQTVHSIPVTIWKLEAIQRP

SEQ ID NO: 43619 - protein, 25 aa, synthetic construct
  source 1..25: note = Seed: NSCVKLQTVHSIPLTINKEEALQRP
NSCVKLQTVHSIPVTIWKLEALQRP

SEQ ID NO: 43620 - protein, 25 aa, synthetic construct
  source 1..25: note = Seed: NSCVKLQTVHSIPLTINKEEALQRP
NSCVKLQTVHSIPVTIWKLEAMQRP

SEQ ID NO: 43621 - protein, 25 aa, synthetic construct
  source 1..25: note = Seed: NSCVKLQTVHSIPLTINKEEALQRP
NSCVKLQTVHSIPVTIWKLEAVQRP

SEQ ID NO: 43622 - protein, 25 aa, synthetic construct
  source 1..25: note = Seed: NSCVKLQTVHSIPLTINKEEALQRP
NSCVKLQTVHSIPVTIWKMEAAQRP

SEQ ID NO: 43623 - protein, 25 aa, synthetic construct
  source 1..25: note = Seed: NSCVKLQTVHSIPLTINKEEALQRP
NSCVKLQTVHSIPVTIWKMEAIQRP

SEQ ID NO: 43624 - protein, 25 aa, synthetic construct
  source 1..25: note = Seed: NSCVKLQTVHSIPLTINKEEALQRP
NSCVKLQTVHSIPVTIWKMEALQRP

SEQ ID NO: 43625 - protein, 25 aa, synthetic construct
  source 1..25: note = Seed: NSCVKLQTVHSIPLTINKEEALQRP
NSCVKLQTVHSIPVTIWKMEAVQRP

SEQ ID NO: 43626 - protein, 25 aa, synthetic construct
  source 1..25: note = Seed: NSCVKLQTVHSIPLTINKEEALQRP
NSCVKLQTVHSIPVTIWKNEAAQRP

SEQ ID NO: 43627 - protein, 25 aa, synthetic construct
  source 1..25: note = Seed: NSCVKLQTVHSIPLTINKEEALQRP
NSCVKLQTVHSIPVTIWKNEAFQRP

SEQ ID NO: 43628 - protein, 25 aa, synthetic construct
  source 1..25: note = Seed: NSCVKLQTVHSIPLTINKEEALQRP
NSCVKLQTVHSIPVTIWKNEAIQRP

SEQ ID NO: 43629 - protein, 25 aa, synthetic construct
  source 1..25: note = Seed: NSCVKLQTVHSIPLTINKEEALQRP
NSCVKLQTVHSIPVTIWKNEALQRP

SEQ ID NO: 43630 - protein, 25 aa, synthetic construct
  source 1..25: note = Seed: NSCVKLQTVHSIPLTINKEEALQRP
NSCVKLQTVHSIPVTIWKNEAVQRP

SEQ ID NO: 43631 - protein, 25 aa, synthetic construct
  source 1..25: note = Seed: NSCVKLQTVHSIPLTINKEEALQRP
NSCVKLQTVHSIPVTIWKVEAAQRP

SEQ ID NO: 43632 - protein, 25 aa, synthetic construct
  source 1..25: note = Seed: NSCVKLQTVHSIPLTINKEEALQRP
NSCVKLQTVHSIPVTIWKVEAFQRP

SEQ ID NO: 43633 - protein, 25 aa, synthetic construct
  source 1..25: note = Seed: NSCVKLQTVHSIPLTINKEEALQRP
NSCVKLQTVHSIPVTIWKVEAIQRP

SEQ ID NO: 43634 - protein, 25 aa, synthetic construct
  source 1..25: note = Seed: NSCVKLQTVHSIPLTINKEEALQRP
NSCVKLQTVHSIPVTIWKVEALQRP

SEQ ID NO: 43635 - protein, 25 aa, synthetic construct
  source 1..25: note = Seed: NSCVKLQTVHSIPLTINKEEALQRP
NSCVKLQTVHSIPVTIWKVEAMQRP

SEQ ID NO: 43636 - protein, 25 aa, synthetic construct
  source 1..25: note = Seed: NSCVKLQTVHSIPLTINKEEALQRP
NSCVKLQTVHSIPVTIWKVEAVQRP

SEQ ID NO: 43637 - protein, 25 aa, synthetic construct
  source 1..25: note = Seed: NSCVKLQTVHSIPLTINKEEALQRP
NSCVKLQTVHSIPVTIYKAEAAQRP

SEQ ID NO: 43638 - protein, 25 aa, synthetic construct
  source 1..25: note = Seed: NSCVKLQTVHSIPLTINKEEALQRP
NSCVKLQTVHSIPVTIYKAEACQRP

SEQ ID NO: 43639 - protein, 25 aa, synthetic construct
  source 1..25: note = Seed: NSCVKLQTVHSIPLTINKEEALQRP
NSCVKLQTVHSIPVTIYKAEAFQRP

SEQ ID NO: 43640 - protein, 25 aa, synthetic construct
  source 1..25: note = Seed: NSCVKLQTVHSIPLTINKEEALQRP
NSCVKLQTVHSIPVTIYKAEAIQRP

SEQ ID NO: 43641 - protein, 25 aa, synthetic construct
  source 1..25: note = Seed: NSCVKLQTVHSIPLTINKEEALQRP
NSCVKLQTVHSIPVTIYKAEALQRP

SEQ ID NO: 43642 - protein, 25 aa, synthetic construct
  source 1..25: note = Seed: NSCVKLQTVHSIPLTINKEEALQRP
NSCVKLQTVHSIPVTIYKAEAMQRP

SEQ ID NO: 43643 - protein, 25 aa, synthetic construct
  source 1..25: note = Seed: NSCVKLQTVHSIPLTINKEEALQRP
NSCVKLQTVHSIPVTIYKAEASQRP

SEQ ID NO: 43644 - protein, 25 aa, synthetic construct
  source 1..25: note = Seed: NSCVKLQTVHSIPLTINKEEALQRP
NSCVKLQTVHSIPVTIYKAEATQRP

SEQ ID NO: 43645 - protein, 25 aa, synthetic construct
  source 1..25: note = Seed: NSCVKLQTVHSIPLTINKEEALQRP
NSCVKLQTVHSIPVTIYKAEAVQRP

SEQ ID NO: 43646 - protein, 25 aa, synthetic construct
  source 1..25: note = Seed: NSCVKLQTVHSIPLTINKEEALQRP
NSCVKLQTVHSIPVTIYKAEAYQRP

SEQ ID NO: 43647 - protein, 25 aa, synthetic construct
  source 1..25: note = Seed: NSCVKLQTVHSIPLTINKEEALQRP
NSCVKLQTVHSIPVTIYKDEAAQRP

SEQ ID NO: 43648 - protein, 25 aa, synthetic construct
  source 1..25: note = Seed: NSCVKLQTVHSIPLTINKEEALQRP
NSCVKLQTVHSIPVTIYKDEACQRP

SEQ ID NO: 43649 - protein, 25 aa, synthetic construct
  source 1..25: note = Seed: NSCVKLQTVHSIPLTINKEEALQRP
NSCVKLQTVHSIPVTIYKDEAFQRP

SEQ ID NO: 43650 - protein, 25 aa, synthetic construct
  source 1..25: note = Seed: NSCVKLQTVHSIPLTINKEEALQRP
NSCVKLQTVHSIPVTIYKDEAGQRP

SEQ ID NO: 43651 - protein, 25 aa, synthetic construct
  source 1..25: note = Seed: NSCVKLQTVHSIPLTINKEEALQRP
NSCVKLQTVHSIPVTIYKDEAIQRP

SEQ ID NO: 43652 - protein, 25 aa, synthetic construct
  source 1..25: note = Seed: NSCVKLQTVHSIPLTINKEEALQRP
NSCVKLQTVHSIPVTIYKDEALQRP

SEQ ID NO: 43653 - protein, 25 aa, synthetic construct
  source 1..25: note = Seed: NSCVKLQTVHSIPLTINKEEALQRP
NSCVKLQTVHSIPVTIYKDEAMQRP

SEQ ID NO: 43654 - protein, 25 aa, synthetic construct
  source 1..25: note = Seed: NSCVKLQTVHSIPLTINKEEALQRP
NSCVKLQTVHSIPVTIYKDEAQQRP

SEQ ID NO: 43655 - protein, 25 aa, synthetic construct
  source 1..25: note = Seed: NSCVKLQTVHSIPLTINKEEALQRP
NSCVKLQTVHSIPVTIYKDEASQRP

SEQ ID NO: 43656 - protein, 25 aa, synthetic construct
  source 1..25: note = Seed: NSCVKLQTVHSIPLTINKEEALQRP
NSCVKLQTVHSIPVTIYKDEATQRP

SEQ ID NO: 43657 - protein, 25 aa, synthetic construct
  source 1..25: note = Seed: NSCVKLQTVHSIPLTINKEEALQRP
NSCVKLQTVHSIPVTIYKDEAVQRP

SEQ ID NO: 43658 - protein, 25 aa, synthetic construct
  source 1..25: note = Seed: NSCVKLQTVHSIPLTINKEEALQRP
NSCVKLQTVHSIPVTIYKDEAYQRP

SEQ ID NO: 43659 - protein, 25 aa, synthetic construct
  source 1..25: note = Seed: NSCVKLQTVHSIPLTINKEEALQRP
NSCVKLQTVHSIPVTIYKFEAFQRP

SEQ ID NO: 43660 - protein, 25 aa, synthetic construct
  source 1..25: note = Seed: NSCVKLQTVHSIPLTINKEEALQRP
NSCVKLQTVHSIPVTIYKFEAIQRP

SEQ ID NO: 43661 - protein, 25 aa, synthetic construct
  source 1..25: note = Seed: NSCVKLQTVHSIPLTINKEEALQRP
NSCVKLQTVHSIPVTIYKFEALQRP

SEQ ID NO: 43662 - protein, 25 aa, synthetic construct
  source 1..25: note = Seed: NSCVKLQTVHSIPLTINKEEALQRP
NSCVKLQTVHSIPVTIYKFEAMQRP

SEQ ID NO: 43663 - protein, 25 aa, synthetic construct
  source 1..25: note = Seed: NSCVKLQTVHSIPLTINKEEALQRP
NSCVKLQTVHSIPVTIYKFEAVQRP

SEQ ID NO: 43664 - protein, 25 aa, synthetic construct
  source 1..25: note = Seed: NSCVKLQTVHSIPLTINKEEALQRP
NSCVKLQTVHSIPVTIYKIEAAQRP

SEQ ID NO: 43665 - protein, 25 aa, synthetic construct
  source 1..25: note = Seed: NSCVKLQTVHSIPLTINKEEALQRP
NSCVKLQTVHSIPVTIYKIEACQRP

SEQ ID NO: 43666 - protein, 25 aa, synthetic construct
  source 1..25: note = Seed: NSCVKLQTVHSIPLTINKEEALQRP
NSCVKLQTVHSIPVTIYKIEAEQRP

SEQ ID NO: 43667 - protein, 25 aa, synthetic construct
  source 1..25: note = Seed: NSCVKLQTVHSIPLTINKEEALQRP
NSCVKLQTVHSIPVTIYKIEAFQRP

SEQ ID NO: 43668 - protein, 25 aa, synthetic construct
  source 1..25: note = Seed: NSCVKLQTVHSIPLTINKEEALQRP
NSCVKLQTVHSIPVTIYKIEAGQRP

SEQ ID NO: 43669 - protein, 25 aa, synthetic construct
  source 1..25: note = Seed: NSCVKLQTVHSIPLTINKEEALQRP
NSCVKLQTVHSIPVTIYKIEAHQRP

SEQ ID NO: 43670 - protein, 25 aa, synthetic construct
  source 1..25: note = Seed: NSCVKLQTVHSIPLTINKEEALQRP
NSCVKLQTVHSIPVTIYKIEAIQRP

SEQ ID NO: 43671 - protein, 25 aa, synthetic construct
  source 1..25: note = Seed: NSCVKLQTVHSIPLTINKEEALQRP
NSCVKLQTVHSIPVTIYKIEALQRP

SEQ ID NO: 43672 - protein, 25 aa, synthetic construct
  source 1..25: note = Seed: NSCVKLQTVHSIPLTINKEEALQRP
NSCVKLQTVHSIPVTIYKIEAMQRP

SEQ ID NO: 43673 - protein, 25 aa, synthetic construct
  source 1..25: note = Seed: NSCVKLQTVHSIPLTINKEEALQRP
NSCVKLQTVHSIPVTIYKIEANQRP

SEQ ID NO: 43674 - protein, 25 aa, synthetic construct
  source 1..25: note = Seed: NSCVKLQTVHSIPLTINKEEALQRP
NSCVKLQTVHSIPVTIYKIEAQQRP

SEQ ID NO: 43675 - protein, 25 aa, synthetic construct
  source 1..25: note = Seed: NSCVKLQTVHSIPLTINKEEALQRP
NSCVKLQTVHSIPVTIYKIEASQRP

SEQ ID NO: 43676 - protein, 25 aa, synthetic construct
  source 1..25: note = Seed: NSCVKLQTVHSIPLTINKEEALQRP
NSCVKLQTVHSIPVTIYKIEATQRP

SEQ ID NO: 43677 - protein, 25 aa, synthetic construct
  source 1..25: note = Seed: NSCVKLQTVHSIPLTINKEEALQRP
NSCVKLQTVHSIPVTIYKIEAVQRP

SEQ ID NO: 43678 - protein, 25 aa, synthetic construct
  source 1..25: note = Seed: NSCVKLQTVHSIPLTINKEEALQRP
NSCVKLQTVHSIPVTIYKIEAYQRP

SEQ ID NO: 43679 - protein, 25 aa, synthetic construct
  source 1..25: note = Seed: NSCVKLQTVHSIPLTINKEEALQRP
NSCVKLQTVHSIPVTIYKLEAAQRP

SEQ ID NO: 43680 - protein, 25 aa, synthetic construct
  source 1..25: note = Seed: NSCVKLQTVHSIPLTINKEEALQRP
NSCVKLQTVHSIPVTIYKLEAFQRP

SEQ ID NO: 43681 - protein, 25 aa, synthetic construct
  source 1..25: note = Seed: NSCVKLQTVHSIPLTINKEEALQRP
NSCVKLQTVHSIPVTIYKLEAIQRP

SEQ ID NO: 43682 - protein, 25 aa, synthetic construct
  source 1..25: note = Seed: NSCVKLQTVHSIPLTINKEEALQRP
NSCVKLQTVHSIPVTIYKLEALQRP

SEQ ID NO: 43683 - protein, 25 aa, synthetic construct
  source 1..25: note = Seed: NSCVKLQTVHSIPLTINKEEALQRP
NSCVKLQTVHSIPVTIYKLEAMQRP

SEQ ID NO: 43684 - protein, 25 aa, synthetic construct
  source 1..25: note = Seed: NSCVKLQTVHSIPLTINKEEALQRP
NSCVKLQTVHSIPVTIYKLEASQRP

SEQ ID NO: 43685 - protein, 25 aa, synthetic construct
  source 1..25: note = Seed: NSCVKLQTVHSIPLTINKEEALQRP
NSCVKLQTVHSIPVTIYKLEATQRP

SEQ ID NO: 43686 - protein, 25 aa, synthetic construct
  source 1..25: note = Seed: NSCVKLQTVHSIPLTINKEEALQRP
NSCVKLQTVHSIPVTIYKLEAVQRP

SEQ ID NO: 43687 - protein, 25 aa, synthetic construct
  source 1..25: note = Seed: NSCVKLQTVHSIPLTINKEEALQRP
NSCVKLQTVHSIPVTIYKLEAYQRP

SEQ ID NO: 43688 - protein, 25 aa, synthetic construct
  source 1..25: note = Seed: NSCVKLQTVHSIPLTINKEEALQRP
NSCVKLQTVHSIPVTIYKMEAAQRP

SEQ ID NO: 43689 - protein, 25 aa, synthetic construct
  source 1..25: note = Seed: NSCVKLQTVHSIPLTINKEEALQRP
NSCVKLQTVHSIPVTIYKMEAFQRP

SEQ ID NO: 43690 - protein, 25 aa, synthetic construct
  source 1..25: note = Seed: NSCVKLQTVHSIPLTINKEEALQRP
NSCVKLQTVHSIPVTIYKMEAIQRP

SEQ ID NO: 43691 - protein, 25 aa, synthetic construct
  source 1..25: note = Seed: NSCVKLQTVHSIPLTINKEEALQRP
NSCVKLQTVHSIPVTIYKMEALQRP

SEQ ID NO: 43692 - protein, 25 aa, synthetic construct
  source 1..25: note = Seed: NSCVKLQTVHSIPLTINKEEALQRP
NSCVKLQTVHSIPVTIYKMEAMQRP

SEQ ID NO: 43693 - protein, 25 aa, synthetic construct
  source 1..25: note = Seed: NSCVKLQTVHSIPLTINKEEALQRP
NSCVKLQTVHSIPVTIYKMEASQRP

SEQ ID NO: 43694 - protein, 25 aa, synthetic construct
  source 1..25: note = Seed: NSCVKLQTVHSIPLTINKEEALQRP
NSCVKLQTVHSIPVTIYKMEAVQRP

SEQ ID NO: 43695 - protein, 25 aa, synthetic construct
  source 1..25: note = Seed: NSCVKLQTVHSIPLTINKEEALQRP
NSCVKLQTVHSIPVTIYKNEAAQRP

SEQ ID NO: 43696 - protein, 25 aa, synthetic construct
  source 1..25: note = Seed: NSCVKLQTVHSIPLTINKEEALQRP
NSCVKLQTVHSIPVTIYKNEAFQRP

SEQ ID NO: 43697 - protein, 25 aa, synthetic construct
  source 1..25: note = Seed: NSCVKLQTVHSIPLTINKEEALQRP
NSCVKLQTVHSIPVTIYKNEAIQRP

SEQ ID NO: 43698 - protein, 25 aa, synthetic construct
  source 1..25: note = Seed: NSCVKLQTVHSIPLTINKEEALQRP
NSCVKLQTVHSIPVTIYKNEALQRP

SEQ ID NO: 43699 - protein, 25 aa, synthetic construct
  source 1..25: note = Seed: NSCVKLQTVHSIPLTINKEEALQRP
NSCVKLQTVHSIPVTIYKNEAMQRP

SEQ ID NO: 43700 - protein, 25 aa, synthetic construct
  source 1..25: note = Seed: NSCVKLQTVHSIPLTINKEEALQRP
NSCVKLQTVHSIPVTIYKNEAVQRP

SEQ ID NO: 43701 - protein, 25 aa, synthetic construct
  source 1..25: note = Seed: NSCVKLQTVHSIPLTINKEEALQRP
NSCVKLQTVHSIPVTIYKPEAIQRP

SEQ ID NO: 43702 - protein, 25 aa, synthetic construct
  source 1..25: note = Seed: NSCVKLQTVHSIPLTINKEEALQRP
NSCVKLQTVHSIPVTIYKSEAAQRP

SEQ ID NO: 43703 - protein, 25 aa, synthetic construct
  source 1..25: note = Seed: NSCVKLQTVHSIPLTINKEEALQRP
NSCVKLQTVHSIPVTIYKSEAFQRP

SEQ ID NO: 43704 - protein, 25 aa, synthetic construct
  source 1..25: note = Seed: NSCVKLQTVHSIPLTINKEEALQRP
NSCVKLQTVHSIPVTIYKSEAIQRP

SEQ ID NO: 43705 - protein, 25 aa, synthetic construct
  source 1..25: note = Seed: NSCVKLQTVHSIPLTINKEEALQRP
NSCVKLQTVHSIPVTIYKSEALQRP

SEQ ID NO: 43706 - protein, 25 aa, synthetic construct
  source 1..25: note = Seed: NSCVKLQTVHSIPLTINKEEALQRP
NSCVKLQTVHSIPVTIYKSEAVQRP

SEQ ID NO: 43707 - protein, 25 aa, synthetic construct
  source 1..25: note = Seed: NSCVKLQTVHSIPLTINKEEALQRP
NSCVKLQTVHSIPVTIYKTEAAQRP

SEQ ID NO: 43708 - protein, 25 aa, synthetic construct
  source 1..25: note = Seed: NSCVKLQTVHSIPLTINKEEALQRP
NSCVKLQTVHSIPVTIYKTEAIQRP

SEQ ID NO: 43709 - protein, 25 aa, synthetic construct
  source 1..25: note = Seed: NSCVKLQTVHSIPLTINKEEALQRP
NSCVKLQTVHSIPVTIYKTEALQRP

SEQ ID NO: 43710 - protein, 25 aa, synthetic construct
  source 1..25: note = Seed: NSCVKLQTVHSIPLTINKEEALQRP
NSCVKLQTVHSIPVTIYKTEAVQRP

SEQ ID NO: 43711 - protein, 25 aa, synthetic construct
  source 1..25: note = Seed: NSCVKLQTVHSIPLTINKEEALQRP
NSCVKLQTVHSIPVTIYKVEAAQRP

SEQ ID NO: 43712 - protein, 25 aa, synthetic construct
  source 1..25: note = Seed: NSCVKLQTVHSIPLTINKEEALQRP
NSCVKLQTVHSIPVTIYKVEAFQRP

SEQ ID NO: 43713 - protein, 25 aa, synthetic construct
  source 1..25: note = Seed: NSCVKLQTVHSIPLTINKEEALQRP
NSCVKLQTVHSIPVTIYKVEAGQRP

SEQ ID NO: 43714 - protein, 25 aa, synthetic construct
  source 1..25: note = Seed: NSCVKLQTVHSIPLTINKEEALQRP
NSCVKLQTVHSIPVTIYKVEAIQRP

SEQ ID NO: 43715 - protein, 25 aa, synthetic construct
  source 1..25: note = Seed: NSCVKLQTVHSIPLTINKEEALQRP
NSCVKLQTVHSIPVTIYKVEALQRP

SEQ ID NO: 43716 - protein, 25 aa, synthetic construct
  source 1..25: note = Seed: NSCVKLQTVHSIPLTINKEEALQRP
NSCVKLQTVHSIPVTIYKVEAMQRP

SEQ ID NO: 43717 - protein, 25 aa, synthetic construct
  source 1..25: note = Seed: NSCVKLQTVHSIPLTINKEEALQRP
NSCVKLQTVHSIPVTIYKVEAQQRP

SEQ ID NO: 43718 - protein, 25 aa, synthetic construct
  source 1..25: note = Seed: NSCVKLQTVHSIPLTINKEEALQRP
NSCVKLQTVHSIPVTIYKVEASQRP

SEQ ID NO: 43719 - protein, 25 aa, synthetic construct
  source 1..25: note = Seed: NSCVKLQTVHSIPLTINKEEALQRP
NSCVKLQTVHSIPVTIYKVEATQRP

SEQ ID NO: 43720 - protein, 25 aa, synthetic construct
  source 1..25: note = Seed: NSCVKLQTVHSIPLTINKEEALQRP
NSCVKLQTVHSIPVTIYKVEAVQRP

SEQ ID NO: 43721 - protein, 25 aa, synthetic construct
  source 1..25: note = Seed: NSCVKLQTVHSIPLTINKEEALQRP
NSCVKLQTVHSIPVTIYKVEAYQRP

SEQ ID NO: 43722 - protein, 25 aa, synthetic construct
  source 1..25: note = Seed: NSCVKLQTVHSIPLTINKEEALQRP
NSCVKLQTVHSIPWTIAKFEAAQRP

SEQ ID NO: 43723 - protein, 25 aa, synthetic construct
  source 1..25: note = Seed: NSCVKLQTVHSIPLTINKEEALQRP
NSCVKLQTVHSIPWTIAKFEAFQRP

SEQ ID NO: 43724 - protein, 25 aa, synthetic construct
  source 1..25: note = Seed: NSCVKLQTVHSIPLTINKEEALQRP
NSCVKLQTVHSIPWTIAKFEAIQRP

SEQ ID NO: 43725 - protein, 25 aa, synthetic construct
  source 1..25: note = Seed: NSCVKLQTVHSIPLTINKEEALQRP
NSCVKLQTVHSIPWTIAKFEALQRP

SEQ ID NO: 43726 - protein, 25 aa, synthetic construct
  source 1..25: note = Seed: NSCVKLQTVHSIPLTINKEEALQRP
NSCVKLQTVHSIPWTIAKFEAMQRP

SEQ ID NO: 43727 - protein, 25 aa, synthetic construct
  source 1..25: note = Seed: NSCVKLQTVHSIPLTINKEEALQRP
NSCVKLQTVHSIPWTIAKFEATQRP

SEQ ID NO: 43728 - protein, 25 aa, synthetic construct
  source 1..25: note = Seed: NSCVKLQTVHSIPLTINKEEALQRP
NSCVKLQTVHSIPWTIAKFEAVQRP

SEQ ID NO: 43729 - protein, 25 aa, synthetic construct
  source 1..25: note = Seed: NSCVKLQTVHSIPLTINKEEALQRP
NSCVKLQTVHSIPWTIAKFEAYQRP

SEQ ID NO: 43730 - protein, 25 aa, synthetic construct
  source 1..25: note = Seed: NSCVKLQTVHSIPLTINKEEALQRP
NSCVKLQTVHSIPWTIAKNEAAQRP

SEQ ID NO: 43731 - protein, 25 aa, synthetic construct
  source 1..25: note = Seed: NSCVKLQTVHSIPLTINKEEALQRP
NSCVKLQTVHSIPWTIAKYEALQRP

SEQ ID NO: 43732 - protein, 25 aa, synthetic construct
  source 1..25: note = Seed: NSCVKLQTVHSIPLTINKEEALQRP
NSCVKLQTVHSIPWTIDKFEAFQRP

SEQ ID NO: 43733 - protein, 25 aa, synthetic construct
  source 1..25: note = Seed: NSCVKLQTVHSIPLTINKEEALQRP
NSCVKLQTVHSIPWTIDKFEAIQRP

SEQ ID NO: 43734 - protein, 25 aa, synthetic construct
  source 1..25: note = Seed: NSCVKLQTVHSIPLTINKEEALQRP
NSCVKLQTVHSIPWTIDKFEALQRP

SEQ ID NO: 43735 - protein, 25 aa, synthetic construct
  source 1..25: note = Seed: NSCVKLQTVHSIPLTINKEEALQRP
NSCVKLQTVHSIPWTIDKFEAVQRP

SEQ ID NO: 43736 - protein, 25 aa, synthetic construct
  source 1..25: note = Seed: NSCVKLQTVHSIPLTINKEEALQRP
NSCVKLQTVHSIPWTIEKFEAFQRP

SEQ ID NO: 43737 - protein, 25 aa, synthetic construct
  source 1..25: note = Seed: NSCVKLQTVHSIPLTINKEEALQRP
NSCVKLQTVHSIPWTIEKFEAIQRP

SEQ ID NO: 43738 - protein, 25 aa, synthetic construct
  source 1..25: note = Seed: NSCVKLQTVHSIPLTINKEEALQRP
NSCVKLQTVHSIPWTIEKFEALQRP

SEQ ID NO: 43739 - protein, 25 aa, synthetic construct
  source 1..25: note = Seed: NSCVKLQTVHSIPLTINKEEALQRP
NSCVKLQTVHSIPWTIEKFEAMQRP

SEQ ID NO: 43740 - protein, 25 aa, synthetic construct
  source 1..25: note = Seed: NSCVKLQTVHSIPLTINKEEALQRP
NSCVKLQTVHSIPWTIEKFEAVQRP

SEQ ID NO: 43741 - protein, 25 aa, synthetic construct
  source 1..25: note = Seed: NSCVKLQTVHSIPLTINKEEALQRP
NSCVKLQTVHSIPWTIEKFEAYQRP

SEQ ID NO: 43742 - protein, 25 aa, synthetic construct
  source 1..25: note = Seed: NSCVKLQTVHSIPLTINKEEALQRP
NSCVKLQTVHSIPWTIFKAEAFQRP

SEQ ID NO: 43743 - protein, 25 aa, synthetic construct
  source 1..25: note = Seed: NSCVKLQTVHSIPLTINKEEALQRP
NSCVKLQTVHSIPWTIFKAEAIQRP

SEQ ID NO: 43744 - protein, 25 aa, synthetic construct
  source 1..25: note = Seed: NSCVKLQTVHSIPLTINKEEALQRP
NSCVKLQTVHSIPWTIFKAEALQRP

SEQ ID NO: 43745 - protein, 25 aa, synthetic construct
  source 1..25: note = Seed: NSCVKLQTVHSIPLTINKEEALQRP
NSCVKLQTVHSIPWTIFKAEAVQRP

SEQ ID NO: 43746 - protein, 25 aa, synthetic construct
  source 1..25: note = Seed: NSCVKLQTVHSIPLTINKEEALQRP
NSCVKLQTVHSIPWTIFKDEAIQRP

SEQ ID NO: 43747 - protein, 25 aa, synthetic construct
  source 1..25: note = Seed: NSCVKLQTVHSIPLTINKEEALQRP
NSCVKLQTVHSIPWTIFKDEALQRP

SEQ ID NO: 43748 - protein, 25 aa, synthetic construct
  source 1..25: note = Seed: NSCVKLQTVHSIPLTINKEEALQRP
NSCVKLQTVHSIPWTIFKDEAVQRP

SEQ ID NO: 43749 - protein, 25 aa, synthetic construct
  source 1..25: note = Seed: NSCVKLQTVHSIPLTINKEEALQRP
NSCVKLQTVHSIPWTIFKFEAAQRP

SEQ ID NO: 43750 - protein, 25 aa, synthetic construct
  source 1..25: note = Seed: NSCVKLQTVHSIPLTINKEEALQRP
NSCVKLQTVHSIPWTIFKFEACQRP

SEQ ID NO: 43751 - protein, 25 aa, synthetic construct
  source 1..25: note = Seed: NSCVKLQTVHSIPLTINKEEALQRP
NSCVKLQTVHSIPWTIFKFEADQRP

SEQ ID NO: 43752 - protein, 25 aa, synthetic construct
  source 1..25: note = Seed: NSCVKLQTVHSIPLTINKEEALQRP
NSCVKLQTVHSIPWTIFKFEAEQRP

SEQ ID NO: 43753 - protein, 25 aa, synthetic construct
  source 1..25: note = Seed: NSCVKLQTVHSIPLTINKEEALQRP
NSCVKLQTVHSIPWTIFKFEAFQRP

SEQ ID NO: 43754 - protein, 25 aa, synthetic construct
  source 1..25: note = Seed: NSCVKLQTVHSIPLTINKEEALQRP
NSCVKLQTVHSIPWTIFKFEAHQRP

SEQ ID NO: 43755 - protein, 25 aa, synthetic construct
  source 1..25: note = Seed: NSCVKLQTVHSIPLTINKEEALQRP
NSCVKLQTVHSIPWTIFKFEAIQRP

SEQ ID NO: 43756 - protein, 25 aa, synthetic construct
  source 1..25: note = Seed: NSCVKLQTVHSIPLTINKEEALQRP
NSCVKLQTVHSIPWTIFKFEAKQRP

SEQ ID NO: 43757 - protein, 25 aa, synthetic construct
  source 1..25: note = Seed: NSCVKLQTVHSIPLTINKEEALQRP
NSCVKLQTVHSIPWTIFKFEALQRP

SEQ ID NO: 43758 - protein, 25 aa, synthetic construct
  source 1..25: note = Seed: NSCVKLQTVHSIPLTINKEEALQRP
NSCVKLQTVHSIPWTIFKFEAMQRP

SEQ ID NO: 43759 - protein, 25 aa, synthetic construct
  source 1..25: note = Seed: NSCVKLQTVHSIPLTINKEEALQRP
NSCVKLQTVHSIPWTIFKFEANQRP

SEQ ID NO: 43760 - protein, 25 aa, synthetic construct
  source 1..25: note = Seed: NSCVKLQTVHSIPLTINKEEALQRP
NSCVKLQTVHSIPWTIFKFEAPQRP

SEQ ID NO: 43761 - protein, 25 aa, synthetic construct
  source 1..25: note = Seed: NSCVKLQTVHSIPLTINKEEALQRP
NSCVKLQTVHSIPWTIFKFEAQQRP

SEQ ID NO: 43762 - protein, 25 aa, synthetic construct
  source 1..25: note = Seed: NSCVKLQTVHSIPLTINKEEALQRP
NSCVKLQTVHSIPWTIFKFEARQRP

SEQ ID NO: 43763 - protein, 25 aa, synthetic construct
  source 1..25: note = Seed: NSCVKLQTVHSIPLTINKEEALQRP
NSCVKLQTVHSIPWTIFKFEASQRP

SEQ ID NO: 43764 - protein, 25 aa, synthetic construct
  source 1..25: note = Seed: NSCVKLQTVHSIPLTINKEEALQRP
NSCVKLQTVHSIPWTIFKFEATQRP

SEQ ID NO: 43765 - protein, 25 aa, synthetic construct
  source 1..25: note = Seed: NSCVKLQTVHSIPLTINKEEALQRP
NSCVKLQTVHSIPWTIFKFEAVQRP

SEQ ID NO: 43766 - protein, 25 aa, synthetic construct
  source 1..25: note = Seed: NSCVKLQTVHSIPLTINKEEALQRP
NSCVKLQTVHSIPWTIFKFEAWQRP

SEQ ID NO: 43767 - protein, 25 aa, synthetic construct
  source 1..25: note = Seed: NSCVKLQTVHSIPLTINKEEALQRP
NSCVKLQTVHSIPWTIFKFEAYQRP

SEQ ID NO: 43768 - protein, 25 aa, synthetic construct
  source 1..25: note = Seed: NSCVKLQTVHSIPLTINKEEALQRP
NSCVKLQTVHSIPWTIFKIEAAQRP

SEQ ID NO: 43769 - protein, 25 aa, synthetic construct
  source 1..25: note = Seed: NSCVKLQTVHSIPLTINKEEALQRP
NSCVKLQTVHSIPWTIFKIEAFQRP

SEQ ID NO: 43770 - protein, 25 aa, synthetic construct
  source 1..25: note = Seed: NSCVKLQTVHSIPLTINKEEALQRP
NSCVKLQTVHSIPWTIFKIEAIQRP

SEQ ID NO: 43771 - protein, 25 aa, synthetic construct
  source 1..25: note = Seed: NSCVKLQTVHSIPLTINKEEALQRP
NSCVKLQTVHSIPWTIFKIEALQRP

SEQ ID NO: 43772 - protein, 25 aa, synthetic construct
  source 1..25: note = Seed: NSCVKLQTVHSIPLTINKEEALQRP
NSCVKLQTVHSIPWTIFKIEAMQRP

SEQ ID NO: 43773 - protein, 25 aa, synthetic construct
  source 1..25: note = Seed: NSCVKLQTVHSIPLTINKEEALQRP
NSCVKLQTVHSIPWTIFKIEARQRP

SEQ ID NO: 43774 - protein, 25 aa, synthetic construct
  source 1..25: note = Seed: NSCVKLQTVHSIPLTINKEEALQRP
NSCVKLQTVHSIPWTIFKIEAVQRP

SEQ ID NO: 43775 - protein, 25 aa, synthetic construct
  source 1..25: note = Seed: NSCVKLQTVHSIPLTINKEEALQRP
NSCVKLQTVHSIPWTIFKIEAYQRP

SEQ ID NO: 43776 - protein, 25 aa, synthetic construct
  source 1..25: note = Seed: NSCVKLQTVHSIPLTINKEEALQRP
NSCVKLQTVHSIPWTIFKLEAAQRP

SEQ ID NO: 43777 - protein, 25 aa, synthetic construct
  source 1..25: note = Seed: NSCVKLQTVHSIPLTINKEEALQRP
NSCVKLQTVHSIPWTIFKLEAFQRP

SEQ ID NO: 43778 - protein, 25 aa, synthetic construct
  source 1..25: note = Seed: NSCVKLQTVHSIPLTINKEEALQRP
NSCVKLQTVHSIPWTIFKLEAIQRP

SEQ ID NO: 43779 - protein, 25 aa, synthetic construct
  source 1..25: note = Seed: NSCVKLQTVHSIPLTINKEEALQRP
NSCVKLQTVHSIPWTIFKLEALQRP

SEQ ID NO: 43780 - protein, 25 aa, synthetic construct
  source 1..25: note = Seed: NSCVKLQTVHSIPLTINKEEALQRP
NSCVKLQTVHSIPWTIFKLEAMQRP

SEQ ID NO: 43781 - protein, 25 aa, synthetic construct
  source 1..25: note = Seed: NSCVKLQTVHSIPLTINKEEALQRP
NSCVKLQTVHSIPWTIFKLEARQRP

SEQ ID NO: 43782 - protein, 25 aa, synthetic construct
  source 1..25: note = Seed: NSCVKLQTVHSIPLTINKEEALQRP
NSCVKLQTVHSIPWTIFKLEAVQRP

SEQ ID NO: 43783 - protein, 25 aa, synthetic construct
  source 1..25: note = Seed: NSCVKLQTVHSIPLTINKEEALQRP
NSCVKLQTVHSIPWTIFKLEAYQRP

SEQ ID NO: 43784 - protein, 25 aa, synthetic construct
  source 1..25: note = Seed: NSCVKLQTVHSIPLTINKEEALQRP
NSCVKLQTVHSIPWTIFKMEAFQRP

SEQ ID NO: 43785 - protein, 25 aa, synthetic construct
  source 1..25: note = Seed: NSCVKLQTVHSIPLTINKEEALQRP
NSCVKLQTVHSIPWTIFKMEAIQRP

SEQ ID NO: 43786 - protein, 25 aa, synthetic construct
  source 1..25: note = Seed: NSCVKLQTVHSIPLTINKEEALQRP
NSCVKLQTVHSIPWTIFKMEALQRP

SEQ ID NO: 43787 - protein, 25 aa, synthetic construct
  source 1..25: note = Seed: NSCVKLQTVHSIPLTINKEEALQRP
NSCVKLQTVHSIPWTIFKMEAMQRP

SEQ ID NO: 43788 - protein, 25 aa, synthetic construct
  source 1..25: note = Seed: NSCVKLQTVHSIPLTINKEEALQRP
NSCVKLQTVHSIPWTIFKMEAVQRP

SEQ ID NO: 43789 - protein, 25 aa, synthetic construct
  source 1..25: note = Seed: NSCVKLQTVHSIPLTINKEEALQRP
NSCVKLQTVHSIPWTIFKMEAYQRP

SEQ ID NO: 43790 - protein, 25 aa, synthetic construct
  source 1..25: note = Seed: NSCVKLQTVHSIPLTINKEEALQRP
NSCVKLQTVHSIPWTIFKSEAFQRP

SEQ ID NO: 43791 - protein, 25 aa, synthetic construct
  source 1..25: note = Seed: NSCVKLQTVHSIPLTINKEEALQRP
NSCVKLQTVHSIPWTIFKTEAFQRP

SEQ ID NO: 43792 - protein, 25 aa, synthetic construct
  source 1..25: note = Seed: NSCVKLQTVHSIPLTINKEEALQRP
NSCVKLQTVHSIPWTIFKVEAAQRP

SEQ ID NO: 43793 - protein, 25 aa, synthetic construct
  source 1..25: note = Seed: NSCVKLQTVHSIPLTINKEEALQRP
NSCVKLQTVHSIPWTIFKVEAFQRP

SEQ ID NO: 43794 - protein, 25 aa, synthetic construct
  source 1..25: note = Seed: NSCVKLQTVHSIPLTINKEEALQRP
NSCVKLQTVHSIPWTIFKVEAIQRP

SEQ ID NO: 43795 - protein, 25 aa, synthetic construct
  source 1..25: note = Seed: NSCVKLQTVHSIPLTINKEEALQRP
NSCVKLQTVHSIPWTIFKVEALQRP

SEQ ID NO: 43796 - protein, 25 aa, synthetic construct
  source 1..25: note = Seed: NSCVKLQTVHSIPLTINKEEALQRP
NSCVKLQTVHSIPWTIFKVEAYQRP

SEQ ID NO: 43797 - protein, 25 aa, synthetic construct
  source 1..25: note = Seed: NSCVKLQTVHSIPLTINKEEALQRP
NSCVKLQTVHSIPWTIFKWEAFQRP

SEQ ID NO: 43798 - protein, 25 aa, synthetic construct
  source 1..25: note = Seed: NSCVKLQTVHSIPLTINKEEALQRP
NSCVKLQTVHSIPWTIFKWEAIQRP

SEQ ID NO: 43799 - protein, 25 aa, synthetic construct
  source 1..25: note = Seed: NSCVKLQTVHSIPLTINKEEALQRP
NSCVKLQTVHSIPWTIFKWEALQRP

SEQ ID NO: 43800 - protein, 25 aa, synthetic construct
  source 1..25: note = Seed: NSCVKLQTVHSIPLTINKEEALQRP
NSCVKLQTVHSIPWTIFKWEAMQRP

SEQ ID NO: 43801 - protein, 25 aa, synthetic construct
  source 1..25: note = Seed: NSCVKLQTVHSIPLTINKEEALQRP
NSCVKLQTVHSIPWTIFKWEAVQRP

SEQ ID NO: 43802 - protein, 25 aa, synthetic construct
  source 1..25: note = Seed: NSCVKLQTVHSIPLTINKEEALQRP
NSCVKLQTVHSIPWTIFKWEAYQRP

SEQ ID NO: 43803 - protein, 25 aa, synthetic construct
  source 1..25: note = Seed: NSCVKLQTVHSIPLTINKEEALQRP
NSCVKLQTVHSIPWTIFKYEAAQRP

SEQ ID NO: 43804 - protein, 25 aa, synthetic construct
  source 1..25: note = Seed: NSCVKLQTVHSIPLTINKEEALQRP
NSCVKLQTVHSIPWTIFKYEAFQRP

SEQ ID NO: 43805 - protein, 25 aa, synthetic construct
  source 1..25: note = Seed: NSCVKLQTVHSIPLTINKEEALQRP
NSCVKLQTVHSIPWTIFKYEAIQRP

SEQ ID NO: 43806 - protein, 25 aa, synthetic construct
  source 1..25: note = Seed: NSCVKLQTVHSIPLTINKEEALQRP
NSCVKLQTVHSIPWTIFKYEALQRP

SEQ ID NO: 43807 - protein, 25 aa, synthetic construct
  source 1..25: note = Seed: NSCVKLQTVHSIPLTINKEEALQRP
NSCVKLQTVHSIPWTIFKYEAMQRP

SEQ ID NO: 43808 - protein, 25 aa, synthetic construct
  source 1..25: note = Seed: NSCVKLQTVHSIPLTINKEEALQRP
NSCVKLQTVHSIPWTIFKYEASQRP

SEQ ID NO: 43809 - protein, 25 aa, synthetic construct
  source 1..25: note = Seed: NSCVKLQTVHSIPLTINKEEALQRP
NSCVKLQTVHSIPWTIFKYEATQRP

SEQ ID NO: 43810 - protein, 25 aa, synthetic construct
  source 1..25: note = Seed: NSCVKLQTVHSIPLTINKEEALQRP
NSCVKLQTVHSIPWTIFKYEAVQRP

SEQ ID NO: 43811 - protein, 25 aa, synthetic construct
  source 1..25: note = Seed: NSCVKLQTVHSIPLTINKEEALQRP
NSCVKLQTVHSIPWTIFKYEAWQRP

SEQ ID NO: 43812 - protein, 25 aa, synthetic construct
  source 1..25: note = Seed: NSCVKLQTVHSIPLTINKEEALQRP
NSCVKLQTVHSIPWTIFKYEAYQRP

SEQ ID NO: 43813 - protein, 25 aa, synthetic construct
  source 1..25: note = Seed: NSCVKLQTVHSIPLTINKEEALQRP
NSCVKLQTVHSIPWTIHKFEAAQRP

SEQ ID NO: 43814 - protein, 25 aa, synthetic construct
  source 1..25: note = Seed: NSCVKLQTVHSIPLTINKEEALQRP
NSCVKLQTVHSIPWTIHKFEAFQRP

SEQ ID NO: 43815 - protein, 25 aa, synthetic construct
  source 1..25: note = Seed: NSCVKLQTVHSIPLTINKEEALQRP
NSCVKLQTVHSIPWTIHKFEAIQRP

SEQ ID NO: 43816 - protein, 25 aa, synthetic construct
  source 1..25: note = Seed: NSCVKLQTVHSIPLTINKEEALQRP
NSCVKLQTVHSIPWTIHKFEALQRP

SEQ ID NO: 43817 - protein, 25 aa, synthetic construct
  source 1..25: note = Seed: NSCVKLQTVHSIPLTINKEEALQRP
NSCVKLQTVHSIPWTIHKFEAMQRP

SEQ ID NO: 43818 - protein, 25 aa, synthetic construct
  source 1..25: note = Seed: NSCVKLQTVHSIPLTINKEEALQRP
NSCVKLQTVHSIPWTIHKFEATQRP

SEQ ID NO: 43819 - protein, 25 aa, synthetic construct
  source 1..25: note = Seed: NSCVKLQTVHSIPLTINKEEALQRP
NSCVKLQTVHSIPWTIHKFEAVQRP

SEQ ID NO: 43820 - protein, 25 aa, synthetic construct
  source 1..25: note = Seed: NSCVKLQTVHSIPLTINKEEALQRP
NSCVKLQTVHSIPWTIHKFEAYQRP

SEQ ID NO: 43821 - protein, 25 aa, synthetic construct
  source 1..25: note = Seed: NSCVKLQTVHSIPLTINKEEALQRP
NSCVKLQTVHSIPWTIIKAEAFQRP

SEQ ID NO: 43822 - protein, 25 aa, synthetic construct
  source 1..25: note = Seed: NSCVKLQTVHSIPLTINKEEALQRP
NSCVKLQTVHSIPWTIIKFEAAQRP

SEQ ID NO: 43823 - protein, 25 aa, synthetic construct
  source 1..25: note = Seed: NSCVKLQTVHSIPLTINKEEALQRP
NSCVKLQTVHSIPWTIIKFEACQRP

SEQ ID NO: 43824 - protein, 25 aa, synthetic construct
  source 1..25: note = Seed: NSCVKLQTVHSIPLTINKEEALQRP
NSCVKLQTVHSIPWTIIKFEADQRP

SEQ ID NO: 43825 - protein, 25 aa, synthetic construct
  source 1..25: note = Seed: NSCVKLQTVHSIPLTINKEEALQRP
NSCVKLQTVHSIPWTIIKFEAEQRP

SEQ ID NO: 43826 - protein, 25 aa, synthetic construct
  source 1..25: note = Seed: NSCVKLQTVHSIPLTINKEEALQRP
NSCVKLQTVHSIPWTIIKFEAFQRP

SEQ ID NO: 43827 - protein, 25 aa, synthetic construct
  source 1..25: note = Seed: NSCVKLQTVHSIPLTINKEEALQRP
NSCVKLQTVHSIPWTIIKFEAGQRP

SEQ ID NO: 43828 - protein, 25 aa, synthetic construct
  source 1..25: note = Seed: NSCVKLQTVHSIPLTINKEEALQRP
NSCVKLQTVHSIPWTIIKFEAHQRP

SEQ ID NO: 43829 - protein, 25 aa, synthetic construct
  source 1..25: note = Seed: NSCVKLQTVHSIPLTINKEEALQRP
NSCVKLQTVHSIPWTIIKFEAIQRP

SEQ ID NO: 43830 - protein, 25 aa, synthetic construct
  source 1..25: note = Seed: NSCVKLQTVHSIPLTINKEEALQRP
NSCVKLQTVHSIPWTIIKFEALQRP

SEQ ID NO: 43831 - protein, 25 aa, synthetic construct
  source 1..25: note = Seed: NSCVKLQTVHSIPLTINKEEALQRP
NSCVKLQTVHSIPWTIIKFEAMQRP

SEQ ID NO: 43832 - protein, 25 aa, synthetic construct
  source 1..25: note = Seed: NSCVKLQTVHSIPLTINKEEALQRP
NSCVKLQTVHSIPWTIIKFEANQRP

SEQ ID NO: 43833 - protein, 25 aa, synthetic construct
  source 1..25: note = Seed: NSCVKLQTVHSIPLTINKEEALQRP
NSCVKLQTVHSIPWTIIKFEAPQRP

SEQ ID NO: 43834 - protein, 25 aa, synthetic construct
  source 1..25: note = Seed: NSCVKLQTVHSIPLTINKEEALQRP
NSCVKLQTVHSIPWTIIKFEAQQRP

SEQ ID NO: 43835 - protein, 25 aa, synthetic construct
  source 1..25: note = Seed: NSCVKLQTVHSIPLTINKEEALQRP
NSCVKLQTVHSIPWTIIKFEARQRP

SEQ ID NO: 43836 - protein, 25 aa, synthetic construct
  source 1..25: note = Seed: NSCVKLQTVHSIPLTINKEEALQRP
NSCVKLQTVHSIPWTIIKFEASQRP

SEQ ID NO: 43837 - protein, 25 aa, synthetic construct
  source 1..25: note = Seed: NSCVKLQTVHSIPLTINKEEALQRP
NSCVKLQTVHSIPWTIIKFEATQRP

SEQ ID NO: 43838 - protein, 25 aa, synthetic construct
  source 1..25: note = Seed: NSCVKLQTVHSIPLTINKEEALQRP
NSCVKLQTVHSIPWTIIKFEAVQRP

SEQ ID NO: 43839 - protein, 25 aa, synthetic construct
  source 1..25: note = Seed: NSCVKLQTVHSIPLTINKEEALQRP
NSCVKLQTVHSIPWTIIKFEAWQRP

SEQ ID NO: 43840 - protein, 25 aa, synthetic construct
  source 1..25: note = Seed: NSCVKLQTVHSIPLTINKEEALQRP
NSCVKLQTVHSIPWTIIKFEAYQRP

SEQ ID NO: 43841 - protein, 25 aa, synthetic construct
  source 1..25: note = Seed: NSCVKLQTVHSIPLTINKEEALQRP
NSCVKLQTVHSIPWTIIKIEAFQRP

SEQ ID NO: 43842 - protein, 25 aa, synthetic construct
  source 1..25: note = Seed: NSCVKLQTVHSIPLTINKEEALQRP
NSCVKLQTVHSIPWTIIKIEAIQRP

SEQ ID NO: 43843 - protein, 25 aa, synthetic construct
  source 1..25: note = Seed: NSCVKLQTVHSIPLTINKEEALQRP
NSCVKLQTVHSIPWTIIKIEALQRP

SEQ ID NO: 43844 - protein, 25 aa, synthetic construct
  source 1..25: note = Seed: NSCVKLQTVHSIPLTINKEEALQRP
NSCVKLQTVHSIPWTIIKIEAVQRP

SEQ ID NO: 43845 - protein, 25 aa, synthetic construct
  source 1..25: note = Seed: NSCVKLQTVHSIPLTINKEEALQRP
NSCVKLQTVHSIPWTIIKLEAFQRP

SEQ ID NO: 43846 - protein, 25 aa, synthetic construct
  source 1..25: note = Seed: NSCVKLQTVHSIPLTINKEEALQRP
NSCVKLQTVHSIPWTIIKLEAIQRP

SEQ ID NO: 43847 - protein, 25 aa, synthetic construct
  source 1..25: note = Seed: NSCVKLQTVHSIPLTINKEEALQRP
NSCVKLQTVHSIPWTIIKLEALQRP

SEQ ID NO: 43848 - protein, 25 aa, synthetic construct
  source 1..25: note = Seed: NSCVKLQTVHSIPLTINKEEALQRP
NSCVKLQTVHSIPWTIIKLEAMQRP

SEQ ID NO: 43849 - protein, 25 aa, synthetic construct
  source 1..25: note = Seed: NSCVKLQTVHSIPLTINKEEALQRP
NSCVKLQTVHSIPWTIIKLEAVQRP

SEQ ID NO: 43850 - protein, 25 aa, synthetic construct
  source 1..25: note = Seed: NSCVKLQTVHSIPLTINKEEALQRP
NSCVKLQTVHSIPWTIIKLEAYQRP

SEQ ID NO: 43851 - protein, 25 aa, synthetic construct
  source 1..25: note = Seed: NSCVKLQTVHSIPLTINKEEALQRP
NSCVKLQTVHSIPWTIIKMEAFQRP

SEQ ID NO: 43852 - protein, 25 aa, synthetic construct
  source 1..25: note = Seed: NSCVKLQTVHSIPLTINKEEALQRP
NSCVKLQTVHSIPWTIIKMEALQRP

SEQ ID NO: 43853 - protein, 25 aa, synthetic construct
  source 1..25: note = Seed: NSCVKLQTVHSIPLTINKEEALQRP
NSCVKLQTVHSIPWTIIKNEAAQRP

SEQ ID NO: 43854 - protein, 25 aa, synthetic construct
  source 1..25: note = Seed: NSCVKLQTVHSIPLTINKEEALQRP
NSCVKLQTVHSIPWTIIKTEAAQRP

SEQ ID NO: 43855 - protein, 25 aa, synthetic construct
  source 1..25: note = Seed: NSCVKLQTVHSIPLTINKEEALQRP
NSCVKLQTVHSIPWTIIKVEAFQRP

SEQ ID NO: 43856 - protein, 25 aa, synthetic construct
  source 1..25: note = Seed: NSCVKLQTVHSIPLTINKEEALQRP
NSCVKLQTVHSIPWTIIKVEALQRP

SEQ ID NO: 43857 - protein, 25 aa, synthetic construct
  source 1..25: note = Seed: NSCVKLQTVHSIPLTINKEEALQRP
NSCVKLQTVHSIPWTIIKWEAFQRP

SEQ ID NO: 43858 - protein, 25 aa, synthetic construct
  source 1..25: note = Seed: NSCVKLQTVHSIPLTINKEEALQRP
NSCVKLQTVHSIPWTIIKWEAIQRP

SEQ ID NO: 43859 - protein, 25 aa, synthetic construct
  source 1..25: note = Seed: NSCVKLQTVHSIPLTINKEEALQRP
NSCVKLQTVHSIPWTIIKWEALQRP

SEQ ID NO: 43860 - protein, 25 aa, synthetic construct
  source 1..25: note = Seed: NSCVKLQTVHSIPLTINKEEALQRP
NSCVKLQTVHSIPWTIIKWEAMQRP

SEQ ID NO: 43861 - protein, 25 aa, synthetic construct
  source 1..25: note = Seed: NSCVKLQTVHSIPLTINKEEALQRP
NSCVKLQTVHSIPWTIIKWEAVQRP

SEQ ID NO: 43862 - protein, 25 aa, synthetic construct
  source 1..25: note = Seed: NSCVKLQTVHSIPLTINKEEALQRP
NSCVKLQTVHSIPWTIIKWEAYQRP

SEQ ID NO: 43863 - protein, 25 aa, synthetic construct
  source 1..25: note = Seed: NSCVKLQTVHSIPLTINKEEALQRP
NSCVKLQTVHSIPWTIIKYEAAQRP

SEQ ID NO: 43864 - protein, 25 aa, synthetic construct
  source 1..25: note = Seed: NSCVKLQTVHSIPLTINKEEALQRP
NSCVKLQTVHSIPWTIIKYEAFQRP

SEQ ID NO: 43865 - protein, 25 aa, synthetic construct
  source 1..25: note = Seed: NSCVKLQTVHSIPLTINKEEALQRP
NSCVKLQTVHSIPWTIIKYEAIQRP

SEQ ID NO: 43866 - protein, 25 aa, synthetic construct
  source 1..25: note = Seed: NSCVKLQTVHSIPLTINKEEALQRP
NSCVKLQTVHSIPWTIIKYEALQRP

SEQ ID NO: 43867 - protein, 25 aa, synthetic construct
  source 1..25: note = Seed: NSCVKLQTVHSIPLTINKEEALQRP
NSCVKLQTVHSIPWTIIKYEAMQRP

SEQ ID NO: 43868 - protein, 25 aa, synthetic construct
  source 1..25: note = Seed: NSCVKLQTVHSIPLTINKEEALQRP
NSCVKLQTVHSIPWTIIKYEATQRP

SEQ ID NO: 43869 - protein, 25 aa, synthetic construct
  source 1..25: note = Seed: NSCVKLQTVHSIPLTINKEEALQRP
NSCVKLQTVHSIPWTIIKYEAVQRP

SEQ ID NO: 43870 - protein, 25 aa, synthetic construct
  source 1..25: note = Seed: NSCVKLQTVHSIPLTINKEEALQRP
NSCVKLQTVHSIPWTIIKYEAYQRP

SEQ ID NO: 43871 - protein, 25 aa, synthetic construct
  source 1..25: note = Seed: NSCVKLQTVHSIPLTINKEEALQRP
NSCVKLQTVHSIPWTIKKFEAIQRP

SEQ ID NO: 43872 - protein, 25 aa, synthetic construct
  source 1..25: note = Seed: NSCVKLQTVHSIPLTINKEEALQRP
NSCVKLQTVHSIPWTIKKFEALQRP

SEQ ID NO: 43873 - protein, 25 aa, synthetic construct
  source 1..25: note = Seed: NSCVKLQTVHSIPLTINKEEALQRP
NSCVKLQTVHSIPWTIKKFEAVQRP

SEQ ID NO: 43874 - protein, 25 aa, synthetic construct
  source 1..25: note = Seed: NSCVKLQTVHSIPLTINKEEALQRP
NSCVKLQTVHSIPWTILKAEAFQRP

SEQ ID NO: 43875 - protein, 25 aa, synthetic construct
  source 1..25: note = Seed: NSCVKLQTVHSIPLTINKEEALQRP
NSCVKLQTVHSIPWTILKFEAAQRP

SEQ ID NO: 43876 - protein, 25 aa, synthetic construct
  source 1..25: note = Seed: NSCVKLQTVHSIPLTINKEEALQRP
NSCVKLQTVHSIPWTILKFEACQRP

SEQ ID NO: 43877 - protein, 25 aa, synthetic construct
  source 1..25: note = Seed: NSCVKLQTVHSIPLTINKEEALQRP
NSCVKLQTVHSIPWTILKFEADQRP

SEQ ID NO: 43878 - protein, 25 aa, synthetic construct
  source 1..25: note = Seed: NSCVKLQTVHSIPLTINKEEALQRP
NSCVKLQTVHSIPWTILKFEAEQRP

SEQ ID NO: 43879 - protein, 25 aa, synthetic construct
  source 1..25: note = Seed: NSCVKLQTVHSIPLTINKEEALQRP
NSCVKLQTVHSIPWTILKFEAFQRP

SEQ ID NO: 43880 - protein, 25 aa, synthetic construct
  source 1..25: note = Seed: NSCVKLQTVHSIPLTINKEEALQRP
NSCVKLQTVHSIPWTILKFEAGQRP

SEQ ID NO: 43881 - protein, 25 aa, synthetic construct
  source 1..25: note = Seed: NSCVKLQTVHSIPLTINKEEALQRP
NSCVKLQTVHSIPWTILKFEAHQRP

SEQ ID NO: 43882 - protein, 25 aa, synthetic construct
  source 1..25: note = Seed: NSCVKLQTVHSIPLTINKEEALQRP
NSCVKLQTVHSIPWTILKFEAIQRP

SEQ ID NO: 43883 - protein, 25 aa, synthetic construct
  source 1..25: note = Seed: NSCVKLQTVHSIPLTINKEEALQRP
NSCVKLQTVHSIPWTILKFEALQRP

SEQ ID NO: 43884 - protein, 25 aa, synthetic construct
  source 1..25: note = Seed: NSCVKLQTVHSIPLTINKEEALQRP
NSCVKLQTVHSIPWTILKFEAMQRP

SEQ ID NO: 43885 - protein, 25 aa, synthetic construct
  source 1..25: note = Seed: NSCVKLQTVHSIPLTINKEEALQRP
NSCVKLQTVHSIPWTILKFEANQRP

SEQ ID NO: 43886 - protein, 25 aa, synthetic construct
  source 1..25: note = Seed: NSCVKLQTVHSIPLTINKEEALQRP
NSCVKLQTVHSIPWTILKFEAPQRP

SEQ ID NO: 43887 - protein, 25 aa, synthetic construct
  source 1..25: note = Seed: NSCVKLQTVHSIPLTINKEEALQRP
NSCVKLQTVHSIPWTILKFEAQQRP

SEQ ID NO: 43888 - protein, 25 aa, synthetic construct
  source 1..25: note = Seed: NSCVKLQTVHSIPLTINKEEALQRP
NSCVKLQTVHSIPWTILKFEARQRP

SEQ ID NO: 43889 - protein, 25 aa, synthetic construct
  source 1..25: note = Seed: NSCVKLQTVHSIPLTINKEEALQRP
NSCVKLQTVHSIPWTILKFEASQRP

SEQ ID NO: 43890 - protein, 25 aa, synthetic construct
  source 1..25: note = Seed: NSCVKLQTVHSIPLTINKEEALQRP
NSCVKLQTVHSIPWTILKFEATQRP

SEQ ID NO: 43891 - protein, 25 aa, synthetic construct
  source 1..25: note = Seed: NSCVKLQTVHSIPLTINKEEALQRP
NSCVKLQTVHSIPWTILKFEAVQRP

SEQ ID NO: 43892 - protein, 25 aa, synthetic construct
  source 1..25: note = Seed: NSCVKLQTVHSIPLTINKEEALQRP
NSCVKLQTVHSIPWTILKFEAYQRP

SEQ ID NO: 43893 - protein, 25 aa, synthetic construct
  source 1..25: note = Seed: NSCVKLQTVHSIPLTINKEEALQRP
NSCVKLQTVHSIPWTILKIEAFQRP

SEQ ID NO: 43894 - protein, 25 aa, synthetic construct
  source 1..25: note = Seed: NSCVKLQTVHSIPLTINKEEALQRP
NSCVKLQTVHSIPWTILKIEAIQRP

SEQ ID NO: 43895 - protein, 25 aa, synthetic construct
  source 1..25: note = Seed: NSCVKLQTVHSIPLTINKEEALQRP
NSCVKLQTVHSIPWTILKIEALQRP

SEQ ID NO: 43896 - protein, 25 aa, synthetic construct
  source 1..25: note = Seed: NSCVKLQTVHSIPLTINKEEALQRP
NSCVKLQTVHSIPWTILKIEAMQRP

SEQ ID NO: 43897 - protein, 25 aa, synthetic construct
  source 1..25: note = Seed: NSCVKLQTVHSIPLTINKEEALQRP
NSCVKLQTVHSIPWTILKIEAVQRP

SEQ ID NO: 43898 - protein, 25 aa, synthetic construct
  source 1..25: note = Seed: NSCVKLQTVHSIPLTINKEEALQRP
NSCVKLQTVHSIPWTILKIEAYQRP

SEQ ID NO: 43899 - protein, 25 aa, synthetic construct
  source 1..25: note = Seed: NSCVKLQTVHSIPLTINKEEALQRP
NSCVKLQTVHSIPWTILKLEAFQRP

SEQ ID NO: 43900 - protein, 25 aa, synthetic construct
  source 1..25: note = Seed: NSCVKLQTVHSIPLTINKEEALQRP
NSCVKLQTVHSIPWTILKLEAIQRP

SEQ ID NO: 43901 - protein, 25 aa, synthetic construct
  source 1..25: note = Seed: NSCVKLQTVHSIPLTINKEEALQRP
NSCVKLQTVHSIPWTILKLEALQRP

SEQ ID NO: 43902 - protein, 25 aa, synthetic construct
  source 1..25: note = Seed: NSCVKLQTVHSIPLTINKEEALQRP
NSCVKLQTVHSIPWTILKLEAMQRP

SEQ ID NO: 43903 - protein, 25 aa, synthetic construct
  source 1..25: note = Seed: NSCVKLQTVHSIPLTINKEEALQRP
NSCVKLQTVHSIPWTILKLEARQRP

SEQ ID NO: 43904 - protein, 25 aa, synthetic construct
  source 1..25: note = Seed: NSCVKLQTVHSIPLTINKEEALQRP
NSCVKLQTVHSIPWTILKLEAVQRP

SEQ ID NO: 43905 - protein, 25 aa, synthetic construct
  source 1..25: note = Seed: NSCVKLQTVHSIPLTINKEEALQRP
NSCVKLQTVHSIPWTILKLEAYQRP

SEQ ID NO: 43906 - protein, 25 aa, synthetic construct
  source 1..25: note = Seed: NSCVKLQTVHSIPLTINKEEALQRP
NSCVKLQTVHSIPWTILKMEAFQRP

SEQ ID NO: 43907 - protein, 25 aa, synthetic construct
  source 1..25: note = Seed: NSCVKLQTVHSIPLTINKEEALQRP
NSCVKLQTVHSIPWTILKMEAIQRP

SEQ ID NO: 43908 - protein, 25 aa, synthetic construct
  source 1..25: note = Seed: NSCVKLQTVHSIPLTINKEEALQRP
NSCVKLQTVHSIPWTILKMEALQRP

SEQ ID NO: 43909 - protein, 25 aa, synthetic construct
  source 1..25: note = Seed: NSCVKLQTVHSIPLTINKEEALQRP
NSCVKLQTVHSIPWTILKMEAVQRP

SEQ ID NO: 43910 - protein, 25 aa, synthetic construct
  source 1..25: note = Seed: NSCVKLQTVHSIPLTINKEEALQRP
NSCVKLQTVHSIPWTILKVEAFQRP

SEQ ID NO: 43911 - protein, 25 aa, synthetic construct
  source 1..25: note = Seed: NSCVKLQTVHSIPLTINKEEALQRP
NSCVKLQTVHSIPWTILKVEALQRP

SEQ ID NO: 43912 - protein, 25 aa, synthetic construct
  source 1..25: note = Seed: NSCVKLQTVHSIPLTINKEEALQRP
NSCVKLQTVHSIPWTILKWEAFQRP

SEQ ID NO: 43913 - protein, 25 aa, synthetic construct
  source 1..25: note = Seed: NSCVKLQTVHSIPLTINKEEALQRP
NSCVKLQTVHSIPWTILKWEAIQRP

SEQ ID NO: 43914 - protein, 25 aa, synthetic construct
  source 1..25: note = Seed: NSCVKLQTVHSIPLTINKEEALQRP
NSCVKLQTVHSIPWTILKWEALQRP

SEQ ID NO: 43915 - protein, 25 aa, synthetic construct
  source 1..25: note = Seed: NSCVKLQTVHSIPLTINKEEALQRP
NSCVKLQTVHSIPWTILKWEAMQRP

SEQ ID NO: 43916 - protein, 25 aa, synthetic construct
  source 1..25: note = Seed: NSCVKLQTVHSIPLTINKEEALQRP
NSCVKLQTVHSIPWTILKWEAVQRP

SEQ ID NO: 43917 - protein, 25 aa, synthetic construct
  source 1..25: note = Seed: NSCVKLQTVHSIPLTINKEEALQRP
NSCVKLQTVHSIPWTILKWEAYQRP

SEQ ID NO: 43918 - protein, 25 aa, synthetic construct
  source 1..25: note = Seed: NSCVKLQTVHSIPLTINKEEALQRP
NSCVKLQTVHSIPWTILKYEAAQRP

SEQ ID NO: 43919 - protein, 25 aa, synthetic construct
  source 1..25: note = Seed: NSCVKLQTVHSIPLTINKEEALQRP
NSCVKLQTVHSIPWTILKYEAFQRP

SEQ ID NO: 43920 - protein, 25 aa, synthetic construct
  source 1..25: note = Seed: NSCVKLQTVHSIPLTINKEEALQRP
NSCVKLQTVHSIPWTILKYEAIQRP

SEQ ID NO: 43921 - protein, 25 aa, synthetic construct
  source 1..25: note = Seed: NSCVKLQTVHSIPLTINKEEALQRP
NSCVKLQTVHSIPWTILKYEALQRP

SEQ ID NO: 43922 - protein, 25 aa, synthetic construct
  source 1..25: note = Seed: NSCVKLQTVHSIPLTINKEEALQRP
NSCVKLQTVHSIPWTILKYEAMQRP

SEQ ID NO: 43923 - protein, 25 aa, synthetic construct
  source 1..25: note = Seed: NSCVKLQTVHSIPLTINKEEALQRP
NSCVKLQTVHSIPWTILKYEASQRP

SEQ ID NO: 43924 - protein, 25 aa, synthetic construct
  source 1..25: note = Seed: NSCVKLQTVHSIPLTINKEEALQRP
NSCVKLQTVHSIPWTILKYEATQRP

SEQ ID NO: 43925 - protein, 25 aa, synthetic construct
  source 1..25: note = Seed: NSCVKLQTVHSIPLTINKEEALQRP
NSCVKLQTVHSIPWTILKYEAVQRP

SEQ ID NO: 43926 - protein, 25 aa, synthetic construct
  source 1..25: note = Seed: NSCVKLQTVHSIPLTINKEEALQRP
NSCVKLQTVHSIPWTILKYEAYQRP

SEQ ID NO: 43927 - protein, 25 aa, synthetic construct
  source 1..25: note = Seed: NSCVKLQTVHSIPLTINKEEALQRP
NSCVKLQTVHSIPWTIMKAEAIQRP

SEQ ID NO: 43928 - protein, 25 aa, synthetic construct
  source 1..25: note = Seed: NSCVKLQTVHSIPLTINKEEALQRP
NSCVKLQTVHSIPWTIMKAEALQRP

SEQ ID NO: 43929 - protein, 25 aa, synthetic construct
  source 1..25: note = Seed: NSCVKLQTVHSIPLTINKEEALQRP
NSCVKLQTVHSIPWTIMKAEAVQRP

SEQ ID NO: 43930 - protein, 25 aa, synthetic construct
  source 1..25: note = Seed: NSCVKLQTVHSIPLTINKEEALQRP
NSCVKLQTVHSIPWTIMKFEAAQRP

SEQ ID NO: 43931 - protein, 25 aa, synthetic construct
  source 1..25: note = Seed: NSCVKLQTVHSIPLTINKEEALQRP
NSCVKLQTVHSIPWTIMKFEADQRP

SEQ ID NO: 43932 - protein, 25 aa, synthetic construct
  source 1..25: note = Seed: NSCVKLQTVHSIPLTINKEEALQRP
NSCVKLQTVHSIPWTIMKFEAEQRP

SEQ ID NO: 43933 - protein, 25 aa, synthetic construct
  source 1..25: note = Seed: NSCVKLQTVHSIPLTINKEEALQRP
NSCVKLQTVHSIPWTIMKFEAFQRP

SEQ ID NO: 43934 - protein, 25 aa, synthetic construct
  source 1..25: note = Seed: NSCVKLQTVHSIPLTINKEEALQRP
NSCVKLQTVHSIPWTIMKFEAHQRP

SEQ ID NO: 43935 - protein, 25 aa, synthetic construct
  source 1..25: note = Seed: NSCVKLQTVHSIPLTINKEEALQRP
NSCVKLQTVHSIPWTIMKFEAIQRP

SEQ ID NO: 43936 - protein, 25 aa, synthetic construct
  source 1..25: note = Seed: NSCVKLQTVHSIPLTINKEEALQRP
NSCVKLQTVHSIPWTIMKFEALQRP

SEQ ID NO: 43937 - protein, 25 aa, synthetic construct
  source 1..25: note = Seed: NSCVKLQTVHSIPLTINKEEALQRP
NSCVKLQTVHSIPWTIMKFEAMQRP

SEQ ID NO: 43938 - protein, 25 aa, synthetic construct
  source 1..25: note = Seed: NSCVKLQTVHSIPLTINKEEALQRP
NSCVKLQTVHSIPWTIMKFEANQRP

SEQ ID NO: 43939 - protein, 25 aa, synthetic construct
  source 1..25: note = Seed: NSCVKLQTVHSIPLTINKEEALQRP
NSCVKLQTVHSIPWTIMKFEARQRP

SEQ ID NO: 43940 - protein, 25 aa, synthetic construct
  source 1..25: note = Seed: NSCVKLQTVHSIPLTINKEEALQRP
NSCVKLQTVHSIPWTIMKFEASQRP

SEQ ID NO: 43941 - protein, 25 aa, synthetic construct
  source 1..25: note = Seed: NSCVKLQTVHSIPLTINKEEALQRP
NSCVKLQTVHSIPWTIMKFEATQRP

SEQ ID NO: 43942 - protein, 25 aa, synthetic construct
  source 1..25: note = Seed: NSCVKLQTVHSIPLTINKEEALQRP
NSCVKLQTVHSIPWTIMKFEAVQRP

SEQ ID NO: 43943 - protein, 25 aa, synthetic construct
  source 1..25: note = Seed: NSCVKLQTVHSIPLTINKEEALQRP
NSCVKLQTVHSIPWTIMKFEAYQRP

SEQ ID NO: 43944 - protein, 25 aa, synthetic construct
  source 1..25: note = Seed: NSCVKLQTVHSIPLTINKEEALQRP
NSCVKLQTVHSIPWTIMKIEAAQRP

SEQ ID NO: 43945 - protein, 25 aa, synthetic construct
  source 1..25: note = Seed: NSCVKLQTVHSIPLTINKEEALQRP
NSCVKLQTVHSIPWTIMKIEAIQRP

SEQ ID NO: 43946 - protein, 25 aa, synthetic construct
  source 1..25: note = Seed: NSCVKLQTVHSIPLTINKEEALQRP
NSCVKLQTVHSIPWTIMKIEALQRP

SEQ ID NO: 43947 - protein, 25 aa, synthetic construct
  source 1..25: note = Seed: NSCVKLQTVHSIPLTINKEEALQRP
NSCVKLQTVHSIPWTIMKIEAVQRP

SEQ ID NO: 43948 - protein, 25 aa, synthetic construct
  source 1..25: note = Seed: NSCVKLQTVHSIPLTINKEEALQRP
NSCVKLQTVHSIPWTIMKLEAFQRP

SEQ ID NO: 43949 - protein, 25 aa, synthetic construct
  source 1..25: note = Seed: NSCVKLQTVHSIPLTINKEEALQRP
NSCVKLQTVHSIPWTIMKLEAIQRP

SEQ ID NO: 43950 - protein, 25 aa, synthetic construct
  source 1..25: note = Seed: NSCVKLQTVHSIPLTINKEEALQRP
NSCVKLQTVHSIPWTIMKLEALQRP

SEQ ID NO: 43951 - protein, 25 aa, synthetic construct
  source 1..25: note = Seed: NSCVKLQTVHSIPLTINKEEALQRP
NSCVKLQTVHSIPWTIMKNEAAQRP

SEQ ID NO: 43952 - protein, 25 aa, synthetic construct
  source 1..25: note = Seed: NSCVKLQTVHSIPLTINKEEALQRP
NSCVKLQTVHSIPWTIMKNEADQRP

SEQ ID NO: 43953 - protein, 25 aa, synthetic construct
  source 1..25: note = Seed: NSCVKLQTVHSIPLTINKEEALQRP
NSCVKLQTVHSIPWTIMKNEAEQRP

SEQ ID NO: 43954 - protein, 25 aa, synthetic construct
  source 1..25: note = Seed: NSCVKLQTVHSIPLTINKEEALQRP
NSCVKLQTVHSIPWTIMKNEASQRP

SEQ ID NO: 43955 - protein, 25 aa, synthetic construct
  source 1..25: note = Seed: NSCVKLQTVHSIPLTINKEEALQRP
NSCVKLQTVHSIPWTIMKSEAAQRP

SEQ ID NO: 43956 - protein, 25 aa, synthetic construct
  source 1..25: note = Seed: NSCVKLQTVHSIPLTINKEEALQRP
NSCVKLQTVHSIPWTIMKTEAAQRP

SEQ ID NO: 43957 - protein, 25 aa, synthetic construct
  source 1..25: note = Seed: NSCVKLQTVHSIPLTINKEEALQRP
NSCVKLQTVHSIPWTIMKTEASQRP

SEQ ID NO: 43958 - protein, 25 aa, synthetic construct
  source 1..25: note = Seed: NSCVKLQTVHSIPLTINKEEALQRP
NSCVKLQTVHSIPWTIMKVEAVQRP

SEQ ID NO: 43959 - protein, 25 aa, synthetic construct
  source 1..25: note = Seed: NSCVKLQTVHSIPLTINKEEALQRP
NSCVKLQTVHSIPWTIMKWEAFQRP

SEQ ID NO: 43960 - protein, 25 aa, synthetic construct
  source 1..25: note = Seed: NSCVKLQTVHSIPLTINKEEALQRP
NSCVKLQTVHSIPWTIMKWEALQRP

SEQ ID NO: 43961 - protein, 25 aa, synthetic construct
  source 1..25: note = Seed: NSCVKLQTVHSIPLTINKEEALQRP
NSCVKLQTVHSIPWTIMKYEAFQRP

SEQ ID NO: 43962 - protein, 25 aa, synthetic construct
  source 1..25: note = Seed: NSCVKLQTVHSIPLTINKEEALQRP
NSCVKLQTVHSIPWTIMKYEAIQRP

SEQ ID NO: 43963 - protein, 25 aa, synthetic construct
  source 1..25: note = Seed: NSCVKLQTVHSIPLTINKEEALQRP
NSCVKLQTVHSIPWTIMKYEALQRP

SEQ ID NO: 43964 - protein, 25 aa, synthetic construct
  source 1..25: note = Seed: NSCVKLQTVHSIPLTINKEEALQRP
NSCVKLQTVHSIPWTIMKYEAVQRP

SEQ ID NO: 43965 - protein, 25 aa, synthetic construct
  source 1..25: note = Seed: NSCVKLQTVHSIPLTINKEEALQRP
NSCVKLQTVHSIPWTINKAEAFQRP

SEQ ID NO: 43966 - protein, 25 aa, synthetic construct
  source 1..25: note = Seed: NSCVKLQTVHSIPLTINKEEALQRP
NSCVKLQTVHSIPWTINKAEAIQRP

SEQ ID NO: 43967 - protein, 25 aa, synthetic construct
  source 1..25: note = Seed: NSCVKLQTVHSIPLTINKEEALQRP
NSCVKLQTVHSIPWTINKAEALQRP

SEQ ID NO: 43968 - protein, 25 aa, synthetic construct
  source 1..25: note = Seed: NSCVKLQTVHSIPLTINKEEALQRP
NSCVKLQTVHSIPWTINKAEAVQRP

SEQ ID NO: 43969 - protein, 25 aa, synthetic construct
  source 1..25: note = Seed: NSCVKLQTVHSIPLTINKEEALQRP
NSCVKLQTVHSIPWTINKFEAFQRP

SEQ ID NO: 43970 - protein, 25 aa, synthetic construct
  source 1..25: note = Seed: NSCVKLQTVHSIPLTINKEEALQRP
NSCVKLQTVHSIPWTINKFEAIQRP

SEQ ID NO: 43971 - protein, 25 aa, synthetic construct
  source 1..25: note = Seed: NSCVKLQTVHSIPLTINKEEALQRP
NSCVKLQTVHSIPWTINKFEALQRP

SEQ ID NO: 43972 - protein, 25 aa, synthetic construct
  source 1..25: note = Seed: NSCVKLQTVHSIPLTINKEEALQRP
NSCVKLQTVHSIPWTINKFEAMQRP

SEQ ID NO: 43973 - protein, 25 aa, synthetic construct
  source 1..25: note = Seed: NSCVKLQTVHSIPLTINKEEALQRP
NSCVKLQTVHSIPWTINKFEAVQRP

SEQ ID NO: 43974 - protein, 25 aa, synthetic construct
  source 1..25: note = Seed: NSCVKLQTVHSIPLTINKEEALQRP
NSCVKLQTVHSIPWTINKIEAIQRP

SEQ ID NO: 43975 - protein, 25 aa, synthetic construct
  source 1..25: note = Seed: NSCVKLQTVHSIPLTINKEEALQRP
NSCVKLQTVHSIPWTINKIEAVQRP

SEQ ID NO: 43976 - protein, 25 aa, synthetic construct
  source 1..25: note = Seed: NSCVKLQTVHSIPLTINKEEALQRP
NSCVKLQTVHSIPWTINKNEAFQRP

SEQ ID NO: 43977 - protein, 25 aa, synthetic construct
  source 1..25: note = Seed: NSCVKLQTVHSIPLTINKEEALQRP
NSCVKLQTVHSIPWTINKNEAIQRP

SEQ ID NO: 43978 - protein, 25 aa, synthetic construct
  source 1..25: note = Seed: NSCVKLQTVHSIPLTINKEEALQRP
NSCVKLQTVHSIPWTINKNEALQRP

SEQ ID NO: 43979 - protein, 25 aa, synthetic construct
  source 1..25: note = Seed: NSCVKLQTVHSIPLTINKEEALQRP
NSCVKLQTVHSIPWTINKNEAVQRP

SEQ ID NO: 43980 - protein, 25 aa, synthetic construct
  source 1..25: note = Seed: NSCVKLQTVHSIPLTINKEEALQRP
NSCVKLQTVHSIPWTINKSEAIQRP

SEQ ID NO: 43981 - protein, 25 aa, synthetic construct
  source 1..25: note = Seed: NSCVKLQTVHSIPLTINKEEALQRP
NSCVKLQTVHSIPWTINKSEALQRP

SEQ ID NO: 43982 - protein, 25 aa, synthetic construct
  source 1..25: note = Seed: NSCVKLQTVHSIPLTINKEEALQRP
NSCVKLQTVHSIPWTINKSEAVQRP

SEQ ID NO: 43983 - protein, 25 aa, synthetic construct
  source 1..25: note = Seed: NSCVKLQTVHSIPLTINKEEALQRP
NSCVKLQTVHSIPWTINKTEAIQRP

SEQ ID NO: 43984 - protein, 25 aa, synthetic construct
  source 1..25: note = Seed: NSCVKLQTVHSIPLTINKEEALQRP
NSCVKLQTVHSIPWTINKTEAVQRP

SEQ ID NO: 43985 - protein, 25 aa, synthetic construct
  source 1..25: note = Seed: NSCVKLQTVHSIPLTINKEEALQRP
NSCVKLQTVHSIPWTINKVEAIQRP

SEQ ID NO: 43986 - protein, 25 aa, synthetic construct
  source 1..25: note = Seed: NSCVKLQTVHSIPLTINKEEALQRP
NSCVKLQTVHSIPWTINKVEAVQRP

SEQ ID NO: 43987 - protein, 25 aa, synthetic construct
  source 1..25: note = Seed: NSCVKLQTVHSIPLTINKEEALQRP
NSCVKLQTVHSIPWTIQKFEAFQRP

SEQ ID NO: 43988 - protein, 25 aa, synthetic construct
  source 1..25: note = Seed: NSCVKLQTVHSIPLTINKEEALQRP
NSCVKLQTVHSIPWTIQKFEAIQRP

SEQ ID NO: 43989 - protein, 25 aa, synthetic construct
  source 1..25: note = Seed: NSCVKLQTVHSIPLTINKEEALQRP
NSCVKLQTVHSIPWTIQKFEALQRP

SEQ ID NO: 43990 - protein, 25 aa, synthetic construct
  source 1..25: note = Seed: NSCVKLQTVHSIPLTINKEEALQRP
NSCVKLQTVHSIPWTIQKFEAMQRP

SEQ ID NO: 43991 - protein, 25 aa, synthetic construct
  source 1..25: note = Seed: NSCVKLQTVHSIPLTINKEEALQRP
NSCVKLQTVHSIPWTIQKFEAVQRP

SEQ ID NO: 43992 - protein, 25 aa, synthetic construct
  source 1..25: note = Seed: NSCVKLQTVHSIPLTINKEEALQRP
NSCVKLQTVHSIPWTISKFEAAQRP

SEQ ID NO: 43993 - protein, 25 aa, synthetic construct
  source 1..25: note = Seed: NSCVKLQTVHSIPLTINKEEALQRP
NSCVKLQTVHSIPWTISKFEAFQRP

SEQ ID NO: 43994 - protein, 25 aa, synthetic construct
  source 1..25: note = Seed: NSCVKLQTVHSIPLTINKEEALQRP
NSCVKLQTVHSIPWTISKFEAIQRP

SEQ ID NO: 43995 - protein, 25 aa, synthetic construct
  source 1..25: note = Seed: NSCVKLQTVHSIPLTINKEEALQRP
NSCVKLQTVHSIPWTISKFEALQRP

SEQ ID NO: 43996 - protein, 25 aa, synthetic construct
  source 1..25: note = Seed: NSCVKLQTVHSIPLTINKEEALQRP
NSCVKLQTVHSIPWTISKFEAMQRP

SEQ ID NO: 43997 - protein, 25 aa, synthetic construct
  source 1..25: note = Seed: NSCVKLQTVHSIPLTINKEEALQRP
NSCVKLQTVHSIPWTISKFEASQRP

SEQ ID NO: 43998 - protein, 25 aa, synthetic construct
  source 1..25: note = Seed: NSCVKLQTVHSIPLTINKEEALQRP
NSCVKLQTVHSIPWTISKFEATQRP

SEQ ID NO: 43999 - protein, 25 aa, synthetic construct
  source 1..25: note = Seed: NSCVKLQTVHSIPLTINKEEALQRP
NSCVKLQTVHSIPWTISKFEAVQRP

SEQ ID NO: 44000 - protein, 25 aa, synthetic construct
  source 1..25: note = Seed: NSCVKLQTVHSIPLTINKEEALQRP
NSCVKLQTVHSIPWTISKFEAYQRP

SEQ ID NO: 44001 - protein, 25 aa, synthetic construct
  source 1..25: note = Seed: NSCVKLQTVHSIPLTINKEEALQRP
NSCVKLQTVHSIPWTITKFEAAQRP

SEQ ID NO: 44002 - protein, 25 aa, synthetic construct
  source 1..25: note = Seed: NSCVKLQTVHSIPLTINKEEALQRP
NSCVKLQTVHSIPWTITKFEAEQRP

SEQ ID NO: 44003 - protein, 25 aa, synthetic construct
  source 1..25: note = Seed: NSCVKLQTVHSIPLTINKEEALQRP
NSCVKLQTVHSIPWTITKFEAFQRP

SEQ ID NO: 44004 - protein, 25 aa, synthetic construct
  source 1..25: note = Seed: NSCVKLQTVHSIPLTINKEEALQRP
NSCVKLQTVHSIPWTITKFEAIQRP

SEQ ID NO: 44005 - protein, 25 aa, synthetic construct
  source 1..25: note = Seed: NSCVKLQTVHSIPLTINKEEALQRP
NSCVKLQTVHSIPWTITKFEALQRP

SEQ ID NO: 44006 - protein, 25 aa, synthetic construct
  source 1..25: note = Seed: NSCVKLQTVHSIPLTINKEEALQRP
NSCVKLQTVHSIPWTITKFEAMQRP

SEQ ID NO: 44007 - protein, 25 aa, synthetic construct
  source 1..25: note = Seed: NSCVKLQTVHSIPLTINKEEALQRP
NSCVKLQTVHSIPWTITKFEANQRP

SEQ ID NO: 44008 - protein, 25 aa, synthetic construct
  source 1..25: note = Seed: NSCVKLQTVHSIPLTINKEEALQRP
NSCVKLQTVHSIPWTITKFEASQRP

SEQ ID NO: 44009 - protein, 25 aa, synthetic construct
  source 1..25: note = Seed: NSCVKLQTVHSIPLTINKEEALQRP
NSCVKLQTVHSIPWTITKFEATQRP

SEQ ID NO: 44010 - protein, 25 aa, synthetic construct
  source 1..25: note = Seed: NSCVKLQTVHSIPLTINKEEALQRP
NSCVKLQTVHSIPWTITKFEAVQRP

SEQ ID NO: 44011 - protein, 25 aa, synthetic construct
  source 1..25: note = Seed: NSCVKLQTVHSIPLTINKEEALQRP
NSCVKLQTVHSIPWTITKFEAYQRP

SEQ ID NO: 44012 - protein, 25 aa, synthetic construct
  source 1..25: note = Seed: NSCVKLQTVHSIPLTINKEEALQRP
NSCVKLQTVHSIPWTITKYEAIQRP

SEQ ID NO: 44013 - protein, 25 aa, synthetic construct
  source 1..25: note = Seed: NSCVKLQTVHSIPLTINKEEALQRP
NSCVKLQTVHSIPWTITKYEALQRP

SEQ ID NO: 44014 - protein, 25 aa, synthetic construct
  source 1..25: note = Seed: NSCVKLQTVHSIPLTINKEEALQRP
NSCVKLQTVHSIPWTITKYEAVQRP

SEQ ID NO: 44015 - protein, 25 aa, synthetic construct
  source 1..25: note = Seed: NSCVKLQTVHSIPLTINKEEALQRP
NSCVKLQTVHSIPWTIVKFEAAQRP

SEQ ID NO: 44016 - protein, 25 aa, synthetic construct
  source 1..25: note = Seed: NSCVKLQTVHSIPLTINKEEALQRP
NSCVKLQTVHSIPWTIVKFEACQRP

SEQ ID NO: 44017 - protein, 25 aa, synthetic construct
  source 1..25: note = Seed: NSCVKLQTVHSIPLTINKEEALQRP
NSCVKLQTVHSIPWTIVKFEADQRP

SEQ ID NO: 44018 - protein, 25 aa, synthetic construct
  source 1..25: note = Seed: NSCVKLQTVHSIPLTINKEEALQRP
NSCVKLQTVHSIPWTIVKFEAEQRP

SEQ ID NO: 44019 - protein, 25 aa, synthetic construct
  source 1..25: note = Seed: NSCVKLQTVHSIPLTINKEEALQRP
NSCVKLQTVHSIPWTIVKFEAFQRP

SEQ ID NO: 44020 - protein, 25 aa, synthetic construct
  source 1..25: note = Seed: NSCVKLQTVHSIPLTINKEEALQRP
NSCVKLQTVHSIPWTIVKFEAHQRP

SEQ ID NO: 44021 - protein, 25 aa, synthetic construct
  source 1..25: note = Seed: NSCVKLQTVHSIPLTINKEEALQRP
NSCVKLQTVHSIPWTIVKFEAIQRP

SEQ ID NO: 44022 - protein, 25 aa, synthetic construct
  source 1..25: note = Seed: NSCVKLQTVHSIPLTINKEEALQRP
NSCVKLQTVHSIPWTIVKFEALQRP

SEQ ID NO: 44023 - protein, 25 aa, synthetic construct
  source 1..25: note = Seed: NSCVKLQTVHSIPLTINKEEALQRP
NSCVKLQTVHSIPWTIVKFEAMQRP

SEQ ID NO: 44024 - protein, 25 aa, synthetic construct
  source 1..25: note = Seed: NSCVKLQTVHSIPLTINKEEALQRP
NSCVKLQTVHSIPWTIVKFEANQRP

SEQ ID NO: 44025 - protein, 25 aa, synthetic construct
  source 1..25: note = Seed: NSCVKLQTVHSIPLTINKEEALQRP
NSCVKLQTVHSIPWTIVKFEAPQRP

SEQ ID NO: 44026 - protein, 25 aa, synthetic construct
  source 1..25: note = Seed: NSCVKLQTVHSIPLTINKEEALQRP
NSCVKLQTVHSIPWTIVKFEAQQRP

SEQ ID NO: 44027 - protein, 25 aa, synthetic construct
  source 1..25: note = Seed: NSCVKLQTVHSIPLTINKEEALQRP
NSCVKLQTVHSIPWTIVKFEARQRP

SEQ ID NO: 44028 - protein, 25 aa, synthetic construct
  source 1..25: note = Seed: NSCVKLQTVHSIPLTINKEEALQRP
NSCVKLQTVHSIPWTIVKFEASQRP

SEQ ID NO: 44029 - protein, 25 aa, synthetic construct
  source 1..25: note = Seed: NSCVKLQTVHSIPLTINKEEALQRP
NSCVKLQTVHSIPWTIVKFEATQRP

SEQ ID NO: 44030 - protein, 25 aa, synthetic construct
  source 1..25: note = Seed: NSCVKLQTVHSIPLTINKEEALQRP
NSCVKLQTVHSIPWTIVKFEAVQRP

SEQ ID NO: 44031 - protein, 25 aa, synthetic construct
  source 1..25: note = Seed: NSCVKLQTVHSIPLTINKEEALQRP
NSCVKLQTVHSIPWTIVKFEAYQRP

SEQ ID NO: 44032 - protein, 25 aa, synthetic construct
  source 1..25: note = Seed: NSCVKLQTVHSIPLTINKEEALQRP
NSCVKLQTVHSIPWTIVKIEAIQRP

SEQ ID NO: 44033 - protein, 25 aa, synthetic construct
  source 1..25: note = Seed: NSCVKLQTVHSIPLTINKEEALQRP
NSCVKLQTVHSIPWTIVKIEALQRP

SEQ ID NO: 44034 - protein, 25 aa, synthetic construct
  source 1..25: note = Seed: NSCVKLQTVHSIPLTINKEEALQRP
NSCVKLQTVHSIPWTIVKLEAFQRP

SEQ ID NO: 44035 - protein, 25 aa, synthetic construct
  source 1..25: note = Seed: NSCVKLQTVHSIPLTINKEEALQRP
NSCVKLQTVHSIPWTIVKLEAIQRP

SEQ ID NO: 44036 - protein, 25 aa, synthetic construct
  source 1..25: note = Seed: NSCVKLQTVHSIPLTINKEEALQRP
NSCVKLQTVHSIPWTIVKLEALQRP

SEQ ID NO: 44037 - protein, 25 aa, synthetic construct
  source 1..25: note = Seed: NSCVKLQTVHSIPLTINKEEALQRP
NSCVKLQTVHSIPWTIVKLEAVQRP

SEQ ID NO: 44038 - protein, 25 aa, synthetic construct
  source 1..25: note = Seed: NSCVKLQTVHSIPLTINKEEALQRP
NSCVKLQTVHSIPWTIVKLEAYQRP

SEQ ID NO: 44039 - protein, 25 aa, synthetic construct
  source 1..25: note = Seed: NSCVKLQTVHSIPLTINKEEALQRP
NSCVKLQTVHSIPWTIVKWEAFQRP

SEQ ID NO: 44040 - protein, 25 aa, synthetic construct
  source 1..25: note = Seed: NSCVKLQTVHSIPLTINKEEALQRP
NSCVKLQTVHSIPWTIVKWEAIQRP

SEQ ID NO: 44041 - protein, 25 aa, synthetic construct
  source 1..25: note = Seed: NSCVKLQTVHSIPLTINKEEALQRP
NSCVKLQTVHSIPWTIVKWEALQRP

SEQ ID NO: 44042 - protein, 25 aa, synthetic construct
  source 1..25: note = Seed: NSCVKLQTVHSIPLTINKEEALQRP
NSCVKLQTVHSIPWTIVKWEAVQRP

SEQ ID NO: 44043 - protein, 25 aa, synthetic construct
  source 1..25: note = Seed: NSCVKLQTVHSIPLTINKEEALQRP
NSCVKLQTVHSIPWTIVKYEAAQRP

SEQ ID NO: 44044 - protein, 25 aa, synthetic construct
  source 1..25: note = Seed: NSCVKLQTVHSIPLTINKEEALQRP
NSCVKLQTVHSIPWTIVKYEAFQRP

SEQ ID NO: 44045 - protein, 25 aa, synthetic construct
  source 1..25: note = Seed: NSCVKLQTVHSIPLTINKEEALQRP
NSCVKLQTVHSIPWTIVKYEAIQRP

SEQ ID NO: 44046 - protein, 25 aa, synthetic construct
  source 1..25: note = Seed: NSCVKLQTVHSIPLTINKEEALQRP
NSCVKLQTVHSIPWTIVKYEALQRP

SEQ ID NO: 44047 - protein, 25 aa, synthetic construct
  source 1..25: note = Seed: NSCVKLQTVHSIPLTINKEEALQRP
NSCVKLQTVHSIPWTIVKYEAMQRP

SEQ ID NO: 44048 - protein, 25 aa, synthetic construct
  source 1..25: note = Seed: NSCVKLQTVHSIPLTINKEEALQRP
NSCVKLQTVHSIPWTIVKYEAVQRP

SEQ ID NO: 44049 - protein, 25 aa, synthetic construct
  source 1..25: note = Seed: NSCVKLQTVHSIPLTINKEEALQRP
NSCVKLQTVHSIPWTIVKYEAYQRP

SEQ ID NO: 44050 - protein, 25 aa, synthetic construct
  source 1..25: note = Seed: NSCVKLQTVHSIPLTINKEEALQRP
NSCVKLQTVHSIPWTIWKFEAFQRP

SEQ ID NO: 44051 - protein, 25 aa, synthetic construct
  source 1..25: note = Seed: NSCVKLQTVHSIPLTINKEEALQRP
NSCVKLQTVHSIPWTIWKFEAIQRP

SEQ ID NO: 44052 - protein, 25 aa, synthetic construct
  source 1..25: note = Seed: NSCVKLQTVHSIPLTINKEEALQRP
NSCVKLQTVHSIPWTIWKFEALQRP

SEQ ID NO: 44053 - protein, 25 aa, synthetic construct
  source 1..25: note = Seed: NSCVKLQTVHSIPLTINKEEALQRP
NSCVKLQTVHSIPWTIWKFEAMQRP

SEQ ID NO: 44054 - protein, 25 aa, synthetic construct
  source 1..25: note = Seed: NSCVKLQTVHSIPLTINKEEALQRP
NSCVKLQTVHSIPWTIWKFEAVQRP

SEQ ID NO: 44055 - protein, 25 aa, synthetic construct
  source 1..25: note = Seed: NSCVKLQTVHSIPLTINKEEALQRP
NSCVKLQTVHSIPWTIWKIEAAQRP

SEQ ID NO: 44056 - protein, 25 aa, synthetic construct
  source 1..25: note = Seed: NSCVKLQTVHSIPLTINKEEALQRP
NSCVKLQTVHSIPWTIWKIEAIQRP

SEQ ID NO: 44057 - protein, 25 aa, synthetic construct
  source 1..25: note = Seed: NSCVKLQTVHSIPLTINKEEALQRP
NSCVKLQTVHSIPWTIWKIEAVQRP

SEQ ID NO: 44058 - protein, 25 aa, synthetic construct
  source 1..25: note = Seed: NSCVKLQTVHSIPLTINKEEALQRP
NSCVKLQTVHSIPWTIYKAEAIQRP

SEQ ID NO: 44059 - protein, 25 aa, synthetic construct
  source 1..25: note = Seed: NSCVKLQTVHSIPLTINKEEALQRP
NSCVKLQTVHSIPWTIYKAEAVQRP

SEQ ID NO: 44060 - protein, 25 aa, synthetic construct
  source 1..25: note = Seed: NSCVKLQTVHSIPLTINKEEALQRP
NSCVKLQTVHSIPWTIYKDEAIQRP

SEQ ID NO: 44061 - protein, 25 aa, synthetic construct
  source 1..25: note = Seed: NSCVKLQTVHSIPLTINKEEALQRP
NSCVKLQTVHSIPWTIYKFEAFQRP

SEQ ID NO: 44062 - protein, 25 aa, synthetic construct
  source 1..25: note = Seed: NSCVKLQTVHSIPLTINKEEALQRP
NSCVKLQTVHSIPWTIYKFEAIQRP

SEQ ID NO: 44063 - protein, 25 aa, synthetic construct
  source 1..25: note = Seed: NSCVKLQTVHSIPLTINKEEALQRP
NSCVKLQTVHSIPWTIYKFEALQRP

SEQ ID NO: 44064 - protein, 25 aa, synthetic construct
  source 1..25: note = Seed: NSCVKLQTVHSIPLTINKEEALQRP
NSCVKLQTVHSIPWTIYKFEAMQRP

SEQ ID NO: 44065 - protein, 25 aa, synthetic construct
  source 1..25: note = Seed: NSCVKLQTVHSIPLTINKEEALQRP
NSCVKLQTVHSIPWTIYKFEAVQRP

SEQ ID NO: 44066 - protein, 25 aa, synthetic construct
  source 1..25: note = Seed: NSCVKLQTVHSIPLTINKEEALQRP
NSCVKLQTVHSIPWTIYKFEAYQRP

SEQ ID NO: 44067 - protein, 25 aa, synthetic construct
  source 1..25: note = Seed: NSCVKLQTVHSIPLTINKEEALQRP
NSCVKLQTVHSIPWTIYKIEAAQRP

SEQ ID NO: 44068 - protein, 25 aa, synthetic construct
  source 1..25: note = Seed: NSCVKLQTVHSIPLTINKEEALQRP
NSCVKLQTVHSIPWTIYKIEAIQRP

SEQ ID NO: 44069 - protein, 25 aa, synthetic construct
  source 1..25: note = Seed: NSCVKLQTVHSIPLTINKEEALQRP
NSCVKLQTVHSIPWTIYKIEALQRP

SEQ ID NO: 44070 - protein, 25 aa, synthetic construct
  source 1..25: note = Seed: NSCVKLQTVHSIPLTINKEEALQRP
NSCVKLQTVHSIPWTIYKIEAVQRP

SEQ ID NO: 44071 - protein, 25 aa, synthetic construct
  source 1..25: note = Seed: NSCVKLQTVHSIPLTINKEEALQRP
NSCVKLQTVHSIPWTIYKLEAFQRP

SEQ ID NO: 44072 - protein, 25 aa, synthetic construct
  source 1..25: note = Seed: NSCVKLQTVHSIPLTINKEEALQRP
NSCVKLQTVHSIPWTIYKLEALQRP

SEQ ID NO: 44073 - protein, 25 aa, synthetic construct
  source 1..25: note = Seed: NSCVKLQTVHSIPLTINKEEALQRP
NSCVKLQTVHSIPWTIYKVEAAQRP

SEQ ID NO: 44074 - protein, 25 aa, synthetic construct
  source 1..25: note = Seed: NSCVKLQTVHSIPLTINKEEALQRP
NSCVKLQTVHSIPWTIYKYEAFQRP

SEQ ID NO: 44075 - protein, 25 aa, synthetic construct
  source 1..25: note = Seed: NSCVKLQTVHSIPLTINKEEALQRP
NSCVKLQTVHSIPWTIYKYEALQRP

SEQ ID NO: 44076 - protein, 25 aa, synthetic construct
  source 1..25: note = Seed: NSCVKLQTVHSIPLTINKEEALQRP
NSCVKLQTVHSIPYTIAKFEAAQRP

SEQ ID NO: 44077 - protein, 25 aa, synthetic construct
  source 1..25: note = Seed: NSCVKLQTVHSIPLTINKEEALQRP
NSCVKLQTVHSIPYTIAKFEAFQRP

SEQ ID NO: 44078 - protein, 25 aa, synthetic construct
  source 1..25: note = Seed: NSCVKLQTVHSIPLTINKEEALQRP
NSCVKLQTVHSIPYTIAKFEAIQRP

SEQ ID NO: 44079 - protein, 25 aa, synthetic construct
  source 1..25: note = Seed: NSCVKLQTVHSIPLTINKEEALQRP
NSCVKLQTVHSIPYTIAKFEALQRP

SEQ ID NO: 44080 - protein, 25 aa, synthetic construct
  source 1..25: note = Seed: NSCVKLQTVHSIPLTINKEEALQRP
NSCVKLQTVHSIPYTIAKFEAMQRP

SEQ ID NO: 44081 - protein, 25 aa, synthetic construct
  source 1..25: note = Seed: NSCVKLQTVHSIPLTINKEEALQRP
NSCVKLQTVHSIPYTIAKFEANQRP

SEQ ID NO: 44082 - protein, 25 aa, synthetic construct
  source 1..25: note = Seed: NSCVKLQTVHSIPLTINKEEALQRP
NSCVKLQTVHSIPYTIAKFEASQRP

SEQ ID NO: 44083 - protein, 25 aa, synthetic construct
  source 1..25: note = Seed: NSCVKLQTVHSIPLTINKEEALQRP
NSCVKLQTVHSIPYTIAKFEATQRP

SEQ ID NO: 44084 - protein, 25 aa, synthetic construct
  source 1..25: note = Seed: NSCVKLQTVHSIPLTINKEEALQRP
NSCVKLQTVHSIPYTIAKFEAVQRP

SEQ ID NO: 44085 - protein, 25 aa, synthetic construct
  source 1..25: note = Seed: NSCVKLQTVHSIPLTINKEEALQRP
NSCVKLQTVHSIPYTIAKFEAYQRP

SEQ ID NO: 44086 - protein, 25 aa, synthetic construct
  source 1..25: note = Seed: NSCVKLQTVHSIPLTINKEEALQRP
NSCVKLQTVHSIPYTIAKNEAAQRP

SEQ ID NO: 44087 - protein, 25 aa, synthetic construct
  source 1..25: note = Seed: NSCVKLQTVHSIPLTINKEEALQRP
NSCVKLQTVHSIPYTIAKNEASQRP

SEQ ID NO: 44088 - protein, 25 aa, synthetic construct
  source 1..25: note = Seed: NSCVKLQTVHSIPLTINKEEALQRP
NSCVKLQTVHSIPYTIAKSEAAQRP

SEQ ID NO: 44089 - protein, 25 aa, synthetic construct
  source 1..25: note = Seed: NSCVKLQTVHSIPLTINKEEALQRP
NSCVKLQTVHSIPYTIAKSEASQRP

SEQ ID NO: 44090 - protein, 25 aa, synthetic construct
  source 1..25: note = Seed: NSCVKLQTVHSIPLTINKEEALQRP
NSCVKLQTVHSIPYTIAKTEAAQRP

SEQ ID NO: 44091 - protein, 25 aa, synthetic construct
  source 1..25: note = Seed: NSCVKLQTVHSIPLTINKEEALQRP
NSCVKLQTVHSIPYTIAKTEASQRP

SEQ ID NO: 44092 - protein, 25 aa, synthetic construct
  source 1..25: note = Seed: NSCVKLQTVHSIPLTINKEEALQRP
NSCVKLQTVHSIPYTIAKWEALQRP

SEQ ID NO: 44093 - protein, 25 aa, synthetic construct
  source 1..25: note = Seed: NSCVKLQTVHSIPLTINKEEALQRP
NSCVKLQTVHSIPYTIAKYEAIQRP

SEQ ID NO: 44094 - protein, 25 aa, synthetic construct
  source 1..25: note = Seed: NSCVKLQTVHSIPLTINKEEALQRP
NSCVKLQTVHSIPYTIAKYEALQRP

SEQ ID NO: 44095 - protein, 25 aa, synthetic construct
  source 1..25: note = Seed: NSCVKLQTVHSIPLTINKEEALQRP
NSCVKLQTVHSIPYTIAKYEAVQRP

SEQ ID NO: 44096 - protein, 25 aa, synthetic construct
  source 1..25: note = Seed: NSCVKLQTVHSIPLTINKEEALQRP
NSCVKLQTVHSIPYTICKFEAFQRP

SEQ ID NO: 44097 - protein, 25 aa, synthetic construct
  source 1..25: note = Seed: NSCVKLQTVHSIPLTINKEEALQRP
NSCVKLQTVHSIPYTICKFEAIQRP

SEQ ID NO: 44098 - protein, 25 aa, synthetic construct
  source 1..25: note = Seed: NSCVKLQTVHSIPLTINKEEALQRP
NSCVKLQTVHSIPYTICKFEALQRP

SEQ ID NO: 44099 - protein, 25 aa, synthetic construct
  source 1..25: note = Seed: NSCVKLQTVHSIPLTINKEEALQRP
NSCVKLQTVHSIPYTICKFEAVQRP

SEQ ID NO: 44100 - protein, 25 aa, synthetic construct
  source 1..25: note = Seed: NSCVKLQTVHSIPLTINKEEALQRP
NSCVKLQTVHSIPYTIDKFEAFQRP

SEQ ID NO: 44101 - protein, 25 aa, synthetic construct
  source 1..25: note = Seed: NSCVKLQTVHSIPLTINKEEALQRP
NSCVKLQTVHSIPYTIDKFEAIQRP

SEQ ID NO: 44102 - protein, 25 aa, synthetic construct
  source 1..25: note = Seed: NSCVKLQTVHSIPLTINKEEALQRP
NSCVKLQTVHSIPYTIDKFEALQRP

SEQ ID NO: 44103 - protein, 25 aa, synthetic construct
  source 1..25: note = Seed: NSCVKLQTVHSIPLTINKEEALQRP
NSCVKLQTVHSIPYTIDKFEAVQRP

SEQ ID NO: 44104 - protein, 25 aa, synthetic construct
  source 1..25: note = Seed: NSCVKLQTVHSIPLTINKEEALQRP
NSCVKLQTVHSIPYTIDKNEAAQRP

SEQ ID NO: 44105 - protein, 25 aa, synthetic construct
  source 1..25: note = Seed: NSCVKLQTVHSIPLTINKEEALQRP
NSCVKLQTVHSIPYTIEKFEAAQRP

SEQ ID NO: 44106 - protein, 25 aa, synthetic construct
  source 1..25: note = Seed: NSCVKLQTVHSIPLTINKEEALQRP
NSCVKLQTVHSIPYTIEKFEAFQRP

SEQ ID NO: 44107 - protein, 25 aa, synthetic construct
  source 1..25: note = Seed: NSCVKLQTVHSIPLTINKEEALQRP
NSCVKLQTVHSIPYTIEKFEAIQRP

SEQ ID NO: 44108 - protein, 25 aa, synthetic construct
  source 1..25: note = Seed: NSCVKLQTVHSIPLTINKEEALQRP
NSCVKLQTVHSIPYTIEKFEALQRP

SEQ ID NO: 44109 - protein, 25 aa, synthetic construct
  source 1..25: note = Seed: NSCVKLQTVHSIPLTINKEEALQRP
NSCVKLQTVHSIPYTIEKFEAMQRP

SEQ ID NO: 44110 - protein, 25 aa, synthetic construct
  source 1..25: note = Seed: NSCVKLQTVHSIPLTINKEEALQRP
NSCVKLQTVHSIPYTIEKFEATQRP

SEQ ID NO: 44111 - protein, 25 aa, synthetic construct
  source 1..25: note = Seed: NSCVKLQTVHSIPLTINKEEALQRP
NSCVKLQTVHSIPYTIEKFEAVQRP

SEQ ID NO: 44112 - protein, 25 aa, synthetic construct
  source 1..25: note = Seed: NSCVKLQTVHSIPLTINKEEALQRP
NSCVKLQTVHSIPYTIEKFEAYQRP

SEQ ID NO: 44113 - protein, 25 aa, synthetic construct
  source 1..25: note = Seed: NSCVKLQTVHSIPLTINKEEALQRP
NSCVKLQTVHSIPYTIFKAEAFQRP

SEQ ID NO: 44114 - protein, 25 aa, synthetic construct
  source 1..25: note = Seed: NSCVKLQTVHSIPLTINKEEALQRP
NSCVKLQTVHSIPYTIFKAEAIQRP

SEQ ID NO: 44115 - protein, 25 aa, synthetic construct
  source 1..25: note = Seed: NSCVKLQTVHSIPLTINKEEALQRP
NSCVKLQTVHSIPYTIFKAEALQRP

SEQ ID NO: 44116 - protein, 25 aa, synthetic construct
  source 1..25: note = Seed: NSCVKLQTVHSIPLTINKEEALQRP
NSCVKLQTVHSIPYTIFKAEAVQRP

SEQ ID NO: 44117 - protein, 25 aa, synthetic construct
  source 1..25: note = Seed: NSCVKLQTVHSIPLTINKEEALQRP
NSCVKLQTVHSIPYTIFKDEAIQRP

SEQ ID NO: 44118 - protein, 25 aa, synthetic construct
  source 1..25: note = Seed: NSCVKLQTVHSIPLTINKEEALQRP
NSCVKLQTVHSIPYTIFKDEALQRP

SEQ ID NO: 44119 - protein, 25 aa, synthetic construct
  source 1..25: note = Seed: NSCVKLQTVHSIPLTINKEEALQRP
NSCVKLQTVHSIPYTIFKDEAVQRP

SEQ ID NO: 44120 - protein, 25 aa, synthetic construct
  source 1..25: note = Seed: NSCVKLQTVHSIPLTINKEEALQRP
NSCVKLQTVHSIPYTIFKFEAAQRP

SEQ ID NO: 44121 - protein, 25 aa, synthetic construct
  source 1..25: note = Seed: NSCVKLQTVHSIPLTINKEEALQRP
NSCVKLQTVHSIPYTIFKFEACQRP

SEQ ID NO: 44122 - protein, 25 aa, synthetic construct
  source 1..25: note = Seed: NSCVKLQTVHSIPLTINKEEALQRP
NSCVKLQTVHSIPYTIFKFEADQRP

SEQ ID NO: 44123 - protein, 25 aa, synthetic construct
  source 1..25: note = Seed: NSCVKLQTVHSIPLTINKEEALQRP
NSCVKLQTVHSIPYTIFKFEAEQRP

SEQ ID NO: 44124 - protein, 25 aa, synthetic construct
  source 1..25: note = Seed: NSCVKLQTVHSIPLTINKEEALQRP
NSCVKLQTVHSIPYTIFKFEAFQRP

SEQ ID NO: 44125 - protein, 25 aa, synthetic construct
  source 1..25: note = Seed: NSCVKLQTVHSIPLTINKEEALQRP
NSCVKLQTVHSIPYTIFKFEAGQRP

SEQ ID NO: 44126 - protein, 25 aa, synthetic construct
  source 1..25: note = Seed: NSCVKLQTVHSIPLTINKEEALQRP
NSCVKLQTVHSIPYTIFKFEAHQRP

SEQ ID NO: 44127 - protein, 25 aa, synthetic construct
  source 1..25: note = Seed: NSCVKLQTVHSIPLTINKEEALQRP
NSCVKLQTVHSIPYTIFKFEAIQRP

SEQ ID NO: 44128 - protein, 25 aa, synthetic construct
  source 1..25: note = Seed: NSCVKLQTVHSIPLTINKEEALQRP
NSCVKLQTVHSIPYTIFKFEAKQRP

SEQ ID NO: 44129 - protein, 25 aa, synthetic construct
  source 1..25: note = Seed: NSCVKLQTVHSIPLTINKEEALQRP
NSCVKLQTVHSIPYTIFKFEALQRP

SEQ ID NO: 44130 - protein, 25 aa, synthetic construct
  source 1..25: note = Seed: NSCVKLQTVHSIPLTINKEEALQRP
NSCVKLQTVHSIPYTIFKFEAMQRP

SEQ ID NO: 44131 - protein, 25 aa, synthetic construct
  source 1..25: note = Seed: NSCVKLQTVHSIPLTINKEEALQRP
NSCVKLQTVHSIPYTIFKFEANQRP

SEQ ID NO: 44132 - protein, 25 aa, synthetic construct
  source 1..25: note = Seed: NSCVKLQTVHSIPLTINKEEALQRP
NSCVKLQTVHSIPYTIFKFEAPQRP

SEQ ID NO: 44133 - protein, 25 aa, synthetic construct
  source 1..25: note = Seed: NSCVKLQTVHSIPLTINKEEALQRP
NSCVKLQTVHSIPYTIFKFEAQQRP

SEQ ID NO: 44134 - protein, 25 aa, synthetic construct
  source 1..25: note = Seed: NSCVKLQTVHSIPLTINKEEALQRP
NSCVKLQTVHSIPYTIFKFEARQRP

SEQ ID NO: 44135 - protein, 25 aa, synthetic construct
  source 1..25: note = Seed: NSCVKLQTVHSIPLTINKEEALQRP
NSCVKLQTVHSIPYTIFKFEASQRP

SEQ ID NO: 44136 - protein, 25 aa, synthetic construct
  source 1..25: note = Seed: NSCVKLQTVHSIPLTINKEEALQRP
NSCVKLQTVHSIPYTIFKFEATQRP

SEQ ID NO: 44137 - protein, 25 aa, synthetic construct
  source 1..25: note = Seed: NSCVKLQTVHSIPLTINKEEALQRP
NSCVKLQTVHSIPYTIFKFEAVQRP

SEQ ID NO: 44138 - protein, 25 aa, synthetic construct
  source 1..25: note = Seed: NSCVKLQTVHSIPLTINKEEALQRP
NSCVKLQTVHSIPYTIFKFEAWQRP

SEQ ID NO: 44139 - protein, 25 aa, synthetic construct
  source 1..25: note = Seed: NSCVKLQTVHSIPLTINKEEALQRP
NSCVKLQTVHSIPYTIFKFEAYQRP

SEQ ID NO: 44140 - protein, 25 aa, synthetic construct
  source 1..25: note = Seed: NSCVKLQTVHSIPLTINKEEALQRP
NSCVKLQTVHSIPYTIFKHEAFQRP

SEQ ID NO: 44141 - protein, 25 aa, synthetic construct
  source 1..25: note = Seed: NSCVKLQTVHSIPLTINKEEALQRP
NSCVKLQTVHSIPYTIFKIEAAQRP

SEQ ID NO: 44142 - protein, 25 aa, synthetic construct
  source 1..25: note = Seed: NSCVKLQTVHSIPLTINKEEALQRP
NSCVKLQTVHSIPYTIFKIEAEQRP

SEQ ID NO: 44143 - protein, 25 aa, synthetic construct
  source 1..25: note = Seed: NSCVKLQTVHSIPLTINKEEALQRP
NSCVKLQTVHSIPYTIFKIEAFQRP

SEQ ID NO: 44144 - protein, 25 aa, synthetic construct
  source 1..25: note = Seed: NSCVKLQTVHSIPLTINKEEALQRP
NSCVKLQTVHSIPYTIFKIEAIQRP

SEQ ID NO: 44145 - protein, 25 aa, synthetic construct
  source 1..25: note = Seed: NSCVKLQTVHSIPLTINKEEALQRP
NSCVKLQTVHSIPYTIFKIEALQRP

SEQ ID NO: 44146 - protein, 25 aa, synthetic construct
  source 1..25: note = Seed: NSCVKLQTVHSIPLTINKEEALQRP
NSCVKLQTVHSIPYTIFKIEAMQRP

SEQ ID NO: 44147 - protein, 25 aa, synthetic construct
  source 1..25: note = Seed: NSCVKLQTVHSIPLTINKEEALQRP
NSCVKLQTVHSIPYTIFKIEARQRP

SEQ ID NO: 44148 - protein, 25 aa, synthetic construct
  source 1..25: note = Seed: NSCVKLQTVHSIPLTINKEEALQRP
NSCVKLQTVHSIPYTIFKIEATQRP

SEQ ID NO: 44149 - protein, 25 aa, synthetic construct
  source 1..25: note = Seed: NSCVKLQTVHSIPLTINKEEALQRP
NSCVKLQTVHSIPYTIFKIEAVQRP

SEQ ID NO: 44150 - protein, 25 aa, synthetic construct
  source 1..25: note = Seed: NSCVKLQTVHSIPLTINKEEALQRP
NSCVKLQTVHSIPYTIFKIEAYQRP

SEQ ID NO: 44151 - protein, 25 aa, synthetic construct
  source 1..25: note = Seed: NSCVKLQTVHSIPLTINKEEALQRP
NSCVKLQTVHSIPYTIFKLEAAQRP

SEQ ID NO: 44152 - protein, 25 aa, synthetic construct
  source 1..25: note = Seed: NSCVKLQTVHSIPLTINKEEALQRP
NSCVKLQTVHSIPYTIFKLEADQRP

SEQ ID NO: 44153 - protein, 25 aa, synthetic construct
  source 1..25: note = Seed: NSCVKLQTVHSIPLTINKEEALQRP
NSCVKLQTVHSIPYTIFKLEAEQRP

SEQ ID NO: 44154 - protein, 25 aa, synthetic construct
  source 1..25: note = Seed: NSCVKLQTVHSIPLTINKEEALQRP
NSCVKLQTVHSIPYTIFKLEAFQRP

SEQ ID NO: 44155 - protein, 25 aa, synthetic construct
  source 1..25: note = Seed: NSCVKLQTVHSIPLTINKEEALQRP
NSCVKLQTVHSIPYTIFKLEAHQRP

SEQ ID NO: 44156 - protein, 25 aa, synthetic construct
  source 1..25: note = Seed: NSCVKLQTVHSIPLTINKEEALQRP
NSCVKLQTVHSIPYTIFKLEAIQRP

SEQ ID NO: 44157 - protein, 25 aa, synthetic construct
  source 1..25: note = Seed: NSCVKLQTVHSIPLTINKEEALQRP
NSCVKLQTVHSIPYTIFKLEALQRP

SEQ ID NO: 44158 - protein, 25 aa, synthetic construct
  source 1..25: note = Seed: NSCVKLQTVHSIPLTINKEEALQRP
NSCVKLQTVHSIPYTIFKLEAMQRP

SEQ ID NO: 44159 - protein, 25 aa, synthetic construct
  source 1..25: note = Seed: NSCVKLQTVHSIPLTINKEEALQRP
NSCVKLQTVHSIPYTIFKLEANQRP

SEQ ID NO: 44160 - protein, 25 aa, synthetic construct
  source 1..25: note = Seed: NSCVKLQTVHSIPLTINKEEALQRP
NSCVKLQTVHSIPYTIFKLEAQQRP

SEQ ID NO: 44161 - protein, 25 aa, synthetic construct
  source 1..25: note = Seed: NSCVKLQTVHSIPLTINKEEALQRP
NSCVKLQTVHSIPYTIFKLEARQRP

SEQ ID NO: 44162 - protein, 25 aa, synthetic construct
  source 1..25: note = Seed: NSCVKLQTVHSIPLTINKEEALQRP
NSCVKLQTVHSIPYTIFKLEASQRP

SEQ ID NO: 44163 - protein, 25 aa, synthetic construct
  source 1..25: note = Seed: NSCVKLQTVHSIPLTINKEEALQRP
NSCVKLQTVHSIPYTIFKLEATQRP

SEQ ID NO: 44164 - protein, 25 aa, synthetic construct
  source 1..25: note = Seed: NSCVKLQTVHSIPLTINKEEALQRP
NSCVKLQTVHSIPYTIFKLEAVQRP

SEQ ID NO: 44165 - protein, 25 aa, synthetic construct
  source 1..25: note = Seed: NSCVKLQTVHSIPLTINKEEALQRP
NSCVKLQTVHSIPYTIFKLEAYQRP

SEQ ID NO: 44166 - protein, 25 aa, synthetic construct
  source 1..25: note = Seed: NSCVKLQTVHSIPLTINKEEALQRP
NSCVKLQTVHSIPYTIFKMEAAQRP

SEQ ID NO: 44167 - protein, 25 aa, synthetic construct
  source 1..25: note = Seed: NSCVKLQTVHSIPLTINKEEALQRP
NSCVKLQTVHSIPYTIFKMEAFQRP

SEQ ID NO: 44168 - protein, 25 aa, synthetic construct
  source 1..25: note = Seed: NSCVKLQTVHSIPLTINKEEALQRP
NSCVKLQTVHSIPYTIFKMEAIQRP

SEQ ID NO: 44169 - protein, 25 aa, synthetic construct
  source 1..25: note = Seed: NSCVKLQTVHSIPLTINKEEALQRP
NSCVKLQTVHSIPYTIFKMEALQRP

SEQ ID NO: 44170 - protein, 25 aa, synthetic construct
  source 1..25: note = Seed: NSCVKLQTVHSIPLTINKEEALQRP
NSCVKLQTVHSIPYTIFKMEAMQRP

SEQ ID NO: 44171 - protein, 25 aa, synthetic construct
  source 1..25: note = Seed: NSCVKLQTVHSIPLTINKEEALQRP
NSCVKLQTVHSIPYTIFKMEAVQRP
